United States Patent 10,611,818 (MHC MULTIMERS IN TUBERCULOSIS DIAGNOSTICS, VACCINE AND THERAPEUTICS) - sequence listing, part 6

SEQ ID NO: 160559 - protein, 14 aa, Mycobacterium tuberculosis
TEPEQLAAAHELID

SEQ ID NO: 160560 - protein, 14 aa, Mycobacterium tuberculosis
EPEQLAAAHELIDR

SEQ ID NO: 160561 - protein, 14 aa, Mycobacterium tuberculosis
PEQLAAAHELIDRG

SEQ ID NO: 160562 - protein, 14 aa, Mycobacterium tuberculosis
EQLAAAHELIDRGR

SEQ ID NO: 160563 - protein, 14 aa, Mycobacterium tuberculosis
QLAAAHELIDRGRA

SEQ ID NO: 160564 - protein, 14 aa, Mycobacterium tuberculosis
LAAAHELIDRGRAE

SEQ ID NO: 160565 - protein, 14 aa, Mycobacterium tuberculosis
AAAHELIDRGRAEV

SEQ ID NO: 160566 - protein, 14 aa, Mycobacterium tuberculosis
AAHELIDRGRAEVV

SEQ ID NO: 160567 - protein, 14 aa, Mycobacterium tuberculosis
AHELIDRGRAEVVV

SEQ ID NO: 160568 - protein, 14 aa, Mycobacterium tuberculosis
HELIDRGRAEVVVV

SEQ ID NO: 160569 - protein, 14 aa, Mycobacterium tuberculosis
ELIDRGRAEVVVVS

SEQ ID NO: 160570 - protein, 14 aa, Mycobacterium tuberculosis
LIDRGRAEVVVVSL

SEQ ID NO: 160571 - protein, 14 aa, Mycobacterium tuberculosis
IDRGRAEVVVVSLG

SEQ ID NO: 160572 - protein, 14 aa, Mycobacterium tuberculosis
DRGRAEVVVVSLGS

SEQ ID NO: 160573 - protein, 14 aa, Mycobacterium tuberculosis
RGRAEVVVVSLGSQ

SEQ ID NO: 160574 - protein, 14 aa, Mycobacterium tuberculosis
GRAEVVVVSLGSQG

SEQ ID NO: 160575 - protein, 14 aa, Mycobacterium tuberculosis
RAEVVVVSLGSQGA

SEQ ID NO: 160576 - protein, 14 aa, Mycobacterium tuberculosis
AEVVVVSLGSQGAL

SEQ ID NO: 160577 - protein, 14 aa, Mycobacterium tuberculosis
EVVVVSLGSQGALL

SEQ ID NO: 160578 - protein, 14 aa, Mycobacterium tuberculosis
VVVVSLGSQGALLA

SEQ ID NO: 160579 - protein, 14 aa, Mycobacterium tuberculosis
VVVSLGSQGALLAT

SEQ ID NO: 160580 - protein, 14 aa, Mycobacterium tuberculosis
VVSLGSQGALLATR

SEQ ID NO: 160581 - protein, 14 aa, Mycobacterium tuberculosis
VSLGSQGALLATRH

SEQ ID NO: 160582 - protein, 14 aa, Mycobacterium tuberculosis
SLGSQGALLATRHA

SEQ ID NO: 160583 - protein, 14 aa, Mycobacterium tuberculosis
LGSQGALLATRHAS

SEQ ID NO: 160584 - protein, 14 aa, Mycobacterium tuberculosis
GSQGALLATRHASH

SEQ ID NO: 160585 - protein, 14 aa, Mycobacterium tuberculosis
SQGALLATRHASHR

SEQ ID NO: 160586 - protein, 14 aa, Mycobacterium tuberculosis
QGALLATRHASHRF

SEQ ID NO: 160587 - protein, 14 aa, Mycobacterium tuberculosis
GALLATRHASHRFS

SEQ ID NO: 160588 - protein, 14 aa, Mycobacterium tuberculosis
ALLATRHASHRFSS

SEQ ID NO: 160589 - protein, 14 aa, Mycobacterium tuberculosis
LLATRHASHRFSSI

SEQ ID NO: 160590 - protein, 14 aa, Mycobacterium tuberculosis
LATRHASHRFSSIP

SEQ ID NO: 160591 - protein, 14 aa, Mycobacterium tuberculosis
ATRHASHRFSSIPM

SEQ ID NO: 160592 - protein, 14 aa, Mycobacterium tuberculosis
TRHASHRFSSIPMT

SEQ ID NO: 160593 - protein, 14 aa, Mycobacterium tuberculosis
RHASHRFSSIPMTA

SEQ ID NO: 160594 - protein, 14 aa, Mycobacterium tuberculosis
HASHRFSSIPMTAV

SEQ ID NO: 160595 - protein, 14 aa, Mycobacterium tuberculosis
ASHRFSSIPMTAVS

SEQ ID NO: 160596 - protein, 14 aa, Mycobacterium tuberculosis
SHRFSSIPMTAVSG

SEQ ID NO: 160597 - protein, 14 aa, Mycobacterium tuberculosis
HRFSSIPMTAVSGV

SEQ ID NO: 160598 - protein, 14 aa, Mycobacterium tuberculosis
RFSSIPMTAVSGVG

SEQ ID NO: 160599 - protein, 14 aa, Mycobacterium tuberculosis
FSSIPMTAVSGVGA

SEQ ID NO: 160600 - protein, 14 aa, Mycobacterium tuberculosis
SSIPMTAVSGVGAG

SEQ ID NO: 160601 - protein, 14 aa, Mycobacterium tuberculosis
SIPMTAVSGVGAGD

SEQ ID NO: 160602 - protein, 14 aa, Mycobacterium tuberculosis
IPMTAVSGVGAGDA

SEQ ID NO: 160603 - protein, 14 aa, Mycobacterium tuberculosis
PMTAVSGVGAGDAM

SEQ ID NO: 160604 - protein, 14 aa, Mycobacterium tuberculosis
MTAVSGVGAGDAMV

SEQ ID NO: 160605 - protein, 14 aa, Mycobacterium tuberculosis
TAVSGVGAGDAMVA

SEQ ID NO: 160606 - protein, 14 aa, Mycobacterium tuberculosis
AVSGVGAGDAMVAA

SEQ ID NO: 160607 - protein, 14 aa, Mycobacterium tuberculosis
VSGVGAGDAMVAAI

SEQ ID NO: 160608 - protein, 14 aa, Mycobacterium tuberculosis
SGVGAGDAMVAAIT

SEQ ID NO: 160609 - protein, 14 aa, Mycobacterium tuberculosis
GVGAGDAMVAAITV

SEQ ID NO: 160610 - protein, 14 aa, Mycobacterium tuberculosis
VGAGDAMVAAITVG

SEQ ID NO: 160611 - protein, 14 aa, Mycobacterium tuberculosis
GAGDAMVAAITVGL

SEQ ID NO: 160612 - protein, 14 aa, Mycobacterium tuberculosis
AGDAMVAAITVGLS

SEQ ID NO: 160613 - protein, 14 aa, Mycobacterium tuberculosis
GDAMVAAITVGLSR

SEQ ID NO: 160614 - protein, 14 aa, Mycobacterium tuberculosis
DAMVAAITVGLSRG

SEQ ID NO: 160615 - protein, 14 aa, Mycobacterium tuberculosis
AMVAAITVGLSRGW

SEQ ID NO: 160616 - protein, 14 aa, Mycobacterium tuberculosis
MVAAITVGLSRGWS

SEQ ID NO: 160617 - protein, 14 aa, Mycobacterium tuberculosis
VAAITVGLSRGWSL

SEQ ID NO: 160618 - protein, 14 aa, Mycobacterium tuberculosis
AAITVGLSRGWSLI

SEQ ID NO: 160619 - protein, 14 aa, Mycobacterium tuberculosis
AITVGLSRGWSLIK

SEQ ID NO: 160620 - protein, 14 aa, Mycobacterium tuberculosis
ITVGLSRGWSLIKS

SEQ ID NO: 160621 - protein, 14 aa, Mycobacterium tuberculosis
TVGLSRGWSLIKSV

SEQ ID NO: 160622 - protein, 14 aa, Mycobacterium tuberculosis
VGLSRGWSLIKSVR

SEQ ID NO: 160623 - protein, 14 aa, Mycobacterium tuberculosis
GLSRGWSLIKSVRL

SEQ ID NO: 160624 - protein, 14 aa, Mycobacterium tuberculosis
LSRGWSLIKSVRLG

SEQ ID NO: 160625 - protein, 14 aa, Mycobacterium tuberculosis
SRGWSLIKSVRLGN

SEQ ID NO: 160626 - protein, 14 aa, Mycobacterium tuberculosis
RGWSLIKSVRLGNA

SEQ ID NO: 160627 - protein, 14 aa, Mycobacterium tuberculosis
GWSLIKSVRLGNAA

SEQ ID NO: 160628 - protein, 14 aa, Mycobacterium tuberculosis
WSLIKSVRLGNAAG

SEQ ID NO: 160629 - protein, 14 aa, Mycobacterium tuberculosis
SLIKSVRLGNAAGA

SEQ ID NO: 160630 - protein, 14 aa, Mycobacterium tuberculosis
LIKSVRLGNAAGAA

SEQ ID NO: 160631 - protein, 14 aa, Mycobacterium tuberculosis
IKSVRLGNAAGAAM

SEQ ID NO: 160632 - protein, 14 aa, Mycobacterium tuberculosis
KSVRLGNAAGAAML

SEQ ID NO: 160633 - protein, 14 aa, Mycobacterium tuberculosis
SVRLGNAAGAAMLL

SEQ ID NO: 160634 - protein, 14 aa, Mycobacterium tuberculosis
VRLGNAAGAAMLLT

SEQ ID NO: 160635 - protein, 14 aa, Mycobacterium tuberculosis
RLGNAAGAAMLLTP

SEQ ID NO: 160636 - protein, 14 aa, Mycobacterium tuberculosis
LGNAAGAAMLLTPG

SEQ ID NO: 160637 - protein, 14 aa, Mycobacterium tuberculosis
GNAAGAAMLLTPGT

SEQ ID NO: 160638 - protein, 14 aa, Mycobacterium tuberculosis
NAAGAAMLLTPGTA

SEQ ID NO: 160639 - protein, 14 aa, Mycobacterium tuberculosis
AAGAAMLLTPGTAA

SEQ ID NO: 160640 - protein, 14 aa, Mycobacterium tuberculosis
AGAAMLLTPGTAAC

SEQ ID NO: 160641 - protein, 14 aa, Mycobacterium tuberculosis
GAAMLLTPGTAACN

SEQ ID NO: 160642 - protein, 14 aa, Mycobacterium tuberculosis
AAMLLTPGTAACNR

SEQ ID NO: 160643 - protein, 14 aa, Mycobacterium tuberculosis
AMLLTPGTAACNRD

SEQ ID NO: 160644 - protein, 14 aa, Mycobacterium tuberculosis
MLLTPGTAACNRDD

SEQ ID NO: 160645 - protein, 14 aa, Mycobacterium tuberculosis
LLTPGTAACNRDDV

SEQ ID NO: 160646 - protein, 14 aa, Mycobacterium tuberculosis
LTPGTAACNRDDVE

SEQ ID NO: 160647 - protein, 14 aa, Mycobacterium tuberculosis
TPGTAACNRDDVER

SEQ ID NO: 160648 - protein, 14 aa, Mycobacterium tuberculosis
PGTAACNRDDVERF

SEQ ID NO: 160649 - protein, 14 aa, Mycobacterium tuberculosis
GTAACNRDDVERFF

SEQ ID NO: 160650 - protein, 14 aa, Mycobacterium tuberculosis
TAACNRDDVERFFE

SEQ ID NO: 160651 - protein, 14 aa, Mycobacterium tuberculosis
AACNRDDVERFFEL

SEQ ID NO: 160652 - protein, 14 aa, Mycobacterium tuberculosis
ACNRDDVERFFELA

SEQ ID NO: 160653 - protein, 14 aa, Mycobacterium tuberculosis
CNRDDVERFFELAA

SEQ ID NO: 160654 - protein, 14 aa, Mycobacterium tuberculosis
NRDDVERFFELAAE

SEQ ID NO: 160655 - protein, 14 aa, Mycobacterium tuberculosis
RDDVERFFELAAEP

SEQ ID NO: 160656 - protein, 14 aa, Mycobacterium tuberculosis
DDVERFFELAAEPT

SEQ ID NO: 160657 - protein, 14 aa, Mycobacterium tuberculosis
DVERFFELAAEPTE

SEQ ID NO: 160658 - protein, 14 aa, Mycobacterium tuberculosis
VERFFELAAEPTEV

SEQ ID NO: 160659 - protein, 14 aa, Mycobacterium tuberculosis
ERFFELAAEPTEVG

SEQ ID NO: 160660 - protein, 14 aa, Mycobacterium tuberculosis
RFFELAAEPTEVGQ

SEQ ID NO: 160661 - protein, 14 aa, Mycobacterium tuberculosis
FFELAAEPTEVGQD

SEQ ID NO: 160662 - protein, 14 aa, Mycobacterium tuberculosis
FELAAEPTEVGQDQ

SEQ ID NO: 160663 - protein, 14 aa, Mycobacterium tuberculosis
ELAAEPTEVGQDQY

SEQ ID NO: 160664 - protein, 14 aa, Mycobacterium tuberculosis
LAAEPTEVGQDQYV

SEQ ID NO: 160665 - protein, 14 aa, Mycobacterium tuberculosis
AAEPTEVGQDQYVW

SEQ ID NO: 160666 - protein, 14 aa, Mycobacterium tuberculosis
AEPTEVGQDQYVWH

SEQ ID NO: 160667 - protein, 14 aa, Mycobacterium tuberculosis
EPTEVGQDQYVWHP

SEQ ID NO: 160668 - protein, 14 aa, Mycobacterium tuberculosis
PTEVGQDQYVWHPI

SEQ ID NO: 160669 - protein, 14 aa, Mycobacterium tuberculosis
TEVGQDQYVWHPIV

SEQ ID NO: 160670 - protein, 14 aa, Mycobacterium tuberculosis
EVGQDQYVWHPIVN

SEQ ID NO: 160671 - protein, 14 aa, Mycobacterium tuberculosis
VGQDQYVWHPIVNP

SEQ ID NO: 160672 - protein, 14 aa, Mycobacterium tuberculosis
GQDQYVWHPIVNPE

SEQ ID NO: 160673 - protein, 14 aa, Mycobacterium tuberculosis
QDQYVWHPIVNPEA

SEQ ID NO: 160674 - protein, 14 aa, Mycobacterium tuberculosis
DQYVWHPIVNPEAS

SEQ ID NO: 160675 - protein, 14 aa, Mycobacterium tuberculosis
QYVWHPIVNPEASP

SEQ ID NO: 160676 - protein, 15 aa, Mycobacterium tuberculosis
MTEPAAWDEGKPRII

SEQ ID NO: 160677 - protein, 15 aa, Mycobacterium tuberculosis
TEPAAWDEGKPRIIT

SEQ ID NO: 160678 - protein, 15 aa, Mycobacterium tuberculosis
EPAAWDEGKPRIITL

SEQ ID NO: 160679 - protein, 15 aa, Mycobacterium tuberculosis
PAAWDEGKPRIITLT

SEQ ID NO: 160680 - protein, 15 aa, Mycobacterium tuberculosis
AAWDEGKPRIITLTM

SEQ ID NO: 160681 - protein, 15 aa, Mycobacterium tuberculosis
AWDEGKPRIITLTMN

SEQ ID NO: 160682 - protein, 15 aa, Mycobacterium tuberculosis
WDEGKPRIITLTMNP

SEQ ID NO: 160683 - protein, 15 aa, Mycobacterium tuberculosis
DEGKPRIITLTMNPA

SEQ ID NO: 160684 - protein, 15 aa, Mycobacterium tuberculosis
EGKPRIITLTMNPAL

SEQ ID NO: 160685 - protein, 15 aa, Mycobacterium tuberculosis
GKPRIITLTMNPALD

SEQ ID NO: 160686 - protein, 15 aa, Mycobacterium tuberculosis
KPRIITLTMNPALDI

SEQ ID NO: 160687 - protein, 15 aa, Mycobacterium tuberculosis
PRIITLTMNPALDIT

SEQ ID NO: 160688 - protein, 15 aa, Mycobacterium tuberculosis
RIITLTMNPALDITT

SEQ ID NO: 160689 - protein, 15 aa, Mycobacterium tuberculosis
IITLTMNPALDITTS

SEQ ID NO: 160690 - protein, 15 aa, Mycobacterium tuberculosis
ITLTMNPALDITTSV

SEQ ID NO: 160691 - protein, 15 aa, Mycobacterium tuberculosis
TLTMNPALDITTSVD

SEQ ID NO: 160692 - protein, 15 aa, Mycobacterium tuberculosis
LTMNPALDITTSVDV

SEQ ID NO: 160693 - protein, 15 aa, Mycobacterium tuberculosis
TMNPALDITTSVDVV

SEQ ID NO: 160694 - protein, 15 aa, Mycobacterium tuberculosis
MNPALDITTSVDVVR

SEQ ID NO: 160695 - protein, 15 aa, Mycobacterium tuberculosis
NPALDITTSVDVVRP

SEQ ID NO: 160696 - protein, 15 aa, Mycobacterium tuberculosis
PALDITTSVDVVRPT

SEQ ID NO: 160697 - protein, 15 aa, Mycobacterium tuberculosis
ALDITTSVDVVRPTE

SEQ ID NO: 160698 - protein, 15 aa, Mycobacterium tuberculosis
LDITTSVDVVRPTEK

SEQ ID NO: 160699 - protein, 15 aa, Mycobacterium tuberculosis
DITTSVDVVRPTEKM

SEQ ID NO: 160700 - protein, 15 aa, Mycobacterium tuberculosis
ITTSVDVVRPTEKMR

SEQ ID NO: 160701 - protein, 15 aa, Mycobacterium tuberculosis
TTSVDVVRPTEKMRC

SEQ ID NO: 160702 - protein, 15 aa, Mycobacterium tuberculosis
TSVDVVRPTEKMRCG

SEQ ID NO: 160703 - protein, 15 aa, Mycobacterium tuberculosis
SVDVVRPTEKMRCGA

SEQ ID NO: 160704 - protein, 15 aa, Mycobacterium tuberculosis
VDVVRPTEKMRCGAP

SEQ ID NO: 160705 - protein, 15 aa, Mycobacterium tuberculosis
DVVRPTEKMRCGAPR

SEQ ID NO: 160706 - protein, 15 aa, Mycobacterium tuberculosis
VVRPTEKMRCGAPRY

SEQ ID NO: 160707 - protein, 15 aa, Mycobacterium tuberculosis
VRPTEKMRCGAPRYD

SEQ ID NO: 160708 - protein, 15 aa, Mycobacterium tuberculosis
RPTEKMRCGAPRYDP

SEQ ID NO: 160709 - protein, 15 aa, Mycobacterium tuberculosis
PTEKMRCGAPRYDPG

SEQ ID NO: 160710 - protein, 15 aa, Mycobacterium tuberculosis
TEKMRCGAPRYDPGG

SEQ ID NO: 160711 - protein, 15 aa, Mycobacterium tuberculosis
EKMRCGAPRYDPGGG

SEQ ID NO: 160712 - protein, 15 aa, Mycobacterium tuberculosis
KMRCGAPRYDPGGGG

SEQ ID NO: 160713 - protein, 15 aa, Mycobacterium tuberculosis
MRCGAPRYDPGGGGI

SEQ ID NO: 160714 - protein, 15 aa, Mycobacterium tuberculosis
RCGAPRYDPGGGGIN

SEQ ID NO: 160715 - protein, 15 aa, Mycobacterium tuberculosis
CGAPRYDPGGGGINV

SEQ ID NO: 160716 - protein, 15 aa, Mycobacterium tuberculosis
GAPRYDPGGGGINVA

SEQ ID NO: 160717 - protein, 15 aa, Mycobacterium tuberculosis
APRYDPGGGGINVAR

SEQ ID NO: 160718 - protein, 15 aa, Mycobacterium tuberculosis
PRYDPGGGGINVARI

SEQ ID NO: 160719 - protein, 15 aa, Mycobacterium tuberculosis
RYDPGGGGINVARIV

SEQ ID NO: 160720 - protein, 15 aa, Mycobacterium tuberculosis
YDPGGGGINVARIVH

SEQ ID NO: 160721 - protein, 15 aa, Mycobacterium tuberculosis
DPGGGGINVARIVHV

SEQ ID NO: 160722 - protein, 15 aa, Mycobacterium tuberculosis
PGGGGINVARIVHVL

SEQ ID NO: 160723 - protein, 15 aa, Mycobacterium tuberculosis
GGGGINVARIVHVLG

SEQ ID NO: 160724 - protein, 15 aa, Mycobacterium tuberculosis
GGGINVARIVHVLGG

SEQ ID NO: 160725 - protein, 15 aa, Mycobacterium tuberculosis
GGINVARIVHVLGGC

SEQ ID NO: 160726 - protein, 15 aa, Mycobacterium tuberculosis
GINVARIVHVLGGCS

SEQ ID NO: 160727 - protein, 15 aa, Mycobacterium tuberculosis
INVARIVHVLGGCST

SEQ ID NO: 160728 - protein, 15 aa, Mycobacterium tuberculosis
NVARIVHVLGGCSTA

SEQ ID NO: 160729 - protein, 15 aa, Mycobacterium tuberculosis
VARIVHVLGGCSTAL

SEQ ID NO: 160730 - protein, 15 aa, Mycobacterium tuberculosis
ARIVHVLGGCSTALF

SEQ ID NO: 160731 - protein, 15 aa, Mycobacterium tuberculosis
RIVHVLGGCSTALFP

SEQ ID NO: 160732 - protein, 15 aa, Mycobacterium tuberculosis
IVHVLGGCSTALFPA

SEQ ID NO: 160733 - protein, 15 aa, Mycobacterium tuberculosis
VHVLGGCSTALFPAG

SEQ ID NO: 160734 - protein, 15 aa, Mycobacterium tuberculosis
HVLGGCSTALFPAGG

SEQ ID NO: 160735 - protein, 15 aa, Mycobacterium tuberculosis
VLGGCSTALFPAGGS

SEQ ID NO: 160736 - protein, 15 aa, Mycobacterium tuberculosis
LGGCSTALFPAGGST

SEQ ID NO: 160737 - protein, 15 aa, Mycobacterium tuberculosis
GGCSTALFPAGGSTG

SEQ ID NO: 160738 - protein, 15 aa, Mycobacterium tuberculosis
GCSTALFPAGGSTGS

SEQ ID NO: 160739 - protein, 15 aa, Mycobacterium tuberculosis
CSTALFPAGGSTGSL

SEQ ID NO: 160740 - protein, 15 aa, Mycobacterium tuberculosis
STALFPAGGSTGSLL

SEQ ID NO: 160741 - protein, 15 aa, Mycobacterium tuberculosis
TALFPAGGSTGSLLM

SEQ ID NO: 160742 - protein, 15 aa, Mycobacterium tuberculosis
ALFPAGGSTGSLLMA

SEQ ID NO: 160743 - protein, 15 aa, Mycobacterium tuberculosis
LFPAGGSTGSLLMAL

SEQ ID NO: 160744 - protein, 15 aa, Mycobacterium tuberculosis
FPAGGSTGSLLMALL

SEQ ID NO: 160745 - protein, 15 aa, Mycobacterium tuberculosis
PAGGSTGSLLMALLG

SEQ ID NO: 160746 - protein, 15 aa, Mycobacterium tuberculosis
AGGSTGSLLMALLGD

SEQ ID NO: 160747 - protein, 15 aa, Mycobacterium tuberculosis
GGSTGSLLMALLGDA

SEQ ID NO: 160748 - protein, 15 aa, Mycobacterium tuberculosis
GSTGSLLMALLGDAG

SEQ ID NO: 160749 - protein, 15 aa, Mycobacterium tuberculosis
STGSLLMALLGDAGV

SEQ ID NO: 160750 - protein, 15 aa, Mycobacterium tuberculosis
TGSLLMALLGDAGVP

SEQ ID NO: 160751 - protein, 15 aa, Mycobacterium tuberculosis
GSLLMALLGDAGVPF

SEQ ID NO: 160752 - protein, 15 aa, Mycobacterium tuberculosis
SLLMALLGDAGVPFR

SEQ ID NO: 160753 - protein, 15 aa, Mycobacterium tuberculosis
LLMALLGDAGVPFRV

SEQ ID NO: 160754 - protein, 15 aa, Mycobacterium tuberculosis
LMALLGDAGVPFRVI

SEQ ID NO: 160755 - protein, 15 aa, Mycobacterium tuberculosis
MALLGDAGVPFRVIP

SEQ ID NO: 160756 - protein, 15 aa, Mycobacterium tuberculosis
ALLGDAGVPFRVIPI

SEQ ID NO: 160757 - protein, 15 aa, Mycobacterium tuberculosis
LLGDAGVPFRVIPIA

SEQ ID NO: 160758 - protein, 15 aa, Mycobacterium tuberculosis
LGDAGVPFRVIPIAA

SEQ ID NO: 160759 - protein, 15 aa, Mycobacterium tuberculosis
GDAGVPFRVIPIAAS

SEQ ID NO: 160760 - protein, 15 aa, Mycobacterium tuberculosis
DAGVPFRVIPIAAST

SEQ ID NO: 160761 - protein, 15 aa, Mycobacterium tuberculosis
AGVPFRVIPIAASTR

SEQ ID NO: 160762 - protein, 15 aa, Mycobacterium tuberculosis
GVPFRVIPIAASTRE

SEQ ID NO: 160763 - protein, 15 aa, Mycobacterium tuberculosis
VPFRVIPIAASTRES

SEQ ID NO: 160764 - protein, 15 aa, Mycobacterium tuberculosis
PFRVIPIAASTRESF

SEQ ID NO: 160765 - protein, 15 aa, Mycobacterium tuberculosis
FRVIPIAASTRESFT

SEQ ID NO: 160766 - protein, 15 aa, Mycobacterium tuberculosis
RVIPIAASTRESFTV

SEQ ID NO: 160767 - protein, 15 aa, Mycobacterium tuberculosis
VIPIAASTRESFTVN

SEQ ID NO: 160768 - protein, 15 aa, Mycobacterium tuberculosis
IPIAASTRESFTVNE

SEQ ID NO: 160769 - protein, 15 aa, Mycobacterium tuberculosis
PIAASTRESFTVNES

SEQ ID NO: 160770 - protein, 15 aa, Mycobacterium tuberculosis
IAASTRESFTVNESR

SEQ ID NO: 160771 - protein, 15 aa, Mycobacterium tuberculosis
AASTRESFTVNESRT

SEQ ID NO: 160772 - protein, 15 aa, Mycobacterium tuberculosis
ASTRESFTVNESRTA

SEQ ID NO: 160773 - protein, 15 aa, Mycobacterium tuberculosis
STRESFTVNESRTAK

SEQ ID NO: 160774 - protein, 15 aa, Mycobacterium tuberculosis
TRESFTVNESRTAKQ

SEQ ID NO: 160775 - protein, 15 aa, Mycobacterium tuberculosis
RESFTVNESRTAKQY

SEQ ID NO: 160776 - protein, 15 aa, Mycobacterium tuberculosis
ESFTVNESRTAKQYR

SEQ ID NO: 160777 - protein, 15 aa, Mycobacterium tuberculosis
SFTVNESRTAKQYRF

SEQ ID NO: 160778 - protein, 15 aa, Mycobacterium tuberculosis
FTVNESRTAKQYRFV

SEQ ID NO: 160779 - protein, 15 aa, Mycobacterium tuberculosis
TVNESRTAKQYRFVL

SEQ ID NO: 160780 - protein, 15 aa, Mycobacterium tuberculosis
VNESRTAKQYRFVLP

SEQ ID NO: 160781 - protein, 15 aa, Mycobacterium tuberculosis
NESRTAKQYRFVLPG

SEQ ID NO: 160782 - protein, 15 aa, Mycobacterium tuberculosis
ESRTAKQYRFVLPGP

SEQ ID NO: 160783 - protein, 15 aa, Mycobacterium tuberculosis
SRTAKQYRFVLPGPS

SEQ ID NO: 160784 - protein, 15 aa, Mycobacterium tuberculosis
RTAKQYRFVLPGPSL

SEQ ID NO: 160785 - protein, 15 aa, Mycobacterium tuberculosis
TAKQYRFVLPGPSLT

SEQ ID NO: 160786 - protein, 15 aa, Mycobacterium tuberculosis
AKQYRFVLPGPSLTV

SEQ ID NO: 160787 - protein, 15 aa, Mycobacterium tuberculosis
KQYRFVLPGPSLTVA

SEQ ID NO: 160788 - protein, 15 aa, Mycobacterium tuberculosis
QYRFVLPGPSLTVAE

SEQ ID NO: 160789 - protein, 15 aa, Mycobacterium tuberculosis
YRFVLPGPSLTVAEQ

SEQ ID NO: 160790 - protein, 15 aa, Mycobacterium tuberculosis
RFVLPGPSLTVAEQE

SEQ ID NO: 160791 - protein, 15 aa, Mycobacterium tuberculosis
FVLPGPSLTVAEQEQ

SEQ ID NO: 160792 - protein, 15 aa, Mycobacterium tuberculosis
VLPGPSLTVAEQEQC

SEQ ID NO: 160793 - protein, 15 aa, Mycobacterium tuberculosis
LPGPSLTVAEQEQCL

SEQ ID NO: 160794 - protein, 15 aa, Mycobacterium tuberculosis
PGPSLTVAEQEQCLD

SEQ ID NO: 160795 - protein, 15 aa, Mycobacterium tuberculosis
GPSLTVAEQEQCLDE

SEQ ID NO: 160796 - protein, 15 aa, Mycobacterium tuberculosis
PSLTVAEQEQCLDEL

SEQ ID NO: 160797 - protein, 15 aa, Mycobacterium tuberculosis
SLTVAEQEQCLDELR

SEQ ID NO: 160798 - protein, 15 aa, Mycobacterium tuberculosis
LTVAEQEQCLDELRG

SEQ ID NO: 160799 - protein, 15 aa, Mycobacterium tuberculosis
TVAEQEQCLDELRGA

SEQ ID NO: 160800 - protein, 15 aa, Mycobacterium tuberculosis
VAEQEQCLDELRGAA

SEQ ID NO: 160801 - protein, 15 aa, Mycobacterium tuberculosis
AEQEQCLDELRGAAA

SEQ ID NO: 160802 - protein, 15 aa, Mycobacterium tuberculosis
EQEQCLDELRGAAAS

SEQ ID NO: 160803 - protein, 15 aa, Mycobacterium tuberculosis
QEQCLDELRGAAASA

SEQ ID NO: 160804 - protein, 15 aa, Mycobacterium tuberculosis
EQCLDELRGAAASAA

SEQ ID NO: 160805 - protein, 15 aa, Mycobacterium tuberculosis
QCLDELRGAAASAAF

SEQ ID NO: 160806 - protein, 15 aa, Mycobacterium tuberculosis
CLDELRGAAASAAFV

SEQ ID NO: 160807 - protein, 15 aa, Mycobacterium tuberculosis
LDELRGAAASAAFVV

SEQ ID NO: 160808 - protein, 15 aa, Mycobacterium tuberculosis
DELRGAAASAAFVVA

SEQ ID NO: 160809 - protein, 15 aa, Mycobacterium tuberculosis
ELRGAAASAAFVVAS

SEQ ID NO: 160810 - protein, 15 aa, Mycobacterium tuberculosis
LRGAAASAAFVVASG

SEQ ID NO: 160811 - protein, 15 aa, Mycobacterium tuberculosis
RGAAASAAFVVASGS

SEQ ID NO: 160812 - protein, 15 aa, Mycobacterium tuberculosis
GAAASAAFVVASGSL

SEQ ID NO: 160813 - protein, 15 aa, Mycobacterium tuberculosis
AAASAAFVVASGSLP

SEQ ID NO: 160814 - protein, 15 aa, Mycobacterium tuberculosis
AASAAFVVASGSLPP

SEQ ID NO: 160815 - protein, 15 aa, Mycobacterium tuberculosis
ASAAFVVASGSLPPG

SEQ ID NO: 160816 - protein, 15 aa, Mycobacterium tuberculosis
SAAFVVASGSLPPGV

SEQ ID NO: 160817 - protein, 15 aa, Mycobacterium tuberculosis
AAFVVASGSLPPGVA

SEQ ID NO: 160818 - protein, 15 aa, Mycobacterium tuberculosis
AFVVASGSLPPGVAA

SEQ ID NO: 160819 - protein, 15 aa, Mycobacterium tuberculosis
FVVASGSLPPGVAAD

SEQ ID NO: 160820 - protein, 15 aa, Mycobacterium tuberculosis
VVASGSLPPGVAADY

SEQ ID NO: 160821 - protein, 15 aa, Mycobacterium tuberculosis
VASGSLPPGVAADYY

SEQ ID NO: 160822 - protein, 15 aa, Mycobacterium tuberculosis
ASGSLPPGVAADYYQ

SEQ ID NO: 160823 - protein, 15 aa, Mycobacterium tuberculosis
SGSLPPGVAADYYQR

SEQ ID NO: 160824 - protein, 15 aa, Mycobacterium tuberculosis
GSLPPGVAADYYQRV

SEQ ID NO: 160825 - protein, 15 aa, Mycobacterium tuberculosis
SLPPGVAADYYQRVA

SEQ ID NO: 160826 - protein, 15 aa, Mycobacterium tuberculosis
LPPGVAADYYQRVAD

SEQ ID NO: 160827 - protein, 15 aa, Mycobacterium tuberculosis
PPGVAADYYQRVADI

SEQ ID NO: 160828 - protein, 15 aa, Mycobacterium tuberculosis
PGVAADYYQRVADIC

SEQ ID NO: 160829 - protein, 15 aa, Mycobacterium tuberculosis
GVAADYYQRVADICR

SEQ ID NO: 160830 - protein, 15 aa, Mycobacterium tuberculosis
VAADYYQRVADICRR

SEQ ID NO: 160831 - protein, 15 aa, Mycobacterium tuberculosis
AADYYQRVADICRRS

SEQ ID NO: 160832 - protein, 15 aa, Mycobacterium tuberculosis
ADYYQRVADICRRSS

SEQ ID NO: 160833 - protein, 15 aa, Mycobacterium tuberculosis
DYYQRVADICRRSST

SEQ ID NO: 160834 - protein, 15 aa, Mycobacterium tuberculosis
YYQRVADICRRSSTP

SEQ ID NO: 160835 - protein, 15 aa, Mycobacterium tuberculosis
YQRVADICRRSSTPL

SEQ ID NO: 160836 - protein, 15 aa, Mycobacterium tuberculosis
QRVADICRRSSTPLI

SEQ ID NO: 160837 - protein, 15 aa, Mycobacterium tuberculosis
RVADICRRSSTPLIL

SEQ ID NO: 160838 - protein, 15 aa, Mycobacterium tuberculosis
VADICRRSSTPLILD

SEQ ID NO: 160839 - protein, 15 aa, Mycobacterium tuberculosis
ADICRRSSTPLILDT

SEQ ID NO: 160840 - protein, 15 aa, Mycobacterium tuberculosis
DICRRSSTPLILDTS

SEQ ID NO: 160841 - protein, 15 aa, Mycobacterium tuberculosis
ICRRSSTPLILDTSG

SEQ ID NO: 160842 - protein, 15 aa, Mycobacterium tuberculosis
CRRSSTPLILDTSGG

SEQ ID NO: 160843 - protein, 15 aa, Mycobacterium tuberculosis
RRSSTPLILDTSGGG

SEQ ID NO: 160844 - protein, 15 aa, Mycobacterium tuberculosis
RSSTPLILDTSGGGL

SEQ ID NO: 160845 - protein, 15 aa, Mycobacterium tuberculosis
SSTPLILDTSGGGLQ

SEQ ID NO: 160846 - protein, 15 aa, Mycobacterium tuberculosis
STPLILDTSGGGLQH

SEQ ID NO: 160847 - protein, 15 aa, Mycobacterium tuberculosis
TPLILDTSGGGLQHI

SEQ ID NO: 160848 - protein, 15 aa, Mycobacterium tuberculosis
PLILDTSGGGLQHIS

SEQ ID NO: 160849 - protein, 15 aa, Mycobacterium tuberculosis
LILDTSGGGLQHISS

SEQ ID NO: 160850 - protein, 15 aa, Mycobacterium tuberculosis
ILDTSGGGLQHISSG

SEQ ID NO: 160851 - protein, 15 aa, Mycobacterium tuberculosis
LDTSGGGLQHISSGV

SEQ ID NO: 160852 - protein, 15 aa, Mycobacterium tuberculosis
DTSGGGLQHISSGVF

SEQ ID NO: 160853 - protein, 15 aa, Mycobacterium tuberculosis
TSGGGLQHISSGVFL

SEQ ID NO: 160854 - protein, 15 aa, Mycobacterium tuberculosis
SGGGLQHISSGVFLL

SEQ ID NO: 160855 - protein, 15 aa, Mycobacterium tuberculosis
GGGLQHISSGVFLLK

SEQ ID NO: 160856 - protein, 15 aa, Mycobacterium tuberculosis
GGLQHISSGVFLLKA

SEQ ID NO: 160857 - protein, 15 aa, Mycobacterium tuberculosis
GLQHISSGVFLLKAS

SEQ ID NO: 160858 - protein, 15 aa, Mycobacterium tuberculosis
LQHISSGVFLLKASV

SEQ ID NO: 160859 - protein, 15 aa, Mycobacterium tuberculosis
QHISSGVFLLKASVR

SEQ ID NO: 160860 - protein, 15 aa, Mycobacterium tuberculosis
HISSGVFLLKASVRE

SEQ ID NO: 160861 - protein, 15 aa, Mycobacterium tuberculosis
ISSGVFLLKASVREL

SEQ ID NO: 160862 - protein, 15 aa, Mycobacterium tuberculosis
SSGVFLLKASVRELR

SEQ ID NO: 160863 - protein, 15 aa, Mycobacterium tuberculosis
SGVFLLKASVRELRE

SEQ ID NO: 160864 - protein, 15 aa, Mycobacterium tuberculosis
GVFLLKASVRELREC

SEQ ID NO: 160865 - protein, 15 aa, Mycobacterium tuberculosis
VFLLKASVRELRECV

SEQ ID NO: 160866 - protein, 15 aa, Mycobacterium tuberculosis
FLLKASVRELRECVG

SEQ ID NO: 160867 - protein, 15 aa, Mycobacterium tuberculosis
LLKASVRELRECVGS

SEQ ID NO: 160868 - protein, 15 aa, Mycobacterium tuberculosis
LKASVRELRECVGSE

SEQ ID NO: 160869 - protein, 15 aa, Mycobacterium tuberculosis
KASVRELRECVGSEL

SEQ ID NO: 160870 - protein, 15 aa, Mycobacterium tuberculosis
ASVRELRECVGSELL

SEQ ID NO: 160871 - protein, 15 aa, Mycobacterium tuberculosis
SVRELRECVGSELLT

SEQ ID NO: 160872 - protein, 15 aa, Mycobacterium tuberculosis
VRELRECVGSELLTE

SEQ ID NO: 160873 - protein, 15 aa, Mycobacterium tuberculosis
RELRECVGSELLTEP

SEQ ID NO: 160874 - protein, 15 aa, Mycobacterium tuberculosis
ELRECVGSELLTEPE

SEQ ID NO: 160875 - protein, 15 aa, Mycobacterium tuberculosis
LRECVGSELLTEPEQ

SEQ ID NO: 160876 - protein, 15 aa, Mycobacterium tuberculosis
RECVGSELLTEPEQL

SEQ ID NO: 160877 - protein, 15 aa, Mycobacterium tuberculosis
ECVGSELLTEPEQLA

SEQ ID NO: 160878 - protein, 15 aa, Mycobacterium tuberculosis
CVGSELLTEPEQLAA

SEQ ID NO: 160879 - protein, 15 aa, Mycobacterium tuberculosis
VGSELLTEPEQLAAA

SEQ ID NO: 160880 - protein, 15 aa, Mycobacterium tuberculosis
GSELLTEPEQLAAAH

SEQ ID NO: 160881 - protein, 15 aa, Mycobacterium tuberculosis
SELLTEPEQLAAAHE

SEQ ID NO: 160882 - protein, 15 aa, Mycobacterium tuberculosis
ELLTEPEQLAAAHEL

SEQ ID NO: 160883 - protein, 15 aa, Mycobacterium tuberculosis
LLTEPEQLAAAHELI

SEQ ID NO: 160884 - protein, 15 aa, Mycobacterium tuberculosis
LTEPEQLAAAHELID

SEQ ID NO: 160885 - protein, 15 aa, Mycobacterium tuberculosis
TEPEQLAAAHELIDR

SEQ ID NO: 160886 - protein, 15 aa, Mycobacterium tuberculosis
EPEQLAAAHELIDRG

SEQ ID NO: 160887 - protein, 15 aa, Mycobacterium tuberculosis
PEQLAAAHELIDRGR

SEQ ID NO: 160888 - protein, 15 aa, Mycobacterium tuberculosis
EQLAAAHELIDRGRA

SEQ ID NO: 160889 - protein, 15 aa, Mycobacterium tuberculosis
QLAAAHELIDRGRAE

SEQ ID NO: 160890 - protein, 15 aa, Mycobacterium tuberculosis
LAAAHELIDRGRAEV

SEQ ID NO: 160891 - protein, 15 aa, Mycobacterium tuberculosis
AAAHELIDRGRAEVV

SEQ ID NO: 160892 - protein, 15 aa, Mycobacterium tuberculosis
AAHELIDRGRAEVVV

SEQ ID NO: 160893 - protein, 15 aa, Mycobacterium tuberculosis
AHELIDRGRAEVVVV

SEQ ID NO: 160894 - protein, 15 aa, Mycobacterium tuberculosis
HELIDRGRAEVVVVS

SEQ ID NO: 160895 - protein, 15 aa, Mycobacterium tuberculosis
ELIDRGRAEVVVVSL

SEQ ID NO: 160896 - protein, 15 aa, Mycobacterium tuberculosis
LIDRGRAEVVVVSLG

SEQ ID NO: 160897 - protein, 15 aa, Mycobacterium tuberculosis
IDRGRAEVVVVSLGS

SEQ ID NO: 160898 - protein, 15 aa, Mycobacterium tuberculosis
DRGRAEVVVVSLGSQ

SEQ ID NO: 160899 - protein, 15 aa, Mycobacterium tuberculosis
RGRAEVVVVSLGSQG

SEQ ID NO: 160900 - protein, 15 aa, Mycobacterium tuberculosis
GRAEVVVVSLGSQGA

SEQ ID NO: 160901 - protein, 15 aa, Mycobacterium tuberculosis
RAEVVVVSLGSQGAL

SEQ ID NO: 160902 - protein, 15 aa, Mycobacterium tuberculosis
AEVVVVSLGSQGALL

SEQ ID NO: 160903 - protein, 15 aa, Mycobacterium tuberculosis
EVVVVSLGSQGALLA

SEQ ID NO: 160904 - protein, 15 aa, Mycobacterium tuberculosis
VVVVSLGSQGALLAT

SEQ ID NO: 160905 - protein, 15 aa, Mycobacterium tuberculosis
VVVSLGSQGALLATR

SEQ ID NO: 160906 - protein, 15 aa, Mycobacterium tuberculosis
VVSLGSQGALLATRH

SEQ ID NO: 160907 - protein, 15 aa, Mycobacterium tuberculosis
VSLGSQGALLATRHA

SEQ ID NO: 160908 - protein, 15 aa, Mycobacterium tuberculosis
SLGSQGALLATRHAS

SEQ ID NO: 160909 - protein, 15 aa, Mycobacterium tuberculosis
LGSQGALLATRHASH

SEQ ID NO: 160910 - protein, 15 aa, Mycobacterium tuberculosis
GSQGALLATRHASHR

SEQ ID NO: 160911 - protein, 15 aa, Mycobacterium tuberculosis
SQGALLATRHASHRF

SEQ ID NO: 160912 - protein, 15 aa, Mycobacterium tuberculosis
QGALLATRHASHRFS

SEQ ID NO: 160913 - protein, 15 aa, Mycobacterium tuberculosis
GALLATRHASHRFSS

SEQ ID NO: 160914 - protein, 15 aa, Mycobacterium tuberculosis
ALLATRHASHRFSSI

SEQ ID NO: 160915 - protein, 15 aa, Mycobacterium tuberculosis
LLATRHASHRFSSIP

SEQ ID NO: 160916 - protein, 15 aa, Mycobacterium tuberculosis
LATRHASHRFSSIPM

SEQ ID NO: 160917 - protein, 15 aa, Mycobacterium tuberculosis
ATRHASHRFSSIPMT

SEQ ID NO: 160918 - protein, 15 aa, Mycobacterium tuberculosis
TRHASHRFSSIPMTA

SEQ ID NO: 160919 - protein, 15 aa, Mycobacterium tuberculosis
RHASHRFSSIPMTAV

SEQ ID NO: 160920 - protein, 15 aa, Mycobacterium tuberculosis
HASHRFSSIPMTAVS

SEQ ID NO: 160921 - protein, 15 aa, Mycobacterium tuberculosis
ASHRFSSIPMTAVSG

SEQ ID NO: 160922 - protein, 15 aa, Mycobacterium tuberculosis
SHRFSSIPMTAVSGV

SEQ ID NO: 160923 - protein, 15 aa, Mycobacterium tuberculosis
HRFSSIPMTAVSGVG

SEQ ID NO: 160924 - protein, 15 aa, Mycobacterium tuberculosis
RFSSIPMTAVSGVGA

SEQ ID NO: 160925 - protein, 15 aa, Mycobacterium tuberculosis
FSSIPMTAVSGVGAG

SEQ ID NO: 160926 - protein, 15 aa, Mycobacterium tuberculosis
SSIPMTAVSGVGAGD

SEQ ID NO: 160927 - protein, 15 aa, Mycobacterium tuberculosis
SIPMTAVSGVGAGDA

SEQ ID NO: 160928 - protein, 15 aa, Mycobacterium tuberculosis
IPMTAVSGVGAGDAM

SEQ ID NO: 160929 - protein, 15 aa, Mycobacterium tuberculosis
PMTAVSGVGAGDAMV

SEQ ID NO: 160930 - protein, 15 aa, Mycobacterium tuberculosis
MTAVSGVGAGDAMVA

SEQ ID NO: 160931 - protein, 15 aa, Mycobacterium tuberculosis
TAVSGVGAGDAMVAA

SEQ ID NO: 160932 - protein, 15 aa, Mycobacterium tuberculosis
AVSGVGAGDAMVAAI

SEQ ID NO: 160933 - protein, 15 aa, Mycobacterium tuberculosis
VSGVGAGDAMVAAIT

SEQ ID NO: 160934 - protein, 15 aa, Mycobacterium tuberculosis
SGVGAGDAMVAAITV

SEQ ID NO: 160935 - protein, 15 aa, Mycobacterium tuberculosis
GVGAGDAMVAAITVG

SEQ ID NO: 160936 - protein, 15 aa, Mycobacterium tuberculosis
VGAGDAMVAAITVGL

SEQ ID NO: 160937 - protein, 15 aa, Mycobacterium tuberculosis
GAGDAMVAAITVGLS

SEQ ID NO: 160938 - protein, 15 aa, Mycobacterium tuberculosis
AGDAMVAAITVGLSR

SEQ ID NO: 160939 - protein, 15 aa, Mycobacterium tuberculosis
GDAMVAAITVGLSRG

SEQ ID NO: 160940 - protein, 15 aa, Mycobacterium tuberculosis
DAMVAAITVGLSRGW

SEQ ID NO: 160941 - protein, 15 aa, Mycobacterium tuberculosis
AMVAAITVGLSRGWS

SEQ ID NO: 160942 - protein, 15 aa, Mycobacterium tuberculosis
MVAAITVGLSRGWSL

SEQ ID NO: 160943 - protein, 15 aa, Mycobacterium tuberculosis
VAAITVGLSRGWSLI

SEQ ID NO: 160944 - protein, 15 aa, Mycobacterium tuberculosis
AAITVGLSRGWSLIK

SEQ ID NO: 160945 - protein, 15 aa, Mycobacterium tuberculosis
AITVGLSRGWSLIKS

SEQ ID NO: 160946 - protein, 15 aa, Mycobacterium tuberculosis
ITVGLSRGWSLIKSV

SEQ ID NO: 160947 - protein, 15 aa, Mycobacterium tuberculosis
TVGLSRGWSLIKSVR

SEQ ID NO: 160948 - protein, 15 aa, Mycobacterium tuberculosis
VGLSRGWSLIKSVRL

SEQ ID NO: 160949 - protein, 15 aa, Mycobacterium tuberculosis
GLSRGWSLIKSVRLG

SEQ ID NO: 160950 - protein, 15 aa, Mycobacterium tuberculosis
LSRGWSLIKSVRLGN

SEQ ID NO: 160951 - protein, 15 aa, Mycobacterium tuberculosis
SRGWSLIKSVRLGNA

SEQ ID NO: 160952 - protein, 15 aa, Mycobacterium tuberculosis
RGWSLIKSVRLGNAA

SEQ ID NO: 160953 - protein, 15 aa, Mycobacterium tuberculosis
GWSLIKSVRLGNAAG

SEQ ID NO: 160954 - protein, 15 aa, Mycobacterium tuberculosis
WSLIKSVRLGNAAGA

SEQ ID NO: 160955 - protein, 15 aa, Mycobacterium tuberculosis
SLIKSVRLGNAAGAA

SEQ ID NO: 160956 - protein, 15 aa, Mycobacterium tuberculosis
LIKSVRLGNAAGAAM

SEQ ID NO: 160957 - protein, 15 aa, Mycobacterium tuberculosis
IKSVRLGNAAGAAML

SEQ ID NO: 160958 - protein, 15 aa, Mycobacterium tuberculosis
KSVRLGNAAGAAMLL

SEQ ID NO: 160959 - protein, 15 aa, Mycobacterium tuberculosis
SVRLGNAAGAAMLLT

SEQ ID NO: 160960 - protein, 15 aa, Mycobacterium tuberculosis
VRLGNAAGAAMLLTP

SEQ ID NO: 160961 - protein, 15 aa, Mycobacterium tuberculosis
RLGNAAGAAMLLTPG

SEQ ID NO: 160962 - protein, 15 aa, Mycobacterium tuberculosis
LGNAAGAAMLLTPGT

SEQ ID NO: 160963 - protein, 15 aa, Mycobacterium tuberculosis
GNAAGAAMLLTPGTA

SEQ ID NO: 160964 - protein, 15 aa, Mycobacterium tuberculosis
NAAGAAMLLTPGTAA

SEQ ID NO: 160965 - protein, 15 aa, Mycobacterium tuberculosis
AAGAAMLLTPGTAAC

SEQ ID NO: 160966 - protein, 15 aa, Mycobacterium tuberculosis
AGAAMLLTPGTAACN

SEQ ID NO: 160967 - protein, 15 aa, Mycobacterium tuberculosis
GAAMLLTPGTAACNR

SEQ ID NO: 160968 - protein, 15 aa, Mycobacterium tuberculosis
AAMLLTPGTAACNRD

SEQ ID NO: 160969 - protein, 15 aa, Mycobacterium tuberculosis
AMLLTPGTAACNRDD

SEQ ID NO: 160970 - protein, 15 aa, Mycobacterium tuberculosis
MLLTPGTAACNRDDV

SEQ ID NO: 160971 - protein, 15 aa, Mycobacterium tuberculosis
LLTPGTAACNRDDVE

SEQ ID NO: 160972 - protein, 15 aa, Mycobacterium tuberculosis
LTPGTAACNRDDVER

SEQ ID NO: 160973 - protein, 15 aa, Mycobacterium tuberculosis
TPGTAACNRDDVERF

SEQ ID NO: 160974 - protein, 15 aa, Mycobacterium tuberculosis
PGTAACNRDDVERFF

SEQ ID NO: 160975 - protein, 15 aa, Mycobacterium tuberculosis
GTAACNRDDVERFFE

SEQ ID NO: 160976 - protein, 15 aa, Mycobacterium tuberculosis
TAACNRDDVERFFEL

SEQ ID NO: 160977 - protein, 15 aa, Mycobacterium tuberculosis
AACNRDDVERFFELA

SEQ ID NO: 160978 - protein, 15 aa, Mycobacterium tuberculosis
ACNRDDVERFFELAA

SEQ ID NO: 160979 - protein, 15 aa, Mycobacterium tuberculosis
CNRDDVERFFELAAE

SEQ ID NO: 160980 - protein, 15 aa, Mycobacterium tuberculosis
NRDDVERFFELAAEP

SEQ ID NO: 160981 - protein, 15 aa, Mycobacterium tuberculosis
RDDVERFFELAAEPT

SEQ ID NO: 160982 - protein, 15 aa, Mycobacterium tuberculosis
DDVERFFELAAEPTE

SEQ ID NO: 160983 - protein, 15 aa, Mycobacterium tuberculosis
DVERFFELAAEPTEV

SEQ ID NO: 160984 - protein, 15 aa, Mycobacterium tuberculosis
VERFFELAAEPTEVG

SEQ ID NO: 160985 - protein, 15 aa, Mycobacterium tuberculosis
ERFFELAAEPTEVGQ

SEQ ID NO: 160986 - protein, 15 aa, Mycobacterium tuberculosis
RFFELAAEPTEVGQD

SEQ ID NO: 160987 - protein, 15 aa, Mycobacterium tuberculosis
FFELAAEPTEVGQDQ

SEQ ID NO: 160988 - protein, 15 aa, Mycobacterium tuberculosis
FELAAEPTEVGQDQY

SEQ ID NO: 160989 - protein, 15 aa, Mycobacterium tuberculosis
ELAAEPTEVGQDQYV

SEQ ID NO: 160990 - protein, 15 aa, Mycobacterium tuberculosis
LAAEPTEVGQDQYVW

SEQ ID NO: 160991 - protein, 15 aa, Mycobacterium tuberculosis
AAEPTEVGQDQYVWH

SEQ ID NO: 160992 - protein, 15 aa, Mycobacterium tuberculosis
AEPTEVGQDQYVWHP

SEQ ID NO: 160993 - protein, 15 aa, Mycobacterium tuberculosis
EPTEVGQDQYVWHPI

SEQ ID NO: 160994 - protein, 15 aa, Mycobacterium tuberculosis
PTEVGQDQYVWHPIV

SEQ ID NO: 160995 - protein, 15 aa, Mycobacterium tuberculosis
TEVGQDQYVWHPIVN

SEQ ID NO: 160996 - protein, 15 aa, Mycobacterium tuberculosis
EVGQDQYVWHPIVNP

SEQ ID NO: 160997 - protein, 15 aa, Mycobacterium tuberculosis
VGQDQYVWHPIVNPE

SEQ ID NO: 160998 - protein, 15 aa, Mycobacterium tuberculosis
GQDQYVWHPIVNPEA

SEQ ID NO: 160999 - protein, 15 aa, Mycobacterium tuberculosis
QDQYVWHPIVNPEAS

SEQ ID NO: 161000 - protein, 15 aa, Mycobacterium tuberculosis
DQYVWHPIVNPEASP

SEQ ID NO: 161001 - protein, 16 aa, Mycobacterium tuberculosis
MTEPAAWDEGKPRIIT

SEQ ID NO: 161002 - protein, 16 aa, Mycobacterium tuberculosis
TEPAAWDEGKPRIITL

SEQ ID NO: 161003 - protein, 16 aa, Mycobacterium tuberculosis
EPAAWDEGKPRIITLT

SEQ ID NO: 161004 - protein, 16 aa, Mycobacterium tuberculosis
PAAWDEGKPRIITLTM

SEQ ID NO: 161005 - protein, 16 aa, Mycobacterium tuberculosis
AAWDEGKPRIITLTMN

SEQ ID NO: 161006 - protein, 16 aa, Mycobacterium tuberculosis
AWDEGKPRIITLTMNP

SEQ ID NO: 161007 - protein, 16 aa, Mycobacterium tuberculosis
WDEGKPRIITLTMNPA

SEQ ID NO: 161008 - protein, 16 aa, Mycobacterium tuberculosis
DEGKPRIITLTMNPAL

SEQ ID NO: 161009 - protein, 16 aa, Mycobacterium tuberculosis
EGKPRIITLTMNPALD

SEQ ID NO: 161010 - protein, 16 aa, Mycobacterium tuberculosis
GKPRIITLTMNPALDI

SEQ ID NO: 161011 - protein, 16 aa, Mycobacterium tuberculosis
KPRIITLTMNPALDIT

SEQ ID NO: 161012 - protein, 16 aa, Mycobacterium tuberculosis
PRIITLTMNPALDITT

SEQ ID NO: 161013 - protein, 16 aa, Mycobacterium tuberculosis
RIITLTMNPALDITTS

SEQ ID NO: 161014 - protein, 16 aa, Mycobacterium tuberculosis
IITLTMNPALDITTSV

SEQ ID NO: 161015 - protein, 16 aa, Mycobacterium tuberculosis
ITLTMNPALDITTSVD

SEQ ID NO: 161016 - protein, 16 aa, Mycobacterium tuberculosis
TLTMNPALDITTSVDV

SEQ ID NO: 161017 - protein, 16 aa, Mycobacterium tuberculosis
LTMNPALDITTSVDVV

SEQ ID NO: 161018 - protein, 16 aa, Mycobacterium tuberculosis
TMNPALDITTSVDVVR

SEQ ID NO: 161019 - protein, 16 aa, Mycobacterium tuberculosis
MNPALDITTSVDVVRP

SEQ ID NO: 161020 - protein, 16 aa, Mycobacterium tuberculosis
NPALDITTSVDVVRPT

SEQ ID NO: 161021 - protein, 16 aa, Mycobacterium tuberculosis
PALDITTSVDVVRPTE

SEQ ID NO: 161022 - protein, 16 aa, Mycobacterium tuberculosis
ALDITTSVDVVRPTEK

SEQ ID NO: 161023 - protein, 16 aa, Mycobacterium tuberculosis
LDITTSVDVVRPTEKM

SEQ ID NO: 161024 - protein, 16 aa, Mycobacterium tuberculosis
DITTSVDVVRPTEKMR

SEQ ID NO: 161025 - protein, 16 aa, Mycobacterium tuberculosis
ITTSVDVVRPTEKMRC

SEQ ID NO: 161026 - protein, 16 aa, Mycobacterium tuberculosis
TTSVDVVRPTEKMRCG

SEQ ID NO: 161027 - protein, 16 aa, Mycobacterium tuberculosis
TSVDVVRPTEKMRCGA

SEQ ID NO: 161028 - protein, 16 aa, Mycobacterium tuberculosis
SVDVVRPTEKMRCGAP

SEQ ID NO: 161029 - protein, 16 aa, Mycobacterium tuberculosis
VDVVRPTEKMRCGAPR

SEQ ID NO: 161030 - protein, 16 aa, Mycobacterium tuberculosis
DVVRPTEKMRCGAPRY

SEQ ID NO: 161031 - protein, 16 aa, Mycobacterium tuberculosis
VVRPTEKMRCGAPRYD

SEQ ID NO: 161032 - protein, 16 aa, Mycobacterium tuberculosis
VRPTEKMRCGAPRYDP

SEQ ID NO: 161033 - protein, 16 aa, Mycobacterium tuberculosis
RPTEKMRCGAPRYDPG

SEQ ID NO: 161034 - protein, 16 aa, Mycobacterium tuberculosis
PTEKMRCGAPRYDPGG

SEQ ID NO: 161035 - protein, 16 aa, Mycobacterium tuberculosis
TEKMRCGAPRYDPGGG

SEQ ID NO: 161036 - protein, 16 aa, Mycobacterium tuberculosis
EKMRCGAPRYDPGGGG

SEQ ID NO: 161037 - protein, 16 aa, Mycobacterium tuberculosis
KMRCGAPRYDPGGGGI

SEQ ID NO: 161038 - protein, 16 aa, Mycobacterium tuberculosis
MRCGAPRYDPGGGGIN

SEQ ID NO: 161039 - protein, 16 aa, Mycobacterium tuberculosis
RCGAPRYDPGGGGINV

SEQ ID NO: 161040 - protein, 16 aa, Mycobacterium tuberculosis
CGAPRYDPGGGGINVA

SEQ ID NO: 161041 - protein, 16 aa, Mycobacterium tuberculosis
GAPRYDPGGGGINVAR

SEQ ID NO: 161042 - protein, 16 aa, Mycobacterium tuberculosis
APRYDPGGGGINVARI

SEQ ID NO: 161043 - protein, 16 aa, Mycobacterium tuberculosis
PRYDPGGGGINVARIV

SEQ ID NO: 161044 - protein, 16 aa, Mycobacterium tuberculosis
RYDPGGGGINVARIVH

SEQ ID NO: 161045 - protein, 16 aa, Mycobacterium tuberculosis
YDPGGGGINVARIVHV

SEQ ID NO: 161046 - protein, 16 aa, Mycobacterium tuberculosis
DPGGGGINVARIVHVL

SEQ ID NO: 161047 - protein, 16 aa, Mycobacterium tuberculosis
PGGGGINVARIVHVLG

SEQ ID NO: 161048 - protein, 16 aa, Mycobacterium tuberculosis
GGGGINVARIVHVLGG

SEQ ID NO: 161049 - protein, 16 aa, Mycobacterium tuberculosis
GGGINVARIVHVLGGC

SEQ ID NO: 161050 - protein, 16 aa, Mycobacterium tuberculosis
GGINVARIVHVLGGCS

SEQ ID NO: 161051 - protein, 16 aa, Mycobacterium tuberculosis
GINVARIVHVLGGCST

SEQ ID NO: 161052 - protein, 16 aa, Mycobacterium tuberculosis
INVARIVHVLGGCSTA

SEQ ID NO: 161053 - protein, 16 aa, Mycobacterium tuberculosis
NVARIVHVLGGCSTAL

SEQ ID NO: 161054 - protein, 16 aa, Mycobacterium tuberculosis
VARIVHVLGGCSTALF

SEQ ID NO: 161055 - protein, 16 aa, Mycobacterium tuberculosis
ARIVHVLGGCSTALFP

SEQ ID NO: 161056 - protein, 16 aa, Mycobacterium tuberculosis
RIVHVLGGCSTALFPA

SEQ ID NO: 161057 - protein, 16 aa, Mycobacterium tuberculosis
IVHVLGGCSTALFPAG

SEQ ID NO: 161058 - protein, 16 aa, Mycobacterium tuberculosis
VHVLGGCSTALFPAGG

SEQ ID NO: 161059 - protein, 16 aa, Mycobacterium tuberculosis
HVLGGCSTALFPAGGS

SEQ ID NO: 161060 - protein, 16 aa, Mycobacterium tuberculosis
VLGGCSTALFPAGGST

SEQ ID NO: 161061 - protein, 16 aa, Mycobacterium tuberculosis
LGGCSTALFPAGGSTG

SEQ ID NO: 161062 - protein, 16 aa, Mycobacterium tuberculosis
GGCSTALFPAGGSTGS

SEQ ID NO: 161063 - protein, 16 aa, Mycobacterium tuberculosis
GCSTALFPAGGSTGSL

SEQ ID NO: 161064 - protein, 16 aa, Mycobacterium tuberculosis
CSTALFPAGGSTGSLL

SEQ ID NO: 161065 - protein, 16 aa, Mycobacterium tuberculosis
STALFPAGGSTGSLLM

SEQ ID NO: 161066 - protein, 16 aa, Mycobacterium tuberculosis
TALFPAGGSTGSLLMA

SEQ ID NO: 161067 - protein, 16 aa, Mycobacterium tuberculosis
ALFPAGGSTGSLLMAL

SEQ ID NO: 161068 - protein, 16 aa, Mycobacterium tuberculosis
LFPAGGSTGSLLMALL

SEQ ID NO: 161069 - protein, 16 aa, Mycobacterium tuberculosis
FPAGGSTGSLLMALLG

SEQ ID NO: 161070 - protein, 16 aa, Mycobacterium tuberculosis
PAGGSTGSLLMALLGD

SEQ ID NO: 161071 - protein, 16 aa, Mycobacterium tuberculosis
AGGSTGSLLMALLGDA

SEQ ID NO: 161072 - protein, 16 aa, Mycobacterium tuberculosis
GGSTGSLLMALLGDAG

SEQ ID NO: 161073 - protein, 16 aa, Mycobacterium tuberculosis
GSTGSLLMALLGDAGV

SEQ ID NO: 161074 - protein, 16 aa, Mycobacterium tuberculosis
STGSLLMALLGDAGVP

SEQ ID NO: 161075 - protein, 16 aa, Mycobacterium tuberculosis
TGSLLMALLGDAGVPF

SEQ ID NO: 161076 - protein, 16 aa, Mycobacterium tuberculosis
GSLLMALLGDAGVPFR

SEQ ID NO: 161077 - protein, 16 aa, Mycobacterium tuberculosis
SLLMALLGDAGVPFRV

SEQ ID NO: 161078 - protein, 16 aa, Mycobacterium tuberculosis
LLMALLGDAGVPFRVI

SEQ ID NO: 161079 - protein, 16 aa, Mycobacterium tuberculosis
LMALLGDAGVPFRVIP

SEQ ID NO: 161080 - protein, 16 aa, Mycobacterium tuberculosis
MALLGDAGVPFRVIPI

SEQ ID NO: 161081 - protein, 16 aa, Mycobacterium tuberculosis
ALLGDAGVPFRVIPIA

SEQ ID NO: 161082 - protein, 16 aa, Mycobacterium tuberculosis
LLGDAGVPFRVIPIAA

SEQ ID NO: 161083 - protein, 16 aa, Mycobacterium tuberculosis
LGDAGVPFRVIPIAAS

SEQ ID NO: 161084 - protein, 16 aa, Mycobacterium tuberculosis
GDAGVPFRVIPIAAST

SEQ ID NO: 161085 - protein, 16 aa, Mycobacterium tuberculosis
DAGVPFRVIPIAASTR

SEQ ID NO: 161086 - protein, 16 aa, Mycobacterium tuberculosis
AGVPFRVIPIAASTRE

SEQ ID NO: 161087 - protein, 16 aa, Mycobacterium tuberculosis
GVPFRVIPIAASTRES

SEQ ID NO: 161088 - protein, 16 aa, Mycobacterium tuberculosis
VPFRVIPIAASTRESF

SEQ ID NO: 161089 - protein, 16 aa, Mycobacterium tuberculosis
PFRVIPIAASTRESFT

SEQ ID NO: 161090 - protein, 16 aa, Mycobacterium tuberculosis
FRVIPIAASTRESFTV

SEQ ID NO: 161091 - protein, 16 aa, Mycobacterium tuberculosis
RVIPIAASTRESFTVN

SEQ ID NO: 161092 - protein, 16 aa, Mycobacterium tuberculosis
VIPIAASTRESFTVNE

SEQ ID NO: 161093 - protein, 16 aa, Mycobacterium tuberculosis
IPIAASTRESFTVNES

SEQ ID NO: 161094 - protein, 16 aa, Mycobacterium tuberculosis
PIAASTRESFTVNESR

SEQ ID NO: 161095 - protein, 16 aa, Mycobacterium tuberculosis
IAASTRESFTVNESRT

SEQ ID NO: 161096 - protein, 16 aa, Mycobacterium tuberculosis
AASTRESFTVNESRTA

SEQ ID NO: 161097 - protein, 16 aa, Mycobacterium tuberculosis
ASTRESFTVNESRTAK

SEQ ID NO: 161098 - protein, 16 aa, Mycobacterium tuberculosis
STRESFTVNESRTAKQ

SEQ ID NO: 161099 - protein, 16 aa, Mycobacterium tuberculosis
TRESFTVNESRTAKQY

SEQ ID NO: 161100 - protein, 16 aa, Mycobacterium tuberculosis
RESFTVNESRTAKQYR

SEQ ID NO: 161101 - protein, 16 aa, Mycobacterium tuberculosis
ESFTVNESRTAKQYRF

SEQ ID NO: 161102 - protein, 16 aa, Mycobacterium tuberculosis
SFTVNESRTAKQYRFV

SEQ ID NO: 161103 - protein, 16 aa, Mycobacterium tuberculosis
FTVNESRTAKQYRFVL

SEQ ID NO: 161104 - protein, 16 aa, Mycobacterium tuberculosis
TVNESRTAKQYRFVLP

SEQ ID NO: 161105 - protein, 16 aa, Mycobacterium tuberculosis
VNESRTAKQYRFVLPG

SEQ ID NO: 161106 - protein, 16 aa, Mycobacterium tuberculosis
NESRTAKQYRFVLPGP

SEQ ID NO: 161107 - protein, 16 aa, Mycobacterium tuberculosis
ESRTAKQYRFVLPGPS

SEQ ID NO: 161108 - protein, 16 aa, Mycobacterium tuberculosis
SRTAKQYRFVLPGPSL

SEQ ID NO: 161109 - protein, 16 aa, Mycobacterium tuberculosis
RTAKQYRFVLPGPSLT

SEQ ID NO: 161110 - protein, 16 aa, Mycobacterium tuberculosis
TAKQYRFVLPGPSLTV

SEQ ID NO: 161111 - protein, 16 aa, Mycobacterium tuberculosis
AKQYRFVLPGPSLTVA

SEQ ID NO: 161112 - protein, 16 aa, Mycobacterium tuberculosis
KQYRFVLPGPSLTVAE

SEQ ID NO: 161113 - protein, 16 aa, Mycobacterium tuberculosis
QYRFVLPGPSLTVAEQ

SEQ ID NO: 161114 - protein, 16 aa, Mycobacterium tuberculosis
YRFVLPGPSLTVAEQE

SEQ ID NO: 161115 - protein, 16 aa, Mycobacterium tuberculosis
RFVLPGPSLTVAEQEQ

SEQ ID NO: 161116 - protein, 16 aa, Mycobacterium tuberculosis
FVLPGPSLTVAEQEQC

SEQ ID NO: 161117 - protein, 16 aa, Mycobacterium tuberculosis
VLPGPSLTVAEQEQCL

SEQ ID NO: 161118 - protein, 16 aa, Mycobacterium tuberculosis
LPGPSLTVAEQEQCLD

SEQ ID NO: 161119 - protein, 16 aa, Mycobacterium tuberculosis
PGPSLTVAEQEQCLDE

SEQ ID NO: 161120 - protein, 16 aa, Mycobacterium tuberculosis
GPSLTVAEQEQCLDEL

SEQ ID NO: 161121 - protein, 16 aa, Mycobacterium tuberculosis
PSLTVAEQEQCLDELR

SEQ ID NO: 161122 - protein, 16 aa, Mycobacterium tuberculosis
SLTVAEQEQCLDELRG

SEQ ID NO: 161123 - protein, 16 aa, Mycobacterium tuberculosis
LTVAEQEQCLDELRGA

SEQ ID NO: 161124 - protein, 16 aa, Mycobacterium tuberculosis
TVAEQEQCLDELRGAA

SEQ ID NO: 161125 - protein, 16 aa, Mycobacterium tuberculosis
VAEQEQCLDELRGAAA

SEQ ID NO: 161126 - protein, 16 aa, Mycobacterium tuberculosis
AEQEQCLDELRGAAAS

SEQ ID NO: 161127 - protein, 16 aa, Mycobacterium tuberculosis
EQEQCLDELRGAAASA

SEQ ID NO: 161128 - protein, 16 aa, Mycobacterium tuberculosis
QEQCLDELRGAAASAA

SEQ ID NO: 161129 - protein, 16 aa, Mycobacterium tuberculosis
EQCLDELRGAAASAAF

SEQ ID NO: 161130 - protein, 16 aa, Mycobacterium tuberculosis
QCLDELRGAAASAAFV

SEQ ID NO: 161131 - protein, 16 aa, Mycobacterium tuberculosis
CLDELRGAAASAAFVV

SEQ ID NO: 161132 - protein, 16 aa, Mycobacterium tuberculosis
LDELRGAAASAAFVVA

SEQ ID NO: 161133 - protein, 16 aa, Mycobacterium tuberculosis
DELRGAAASAAFVVAS

SEQ ID NO: 161134 - protein, 16 aa, Mycobacterium tuberculosis
ELRGAAASAAFVVASG

SEQ ID NO: 161135 - protein, 16 aa, Mycobacterium tuberculosis
LRGAAASAAFVVASGS

SEQ ID NO: 161136 - protein, 16 aa, Mycobacterium tuberculosis
RGAAASAAFVVASGSL

SEQ ID NO: 161137 - protein, 16 aa, Mycobacterium tuberculosis
GAAASAAFVVASGSLP

SEQ ID NO: 161138 - protein, 16 aa, Mycobacterium tuberculosis
AAASAAFVVASGSLPP

SEQ ID NO: 161139 - protein, 16 aa, Mycobacterium tuberculosis
AASAAFVVASGSLPPG

SEQ ID NO: 161140 - protein, 16 aa, Mycobacterium tuberculosis
ASAAFVVASGSLPPGV

SEQ ID NO: 161141 - protein, 16 aa, Mycobacterium tuberculosis
SAAFVVASGSLPPGVA

SEQ ID NO: 161142 - protein, 16 aa, Mycobacterium tuberculosis
AAFVVASGSLPPGVAA

SEQ ID NO: 161143 - protein, 16 aa, Mycobacterium tuberculosis
AFVVASGSLPPGVAAD

SEQ ID NO: 161144 - protein, 16 aa, Mycobacterium tuberculosis
FVVASGSLPPGVAADY

SEQ ID NO: 161145 - protein, 16 aa, Mycobacterium tuberculosis
VVASGSLPPGVAADYY

SEQ ID NO: 161146 - protein, 16 aa, Mycobacterium tuberculosis
VASGSLPPGVAADYYQ

SEQ ID NO: 161147 - protein, 16 aa, Mycobacterium tuberculosis
ASGSLPPGVAADYYQR

SEQ ID NO: 161148 - protein, 16 aa, Mycobacterium tuberculosis
SGSLPPGVAADYYQRV

SEQ ID NO: 161149 - protein, 16 aa, Mycobacterium tuberculosis
GSLPPGVAADYYQRVA

SEQ ID NO: 161150 - protein, 16 aa, Mycobacterium tuberculosis
SLPPGVAADYYQRVAD

SEQ ID NO: 161151 - protein, 16 aa, Mycobacterium tuberculosis
LPPGVAADYYQRVADI

SEQ ID NO: 161152 - protein, 16 aa, Mycobacterium tuberculosis
PPGVAADYYQRVADIC

SEQ ID NO: 161153 - protein, 16 aa, Mycobacterium tuberculosis
PGVAADYYQRVADICR

SEQ ID NO: 161154 - protein, 16 aa, Mycobacterium tuberculosis
GVAADYYQRVADICRR

SEQ ID NO: 161155 - protein, 16 aa, Mycobacterium tuberculosis
VAADYYQRVADICRRS

SEQ ID NO: 161156 - protein, 16 aa, Mycobacterium tuberculosis
AADYYQRVADICRRSS

SEQ ID NO: 161157 - protein, 16 aa, Mycobacterium tuberculosis
ADYYQRVADICRRSST

SEQ ID NO: 161158 - protein, 16 aa, Mycobacterium tuberculosis
DYYQRVADICRRSSTP

SEQ ID NO: 161159 - protein, 16 aa, Mycobacterium tuberculosis
YYQRVADICRRSSTPL

SEQ ID NO: 161160 - protein, 16 aa, Mycobacterium tuberculosis
YQRVADICRRSSTPLI

SEQ ID NO: 161161 - protein, 16 aa, Mycobacterium tuberculosis
QRVADICRRSSTPLIL

SEQ ID NO: 161162 - protein, 16 aa, Mycobacterium tuberculosis
RVADICRRSSTPLILD

SEQ ID NO: 161163 - protein, 16 aa, Mycobacterium tuberculosis
VADICRRSSTPLILDT

SEQ ID NO: 161164 - protein, 16 aa, Mycobacterium tuberculosis
ADICRRSSTPLILDTS

SEQ ID NO: 161165 - protein, 16 aa, Mycobacterium tuberculosis
DICRRSSTPLILDTSG

SEQ ID NO: 161166 - protein, 16 aa, Mycobacterium tuberculosis
ICRRSSTPLILDTSGG

SEQ ID NO: 161167 - protein, 16 aa, Mycobacterium tuberculosis
CRRSSTPLILDTSGGG

SEQ ID NO: 161168 - protein, 16 aa, Mycobacterium tuberculosis
RRSSTPLILDTSGGGL

SEQ ID NO: 161169 - protein, 16 aa, Mycobacterium tuberculosis
RSSTPLILDTSGGGLQ

SEQ ID NO: 161170 - protein, 16 aa, Mycobacterium tuberculosis
SSTPLILDTSGGGLQH

SEQ ID NO: 161171 - protein, 16 aa, Mycobacterium tuberculosis
STPLILDTSGGGLQHI

SEQ ID NO: 161172 - protein, 16 aa, Mycobacterium tuberculosis
TPLILDTSGGGLQHIS

SEQ ID NO: 161173 - protein, 16 aa, Mycobacterium tuberculosis
PLILDTSGGGLQHISS

SEQ ID NO: 161174 - protein, 16 aa, Mycobacterium tuberculosis
LILDTSGGGLQHISSG

SEQ ID NO: 161175 - protein, 16 aa, Mycobacterium tuberculosis
ILDTSGGGLQHISSGV

SEQ ID NO: 161176 - protein, 16 aa, Mycobacterium tuberculosis
LDTSGGGLQHISSGVF

SEQ ID NO: 161177 - protein, 16 aa, Mycobacterium tuberculosis
DTSGGGLQHISSGVFL

SEQ ID NO: 161178 - protein, 16 aa, Mycobacterium tuberculosis
TSGGGLQHISSGVFLL

SEQ ID NO: 161179 - protein, 16 aa, Mycobacterium tuberculosis
SGGGLQHISSGVFLLK

SEQ ID NO: 161180 - protein, 16 aa, Mycobacterium tuberculosis
GGGLQHISSGVFLLKA

SEQ ID NO: 161181 - protein, 16 aa, Mycobacterium tuberculosis
GGLQHISSGVFLLKAS

SEQ ID NO: 161182 - protein, 16 aa, Mycobacterium tuberculosis
GLQHISSGVFLLKASV

SEQ ID NO: 161183 - protein, 16 aa, Mycobacterium tuberculosis
LQHISSGVFLLKASVR

SEQ ID NO: 161184 - protein, 16 aa, Mycobacterium tuberculosis
QHISSGVFLLKASVRE

SEQ ID NO: 161185 - protein, 16 aa, Mycobacterium tuberculosis
HISSGVFLLKASVREL

SEQ ID NO: 161186 - protein, 16 aa, Mycobacterium tuberculosis
ISSGVFLLKASVRELR

SEQ ID NO: 161187 - protein, 16 aa, Mycobacterium tuberculosis
SSGVFLLKASVRELRE

SEQ ID NO: 161188 - protein, 16 aa, Mycobacterium tuberculosis
SGVFLLKASVRELREC

SEQ ID NO: 161189 - protein, 16 aa, Mycobacterium tuberculosis
GVFLLKASVRELRECV

SEQ ID NO: 161190 - protein, 16 aa, Mycobacterium tuberculosis
VFLLKASVRELRECVG

SEQ ID NO: 161191 - protein, 16 aa, Mycobacterium tuberculosis
FLLKASVRELRECVGS

SEQ ID NO: 161192 - protein, 16 aa, Mycobacterium tuberculosis
LLKASVRELRECVGSE

SEQ ID NO: 161193 - protein, 16 aa, Mycobacterium tuberculosis
LKASVRELRECVGSEL

SEQ ID NO: 161194 - protein, 16 aa, Mycobacterium tuberculosis
KASVRELRECVGSELL

SEQ ID NO: 161195 - protein, 16 aa, Mycobacterium tuberculosis
ASVRELRECVGSELLT

SEQ ID NO: 161196 - protein, 16 aa, Mycobacterium tuberculosis
SVRELRECVGSELLTE

SEQ ID NO: 161197 - protein, 16 aa, Mycobacterium tuberculosis
VRELRECVGSELLTEP

SEQ ID NO: 161198 - protein, 16 aa, Mycobacterium tuberculosis
RELRECVGSELLTEPE

SEQ ID NO: 161199 - protein, 16 aa, Mycobacterium tuberculosis
ELRECVGSELLTEPEQ

SEQ ID NO: 161200 - protein, 16 aa, Mycobacterium tuberculosis
LRECVGSELLTEPEQL

SEQ ID NO: 161201 - protein, 16 aa, Mycobacterium tuberculosis
RECVGSELLTEPEQLA

SEQ ID NO: 161202 - protein, 16 aa, Mycobacterium tuberculosis
ECVGSELLTEPEQLAA

SEQ ID NO: 161203 - protein, 16 aa, Mycobacterium tuberculosis
CVGSELLTEPEQLAAA

SEQ ID NO: 161204 - protein, 16 aa, Mycobacterium tuberculosis
VGSELLTEPEQLAAAH

SEQ ID NO: 161205 - protein, 16 aa, Mycobacterium tuberculosis
GSELLTEPEQLAAAHE

SEQ ID NO: 161206 - protein, 16 aa, Mycobacterium tuberculosis
SELLTEPEQLAAAHEL

SEQ ID NO: 161207 - protein, 16 aa, Mycobacterium tuberculosis
ELLTEPEQLAAAHELI

SEQ ID NO: 161208 - protein, 16 aa, Mycobacterium tuberculosis
LLTEPEQLAAAHELID

SEQ ID NO: 161209 - protein, 16 aa, Mycobacterium tuberculosis
LTEPEQLAAAHELIDR

SEQ ID NO: 161210 - protein, 16 aa, Mycobacterium tuberculosis
TEPEQLAAAHELIDRG

SEQ ID NO: 161211 - protein, 16 aa, Mycobacterium tuberculosis
EPEQLAAAHELIDRGR

SEQ ID NO: 161212 - protein, 16 aa, Mycobacterium tuberculosis
PEQLAAAHELIDRGRA

SEQ ID NO: 161213 - protein, 16 aa, Mycobacterium tuberculosis
EQLAAAHELIDRGRAE

SEQ ID NO: 161214 - protein, 16 aa, Mycobacterium tuberculosis
QLAAAHELIDRGRAEV

SEQ ID NO: 161215 - protein, 16 aa, Mycobacterium tuberculosis
LAAAHELIDRGRAEVV

SEQ ID NO: 161216 - protein, 16 aa, Mycobacterium tuberculosis
AAAHELIDRGRAEVVV

SEQ ID NO: 161217 - protein, 16 aa, Mycobacterium tuberculosis
AAHELIDRGRAEVVVV

SEQ ID NO: 161218 - protein, 16 aa, Mycobacterium tuberculosis
AHELIDRGRAEVVVVS

SEQ ID NO: 161219 - protein, 16 aa, Mycobacterium tuberculosis
HELIDRGRAEVVVVSL

SEQ ID NO: 161220 - protein, 16 aa, Mycobacterium tuberculosis
ELIDRGRAEVVVVSLG

SEQ ID NO: 161221 - protein, 16 aa, Mycobacterium tuberculosis
LIDRGRAEVVVVSLGS

SEQ ID NO: 161222 - protein, 16 aa, Mycobacterium tuberculosis
IDRGRAEVVVVSLGSQ

SEQ ID NO: 161223 - protein, 16 aa, Mycobacterium tuberculosis
DRGRAEVVVVSLGSQG

SEQ ID NO: 161224 - protein, 16 aa, Mycobacterium tuberculosis
RGRAEVVVVSLGSQGA

SEQ ID NO: 161225 - protein, 16 aa, Mycobacterium tuberculosis
GRAEVVVVSLGSQGAL

SEQ ID NO: 161226 - protein, 16 aa, Mycobacterium tuberculosis
RAEVVVVSLGSQGALL

SEQ ID NO: 161227 - protein, 16 aa, Mycobacterium tuberculosis
AEVVVVSLGSQGALLA

SEQ ID NO: 161228 - protein, 16 aa, Mycobacterium tuberculosis
EVVVVSLGSQGALLAT

SEQ ID NO: 161229 - protein, 16 aa, Mycobacterium tuberculosis
VVVVSLGSQGALLATR

SEQ ID NO: 161230 - protein, 16 aa, Mycobacterium tuberculosis
VVVSLGSQGALLATRH

SEQ ID NO: 161231 - protein, 16 aa, Mycobacterium tuberculosis
VVSLGSQGALLATRHA

SEQ ID NO: 161232 - protein, 16 aa, Mycobacterium tuberculosis
VSLGSQGALLATRHAS

SEQ ID NO: 161233 - protein, 16 aa, Mycobacterium tuberculosis
SLGSQGALLATRHASH

SEQ ID NO: 161234 - protein, 16 aa, Mycobacterium tuberculosis
LGSQGALLATRHASHR

SEQ ID NO: 161235 - protein, 16 aa, Mycobacterium tuberculosis
GSQGALLATRHASHRF

SEQ ID NO: 161236 - protein, 16 aa, Mycobacterium tuberculosis
SQGALLATRHASHRFS

SEQ ID NO: 161237 - protein, 16 aa, Mycobacterium tuberculosis
QGALLATRHASHRFSS

SEQ ID NO: 161238 - protein, 16 aa, Mycobacterium tuberculosis
GALLATRHASHRFSSI

SEQ ID NO: 161239 - protein, 16 aa, Mycobacterium tuberculosis
ALLATRHASHRFSSIP

SEQ ID NO: 161240 - protein, 16 aa, Mycobacterium tuberculosis
LLATRHASHRFSSIPM

SEQ ID NO: 161241 - protein, 16 aa, Mycobacterium tuberculosis
LATRHASHRFSSIPMT

SEQ ID NO: 161242 - protein, 16 aa, Mycobacterium tuberculosis
ATRHASHRFSSIPMTA

SEQ ID NO: 161243 - protein, 16 aa, Mycobacterium tuberculosis
TRHASHRFSSIPMTAV

SEQ ID NO: 161244 - protein, 16 aa, Mycobacterium tuberculosis
RHASHRFSSIPMTAVS

SEQ ID NO: 161245 - protein, 16 aa, Mycobacterium tuberculosis
HASHRFSSIPMTAVSG

SEQ ID NO: 161246 - protein, 16 aa, Mycobacterium tuberculosis
ASHRFSSIPMTAVSGV

SEQ ID NO: 161247 - protein, 16 aa, Mycobacterium tuberculosis
SHRFSSIPMTAVSGVG

SEQ ID NO: 161248 - protein, 16 aa, Mycobacterium tuberculosis
HRFSSIPMTAVSGVGA

SEQ ID NO: 161249 - protein, 16 aa, Mycobacterium tuberculosis
RFSSIPMTAVSGVGAG

SEQ ID NO: 161250 - protein, 16 aa, Mycobacterium tuberculosis
FSSIPMTAVSGVGAGD

SEQ ID NO: 161251 - protein, 16 aa, Mycobacterium tuberculosis
SSIPMTAVSGVGAGDA

SEQ ID NO: 161252 - protein, 16 aa, Mycobacterium tuberculosis
SIPMTAVSGVGAGDAM

SEQ ID NO: 161253 - protein, 16 aa, Mycobacterium tuberculosis
IPMTAVSGVGAGDAMV

SEQ ID NO: 161254 - protein, 16 aa, Mycobacterium tuberculosis
PMTAVSGVGAGDAMVA

SEQ ID NO: 161255 - protein, 16 aa, Mycobacterium tuberculosis
MTAVSGVGAGDAMVAA

SEQ ID NO: 161256 - protein, 16 aa, Mycobacterium tuberculosis
TAVSGVGAGDAMVAAI

SEQ ID NO: 161257 - protein, 16 aa, Mycobacterium tuberculosis
AVSGVGAGDAMVAAIT

SEQ ID NO: 161258 - protein, 16 aa, Mycobacterium tuberculosis
VSGVGAGDAMVAAITV

SEQ ID NO: 161259 - protein, 16 aa, Mycobacterium tuberculosis
SGVGAGDAMVAAITVG

SEQ ID NO: 161260 - protein, 16 aa, Mycobacterium tuberculosis
GVGAGDAMVAAITVGL

SEQ ID NO: 161261 - protein, 16 aa, Mycobacterium tuberculosis
VGAGDAMVAAITVGLS

SEQ ID NO: 161262 - protein, 16 aa, Mycobacterium tuberculosis
GAGDAMVAAITVGLSR

SEQ ID NO: 161263 - protein, 16 aa, Mycobacterium tuberculosis
AGDAMVAAITVGLSRG

SEQ ID NO: 161264 - protein, 16 aa, Mycobacterium tuberculosis
GDAMVAAITVGLSRGW

SEQ ID NO: 161265 - protein, 16 aa, Mycobacterium tuberculosis
DAMVAAITVGLSRGWS

SEQ ID NO: 161266 - protein, 16 aa, Mycobacterium tuberculosis
AMVAAITVGLSRGWSL

SEQ ID NO: 161267 - protein, 16 aa, Mycobacterium tuberculosis
MVAAITVGLSRGWSLI

SEQ ID NO: 161268 - protein, 16 aa, Mycobacterium tuberculosis
VAAITVGLSRGWSLIK

SEQ ID NO: 161269 - protein, 16 aa, Mycobacterium tuberculosis
AAITVGLSRGWSLIKS

SEQ ID NO: 161270 - protein, 16 aa, Mycobacterium tuberculosis
AITVGLSRGWSLIKSV

SEQ ID NO: 161271 - protein, 16 aa, Mycobacterium tuberculosis
ITVGLSRGWSLIKSVR

SEQ ID NO: 161272 - protein, 16 aa, Mycobacterium tuberculosis
TVGLSRGWSLIKSVRL

SEQ ID NO: 161273 - protein, 16 aa, Mycobacterium tuberculosis
VGLSRGWSLIKSVRLG

SEQ ID NO: 161274 - protein, 16 aa, Mycobacterium tuberculosis
GLSRGWSLIKSVRLGN

SEQ ID NO: 161275 - protein, 16 aa, Mycobacterium tuberculosis
LSRGWSLIKSVRLGNA

SEQ ID NO: 161276 - protein, 16 aa, Mycobacterium tuberculosis
SRGWSLIKSVRLGNAA

SEQ ID NO: 161277 - protein, 16 aa, Mycobacterium tuberculosis
RGWSLIKSVRLGNAAG

SEQ ID NO: 161278 - protein, 16 aa, Mycobacterium tuberculosis
GWSLIKSVRLGNAAGA

SEQ ID NO: 161279 - protein, 16 aa, Mycobacterium tuberculosis
WSLIKSVRLGNAAGAA

SEQ ID NO: 161280 - protein, 16 aa, Mycobacterium tuberculosis
SLIKSVRLGNAAGAAM

SEQ ID NO: 161281 - protein, 16 aa, Mycobacterium tuberculosis
LIKSVRLGNAAGAAML

SEQ ID NO: 161282 - protein, 16 aa, Mycobacterium tuberculosis
IKSVRLGNAAGAAMLL

SEQ ID NO: 161283 - protein, 16 aa, Mycobacterium tuberculosis
KSVRLGNAAGAAMLLT

SEQ ID NO: 161284 - protein, 16 aa, Mycobacterium tuberculosis
SVRLGNAAGAAMLLTP

SEQ ID NO: 161285 - protein, 16 aa, Mycobacterium tuberculosis
VRLGNAAGAAMLLTPG

SEQ ID NO: 161286 - protein, 16 aa, Mycobacterium tuberculosis
RLGNAAGAAMLLTPGT

SEQ ID NO: 161287 - protein, 16 aa, Mycobacterium tuberculosis
LGNAAGAAMLLTPGTA

SEQ ID NO: 161288 - protein, 16 aa, Mycobacterium tuberculosis
GNAAGAAMLLTPGTAA

SEQ ID NO: 161289 - protein, 16 aa, Mycobacterium tuberculosis
NAAGAAMLLTPGTAAC

SEQ ID NO: 161290 - protein, 16 aa, Mycobacterium tuberculosis
AAGAAMLLTPGTAACN

SEQ ID NO: 161291 - protein, 16 aa, Mycobacterium tuberculosis
AGAAMLLTPGTAACNR

SEQ ID NO: 161292 - protein, 16 aa, Mycobacterium tuberculosis
GAAMLLTPGTAACNRD

SEQ ID NO: 161293 - protein, 16 aa, Mycobacterium tuberculosis
AAMLLTPGTAACNRDD

SEQ ID NO: 161294 - protein, 16 aa, Mycobacterium tuberculosis
AMLLTPGTAACNRDDV

SEQ ID NO: 161295 - protein, 16 aa, Mycobacterium tuberculosis
MLLTPGTAACNRDDVE

SEQ ID NO: 161296 - protein, 16 aa, Mycobacterium tuberculosis
LLTPGTAACNRDDVER

SEQ ID NO: 161297 - protein, 16 aa, Mycobacterium tuberculosis
LTPGTAACNRDDVERF

SEQ ID NO: 161298 - protein, 16 aa, Mycobacterium tuberculosis
TPGTAACNRDDVERFF

SEQ ID NO: 161299 - protein, 16 aa, Mycobacterium tuberculosis
PGTAACNRDDVERFFE

SEQ ID NO: 161300 - protein, 16 aa, Mycobacterium tuberculosis
GTAACNRDDVERFFEL

SEQ ID NO: 161301 - protein, 16 aa, Mycobacterium tuberculosis
TAACNRDDVERFFELA

SEQ ID NO: 161302 - protein, 16 aa, Mycobacterium tuberculosis
AACNRDDVERFFELAA

SEQ ID NO: 161303 - protein, 16 aa, Mycobacterium tuberculosis
ACNRDDVERFFELAAE

SEQ ID NO: 161304 - protein, 16 aa, Mycobacterium tuberculosis
CNRDDVERFFELAAEP

SEQ ID NO: 161305 - protein, 16 aa, Mycobacterium tuberculosis
NRDDVERFFELAAEPT

SEQ ID NO: 161306 - protein, 16 aa, Mycobacterium tuberculosis
RDDVERFFELAAEPTE

SEQ ID NO: 161307 - protein, 16 aa, Mycobacterium tuberculosis
DDVERFFELAAEPTEV

SEQ ID NO: 161308 - protein, 16 aa, Mycobacterium tuberculosis
DVERFFELAAEPTEVG

SEQ ID NO: 161309 - protein, 16 aa, Mycobacterium tuberculosis
VERFFELAAEPTEVGQ

SEQ ID NO: 161310 - protein, 16 aa, Mycobacterium tuberculosis
ERFFELAAEPTEVGQD

SEQ ID NO: 161311 - protein, 16 aa, Mycobacterium tuberculosis
RFFELAAEPTEVGQDQ

SEQ ID NO: 161312 - protein, 16 aa, Mycobacterium tuberculosis
FFELAAEPTEVGQDQY

SEQ ID NO: 161313 - protein, 16 aa, Mycobacterium tuberculosis
FELAAEPTEVGQDQYV

SEQ ID NO: 161314 - protein, 16 aa, Mycobacterium tuberculosis
ELAAEPTEVGQDQYVW

SEQ ID NO: 161315 - protein, 16 aa, Mycobacterium tuberculosis
LAAEPTEVGQDQYVWH

SEQ ID NO: 161316 - protein, 16 aa, Mycobacterium tuberculosis
AAEPTEVGQDQYVWHP

SEQ ID NO: 161317 - protein, 16 aa, Mycobacterium tuberculosis
AEPTEVGQDQYVWHPI

SEQ ID NO: 161318 - protein, 16 aa, Mycobacterium tuberculosis
EPTEVGQDQYVWHPIV

SEQ ID NO: 161319 - protein, 16 aa, Mycobacterium tuberculosis
PTEVGQDQYVWHPIVN

SEQ ID NO: 161320 - protein, 16 aa, Mycobacterium tuberculosis
TEVGQDQYVWHPIVNP

SEQ ID NO: 161321 - protein, 16 aa, Mycobacterium tuberculosis
EVGQDQYVWHPIVNPE

SEQ ID NO: 161322 - protein, 16 aa, Mycobacterium tuberculosis
VGQDQYVWHPIVNPEA

SEQ ID NO: 161323 - protein, 16 aa, Mycobacterium tuberculosis
GQDQYVWHPIVNPEAS

SEQ ID NO: 161324 - protein, 16 aa, Mycobacterium tuberculosis
QDQYVWHPIVNPEASP

SEQ ID NO: 161325 - protein, 413 aa, Mycobacterium tuberculosis
MASSASDGTHERSAFRLSPPVLSGAMGPFMHTGLYVAQSWRDYLGQQPDKLPIARPTIALAAQAFRDEIVLLGLKARRPVSNHRVFERISQEVAAGLEFYGNRRWLEKPSGFFAQPPPLTEVAVRKVKDRRRSFYRIFFDSGFTPHPGEPGSQRWLSYTANNREYALLLRHPEPRPWLVCVHGTEMGRAPLDLAVFRAWKLHDELGLNIVMPVLPMHGPRGQGLPKGAVFPGEDVLDDVHGTAQAVWDIRRLLSWIRSQEEESLIGLNGLSLGGYIASLVASLEEGLACAILGVPVADLIELLGRHCGLRHKDPRRHTVKMAEPIGRMISPLSLTPLVPMPGRFIYAGIADRLVHPREQVTRLWEHWGKPEIVWYPGGHTGFFQSRPVRRFVQAALEQSGLLDAPRTQRDRSA

SEQ ID NO: 161326 - protein, 8 aa, Mycobacterium tuberculosis
GTHERSAF

SEQ ID NO: 161327 - protein, 8 aa, Mycobacterium tuberculosis
HERSAFRL

SEQ ID NO: 161328 - protein, 8 aa, Mycobacterium tuberculosis
AFRLSPPV

SEQ ID NO: 161329 - protein, 8 aa, Mycobacterium tuberculosis
FRLSPPVL

SEQ ID NO: 161330 - protein, 8 aa, Mycobacterium tuberculosis
RLSPPVLS

SEQ ID NO: 161331 - protein, 8 aa, Mycobacterium tuberculosis
SPPVLSGA

SEQ ID NO: 161332 - protein, 8 aa, Mycobacterium tuberculosis
PPVLSGAM

SEQ ID NO: 161333 - protein, 8 aa, Mycobacterium tuberculosis
VLSGAMGP

SEQ ID NO: 161334 - protein, 8 aa, Mycobacterium tuberculosis
LSGAMGPF

SEQ ID NO: 161335 - protein, 8 aa, Mycobacterium tuberculosis
AMGPFMHT

SEQ ID NO: 161336 - protein, 8 aa, Mycobacterium tuberculosis
GPFMHTGL

SEQ ID NO: 161337 - protein, 8 aa, Mycobacterium tuberculosis
PFMHTGLY

SEQ ID NO: 161338 - protein, 8 aa, Mycobacterium tuberculosis
FMHTGLYV

SEQ ID NO: 161339 - protein, 8 aa, Mycobacterium tuberculosis
MHTGLYVA

SEQ ID NO: 161340 - protein, 8 aa, Mycobacterium tuberculosis
GLYVAQSW

SEQ ID NO: 161341 - protein, 8 aa, Mycobacterium tuberculosis
LYVAQSWR

SEQ ID NO: 161342 - protein, 8 aa, Mycobacterium tuberculosis
AQSWRDYL

SEQ ID NO: 161343 - protein, 8 aa, Mycobacterium tuberculosis
QQPDKLPI

SEQ ID NO: 161344 - protein, 8 aa, Mycobacterium tuberculosis
LPIARPTI

SEQ ID NO: 161345 - protein, 8 aa, Mycobacterium tuberculosis
IARPTIAL

SEQ ID NO: 161346 - protein, 8 aa, Mycobacterium tuberculosis
RPTIALAA

SEQ ID NO: 161347 - protein, 8 aa, Mycobacterium tuberculosis
TIALAAQA

SEQ ID NO: 161348 - protein, 8 aa, Mycobacterium tuberculosis
IALAAQAF

SEQ ID NO: 161349 - protein, 8 aa, Mycobacterium tuberculosis
ALAAQAFR

SEQ ID NO: 161350 - protein, 8 aa, Mycobacterium tuberculosis
AQAFRDEI

SEQ ID NO: 161351 - protein, 8 aa, Mycobacterium tuberculosis
QAFRDEIV

SEQ ID NO: 161352 - protein, 8 aa, Mycobacterium tuberculosis
FRDEIVLL

SEQ ID NO: 161353 - protein, 8 aa, Mycobacterium tuberculosis
DEIVLLGL

SEQ ID NO: 161354 - protein, 8 aa, Mycobacterium tuberculosis
EIVLLGLK

SEQ ID NO: 161355 - protein, 8 aa, Mycobacterium tuberculosis
VLLGLKAR

SEQ ID NO: 161356 - protein, 8 aa, Mycobacterium tuberculosis
LLGLKARR

SEQ ID NO: 161357 - protein, 8 aa, Mycobacterium tuberculosis
GLKARRPV

SEQ ID NO: 161358 - protein, 8 aa, Mycobacterium tuberculosis
RPVSNHRV

SEQ ID NO: 161359 - protein, 8 aa, Mycobacterium tuberculosis
PVSNHRVF

SEQ ID NO: 161360 - protein, 8 aa, Mycobacterium tuberculosis
SNHRVFER

SEQ ID NO: 161361 - protein, 8 aa, Mycobacterium tuberculosis
FERISQEV

SEQ ID NO: 161362 - protein, 8 aa, Mycobacterium tuberculosis
RISQEVAA

SEQ ID NO: 161363 - protein, 8 aa, Mycobacterium tuberculosis
SQEVAAGL

SEQ ID NO: 161364 - protein, 8 aa, Mycobacterium tuberculosis
EVAAGLEF

SEQ ID NO: 161365 - protein, 8 aa, Mycobacterium tuberculosis
VAAGLEFY

SEQ ID NO: 161366 - protein, 8 aa, Mycobacterium tuberculosis
GLEFYGNR

SEQ ID NO: 161367 - protein, 8 aa, Mycobacterium tuberculosis
FYGNRRWL

SEQ ID NO: 161368 - protein, 8 aa, Mycobacterium tuberculosis
GNRRWLEK

SEQ ID NO: 161369 - protein, 8 aa, Mycobacterium tuberculosis
RRWLEKPS

SEQ ID NO: 161370 - protein, 8 aa, Mycobacterium tuberculosis
LEKPSGFF

SEQ ID NO: 161371 - protein, 8 aa, Mycobacterium tuberculosis
FFAQPPPL

SEQ ID NO: 161372 - protein, 8 aa, Mycobacterium tuberculosis
QPPPLTEV

SEQ ID NO: 161373 - protein, 8 aa, Mycobacterium tuberculosis
LTEVAVRK

SEQ ID NO: 161374 - protein, 8 aa, Mycobacterium tuberculosis
EVAVRKVK

SEQ ID NO: 161375 - protein, 8 aa, Mycobacterium tuberculosis
AVRKVKDR

SEQ ID NO: 161376 - protein, 8 aa, Mycobacterium tuberculosis
KDRRRSFY

SEQ ID NO: 161377 - protein, 8 aa, Mycobacterium tuberculosis
DRRRSFYR

SEQ ID NO: 161378 - protein, 8 aa, Mycobacterium tuberculosis
RRRSFYRI

SEQ ID NO: 161379 - protein, 8 aa, Mycobacterium tuberculosis
RRSFYRIF

SEQ ID NO: 161380 - protein, 8 aa, Mycobacterium tuberculosis
RSFYRIFF

SEQ ID NO: 161381 - protein, 8 aa, Mycobacterium tuberculosis
RIFFDSGF

SEQ ID NO: 161382 - protein, 8 aa, Mycobacterium tuberculosis
GSQRWLSY

SEQ ID NO: 161383 - protein, 8 aa, Mycobacterium tuberculosis
SQRWLSYT

SEQ ID NO: 161384 - protein, 8 aa, Mycobacterium tuberculosis
QRWLSYTA

SEQ ID NO: 161385 - protein, 8 aa, Mycobacterium tuberculosis
LSYTANNR

SEQ ID NO: 161386 - protein, 8 aa, Mycobacterium tuberculosis
YTANNREY

SEQ ID NO: 161387 - protein, 8 aa, Mycobacterium tuberculosis
REYALLLR

SEQ ID NO: 161388 - protein, 8 aa, Mycobacterium tuberculosis
LLRHPEPR

SEQ ID NO: 161389 - protein, 8 aa, Mycobacterium tuberculosis
HPEPRPWL

SEQ ID NO: 161390 - protein, 8 aa, Mycobacterium tuberculosis
RPWLVCVH

SEQ ID NO: 161391 - protein, 8 aa, Mycobacterium tuberculosis
WLVCVHGT

SEQ ID NO: 161392 - protein, 8 aa, Mycobacterium tuberculosis
TEMGRAPL

SEQ ID NO: 161393 - protein, 8 aa, Mycobacterium tuberculosis
RAPLDLAV

SEQ ID NO: 161394 - protein, 8 aa, Mycobacterium tuberculosis
APLDLAVF

SEQ ID NO: 161395 - protein, 8 aa, Mycobacterium tuberculosis
LAVFRAWK

SEQ ID NO: 161396 - protein, 8 aa, Mycobacterium tuberculosis
AVFRAWKL

SEQ ID NO: 161397 - protein, 8 aa, Mycobacterium tuberculosis
KLHDELGL

SEQ ID NO: 161398 - protein, 8 aa, Mycobacterium tuberculosis
DELGLNIV

SEQ ID NO: 161399 - protein, 8 aa, Mycobacterium tuberculosis
ELGLNIVM

SEQ ID NO: 161400 - protein, 8 aa, Mycobacterium tuberculosis
GLNIVMPV

SEQ ID NO: 161401 - protein, 8 aa, Mycobacterium tuberculosis
IVMPVLPM

SEQ ID NO: 161402 - protein, 8 aa, Mycobacterium tuberculosis
MPVLPMHG

SEQ ID NO: 161403 - protein, 8 aa, Mycobacterium tuberculosis
VLPMHGPR

SEQ ID NO: 161404 - protein, 8 aa, Mycobacterium tuberculosis
AVFPGEDV

SEQ ID NO: 161405 - protein, 8 aa, Mycobacterium tuberculosis
VFPGEDVL

SEQ ID NO: 161406 - protein, 8 aa, Mycobacterium tuberculosis
VLDDVHGT

SEQ ID NO: 161407 - protein, 8 aa, Mycobacterium tuberculosis
HGTAQAVW

SEQ ID NO: 161408 - protein, 8 aa, Mycobacterium tuberculosis
QAVWDIRR

SEQ ID NO: 161409 - protein, 8 aa, Mycobacterium tuberculosis
AVWDIRRL

SEQ ID NO: 161410 - protein, 8 aa, Mycobacterium tuberculosis
RRLLSWIR

SEQ ID NO: 161411 - protein, 8 aa, Mycobacterium tuberculosis
RLLSWIRS

SEQ ID NO: 161412 - protein, 8 aa, Mycobacterium tuberculosis
LLSWIRSQ

SEQ ID NO: 161413 - protein, 8 aa, Mycobacterium tuberculosis
SQEEESLI

SEQ ID NO: 161414 - protein, 8 aa, Mycobacterium tuberculosis
EEESLIGL

SEQ ID NO: 161415 - protein, 8 aa, Mycobacterium tuberculosis
SLIGLNGL

SEQ ID NO: 161416 - protein, 8 aa, Mycobacterium tuberculosis
GLSLGGYI

SEQ ID NO: 161417 - protein, 8 aa, Mycobacterium tuberculosis
SLGGYIAS

SEQ ID NO: 161418 - protein, 8 aa, Mycobacterium tuberculosis
YIASLVAS

SEQ ID NO: 161419 - protein, 8 aa, Mycobacterium tuberculosis
IASLVASL

SEQ ID NO: 161420 - protein, 8 aa, Mycobacterium tuberculosis
SLEEGLAC

SEQ ID NO: 161421 - protein, 8 aa, Mycobacterium tuberculosis
EEGLACAI

SEQ ID NO: 161422 - protein, 8 aa, Mycobacterium tuberculosis
LACAILGV

SEQ ID NO: 161423 - protein, 8 aa, Mycobacterium tuberculosis
CAILGVPV

SEQ ID NO: 161424 - protein, 8 aa, Mycobacterium tuberculosis
AILGVPVA

SEQ ID NO: 161425 - protein, 8 aa, Mycobacterium tuberculosis
PVADLIEL

SEQ ID NO: 161426 - protein, 8 aa, Mycobacterium tuberculosis
DLIELLGR

SEQ ID NO: 161427 - protein, 8 aa, Mycobacterium tuberculosis
LLGRHCGL

SEQ ID NO: 161428 - protein, 8 aa, Mycobacterium tuberculosis
GLRHKDPR

SEQ ID NO: 161429 - protein, 8 aa, Mycobacterium tuberculosis
KMAEPIGR

SEQ ID NO: 161430 - protein, 8 aa, Mycobacterium tuberculosis
MAEPIGRM

SEQ ID NO: 161431 - protein, 8 aa, Mycobacterium tuberculosis
RMISPLSL

SEQ ID NO: 161432 - protein, 8 aa, Mycobacterium tuberculosis
MISPLSLT

SEQ ID NO: 161433 - protein, 8 aa, Mycobacterium tuberculosis
SPLSLTPL

SEQ ID NO: 161434 - protein, 8 aa, Mycobacterium tuberculosis
PLSLTPLV

SEQ ID NO: 161435 - protein, 8 aa, Mycobacterium tuberculosis
SLTPLVPM

SEQ ID NO: 161436 - protein, 8 aa, Mycobacterium tuberculosis
LVPMPGRF

SEQ ID NO: 161437 - protein, 8 aa, Mycobacterium tuberculosis
VPMPGRFI

SEQ ID NO: 161438 - protein, 8 aa, Mycobacterium tuberculosis
PMPGRFIY

SEQ ID NO: 161439 - protein, 8 aa, Mycobacterium tuberculosis
MPGRFIYA

SEQ ID NO: 161440 - protein, 8 aa, Mycobacterium tuberculosis
GRFIYAGI

SEQ ID NO: 161441 - protein, 8 aa, Mycobacterium tuberculosis
IYAGIADR

SEQ ID NO: 161442 - protein, 8 aa, Mycobacterium tuberculosis
ADRLVHPR

SEQ ID NO: 161443 - protein, 8 aa, Mycobacterium tuberculosis
LVHPREQV

SEQ ID NO: 161444 - protein, 8 aa, Mycobacterium tuberculosis
HPREQVTR

SEQ ID NO: 161445 - protein, 8 aa, Mycobacterium tuberculosis
VTRLWEHW

SEQ ID NO: 161446 - protein, 8 aa, Mycobacterium tuberculosis
RLWEHWGK

SEQ ID NO: 161447 - protein, 8 aa, Mycobacterium tuberculosis
YPGGHTGF

SEQ ID NO: 161448 - protein, 8 aa, Mycobacterium tuberculosis
HTGFFQSR

SEQ ID NO: 161449 - protein, 8 aa, Mycobacterium tuberculosis
FFQSRPVR

SEQ ID NO: 161450 - protein, 8 aa, Mycobacterium tuberculosis
FQSRPVRR

SEQ ID NO: 161451 - protein, 8 aa, Mycobacterium tuberculosis
RPVRRFVQ

SEQ ID NO: 161452 - protein, 8 aa, Mycobacterium tuberculosis
RRFVQAAL

SEQ ID NO: 161453 - protein, 8 aa, Mycobacterium tuberculosis
AALEQSGL

SEQ ID NO: 161454 - protein, 8 aa, Mycobacterium tuberculosis
ALEQSGLL

SEQ ID NO: 161455 - protein, 8 aa, Mycobacterium tuberculosis
GLLDAPRT

SEQ ID NO: 161456 - protein, 8 aa, Mycobacterium tuberculosis
LLDAPRTQ

SEQ ID NO: 161457 - protein, 9 aa, Mycobacterium tuberculosis
MASSASDGT

SEQ ID NO: 161458 - protein, 9 aa, Mycobacterium tuberculosis
SASDGTHER

SEQ ID NO: 161459 - protein, 9 aa, Mycobacterium tuberculosis
GTHERSAFR

SEQ ID NO: 161460 - protein, 9 aa, Mycobacterium tuberculosis
THERSAFRL

SEQ ID NO: 161461 - protein, 9 aa, Mycobacterium tuberculosis
SAFRLSPPV

SEQ ID NO: 161462 - protein, 9 aa, Mycobacterium tuberculosis
RLSPPVLSG

SEQ ID NO: 161463 - protein, 9 aa, Mycobacterium tuberculosis
LSPPVLSGA

SEQ ID NO: 161464 - protein, 9 aa, Mycobacterium tuberculosis
SPPVLSGAM

SEQ ID NO: 161465 - protein, 9 aa, Mycobacterium tuberculosis
VLSGAMGPF

SEQ ID NO: 161466 - protein, 9 aa, Mycobacterium tuberculosis
AMGPFMHTG

SEQ ID NO: 161467 - protein, 9 aa, Mycobacterium tuberculosis
MGPFMHTGL

SEQ ID NO: 161468 - protein, 9 aa, Mycobacterium tuberculosis
GPFMHTGLY

SEQ ID NO: 161469 - protein, 9 aa, Mycobacterium tuberculosis
FMHTGLYVA

SEQ ID NO: 161470 - protein, 9 aa, Mycobacterium tuberculosis
TGLYVAQSW

SEQ ID NO: 161471 - protein, 9 aa, Mycobacterium tuberculosis
GLYVAQSWR

SEQ ID NO: 161472 - protein, 9 aa, Mycobacterium tuberculosis
YVAQSWRDY

SEQ ID NO: 161473 - protein, 9 aa, Mycobacterium tuberculosis
DYLGQQPDK

SEQ ID NO: 161474 - protein, 9 aa, Mycobacterium tuberculosis
YLGQQPDKL

SEQ ID NO: 161475 - protein, 9 aa, Mycobacterium tuberculosis
QQPDKLPIA

SEQ ID NO: 161476 - protein, 9 aa, Mycobacterium tuberculosis
KLPIARPTI

SEQ ID NO: 161477 - protein, 9 aa, Mycobacterium tuberculosis
LPIARPTIA

SEQ ID NO: 161478 - protein, 9 aa, Mycobacterium tuberculosis
PIARPTIAL

SEQ ID NO: 161479 - protein, 9 aa, Mycobacterium tuberculosis
IARPTIALA

SEQ ID NO: 161480 - protein, 9 aa, Mycobacterium tuberculosis
RPTIALAAQ

SEQ ID NO: 161481 - protein, 9 aa, Mycobacterium tuberculosis
TIALAAQAF

SEQ ID NO: 161482 - protein, 9 aa, Mycobacterium tuberculosis
IALAAQAFR

SEQ ID NO: 161483 - protein, 9 aa, Mycobacterium tuberculosis
AQAFRDEIV

SEQ ID NO: 161484 - protein, 9 aa, Mycobacterium tuberculosis
IVLLGLKAR

SEQ ID NO: 161485 - protein, 9 aa, Mycobacterium tuberculosis
VLLGLKARR

SEQ ID NO: 161486 - protein, 9 aa, Mycobacterium tuberculosis
ARRPVSNHR

SEQ ID NO: 161487 - protein, 9 aa, Mycobacterium tuberculosis
RPVSNHRVF

SEQ ID NO: 161488 - protein, 9 aa, Mycobacterium tuberculosis
VSNHRVFER

SEQ ID NO: 161489 - protein, 9 aa, Mycobacterium tuberculosis
VFERISQEV

SEQ ID NO: 161490 - protein, 9 aa, Mycobacterium tuberculosis
QEVAAGLEF

SEQ ID NO: 161491 - protein, 9 aa, Mycobacterium tuberculosis
EVAAGLEFY

SEQ ID NO: 161492 - protein, 9 aa, Mycobacterium tuberculosis
EFYGNRRWL

SEQ ID NO: 161493 - protein, 9 aa, Mycobacterium tuberculosis
YGNRRWLEK

SEQ ID NO: 161494 - protein, 9 aa, Mycobacterium tuberculosis
RRWLEKPSG

SEQ ID NO: 161495 - protein, 9 aa, Mycobacterium tuberculosis
RWLEKPSGF

SEQ ID NO: 161496 - protein, 9 aa, Mycobacterium tuberculosis
AQPPPLTEV

SEQ ID NO: 161497 - protein, 9 aa, Mycobacterium tuberculosis
AVRKVKDRR

SEQ ID NO: 161498 - protein, 9 aa, Mycobacterium tuberculosis
KVKDRRRSF

SEQ ID NO: 161499 - protein, 9 aa, Mycobacterium tuberculosis
KDRRRSFYR

SEQ ID NO: 161500 - protein, 9 aa, Mycobacterium tuberculosis
RRRSFYRIF

SEQ ID NO: 161501 - protein, 9 aa, Mycobacterium tuberculosis
RRSFYRIFF

SEQ ID NO: 161502 - protein, 9 aa, Mycobacterium tuberculosis
RSFYRIFFD

SEQ ID NO: 161503 - protein, 9 aa, Mycobacterium tuberculosis
YRIFFDSGF

SEQ ID NO: 161504 - protein, 9 aa, Mycobacterium tuberculosis
FFDSGFTPH

SEQ ID NO: 161505 - protein, 9 aa, Mycobacterium tuberculosis
GEPGSQRWL

SEQ ID NO: 161506 - protein, 9 aa, Mycobacterium tuberculosis
SQRWLSYTA

SEQ ID NO: 161507 - protein, 9 aa, Mycobacterium tuberculosis
QRWLSYTAN

SEQ ID NO: 161508 - protein, 9 aa, Mycobacterium tuberculosis
WLSYTANNR

SEQ ID NO: 161509 - protein, 9 aa, Mycobacterium tuberculosis
SYTANNREY

SEQ ID NO: 161510 - protein, 9 aa, Mycobacterium tuberculosis
YTANNREYA

SEQ ID NO: 161511 - protein, 9 aa, Mycobacterium tuberculosis
TANNREYAL

SEQ ID NO: 161512 - protein, 9 aa, Mycobacterium tuberculosis
LLLRHPEPR

SEQ ID NO: 161513 - protein, 9 aa, Mycobacterium tuberculosis
HPEPRPWLV

SEQ ID NO: 161514 - protein, 9 aa, Mycobacterium tuberculosis
EPRPWLVCV

SEQ ID NO: 161515 - protein, 9 aa, Mycobacterium tuberculosis
LVCVHGTEM

SEQ ID NO: 161516 - protein, 9 aa, Mycobacterium tuberculosis
CVHGTEMGR

SEQ ID NO: 161517 - protein, 9 aa, Mycobacterium tuberculosis
EMGRAPLDL

SEQ ID NO: 161518 - protein, 9 aa, Mycobacterium tuberculosis
RAPLDLAVF

SEQ ID NO: 161519 - protein, 9 aa, Mycobacterium tuberculosis
APLDLAVFR

SEQ ID NO: 161520 - protein, 9 aa, Mycobacterium tuberculosis
PLDLAVFRA

SEQ ID NO: 161521 - protein, 9 aa, Mycobacterium tuberculosis
DLAVFRAWK

SEQ ID NO: 161522 - protein, 9 aa, Mycobacterium tuberculosis
LAVFRAWKL

SEQ ID NO: 161523 - protein, 9 aa, Mycobacterium tuberculosis
RAWKLHDEL

SEQ ID NO: 161524 - protein, 9 aa, Mycobacterium tuberculosis
WKLHDELGL

SEQ ID NO: 161525 - protein, 9 aa, Mycobacterium tuberculosis
DELGLNIVM

SEQ ID NO: 161526 - protein, 9 aa, Mycobacterium tuberculosis
LGLNIVMPV

SEQ ID NO: 161527 - protein, 9 aa, Mycobacterium tuberculosis
GLNIVMPVL

SEQ ID NO: 161528 - protein, 9 aa, Mycobacterium tuberculosis
NIVMPVLPM

SEQ ID NO: 161529 - protein, 9 aa, Mycobacterium tuberculosis
IVMPVLPMH

SEQ ID NO: 161530 - protein, 9 aa, Mycobacterium tuberculosis
MPVLPMHGP

SEQ ID NO: 161531 - protein, 9 aa, Mycobacterium tuberculosis
PVLPMHGPR

SEQ ID NO: 161532 - protein, 9 aa, Mycobacterium tuberculosis
GPRGQGLPK

SEQ ID NO: 161533 - protein, 9 aa, Mycobacterium tuberculosis
GLPKGAVFP

SEQ ID NO: 161534 - protein, 9 aa, Mycobacterium tuberculosis
LPKGAVFPG

SEQ ID NO: 161535 - protein, 9 aa, Mycobacterium tuberculosis
AVFPGEDVL

SEQ ID NO: 161536 - protein, 9 aa, Mycobacterium tuberculosis
DVLDDVHGT

SEQ ID NO: 161537 - protein, 9 aa, Mycobacterium tuberculosis
VLDDVHGTA

SEQ ID NO: 161538 - protein, 9 aa, Mycobacterium tuberculosis
DVHGTAQAV

SEQ ID NO: 161539 - protein, 9 aa, Mycobacterium tuberculosis
TAQAVWDIR

SEQ ID NO: 161540 - protein, 9 aa, Mycobacterium tuberculosis
AQAVWDIRR

SEQ ID NO: 161541 - protein, 9 aa, Mycobacterium tuberculosis
AVWDIRRLL

SEQ ID NO: 161542 - protein, 9 aa, Mycobacterium tuberculosis
DIRRLLSWI

SEQ ID NO: 161543 - protein, 9 aa, Mycobacterium tuberculosis
RRLLSWIRS

SEQ ID NO: 161544 - protein, 9 aa, Mycobacterium tuberculosis
RLLSWIRSQ

SEQ ID NO: 161545 - protein, 9 aa, Mycobacterium tuberculosis
QEEESLIGL

SEQ ID NO: 161546 - protein, 9 aa, Mycobacterium tuberculosis
ESLIGLNGL

SEQ ID NO: 161547 - protein, 9 aa, Mycobacterium tuberculosis
SLIGLNGLS

SEQ ID NO: 161548 - protein, 9 aa, Mycobacterium tuberculosis
GLSLGGYIA

SEQ ID NO: 161549 - protein, 9 aa, Mycobacterium tuberculosis
SLGGYIASL

SEQ ID NO: 161550 - protein, 9 aa, Mycobacterium tuberculosis
YIASLVASL

SEQ ID NO: 161551 - protein, 9 aa, Mycobacterium tuberculosis
LVASLEEGL

SEQ ID NO: 161552 - protein, 9 aa, Mycobacterium tuberculosis
SLEEGLACA

SEQ ID NO: 161553 - protein, 9 aa, Mycobacterium tuberculosis
LEEGLACAI

SEQ ID NO: 161554 - protein, 9 aa, Mycobacterium tuberculosis
EEGLACAIL

SEQ ID NO: 161555 - protein, 9 aa, Mycobacterium tuberculosis
GLACAILGV

SEQ ID NO: 161556 - protein, 9 aa, Mycobacterium tuberculosis
ILGVPVADL

SEQ ID NO: 161557 - protein, 9 aa, Mycobacterium tuberculosis
VPVADLIEL

SEQ ID NO: 161558 - protein, 9 aa, Mycobacterium tuberculosis
PVADLIELL

SEQ ID NO: 161559 - protein, 9 aa, Mycobacterium tuberculosis
DLIELLGRH

SEQ ID NO: 161560 - protein, 9 aa, Mycobacterium tuberculosis
ELLGRHCGL

SEQ ID NO: 161561 - protein, 9 aa, Mycobacterium tuberculosis
LLGRHCGLR

SEQ ID NO: 161562 - protein, 9 aa, Mycobacterium tuberculosis
GRHCGLRHK

SEQ ID NO: 161563 - protein, 9 aa, Mycobacterium tuberculosis
GLRHKDPRR

SEQ ID NO: 161564 - protein, 9 aa, Mycobacterium tuberculosis
HKDPRRHTV

SEQ ID NO: 161565 - protein, 9 aa, Mycobacterium tuberculosis
DPRRHTVKM

SEQ ID NO: 161566 - protein, 9 aa, Mycobacterium tuberculosis
RRHTVKMAE

SEQ ID NO: 161567 - protein, 9 aa, Mycobacterium tuberculosis
HTVKMAEPI

SEQ ID NO: 161568 - protein, 9 aa, Mycobacterium tuberculosis
KMAEPIGRM

SEQ ID NO: 161569 - protein, 9 aa, Mycobacterium tuberculosis
PIGRMISPL

SEQ ID NO: 161570 - protein, 9 aa, Mycobacterium tuberculosis
GRMISPLSL

SEQ ID NO: 161571 - protein, 9 aa, Mycobacterium tuberculosis
RMISPLSLT

SEQ ID NO: 161572 - protein, 9 aa, Mycobacterium tuberculosis
SPLSLTPLV

SEQ ID NO: 161573 - protein, 9 aa, Mycobacterium tuberculosis
SLTPLVPMP

SEQ ID NO: 161574 - protein, 9 aa, Mycobacterium tuberculosis
VPMPGRFIY

SEQ ID NO: 161575 - protein, 9 aa, Mycobacterium tuberculosis
PMPGRFIYA

SEQ ID NO: 161576 - protein, 9 aa, Mycobacterium tuberculosis
MPGRFIYAG

SEQ ID NO: 161577 - protein, 9 aa, Mycobacterium tuberculosis
FIYAGIADR

SEQ ID NO: 161578 - protein, 9 aa, Mycobacterium tuberculosis
IYAGIADRL

SEQ ID NO: 161579 - protein, 9 aa, Mycobacterium tuberculosis
IADRLVHPR

SEQ ID NO: 161580 - protein, 9 aa, Mycobacterium tuberculosis
RLVHPREQV

SEQ ID NO: 161581 - protein, 9 aa, Mycobacterium tuberculosis
HPREQVTRL

SEQ ID NO: 161582 - protein, 9 aa, Mycobacterium tuberculosis
QVTRLWEHW

SEQ ID NO: 161583 - protein, 9 aa, Mycobacterium tuberculosis
WEHWGKPEI

SEQ ID NO: 161584 - protein, 9 aa, Mycobacterium tuberculosis
WYPGGHTGF

SEQ ID NO: 161585 - protein, 9 aa, Mycobacterium tuberculosis
YPGGHTGFF

SEQ ID NO: 161586 - protein, 9 aa, Mycobacterium tuberculosis
TGFFQSRPV

SEQ ID NO: 161587 - protein, 9 aa, Mycobacterium tuberculosis
GFFQSRPVR

SEQ ID NO: 161588 - protein, 9 aa, Mycobacterium tuberculosis
FFQSRPVRR

SEQ ID NO: 161589 - protein, 9 aa, Mycobacterium tuberculosis
FQSRPVRRF

SEQ ID NO: 161590 - protein, 9 aa, Mycobacterium tuberculosis
QSRPVRRFV

SEQ ID NO: 161591 - protein, 9 aa, Mycobacterium tuberculosis
RPVRRFVQA

SEQ ID NO: 161592 - protein, 9 aa, Mycobacterium tuberculosis
RRFVQAALE

SEQ ID NO: 161593 - protein, 9 aa, Mycobacterium tuberculosis
QAALEQSGL

SEQ ID NO: 161594 - protein, 9 aa, Mycobacterium tuberculosis
AALEQSGLL

SEQ ID NO: 161595 - protein, 9 aa, Mycobacterium tuberculosis
QSGLLDAPR

SEQ ID NO: 161596 - protein, 9 aa, Mycobacterium tuberculosis
GLLDAPRTQ

SEQ ID NO: 161597 - protein, 9 aa, Mycobacterium tuberculosis
LLDAPRTQR

SEQ ID NO: 161598 - protein, 9 aa, Mycobacterium tuberculosis
APRTQRDRS

SEQ ID NO: 161599 - protein, 10 aa, Mycobacterium tuberculosis
MASSASDGTH

SEQ ID NO: 161600 - protein, 10 aa, Mycobacterium tuberculosis
SSASDGTHER

SEQ ID NO: 161601 - protein, 10 aa, Mycobacterium tuberculosis
DGTHERSAFR

SEQ ID NO: 161602 - protein, 10 aa, Mycobacterium tuberculosis
RSAFRLSPPV

SEQ ID NO: 161603 - protein, 10 aa, Mycobacterium tuberculosis
RLSPPVLSGA

SEQ ID NO: 161604 - protein, 10 aa, Mycobacterium tuberculosis
PVLSGAMGPF

SEQ ID NO: 161605 - protein, 10 aa, Mycobacterium tuberculosis
VLSGAMGPFM

SEQ ID NO: 161606 - protein, 10 aa, Mycobacterium tuberculosis
AMGPFMHTGL

SEQ ID NO: 161607 - protein, 10 aa, Mycobacterium tuberculosis
FMHTGLYVAQ

SEQ ID NO: 161608 - protein, 10 aa, Mycobacterium tuberculosis
HTGLYVAQSW

SEQ ID NO: 161609 - protein, 10 aa, Mycobacterium tuberculosis
TGLYVAQSWR

SEQ ID NO: 161610 - protein, 10 aa, Mycobacterium tuberculosis
YVAQSWRDYL

SEQ ID NO: 161611 - protein, 10 aa, Mycobacterium tuberculosis
RDYLGQQPDK

SEQ ID NO: 161612 - protein, 10 aa, Mycobacterium tuberculosis
DYLGQQPDKL

SEQ ID NO: 161613 - protein, 10 aa, Mycobacterium tuberculosis
GQQPDKLPIA

SEQ ID NO: 161614 - protein, 10 aa, Mycobacterium tuberculosis
KLPIARPTIA

SEQ ID NO: 161615 - protein, 10 aa, Mycobacterium tuberculosis
LPIARPTIAL

SEQ ID NO: 161616 - protein, 10 aa, Mycobacterium tuberculosis
RPTIALAAQA

SEQ ID NO: 161617 - protein, 10 aa, Mycobacterium tuberculosis
PTIALAAQAF

SEQ ID NO: 161618 - protein, 10 aa, Mycobacterium tuberculosis
TIALAAQAFR

SEQ ID NO: 161619 - protein, 10 aa, Mycobacterium tuberculosis
LAAQAFRDEI

SEQ ID NO: 161620 - protein, 10 aa, Mycobacterium tuberculosis
AQAFRDEIVL

SEQ ID NO: 161621 - protein, 10 aa, Mycobacterium tuberculosis
QAFRDEIVLL

SEQ ID NO: 161622 - protein, 10 aa, Mycobacterium tuberculosis
FRDEIVLLGL

SEQ ID NO: 161623 - protein, 10 aa, Mycobacterium tuberculosis
EIVLLGLKAR

SEQ ID NO: 161624 - protein, 10 aa, Mycobacterium tuberculosis
IVLLGLKARR

SEQ ID NO: 161625 - protein, 10 aa, Mycobacterium tuberculosis
LLGLKARRPV

SEQ ID NO: 161626 - protein, 10 aa, Mycobacterium tuberculosis
KARRPVSNHR

SEQ ID NO: 161627 - protein, 10 aa, Mycobacterium tuberculosis
RRPVSNHRVF

SEQ ID NO: 161628 - protein, 10 aa, Mycobacterium tuberculosis
RPVSNHRVFE

SEQ ID NO: 161629 - protein, 10 aa, Mycobacterium tuberculosis
PVSNHRVFER

SEQ ID NO: 161630 - protein, 10 aa, Mycobacterium tuberculosis
RVFERISQEV

SEQ ID NO: 161631 - protein, 10 aa, Mycobacterium tuberculosis
RISQEVAAGL

SEQ ID NO: 161632 - protein, 10 aa, Mycobacterium tuberculosis
SQEVAAGLEF

SEQ ID NO: 161633 - protein, 10 aa, Mycobacterium tuberculosis
QEVAAGLEFY

SEQ ID NO: 161634 - protein, 10 aa, Mycobacterium tuberculosis
AGLEFYGNRR

SEQ ID NO: 161635 - protein, 10 aa, Mycobacterium tuberculosis
LEFYGNRRWL

SEQ ID NO: 161636 - protein, 10 aa, Mycobacterium tuberculosis
EFYGNRRWLE

SEQ ID NO: 161637 - protein, 10 aa, Mycobacterium tuberculosis
FYGNRRWLEK

SEQ ID NO: 161638 - protein, 10 aa, Mycobacterium tuberculosis
RRWLEKPSGF

SEQ ID NO: 161639 - protein, 10 aa, Mycobacterium tuberculosis
RWLEKPSGFF

SEQ ID NO: 161640 - protein, 10 aa, Mycobacterium tuberculosis
WLEKPSGFFA

SEQ ID NO: 161641 - protein, 10 aa, Mycobacterium tuberculosis
FAQPPPLTEV

SEQ ID NO: 161642 - protein, 10 aa, Mycobacterium tuberculosis
AQPPPLTEVA

SEQ ID NO: 161643 - protein, 10 aa, Mycobacterium tuberculosis
QPPPLTEVAV

SEQ ID NO: 161644 - protein, 10 aa, Mycobacterium tuberculosis
PLTEVAVRKV

SEQ ID NO: 161645 - protein, 10 aa, Mycobacterium tuberculosis
LTEVAVRKVK

SEQ ID NO: 161646 - protein, 10 aa, Mycobacterium tuberculosis
EVAVRKVKDR

SEQ ID NO: 161647 - protein, 10 aa, Mycobacterium tuberculosis
AVRKVKDRRR

SEQ ID NO: 161648 - protein, 10 aa, Mycobacterium tuberculosis
KVKDRRRSFY

SEQ ID NO: 161649 - protein, 10 aa, Mycobacterium tuberculosis
VKDRRRSFYR

SEQ ID NO: 161650 - protein, 10 aa, Mycobacterium tuberculosis
RRRSFYRIFF

SEQ ID NO: 161651 - protein, 10 aa, Mycobacterium tuberculosis
FYRIFFDSGF

SEQ ID NO: 161652 - protein, 10 aa, Mycobacterium tuberculosis
EPGSQRWLSY

SEQ ID NO: 161653 - protein, 10 aa, Mycobacterium tuberculosis
QRWLSYTANN

SEQ ID NO: 161654 - protein, 10 aa, Mycobacterium tuberculosis
RWLSYTANNR

SEQ ID NO: 161655 - protein, 10 aa, Mycobacterium tuberculosis
LSYTANNREY

SEQ ID NO: 161656 - protein, 10 aa, Mycobacterium tuberculosis
YTANNREYAL

SEQ ID NO: 161657 - protein, 10 aa, Mycobacterium tuberculosis
NNREYALLLR

SEQ ID NO: 161658 - protein, 10 aa, Mycobacterium tuberculosis
ALLLRHPEPR

SEQ ID NO: 161659 - protein, 10 aa, Mycobacterium tuberculosis
RHPEPRPWLV

SEQ ID NO: 161660 - protein, 10 aa, Mycobacterium tuberculosis
EPRPWLVCVH

SEQ ID NO: 161661 - protein, 10 aa, Mycobacterium tuberculosis
RPWLVCVHGT

SEQ ID NO: 161662 - protein, 10 aa, Mycobacterium tuberculosis
WLVCVHGTEM

SEQ ID NO: 161663 - protein, 10 aa, Mycobacterium tuberculosis
TEMGRAPLDL

SEQ ID NO: 161664 - protein, 10 aa, Mycobacterium tuberculosis
MGRAPLDLAV

SEQ ID NO: 161665 - protein, 10 aa, Mycobacterium tuberculosis
GRAPLDLAVF

SEQ ID NO: 161666 - protein, 10 aa, Mycobacterium tuberculosis
RAPLDLAVFR

SEQ ID NO: 161667 - protein, 10 aa, Mycobacterium tuberculosis
APLDLAVFRA

SEQ ID NO: 161668 - protein, 10 aa, Mycobacterium tuberculosis
LDLAVFRAWK

SEQ ID NO: 161669 - protein, 10 aa, Mycobacterium tuberculosis
DLAVFRAWKL

SEQ ID NO: 161670 - protein, 10 aa, Mycobacterium tuberculosis
FRAWKLHDEL

SEQ ID NO: 161671 - protein, 10 aa, Mycobacterium tuberculosis
KLHDELGLNI

SEQ ID NO: 161672 - protein, 10 aa, Mycobacterium tuberculosis
ELGLNIVMPV

SEQ ID NO: 161673 - protein, 10 aa, Mycobacterium tuberculosis
MPVLPMHGPR

SEQ ID NO: 161674 - protein, 10 aa, Mycobacterium tuberculosis
VLPMHGPRGQ

SEQ ID NO: 161675 - protein, 10 aa, Mycobacterium tuberculosis
PMHGPRGQGL

SEQ ID NO: 161676 - protein, 10 aa, Mycobacterium tuberculosis
GQGLPKGAVF

SEQ ID NO: 161677 - protein, 10 aa, Mycobacterium tuberculosis
FPGEDVLDDV

SEQ ID NO: 161678 - protein, 10 aa, Mycobacterium tuberculosis
DVLDDVHGTA

SEQ ID NO: 161679 - protein, 10 aa, Mycobacterium tuberculosis
VLDDVHGTAQ

SEQ ID NO: 161680 - protein, 10 aa, Mycobacterium tuberculosis
GTAQAVWDIR

SEQ ID NO: 161681 - protein, 10 aa, Mycobacterium tuberculosis
TAQAVWDIRR

SEQ ID NO: 161682 - protein, 10 aa, Mycobacterium tuberculosis
AQAVWDIRRL

SEQ ID NO: 161683 - protein, 10 aa, Mycobacterium tuberculosis
DIRRLLSWIR

SEQ ID NO: 161684 - protein, 10 aa, Mycobacterium tuberculosis
RRLLSWIRSQ

SEQ ID NO: 161685 - protein, 10 aa, Mycobacterium tuberculosis
WIRSQEEESL

SEQ ID NO: 161686 - protein, 10 aa, Mycobacterium tuberculosis
SQEEESLIGL

SEQ ID NO: 161687 - protein, 10 aa, Mycobacterium tuberculosis
EESLIGLNGL

SEQ ID NO: 161688 - protein, 10 aa, Mycobacterium tuberculosis
SLIGLNGLSL

SEQ ID NO: 161689 - protein, 10 aa, Mycobacterium tuberculosis
GLNGLSLGGY

SEQ ID NO: 161690 - protein, 10 aa, Mycobacterium tuberculosis
GLSLGGYIAS

SEQ ID NO: 161691 - protein, 10 aa, Mycobacterium tuberculosis
LSLGGYIASL

SEQ ID NO: 161692 - protein, 10 aa, Mycobacterium tuberculosis
SLGGYIASLV

SEQ ID NO: 161693 - protein, 10 aa, Mycobacterium tuberculosis
GYIASLVASL

SEQ ID NO: 161694 - protein, 10 aa, Mycobacterium tuberculosis
SLVASLEEGL

SEQ ID NO: 161695 - protein, 10 aa, Mycobacterium tuberculosis
LVASLEEGLA

SEQ ID NO: 161696 - protein, 10 aa, Mycobacterium tuberculosis
SLEEGLACAI

SEQ ID NO: 161697 - protein, 10 aa, Mycobacterium tuberculosis
LEEGLACAIL

SEQ ID NO: 161698 - protein, 10 aa, Mycobacterium tuberculosis
EGLACAILGV

SEQ ID NO: 161699 - protein, 10 aa, Mycobacterium tuberculosis
LACAILGVPV

SEQ ID NO: 161700 - protein, 10 aa, Mycobacterium tuberculosis
AILGVPVADL

SEQ ID NO: 161701 - protein, 10 aa, Mycobacterium tuberculosis
ILGVPVADLI

SEQ ID NO: 161702 - protein, 10 aa, Mycobacterium tuberculosis
VPVADLIELL

SEQ ID NO: 161703 - protein, 10 aa, Mycobacterium tuberculosis
IELLGRHCGL

SEQ ID NO: 161704 - protein, 10 aa, Mycobacterium tuberculosis
ELLGRHCGLR

SEQ ID NO: 161705 - protein, 10 aa, Mycobacterium tuberculosis
LGRHCGLRHK

SEQ ID NO: 161706 - protein, 10 aa, Mycobacterium tuberculosis
RRHTVKMAEP

SEQ ID NO: 161707 - protein, 10 aa, Mycobacterium tuberculosis
TVKMAEPIGR

SEQ ID NO: 161708 - protein, 10 aa, Mycobacterium tuberculosis
KMAEPIGRMI

SEQ ID NO: 161709 - protein, 10 aa, Mycobacterium tuberculosis
EPIGRMISPL

SEQ ID NO: 161710 - protein, 10 aa, Mycobacterium tuberculosis
MISPLSLTPL

SEQ ID NO: 161711 - protein, 10 aa, Mycobacterium tuberculosis
SLTPLVPMPG

SEQ ID NO: 161712 - protein, 10 aa, Mycobacterium tuberculosis
LTPLVPMPGR

SEQ ID NO: 161713 - protein, 10 aa, Mycobacterium tuberculosis
TPLVPMPGRF

SEQ ID NO: 161714 - protein, 10 aa, Mycobacterium tuberculosis
PLVPMPGRFI

SEQ ID NO: 161715 - protein, 10 aa, Mycobacterium tuberculosis
LVPMPGRFIY

SEQ ID NO: 161716 - protein, 10 aa, Mycobacterium tuberculosis
VPMPGRFIYA

SEQ ID NO: 161717 - protein, 10 aa, Mycobacterium tuberculosis
MPGRFIYAGI

SEQ ID NO: 161718 - protein, 10 aa, Mycobacterium tuberculosis
RFIYAGIADR

SEQ ID NO: 161719 - protein, 10 aa, Mycobacterium tuberculosis
FIYAGIADRL

SEQ ID NO: 161720 - protein, 10 aa, Mycobacterium tuberculosis
IYAGIADRLV

SEQ ID NO: 161721 - protein, 10 aa, Mycobacterium tuberculosis
GIADRLVHPR

SEQ ID NO: 161722 - protein, 10 aa, Mycobacterium tuberculosis
LVHPREQVTR

SEQ ID NO: 161723 - protein, 10 aa, Mycobacterium tuberculosis
HPREQVTRLW

SEQ ID NO: 161724 - protein, 10 aa, Mycobacterium tuberculosis
VTRLWEHWGK

SEQ ID NO: 161725 - protein, 10 aa, Mycobacterium tuberculosis
RLWEHWGKPE

SEQ ID NO: 161726 - protein, 10 aa, Mycobacterium tuberculosis
WEHWGKPEIV

SEQ ID NO: 161727 - protein, 10 aa, Mycobacterium tuberculosis
HWGKPEIVWY

SEQ ID NO: 161728 - protein, 10 aa, Mycobacterium tuberculosis
VWYPGGHTGF

SEQ ID NO: 161729 - protein, 10 aa, Mycobacterium tuberculosis
WYPGGHTGFF

SEQ ID NO: 161730 - protein, 10 aa, Mycobacterium tuberculosis
HTGFFQSRPV

SEQ ID NO: 161731 - protein, 10 aa, Mycobacterium tuberculosis
TGFFQSRPVR

SEQ ID NO: 161732 - protein, 10 aa, Mycobacterium tuberculosis
GFFQSRPVRR

SEQ ID NO: 161733 - protein, 10 aa, Mycobacterium tuberculosis
FFQSRPVRRF

SEQ ID NO: 161734 - protein, 10 aa, Mycobacterium tuberculosis
FQSRPVRRFV

SEQ ID NO: 161735 - protein, 10 aa, Mycobacterium tuberculosis
QSRPVRRFVQ

SEQ ID NO: 161736 - protein, 10 aa, Mycobacterium tuberculosis
RPVRRFVQAA

SEQ ID NO: 161737 - protein, 10 aa, Mycobacterium tuberculosis
RRFVQAALEQ

SEQ ID NO: 161738 - protein, 10 aa, Mycobacterium tuberculosis
VQAALEQSGL

SEQ ID NO: 161739 - protein, 10 aa, Mycobacterium tuberculosis
QAALEQSGLL

SEQ ID NO: 161740 - protein, 10 aa, Mycobacterium tuberculosis
ALEQSGLLDA

SEQ ID NO: 161741 - protein, 10 aa, Mycobacterium tuberculosis
EQSGLLDAPR

SEQ ID NO: 161742 - protein, 10 aa, Mycobacterium tuberculosis
APRTQRDRSA

SEQ ID NO: 161743 - protein, 11 aa, Mycobacterium tuberculosis
ASSASDGTHER

SEQ ID NO: 161744 - protein, 11 aa, Mycobacterium tuberculosis
SASDGTHERSA

SEQ ID NO: 161745 - protein, 11 aa, Mycobacterium tuberculosis
ERSAFRLSPPV

SEQ ID NO: 161746 - protein, 11 aa, Mycobacterium tuberculosis
RSAFRLSPPVL

SEQ ID NO: 161747 - protein, 11 aa, Mycobacterium tuberculosis
RLSPPVLSGAM

SEQ ID NO: 161748 - protein, 11 aa, Mycobacterium tuberculosis
PPVLSGAMGPF

SEQ ID NO: 161749 - protein, 11 aa, Mycobacterium tuberculosis
PVLSGAMGPFM

SEQ ID NO: 161750 - protein, 11 aa, Mycobacterium tuberculosis
GAMGPFMHTGL

SEQ ID NO: 161751 - protein, 11 aa, Mycobacterium tuberculosis
AMGPFMHTGLY

SEQ ID NO: 161752 - protein, 11 aa, Mycobacterium tuberculosis
MGPFMHTGLYV

SEQ ID NO: 161753 - protein, 11 aa, Mycobacterium tuberculosis
GPFMHTGLYVA

SEQ ID NO: 161754 - protein, 11 aa, Mycobacterium tuberculosis
FMHTGLYVAQS

SEQ ID NO: 161755 - protein, 11 aa, Mycobacterium tuberculosis
HTGLYVAQSWR

SEQ ID NO: 161756 - protein, 11 aa, Mycobacterium tuberculosis
GLYVAQSWRDY

SEQ ID NO: 161757 - protein, 11 aa, Mycobacterium tuberculosis
LYVAQSWRDYL

SEQ ID NO: 161758 - protein, 11 aa, Mycobacterium tuberculosis
YLGQQPDKLPI

SEQ ID NO: 161759 - protein, 11 aa, Mycobacterium tuberculosis
GQQPDKLPIAR

SEQ ID NO: 161760 - protein, 11 aa, Mycobacterium tuberculosis
KLPIARPTIAL

SEQ ID NO: 161761 - protein, 11 aa, Mycobacterium tuberculosis
LPIARPTIALA

SEQ ID NO: 161762 - protein, 11 aa, Mycobacterium tuberculosis
RPTIALAAQAF

SEQ ID NO: 161763 - protein, 11 aa, Mycobacterium tuberculosis
PTIALAAQAFR

SEQ ID NO: 161764 - protein, 11 aa, Mycobacterium tuberculosis
ALAAQAFRDEI

SEQ ID NO: 161765 - protein, 11 aa, Mycobacterium tuberculosis
LAAQAFRDEIV

SEQ ID NO: 161766 - protein, 11 aa, Mycobacterium tuberculosis
AQAFRDEIVLL

SEQ ID NO: 161767 - protein, 11 aa, Mycobacterium tuberculosis
DEIVLLGLKAR

SEQ ID NO: 161768 - protein, 11 aa, Mycobacterium tuberculosis
EIVLLGLKARR

SEQ ID NO: 161769 - protein, 11 aa, Mycobacterium tuberculosis
VLLGLKARRPV

SEQ ID NO: 161770 - protein, 11 aa, Mycobacterium tuberculosis
KARRPVSNHRV

SEQ ID NO: 161771 - protein, 11 aa, Mycobacterium tuberculosis
RPVSNHRVFER

SEQ ID NO: 161772 - protein, 11 aa, Mycobacterium tuberculosis
HRVFERISQEV

SEQ ID NO: 161773 - protein, 11 aa, Mycobacterium tuberculosis
RVFERISQEVA

SEQ ID NO: 161774 - protein, 11 aa, Mycobacterium tuberculosis
ISQEVAAGLEF

SEQ ID NO: 161775 - protein, 11 aa, Mycobacterium tuberculosis
SQEVAAGLEFY

SEQ ID NO: 161776 - protein, 11 aa, Mycobacterium tuberculosis
EVAAGLEFYGN

SEQ ID NO: 161777 - protein, 11 aa, Mycobacterium tuberculosis
VAAGLEFYGNR

SEQ ID NO: 161778 - protein, 11 aa, Mycobacterium tuberculosis
GLEFYGNRRWL

SEQ ID NO: 161779 - protein, 11 aa, Mycobacterium tuberculosis
EFYGNRRWLEK

SEQ ID NO: 161780 - protein, 11 aa, Mycobacterium tuberculosis
RRWLEKPSGFF

SEQ ID NO: 161781 - protein, 11 aa, Mycobacterium tuberculosis
WLEKPSGFFAQ

SEQ ID NO: 161782 - protein, 11 aa, Mycobacterium tuberculosis
FFAQPPPLTEV

SEQ ID NO: 161783 - protein, 11 aa, Mycobacterium tuberculosis
FAQPPPLTEVA

SEQ ID NO: 161784 - protein, 11 aa, Mycobacterium tuberculosis
AQPPPLTEVAV

SEQ ID NO: 161785 - protein, 11 aa, Mycobacterium tuberculosis
EVAVRKVKDRR

SEQ ID NO: 161786 - protein, 11 aa, Mycobacterium tuberculosis
KVKDRRRSFYR

SEQ ID NO: 161787 - protein, 11 aa, Mycobacterium tuberculosis
SFYRIFFDSGF

SEQ ID NO: 161788 - protein, 11 aa, Mycobacterium tuberculosis
RIFFDSGFTPH

SEQ ID NO: 161789 - protein, 11 aa, Mycobacterium tuberculosis
TPHPGEPGSQR

SEQ ID NO: 161790 - protein, 11 aa, Mycobacterium tuberculosis
HPGEPGSQRWL

SEQ ID NO: 161791 - protein, 11 aa, Mycobacterium tuberculosis
GEPGSQRWLSY

SEQ ID NO: 161792 - protein, 11 aa, Mycobacterium tuberculosis
QRWLSYTANNR

SEQ ID NO: 161793 - protein, 11 aa, Mycobacterium tuberculosis
WLSYTANNREY

SEQ ID NO: 161794 - protein, 11 aa, Mycobacterium tuberculosis
SYTANNREYAL

SEQ ID NO: 161795 - protein, 11 aa, Mycobacterium tuberculosis
YTANNREYALL

SEQ ID NO: 161796 - protein, 11 aa, Mycobacterium tuberculosis
YALLLRHPEPR

SEQ ID NO: 161797 - protein, 11 aa, Mycobacterium tuberculosis
LLLRHPEPRPW

SEQ ID NO: 161798 - protein, 11 aa, Mycobacterium tuberculosis
LLRHPEPRPWL

SEQ ID NO: 161799 - protein, 11 aa, Mycobacterium tuberculosis
HPEPRPWLVCV

SEQ ID NO: 161800 - protein, 11 aa, Mycobacterium tuberculosis
LVCVHGTEMGR

SEQ ID NO: 161801 - protein, 11 aa, Mycobacterium tuberculosis
EMGRAPLDLAV

SEQ ID NO: 161802 - protein, 11 aa, Mycobacterium tuberculosis
APLDLAVFRAW

SEQ ID NO: 161803 - protein, 11 aa, Mycobacterium tuberculosis
VFRAWKLHDEL

SEQ ID NO: 161804 - protein, 11 aa, Mycobacterium tuberculosis
RAWKLHDELGL

SEQ ID NO: 161805 - protein, 11 aa, Mycobacterium tuberculosis
WKLHDELGLNI

SEQ ID NO: 161806 - protein, 11 aa, Mycobacterium tuberculosis
KLHDELGLNIV

SEQ ID NO: 161807 - protein, 11 aa, Mycobacterium tuberculosis
LHDELGLNIVM

SEQ ID NO: 161808 - protein, 11 aa, Mycobacterium tuberculosis
DELGLNIVMPV

SEQ ID NO: 161809 - protein, 11 aa, Mycobacterium tuberculosis
ELGLNIVMPVL

SEQ ID NO: 161810 - protein, 11 aa, Mycobacterium tuberculosis
GLNIVMPVLPM

SEQ ID NO: 161811 - protein, 11 aa, Mycobacterium tuberculosis
VMPVLPMHGPR

SEQ ID NO: 161812 - protein, 11 aa, Mycobacterium tuberculosis
MPVLPMHGPRG

SEQ ID NO: 161813 - protein, 11 aa, Mycobacterium tuberculosis
LPMHGPRGQGL

SEQ ID NO: 161814 - protein, 11 aa, Mycobacterium tuberculosis
VFPGEDVLDDV

SEQ ID NO: 161815 - protein, 11 aa, Mycobacterium tuberculosis
FPGEDVLDDVH

SEQ ID NO: 161816 - protein, 11 aa, Mycobacterium tuberculosis
VLDDVHGTAQA

SEQ ID NO: 161817 - protein, 11 aa, Mycobacterium tuberculosis
HGTAQAVWDIR

SEQ ID NO: 161818 - protein, 11 aa, Mycobacterium tuberculosis
GTAQAVWDIRR

SEQ ID NO: 161819 - protein, 11 aa, Mycobacterium tuberculosis
AQAVWDIRRLL

SEQ ID NO: 161820 - protein, 11 aa, Mycobacterium tuberculosis
VWDIRRLLSWI

SEQ ID NO: 161821 - protein, 11 aa, Mycobacterium tuberculosis
RRLLSWIRSQE

SEQ ID NO: 161822 - protein, 11 aa, Mycobacterium tuberculosis
RLLSWIRSQEE

SEQ ID NO: 161823 - protein, 11 aa, Mycobacterium tuberculosis
EEESLIGLNGL

SEQ ID NO: 161824 - protein, 11 aa, Mycobacterium tuberculosis
EESLIGLNGLS

SEQ ID NO: 161825 - protein, 11 aa, Mycobacterium tuberculosis
GLNGLSLGGYI

SEQ ID NO: 161826 - protein, 11 aa, Mycobacterium tuberculosis
GLSLGGYIASL

SEQ ID NO: 161827 - protein, 11 aa, Mycobacterium tuberculosis
LSLGGYIASLV

SEQ ID NO: 161828 - protein, 11 aa, Mycobacterium tuberculosis
SLGGYIASLVA

SEQ ID NO: 161829 - protein, 11 aa, Mycobacterium tuberculosis
SLVASLEEGLA

SEQ ID NO: 161830 - protein, 11 aa, Mycobacterium tuberculosis
SLEEGLACAIL

SEQ ID NO: 161831 - protein, 11 aa, Mycobacterium tuberculosis
EEGLACAILGV

SEQ ID NO: 161832 - protein, 11 aa, Mycobacterium tuberculosis
GLACAILGVPV

SEQ ID NO: 161833 - protein, 11 aa, Mycobacterium tuberculosis
LACAILGVPVA

SEQ ID NO: 161834 - protein, 11 aa, Mycobacterium tuberculosis
AILGVPVADLI

SEQ ID NO: 161835 - protein, 11 aa, Mycobacterium tuberculosis
LLGRHCGLRHK

SEQ ID NO: 161836 - protein, 11 aa, Mycobacterium tuberculosis
RHCGLRHKDPR

SEQ ID NO: 161837 - protein, 11 aa, Mycobacterium tuberculosis
RHKDPRRHTVK

SEQ ID NO: 161838 - protein, 11 aa, Mycobacterium tuberculosis
RRHTVKMAEPI

SEQ ID NO: 161839 - protein, 11 aa, Mycobacterium tuberculosis
HTVKMAEPIGR

SEQ ID NO: 161840 - protein, 11 aa, Mycobacterium tuberculosis
TVKMAEPIGRM

SEQ ID NO: 161841 - protein, 11 aa, Mycobacterium tuberculosis
KMAEPIGRMIS

SEQ ID NO: 161842 - protein, 11 aa, Mycobacterium tuberculosis
AEPIGRMISPL

SEQ ID NO: 161843 - protein, 11 aa, Mycobacterium tuberculosis
EPIGRMISPLS

SEQ ID NO: 161844 - protein, 11 aa, Mycobacterium tuberculosis
PIGRMISPLSL

SEQ ID NO: 161845 - protein, 11 aa, Mycobacterium tuberculosis
RMISPLSLTPL

SEQ ID NO: 161846 - protein, 11 aa, Mycobacterium tuberculosis
MISPLSLTPLV

SEQ ID NO: 161847 - protein, 11 aa, Mycobacterium tuberculosis
SPLSLTPLVPM

SEQ ID NO: 161848 - protein, 11 aa, Mycobacterium tuberculosis
SLTPLVPMPGR

SEQ ID NO: 161849 - protein, 11 aa, Mycobacterium tuberculosis
TPLVPMPGRFI

SEQ ID NO: 161850 - protein, 11 aa, Mycobacterium tuberculosis
PLVPMPGRFIY

SEQ ID NO: 161851 - protein, 11 aa, Mycobacterium tuberculosis
VPMPGRFIYAG

SEQ ID NO: 161852 - protein, 11 aa, Mycobacterium tuberculosis
PMPGRFIYAGI

SEQ ID NO: 161853 - protein, 11 aa, Mycobacterium tuberculosis
MPGRFIYAGIA

SEQ ID NO: 161854 - protein, 11 aa, Mycobacterium tuberculosis
GRFIYAGIADR

SEQ ID NO: 161855 - protein, 11 aa, Mycobacterium tuberculosis
RFIYAGIADRL

SEQ ID NO: 161856 - protein, 11 aa, Mycobacterium tuberculosis
FIYAGIADRLV

SEQ ID NO: 161857 - protein, 11 aa, Mycobacterium tuberculosis
RLVHPREQVTR

SEQ ID NO: 161858 - protein, 11 aa, Mycobacterium tuberculosis
LVHPREQVTRL

SEQ ID NO: 161859 - protein, 11 aa, Mycobacterium tuberculosis
QVTRLWEHWGK

SEQ ID NO: 161860 - protein, 11 aa, Mycobacterium tuberculosis
RLWEHWGKPEI

SEQ ID NO: 161861 - protein, 11 aa, Mycobacterium tuberculosis
WEHWGKPEIVW

SEQ ID NO: 161862 - protein, 11 aa, Mycobacterium tuberculosis
IVWYPGGHTGF

SEQ ID NO: 161863 - protein, 11 aa, Mycobacterium tuberculosis
VWYPGGHTGFF

SEQ ID NO: 161864 - protein, 11 aa, Mycobacterium tuberculosis
YPGGHTGFFQS

SEQ ID NO: 161865 - protein, 11 aa, Mycobacterium tuberculosis
HTGFFQSRPVR

SEQ ID NO: 161866 - protein, 11 aa, Mycobacterium tuberculosis
TGFFQSRPVRR

SEQ ID NO: 161867 - protein, 11 aa, Mycobacterium tuberculosis
GFFQSRPVRRF

SEQ ID NO: 161868 - protein, 11 aa, Mycobacterium tuberculosis
FFQSRPVRRFV

SEQ ID NO: 161869 - protein, 11 aa, Mycobacterium tuberculosis
RPVRRFVQAAL

SEQ ID NO: 161870 - protein, 11 aa, Mycobacterium tuberculosis
FVQAALEQSGL

SEQ ID NO: 161871 - protein, 11 aa, Mycobacterium tuberculosis
VQAALEQSGLL

SEQ ID NO: 161872 - protein, 13 aa, Mycobacterium tuberculosis
MASSASDGTHERS

SEQ ID NO: 161873 - protein, 13 aa, Mycobacterium tuberculosis
ASSASDGTHERSA

SEQ ID NO: 161874 - protein, 13 aa, Mycobacterium tuberculosis
SSASDGTHERSAF

SEQ ID NO: 161875 - protein, 13 aa, Mycobacterium tuberculosis
SASDGTHERSAFR

SEQ ID NO: 161876 - protein, 13 aa, Mycobacterium tuberculosis
ASDGTHERSAFRL

SEQ ID NO: 161877 - protein, 13 aa, Mycobacterium tuberculosis
SDGTHERSAFRLS

SEQ ID NO: 161878 - protein, 13 aa, Mycobacterium tuberculosis
DGTHERSAFRLSP

SEQ ID NO: 161879 - protein, 13 aa, Mycobacterium tuberculosis
GTHERSAFRLSPP

SEQ ID NO: 161880 - protein, 13 aa, Mycobacterium tuberculosis
THERSAFRLSPPV

SEQ ID NO: 161881 - protein, 13 aa, Mycobacterium tuberculosis
HERSAFRLSPPVL

SEQ ID NO: 161882 - protein, 13 aa, Mycobacterium tuberculosis
ERSAFRLSPPVLS

SEQ ID NO: 161883 - protein, 13 aa, Mycobacterium tuberculosis
RSAFRLSPPVLSG

SEQ ID NO: 161884 - protein, 13 aa, Mycobacterium tuberculosis
SAFRLSPPVLSGA

SEQ ID NO: 161885 - protein, 13 aa, Mycobacterium tuberculosis
AFRLSPPVLSGAM

SEQ ID NO: 161886 - protein, 13 aa, Mycobacterium tuberculosis
FRLSPPVLSGAMG

SEQ ID NO: 161887 - protein, 13 aa, Mycobacterium tuberculosis
RLSPPVLSGAMGP

SEQ ID NO: 161888 - protein, 13 aa, Mycobacterium tuberculosis
LSPPVLSGAMGPF

SEQ ID NO: 161889 - protein, 13 aa, Mycobacterium tuberculosis
SPPVLSGAMGPFM

SEQ ID NO: 161890 - protein, 13 aa, Mycobacterium tuberculosis
PPVLSGAMGPFMH

SEQ ID NO: 161891 - protein, 13 aa, Mycobacterium tuberculosis
PVLSGAMGPFMHT

SEQ ID NO: 161892 - protein, 13 aa, Mycobacterium tuberculosis
VLSGAMGPFMHTG

SEQ ID NO: 161893 - protein, 13 aa, Mycobacterium tuberculosis
LSGAMGPFMHTGL

SEQ ID NO: 161894 - protein, 13 aa, Mycobacterium tuberculosis
SGAMGPFMHTGLY

SEQ ID NO: 161895 - protein, 13 aa, Mycobacterium tuberculosis
GAMGPFMHTGLYV

SEQ ID NO: 161896 - protein, 13 aa, Mycobacterium tuberculosis
AMGPFMHTGLYVA

SEQ ID NO: 161897 - protein, 13 aa, Mycobacterium tuberculosis
MGPFMHTGLYVAQ

SEQ ID NO: 161898 - protein, 13 aa, Mycobacterium tuberculosis
GPFMHTGLYVAQS

SEQ ID NO: 161899 - protein, 13 aa, Mycobacterium tuberculosis
PFMHTGLYVAQSW

SEQ ID NO: 161900 - protein, 13 aa, Mycobacterium tuberculosis
FMHTGLYVAQSWR

SEQ ID NO: 161901 - protein, 13 aa, Mycobacterium tuberculosis
MHTGLYVAQSWRD

SEQ ID NO: 161902 - protein, 13 aa, Mycobacterium tuberculosis
HTGLYVAQSWRDY

SEQ ID NO: 161903 - protein, 13 aa, Mycobacterium tuberculosis
TGLYVAQSWRDYL

SEQ ID NO: 161904 - protein, 13 aa, Mycobacterium tuberculosis
GLYVAQSWRDYLG

SEQ ID NO: 161905 - protein, 13 aa, Mycobacterium tuberculosis
LYVAQSWRDYLGQ

SEQ ID NO: 161906 - protein, 13 aa, Mycobacterium tuberculosis
YVAQSWRDYLGQQ

SEQ ID NO: 161907 - protein, 13 aa, Mycobacterium tuberculosis
VAQSWRDYLGQQP

SEQ ID NO: 161908 - protein, 13 aa, Mycobacterium tuberculosis
AQSWRDYLGQQPD

SEQ ID NO: 161909 - protein, 13 aa, Mycobacterium tuberculosis
QSWRDYLGQQPDK

SEQ ID NO: 161910 - protein, 13 aa, Mycobacterium tuberculosis
SWRDYLGQQPDKL

SEQ ID NO: 161911 - protein, 13 aa, Mycobacterium tuberculosis
WRDYLGQQPDKLP

SEQ ID NO: 161912 - protein, 13 aa, Mycobacterium tuberculosis
RDYLGQQPDKLPI

SEQ ID NO: 161913 - protein, 13 aa, Mycobacterium tuberculosis
DYLGQQPDKLPIA

SEQ ID NO: 161914 - protein, 13 aa, Mycobacterium tuberculosis
YLGQQPDKLPIAR

SEQ ID NO: 161915 - protein, 13 aa, Mycobacterium tuberculosis
LGQQPDKLPIARP

SEQ ID NO: 161916 - protein, 13 aa, Mycobacterium tuberculosis
GQQPDKLPIARPT

SEQ ID NO: 161917 - protein, 13 aa, Mycobacterium tuberculosis
QQPDKLPIARPTI

SEQ ID NO: 161918 - protein, 13 aa, Mycobacterium tuberculosis
QPDKLPIARPTIA

SEQ ID NO: 161919 - protein, 13 aa, Mycobacterium tuberculosis
PDKLPIARPTIAL

SEQ ID NO: 161920 - protein, 13 aa, Mycobacterium tuberculosis
DKLPIARPTIALA

SEQ ID NO: 161921 - protein, 13 aa, Mycobacterium tuberculosis
KLPIARPTIALAA

SEQ ID NO: 161922 - protein, 13 aa, Mycobacterium tuberculosis
LPIARPTIALAAQ

SEQ ID NO: 161923 - protein, 13 aa, Mycobacterium tuberculosis
PIARPTIALAAQA

SEQ ID NO: 161924 - protein, 13 aa, Mycobacterium tuberculosis
IARPTIALAAQAF

SEQ ID NO: 161925 - protein, 13 aa, Mycobacterium tuberculosis
ARPTIALAAQAFR

SEQ ID NO: 161926 - protein, 13 aa, Mycobacterium tuberculosis
RPTIALAAQAFRD

SEQ ID NO: 161927 - protein, 13 aa, Mycobacterium tuberculosis
PTIALAAQAFRDE

SEQ ID NO: 161928 - protein, 13 aa, Mycobacterium tuberculosis
TIALAAQAFRDEI

SEQ ID NO: 161929 - protein, 13 aa, Mycobacterium tuberculosis
IALAAQAFRDEIV

SEQ ID NO: 161930 - protein, 13 aa, Mycobacterium tuberculosis
ALAAQAFRDEIVL

SEQ ID NO: 161931 - protein, 13 aa, Mycobacterium tuberculosis
LAAQAFRDEIVLL

SEQ ID NO: 161932 - protein, 13 aa, Mycobacterium tuberculosis
AAQAFRDEIVLLG

SEQ ID NO: 161933 - protein, 13 aa, Mycobacterium tuberculosis
AQAFRDEIVLLGL

SEQ ID NO: 161934 - protein, 13 aa, Mycobacterium tuberculosis
QAFRDEIVLLGLK

SEQ ID NO: 161935 - protein, 13 aa, Mycobacterium tuberculosis
AFRDEIVLLGLKA

SEQ ID NO: 161936 - protein, 13 aa, Mycobacterium tuberculosis
FRDEIVLLGLKAR

SEQ ID NO: 161937 - protein, 13 aa, Mycobacterium tuberculosis
RDEIVLLGLKARR

SEQ ID NO: 161938 - protein, 13 aa, Mycobacterium tuberculosis
DEIVLLGLKARRP

SEQ ID NO: 161939 - protein, 13 aa, Mycobacterium tuberculosis
EIVLLGLKARRPV

SEQ ID NO: 161940 - protein, 13 aa, Mycobacterium tuberculosis
IVLLGLKARRPVS

SEQ ID NO: 161941 - protein, 13 aa, Mycobacterium tuberculosis
VLLGLKARRPVSN

SEQ ID NO: 161942 - protein, 13 aa, Mycobacterium tuberculosis
LLGLKARRPVSNH

SEQ ID NO: 161943 - protein, 13 aa, Mycobacterium tuberculosis
LGLKARRPVSNHR

SEQ ID NO: 161944 - protein, 13 aa, Mycobacterium tuberculosis
GLKARRPVSNHRV

SEQ ID NO: 161945 - protein, 13 aa, Mycobacterium tuberculosis
LKARRPVSNHRVF

SEQ ID NO: 161946 - protein, 13 aa, Mycobacterium tuberculosis
KARRPVSNHRVFE

SEQ ID NO: 161947 - protein, 13 aa, Mycobacterium tuberculosis
ARRPVSNHRVFER

SEQ ID NO: 161948 - protein, 13 aa, Mycobacterium tuberculosis
RRPVSNHRVFERI

SEQ ID NO: 161949 - protein, 13 aa, Mycobacterium tuberculosis
RPVSNHRVFERIS

SEQ ID NO: 161950 - protein, 13 aa, Mycobacterium tuberculosis
PVSNHRVFERISQ

SEQ ID NO: 161951 - protein, 13 aa, Mycobacterium tuberculosis
VSNHRVFERISQE

SEQ ID NO: 161952 - protein, 13 aa, Mycobacterium tuberculosis
SNHRVFERISQEV

SEQ ID NO: 161953 - protein, 13 aa, Mycobacterium tuberculosis
NHRVFERISQEVA

SEQ ID NO: 161954 - protein, 13 aa, Mycobacterium tuberculosis
HRVFERISQEVAA

SEQ ID NO: 161955 - protein, 13 aa, Mycobacterium tuberculosis
RVFERISQEVAAG

SEQ ID NO: 161956 - protein, 13 aa, Mycobacterium tuberculosis
VFERISQEVAAGL

SEQ ID NO: 161957 - protein, 13 aa, Mycobacterium tuberculosis
FERISQEVAAGLE

SEQ ID NO: 161958 - protein, 13 aa, Mycobacterium tuberculosis
ERISQEVAAGLEF

SEQ ID NO: 161959 - protein, 13 aa, Mycobacterium tuberculosis
RISQEVAAGLEFY

SEQ ID NO: 161960 - protein, 13 aa, Mycobacterium tuberculosis
ISQEVAAGLEFYG

SEQ ID NO: 161961 - protein, 13 aa, Mycobacterium tuberculosis
SQEVAAGLEFYGN

SEQ ID NO: 161962 - protein, 13 aa, Mycobacterium tuberculosis
QEVAAGLEFYGNR

SEQ ID NO: 161963 - protein, 13 aa, Mycobacterium tuberculosis
EVAAGLEFYGNRR

SEQ ID NO: 161964 - protein, 13 aa, Mycobacterium tuberculosis
VAAGLEFYGNRRW

SEQ ID NO: 161965 - protein, 13 aa, Mycobacterium tuberculosis
AAGLEFYGNRRWL

SEQ ID NO: 161966 - protein, 13 aa, Mycobacterium tuberculosis
AGLEFYGNRRWLE

SEQ ID NO: 161967 - protein, 13 aa, Mycobacterium tuberculosis
GLEFYGNRRWLEK

SEQ ID NO: 161968 - protein, 13 aa, Mycobacterium tuberculosis
LEFYGNRRWLEKP

SEQ ID NO: 161969 - protein, 13 aa, Mycobacterium tuberculosis
EFYGNRRWLEKPS

SEQ ID NO: 161970 - protein, 13 aa, Mycobacterium tuberculosis
FYGNRRWLEKPSG

SEQ ID NO: 161971 - protein, 13 aa, Mycobacterium tuberculosis
YGNRRWLEKPSGF

SEQ ID NO: 161972 - protein, 13 aa, Mycobacterium tuberculosis
GNRRWLEKPSGFF

SEQ ID NO: 161973 - protein, 13 aa, Mycobacterium tuberculosis
NRRWLEKPSGFFA

SEQ ID NO: 161974 - protein, 13 aa, Mycobacterium tuberculosis
RRWLEKPSGFFAQ

SEQ ID NO: 161975 - protein, 13 aa, Mycobacterium tuberculosis
RWLEKPSGFFAQP

SEQ ID NO: 161976 - protein, 13 aa, Mycobacterium tuberculosis
WLEKPSGFFAQPP

SEQ ID NO: 161977 - protein, 13 aa, Mycobacterium tuberculosis
LEKPSGFFAQPPP

SEQ ID NO: 161978 - protein, 13 aa, Mycobacterium tuberculosis
EKPSGFFAQPPPL

SEQ ID NO: 161979 - protein, 13 aa, Mycobacterium tuberculosis
KPSGFFAQPPPLT

SEQ ID NO: 161980 - protein, 13 aa, Mycobacterium tuberculosis
PSGFFAQPPPLTE

SEQ ID NO: 161981 - protein, 13 aa, Mycobacterium tuberculosis
SGFFAQPPPLTEV

SEQ ID NO: 161982 - protein, 13 aa, Mycobacterium tuberculosis
GFFAQPPPLTEVA

SEQ ID NO: 161983 - protein, 13 aa, Mycobacterium tuberculosis
FFAQPPPLTEVAV

SEQ ID NO: 161984 - protein, 13 aa, Mycobacterium tuberculosis
FAQPPPLTEVAVR

SEQ ID NO: 161985 - protein, 13 aa, Mycobacterium tuberculosis
AQPPPLTEVAVRK

SEQ ID NO: 161986 - protein, 13 aa, Mycobacterium tuberculosis
QPPPLTEVAVRKV

SEQ ID NO: 161987 - protein, 13 aa, Mycobacterium tuberculosis
PPPLTEVAVRKVK

SEQ ID NO: 161988 - protein, 13 aa, Mycobacterium tuberculosis
PPLTEVAVRKVKD

SEQ ID NO: 161989 - protein, 13 aa, Mycobacterium tuberculosis
PLTEVAVRKVKDR

SEQ ID NO: 161990 - protein, 13 aa, Mycobacterium tuberculosis
LTEVAVRKVKDRR

SEQ ID NO: 161991 - protein, 13 aa, Mycobacterium tuberculosis
TEVAVRKVKDRRR

SEQ ID NO: 161992 - protein, 13 aa, Mycobacterium tuberculosis
EVAVRKVKDRRRS

SEQ ID NO: 161993 - protein, 13 aa, Mycobacterium tuberculosis
VAVRKVKDRRRSF

SEQ ID NO: 161994 - protein, 13 aa, Mycobacterium tuberculosis
AVRKVKDRRRSFY

SEQ ID NO: 161995 - protein, 13 aa, Mycobacterium tuberculosis
VRKVKDRRRSFYR

SEQ ID NO: 161996 - protein, 13 aa, Mycobacterium tuberculosis
RKVKDRRRSFYRI

SEQ ID NO: 161997 - protein, 13 aa, Mycobacterium tuberculosis
KVKDRRRSFYRIF

SEQ ID NO: 161998 - protein, 13 aa, Mycobacterium tuberculosis
VKDRRRSFYRIFF

SEQ ID NO: 161999 - protein, 13 aa, Mycobacterium tuberculosis
KDRRRSFYRIFFD

SEQ ID NO: 162000 - protein, 13 aa, Mycobacterium tuberculosis
DRRRSFYRIFFDS

SEQ ID NO: 162001 - protein, 13 aa, Mycobacterium tuberculosis
RRRSFYRIFFDSG

SEQ ID NO: 162002 - protein, 13 aa, Mycobacterium tuberculosis
RRSFYRIFFDSGF

SEQ ID NO: 162003 - protein, 13 aa, Mycobacterium tuberculosis
RSFYRIFFDSGFT

SEQ ID NO: 162004 - protein, 13 aa, Mycobacterium tuberculosis
SFYRIFFDSGFTP

SEQ ID NO: 162005 - protein, 13 aa, Mycobacterium tuberculosis
FYRIFFDSGFTPH

SEQ ID NO: 162006 - protein, 13 aa, Mycobacterium tuberculosis
YRIFFDSGFTPHP

SEQ ID NO: 162007 - protein, 13 aa, Mycobacterium tuberculosis
RIFFDSGFTPHPG

SEQ ID NO: 162008 - protein, 13 aa, Mycobacterium tuberculosis
IFFDSGFTPHPGE

SEQ ID NO: 162009 - protein, 13 aa, Mycobacterium tuberculosis
FFDSGFTPHPGEP

SEQ ID NO: 162010 - protein, 13 aa, Mycobacterium tuberculosis
FDSGFTPHPGEPG

SEQ ID NO: 162011 - protein, 13 aa, Mycobacterium tuberculosis
DSGFTPHPGEPGS

SEQ ID NO: 162012 - protein, 13 aa, Mycobacterium tuberculosis
SGFTPHPGEPGSQ

SEQ ID NO: 162013 - protein, 13 aa, Mycobacterium tuberculosis
GFTPHPGEPGSQR

SEQ ID NO: 162014 - protein, 13 aa, Mycobacterium tuberculosis
FTPHPGEPGSQRW

SEQ ID NO: 162015 - protein, 13 aa, Mycobacterium tuberculosis
TPHPGEPGSQRWL

SEQ ID NO: 162016 - protein, 13 aa, Mycobacterium tuberculosis
PHPGEPGSQRWLS

SEQ ID NO: 162017 - protein, 13 aa, Mycobacterium tuberculosis
HPGEPGSQRWLSY

SEQ ID NO: 162018 - protein, 13 aa, Mycobacterium tuberculosis
PGEPGSQRWLSYT

SEQ ID NO: 162019 - protein, 13 aa, Mycobacterium tuberculosis
GEPGSQRWLSYTA

SEQ ID NO: 162020 - protein, 13 aa, Mycobacterium tuberculosis
EPGSQRWLSYTAN

SEQ ID NO: 162021 - protein, 13 aa, Mycobacterium tuberculosis
PGSQRWLSYTANN

SEQ ID NO: 162022 - protein, 13 aa, Mycobacterium tuberculosis
GSQRWLSYTANNR

SEQ ID NO: 162023 - protein, 13 aa, Mycobacterium tuberculosis
SQRWLSYTANNRE

SEQ ID NO: 162024 - protein, 13 aa, Mycobacterium tuberculosis
QRWLSYTANNREY

SEQ ID NO: 162025 - protein, 13 aa, Mycobacterium tuberculosis
RWLSYTANNREYA

SEQ ID NO: 162026 - protein, 13 aa, Mycobacterium tuberculosis
WLSYTANNREYAL

SEQ ID NO: 162027 - protein, 13 aa, Mycobacterium tuberculosis
LSYTANNREYALL

SEQ ID NO: 162028 - protein, 13 aa, Mycobacterium tuberculosis
SYTANNREYALLL

SEQ ID NO: 162029 - protein, 13 aa, Mycobacterium tuberculosis
YTANNREYALLLR

SEQ ID NO: 162030 - protein, 13 aa, Mycobacterium tuberculosis
TANNREYALLLRH

SEQ ID NO: 162031 - protein, 13 aa, Mycobacterium tuberculosis
ANNREYALLLRHP

SEQ ID NO: 162032 - protein, 13 aa, Mycobacterium tuberculosis
NNREYALLLRHPE

SEQ ID NO: 162033 - protein, 13 aa, Mycobacterium tuberculosis
NREYALLLRHPEP

SEQ ID NO: 162034 - protein, 13 aa, Mycobacterium tuberculosis
REYALLLRHPEPR

SEQ ID NO: 162035 - protein, 13 aa, Mycobacterium tuberculosis
EYALLLRHPEPRP

SEQ ID NO: 162036 - protein, 13 aa, Mycobacterium tuberculosis
YALLLRHPEPRPW

SEQ ID NO: 162037 - protein, 13 aa, Mycobacterium tuberculosis
ALLLRHPEPRPWL

SEQ ID NO: 162038 - protein, 13 aa, Mycobacterium tuberculosis
LLLRHPEPRPWLV

SEQ ID NO: 162039 - protein, 13 aa, Mycobacterium tuberculosis
LLRHPEPRPWLVC

SEQ ID NO: 162040 - protein, 13 aa, Mycobacterium tuberculosis
LRHPEPRPWLVCV

SEQ ID NO: 162041 - protein, 13 aa, Mycobacterium tuberculosis
RHPEPRPWLVCVH

SEQ ID NO: 162042 - protein, 13 aa, Mycobacterium tuberculosis
HPEPRPWLVCVHG

SEQ ID NO: 162043 - protein, 13 aa, Mycobacterium tuberculosis
PEPRPWLVCVHGT

SEQ ID NO: 162044 - protein, 13 aa, Mycobacterium tuberculosis
EPRPWLVCVHGTE

SEQ ID NO: 162045 - protein, 13 aa, Mycobacterium tuberculosis
PRPWLVCVHGTEM

SEQ ID NO: 162046 - protein, 13 aa, Mycobacterium tuberculosis
RPWLVCVHGTEMG

SEQ ID NO: 162047 - protein, 13 aa, Mycobacterium tuberculosis
PWLVCVHGTEMGR

SEQ ID NO: 162048 - protein, 13 aa, Mycobacterium tuberculosis
WLVCVHGTEMGRA

SEQ ID NO: 162049 - protein, 13 aa, Mycobacterium tuberculosis
LVCVHGTEMGRAP

SEQ ID NO: 162050 - protein, 13 aa, Mycobacterium tuberculosis
VCVHGTEMGRAPL

SEQ ID NO: 162051 - protein, 13 aa, Mycobacterium tuberculosis
CVHGTEMGRAPLD

SEQ ID NO: 162052 - protein, 13 aa, Mycobacterium tuberculosis
VHGTEMGRAPLDL

SEQ ID NO: 162053 - protein, 13 aa, Mycobacterium tuberculosis
HGTEMGRAPLDLA

SEQ ID NO: 162054 - protein, 13 aa, Mycobacterium tuberculosis
GTEMGRAPLDLAV

SEQ ID NO: 162055 - protein, 13 aa, Mycobacterium tuberculosis
TEMGRAPLDLAVF

SEQ ID NO: 162056 - protein, 13 aa, Mycobacterium tuberculosis
EMGRAPLDLAVFR

SEQ ID NO: 162057 - protein, 13 aa, Mycobacterium tuberculosis
MGRAPLDLAVFRA

SEQ ID NO: 162058 - protein, 13 aa, Mycobacterium tuberculosis
GRAPLDLAVFRAW

SEQ ID NO: 162059 - protein, 13 aa, Mycobacterium tuberculosis
RAPLDLAVFRAWK

SEQ ID NO: 162060 - protein, 13 aa, Mycobacterium tuberculosis
APLDLAVFRAWKL

SEQ ID NO: 162061 - protein, 13 aa, Mycobacterium tuberculosis
PLDLAVFRAWKLH

SEQ ID NO: 162062 - protein, 13 aa, Mycobacterium tuberculosis
LDLAVFRAWKLHD

SEQ ID NO: 162063 - protein, 13 aa, Mycobacterium tuberculosis
DLAVFRAWKLHDE

SEQ ID NO: 162064 - protein, 13 aa, Mycobacterium tuberculosis
LAVFRAWKLHDEL

SEQ ID NO: 162065 - protein, 13 aa, Mycobacterium tuberculosis
AVFRAWKLHDELG

SEQ ID NO: 162066 - protein, 13 aa, Mycobacterium tuberculosis
VFRAWKLHDELGL

SEQ ID NO: 162067 - protein, 13 aa, Mycobacterium tuberculosis
FRAWKLHDELGLN

SEQ ID NO: 162068 - protein, 13 aa, Mycobacterium tuberculosis
RAWKLHDELGLNI

SEQ ID NO: 162069 - protein, 13 aa, Mycobacterium tuberculosis
AWKLHDELGLNIV

SEQ ID NO: 162070 - protein, 13 aa, Mycobacterium tuberculosis
WKLHDELGLNIVM

SEQ ID NO: 162071 - protein, 13 aa, Mycobacterium tuberculosis
KLHDELGLNIVMP

SEQ ID NO: 162072 - protein, 13 aa, Mycobacterium tuberculosis
LHDELGLNIVMPV

SEQ ID NO: 162073 - protein, 13 aa, Mycobacterium tuberculosis
HDELGLNIVMPVL

SEQ ID NO: 162074 - protein, 13 aa, Mycobacterium tuberculosis
DELGLNIVMPVLP

SEQ ID NO: 162075 - protein, 13 aa, Mycobacterium tuberculosis
ELGLNIVMPVLPM

SEQ ID NO: 162076 - protein, 13 aa, Mycobacterium tuberculosis
LGLNIVMPVLPMH

SEQ ID NO: 162077 - protein, 13 aa, Mycobacterium tuberculosis
GLNIVMPVLPMHG

SEQ ID NO: 162078 - protein, 13 aa, Mycobacterium tuberculosis
LNIVMPVLPMHGP

SEQ ID NO: 162079 - protein, 13 aa, Mycobacterium tuberculosis
NIVMPVLPMHGPR

SEQ ID NO: 162080 - protein, 13 aa, Mycobacterium tuberculosis
IVMPVLPMHGPRG

SEQ ID NO: 162081 - protein, 13 aa, Mycobacterium tuberculosis
VMPVLPMHGPRGQ

SEQ ID NO: 162082 - protein, 13 aa, Mycobacterium tuberculosis
MPVLPMHGPRGQG

SEQ ID NO: 162083 - protein, 13 aa, Mycobacterium tuberculosis
PVLPMHGPRGQGL

SEQ ID NO: 162084 - protein, 13 aa, Mycobacterium tuberculosis
VLPMHGPRGQGLP

SEQ ID NO: 162085 - protein, 13 aa, Mycobacterium tuberculosis
LPMHGPRGQGLPK

SEQ ID NO: 162086 - protein, 13 aa, Mycobacterium tuberculosis
PMHGPRGQGLPKG

SEQ ID NO: 162087 - protein, 13 aa, Mycobacterium tuberculosis
MHGPRGQGLPKGA

SEQ ID NO: 162088 - protein, 13 aa, Mycobacterium tuberculosis
HGPRGQGLPKGAV

SEQ ID NO: 162089 - protein, 13 aa, Mycobacterium tuberculosis
GPRGQGLPKGAVF

SEQ ID NO: 162090 - protein, 13 aa, Mycobacterium tuberculosis
PRGQGLPKGAVFP

SEQ ID NO: 162091 - protein, 13 aa, Mycobacterium tuberculosis
RGQGLPKGAVFPG

SEQ ID NO: 162092 - protein, 13 aa, Mycobacterium tuberculosis
GQGLPKGAVFPGE

SEQ ID NO: 162093 - protein, 13 aa, Mycobacterium tuberculosis
QGLPKGAVFPGED

SEQ ID NO: 162094 - protein, 13 aa, Mycobacterium tuberculosis
GLPKGAVFPGEDV

SEQ ID NO: 162095 - protein, 13 aa, Mycobacterium tuberculosis
LPKGAVFPGEDVL

SEQ ID NO: 162096 - protein, 13 aa, Mycobacterium tuberculosis
PKGAVFPGEDVLD

SEQ ID NO: 162097 - protein, 13 aa, Mycobacterium tuberculosis
KGAVFPGEDVLDD

SEQ ID NO: 162098 - protein, 13 aa, Mycobacterium tuberculosis
GAVFPGEDVLDDV

SEQ ID NO: 162099 - protein, 13 aa, Mycobacterium tuberculosis
AVFPGEDVLDDVH

SEQ ID NO: 162100 - protein, 13 aa, Mycobacterium tuberculosis
VFPGEDVLDDVHG

SEQ ID NO: 162101 - protein, 13 aa, Mycobacterium tuberculosis
FPGEDVLDDVHGT

SEQ ID NO: 162102 - protein, 13 aa, Mycobacterium tuberculosis
PGEDVLDDVHGTA

SEQ ID NO: 162103 - protein, 13 aa, Mycobacterium tuberculosis
GEDVLDDVHGTAQ

SEQ ID NO: 162104 - protein, 13 aa, Mycobacterium tuberculosis
EDVLDDVHGTAQA

SEQ ID NO: 162105 - protein, 13 aa, Mycobacterium tuberculosis
DVLDDVHGTAQAV

SEQ ID NO: 162106 - protein, 13 aa, Mycobacterium tuberculosis
VLDDVHGTAQAVW

SEQ ID NO: 162107 - protein, 13 aa, Mycobacterium tuberculosis
LDDVHGTAQAVWD

SEQ ID NO: 162108 - protein, 13 aa, Mycobacterium tuberculosis
DDVHGTAQAVWDI

SEQ ID NO: 162109 - protein, 13 aa, Mycobacterium tuberculosis
DVHGTAQAVWDIR

SEQ ID NO: 162110 - protein, 13 aa, Mycobacterium tuberculosis
VHGTAQAVWDIRR

SEQ ID NO: 162111 - protein, 13 aa, Mycobacterium tuberculosis
HGTAQAVWDIRRL

SEQ ID NO: 162112 - protein, 13 aa, Mycobacterium tuberculosis
GTAQAVWDIRRLL

SEQ ID NO: 162113 - protein, 13 aa, Mycobacterium tuberculosis
TAQAVWDIRRLLS

SEQ ID NO: 162114 - protein, 13 aa, Mycobacterium tuberculosis
AQAVWDIRRLLSW

SEQ ID NO: 162115 - protein, 13 aa, Mycobacterium tuberculosis
QAVWDIRRLLSWI

SEQ ID NO: 162116 - protein, 13 aa, Mycobacterium tuberculosis
AVWDIRRLLSWIR

SEQ ID NO: 162117 - protein, 13 aa, Mycobacterium tuberculosis
VWDIRRLLSWIRS

SEQ ID NO: 162118 - protein, 13 aa, Mycobacterium tuberculosis
WDIRRLLSWIRSQ

SEQ ID NO: 162119 - protein, 13 aa, Mycobacterium tuberculosis
DIRRLLSWIRSQE

SEQ ID NO: 162120 - protein, 13 aa, Mycobacterium tuberculosis
IRRLLSWIRSQEE

SEQ ID NO: 162121 - protein, 13 aa, Mycobacterium tuberculosis
RRLLSWIRSQEEE

SEQ ID NO: 162122 - protein, 13 aa, Mycobacterium tuberculosis
RLLSWIRSQEEES

SEQ ID NO: 162123 - protein, 13 aa, Mycobacterium tuberculosis
LLSWIRSQEEESL

SEQ ID NO: 162124 - protein, 13 aa, Mycobacterium tuberculosis
LSWIRSQEEESLI

SEQ ID NO: 162125 - protein, 13 aa, Mycobacterium tuberculosis
SWIRSQEEESLIG

SEQ ID NO: 162126 - protein, 13 aa, Mycobacterium tuberculosis
WIRSQEEESLIGL

SEQ ID NO: 162127 - protein, 13 aa, Mycobacterium tuberculosis
IRSQEEESLIGLN

SEQ ID NO: 162128 - protein, 13 aa, Mycobacterium tuberculosis
RSQEEESLIGLNG

SEQ ID NO: 162129 - protein, 13 aa, Mycobacterium tuberculosis
SQEEESLIGLNGL

SEQ ID NO: 162130 - protein, 13 aa, Mycobacterium tuberculosis
QEEESLIGLNGLS

SEQ ID NO: 162131 - protein, 13 aa, Mycobacterium tuberculosis
EEESLIGLNGLSL

SEQ ID NO: 162132 - protein, 13 aa, Mycobacterium tuberculosis
EESLIGLNGLSLG

SEQ ID NO: 162133 - protein, 13 aa, Mycobacterium tuberculosis
ESLIGLNGLSLGG

SEQ ID NO: 162134 - protein, 13 aa, Mycobacterium tuberculosis
SLIGLNGLSLGGY

SEQ ID NO: 162135 - protein, 13 aa, Mycobacterium tuberculosis
LIGLNGLSLGGYI

SEQ ID NO: 162136 - protein, 13 aa, Mycobacterium tuberculosis
IGLNGLSLGGYIA

SEQ ID NO: 162137 - protein, 13 aa, Mycobacterium tuberculosis
GLNGLSLGGYIAS

SEQ ID NO: 162138 - protein, 13 aa, Mycobacterium tuberculosis
LNGLSLGGYIASL

SEQ ID NO: 162139 - protein, 13 aa, Mycobacterium tuberculosis
NGLSLGGYIASLV

SEQ ID NO: 162140 - protein, 13 aa, Mycobacterium tuberculosis
GLSLGGYIASLVA

SEQ ID NO: 162141 - protein, 13 aa, Mycobacterium tuberculosis
LSLGGYIASLVAS

SEQ ID NO: 162142 - protein, 13 aa, Mycobacterium tuberculosis
SLGGYIASLVASL

SEQ ID NO: 162143 - protein, 13 aa, Mycobacterium tuberculosis
LGGYIASLVASLE

SEQ ID NO: 162144 - protein, 13 aa, Mycobacterium tuberculosis
GGYIASLVASLEE

SEQ ID NO: 162145 - protein, 13 aa, Mycobacterium tuberculosis
GYIASLVASLEEG

SEQ ID NO: 162146 - protein, 13 aa, Mycobacterium tuberculosis
YIASLVASLEEGL

SEQ ID NO: 162147 - protein, 13 aa, Mycobacterium tuberculosis
IASLVASLEEGLA

SEQ ID NO: 162148 - protein, 13 aa, Mycobacterium tuberculosis
ASLVASLEEGLAC

SEQ ID NO: 162149 - protein, 13 aa, Mycobacterium tuberculosis
SLVASLEEGLACA

SEQ ID NO: 162150 - protein, 13 aa, Mycobacterium tuberculosis
LVASLEEGLACAI

SEQ ID NO: 162151 - protein, 13 aa, Mycobacterium tuberculosis
VASLEEGLACAIL

SEQ ID NO: 162152 - protein, 13 aa, Mycobacterium tuberculosis
ASLEEGLACAILG

SEQ ID NO: 162153 - protein, 13 aa, Mycobacterium tuberculosis
SLEEGLACAILGV

SEQ ID NO: 162154 - protein, 13 aa, Mycobacterium tuberculosis
LEEGLACAILGVP

SEQ ID NO: 162155 - protein, 13 aa, Mycobacterium tuberculosis
EEGLACAILGVPV

SEQ ID NO: 162156 - protein, 13 aa, Mycobacterium tuberculosis
EGLACAILGVPVA

SEQ ID NO: 162157 - protein, 13 aa, Mycobacterium tuberculosis
GLACAILGVPVAD

SEQ ID NO: 162158 - protein, 13 aa, Mycobacterium tuberculosis
LACAILGVPVADL

SEQ ID NO: 162159 - protein, 13 aa, Mycobacterium tuberculosis
ACAILGVPVADLI

SEQ ID NO: 162160 - protein, 13 aa, Mycobacterium tuberculosis
CAILGVPVADLIE

SEQ ID NO: 162161 - protein, 13 aa, Mycobacterium tuberculosis
AILGVPVADLIEL

SEQ ID NO: 162162 - protein, 13 aa, Mycobacterium tuberculosis
ILGVPVADLIELL

SEQ ID NO: 162163 - protein, 13 aa, Mycobacterium tuberculosis
LGVPVADLIELLG

SEQ ID NO: 162164 - protein, 13 aa, Mycobacterium tuberculosis
GVPVADLIELLGR

SEQ ID NO: 162165 - protein, 13 aa, Mycobacterium tuberculosis
VPVADLIELLGRH

SEQ ID NO: 162166 - protein, 13 aa, Mycobacterium tuberculosis
PVADLIELLGRHC

SEQ ID NO: 162167 - protein, 13 aa, Mycobacterium tuberculosis
VADLIELLGRHCG

SEQ ID NO: 162168 - protein, 13 aa, Mycobacterium tuberculosis
ADLIELLGRHCGL

SEQ ID NO: 162169 - protein, 13 aa, Mycobacterium tuberculosis
DLIELLGRHCGLR

SEQ ID NO: 162170 - protein, 13 aa, Mycobacterium tuberculosis
LIELLGRHCGLRH

SEQ ID NO: 162171 - protein, 13 aa, Mycobacterium tuberculosis
IELLGRHCGLRHK

SEQ ID NO: 162172 - protein, 13 aa, Mycobacterium tuberculosis
ELLGRHCGLRHKD

SEQ ID NO: 162173 - protein, 13 aa, Mycobacterium tuberculosis
LLGRHCGLRHKDP

SEQ ID NO: 162174 - protein, 13 aa, Mycobacterium tuberculosis
LGRHCGLRHKDPR

SEQ ID NO: 162175 - protein, 13 aa, Mycobacterium tuberculosis
GRHCGLRHKDPRR

SEQ ID NO: 162176 - protein, 13 aa, Mycobacterium tuberculosis
RHCGLRHKDPRRH

SEQ ID NO: 162177 - protein, 13 aa, Mycobacterium tuberculosis
HCGLRHKDPRRHT

SEQ ID NO: 162178 - protein, 13 aa, Mycobacterium tuberculosis
CGLRHKDPRRHTV

SEQ ID NO: 162179 - protein, 13 aa, Mycobacterium tuberculosis
GLRHKDPRRHTVK

SEQ ID NO: 162180 - protein, 13 aa, Mycobacterium tuberculosis
LRHKDPRRHTVKM

SEQ ID NO: 162181 - protein, 13 aa, Mycobacterium tuberculosis
RHKDPRRHTVKMA

SEQ ID NO: 162182 - protein, 13 aa, Mycobacterium tuberculosis
HKDPRRHTVKMAE

SEQ ID NO: 162183 - protein, 13 aa, Mycobacterium tuberculosis
KDPRRHTVKMAEP

SEQ ID NO: 162184 - protein, 13 aa, Mycobacterium tuberculosis
DPRRHTVKMAEPI

SEQ ID NO: 162185 - protein, 13 aa, Mycobacterium tuberculosis
PRRHTVKMAEPIG

SEQ ID NO: 162186 - protein, 13 aa, Mycobacterium tuberculosis
RRHTVKMAEPIGR

SEQ ID NO: 162187 - protein, 13 aa, Mycobacterium tuberculosis
RHTVKMAEPIGRM

SEQ ID NO: 162188 - protein, 13 aa, Mycobacterium tuberculosis
HTVKMAEPIGRMI

SEQ ID NO: 162189 - protein, 13 aa, Mycobacterium tuberculosis
TVKMAEPIGRMIS

SEQ ID NO: 162190 - protein, 13 aa, Mycobacterium tuberculosis
VKMAEPIGRMISP

SEQ ID NO: 162191 - protein, 13 aa, Mycobacterium tuberculosis
KMAEPIGRMISPL

SEQ ID NO: 162192 - protein, 13 aa, Mycobacterium tuberculosis
MAEPIGRMISPLS

SEQ ID NO: 162193 - protein, 13 aa, Mycobacterium tuberculosis
AEPIGRMISPLSL

SEQ ID NO: 162194 - protein, 13 aa, Mycobacterium tuberculosis
EPIGRMISPLSLT

SEQ ID NO: 162195 - protein, 13 aa, Mycobacterium tuberculosis
PIGRMISPLSLTP

SEQ ID NO: 162196 - protein, 13 aa, Mycobacterium tuberculosis
IGRMISPLSLTPL

SEQ ID NO: 162197 - protein, 13 aa, Mycobacterium tuberculosis
GRMISPLSLTPLV

SEQ ID NO: 162198 - protein, 13 aa, Mycobacterium tuberculosis
RMISPLSLTPLVP

SEQ ID NO: 162199 - protein, 13 aa, Mycobacterium tuberculosis
MISPLSLTPLVPM

SEQ ID NO: 162200 - protein, 13 aa, Mycobacterium tuberculosis
ISPLSLTPLVPMP

SEQ ID NO: 162201 - protein, 13 aa, Mycobacterium tuberculosis
SPLSLTPLVPMPG

SEQ ID NO: 162202 - protein, 13 aa, Mycobacterium tuberculosis
PLSLTPLVPMPGR

SEQ ID NO: 162203 - protein, 13 aa, Mycobacterium tuberculosis
LSLTPLVPMPGRF

SEQ ID NO: 162204 - protein, 13 aa, Mycobacterium tuberculosis
SLTPLVPMPGRFI

SEQ ID NO: 162205 - protein, 13 aa, Mycobacterium tuberculosis
LTPLVPMPGRFIY

SEQ ID NO: 162206 - protein, 13 aa, Mycobacterium tuberculosis
TPLVPMPGRFIYA

SEQ ID NO: 162207 - protein, 13 aa, Mycobacterium tuberculosis
PLVPMPGRFIYAG

SEQ ID NO: 162208 - protein, 13 aa, Mycobacterium tuberculosis
LVPMPGRFIYAGI

SEQ ID NO: 162209 - protein, 13 aa, Mycobacterium tuberculosis
VPMPGRFIYAGIA

SEQ ID NO: 162210 - protein, 13 aa, Mycobacterium tuberculosis
PMPGRFIYAGIAD

SEQ ID NO: 162211 - protein, 13 aa, Mycobacterium tuberculosis
MPGRFIYAGIADR

SEQ ID NO: 162212 - protein, 13 aa, Mycobacterium tuberculosis
PGRFIYAGIADRL

SEQ ID NO: 162213 - protein, 13 aa, Mycobacterium tuberculosis
GRFIYAGIADRLV

SEQ ID NO: 162214 - protein, 13 aa, Mycobacterium tuberculosis
RFIYAGIADRLVH

SEQ ID NO: 162215 - protein, 13 aa, Mycobacterium tuberculosis
FIYAGIADRLVHP

SEQ ID NO: 162216 - protein, 13 aa, Mycobacterium tuberculosis
IYAGIADRLVHPR

SEQ ID NO: 162217 - protein, 13 aa, Mycobacterium tuberculosis
YAGIADRLVHPRE

SEQ ID NO: 162218 - protein, 13 aa, Mycobacterium tuberculosis
AGIADRLVHPREQ

SEQ ID NO: 162219 - protein, 13 aa, Mycobacterium tuberculosis
GIADRLVHPREQV

SEQ ID NO: 162220 - protein, 13 aa, Mycobacterium tuberculosis
IADRLVHPREQVT

SEQ ID NO: 162221 - protein, 13 aa, Mycobacterium tuberculosis
ADRLVHPREQVTR

SEQ ID NO: 162222 - protein, 13 aa, Mycobacterium tuberculosis
DRLVHPREQVTRL

SEQ ID NO: 162223 - protein, 13 aa, Mycobacterium tuberculosis
RLVHPREQVTRLW

SEQ ID NO: 162224 - protein, 13 aa, Mycobacterium tuberculosis
LVHPREQVTRLWE

SEQ ID NO: 162225 - protein, 13 aa, Mycobacterium tuberculosis
VHPREQVTRLWEH

SEQ ID NO: 162226 - protein, 13 aa, Mycobacterium tuberculosis
HPREQVTRLWEHW

SEQ ID NO: 162227 - protein, 13 aa, Mycobacterium tuberculosis
PREQVTRLWEHWG

SEQ ID NO: 162228 - protein, 13 aa, Mycobacterium tuberculosis
REQVTRLWEHWGK

SEQ ID NO: 162229 - protein, 13 aa, Mycobacterium tuberculosis
EQVTRLWEHWGKP

SEQ ID NO: 162230 - protein, 13 aa, Mycobacterium tuberculosis
QVTRLWEHWGKPE

SEQ ID NO: 162231 - protein, 13 aa, Mycobacterium tuberculosis
VTRLWEHWGKPEI

SEQ ID NO: 162232 - protein, 13 aa, Mycobacterium tuberculosis
TRLWEHWGKPEIV

SEQ ID NO: 162233 - protein, 13 aa, Mycobacterium tuberculosis
RLWEHWGKPEIVW

SEQ ID NO: 162234 - protein, 13 aa, Mycobacterium tuberculosis
LWEHWGKPEIVWY

SEQ ID NO: 162235 - protein, 13 aa, Mycobacterium tuberculosis
WEHWGKPEIVWYP

SEQ ID NO: 162236 - protein, 13 aa, Mycobacterium tuberculosis
EHWGKPEIVWYPG

SEQ ID NO: 162237 - protein, 13 aa, Mycobacterium tuberculosis
HWGKPEIVWYPGG

SEQ ID NO: 162238 - protein, 13 aa, Mycobacterium tuberculosis
WGKPEIVWYPGGH

SEQ ID NO: 162239 - protein, 13 aa, Mycobacterium tuberculosis
GKPEIVWYPGGHT

SEQ ID NO: 162240 - protein, 13 aa, Mycobacterium tuberculosis
KPEIVWYPGGHTG

SEQ ID NO: 162241 - protein, 13 aa, Mycobacterium tuberculosis
PEIVWYPGGHTGF

SEQ ID NO: 162242 - protein, 13 aa, Mycobacterium tuberculosis
EIVWYPGGHTGFF

SEQ ID NO: 162243 - protein, 13 aa, Mycobacterium tuberculosis
IVWYPGGHTGFFQ

SEQ ID NO: 162244 - protein, 13 aa, Mycobacterium tuberculosis
VWYPGGHTGFFQS

SEQ ID NO: 162245 - protein, 13 aa, Mycobacterium tuberculosis
WYPGGHTGFFQSR

SEQ ID NO: 162246 - protein, 13 aa, Mycobacterium tuberculosis
YPGGHTGFFQSRP

SEQ ID NO: 162247 - protein, 13 aa, Mycobacterium tuberculosis
PGGHTGFFQSRPV

SEQ ID NO: 162248 - protein, 13 aa, Mycobacterium tuberculosis
GGHTGFFQSRPVR

SEQ ID NO: 162249 - protein, 13 aa, Mycobacterium tuberculosis
GHTGFFQSRPVRR

SEQ ID NO: 162250 - protein, 13 aa, Mycobacterium tuberculosis
HTGFFQSRPVRRF

SEQ ID NO: 162251 - protein, 13 aa, Mycobacterium tuberculosis
TGFFQSRPVRRFV

SEQ ID NO: 162252 - protein, 13 aa, Mycobacterium tuberculosis
GFFQSRPVRRFVQ

SEQ ID NO: 162253 - protein, 13 aa, Mycobacterium tuberculosis
FFQSRPVRRFVQA

SEQ ID NO: 162254 - protein, 13 aa, Mycobacterium tuberculosis
FQSRPVRRFVQAA

SEQ ID NO: 162255 - protein, 13 aa, Mycobacterium tuberculosis
QSRPVRRFVQAAL

SEQ ID NO: 162256 - protein, 13 aa, Mycobacterium tuberculosis
SRPVRRFVQAALE

SEQ ID NO: 162257 - protein, 13 aa, Mycobacterium tuberculosis
RPVRRFVQAALEQ

SEQ ID NO: 162258 - protein, 13 aa, Mycobacterium tuberculosis
PVRRFVQAALEQS

SEQ ID NO: 162259 - protein, 13 aa, Mycobacterium tuberculosis
VRRFVQAALEQSG

SEQ ID NO: 162260 - protein, 13 aa, Mycobacterium tuberculosis
RRFVQAALEQSGL

SEQ ID NO: 162261 - protein, 13 aa, Mycobacterium tuberculosis
RFVQAALEQSGLL

SEQ ID NO: 162262 - protein, 13 aa, Mycobacterium tuberculosis
FVQAALEQSGLLD

SEQ ID NO: 162263 - protein, 13 aa, Mycobacterium tuberculosis
VQAALEQSGLLDA

SEQ ID NO: 162264 - protein, 13 aa, Mycobacterium tuberculosis
QAALEQSGLLDAP

SEQ ID NO: 162265 - protein, 13 aa, Mycobacterium tuberculosis
AALEQSGLLDAPR

SEQ ID NO: 162266 - protein, 13 aa, Mycobacterium tuberculosis
ALEQSGLLDAPRT

SEQ ID NO: 162267 - protein, 13 aa, Mycobacterium tuberculosis
LEQSGLLDAPRTQ

SEQ ID NO: 162268 - protein, 13 aa, Mycobacterium tuberculosis
EQSGLLDAPRTQR

SEQ ID NO: 162269 - protein, 13 aa, Mycobacterium tuberculosis
QSGLLDAPRTQRD

SEQ ID NO: 162270 - protein, 13 aa, Mycobacterium tuberculosis
SGLLDAPRTQRDR

SEQ ID NO: 162271 - protein, 13 aa, Mycobacterium tuberculosis
GLLDAPRTQRDRS

SEQ ID NO: 162272 - protein, 13 aa, Mycobacterium tuberculosis
LLDAPRTQRDRSA

SEQ ID NO: 162273 - protein, 14 aa, Mycobacterium tuberculosis
MASSASDGTHERSA

SEQ ID NO: 162274 - protein, 14 aa, Mycobacterium tuberculosis
ASSASDGTHERSAF

SEQ ID NO: 162275 - protein, 14 aa, Mycobacterium tuberculosis
SSASDGTHERSAFR

SEQ ID NO: 162276 - protein, 14 aa, Mycobacterium tuberculosis
SASDGTHERSAFRL

SEQ ID NO: 162277 - protein, 14 aa, Mycobacterium tuberculosis
ASDGTHERSAFRLS

SEQ ID NO: 162278 - protein, 14 aa, Mycobacterium tuberculosis
SDGTHERSAFRLSP

SEQ ID NO: 162279 - protein, 14 aa, Mycobacterium tuberculosis
DGTHERSAFRLSPP

SEQ ID NO: 162280 - protein, 14 aa, Mycobacterium tuberculosis
GTHERSAFRLSPPV

SEQ ID NO: 162281 - protein, 14 aa, Mycobacterium tuberculosis
THERSAFRLSPPVL

SEQ ID NO: 162282 - protein, 14 aa, Mycobacterium tuberculosis
HERSAFRLSPPVLS

SEQ ID NO: 162283 - protein, 14 aa, Mycobacterium tuberculosis
ERSAFRLSPPVLSG

SEQ ID NO: 162284 - protein, 14 aa, Mycobacterium tuberculosis
RSAFRLSPPVLSGA

SEQ ID NO: 162285 - protein, 14 aa, Mycobacterium tuberculosis
SAFRLSPPVLSGAM

SEQ ID NO: 162286 - protein, 14 aa, Mycobacterium tuberculosis
AFRLSPPVLSGAMG

SEQ ID NO: 162287 - protein, 14 aa, Mycobacterium tuberculosis
FRLSPPVLSGAMGP

SEQ ID NO: 162288 - protein, 14 aa, Mycobacterium tuberculosis
RLSPPVLSGAMGPF

SEQ ID NO: 162289 - protein, 14 aa, Mycobacterium tuberculosis
LSPPVLSGAMGPFM

SEQ ID NO: 162290 - protein, 14 aa, Mycobacterium tuberculosis
SPPVLSGAMGPFMH

SEQ ID NO: 162291 - protein, 14 aa, Mycobacterium tuberculosis
PPVLSGAMGPFMHT

SEQ ID NO: 162292 - protein, 14 aa, Mycobacterium tuberculosis
PVLSGAMGPFMHTG

SEQ ID NO: 162293 - protein, 14 aa, Mycobacterium tuberculosis
VLSGAMGPFMHTGL

SEQ ID NO: 162294 - protein, 14 aa, Mycobacterium tuberculosis
LSGAMGPFMHTGLY

SEQ ID NO: 162295 - protein, 14 aa, Mycobacterium tuberculosis
SGAMGPFMHTGLYV

SEQ ID NO: 162296 - protein, 14 aa, Mycobacterium tuberculosis
GAMGPFMHTGLYVA

SEQ ID NO: 162297 - protein, 14 aa, Mycobacterium tuberculosis
AMGPFMHTGLYVAQ

SEQ ID NO: 162298 - protein, 14 aa, Mycobacterium tuberculosis
MGPFMHTGLYVAQS

SEQ ID NO: 162299 - protein, 14 aa, Mycobacterium tuberculosis
GPFMHTGLYVAQSW

SEQ ID NO: 162300 - protein, 14 aa, Mycobacterium tuberculosis
PFMHTGLYVAQSWR

SEQ ID NO: 162301 - protein, 14 aa, Mycobacterium tuberculosis
FMHTGLYVAQSWRD

SEQ ID NO: 162302 - protein, 14 aa, Mycobacterium tuberculosis
MHTGLYVAQSWRDY

SEQ ID NO: 162303 - protein, 14 aa, Mycobacterium tuberculosis
HTGLYVAQSWRDYL

SEQ ID NO: 162304 - protein, 14 aa, Mycobacterium tuberculosis
TGLYVAQSWRDYLG

SEQ ID NO: 162305 - protein, 14 aa, Mycobacterium tuberculosis
GLYVAQSWRDYLGQ

SEQ ID NO: 162306 - protein, 14 aa, Mycobacterium tuberculosis
LYVAQSWRDYLGQQ

SEQ ID NO: 162307 - protein, 14 aa, Mycobacterium tuberculosis
YVAQSWRDYLGQQP

SEQ ID NO: 162308 - protein, 14 aa, Mycobacterium tuberculosis
VAQSWRDYLGQQPD

SEQ ID NO: 162309 - protein, 14 aa, Mycobacterium tuberculosis
AQSWRDYLGQQPDK

SEQ ID NO: 162310 - protein, 14 aa, Mycobacterium tuberculosis
QSWRDYLGQQPDKL

SEQ ID NO: 162311 - protein, 14 aa, Mycobacterium tuberculosis
SWRDYLGQQPDKLP

SEQ ID NO: 162312 - protein, 14 aa, Mycobacterium tuberculosis
WRDYLGQQPDKLPI

SEQ ID NO: 162313 - protein, 14 aa, Mycobacterium tuberculosis
RDYLGQQPDKLPIA

SEQ ID NO: 162314 - protein, 14 aa, Mycobacterium tuberculosis
DYLGQQPDKLPIAR

SEQ ID NO: 162315 - protein, 14 aa, Mycobacterium tuberculosis
YLGQQPDKLPIARP

SEQ ID NO: 162316 - protein, 14 aa, Mycobacterium tuberculosis
LGQQPDKLPIARPT

SEQ ID NO: 162317 - protein, 14 aa, Mycobacterium tuberculosis
GQQPDKLPIARPTI

SEQ ID NO: 162318 - protein, 14 aa, Mycobacterium tuberculosis
QQPDKLPIARPTIA

SEQ ID NO: 162319 - protein, 14 aa, Mycobacterium tuberculosis
QPDKLPIARPTIAL

SEQ ID NO: 162320 - protein, 14 aa, Mycobacterium tuberculosis
PDKLPIARPTIALA

SEQ ID NO: 162321 - protein, 14 aa, Mycobacterium tuberculosis
DKLPIARPTIALAA

SEQ ID NO: 162322 - protein, 14 aa, Mycobacterium tuberculosis
KLPIARPTIALAAQ

SEQ ID NO: 162323 - protein, 14 aa, Mycobacterium tuberculosis
LPIARPTIALAAQA

SEQ ID NO: 162324 - protein, 14 aa, Mycobacterium tuberculosis
PIARPTIALAAQAF

SEQ ID NO: 162325 - protein, 14 aa, Mycobacterium tuberculosis
IARPTIALAAQAFR

SEQ ID NO: 162326 - protein, 14 aa, Mycobacterium tuberculosis
ARPTIALAAQAFRD

SEQ ID NO: 162327 - protein, 14 aa, Mycobacterium tuberculosis
RPTIALAAQAFRDE

SEQ ID NO: 162328 - protein, 14 aa, Mycobacterium tuberculosis
PTIALAAQAFRDEI

SEQ ID NO: 162329 - protein, 14 aa, Mycobacterium tuberculosis
TIALAAQAFRDEIV

SEQ ID NO: 162330 - protein, 14 aa, Mycobacterium tuberculosis
IALAAQAFRDEIVL

SEQ ID NO: 162331 - protein, 14 aa, Mycobacterium tuberculosis
ALAAQAFRDEIVLL

SEQ ID NO: 162332 - protein, 14 aa, Mycobacterium tuberculosis
LAAQAFRDEIVLLG

SEQ ID NO: 162333 - protein, 14 aa, Mycobacterium tuberculosis
AAQAFRDEIVLLGL

SEQ ID NO: 162334 - protein, 14 aa, Mycobacterium tuberculosis
AQAFRDEIVLLGLK

SEQ ID NO: 162335 - protein, 14 aa, Mycobacterium tuberculosis
QAFRDEIVLLGLKA

SEQ ID NO: 162336 - protein, 14 aa, Mycobacterium tuberculosis
AFRDEIVLLGLKAR

SEQ ID NO: 162337 - protein, 14 aa, Mycobacterium tuberculosis
FRDEIVLLGLKARR

SEQ ID NO: 162338 - protein, 14 aa, Mycobacterium tuberculosis
RDEIVLLGLKARRP

SEQ ID NO: 162339 - protein, 14 aa, Mycobacterium tuberculosis
DEIVLLGLKARRPV

SEQ ID NO: 162340 - protein, 14 aa, Mycobacterium tuberculosis
EIVLLGLKARRPVS

SEQ ID NO: 162341 - protein, 14 aa, Mycobacterium tuberculosis
IVLLGLKARRPVSN

SEQ ID NO: 162342 - protein, 14 aa, Mycobacterium tuberculosis
VLLGLKARRPVSNH

SEQ ID NO: 162343 - protein, 14 aa, Mycobacterium tuberculosis
LLGLKARRPVSNHR

SEQ ID NO: 162344 - protein, 14 aa, Mycobacterium tuberculosis
LGLKARRPVSNHRV

SEQ ID NO: 162345 - protein, 14 aa, Mycobacterium tuberculosis
GLKARRPVSNHRVF

SEQ ID NO: 162346 - protein, 14 aa, Mycobacterium tuberculosis
LKARRPVSNHRVFE

SEQ ID NO: 162347 - protein, 14 aa, Mycobacterium tuberculosis
KARRPVSNHRVFER

SEQ ID NO: 162348 - protein, 14 aa, Mycobacterium tuberculosis
ARRPVSNHRVFERI

SEQ ID NO: 162349 - protein, 14 aa, Mycobacterium tuberculosis
RRPVSNHRVFERIS

SEQ ID NO: 162350 - protein, 14 aa, Mycobacterium tuberculosis
RPVSNHRVFERISQ

SEQ ID NO: 162351 - protein, 14 aa, Mycobacterium tuberculosis
PVSNHRVFERISQE

SEQ ID NO: 162352 - protein, 14 aa, Mycobacterium tuberculosis
VSNHRVFERISQEV

SEQ ID NO: 162353 - protein, 14 aa, Mycobacterium tuberculosis
SNHRVFERISQEVA

SEQ ID NO: 162354 - protein, 14 aa, Mycobacterium tuberculosis
NHRVFERISQEVAA

SEQ ID NO: 162355 - protein, 14 aa, Mycobacterium tuberculosis
HRVFERISQEVAAG

SEQ ID NO: 162356 - protein, 14 aa, Mycobacterium tuberculosis
RVFERISQEVAAGL

SEQ ID NO: 162357 - protein, 14 aa, Mycobacterium tuberculosis
VFERISQEVAAGLE

SEQ ID NO: 162358 - protein, 14 aa, Mycobacterium tuberculosis
FERISQEVAAGLEF

SEQ ID NO: 162359 - protein, 14 aa, Mycobacterium tuberculosis
ERISQEVAAGLEFY

SEQ ID NO: 162360 - protein, 14 aa, Mycobacterium tuberculosis
RISQEVAAGLEFYG

SEQ ID NO: 162361 - protein, 14 aa, Mycobacterium tuberculosis
ISQEVAAGLEFYGN

SEQ ID NO: 162362 - protein, 14 aa, Mycobacterium tuberculosis
SQEVAAGLEFYGNR

SEQ ID NO: 162363 - protein, 14 aa, Mycobacterium tuberculosis
QEVAAGLEFYGNRR

SEQ ID NO: 162364 - protein, 14 aa, Mycobacterium tuberculosis
EVAAGLEFYGNRRW

SEQ ID NO: 162365 - protein, 14 aa, Mycobacterium tuberculosis
VAAGLEFYGNRRWL

SEQ ID NO: 162366 - protein, 14 aa, Mycobacterium tuberculosis
AAGLEFYGNRRWLE

SEQ ID NO: 162367 - protein, 14 aa, Mycobacterium tuberculosis
AGLEFYGNRRWLEK

SEQ ID NO: 162368 - protein, 14 aa, Mycobacterium tuberculosis
GLEFYGNRRWLEKP

SEQ ID NO: 162369 - protein, 14 aa, Mycobacterium tuberculosis
LEFYGNRRWLEKPS

SEQ ID NO: 162370 - protein, 14 aa, Mycobacterium tuberculosis
EFYGNRRWLEKPSG

SEQ ID NO: 162371 - protein, 14 aa, Mycobacterium tuberculosis
FYGNRRWLEKPSGF

SEQ ID NO: 162372 - protein, 14 aa, Mycobacterium tuberculosis
YGNRRWLEKPSGFF

SEQ ID NO: 162373 - protein, 14 aa, Mycobacterium tuberculosis
GNRRWLEKPSGFFA

SEQ ID NO: 162374 - protein, 14 aa, Mycobacterium tuberculosis
NRRWLEKPSGFFAQ

SEQ ID NO: 162375 - protein, 14 aa, Mycobacterium tuberculosis
RRWLEKPSGFFAQP

SEQ ID NO: 162376 - protein, 14 aa, Mycobacterium tuberculosis
RWLEKPSGFFAQPP

SEQ ID NO: 162377 - protein, 14 aa, Mycobacterium tuberculosis
WLEKPSGFFAQPPP

SEQ ID NO: 162378 - protein, 14 aa, Mycobacterium tuberculosis
LEKPSGFFAQPPPL

SEQ ID NO: 162379 - protein, 14 aa, Mycobacterium tuberculosis
EKPSGFFAQPPPLT

SEQ ID NO: 162380 - protein, 14 aa, Mycobacterium tuberculosis
KPSGFFAQPPPLTE

SEQ ID NO: 162381 - protein, 14 aa, Mycobacterium tuberculosis
PSGFFAQPPPLTEV

SEQ ID NO: 162382 - protein, 14 aa, Mycobacterium tuberculosis
SGFFAQPPPLTEVA

SEQ ID NO: 162383 - protein, 14 aa, Mycobacterium tuberculosis
GFFAQPPPLTEVAV

SEQ ID NO: 162384 - protein, 14 aa, Mycobacterium tuberculosis
FFAQPPPLTEVAVR

SEQ ID NO: 162385 - protein, 14 aa, Mycobacterium tuberculosis
FAQPPPLTEVAVRK

SEQ ID NO: 162386 - protein, 14 aa, Mycobacterium tuberculosis
AQPPPLTEVAVRKV

SEQ ID NO: 162387 - protein, 14 aa, Mycobacterium tuberculosis
QPPPLTEVAVRKVK

SEQ ID NO: 162388 - protein, 14 aa, Mycobacterium tuberculosis
PPPLTEVAVRKVKD

SEQ ID NO: 162389 - protein, 14 aa, Mycobacterium tuberculosis
PPLTEVAVRKVKDR

SEQ ID NO: 162390 - protein, 14 aa, Mycobacterium tuberculosis
PLTEVAVRKVKDRR

SEQ ID NO: 162391 - protein, 14 aa, Mycobacterium tuberculosis
LTEVAVRKVKDRRR

SEQ ID NO: 162392 - protein, 14 aa, Mycobacterium tuberculosis
TEVAVRKVKDRRRS

SEQ ID NO: 162393 - protein, 14 aa, Mycobacterium tuberculosis
EVAVRKVKDRRRSF

SEQ ID NO: 162394 - protein, 14 aa, Mycobacterium tuberculosis
VAVRKVKDRRRSFY

SEQ ID NO: 162395 - protein, 14 aa, Mycobacterium tuberculosis
AVRKVKDRRRSFYR

SEQ ID NO: 162396 - protein, 14 aa, Mycobacterium tuberculosis
VRKVKDRRRSFYRI

SEQ ID NO: 162397 - protein, 14 aa, Mycobacterium tuberculosis
RKVKDRRRSFYRIF

SEQ ID NO: 162398 - protein, 14 aa, Mycobacterium tuberculosis
KVKDRRRSFYRIFF

SEQ ID NO: 162399 - protein, 14 aa, Mycobacterium tuberculosis
VKDRRRSFYRIFFD

SEQ ID NO: 162400 - protein, 14 aa, Mycobacterium tuberculosis
KDRRRSFYRIFFDS

SEQ ID NO: 162401 - protein, 14 aa, Mycobacterium tuberculosis
DRRRSFYRIFFDSG

SEQ ID NO: 162402 - protein, 14 aa, Mycobacterium tuberculosis
RRRSFYRIFFDSGF

SEQ ID NO: 162403 - protein, 14 aa, Mycobacterium tuberculosis
RRSFYRIFFDSGFT

SEQ ID NO: 162404 - protein, 14 aa, Mycobacterium tuberculosis
RSFYRIFFDSGFTP

SEQ ID NO: 162405 - protein, 14 aa, Mycobacterium tuberculosis
SFYRIFFDSGFTPH

SEQ ID NO: 162406 - protein, 14 aa, Mycobacterium tuberculosis
FYRIFFDSGFTPHP

SEQ ID NO: 162407 - protein, 14 aa, Mycobacterium tuberculosis
YRIFFDSGFTPHPG

SEQ ID NO: 162408 - protein, 14 aa, Mycobacterium tuberculosis
RIFFDSGFTPHPGE

SEQ ID NO: 162409 - protein, 14 aa, Mycobacterium tuberculosis
IFFDSGFTPHPGEP

SEQ ID NO: 162410 - protein, 14 aa, Mycobacterium tuberculosis
FFDSGFTPHPGEPG

SEQ ID NO: 162411 - protein, 14 aa, Mycobacterium tuberculosis
FDSGFTPHPGEPGS

SEQ ID NO: 162412 - protein, 14 aa, Mycobacterium tuberculosis
DSGFTPHPGEPGSQ

SEQ ID NO: 162413 - protein, 14 aa, Mycobacterium tuberculosis
SGFTPHPGEPGSQR

SEQ ID NO: 162414 - protein, 14 aa, Mycobacterium tuberculosis
GFTPHPGEPGSQRW

SEQ ID NO: 162415 - protein, 14 aa, Mycobacterium tuberculosis
FTPHPGEPGSQRWL

SEQ ID NO: 162416 - protein, 14 aa, Mycobacterium tuberculosis
TPHPGEPGSQRWLS

SEQ ID NO: 162417 - protein, 14 aa, Mycobacterium tuberculosis
PHPGEPGSQRWLSY

SEQ ID NO: 162418 - protein, 14 aa, Mycobacterium tuberculosis
HPGEPGSQRWLSYT

SEQ ID NO: 162419 - protein, 14 aa, Mycobacterium tuberculosis
PGEPGSQRWLSYTA

SEQ ID NO: 162420 - protein, 14 aa, Mycobacterium tuberculosis
GEPGSQRWLSYTAN

SEQ ID NO: 162421 - protein, 14 aa, Mycobacterium tuberculosis
EPGSQRWLSYTANN

SEQ ID NO: 162422 - protein, 14 aa, Mycobacterium tuberculosis
PGSQRWLSYTANNR

SEQ ID NO: 162423 - protein, 14 aa, Mycobacterium tuberculosis
GSQRWLSYTANNRE

SEQ ID NO: 162424 - protein, 14 aa, Mycobacterium tuberculosis
SQRWLSYTANNREY

SEQ ID NO: 162425 - protein, 14 aa, Mycobacterium tuberculosis
QRWLSYTANNREYA

SEQ ID NO: 162426 - protein, 14 aa, Mycobacterium tuberculosis
RWLSYTANNREYAL

SEQ ID NO: 162427 - protein, 14 aa, Mycobacterium tuberculosis
WLSYTANNREYALL

SEQ ID NO: 162428 - protein, 14 aa, Mycobacterium tuberculosis
LSYTANNREYALLL

SEQ ID NO: 162429 - protein, 14 aa, Mycobacterium tuberculosis
SYTANNREYALLLR

SEQ ID NO: 162430 - protein, 14 aa, Mycobacterium tuberculosis
YTANNREYALLLRH

SEQ ID NO: 162431 - protein, 14 aa, Mycobacterium tuberculosis
TANNREYALLLRHP

SEQ ID NO: 162432 - protein, 14 aa, Mycobacterium tuberculosis
ANNREYALLLRHPE

SEQ ID NO: 162433 - protein, 14 aa, Mycobacterium tuberculosis
NNREYALLLRHPEP

SEQ ID NO: 162434 - protein, 14 aa, Mycobacterium tuberculosis
NREYALLLRHPEPR

SEQ ID NO: 162435 - protein, 14 aa, Mycobacterium tuberculosis
REYALLLRHPEPRP

SEQ ID NO: 162436 - protein, 14 aa, Mycobacterium tuberculosis
EYALLLRHPEPRPW

SEQ ID NO: 162437 - protein, 14 aa, Mycobacterium tuberculosis
YALLLRHPEPRPWL

SEQ ID NO: 162438 - protein, 14 aa, Mycobacterium tuberculosis
ALLLRHPEPRPWLV

SEQ ID NO: 162439 - protein, 14 aa, Mycobacterium tuberculosis
LLLRHPEPRPWLVC

SEQ ID NO: 162440 - protein, 14 aa, Mycobacterium tuberculosis
LLRHPEPRPWLVCV

SEQ ID NO: 162441 - protein, 14 aa, Mycobacterium tuberculosis
LRHPEPRPWLVCVH

SEQ ID NO: 162442 - protein, 14 aa, Mycobacterium tuberculosis
RHPEPRPWLVCVHG

SEQ ID NO: 162443 - protein, 14 aa, Mycobacterium tuberculosis
HPEPRPWLVCVHGT

SEQ ID NO: 162444 - protein, 14 aa, Mycobacterium tuberculosis
PEPRPWLVCVHGTE

SEQ ID NO: 162445 - protein, 14 aa, Mycobacterium tuberculosis
EPRPWLVCVHGTEM

SEQ ID NO: 162446 - protein, 14 aa, Mycobacterium tuberculosis
PRPWLVCVHGTEMG

SEQ ID NO: 162447 - protein, 14 aa, Mycobacterium tuberculosis
RPWLVCVHGTEMGR

SEQ ID NO: 162448 - protein, 14 aa, Mycobacterium tuberculosis
PWLVCVHGTEMGRA

SEQ ID NO: 162449 - protein, 14 aa, Mycobacterium tuberculosis
WLVCVHGTEMGRAP

SEQ ID NO: 162450 - protein, 14 aa, Mycobacterium tuberculosis
LVCVHGTEMGRAPL

SEQ ID NO: 162451 - protein, 14 aa, Mycobacterium tuberculosis
VCVHGTEMGRAPLD

SEQ ID NO: 162452 - protein, 14 aa, Mycobacterium tuberculosis
CVHGTEMGRAPLDL

SEQ ID NO: 162453 - protein, 14 aa, Mycobacterium tuberculosis
VHGTEMGRAPLDLA

SEQ ID NO: 162454 - protein, 14 aa, Mycobacterium tuberculosis
HGTEMGRAPLDLAV

SEQ ID NO: 162455 - protein, 14 aa, Mycobacterium tuberculosis
GTEMGRAPLDLAVF

SEQ ID NO: 162456 - protein, 14 aa, Mycobacterium tuberculosis
TEMGRAPLDLAVFR

SEQ ID NO: 162457 - protein, 14 aa, Mycobacterium tuberculosis
EMGRAPLDLAVFRA

SEQ ID NO: 162458 - protein, 14 aa, Mycobacterium tuberculosis
MGRAPLDLAVFRAW

SEQ ID NO: 162459 - protein, 14 aa, Mycobacterium tuberculosis
GRAPLDLAVFRAWK

SEQ ID NO: 162460 - protein, 14 aa, Mycobacterium tuberculosis
RAPLDLAVFRAWKL

SEQ ID NO: 162461 - protein, 14 aa, Mycobacterium tuberculosis
APLDLAVFRAWKLH

SEQ ID NO: 162462 - protein, 14 aa, Mycobacterium tuberculosis
PLDLAVFRAWKLHD

SEQ ID NO: 162463 - protein, 14 aa, Mycobacterium tuberculosis
LDLAVFRAWKLHDE

SEQ ID NO: 162464 - protein, 14 aa, Mycobacterium tuberculosis
DLAVFRAWKLHDEL

SEQ ID NO: 162465 - protein, 14 aa, Mycobacterium tuberculosis
LAVFRAWKLHDELG

SEQ ID NO: 162466 - protein, 14 aa, Mycobacterium tuberculosis
AVFRAWKLHDELGL

SEQ ID NO: 162467 - protein, 14 aa, Mycobacterium tuberculosis
VFRAWKLHDELGLN

SEQ ID NO: 162468 - protein, 14 aa, Mycobacterium tuberculosis
FRAWKLHDELGLNI

SEQ ID NO: 162469 - protein, 14 aa, Mycobacterium tuberculosis
RAWKLHDELGLNIV

SEQ ID NO: 162470 - protein, 14 aa, Mycobacterium tuberculosis
AWKLHDELGLNIVM

SEQ ID NO: 162471 - protein, 14 aa, Mycobacterium tuberculosis
WKLHDELGLNIVMP

SEQ ID NO: 162472 - protein, 14 aa, Mycobacterium tuberculosis
KLHDELGLNIVMPV

SEQ ID NO: 162473 - protein, 14 aa, Mycobacterium tuberculosis
LHDELGLNIVMPVL

SEQ ID NO: 162474 - protein, 14 aa, Mycobacterium tuberculosis
HDELGLNIVMPVLP

SEQ ID NO: 162475 - protein, 14 aa, Mycobacterium tuberculosis
DELGLNIVMPVLPM

SEQ ID NO: 162476 - protein, 14 aa, Mycobacterium tuberculosis
ELGLNIVMPVLPMH

SEQ ID NO: 162477 - protein, 14 aa, Mycobacterium tuberculosis
LGLNIVMPVLPMHG

SEQ ID NO: 162478 - protein, 14 aa, Mycobacterium tuberculosis
GLNIVMPVLPMHGP

SEQ ID NO: 162479 - protein, 14 aa, Mycobacterium tuberculosis
LNIVMPVLPMHGPR

SEQ ID NO: 162480 - protein, 14 aa, Mycobacterium tuberculosis
NIVMPVLPMHGPRG

SEQ ID NO: 162481 - protein, 14 aa, Mycobacterium tuberculosis
IVMPVLPMHGPRGQ

SEQ ID NO: 162482 - protein, 14 aa, Mycobacterium tuberculosis
VMPVLPMHGPRGQG

SEQ ID NO: 162483 - protein, 14 aa, Mycobacterium tuberculosis
MPVLPMHGPRGQGL

SEQ ID NO: 162484 - protein, 14 aa, Mycobacterium tuberculosis
PVLPMHGPRGQGLP

SEQ ID NO: 162485 - protein, 14 aa, Mycobacterium tuberculosis
VLPMHGPRGQGLPK

SEQ ID NO: 162486 - protein, 14 aa, Mycobacterium tuberculosis
LPMHGPRGQGLPKG

SEQ ID NO: 162487 - protein, 14 aa, Mycobacterium tuberculosis
PMHGPRGQGLPKGA

SEQ ID NO: 162488 - protein, 14 aa, Mycobacterium tuberculosis
MHGPRGQGLPKGAV

SEQ ID NO: 162489 - protein, 14 aa, Mycobacterium tuberculosis
HGPRGQGLPKGAVF

SEQ ID NO: 162490 - protein, 14 aa, Mycobacterium tuberculosis
GPRGQGLPKGAVFP

SEQ ID NO: 162491 - protein, 14 aa, Mycobacterium tuberculosis
PRGQGLPKGAVFPG

SEQ ID NO: 162492 - protein, 14 aa, Mycobacterium tuberculosis
RGQGLPKGAVFPGE

SEQ ID NO: 162493 - protein, 14 aa, Mycobacterium tuberculosis
GQGLPKGAVFPGED

SEQ ID NO: 162494 - protein, 14 aa, Mycobacterium tuberculosis
QGLPKGAVFPGEDV

SEQ ID NO: 162495 - protein, 14 aa, Mycobacterium tuberculosis
GLPKGAVFPGEDVL

SEQ ID NO: 162496 - protein, 14 aa, Mycobacterium tuberculosis
LPKGAVFPGEDVLD

SEQ ID NO: 162497 - protein, 14 aa, Mycobacterium tuberculosis
PKGAVFPGEDVLDD

SEQ ID NO: 162498 - protein, 14 aa, Mycobacterium tuberculosis
KGAVFPGEDVLDDV

SEQ ID NO: 162499 - protein, 14 aa, Mycobacterium tuberculosis
GAVFPGEDVLDDVH

SEQ ID NO: 162500 - protein, 14 aa, Mycobacterium tuberculosis
AVFPGEDVLDDVHG

SEQ ID NO: 162501 - protein, 14 aa, Mycobacterium tuberculosis
VFPGEDVLDDVHGT

SEQ ID NO: 162502 - protein, 14 aa, Mycobacterium tuberculosis
FPGEDVLDDVHGTA

SEQ ID NO: 162503 - protein, 14 aa, Mycobacterium tuberculosis
PGEDVLDDVHGTAQ

SEQ ID NO: 162504 - protein, 14 aa, Mycobacterium tuberculosis
GEDVLDDVHGTAQA

SEQ ID NO: 162505 - protein, 14 aa, Mycobacterium tuberculosis
EDVLDDVHGTAQAV

SEQ ID NO: 162506 - protein, 14 aa, Mycobacterium tuberculosis
DVLDDVHGTAQAVW

SEQ ID NO: 162507 - protein, 14 aa, Mycobacterium tuberculosis
VLDDVHGTAQAVWD

SEQ ID NO: 162508 - protein, 14 aa, Mycobacterium tuberculosis
LDDVHGTAQAVWDI

SEQ ID NO: 162509 - protein, 14 aa, Mycobacterium tuberculosis
DDVHGTAQAVWDIR

SEQ ID NO: 162510 - protein, 14 aa, Mycobacterium tuberculosis
DVHGTAQAVWDIRR

SEQ ID NO: 162511 - protein, 14 aa, Mycobacterium tuberculosis
VHGTAQAVWDIRRL

SEQ ID NO: 162512 - protein, 14 aa, Mycobacterium tuberculosis
HGTAQAVWDIRRLL

SEQ ID NO: 162513 - protein, 14 aa, Mycobacterium tuberculosis
GTAQAVWDIRRLLS

SEQ ID NO: 162514 - protein, 14 aa, Mycobacterium tuberculosis
TAQAVWDIRRLLSW

SEQ ID NO: 162515 - protein, 14 aa, Mycobacterium tuberculosis
AQAVWDIRRLLSWI

SEQ ID NO: 162516 - protein, 14 aa, Mycobacterium tuberculosis
QAVWDIRRLLSWIR

SEQ ID NO: 162517 - protein, 14 aa, Mycobacterium tuberculosis
AVWDIRRLLSWIRS

SEQ ID NO: 162518 - protein, 14 aa, Mycobacterium tuberculosis
VWDIRRLLSWIRSQ

SEQ ID NO: 162519 - protein, 14 aa, Mycobacterium tuberculosis
WDIRRLLSWIRSQE

SEQ ID NO: 162520 - protein, 14 aa, Mycobacterium tuberculosis
DIRRLLSWIRSQEE

SEQ ID NO: 162521 - protein, 14 aa, Mycobacterium tuberculosis
IRRLLSWIRSQEEE

SEQ ID NO: 162522 - protein, 14 aa, Mycobacterium tuberculosis
RRLLSWIRSQEEES

SEQ ID NO: 162523 - protein, 14 aa, Mycobacterium tuberculosis
RLLSWIRSQEEESL

SEQ ID NO: 162524 - protein, 14 aa, Mycobacterium tuberculosis
LLSWIRSQEEESLI

SEQ ID NO: 162525 - protein, 14 aa, Mycobacterium tuberculosis
LSWIRSQEEESLIG

SEQ ID NO: 162526 - protein, 14 aa, Mycobacterium tuberculosis
SWIRSQEEESLIGL

SEQ ID NO: 162527 - protein, 14 aa, Mycobacterium tuberculosis
WIRSQEEESLIGLN

SEQ ID NO: 162528 - protein, 14 aa, Mycobacterium tuberculosis
IRSQEEESLIGLNG

SEQ ID NO: 162529 - protein, 14 aa, Mycobacterium tuberculosis
RSQEEESLIGLNGL

SEQ ID NO: 162530 - protein, 14 aa, Mycobacterium tuberculosis
SQEEESLIGLNGLS

SEQ ID NO: 162531 - protein, 14 aa, Mycobacterium tuberculosis
QEEESLIGLNGLSL

SEQ ID NO: 162532 - protein, 14 aa, Mycobacterium tuberculosis
EEESLIGLNGLSLG

SEQ ID NO: 162533 - protein, 14 aa, Mycobacterium tuberculosis
EESLIGLNGLSLGG

SEQ ID NO: 162534 - protein, 14 aa, Mycobacterium tuberculosis
ESLIGLNGLSLGGY

SEQ ID NO: 162535 - protein, 14 aa, Mycobacterium tuberculosis
SLIGLNGLSLGGYI

SEQ ID NO: 162536 - protein, 14 aa, Mycobacterium tuberculosis
LIGLNGLSLGGYIA

SEQ ID NO: 162537 - protein, 14 aa, Mycobacterium tuberculosis
IGLNGLSLGGYIAS

SEQ ID NO: 162538 - protein, 14 aa, Mycobacterium tuberculosis
GLNGLSLGGYIASL

SEQ ID NO: 162539 - protein, 14 aa, Mycobacterium tuberculosis
LNGLSLGGYIASLV

SEQ ID NO: 162540 - protein, 14 aa, Mycobacterium tuberculosis
NGLSLGGYIASLVA

SEQ ID NO: 162541 - protein, 14 aa, Mycobacterium tuberculosis
GLSLGGYIASLVAS

SEQ ID NO: 162542 - protein, 14 aa, Mycobacterium tuberculosis
LSLGGYIASLVASL

SEQ ID NO: 162543 - protein, 14 aa, Mycobacterium tuberculosis
SLGGYIASLVASLE

SEQ ID NO: 162544 - protein, 14 aa, Mycobacterium tuberculosis
LGGYIASLVASLEE

SEQ ID NO: 162545 - protein, 14 aa, Mycobacterium tuberculosis
GGYIASLVASLEEG

SEQ ID NO: 162546 - protein, 14 aa, Mycobacterium tuberculosis
GYIASLVASLEEGL

SEQ ID NO: 162547 - protein, 14 aa, Mycobacterium tuberculosis
YIASLVASLEEGLA

SEQ ID NO: 162548 - protein, 14 aa, Mycobacterium tuberculosis
IASLVASLEEGLAC

SEQ ID NO: 162549 - protein, 14 aa, Mycobacterium tuberculosis
ASLVASLEEGLACA

SEQ ID NO: 162550 - protein, 14 aa, Mycobacterium tuberculosis
SLVASLEEGLACAI

SEQ ID NO: 162551 - protein, 14 aa, Mycobacterium tuberculosis
LVASLEEGLACAIL

SEQ ID NO: 162552 - protein, 14 aa, Mycobacterium tuberculosis
VASLEEGLACAILG

SEQ ID NO: 162553 - protein, 14 aa, Mycobacterium tuberculosis
ASLEEGLACAILGV

SEQ ID NO: 162554 - protein, 14 aa, Mycobacterium tuberculosis
SLEEGLACAILGVP

SEQ ID NO: 162555 - protein, 14 aa, Mycobacterium tuberculosis
LEEGLACAILGVPV

SEQ ID NO: 162556 - protein, 14 aa, Mycobacterium tuberculosis
EEGLACAILGVPVA

SEQ ID NO: 162557 - protein, 14 aa, Mycobacterium tuberculosis
EGLACAILGVPVAD

SEQ ID NO: 162558 - protein, 14 aa, Mycobacterium tuberculosis
GLACAILGVPVADL

SEQ ID NO: 162559 - protein, 14 aa, Mycobacterium tuberculosis
LACAILGVPVADLI

SEQ ID NO: 162560 - protein, 14 aa, Mycobacterium tuberculosis
ACAILGVPVADLIE

SEQ ID NO: 162561 - protein, 14 aa, Mycobacterium tuberculosis
CAILGVPVADLIEL

SEQ ID NO: 162562 - protein, 14 aa, Mycobacterium tuberculosis
AILGVPVADLIELL

SEQ ID NO: 162563 - protein, 14 aa, Mycobacterium tuberculosis
ILGVPVADLIELLG

SEQ ID NO: 162564 - protein, 14 aa, Mycobacterium tuberculosis
LGVPVADLIELLGR

SEQ ID NO: 162565 - protein, 14 aa, Mycobacterium tuberculosis
GVPVADLIELLGRH

SEQ ID NO: 162566 - protein, 14 aa, Mycobacterium tuberculosis
VPVADLIELLGRHC

SEQ ID NO: 162567 - protein, 14 aa, Mycobacterium tuberculosis
PVADLIELLGRHCG

SEQ ID NO: 162568 - protein, 14 aa, Mycobacterium tuberculosis
VADLIELLGRHCGL

SEQ ID NO: 162569 - protein, 14 aa, Mycobacterium tuberculosis
ADLIELLGRHCGLR

SEQ ID NO: 162570 - protein, 14 aa, Mycobacterium tuberculosis
DLIELLGRHCGLRH

SEQ ID NO: 162571 - protein, 14 aa, Mycobacterium tuberculosis
LIELLGRHCGLRHK

SEQ ID NO: 162572 - protein, 14 aa, Mycobacterium tuberculosis
IELLGRHCGLRHKD

SEQ ID NO: 162573 - protein, 14 aa, Mycobacterium tuberculosis
ELLGRHCGLRHKDP

SEQ ID NO: 162574 - protein, 14 aa, Mycobacterium tuberculosis
LLGRHCGLRHKDPR

SEQ ID NO: 162575 - protein, 14 aa, Mycobacterium tuberculosis
LGRHCGLRHKDPRR

SEQ ID NO: 162576 - protein, 14 aa, Mycobacterium tuberculosis
GRHCGLRHKDPRRH

SEQ ID NO: 162577 - protein, 14 aa, Mycobacterium tuberculosis
RHCGLRHKDPRRHT

SEQ ID NO: 162578 - protein, 14 aa, Mycobacterium tuberculosis
HCGLRHKDPRRHTV

SEQ ID NO: 162579 - protein, 14 aa, Mycobacterium tuberculosis
CGLRHKDPRRHTVK

SEQ ID NO: 162580 - protein, 14 aa, Mycobacterium tuberculosis
GLRHKDPRRHTVKM

SEQ ID NO: 162581 - protein, 14 aa, Mycobacterium tuberculosis
LRHKDPRRHTVKMA

SEQ ID NO: 162582 - protein, 14 aa, Mycobacterium tuberculosis
RHKDPRRHTVKMAE

SEQ ID NO: 162583 - protein, 14 aa, Mycobacterium tuberculosis
HKDPRRHTVKMAEP

SEQ ID NO: 162584 - protein, 14 aa, Mycobacterium tuberculosis
KDPRRHTVKMAEPI

SEQ ID NO: 162585 - protein, 14 aa, Mycobacterium tuberculosis
DPRRHTVKMAEPIG

SEQ ID NO: 162586 - protein, 14 aa, Mycobacterium tuberculosis
PRRHTVKMAEPIGR

SEQ ID NO: 162587 - protein, 14 aa, Mycobacterium tuberculosis
RRHTVKMAEPIGRM

SEQ ID NO: 162588 - protein, 14 aa, Mycobacterium tuberculosis
RHTVKMAEPIGRMI

SEQ ID NO: 162589 - protein, 14 aa, Mycobacterium tuberculosis
HTVKMAEPIGRMIS

SEQ ID NO: 162590 - protein, 14 aa, Mycobacterium tuberculosis
TVKMAEPIGRMISP

SEQ ID NO: 162591 - protein, 14 aa, Mycobacterium tuberculosis
VKMAEPIGRMISPL

SEQ ID NO: 162592 - protein, 14 aa, Mycobacterium tuberculosis
KMAEPIGRMISPLS

SEQ ID NO: 162593 - protein, 14 aa, Mycobacterium tuberculosis
MAEPIGRMISPLSL

SEQ ID NO: 162594 - protein, 14 aa, Mycobacterium tuberculosis
AEPIGRMISPLSLT

SEQ ID NO: 162595 - protein, 14 aa, Mycobacterium tuberculosis
EPIGRMISPLSLTP

SEQ ID NO: 162596 - protein, 14 aa, Mycobacterium tuberculosis
PIGRMISPLSLTPL

SEQ ID NO: 162597 - protein, 14 aa, Mycobacterium tuberculosis
IGRMISPLSLTPLV

SEQ ID NO: 162598 - protein, 14 aa, Mycobacterium tuberculosis
GRMISPLSLTPLVP

SEQ ID NO: 162599 - protein, 14 aa, Mycobacterium tuberculosis
RMISPLSLTPLVPM

SEQ ID NO: 162600 - protein, 14 aa, Mycobacterium tuberculosis
MISPLSLTPLVPMP

SEQ ID NO: 162601 - protein, 14 aa, Mycobacterium tuberculosis
ISPLSLTPLVPMPG

SEQ ID NO: 162602 - protein, 14 aa, Mycobacterium tuberculosis
SPLSLTPLVPMPGR

SEQ ID NO: 162603 - protein, 14 aa, Mycobacterium tuberculosis
PLSLTPLVPMPGRF

SEQ ID NO: 162604 - protein, 14 aa, Mycobacterium tuberculosis
LSLTPLVPMPGRFI

SEQ ID NO: 162605 - protein, 14 aa, Mycobacterium tuberculosis
SLTPLVPMPGRFIY

SEQ ID NO: 162606 - protein, 14 aa, Mycobacterium tuberculosis
LTPLVPMPGRFIYA

SEQ ID NO: 162607 - protein, 14 aa, Mycobacterium tuberculosis
TPLVPMPGRFIYAG

SEQ ID NO: 162608 - protein, 14 aa, Mycobacterium tuberculosis
PLVPMPGRFIYAGI

SEQ ID NO: 162609 - protein, 14 aa, Mycobacterium tuberculosis
LVPMPGRFIYAGIA

SEQ ID NO: 162610 - protein, 14 aa, Mycobacterium tuberculosis
VPMPGRFIYAGIAD

SEQ ID NO: 162611 - protein, 14 aa, Mycobacterium tuberculosis
PMPGRFIYAGIADR

SEQ ID NO: 162612 - protein, 14 aa, Mycobacterium tuberculosis
MPGRFIYAGIADRL

SEQ ID NO: 162613 - protein, 14 aa, Mycobacterium tuberculosis
PGRFIYAGIADRLV

SEQ ID NO: 162614 - protein, 14 aa, Mycobacterium tuberculosis
GRFIYAGIADRLVH

SEQ ID NO: 162615 - protein, 14 aa, Mycobacterium tuberculosis
RFIYAGIADRLVHP

SEQ ID NO: 162616 - protein, 14 aa, Mycobacterium tuberculosis
FIYAGIADRLVHPR

SEQ ID NO: 162617 - protein, 14 aa, Mycobacterium tuberculosis
IYAGIADRLVHPRE

SEQ ID NO: 162618 - protein, 14 aa, Mycobacterium tuberculosis
YAGIADRLVHPREQ

SEQ ID NO: 162619 - protein, 14 aa, Mycobacterium tuberculosis
AGIADRLVHPREQV

SEQ ID NO: 162620 - protein, 14 aa, Mycobacterium tuberculosis
GIADRLVHPREQVT

SEQ ID NO: 162621 - protein, 14 aa, Mycobacterium tuberculosis
IADRLVHPREQVTR

SEQ ID NO: 162622 - protein, 14 aa, Mycobacterium tuberculosis
ADRLVHPREQVTRL

SEQ ID NO: 162623 - protein, 14 aa, Mycobacterium tuberculosis
DRLVHPREQVTRLW

SEQ ID NO: 162624 - protein, 14 aa, Mycobacterium tuberculosis
RLVHPREQVTRLWE

SEQ ID NO: 162625 - protein, 14 aa, Mycobacterium tuberculosis
LVHPREQVTRLWEH

SEQ ID NO: 162626 - protein, 14 aa, Mycobacterium tuberculosis
VHPREQVTRLWEHW

SEQ ID NO: 162627 - protein, 14 aa, Mycobacterium tuberculosis
HPREQVTRLWEHWG

SEQ ID NO: 162628 - protein, 14 aa, Mycobacterium tuberculosis
PREQVTRLWEHWGK

SEQ ID NO: 162629 - protein, 14 aa, Mycobacterium tuberculosis
REQVTRLWEHWGKP

SEQ ID NO: 162630 - protein, 14 aa, Mycobacterium tuberculosis
EQVTRLWEHWGKPE

SEQ ID NO: 162631 - protein, 14 aa, Mycobacterium tuberculosis
QVTRLWEHWGKPEI

SEQ ID NO: 162632 - protein, 14 aa, Mycobacterium tuberculosis
VTRLWEHWGKPEIV

SEQ ID NO: 162633 - protein, 14 aa, Mycobacterium tuberculosis
TRLWEHWGKPEIVW

SEQ ID NO: 162634 - protein, 14 aa, Mycobacterium tuberculosis
RLWEHWGKPEIVWY

SEQ ID NO: 162635 - protein, 14 aa, Mycobacterium tuberculosis
LWEHWGKPEIVWYP

SEQ ID NO: 162636 - protein, 14 aa, Mycobacterium tuberculosis
WEHWGKPEIVWYPG

SEQ ID NO: 162637 - protein, 14 aa, Mycobacterium tuberculosis
EHWGKPEIVWYPGG

SEQ ID NO: 162638 - protein, 14 aa, Mycobacterium tuberculosis
HWGKPEIVWYPGGH

SEQ ID NO: 162639 - protein, 14 aa, Mycobacterium tuberculosis
WGKPEIVWYPGGHT

SEQ ID NO: 162640 - protein, 14 aa, Mycobacterium tuberculosis
GKPEIVWYPGGHTG

SEQ ID NO: 162641 - protein, 14 aa, Mycobacterium tuberculosis
KPEIVWYPGGHTGF

SEQ ID NO: 162642 - protein, 14 aa, Mycobacterium tuberculosis
PEIVWYPGGHTGFF

SEQ ID NO: 162643 - protein, 14 aa, Mycobacterium tuberculosis
EIVWYPGGHTGFFQ

SEQ ID NO: 162644 - protein, 14 aa, Mycobacterium tuberculosis
IVWYPGGHTGFFQS

SEQ ID NO: 162645 - protein, 14 aa, Mycobacterium tuberculosis
VWYPGGHTGFFQSR

SEQ ID NO: 162646 - protein, 14 aa, Mycobacterium tuberculosis
WYPGGHTGFFQSRP

SEQ ID NO: 162647 - protein, 14 aa, Mycobacterium tuberculosis
YPGGHTGFFQSRPV

SEQ ID NO: 162648 - protein, 14 aa, Mycobacterium tuberculosis
PGGHTGFFQSRPVR

SEQ ID NO: 162649 - protein, 14 aa, Mycobacterium tuberculosis
GGHTGFFQSRPVRR

SEQ ID NO: 162650 - protein, 14 aa, Mycobacterium tuberculosis
GHTGFFQSRPVRRF

SEQ ID NO: 162651 - protein, 14 aa, Mycobacterium tuberculosis
HTGFFQSRPVRRFV

SEQ ID NO: 162652 - protein, 14 aa, Mycobacterium tuberculosis
TGFFQSRPVRRFVQ

SEQ ID NO: 162653 - protein, 14 aa, Mycobacterium tuberculosis
GFFQSRPVRRFVQA

SEQ ID NO: 162654 - protein, 14 aa, Mycobacterium tuberculosis
FFQSRPVRRFVQAA

SEQ ID NO: 162655 - protein, 14 aa, Mycobacterium tuberculosis
FQSRPVRRFVQAAL

SEQ ID NO: 162656 - protein, 14 aa, Mycobacterium tuberculosis
QSRPVRRFVQAALE

SEQ ID NO: 162657 - protein, 14 aa, Mycobacterium tuberculosis
SRPVRRFVQAALEQ

SEQ ID NO: 162658 - protein, 14 aa, Mycobacterium tuberculosis
RPVRRFVQAALEQS

SEQ ID NO: 162659 - protein, 14 aa, Mycobacterium tuberculosis
PVRRFVQAALEQSG

SEQ ID NO: 162660 - protein, 14 aa, Mycobacterium tuberculosis
VRRFVQAALEQSGL

SEQ ID NO: 162661 - protein, 14 aa, Mycobacterium tuberculosis
RRFVQAALEQSGLL

SEQ ID NO: 162662 - protein, 14 aa, Mycobacterium tuberculosis
RFVQAALEQSGLLD

SEQ ID NO: 162663 - protein, 14 aa, Mycobacterium tuberculosis
FVQAALEQSGLLDA

SEQ ID NO: 162664 - protein, 14 aa, Mycobacterium tuberculosis
VQAALEQSGLLDAP

SEQ ID NO: 162665 - protein, 14 aa, Mycobacterium tuberculosis
QAALEQSGLLDAPR

SEQ ID NO: 162666 - protein, 14 aa, Mycobacterium tuberculosis
AALEQSGLLDAPRT

SEQ ID NO: 162667 - protein, 14 aa, Mycobacterium tuberculosis
ALEQSGLLDAPRTQ

SEQ ID NO: 162668 - protein, 14 aa, Mycobacterium tuberculosis
LEQSGLLDAPRTQR

SEQ ID NO: 162669 - protein, 14 aa, Mycobacterium tuberculosis
EQSGLLDAPRTQRD

SEQ ID NO: 162670 - protein, 14 aa, Mycobacterium tuberculosis
QSGLLDAPRTQRDR

SEQ ID NO: 162671 - protein, 14 aa, Mycobacterium tuberculosis
SGLLDAPRTQRDRS

SEQ ID NO: 162672 - protein, 14 aa, Mycobacterium tuberculosis
GLLDAPRTQRDRSA

SEQ ID NO: 162673 - protein, 15 aa, Mycobacterium tuberculosis
MASSASDGTHERSAF

SEQ ID NO: 162674 - protein, 15 aa, Mycobacterium tuberculosis
ASSASDGTHERSAFR

SEQ ID NO: 162675 - protein, 15 aa, Mycobacterium tuberculosis
SSASDGTHERSAFRL

SEQ ID NO: 162676 - protein, 15 aa, Mycobacterium tuberculosis
SASDGTHERSAFRLS

SEQ ID NO: 162677 - protein, 15 aa, Mycobacterium tuberculosis
ASDGTHERSAFRLSP

SEQ ID NO: 162678 - protein, 15 aa, Mycobacterium tuberculosis
SDGTHERSAFRLSPP

SEQ ID NO: 162679 - protein, 15 aa, Mycobacterium tuberculosis
DGTHERSAFRLSPPV

SEQ ID NO: 162680 - protein, 15 aa, Mycobacterium tuberculosis
GTHERSAFRLSPPVL

SEQ ID NO: 162681 - protein, 15 aa, Mycobacterium tuberculosis
THERSAFRLSPPVLS

SEQ ID NO: 162682 - protein, 15 aa, Mycobacterium tuberculosis
HERSAFRLSPPVLSG

SEQ ID NO: 162683 - protein, 15 aa, Mycobacterium tuberculosis
ERSAFRLSPPVLSGA

SEQ ID NO: 162684 - protein, 15 aa, Mycobacterium tuberculosis
RSAFRLSPPVLSGAM

SEQ ID NO: 162685 - protein, 15 aa, Mycobacterium tuberculosis
SAFRLSPPVLSGAMG

SEQ ID NO: 162686 - protein, 15 aa, Mycobacterium tuberculosis
AFRLSPPVLSGAMGP

SEQ ID NO: 162687 - protein, 15 aa, Mycobacterium tuberculosis
FRLSPPVLSGAMGPF

SEQ ID NO: 162688 - protein, 15 aa, Mycobacterium tuberculosis
RLSPPVLSGAMGPFM

SEQ ID NO: 162689 - protein, 15 aa, Mycobacterium tuberculosis
LSPPVLSGAMGPFMH

SEQ ID NO: 162690 - protein, 15 aa, Mycobacterium tuberculosis
SPPVLSGAMGPFMHT

SEQ ID NO: 162691 - protein, 15 aa, Mycobacterium tuberculosis
PPVLSGAMGPFMHTG

SEQ ID NO: 162692 - protein, 15 aa, Mycobacterium tuberculosis
PVLSGAMGPFMHTGL

SEQ ID NO: 162693 - protein, 15 aa, Mycobacterium tuberculosis
VLSGAMGPFMHTGLY

SEQ ID NO: 162694 - protein, 15 aa, Mycobacterium tuberculosis
LSGAMGPFMHTGLYV

SEQ ID NO: 162695 - protein, 15 aa, Mycobacterium tuberculosis
SGAMGPFMHTGLYVA

SEQ ID NO: 162696 - protein, 15 aa, Mycobacterium tuberculosis
GAMGPFMHTGLYVAQ

SEQ ID NO: 162697 - protein, 15 aa, Mycobacterium tuberculosis
AMGPFMHTGLYVAQS

SEQ ID NO: 162698 - protein, 15 aa, Mycobacterium tuberculosis
MGPFMHTGLYVAQSW

SEQ ID NO: 162699 - protein, 15 aa, Mycobacterium tuberculosis
GPFMHTGLYVAQSWR

SEQ ID NO: 162700 - protein, 15 aa, Mycobacterium tuberculosis
PFMHTGLYVAQSWRD

SEQ ID NO: 162701 - protein, 15 aa, Mycobacterium tuberculosis
FMHTGLYVAQSWRDY

SEQ ID NO: 162702 - protein, 15 aa, Mycobacterium tuberculosis
MHTGLYVAQSWRDYL

SEQ ID NO: 162703 - protein, 15 aa, Mycobacterium tuberculosis
HTGLYVAQSWRDYLG

SEQ ID NO: 162704 - protein, 15 aa, Mycobacterium tuberculosis
TGLYVAQSWRDYLGQ

SEQ ID NO: 162705 - protein, 15 aa, Mycobacterium tuberculosis
GLYVAQSWRDYLGQQ

SEQ ID NO: 162706 - protein, 15 aa, Mycobacterium tuberculosis
LYVAQSWRDYLGQQP

SEQ ID NO: 162707 - protein, 15 aa, Mycobacterium tuberculosis
YVAQSWRDYLGQQPD

SEQ ID NO: 162708 - protein, 15 aa, Mycobacterium tuberculosis
VAQSWRDYLGQQPDK

SEQ ID NO: 162709 - protein, 15 aa, Mycobacterium tuberculosis
AQSWRDYLGQQPDKL

SEQ ID NO: 162710 - protein, 15 aa, Mycobacterium tuberculosis
QSWRDYLGQQPDKLP

SEQ ID NO: 162711 - protein, 15 aa, Mycobacterium tuberculosis
SWRDYLGQQPDKLPI

SEQ ID NO: 162712 - protein, 15 aa, Mycobacterium tuberculosis
WRDYLGQQPDKLPIA

SEQ ID NO: 162713 - protein, 15 aa, Mycobacterium tuberculosis
RDYLGQQPDKLPIAR

SEQ ID NO: 162714 - protein, 15 aa, Mycobacterium tuberculosis
DYLGQQPDKLPIARP

SEQ ID NO: 162715 - protein, 15 aa, Mycobacterium tuberculosis
YLGQQPDKLPIARPT

SEQ ID NO: 162716 - protein, 15 aa, Mycobacterium tuberculosis
LGQQPDKLPIARPTI

SEQ ID NO: 162717 - protein, 15 aa, Mycobacterium tuberculosis
GQQPDKLPIARPTIA

SEQ ID NO: 162718 - protein, 15 aa, Mycobacterium tuberculosis
QQPDKLPIARPTIAL

SEQ ID NO: 162719 - protein, 15 aa, Mycobacterium tuberculosis
QPDKLPIARPTIALA

SEQ ID NO: 162720 - protein, 15 aa, Mycobacterium tuberculosis
PDKLPIARPTIALAA

SEQ ID NO: 162721 - protein, 15 aa, Mycobacterium tuberculosis
DKLPIARPTIALAAQ

SEQ ID NO: 162722 - protein, 15 aa, Mycobacterium tuberculosis
KLPIARPTIALAAQA

SEQ ID NO: 162723 - protein, 15 aa, Mycobacterium tuberculosis
LPIARPTIALAAQAF

SEQ ID NO: 162724 - protein, 15 aa, Mycobacterium tuberculosis
PIARPTIALAAQAFR

SEQ ID NO: 162725 - protein, 15 aa, Mycobacterium tuberculosis
IARPTIALAAQAFRD

SEQ ID NO: 162726 - protein, 15 aa, Mycobacterium tuberculosis
ARPTIALAAQAFRDE

SEQ ID NO: 162727 - protein, 15 aa, Mycobacterium tuberculosis
RPTIALAAQAFRDEI

SEQ ID NO: 162728 - protein, 15 aa, Mycobacterium tuberculosis
PTIALAAQAFRDEIV

SEQ ID NO: 162729 - protein, 15 aa, Mycobacterium tuberculosis
TIALAAQAFRDEIVL

SEQ ID NO: 162730 - protein, 15 aa, Mycobacterium tuberculosis
IALAAQAFRDEIVLL

SEQ ID NO: 162731 - protein, 15 aa, Mycobacterium tuberculosis
ALAAQAFRDEIVLLG

SEQ ID NO: 162732 - protein, 15 aa, Mycobacterium tuberculosis
LAAQAFRDEIVLLGL

SEQ ID NO: 162733 - protein, 15 aa, Mycobacterium tuberculosis
AAQAFRDEIVLLGLK

SEQ ID NO: 162734 - protein, 15 aa, Mycobacterium tuberculosis
AQAFRDEIVLLGLKA

SEQ ID NO: 162735 - protein, 15 aa, Mycobacterium tuberculosis
QAFRDEIVLLGLKAR

SEQ ID NO: 162736 - protein, 15 aa, Mycobacterium tuberculosis
AFRDEIVLLGLKARR

SEQ ID NO: 162737 - protein, 15 aa, Mycobacterium tuberculosis
FRDEIVLLGLKARRP

SEQ ID NO: 162738 - protein, 15 aa, Mycobacterium tuberculosis
RDEIVLLGLKARRPV

SEQ ID NO: 162739 - protein, 15 aa, Mycobacterium tuberculosis
DEIVLLGLKARRPVS

SEQ ID NO: 162740 - protein, 15 aa, Mycobacterium tuberculosis
EIVLLGLKARRPVSN

SEQ ID NO: 162741 - protein, 15 aa, Mycobacterium tuberculosis
IVLLGLKARRPVSNH

SEQ ID NO: 162742 - protein, 15 aa, Mycobacterium tuberculosis
VLLGLKARRPVSNHR

SEQ ID NO: 162743 - protein, 15 aa, Mycobacterium tuberculosis
LLGLKARRPVSNHRV

SEQ ID NO: 162744 - protein, 15 aa, Mycobacterium tuberculosis
LGLKARRPVSNHRVF

SEQ ID NO: 162745 - protein, 15 aa, Mycobacterium tuberculosis
GLKARRPVSNHRVFE

SEQ ID NO: 162746 - protein, 15 aa, Mycobacterium tuberculosis
LKARRPVSNHRVFER

SEQ ID NO: 162747 - protein, 15 aa, Mycobacterium tuberculosis
KARRPVSNHRVFERI

SEQ ID NO: 162748 - protein, 15 aa, Mycobacterium tuberculosis
ARRPVSNHRVFERIS

SEQ ID NO: 162749 - protein, 15 aa, Mycobacterium tuberculosis
RRPVSNHRVFERISQ

SEQ ID NO: 162750 - protein, 15 aa, Mycobacterium tuberculosis
RPVSNHRVFERISQE

SEQ ID NO: 162751 - protein, 15 aa, Mycobacterium tuberculosis
PVSNHRVFERISQEV

SEQ ID NO: 162752 - protein, 15 aa, Mycobacterium tuberculosis
VSNHRVFERISQEVA

SEQ ID NO: 162753 - protein, 15 aa, Mycobacterium tuberculosis
SNHRVFERISQEVAA

SEQ ID NO: 162754 - protein, 15 aa, Mycobacterium tuberculosis
NHRVFERISQEVAAG

SEQ ID NO: 162755 - protein, 15 aa, Mycobacterium tuberculosis
HRVFERISQEVAAGL

SEQ ID NO: 162756 - protein, 15 aa, Mycobacterium tuberculosis
RVFERISQEVAAGLE

SEQ ID NO: 162757 - protein, 15 aa, Mycobacterium tuberculosis
VFERISQEVAAGLEF

SEQ ID NO: 162758 - protein, 15 aa, Mycobacterium tuberculosis
FERISQEVAAGLEFY

SEQ ID NO: 162759 - protein, 15 aa, Mycobacterium tuberculosis
ERISQEVAAGLEFYG

SEQ ID NO: 162760 - protein, 15 aa, Mycobacterium tuberculosis
RISQEVAAGLEFYGN

SEQ ID NO: 162761 - protein, 15 aa, Mycobacterium tuberculosis
ISQEVAAGLEFYGNR

SEQ ID NO: 162762 - protein, 15 aa, Mycobacterium tuberculosis
SQEVAAGLEFYGNRR

SEQ ID NO: 162763 - protein, 15 aa, Mycobacterium tuberculosis
QEVAAGLEFYGNRRW

SEQ ID NO: 162764 - protein, 15 aa, Mycobacterium tuberculosis
EVAAGLEFYGNRRWL

SEQ ID NO: 162765 - protein, 15 aa, Mycobacterium tuberculosis
VAAGLEFYGNRRWLE

SEQ ID NO: 162766 - protein, 15 aa, Mycobacterium tuberculosis
AAGLEFYGNRRWLEK

SEQ ID NO: 162767 - protein, 15 aa, Mycobacterium tuberculosis
AGLEFYGNRRWLEKP

SEQ ID NO: 162768 - protein, 15 aa, Mycobacterium tuberculosis
GLEFYGNRRWLEKPS

SEQ ID NO: 162769 - protein, 15 aa, Mycobacterium tuberculosis
LEFYGNRRWLEKPSG

SEQ ID NO: 162770 - protein, 15 aa, Mycobacterium tuberculosis
EFYGNRRWLEKPSGF

SEQ ID NO: 162771 - protein, 15 aa, Mycobacterium tuberculosis
FYGNRRWLEKPSGFF

SEQ ID NO: 162772 - protein, 15 aa, Mycobacterium tuberculosis
YGNRRWLEKPSGFFA

SEQ ID NO: 162773 - protein, 15 aa, Mycobacterium tuberculosis
GNRRWLEKPSGFFAQ

SEQ ID NO: 162774 - protein, 15 aa, Mycobacterium tuberculosis
NRRWLEKPSGFFAQP

SEQ ID NO: 162775 - protein, 15 aa, Mycobacterium tuberculosis
RRWLEKPSGFFAQPP

SEQ ID NO: 162776 - protein, 15 aa, Mycobacterium tuberculosis
RWLEKPSGFFAQPPP

SEQ ID NO: 162777 - protein, 15 aa, Mycobacterium tuberculosis
WLEKPSGFFAQPPPL

SEQ ID NO: 162778 - protein, 15 aa, Mycobacterium tuberculosis
LEKPSGFFAQPPPLT

SEQ ID NO: 162779 - protein, 15 aa, Mycobacterium tuberculosis
EKPSGFFAQPPPLTE

SEQ ID NO: 162780 - protein, 15 aa, Mycobacterium tuberculosis
KPSGFFAQPPPLTEV

SEQ ID NO: 162781 - protein, 15 aa, Mycobacterium tuberculosis
PSGFFAQPPPLTEVA

SEQ ID NO: 162782 - protein, 15 aa, Mycobacterium tuberculosis
SGFFAQPPPLTEVAV

SEQ ID NO: 162783 - protein, 15 aa, Mycobacterium tuberculosis
GFFAQPPPLTEVAVR

SEQ ID NO: 162784 - protein, 15 aa, Mycobacterium tuberculosis
FFAQPPPLTEVAVRK

SEQ ID NO: 162785 - protein, 15 aa, Mycobacterium tuberculosis
FAQPPPLTEVAVRKV

SEQ ID NO: 162786 - protein, 15 aa, Mycobacterium tuberculosis
AQPPPLTEVAVRKVK

SEQ ID NO: 162787 - protein, 15 aa, Mycobacterium tuberculosis
QPPPLTEVAVRKVKD

SEQ ID NO: 162788 - protein, 15 aa, Mycobacterium tuberculosis
PPPLTEVAVRKVKDR

SEQ ID NO: 162789 - protein, 15 aa, Mycobacterium tuberculosis
PPLTEVAVRKVKDRR

SEQ ID NO: 162790 - protein, 15 aa, Mycobacterium tuberculosis
PLTEVAVRKVKDRRR

SEQ ID NO: 162791 - protein, 15 aa, Mycobacterium tuberculosis
LTEVAVRKVKDRRRS

SEQ ID NO: 162792 - protein, 15 aa, Mycobacterium tuberculosis
TEVAVRKVKDRRRSF

SEQ ID NO: 162793 - protein, 15 aa, Mycobacterium tuberculosis
EVAVRKVKDRRRSFY

SEQ ID NO: 162794 - protein, 15 aa, Mycobacterium tuberculosis
VAVRKVKDRRRSFYR

SEQ ID NO: 162795 - protein, 15 aa, Mycobacterium tuberculosis
AVRKVKDRRRSFYRI

SEQ ID NO: 162796 - protein, 15 aa, Mycobacterium tuberculosis
VRKVKDRRRSFYRIF

SEQ ID NO: 162797 - protein, 15 aa, Mycobacterium tuberculosis
RKVKDRRRSFYRIFF

SEQ ID NO: 162798 - protein, 15 aa, Mycobacterium tuberculosis
KVKDRRRSFYRIFFD

SEQ ID NO: 162799 - protein, 15 aa, Mycobacterium tuberculosis
VKDRRRSFYRIFFDS

SEQ ID NO: 162800 - protein, 15 aa, Mycobacterium tuberculosis
KDRRRSFYRIFFDSG

SEQ ID NO: 162801 - protein, 15 aa, Mycobacterium tuberculosis
DRRRSFYRIFFDSGF

SEQ ID NO: 162802 - protein, 15 aa, Mycobacterium tuberculosis
RRRSFYRIFFDSGFT

SEQ ID NO: 162803 - protein, 15 aa, Mycobacterium tuberculosis
RRSFYRIFFDSGFTP

SEQ ID NO: 162804 - protein, 15 aa, Mycobacterium tuberculosis
RSFYRIFFDSGFTPH

SEQ ID NO: 162805 - protein, 15 aa, Mycobacterium tuberculosis
SFYRIFFDSGFTPHP

SEQ ID NO: 162806 - protein, 15 aa, Mycobacterium tuberculosis
FYRIFFDSGFTPHPG

SEQ ID NO: 162807 - protein, 15 aa, Mycobacterium tuberculosis
YRIFFDSGFTPHPGE

SEQ ID NO: 162808 - protein, 15 aa, Mycobacterium tuberculosis
RIFFDSGFTPHPGEP

SEQ ID NO: 162809 - protein, 15 aa, Mycobacterium tuberculosis
IFFDSGFTPHPGEPG

SEQ ID NO: 162810 - protein, 15 aa, Mycobacterium tuberculosis
FFDSGFTPHPGEPGS

SEQ ID NO: 162811 - protein, 15 aa, Mycobacterium tuberculosis
FDSGFTPHPGEPGSQ

SEQ ID NO: 162812 - protein, 15 aa, Mycobacterium tuberculosis
DSGFTPHPGEPGSQR

SEQ ID NO: 162813 - protein, 15 aa, Mycobacterium tuberculosis
SGFTPHPGEPGSQRW

SEQ ID NO: 162814 - protein, 15 aa, Mycobacterium tuberculosis
GFTPHPGEPGSQRWL

SEQ ID NO: 162815 - protein, 15 aa, Mycobacterium tuberculosis
FTPHPGEPGSQRWLS

SEQ ID NO: 162816 - protein, 15 aa, Mycobacterium tuberculosis
TPHPGEPGSQRWLSY

SEQ ID NO: 162817 - protein, 15 aa, Mycobacterium tuberculosis
PHPGEPGSQRWLSYT

SEQ ID NO: 162818 - protein, 15 aa, Mycobacterium tuberculosis
HPGEPGSQRWLSYTA

SEQ ID NO: 162819 - protein, 15 aa, Mycobacterium tuberculosis
PGEPGSQRWLSYTAN

SEQ ID NO: 162820 - protein, 15 aa, Mycobacterium tuberculosis
GEPGSQRWLSYTANN

SEQ ID NO: 162821 - protein, 15 aa, Mycobacterium tuberculosis
EPGSQRWLSYTANNR

SEQ ID NO: 162822 - protein, 15 aa, Mycobacterium tuberculosis
PGSQRWLSYTANNRE

SEQ ID NO: 162823 - protein, 15 aa, Mycobacterium tuberculosis
GSQRWLSYTANNREY

SEQ ID NO: 162824 - protein, 15 aa, Mycobacterium tuberculosis
SQRWLSYTANNREYA

SEQ ID NO: 162825 - protein, 15 aa, Mycobacterium tuberculosis
QRWLSYTANNREYAL

SEQ ID NO: 162826 - protein, 15 aa, Mycobacterium tuberculosis
RWLSYTANNREYALL

SEQ ID NO: 162827 - protein, 15 aa, Mycobacterium tuberculosis
WLSYTANNREYALLL

SEQ ID NO: 162828 - protein, 15 aa, Mycobacterium tuberculosis
LSYTANNREYALLLR

SEQ ID NO: 162829 - protein, 15 aa, Mycobacterium tuberculosis
SYTANNREYALLLRH

SEQ ID NO: 162830 - protein, 15 aa, Mycobacterium tuberculosis
YTANNREYALLLRHP

SEQ ID NO: 162831 - protein, 15 aa, Mycobacterium tuberculosis
TANNREYALLLRHPE

SEQ ID NO: 162832 - protein, 15 aa, Mycobacterium tuberculosis
ANNREYALLLRHPEP

SEQ ID NO: 162833 - protein, 15 aa, Mycobacterium tuberculosis
NNREYALLLRHPEPR

SEQ ID NO: 162834 - protein, 15 aa, Mycobacterium tuberculosis
NREYALLLRHPEPRP

SEQ ID NO: 162835 - protein, 15 aa, Mycobacterium tuberculosis
REYALLLRHPEPRPW

SEQ ID NO: 162836 - protein, 15 aa, Mycobacterium tuberculosis
EYALLLRHPEPRPWL

SEQ ID NO: 162837 - protein, 15 aa, Mycobacterium tuberculosis
YALLLRHPEPRPWLV

SEQ ID NO: 162838 - protein, 15 aa, Mycobacterium tuberculosis
ALLLRHPEPRPWLVC

SEQ ID NO: 162839 - protein, 15 aa, Mycobacterium tuberculosis
LLLRHPEPRPWLVCV

SEQ ID NO: 162840 - protein, 15 aa, Mycobacterium tuberculosis
LLRHPEPRPWLVCVH

SEQ ID NO: 162841 - protein, 15 aa, Mycobacterium tuberculosis
LRHPEPRPWLVCVHG

SEQ ID NO: 162842 - protein, 15 aa, Mycobacterium tuberculosis
RHPEPRPWLVCVHGT

SEQ ID NO: 162843 - protein, 15 aa, Mycobacterium tuberculosis
HPEPRPWLVCVHGTE

SEQ ID NO: 162844 - protein, 15 aa, Mycobacterium tuberculosis
PEPRPWLVCVHGTEM

SEQ ID NO: 162845 - protein, 15 aa, Mycobacterium tuberculosis
EPRPWLVCVHGTEMG

SEQ ID NO: 162846 - protein, 15 aa, Mycobacterium tuberculosis
PRPWLVCVHGTEMGR

SEQ ID NO: 162847 - protein, 15 aa, Mycobacterium tuberculosis
RPWLVCVHGTEMGRA

SEQ ID NO: 162848 - protein, 15 aa, Mycobacterium tuberculosis
PWLVCVHGTEMGRAP

SEQ ID NO: 162849 - protein, 15 aa, Mycobacterium tuberculosis
WLVCVHGTEMGRAPL

SEQ ID NO: 162850 - protein, 15 aa, Mycobacterium tuberculosis
LVCVHGTEMGRAPLD

SEQ ID NO: 162851 - protein, 15 aa, Mycobacterium tuberculosis
VCVHGTEMGRAPLDL

SEQ ID NO: 162852 - protein, 15 aa, Mycobacterium tuberculosis
CVHGTEMGRAPLDLA

SEQ ID NO: 162853 - protein, 15 aa, Mycobacterium tuberculosis
VHGTEMGRAPLDLAV

SEQ ID NO: 162854 - protein, 15 aa, Mycobacterium tuberculosis
HGTEMGRAPLDLAVF

SEQ ID NO: 162855 - protein, 15 aa, Mycobacterium tuberculosis
GTEMGRAPLDLAVFR

SEQ ID NO: 162856 - protein, 15 aa, Mycobacterium tuberculosis
TEMGRAPLDLAVFRA

SEQ ID NO: 162857 - protein, 15 aa, Mycobacterium tuberculosis
EMGRAPLDLAVFRAW

SEQ ID NO: 162858 - protein, 15 aa, Mycobacterium tuberculosis
MGRAPLDLAVFRAWK

SEQ ID NO: 162859 - protein, 15 aa, Mycobacterium tuberculosis
GRAPLDLAVFRAWKL

SEQ ID NO: 162860 - protein, 15 aa, Mycobacterium tuberculosis
RAPLDLAVFRAWKLH

SEQ ID NO: 162861 - protein, 15 aa, Mycobacterium tuberculosis
APLDLAVFRAWKLHD

SEQ ID NO: 162862 - protein, 15 aa, Mycobacterium tuberculosis
PLDLAVFRAWKLHDE

SEQ ID NO: 162863 - protein, 15 aa, Mycobacterium tuberculosis
LDLAVFRAWKLHDEL

SEQ ID NO: 162864 - protein, 15 aa, Mycobacterium tuberculosis
DLAVFRAWKLHDELG

SEQ ID NO: 162865 - protein, 15 aa, Mycobacterium tuberculosis
LAVFRAWKLHDELGL

SEQ ID NO: 162866 - protein, 15 aa, Mycobacterium tuberculosis
AVFRAWKLHDELGLN

SEQ ID NO: 162867 - protein, 15 aa, Mycobacterium tuberculosis
VFRAWKLHDELGLNI

SEQ ID NO: 162868 - protein, 15 aa, Mycobacterium tuberculosis
FRAWKLHDELGLNIV

SEQ ID NO: 162869 - protein, 15 aa, Mycobacterium tuberculosis
RAWKLHDELGLNIVM

SEQ ID NO: 162870 - protein, 15 aa, Mycobacterium tuberculosis
AWKLHDELGLNIVMP

SEQ ID NO: 162871 - protein, 15 aa, Mycobacterium tuberculosis
WKLHDELGLNIVMPV

SEQ ID NO: 162872 - protein, 15 aa, Mycobacterium tuberculosis
KLHDELGLNIVMPVL

SEQ ID NO: 162873 - protein, 15 aa, Mycobacterium tuberculosis
LHDELGLNIVMPVLP

SEQ ID NO: 162874 - protein, 15 aa, Mycobacterium tuberculosis
HDELGLNIVMPVLPM

SEQ ID NO: 162875 - protein, 15 aa, Mycobacterium tuberculosis
DELGLNIVMPVLPMH

SEQ ID NO: 162876 - protein, 15 aa, Mycobacterium tuberculosis
ELGLNIVMPVLPMHG

SEQ ID NO: 162877 - protein, 15 aa, Mycobacterium tuberculosis
LGLNIVMPVLPMHGP

SEQ ID NO: 162878 - protein, 15 aa, Mycobacterium tuberculosis
GLNIVMPVLPMHGPR

SEQ ID NO: 162879 - protein, 15 aa, Mycobacterium tuberculosis
LNIVMPVLPMHGPRG

SEQ ID NO: 162880 - protein, 15 aa, Mycobacterium tuberculosis
NIVMPVLPMHGPRGQ

SEQ ID NO: 162881 - protein, 15 aa, Mycobacterium tuberculosis
IVMPVLPMHGPRGQG

SEQ ID NO: 162882 - protein, 15 aa, Mycobacterium tuberculosis
VMPVLPMHGPRGQGL

SEQ ID NO: 162883 - protein, 15 aa, Mycobacterium tuberculosis
MPVLPMHGPRGQGLP

SEQ ID NO: 162884 - protein, 15 aa, Mycobacterium tuberculosis
PVLPMHGPRGQGLPK

SEQ ID NO: 162885 - protein, 15 aa, Mycobacterium tuberculosis
VLPMHGPRGQGLPKG

SEQ ID NO: 162886 - protein, 15 aa, Mycobacterium tuberculosis
LPMHGPRGQGLPKGA

SEQ ID NO: 162887 - protein, 15 aa, Mycobacterium tuberculosis
PMHGPRGQGLPKGAV

SEQ ID NO: 162888 - protein, 15 aa, Mycobacterium tuberculosis
MHGPRGQGLPKGAVF

SEQ ID NO: 162889 - protein, 15 aa, Mycobacterium tuberculosis
HGPRGQGLPKGAVFP

SEQ ID NO: 162890 - protein, 15 aa, Mycobacterium tuberculosis
GPRGQGLPKGAVFPG

SEQ ID NO: 162891 - protein, 15 aa, Mycobacterium tuberculosis
PRGQGLPKGAVFPGE

SEQ ID NO: 162892 - protein, 15 aa, Mycobacterium tuberculosis
RGQGLPKGAVFPGED

SEQ ID NO: 162893 - protein, 15 aa, Mycobacterium tuberculosis
GQGLPKGAVFPGEDV

SEQ ID NO: 162894 - protein, 15 aa, Mycobacterium tuberculosis
QGLPKGAVFPGEDVL

SEQ ID NO: 162895 - protein, 15 aa, Mycobacterium tuberculosis
GLPKGAVFPGEDVLD

SEQ ID NO: 162896 - protein, 15 aa, Mycobacterium tuberculosis
LPKGAVFPGEDVLDD

SEQ ID NO: 162897 - protein, 15 aa, Mycobacterium tuberculosis
PKGAVFPGEDVLDDV

SEQ ID NO: 162898 - protein, 15 aa, Mycobacterium tuberculosis
KGAVFPGEDVLDDVH

SEQ ID NO: 162899 - protein, 15 aa, Mycobacterium tuberculosis
GAVFPGEDVLDDVHG

SEQ ID NO: 162900 - protein, 15 aa, Mycobacterium tuberculosis
AVFPGEDVLDDVHGT

SEQ ID NO: 162901 - protein, 15 aa, Mycobacterium tuberculosis
VFPGEDVLDDVHGTA

SEQ ID NO: 162902 - protein, 15 aa, Mycobacterium tuberculosis
FPGEDVLDDVHGTAQ

SEQ ID NO: 162903 - protein, 15 aa, Mycobacterium tuberculosis
PGEDVLDDVHGTAQA

SEQ ID NO: 162904 - protein, 15 aa, Mycobacterium tuberculosis
GEDVLDDVHGTAQAV

SEQ ID NO: 162905 - protein, 15 aa, Mycobacterium tuberculosis
EDVLDDVHGTAQAVW

SEQ ID NO: 162906 - protein, 15 aa, Mycobacterium tuberculosis
DVLDDVHGTAQAVWD

SEQ ID NO: 162907 - protein, 15 aa, Mycobacterium tuberculosis
VLDDVHGTAQAVWDI

SEQ ID NO: 162908 - protein, 15 aa, Mycobacterium tuberculosis
LDDVHGTAQAVWDIR

SEQ ID NO: 162909 - protein, 15 aa, Mycobacterium tuberculosis
DDVHGTAQAVWDIRR

SEQ ID NO: 162910 - protein, 15 aa, Mycobacterium tuberculosis
DVHGTAQAVWDIRRL

SEQ ID NO: 162911 - protein, 15 aa, Mycobacterium tuberculosis
VHGTAQAVWDIRRLL

SEQ ID NO: 162912 - protein, 15 aa, Mycobacterium tuberculosis
HGTAQAVWDIRRLLS

SEQ ID NO: 162913 - protein, 15 aa, Mycobacterium tuberculosis
GTAQAVWDIRRLLSW

SEQ ID NO: 162914 - protein, 15 aa, Mycobacterium tuberculosis
TAQAVWDIRRLLSWI

SEQ ID NO: 162915 - protein, 15 aa, Mycobacterium tuberculosis
AQAVWDIRRLLSWIR

SEQ ID NO: 162916 - protein, 15 aa, Mycobacterium tuberculosis
QAVWDIRRLLSWIRS

SEQ ID NO: 162917 - protein, 15 aa, Mycobacterium tuberculosis
AVWDIRRLLSWIRSQ

SEQ ID NO: 162918 - protein, 15 aa, Mycobacterium tuberculosis
VWDIRRLLSWIRSQE

SEQ ID NO: 162919 - protein, 15 aa, Mycobacterium tuberculosis
WDIRRLLSWIRSQEE

SEQ ID NO: 162920 - protein, 15 aa, Mycobacterium tuberculosis
DIRRLLSWIRSQEEE

SEQ ID NO: 162921 - protein, 15 aa, Mycobacterium tuberculosis
IRRLLSWIRSQEEES

SEQ ID NO: 162922 - protein, 15 aa, Mycobacterium tuberculosis
RRLLSWIRSQEEESL

SEQ ID NO: 162923 - protein, 15 aa, Mycobacterium tuberculosis
RLLSWIRSQEEESLI

SEQ ID NO: 162924 - protein, 15 aa, Mycobacterium tuberculosis
LLSWIRSQEEESLIG

SEQ ID NO: 162925 - protein, 15 aa, Mycobacterium tuberculosis
LSWIRSQEEESLIGL

SEQ ID NO: 162926 - protein, 15 aa, Mycobacterium tuberculosis
SWIRSQEEESLIGLN

SEQ ID NO: 162927 - protein, 15 aa, Mycobacterium tuberculosis
WIRSQEEESLIGLNG

SEQ ID NO: 162928 - protein, 15 aa, Mycobacterium tuberculosis
IRSQEEESLIGLNGL

SEQ ID NO: 162929 - protein, 15 aa, Mycobacterium tuberculosis
RSQEEESLIGLNGLS

SEQ ID NO: 162930 - protein, 15 aa, Mycobacterium tuberculosis
SQEEESLIGLNGLSL

SEQ ID NO: 162931 - protein, 15 aa, Mycobacterium tuberculosis
QEEESLIGLNGLSLG

SEQ ID NO: 162932 - protein, 15 aa, Mycobacterium tuberculosis
EEESLIGLNGLSLGG

SEQ ID NO: 162933 - protein, 15 aa, Mycobacterium tuberculosis
EESLIGLNGLSLGGY

SEQ ID NO: 162934 - protein, 15 aa, Mycobacterium tuberculosis
ESLIGLNGLSLGGYI

SEQ ID NO: 162935 - protein, 15 aa, Mycobacterium tuberculosis
SLIGLNGLSLGGYIA

SEQ ID NO: 162936 - protein, 15 aa, Mycobacterium tuberculosis
LIGLNGLSLGGYIAS

SEQ ID NO: 162937 - protein, 15 aa, Mycobacterium tuberculosis
IGLNGLSLGGYIASL

SEQ ID NO: 162938 - protein, 15 aa, Mycobacterium tuberculosis
GLNGLSLGGYIASLV

SEQ ID NO: 162939 - protein, 15 aa, Mycobacterium tuberculosis
LNGLSLGGYIASLVA

SEQ ID NO: 162940 - protein, 15 aa, Mycobacterium tuberculosis
NGLSLGGYIASLVAS

SEQ ID NO: 162941 - protein, 15 aa, Mycobacterium tuberculosis
GLSLGGYIASLVASL

SEQ ID NO: 162942 - protein, 15 aa, Mycobacterium tuberculosis
LSLGGYIASLVASLE

SEQ ID NO: 162943 - protein, 15 aa, Mycobacterium tuberculosis
SLGGYIASLVASLEE

SEQ ID NO: 162944 - protein, 15 aa, Mycobacterium tuberculosis
LGGYIASLVASLEEG

SEQ ID NO: 162945 - protein, 15 aa, Mycobacterium tuberculosis
GGYIASLVASLEEGL

SEQ ID NO: 162946 - protein, 15 aa, Mycobacterium tuberculosis
GYIASLVASLEEGLA

SEQ ID NO: 162947 - protein, 15 aa, Mycobacterium tuberculosis
YIASLVASLEEGLAC

SEQ ID NO: 162948 - protein, 15 aa, Mycobacterium tuberculosis
IASLVASLEEGLACA

SEQ ID NO: 162949 - protein, 15 aa, Mycobacterium tuberculosis
ASLVASLEEGLACAI

SEQ ID NO: 162950 - protein, 15 aa, Mycobacterium tuberculosis
SLVASLEEGLACAIL

SEQ ID NO: 162951 - protein, 15 aa, Mycobacterium tuberculosis
LVASLEEGLACAILG

SEQ ID NO: 162952 - protein, 15 aa, Mycobacterium tuberculosis
VASLEEGLACAILGV

SEQ ID NO: 162953 - protein, 15 aa, Mycobacterium tuberculosis
ASLEEGLACAILGVP

SEQ ID NO: 162954 - protein, 15 aa, Mycobacterium tuberculosis
SLEEGLACAILGVPV

SEQ ID NO: 162955 - protein, 15 aa, Mycobacterium tuberculosis
LEEGLACAILGVPVA

SEQ ID NO: 162956 - protein, 15 aa, Mycobacterium tuberculosis
EEGLACAILGVPVAD

SEQ ID NO: 162957 - protein, 15 aa, Mycobacterium tuberculosis
EGLACAILGVPVADL

SEQ ID NO: 162958 - protein, 15 aa, Mycobacterium tuberculosis
GLACAILGVPVADLI

SEQ ID NO: 162959 - protein, 15 aa, Mycobacterium tuberculosis
LACAILGVPVADLIE

SEQ ID NO: 162960 - protein, 15 aa, Mycobacterium tuberculosis
ACAILGVPVADLIEL

SEQ ID NO: 162961 - protein, 15 aa, Mycobacterium tuberculosis
CAILGVPVADLIELL

SEQ ID NO: 162962 - protein, 15 aa, Mycobacterium tuberculosis
AILGVPVADLIELLG

SEQ ID NO: 162963 - protein, 15 aa, Mycobacterium tuberculosis
ILGVPVADLIELLGR

SEQ ID NO: 162964 - protein, 15 aa, Mycobacterium tuberculosis
LGVPVADLIELLGRH

SEQ ID NO: 162965 - protein, 15 aa, Mycobacterium tuberculosis
GVPVADLIELLGRHC

SEQ ID NO: 162966 - protein, 15 aa, Mycobacterium tuberculosis
VPVADLIELLGRHCG

SEQ ID NO: 162967 - protein, 15 aa, Mycobacterium tuberculosis
PVADLIELLGRHCGL

SEQ ID NO: 162968 - protein, 15 aa, Mycobacterium tuberculosis
VADLIELLGRHCGLR

SEQ ID NO: 162969 - protein, 15 aa, Mycobacterium tuberculosis
ADLIELLGRHCGLRH

SEQ ID NO: 162970 - protein, 15 aa, Mycobacterium tuberculosis
DLIELLGRHCGLRHK

SEQ ID NO: 162971 - protein, 15 aa, Mycobacterium tuberculosis
LIELLGRHCGLRHKD

SEQ ID NO: 162972 - protein, 15 aa, Mycobacterium tuberculosis
IELLGRHCGLRHKDP

SEQ ID NO: 162973 - protein, 15 aa, Mycobacterium tuberculosis
ELLGRHCGLRHKDPR

SEQ ID NO: 162974 - protein, 15 aa, Mycobacterium tuberculosis
LLGRHCGLRHKDPRR

SEQ ID NO: 162975 - protein, 15 aa, Mycobacterium tuberculosis
LGRHCGLRHKDPRRH

SEQ ID NO: 162976 - protein, 15 aa, Mycobacterium tuberculosis
GRHCGLRHKDPRRHT

SEQ ID NO: 162977 - protein, 15 aa, Mycobacterium tuberculosis
RHCGLRHKDPRRHTV

SEQ ID NO: 162978 - protein, 15 aa, Mycobacterium tuberculosis
HCGLRHKDPRRHTVK

SEQ ID NO: 162979 - protein, 15 aa, Mycobacterium tuberculosis
CGLRHKDPRRHTVKM

SEQ ID NO: 162980 - protein, 15 aa, Mycobacterium tuberculosis
GLRHKDPRRHTVKMA

SEQ ID NO: 162981 - protein, 15 aa, Mycobacterium tuberculosis
LRHKDPRRHTVKMAE

SEQ ID NO: 162982 - protein, 15 aa, Mycobacterium tuberculosis
RHKDPRRHTVKMAEP

SEQ ID NO: 162983 - protein, 15 aa, Mycobacterium tuberculosis
HKDPRRHTVKMAEPI

SEQ ID NO: 162984 - protein, 15 aa, Mycobacterium tuberculosis
KDPRRHTVKMAEPIG

SEQ ID NO: 162985 - protein, 15 aa, Mycobacterium tuberculosis
DPRRHTVKMAEPIGR

SEQ ID NO: 162986 - protein, 15 aa, Mycobacterium tuberculosis
PRRHTVKMAEPIGRM

SEQ ID NO: 162987 - protein, 15 aa, Mycobacterium tuberculosis
RRHTVKMAEPIGRMI

SEQ ID NO: 162988 - protein, 15 aa, Mycobacterium tuberculosis
RHTVKMAEPIGRMIS

SEQ ID NO: 162989 - protein, 15 aa, Mycobacterium tuberculosis
HTVKMAEPIGRMISP

SEQ ID NO: 162990 - protein, 15 aa, Mycobacterium tuberculosis
TVKMAEPIGRMISPL

SEQ ID NO: 162991 - protein, 15 aa, Mycobacterium tuberculosis
VKMAEPIGRMISPLS

SEQ ID NO: 162992 - protein, 15 aa, Mycobacterium tuberculosis
KMAEPIGRMISPLSL

SEQ ID NO: 162993 - protein, 15 aa, Mycobacterium tuberculosis
MAEPIGRMISPLSLT

SEQ ID NO: 162994 - protein, 15 aa, Mycobacterium tuberculosis
AEPIGRMISPLSLTP

SEQ ID NO: 162995 - protein, 15 aa, Mycobacterium tuberculosis
EPIGRMISPLSLTPL

SEQ ID NO: 162996 - protein, 15 aa, Mycobacterium tuberculosis
PIGRMISPLSLTPLV

SEQ ID NO: 162997 - protein, 15 aa, Mycobacterium tuberculosis
IGRMISPLSLTPLVP

SEQ ID NO: 162998 - protein, 15 aa, Mycobacterium tuberculosis
GRMISPLSLTPLVPM

SEQ ID NO: 162999 - protein, 15 aa, Mycobacterium tuberculosis
RMISPLSLTPLVPMP

SEQ ID NO: 163000 - protein, 15 aa, Mycobacterium tuberculosis
MISPLSLTPLVPMPG

SEQ ID NO: 163001 - protein, 15 aa, Mycobacterium tuberculosis
ISPLSLTPLVPMPGR

SEQ ID NO: 163002 - protein, 15 aa, Mycobacterium tuberculosis
SPLSLTPLVPMPGRF

SEQ ID NO: 163003 - protein, 15 aa, Mycobacterium tuberculosis
PLSLTPLVPMPGRFI

SEQ ID NO: 163004 - protein, 15 aa, Mycobacterium tuberculosis
LSLTPLVPMPGRFIY

SEQ ID NO: 163005 - protein, 15 aa, Mycobacterium tuberculosis
SLTPLVPMPGRFIYA

SEQ ID NO: 163006 - protein, 15 aa, Mycobacterium tuberculosis
LTPLVPMPGRFIYAG

SEQ ID NO: 163007 - protein, 15 aa, Mycobacterium tuberculosis
TPLVPMPGRFIYAGI

SEQ ID NO: 163008 - protein, 15 aa, Mycobacterium tuberculosis
PLVPMPGRFIYAGIA

SEQ ID NO: 163009 - protein, 15 aa, Mycobacterium tuberculosis
LVPMPGRFIYAGIAD

SEQ ID NO: 163010 - protein, 15 aa, Mycobacterium tuberculosis
VPMPGRFIYAGIADR

SEQ ID NO: 163011 - protein, 15 aa, Mycobacterium tuberculosis
PMPGRFIYAGIADRL

SEQ ID NO: 163012 - protein, 15 aa, Mycobacterium tuberculosis
MPGRFIYAGIADRLV

SEQ ID NO: 163013 - protein, 15 aa, Mycobacterium tuberculosis
PGRFIYAGIADRLVH

SEQ ID NO: 163014 - protein, 15 aa, Mycobacterium tuberculosis
GRFIYAGIADRLVHP

SEQ ID NO: 163015 - protein, 15 aa, Mycobacterium tuberculosis
RFIYAGIADRLVHPR

SEQ ID NO: 163016 - protein, 15 aa, Mycobacterium tuberculosis
FIYAGIADRLVHPRE

SEQ ID NO: 163017 - protein, 15 aa, Mycobacterium tuberculosis
IYAGIADRLVHPREQ

SEQ ID NO: 163018 - protein, 15 aa, Mycobacterium tuberculosis
YAGIADRLVHPREQV

SEQ ID NO: 163019 - protein, 15 aa, Mycobacterium tuberculosis
AGIADRLVHPREQVT

SEQ ID NO: 163020 - protein, 15 aa, Mycobacterium tuberculosis
GIADRLVHPREQVTR

SEQ ID NO: 163021 - protein, 15 aa, Mycobacterium tuberculosis
IADRLVHPREQVTRL

SEQ ID NO: 163022 - protein, 15 aa, Mycobacterium tuberculosis
ADRLVHPREQVTRLW

SEQ ID NO: 163023 - protein, 15 aa, Mycobacterium tuberculosis
DRLVHPREQVTRLWE

SEQ ID NO: 163024 - protein, 15 aa, Mycobacterium tuberculosis
RLVHPREQVTRLWEH

SEQ ID NO: 163025 - protein, 15 aa, Mycobacterium tuberculosis
LVHPREQVTRLWEHW

SEQ ID NO: 163026 - protein, 15 aa, Mycobacterium tuberculosis
VHPREQVTRLWEHWG

SEQ ID NO: 163027 - protein, 15 aa, Mycobacterium tuberculosis
HPREQVTRLWEHWGK

SEQ ID NO: 163028 - protein, 15 aa, Mycobacterium tuberculosis
PREQVTRLWEHWGKP

SEQ ID NO: 163029 - protein, 15 aa, Mycobacterium tuberculosis
REQVTRLWEHWGKPE

SEQ ID NO: 163030 - protein, 15 aa, Mycobacterium tuberculosis
EQVTRLWEHWGKPEI

SEQ ID NO: 163031 - protein, 15 aa, Mycobacterium tuberculosis
QVTRLWEHWGKPEIV

SEQ ID NO: 163032 - protein, 15 aa, Mycobacterium tuberculosis
VTRLWEHWGKPEIVW

SEQ ID NO: 163033 - protein, 15 aa, Mycobacterium tuberculosis
TRLWEHWGKPEIVWY

SEQ ID NO: 163034 - protein, 15 aa, Mycobacterium tuberculosis
RLWEHWGKPEIVWYP

SEQ ID NO: 163035 - protein, 15 aa, Mycobacterium tuberculosis
LWEHWGKPEIVWYPG

SEQ ID NO: 163036 - protein, 15 aa, Mycobacterium tuberculosis
WEHWGKPEIVWYPGG

SEQ ID NO: 163037 - protein, 15 aa, Mycobacterium tuberculosis
EHWGKPEIVWYPGGH

SEQ ID NO: 163038 - protein, 15 aa, Mycobacterium tuberculosis
HWGKPEIVWYPGGHT

SEQ ID NO: 163039 - protein, 15 aa, Mycobacterium tuberculosis
WGKPEIVWYPGGHTG

SEQ ID NO: 163040 - protein, 15 aa, Mycobacterium tuberculosis
GKPEIVWYPGGHTGF

SEQ ID NO: 163041 - protein, 15 aa, Mycobacterium tuberculosis
KPEIVWYPGGHTGFF

SEQ ID NO: 163042 - protein, 15 aa, Mycobacterium tuberculosis
PEIVWYPGGHTGFFQ

SEQ ID NO: 163043 - protein, 15 aa, Mycobacterium tuberculosis
EIVWYPGGHTGFFQS

SEQ ID NO: 163044 - protein, 15 aa, Mycobacterium tuberculosis
IVWYPGGHTGFFQSR

SEQ ID NO: 163045 - protein, 15 aa, Mycobacterium tuberculosis
VWYPGGHTGFFQSRP

SEQ ID NO: 163046 - protein, 15 aa, Mycobacterium tuberculosis
WYPGGHTGFFQSRPV

SEQ ID NO: 163047 - protein, 15 aa, Mycobacterium tuberculosis
YPGGHTGFFQSRPVR

SEQ ID NO: 163048 - protein, 15 aa, Mycobacterium tuberculosis
PGGHTGFFQSRPVRR

SEQ ID NO: 163049 - protein, 15 aa, Mycobacterium tuberculosis
GGHTGFFQSRPVRRF

SEQ ID NO: 163050 - protein, 15 aa, Mycobacterium tuberculosis
GHTGFFQSRPVRRFV

SEQ ID NO: 163051 - protein, 15 aa, Mycobacterium tuberculosis
HTGFFQSRPVRRFVQ

SEQ ID NO: 163052 - protein, 15 aa, Mycobacterium tuberculosis
TGFFQSRPVRRFVQA

SEQ ID NO: 163053 - protein, 15 aa, Mycobacterium tuberculosis
GFFQSRPVRRFVQAA

SEQ ID NO: 163054 - protein, 15 aa, Mycobacterium tuberculosis
FFQSRPVRRFVQAAL

SEQ ID NO: 163055 - protein, 15 aa, Mycobacterium tuberculosis
FQSRPVRRFVQAALE

SEQ ID NO: 163056 - protein, 15 aa, Mycobacterium tuberculosis
QSRPVRRFVQAALEQ

SEQ ID NO: 163057 - protein, 15 aa, Mycobacterium tuberculosis
SRPVRRFVQAALEQS

SEQ ID NO: 163058 - protein, 15 aa, Mycobacterium tuberculosis
RPVRRFVQAALEQSG

SEQ ID NO: 163059 - protein, 15 aa, Mycobacterium tuberculosis
PVRRFVQAALEQSGL

SEQ ID NO: 163060 - protein, 15 aa, Mycobacterium tuberculosis
VRRFVQAALEQSGLL

SEQ ID NO: 163061 - protein, 15 aa, Mycobacterium tuberculosis
RRFVQAALEQSGLLD

SEQ ID NO: 163062 - protein, 15 aa, Mycobacterium tuberculosis
RFVQAALEQSGLLDA

SEQ ID NO: 163063 - protein, 15 aa, Mycobacterium tuberculosis
FVQAALEQSGLLDAP

SEQ ID NO: 163064 - protein, 15 aa, Mycobacterium tuberculosis
VQAALEQSGLLDAPR

SEQ ID NO: 163065 - protein, 15 aa, Mycobacterium tuberculosis
QAALEQSGLLDAPRT

SEQ ID NO: 163066 - protein, 15 aa, Mycobacterium tuberculosis
AALEQSGLLDAPRTQ

SEQ ID NO: 163067 - protein, 15 aa, Mycobacterium tuberculosis
ALEQSGLLDAPRTQR

SEQ ID NO: 163068 - protein, 15 aa, Mycobacterium tuberculosis
LEQSGLLDAPRTQRD

SEQ ID NO: 163069 - protein, 15 aa, Mycobacterium tuberculosis
EQSGLLDAPRTQRDR

SEQ ID NO: 163070 - protein, 15 aa, Mycobacterium tuberculosis
QSGLLDAPRTQRDRS

SEQ ID NO: 163071 - protein, 15 aa, Mycobacterium tuberculosis
SGLLDAPRTQRDRSA

SEQ ID NO: 163072 - protein, 16 aa, Mycobacterium tuberculosis
MASSASDGTHERSAFR

SEQ ID NO: 163073 - protein, 16 aa, Mycobacterium tuberculosis
ASSASDGTHERSAFRL

SEQ ID NO: 163074 - protein, 16 aa, Mycobacterium tuberculosis
SSASDGTHERSAFRLS

SEQ ID NO: 163075 - protein, 16 aa, Mycobacterium tuberculosis
SASDGTHERSAFRLSP

SEQ ID NO: 163076 - protein, 16 aa, Mycobacterium tuberculosis
ASDGTHERSAFRLSPP

SEQ ID NO: 163077 - protein, 16 aa, Mycobacterium tuberculosis
SDGTHERSAFRLSPPV

SEQ ID NO: 163078 - protein, 16 aa, Mycobacterium tuberculosis
DGTHERSAFRLSPPVL

SEQ ID NO: 163079 - protein, 16 aa, Mycobacterium tuberculosis
GTHERSAFRLSPPVLS

SEQ ID NO: 163080 - protein, 16 aa, Mycobacterium tuberculosis
THERSAFRLSPPVLSG

SEQ ID NO: 163081 - protein, 16 aa, Mycobacterium tuberculosis
HERSAFRLSPPVLSGA

SEQ ID NO: 163082 - protein, 16 aa, Mycobacterium tuberculosis
ERSAFRLSPPVLSGAM

SEQ ID NO: 163083 - protein, 16 aa, Mycobacterium tuberculosis
RSAFRLSPPVLSGAMG

SEQ ID NO: 163084 - protein, 16 aa, Mycobacterium tuberculosis
SAFRLSPPVLSGAMGP

SEQ ID NO: 163085 - protein, 16 aa, Mycobacterium tuberculosis
AFRLSPPVLSGAMGPF

SEQ ID NO: 163086 - protein, 16 aa, Mycobacterium tuberculosis
FRLSPPVLSGAMGPFM

SEQ ID NO: 163087 - protein, 16 aa, Mycobacterium tuberculosis
RLSPPVLSGAMGPFMH

SEQ ID NO: 163088 - protein, 16 aa, Mycobacterium tuberculosis
LSPPVLSGAMGPFMHT

SEQ ID NO: 163089 - protein, 16 aa, Mycobacterium tuberculosis
SPPVLSGAMGPFMHTG

SEQ ID NO: 163090 - protein, 16 aa, Mycobacterium tuberculosis
PPVLSGAMGPFMHTGL

SEQ ID NO: 163091 - protein, 16 aa, Mycobacterium tuberculosis
PVLSGAMGPFMHTGLY

SEQ ID NO: 163092 - protein, 16 aa, Mycobacterium tuberculosis
VLSGAMGPFMHTGLYV

SEQ ID NO: 163093 - protein, 16 aa, Mycobacterium tuberculosis
LSGAMGPFMHTGLYVA

SEQ ID NO: 163094 - protein, 16 aa, Mycobacterium tuberculosis
SGAMGPFMHTGLYVAQ

SEQ ID NO: 163095 - protein, 16 aa, Mycobacterium tuberculosis
GAMGPFMHTGLYVAQS

SEQ ID NO: 163096 - protein, 16 aa, Mycobacterium tuberculosis
AMGPFMHTGLYVAQSW

SEQ ID NO: 163097 - protein, 16 aa, Mycobacterium tuberculosis
MGPFMHTGLYVAQSWR

SEQ ID NO: 163098 - protein, 16 aa, Mycobacterium tuberculosis
GPFMHTGLYVAQSWRD

SEQ ID NO: 163099 - protein, 16 aa, Mycobacterium tuberculosis
PFMHTGLYVAQSWRDY

SEQ ID NO: 163100 - protein, 16 aa, Mycobacterium tuberculosis
FMHTGLYVAQSWRDYL

SEQ ID NO: 163101 - protein, 16 aa, Mycobacterium tuberculosis
MHTGLYVAQSWRDYLG

SEQ ID NO: 163102 - protein, 16 aa, Mycobacterium tuberculosis
HTGLYVAQSWRDYLGQ

SEQ ID NO: 163103 - protein, 16 aa, Mycobacterium tuberculosis
TGLYVAQSWRDYLGQQ

SEQ ID NO: 163104 - protein, 16 aa, Mycobacterium tuberculosis
GLYVAQSWRDYLGQQP

SEQ ID NO: 163105 - protein, 16 aa, Mycobacterium tuberculosis
LYVAQSWRDYLGQQPD

SEQ ID NO: 163106 - protein, 16 aa, Mycobacterium tuberculosis
YVAQSWRDYLGQQPDK

SEQ ID NO: 163107 - protein, 16 aa, Mycobacterium tuberculosis
VAQSWRDYLGQQPDKL

SEQ ID NO: 163108 - protein, 16 aa, Mycobacterium tuberculosis
AQSWRDYLGQQPDKLP

SEQ ID NO: 163109 - protein, 16 aa, Mycobacterium tuberculosis
QSWRDYLGQQPDKLPI

SEQ ID NO: 163110 - protein, 16 aa, Mycobacterium tuberculosis
SWRDYLGQQPDKLPIA

SEQ ID NO: 163111 - protein, 16 aa, Mycobacterium tuberculosis
WRDYLGQQPDKLPIAR

SEQ ID NO: 163112 - protein, 16 aa, Mycobacterium tuberculosis
RDYLGQQPDKLPIARP

SEQ ID NO: 163113 - protein, 16 aa, Mycobacterium tuberculosis
DYLGQQPDKLPIARPT

SEQ ID NO: 163114 - protein, 16 aa, Mycobacterium tuberculosis
YLGQQPDKLPIARPTI

SEQ ID NO: 163115 - protein, 16 aa, Mycobacterium tuberculosis
LGQQPDKLPIARPTIA

SEQ ID NO: 163116 - protein, 16 aa, Mycobacterium tuberculosis
GQQPDKLPIARPTIAL

SEQ ID NO: 163117 - protein, 16 aa, Mycobacterium tuberculosis
QQPDKLPIARPTIALA

SEQ ID NO: 163118 - protein, 16 aa, Mycobacterium tuberculosis
QPDKLPIARPTIALAA

SEQ ID NO: 163119 - protein, 16 aa, Mycobacterium tuberculosis
PDKLPIARPTIALAAQ

SEQ ID NO: 163120 - protein, 16 aa, Mycobacterium tuberculosis
DKLPIARPTIALAAQA

SEQ ID NO: 163121 - protein, 16 aa, Mycobacterium tuberculosis
KLPIARPTIALAAQAF

SEQ ID NO: 163122 - protein, 16 aa, Mycobacterium tuberculosis
LPIARPTIALAAQAFR

SEQ ID NO: 163123 - protein, 16 aa, Mycobacterium tuberculosis
PIARPTIALAAQAFRD

SEQ ID NO: 163124 - protein, 16 aa, Mycobacterium tuberculosis
IARPTIALAAQAFRDE

SEQ ID NO: 163125 - protein, 16 aa, Mycobacterium tuberculosis
ARPTIALAAQAFRDEI

SEQ ID NO: 163126 - protein, 16 aa, Mycobacterium tuberculosis
RPTIALAAQAFRDEIV

SEQ ID NO: 163127 - protein, 16 aa, Mycobacterium tuberculosis
PTIALAAQAFRDEIVL

SEQ ID NO: 163128 - protein, 16 aa, Mycobacterium tuberculosis
TIALAAQAFRDEIVLL

SEQ ID NO: 163129 - protein, 16 aa, Mycobacterium tuberculosis
IALAAQAFRDEIVLLG

SEQ ID NO: 163130 - protein, 16 aa, Mycobacterium tuberculosis
ALAAQAFRDEIVLLGL

SEQ ID NO: 163131 - protein, 16 aa, Mycobacterium tuberculosis
LAAQAFRDEIVLLGLK

SEQ ID NO: 163132 - protein, 16 aa, Mycobacterium tuberculosis
AAQAFRDEIVLLGLKA

SEQ ID NO: 163133 - protein, 16 aa, Mycobacterium tuberculosis
AQAFRDEIVLLGLKAR

SEQ ID NO: 163134 - protein, 16 aa, Mycobacterium tuberculosis
QAFRDEIVLLGLKARR

SEQ ID NO: 163135 - protein, 16 aa, Mycobacterium tuberculosis
AFRDEIVLLGLKARRP

SEQ ID NO: 163136 - protein, 16 aa, Mycobacterium tuberculosis
FRDEIVLLGLKARRPV

SEQ ID NO: 163137 - protein, 16 aa, Mycobacterium tuberculosis
RDEIVLLGLKARRPVS

SEQ ID NO: 163138 - protein, 16 aa, Mycobacterium tuberculosis
DEIVLLGLKARRPVSN

SEQ ID NO: 163139 - protein, 16 aa, Mycobacterium tuberculosis
EIVLLGLKARRPVSNH

SEQ ID NO: 163140 - protein, 16 aa, Mycobacterium tuberculosis
IVLLGLKARRPVSNHR

SEQ ID NO: 163141 - protein, 16 aa, Mycobacterium tuberculosis
VLLGLKARRPVSNHRV

SEQ ID NO: 163142 - protein, 16 aa, Mycobacterium tuberculosis
LLGLKARRPVSNHRVF

SEQ ID NO: 163143 - protein, 16 aa, Mycobacterium tuberculosis
LGLKARRPVSNHRVFE

SEQ ID NO: 163144 - protein, 16 aa, Mycobacterium tuberculosis
GLKARRPVSNHRVFER

SEQ ID NO: 163145 - protein, 16 aa, Mycobacterium tuberculosis
LKARRPVSNHRVFERI

SEQ ID NO: 163146 - protein, 16 aa, Mycobacterium tuberculosis
KARRPVSNHRVFERIS

SEQ ID NO: 163147 - protein, 16 aa, Mycobacterium tuberculosis
ARRPVSNHRVFERISQ

SEQ ID NO: 163148 - protein, 16 aa, Mycobacterium tuberculosis
RRPVSNHRVFERISQE

SEQ ID NO: 163149 - protein, 16 aa, Mycobacterium tuberculosis
RPVSNHRVFERISQEV

SEQ ID NO: 163150 - protein, 16 aa, Mycobacterium tuberculosis
PVSNHRVFERISQEVA

SEQ ID NO: 163151 - protein, 16 aa, Mycobacterium tuberculosis
VSNHRVFERISQEVAA

SEQ ID NO: 163152 - protein, 16 aa, Mycobacterium tuberculosis
SNHRVFERISQEVAAG

SEQ ID NO: 163153 - protein, 16 aa, Mycobacterium tuberculosis
NHRVFERISQEVAAGL

SEQ ID NO: 163154 - protein, 16 aa, Mycobacterium tuberculosis
HRVFERISQEVAAGLE

SEQ ID NO: 163155 - protein, 16 aa, Mycobacterium tuberculosis
RVFERISQEVAAGLEF

SEQ ID NO: 163156 - protein, 16 aa, Mycobacterium tuberculosis
VFERISQEVAAGLEFY

SEQ ID NO: 163157 - protein, 16 aa, Mycobacterium tuberculosis
FERISQEVAAGLEFYG

SEQ ID NO: 163158 - protein, 16 aa, Mycobacterium tuberculosis
ERISQEVAAGLEFYGN

SEQ ID NO: 163159 - protein, 16 aa, Mycobacterium tuberculosis
RISQEVAAGLEFYGNR

SEQ ID NO: 163160 - protein, 16 aa, Mycobacterium tuberculosis
ISQEVAAGLEFYGNRR

SEQ ID NO: 163161 - protein, 16 aa, Mycobacterium tuberculosis
SQEVAAGLEFYGNRRW

SEQ ID NO: 163162 - protein, 16 aa, Mycobacterium tuberculosis
QEVAAGLEFYGNRRWL

SEQ ID NO: 163163 - protein, 16 aa, Mycobacterium tuberculosis
EVAAGLEFYGNRRWLE

SEQ ID NO: 163164 - protein, 16 aa, Mycobacterium tuberculosis
VAAGLEFYGNRRWLEK

SEQ ID NO: 163165 - protein, 16 aa, Mycobacterium tuberculosis
AAGLEFYGNRRWLEKP

SEQ ID NO: 163166 - protein, 16 aa, Mycobacterium tuberculosis
AGLEFYGNRRWLEKPS

SEQ ID NO: 163167 - protein, 16 aa, Mycobacterium tuberculosis
GLEFYGNRRWLEKPSG

SEQ ID NO: 163168 - protein, 16 aa, Mycobacterium tuberculosis
LEFYGNRRWLEKPSGF

SEQ ID NO: 163169 - protein, 16 aa, Mycobacterium tuberculosis
EFYGNRRWLEKPSGFF

SEQ ID NO: 163170 - protein, 16 aa, Mycobacterium tuberculosis
FYGNRRWLEKPSGFFA

SEQ ID NO: 163171 - protein, 16 aa, Mycobacterium tuberculosis
YGNRRWLEKPSGFFAQ

SEQ ID NO: 163172 - protein, 16 aa, Mycobacterium tuberculosis
GNRRWLEKPSGFFAQP

SEQ ID NO: 163173 - protein, 16 aa, Mycobacterium tuberculosis
NRRWLEKPSGFFAQPP

SEQ ID NO: 163174 - protein, 16 aa, Mycobacterium tuberculosis
RRWLEKPSGFFAQPPP

SEQ ID NO: 163175 - protein, 16 aa, Mycobacterium tuberculosis
RWLEKPSGFFAQPPPL

SEQ ID NO: 163176 - protein, 16 aa, Mycobacterium tuberculosis
WLEKPSGFFAQPPPLT

SEQ ID NO: 163177 - protein, 16 aa, Mycobacterium tuberculosis
LEKPSGFFAQPPPLTE

SEQ ID NO: 163178 - protein, 16 aa, Mycobacterium tuberculosis
EKPSGFFAQPPPLTEV

SEQ ID NO: 163179 - protein, 16 aa, Mycobacterium tuberculosis
KPSGFFAQPPPLTEVA

SEQ ID NO: 163180 - protein, 16 aa, Mycobacterium tuberculosis
PSGFFAQPPPLTEVAV

SEQ ID NO: 163181 - protein, 16 aa, Mycobacterium tuberculosis
SGFFAQPPPLTEVAVR

SEQ ID NO: 163182 - protein, 16 aa, Mycobacterium tuberculosis
GFFAQPPPLTEVAVRK

SEQ ID NO: 163183 - protein, 16 aa, Mycobacterium tuberculosis
FFAQPPPLTEVAVRKV

SEQ ID NO: 163184 - protein, 16 aa, Mycobacterium tuberculosis
FAQPPPLTEVAVRKVK

SEQ ID NO: 163185 - protein, 16 aa, Mycobacterium tuberculosis
AQPPPLTEVAVRKVKD

SEQ ID NO: 163186 - protein, 16 aa, Mycobacterium tuberculosis
QPPPLTEVAVRKVKDR

SEQ ID NO: 163187 - protein, 16 aa, Mycobacterium tuberculosis
PPPLTEVAVRKVKDRR

SEQ ID NO: 163188 - protein, 16 aa, Mycobacterium tuberculosis
PPLTEVAVRKVKDRRR

SEQ ID NO: 163189 - protein, 16 aa, Mycobacterium tuberculosis
PLTEVAVRKVKDRRRS

SEQ ID NO: 163190 - protein, 16 aa, Mycobacterium tuberculosis
LTEVAVRKVKDRRRSF

SEQ ID NO: 163191 - protein, 16 aa, Mycobacterium tuberculosis
TEVAVRKVKDRRRSFY

SEQ ID NO: 163192 - protein, 16 aa, Mycobacterium tuberculosis
EVAVRKVKDRRRSFYR

SEQ ID NO: 163193 - protein, 16 aa, Mycobacterium tuberculosis
VAVRKVKDRRRSFYRI

SEQ ID NO: 163194 - protein, 16 aa, Mycobacterium tuberculosis
AVRKVKDRRRSFYRIF

SEQ ID NO: 163195 - protein, 16 aa, Mycobacterium tuberculosis
VRKVKDRRRSFYRIFF

SEQ ID NO: 163196 - protein, 16 aa, Mycobacterium tuberculosis
RKVKDRRRSFYRIFFD

SEQ ID NO: 163197 - protein, 16 aa, Mycobacterium tuberculosis
KVKDRRRSFYRIFFDS

SEQ ID NO: 163198 - protein, 16 aa, Mycobacterium tuberculosis
VKDRRRSFYRIFFDSG

SEQ ID NO: 163199 - protein, 16 aa, Mycobacterium tuberculosis
KDRRRSFYRIFFDSGF

SEQ ID NO: 163200 - protein, 16 aa, Mycobacterium tuberculosis
DRRRSFYRIFFDSGFT

SEQ ID NO: 163201 - protein, 16 aa, Mycobacterium tuberculosis
RRRSFYRIFFDSGFTP

SEQ ID NO: 163202 - protein, 16 aa, Mycobacterium tuberculosis
RRSFYRIFFDSGFTPH

SEQ ID NO: 163203 - protein, 16 aa, Mycobacterium tuberculosis
RSFYRIFFDSGFTPHP

SEQ ID NO: 163204 - protein, 16 aa, Mycobacterium tuberculosis
SFYRIFFDSGFTPHPG

SEQ ID NO: 163205 - protein, 16 aa, Mycobacterium tuberculosis
FYRIFFDSGFTPHPGE

SEQ ID NO: 163206 - protein, 16 aa, Mycobacterium tuberculosis
YRIFFDSGFTPHPGEP

SEQ ID NO: 163207 - protein, 16 aa, Mycobacterium tuberculosis
RIFFDSGFTPHPGEPG

SEQ ID NO: 163208 - protein, 16 aa, Mycobacterium tuberculosis
IFFDSGFTPHPGEPGS

SEQ ID NO: 163209 - protein, 16 aa, Mycobacterium tuberculosis
FFDSGFTPHPGEPGSQ

SEQ ID NO: 163210 - protein, 16 aa, Mycobacterium tuberculosis
FDSGFTPHPGEPGSQR

SEQ ID NO: 163211 - protein, 16 aa, Mycobacterium tuberculosis
DSGFTPHPGEPGSQRW

SEQ ID NO: 163212 - protein, 16 aa, Mycobacterium tuberculosis
SGFTPHPGEPGSQRWL

SEQ ID NO: 163213 - protein, 16 aa, Mycobacterium tuberculosis
GFTPHPGEPGSQRWLS

SEQ ID NO: 163214 - protein, 16 aa, Mycobacterium tuberculosis
FTPHPGEPGSQRWLSY

SEQ ID NO: 163215 - protein, 16 aa, Mycobacterium tuberculosis
TPHPGEPGSQRWLSYT

SEQ ID NO: 163216 - protein, 16 aa, Mycobacterium tuberculosis
PHPGEPGSQRWLSYTA

SEQ ID NO: 163217 - protein, 16 aa, Mycobacterium tuberculosis
HPGEPGSQRWLSYTAN

SEQ ID NO: 163218 - protein, 16 aa, Mycobacterium tuberculosis
PGEPGSQRWLSYTANN

SEQ ID NO: 163219 - protein, 16 aa, Mycobacterium tuberculosis
GEPGSQRWLSYTANNR

SEQ ID NO: 163220 - protein, 16 aa, Mycobacterium tuberculosis
EPGSQRWLSYTANNRE

SEQ ID NO: 163221 - protein, 16 aa, Mycobacterium tuberculosis
PGSQRWLSYTANNREY

SEQ ID NO: 163222 - protein, 16 aa, Mycobacterium tuberculosis
GSQRWLSYTANNREYA

SEQ ID NO: 163223 - protein, 16 aa, Mycobacterium tuberculosis
SQRWLSYTANNREYAL

SEQ ID NO: 163224 - protein, 16 aa, Mycobacterium tuberculosis
QRWLSYTANNREYALL

SEQ ID NO: 163225 - protein, 16 aa, Mycobacterium tuberculosis
RWLSYTANNREYALLL

SEQ ID NO: 163226 - protein, 16 aa, Mycobacterium tuberculosis
WLSYTANNREYALLLR

SEQ ID NO: 163227 - protein, 16 aa, Mycobacterium tuberculosis
LSYTANNREYALLLRH

SEQ ID NO: 163228 - protein, 16 aa, Mycobacterium tuberculosis
SYTANNREYALLLRHP

SEQ ID NO: 163229 - protein, 16 aa, Mycobacterium tuberculosis
YTANNREYALLLRHPE

SEQ ID NO: 163230 - protein, 16 aa, Mycobacterium tuberculosis
TANNREYALLLRHPEP

SEQ ID NO: 163231 - protein, 16 aa, Mycobacterium tuberculosis
ANNREYALLLRHPEPR

SEQ ID NO: 163232 - protein, 16 aa, Mycobacterium tuberculosis
NNREYALLLRHPEPRP

SEQ ID NO: 163233 - protein, 16 aa, Mycobacterium tuberculosis
NREYALLLRHPEPRPW

SEQ ID NO: 163234 - protein, 16 aa, Mycobacterium tuberculosis
REYALLLRHPEPRPWL

SEQ ID NO: 163235 - protein, 16 aa, Mycobacterium tuberculosis
EYALLLRHPEPRPWLV

SEQ ID NO: 163236 - protein, 16 aa, Mycobacterium tuberculosis
YALLLRHPEPRPWLVC

SEQ ID NO: 163237 - protein, 16 aa, Mycobacterium tuberculosis
ALLLRHPEPRPWLVCV

SEQ ID NO: 163238 - protein, 16 aa, Mycobacterium tuberculosis
LLLRHPEPRPWLVCVH

SEQ ID NO: 163239 - protein, 16 aa, Mycobacterium tuberculosis
LLRHPEPRPWLVCVHG

SEQ ID NO: 163240 - protein, 16 aa, Mycobacterium tuberculosis
LRHPEPRPWLVCVHGT

SEQ ID NO: 163241 - protein, 16 aa, Mycobacterium tuberculosis
RHPEPRPWLVCVHGTE

SEQ ID NO: 163242 - protein, 16 aa, Mycobacterium tuberculosis
HPEPRPWLVCVHGTEM

SEQ ID NO: 163243 - protein, 16 aa, Mycobacterium tuberculosis
PEPRPWLVCVHGTEMG

SEQ ID NO: 163244 - protein, 16 aa, Mycobacterium tuberculosis
EPRPWLVCVHGTEMGR

SEQ ID NO: 163245 - protein, 16 aa, Mycobacterium tuberculosis
PRPWLVCVHGTEMGRA

SEQ ID NO: 163246 - protein, 16 aa, Mycobacterium tuberculosis
RPWLVCVHGTEMGRAP

SEQ ID NO: 163247 - protein, 16 aa, Mycobacterium tuberculosis
PWLVCVHGTEMGRAPL

SEQ ID NO: 163248 - protein, 16 aa, Mycobacterium tuberculosis
WLVCVHGTEMGRAPLD

SEQ ID NO: 163249 - protein, 16 aa, Mycobacterium tuberculosis
LVCVHGTEMGRAPLDL

SEQ ID NO: 163250 - protein, 16 aa, Mycobacterium tuberculosis
VCVHGTEMGRAPLDLA

SEQ ID NO: 163251 - protein, 16 aa, Mycobacterium tuberculosis
CVHGTEMGRAPLDLAV

SEQ ID NO: 163252 - protein, 16 aa, Mycobacterium tuberculosis
VHGTEMGRAPLDLAVF

SEQ ID NO: 163253 - protein, 16 aa, Mycobacterium tuberculosis
HGTEMGRAPLDLAVFR

SEQ ID NO: 163254 - protein, 16 aa, Mycobacterium tuberculosis
GTEMGRAPLDLAVFRA

SEQ ID NO: 163255 - protein, 16 aa, Mycobacterium tuberculosis
TEMGRAPLDLAVFRAW

SEQ ID NO: 163256 - protein, 16 aa, Mycobacterium tuberculosis
EMGRAPLDLAVFRAWK

SEQ ID NO: 163257 - protein, 16 aa, Mycobacterium tuberculosis
MGRAPLDLAVFRAWKL

SEQ ID NO: 163258 - protein, 16 aa, Mycobacterium tuberculosis
GRAPLDLAVFRAWKLH

SEQ ID NO: 163259 - protein, 16 aa, Mycobacterium tuberculosis
RAPLDLAVFRAWKLHD

SEQ ID NO: 163260 - protein, 16 aa, Mycobacterium tuberculosis
APLDLAVFRAWKLHDE

SEQ ID NO: 163261 - protein, 16 aa, Mycobacterium tuberculosis
PLDLAVFRAWKLHDEL

SEQ ID NO: 163262 - protein, 16 aa, Mycobacterium tuberculosis
LDLAVFRAWKLHDELG

SEQ ID NO: 163263 - protein, 16 aa, Mycobacterium tuberculosis
DLAVFRAWKLHDELGL

SEQ ID NO: 163264 - protein, 16 aa, Mycobacterium tuberculosis
LAVFRAWKLHDELGLN

SEQ ID NO: 163265 - protein, 16 aa, Mycobacterium tuberculosis
AVFRAWKLHDELGLNI

SEQ ID NO: 163266 - protein, 16 aa, Mycobacterium tuberculosis
VFRAWKLHDELGLNIV

SEQ ID NO: 163267 - protein, 16 aa, Mycobacterium tuberculosis
FRAWKLHDELGLNIVM

SEQ ID NO: 163268 - protein, 16 aa, Mycobacterium tuberculosis
RAWKLHDELGLNIVMP

SEQ ID NO: 163269 - protein, 16 aa, Mycobacterium tuberculosis
AWKLHDELGLNIVMPV

SEQ ID NO: 163270 - protein, 16 aa, Mycobacterium tuberculosis
WKLHDELGLNIVMPVL

SEQ ID NO: 163271 - protein, 16 aa, Mycobacterium tuberculosis
KLHDELGLNIVMPVLP

SEQ ID NO: 163272 - protein, 16 aa, Mycobacterium tuberculosis
LHDELGLNIVMPVLPM

SEQ ID NO: 163273 - protein, 16 aa, Mycobacterium tuberculosis
HDELGLNIVMPVLPMH

SEQ ID NO: 163274 - protein, 16 aa, Mycobacterium tuberculosis
DELGLNIVMPVLPMHG

SEQ ID NO: 163275 - protein, 16 aa, Mycobacterium tuberculosis
ELGLNIVMPVLPMHGP

SEQ ID NO: 163276 - protein, 16 aa, Mycobacterium tuberculosis
LGLNIVMPVLPMHGPR

SEQ ID NO: 163277 - protein, 16 aa, Mycobacterium tuberculosis
GLNIVMPVLPMHGPRG

SEQ ID NO: 163278 - protein, 16 aa, Mycobacterium tuberculosis
LNIVMPVLPMHGPRGQ

SEQ ID NO: 163279 - protein, 16 aa, Mycobacterium tuberculosis
NIVMPVLPMHGPRGQG

SEQ ID NO: 163280 - protein, 16 aa, Mycobacterium tuberculosis
IVMPVLPMHGPRGQGL

SEQ ID NO: 163281 - protein, 16 aa, Mycobacterium tuberculosis
VMPVLPMHGPRGQGLP

SEQ ID NO: 163282 - protein, 16 aa, Mycobacterium tuberculosis
MPVLPMHGPRGQGLPK

SEQ ID NO: 163283 - protein, 16 aa, Mycobacterium tuberculosis
PVLPMHGPRGQGLPKG

SEQ ID NO: 163284 - protein, 16 aa, Mycobacterium tuberculosis
VLPMHGPRGQGLPKGA

SEQ ID NO: 163285 - protein, 16 aa, Mycobacterium tuberculosis
LPMHGPRGQGLPKGAV

SEQ ID NO: 163286 - protein, 16 aa, Mycobacterium tuberculosis
PMHGPRGQGLPKGAVF

SEQ ID NO: 163287 - protein, 16 aa, Mycobacterium tuberculosis
MHGPRGQGLPKGAVFP

SEQ ID NO: 163288 - protein, 16 aa, Mycobacterium tuberculosis
HGPRGQGLPKGAVFPG

SEQ ID NO: 163289 - protein, 16 aa, Mycobacterium tuberculosis
GPRGQGLPKGAVFPGE

SEQ ID NO: 163290 - protein, 16 aa, Mycobacterium tuberculosis
PRGQGLPKGAVFPGED

SEQ ID NO: 163291 - protein, 16 aa, Mycobacterium tuberculosis
RGQGLPKGAVFPGEDV

SEQ ID NO: 163292 - protein, 16 aa, Mycobacterium tuberculosis
GQGLPKGAVFPGEDVL

SEQ ID NO: 163293 - protein, 16 aa, Mycobacterium tuberculosis
QGLPKGAVFPGEDVLD

SEQ ID NO: 163294 - protein, 16 aa, Mycobacterium tuberculosis
GLPKGAVFPGEDVLDD

SEQ ID NO: 163295 - protein, 16 aa, Mycobacterium tuberculosis
LPKGAVFPGEDVLDDV

SEQ ID NO: 163296 - protein, 16 aa, Mycobacterium tuberculosis
PKGAVFPGEDVLDDVH

SEQ ID NO: 163297 - protein, 16 aa, Mycobacterium tuberculosis
KGAVFPGEDVLDDVHG

SEQ ID NO: 163298 - protein, 16 aa, Mycobacterium tuberculosis
GAVFPGEDVLDDVHGT

SEQ ID NO: 163299 - protein, 16 aa, Mycobacterium tuberculosis
AVFPGEDVLDDVHGTA

SEQ ID NO: 163300 - protein, 16 aa, Mycobacterium tuberculosis
VFPGEDVLDDVHGTAQ

SEQ ID NO: 163301 - protein, 16 aa, Mycobacterium tuberculosis
FPGEDVLDDVHGTAQA

SEQ ID NO: 163302 - protein, 16 aa, Mycobacterium tuberculosis
PGEDVLDDVHGTAQAV

SEQ ID NO: 163303 - protein, 16 aa, Mycobacterium tuberculosis
GEDVLDDVHGTAQAVW

SEQ ID NO: 163304 - protein, 16 aa, Mycobacterium tuberculosis
EDVLDDVHGTAQAVWD

SEQ ID NO: 163305 - protein, 16 aa, Mycobacterium tuberculosis
DVLDDVHGTAQAVWDI

SEQ ID NO: 163306 - protein, 16 aa, Mycobacterium tuberculosis
VLDDVHGTAQAVWDIR

SEQ ID NO: 163307 - protein, 16 aa, Mycobacterium tuberculosis
LDDVHGTAQAVWDIRR

SEQ ID NO: 163308 - protein, 16 aa, Mycobacterium tuberculosis
DDVHGTAQAVWDIRRL

SEQ ID NO: 163309 - protein, 16 aa, Mycobacterium tuberculosis
DVHGTAQAVWDIRRLL

SEQ ID NO: 163310 - protein, 16 aa, Mycobacterium tuberculosis
VHGTAQAVWDIRRLLS

SEQ ID NO: 163311 - protein, 16 aa, Mycobacterium tuberculosis
HGTAQAVWDIRRLLSW

SEQ ID NO: 163312 - protein, 16 aa, Mycobacterium tuberculosis
GTAQAVWDIRRLLSWI

SEQ ID NO: 163313 - protein, 16 aa, Mycobacterium tuberculosis
TAQAVWDIRRLLSWIR

SEQ ID NO: 163314 - protein, 16 aa, Mycobacterium tuberculosis
AQAVWDIRRLLSWIRS

SEQ ID NO: 163315 - protein, 16 aa, Mycobacterium tuberculosis
QAVWDIRRLLSWIRSQ

SEQ ID NO: 163316 - protein, 16 aa, Mycobacterium tuberculosis
AVWDIRRLLSWIRSQE

SEQ ID NO: 163317 - protein, 16 aa, Mycobacterium tuberculosis
VWDIRRLLSWIRSQEE

SEQ ID NO: 163318 - protein, 16 aa, Mycobacterium tuberculosis
WDIRRLLSWIRSQEEE

SEQ ID NO: 163319 - protein, 16 aa, Mycobacterium tuberculosis
DIRRLLSWIRSQEEES

SEQ ID NO: 163320 - protein, 16 aa, Mycobacterium tuberculosis
IRRLLSWIRSQEEESL

SEQ ID NO: 163321 - protein, 16 aa, Mycobacterium tuberculosis
RRLLSWIRSQEEESLI

SEQ ID NO: 163322 - protein, 16 aa, Mycobacterium tuberculosis
RLLSWIRSQEEESLIG

SEQ ID NO: 163323 - protein, 16 aa, Mycobacterium tuberculosis
LLSWIRSQEEESLIGL

SEQ ID NO: 163324 - protein, 16 aa, Mycobacterium tuberculosis
LSWIRSQEEESLIGLN

SEQ ID NO: 163325 - protein, 16 aa, Mycobacterium tuberculosis
SWIRSQEEESLIGLNG

SEQ ID NO: 163326 - protein, 16 aa, Mycobacterium tuberculosis
WIRSQEEESLIGLNGL

SEQ ID NO: 163327 - protein, 16 aa, Mycobacterium tuberculosis
IRSQEEESLIGLNGLS

SEQ ID NO: 163328 - protein, 16 aa, Mycobacterium tuberculosis
RSQEEESLIGLNGLSL

SEQ ID NO: 163329 - protein, 16 aa, Mycobacterium tuberculosis
SQEEESLIGLNGLSLG

SEQ ID NO: 163330 - protein, 16 aa, Mycobacterium tuberculosis
QEEESLIGLNGLSLGG

SEQ ID NO: 163331 - protein, 16 aa, Mycobacterium tuberculosis
EEESLIGLNGLSLGGY

SEQ ID NO: 163332 - protein, 16 aa, Mycobacterium tuberculosis
EESLIGLNGLSLGGYI

SEQ ID NO: 163333 - protein, 16 aa, Mycobacterium tuberculosis
ESLIGLNGLSLGGYIA

SEQ ID NO: 163334 - protein, 16 aa, Mycobacterium tuberculosis
SLIGLNGLSLGGYIAS

SEQ ID NO: 163335 - protein, 16 aa, Mycobacterium tuberculosis
LIGLNGLSLGGYIASL

SEQ ID NO: 163336 - protein, 16 aa, Mycobacterium tuberculosis
IGLNGLSLGGYIASLV

SEQ ID NO: 163337 - protein, 16 aa, Mycobacterium tuberculosis
GLNGLSLGGYIASLVA

SEQ ID NO: 163338 - protein, 16 aa, Mycobacterium tuberculosis
LNGLSLGGYIASLVAS

SEQ ID NO: 163339 - protein, 16 aa, Mycobacterium tuberculosis
NGLSLGGYIASLVASL

SEQ ID NO: 163340 - protein, 16 aa, Mycobacterium tuberculosis
GLSLGGYIASLVASLE

SEQ ID NO: 163341 - protein, 16 aa, Mycobacterium tuberculosis
LSLGGYIASLVASLEE

SEQ ID NO: 163342 - protein, 16 aa, Mycobacterium tuberculosis
SLGGYIASLVASLEEG

SEQ ID NO: 163343 - protein, 16 aa, Mycobacterium tuberculosis
LGGYIASLVASLEEGL

SEQ ID NO: 163344 - protein, 16 aa, Mycobacterium tuberculosis
GGYIASLVASLEEGLA

SEQ ID NO: 163345 - protein, 16 aa, Mycobacterium tuberculosis
GYIASLVASLEEGLAC

SEQ ID NO: 163346 - protein, 16 aa, Mycobacterium tuberculosis
YIASLVASLEEGLACA

SEQ ID NO: 163347 - protein, 16 aa, Mycobacterium tuberculosis
IASLVASLEEGLACAI

SEQ ID NO: 163348 - protein, 16 aa, Mycobacterium tuberculosis
ASLVASLEEGLACAIL

SEQ ID NO: 163349 - protein, 16 aa, Mycobacterium tuberculosis
SLVASLEEGLACAILG

SEQ ID NO: 163350 - protein, 16 aa, Mycobacterium tuberculosis
LVASLEEGLACAILGV

SEQ ID NO: 163351 - protein, 16 aa, Mycobacterium tuberculosis
VASLEEGLACAILGVP

SEQ ID NO: 163352 - protein, 16 aa, Mycobacterium tuberculosis
ASLEEGLACAILGVPV

SEQ ID NO: 163353 - protein, 16 aa, Mycobacterium tuberculosis
SLEEGLACAILGVPVA

SEQ ID NO: 163354 - protein, 16 aa, Mycobacterium tuberculosis
LEEGLACAILGVPVAD

SEQ ID NO: 163355 - protein, 16 aa, Mycobacterium tuberculosis
EEGLACAILGVPVADL

SEQ ID NO: 163356 - protein, 16 aa, Mycobacterium tuberculosis
EGLACAILGVPVADLI

SEQ ID NO: 163357 - protein, 16 aa, Mycobacterium tuberculosis
GLACAILGVPVADLIE

SEQ ID NO: 163358 - protein, 16 aa, Mycobacterium tuberculosis
LACAILGVPVADLIEL

SEQ ID NO: 163359 - protein, 16 aa, Mycobacterium tuberculosis
ACAILGVPVADLIELL

SEQ ID NO: 163360 - protein, 16 aa, Mycobacterium tuberculosis
CAILGVPVADLIELLG

SEQ ID NO: 163361 - protein, 16 aa, Mycobacterium tuberculosis
AILGVPVADLIELLGR

SEQ ID NO: 163362 - protein, 16 aa, Mycobacterium tuberculosis
ILGVPVADLIELLGRH

SEQ ID NO: 163363 - protein, 16 aa, Mycobacterium tuberculosis
LGVPVADLIELLGRHC

SEQ ID NO: 163364 - protein, 16 aa, Mycobacterium tuberculosis
GVPVADLIELLGRHCG

SEQ ID NO: 163365 - protein, 16 aa, Mycobacterium tuberculosis
VPVADLIELLGRHCGL

SEQ ID NO: 163366 - protein, 16 aa, Mycobacterium tuberculosis
PVADLIELLGRHCGLR

SEQ ID NO: 163367 - protein, 16 aa, Mycobacterium tuberculosis
VADLIELLGRHCGLRH

SEQ ID NO: 163368 - protein, 16 aa, Mycobacterium tuberculosis
ADLIELLGRHCGLRHK

SEQ ID NO: 163369 - protein, 16 aa, Mycobacterium tuberculosis
DLIELLGRHCGLRHKD

SEQ ID NO: 163370 - protein, 16 aa, Mycobacterium tuberculosis
LIELLGRHCGLRHKDP

SEQ ID NO: 163371 - protein, 16 aa, Mycobacterium tuberculosis
IELLGRHCGLRHKDPR

SEQ ID NO: 163372 - protein, 16 aa, Mycobacterium tuberculosis
ELLGRHCGLRHKDPRR

SEQ ID NO: 163373 - protein, 16 aa, Mycobacterium tuberculosis
LLGRHCGLRHKDPRRH

SEQ ID NO: 163374 - protein, 16 aa, Mycobacterium tuberculosis
LGRHCGLRHKDPRRHT

SEQ ID NO: 163375 - protein, 16 aa, Mycobacterium tuberculosis
GRHCGLRHKDPRRHTV

SEQ ID NO: 163376 - protein, 16 aa, Mycobacterium tuberculosis
RHCGLRHKDPRRHTVK

SEQ ID NO: 163377 - protein, 16 aa, Mycobacterium tuberculosis
HCGLRHKDPRRHTVKM

SEQ ID NO: 163378 - protein, 16 aa, Mycobacterium tuberculosis
CGLRHKDPRRHTVKMA

SEQ ID NO: 163379 - protein, 16 aa, Mycobacterium tuberculosis
GLRHKDPRRHTVKMAE

SEQ ID NO: 163380 - protein, 16 aa, Mycobacterium tuberculosis
LRHKDPRRHTVKMAEP

SEQ ID NO: 163381 - protein, 16 aa, Mycobacterium tuberculosis
RHKDPRRHTVKMAEPI

SEQ ID NO: 163382 - protein, 16 aa, Mycobacterium tuberculosis
HKDPRRHTVKMAEPIG

SEQ ID NO: 163383 - protein, 16 aa, Mycobacterium tuberculosis
KDPRRHTVKMAEPIGR

SEQ ID NO: 163384 - protein, 16 aa, Mycobacterium tuberculosis
DPRRHTVKMAEPIGRM

SEQ ID NO: 163385 - protein, 16 aa, Mycobacterium tuberculosis
PRRHTVKMAEPIGRMI

SEQ ID NO: 163386 - protein, 16 aa, Mycobacterium tuberculosis
RRHTVKMAEPIGRMIS

SEQ ID NO: 163387 - protein, 16 aa, Mycobacterium tuberculosis
RHTVKMAEPIGRMISP

SEQ ID NO: 163388 - protein, 16 aa, Mycobacterium tuberculosis
HTVKMAEPIGRMISPL

SEQ ID NO: 163389 - protein, 16 aa, Mycobacterium tuberculosis
TVKMAEPIGRMISPLS

SEQ ID NO: 163390 - protein, 16 aa, Mycobacterium tuberculosis
VKMAEPIGRMISPLSL

SEQ ID NO: 163391 - protein, 16 aa, Mycobacterium tuberculosis
KMAEPIGRMISPLSLT

SEQ ID NO: 163392 - protein, 16 aa, Mycobacterium tuberculosis
MAEPIGRMISPLSLTP

SEQ ID NO: 163393 - protein, 16 aa, Mycobacterium tuberculosis
AEPIGRMISPLSLTPL

SEQ ID NO: 163394 - protein, 16 aa, Mycobacterium tuberculosis
EPIGRMISPLSLTPLV

SEQ ID NO: 163395 - protein, 16 aa, Mycobacterium tuberculosis
PIGRMISPLSLTPLVP

SEQ ID NO: 163396 - protein, 16 aa, Mycobacterium tuberculosis
IGRMISPLSLTPLVPM

SEQ ID NO: 163397 - protein, 16 aa, Mycobacterium tuberculosis
GRMISPLSLTPLVPMP

SEQ ID NO: 163398 - protein, 16 aa, Mycobacterium tuberculosis
RMISPLSLTPLVPMPG

SEQ ID NO: 163399 - protein, 16 aa, Mycobacterium tuberculosis
MISPLSLTPLVPMPGR

SEQ ID NO: 163400 - protein, 16 aa, Mycobacterium tuberculosis
ISPLSLTPLVPMPGRF

SEQ ID NO: 163401 - protein, 16 aa, Mycobacterium tuberculosis
SPLSLTPLVPMPGRFI

SEQ ID NO: 163402 - protein, 16 aa, Mycobacterium tuberculosis
PLSLTPLVPMPGRFIY

SEQ ID NO: 163403 - protein, 16 aa, Mycobacterium tuberculosis
LSLTPLVPMPGRFIYA

SEQ ID NO: 163404 - protein, 16 aa, Mycobacterium tuberculosis
SLTPLVPMPGRFIYAG

SEQ ID NO: 163405 - protein, 16 aa, Mycobacterium tuberculosis
LTPLVPMPGRFIYAGI

SEQ ID NO: 163406 - protein, 16 aa, Mycobacterium tuberculosis
TPLVPMPGRFIYAGIA

SEQ ID NO: 163407 - protein, 16 aa, Mycobacterium tuberculosis
PLVPMPGRFIYAGIAD

SEQ ID NO: 163408 - protein, 16 aa, Mycobacterium tuberculosis
LVPMPGRFIYAGIADR

SEQ ID NO: 163409 - protein, 16 aa, Mycobacterium tuberculosis
VPMPGRFIYAGIADRL

SEQ ID NO: 163410 - protein, 16 aa, Mycobacterium tuberculosis
PMPGRFIYAGIADRLV

SEQ ID NO: 163411 - protein, 16 aa, Mycobacterium tuberculosis
MPGRFIYAGIADRLVH

SEQ ID NO: 163412 - protein, 16 aa, Mycobacterium tuberculosis
PGRFIYAGIADRLVHP

SEQ ID NO: 163413 - protein, 16 aa, Mycobacterium tuberculosis
GRFIYAGIADRLVHPR

SEQ ID NO: 163414 - protein, 16 aa, Mycobacterium tuberculosis
RFIYAGIADRLVHPRE

SEQ ID NO: 163415 - protein, 16 aa, Mycobacterium tuberculosis
FIYAGIADRLVHPREQ

SEQ ID NO: 163416 - protein, 16 aa, Mycobacterium tuberculosis
IYAGIADRLVHPREQV

SEQ ID NO: 163417 - protein, 16 aa, Mycobacterium tuberculosis
YAGIADRLVHPREQVT

SEQ ID NO: 163418 - protein, 16 aa, Mycobacterium tuberculosis
AGIADRLVHPREQVTR

SEQ ID NO: 163419 - protein, 16 aa, Mycobacterium tuberculosis
GIADRLVHPREQVTRL

SEQ ID NO: 163420 - protein, 16 aa, Mycobacterium tuberculosis
IADRLVHPREQVTRLW

SEQ ID NO: 163421 - protein, 16 aa, Mycobacterium tuberculosis
ADRLVHPREQVTRLWE

SEQ ID NO: 163422 - protein, 16 aa, Mycobacterium tuberculosis
DRLVHPREQVTRLWEH

SEQ ID NO: 163423 - protein, 16 aa, Mycobacterium tuberculosis
RLVHPREQVTRLWEHW

SEQ ID NO: 163424 - protein, 16 aa, Mycobacterium tuberculosis
LVHPREQVTRLWEHWG

SEQ ID NO: 163425 - protein, 16 aa, Mycobacterium tuberculosis
VHPREQVTRLWEHWGK

SEQ ID NO: 163426 - protein, 16 aa, Mycobacterium tuberculosis
HPREQVTRLWEHWGKP

SEQ ID NO: 163427 - protein, 16 aa, Mycobacterium tuberculosis
PREQVTRLWEHWGKPE

SEQ ID NO: 163428 - protein, 16 aa, Mycobacterium tuberculosis
REQVTRLWEHWGKPEI

SEQ ID NO: 163429 - protein, 16 aa, Mycobacterium tuberculosis
EQVTRLWEHWGKPEIV

SEQ ID NO: 163430 - protein, 16 aa, Mycobacterium tuberculosis
QVTRLWEHWGKPEIVW

SEQ ID NO: 163431 - protein, 16 aa, Mycobacterium tuberculosis
VTRLWEHWGKPEIVWY

SEQ ID NO: 163432 - protein, 16 aa, Mycobacterium tuberculosis
TRLWEHWGKPEIVWYP

SEQ ID NO: 163433 - protein, 16 aa, Mycobacterium tuberculosis
RLWEHWGKPEIVWYPG

SEQ ID NO: 163434 - protein, 16 aa, Mycobacterium tuberculosis
LWEHWGKPEIVWYPGG

SEQ ID NO: 163435 - protein, 16 aa, Mycobacterium tuberculosis
WEHWGKPEIVWYPGGH

SEQ ID NO: 163436 - protein, 16 aa, Mycobacterium tuberculosis
EHWGKPEIVWYPGGHT

SEQ ID NO: 163437 - protein, 16 aa, Mycobacterium tuberculosis
HWGKPEIVWYPGGHTG

SEQ ID NO: 163438 - protein, 16 aa, Mycobacterium tuberculosis
WGKPEIVWYPGGHTGF

SEQ ID NO: 163439 - protein, 16 aa, Mycobacterium tuberculosis
GKPEIVWYPGGHTGFF

SEQ ID NO: 163440 - protein, 16 aa, Mycobacterium tuberculosis
KPEIVWYPGGHTGFFQ

SEQ ID NO: 163441 - protein, 16 aa, Mycobacterium tuberculosis
PEIVWYPGGHTGFFQS

SEQ ID NO: 163442 - protein, 16 aa, Mycobacterium tuberculosis
EIVWYPGGHTGFFQSR

SEQ ID NO: 163443 - protein, 16 aa, Mycobacterium tuberculosis
IVWYPGGHTGFFQSRP

SEQ ID NO: 163444 - protein, 16 aa, Mycobacterium tuberculosis
VWYPGGHTGFFQSRPV

SEQ ID NO: 163445 - protein, 16 aa, Mycobacterium tuberculosis
WYPGGHTGFFQSRPVR

SEQ ID NO: 163446 - protein, 16 aa, Mycobacterium tuberculosis
YPGGHTGFFQSRPVRR

SEQ ID NO: 163447 - protein, 16 aa, Mycobacterium tuberculosis
PGGHTGFFQSRPVRRF

SEQ ID NO: 163448 - protein, 16 aa, Mycobacterium tuberculosis
GGHTGFFQSRPVRRFV

SEQ ID NO: 163449 - protein, 16 aa, Mycobacterium tuberculosis
GHTGFFQSRPVRRFVQ

SEQ ID NO: 163450 - protein, 16 aa, Mycobacterium tuberculosis
HTGFFQSRPVRRFVQA

SEQ ID NO: 163451 - protein, 16 aa, Mycobacterium tuberculosis
TGFFQSRPVRRFVQAA

SEQ ID NO: 163452 - protein, 16 aa, Mycobacterium tuberculosis
GFFQSRPVRRFVQAAL

SEQ ID NO: 163453 - protein, 16 aa, Mycobacterium tuberculosis
FFQSRPVRRFVQAALE

SEQ ID NO: 163454 - protein, 16 aa, Mycobacterium tuberculosis
FQSRPVRRFVQAALEQ

SEQ ID NO: 163455 - protein, 16 aa, Mycobacterium tuberculosis
QSRPVRRFVQAALEQS

SEQ ID NO: 163456 - protein, 16 aa, Mycobacterium tuberculosis
SRPVRRFVQAALEQSG

SEQ ID NO: 163457 - protein, 16 aa, Mycobacterium tuberculosis
RPVRRFVQAALEQSGL

SEQ ID NO: 163458 - protein, 16 aa, Mycobacterium tuberculosis
PVRRFVQAALEQSGLL

SEQ ID NO: 163459 - protein, 16 aa, Mycobacterium tuberculosis
VRRFVQAALEQSGLLD

SEQ ID NO: 163460 - protein, 16 aa, Mycobacterium tuberculosis
RRFVQAALEQSGLLDA

SEQ ID NO: 163461 - protein, 16 aa, Mycobacterium tuberculosis
RFVQAALEQSGLLDAP

SEQ ID NO: 163462 - protein, 16 aa, Mycobacterium tuberculosis
FVQAALEQSGLLDAPR

SEQ ID NO: 163463 - protein, 16 aa, Mycobacterium tuberculosis
VQAALEQSGLLDAPRT

SEQ ID NO: 163464 - protein, 16 aa, Mycobacterium tuberculosis
QAALEQSGLLDAPRTQ

SEQ ID NO: 163465 - protein, 16 aa, Mycobacterium tuberculosis
AALEQSGLLDAPRTQR

SEQ ID NO: 163466 - protein, 16 aa, Mycobacterium tuberculosis
ALEQSGLLDAPRTQRD

SEQ ID NO: 163467 - protein, 16 aa, Mycobacterium tuberculosis
LEQSGLLDAPRTQRDR

SEQ ID NO: 163468 - protein, 16 aa, Mycobacterium tuberculosis
EQSGLLDAPRTQRDRS

SEQ ID NO: 163469 - protein, 16 aa, Mycobacterium tuberculosis
QSGLLDAPRTQRDRSA

SEQ ID NO: 163470 - protein, 371 aa, Mycobacterium tuberculosis
MRVGIPTETKNNEFRVAITPAGVAELTRRGHEVLIQAGAGEGSAITDADFKAAGAQLVGTADQVWADADLLLKVKEPIAAEYGRLRHGQILFTFLHLAASRACTDALLDSGTTSIAYETVQTADGALPLLAPMSEVAGRLAAQVGAYHLMRTQGGRGVLMGGVPGVEPADVVVIGAGTAGYNAARIANGMGATVTVLDINIDKLRQLDAEFCGRIHTRYSSAYELEGAVKRADLVIGAVLVPGAKAPKLVSNSLVAHMKPGAVLVDIAIDQGGCFEGSRPTTYDHPTFAVHDTLFYCVANMPASVPKTSTYALTNATMPYVLELADHGWRAACRSNPALAKGLSTHEGALLSERVATDLGVPFTEPASVLA

SEQ ID NO: 163471 - protein, 8 aa, Mycobacterium tuberculosis
TETKNNEF

SEQ ID NO: 163472 - protein, 8 aa, Mycobacterium tuberculosis
ETKNNEFR

SEQ ID NO: 163473 - protein, 8 aa, Mycobacterium tuberculosis
FRVAITPA

SEQ ID NO: 163474 - protein, 8 aa, Mycobacterium tuberculosis
VAITPAGV

SEQ ID NO: 163475 - protein, 8 aa, Mycobacterium tuberculosis
TPAGVAEL

SEQ ID NO: 163476 - protein, 8 aa, Mycobacterium tuberculosis
GVAELTRR

SEQ ID NO: 163477 - protein, 8 aa, Mycobacterium tuberculosis
LTRRGHEV

SEQ ID NO: 163478 - protein, 8 aa, Mycobacterium tuberculosis
EVLIQAGA

SEQ ID NO: 163479 - protein, 8 aa, Mycobacterium tuberculosis
EGSAITDA

SEQ ID NO: 163480 - protein, 8 aa, Mycobacterium tuberculosis
SAITDADF

SEQ ID NO: 163481 - protein, 8 aa, Mycobacterium tuberculosis
AITDADFK

SEQ ID NO: 163482 - protein, 8 aa, Mycobacterium tuberculosis
FKAAGAQL

SEQ ID NO: 163483 - protein, 8 aa, Mycobacterium tuberculosis
KAAGAQLV

SEQ ID NO: 163484 - protein, 8 aa, Mycobacterium tuberculosis
LVGTADQV

SEQ ID NO: 163485 - protein, 8 aa, Mycobacterium tuberculosis
VGTADQVW

SEQ ID NO: 163486 - protein, 8 aa, Mycobacterium tuberculosis
GTADQVWA

SEQ ID NO: 163487 - protein, 8 aa, Mycobacterium tuberculosis
VWADADLL

SEQ ID NO: 163488 - protein, 8 aa, Mycobacterium tuberculosis
WADADLLL

SEQ ID NO: 163489 - protein, 8 aa, Mycobacterium tuberculosis
LLKVKEPI

SEQ ID NO: 163490 - protein, 8 aa, Mycobacterium tuberculosis
AAEYGRLR

SEQ ID NO: 163491 - protein, 8 aa, Mycobacterium tuberculosis
RLRHGQIL

SEQ ID NO: 163492 - protein, 8 aa, Mycobacterium tuberculosis
GQILFTFL

SEQ ID NO: 163493 - protein, 8 aa, Mycobacterium tuberculosis
ILFTFLHL

SEQ ID NO: 163494 - protein, 8 aa, Mycobacterium tuberculosis
FTFLHLAA

SEQ ID NO: 163495 - protein, 8 aa, Mycobacterium tuberculosis
FLHLAASR

SEQ ID NO: 163496 - protein, 8 aa, Mycobacterium tuberculosis
SRACTDAL

SEQ ID NO: 163497 - protein, 8 aa, Mycobacterium tuberculosis
ALLDSGTT

SEQ ID NO: 163498 - protein, 8 aa, Mycobacterium tuberculosis
LLDSGTTS

SEQ ID NO: 163499 - protein, 8 aa, Mycobacterium tuberculosis
TTSIAYET

SEQ ID NO: 163500 - protein, 8 aa, Mycobacterium tuberculosis
TSIAYETV

SEQ ID NO: 163501 - protein, 8 aa, Mycobacterium tuberculosis
VQTADGAL

SEQ ID NO: 163502 - protein, 8 aa, Mycobacterium tuberculosis
TADGALPL

SEQ ID NO: 163503 - protein, 8 aa, Mycobacterium tuberculosis
ALPLLAPM

SEQ ID NO: 163504 - protein, 8 aa, Mycobacterium tuberculosis
LPLLAPMS

SEQ ID NO: 163505 - protein, 8 aa, Mycobacterium tuberculosis
LLAPMSEV

SEQ ID NO: 163506 - protein, 8 aa, Mycobacterium tuberculosis
EVAGRLAA

SEQ ID NO: 163507 - protein, 8 aa, Mycobacterium tuberculosis
RLAAQVGA

SEQ ID NO: 163508 - protein, 8 aa, Mycobacterium tuberculosis
LAAQVGAY

SEQ ID NO: 163509 - protein, 8 aa, Mycobacterium tuberculosis
AQVGAYHL

SEQ ID NO: 163510 - protein, 8 aa, Mycobacterium tuberculosis
QVGAYHLM

SEQ ID NO: 163511 - protein, 8 aa, Mycobacterium tuberculosis
LMRTQGGR

SEQ ID NO: 163512 - protein, 8 aa, Mycobacterium tuberculosis
RTQGGRGV

SEQ ID NO: 163513 - protein, 8 aa, Mycobacterium tuberculosis
VLMGGVPG

SEQ ID NO: 163514 - protein, 8 aa, Mycobacterium tuberculosis
LMGGVPGV

SEQ ID NO: 163515 - protein, 8 aa, Mycobacterium tuberculosis
GVEPADVV

SEQ ID NO: 163516 - protein, 8 aa, Mycobacterium tuberculosis
EPADVVVI

SEQ ID NO: 163517 - protein, 8 aa, Mycobacterium tuberculosis
VVIGAGTA

SEQ ID NO: 163518 - protein, 8 aa, Mycobacterium tuberculosis
IGAGTAGY

SEQ ID NO: 163519 - protein, 8 aa, Mycobacterium tuberculosis
GTAGYNAA

SEQ ID NO: 163520 - protein, 8 aa, Mycobacterium tuberculosis
TAGYNAAR

SEQ ID NO: 163521 - protein, 8 aa, Mycobacterium tuberculosis
AARIANGM

SEQ ID NO: 163522 - protein, 8 aa, Mycobacterium tuberculosis
RIANGMGA

SEQ ID NO: 163523 - protein, 8 aa, Mycobacterium tuberculosis
GMGATVTV

SEQ ID NO: 163524 - protein, 8 aa, Mycobacterium tuberculosis
MGATVTVL

SEQ ID NO: 163525 - protein, 8 aa, Mycobacterium tuberculosis
DINIDKLR

SEQ ID NO: 163526 - protein, 8 aa, Mycobacterium tuberculosis
NIDKLRQL

SEQ ID NO: 163527 - protein, 8 aa, Mycobacterium tuberculosis
RQLDAEFC

SEQ ID NO: 163528 - protein, 8 aa, Mycobacterium tuberculosis
HTRYSSAY

SEQ ID NO: 163529 - protein, 8 aa, Mycobacterium tuberculosis
RYSSAYEL

SEQ ID NO: 163530 - protein, 8 aa, Mycobacterium tuberculosis
SAYELEGA

SEQ ID NO: 163531 - protein, 8 aa, Mycobacterium tuberculosis
ELEGAVKR

SEQ ID NO: 163532 - protein, 8 aa, Mycobacterium tuberculosis
AVKRADLV

SEQ ID NO: 163533 - protein, 8 aa, Mycobacterium tuberculosis
DLVIGAVL

SEQ ID NO: 163534 - protein, 8 aa, Mycobacterium tuberculosis
LVIGAVLV

SEQ ID NO: 163535 - protein, 8 aa, Mycobacterium tuberculosis
AVLVPGAK

SEQ ID NO: 163536 - protein, 8 aa, Mycobacterium tuberculosis
VLVPGAKA

SEQ ID NO: 163537 - protein, 8 aa, Mycobacterium tuberculosis
KLVSNSLV

SEQ ID NO: 163538 - protein, 8 aa, Mycobacterium tuberculosis
NSLVAHMK

SEQ ID NO: 163539 - protein, 8 aa, Mycobacterium tuberculosis
HMKPGAVL

SEQ ID NO: 163540 - protein, 8 aa, Mycobacterium tuberculosis
MKPGAVLV

SEQ ID NO: 163541 - protein, 8 aa, Mycobacterium tuberculosis
AVLVDIAI

SEQ ID NO: 163542 - protein, 8 aa, Mycobacterium tuberculosis
EGSRPTTY

SEQ ID NO: 163543 - protein, 8 aa, Mycobacterium tuberculosis
TTYDHPTF

SEQ ID NO: 163544 - protein, 8 aa, Mycobacterium tuberculosis
YDHPTFAV

SEQ ID NO: 163545 - protein, 8 aa, Mycobacterium tuberculosis
FAVHDTLF

SEQ ID NO: 163546 - protein, 8 aa, Mycobacterium tuberculosis
AVHDTLFY

SEQ ID NO: 163547 - protein, 8 aa, Mycobacterium tuberculosis
HDTLFYCV

SEQ ID NO: 163548 - protein, 8 aa, Mycobacterium tuberculosis
DTLFYCVA

SEQ ID NO: 163549 - protein, 8 aa, Mycobacterium tuberculosis
YCVANMPA

SEQ ID NO: 163550 - protein, 8 aa, Mycobacterium tuberculosis
VANMPASV

SEQ ID NO: 163551 - protein, 8 aa, Mycobacterium tuberculosis
NMPASVPK

SEQ ID NO: 163552 - protein, 8 aa, Mycobacterium tuberculosis
MPASVPKT

SEQ ID NO: 163553 - protein, 8 aa, Mycobacterium tuberculosis
SVPKTSTY

SEQ ID NO: 163554 - protein, 8 aa, Mycobacterium tuberculosis
VPKTSTYA

SEQ ID NO: 163555 - protein, 8 aa, Mycobacterium tuberculosis
STYALTNA

SEQ ID NO: 163556 - protein, 8 aa, Mycobacterium tuberculosis
YALTNATM

SEQ ID NO: 163557 - protein, 8 aa, Mycobacterium tuberculosis
LTNATMPY

SEQ ID NO: 163558 - protein, 8 aa, Mycobacterium tuberculosis
TNATMPYV

SEQ ID NO: 163559 - protein, 8 aa, Mycobacterium tuberculosis
NATMPYVL

SEQ ID NO: 163560 - protein, 8 aa, Mycobacterium tuberculosis
TMPYVLEL

SEQ ID NO: 163561 - protein, 8 aa, Mycobacterium tuberculosis
MPYVLELA

SEQ ID NO: 163562 - protein, 8 aa, Mycobacterium tuberculosis
ELADHGWR

SEQ ID NO: 163563 - protein, 8 aa, Mycobacterium tuberculosis
HGWRAACR

SEQ ID NO: 163564 - protein, 8 aa, Mycobacterium tuberculosis
ACRSNPAL

SEQ ID NO: 163565 - protein, 8 aa, Mycobacterium tuberculosis
RSNPALAK

SEQ ID NO: 163566 - protein, 8 aa, Mycobacterium tuberculosis
NPALAKGL

SEQ ID NO: 163567 - protein, 8 aa, Mycobacterium tuberculosis
ALAKGLST

SEQ ID NO: 163568 - protein, 8 aa, Mycobacterium tuberculosis
GLSTHEGA

SEQ ID NO: 163569 - protein, 8 aa, Mycobacterium tuberculosis
STHEGALL

SEQ ID NO: 163570 - protein, 8 aa, Mycobacterium tuberculosis
EGALLSER

SEQ ID NO: 163571 - protein, 8 aa, Mycobacterium tuberculosis
ALLSERVA

SEQ ID NO: 163572 - protein, 8 aa, Mycobacterium tuberculosis
LLSERVAT

SEQ ID NO: 163573 - protein, 8 aa, Mycobacterium tuberculosis
SERVATDL

SEQ ID NO: 163574 - protein, 8 aa, Mycobacterium tuberculosis
RVATDLGV

SEQ ID NO: 163575 - protein, 8 aa, Mycobacterium tuberculosis
VPFTEPAS

SEQ ID NO: 163576 - protein, 8 aa, Mycobacterium tuberculosis
FTEPASVL

SEQ ID NO: 163577 - protein, 9 aa, Mycobacterium tuberculosis
RVGIPTETK

SEQ ID NO: 163578 - protein, 9 aa, Mycobacterium tuberculosis
TETKNNEFR

SEQ ID NO: 163579 - protein, 9 aa, Mycobacterium tuberculosis
ETKNNEFRV

SEQ ID NO: 163580 - protein, 9 aa, Mycobacterium tuberculosis
RVAITPAGV

SEQ ID NO: 163581 - protein, 9 aa, Mycobacterium tuberculosis
ITPAGVAEL

SEQ ID NO: 163582 - protein, 9 aa, Mycobacterium tuberculosis
TPAGVAELT

SEQ ID NO: 163583 - protein, 9 aa, Mycobacterium tuberculosis
ELTRRGHEV

SEQ ID NO: 163584 - protein, 9 aa, Mycobacterium tuberculosis
SAITDADFK

SEQ ID NO: 163585 - protein, 9 aa, Mycobacterium tuberculosis
AITDADFKA

SEQ ID NO: 163586 - protein, 9 aa, Mycobacterium tuberculosis
FKAAGAQLV

SEQ ID NO: 163587 - protein, 9 aa, Mycobacterium tuberculosis
QLVGTADQV

SEQ ID NO: 163588 - protein, 9 aa, Mycobacterium tuberculosis
LVGTADQVW

SEQ ID NO: 163589 - protein, 9 aa, Mycobacterium tuberculosis
QVWADADLL

SEQ ID NO: 163590 - protein, 9 aa, Mycobacterium tuberculosis
VWADADLLL

SEQ ID NO: 163591 - protein, 9 aa, Mycobacterium tuberculosis
WADADLLLK

SEQ ID NO: 163592 - protein, 9 aa, Mycobacterium tuberculosis
ADADLLLKV

SEQ ID NO: 163593 - protein, 9 aa, Mycobacterium tuberculosis
LLLKVKEPI

SEQ ID NO: 163594 - protein, 9 aa, Mycobacterium tuberculosis
EPIAAEYGR

SEQ ID NO: 163595 - protein, 9 aa, Mycobacterium tuberculosis
IAAEYGRLR

SEQ ID NO: 163596 - protein, 9 aa, Mycobacterium tuberculosis
YGRLRHGQI

SEQ ID NO: 163597 - protein, 9 aa, Mycobacterium tuberculosis
RLRHGQILF

SEQ ID NO: 163598 - protein, 9 aa, Mycobacterium tuberculosis
RHGQILFTF

SEQ ID NO: 163599 - protein, 9 aa, Mycobacterium tuberculosis
QILFTFLHL

SEQ ID NO: 163600 - protein, 9 aa, Mycobacterium tuberculosis
ILFTFLHLA

SEQ ID NO: 163601 - protein, 9 aa, Mycobacterium tuberculosis
FTFLHLAAS

SEQ ID NO: 163602 - protein, 9 aa, Mycobacterium tuberculosis
TFLHLAASR

SEQ ID NO: 163603 - protein, 9 aa, Mycobacterium tuberculosis
FLHLAASRA

SEQ ID NO: 163604 - protein, 9 aa, Mycobacterium tuberculosis
ASRACTDAL

SEQ ID NO: 163605 - protein, 9 aa, Mycobacterium tuberculosis
ALLDSGTTS

SEQ ID NO: 163606 - protein, 9 aa, Mycobacterium tuberculosis
LLDSGTTSI

SEQ ID NO: 163607 - protein, 9 aa, Mycobacterium tuberculosis
DSGTTSIAY

SEQ ID NO: 163608 - protein, 9 aa, Mycobacterium tuberculosis
TTSIAYETV

SEQ ID NO: 163609 - protein, 9 aa, Mycobacterium tuberculosis
IAYETVQTA

SEQ ID NO: 163610 - protein, 9 aa, Mycobacterium tuberculosis
ETVQTADGA

SEQ ID NO: 163611 - protein, 9 aa, Mycobacterium tuberculosis
TVQTADGAL

SEQ ID NO: 163612 - protein, 9 aa, Mycobacterium tuberculosis
QTADGALPL

SEQ ID NO: 163613 - protein, 9 aa, Mycobacterium tuberculosis
TADGALPLL

SEQ ID NO: 163614 - protein, 9 aa, Mycobacterium tuberculosis
GALPLLAPM

SEQ ID NO: 163615 - protein, 9 aa, Mycobacterium tuberculosis
LPLLAPMSE

SEQ ID NO: 163616 - protein, 9 aa, Mycobacterium tuberculosis
PLLAPMSEV

SEQ ID NO: 163617 - protein, 9 aa, Mycobacterium tuberculosis
LLAPMSEVA

SEQ ID NO: 163618 - protein, 9 aa, Mycobacterium tuberculosis
PMSEVAGRL

SEQ ID NO: 163619 - protein, 9 aa, Mycobacterium tuberculosis
EVAGRLAAQ

SEQ ID NO: 163620 - protein, 9 aa, Mycobacterium tuberculosis
VAGRLAAQV

SEQ ID NO: 163621 - protein, 9 aa, Mycobacterium tuberculosis
RLAAQVGAY

SEQ ID NO: 163622 - protein, 9 aa, Mycobacterium tuberculosis
LAAQVGAYH

SEQ ID NO: 163623 - protein, 9 aa, Mycobacterium tuberculosis
AQVGAYHLM

SEQ ID NO: 163624 - protein, 9 aa, Mycobacterium tuberculosis
QVGAYHLMR

SEQ ID NO: 163625 - protein, 9 aa, Mycobacterium tuberculosis
HLMRTQGGR

SEQ ID NO: 163626 - protein, 9 aa, Mycobacterium tuberculosis
RTQGGRGVL

SEQ ID NO: 163627 - protein, 9 aa, Mycobacterium tuberculosis
VLMGGVPGV

SEQ ID NO: 163628 - protein, 9 aa, Mycobacterium tuberculosis
GVEPADVVV

SEQ ID NO: 163629 - protein, 9 aa, Mycobacterium tuberculosis
VIGAGTAGY

SEQ ID NO: 163630 - protein, 9 aa, Mycobacterium tuberculosis
GTAGYNAAR

SEQ ID NO: 163631 - protein, 9 aa, Mycobacterium tuberculosis
NAARIANGM

SEQ ID NO: 163632 - protein, 9 aa, Mycobacterium tuberculosis
RIANGMGAT

SEQ ID NO: 163633 - protein, 9 aa, Mycobacterium tuberculosis
IANGMGATV

SEQ ID NO: 163634 - protein, 9 aa, Mycobacterium tuberculosis
NGMGATVTV

SEQ ID NO: 163635 - protein, 9 aa, Mycobacterium tuberculosis
GMGATVTVL

SEQ ID NO: 163636 - protein, 9 aa, Mycobacterium tuberculosis
TVTVLDINI

SEQ ID NO: 163637 - protein, 9 aa, Mycobacterium tuberculosis
TVLDINIDK

SEQ ID NO: 163638 - protein, 9 aa, Mycobacterium tuberculosis
VLDINIDKL

SEQ ID NO: 163639 - protein, 9 aa, Mycobacterium tuberculosis
KLRQLDAEF

SEQ ID NO: 163640 - protein, 9 aa, Mycobacterium tuberculosis
AEFCGRIHT

SEQ ID NO: 163641 - protein, 9 aa, Mycobacterium tuberculosis
EFCGRIHTR

SEQ ID NO: 163642 - protein, 9 aa, Mycobacterium tuberculosis
FCGRIHTRY

SEQ ID NO: 163643 - protein, 9 aa, Mycobacterium tuberculosis
GRIHTRYSS

SEQ ID NO: 163644 - protein, 9 aa, Mycobacterium tuberculosis
RIHTRYSSA

SEQ ID NO: 163645 - protein, 9 aa, Mycobacterium tuberculosis
TRYSSAYEL

SEQ ID NO: 163646 - protein, 9 aa, Mycobacterium tuberculosis
SSAYELEGA

SEQ ID NO: 163647 - protein, 9 aa, Mycobacterium tuberculosis
SAYELEGAV

SEQ ID NO: 163648 - protein, 9 aa, Mycobacterium tuberculosis
AYELEGAVK

SEQ ID NO: 163649 - protein, 9 aa, Mycobacterium tuberculosis
ELEGAVKRA

SEQ ID NO: 163650 - protein, 9 aa, Mycobacterium tuberculosis
GAVKRADLV

SEQ ID NO: 163651 - protein, 9 aa, Mycobacterium tuberculosis
RADLVIGAV

SEQ ID NO: 163652 - protein, 9 aa, Mycobacterium tuberculosis
DLVIGAVLV

SEQ ID NO: 163653 - protein, 9 aa, Mycobacterium tuberculosis
GAVLVPGAK

SEQ ID NO: 163654 - protein, 9 aa, Mycobacterium tuberculosis
LVPGAKAPK

SEQ ID NO: 163655 - protein, 9 aa, Mycobacterium tuberculosis
VPGAKAPKL

SEQ ID NO: 163656 - protein, 9 aa, Mycobacterium tuberculosis
APKLVSNSL

SEQ ID NO: 163657 - protein, 9 aa, Mycobacterium tuberculosis
KLVSNSLVA

SEQ ID NO: 163658 - protein, 9 aa, Mycobacterium tuberculosis
SNSLVAHMK

SEQ ID NO: 163659 - protein, 9 aa, Mycobacterium tuberculosis
VAHMKPGAV

SEQ ID NO: 163660 - protein, 9 aa, Mycobacterium tuberculosis
AHMKPGAVL

SEQ ID NO: 163661 - protein, 9 aa, Mycobacterium tuberculosis
HMKPGAVLV

SEQ ID NO: 163662 - protein, 9 aa, Mycobacterium tuberculosis
KPGAVLVDI

SEQ ID NO: 163663 - protein, 9 aa, Mycobacterium tuberculosis
VLVDIAIDQ

SEQ ID NO: 163664 - protein, 9 aa, Mycobacterium tuberculosis
IAIDQGGCF

SEQ ID NO: 163665 - protein, 9 aa, Mycobacterium tuberculosis
RPTTYDHPT

SEQ ID NO: 163666 - protein, 9 aa, Mycobacterium tuberculosis
PTTYDHPTF

SEQ ID NO: 163667 - protein, 9 aa, Mycobacterium tuberculosis
TTYDHPTFA

SEQ ID NO: 163668 - protein, 9 aa, Mycobacterium tuberculosis
TYDHPTFAV

SEQ ID NO: 163669 - protein, 9 aa, Mycobacterium tuberculosis
HPTFAVHDT

SEQ ID NO: 163670 - protein, 9 aa, Mycobacterium tuberculosis
TFAVHDTLF

SEQ ID NO: 163671 - protein, 9 aa, Mycobacterium tuberculosis
FAVHDTLFY

SEQ ID NO: 163672 - protein, 9 aa, Mycobacterium tuberculosis
AVHDTLFYC

SEQ ID NO: 163673 - protein, 9 aa, Mycobacterium tuberculosis
TLFYCVANM

SEQ ID NO: 163674 - protein, 9 aa, Mycobacterium tuberculosis
CVANMPASV

SEQ ID NO: 163675 - protein, 9 aa, Mycobacterium tuberculosis
ANMPASVPK

SEQ ID NO: 163676 - protein, 9 aa, Mycobacterium tuberculosis
MPASVPKTS

SEQ ID NO: 163677 - protein, 9 aa, Mycobacterium tuberculosis
ASVPKTSTY

SEQ ID NO: 163678 - protein, 9 aa, Mycobacterium tuberculosis
SVPKTSTYA

SEQ ID NO: 163679 - protein, 9 aa, Mycobacterium tuberculosis
VPKTSTYAL

SEQ ID NO: 163680 - protein, 9 aa, Mycobacterium tuberculosis
TSTYALTNA

SEQ ID NO: 163681 - protein, 9 aa, Mycobacterium tuberculosis
STYALTNAT

SEQ ID NO: 163682 - protein, 9 aa, Mycobacterium tuberculosis
TYALTNATM

SEQ ID NO: 163683 - protein, 9 aa, Mycobacterium tuberculosis
ALTNATMPY

SEQ ID NO: 163684 - protein, 9 aa, Mycobacterium tuberculosis
LTNATMPYV

SEQ ID NO: 163685 - protein, 9 aa, Mycobacterium tuberculosis
ATMPYVLEL

SEQ ID NO: 163686 - protein, 9 aa, Mycobacterium tuberculosis
TMPYVLELA

SEQ ID NO: 163687 - protein, 9 aa, Mycobacterium tuberculosis
MPYVLELAD

SEQ ID NO: 163688 - protein, 9 aa, Mycobacterium tuberculosis
ELADHGWRA

SEQ ID NO: 163689 - protein, 9 aa, Mycobacterium tuberculosis
DHGWRAACR

SEQ ID NO: 163690 - protein, 9 aa, Mycobacterium tuberculosis
RAACRSNPA

SEQ ID NO: 163691 - protein, 9 aa, Mycobacterium tuberculosis
GLSTHEGAL

SEQ ID NO: 163692 - protein, 9 aa, Mycobacterium tuberculosis
EGALLSERV

SEQ ID NO: 163693 - protein, 9 aa, Mycobacterium tuberculosis
ALLSERVAT

SEQ ID NO: 163694 - protein, 9 aa, Mycobacterium tuberculosis
ERVATDLGV

SEQ ID NO: 163695 - protein, 9 aa, Mycobacterium tuberculosis
VATDLGVPF

SEQ ID NO: 163696 - protein, 9 aa, Mycobacterium tuberculosis
LGVPFTEPA

SEQ ID NO: 163697 - protein, 9 aa, Mycobacterium tuberculosis
VPFTEPASV

SEQ ID NO: 163698 - protein, 9 aa, Mycobacterium tuberculosis
FTEPASVLA

SEQ ID NO: 163699 - protein, 10 aa, Mycobacterium tuberculosis
MRVGIPTETK

SEQ ID NO: 163700 - protein, 10 aa, Mycobacterium tuberculosis
IPTETKNNEF

SEQ ID NO: 163701 - protein, 10 aa, Mycobacterium tuberculosis
FRVAITPAGV

SEQ ID NO: 163702 - protein, 10 aa, Mycobacterium tuberculosis
AITPAGVAEL

SEQ ID NO: 163703 - protein, 10 aa, Mycobacterium tuberculosis
TPAGVAELTR

SEQ ID NO: 163704 - protein, 10 aa, Mycobacterium tuberculosis
AELTRRGHEV

SEQ ID NO: 163705 - protein, 10 aa, Mycobacterium tuberculosis
ELTRRGHEVL

SEQ ID NO: 163706 - protein, 10 aa, Mycobacterium tuberculosis
IQAGAGEGSA

SEQ ID NO: 163707 - protein, 10 aa, Mycobacterium tuberculosis
GSAITDADFK

SEQ ID NO: 163708 - protein, 10 aa, Mycobacterium tuberculosis
AITDADFKAA

SEQ ID NO: 163709 - protein, 10 aa, Mycobacterium tuberculosis
AQLVGTADQV

SEQ ID NO: 163710 - protein, 10 aa, Mycobacterium tuberculosis
QLVGTADQVW

SEQ ID NO: 163711 - protein, 10 aa, Mycobacterium tuberculosis
QVWADADLLL

SEQ ID NO: 163712 - protein, 10 aa, Mycobacterium tuberculosis
VWADADLLLK

SEQ ID NO: 163713 - protein, 10 aa, Mycobacterium tuberculosis
WADADLLLKV

SEQ ID NO: 163714 - protein, 10 aa, Mycobacterium tuberculosis
LLLKVKEPIA

SEQ ID NO: 163715 - protein, 10 aa, Mycobacterium tuberculosis
LLKVKEPIAA

SEQ ID NO: 163716 - protein, 10 aa, Mycobacterium tuberculosis
KVKEPIAAEY

SEQ ID NO: 163717 - protein, 10 aa, Mycobacterium tuberculosis
EPIAAEYGRL

SEQ ID NO: 163718 - protein, 10 aa, Mycobacterium tuberculosis
EYGRLRHGQI

SEQ ID NO: 163719 - protein, 10 aa, Mycobacterium tuberculosis
YGRLRHGQIL

SEQ ID NO: 163720 - protein, 10 aa, Mycobacterium tuberculosis
GRLRHGQILF

SEQ ID NO: 163721 - protein, 10 aa, Mycobacterium tuberculosis
RLRHGQILFT

SEQ ID NO: 163722 - protein, 10 aa, Mycobacterium tuberculosis
LRHGQILFTF

SEQ ID NO: 163723 - protein, 10 aa, Mycobacterium tuberculosis
GQILFTFLHL

SEQ ID NO: 163724 - protein, 10 aa, Mycobacterium tuberculosis
QILFTFLHLA

SEQ ID NO: 163725 - protein, 10 aa, Mycobacterium tuberculosis
ILFTFLHLAA

SEQ ID NO: 163726 - protein, 10 aa, Mycobacterium tuberculosis
FTFLHLAASR

SEQ ID NO: 163727 - protein, 10 aa, Mycobacterium tuberculosis
FLHLAASRAC

SEQ ID NO: 163728 - protein, 10 aa, Mycobacterium tuberculosis
AASRACTDAL

SEQ ID NO: 163729 - protein, 10 aa, Mycobacterium tuberculosis
ALLDSGTTSI

SEQ ID NO: 163730 - protein, 10 aa, Mycobacterium tuberculosis
LLDSGTTSIA

SEQ ID NO: 163731 - protein, 10 aa, Mycobacterium tuberculosis
LDSGTTSIAY

SEQ ID NO: 163732 - protein, 10 aa, Mycobacterium tuberculosis
GTTSIAYETV

SEQ ID NO: 163733 - protein, 10 aa, Mycobacterium tuberculosis
SIAYETVQTA

SEQ ID NO: 163734 - protein, 10 aa, Mycobacterium tuberculosis
ETVQTADGAL

SEQ ID NO: 163735 - protein, 10 aa, Mycobacterium tuberculosis
VQTADGALPL

SEQ ID NO: 163736 - protein, 10 aa, Mycobacterium tuberculosis
QTADGALPLL

SEQ ID NO: 163737 - protein, 10 aa, Mycobacterium tuberculosis
DGALPLLAPM

SEQ ID NO: 163738 - protein, 10 aa, Mycobacterium tuberculosis
LPLLAPMSEV

SEQ ID NO: 163739 - protein, 10 aa, Mycobacterium tuberculosis
PLLAPMSEVA

SEQ ID NO: 163740 - protein, 10 aa, Mycobacterium tuberculosis
LAPMSEVAGR

SEQ ID NO: 163741 - protein, 10 aa, Mycobacterium tuberculosis
APMSEVAGRL

SEQ ID NO: 163742 - protein, 10 aa, Mycobacterium tuberculosis
PMSEVAGRLA

SEQ ID NO: 163743 - protein, 10 aa, Mycobacterium tuberculosis
EVAGRLAAQV

SEQ ID NO: 163744 - protein, 10 aa, Mycobacterium tuberculosis
GRLAAQVGAY

SEQ ID NO: 163745 - protein, 10 aa, Mycobacterium tuberculosis
RLAAQVGAYH

SEQ ID NO: 163746 - protein, 10 aa, Mycobacterium tuberculosis
LAAQVGAYHL

SEQ ID NO: 163747 - protein, 10 aa, Mycobacterium tuberculosis
AQVGAYHLMR

SEQ ID NO: 163748 - protein, 10 aa, Mycobacterium tuberculosis
LMRTQGGRGV

SEQ ID NO: 163749 - protein, 10 aa, Mycobacterium tuberculosis
GVLMGGVPGV

SEQ ID NO: 163750 - protein, 10 aa, Mycobacterium tuberculosis
GVPGVEPADV

SEQ ID NO: 163751 - protein, 10 aa, Mycobacterium tuberculosis
VPGVEPADVV

SEQ ID NO: 163752 - protein, 10 aa, Mycobacterium tuberculosis
EPADVVVIGA

SEQ ID NO: 163753 - protein, 10 aa, Mycobacterium tuberculosis
VVIGAGTAGY

SEQ ID NO: 163754 - protein, 10 aa, Mycobacterium tuberculosis
GTAGYNAARI

SEQ ID NO: 163755 - protein, 10 aa, Mycobacterium tuberculosis
RIANGMGATV

SEQ ID NO: 163756 - protein, 10 aa, Mycobacterium tuberculosis
IANGMGATVT

SEQ ID NO: 163757 - protein, 10 aa, Mycobacterium tuberculosis
NGMGATVTVL

SEQ ID NO: 163758 - protein, 10 aa, Mycobacterium tuberculosis
MGATVTVLDI

SEQ ID NO: 163759 - protein, 10 aa, Mycobacterium tuberculosis
ATVTVLDINI

SEQ ID NO: 163760 - protein, 10 aa, Mycobacterium tuberculosis
VTVLDINIDK

SEQ ID NO: 163761 - protein, 10 aa, Mycobacterium tuberculosis
TVLDINIDKL

SEQ ID NO: 163762 - protein, 10 aa, Mycobacterium tuberculosis
RQLDAEFCGR

SEQ ID NO: 163763 - protein, 10 aa, Mycobacterium tuberculosis
QLDAEFCGRI

SEQ ID NO: 163764 - protein, 10 aa, Mycobacterium tuberculosis
AEFCGRIHTR

SEQ ID NO: 163765 - protein, 10 aa, Mycobacterium tuberculosis
EFCGRIHTRY

SEQ ID NO: 163766 - protein, 10 aa, Mycobacterium tuberculosis
RIHTRYSSAY

SEQ ID NO: 163767 - protein, 10 aa, Mycobacterium tuberculosis
HTRYSSAYEL

SEQ ID NO: 163768 - protein, 10 aa, Mycobacterium tuberculosis
YSSAYELEGA

SEQ ID NO: 163769 - protein, 10 aa, Mycobacterium tuberculosis
SSAYELEGAV

SEQ ID NO: 163770 - protein, 10 aa, Mycobacterium tuberculosis
SAYELEGAVK

SEQ ID NO: 163771 - protein, 10 aa, Mycobacterium tuberculosis
YELEGAVKRA

SEQ ID NO: 163772 - protein, 10 aa, Mycobacterium tuberculosis
EGAVKRADLV

SEQ ID NO: 163773 - protein, 10 aa, Mycobacterium tuberculosis
KRADLVIGAV

SEQ ID NO: 163774 - protein, 10 aa, Mycobacterium tuberculosis
VIGAVLVPGA

SEQ ID NO: 163775 - protein, 10 aa, Mycobacterium tuberculosis
VLVPGAKAPK

SEQ ID NO: 163776 - protein, 10 aa, Mycobacterium tuberculosis
LVPGAKAPKL

SEQ ID NO: 163777 - protein, 10 aa, Mycobacterium tuberculosis
VPGAKAPKLV

SEQ ID NO: 163778 - protein, 10 aa, Mycobacterium tuberculosis
APKLVSNSLV

SEQ ID NO: 163779 - protein, 10 aa, Mycobacterium tuberculosis
LVSNSLVAHM

SEQ ID NO: 163780 - protein, 10 aa, Mycobacterium tuberculosis
VSNSLVAHMK

SEQ ID NO: 163781 - protein, 10 aa, Mycobacterium tuberculosis
SLVAHMKPGA

SEQ ID NO: 163782 - protein, 10 aa, Mycobacterium tuberculosis
LVAHMKPGAV

SEQ ID NO: 163783 - protein, 10 aa, Mycobacterium tuberculosis
KPGAVLVDIA

SEQ ID NO: 163784 - protein, 10 aa, Mycobacterium tuberculosis
DIAIDQGGCF

SEQ ID NO: 163785 - protein, 10 aa, Mycobacterium tuberculosis
RPTTYDHPTF

SEQ ID NO: 163786 - protein, 10 aa, Mycobacterium tuberculosis
TTYDHPTFAV

SEQ ID NO: 163787 - protein, 10 aa, Mycobacterium tuberculosis
HPTFAVHDTL

SEQ ID NO: 163788 - protein, 10 aa, Mycobacterium tuberculosis
PTFAVHDTLF

SEQ ID NO: 163789 - protein, 10 aa, Mycobacterium tuberculosis
TFAVHDTLFY

SEQ ID NO: 163790 - protein, 10 aa, Mycobacterium tuberculosis
FAVHDTLFYC

SEQ ID NO: 163791 - protein, 10 aa, Mycobacterium tuberculosis
AVHDTLFYCV

SEQ ID NO: 163792 - protein, 10 aa, Mycobacterium tuberculosis
DTLFYCVANM

SEQ ID NO: 163793 - protein, 10 aa, Mycobacterium tuberculosis
YCVANMPASV

SEQ ID NO: 163794 - protein, 10 aa, Mycobacterium tuberculosis
VANMPASVPK

SEQ ID NO: 163795 - protein, 10 aa, Mycobacterium tuberculosis
MPASVPKTST

SEQ ID NO: 163796 - protein, 10 aa, Mycobacterium tuberculosis
SVPKTSTYAL

SEQ ID NO: 163797 - protein, 10 aa, Mycobacterium tuberculosis
VPKTSTYALT

SEQ ID NO: 163798 - protein, 10 aa, Mycobacterium tuberculosis
KTSTYALTNA

SEQ ID NO: 163799 - protein, 10 aa, Mycobacterium tuberculosis
STYALTNATM

SEQ ID NO: 163800 - protein, 10 aa, Mycobacterium tuberculosis
YALTNATMPY

SEQ ID NO: 163801 - protein, 10 aa, Mycobacterium tuberculosis
ALTNATMPYV

SEQ ID NO: 163802 - protein, 10 aa, Mycobacterium tuberculosis
LTNATMPYVL

SEQ ID NO: 163803 - protein, 10 aa, Mycobacterium tuberculosis
ATMPYVLELA

SEQ ID NO: 163804 - protein, 10 aa, Mycobacterium tuberculosis
MPYVLELADH

SEQ ID NO: 163805 - protein, 10 aa, Mycobacterium tuberculosis
YVLELADHGW

SEQ ID NO: 163806 - protein, 10 aa, Mycobacterium tuberculosis
ELADHGWRAA

SEQ ID NO: 163807 - protein, 10 aa, Mycobacterium tuberculosis
ADHGWRAACR

SEQ ID NO: 163808 - protein, 10 aa, Mycobacterium tuberculosis
WRAACRSNPA

SEQ ID NO: 163809 - protein, 10 aa, Mycobacterium tuberculosis
RAACRSNPAL

SEQ ID NO: 163810 - protein, 10 aa, Mycobacterium tuberculosis
ACRSNPALAK

SEQ ID NO: 163811 - protein, 10 aa, Mycobacterium tuberculosis
NPALAKGLST

SEQ ID NO: 163812 - protein, 10 aa, Mycobacterium tuberculosis
GLSTHEGALL

SEQ ID NO: 163813 - protein, 10 aa, Mycobacterium tuberculosis
LLSERVATDL

SEQ ID NO: 163814 - protein, 10 aa, Mycobacterium tuberculosis
SERVATDLGV

SEQ ID NO: 163815 - protein, 10 aa, Mycobacterium tuberculosis
RVATDLGVPF

SEQ ID NO: 163816 - protein, 10 aa, Mycobacterium tuberculosis
GVPFTEPASV

SEQ ID NO: 163817 - protein, 10 aa, Mycobacterium tuberculosis
VPFTEPASVL

SEQ ID NO: 163818 - protein, 11 aa, Mycobacterium tuberculosis
GIPTETKNNEF

SEQ ID NO: 163819 - protein, 11 aa, Mycobacterium tuberculosis
IPTETKNNEFR

SEQ ID NO: 163820 - protein, 11 aa, Mycobacterium tuberculosis
ETKNNEFRVAI

SEQ ID NO: 163821 - protein, 11 aa, Mycobacterium tuberculosis
ITPAGVAELTR

SEQ ID NO: 163822 - protein, 11 aa, Mycobacterium tuberculosis
TPAGVAELTRR

SEQ ID NO: 163823 - protein, 11 aa, Mycobacterium tuberculosis
AELTRRGHEVL

SEQ ID NO: 163824 - protein, 11 aa, Mycobacterium tuberculosis
ELTRRGHEVLI

SEQ ID NO: 163825 - protein, 11 aa, Mycobacterium tuberculosis
LIQAGAGEGSA

SEQ ID NO: 163826 - protein, 11 aa, Mycobacterium tuberculosis
IQAGAGEGSAI

SEQ ID NO: 163827 - protein, 11 aa, Mycobacterium tuberculosis
EGSAITDADFK

SEQ ID NO: 163828 - protein, 11 aa, Mycobacterium tuberculosis
AQLVGTADQVW

SEQ ID NO: 163829 - protein, 11 aa, Mycobacterium tuberculosis
QLVGTADQVWA

SEQ ID NO: 163830 - protein, 11 aa, Mycobacterium tuberculosis
QVWADADLLLK

SEQ ID NO: 163831 - protein, 11 aa, Mycobacterium tuberculosis
VWADADLLLKV

SEQ ID NO: 163832 - protein, 11 aa, Mycobacterium tuberculosis
LLLKVKEPIAA

SEQ ID NO: 163833 - protein, 11 aa, Mycobacterium tuberculosis
KEPIAAEYGRL

SEQ ID NO: 163834 - protein, 11 aa, Mycobacterium tuberculosis
EPIAAEYGRLR

SEQ ID NO: 163835 - protein, 11 aa, Mycobacterium tuberculosis
EYGRLRHGQIL

SEQ ID NO: 163836 - protein, 11 aa, Mycobacterium tuberculosis
RLRHGQILFTF

SEQ ID NO: 163837 - protein, 11 aa, Mycobacterium tuberculosis
GQILFTFLHLA

SEQ ID NO: 163838 - protein, 11 aa, Mycobacterium tuberculosis
QILFTFLHLAA

SEQ ID NO: 163839 - protein, 11 aa, Mycobacterium tuberculosis
ILFTFLHLAAS

SEQ ID NO: 163840 - protein, 11 aa, Mycobacterium tuberculosis
LFTFLHLAASR

SEQ ID NO: 163841 - protein, 11 aa, Mycobacterium tuberculosis
FTFLHLAASRA

SEQ ID NO: 163842 - protein, 11 aa, Mycobacterium tuberculosis
FLHLAASRACT

SEQ ID NO: 163843 - protein, 11 aa, Mycobacterium tuberculosis
HLAASRACTDA

SEQ ID NO: 163844 - protein, 11 aa, Mycobacterium tuberculosis
LAASRACTDAL

SEQ ID NO: 163845 - protein, 11 aa, Mycobacterium tuberculosis
ALLDSGTTSIA

SEQ ID NO: 163846 - protein, 11 aa, Mycobacterium tuberculosis
LLDSGTTSIAY

SEQ ID NO: 163847 - protein, 11 aa, Mycobacterium tuberculosis
YETVQTADGAL

SEQ ID NO: 163848 - protein, 11 aa, Mycobacterium tuberculosis
TVQTADGALPL

SEQ ID NO: 163849 - protein, 11 aa, Mycobacterium tuberculosis
VQTADGALPLL

SEQ ID NO: 163850 - protein, 11 aa, Mycobacterium tuberculosis
QTADGALPLLA

SEQ ID NO: 163851 - protein, 11 aa, Mycobacterium tuberculosis
ALPLLAPMSEV

SEQ ID NO: 163852 - protein, 11 aa, Mycobacterium tuberculosis
LPLLAPMSEVA

SEQ ID NO: 163853 - protein, 11 aa, Mycobacterium tuberculosis
LLAPMSEVAGR

SEQ ID NO: 163854 - protein, 11 aa, Mycobacterium tuberculosis
APMSEVAGRLA

SEQ ID NO: 163855 - protein, 11 aa, Mycobacterium tuberculosis
PMSEVAGRLAA

SEQ ID NO: 163856 - protein, 11 aa, Mycobacterium tuberculosis
SEVAGRLAAQV

SEQ ID NO: 163857 - protein, 11 aa, Mycobacterium tuberculosis
AGRLAAQVGAY

SEQ ID NO: 163858 - protein, 11 aa, Mycobacterium tuberculosis
GRLAAQVGAYH

SEQ ID NO: 163859 - protein, 11 aa, Mycobacterium tuberculosis
RLAAQVGAYHL

SEQ ID NO: 163860 - protein, 11 aa, Mycobacterium tuberculosis
LAAQVGAYHLM

SEQ ID NO: 163861 - protein, 11 aa, Mycobacterium tuberculosis
AAQVGAYHLMR

SEQ ID NO: 163862 - protein, 11 aa, Mycobacterium tuberculosis
AQVGAYHLMRT

SEQ ID NO: 163863 - protein, 11 aa, Mycobacterium tuberculosis
AYHLMRTQGGR

SEQ ID NO: 163864 - protein, 11 aa, Mycobacterium tuberculosis
HLMRTQGGRGV

SEQ ID NO: 163865 - protein, 11 aa, Mycobacterium tuberculosis
LMRTQGGRGVL

SEQ ID NO: 163866 - protein, 11 aa, Mycobacterium tuberculosis
VLMGGVPGVEP

SEQ ID NO: 163867 - protein, 11 aa, Mycobacterium tuberculosis
LMGGVPGVEPA

SEQ ID NO: 163868 - protein, 11 aa, Mycobacterium tuberculosis
GVPGVEPADVV

SEQ ID NO: 163869 - protein, 11 aa, Mycobacterium tuberculosis
VPGVEPADVVV

SEQ ID NO: 163870 - protein, 11 aa, Mycobacterium tuberculosis
VVVIGAGTAGY

SEQ ID NO: 163871 - protein, 11 aa, Mycobacterium tuberculosis
VIGAGTAGYNA

SEQ ID NO: 163872 - protein, 11 aa, Mycobacterium tuberculosis
GAGTAGYNAAR

SEQ ID NO: 163873 - protein, 11 aa, Mycobacterium tuberculosis
GYNAARIANGM

SEQ ID NO: 163874 - protein, 11 aa, Mycobacterium tuberculosis
NAARIANGMGA

SEQ ID NO: 163875 - protein, 11 aa, Mycobacterium tuberculosis
AARIANGMGAT

SEQ ID NO: 163876 - protein, 11 aa, Mycobacterium tuberculosis
IANGMGATVTV

SEQ ID NO: 163877 - protein, 11 aa, Mycobacterium tuberculosis
GMGATVTVLDI

SEQ ID NO: 163878 - protein, 11 aa, Mycobacterium tuberculosis
TVTVLDINIDK

SEQ ID NO: 163879 - protein, 11 aa, Mycobacterium tuberculosis
TVLDINIDKLR

SEQ ID NO: 163880 - protein, 11 aa, Mycobacterium tuberculosis
VLDINIDKLRQ

SEQ ID NO: 163881 - protein, 11 aa, Mycobacterium tuberculosis
RQLDAEFCGRI

SEQ ID NO: 163882 - protein, 11 aa, Mycobacterium tuberculosis
DAEFCGRIHTR

SEQ ID NO: 163883 - protein, 11 aa, Mycobacterium tuberculosis
AEFCGRIHTRY

SEQ ID NO: 163884 - protein, 11 aa, Mycobacterium tuberculosis
GRIHTRYSSAY

SEQ ID NO: 163885 - protein, 11 aa, Mycobacterium tuberculosis
IHTRYSSAYEL

SEQ ID NO: 163886 - protein, 11 aa, Mycobacterium tuberculosis
YSSAYELEGAV

SEQ ID NO: 163887 - protein, 11 aa, Mycobacterium tuberculosis
SSAYELEGAVK

SEQ ID NO: 163888 - protein, 11 aa, Mycobacterium tuberculosis
SAYELEGAVKR

SEQ ID NO: 163889 - protein, 11 aa, Mycobacterium tuberculosis
ELEGAVKRADL

SEQ ID NO: 163890 - protein, 11 aa, Mycobacterium tuberculosis
KRADLVIGAVL

SEQ ID NO: 163891 - protein, 11 aa, Mycobacterium tuberculosis
RADLVIGAVLV

SEQ ID NO: 163892 - protein, 11 aa, Mycobacterium tuberculosis
LVIGAVLVPGA

SEQ ID NO: 163893 - protein, 11 aa, Mycobacterium tuberculosis
VIGAVLVPGAK

SEQ ID NO: 163894 - protein, 11 aa, Mycobacterium tuberculosis
AVLVPGAKAPK

SEQ ID NO: 163895 - protein, 11 aa, Mycobacterium tuberculosis
VLVPGAKAPKL

SEQ ID NO: 163896 - protein, 11 aa, Mycobacterium tuberculosis
LVPGAKAPKLV

SEQ ID NO: 163897 - protein, 11 aa, Mycobacterium tuberculosis
AKAPKLVSNSL

SEQ ID NO: 163898 - protein, 11 aa, Mycobacterium tuberculosis
KAPKLVSNSLV

SEQ ID NO: 163899 - protein, 11 aa, Mycobacterium tuberculosis
APKLVSNSLVA

SEQ ID NO: 163900 - protein, 11 aa, Mycobacterium tuberculosis
KLVSNSLVAHM

SEQ ID NO: 163901 - protein, 11 aa, Mycobacterium tuberculosis
LVSNSLVAHMK

SEQ ID NO: 163902 - protein, 11 aa, Mycobacterium tuberculosis
SLVAHMKPGAV

SEQ ID NO: 163903 - protein, 11 aa, Mycobacterium tuberculosis
VAHMKPGAVLV

SEQ ID NO: 163904 - protein, 11 aa, Mycobacterium tuberculosis
HMKPGAVLVDI

SEQ ID NO: 163905 - protein, 11 aa, Mycobacterium tuberculosis
KPGAVLVDIAI

SEQ ID NO: 163906 - protein, 11 aa, Mycobacterium tuberculosis
RPTTYDHPTFA

SEQ ID NO: 163907 - protein, 11 aa, Mycobacterium tuberculosis
PTTYDHPTFAV

SEQ ID NO: 163908 - protein, 11 aa, Mycobacterium tuberculosis
TTYDHPTFAVH

SEQ ID NO: 163909 - protein, 11 aa, Mycobacterium tuberculosis
HPTFAVHDTLF

SEQ ID NO: 163910 - protein, 11 aa, Mycobacterium tuberculosis
PTFAVHDTLFY

SEQ ID NO: 163911 - protein, 11 aa, Mycobacterium tuberculosis
FAVHDTLFYCV

SEQ ID NO: 163912 - protein, 11 aa, Mycobacterium tuberculosis
AVHDTLFYCVA

SEQ ID NO: 163913 - protein, 11 aa, Mycobacterium tuberculosis
TLFYCVANMPA

SEQ ID NO: 163914 - protein, 11 aa, Mycobacterium tuberculosis
CVANMPASVPK

SEQ ID NO: 163915 - protein, 11 aa, Mycobacterium tuberculosis
MPASVPKTSTY

SEQ ID NO: 163916 - protein, 11 aa, Mycobacterium tuberculosis
ASVPKTSTYAL

SEQ ID NO: 163917 - protein, 11 aa, Mycobacterium tuberculosis
TYALTNATMPY

SEQ ID NO: 163918 - protein, 11 aa, Mycobacterium tuberculosis
YALTNATMPYV

SEQ ID NO: 163919 - protein, 11 aa, Mycobacterium tuberculosis
ALTNATMPYVL

SEQ ID NO: 163920 - protein, 11 aa, Mycobacterium tuberculosis
NATMPYVLELA

SEQ ID NO: 163921 - protein, 11 aa, Mycobacterium tuberculosis
MPYVLELADHG

SEQ ID NO: 163922 - protein, 11 aa, Mycobacterium tuberculosis
PYVLELADHGW

SEQ ID NO: 163923 - protein, 11 aa, Mycobacterium tuberculosis
YVLELADHGWR

SEQ ID NO: 163924 - protein, 11 aa, Mycobacterium tuberculosis
VLELADHGWRA

SEQ ID NO: 163925 - protein, 11 aa, Mycobacterium tuberculosis
ELADHGWRAAC

SEQ ID NO: 163926 - protein, 11 aa, Mycobacterium tuberculosis
WRAACRSNPAL

SEQ ID NO: 163927 - protein, 11 aa, Mycobacterium tuberculosis
RAACRSNPALA

SEQ ID NO: 163928 - protein, 11 aa, Mycobacterium tuberculosis
AACRSNPALAK

SEQ ID NO: 163929 - protein, 11 aa, Mycobacterium tuberculosis
NPALAKGLSTH

SEQ ID NO: 163930 - protein, 11 aa, Mycobacterium tuberculosis
ALAKGLSTHEG

SEQ ID NO: 163931 - protein, 11 aa, Mycobacterium tuberculosis
STHEGALLSER

SEQ ID NO: 163932 - protein, 11 aa, Mycobacterium tuberculosis
ALLSERVATDL

SEQ ID NO: 163933 - protein, 11 aa, Mycobacterium tuberculosis
LLSERVATDLG

SEQ ID NO: 163934 - protein, 11 aa, Mycobacterium tuberculosis
LGVPFTEPASV

SEQ ID NO: 163935 - protein, 11 aa, Mycobacterium tuberculosis
VPFTEPASVLA

SEQ ID NO: 163936 - protein, 13 aa, Mycobacterium tuberculosis
MRVGIPTETKNNE

SEQ ID NO: 163937 - protein, 13 aa, Mycobacterium tuberculosis
RVGIPTETKNNEF

SEQ ID NO: 163938 - protein, 13 aa, Mycobacterium tuberculosis
VGIPTETKNNEFR

SEQ ID NO: 163939 - protein, 13 aa, Mycobacterium tuberculosis
GIPTETKNNEFRV

SEQ ID NO: 163940 - protein, 13 aa, Mycobacterium tuberculosis
IPTETKNNEFRVA

SEQ ID NO: 163941 - protein, 13 aa, Mycobacterium tuberculosis
PTETKNNEFRVAI

SEQ ID NO: 163942 - protein, 13 aa, Mycobacterium tuberculosis
TETKNNEFRVAIT

SEQ ID NO: 163943 - protein, 13 aa, Mycobacterium tuberculosis
ETKNNEFRVAITP

SEQ ID NO: 163944 - protein, 13 aa, Mycobacterium tuberculosis
TKNNEFRVAITPA

SEQ ID NO: 163945 - protein, 13 aa, Mycobacterium tuberculosis
KNNEFRVAITPAG

SEQ ID NO: 163946 - protein, 13 aa, Mycobacterium tuberculosis
NNEFRVAITPAGV

SEQ ID NO: 163947 - protein, 13 aa, Mycobacterium tuberculosis
NEFRVAITPAGVA

SEQ ID NO: 163948 - protein, 13 aa, Mycobacterium tuberculosis
EFRVAITPAGVAE

SEQ ID NO: 163949 - protein, 13 aa, Mycobacterium tuberculosis
FRVAITPAGVAEL

SEQ ID NO: 163950 - protein, 13 aa, Mycobacterium tuberculosis
RVAITPAGVAELT

SEQ ID NO: 163951 - protein, 13 aa, Mycobacterium tuberculosis
VAITPAGVAELTR

SEQ ID NO: 163952 - protein, 13 aa, Mycobacterium tuberculosis
AITPAGVAELTRR

SEQ ID NO: 163953 - protein, 13 aa, Mycobacterium tuberculosis
ITPAGVAELTRRG

SEQ ID NO: 163954 - protein, 13 aa, Mycobacterium tuberculosis
TPAGVAELTRRGH

SEQ ID NO: 163955 - protein, 13 aa, Mycobacterium tuberculosis
PAGVAELTRRGHE

SEQ ID NO: 163956 - protein, 13 aa, Mycobacterium tuberculosis
AGVAELTRRGHEV

SEQ ID NO: 163957 - protein, 13 aa, Mycobacterium tuberculosis
GVAELTRRGHEVL

SEQ ID NO: 163958 - protein, 13 aa, Mycobacterium tuberculosis
VAELTRRGHEVLI

SEQ ID NO: 163959 - protein, 13 aa, Mycobacterium tuberculosis
AELTRRGHEVLIQ

SEQ ID NO: 163960 - protein, 13 aa, Mycobacterium tuberculosis
ELTRRGHEVLIQA

SEQ ID NO: 163961 - protein, 13 aa, Mycobacterium tuberculosis
LTRRGHEVLIQAG

SEQ ID NO: 163962 - protein, 13 aa, Mycobacterium tuberculosis
TRRGHEVLIQAGA

SEQ ID NO: 163963 - protein, 13 aa, Mycobacterium tuberculosis
RRGHEVLIQAGAG

SEQ ID NO: 163964 - protein, 13 aa, Mycobacterium tuberculosis
RGHEVLIQAGAGE

SEQ ID NO: 163965 - protein, 13 aa, Mycobacterium tuberculosis
GHEVLIQAGAGEG

SEQ ID NO: 163966 - protein, 13 aa, Mycobacterium tuberculosis
HEVLIQAGAGEGS

SEQ ID NO: 163967 - protein, 13 aa, Mycobacterium tuberculosis
EVLIQAGAGEGSA

SEQ ID NO: 163968 - protein, 13 aa, Mycobacterium tuberculosis
VLIQAGAGEGSAI

SEQ ID NO: 163969 - protein, 13 aa, Mycobacterium tuberculosis
LIQAGAGEGSAIT

SEQ ID NO: 163970 - protein, 13 aa, Mycobacterium tuberculosis
IQAGAGEGSAITD

SEQ ID NO: 163971 - protein, 13 aa, Mycobacterium tuberculosis
QAGAGEGSAITDA

SEQ ID NO: 163972 - protein, 13 aa, Mycobacterium tuberculosis
AGAGEGSAITDAD

SEQ ID NO: 163973 - protein, 13 aa, Mycobacterium tuberculosis
GAGEGSAITDADF

SEQ ID NO: 163974 - protein, 13 aa, Mycobacterium tuberculosis
AGEGSAITDADFK

SEQ ID NO: 163975 - protein, 13 aa, Mycobacterium tuberculosis
GEGSAITDADFKA

SEQ ID NO: 163976 - protein, 13 aa, Mycobacterium tuberculosis
EGSAITDADFKAA

SEQ ID NO: 163977 - protein, 13 aa, Mycobacterium tuberculosis
GSAITDADFKAAG

SEQ ID NO: 163978 - protein, 13 aa, Mycobacterium tuberculosis
SAITDADFKAAGA

SEQ ID NO: 163979 - protein, 13 aa, Mycobacterium tuberculosis
AITDADFKAAGAQ

SEQ ID NO: 163980 - protein, 13 aa, Mycobacterium tuberculosis
ITDADFKAAGAQL

SEQ ID NO: 163981 - protein, 13 aa, Mycobacterium tuberculosis
TDADFKAAGAQLV

SEQ ID NO: 163982 - protein, 13 aa, Mycobacterium tuberculosis
DADFKAAGAQLVG

SEQ ID NO: 163983 - protein, 13 aa, Mycobacterium tuberculosis
ADFKAAGAQLVGT

SEQ ID NO: 163984 - protein, 13 aa, Mycobacterium tuberculosis
DFKAAGAQLVGTA

SEQ ID NO: 163985 - protein, 13 aa, Mycobacterium tuberculosis
FKAAGAQLVGTAD

SEQ ID NO: 163986 - protein, 13 aa, Mycobacterium tuberculosis
KAAGAQLVGTADQ

SEQ ID NO: 163987 - protein, 13 aa, Mycobacterium tuberculosis
AAGAQLVGTADQV

SEQ ID NO: 163988 - protein, 13 aa, Mycobacterium tuberculosis
AGAQLVGTADQVW

SEQ ID NO: 163989 - protein, 13 aa, Mycobacterium tuberculosis
GAQLVGTADQVWA

SEQ ID NO: 163990 - protein, 13 aa, Mycobacterium tuberculosis
AQLVGTADQVWAD

SEQ ID NO: 163991 - protein, 13 aa, Mycobacterium tuberculosis
QLVGTADQVWADA

SEQ ID NO: 163992 - protein, 13 aa, Mycobacterium tuberculosis
LVGTADQVWADAD

SEQ ID NO: 163993 - protein, 13 aa, Mycobacterium tuberculosis
VGTADQVWADADL

SEQ ID NO: 163994 - protein, 13 aa, Mycobacterium tuberculosis
GTADQVWADADLL

SEQ ID NO: 163995 - protein, 13 aa, Mycobacterium tuberculosis
TADQVWADADLLL

SEQ ID NO: 163996 - protein, 13 aa, Mycobacterium tuberculosis
ADQVWADADLLLK

SEQ ID NO: 163997 - protein, 13 aa, Mycobacterium tuberculosis
DQVWADADLLLKV

SEQ ID NO: 163998 - protein, 13 aa, Mycobacterium tuberculosis
QVWADADLLLKVK

SEQ ID NO: 163999 - protein, 13 aa, Mycobacterium tuberculosis
VWADADLLLKVKE

SEQ ID NO: 164000 - protein, 13 aa, Mycobacterium tuberculosis
WADADLLLKVKEP

SEQ ID NO: 164001 - protein, 13 aa, Mycobacterium tuberculosis
ADADLLLKVKEPI

SEQ ID NO: 164002 - protein, 13 aa, Mycobacterium tuberculosis
DADLLLKVKEPIA

SEQ ID NO: 164003 - protein, 13 aa, Mycobacterium tuberculosis
ADLLLKVKEPIAA

SEQ ID NO: 164004 - protein, 13 aa, Mycobacterium tuberculosis
DLLLKVKEPIAAE

SEQ ID NO: 164005 - protein, 13 aa, Mycobacterium tuberculosis
LLLKVKEPIAAEY

SEQ ID NO: 164006 - protein, 13 aa, Mycobacterium tuberculosis
LLKVKEPIAAEYG

SEQ ID NO: 164007 - protein, 13 aa, Mycobacterium tuberculosis
LKVKEPIAAEYGR

SEQ ID NO: 164008 - protein, 13 aa, Mycobacterium tuberculosis
KVKEPIAAEYGRL

SEQ ID NO: 164009 - protein, 13 aa, Mycobacterium tuberculosis
VKEPIAAEYGRLR

SEQ ID NO: 164010 - protein, 13 aa, Mycobacterium tuberculosis
KEPIAAEYGRLRH

SEQ ID NO: 164011 - protein, 13 aa, Mycobacterium tuberculosis
EPIAAEYGRLRHG

SEQ ID NO: 164012 - protein, 13 aa, Mycobacterium tuberculosis
PIAAEYGRLRHGQ

SEQ ID NO: 164013 - protein, 13 aa, Mycobacterium tuberculosis
IAAEYGRLRHGQI

SEQ ID NO: 164014 - protein, 13 aa, Mycobacterium tuberculosis
AAEYGRLRHGQIL

SEQ ID NO: 164015 - protein, 13 aa, Mycobacterium tuberculosis
AEYGRLRHGQILF

SEQ ID NO: 164016 - protein, 13 aa, Mycobacterium tuberculosis
EYGRLRHGQILFT

SEQ ID NO: 164017 - protein, 13 aa, Mycobacterium tuberculosis
YGRLRHGQILFTF

SEQ ID NO: 164018 - protein, 13 aa, Mycobacterium tuberculosis
GRLRHGQILFTFL

SEQ ID NO: 164019 - protein, 13 aa, Mycobacterium tuberculosis
RLRHGQILFTFLH

SEQ ID NO: 164020 - protein, 13 aa, Mycobacterium tuberculosis
LRHGQILFTFLHL

SEQ ID NO: 164021 - protein, 13 aa, Mycobacterium tuberculosis
RHGQILFTFLHLA

SEQ ID NO: 164022 - protein, 13 aa, Mycobacterium tuberculosis
HGQILFTFLHLAA

SEQ ID NO: 164023 - protein, 13 aa, Mycobacterium tuberculosis
GQILFTFLHLAAS

SEQ ID NO: 164024 - protein, 13 aa, Mycobacterium tuberculosis
QILFTFLHLAASR

SEQ ID NO: 164025 - protein, 13 aa, Mycobacterium tuberculosis
ILFTFLHLAASRA

SEQ ID NO: 164026 - protein, 13 aa, Mycobacterium tuberculosis
LFTFLHLAASRAC

SEQ ID NO: 164027 - protein, 13 aa, Mycobacterium tuberculosis
FTFLHLAASRACT

SEQ ID NO: 164028 - protein, 13 aa, Mycobacterium tuberculosis
TFLHLAASRACTD

SEQ ID NO: 164029 - protein, 13 aa, Mycobacterium tuberculosis
FLHLAASRACTDA

SEQ ID NO: 164030 - protein, 13 aa, Mycobacterium tuberculosis
LHLAASRACTDAL

SEQ ID NO: 164031 - protein, 13 aa, Mycobacterium tuberculosis
HLAASRACTDALL

SEQ ID NO: 164032 - protein, 13 aa, Mycobacterium tuberculosis
LAASRACTDALLD

SEQ ID NO: 164033 - protein, 13 aa, Mycobacterium tuberculosis
AASRACTDALLDS

SEQ ID NO: 164034 - protein, 13 aa, Mycobacterium tuberculosis
ASRACTDALLDSG

SEQ ID NO: 164035 - protein, 13 aa, Mycobacterium tuberculosis
SRACTDALLDSGT

SEQ ID NO: 164036 - protein, 13 aa, Mycobacterium tuberculosis
RACTDALLDSGTT

SEQ ID NO: 164037 - protein, 13 aa, Mycobacterium tuberculosis
ACTDALLDSGTTS

SEQ ID NO: 164038 - protein, 13 aa, Mycobacterium tuberculosis
CTDALLDSGTTSI

SEQ ID NO: 164039 - protein, 13 aa, Mycobacterium tuberculosis
TDALLDSGTTSIA

SEQ ID NO: 164040 - protein, 13 aa, Mycobacterium tuberculosis
DALLDSGTTSIAY

SEQ ID NO: 164041 - protein, 13 aa, Mycobacterium tuberculosis
ALLDSGTTSIAYE

SEQ ID NO: 164042 - protein, 13 aa, Mycobacterium tuberculosis
LLDSGTTSIAYET

SEQ ID NO: 164043 - protein, 13 aa, Mycobacterium tuberculosis
LDSGTTSIAYETV

SEQ ID NO: 164044 - protein, 13 aa, Mycobacterium tuberculosis
DSGTTSIAYETVQ

SEQ ID NO: 164045 - protein, 13 aa, Mycobacterium tuberculosis
SGTTSIAYETVQT

SEQ ID NO: 164046 - protein, 13 aa, Mycobacterium tuberculosis
GTTSIAYETVQTA

SEQ ID NO: 164047 - protein, 13 aa, Mycobacterium tuberculosis
TTSIAYETVQTAD

SEQ ID NO: 164048 - protein, 13 aa, Mycobacterium tuberculosis
TSIAYETVQTADG

SEQ ID NO: 164049 - protein, 13 aa, Mycobacterium tuberculosis
SIAYETVQTADGA

SEQ ID NO: 164050 - protein, 13 aa, Mycobacterium tuberculosis
IAYETVQTADGAL

SEQ ID NO: 164051 - protein, 13 aa, Mycobacterium tuberculosis
AYETVQTADGALP

SEQ ID NO: 164052 - protein, 13 aa, Mycobacterium tuberculosis
YETVQTADGALPL

SEQ ID NO: 164053 - protein, 13 aa, Mycobacterium tuberculosis
ETVQTADGALPLL

SEQ ID NO: 164054 - protein, 13 aa, Mycobacterium tuberculosis
TVQTADGALPLLA

SEQ ID NO: 164055 - protein, 13 aa, Mycobacterium tuberculosis
VQTADGALPLLAP

SEQ ID NO: 164056 - protein, 13 aa, Mycobacterium tuberculosis
QTADGALPLLAPM

SEQ ID NO: 164057 - protein, 13 aa, Mycobacterium tuberculosis
TADGALPLLAPMS

SEQ ID NO: 164058 - protein, 13 aa, Mycobacterium tuberculosis
ADGALPLLAPMSE

SEQ ID NO: 164059 - protein, 13 aa, Mycobacterium tuberculosis
DGALPLLAPMSEV

SEQ ID NO: 164060 - protein, 13 aa, Mycobacterium tuberculosis
GALPLLAPMSEVA

SEQ ID NO: 164061 - protein, 13 aa, Mycobacterium tuberculosis
ALPLLAPMSEVAG

SEQ ID NO: 164062 - protein, 13 aa, Mycobacterium tuberculosis
LPLLAPMSEVAGR

SEQ ID NO: 164063 - protein, 13 aa, Mycobacterium tuberculosis
PLLAPMSEVAGRL

SEQ ID NO: 164064 - protein, 13 aa, Mycobacterium tuberculosis
LLAPMSEVAGRLA

SEQ ID NO: 164065 - protein, 13 aa, Mycobacterium tuberculosis
LAPMSEVAGRLAA

SEQ ID NO: 164066 - protein, 13 aa, Mycobacterium tuberculosis
APMSEVAGRLAAQ

SEQ ID NO: 164067 - protein, 13 aa, Mycobacterium tuberculosis
PMSEVAGRLAAQV

SEQ ID NO: 164068 - protein, 13 aa, Mycobacterium tuberculosis
MSEVAGRLAAQVG

SEQ ID NO: 164069 - protein, 13 aa, Mycobacterium tuberculosis
SEVAGRLAAQVGA

SEQ ID NO: 164070 - protein, 13 aa, Mycobacterium tuberculosis
EVAGRLAAQVGAY

SEQ ID NO: 164071 - protein, 13 aa, Mycobacterium tuberculosis
VAGRLAAQVGAYH

SEQ ID NO: 164072 - protein, 13 aa, Mycobacterium tuberculosis
AGRLAAQVGAYHL

SEQ ID NO: 164073 - protein, 13 aa, Mycobacterium tuberculosis
GRLAAQVGAYHLM

SEQ ID NO: 164074 - protein, 13 aa, Mycobacterium tuberculosis
RLAAQVGAYHLMR

SEQ ID NO: 164075 - protein, 13 aa, Mycobacterium tuberculosis
LAAQVGAYHLMRT

SEQ ID NO: 164076 - protein, 13 aa, Mycobacterium tuberculosis
AAQVGAYHLMRTQ

SEQ ID NO: 164077 - protein, 13 aa, Mycobacterium tuberculosis
AQVGAYHLMRTQG

SEQ ID NO: 164078 - protein, 13 aa, Mycobacterium tuberculosis
QVGAYHLMRTQGG

SEQ ID NO: 164079 - protein, 13 aa, Mycobacterium tuberculosis
VGAYHLMRTQGGR

SEQ ID NO: 164080 - protein, 13 aa, Mycobacterium tuberculosis
GAYHLMRTQGGRG

SEQ ID NO: 164081 - protein, 13 aa, Mycobacterium tuberculosis
AYHLMRTQGGRGV

SEQ ID NO: 164082 - protein, 13 aa, Mycobacterium tuberculosis
YHLMRTQGGRGVL

SEQ ID NO: 164083 - protein, 13 aa, Mycobacterium tuberculosis
HLMRTQGGRGVLM

SEQ ID NO: 164084 - protein, 13 aa, Mycobacterium tuberculosis
LMRTQGGRGVLMG

SEQ ID NO: 164085 - protein, 13 aa, Mycobacterium tuberculosis
MRTQGGRGVLMGG

SEQ ID NO: 164086 - protein, 13 aa, Mycobacterium tuberculosis
RTQGGRGVLMGGV

SEQ ID NO: 164087 - protein, 13 aa, Mycobacterium tuberculosis
TQGGRGVLMGGVP

SEQ ID NO: 164088 - protein, 13 aa, Mycobacterium tuberculosis
QGGRGVLMGGVPG

SEQ ID NO: 164089 - protein, 13 aa, Mycobacterium tuberculosis
GGRGVLMGGVPGV

SEQ ID NO: 164090 - protein, 13 aa, Mycobacterium tuberculosis
GRGVLMGGVPGVE

SEQ ID NO: 164091 - protein, 13 aa, Mycobacterium tuberculosis
RGVLMGGVPGVEP

SEQ ID NO: 164092 - protein, 13 aa, Mycobacterium tuberculosis
GVLMGGVPGVEPA

SEQ ID NO: 164093 - protein, 13 aa, Mycobacterium tuberculosis
VLMGGVPGVEPAD

SEQ ID NO: 164094 - protein, 13 aa, Mycobacterium tuberculosis
LMGGVPGVEPADV

SEQ ID NO: 164095 - protein, 13 aa, Mycobacterium tuberculosis
MGGVPGVEPADVV

SEQ ID NO: 164096 - protein, 13 aa, Mycobacterium tuberculosis
GGVPGVEPADVVV

SEQ ID NO: 164097 - protein, 13 aa, Mycobacterium tuberculosis
GVPGVEPADVVVI

SEQ ID NO: 164098 - protein, 13 aa, Mycobacterium tuberculosis
VPGVEPADVVVIG

SEQ ID NO: 164099 - protein, 13 aa, Mycobacterium tuberculosis
PGVEPADVVVIGA

SEQ ID NO: 164100 - protein, 13 aa, Mycobacterium tuberculosis
GVEPADVVVIGAG

SEQ ID NO: 164101 - protein, 13 aa, Mycobacterium tuberculosis
VEPADVVVIGAGT

SEQ ID NO: 164102 - protein, 13 aa, Mycobacterium tuberculosis
EPADVVVIGAGTA

SEQ ID NO: 164103 - protein, 13 aa, Mycobacterium tuberculosis
PADVVVIGAGTAG

SEQ ID NO: 164104 - protein, 13 aa, Mycobacterium tuberculosis
ADVVVIGAGTAGY

SEQ ID NO: 164105 - protein, 13 aa, Mycobacterium tuberculosis
DVVVIGAGTAGYN

SEQ ID NO: 164106 - protein, 13 aa, Mycobacterium tuberculosis
VVVIGAGTAGYNA

SEQ ID NO: 164107 - protein, 13 aa, Mycobacterium tuberculosis
VVIGAGTAGYNAA

SEQ ID NO: 164108 - protein, 13 aa, Mycobacterium tuberculosis
VIGAGTAGYNAAR

SEQ ID NO: 164109 - protein, 13 aa, Mycobacterium tuberculosis
IGAGTAGYNAARI

SEQ ID NO: 164110 - protein, 13 aa, Mycobacterium tuberculosis
GAGTAGYNAARIA

SEQ ID NO: 164111 - protein, 13 aa, Mycobacterium tuberculosis
AGTAGYNAARIAN

SEQ ID NO: 164112 - protein, 13 aa, Mycobacterium tuberculosis
GTAGYNAARIANG

SEQ ID NO: 164113 - protein, 13 aa, Mycobacterium tuberculosis
TAGYNAARIANGM

SEQ ID NO: 164114 - protein, 13 aa, Mycobacterium tuberculosis
AGYNAARIANGMG

SEQ ID NO: 164115 - protein, 13 aa, Mycobacterium tuberculosis
GYNAARIANGMGA

SEQ ID NO: 164116 - protein, 13 aa, Mycobacterium tuberculosis
YNAARIANGMGAT

SEQ ID NO: 164117 - protein, 13 aa, Mycobacterium tuberculosis
NAARIANGMGATV

SEQ ID NO: 164118 - protein, 13 aa, Mycobacterium tuberculosis
AARIANGMGATVT

SEQ ID NO: 164119 - protein, 13 aa, Mycobacterium tuberculosis
ARIANGMGATVTV

SEQ ID NO: 164120 - protein, 13 aa, Mycobacterium tuberculosis
RIANGMGATVTVL

SEQ ID NO: 164121 - protein, 13 aa, Mycobacterium tuberculosis
IANGMGATVTVLD

SEQ ID NO: 164122 - protein, 13 aa, Mycobacterium tuberculosis
ANGMGATVTVLDI

SEQ ID NO: 164123 - protein, 13 aa, Mycobacterium tuberculosis
NGMGATVTVLDIN

SEQ ID NO: 164124 - protein, 13 aa, Mycobacterium tuberculosis
GMGATVTVLDINI

SEQ ID NO: 164125 - protein, 13 aa, Mycobacterium tuberculosis
MGATVTVLDINID

SEQ ID NO: 164126 - protein, 13 aa, Mycobacterium tuberculosis
GATVTVLDINIDK

SEQ ID NO: 164127 - protein, 13 aa, Mycobacterium tuberculosis
ATVTVLDINIDKL

SEQ ID NO: 164128 - protein, 13 aa, Mycobacterium tuberculosis
TVTVLDINIDKLR

SEQ ID NO: 164129 - protein, 13 aa, Mycobacterium tuberculosis
VTVLDINIDKLRQ

SEQ ID NO: 164130 - protein, 13 aa, Mycobacterium tuberculosis
TVLDINIDKLRQL

SEQ ID NO: 164131 - protein, 13 aa, Mycobacterium tuberculosis
VLDINIDKLRQLD

SEQ ID NO: 164132 - protein, 13 aa, Mycobacterium tuberculosis
LDINIDKLRQLDA

SEQ ID NO: 164133 - protein, 13 aa, Mycobacterium tuberculosis
DINIDKLRQLDAE

SEQ ID NO: 164134 - protein, 13 aa, Mycobacterium tuberculosis
INIDKLRQLDAEF

SEQ ID NO: 164135 - protein, 13 aa, Mycobacterium tuberculosis
NIDKLRQLDAEFC

SEQ ID NO: 164136 - protein, 13 aa, Mycobacterium tuberculosis
IDKLRQLDAEFCG

SEQ ID NO: 164137 - protein, 13 aa, Mycobacterium tuberculosis
DKLRQLDAEFCGR

SEQ ID NO: 164138 - protein, 13 aa, Mycobacterium tuberculosis
KLRQLDAEFCGRI

SEQ ID NO: 164139 - protein, 13 aa, Mycobacterium tuberculosis
LRQLDAEFCGRIH

SEQ ID NO: 164140 - protein, 13 aa, Mycobacterium tuberculosis
RQLDAEFCGRIHT

SEQ ID NO: 164141 - protein, 13 aa, Mycobacterium tuberculosis
QLDAEFCGRIHTR

SEQ ID NO: 164142 - protein, 13 aa, Mycobacterium tuberculosis
LDAEFCGRIHTRY

SEQ ID NO: 164143 - protein, 13 aa, Mycobacterium tuberculosis
DAEFCGRIHTRYS

SEQ ID NO: 164144 - protein, 13 aa, Mycobacterium tuberculosis
AEFCGRIHTRYSS

SEQ ID NO: 164145 - protein, 13 aa, Mycobacterium tuberculosis
EFCGRIHTRYSSA

SEQ ID NO: 164146 - protein, 13 aa, Mycobacterium tuberculosis
FCGRIHTRYSSAY

SEQ ID NO: 164147 - protein, 13 aa, Mycobacterium tuberculosis
CGRIHTRYSSAYE

SEQ ID NO: 164148 - protein, 13 aa, Mycobacterium tuberculosis
GRIHTRYSSAYEL

SEQ ID NO: 164149 - protein, 13 aa, Mycobacterium tuberculosis
RIHTRYSSAYELE

SEQ ID NO: 164150 - protein, 13 aa, Mycobacterium tuberculosis
IHTRYSSAYELEG

SEQ ID NO: 164151 - protein, 13 aa, Mycobacterium tuberculosis
HTRYSSAYELEGA

SEQ ID NO: 164152 - protein, 13 aa, Mycobacterium tuberculosis
TRYSSAYELEGAV

SEQ ID NO: 164153 - protein, 13 aa, Mycobacterium tuberculosis
RYSSAYELEGAVK

SEQ ID NO: 164154 - protein, 13 aa, Mycobacterium tuberculosis
YSSAYELEGAVKR

SEQ ID NO: 164155 - protein, 13 aa, Mycobacterium tuberculosis
SSAYELEGAVKRA

SEQ ID NO: 164156 - protein, 13 aa, Mycobacterium tuberculosis
SAYELEGAVKRAD

SEQ ID NO: 164157 - protein, 13 aa, Mycobacterium tuberculosis
AYELEGAVKRADL

SEQ ID NO: 164158 - protein, 13 aa, Mycobacterium tuberculosis
YELEGAVKRADLV

SEQ ID NO: 164159 - protein, 13 aa, Mycobacterium tuberculosis
ELEGAVKRADLVI

SEQ ID NO: 164160 - protein, 13 aa, Mycobacterium tuberculosis
LEGAVKRADLVIG

SEQ ID NO: 164161 - protein, 13 aa, Mycobacterium tuberculosis
EGAVKRADLVIGA

SEQ ID NO: 164162 - protein, 13 aa, Mycobacterium tuberculosis
GAVKRADLVIGAV

SEQ ID NO: 164163 - protein, 13 aa, Mycobacterium tuberculosis
AVKRADLVIGAVL

SEQ ID NO: 164164 - protein, 13 aa, Mycobacterium tuberculosis
VKRADLVIGAVLV

SEQ ID NO: 164165 - protein, 13 aa, Mycobacterium tuberculosis
KRADLVIGAVLVP

SEQ ID NO: 164166 - protein, 13 aa, Mycobacterium tuberculosis
RADLVIGAVLVPG

SEQ ID NO: 164167 - protein, 13 aa, Mycobacterium tuberculosis
ADLVIGAVLVPGA

SEQ ID NO: 164168 - protein, 13 aa, Mycobacterium tuberculosis
DLVIGAVLVPGAK

SEQ ID NO: 164169 - protein, 13 aa, Mycobacterium tuberculosis
LVIGAVLVPGAKA

SEQ ID NO: 164170 - protein, 13 aa, Mycobacterium tuberculosis
VIGAVLVPGAKAP

SEQ ID NO: 164171 - protein, 13 aa, Mycobacterium tuberculosis
IGAVLVPGAKAPK

SEQ ID NO: 164172 - protein, 13 aa, Mycobacterium tuberculosis
GAVLVPGAKAPKL

SEQ ID NO: 164173 - protein, 13 aa, Mycobacterium tuberculosis
AVLVPGAKAPKLV

SEQ ID NO: 164174 - protein, 13 aa, Mycobacterium tuberculosis
VLVPGAKAPKLVS

SEQ ID NO: 164175 - protein, 13 aa, Mycobacterium tuberculosis
LVPGAKAPKLVSN

SEQ ID NO: 164176 - protein, 13 aa, Mycobacterium tuberculosis
VPGAKAPKLVSNS

SEQ ID NO: 164177 - protein, 13 aa, Mycobacterium tuberculosis
PGAKAPKLVSNSL

SEQ ID NO: 164178 - protein, 13 aa, Mycobacterium tuberculosis
GAKAPKLVSNSLV

SEQ ID NO: 164179 - protein, 13 aa, Mycobacterium tuberculosis
AKAPKLVSNSLVA

SEQ ID NO: 164180 - protein, 13 aa, Mycobacterium tuberculosis
KAPKLVSNSLVAH

SEQ ID NO: 164181 - protein, 13 aa, Mycobacterium tuberculosis
APKLVSNSLVAHM

SEQ ID NO: 164182 - protein, 13 aa, Mycobacterium tuberculosis
PKLVSNSLVAHMK

SEQ ID NO: 164183 - protein, 13 aa, Mycobacterium tuberculosis
KLVSNSLVAHMKP

SEQ ID NO: 164184 - protein, 13 aa, Mycobacterium tuberculosis
LVSNSLVAHMKPG

SEQ ID NO: 164185 - protein, 13 aa, Mycobacterium tuberculosis
VSNSLVAHMKPGA

SEQ ID NO: 164186 - protein, 13 aa, Mycobacterium tuberculosis
SNSLVAHMKPGAV

SEQ ID NO: 164187 - protein, 13 aa, Mycobacterium tuberculosis
NSLVAHMKPGAVL

SEQ ID NO: 164188 - protein, 13 aa, Mycobacterium tuberculosis
SLVAHMKPGAVLV

SEQ ID NO: 164189 - protein, 13 aa, Mycobacterium tuberculosis
LVAHMKPGAVLVD

SEQ ID NO: 164190 - protein, 13 aa, Mycobacterium tuberculosis
VAHMKPGAVLVDI

SEQ ID NO: 164191 - protein, 13 aa, Mycobacterium tuberculosis
AHMKPGAVLVDIA

SEQ ID NO: 164192 - protein, 13 aa, Mycobacterium tuberculosis
HMKPGAVLVDIAI

SEQ ID NO: 164193 - protein, 13 aa, Mycobacterium tuberculosis
MKPGAVLVDIAID

SEQ ID NO: 164194 - protein, 13 aa, Mycobacterium tuberculosis
KPGAVLVDIAIDQ

SEQ ID NO: 164195 - protein, 13 aa, Mycobacterium tuberculosis
PGAVLVDIAIDQG

SEQ ID NO: 164196 - protein, 13 aa, Mycobacterium tuberculosis
GAVLVDIAIDQGG

SEQ ID NO: 164197 - protein, 13 aa, Mycobacterium tuberculosis
AVLVDIAIDQGGC

SEQ ID NO: 164198 - protein, 13 aa, Mycobacterium tuberculosis
VLVDIAIDQGGCF

SEQ ID NO: 164199 - protein, 13 aa, Mycobacterium tuberculosis
LVDIAIDQGGCFE

SEQ ID NO: 164200 - protein, 13 aa, Mycobacterium tuberculosis
VDIAIDQGGCFEG

SEQ ID NO: 164201 - protein, 13 aa, Mycobacterium tuberculosis
DIAIDQGGCFEGS

SEQ ID NO: 164202 - protein, 13 aa, Mycobacterium tuberculosis
IAIDQGGCFEGSR

SEQ ID NO: 164203 - protein, 13 aa, Mycobacterium tuberculosis
AIDQGGCFEGSRP

SEQ ID NO: 164204 - protein, 13 aa, Mycobacterium tuberculosis
IDQGGCFEGSRPT

SEQ ID NO: 164205 - protein, 13 aa, Mycobacterium tuberculosis
DQGGCFEGSRPTT

SEQ ID NO: 164206 - protein, 13 aa, Mycobacterium tuberculosis
QGGCFEGSRPTTY

SEQ ID NO: 164207 - protein, 13 aa, Mycobacterium tuberculosis
GGCFEGSRPTTYD

SEQ ID NO: 164208 - protein, 13 aa, Mycobacterium tuberculosis
GCFEGSRPTTYDH

SEQ ID NO: 164209 - protein, 13 aa, Mycobacterium tuberculosis
CFEGSRPTTYDHP

SEQ ID NO: 164210 - protein, 13 aa, Mycobacterium tuberculosis
FEGSRPTTYDHPT

SEQ ID NO: 164211 - protein, 13 aa, Mycobacterium tuberculosis
EGSRPTTYDHPTF

SEQ ID NO: 164212 - protein, 13 aa, Mycobacterium tuberculosis
GSRPTTYDHPTFA

SEQ ID NO: 164213 - protein, 13 aa, Mycobacterium tuberculosis
SRPTTYDHPTFAV

SEQ ID NO: 164214 - protein, 13 aa, Mycobacterium tuberculosis
RPTTYDHPTFAVH

SEQ ID NO: 164215 - protein, 13 aa, Mycobacterium tuberculosis
PTTYDHPTFAVHD

SEQ ID NO: 164216 - protein, 13 aa, Mycobacterium tuberculosis
TTYDHPTFAVHDT

SEQ ID NO: 164217 - protein, 13 aa, Mycobacterium tuberculosis
TYDHPTFAVHDTL

SEQ ID NO: 164218 - protein, 13 aa, Mycobacterium tuberculosis
YDHPTFAVHDTLF

SEQ ID NO: 164219 - protein, 13 aa, Mycobacterium tuberculosis
DHPTFAVHDTLFY

SEQ ID NO: 164220 - protein, 13 aa, Mycobacterium tuberculosis
HPTFAVHDTLFYC

SEQ ID NO: 164221 - protein, 13 aa, Mycobacterium tuberculosis
PTFAVHDTLFYCV

SEQ ID NO: 164222 - protein, 13 aa, Mycobacterium tuberculosis
TFAVHDTLFYCVA

SEQ ID NO: 164223 - protein, 13 aa, Mycobacterium tuberculosis
FAVHDTLFYCVAN

SEQ ID NO: 164224 - protein, 13 aa, Mycobacterium tuberculosis
AVHDTLFYCVANM

SEQ ID NO: 164225 - protein, 13 aa, Mycobacterium tuberculosis
VHDTLFYCVANMP

SEQ ID NO: 164226 - protein, 13 aa, Mycobacterium tuberculosis
HDTLFYCVANMPA

SEQ ID NO: 164227 - protein, 13 aa, Mycobacterium tuberculosis
DTLFYCVANMPAS

SEQ ID NO: 164228 - protein, 13 aa, Mycobacterium tuberculosis
TLFYCVANMPASV

SEQ ID NO: 164229 - protein, 13 aa, Mycobacterium tuberculosis
LFYCVANMPASVP

SEQ ID NO: 164230 - protein, 13 aa, Mycobacterium tuberculosis
FYCVANMPASVPK

SEQ ID NO: 164231 - protein, 13 aa, Mycobacterium tuberculosis
YCVANMPASVPKT

SEQ ID NO: 164232 - protein, 13 aa, Mycobacterium tuberculosis
CVANMPASVPKTS

SEQ ID NO: 164233 - protein, 13 aa, Mycobacterium tuberculosis
VANMPASVPKTST

SEQ ID NO: 164234 - protein, 13 aa, Mycobacterium tuberculosis
ANMPASVPKTSTY

SEQ ID NO: 164235 - protein, 13 aa, Mycobacterium tuberculosis
NMPASVPKTSTYA

SEQ ID NO: 164236 - protein, 13 aa, Mycobacterium tuberculosis
MPASVPKTSTYAL

SEQ ID NO: 164237 - protein, 13 aa, Mycobacterium tuberculosis
PASVPKTSTYALT

SEQ ID NO: 164238 - protein, 13 aa, Mycobacterium tuberculosis
ASVPKTSTYALTN

SEQ ID NO: 164239 - protein, 13 aa, Mycobacterium tuberculosis
SVPKTSTYALTNA

SEQ ID NO: 164240 - protein, 13 aa, Mycobacterium tuberculosis
VPKTSTYALTNAT

SEQ ID NO: 164241 - protein, 13 aa, Mycobacterium tuberculosis
PKTSTYALTNATM

SEQ ID NO: 164242 - protein, 13 aa, Mycobacterium tuberculosis
KTSTYALTNATMP

SEQ ID NO: 164243 - protein, 13 aa, Mycobacterium tuberculosis
TSTYALTNATMPY

SEQ ID NO: 164244 - protein, 13 aa, Mycobacterium tuberculosis
STYALTNATMPYV

SEQ ID NO: 164245 - protein, 13 aa, Mycobacterium tuberculosis
TYALTNATMPYVL

SEQ ID NO: 164246 - protein, 13 aa, Mycobacterium tuberculosis
YALTNATMPYVLE

SEQ ID NO: 164247 - protein, 13 aa, Mycobacterium tuberculosis
ALTNATMPYVLEL

SEQ ID NO: 164248 - protein, 13 aa, Mycobacterium tuberculosis
LTNATMPYVLELA

SEQ ID NO: 164249 - protein, 13 aa, Mycobacterium tuberculosis
TNATMPYVLELAD

SEQ ID NO: 164250 - protein, 13 aa, Mycobacterium tuberculosis
NATMPYVLELADH

SEQ ID NO: 164251 - protein, 13 aa, Mycobacterium tuberculosis
ATMPYVLELADHG

SEQ ID NO: 164252 - protein, 13 aa, Mycobacterium tuberculosis
TMPYVLELADHGW

SEQ ID NO: 164253 - protein, 13 aa, Mycobacterium tuberculosis
MPYVLELADHGWR

SEQ ID NO: 164254 - protein, 13 aa, Mycobacterium tuberculosis
PYVLELADHGWRA

SEQ ID NO: 164255 - protein, 13 aa, Mycobacterium tuberculosis
YVLELADHGWRAA

SEQ ID NO: 164256 - protein, 13 aa, Mycobacterium tuberculosis
VLELADHGWRAAC

SEQ ID NO: 164257 - protein, 13 aa, Mycobacterium tuberculosis
LELADHGWRAACR

SEQ ID NO: 164258 - protein, 13 aa, Mycobacterium tuberculosis
ELADHGWRAACRS

SEQ ID NO: 164259 - protein, 13 aa, Mycobacterium tuberculosis
LADHGWRAACRSN

SEQ ID NO: 164260 - protein, 13 aa, Mycobacterium tuberculosis
ADHGWRAACRSNP

SEQ ID NO: 164261 - protein, 13 aa, Mycobacterium tuberculosis
DHGWRAACRSNPA

SEQ ID NO: 164262 - protein, 13 aa, Mycobacterium tuberculosis
HGWRAACRSNPAL

SEQ ID NO: 164263 - protein, 13 aa, Mycobacterium tuberculosis
GWRAACRSNPALA

SEQ ID NO: 164264 - protein, 13 aa, Mycobacterium tuberculosis
WRAACRSNPALAK

SEQ ID NO: 164265 - protein, 13 aa, Mycobacterium tuberculosis
RAACRSNPALAKG

SEQ ID NO: 164266 - protein, 13 aa, Mycobacterium tuberculosis
AACRSNPALAKGL

SEQ ID NO: 164267 - protein, 13 aa, Mycobacterium tuberculosis
ACRSNPALAKGLS

SEQ ID NO: 164268 - protein, 13 aa, Mycobacterium tuberculosis
CRSNPALAKGLST

SEQ ID NO: 164269 - protein, 13 aa, Mycobacterium tuberculosis
RSNPALAKGLSTH

SEQ ID NO: 164270 - protein, 13 aa, Mycobacterium tuberculosis
SNPALAKGLSTHE

SEQ ID NO: 164271 - protein, 13 aa, Mycobacterium tuberculosis
NPALAKGLSTHEG

SEQ ID NO: 164272 - protein, 13 aa, Mycobacterium tuberculosis
PALAKGLSTHEGA

SEQ ID NO: 164273 - protein, 13 aa, Mycobacterium tuberculosis
ALAKGLSTHEGAL

SEQ ID NO: 164274 - protein, 13 aa, Mycobacterium tuberculosis
LAKGLSTHEGALL

SEQ ID NO: 164275 - protein, 13 aa, Mycobacterium tuberculosis
AKGLSTHEGALLS

SEQ ID NO: 164276 - protein, 13 aa, Mycobacterium tuberculosis
KGLSTHEGALLSE

SEQ ID NO: 164277 - protein, 13 aa, Mycobacterium tuberculosis
GLSTHEGALLSER

SEQ ID NO: 164278 - protein, 13 aa, Mycobacterium tuberculosis
LSTHEGALLSERV

SEQ ID NO: 164279 - protein, 13 aa, Mycobacterium tuberculosis
STHEGALLSERVA

SEQ ID NO: 164280 - protein, 13 aa, Mycobacterium tuberculosis
THEGALLSERVAT

SEQ ID NO: 164281 - protein, 13 aa, Mycobacterium tuberculosis
HEGALLSERVATD

SEQ ID NO: 164282 - protein, 13 aa, Mycobacterium tuberculosis
EGALLSERVATDL

SEQ ID NO: 164283 - protein, 13 aa, Mycobacterium tuberculosis
GALLSERVATDLG

SEQ ID NO: 164284 - protein, 13 aa, Mycobacterium tuberculosis
ALLSERVATDLGV

SEQ ID NO: 164285 - protein, 13 aa, Mycobacterium tuberculosis
LLSERVATDLGVP

SEQ ID NO: 164286 - protein, 13 aa, Mycobacterium tuberculosis
LSERVATDLGVPF

SEQ ID NO: 164287 - protein, 13 aa, Mycobacterium tuberculosis
SERVATDLGVPFT

SEQ ID NO: 164288 - protein, 13 aa, Mycobacterium tuberculosis
ERVATDLGVPFTE

SEQ ID NO: 164289 - protein, 13 aa, Mycobacterium tuberculosis
RVATDLGVPFTEP

SEQ ID NO: 164290 - protein, 13 aa, Mycobacterium tuberculosis
VATDLGVPFTEPA

SEQ ID NO: 164291 - protein, 13 aa, Mycobacterium tuberculosis
ATDLGVPFTEPAS

SEQ ID NO: 164292 - protein, 13 aa, Mycobacterium tuberculosis
TDLGVPFTEPASV

SEQ ID NO: 164293 - protein, 13 aa, Mycobacterium tuberculosis
DLGVPFTEPASVL

SEQ ID NO: 164294 - protein, 13 aa, Mycobacterium tuberculosis
LGVPFTEPASVLA

SEQ ID NO: 164295 - protein, 14 aa, Mycobacterium tuberculosis
MRVGIPTETKNNEF

SEQ ID NO: 164296 - protein, 14 aa, Mycobacterium tuberculosis
RVGIPTETKNNEFR

SEQ ID NO: 164297 - protein, 14 aa, Mycobacterium tuberculosis
VGIPTETKNNEFRV

SEQ ID NO: 164298 - protein, 14 aa, Mycobacterium tuberculosis
GIPTETKNNEFRVA

SEQ ID NO: 164299 - protein, 14 aa, Mycobacterium tuberculosis
IPTETKNNEFRVAI

SEQ ID NO: 164300 - protein, 14 aa, Mycobacterium tuberculosis
PTETKNNEFRVAIT

SEQ ID NO: 164301 - protein, 14 aa, Mycobacterium tuberculosis
TETKNNEFRVAITP

SEQ ID NO: 164302 - protein, 14 aa, Mycobacterium tuberculosis
ETKNNEFRVAITPA

SEQ ID NO: 164303 - protein, 14 aa, Mycobacterium tuberculosis
TKNNEFRVAITPAG

SEQ ID NO: 164304 - protein, 14 aa, Mycobacterium tuberculosis
KNNEFRVAITPAGV

SEQ ID NO: 164305 - protein, 14 aa, Mycobacterium tuberculosis
NNEFRVAITPAGVA

SEQ ID NO: 164306 - protein, 14 aa, Mycobacterium tuberculosis
NEFRVAITPAGVAE

SEQ ID NO: 164307 - protein, 14 aa, Mycobacterium tuberculosis
EFRVAITPAGVAEL

SEQ ID NO: 164308 - protein, 14 aa, Mycobacterium tuberculosis
FRVAITPAGVAELT

SEQ ID NO: 164309 - protein, 14 aa, Mycobacterium tuberculosis
RVAITPAGVAELTR

SEQ ID NO: 164310 - protein, 14 aa, Mycobacterium tuberculosis
VAITPAGVAELTRR

SEQ ID NO: 164311 - protein, 14 aa, Mycobacterium tuberculosis
AITPAGVAELTRRG

SEQ ID NO: 164312 - protein, 14 aa, Mycobacterium tuberculosis
ITPAGVAELTRRGH

SEQ ID NO: 164313 - protein, 14 aa, Mycobacterium tuberculosis
TPAGVAELTRRGHE

SEQ ID NO: 164314 - protein, 14 aa, Mycobacterium tuberculosis
PAGVAELTRRGHEV

SEQ ID NO: 164315 - protein, 14 aa, Mycobacterium tuberculosis
AGVAELTRRGHEVL

SEQ ID NO: 164316 - protein, 14 aa, Mycobacterium tuberculosis
GVAELTRRGHEVLI

SEQ ID NO: 164317 - protein, 14 aa, Mycobacterium tuberculosis
VAELTRRGHEVLIQ

SEQ ID NO: 164318 - protein, 14 aa, Mycobacterium tuberculosis
AELTRRGHEVLIQA

SEQ ID NO: 164319 - protein, 14 aa, Mycobacterium tuberculosis
ELTRRGHEVLIQAG

SEQ ID NO: 164320 - protein, 14 aa, Mycobacterium tuberculosis
LTRRGHEVLIQAGA

SEQ ID NO: 164321 - protein, 14 aa, Mycobacterium tuberculosis
TRRGHEVLIQAGAG

SEQ ID NO: 164322 - protein, 14 aa, Mycobacterium tuberculosis
RRGHEVLIQAGAGE

SEQ ID NO: 164323 - protein, 14 aa, Mycobacterium tuberculosis
RGHEVLIQAGAGEG

SEQ ID NO: 164324 - protein, 14 aa, Mycobacterium tuberculosis
GHEVLIQAGAGEGS

SEQ ID NO: 164325 - protein, 14 aa, Mycobacterium tuberculosis
HEVLIQAGAGEGSA

SEQ ID NO: 164326 - protein, 14 aa, Mycobacterium tuberculosis
EVLIQAGAGEGSAI

SEQ ID NO: 164327 - protein, 14 aa, Mycobacterium tuberculosis
VLIQAGAGEGSAIT

SEQ ID NO: 164328 - protein, 14 aa, Mycobacterium tuberculosis
LIQAGAGEGSAITD

SEQ ID NO: 164329 - protein, 14 aa, Mycobacterium tuberculosis
IQAGAGEGSAITDA

SEQ ID NO: 164330 - protein, 14 aa, Mycobacterium tuberculosis
QAGAGEGSAITDAD

SEQ ID NO: 164331 - protein, 14 aa, Mycobacterium tuberculosis
AGAGEGSAITDADF

SEQ ID NO: 164332 - protein, 14 aa, Mycobacterium tuberculosis
GAGEGSAITDADFK

SEQ ID NO: 164333 - protein, 14 aa, Mycobacterium tuberculosis
AGEGSAITDADFKA

SEQ ID NO: 164334 - protein, 14 aa, Mycobacterium tuberculosis
GEGSAITDADFKAA

SEQ ID NO: 164335 - protein, 14 aa, Mycobacterium tuberculosis
EGSAITDADFKAAG

SEQ ID NO: 164336 - protein, 14 aa, Mycobacterium tuberculosis
GSAITDADFKAAGA

SEQ ID NO: 164337 - protein, 14 aa, Mycobacterium tuberculosis
SAITDADFKAAGAQ

SEQ ID NO: 164338 - protein, 14 aa, Mycobacterium tuberculosis
AITDADFKAAGAQL

SEQ ID NO: 164339 - protein, 14 aa, Mycobacterium tuberculosis
ITDADFKAAGAQLV

SEQ ID NO: 164340 - protein, 14 aa, Mycobacterium tuberculosis
TDADFKAAGAQLVG

SEQ ID NO: 164341 - protein, 14 aa, Mycobacterium tuberculosis
DADFKAAGAQLVGT

SEQ ID NO: 164342 - protein, 14 aa, Mycobacterium tuberculosis
ADFKAAGAQLVGTA

SEQ ID NO: 164343 - protein, 14 aa, Mycobacterium tuberculosis
DFKAAGAQLVGTAD

SEQ ID NO: 164344 - protein, 14 aa, Mycobacterium tuberculosis
FKAAGAQLVGTADQ

SEQ ID NO: 164345 - protein, 14 aa, Mycobacterium tuberculosis
KAAGAQLVGTADQV

SEQ ID NO: 164346 - protein, 14 aa, Mycobacterium tuberculosis
AAGAQLVGTADQVW

SEQ ID NO: 164347 - protein, 14 aa, Mycobacterium tuberculosis
AGAQLVGTADQVWA

SEQ ID NO: 164348 - protein, 14 aa, Mycobacterium tuberculosis
GAQLVGTADQVWAD

SEQ ID NO: 164349 - protein, 14 aa, Mycobacterium tuberculosis
AQLVGTADQVWADA

SEQ ID NO: 164350 - protein, 14 aa, Mycobacterium tuberculosis
QLVGTADQVWADAD

SEQ ID NO: 164351 - protein, 14 aa, Mycobacterium tuberculosis
LVGTADQVWADADL

SEQ ID NO: 164352 - protein, 14 aa, Mycobacterium tuberculosis
VGTADQVWADADLL

SEQ ID NO: 164353 - protein, 14 aa, Mycobacterium tuberculosis
GTADQVWADADLLL

SEQ ID NO: 164354 - protein, 14 aa, Mycobacterium tuberculosis
TADQVWADADLLLK

SEQ ID NO: 164355 - protein, 14 aa, Mycobacterium tuberculosis
ADQVWADADLLLKV

SEQ ID NO: 164356 - protein, 14 aa, Mycobacterium tuberculosis
DQVWADADLLLKVK

SEQ ID NO: 164357 - protein, 14 aa, Mycobacterium tuberculosis
QVWADADLLLKVKE

SEQ ID NO: 164358 - protein, 14 aa, Mycobacterium tuberculosis
VWADADLLLKVKEP

SEQ ID NO: 164359 - protein, 14 aa, Mycobacterium tuberculosis
WADADLLLKVKEPI

SEQ ID NO: 164360 - protein, 14 aa, Mycobacterium tuberculosis
ADADLLLKVKEPIA

SEQ ID NO: 164361 - protein, 14 aa, Mycobacterium tuberculosis
DADLLLKVKEPIAA

SEQ ID NO: 164362 - protein, 14 aa, Mycobacterium tuberculosis
ADLLLKVKEPIAAE

SEQ ID NO: 164363 - protein, 14 aa, Mycobacterium tuberculosis
DLLLKVKEPIAAEY

SEQ ID NO: 164364 - protein, 14 aa, Mycobacterium tuberculosis
LLLKVKEPIAAEYG

SEQ ID NO: 164365 - protein, 14 aa, Mycobacterium tuberculosis
LLKVKEPIAAEYGR

SEQ ID NO: 164366 - protein, 14 aa, Mycobacterium tuberculosis
LKVKEPIAAEYGRL

SEQ ID NO: 164367 - protein, 14 aa, Mycobacterium tuberculosis
KVKEPIAAEYGRLR

SEQ ID NO: 164368 - protein, 14 aa, Mycobacterium tuberculosis
VKEPIAAEYGRLRH

SEQ ID NO: 164369 - protein, 14 aa, Mycobacterium tuberculosis
KEPIAAEYGRLRHG

SEQ ID NO: 164370 - protein, 14 aa, Mycobacterium tuberculosis
EPIAAEYGRLRHGQ

SEQ ID NO: 164371 - protein, 14 aa, Mycobacterium tuberculosis
PIAAEYGRLRHGQI

SEQ ID NO: 164372 - protein, 14 aa, Mycobacterium tuberculosis
IAAEYGRLRHGQIL

SEQ ID NO: 164373 - protein, 14 aa, Mycobacterium tuberculosis
AAEYGRLRHGQILF

SEQ ID NO: 164374 - protein, 14 aa, Mycobacterium tuberculosis
AEYGRLRHGQILFT

SEQ ID NO: 164375 - protein, 14 aa, Mycobacterium tuberculosis
EYGRLRHGQILFTF

SEQ ID NO: 164376 - protein, 14 aa, Mycobacterium tuberculosis
YGRLRHGQILFTFL

SEQ ID NO: 164377 - protein, 14 aa, Mycobacterium tuberculosis
GRLRHGQILFTFLH

SEQ ID NO: 164378 - protein, 14 aa, Mycobacterium tuberculosis
RLRHGQILFTFLHL

SEQ ID NO: 164379 - protein, 14 aa, Mycobacterium tuberculosis
LRHGQILFTFLHLA

SEQ ID NO: 164380 - protein, 14 aa, Mycobacterium tuberculosis
RHGQILFTFLHLAA

SEQ ID NO: 164381 - protein, 14 aa, Mycobacterium tuberculosis
HGQILFTFLHLAAS

SEQ ID NO: 164382 - protein, 14 aa, Mycobacterium tuberculosis
GQILFTFLHLAASR

SEQ ID NO: 164383 - protein, 14 aa, Mycobacterium tuberculosis
QILFTFLHLAASRA

SEQ ID NO: 164384 - protein, 14 aa, Mycobacterium tuberculosis
ILFTFLHLAASRAC

SEQ ID NO: 164385 - protein, 14 aa, Mycobacterium tuberculosis
LFTFLHLAASRACT

SEQ ID NO: 164386 - protein, 14 aa, Mycobacterium tuberculosis
FTFLHLAASRACTD

SEQ ID NO: 164387 - protein, 14 aa, Mycobacterium tuberculosis
TFLHLAASRACTDA

SEQ ID NO: 164388 - protein, 14 aa, Mycobacterium tuberculosis
FLHLAASRACTDAL

SEQ ID NO: 164389 - protein, 14 aa, Mycobacterium tuberculosis
LHLAASRACTDALL

SEQ ID NO: 164390 - protein, 14 aa, Mycobacterium tuberculosis
HLAASRACTDALLD

SEQ ID NO: 164391 - protein, 14 aa, Mycobacterium tuberculosis
LAASRACTDALLDS

SEQ ID NO: 164392 - protein, 14 aa, Mycobacterium tuberculosis
AASRACTDALLDSG

SEQ ID NO: 164393 - protein, 14 aa, Mycobacterium tuberculosis
ASRACTDALLDSGT

SEQ ID NO: 164394 - protein, 14 aa, Mycobacterium tuberculosis
SRACTDALLDSGTT

SEQ ID NO: 164395 - protein, 14 aa, Mycobacterium tuberculosis
RACTDALLDSGTTS

SEQ ID NO: 164396 - protein, 14 aa, Mycobacterium tuberculosis
ACTDALLDSGTTSI

SEQ ID NO: 164397 - protein, 14 aa, Mycobacterium tuberculosis
CTDALLDSGTTSIA

SEQ ID NO: 164398 - protein, 14 aa, Mycobacterium tuberculosis
TDALLDSGTTSIAY

SEQ ID NO: 164399 - protein, 14 aa, Mycobacterium tuberculosis
DALLDSGTTSIAYE

SEQ ID NO: 164400 - protein, 14 aa, Mycobacterium tuberculosis
ALLDSGTTSIAYET

SEQ ID NO: 164401 - protein, 14 aa, Mycobacterium tuberculosis
LLDSGTTSIAYETV

SEQ ID NO: 164402 - protein, 14 aa, Mycobacterium tuberculosis
LDSGTTSIAYETVQ

SEQ ID NO: 164403 - protein, 14 aa, Mycobacterium tuberculosis
DSGTTSIAYETVQT

SEQ ID NO: 164404 - protein, 14 aa, Mycobacterium tuberculosis
SGTTSIAYETVQTA

SEQ ID NO: 164405 - protein, 14 aa, Mycobacterium tuberculosis
GTTSIAYETVQTAD

SEQ ID NO: 164406 - protein, 14 aa, Mycobacterium tuberculosis
TTSIAYETVQTADG

SEQ ID NO: 164407 - protein, 14 aa, Mycobacterium tuberculosis
TSIAYETVQTADGA

SEQ ID NO: 164408 - protein, 14 aa, Mycobacterium tuberculosis
SIAYETVQTADGAL

SEQ ID NO: 164409 - protein, 14 aa, Mycobacterium tuberculosis
IAYETVQTADGALP

SEQ ID NO: 164410 - protein, 14 aa, Mycobacterium tuberculosis
AYETVQTADGALPL

SEQ ID NO: 164411 - protein, 14 aa, Mycobacterium tuberculosis
YETVQTADGALPLL

SEQ ID NO: 164412 - protein, 14 aa, Mycobacterium tuberculosis
ETVQTADGALPLLA

SEQ ID NO: 164413 - protein, 14 aa, Mycobacterium tuberculosis
TVQTADGALPLLAP

SEQ ID NO: 164414 - protein, 14 aa, Mycobacterium tuberculosis
VQTADGALPLLAPM

SEQ ID NO: 164415 - protein, 14 aa, Mycobacterium tuberculosis
QTADGALPLLAPMS

SEQ ID NO: 164416 - protein, 14 aa, Mycobacterium tuberculosis
TADGALPLLAPMSE

SEQ ID NO: 164417 - protein, 14 aa, Mycobacterium tuberculosis
ADGALPLLAPMSEV

SEQ ID NO: 164418 - protein, 14 aa, Mycobacterium tuberculosis
DGALPLLAPMSEVA

SEQ ID NO: 164419 - protein, 14 aa, Mycobacterium tuberculosis
GALPLLAPMSEVAG

SEQ ID NO: 164420 - protein, 14 aa, Mycobacterium tuberculosis
ALPLLAPMSEVAGR

SEQ ID NO: 164421 - protein, 14 aa, Mycobacterium tuberculosis
LPLLAPMSEVAGRL

SEQ ID NO: 164422 - protein, 14 aa, Mycobacterium tuberculosis
PLLAPMSEVAGRLA

SEQ ID NO: 164423 - protein, 14 aa, Mycobacterium tuberculosis
LLAPMSEVAGRLAA

SEQ ID NO: 164424 - protein, 14 aa, Mycobacterium tuberculosis
LAPMSEVAGRLAAQ

SEQ ID NO: 164425 - protein, 14 aa, Mycobacterium tuberculosis
APMSEVAGRLAAQV

SEQ ID NO: 164426 - protein, 14 aa, Mycobacterium tuberculosis
PMSEVAGRLAAQVG

SEQ ID NO: 164427 - protein, 14 aa, Mycobacterium tuberculosis
MSEVAGRLAAQVGA

SEQ ID NO: 164428 - protein, 14 aa, Mycobacterium tuberculosis
SEVAGRLAAQVGAY

SEQ ID NO: 164429 - protein, 14 aa, Mycobacterium tuberculosis
EVAGRLAAQVGAYH

SEQ ID NO: 164430 - protein, 14 aa, Mycobacterium tuberculosis
VAGRLAAQVGAYHL

SEQ ID NO: 164431 - protein, 14 aa, Mycobacterium tuberculosis
AGRLAAQVGAYHLM

SEQ ID NO: 164432 - protein, 14 aa, Mycobacterium tuberculosis
GRLAAQVGAYHLMR

SEQ ID NO: 164433 - protein, 14 aa, Mycobacterium tuberculosis
RLAAQVGAYHLMRT

SEQ ID NO: 164434 - protein, 14 aa, Mycobacterium tuberculosis
LAAQVGAYHLMRTQ

SEQ ID NO: 164435 - protein, 14 aa, Mycobacterium tuberculosis
AAQVGAYHLMRTQG

SEQ ID NO: 164436 - protein, 14 aa, Mycobacterium tuberculosis
AQVGAYHLMRTQGG

SEQ ID NO: 164437 - protein, 14 aa, Mycobacterium tuberculosis
QVGAYHLMRTQGGR

SEQ ID NO: 164438 - protein, 14 aa, Mycobacterium tuberculosis
VGAYHLMRTQGGRG

SEQ ID NO: 164439 - protein, 14 aa, Mycobacterium tuberculosis
GAYHLMRTQGGRGV

SEQ ID NO: 164440 - protein, 14 aa, Mycobacterium tuberculosis
AYHLMRTQGGRGVL

SEQ ID NO: 164441 - protein, 14 aa, Mycobacterium tuberculosis
YHLMRTQGGRGVLM

SEQ ID NO: 164442 - protein, 14 aa, Mycobacterium tuberculosis
HLMRTQGGRGVLMG

SEQ ID NO: 164443 - protein, 14 aa, Mycobacterium tuberculosis
LMRTQGGRGVLMGG

SEQ ID NO: 164444 - protein, 14 aa, Mycobacterium tuberculosis
MRTQGGRGVLMGGV

SEQ ID NO: 164445 - protein, 14 aa, Mycobacterium tuberculosis
RTQGGRGVLMGGVP

SEQ ID NO: 164446 - protein, 14 aa, Mycobacterium tuberculosis
TQGGRGVLMGGVPG

SEQ ID NO: 164447 - protein, 14 aa, Mycobacterium tuberculosis
QGGRGVLMGGVPGV

SEQ ID NO: 164448 - protein, 14 aa, Mycobacterium tuberculosis
GGRGVLMGGVPGVE

SEQ ID NO: 164449 - protein, 14 aa, Mycobacterium tuberculosis
GRGVLMGGVPGVEP

SEQ ID NO: 164450 - protein, 14 aa, Mycobacterium tuberculosis
RGVLMGGVPGVEPA

SEQ ID NO: 164451 - protein, 14 aa, Mycobacterium tuberculosis
GVLMGGVPGVEPAD

SEQ ID NO: 164452 - protein, 14 aa, Mycobacterium tuberculosis
VLMGGVPGVEPADV

SEQ ID NO: 164453 - protein, 14 aa, Mycobacterium tuberculosis
LMGGVPGVEPADVV

SEQ ID NO: 164454 - protein, 14 aa, Mycobacterium tuberculosis
MGGVPGVEPADVVV

SEQ ID NO: 164455 - protein, 14 aa, Mycobacterium tuberculosis
GGVPGVEPADVVVI

SEQ ID NO: 164456 - protein, 14 aa, Mycobacterium tuberculosis
GVPGVEPADVVVIG

SEQ ID NO: 164457 - protein, 14 aa, Mycobacterium tuberculosis
VPGVEPADVVVIGA

SEQ ID NO: 164458 - protein, 14 aa, Mycobacterium tuberculosis
PGVEPADVVVIGAG

SEQ ID NO: 164459 - protein, 14 aa, Mycobacterium tuberculosis
GVEPADVVVIGAGT

SEQ ID NO: 164460 - protein, 14 aa, Mycobacterium tuberculosis
VEPADVVVIGAGTA

SEQ ID NO: 164461 - protein, 14 aa, Mycobacterium tuberculosis
EPADVVVIGAGTAG

SEQ ID NO: 164462 - protein, 14 aa, Mycobacterium tuberculosis
PADVVVIGAGTAGY

SEQ ID NO: 164463 - protein, 14 aa, Mycobacterium tuberculosis
ADVVVIGAGTAGYN

SEQ ID NO: 164464 - protein, 14 aa, Mycobacterium tuberculosis
DVVVIGAGTAGYNA

SEQ ID NO: 164465 - protein, 14 aa, Mycobacterium tuberculosis
VVVIGAGTAGYNAA

SEQ ID NO: 164466 - protein, 14 aa, Mycobacterium tuberculosis
VVIGAGTAGYNAAR

SEQ ID NO: 164467 - protein, 14 aa, Mycobacterium tuberculosis
VIGAGTAGYNAARI

SEQ ID NO: 164468 - protein, 14 aa, Mycobacterium tuberculosis
IGAGTAGYNAARIA

SEQ ID NO: 164469 - protein, 14 aa, Mycobacterium tuberculosis
GAGTAGYNAARIAN

SEQ ID NO: 164470 - protein, 14 aa, Mycobacterium tuberculosis
AGTAGYNAARIANG

SEQ ID NO: 164471 - protein, 14 aa, Mycobacterium tuberculosis
GTAGYNAARIANGM

SEQ ID NO: 164472 - protein, 14 aa, Mycobacterium tuberculosis
TAGYNAARIANGMG

SEQ ID NO: 164473 - protein, 14 aa, Mycobacterium tuberculosis
AGYNAARIANGMGA

SEQ ID NO: 164474 - protein, 14 aa, Mycobacterium tuberculosis
GYNAARIANGMGAT

SEQ ID NO: 164475 - protein, 14 aa, Mycobacterium tuberculosis
YNAARIANGMGATV

SEQ ID NO: 164476 - protein, 14 aa, Mycobacterium tuberculosis
NAARIANGMGATVT

SEQ ID NO: 164477 - protein, 14 aa, Mycobacterium tuberculosis
AARIANGMGATVTV

SEQ ID NO: 164478 - protein, 14 aa, Mycobacterium tuberculosis
ARIANGMGATVTVL

SEQ ID NO: 164479 - protein, 14 aa, Mycobacterium tuberculosis
RIANGMGATVTVLD

SEQ ID NO: 164480 - protein, 14 aa, Mycobacterium tuberculosis
IANGMGATVTVLDI

SEQ ID NO: 164481 - protein, 14 aa, Mycobacterium tuberculosis
ANGMGATVTVLDIN

SEQ ID NO: 164482 - protein, 14 aa, Mycobacterium tuberculosis
NGMGATVTVLDINI

SEQ ID NO: 164483 - protein, 14 aa, Mycobacterium tuberculosis
GMGATVTVLDINID

SEQ ID NO: 164484 - protein, 14 aa, Mycobacterium tuberculosis
MGATVTVLDINIDK

SEQ ID NO: 164485 - protein, 14 aa, Mycobacterium tuberculosis
GATVTVLDINIDKL

SEQ ID NO: 164486 - protein, 14 aa, Mycobacterium tuberculosis
ATVTVLDINIDKLR

SEQ ID NO: 164487 - protein, 14 aa, Mycobacterium tuberculosis
TVTVLDINIDKLRQ

SEQ ID NO: 164488 - protein, 14 aa, Mycobacterium tuberculosis
VTVLDINIDKLRQL

SEQ ID NO: 164489 - protein, 14 aa, Mycobacterium tuberculosis
TVLDINIDKLRQLD

SEQ ID NO: 164490 - protein, 14 aa, Mycobacterium tuberculosis
VLDINIDKLRQLDA

SEQ ID NO: 164491 - protein, 14 aa, Mycobacterium tuberculosis
LDINIDKLRQLDAE

SEQ ID NO: 164492 - protein, 14 aa, Mycobacterium tuberculosis
DINIDKLRQLDAEF

SEQ ID NO: 164493 - protein, 14 aa, Mycobacterium tuberculosis
INIDKLRQLDAEFC

SEQ ID NO: 164494 - protein, 14 aa, Mycobacterium tuberculosis
NIDKLRQLDAEFCG

SEQ ID NO: 164495 - protein, 14 aa, Mycobacterium tuberculosis
IDKLRQLDAEFCGR

SEQ ID NO: 164496 - protein, 14 aa, Mycobacterium tuberculosis
DKLRQLDAEFCGRI

SEQ ID NO: 164497 - protein, 14 aa, Mycobacterium tuberculosis
KLRQLDAEFCGRIH

SEQ ID NO: 164498 - protein, 14 aa, Mycobacterium tuberculosis
LRQLDAEFCGRIHT

SEQ ID NO: 164499 - protein, 14 aa, Mycobacterium tuberculosis
RQLDAEFCGRIHTR

SEQ ID NO: 164500 - protein, 14 aa, Mycobacterium tuberculosis
QLDAEFCGRIHTRY

SEQ ID NO: 164501 - protein, 14 aa, Mycobacterium tuberculosis
LDAEFCGRIHTRYS

SEQ ID NO: 164502 - protein, 14 aa, Mycobacterium tuberculosis
DAEFCGRIHTRYSS

SEQ ID NO: 164503 - protein, 14 aa, Mycobacterium tuberculosis
AEFCGRIHTRYSSA

SEQ ID NO: 164504 - protein, 14 aa, Mycobacterium tuberculosis
EFCGRIHTRYSSAY

SEQ ID NO: 164505 - protein, 14 aa, Mycobacterium tuberculosis
FCGRIHTRYSSAYE

SEQ ID NO: 164506 - protein, 14 aa, Mycobacterium tuberculosis
CGRIHTRYSSAYEL

SEQ ID NO: 164507 - protein, 14 aa, Mycobacterium tuberculosis
GRIHTRYSSAYELE

SEQ ID NO: 164508 - protein, 14 aa, Mycobacterium tuberculosis
RIHTRYSSAYELEG

SEQ ID NO: 164509 - protein, 14 aa, Mycobacterium tuberculosis
IHTRYSSAYELEGA

SEQ ID NO: 164510 - protein, 14 aa, Mycobacterium tuberculosis
HTRYSSAYELEGAV

SEQ ID NO: 164511 - protein, 14 aa, Mycobacterium tuberculosis
TRYSSAYELEGAVK

SEQ ID NO: 164512 - protein, 14 aa, Mycobacterium tuberculosis
RYSSAYELEGAVKR

SEQ ID NO: 164513 - protein, 14 aa, Mycobacterium tuberculosis
YSSAYELEGAVKRA

SEQ ID NO: 164514 - protein, 14 aa, Mycobacterium tuberculosis
SSAYELEGAVKRAD

SEQ ID NO: 164515 - protein, 14 aa, Mycobacterium tuberculosis
SAYELEGAVKRADL

SEQ ID NO: 164516 - protein, 14 aa, Mycobacterium tuberculosis
AYELEGAVKRADLV

SEQ ID NO: 164517 - protein, 14 aa, Mycobacterium tuberculosis
YELEGAVKRADLVI

SEQ ID NO: 164518 - protein, 14 aa, Mycobacterium tuberculosis
ELEGAVKRADLVIG

SEQ ID NO: 164519 - protein, 14 aa, Mycobacterium tuberculosis
LEGAVKRADLVIGA

SEQ ID NO: 164520 - protein, 14 aa, Mycobacterium tuberculosis
EGAVKRADLVIGAV

SEQ ID NO: 164521 - protein, 14 aa, Mycobacterium tuberculosis
GAVKRADLVIGAVL

SEQ ID NO: 164522 - protein, 14 aa, Mycobacterium tuberculosis
AVKRADLVIGAVLV

SEQ ID NO: 164523 - protein, 14 aa, Mycobacterium tuberculosis
VKRADLVIGAVLVP

SEQ ID NO: 164524 - protein, 14 aa, Mycobacterium tuberculosis
KRADLVIGAVLVPG

SEQ ID NO: 164525 - protein, 14 aa, Mycobacterium tuberculosis
RADLVIGAVLVPGA

SEQ ID NO: 164526 - protein, 14 aa, Mycobacterium tuberculosis
ADLVIGAVLVPGAK

SEQ ID NO: 164527 - protein, 14 aa, Mycobacterium tuberculosis
DLVIGAVLVPGAKA

SEQ ID NO: 164528 - protein, 14 aa, Mycobacterium tuberculosis
LVIGAVLVPGAKAP

SEQ ID NO: 164529 - protein, 14 aa, Mycobacterium tuberculosis
VIGAVLVPGAKAPK

SEQ ID NO: 164530 - protein, 14 aa, Mycobacterium tuberculosis
IGAVLVPGAKAPKL

SEQ ID NO: 164531 - protein, 14 aa, Mycobacterium tuberculosis
GAVLVPGAKAPKLV

SEQ ID NO: 164532 - protein, 14 aa, Mycobacterium tuberculosis
AVLVPGAKAPKLVS

SEQ ID NO: 164533 - protein, 14 aa, Mycobacterium tuberculosis
VLVPGAKAPKLVSN

SEQ ID NO: 164534 - protein, 14 aa, Mycobacterium tuberculosis
LVPGAKAPKLVSNS

SEQ ID NO: 164535 - protein, 14 aa, Mycobacterium tuberculosis
VPGAKAPKLVSNSL

SEQ ID NO: 164536 - protein, 14 aa, Mycobacterium tuberculosis
PGAKAPKLVSNSLV

SEQ ID NO: 164537 - protein, 14 aa, Mycobacterium tuberculosis
GAKAPKLVSNSLVA

SEQ ID NO: 164538 - protein, 14 aa, Mycobacterium tuberculosis
AKAPKLVSNSLVAH

SEQ ID NO: 164539 - protein, 14 aa, Mycobacterium tuberculosis
KAPKLVSNSLVAHM

SEQ ID NO: 164540 - protein, 14 aa, Mycobacterium tuberculosis
APKLVSNSLVAHMK

SEQ ID NO: 164541 - protein, 14 aa, Mycobacterium tuberculosis
PKLVSNSLVAHMKP

SEQ ID NO: 164542 - protein, 14 aa, Mycobacterium tuberculosis
KLVSNSLVAHMKPG

SEQ ID NO: 164543 - protein, 14 aa, Mycobacterium tuberculosis
LVSNSLVAHMKPGA

SEQ ID NO: 164544 - protein, 14 aa, Mycobacterium tuberculosis
VSNSLVAHMKPGAV

SEQ ID NO: 164545 - protein, 14 aa, Mycobacterium tuberculosis
SNSLVAHMKPGAVL

SEQ ID NO: 164546 - protein, 14 aa, Mycobacterium tuberculosis
NSLVAHMKPGAVLV

SEQ ID NO: 164547 - protein, 14 aa, Mycobacterium tuberculosis
SLVAHMKPGAVLVD

SEQ ID NO: 164548 - protein, 14 aa, Mycobacterium tuberculosis
LVAHMKPGAVLVDI

SEQ ID NO: 164549 - protein, 14 aa, Mycobacterium tuberculosis
VAHMKPGAVLVDIA

SEQ ID NO: 164550 - protein, 14 aa, Mycobacterium tuberculosis
AHMKPGAVLVDIAI

SEQ ID NO: 164551 - protein, 14 aa, Mycobacterium tuberculosis
HMKPGAVLVDIAID

SEQ ID NO: 164552 - protein, 14 aa, Mycobacterium tuberculosis
MKPGAVLVDIAIDQ

SEQ ID NO: 164553 - protein, 14 aa, Mycobacterium tuberculosis
KPGAVLVDIAIDQG

SEQ ID NO: 164554 - protein, 14 aa, Mycobacterium tuberculosis
PGAVLVDIAIDQGG

SEQ ID NO: 164555 - protein, 14 aa, Mycobacterium tuberculosis
GAVLVDIAIDQGGC

SEQ ID NO: 164556 - protein, 14 aa, Mycobacterium tuberculosis
AVLVDIAIDQGGCF

SEQ ID NO: 164557 - protein, 14 aa, Mycobacterium tuberculosis
VLVDIAIDQGGCFE

SEQ ID NO: 164558 - protein, 14 aa, Mycobacterium tuberculosis
LVDIAIDQGGCFEG

SEQ ID NO: 164559 - protein, 14 aa, Mycobacterium tuberculosis
VDIAIDQGGCFEGS

SEQ ID NO: 164560 - protein, 14 aa, Mycobacterium tuberculosis
DIAIDQGGCFEGSR

SEQ ID NO: 164561 - protein, 14 aa, Mycobacterium tuberculosis
IAIDQGGCFEGSRP

SEQ ID NO: 164562 - protein, 14 aa, Mycobacterium tuberculosis
AIDQGGCFEGSRPT

SEQ ID NO: 164563 - protein, 14 aa, Mycobacterium tuberculosis
IDQGGCFEGSRPTT

SEQ ID NO: 164564 - protein, 14 aa, Mycobacterium tuberculosis
DQGGCFEGSRPTTY

SEQ ID NO: 164565 - protein, 14 aa, Mycobacterium tuberculosis
QGGCFEGSRPTTYD

SEQ ID NO: 164566 - protein, 14 aa, Mycobacterium tuberculosis
GGCFEGSRPTTYDH

SEQ ID NO: 164567 - protein, 14 aa, Mycobacterium tuberculosis
GCFEGSRPTTYDHP

SEQ ID NO: 164568 - protein, 14 aa, Mycobacterium tuberculosis
CFEGSRPTTYDHPT

SEQ ID NO: 164569 - protein, 14 aa, Mycobacterium tuberculosis
FEGSRPTTYDHPTF

SEQ ID NO: 164570 - protein, 14 aa, Mycobacterium tuberculosis
EGSRPTTYDHPTFA

SEQ ID NO: 164571 - protein, 14 aa, Mycobacterium tuberculosis
GSRPTTYDHPTFAV

SEQ ID NO: 164572 - protein, 14 aa, Mycobacterium tuberculosis
SRPTTYDHPTFAVH

SEQ ID NO: 164573 - protein, 14 aa, Mycobacterium tuberculosis
RPTTYDHPTFAVHD

SEQ ID NO: 164574 - protein, 14 aa, Mycobacterium tuberculosis
PTTYDHPTFAVHDT

SEQ ID NO: 164575 - protein, 14 aa, Mycobacterium tuberculosis
TTYDHPTFAVHDTL

SEQ ID NO: 164576 - protein, 14 aa, Mycobacterium tuberculosis
TYDHPTFAVHDTLF

SEQ ID NO: 164577 - protein, 14 aa, Mycobacterium tuberculosis
YDHPTFAVHDTLFY

SEQ ID NO: 164578 - protein, 14 aa, Mycobacterium tuberculosis
DHPTFAVHDTLFYC

SEQ ID NO: 164579 - protein, 14 aa, Mycobacterium tuberculosis
HPTFAVHDTLFYCV

SEQ ID NO: 164580 - protein, 14 aa, Mycobacterium tuberculosis
PTFAVHDTLFYCVA

SEQ ID NO: 164581 - protein, 14 aa, Mycobacterium tuberculosis
TFAVHDTLFYCVAN

SEQ ID NO: 164582 - protein, 14 aa, Mycobacterium tuberculosis
FAVHDTLFYCVANM

SEQ ID NO: 164583 - protein, 14 aa, Mycobacterium tuberculosis
AVHDTLFYCVANMP

SEQ ID NO: 164584 - protein, 14 aa, Mycobacterium tuberculosis
VHDTLFYCVANMPA

SEQ ID NO: 164585 - protein, 14 aa, Mycobacterium tuberculosis
HDTLFYCVANMPAS

SEQ ID NO: 164586 - protein, 14 aa, Mycobacterium tuberculosis
DTLFYCVANMPASV

SEQ ID NO: 164587 - protein, 14 aa, Mycobacterium tuberculosis
TLFYCVANMPASVP

SEQ ID NO: 164588 - protein, 14 aa, Mycobacterium tuberculosis
LFYCVANMPASVPK

SEQ ID NO: 164589 - protein, 14 aa, Mycobacterium tuberculosis
FYCVANMPASVPKT

SEQ ID NO: 164590 - protein, 14 aa, Mycobacterium tuberculosis
YCVANMPASVPKTS

SEQ ID NO: 164591 - protein, 14 aa, Mycobacterium tuberculosis
CVANMPASVPKTST

SEQ ID NO: 164592 - protein, 14 aa, Mycobacterium tuberculosis
VANMPASVPKTSTY

SEQ ID NO: 164593 - protein, 14 aa, Mycobacterium tuberculosis
ANMPASVPKTSTYA

SEQ ID NO: 164594 - protein, 14 aa, Mycobacterium tuberculosis
NMPASVPKTSTYAL

SEQ ID NO: 164595 - protein, 14 aa, Mycobacterium tuberculosis
MPASVPKTSTYALT

SEQ ID NO: 164596 - protein, 14 aa, Mycobacterium tuberculosis
PASVPKTSTYALTN

SEQ ID NO: 164597 - protein, 14 aa, Mycobacterium tuberculosis
ASVPKTSTYALTNA

SEQ ID NO: 164598 - protein, 14 aa, Mycobacterium tuberculosis
SVPKTSTYALTNAT

SEQ ID NO: 164599 - protein, 14 aa, Mycobacterium tuberculosis
VPKTSTYALTNATM

SEQ ID NO: 164600 - protein, 14 aa, Mycobacterium tuberculosis
PKTSTYALTNATMP

SEQ ID NO: 164601 - protein, 14 aa, Mycobacterium tuberculosis
KTSTYALTNATMPY

SEQ ID NO: 164602 - protein, 14 aa, Mycobacterium tuberculosis
TSTYALTNATMPYV

SEQ ID NO: 164603 - protein, 14 aa, Mycobacterium tuberculosis
STYALTNATMPYVL

SEQ ID NO: 164604 - protein, 14 aa, Mycobacterium tuberculosis
TYALTNATMPYVLE

SEQ ID NO: 164605 - protein, 14 aa, Mycobacterium tuberculosis
YALTNATMPYVLEL

SEQ ID NO: 164606 - protein, 14 aa, Mycobacterium tuberculosis
ALTNATMPYVLELA

SEQ ID NO: 164607 - protein, 14 aa, Mycobacterium tuberculosis
LTNATMPYVLELAD

SEQ ID NO: 164608 - protein, 14 aa, Mycobacterium tuberculosis
TNATMPYVLELADH

SEQ ID NO: 164609 - protein, 14 aa, Mycobacterium tuberculosis
NATMPYVLELADHG

SEQ ID NO: 164610 - protein, 14 aa, Mycobacterium tuberculosis
ATMPYVLELADHGW

SEQ ID NO: 164611 - protein, 14 aa, Mycobacterium tuberculosis
TMPYVLELADHGWR

SEQ ID NO: 164612 - protein, 14 aa, Mycobacterium tuberculosis
MPYVLELADHGWRA

SEQ ID NO: 164613 - protein, 14 aa, Mycobacterium tuberculosis
PYVLELADHGWRAA

SEQ ID NO: 164614 - protein, 14 aa, Mycobacterium tuberculosis
YVLELADHGWRAAC

SEQ ID NO: 164615 - protein, 14 aa, Mycobacterium tuberculosis
VLELADHGWRAACR

SEQ ID NO: 164616 - protein, 14 aa, Mycobacterium tuberculosis
LELADHGWRAACRS

SEQ ID NO: 164617 - protein, 14 aa, Mycobacterium tuberculosis
ELADHGWRAACRSN

SEQ ID NO: 164618 - protein, 14 aa, Mycobacterium tuberculosis
LADHGWRAACRSNP

SEQ ID NO: 164619 - protein, 14 aa, Mycobacterium tuberculosis
ADHGWRAACRSNPA

SEQ ID NO: 164620 - protein, 14 aa, Mycobacterium tuberculosis
DHGWRAACRSNPAL

SEQ ID NO: 164621 - protein, 14 aa, Mycobacterium tuberculosis
HGWRAACRSNPALA

SEQ ID NO: 164622 - protein, 14 aa, Mycobacterium tuberculosis
GWRAACRSNPALAK

SEQ ID NO: 164623 - protein, 14 aa, Mycobacterium tuberculosis
WRAACRSNPALAKG

SEQ ID NO: 164624 - protein, 14 aa, Mycobacterium tuberculosis
RAACRSNPALAKGL

SEQ ID NO: 164625 - protein, 14 aa, Mycobacterium tuberculosis
AACRSNPALAKGLS

SEQ ID NO: 164626 - protein, 14 aa, Mycobacterium tuberculosis
ACRSNPALAKGLST

SEQ ID NO: 164627 - protein, 14 aa, Mycobacterium tuberculosis
CRSNPALAKGLSTH

SEQ ID NO: 164628 - protein, 14 aa, Mycobacterium tuberculosis
RSNPALAKGLSTHE

SEQ ID NO: 164629 - protein, 14 aa, Mycobacterium tuberculosis
SNPALAKGLSTHEG

SEQ ID NO: 164630 - protein, 14 aa, Mycobacterium tuberculosis
NPALAKGLSTHEGA

SEQ ID NO: 164631 - protein, 14 aa, Mycobacterium tuberculosis
PALAKGLSTHEGAL

SEQ ID NO: 164632 - protein, 14 aa, Mycobacterium tuberculosis
ALAKGLSTHEGALL

SEQ ID NO: 164633 - protein, 14 aa, Mycobacterium tuberculosis
LAKGLSTHEGALLS

SEQ ID NO: 164634 - protein, 14 aa, Mycobacterium tuberculosis
AKGLSTHEGALLSE

SEQ ID NO: 164635 - protein, 14 aa, Mycobacterium tuberculosis
KGLSTHEGALLSER

SEQ ID NO: 164636 - protein, 14 aa, Mycobacterium tuberculosis
GLSTHEGALLSERV

SEQ ID NO: 164637 - protein, 14 aa, Mycobacterium tuberculosis
LSTHEGALLSERVA

SEQ ID NO: 164638 - protein, 14 aa, Mycobacterium tuberculosis
STHEGALLSERVAT

SEQ ID NO: 164639 - protein, 14 aa, Mycobacterium tuberculosis
THEGALLSERVATD

SEQ ID NO: 164640 - protein, 14 aa, Mycobacterium tuberculosis
HEGALLSERVATDL

SEQ ID NO: 164641 - protein, 14 aa, Mycobacterium tuberculosis
EGALLSERVATDLG

SEQ ID NO: 164642 - protein, 14 aa, Mycobacterium tuberculosis
GALLSERVATDLGV

SEQ ID NO: 164643 - protein, 14 aa, Mycobacterium tuberculosis
ALLSERVATDLGVP

SEQ ID NO: 164644 - protein, 14 aa, Mycobacterium tuberculosis
LLSERVATDLGVPF

SEQ ID NO: 164645 - protein, 14 aa, Mycobacterium tuberculosis
LSERVATDLGVPFT

SEQ ID NO: 164646 - protein, 14 aa, Mycobacterium tuberculosis
SERVATDLGVPFTE

SEQ ID NO: 164647 - protein, 14 aa, Mycobacterium tuberculosis
ERVATDLGVPFTEP

SEQ ID NO: 164648 - protein, 14 aa, Mycobacterium tuberculosis
RVATDLGVPFTEPA

SEQ ID NO: 164649 - protein, 14 aa, Mycobacterium tuberculosis
VATDLGVPFTEPAS

SEQ ID NO: 164650 - protein, 14 aa, Mycobacterium tuberculosis
ATDLGVPFTEPASV

SEQ ID NO: 164651 - protein, 14 aa, Mycobacterium tuberculosis
TDLGVPFTEPASVL

SEQ ID NO: 164652 - protein, 14 aa, Mycobacterium tuberculosis
DLGVPFTEPASVLA

SEQ ID NO: 164653 - protein, 15 aa, Mycobacterium tuberculosis
MRVGIPTETKNNEFR

SEQ ID NO: 164654 - protein, 15 aa, Mycobacterium tuberculosis
RVGIPTETKNNEFRV

SEQ ID NO: 164655 - protein, 15 aa, Mycobacterium tuberculosis
VGIPTETKNNEFRVA

SEQ ID NO: 164656 - protein, 15 aa, Mycobacterium tuberculosis
GIPTETKNNEFRVAI

SEQ ID NO: 164657 - protein, 15 aa, Mycobacterium tuberculosis
IPTETKNNEFRVAIT

SEQ ID NO: 164658 - protein, 15 aa, Mycobacterium tuberculosis
PTETKNNEFRVAITP

SEQ ID NO: 164659 - protein, 15 aa, Mycobacterium tuberculosis
TETKNNEFRVAITPA

SEQ ID NO: 164660 - protein, 15 aa, Mycobacterium tuberculosis
ETKNNEFRVAITPAG

SEQ ID NO: 164661 - protein, 15 aa, Mycobacterium tuberculosis
TKNNEFRVAITPAGV

SEQ ID NO: 164662 - protein, 15 aa, Mycobacterium tuberculosis
KNNEFRVAITPAGVA

SEQ ID NO: 164663 - protein, 15 aa, Mycobacterium tuberculosis
NNEFRVAITPAGVAE

SEQ ID NO: 164664 - protein, 15 aa, Mycobacterium tuberculosis
NEFRVAITPAGVAEL

SEQ ID NO: 164665 - protein, 15 aa, Mycobacterium tuberculosis
EFRVAITPAGVAELT

SEQ ID NO: 164666 - protein, 15 aa, Mycobacterium tuberculosis
FRVAITPAGVAELTR

SEQ ID NO: 164667 - protein, 15 aa, Mycobacterium tuberculosis
RVAITPAGVAELTRR

SEQ ID NO: 164668 - protein, 15 aa, Mycobacterium tuberculosis
VAITPAGVAELTRRG

SEQ ID NO: 164669 - protein, 15 aa, Mycobacterium tuberculosis
AITPAGVAELTRRGH

SEQ ID NO: 164670 - protein, 15 aa, Mycobacterium tuberculosis
ITPAGVAELTRRGHE

SEQ ID NO: 164671 - protein, 15 aa, Mycobacterium tuberculosis
TPAGVAELTRRGHEV

SEQ ID NO: 164672 - protein, 15 aa, Mycobacterium tuberculosis
PAGVAELTRRGHEVL

SEQ ID NO: 164673 - protein, 15 aa, Mycobacterium tuberculosis
AGVAELTRRGHEVLI

SEQ ID NO: 164674 - protein, 15 aa, Mycobacterium tuberculosis
GVAELTRRGHEVLIQ

SEQ ID NO: 164675 - protein, 15 aa, Mycobacterium tuberculosis
VAELTRRGHEVLIQA

SEQ ID NO: 164676 - protein, 15 aa, Mycobacterium tuberculosis
AELTRRGHEVLIQAG

SEQ ID NO: 164677 - protein, 15 aa, Mycobacterium tuberculosis
ELTRRGHEVLIQAGA

SEQ ID NO: 164678 - protein, 15 aa, Mycobacterium tuberculosis
LTRRGHEVLIQAGAG

SEQ ID NO: 164679 - protein, 15 aa, Mycobacterium tuberculosis
TRRGHEVLIQAGAGE

SEQ ID NO: 164680 - protein, 15 aa, Mycobacterium tuberculosis
RRGHEVLIQAGAGEG

SEQ ID NO: 164681 - protein, 15 aa, Mycobacterium tuberculosis
RGHEVLIQAGAGEGS

SEQ ID NO: 164682 - protein, 15 aa, Mycobacterium tuberculosis
GHEVLIQAGAGEGSA

SEQ ID NO: 164683 - protein, 15 aa, Mycobacterium tuberculosis
HEVLIQAGAGEGSAI

SEQ ID NO: 164684 - protein, 15 aa, Mycobacterium tuberculosis
EVLIQAGAGEGSAIT

SEQ ID NO: 164685 - protein, 15 aa, Mycobacterium tuberculosis
VLIQAGAGEGSAITD

SEQ ID NO: 164686 - protein, 15 aa, Mycobacterium tuberculosis
LIQAGAGEGSAITDA

SEQ ID NO: 164687 - protein, 15 aa, Mycobacterium tuberculosis
IQAGAGEGSAITDAD

SEQ ID NO: 164688 - protein, 15 aa, Mycobacterium tuberculosis
QAGAGEGSAITDADF

SEQ ID NO: 164689 - protein, 15 aa, Mycobacterium tuberculosis
AGAGEGSAITDADFK

SEQ ID NO: 164690 - protein, 15 aa, Mycobacterium tuberculosis
GAGEGSAITDADFKA

SEQ ID NO: 164691 - protein, 15 aa, Mycobacterium tuberculosis
AGEGSAITDADFKAA

SEQ ID NO: 164692 - protein, 15 aa, Mycobacterium tuberculosis
GEGSAITDADFKAAG

SEQ ID NO: 164693 - protein, 15 aa, Mycobacterium tuberculosis
EGSAITDADFKAAGA

SEQ ID NO: 164694 - protein, 15 aa, Mycobacterium tuberculosis
GSAITDADFKAAGAQ

SEQ ID NO: 164695 - protein, 15 aa, Mycobacterium tuberculosis
SAITDADFKAAGAQL

SEQ ID NO: 164696 - protein, 15 aa, Mycobacterium tuberculosis
AITDADFKAAGAQLV

SEQ ID NO: 164697 - protein, 15 aa, Mycobacterium tuberculosis
ITDADFKAAGAQLVG

SEQ ID NO: 164698 - protein, 15 aa, Mycobacterium tuberculosis
TDADFKAAGAQLVGT

SEQ ID NO: 164699 - protein, 15 aa, Mycobacterium tuberculosis
DADFKAAGAQLVGTA

SEQ ID NO: 164700 - protein, 15 aa, Mycobacterium tuberculosis
ADFKAAGAQLVGTAD

SEQ ID NO: 164701 - protein, 15 aa, Mycobacterium tuberculosis
DFKAAGAQLVGTADQ

SEQ ID NO: 164702 - protein, 15 aa, Mycobacterium tuberculosis
FKAAGAQLVGTADQV

SEQ ID NO: 164703 - protein, 15 aa, Mycobacterium tuberculosis
KAAGAQLVGTADQVW

SEQ ID NO: 164704 - protein, 15 aa, Mycobacterium tuberculosis
AAGAQLVGTADQVWA

SEQ ID NO: 164705 - protein, 15 aa, Mycobacterium tuberculosis
AGAQLVGTADQVWAD

SEQ ID NO: 164706 - protein, 15 aa, Mycobacterium tuberculosis
GAQLVGTADQVWADA

SEQ ID NO: 164707 - protein, 15 aa, Mycobacterium tuberculosis
AQLVGTADQVWADAD

SEQ ID NO: 164708 - protein, 15 aa, Mycobacterium tuberculosis
QLVGTADQVWADADL

SEQ ID NO: 164709 - protein, 15 aa, Mycobacterium tuberculosis
LVGTADQVWADADLL

SEQ ID NO: 164710 - protein, 15 aa, Mycobacterium tuberculosis
VGTADQVWADADLLL

SEQ ID NO: 164711 - protein, 15 aa, Mycobacterium tuberculosis
GTADQVWADADLLLK

SEQ ID NO: 164712 - protein, 15 aa, Mycobacterium tuberculosis
TADQVWADADLLLKV

SEQ ID NO: 164713 - protein, 15 aa, Mycobacterium tuberculosis
ADQVWADADLLLKVK

SEQ ID NO: 164714 - protein, 15 aa, Mycobacterium tuberculosis
DQVWADADLLLKVKE

SEQ ID NO: 164715 - protein, 15 aa, Mycobacterium tuberculosis
QVWADADLLLKVKEP

SEQ ID NO: 164716 - protein, 15 aa, Mycobacterium tuberculosis
VWADADLLLKVKEPI

SEQ ID NO: 164717 - protein, 15 aa, Mycobacterium tuberculosis
WADADLLLKVKEPIA

SEQ ID NO: 164718 - protein, 15 aa, Mycobacterium tuberculosis
ADADLLLKVKEPIAA

SEQ ID NO: 164719 - protein, 15 aa, Mycobacterium tuberculosis
DADLLLKVKEPIAAE

SEQ ID NO: 164720 - protein, 15 aa, Mycobacterium tuberculosis
ADLLLKVKEPIAAEY

SEQ ID NO: 164721 - protein, 15 aa, Mycobacterium tuberculosis
DLLLKVKEPIAAEYG

SEQ ID NO: 164722 - protein, 15 aa, Mycobacterium tuberculosis
LLLKVKEPIAAEYGR

SEQ ID NO: 164723 - protein, 15 aa, Mycobacterium tuberculosis
LLKVKEPIAAEYGRL

SEQ ID NO: 164724 - protein, 15 aa, Mycobacterium tuberculosis
LKVKEPIAAEYGRLR

SEQ ID NO: 164725 - protein, 15 aa, Mycobacterium tuberculosis
KVKEPIAAEYGRLRH

SEQ ID NO: 164726 - protein, 15 aa, Mycobacterium tuberculosis
VKEPIAAEYGRLRHG

SEQ ID NO: 164727 - protein, 15 aa, Mycobacterium tuberculosis
KEPIAAEYGRLRHGQ

SEQ ID NO: 164728 - protein, 15 aa, Mycobacterium tuberculosis
EPIAAEYGRLRHGQI

SEQ ID NO: 164729 - protein, 15 aa, Mycobacterium tuberculosis
PIAAEYGRLRHGQIL

SEQ ID NO: 164730 - protein, 15 aa, Mycobacterium tuberculosis
IAAEYGRLRHGQILF

SEQ ID NO: 164731 - protein, 15 aa, Mycobacterium tuberculosis
AAEYGRLRHGQILFT

SEQ ID NO: 164732 - protein, 15 aa, Mycobacterium tuberculosis
AEYGRLRHGQILFTF

SEQ ID NO: 164733 - protein, 15 aa, Mycobacterium tuberculosis
EYGRLRHGQILFTFL

SEQ ID NO: 164734 - protein, 15 aa, Mycobacterium tuberculosis
YGRLRHGQILFTFLH

SEQ ID NO: 164735 - protein, 15 aa, Mycobacterium tuberculosis
GRLRHGQILFTFLHL

SEQ ID NO: 164736 - protein, 15 aa, Mycobacterium tuberculosis
RLRHGQILFTFLHLA

SEQ ID NO: 164737 - protein, 15 aa, Mycobacterium tuberculosis
LRHGQILFTFLHLAA

SEQ ID NO: 164738 - protein, 15 aa, Mycobacterium tuberculosis
RHGQILFTFLHLAAS

SEQ ID NO: 164739 - protein, 15 aa, Mycobacterium tuberculosis
HGQILFTFLHLAASR

SEQ ID NO: 164740 - protein, 15 aa, Mycobacterium tuberculosis
GQILFTFLHLAASRA

SEQ ID NO: 164741 - protein, 15 aa, Mycobacterium tuberculosis
QILFTFLHLAASRAC

SEQ ID NO: 164742 - protein, 15 aa, Mycobacterium tuberculosis
ILFTFLHLAASRACT

SEQ ID NO: 164743 - protein, 15 aa, Mycobacterium tuberculosis
LFTFLHLAASRACTD

SEQ ID NO: 164744 - protein, 15 aa, Mycobacterium tuberculosis
FTFLHLAASRACTDA

SEQ ID NO: 164745 - protein, 15 aa, Mycobacterium tuberculosis
TFLHLAASRACTDAL

SEQ ID NO: 164746 - protein, 15 aa, Mycobacterium tuberculosis
FLHLAASRACTDALL

SEQ ID NO: 164747 - protein, 15 aa, Mycobacterium tuberculosis
LHLAASRACTDALLD

SEQ ID NO: 164748 - protein, 15 aa, Mycobacterium tuberculosis
HLAASRACTDALLDS

SEQ ID NO: 164749 - protein, 15 aa, Mycobacterium tuberculosis
LAASRACTDALLDSG

SEQ ID NO: 164750 - protein, 15 aa, Mycobacterium tuberculosis
AASRACTDALLDSGT

SEQ ID NO: 164751 - protein, 15 aa, Mycobacterium tuberculosis
ASRACTDALLDSGTT

SEQ ID NO: 164752 - protein, 15 aa, Mycobacterium tuberculosis
SRACTDALLDSGTTS

SEQ ID NO: 164753 - protein, 15 aa, Mycobacterium tuberculosis
RACTDALLDSGTTSI

SEQ ID NO: 164754 - protein, 15 aa, Mycobacterium tuberculosis
ACTDALLDSGTTSIA

SEQ ID NO: 164755 - protein, 15 aa, Mycobacterium tuberculosis
CTDALLDSGTTSIAY

SEQ ID NO: 164756 - protein, 15 aa, Mycobacterium tuberculosis
TDALLDSGTTSIAYE

SEQ ID NO: 164757 - protein, 15 aa, Mycobacterium tuberculosis
DALLDSGTTSIAYET

SEQ ID NO: 164758 - protein, 15 aa, Mycobacterium tuberculosis
ALLDSGTTSIAYETV

SEQ ID NO: 164759 - protein, 15 aa, Mycobacterium tuberculosis
LLDSGTTSIAYETVQ

SEQ ID NO: 164760 - protein, 15 aa, Mycobacterium tuberculosis
LDSGTTSIAYETVQT

SEQ ID NO: 164761 - protein, 15 aa, Mycobacterium tuberculosis
DSGTTSIAYETVQTA

SEQ ID NO: 164762 - protein, 15 aa, Mycobacterium tuberculosis
SGTTSIAYETVQTAD

SEQ ID NO: 164763 - protein, 15 aa, Mycobacterium tuberculosis
GTTSIAYETVQTADG

SEQ ID NO: 164764 - protein, 15 aa, Mycobacterium tuberculosis
TTSIAYETVQTADGA

SEQ ID NO: 164765 - protein, 15 aa, Mycobacterium tuberculosis
TSIAYETVQTADGAL

SEQ ID NO: 164766 - protein, 15 aa, Mycobacterium tuberculosis
SIAYETVQTADGALP

SEQ ID NO: 164767 - protein, 15 aa, Mycobacterium tuberculosis
IAYETVQTADGALPL

SEQ ID NO: 164768 - protein, 15 aa, Mycobacterium tuberculosis
AYETVQTADGALPLL

SEQ ID NO: 164769 - protein, 15 aa, Mycobacterium tuberculosis
YETVQTADGALPLLA

SEQ ID NO: 164770 - protein, 15 aa, Mycobacterium tuberculosis
ETVQTADGALPLLAP

SEQ ID NO: 164771 - protein, 15 aa, Mycobacterium tuberculosis
TVQTADGALPLLAPM

SEQ ID NO: 164772 - protein, 15 aa, Mycobacterium tuberculosis
VQTADGALPLLAPMS

SEQ ID NO: 164773 - protein, 15 aa, Mycobacterium tuberculosis
QTADGALPLLAPMSE

SEQ ID NO: 164774 - protein, 15 aa, Mycobacterium tuberculosis
TADGALPLLAPMSEV

SEQ ID NO: 164775 - protein, 15 aa, Mycobacterium tuberculosis
ADGALPLLAPMSEVA

SEQ ID NO: 164776 - protein, 15 aa, Mycobacterium tuberculosis
DGALPLLAPMSEVAG

SEQ ID NO: 164777 - protein, 15 aa, Mycobacterium tuberculosis
GALPLLAPMSEVAGR

SEQ ID NO: 164778 - protein, 15 aa, Mycobacterium tuberculosis
ALPLLAPMSEVAGRL

SEQ ID NO: 164779 - protein, 15 aa, Mycobacterium tuberculosis
LPLLAPMSEVAGRLA

SEQ ID NO: 164780 - protein, 15 aa, Mycobacterium tuberculosis
PLLAPMSEVAGRLAA

SEQ ID NO: 164781 - protein, 15 aa, Mycobacterium tuberculosis
LLAPMSEVAGRLAAQ

SEQ ID NO: 164782 - protein, 15 aa, Mycobacterium tuberculosis
LAPMSEVAGRLAAQV

SEQ ID NO: 164783 - protein, 15 aa, Mycobacterium tuberculosis
APMSEVAGRLAAQVG

SEQ ID NO: 164784 - protein, 15 aa, Mycobacterium tuberculosis
PMSEVAGRLAAQVGA

SEQ ID NO: 164785 - protein, 15 aa, Mycobacterium tuberculosis
MSEVAGRLAAQVGAY

SEQ ID NO: 164786 - protein, 15 aa, Mycobacterium tuberculosis
SEVAGRLAAQVGAYH

SEQ ID NO: 164787 - protein, 15 aa, Mycobacterium tuberculosis
EVAGRLAAQVGAYHL

SEQ ID NO: 164788 - protein, 15 aa, Mycobacterium tuberculosis
VAGRLAAQVGAYHLM

SEQ ID NO: 164789 - protein, 15 aa, Mycobacterium tuberculosis
AGRLAAQVGAYHLMR

SEQ ID NO: 164790 - protein, 15 aa, Mycobacterium tuberculosis
GRLAAQVGAYHLMRT

SEQ ID NO: 164791 - protein, 15 aa, Mycobacterium tuberculosis
RLAAQVGAYHLMRTQ

SEQ ID NO: 164792 - protein, 15 aa, Mycobacterium tuberculosis
LAAQVGAYHLMRTQG

SEQ ID NO: 164793 - protein, 15 aa, Mycobacterium tuberculosis
AAQVGAYHLMRTQGG

SEQ ID NO: 164794 - protein, 15 aa, Mycobacterium tuberculosis
AQVGAYHLMRTQGGR

SEQ ID NO: 164795 - protein, 15 aa, Mycobacterium tuberculosis
QVGAYHLMRTQGGRG

SEQ ID NO: 164796 - protein, 15 aa, Mycobacterium tuberculosis
VGAYHLMRTQGGRGV

SEQ ID NO: 164797 - protein, 15 aa, Mycobacterium tuberculosis
GAYHLMRTQGGRGVL

SEQ ID NO: 164798 - protein, 15 aa, Mycobacterium tuberculosis
AYHLMRTQGGRGVLM

SEQ ID NO: 164799 - protein, 15 aa, Mycobacterium tuberculosis
YHLMRTQGGRGVLMG

SEQ ID NO: 164800 - protein, 15 aa, Mycobacterium tuberculosis
HLMRTQGGRGVLMGG

SEQ ID NO: 164801 - protein, 15 aa, Mycobacterium tuberculosis
LMRTQGGRGVLMGGV

SEQ ID NO: 164802 - protein, 15 aa, Mycobacterium tuberculosis
MRTQGGRGVLMGGVP

SEQ ID NO: 164803 - protein, 15 aa, Mycobacterium tuberculosis
RTQGGRGVLMGGVPG

SEQ ID NO: 164804 - protein, 15 aa, Mycobacterium tuberculosis
TQGGRGVLMGGVPGV

SEQ ID NO: 164805 - protein, 15 aa, Mycobacterium tuberculosis
QGGRGVLMGGVPGVE

SEQ ID NO: 164806 - protein, 15 aa, Mycobacterium tuberculosis
GGRGVLMGGVPGVEP

SEQ ID NO: 164807 - protein, 15 aa, Mycobacterium tuberculosis
GRGVLMGGVPGVEPA

SEQ ID NO: 164808 - protein, 15 aa, Mycobacterium tuberculosis
RGVLMGGVPGVEPAD

SEQ ID NO: 164809 - protein, 15 aa, Mycobacterium tuberculosis
GVLMGGVPGVEPADV

SEQ ID NO: 164810 - protein, 15 aa, Mycobacterium tuberculosis
VLMGGVPGVEPADVV

SEQ ID NO: 164811 - protein, 15 aa, Mycobacterium tuberculosis
LMGGVPGVEPADVVV

SEQ ID NO: 164812 - protein, 15 aa, Mycobacterium tuberculosis
MGGVPGVEPADVVVI

SEQ ID NO: 164813 - protein, 15 aa, Mycobacterium tuberculosis
GGVPGVEPADVVVIG

SEQ ID NO: 164814 - protein, 15 aa, Mycobacterium tuberculosis
GVPGVEPADVVVIGA

SEQ ID NO: 164815 - protein, 15 aa, Mycobacterium tuberculosis
VPGVEPADVVVIGAG

SEQ ID NO: 164816 - protein, 15 aa, Mycobacterium tuberculosis
PGVEPADVVVIGAGT

SEQ ID NO: 164817 - protein, 15 aa, Mycobacterium tuberculosis
GVEPADVVVIGAGTA

SEQ ID NO: 164818 - protein, 15 aa, Mycobacterium tuberculosis
VEPADVVVIGAGTAG

SEQ ID NO: 164819 - protein, 15 aa, Mycobacterium tuberculosis
EPADVVVIGAGTAGY

SEQ ID NO: 164820 - protein, 15 aa, Mycobacterium tuberculosis
PADVVVIGAGTAGYN

SEQ ID NO: 164821 - protein, 15 aa, Mycobacterium tuberculosis
ADVVVIGAGTAGYNA

SEQ ID NO: 164822 - protein, 15 aa, Mycobacterium tuberculosis
DVVVIGAGTAGYNAA

SEQ ID NO: 164823 - protein, 15 aa, Mycobacterium tuberculosis
VVVIGAGTAGYNAAR

SEQ ID NO: 164824 - protein, 15 aa, Mycobacterium tuberculosis
VVIGAGTAGYNAARI

SEQ ID NO: 164825 - protein, 15 aa, Mycobacterium tuberculosis
VIGAGTAGYNAARIA

SEQ ID NO: 164826 - protein, 15 aa, Mycobacterium tuberculosis
IGAGTAGYNAARIAN

SEQ ID NO: 164827 - protein, 15 aa, Mycobacterium tuberculosis
GAGTAGYNAARIANG

SEQ ID NO: 164828 - protein, 15 aa, Mycobacterium tuberculosis
AGTAGYNAARIANGM

SEQ ID NO: 164829 - protein, 15 aa, Mycobacterium tuberculosis
GTAGYNAARIANGMG

SEQ ID NO: 164830 - protein, 15 aa, Mycobacterium tuberculosis
TAGYNAARIANGMGA

SEQ ID NO: 164831 - protein, 15 aa, Mycobacterium tuberculosis
AGYNAARIANGMGAT

SEQ ID NO: 164832 - protein, 15 aa, Mycobacterium tuberculosis
GYNAARIANGMGATV

SEQ ID NO: 164833 - protein, 15 aa, Mycobacterium tuberculosis
YNAARIANGMGATVT

SEQ ID NO: 164834 - protein, 15 aa, Mycobacterium tuberculosis
NAARIANGMGATVTV

SEQ ID NO: 164835 - protein, 15 aa, Mycobacterium tuberculosis
AARIANGMGATVTVL

SEQ ID NO: 164836 - protein, 15 aa, Mycobacterium tuberculosis
ARIANGMGATVTVLD

SEQ ID NO: 164837 - protein, 15 aa, Mycobacterium tuberculosis
RIANGMGATVTVLDI

SEQ ID NO: 164838 - protein, 15 aa, Mycobacterium tuberculosis
IANGMGATVTVLDIN

SEQ ID NO: 164839 - protein, 15 aa, Mycobacterium tuberculosis
ANGMGATVTVLDINI

SEQ ID NO: 164840 - protein, 15 aa, Mycobacterium tuberculosis
NGMGATVTVLDINID

SEQ ID NO: 164841 - protein, 15 aa, Mycobacterium tuberculosis
GMGATVTVLDINIDK

SEQ ID NO: 164842 - protein, 15 aa, Mycobacterium tuberculosis
MGATVTVLDINIDKL

SEQ ID NO: 164843 - protein, 15 aa, Mycobacterium tuberculosis
GATVTVLDINIDKLR

SEQ ID NO: 164844 - protein, 15 aa, Mycobacterium tuberculosis
ATVTVLDINIDKLRQ

SEQ ID NO: 164845 - protein, 15 aa, Mycobacterium tuberculosis
TVTVLDINIDKLRQL

SEQ ID NO: 164846 - protein, 15 aa, Mycobacterium tuberculosis
VTVLDINIDKLRQLD

SEQ ID NO: 164847 - protein, 15 aa, Mycobacterium tuberculosis
TVLDINIDKLRQLDA

SEQ ID NO: 164848 - protein, 15 aa, Mycobacterium tuberculosis
VLDINIDKLRQLDAE

SEQ ID NO: 164849 - protein, 15 aa, Mycobacterium tuberculosis
LDINIDKLRQLDAEF

SEQ ID NO: 164850 - protein, 15 aa, Mycobacterium tuberculosis
DINIDKLRQLDAEFC

SEQ ID NO: 164851 - protein, 15 aa, Mycobacterium tuberculosis
INIDKLRQLDAEFCG

SEQ ID NO: 164852 - protein, 15 aa, Mycobacterium tuberculosis
NIDKLRQLDAEFCGR

SEQ ID NO: 164853 - protein, 15 aa, Mycobacterium tuberculosis
IDKLRQLDAEFCGRI

SEQ ID NO: 164854 - protein, 15 aa, Mycobacterium tuberculosis
DKLRQLDAEFCGRIH

SEQ ID NO: 164855 - protein, 15 aa, Mycobacterium tuberculosis
KLRQLDAEFCGRIHT

SEQ ID NO: 164856 - protein, 15 aa, Mycobacterium tuberculosis
LRQLDAEFCGRIHTR

SEQ ID NO: 164857 - protein, 15 aa, Mycobacterium tuberculosis
RQLDAEFCGRIHTRY

SEQ ID NO: 164858 - protein, 15 aa, Mycobacterium tuberculosis
QLDAEFCGRIHTRYS

SEQ ID NO: 164859 - protein, 15 aa, Mycobacterium tuberculosis
LDAEFCGRIHTRYSS

SEQ ID NO: 164860 - protein, 15 aa, Mycobacterium tuberculosis
DAEFCGRIHTRYSSA

SEQ ID NO: 164861 - protein, 15 aa, Mycobacterium tuberculosis
AEFCGRIHTRYSSAY

SEQ ID NO: 164862 - protein, 15 aa, Mycobacterium tuberculosis
EFCGRIHTRYSSAYE

SEQ ID NO: 164863 - protein, 15 aa, Mycobacterium tuberculosis
FCGRIHTRYSSAYEL

SEQ ID NO: 164864 - protein, 15 aa, Mycobacterium tuberculosis
CGRIHTRYSSAYELE

SEQ ID NO: 164865 - protein, 15 aa, Mycobacterium tuberculosis
GRIHTRYSSAYELEG

SEQ ID NO: 164866 - protein, 15 aa, Mycobacterium tuberculosis
RIHTRYSSAYELEGA

SEQ ID NO: 164867 - protein, 15 aa, Mycobacterium tuberculosis
IHTRYSSAYELEGAV

SEQ ID NO: 164868 - protein, 15 aa, Mycobacterium tuberculosis
HTRYSSAYELEGAVK

SEQ ID NO: 164869 - protein, 15 aa, Mycobacterium tuberculosis
TRYSSAYELEGAVKR

SEQ ID NO: 164870 - protein, 15 aa, Mycobacterium tuberculosis
RYSSAYELEGAVKRA

SEQ ID NO: 164871 - protein, 15 aa, Mycobacterium tuberculosis
YSSAYELEGAVKRAD

SEQ ID NO: 164872 - protein, 15 aa, Mycobacterium tuberculosis
SSAYELEGAVKRADL

SEQ ID NO: 164873 - protein, 15 aa, Mycobacterium tuberculosis
SAYELEGAVKRADLV

SEQ ID NO: 164874 - protein, 15 aa, Mycobacterium tuberculosis
AYELEGAVKRADLVI

SEQ ID NO: 164875 - protein, 15 aa, Mycobacterium tuberculosis
YELEGAVKRADLVIG

SEQ ID NO: 164876 - protein, 15 aa, Mycobacterium tuberculosis
ELEGAVKRADLVIGA

SEQ ID NO: 164877 - protein, 15 aa, Mycobacterium tuberculosis
LEGAVKRADLVIGAV

SEQ ID NO: 164878 - protein, 15 aa, Mycobacterium tuberculosis
EGAVKRADLVIGAVL

SEQ ID NO: 164879 - protein, 15 aa, Mycobacterium tuberculosis
GAVKRADLVIGAVLV

SEQ ID NO: 164880 - protein, 15 aa, Mycobacterium tuberculosis
AVKRADLVIGAVLVP

SEQ ID NO: 164881 - protein, 15 aa, Mycobacterium tuberculosis
VKRADLVIGAVLVPG

SEQ ID NO: 164882 - protein, 15 aa, Mycobacterium tuberculosis
KRADLVIGAVLVPGA

SEQ ID NO: 164883 - protein, 15 aa, Mycobacterium tuberculosis
RADLVIGAVLVPGAK

SEQ ID NO: 164884 - protein, 15 aa, Mycobacterium tuberculosis
ADLVIGAVLVPGAKA

SEQ ID NO: 164885 - protein, 15 aa, Mycobacterium tuberculosis
DLVIGAVLVPGAKAP

SEQ ID NO: 164886 - protein, 15 aa, Mycobacterium tuberculosis
LVIGAVLVPGAKAPK

SEQ ID NO: 164887 - protein, 15 aa, Mycobacterium tuberculosis
VIGAVLVPGAKAPKL

SEQ ID NO: 164888 - protein, 15 aa, Mycobacterium tuberculosis
IGAVLVPGAKAPKLV

SEQ ID NO: 164889 - protein, 15 aa, Mycobacterium tuberculosis
GAVLVPGAKAPKLVS

SEQ ID NO: 164890 - protein, 15 aa, Mycobacterium tuberculosis
AVLVPGAKAPKLVSN

SEQ ID NO: 164891 - protein, 15 aa, Mycobacterium tuberculosis
VLVPGAKAPKLVSNS

SEQ ID NO: 164892 - protein, 15 aa, Mycobacterium tuberculosis
LVPGAKAPKLVSNSL

SEQ ID NO: 164893 - protein, 15 aa, Mycobacterium tuberculosis
VPGAKAPKLVSNSLV

SEQ ID NO: 164894 - protein, 15 aa, Mycobacterium tuberculosis
PGAKAPKLVSNSLVA

SEQ ID NO: 164895 - protein, 15 aa, Mycobacterium tuberculosis
GAKAPKLVSNSLVAH

SEQ ID NO: 164896 - protein, 15 aa, Mycobacterium tuberculosis
AKAPKLVSNSLVAHM

SEQ ID NO: 164897 - protein, 15 aa, Mycobacterium tuberculosis
KAPKLVSNSLVAHMK

SEQ ID NO: 164898 - protein, 15 aa, Mycobacterium tuberculosis
APKLVSNSLVAHMKP

SEQ ID NO: 164899 - protein, 15 aa, Mycobacterium tuberculosis
PKLVSNSLVAHMKPG

SEQ ID NO: 164900 - protein, 15 aa, Mycobacterium tuberculosis
KLVSNSLVAHMKPGA

SEQ ID NO: 164901 - protein, 15 aa, Mycobacterium tuberculosis
LVSNSLVAHMKPGAV

SEQ ID NO: 164902 - protein, 15 aa, Mycobacterium tuberculosis
VSNSLVAHMKPGAVL

SEQ ID NO: 164903 - protein, 15 aa, Mycobacterium tuberculosis
SNSLVAHMKPGAVLV

SEQ ID NO: 164904 - protein, 15 aa, Mycobacterium tuberculosis
NSLVAHMKPGAVLVD

SEQ ID NO: 164905 - protein, 15 aa, Mycobacterium tuberculosis
SLVAHMKPGAVLVDI

SEQ ID NO: 164906 - protein, 15 aa, Mycobacterium tuberculosis
LVAHMKPGAVLVDIA

SEQ ID NO: 164907 - protein, 15 aa, Mycobacterium tuberculosis
VAHMKPGAVLVDIAI

SEQ ID NO: 164908 - protein, 15 aa, Mycobacterium tuberculosis
AHMKPGAVLVDIAID

SEQ ID NO: 164909 - protein, 15 aa, Mycobacterium tuberculosis
HMKPGAVLVDIAIDQ

SEQ ID NO: 164910 - protein, 15 aa, Mycobacterium tuberculosis
MKPGAVLVDIAIDQG

SEQ ID NO: 164911 - protein, 15 aa, Mycobacterium tuberculosis
KPGAVLVDIAIDQGG

SEQ ID NO: 164912 - protein, 15 aa, Mycobacterium tuberculosis
PGAVLVDIAIDQGGC

SEQ ID NO: 164913 - protein, 15 aa, Mycobacterium tuberculosis
GAVLVDIAIDQGGCF

SEQ ID NO: 164914 - protein, 15 aa, Mycobacterium tuberculosis
AVLVDIAIDQGGCFE

SEQ ID NO: 164915 - protein, 15 aa, Mycobacterium tuberculosis
VLVDIAIDQGGCFEG

SEQ ID NO: 164916 - protein, 15 aa, Mycobacterium tuberculosis
LVDIAIDQGGCFEGS

SEQ ID NO: 164917 - protein, 15 aa, Mycobacterium tuberculosis
VDIAIDQGGCFEGSR

SEQ ID NO: 164918 - protein, 15 aa, Mycobacterium tuberculosis
DIAIDQGGCFEGSRP

SEQ ID NO: 164919 - protein, 15 aa, Mycobacterium tuberculosis
IAIDQGGCFEGSRPT

SEQ ID NO: 164920 - protein, 15 aa, Mycobacterium tuberculosis
AIDQGGCFEGSRPTT

SEQ ID NO: 164921 - protein, 15 aa, Mycobacterium tuberculosis
IDQGGCFEGSRPTTY

SEQ ID NO: 164922 - protein, 15 aa, Mycobacterium tuberculosis
DQGGCFEGSRPTTYD

SEQ ID NO: 164923 - protein, 15 aa, Mycobacterium tuberculosis
QGGCFEGSRPTTYDH

SEQ ID NO: 164924 - protein, 15 aa, Mycobacterium tuberculosis
GGCFEGSRPTTYDHP

SEQ ID NO: 164925 - protein, 15 aa, Mycobacterium tuberculosis
GCFEGSRPTTYDHPT

SEQ ID NO: 164926 - protein, 15 aa, Mycobacterium tuberculosis
CFEGSRPTTYDHPTF

SEQ ID NO: 164927 - protein, 15 aa, Mycobacterium tuberculosis
FEGSRPTTYDHPTFA

SEQ ID NO: 164928 - protein, 15 aa, Mycobacterium tuberculosis
EGSRPTTYDHPTFAV

SEQ ID NO: 164929 - protein, 15 aa, Mycobacterium tuberculosis
GSRPTTYDHPTFAVH

SEQ ID NO: 164930 - protein, 15 aa, Mycobacterium tuberculosis
SRPTTYDHPTFAVHD

SEQ ID NO: 164931 - protein, 15 aa, Mycobacterium tuberculosis
RPTTYDHPTFAVHDT

SEQ ID NO: 164932 - protein, 15 aa, Mycobacterium tuberculosis
PTTYDHPTFAVHDTL

SEQ ID NO: 164933 - protein, 15 aa, Mycobacterium tuberculosis
TTYDHPTFAVHDTLF

SEQ ID NO: 164934 - protein, 15 aa, Mycobacterium tuberculosis
TYDHPTFAVHDTLFY

SEQ ID NO: 164935 - protein, 15 aa, Mycobacterium tuberculosis
YDHPTFAVHDTLFYC

SEQ ID NO: 164936 - protein, 15 aa, Mycobacterium tuberculosis
DHPTFAVHDTLFYCV

SEQ ID NO: 164937 - protein, 15 aa, Mycobacterium tuberculosis
HPTFAVHDTLFYCVA

SEQ ID NO: 164938 - protein, 15 aa, Mycobacterium tuberculosis
PTFAVHDTLFYCVAN

SEQ ID NO: 164939 - protein, 15 aa, Mycobacterium tuberculosis
TFAVHDTLFYCVANM

SEQ ID NO: 164940 - protein, 15 aa, Mycobacterium tuberculosis
FAVHDTLFYCVANMP

SEQ ID NO: 164941 - protein, 15 aa, Mycobacterium tuberculosis
AVHDTLFYCVANMPA

SEQ ID NO: 164942 - protein, 15 aa, Mycobacterium tuberculosis
VHDTLFYCVANMPAS

SEQ ID NO: 164943 - protein, 15 aa, Mycobacterium tuberculosis
HDTLFYCVANMPASV

SEQ ID NO: 164944 - protein, 15 aa, Mycobacterium tuberculosis
DTLFYCVANMPASVP

SEQ ID NO: 164945 - protein, 15 aa, Mycobacterium tuberculosis
TLFYCVANMPASVPK

SEQ ID NO: 164946 - protein, 15 aa, Mycobacterium tuberculosis
LFYCVANMPASVPKT

SEQ ID NO: 164947 - protein, 15 aa, Mycobacterium tuberculosis
FYCVANMPASVPKTS

SEQ ID NO: 164948 - protein, 15 aa, Mycobacterium tuberculosis
YCVANMPASVPKTST

SEQ ID NO: 164949 - protein, 15 aa, Mycobacterium tuberculosis
CVANMPASVPKTSTY

SEQ ID NO: 164950 - protein, 15 aa, Mycobacterium tuberculosis
VANMPASVPKTSTYA

SEQ ID NO: 164951 - protein, 15 aa, Mycobacterium tuberculosis
ANMPASVPKTSTYAL

SEQ ID NO: 164952 - protein, 15 aa, Mycobacterium tuberculosis
NMPASVPKTSTYALT

SEQ ID NO: 164953 - protein, 15 aa, Mycobacterium tuberculosis
MPASVPKTSTYALTN

SEQ ID NO: 164954 - protein, 15 aa, Mycobacterium tuberculosis
PASVPKTSTYALTNA

SEQ ID NO: 164955 - protein, 15 aa, Mycobacterium tuberculosis
ASVPKTSTYALTNAT

SEQ ID NO: 164956 - protein, 15 aa, Mycobacterium tuberculosis
SVPKTSTYALTNATM

SEQ ID NO: 164957 - protein, 15 aa, Mycobacterium tuberculosis
VPKTSTYALTNATMP

SEQ ID NO: 164958 - protein, 15 aa, Mycobacterium tuberculosis
PKTSTYALTNATMPY

SEQ ID NO: 164959 - protein, 15 aa, Mycobacterium tuberculosis
KTSTYALTNATMPYV

SEQ ID NO: 164960 - protein, 15 aa, Mycobacterium tuberculosis
TSTYALTNATMPYVL

SEQ ID NO: 164961 - protein, 15 aa, Mycobacterium tuberculosis
STYALTNATMPYVLE

SEQ ID NO: 164962 - protein, 15 aa, Mycobacterium tuberculosis
TYALTNATMPYVLEL

SEQ ID NO: 164963 - protein, 15 aa, Mycobacterium tuberculosis
YALTNATMPYVLELA

SEQ ID NO: 164964 - protein, 15 aa, Mycobacterium tuberculosis
ALTNATMPYVLELAD

SEQ ID NO: 164965 - protein, 15 aa, Mycobacterium tuberculosis
LTNATMPYVLELADH

SEQ ID NO: 164966 - protein, 15 aa, Mycobacterium tuberculosis
TNATMPYVLELADHG

SEQ ID NO: 164967 - protein, 15 aa, Mycobacterium tuberculosis
NATMPYVLELADHGW

SEQ ID NO: 164968 - protein, 15 aa, Mycobacterium tuberculosis
ATMPYVLELADHGWR

SEQ ID NO: 164969 - protein, 15 aa, Mycobacterium tuberculosis
TMPYVLELADHGWRA

SEQ ID NO: 164970 - protein, 15 aa, Mycobacterium tuberculosis
MPYVLELADHGWRAA

SEQ ID NO: 164971 - protein, 15 aa, Mycobacterium tuberculosis
PYVLELADHGWRAAC

SEQ ID NO: 164972 - protein, 15 aa, Mycobacterium tuberculosis
YVLELADHGWRAACR

SEQ ID NO: 164973 - protein, 15 aa, Mycobacterium tuberculosis
VLELADHGWRAACRS

SEQ ID NO: 164974 - protein, 15 aa, Mycobacterium tuberculosis
LELADHGWRAACRSN

SEQ ID NO: 164975 - protein, 15 aa, Mycobacterium tuberculosis
ELADHGWRAACRSNP

SEQ ID NO: 164976 - protein, 15 aa, Mycobacterium tuberculosis
LADHGWRAACRSNPA

SEQ ID NO: 164977 - protein, 15 aa, Mycobacterium tuberculosis
ADHGWRAACRSNPAL

SEQ ID NO: 164978 - protein, 15 aa, Mycobacterium tuberculosis
DHGWRAACRSNPALA

SEQ ID NO: 164979 - protein, 15 aa, Mycobacterium tuberculosis
HGWRAACRSNPALAK

SEQ ID NO: 164980 - protein, 15 aa, Mycobacterium tuberculosis
GWRAACRSNPALAKG

SEQ ID NO: 164981 - protein, 15 aa, Mycobacterium tuberculosis
WRAACRSNPALAKGL

SEQ ID NO: 164982 - protein, 15 aa, Mycobacterium tuberculosis
RAACRSNPALAKGLS

SEQ ID NO: 164983 - protein, 15 aa, Mycobacterium tuberculosis
AACRSNPALAKGLST

SEQ ID NO: 164984 - protein, 15 aa, Mycobacterium tuberculosis
ACRSNPALAKGLSTH

SEQ ID NO: 164985 - protein, 15 aa, Mycobacterium tuberculosis
CRSNPALAKGLSTHE

SEQ ID NO: 164986 - protein, 15 aa, Mycobacterium tuberculosis
RSNPALAKGLSTHEG

SEQ ID NO: 164987 - protein, 15 aa, Mycobacterium tuberculosis
SNPALAKGLSTHEGA

SEQ ID NO: 164988 - protein, 15 aa, Mycobacterium tuberculosis
NPALAKGLSTHEGAL

SEQ ID NO: 164989 - protein, 15 aa, Mycobacterium tuberculosis
PALAKGLSTHEGALL

SEQ ID NO: 164990 - protein, 15 aa, Mycobacterium tuberculosis
ALAKGLSTHEGALLS

SEQ ID NO: 164991 - protein, 15 aa, Mycobacterium tuberculosis
LAKGLSTHEGALLSE

SEQ ID NO: 164992 - protein, 15 aa, Mycobacterium tuberculosis
AKGLSTHEGALLSER

SEQ ID NO: 164993 - protein, 15 aa, Mycobacterium tuberculosis
KGLSTHEGALLSERV

SEQ ID NO: 164994 - protein, 15 aa, Mycobacterium tuberculosis
GLSTHEGALLSERVA

SEQ ID NO: 164995 - protein, 15 aa, Mycobacterium tuberculosis
LSTHEGALLSERVAT

SEQ ID NO: 164996 - protein, 15 aa, Mycobacterium tuberculosis
STHEGALLSERVATD

SEQ ID NO: 164997 - protein, 15 aa, Mycobacterium tuberculosis
THEGALLSERVATDL

SEQ ID NO: 164998 - protein, 15 aa, Mycobacterium tuberculosis
HEGALLSERVATDLG

SEQ ID NO: 164999 - protein, 15 aa, Mycobacterium tuberculosis
EGALLSERVATDLGV

SEQ ID NO: 165000 - protein, 15 aa, Mycobacterium tuberculosis
GALLSERVATDLGVP

SEQ ID NO: 165001 - protein, 15 aa, Mycobacterium tuberculosis
ALLSERVATDLGVPF

SEQ ID NO: 165002 - protein, 15 aa, Mycobacterium tuberculosis
LLSERVATDLGVPFT

SEQ ID NO: 165003 - protein, 15 aa, Mycobacterium tuberculosis
LSERVATDLGVPFTE

SEQ ID NO: 165004 - protein, 15 aa, Mycobacterium tuberculosis
SERVATDLGVPFTEP

SEQ ID NO: 165005 - protein, 15 aa, Mycobacterium tuberculosis
ERVATDLGVPFTEPA

SEQ ID NO: 165006 - protein, 15 aa, Mycobacterium tuberculosis
RVATDLGVPFTEPAS

SEQ ID NO: 165007 - protein, 15 aa, Mycobacterium tuberculosis
VATDLGVPFTEPASV

SEQ ID NO: 165008 - protein, 15 aa, Mycobacterium tuberculosis
ATDLGVPFTEPASVL

SEQ ID NO: 165009 - protein, 15 aa, Mycobacterium tuberculosis
TDLGVPFTEPASVLA

SEQ ID NO: 165010 - protein, 16 aa, Mycobacterium tuberculosis
MRVGIPTETKNNEFRV

SEQ ID NO: 165011 - protein, 16 aa, Mycobacterium tuberculosis
RVGIPTETKNNEFRVA

SEQ ID NO: 165012 - protein, 16 aa, Mycobacterium tuberculosis
VGIPTETKNNEFRVAI

SEQ ID NO: 165013 - protein, 16 aa, Mycobacterium tuberculosis
GIPTETKNNEFRVAIT

SEQ ID NO: 165014 - protein, 16 aa, Mycobacterium tuberculosis
IPTETKNNEFRVAITP

SEQ ID NO: 165015 - protein, 16 aa, Mycobacterium tuberculosis
PTETKNNEFRVAITPA

SEQ ID NO: 165016 - protein, 16 aa, Mycobacterium tuberculosis
TETKNNEFRVAITPAG

SEQ ID NO: 165017 - protein, 16 aa, Mycobacterium tuberculosis
ETKNNEFRVAITPAGV

SEQ ID NO: 165018 - protein, 16 aa, Mycobacterium tuberculosis
TKNNEFRVAITPAGVA

SEQ ID NO: 165019 - protein, 16 aa, Mycobacterium tuberculosis
KNNEFRVAITPAGVAE

SEQ ID NO: 165020 - protein, 16 aa, Mycobacterium tuberculosis
NNEFRVAITPAGVAEL

SEQ ID NO: 165021 - protein, 16 aa, Mycobacterium tuberculosis
NEFRVAITPAGVAELT

SEQ ID NO: 165022 - protein, 16 aa, Mycobacterium tuberculosis
EFRVAITPAGVAELTR

SEQ ID NO: 165023 - protein, 16 aa, Mycobacterium tuberculosis
FRVAITPAGVAELTRR

SEQ ID NO: 165024 - protein, 16 aa, Mycobacterium tuberculosis
RVAITPAGVAELTRRG

SEQ ID NO: 165025 - protein, 16 aa, Mycobacterium tuberculosis
VAITPAGVAELTRRGH

SEQ ID NO: 165026 - protein, 16 aa, Mycobacterium tuberculosis
AITPAGVAELTRRGHE

SEQ ID NO: 165027 - protein, 16 aa, Mycobacterium tuberculosis
ITPAGVAELTRRGHEV

SEQ ID NO: 165028 - protein, 16 aa, Mycobacterium tuberculosis
TPAGVAELTRRGHEVL

SEQ ID NO: 165029 - protein, 16 aa, Mycobacterium tuberculosis
PAGVAELTRRGHEVLI

SEQ ID NO: 165030 - protein, 16 aa, Mycobacterium tuberculosis
AGVAELTRRGHEVLIQ

SEQ ID NO: 165031 - protein, 16 aa, Mycobacterium tuberculosis
GVAELTRRGHEVLIQA

SEQ ID NO: 165032 - protein, 16 aa, Mycobacterium tuberculosis
VAELTRRGHEVLIQAG

SEQ ID NO: 165033 - protein, 16 aa, Mycobacterium tuberculosis
AELTRRGHEVLIQAGA

SEQ ID NO: 165034 - protein, 16 aa, Mycobacterium tuberculosis
ELTRRGHEVLIQAGAG

SEQ ID NO: 165035 - protein, 16 aa, Mycobacterium tuberculosis
LTRRGHEVLIQAGAGE

SEQ ID NO: 165036 - protein, 16 aa, Mycobacterium tuberculosis
TRRGHEVLIQAGAGEG

SEQ ID NO: 165037 - protein, 16 aa, Mycobacterium tuberculosis
RRGHEVLIQAGAGEGS

SEQ ID NO: 165038 - protein, 16 aa, Mycobacterium tuberculosis
RGHEVLIQAGAGEGSA

SEQ ID NO: 165039 - protein, 16 aa, Mycobacterium tuberculosis
GHEVLIQAGAGEGSAI

SEQ ID NO: 165040 - protein, 16 aa, Mycobacterium tuberculosis
HEVLIQAGAGEGSAIT

SEQ ID NO: 165041 - protein, 16 aa, Mycobacterium tuberculosis
EVLIQAGAGEGSAITD

SEQ ID NO: 165042 - protein, 16 aa, Mycobacterium tuberculosis
VLIQAGAGEGSAITDA

SEQ ID NO: 165043 - protein, 16 aa, Mycobacterium tuberculosis
LIQAGAGEGSAITDAD

SEQ ID NO: 165044 - protein, 16 aa, Mycobacterium tuberculosis
IQAGAGEGSAITDADF

SEQ ID NO: 165045 - protein, 16 aa, Mycobacterium tuberculosis
QAGAGEGSAITDADFK

SEQ ID NO: 165046 - protein, 16 aa, Mycobacterium tuberculosis
AGAGEGSAITDADFKA

SEQ ID NO: 165047 - protein, 16 aa, Mycobacterium tuberculosis
GAGEGSAITDADFKAA

SEQ ID NO: 165048 - protein, 16 aa, Mycobacterium tuberculosis
AGEGSAITDADFKAAG

SEQ ID NO: 165049 - protein, 16 aa, Mycobacterium tuberculosis
GEGSAITDADFKAAGA

SEQ ID NO: 165050 - protein, 16 aa, Mycobacterium tuberculosis
EGSAITDADFKAAGAQ

SEQ ID NO: 165051 - protein, 16 aa, Mycobacterium tuberculosis
GSAITDADFKAAGAQL

SEQ ID NO: 165052 - protein, 16 aa, Mycobacterium tuberculosis
SAITDADFKAAGAQLV

SEQ ID NO: 165053 - protein, 16 aa, Mycobacterium tuberculosis
AITDADFKAAGAQLVG

SEQ ID NO: 165054 - protein, 16 aa, Mycobacterium tuberculosis
ITDADFKAAGAQLVGT

SEQ ID NO: 165055 - protein, 16 aa, Mycobacterium tuberculosis
TDADFKAAGAQLVGTA

SEQ ID NO: 165056 - protein, 16 aa, Mycobacterium tuberculosis
DADFKAAGAQLVGTAD

SEQ ID NO: 165057 - protein, 16 aa, Mycobacterium tuberculosis
ADFKAAGAQLVGTADQ

SEQ ID NO: 165058 - protein, 16 aa, Mycobacterium tuberculosis
DFKAAGAQLVGTADQV

SEQ ID NO: 165059 - protein, 16 aa, Mycobacterium tuberculosis
FKAAGAQLVGTADQVW

SEQ ID NO: 165060 - protein, 16 aa, Mycobacterium tuberculosis
KAAGAQLVGTADQVWA

SEQ ID NO: 165061 - protein, 16 aa, Mycobacterium tuberculosis
AAGAQLVGTADQVWAD

SEQ ID NO: 165062 - protein, 16 aa, Mycobacterium tuberculosis
AGAQLVGTADQVWADA

SEQ ID NO: 165063 - protein, 16 aa, Mycobacterium tuberculosis
GAQLVGTADQVWADAD

SEQ ID NO: 165064 - protein, 16 aa, Mycobacterium tuberculosis
AQLVGTADQVWADADL

SEQ ID NO: 165065 - protein, 16 aa, Mycobacterium tuberculosis
QLVGTADQVWADADLL

SEQ ID NO: 165066 - protein, 16 aa, Mycobacterium tuberculosis
LVGTADQVWADADLLL

SEQ ID NO: 165067 - protein, 16 aa, Mycobacterium tuberculosis
VGTADQVWADADLLLK

SEQ ID NO: 165068 - protein, 16 aa, Mycobacterium tuberculosis
GTADQVWADADLLLKV

SEQ ID NO: 165069 - protein, 16 aa, Mycobacterium tuberculosis
TADQVWADADLLLKVK

SEQ ID NO: 165070 - protein, 16 aa, Mycobacterium tuberculosis
ADQVWADADLLLKVKE

SEQ ID NO: 165071 - protein, 16 aa, Mycobacterium tuberculosis
DQVWADADLLLKVKEP

SEQ ID NO: 165072 - protein, 16 aa, Mycobacterium tuberculosis
QVWADADLLLKVKEPI

SEQ ID NO: 165073 - protein, 16 aa, Mycobacterium tuberculosis
VWADADLLLKVKEPIA

SEQ ID NO: 165074 - protein, 16 aa, Mycobacterium tuberculosis
WADADLLLKVKEPIAA

SEQ ID NO: 165075 - protein, 16 aa, Mycobacterium tuberculosis
ADADLLLKVKEPIAAE

SEQ ID NO: 165076 - protein, 16 aa, Mycobacterium tuberculosis
DADLLLKVKEPIAAEY

SEQ ID NO: 165077 - protein, 16 aa, Mycobacterium tuberculosis
ADLLLKVKEPIAAEYG

SEQ ID NO: 165078 - protein, 16 aa, Mycobacterium tuberculosis
DLLLKVKEPIAAEYGR

SEQ ID NO: 165079 - protein, 16 aa, Mycobacterium tuberculosis
LLLKVKEPIAAEYGRL

SEQ ID NO: 165080 - protein, 16 aa, Mycobacterium tuberculosis
LLKVKEPIAAEYGRLR

SEQ ID NO: 165081 - protein, 16 aa, Mycobacterium tuberculosis
LKVKEPIAAEYGRLRH

SEQ ID NO: 165082 - protein, 16 aa, Mycobacterium tuberculosis
KVKEPIAAEYGRLRHG

SEQ ID NO: 165083 - protein, 16 aa, Mycobacterium tuberculosis
VKEPIAAEYGRLRHGQ

SEQ ID NO: 165084 - protein, 16 aa, Mycobacterium tuberculosis
KEPIAAEYGRLRHGQI

SEQ ID NO: 165085 - protein, 16 aa, Mycobacterium tuberculosis
EPIAAEYGRLRHGQIL

SEQ ID NO: 165086 - protein, 16 aa, Mycobacterium tuberculosis
PIAAEYGRLRHGQILF

SEQ ID NO: 165087 - protein, 16 aa, Mycobacterium tuberculosis
IAAEYGRLRHGQILFT

SEQ ID NO: 165088 - protein, 16 aa, Mycobacterium tuberculosis
AAEYGRLRHGQILFTF

SEQ ID NO: 165089 - protein, 16 aa, Mycobacterium tuberculosis
AEYGRLRHGQILFTFL

SEQ ID NO: 165090 - protein, 16 aa, Mycobacterium tuberculosis
EYGRLRHGQILFTFLH

SEQ ID NO: 165091 - protein, 16 aa, Mycobacterium tuberculosis
YGRLRHGQILFTFLHL

SEQ ID NO: 165092 - protein, 16 aa, Mycobacterium tuberculosis
GRLRHGQILFTFLHLA

SEQ ID NO: 165093 - protein, 16 aa, Mycobacterium tuberculosis
RLRHGQILFTFLHLAA

SEQ ID NO: 165094 - protein, 16 aa, Mycobacterium tuberculosis
LRHGQILFTFLHLAAS

SEQ ID NO: 165095 - protein, 16 aa, Mycobacterium tuberculosis
RHGQILFTFLHLAASR

SEQ ID NO: 165096 - protein, 16 aa, Mycobacterium tuberculosis
HGQILFTFLHLAASRA

SEQ ID NO: 165097 - protein, 16 aa, Mycobacterium tuberculosis
GQILFTFLHLAASRAC

SEQ ID NO: 165098 - protein, 16 aa, Mycobacterium tuberculosis
QILFTFLHLAASRACT

SEQ ID NO: 165099 - protein, 16 aa, Mycobacterium tuberculosis
ILFTFLHLAASRACTD

SEQ ID NO: 165100 - protein, 16 aa, Mycobacterium tuberculosis
LFTFLHLAASRACTDA

SEQ ID NO: 165101 - protein, 16 aa, Mycobacterium tuberculosis
FTFLHLAASRACTDAL

SEQ ID NO: 165102 - protein, 16 aa, Mycobacterium tuberculosis
TFLHLAASRACTDALL

SEQ ID NO: 165103 - protein, 16 aa, Mycobacterium tuberculosis
FLHLAASRACTDALLD

SEQ ID NO: 165104 - protein, 16 aa, Mycobacterium tuberculosis
LHLAASRACTDALLDS

SEQ ID NO: 165105 - protein, 16 aa, Mycobacterium tuberculosis
HLAASRACTDALLDSG

SEQ ID NO: 165106 - protein, 16 aa, Mycobacterium tuberculosis
LAASRACTDALLDSGT

SEQ ID NO: 165107 - protein, 16 aa, Mycobacterium tuberculosis
AASRACTDALLDSGTT

SEQ ID NO: 165108 - protein, 16 aa, Mycobacterium tuberculosis
ASRACTDALLDSGTTS

SEQ ID NO: 165109 - protein, 16 aa, Mycobacterium tuberculosis
SRACTDALLDSGTTSI

SEQ ID NO: 165110 - protein, 16 aa, Mycobacterium tuberculosis
RACTDALLDSGTTSIA

SEQ ID NO: 165111 - protein, 16 aa, Mycobacterium tuberculosis
ACTDALLDSGTTSIAY

SEQ ID NO: 165112 - protein, 16 aa, Mycobacterium tuberculosis
CTDALLDSGTTSIAYE

SEQ ID NO: 165113 - protein, 16 aa, Mycobacterium tuberculosis
TDALLDSGTTSIAYET

SEQ ID NO: 165114 - protein, 16 aa, Mycobacterium tuberculosis
DALLDSGTTSIAYETV

SEQ ID NO: 165115 - protein, 16 aa, Mycobacterium tuberculosis
ALLDSGTTSIAYETVQ

SEQ ID NO: 165116 - protein, 16 aa, Mycobacterium tuberculosis
LLDSGTTSIAYETVQT

SEQ ID NO: 165117 - protein, 16 aa, Mycobacterium tuberculosis
LDSGTTSIAYETVQTA

SEQ ID NO: 165118 - protein, 16 aa, Mycobacterium tuberculosis
DSGTTSIAYETVQTAD

SEQ ID NO: 165119 - protein, 16 aa, Mycobacterium tuberculosis
SGTTSIAYETVQTADG

SEQ ID NO: 165120 - protein, 16 aa, Mycobacterium tuberculosis
GTTSIAYETVQTADGA

SEQ ID NO: 165121 - protein, 16 aa, Mycobacterium tuberculosis
TTSIAYETVQTADGAL

SEQ ID NO: 165122 - protein, 16 aa, Mycobacterium tuberculosis
TSIAYETVQTADGALP

SEQ ID NO: 165123 - protein, 16 aa, Mycobacterium tuberculosis
SIAYETVQTADGALPL

SEQ ID NO: 165124 - protein, 16 aa, Mycobacterium tuberculosis
IAYETVQTADGALPLL

SEQ ID NO: 165125 - protein, 16 aa, Mycobacterium tuberculosis
AYETVQTADGALPLLA

SEQ ID NO: 165126 - protein, 16 aa, Mycobacterium tuberculosis
YETVQTADGALPLLAP

SEQ ID NO: 165127 - protein, 16 aa, Mycobacterium tuberculosis
ETVQTADGALPLLAPM

SEQ ID NO: 165128 - protein, 16 aa, Mycobacterium tuberculosis
TVQTADGALPLLAPMS

SEQ ID NO: 165129 - protein, 16 aa, Mycobacterium tuberculosis
VQTADGALPLLAPMSE

SEQ ID NO: 165130 - protein, 16 aa, Mycobacterium tuberculosis
QTADGALPLLAPMSEV

SEQ ID NO: 165131 - protein, 16 aa, Mycobacterium tuberculosis
TADGALPLLAPMSEVA

SEQ ID NO: 165132 - protein, 16 aa, Mycobacterium tuberculosis
ADGALPLLAPMSEVAG

SEQ ID NO: 165133 - protein, 16 aa, Mycobacterium tuberculosis
DGALPLLAPMSEVAGR

SEQ ID NO: 165134 - protein, 16 aa, Mycobacterium tuberculosis
GALPLLAPMSEVAGRL

SEQ ID NO: 165135 - protein, 16 aa, Mycobacterium tuberculosis
ALPLLAPMSEVAGRLA

SEQ ID NO: 165136 - protein, 16 aa, Mycobacterium tuberculosis
LPLLAPMSEVAGRLAA

SEQ ID NO: 165137 - protein, 16 aa, Mycobacterium tuberculosis
PLLAPMSEVAGRLAAQ

SEQ ID NO: 165138 - protein, 16 aa, Mycobacterium tuberculosis
LLAPMSEVAGRLAAQV

SEQ ID NO: 165139 - protein, 16 aa, Mycobacterium tuberculosis
LAPMSEVAGRLAAQVG

SEQ ID NO: 165140 - protein, 16 aa, Mycobacterium tuberculosis
APMSEVAGRLAAQVGA

SEQ ID NO: 165141 - protein, 16 aa, Mycobacterium tuberculosis
PMSEVAGRLAAQVGAY

SEQ ID NO: 165142 - protein, 16 aa, Mycobacterium tuberculosis
MSEVAGRLAAQVGAYH

SEQ ID NO: 165143 - protein, 16 aa, Mycobacterium tuberculosis
SEVAGRLAAQVGAYHL

SEQ ID NO: 165144 - protein, 16 aa, Mycobacterium tuberculosis
EVAGRLAAQVGAYHLM

SEQ ID NO: 165145 - protein, 16 aa, Mycobacterium tuberculosis
VAGRLAAQVGAYHLMR

SEQ ID NO: 165146 - protein, 16 aa, Mycobacterium tuberculosis
AGRLAAQVGAYHLMRT

SEQ ID NO: 165147 - protein, 16 aa, Mycobacterium tuberculosis
GRLAAQVGAYHLMRTQ

SEQ ID NO: 165148 - protein, 16 aa, Mycobacterium tuberculosis
RLAAQVGAYHLMRTQG

SEQ ID NO: 165149 - protein, 16 aa, Mycobacterium tuberculosis
LAAQVGAYHLMRTQGG

SEQ ID NO: 165150 - protein, 16 aa, Mycobacterium tuberculosis
AAQVGAYHLMRTQGGR

SEQ ID NO: 165151 - protein, 16 aa, Mycobacterium tuberculosis
AQVGAYHLMRTQGGRG

SEQ ID NO: 165152 - protein, 16 aa, Mycobacterium tuberculosis
QVGAYHLMRTQGGRGV

SEQ ID NO: 165153 - protein, 16 aa, Mycobacterium tuberculosis
VGAYHLMRTQGGRGVL

SEQ ID NO: 165154 - protein, 16 aa, Mycobacterium tuberculosis
GAYHLMRTQGGRGVLM

SEQ ID NO: 165155 - protein, 16 aa, Mycobacterium tuberculosis
AYHLMRTQGGRGVLMG

SEQ ID NO: 165156 - protein, 16 aa, Mycobacterium tuberculosis
YHLMRTQGGRGVLMGG

SEQ ID NO: 165157 - protein, 16 aa, Mycobacterium tuberculosis
HLMRTQGGRGVLMGGV

SEQ ID NO: 165158 - protein, 16 aa, Mycobacterium tuberculosis
LMRTQGGRGVLMGGVP

SEQ ID NO: 165159 - protein, 16 aa, Mycobacterium tuberculosis
MRTQGGRGVLMGGVPG

SEQ ID NO: 165160 - protein, 16 aa, Mycobacterium tuberculosis
RTQGGRGVLMGGVPGV

SEQ ID NO: 165161 - protein, 16 aa, Mycobacterium tuberculosis
TQGGRGVLMGGVPGVE

SEQ ID NO: 165162 - protein, 16 aa, Mycobacterium tuberculosis
QGGRGVLMGGVPGVEP

SEQ ID NO: 165163 - protein, 16 aa, Mycobacterium tuberculosis
GGRGVLMGGVPGVEPA

SEQ ID NO: 165164 - protein, 16 aa, Mycobacterium tuberculosis
GRGVLMGGVPGVEPAD

SEQ ID NO: 165165 - protein, 16 aa, Mycobacterium tuberculosis
RGVLMGGVPGVEPADV

SEQ ID NO: 165166 - protein, 16 aa, Mycobacterium tuberculosis
GVLMGGVPGVEPADVV

SEQ ID NO: 165167 - protein, 16 aa, Mycobacterium tuberculosis
VLMGGVPGVEPADVVV

SEQ ID NO: 165168 - protein, 16 aa, Mycobacterium tuberculosis
LMGGVPGVEPADVVVI

SEQ ID NO: 165169 - protein, 16 aa, Mycobacterium tuberculosis
MGGVPGVEPADVVVIG

SEQ ID NO: 165170 - protein, 16 aa, Mycobacterium tuberculosis
GGVPGVEPADVVVIGA

SEQ ID NO: 165171 - protein, 16 aa, Mycobacterium tuberculosis
GVPGVEPADVVVIGAG

SEQ ID NO: 165172 - protein, 16 aa, Mycobacterium tuberculosis
VPGVEPADVVVIGAGT

SEQ ID NO: 165173 - protein, 16 aa, Mycobacterium tuberculosis
PGVEPADVVVIGAGTA

SEQ ID NO: 165174 - protein, 16 aa, Mycobacterium tuberculosis
GVEPADVVVIGAGTAG

SEQ ID NO: 165175 - protein, 16 aa, Mycobacterium tuberculosis
VEPADVVVIGAGTAGY

SEQ ID NO: 165176 - protein, 16 aa, Mycobacterium tuberculosis
EPADVVVIGAGTAGYN

SEQ ID NO: 165177 - protein, 16 aa, Mycobacterium tuberculosis
PADVVVIGAGTAGYNA

SEQ ID NO: 165178 - protein, 16 aa, Mycobacterium tuberculosis
ADVVVIGAGTAGYNAA

SEQ ID NO: 165179 - protein, 16 aa, Mycobacterium tuberculosis
DVVVIGAGTAGYNAAR

SEQ ID NO: 165180 - protein, 16 aa, Mycobacterium tuberculosis
VVVIGAGTAGYNAARI

SEQ ID NO: 165181 - protein, 16 aa, Mycobacterium tuberculosis
VVIGAGTAGYNAARIA

SEQ ID NO: 165182 - protein, 16 aa, Mycobacterium tuberculosis
VIGAGTAGYNAARIAN

SEQ ID NO: 165183 - protein, 16 aa, Mycobacterium tuberculosis
IGAGTAGYNAARIANG

SEQ ID NO: 165184 - protein, 16 aa, Mycobacterium tuberculosis
GAGTAGYNAARIANGM

SEQ ID NO: 165185 - protein, 16 aa, Mycobacterium tuberculosis
AGTAGYNAARIANGMG

SEQ ID NO: 165186 - protein, 16 aa, Mycobacterium tuberculosis
GTAGYNAARIANGMGA

SEQ ID NO: 165187 - protein, 16 aa, Mycobacterium tuberculosis
TAGYNAARIANGMGAT

SEQ ID NO: 165188 - protein, 16 aa, Mycobacterium tuberculosis
AGYNAARIANGMGATV

SEQ ID NO: 165189 - protein, 16 aa, Mycobacterium tuberculosis
GYNAARIANGMGATVT

SEQ ID NO: 165190 - protein, 16 aa, Mycobacterium tuberculosis
YNAARIANGMGATVTV

SEQ ID NO: 165191 - protein, 16 aa, Mycobacterium tuberculosis
NAARIANGMGATVTVL

SEQ ID NO: 165192 - protein, 16 aa, Mycobacterium tuberculosis
AARIANGMGATVTVLD

SEQ ID NO: 165193 - protein, 16 aa, Mycobacterium tuberculosis
ARIANGMGATVTVLDI

SEQ ID NO: 165194 - protein, 16 aa, Mycobacterium tuberculosis
RIANGMGATVTVLDIN

SEQ ID NO: 165195 - protein, 16 aa, Mycobacterium tuberculosis
IANGMGATVTVLDINI

SEQ ID NO: 165196 - protein, 16 aa, Mycobacterium tuberculosis
ANGMGATVTVLDINID

SEQ ID NO: 165197 - protein, 16 aa, Mycobacterium tuberculosis
NGMGATVTVLDINIDK

SEQ ID NO: 165198 - protein, 16 aa, Mycobacterium tuberculosis
GMGATVTVLDINIDKL

SEQ ID NO: 165199 - protein, 16 aa, Mycobacterium tuberculosis
MGATVTVLDINIDKLR

SEQ ID NO: 165200 - protein, 16 aa, Mycobacterium tuberculosis
GATVTVLDINIDKLRQ

SEQ ID NO: 165201 - protein, 16 aa, Mycobacterium tuberculosis
ATVTVLDINIDKLRQL

SEQ ID NO: 165202 - protein, 16 aa, Mycobacterium tuberculosis
TVTVLDINIDKLRQLD

SEQ ID NO: 165203 - protein, 16 aa, Mycobacterium tuberculosis
VTVLDINIDKLRQLDA

SEQ ID NO: 165204 - protein, 16 aa, Mycobacterium tuberculosis
TVLDINIDKLRQLDAE

SEQ ID NO: 165205 - protein, 16 aa, Mycobacterium tuberculosis
VLDINIDKLRQLDAEF

SEQ ID NO: 165206 - protein, 16 aa, Mycobacterium tuberculosis
LDINIDKLRQLDAEFC

SEQ ID NO: 165207 - protein, 16 aa, Mycobacterium tuberculosis
DINIDKLRQLDAEFCG

SEQ ID NO: 165208 - protein, 16 aa, Mycobacterium tuberculosis
INIDKLRQLDAEFCGR

SEQ ID NO: 165209 - protein, 16 aa, Mycobacterium tuberculosis
NIDKLRQLDAEFCGRI

SEQ ID NO: 165210 - protein, 16 aa, Mycobacterium tuberculosis
IDKLRQLDAEFCGRIH

SEQ ID NO: 165211 - protein, 16 aa, Mycobacterium tuberculosis
DKLRQLDAEFCGRIHT

SEQ ID NO: 165212 - protein, 16 aa, Mycobacterium tuberculosis
KLRQLDAEFCGRIHTR

SEQ ID NO: 165213 - protein, 16 aa, Mycobacterium tuberculosis
LRQLDAEFCGRIHTRY

SEQ ID NO: 165214 - protein, 16 aa, Mycobacterium tuberculosis
RQLDAEFCGRIHTRYS

SEQ ID NO: 165215 - protein, 16 aa, Mycobacterium tuberculosis
QLDAEFCGRIHTRYSS

SEQ ID NO: 165216 - protein, 16 aa, Mycobacterium tuberculosis
LDAEFCGRIHTRYSSA

SEQ ID NO: 165217 - protein, 16 aa, Mycobacterium tuberculosis
DAEFCGRIHTRYSSAY

SEQ ID NO: 165218 - protein, 16 aa, Mycobacterium tuberculosis
AEFCGRIHTRYSSAYE

SEQ ID NO: 165219 - protein, 16 aa, Mycobacterium tuberculosis
EFCGRIHTRYSSAYEL

SEQ ID NO: 165220 - protein, 16 aa, Mycobacterium tuberculosis
FCGRIHTRYSSAYELE

SEQ ID NO: 165221 - protein, 16 aa, Mycobacterium tuberculosis
CGRIHTRYSSAYELEG

SEQ ID NO: 165222 - protein, 16 aa, Mycobacterium tuberculosis
GRIHTRYSSAYELEGA

SEQ ID NO: 165223 - protein, 16 aa, Mycobacterium tuberculosis
RIHTRYSSAYELEGAV

SEQ ID NO: 165224 - protein, 16 aa, Mycobacterium tuberculosis
IHTRYSSAYELEGAVK

SEQ ID NO: 165225 - protein, 16 aa, Mycobacterium tuberculosis
HTRYSSAYELEGAVKR

SEQ ID NO: 165226 - protein, 16 aa, Mycobacterium tuberculosis
TRYSSAYELEGAVKRA

SEQ ID NO: 165227 - protein, 16 aa, Mycobacterium tuberculosis
RYSSAYELEGAVKRAD

SEQ ID NO: 165228 - protein, 16 aa, Mycobacterium tuberculosis
YSSAYELEGAVKRADL

SEQ ID NO: 165229 - protein, 16 aa, Mycobacterium tuberculosis
SSAYELEGAVKRADLV

SEQ ID NO: 165230 - protein, 16 aa, Mycobacterium tuberculosis
SAYELEGAVKRADLVI

SEQ ID NO: 165231 - protein, 16 aa, Mycobacterium tuberculosis
AYELEGAVKRADLVIG

SEQ ID NO: 165232 - protein, 16 aa, Mycobacterium tuberculosis
YELEGAVKRADLVIGA

SEQ ID NO: 165233 - protein, 16 aa, Mycobacterium tuberculosis
ELEGAVKRADLVIGAV

SEQ ID NO: 165234 - protein, 16 aa, Mycobacterium tuberculosis
LEGAVKRADLVIGAVL

SEQ ID NO: 165235 - protein, 16 aa, Mycobacterium tuberculosis
EGAVKRADLVIGAVLV

SEQ ID NO: 165236 - protein, 16 aa, Mycobacterium tuberculosis
GAVKRADLVIGAVLVP

SEQ ID NO: 165237 - protein, 16 aa, Mycobacterium tuberculosis
AVKRADLVIGAVLVPG

SEQ ID NO: 165238 - protein, 16 aa, Mycobacterium tuberculosis
VKRADLVIGAVLVPGA

SEQ ID NO: 165239 - protein, 16 aa, Mycobacterium tuberculosis
KRADLVIGAVLVPGAK

SEQ ID NO: 165240 - protein, 16 aa, Mycobacterium tuberculosis
RADLVIGAVLVPGAKA

SEQ ID NO: 165241 - protein, 16 aa, Mycobacterium tuberculosis
ADLVIGAVLVPGAKAP

SEQ ID NO: 165242 - protein, 16 aa, Mycobacterium tuberculosis
DLVIGAVLVPGAKAPK

SEQ ID NO: 165243 - protein, 16 aa, Mycobacterium tuberculosis
LVIGAVLVPGAKAPKL

SEQ ID NO: 165244 - protein, 16 aa, Mycobacterium tuberculosis
VIGAVLVPGAKAPKLV

SEQ ID NO: 165245 - protein, 16 aa, Mycobacterium tuberculosis
IGAVLVPGAKAPKLVS

SEQ ID NO: 165246 - protein, 16 aa, Mycobacterium tuberculosis
GAVLVPGAKAPKLVSN

SEQ ID NO: 165247 - protein, 16 aa, Mycobacterium tuberculosis
AVLVPGAKAPKLVSNS

SEQ ID NO: 165248 - protein, 16 aa, Mycobacterium tuberculosis
VLVPGAKAPKLVSNSL

SEQ ID NO: 165249 - protein, 16 aa, Mycobacterium tuberculosis
LVPGAKAPKLVSNSLV

SEQ ID NO: 165250 - protein, 16 aa, Mycobacterium tuberculosis
VPGAKAPKLVSNSLVA

SEQ ID NO: 165251 - protein, 16 aa, Mycobacterium tuberculosis
PGAKAPKLVSNSLVAH

SEQ ID NO: 165252 - protein, 16 aa, Mycobacterium tuberculosis
GAKAPKLVSNSLVAHM

SEQ ID NO: 165253 - protein, 16 aa, Mycobacterium tuberculosis
AKAPKLVSNSLVAHMK

SEQ ID NO: 165254 - protein, 16 aa, Mycobacterium tuberculosis
KAPKLVSNSLVAHMKP

SEQ ID NO: 165255 - protein, 16 aa, Mycobacterium tuberculosis
APKLVSNSLVAHMKPG

SEQ ID NO: 165256 - protein, 16 aa, Mycobacterium tuberculosis
PKLVSNSLVAHMKPGA

SEQ ID NO: 165257 - protein, 16 aa, Mycobacterium tuberculosis
KLVSNSLVAHMKPGAV

SEQ ID NO: 165258 - protein, 16 aa, Mycobacterium tuberculosis
LVSNSLVAHMKPGAVL

SEQ ID NO: 165259 - protein, 16 aa, Mycobacterium tuberculosis
VSNSLVAHMKPGAVLV

SEQ ID NO: 165260 - protein, 16 aa, Mycobacterium tuberculosis
SNSLVAHMKPGAVLVD

SEQ ID NO: 165261 - protein, 16 aa, Mycobacterium tuberculosis
NSLVAHMKPGAVLVDI

SEQ ID NO: 165262 - protein, 16 aa, Mycobacterium tuberculosis
SLVAHMKPGAVLVDIA

SEQ ID NO: 165263 - protein, 16 aa, Mycobacterium tuberculosis
LVAHMKPGAVLVDIAI

SEQ ID NO: 165264 - protein, 16 aa, Mycobacterium tuberculosis
VAHMKPGAVLVDIAID

SEQ ID NO: 165265 - protein, 16 aa, Mycobacterium tuberculosis
AHMKPGAVLVDIAIDQ

SEQ ID NO: 165266 - protein, 16 aa, Mycobacterium tuberculosis
HMKPGAVLVDIAIDQG

SEQ ID NO: 165267 - protein, 16 aa, Mycobacterium tuberculosis
MKPGAVLVDIAIDQGG

SEQ ID NO: 165268 - protein, 16 aa, Mycobacterium tuberculosis
KPGAVLVDIAIDQGGC

SEQ ID NO: 165269 - protein, 16 aa, Mycobacterium tuberculosis
PGAVLVDIAIDQGGCF

SEQ ID NO: 165270 - protein, 16 aa, Mycobacterium tuberculosis
GAVLVDIAIDQGGCFE

SEQ ID NO: 165271 - protein, 16 aa, Mycobacterium tuberculosis
AVLVDIAIDQGGCFEG

SEQ ID NO: 165272 - protein, 16 aa, Mycobacterium tuberculosis
VLVDIAIDQGGCFEGS

SEQ ID NO: 165273 - protein, 16 aa, Mycobacterium tuberculosis
LVDIAIDQGGCFEGSR

SEQ ID NO: 165274 - protein, 16 aa, Mycobacterium tuberculosis
VDIAIDQGGCFEGSRP

SEQ ID NO: 165275 - protein, 16 aa, Mycobacterium tuberculosis
DIAIDQGGCFEGSRPT

SEQ ID NO: 165276 - protein, 16 aa, Mycobacterium tuberculosis
IAIDQGGCFEGSRPTT

SEQ ID NO: 165277 - protein, 16 aa, Mycobacterium tuberculosis
AIDQGGCFEGSRPTTY

SEQ ID NO: 165278 - protein, 16 aa, Mycobacterium tuberculosis
IDQGGCFEGSRPTTYD

SEQ ID NO: 165279 - protein, 16 aa, Mycobacterium tuberculosis
DQGGCFEGSRPTTYDH

SEQ ID NO: 165280 - protein, 16 aa, Mycobacterium tuberculosis
QGGCFEGSRPTTYDHP

SEQ ID NO: 165281 - protein, 16 aa, Mycobacterium tuberculosis
GGCFEGSRPTTYDHPT

SEQ ID NO: 165282 - protein, 16 aa, Mycobacterium tuberculosis
GCFEGSRPTTYDHPTF

SEQ ID NO: 165283 - protein, 16 aa, Mycobacterium tuberculosis
CFEGSRPTTYDHPTFA

SEQ ID NO: 165284 - protein, 16 aa, Mycobacterium tuberculosis
FEGSRPTTYDHPTFAV

SEQ ID NO: 165285 - protein, 16 aa, Mycobacterium tuberculosis
EGSRPTTYDHPTFAVH

SEQ ID NO: 165286 - protein, 16 aa, Mycobacterium tuberculosis
GSRPTTYDHPTFAVHD

SEQ ID NO: 165287 - protein, 16 aa, Mycobacterium tuberculosis
SRPTTYDHPTFAVHDT

SEQ ID NO: 165288 - protein, 16 aa, Mycobacterium tuberculosis
RPTTYDHPTFAVHDTL

SEQ ID NO: 165289 - protein, 16 aa, Mycobacterium tuberculosis
PTTYDHPTFAVHDTLF

SEQ ID NO: 165290 - protein, 16 aa, Mycobacterium tuberculosis
TTYDHPTFAVHDTLFY

SEQ ID NO: 165291 - protein, 16 aa, Mycobacterium tuberculosis
TYDHPTFAVHDTLFYC

SEQ ID NO: 165292 - protein, 16 aa, Mycobacterium tuberculosis
YDHPTFAVHDTLFYCV

SEQ ID NO: 165293 - protein, 16 aa, Mycobacterium tuberculosis
DHPTFAVHDTLFYCVA

SEQ ID NO: 165294 - protein, 16 aa, Mycobacterium tuberculosis
HPTFAVHDTLFYCVAN

SEQ ID NO: 165295 - protein, 16 aa, Mycobacterium tuberculosis
PTFAVHDTLFYCVANM

SEQ ID NO: 165296 - protein, 16 aa, Mycobacterium tuberculosis
TFAVHDTLFYCVANMP

SEQ ID NO: 165297 - protein, 16 aa, Mycobacterium tuberculosis
FAVHDTLFYCVANMPA

SEQ ID NO: 165298 - protein, 16 aa, Mycobacterium tuberculosis
AVHDTLFYCVANMPAS

SEQ ID NO: 165299 - protein, 16 aa, Mycobacterium tuberculosis
VHDTLFYCVANMPASV

SEQ ID NO: 165300 - protein, 16 aa, Mycobacterium tuberculosis
HDTLFYCVANMPASVP

SEQ ID NO: 165301 - protein, 16 aa, Mycobacterium tuberculosis
DTLFYCVANMPASVPK

SEQ ID NO: 165302 - protein, 16 aa, Mycobacterium tuberculosis
TLFYCVANMPASVPKT

SEQ ID NO: 165303 - protein, 16 aa, Mycobacterium tuberculosis
LFYCVANMPASVPKTS

SEQ ID NO: 165304 - protein, 16 aa, Mycobacterium tuberculosis
FYCVANMPASVPKTST

SEQ ID NO: 165305 - protein, 16 aa, Mycobacterium tuberculosis
YCVANMPASVPKTSTY

SEQ ID NO: 165306 - protein, 16 aa, Mycobacterium tuberculosis
CVANMPASVPKTSTYA

SEQ ID NO: 165307 - protein, 16 aa, Mycobacterium tuberculosis
VANMPASVPKTSTYAL

SEQ ID NO: 165308 - protein, 16 aa, Mycobacterium tuberculosis
ANMPASVPKTSTYALT

SEQ ID NO: 165309 - protein, 16 aa, Mycobacterium tuberculosis
NMPASVPKTSTYALTN

SEQ ID NO: 165310 - protein, 16 aa, Mycobacterium tuberculosis
MPASVPKTSTYALTNA

SEQ ID NO: 165311 - protein, 16 aa, Mycobacterium tuberculosis
PASVPKTSTYALTNAT

SEQ ID NO: 165312 - protein, 16 aa, Mycobacterium tuberculosis
ASVPKTSTYALTNATM

SEQ ID NO: 165313 - protein, 16 aa, Mycobacterium tuberculosis
SVPKTSTYALTNATMP

SEQ ID NO: 165314 - protein, 16 aa, Mycobacterium tuberculosis
VPKTSTYALTNATMPY

SEQ ID NO: 165315 - protein, 16 aa, Mycobacterium tuberculosis
PKTSTYALTNATMPYV

SEQ ID NO: 165316 - protein, 16 aa, Mycobacterium tuberculosis
KTSTYALTNATMPYVL

SEQ ID NO: 165317 - protein, 16 aa, Mycobacterium tuberculosis
TSTYALTNATMPYVLE

SEQ ID NO: 165318 - protein, 16 aa, Mycobacterium tuberculosis
STYALTNATMPYVLEL

SEQ ID NO: 165319 - protein, 16 aa, Mycobacterium tuberculosis
TYALTNATMPYVLELA

SEQ ID NO: 165320 - protein, 16 aa, Mycobacterium tuberculosis
YALTNATMPYVLELAD

SEQ ID NO: 165321 - protein, 16 aa, Mycobacterium tuberculosis
ALTNATMPYVLELADH

SEQ ID NO: 165322 - protein, 16 aa, Mycobacterium tuberculosis
LTNATMPYVLELADHG

SEQ ID NO: 165323 - protein, 16 aa, Mycobacterium tuberculosis
TNATMPYVLELADHGW

SEQ ID NO: 165324 - protein, 16 aa, Mycobacterium tuberculosis
NATMPYVLELADHGWR

SEQ ID NO: 165325 - protein, 16 aa, Mycobacterium tuberculosis
ATMPYVLELADHGWRA

SEQ ID NO: 165326 - protein, 16 aa, Mycobacterium tuberculosis
TMPYVLELADHGWRAA

SEQ ID NO: 165327 - protein, 16 aa, Mycobacterium tuberculosis
MPYVLELADHGWRAAC

SEQ ID NO: 165328 - protein, 16 aa, Mycobacterium tuberculosis
PYVLELADHGWRAACR

SEQ ID NO: 165329 - protein, 16 aa, Mycobacterium tuberculosis
YVLELADHGWRAACRS

SEQ ID NO: 165330 - protein, 16 aa, Mycobacterium tuberculosis
VLELADHGWRAACRSN

SEQ ID NO: 165331 - protein, 16 aa, Mycobacterium tuberculosis
LELADHGWRAACRSNP

SEQ ID NO: 165332 - protein, 16 aa, Mycobacterium tuberculosis
ELADHGWRAACRSNPA

SEQ ID NO: 165333 - protein, 16 aa, Mycobacterium tuberculosis
LADHGWRAACRSNPAL

SEQ ID NO: 165334 - protein, 16 aa, Mycobacterium tuberculosis
ADHGWRAACRSNPALA

SEQ ID NO: 165335 - protein, 16 aa, Mycobacterium tuberculosis
DHGWRAACRSNPALAK

SEQ ID NO: 165336 - protein, 16 aa, Mycobacterium tuberculosis
HGWRAACRSNPALAKG

SEQ ID NO: 165337 - protein, 16 aa, Mycobacterium tuberculosis
GWRAACRSNPALAKGL

SEQ ID NO: 165338 - protein, 16 aa, Mycobacterium tuberculosis
WRAACRSNPALAKGLS

SEQ ID NO: 165339 - protein, 16 aa, Mycobacterium tuberculosis
RAACRSNPALAKGLST

SEQ ID NO: 165340 - protein, 16 aa, Mycobacterium tuberculosis
AACRSNPALAKGLSTH

SEQ ID NO: 165341 - protein, 16 aa, Mycobacterium tuberculosis
ACRSNPALAKGLSTHE

SEQ ID NO: 165342 - protein, 16 aa, Mycobacterium tuberculosis
CRSNPALAKGLSTHEG

SEQ ID NO: 165343 - protein, 16 aa, Mycobacterium tuberculosis
RSNPALAKGLSTHEGA

SEQ ID NO: 165344 - protein, 16 aa, Mycobacterium tuberculosis
SNPALAKGLSTHEGAL

SEQ ID NO: 165345 - protein, 16 aa, Mycobacterium tuberculosis
NPALAKGLSTHEGALL

SEQ ID NO: 165346 - protein, 16 aa, Mycobacterium tuberculosis
PALAKGLSTHEGALLS

SEQ ID NO: 165347 - protein, 16 aa, Mycobacterium tuberculosis
ALAKGLSTHEGALLSE

SEQ ID NO: 165348 - protein, 16 aa, Mycobacterium tuberculosis
LAKGLSTHEGALLSER

SEQ ID NO: 165349 - protein, 16 aa, Mycobacterium tuberculosis
AKGLSTHEGALLSERV

SEQ ID NO: 165350 - protein, 16 aa, Mycobacterium tuberculosis
KGLSTHEGALLSERVA

SEQ ID NO: 165351 - protein, 16 aa, Mycobacterium tuberculosis
GLSTHEGALLSERVAT

SEQ ID NO: 165352 - protein, 16 aa, Mycobacterium tuberculosis
LSTHEGALLSERVATD

SEQ ID NO: 165353 - protein, 16 aa, Mycobacterium tuberculosis
STHEGALLSERVATDL

SEQ ID NO: 165354 - protein, 16 aa, Mycobacterium tuberculosis
THEGALLSERVATDLG

SEQ ID NO: 165355 - protein, 16 aa, Mycobacterium tuberculosis
HEGALLSERVATDLGV

SEQ ID NO: 165356 - protein, 16 aa, Mycobacterium tuberculosis
EGALLSERVATDLGVP

SEQ ID NO: 165357 - protein, 16 aa, Mycobacterium tuberculosis
GALLSERVATDLGVPF

SEQ ID NO: 165358 - protein, 16 aa, Mycobacterium tuberculosis
ALLSERVATDLGVPFT

SEQ ID NO: 165359 - protein, 16 aa, Mycobacterium tuberculosis
LLSERVATDLGVPFTE

SEQ ID NO: 165360 - protein, 16 aa, Mycobacterium tuberculosis
LSERVATDLGVPFTEP

SEQ ID NO: 165361 - protein, 16 aa, Mycobacterium tuberculosis
SERVATDLGVPFTEPA

SEQ ID NO: 165362 - protein, 16 aa, Mycobacterium tuberculosis
ERVATDLGVPFTEPAS

SEQ ID NO: 165363 - protein, 16 aa, Mycobacterium tuberculosis
RVATDLGVPFTEPASV

SEQ ID NO: 165364 - protein, 16 aa, Mycobacterium tuberculosis
VATDLGVPFTEPASVL

SEQ ID NO: 165365 - protein, 16 aa, Mycobacterium tuberculosis
ATDLGVPFTEPASVLA

SEQ ID NO: 165366 - protein, 176 aa, Mycobacterium tuberculosis
MHPLPADHGRSRCNRHPISPLSLIGNASATSGDMSSMTRIAKPLIKSAMAAGLVTASMSLSTAVAHAGPSPNWDAVAQCESGGNWAANTGNGKYGGLQFKPATWAAFGGVGNPAAASREQQIAVANRVLAEQGLDAWPTCGAASGLPIALWSKPAQGIKQIINEIIWAGIQASIPR

SEQ ID NO: 165367 - protein, 8 aa, Mycobacterium tuberculosis
HGRSRCNR

SEQ ID NO: 165368 - protein, 8 aa, Mycobacterium tuberculosis
RSRCNRHP

SEQ ID NO: 165369 - protein, 8 aa, Mycobacterium tuberculosis
HPISPLSL

SEQ ID NO: 165370 - protein, 8 aa, Mycobacterium tuberculosis
PISPLSLI

SEQ ID NO: 165371 - protein, 8 aa, Mycobacterium tuberculosis
SLIGNASA

SEQ ID NO: 165372 - protein, 8 aa, Mycobacterium tuberculosis
DMSSMTRI

SEQ ID NO: 165373 - protein, 8 aa, Mycobacterium tuberculosis
SSMTRIAK

SEQ ID NO: 165374 - protein, 8 aa, Mycobacterium tuberculosis
MTRIAKPL

SEQ ID NO: 165375 - protein, 8 aa, Mycobacterium tuberculosis
RIAKPLIK

SEQ ID NO: 165376 - protein, 8 aa, Mycobacterium tuberculosis
KPLIKSAM

SEQ ID NO: 165377 - protein, 8 aa, Mycobacterium tuberculosis
PLIKSAMA

SEQ ID NO: 165378 - protein, 8 aa, Mycobacterium tuberculosis
LIKSAMAA

SEQ ID NO: 165379 - protein, 8 aa, Mycobacterium tuberculosis
SAMAAGLV

SEQ ID NO: 165380 - protein, 8 aa, Mycobacterium tuberculosis
AMAAGLVT

SEQ ID NO: 165381 - protein, 8 aa, Mycobacterium tuberculosis
MAAGLVTA

SEQ ID NO: 165382 - protein, 8 aa, Mycobacterium tuberculosis
LVTASMSL

SEQ ID NO: 165383 - protein, 8 aa, Mycobacterium tuberculosis
SMSLSTAV

SEQ ID NO: 165384 - protein, 8 aa, Mycobacterium tuberculosis
HAGPSPNW

SEQ ID NO: 165385 - protein, 8 aa, Mycobacterium tuberculosis
SPNWDAVA

SEQ ID NO: 165386 - protein, 8 aa, Mycobacterium tuberculosis
AANTGNGK

SEQ ID NO: 165387 - protein, 8 aa, Mycobacterium tuberculosis
KYGGLQFK

SEQ ID NO: 165388 - protein, 8 aa, Mycobacterium tuberculosis
LQFKPATW

SEQ ID NO: 165389 - protein, 8 aa, Mycobacterium tuberculosis
FKPATWAA

SEQ ID NO: 165390 - protein, 8 aa, Mycobacterium tuberculosis
KPATWAAF

SEQ ID NO: 165391 - protein, 8 aa, Mycobacterium tuberculosis
TWAAFGGV

SEQ ID NO: 165392 - protein, 8 aa, Mycobacterium tuberculosis
QQIAVANR

SEQ ID NO: 165393 - protein, 8 aa, Mycobacterium tuberculosis
QIAVANRV

SEQ ID NO: 165394 - protein, 8 aa, Mycobacterium tuberculosis
IAVANRVL

SEQ ID NO: 165395 - protein, 8 aa, Mycobacterium tuberculosis
AVANRVLA

SEQ ID NO: 165396 - protein, 8 aa, Mycobacterium tuberculosis
RVLAEQGL

SEQ ID NO: 165397 - protein, 8 aa, Mycobacterium tuberculosis
AEQGLDAW

SEQ ID NO: 165398 - protein, 8 aa, Mycobacterium tuberculosis
GLDAWPTC

SEQ ID NO: 165399 - protein, 8 aa, Mycobacterium tuberculosis
DAWPTCGA

SEQ ID NO: 165400 - protein, 8 aa, Mycobacterium tuberculosis
WPTCGAAS

SEQ ID NO: 165401 - protein, 8 aa, Mycobacterium tuberculosis
GAASGLPI

SEQ ID NO: 165402 - protein, 8 aa, Mycobacterium tuberculosis
SGLPIALW

SEQ ID NO: 165403 - protein, 8 aa, Mycobacterium tuberculosis
LPIALWSK

SEQ ID NO: 165404 - protein, 8 aa, Mycobacterium tuberculosis
ALWSKPAQ

SEQ ID NO: 165405 - protein, 8 aa, Mycobacterium tuberculosis
KQIINEII

SEQ ID NO: 165406 - protein, 8 aa, Mycobacterium tuberculosis
QIINEIIW

SEQ ID NO: 165407 - protein, 8 aa, Mycobacterium tuberculosis
IINEIIWA

SEQ ID NO: 165408 - protein, 8 aa, Mycobacterium tuberculosis
IIWAGIQA

SEQ ID NO: 165409 - protein, 8 aa, Mycobacterium tuberculosis
GIQASIPR

SEQ ID NO: 165410 - protein, 9 aa, Mycobacterium tuberculosis
DHGRSRCNR

SEQ ID NO: 165411 - protein, 9 aa, Mycobacterium tuberculosis
RSRCNRHPI

SEQ ID NO: 165412 - protein, 9 aa, Mycobacterium tuberculosis
HPISPLSLI

SEQ ID NO: 165413 - protein, 9 aa, Mycobacterium tuberculosis
SPLSLIGNA

SEQ ID NO: 165414 - protein, 9 aa, Mycobacterium tuberculosis
SLIGNASAT

SEQ ID NO: 165415 - protein, 9 aa, Mycobacterium tuberculosis
ATSGDMSSM

SEQ ID NO: 165416 - protein, 9 aa, Mycobacterium tuberculosis
MSSMTRIAK

SEQ ID NO: 165417 - protein, 9 aa, Mycobacterium tuberculosis
SMTRIAKPL

SEQ ID NO: 165418 - protein, 9 aa, Mycobacterium tuberculosis
MTRIAKPLI

SEQ ID NO: 165419 - protein, 9 aa, Mycobacterium tuberculosis
IAKPLIKSA

SEQ ID NO: 165420 - protein, 9 aa, Mycobacterium tuberculosis
KPLIKSAMA

SEQ ID NO: 165421 - protein, 9 aa, Mycobacterium tuberculosis
PLIKSAMAA

SEQ ID NO: 165422 - protein, 9 aa, Mycobacterium tuberculosis
AMAAGLVTA

SEQ ID NO: 165423 - protein, 9 aa, Mycobacterium tuberculosis
MAAGLVTAS

SEQ ID NO: 165424 - protein, 9 aa, Mycobacterium tuberculosis
AAGLVTASM

SEQ ID NO: 165425 - protein, 9 aa, Mycobacterium tuberculosis
GLVTASMSL

SEQ ID NO: 165426 - protein, 9 aa, Mycobacterium tuberculosis
TASMSLSTA

SEQ ID NO: 165427 - protein, 9 aa, Mycobacterium tuberculosis
ASMSLSTAV

SEQ ID NO: 165428 - protein, 9 aa, Mycobacterium tuberculosis
SMSLSTAVA

SEQ ID NO: 165429 - protein, 9 aa, Mycobacterium tuberculosis
SLSTAVAHA

SEQ ID NO: 165430 - protein, 9 aa, Mycobacterium tuberculosis
GPSPNWDAV

SEQ ID NO: 165431 - protein, 9 aa, Mycobacterium tuberculosis
SPNWDAVAQ

SEQ ID NO: 165432 - protein, 9 aa, Mycobacterium tuberculosis
WAANTGNGK

SEQ ID NO: 165433 - protein, 9 aa, Mycobacterium tuberculosis
LQFKPATWA

SEQ ID NO: 165434 - protein, 9 aa, Mycobacterium tuberculosis
FKPATWAAF

SEQ ID NO: 165435 - protein, 9 aa, Mycobacterium tuberculosis
ATWAAFGGV

SEQ ID NO: 165436 - protein, 9 aa, Mycobacterium tuberculosis
EQQIAVANR

SEQ ID NO: 165437 - protein, 9 aa, Mycobacterium tuberculosis
QQIAVANRV

SEQ ID NO: 165438 - protein, 9 aa, Mycobacterium tuberculosis
VLAEQGLDA

SEQ ID NO: 165439 - protein, 9 aa, Mycobacterium tuberculosis
LAEQGLDAW

SEQ ID NO: 165440 - protein, 9 aa, Mycobacterium tuberculosis
DAWPTCGAA

SEQ ID NO: 165441 - protein, 9 aa, Mycobacterium tuberculosis
AASGLPIAL

SEQ ID NO: 165442 - protein, 9 aa, Mycobacterium tuberculosis
GLPIALWSK

SEQ ID NO: 165443 - protein, 9 aa, Mycobacterium tuberculosis
LPIALWSKP

SEQ ID NO: 165444 - protein, 9 aa, Mycobacterium tuberculosis
WSKPAQGIK

SEQ ID NO: 165445 - protein, 9 aa, Mycobacterium tuberculosis
KPAQGIKQI

SEQ ID NO: 165446 - protein, 9 aa, Mycobacterium tuberculosis
GIKQIINEI

SEQ ID NO: 165447 - protein, 9 aa, Mycobacterium tuberculosis
KQIINEIIW

SEQ ID NO: 165448 - protein, 9 aa, Mycobacterium tuberculosis
QIINEIIWA

SEQ ID NO: 165449 - protein, 9 aa, Mycobacterium tuberculosis
EIIWAGIQA

SEQ ID NO: 165450 - protein, 9 aa, Mycobacterium tuberculosis
IIWAGIQAS

SEQ ID NO: 165451 - protein, 9 aa, Mycobacterium tuberculosis
IWAGIQASI

SEQ ID NO: 165452 - protein, 10 aa, Mycobacterium tuberculosis
LPADHGRSRC

SEQ ID NO: 165453 - protein, 10 aa, Mycobacterium tuberculosis
ADHGRSRCNR

SEQ ID NO: 165454 - protein, 10 aa, Mycobacterium tuberculosis
RSRCNRHPIS

SEQ ID NO: 165455 - protein, 10 aa, Mycobacterium tuberculosis
SPLSLIGNAS

SEQ ID NO: 165456 - protein, 10 aa, Mycobacterium tuberculosis
PLSLIGNASA

SEQ ID NO: 165457 - protein, 10 aa, Mycobacterium tuberculosis
SLIGNASATS

SEQ ID NO: 165458 - protein, 10 aa, Mycobacterium tuberculosis
SATSGDMSSM

SEQ ID NO: 165459 - protein, 10 aa, Mycobacterium tuberculosis
TSGDMSSMTR

SEQ ID NO: 165460 - protein, 10 aa, Mycobacterium tuberculosis
DMSSMTRIAK

SEQ ID NO: 165461 - protein, 10 aa, Mycobacterium tuberculosis
SSMTRIAKPL

SEQ ID NO: 165462 - protein, 10 aa, Mycobacterium tuberculosis
SMTRIAKPLI

SEQ ID NO: 165463 - protein, 10 aa, Mycobacterium tuberculosis
MTRIAKPLIK

SEQ ID NO: 165464 - protein, 10 aa, Mycobacterium tuberculosis
RIAKPLIKSA

SEQ ID NO: 165465 - protein, 10 aa, Mycobacterium tuberculosis
IAKPLIKSAM

SEQ ID NO: 165466 - protein, 10 aa, Mycobacterium tuberculosis
KPLIKSAMAA

SEQ ID NO: 165467 - protein, 10 aa, Mycobacterium tuberculosis
LIKSAMAAGL

SEQ ID NO: 165468 - protein, 10 aa, Mycobacterium tuberculosis
SAMAAGLVTA

SEQ ID NO: 165469 - protein, 10 aa, Mycobacterium tuberculosis
AMAAGLVTAS

SEQ ID NO: 165470 - protein, 10 aa, Mycobacterium tuberculosis
MAAGLVTASM

SEQ ID NO: 165471 - protein, 10 aa, Mycobacterium tuberculosis
GLVTASMSLS

SEQ ID NO: 165472 - protein, 10 aa, Mycobacterium tuberculosis
VTASMSLSTA

SEQ ID NO: 165473 - protein, 10 aa, Mycobacterium tuberculosis
TASMSLSTAV

SEQ ID NO: 165474 - protein, 10 aa, Mycobacterium tuberculosis
SMSLSTAVAH

SEQ ID NO: 165475 - protein, 10 aa, Mycobacterium tuberculosis
STAVAHAGPS

SEQ ID NO: 165476 - protein, 10 aa, Mycobacterium tuberculosis
VAHAGPSPNW

SEQ ID NO: 165477 - protein, 10 aa, Mycobacterium tuberculosis
AQCESGGNWA

SEQ ID NO: 165478 - protein, 10 aa, Mycobacterium tuberculosis
NWAANTGNGK

SEQ ID NO: 165479 - protein, 10 aa, Mycobacterium tuberculosis
WAANTGNGKY

SEQ ID NO: 165480 - protein, 10 aa, Mycobacterium tuberculosis
GGLQFKPATW

SEQ ID NO: 165481 - protein, 10 aa, Mycobacterium tuberculosis
GLQFKPATWA

SEQ ID NO: 165482 - protein, 10 aa, Mycobacterium tuberculosis
LQFKPATWAA

SEQ ID NO: 165483 - protein, 10 aa, Mycobacterium tuberculosis
QFKPATWAAF

SEQ ID NO: 165484 - protein, 10 aa, Mycobacterium tuberculosis
AAFGGVGNPA

SEQ ID NO: 165485 - protein, 10 aa, Mycobacterium tuberculosis
AASREQQIAV

SEQ ID NO: 165486 - protein, 10 aa, Mycobacterium tuberculosis
QQIAVANRVL

SEQ ID NO: 165487 - protein, 10 aa, Mycobacterium tuberculosis
QIAVANRVLA

SEQ ID NO: 165488 - protein, 10 aa, Mycobacterium tuberculosis
VLAEQGLDAW

SEQ ID NO: 165489 - protein, 10 aa, Mycobacterium tuberculosis
AEQGLDAWPT

SEQ ID NO: 165490 - protein, 10 aa, Mycobacterium tuberculosis
GLDAWPTCGA

SEQ ID NO: 165491 - protein, 10 aa, Mycobacterium tuberculosis
DAWPTCGAAS

SEQ ID NO: 165492 - protein, 10 aa, Mycobacterium tuberculosis
WPTCGAASGL

SEQ ID NO: 165493 - protein, 10 aa, Mycobacterium tuberculosis
GAASGLPIAL

SEQ ID NO: 165494 - protein, 10 aa, Mycobacterium tuberculosis
AASGLPIALW

SEQ ID NO: 165495 - protein, 10 aa, Mycobacterium tuberculosis
SGLPIALWSK

SEQ ID NO: 165496 - protein, 10 aa, Mycobacterium tuberculosis
LPIALWSKPA

SEQ ID NO: 165497 - protein, 10 aa, Mycobacterium tuberculosis
ALWSKPAQGI

SEQ ID NO: 165498 - protein, 10 aa, Mycobacterium tuberculosis
KPAQGIKQII

SEQ ID NO: 165499 - protein, 10 aa, Mycobacterium tuberculosis
QGIKQIINEI

SEQ ID NO: 165500 - protein, 10 aa, Mycobacterium tuberculosis
GIKQIINEII

SEQ ID NO: 165501 - protein, 10 aa, Mycobacterium tuberculosis
KQIINEIIWA

SEQ ID NO: 165502 - protein, 10 aa, Mycobacterium tuberculosis
IINEIIWAGI

SEQ ID NO: 165503 - protein, 10 aa, Mycobacterium tuberculosis
NEIIWAGIQA

SEQ ID NO: 165504 - protein, 10 aa, Mycobacterium tuberculosis
IIWAGIQASI

SEQ ID NO: 165505 - protein, 11 aa, Mycobacterium tuberculosis
RSRCNRHPISP

SEQ ID NO: 165506 - protein, 11 aa, Mycobacterium tuberculosis
SPLSLIGNASA

SEQ ID NO: 165507 - protein, 11 aa, Mycobacterium tuberculosis
ATSGDMSSMTR

SEQ ID NO: 165508 - protein, 11 aa, Mycobacterium tuberculosis
MSSMTRIAKPL

SEQ ID NO: 165509 - protein, 11 aa, Mycobacterium tuberculosis
SMTRIAKPLIK

SEQ ID NO: 165510 - protein, 11 aa, Mycobacterium tuberculosis
RIAKPLIKSAM

SEQ ID NO: 165511 - protein, 11 aa, Mycobacterium tuberculosis
PLIKSAMAAGL

SEQ ID NO: 165512 - protein, 11 aa, Mycobacterium tuberculosis
LIKSAMAAGLV

SEQ ID NO: 165513 - protein, 11 aa, Mycobacterium tuberculosis
AMAAGLVTASM

SEQ ID NO: 165514 - protein, 11 aa, Mycobacterium tuberculosis
AAGLVTASMSL

SEQ ID NO: 165515 - protein, 11 aa, Mycobacterium tuberculosis
GLVTASMSLST

SEQ ID NO: 165516 - protein, 11 aa, Mycobacterium tuberculosis
LVTASMSLSTA

SEQ ID NO: 165517 - protein, 11 aa, Mycobacterium tuberculosis
VTASMSLSTAV

SEQ ID NO: 165518 - protein, 11 aa, Mycobacterium tuberculosis
ASMSLSTAVAH

SEQ ID NO: 165519 - protein, 11 aa, Mycobacterium tuberculosis
SMSLSTAVAHA

SEQ ID NO: 165520 - protein, 11 aa, Mycobacterium tuberculosis
AVAHAGPSPNW

SEQ ID NO: 165521 - protein, 11 aa, Mycobacterium tuberculosis
HAGPSPNWDAV

SEQ ID NO: 165522 - protein, 11 aa, Mycobacterium tuberculosis
AQCESGGNWAA

SEQ ID NO: 165523 - protein, 11 aa, Mycobacterium tuberculosis
NWAANTGNGKY

SEQ ID NO: 165524 - protein, 11 aa, Mycobacterium tuberculosis
GLQFKPATWAA

SEQ ID NO: 165525 - protein, 11 aa, Mycobacterium tuberculosis
LQFKPATWAAF

SEQ ID NO: 165526 - protein, 11 aa, Mycobacterium tuberculosis
KPATWAAFGGV

SEQ ID NO: 165527 - protein, 11 aa, Mycobacterium tuberculosis
WAAFGGVGNPA

SEQ ID NO: 165528 - protein, 11 aa, Mycobacterium tuberculosis
AAFGGVGNPAA

SEQ ID NO: 165529 - protein, 11 aa, Mycobacterium tuberculosis
AAASREQQIAV

SEQ ID NO: 165530 - protein, 11 aa, Mycobacterium tuberculosis
REQQIAVANRV

SEQ ID NO: 165531 - protein, 11 aa, Mycobacterium tuberculosis
QQIAVANRVLA

SEQ ID NO: 165532 - protein, 11 aa, Mycobacterium tuberculosis
RVLAEQGLDAW

SEQ ID NO: 165533 - protein, 11 aa, Mycobacterium tuberculosis
LAEQGLDAWPT

SEQ ID NO: 165534 - protein, 11 aa, Mycobacterium tuberculosis
GLDAWPTCGAA

SEQ ID NO: 165535 - protein, 11 aa, Mycobacterium tuberculosis
GAASGLPIALW

SEQ ID NO: 165536 - protein, 11 aa, Mycobacterium tuberculosis
ASGLPIALWSK

SEQ ID NO: 165537 - protein, 11 aa, Mycobacterium tuberculosis
GLPIALWSKPA

SEQ ID NO: 165538 - protein, 11 aa, Mycobacterium tuberculosis
LPIALWSKPAQ

SEQ ID NO: 165539 - protein, 11 aa, Mycobacterium tuberculosis
ALWSKPAQGIK

SEQ ID NO: 165540 - protein, 11 aa, Mycobacterium tuberculosis
AQGIKQIINEI

SEQ ID NO: 165541 - protein, 11 aa, Mycobacterium tuberculosis
QIINEIIWAGI

SEQ ID NO: 165542 - protein, 11 aa, Mycobacterium tuberculosis
EIIWAGIQASI

SEQ ID NO: 165543 - protein, 11 aa, Mycobacterium tuberculosis
IWAGIQASIPR

SEQ ID NO: 165544 - protein, 13 aa, Mycobacterium tuberculosis
MHPLPADHGRSRC

SEQ ID NO: 165545 - protein, 13 aa, Mycobacterium tuberculosis
HPLPADHGRSRCN

SEQ ID NO: 165546 - protein, 13 aa, Mycobacterium tuberculosis
PLPADHGRSRCNR

SEQ ID NO: 165547 - protein, 13 aa, Mycobacterium tuberculosis
LPADHGRSRCNRH

SEQ ID NO: 165548 - protein, 13 aa, Mycobacterium tuberculosis
PADHGRSRCNRHP

SEQ ID NO: 165549 - protein, 13 aa, Mycobacterium tuberculosis
ADHGRSRCNRHPI

SEQ ID NO: 165550 - protein, 13 aa, Mycobacterium tuberculosis
DHGRSRCNRHPIS

SEQ ID NO: 165551 - protein, 13 aa, Mycobacterium tuberculosis
HGRSRCNRHPISP

SEQ ID NO: 165552 - protein, 13 aa, Mycobacterium tuberculosis
GRSRCNRHPISPL

SEQ ID NO: 165553 - protein, 13 aa, Mycobacterium tuberculosis
RSRCNRHPISPLS

SEQ ID NO: 165554 - protein, 13 aa, Mycobacterium tuberculosis
SRCNRHPISPLSL

SEQ ID NO: 165555 - protein, 13 aa, Mycobacterium tuberculosis
RCNRHPISPLSLI

SEQ ID NO: 165556 - protein, 13 aa, Mycobacterium tuberculosis
CNRHPISPLSLIG

SEQ ID NO: 165557 - protein, 13 aa, Mycobacterium tuberculosis
NRHPISPLSLIGN

SEQ ID NO: 165558 - protein, 13 aa, Mycobacterium tuberculosis
RHPISPLSLIGNA

SEQ ID NO: 165559 - protein, 13 aa, Mycobacterium tuberculosis
HPISPLSLIGNAS

SEQ ID NO: 165560 - protein, 13 aa, Mycobacterium tuberculosis
PISPLSLIGNASA

SEQ ID NO: 165561 - protein, 13 aa, Mycobacterium tuberculosis
ISPLSLIGNASAT

SEQ ID NO: 165562 - protein, 13 aa, Mycobacterium tuberculosis
SPLSLIGNASATS

SEQ ID NO: 165563 - protein, 13 aa, Mycobacterium tuberculosis
PLSLIGNASATSG

SEQ ID NO: 165564 - protein, 13 aa, Mycobacterium tuberculosis
LSLIGNASATSGD

SEQ ID NO: 165565 - protein, 13 aa, Mycobacterium tuberculosis
SLIGNASATSGDM

SEQ ID NO: 165566 - protein, 13 aa, Mycobacterium tuberculosis
LIGNASATSGDMS

SEQ ID NO: 165567 - protein, 13 aa, Mycobacterium tuberculosis
IGNASATSGDMSS

SEQ ID NO: 165568 - protein, 13 aa, Mycobacterium tuberculosis
GNASATSGDMSSM

SEQ ID NO: 165569 - protein, 13 aa, Mycobacterium tuberculosis
NASATSGDMSSMT

SEQ ID NO: 165570 - protein, 13 aa, Mycobacterium tuberculosis
ASATSGDMSSMTR

SEQ ID NO: 165571 - protein, 13 aa, Mycobacterium tuberculosis
SATSGDMSSMTRI

SEQ ID NO: 165572 - protein, 13 aa, Mycobacterium tuberculosis
ATSGDMSSMTRIA

SEQ ID NO: 165573 - protein, 13 aa, Mycobacterium tuberculosis
TSGDMSSMTRIAK

SEQ ID NO: 165574 - protein, 13 aa, Mycobacterium tuberculosis
SGDMSSMTRIAKP

SEQ ID NO: 165575 - protein, 13 aa, Mycobacterium tuberculosis
GDMSSMTRIAKPL

SEQ ID NO: 165576 - protein, 13 aa, Mycobacterium tuberculosis
DMSSMTRIAKPLI

SEQ ID NO: 165577 - protein, 13 aa, Mycobacterium tuberculosis
MSSMTRIAKPLIK

SEQ ID NO: 165578 - protein, 13 aa, Mycobacterium tuberculosis
SSMTRIAKPLIKS

SEQ ID NO: 165579 - protein, 13 aa, Mycobacterium tuberculosis
SMTRIAKPLIKSA

SEQ ID NO: 165580 - protein, 13 aa, Mycobacterium tuberculosis
MTRIAKPLIKSAM

SEQ ID NO: 165581 - protein, 13 aa, Mycobacterium tuberculosis
TRIAKPLIKSAMA

SEQ ID NO: 165582 - protein, 13 aa, Mycobacterium tuberculosis
RIAKPLIKSAMAA

SEQ ID NO: 165583 - protein, 13 aa, Mycobacterium tuberculosis
IAKPLIKSAMAAG

SEQ ID NO: 165584 - protein, 13 aa, Mycobacterium tuberculosis
AKPLIKSAMAAGL

SEQ ID NO: 165585 - protein, 13 aa, Mycobacterium tuberculosis
KPLIKSAMAAGLV

SEQ ID NO: 165586 - protein, 13 aa, Mycobacterium tuberculosis
PLIKSAMAAGLVT

SEQ ID NO: 165587 - protein, 13 aa, Mycobacterium tuberculosis
LIKSAMAAGLVTA

SEQ ID NO: 165588 - protein, 13 aa, Mycobacterium tuberculosis
IKSAMAAGLVTAS

SEQ ID NO: 165589 - protein, 13 aa, Mycobacterium tuberculosis
KSAMAAGLVTASM

SEQ ID NO: 165590 - protein, 13 aa, Mycobacterium tuberculosis
SAMAAGLVTASMS

SEQ ID NO: 165591 - protein, 13 aa, Mycobacterium tuberculosis
AMAAGLVTASMSL

SEQ ID NO: 165592 - protein, 13 aa, Mycobacterium tuberculosis
MAAGLVTASMSLS

SEQ ID NO: 165593 - protein, 13 aa, Mycobacterium tuberculosis
AAGLVTASMSLST

SEQ ID NO: 165594 - protein, 13 aa, Mycobacterium tuberculosis
AGLVTASMSLSTA

SEQ ID NO: 165595 - protein, 13 aa, Mycobacterium tuberculosis
GLVTASMSLSTAV

SEQ ID NO: 165596 - protein, 13 aa, Mycobacterium tuberculosis
LVTASMSLSTAVA

SEQ ID NO: 165597 - protein, 13 aa, Mycobacterium tuberculosis
VTASMSLSTAVAH

SEQ ID NO: 165598 - protein, 13 aa, Mycobacterium tuberculosis
TASMSLSTAVAHA

SEQ ID NO: 165599 - protein, 13 aa, Mycobacterium tuberculosis
ASMSLSTAVAHAG

SEQ ID NO: 165600 - protein, 13 aa, Mycobacterium tuberculosis
SMSLSTAVAHAGP

SEQ ID NO: 165601 - protein, 13 aa, Mycobacterium tuberculosis
MSLSTAVAHAGPS

SEQ ID NO: 165602 - protein, 13 aa, Mycobacterium tuberculosis
SLSTAVAHAGPSP

SEQ ID NO: 165603 - protein, 13 aa, Mycobacterium tuberculosis
LSTAVAHAGPSPN

SEQ ID NO: 165604 - protein, 13 aa, Mycobacterium tuberculosis
STAVAHAGPSPNW

SEQ ID NO: 165605 - protein, 13 aa, Mycobacterium tuberculosis
TAVAHAGPSPNWD

SEQ ID NO: 165606 - protein, 13 aa, Mycobacterium tuberculosis
AVAHAGPSPNWDA

SEQ ID NO: 165607 - protein, 13 aa, Mycobacterium tuberculosis
VAHAGPSPNWDAV

SEQ ID NO: 165608 - protein, 13 aa, Mycobacterium tuberculosis
AHAGPSPNWDAVA

SEQ ID NO: 165609 - protein, 13 aa, Mycobacterium tuberculosis
HAGPSPNWDAVAQ

SEQ ID NO: 165610 - protein, 13 aa, Mycobacterium tuberculosis
AGPSPNWDAVAQC

SEQ ID NO: 165611 - protein, 13 aa, Mycobacterium tuberculosis
GPSPNWDAVAQCE

SEQ ID NO: 165612 - protein, 13 aa, Mycobacterium tuberculosis
PSPNWDAVAQCES

SEQ ID NO: 165613 - protein, 13 aa, Mycobacterium tuberculosis
SPNWDAVAQCESG

SEQ ID NO: 165614 - protein, 13 aa, Mycobacterium tuberculosis
PNWDAVAQCESGG

SEQ ID NO: 165615 - protein, 13 aa, Mycobacterium tuberculosis
NWDAVAQCESGGN

SEQ ID NO: 165616 - protein, 13 aa, Mycobacterium tuberculosis
WDAVAQCESGGNW

SEQ ID NO: 165617 - protein, 13 aa, Mycobacterium tuberculosis
DAVAQCESGGNWA

SEQ ID NO: 165618 - protein, 13 aa, Mycobacterium tuberculosis
AVAQCESGGNWAA

SEQ ID NO: 165619 - protein, 13 aa, Mycobacterium tuberculosis
VAQCESGGNWAAN

SEQ ID NO: 165620 - protein, 13 aa, Mycobacterium tuberculosis
AQCESGGNWAANT

SEQ ID NO: 165621 - protein, 13 aa, Mycobacterium tuberculosis
QCESGGNWAANTG

SEQ ID NO: 165622 - protein, 13 aa, Mycobacterium tuberculosis
CESGGNWAANTGN

SEQ ID NO: 165623 - protein, 13 aa, Mycobacterium tuberculosis
ESGGNWAANTGNG

SEQ ID NO: 165624 - protein, 13 aa, Mycobacterium tuberculosis
SGGNWAANTGNGK

SEQ ID NO: 165625 - protein, 13 aa, Mycobacterium tuberculosis
GGNWAANTGNGKY

SEQ ID NO: 165626 - protein, 13 aa, Mycobacterium tuberculosis
GNWAANTGNGKYG

SEQ ID NO: 165627 - protein, 13 aa, Mycobacterium tuberculosis
NWAANTGNGKYGG

SEQ ID NO: 165628 - protein, 13 aa, Mycobacterium tuberculosis
WAANTGNGKYGGL

SEQ ID NO: 165629 - protein, 13 aa, Mycobacterium tuberculosis
AANTGNGKYGGLQ

SEQ ID NO: 165630 - protein, 13 aa, Mycobacterium tuberculosis
ANTGNGKYGGLQF

SEQ ID NO: 165631 - protein, 13 aa, Mycobacterium tuberculosis
NTGNGKYGGLQFK

SEQ ID NO: 165632 - protein, 13 aa, Mycobacterium tuberculosis
TGNGKYGGLQFKP

SEQ ID NO: 165633 - protein, 13 aa, Mycobacterium tuberculosis
GNGKYGGLQFKPA

SEQ ID NO: 165634 - protein, 13 aa, Mycobacterium tuberculosis
NGKYGGLQFKPAT

SEQ ID NO: 165635 - protein, 13 aa, Mycobacterium tuberculosis
GKYGGLQFKPATW

SEQ ID NO: 165636 - protein, 13 aa, Mycobacterium tuberculosis
KYGGLQFKPATWA

SEQ ID NO: 165637 - protein, 13 aa, Mycobacterium tuberculosis
YGGLQFKPATWAA

SEQ ID NO: 165638 - protein, 13 aa, Mycobacterium tuberculosis
GGLQFKPATWAAF

SEQ ID NO: 165639 - protein, 13 aa, Mycobacterium tuberculosis
GLQFKPATWAAFG

SEQ ID NO: 165640 - protein, 13 aa, Mycobacterium tuberculosis
LQFKPATWAAFGG

SEQ ID NO: 165641 - protein, 13 aa, Mycobacterium tuberculosis
QFKPATWAAFGGV

SEQ ID NO: 165642 - protein, 13 aa, Mycobacterium tuberculosis
FKPATWAAFGGVG

SEQ ID NO: 165643 - protein, 13 aa, Mycobacterium tuberculosis
KPATWAAFGGVGN

SEQ ID NO: 165644 - protein, 13 aa, Mycobacterium tuberculosis
PATWAAFGGVGNP

SEQ ID NO: 165645 - protein, 13 aa, Mycobacterium tuberculosis
ATWAAFGGVGNPA

SEQ ID NO: 165646 - protein, 13 aa, Mycobacterium tuberculosis
TWAAFGGVGNPAA

SEQ ID NO: 165647 - protein, 13 aa, Mycobacterium tuberculosis
WAAFGGVGNPAAA

SEQ ID NO: 165648 - protein, 13 aa, Mycobacterium tuberculosis
AAFGGVGNPAAAS

SEQ ID NO: 165649 - protein, 13 aa, Mycobacterium tuberculosis
AFGGVGNPAAASR

SEQ ID NO: 165650 - protein, 13 aa, Mycobacterium tuberculosis
FGGVGNPAAASRE

SEQ ID NO: 165651 - protein, 13 aa, Mycobacterium tuberculosis
GGVGNPAAASREQ

SEQ ID NO: 165652 - protein, 13 aa, Mycobacterium tuberculosis
GVGNPAAASREQQ

SEQ ID NO: 165653 - protein, 13 aa, Mycobacterium tuberculosis
VGNPAAASREQQI

SEQ ID NO: 165654 - protein, 13 aa, Mycobacterium tuberculosis
GNPAAASREQQIA

SEQ ID NO: 165655 - protein, 13 aa, Mycobacterium tuberculosis
NPAAASREQQIAV

SEQ ID NO: 165656 - protein, 13 aa, Mycobacterium tuberculosis
PAAASREQQIAVA

SEQ ID NO: 165657 - protein, 13 aa, Mycobacterium tuberculosis
AAASREQQIAVAN

SEQ ID NO: 165658 - protein, 13 aa, Mycobacterium tuberculosis
AASREQQIAVANR

SEQ ID NO: 165659 - protein, 13 aa, Mycobacterium tuberculosis
ASREQQIAVANRV

SEQ ID NO: 165660 - protein, 13 aa, Mycobacterium tuberculosis
SREQQIAVANRVL

SEQ ID NO: 165661 - protein, 13 aa, Mycobacterium tuberculosis
REQQIAVANRVLA

SEQ ID NO: 165662 - protein, 13 aa, Mycobacterium tuberculosis
EQQIAVANRVLAE

SEQ ID NO: 165663 - protein, 13 aa, Mycobacterium tuberculosis
QQIAVANRVLAEQ

SEQ ID NO: 165664 - protein, 13 aa, Mycobacterium tuberculosis
QIAVANRVLAEQG

SEQ ID NO: 165665 - protein, 13 aa, Mycobacterium tuberculosis
IAVANRVLAEQGL

SEQ ID NO: 165666 - protein, 13 aa, Mycobacterium tuberculosis
AVANRVLAEQGLD

SEQ ID NO: 165667 - protein, 13 aa, Mycobacterium tuberculosis
VANRVLAEQGLDA

SEQ ID NO: 165668 - protein, 13 aa, Mycobacterium tuberculosis
ANRVLAEQGLDAW

SEQ ID NO: 165669 - protein, 13 aa, Mycobacterium tuberculosis
NRVLAEQGLDAWP

SEQ ID NO: 165670 - protein, 13 aa, Mycobacterium tuberculosis
RVLAEQGLDAWPT

SEQ ID NO: 165671 - protein, 13 aa, Mycobacterium tuberculosis
VLAEQGLDAWPTC

SEQ ID NO: 165672 - protein, 13 aa, Mycobacterium tuberculosis
LAEQGLDAWPTCG

SEQ ID NO: 165673 - protein, 13 aa, Mycobacterium tuberculosis
AEQGLDAWPTCGA

SEQ ID NO: 165674 - protein, 13 aa, Mycobacterium tuberculosis
EQGLDAWPTCGAA

SEQ ID NO: 165675 - protein, 13 aa, Mycobacterium tuberculosis
QGLDAWPTCGAAS

SEQ ID NO: 165676 - protein, 13 aa, Mycobacterium tuberculosis
GLDAWPTCGAASG

SEQ ID NO: 165677 - protein, 13 aa, Mycobacterium tuberculosis
LDAWPTCGAASGL

SEQ ID NO: 165678 - protein, 13 aa, Mycobacterium tuberculosis
DAWPTCGAASGLP

SEQ ID NO: 165679 - protein, 13 aa, Mycobacterium tuberculosis
AWPTCGAASGLPI

SEQ ID NO: 165680 - protein, 13 aa, Mycobacterium tuberculosis
WPTCGAASGLPIA

SEQ ID NO: 165681 - protein, 13 aa, Mycobacterium tuberculosis
PTCGAASGLPIAL

SEQ ID NO: 165682 - protein, 13 aa, Mycobacterium tuberculosis
TCGAASGLPIALW

SEQ ID NO: 165683 - protein, 13 aa, Mycobacterium tuberculosis
CGAASGLPIALWS

SEQ ID NO: 165684 - protein, 13 aa, Mycobacterium tuberculosis
GAASGLPIALWSK

SEQ ID NO: 165685 - protein, 13 aa, Mycobacterium tuberculosis
AASGLPIALWSKP

SEQ ID NO: 165686 - protein, 13 aa, Mycobacterium tuberculosis
ASGLPIALWSKPA

SEQ ID NO: 165687 - protein, 13 aa, Mycobacterium tuberculosis
SGLPIALWSKPAQ

SEQ ID NO: 165688 - protein, 13 aa, Mycobacterium tuberculosis
GLPIALWSKPAQG

SEQ ID NO: 165689 - protein, 13 aa, Mycobacterium tuberculosis
LPIALWSKPAQGI

SEQ ID NO: 165690 - protein, 13 aa, Mycobacterium tuberculosis
PIALWSKPAQGIK

SEQ ID NO: 165691 - protein, 13 aa, Mycobacterium tuberculosis
IALWSKPAQGIKQ

SEQ ID NO: 165692 - protein, 13 aa, Mycobacterium tuberculosis
ALWSKPAQGIKQI

SEQ ID NO: 165693 - protein, 13 aa, Mycobacterium tuberculosis
LWSKPAQGIKQII

SEQ ID NO: 165694 - protein, 13 aa, Mycobacterium tuberculosis
WSKPAQGIKQIIN

SEQ ID NO: 165695 - protein, 13 aa, Mycobacterium tuberculosis
SKPAQGIKQIINE

SEQ ID NO: 165696 - protein, 13 aa, Mycobacterium tuberculosis
KPAQGIKQIINEI

SEQ ID NO: 165697 - protein, 13 aa, Mycobacterium tuberculosis
PAQGIKQIINEII

SEQ ID NO: 165698 - protein, 13 aa, Mycobacterium tuberculosis
AQGIKQIINEIIW

SEQ ID NO: 165699 - protein, 13 aa, Mycobacterium tuberculosis
QGIKQIINEIIWA

SEQ ID NO: 165700 - protein, 13 aa, Mycobacterium tuberculosis
GIKQIINEIIWAG

SEQ ID NO: 165701 - protein, 13 aa, Mycobacterium tuberculosis
IKQIINEIIWAGI

SEQ ID NO: 165702 - protein, 13 aa, Mycobacterium tuberculosis
KQIINEIIWAGIQ

SEQ ID NO: 165703 - protein, 13 aa, Mycobacterium tuberculosis
QIINEIIWAGIQA

SEQ ID NO: 165704 - protein, 13 aa, Mycobacterium tuberculosis
IINEIIWAGIQAS

SEQ ID NO: 165705 - protein, 13 aa, Mycobacterium tuberculosis
INEIIWAGIQASI

SEQ ID NO: 165706 - protein, 13 aa, Mycobacterium tuberculosis
NEIIWAGIQASIP

SEQ ID NO: 165707 - protein, 13 aa, Mycobacterium tuberculosis
EIIWAGIQASIPR

SEQ ID NO: 165708 - protein, 14 aa, Mycobacterium tuberculosis
MHPLPADHGRSRCN

SEQ ID NO: 165709 - protein, 14 aa, Mycobacterium tuberculosis
HPLPADHGRSRCNR

SEQ ID NO: 165710 - protein, 14 aa, Mycobacterium tuberculosis
PLPADHGRSRCNRH

SEQ ID NO: 165711 - protein, 14 aa, Mycobacterium tuberculosis
LPADHGRSRCNRHP

SEQ ID NO: 165712 - protein, 14 aa, Mycobacterium tuberculosis
PADHGRSRCNRHPI

SEQ ID NO: 165713 - protein, 14 aa, Mycobacterium tuberculosis
ADHGRSRCNRHPIS

SEQ ID NO: 165714 - protein, 14 aa, Mycobacterium tuberculosis
DHGRSRCNRHPISP

SEQ ID NO: 165715 - protein, 14 aa, Mycobacterium tuberculosis
HGRSRCNRHPISPL

SEQ ID NO: 165716 - protein, 14 aa, Mycobacterium tuberculosis
GRSRCNRHPISPLS

SEQ ID NO: 165717 - protein, 14 aa, Mycobacterium tuberculosis
RSRCNRHPISPLSL

SEQ ID NO: 165718 - protein, 14 aa, Mycobacterium tuberculosis
SRCNRHPISPLSLI

SEQ ID NO: 165719 - protein, 14 aa, Mycobacterium tuberculosis
RCNRHPISPLSLIG

SEQ ID NO: 165720 - protein, 14 aa, Mycobacterium tuberculosis
CNRHPISPLSLIGN

SEQ ID NO: 165721 - protein, 14 aa, Mycobacterium tuberculosis
NRHPISPLSLIGNA

SEQ ID NO: 165722 - protein, 14 aa, Mycobacterium tuberculosis
RHPISPLSLIGNAS

SEQ ID NO: 165723 - protein, 14 aa, Mycobacterium tuberculosis
HPISPLSLIGNASA

SEQ ID NO: 165724 - protein, 14 aa, Mycobacterium tuberculosis
PISPLSLIGNASAT

SEQ ID NO: 165725 - protein, 14 aa, Mycobacterium tuberculosis
ISPLSLIGNASATS

SEQ ID NO: 165726 - protein, 14 aa, Mycobacterium tuberculosis
SPLSLIGNASATSG

SEQ ID NO: 165727 - protein, 14 aa, Mycobacterium tuberculosis
PLSLIGNASATSGD

SEQ ID NO: 165728 - protein, 14 aa, Mycobacterium tuberculosis
LSLIGNASATSGDM

SEQ ID NO: 165729 - protein, 14 aa, Mycobacterium tuberculosis
SLIGNASATSGDMS

SEQ ID NO: 165730 - protein, 14 aa, Mycobacterium tuberculosis
LIGNASATSGDMSS

SEQ ID NO: 165731 - protein, 14 aa, Mycobacterium tuberculosis
IGNASATSGDMSSM

SEQ ID NO: 165732 - protein, 14 aa, Mycobacterium tuberculosis
GNASATSGDMSSMT

SEQ ID NO: 165733 - protein, 14 aa, Mycobacterium tuberculosis
NASATSGDMSSMTR

SEQ ID NO: 165734 - protein, 14 aa, Mycobacterium tuberculosis
ASATSGDMSSMTRI

SEQ ID NO: 165735 - protein, 14 aa, Mycobacterium tuberculosis
SATSGDMSSMTRIA

SEQ ID NO: 165736 - protein, 14 aa, Mycobacterium tuberculosis
ATSGDMSSMTRIAK

SEQ ID NO: 165737 - protein, 14 aa, Mycobacterium tuberculosis
TSGDMSSMTRIAKP

SEQ ID NO: 165738 - protein, 14 aa, Mycobacterium tuberculosis
SGDMSSMTRIAKPL

SEQ ID NO: 165739 - protein, 14 aa, Mycobacterium tuberculosis
GDMSSMTRIAKPLI

SEQ ID NO: 165740 - protein, 14 aa, Mycobacterium tuberculosis
DMSSMTRIAKPLIK

SEQ ID NO: 165741 - protein, 14 aa, Mycobacterium tuberculosis
MSSMTRIAKPLIKS

SEQ ID NO: 165742 - protein, 14 aa, Mycobacterium tuberculosis
SSMTRIAKPLIKSA

SEQ ID NO: 165743 - protein, 14 aa, Mycobacterium tuberculosis
SMTRIAKPLIKSAM

SEQ ID NO: 165744 - protein, 14 aa, Mycobacterium tuberculosis
MTRIAKPLIKSAMA

SEQ ID NO: 165745 - protein, 14 aa, Mycobacterium tuberculosis
TRIAKPLIKSAMAA

SEQ ID NO: 165746 - protein, 14 aa, Mycobacterium tuberculosis
RIAKPLIKSAMAAG

SEQ ID NO: 165747 - protein, 14 aa, Mycobacterium tuberculosis
IAKPLIKSAMAAGL

SEQ ID NO: 165748 - protein, 14 aa, Mycobacterium tuberculosis
AKPLIKSAMAAGLV

SEQ ID NO: 165749 - protein, 14 aa, Mycobacterium tuberculosis
KPLIKSAMAAGLVT

SEQ ID NO: 165750 - protein, 14 aa, Mycobacterium tuberculosis
PLIKSAMAAGLVTA

SEQ ID NO: 165751 - protein, 14 aa, Mycobacterium tuberculosis
LIKSAMAAGLVTAS

SEQ ID NO: 165752 - protein, 14 aa, Mycobacterium tuberculosis
IKSAMAAGLVTASM

SEQ ID NO: 165753 - protein, 14 aa, Mycobacterium tuberculosis
KSAMAAGLVTASMS

SEQ ID NO: 165754 - protein, 14 aa, Mycobacterium tuberculosis
SAMAAGLVTASMSL

SEQ ID NO: 165755 - protein, 14 aa, Mycobacterium tuberculosis
AMAAGLVTASMSLS

SEQ ID NO: 165756 - protein, 14 aa, Mycobacterium tuberculosis
MAAGLVTASMSLST

SEQ ID NO: 165757 - protein, 14 aa, Mycobacterium tuberculosis
AAGLVTASMSLSTA

SEQ ID NO: 165758 - protein, 14 aa, Mycobacterium tuberculosis
AGLVTASMSLSTAV

SEQ ID NO: 165759 - protein, 14 aa, Mycobacterium tuberculosis
GLVTASMSLSTAVA

SEQ ID NO: 165760 - protein, 14 aa, Mycobacterium tuberculosis
LVTASMSLSTAVAH

SEQ ID NO: 165761 - protein, 14 aa, Mycobacterium tuberculosis
VTASMSLSTAVAHA

SEQ ID NO: 165762 - protein, 14 aa, Mycobacterium tuberculosis
TASMSLSTAVAHAG

SEQ ID NO: 165763 - protein, 14 aa, Mycobacterium tuberculosis
ASMSLSTAVAHAGP

SEQ ID NO: 165764 - protein, 14 aa, Mycobacterium tuberculosis
SMSLSTAVAHAGPS

SEQ ID NO: 165765 - protein, 14 aa, Mycobacterium tuberculosis
MSLSTAVAHAGPSP

SEQ ID NO: 165766 - protein, 14 aa, Mycobacterium tuberculosis
SLSTAVAHAGPSPN

SEQ ID NO: 165767 - protein, 14 aa, Mycobacterium tuberculosis
LSTAVAHAGPSPNW

SEQ ID NO: 165768 - protein, 14 aa, Mycobacterium tuberculosis
STAVAHAGPSPNWD

SEQ ID NO: 165769 - protein, 14 aa, Mycobacterium tuberculosis
TAVAHAGPSPNWDA

SEQ ID NO: 165770 - protein, 14 aa, Mycobacterium tuberculosis
AVAHAGPSPNWDAV

SEQ ID NO: 165771 - protein, 14 aa, Mycobacterium tuberculosis
VAHAGPSPNWDAVA

SEQ ID NO: 165772 - protein, 14 aa, Mycobacterium tuberculosis
AHAGPSPNWDAVAQ

SEQ ID NO: 165773 - protein, 14 aa, Mycobacterium tuberculosis
HAGPSPNWDAVAQC

SEQ ID NO: 165774 - protein, 14 aa, Mycobacterium tuberculosis
AGPSPNWDAVAQCE

SEQ ID NO: 165775 - protein, 14 aa, Mycobacterium tuberculosis
GPSPNWDAVAQCES

SEQ ID NO: 165776 - protein, 14 aa, Mycobacterium tuberculosis
PSPNWDAVAQCESG

SEQ ID NO: 165777 - protein, 14 aa, Mycobacterium tuberculosis
SPNWDAVAQCESGG

SEQ ID NO: 165778 - protein, 14 aa, Mycobacterium tuberculosis
PNWDAVAQCESGGN

SEQ ID NO: 165779 - protein, 14 aa, Mycobacterium tuberculosis
NWDAVAQCESGGNW

SEQ ID NO: 165780 - protein, 14 aa, Mycobacterium tuberculosis
WDAVAQCESGGNWA

SEQ ID NO: 165781 - protein, 14 aa, Mycobacterium tuberculosis
DAVAQCESGGNWAA

SEQ ID NO: 165782 - protein, 14 aa, Mycobacterium tuberculosis
AVAQCESGGNWAAN

SEQ ID NO: 165783 - protein, 14 aa, Mycobacterium tuberculosis
VAQCESGGNWAANT

SEQ ID NO: 165784 - protein, 14 aa, Mycobacterium tuberculosis
AQCESGGNWAANTG

SEQ ID NO: 165785 - protein, 14 aa, Mycobacterium tuberculosis
QCESGGNWAANTGN

SEQ ID NO: 165786 - protein, 14 aa, Mycobacterium tuberculosis
CESGGNWAANTGNG

SEQ ID NO: 165787 - protein, 14 aa, Mycobacterium tuberculosis
ESGGNWAANTGNGK

SEQ ID NO: 165788 - protein, 14 aa, Mycobacterium tuberculosis
SGGNWAANTGNGKY

SEQ ID NO: 165789 - protein, 14 aa, Mycobacterium tuberculosis
GGNWAANTGNGKYG

SEQ ID NO: 165790 - protein, 14 aa, Mycobacterium tuberculosis
GNWAANTGNGKYGG

SEQ ID NO: 165791 - protein, 14 aa, Mycobacterium tuberculosis
NWAANTGNGKYGGL

SEQ ID NO: 165792 - protein, 14 aa, Mycobacterium tuberculosis
WAANTGNGKYGGLQ

SEQ ID NO: 165793 - protein, 14 aa, Mycobacterium tuberculosis
AANTGNGKYGGLQF

SEQ ID NO: 165794 - protein, 14 aa, Mycobacterium tuberculosis
ANTGNGKYGGLQFK

SEQ ID NO: 165795 - protein, 14 aa, Mycobacterium tuberculosis
NTGNGKYGGLQFKP

SEQ ID NO: 165796 - protein, 14 aa, Mycobacterium tuberculosis
TGNGKYGGLQFKPA

SEQ ID NO: 165797 - protein, 14 aa, Mycobacterium tuberculosis
GNGKYGGLQFKPAT

SEQ ID NO: 165798 - protein, 14 aa, Mycobacterium tuberculosis
NGKYGGLQFKPATW

SEQ ID NO: 165799 - protein, 14 aa, Mycobacterium tuberculosis
GKYGGLQFKPATWA

SEQ ID NO: 165800 - protein, 14 aa, Mycobacterium tuberculosis
KYGGLQFKPATWAA

SEQ ID NO: 165801 - protein, 14 aa, Mycobacterium tuberculosis
YGGLQFKPATWAAF

SEQ ID NO: 165802 - protein, 14 aa, Mycobacterium tuberculosis
GGLQFKPATWAAFG

SEQ ID NO: 165803 - protein, 14 aa, Mycobacterium tuberculosis
GLQFKPATWAAFGG

SEQ ID NO: 165804 - protein, 14 aa, Mycobacterium tuberculosis
LQFKPATWAAFGGV

SEQ ID NO: 165805 - protein, 14 aa, Mycobacterium tuberculosis
QFKPATWAAFGGVG

SEQ ID NO: 165806 - protein, 14 aa, Mycobacterium tuberculosis
FKPATWAAFGGVGN

SEQ ID NO: 165807 - protein, 14 aa, Mycobacterium tuberculosis
KPATWAAFGGVGNP

SEQ ID NO: 165808 - protein, 14 aa, Mycobacterium tuberculosis
PATWAAFGGVGNPA

SEQ ID NO: 165809 - protein, 14 aa, Mycobacterium tuberculosis
ATWAAFGGVGNPAA

SEQ ID NO: 165810 - protein, 14 aa, Mycobacterium tuberculosis
TWAAFGGVGNPAAA

SEQ ID NO: 165811 - protein, 14 aa, Mycobacterium tuberculosis
WAAFGGVGNPAAAS

SEQ ID NO: 165812 - protein, 14 aa, Mycobacterium tuberculosis
AAFGGVGNPAAASR

SEQ ID NO: 165813 - protein, 14 aa, Mycobacterium tuberculosis
AFGGVGNPAAASRE

SEQ ID NO: 165814 - protein, 14 aa, Mycobacterium tuberculosis
FGGVGNPAAASREQ

SEQ ID NO: 165815 - protein, 14 aa, Mycobacterium tuberculosis
GGVGNPAAASREQQ

SEQ ID NO: 165816 - protein, 14 aa, Mycobacterium tuberculosis
GVGNPAAASREQQI

SEQ ID NO: 165817 - protein, 14 aa, Mycobacterium tuberculosis
VGNPAAASREQQIA

SEQ ID NO: 165818 - protein, 14 aa, Mycobacterium tuberculosis
GNPAAASREQQIAV

SEQ ID NO: 165819 - protein, 14 aa, Mycobacterium tuberculosis
NPAAASREQQIAVA

SEQ ID NO: 165820 - protein, 14 aa, Mycobacterium tuberculosis
PAAASREQQIAVAN

SEQ ID NO: 165821 - protein, 14 aa, Mycobacterium tuberculosis
AAASREQQIAVANR

SEQ ID NO: 165822 - protein, 14 aa, Mycobacterium tuberculosis
AASREQQIAVANRV

SEQ ID NO: 165823 - protein, 14 aa, Mycobacterium tuberculosis
ASREQQIAVANRVL

SEQ ID NO: 165824 - protein, 14 aa, Mycobacterium tuberculosis
SREQQIAVANRVLA

SEQ ID NO: 165825 - protein, 14 aa, Mycobacterium tuberculosis
REQQIAVANRVLAE

SEQ ID NO: 165826 - protein, 14 aa, Mycobacterium tuberculosis
EQQIAVANRVLAEQ

SEQ ID NO: 165827 - protein, 14 aa, Mycobacterium tuberculosis
QQIAVANRVLAEQG

SEQ ID NO: 165828 - protein, 14 aa, Mycobacterium tuberculosis
QIAVANRVLAEQGL

SEQ ID NO: 165829 - protein, 14 aa, Mycobacterium tuberculosis
IAVANRVLAEQGLD

SEQ ID NO: 165830 - protein, 14 aa, Mycobacterium tuberculosis
AVANRVLAEQGLDA

SEQ ID NO: 165831 - protein, 14 aa, Mycobacterium tuberculosis
VANRVLAEQGLDAW

SEQ ID NO: 165832 - protein, 14 aa, Mycobacterium tuberculosis
ANRVLAEQGLDAWP

SEQ ID NO: 165833 - protein, 14 aa, Mycobacterium tuberculosis
NRVLAEQGLDAWPT

SEQ ID NO: 165834 - protein, 14 aa, Mycobacterium tuberculosis
RVLAEQGLDAWPTC

SEQ ID NO: 165835 - protein, 14 aa, Mycobacterium tuberculosis
VLAEQGLDAWPTCG

SEQ ID NO: 165836 - protein, 14 aa, Mycobacterium tuberculosis
LAEQGLDAWPTCGA

SEQ ID NO: 165837 - protein, 14 aa, Mycobacterium tuberculosis
AEQGLDAWPTCGAA

SEQ ID NO: 165838 - protein, 14 aa, Mycobacterium tuberculosis
EQGLDAWPTCGAAS

SEQ ID NO: 165839 - protein, 14 aa, Mycobacterium tuberculosis
QGLDAWPTCGAASG

SEQ ID NO: 165840 - protein, 14 aa, Mycobacterium tuberculosis
GLDAWPTCGAASGL

SEQ ID NO: 165841 - protein, 14 aa, Mycobacterium tuberculosis
LDAWPTCGAASGLP

SEQ ID NO: 165842 - protein, 14 aa, Mycobacterium tuberculosis
DAWPTCGAASGLPI

SEQ ID NO: 165843 - protein, 14 aa, Mycobacterium tuberculosis
AWPTCGAASGLPIA

SEQ ID NO: 165844 - protein, 14 aa, Mycobacterium tuberculosis
WPTCGAASGLPIAL

SEQ ID NO: 165845 - protein, 14 aa, Mycobacterium tuberculosis
PTCGAASGLPIALW

SEQ ID NO: 165846 - protein, 14 aa, Mycobacterium tuberculosis
TCGAASGLPIALWS

SEQ ID NO: 165847 - protein, 14 aa, Mycobacterium tuberculosis
CGAASGLPIALWSK

SEQ ID NO: 165848 - protein, 14 aa, Mycobacterium tuberculosis
GAASGLPIALWSKP

SEQ ID NO: 165849 - protein, 14 aa, Mycobacterium tuberculosis
AASGLPIALWSKPA

SEQ ID NO: 165850 - protein, 14 aa, Mycobacterium tuberculosis
ASGLPIALWSKPAQ

SEQ ID NO: 165851 - protein, 14 aa, Mycobacterium tuberculosis
SGLPIALWSKPAQG

SEQ ID NO: 165852 - protein, 14 aa, Mycobacterium tuberculosis
GLPIALWSKPAQGI

SEQ ID NO: 165853 - protein, 14 aa, Mycobacterium tuberculosis
LPIALWSKPAQGIK

SEQ ID NO: 165854 - protein, 14 aa, Mycobacterium tuberculosis
PIALWSKPAQGIKQ

SEQ ID NO: 165855 - protein, 14 aa, Mycobacterium tuberculosis
IALWSKPAQGIKQI

SEQ ID NO: 165856 - protein, 14 aa, Mycobacterium tuberculosis
ALWSKPAQGIKQII

SEQ ID NO: 165857 - protein, 14 aa, Mycobacterium tuberculosis
LWSKPAQGIKQIIN

SEQ ID NO: 165858 - protein, 14 aa, Mycobacterium tuberculosis
WSKPAQGIKQIINE

SEQ ID NO: 165859 - protein, 14 aa, Mycobacterium tuberculosis
SKPAQGIKQIINEI

SEQ ID NO: 165860 - protein, 14 aa, Mycobacterium tuberculosis
KPAQGIKQIINEII

SEQ ID NO: 165861 - protein, 14 aa, Mycobacterium tuberculosis
PAQGIKQIINEIIW

SEQ ID NO: 165862 - protein, 14 aa, Mycobacterium tuberculosis
AQGIKQIINEIIWA

SEQ ID NO: 165863 - protein, 14 aa, Mycobacterium tuberculosis
QGIKQIINEIIWAG

SEQ ID NO: 165864 - protein, 14 aa, Mycobacterium tuberculosis
GIKQIINEIIWAGI

SEQ ID NO: 165865 - protein, 14 aa, Mycobacterium tuberculosis
IKQIINEIIWAGIQ

SEQ ID NO: 165866 - protein, 14 aa, Mycobacterium tuberculosis
KQIINEIIWAGIQA

SEQ ID NO: 165867 - protein, 14 aa, Mycobacterium tuberculosis
QIINEIIWAGIQAS

SEQ ID NO: 165868 - protein, 14 aa, Mycobacterium tuberculosis
IINEIIWAGIQASI

SEQ ID NO: 165869 - protein, 14 aa, Mycobacterium tuberculosis
INEIIWAGIQASIP

SEQ ID NO: 165870 - protein, 14 aa, Mycobacterium tuberculosis
NEIIWAGIQASIPR

SEQ ID NO: 165871 - protein, 15 aa, Mycobacterium tuberculosis
MHPLPADHGRSRCNR

SEQ ID NO: 165872 - protein, 15 aa, Mycobacterium tuberculosis
HPLPADHGRSRCNRH

SEQ ID NO: 165873 - protein, 15 aa, Mycobacterium tuberculosis
PLPADHGRSRCNRHP

SEQ ID NO: 165874 - protein, 15 aa, Mycobacterium tuberculosis
LPADHGRSRCNRHPI

SEQ ID NO: 165875 - protein, 15 aa, Mycobacterium tuberculosis
PADHGRSRCNRHPIS

SEQ ID NO: 165876 - protein, 15 aa, Mycobacterium tuberculosis
ADHGRSRCNRHPISP

SEQ ID NO: 165877 - protein, 15 aa, Mycobacterium tuberculosis
DHGRSRCNRHPISPL

SEQ ID NO: 165878 - protein, 15 aa, Mycobacterium tuberculosis
HGRSRCNRHPISPLS

SEQ ID NO: 165879 - protein, 15 aa, Mycobacterium tuberculosis
GRSRCNRHPISPLSL

SEQ ID NO: 165880 - protein, 15 aa, Mycobacterium tuberculosis
RSRCNRHPISPLSLI

SEQ ID NO: 165881 - protein, 15 aa, Mycobacterium tuberculosis
SRCNRHPISPLSLIG

SEQ ID NO: 165882 - protein, 15 aa, Mycobacterium tuberculosis
RCNRHPISPLSLIGN

SEQ ID NO: 165883 - protein, 15 aa, Mycobacterium tuberculosis
CNRHPISPLSLIGNA

SEQ ID NO: 165884 - protein, 15 aa, Mycobacterium tuberculosis
NRHPISPLSLIGNAS

SEQ ID NO: 165885 - protein, 15 aa, Mycobacterium tuberculosis
RHPISPLSLIGNASA

SEQ ID NO: 165886 - protein, 15 aa, Mycobacterium tuberculosis
HPISPLSLIGNASAT

SEQ ID NO: 165887 - protein, 15 aa, Mycobacterium tuberculosis
PISPLSLIGNASATS

SEQ ID NO: 165888 - protein, 15 aa, Mycobacterium tuberculosis
ISPLSLIGNASATSG

SEQ ID NO: 165889 - protein, 15 aa, Mycobacterium tuberculosis
SPLSLIGNASATSGD

SEQ ID NO: 165890 - protein, 15 aa, Mycobacterium tuberculosis
PLSLIGNASATSGDM

SEQ ID NO: 165891 - protein, 15 aa, Mycobacterium tuberculosis
LSLIGNASATSGDMS

SEQ ID NO: 165892 - protein, 15 aa, Mycobacterium tuberculosis
SLIGNASATSGDMSS

SEQ ID NO: 165893 - protein, 15 aa, Mycobacterium tuberculosis
LIGNASATSGDMSSM

SEQ ID NO: 165894 - protein, 15 aa, Mycobacterium tuberculosis
IGNASATSGDMSSMT

SEQ ID NO: 165895 - protein, 15 aa, Mycobacterium tuberculosis
GNASATSGDMSSMTR

SEQ ID NO: 165896 - protein, 15 aa, Mycobacterium tuberculosis
NASATSGDMSSMTRI

SEQ ID NO: 165897 - protein, 15 aa, Mycobacterium tuberculosis
ASATSGDMSSMTRIA

SEQ ID NO: 165898 - protein, 15 aa, Mycobacterium tuberculosis
SATSGDMSSMTRIAK

SEQ ID NO: 165899 - protein, 15 aa, Mycobacterium tuberculosis
ATSGDMSSMTRIAKP

SEQ ID NO: 165900 - protein, 15 aa, Mycobacterium tuberculosis
TSGDMSSMTRIAKPL

SEQ ID NO: 165901 - protein, 15 aa, Mycobacterium tuberculosis
SGDMSSMTRIAKPLI

SEQ ID NO: 165902 - protein, 15 aa, Mycobacterium tuberculosis
GDMSSMTRIAKPLIK

SEQ ID NO: 165903 - protein, 15 aa, Mycobacterium tuberculosis
DMSSMTRIAKPLIKS

SEQ ID NO: 165904 - protein, 15 aa, Mycobacterium tuberculosis
MSSMTRIAKPLIKSA

SEQ ID NO: 165905 - protein, 15 aa, Mycobacterium tuberculosis
SSMTRIAKPLIKSAM

SEQ ID NO: 165906 - protein, 15 aa, Mycobacterium tuberculosis
SMTRIAKPLIKSAMA

SEQ ID NO: 165907 - protein, 15 aa, Mycobacterium tuberculosis
MTRIAKPLIKSAMAA

SEQ ID NO: 165908 - protein, 15 aa, Mycobacterium tuberculosis
TRIAKPLIKSAMAAG

SEQ ID NO: 165909 - protein, 15 aa, Mycobacterium tuberculosis
RIAKPLIKSAMAAGL

SEQ ID NO: 165910 - protein, 15 aa, Mycobacterium tuberculosis
IAKPLIKSAMAAGLV

SEQ ID NO: 165911 - protein, 15 aa, Mycobacterium tuberculosis
AKPLIKSAMAAGLVT

SEQ ID NO: 165912 - protein, 15 aa, Mycobacterium tuberculosis
KPLIKSAMAAGLVTA

SEQ ID NO: 165913 - protein, 15 aa, Mycobacterium tuberculosis
PLIKSAMAAGLVTAS

SEQ ID NO: 165914 - protein, 15 aa, Mycobacterium tuberculosis
LIKSAMAAGLVTASM

SEQ ID NO: 165915 - protein, 15 aa, Mycobacterium tuberculosis
IKSAMAAGLVTASMS

SEQ ID NO: 165916 - protein, 15 aa, Mycobacterium tuberculosis
KSAMAAGLVTASMSL

SEQ ID NO: 165917 - protein, 15 aa, Mycobacterium tuberculosis
SAMAAGLVTASMSLS

SEQ ID NO: 165918 - protein, 15 aa, Mycobacterium tuberculosis
AMAAGLVTASMSLST

SEQ ID NO: 165919 - protein, 15 aa, Mycobacterium tuberculosis
MAAGLVTASMSLSTA

SEQ ID NO: 165920 - protein, 15 aa, Mycobacterium tuberculosis
AAGLVTASMSLSTAV

SEQ ID NO: 165921 - protein, 15 aa, Mycobacterium tuberculosis
AGLVTASMSLSTAVA

SEQ ID NO: 165922 - protein, 15 aa, Mycobacterium tuberculosis
GLVTASMSLSTAVAH

SEQ ID NO: 165923 - protein, 15 aa, Mycobacterium tuberculosis
LVTASMSLSTAVAHA

SEQ ID NO: 165924 - protein, 15 aa, Mycobacterium tuberculosis
VTASMSLSTAVAHAG

SEQ ID NO: 165925 - protein, 15 aa, Mycobacterium tuberculosis
TASMSLSTAVAHAGP

SEQ ID NO: 165926 - protein, 15 aa, Mycobacterium tuberculosis
ASMSLSTAVAHAGPS

SEQ ID NO: 165927 - protein, 15 aa, Mycobacterium tuberculosis
SMSLSTAVAHAGPSP

SEQ ID NO: 165928 - protein, 15 aa, Mycobacterium tuberculosis
MSLSTAVAHAGPSPN

SEQ ID NO: 165929 - protein, 15 aa, Mycobacterium tuberculosis
SLSTAVAHAGPSPNW

SEQ ID NO: 165930 - protein, 15 aa, Mycobacterium tuberculosis
LSTAVAHAGPSPNWD

SEQ ID NO: 165931 - protein, 15 aa, Mycobacterium tuberculosis
STAVAHAGPSPNWDA

SEQ ID NO: 165932 - protein, 15 aa, Mycobacterium tuberculosis
TAVAHAGPSPNWDAV

SEQ ID NO: 165933 - protein, 15 aa, Mycobacterium tuberculosis
AVAHAGPSPNWDAVA

SEQ ID NO: 165934 - protein, 15 aa, Mycobacterium tuberculosis
VAHAGPSPNWDAVAQ

SEQ ID NO: 165935 - protein, 15 aa, Mycobacterium tuberculosis
AHAGPSPNWDAVAQC

SEQ ID NO: 165936 - protein, 15 aa, Mycobacterium tuberculosis
HAGPSPNWDAVAQCE

SEQ ID NO: 165937 - protein, 15 aa, Mycobacterium tuberculosis
AGPSPNWDAVAQCES

SEQ ID NO: 165938 - protein, 15 aa, Mycobacterium tuberculosis
GPSPNWDAVAQCESG

SEQ ID NO: 165939 - protein, 15 aa, Mycobacterium tuberculosis
PSPNWDAVAQCESGG

SEQ ID NO: 165940 - protein, 15 aa, Mycobacterium tuberculosis
SPNWDAVAQCESGGN

SEQ ID NO: 165941 - protein, 15 aa, Mycobacterium tuberculosis
PNWDAVAQCESGGNW

SEQ ID NO: 165942 - protein, 15 aa, Mycobacterium tuberculosis
NWDAVAQCESGGNWA

SEQ ID NO: 165943 - protein, 15 aa, Mycobacterium tuberculosis
WDAVAQCESGGNWAA

SEQ ID NO: 165944 - protein, 15 aa, Mycobacterium tuberculosis
DAVAQCESGGNWAAN

SEQ ID NO: 165945 - protein, 15 aa, Mycobacterium tuberculosis
AVAQCESGGNWAANT

SEQ ID NO: 165946 - protein, 15 aa, Mycobacterium tuberculosis
VAQCESGGNWAANTG

SEQ ID NO: 165947 - protein, 15 aa, Mycobacterium tuberculosis
AQCESGGNWAANTGN

SEQ ID NO: 165948 - protein, 15 aa, Mycobacterium tuberculosis
QCESGGNWAANTGNG

SEQ ID NO: 165949 - protein, 15 aa, Mycobacterium tuberculosis
CESGGNWAANTGNGK

SEQ ID NO: 165950 - protein, 15 aa, Mycobacterium tuberculosis
ESGGNWAANTGNGKY

SEQ ID NO: 165951 - protein, 15 aa, Mycobacterium tuberculosis
SGGNWAANTGNGKYG

SEQ ID NO: 165952 - protein, 15 aa, Mycobacterium tuberculosis
GGNWAANTGNGKYGG

SEQ ID NO: 165953 - protein, 15 aa, Mycobacterium tuberculosis
GNWAANTGNGKYGGL

SEQ ID NO: 165954 - protein, 15 aa, Mycobacterium tuberculosis
NWAANTGNGKYGGLQ

SEQ ID NO: 165955 - protein, 15 aa, Mycobacterium tuberculosis
WAANTGNGKYGGLQF

SEQ ID NO: 165956 - protein, 15 aa, Mycobacterium tuberculosis
AANTGNGKYGGLQFK

SEQ ID NO: 165957 - protein, 15 aa, Mycobacterium tuberculosis
ANTGNGKYGGLQFKP

SEQ ID NO: 165958 - protein, 15 aa, Mycobacterium tuberculosis
NTGNGKYGGLQFKPA

SEQ ID NO: 165959 - protein, 15 aa, Mycobacterium tuberculosis
TGNGKYGGLQFKPAT

SEQ ID NO: 165960 - protein, 15 aa, Mycobacterium tuberculosis
GNGKYGGLQFKPATW

SEQ ID NO: 165961 - protein, 15 aa, Mycobacterium tuberculosis
NGKYGGLQFKPATWA

SEQ ID NO: 165962 - protein, 15 aa, Mycobacterium tuberculosis
GKYGGLQFKPATWAA

SEQ ID NO: 165963 - protein, 15 aa, Mycobacterium tuberculosis
KYGGLQFKPATWAAF

SEQ ID NO: 165964 - protein, 15 aa, Mycobacterium tuberculosis
YGGLQFKPATWAAFG

SEQ ID NO: 165965 - protein, 15 aa, Mycobacterium tuberculosis
GGLQFKPATWAAFGG

SEQ ID NO: 165966 - protein, 15 aa, Mycobacterium tuberculosis
GLQFKPATWAAFGGV

SEQ ID NO: 165967 - protein, 15 aa, Mycobacterium tuberculosis
LQFKPATWAAFGGVG

SEQ ID NO: 165968 - protein, 15 aa, Mycobacterium tuberculosis
QFKPATWAAFGGVGN

SEQ ID NO: 165969 - protein, 15 aa, Mycobacterium tuberculosis
FKPATWAAFGGVGNP

SEQ ID NO: 165970 - protein, 15 aa, Mycobacterium tuberculosis
KPATWAAFGGVGNPA

SEQ ID NO: 165971 - protein, 15 aa, Mycobacterium tuberculosis
PATWAAFGGVGNPAA

SEQ ID NO: 165972 - protein, 15 aa, Mycobacterium tuberculosis
ATWAAFGGVGNPAAA

SEQ ID NO: 165973 - protein, 15 aa, Mycobacterium tuberculosis
TWAAFGGVGNPAAAS

SEQ ID NO: 165974 - protein, 15 aa, Mycobacterium tuberculosis
WAAFGGVGNPAAASR

SEQ ID NO: 165975 - protein, 15 aa, Mycobacterium tuberculosis
AAFGGVGNPAAASRE

SEQ ID NO: 165976 - protein, 15 aa, Mycobacterium tuberculosis
AFGGVGNPAAASREQ

SEQ ID NO: 165977 - protein, 15 aa, Mycobacterium tuberculosis
FGGVGNPAAASREQQ

SEQ ID NO: 165978 - protein, 15 aa, Mycobacterium tuberculosis
GGVGNPAAASREQQI

SEQ ID NO: 165979 - protein, 15 aa, Mycobacterium tuberculosis
GVGNPAAASREQQIA

SEQ ID NO: 165980 - protein, 15 aa, Mycobacterium tuberculosis
VGNPAAASREQQIAV

SEQ ID NO: 165981 - protein, 15 aa, Mycobacterium tuberculosis
GNPAAASREQQIAVA

SEQ ID NO: 165982 - protein, 15 aa, Mycobacterium tuberculosis
NPAAASREQQIAVAN

SEQ ID NO: 165983 - protein, 15 aa, Mycobacterium tuberculosis
PAAASREQQIAVANR

SEQ ID NO: 165984 - protein, 15 aa, Mycobacterium tuberculosis
AAASREQQIAVANRV

SEQ ID NO: 165985 - protein, 15 aa, Mycobacterium tuberculosis
AASREQQIAVANRVL

SEQ ID NO: 165986 - protein, 15 aa, Mycobacterium tuberculosis
ASREQQIAVANRVLA

SEQ ID NO: 165987 - protein, 15 aa, Mycobacterium tuberculosis
SREQQIAVANRVLAE

SEQ ID NO: 165988 - protein, 15 aa, Mycobacterium tuberculosis
REQQIAVANRVLAEQ

SEQ ID NO: 165989 - protein, 15 aa, Mycobacterium tuberculosis
EQQIAVANRVLAEQG

SEQ ID NO: 165990 - protein, 15 aa, Mycobacterium tuberculosis
QQIAVANRVLAEQGL

SEQ ID NO: 165991 - protein, 15 aa, Mycobacterium tuberculosis
QIAVANRVLAEQGLD

SEQ ID NO: 165992 - protein, 15 aa, Mycobacterium tuberculosis
IAVANRVLAEQGLDA

SEQ ID NO: 165993 - protein, 15 aa, Mycobacterium tuberculosis
AVANRVLAEQGLDAW

SEQ ID NO: 165994 - protein, 15 aa, Mycobacterium tuberculosis
VANRVLAEQGLDAWP

SEQ ID NO: 165995 - protein, 15 aa, Mycobacterium tuberculosis
ANRVLAEQGLDAWPT

SEQ ID NO: 165996 - protein, 15 aa, Mycobacterium tuberculosis
NRVLAEQGLDAWPTC

SEQ ID NO: 165997 - protein, 15 aa, Mycobacterium tuberculosis
RVLAEQGLDAWPTCG

SEQ ID NO: 165998 - protein, 15 aa, Mycobacterium tuberculosis
VLAEQGLDAWPTCGA

SEQ ID NO: 165999 - protein, 15 aa, Mycobacterium tuberculosis
LAEQGLDAWPTCGAA

SEQ ID NO: 166000 - protein, 15 aa, Mycobacterium tuberculosis
AEQGLDAWPTCGAAS

SEQ ID NO: 166001 - protein, 15 aa, Mycobacterium tuberculosis
EQGLDAWPTCGAASG

SEQ ID NO: 166002 - protein, 15 aa, Mycobacterium tuberculosis
QGLDAWPTCGAASGL

SEQ ID NO: 166003 - protein, 15 aa, Mycobacterium tuberculosis
GLDAWPTCGAASGLP

SEQ ID NO: 166004 - protein, 15 aa, Mycobacterium tuberculosis
LDAWPTCGAASGLPI

SEQ ID NO: 166005 - protein, 15 aa, Mycobacterium tuberculosis
DAWPTCGAASGLPIA

SEQ ID NO: 166006 - protein, 15 aa, Mycobacterium tuberculosis
AWPTCGAASGLPIAL

SEQ ID NO: 166007 - protein, 15 aa, Mycobacterium tuberculosis
WPTCGAASGLPIALW

SEQ ID NO: 166008 - protein, 15 aa, Mycobacterium tuberculosis
PTCGAASGLPIALWS

SEQ ID NO: 166009 - protein, 15 aa, Mycobacterium tuberculosis
TCGAASGLPIALWSK

SEQ ID NO: 166010 - protein, 15 aa, Mycobacterium tuberculosis
CGAASGLPIALWSKP

SEQ ID NO: 166011 - protein, 15 aa, Mycobacterium tuberculosis
GAASGLPIALWSKPA

SEQ ID NO: 166012 - protein, 15 aa, Mycobacterium tuberculosis
AASGLPIALWSKPAQ

SEQ ID NO: 166013 - protein, 15 aa, Mycobacterium tuberculosis
ASGLPIALWSKPAQG

SEQ ID NO: 166014 - protein, 15 aa, Mycobacterium tuberculosis
SGLPIALWSKPAQGI

SEQ ID NO: 166015 - protein, 15 aa, Mycobacterium tuberculosis
GLPIALWSKPAQGIK

SEQ ID NO: 166016 - protein, 15 aa, Mycobacterium tuberculosis
LPIALWSKPAQGIKQ

SEQ ID NO: 166017 - protein, 15 aa, Mycobacterium tuberculosis
PIALWSKPAQGIKQI

SEQ ID NO: 166018 - protein, 15 aa, Mycobacterium tuberculosis
IALWSKPAQGIKQII

SEQ ID NO: 166019 - protein, 15 aa, Mycobacterium tuberculosis
ALWSKPAQGIKQIIN

SEQ ID NO: 166020 - protein, 15 aa, Mycobacterium tuberculosis
LWSKPAQGIKQIINE

SEQ ID NO: 166021 - protein, 15 aa, Mycobacterium tuberculosis
WSKPAQGIKQIINEI

SEQ ID NO: 166022 - protein, 15 aa, Mycobacterium tuberculosis
SKPAQGIKQIINEII

SEQ ID NO: 166023 - protein, 15 aa, Mycobacterium tuberculosis
KPAQGIKQIINEIIW

SEQ ID NO: 166024 - protein, 15 aa, Mycobacterium tuberculosis
PAQGIKQIINEIIWA

SEQ ID NO: 166025 - protein, 15 aa, Mycobacterium tuberculosis
AQGIKQIINEIIWAG

SEQ ID NO: 166026 - protein, 15 aa, Mycobacterium tuberculosis
QGIKQIINEIIWAGI

SEQ ID NO: 166027 - protein, 15 aa, Mycobacterium tuberculosis
GIKQIINEIIWAGIQ

SEQ ID NO: 166028 - protein, 15 aa, Mycobacterium tuberculosis
IKQIINEIIWAGIQA

SEQ ID NO: 166029 - protein, 15 aa, Mycobacterium tuberculosis
KQIINEIIWAGIQAS

SEQ ID NO: 166030 - protein, 15 aa, Mycobacterium tuberculosis
QIINEIIWAGIQASI

SEQ ID NO: 166031 - protein, 15 aa, Mycobacterium tuberculosis
IINEIIWAGIQASIP

SEQ ID NO: 166032 - protein, 15 aa, Mycobacterium tuberculosis
INEIIWAGIQASIPR

SEQ ID NO: 166033 - protein, 16 aa, Mycobacterium tuberculosis
MHPLPADHGRSRCNRH

SEQ ID NO: 166034 - protein, 16 aa, Mycobacterium tuberculosis
HPLPADHGRSRCNRHP

SEQ ID NO: 166035 - protein, 16 aa, Mycobacterium tuberculosis
PLPADHGRSRCNRHPI

SEQ ID NO: 166036 - protein, 16 aa, Mycobacterium tuberculosis
LPADHGRSRCNRHPIS

SEQ ID NO: 166037 - protein, 16 aa, Mycobacterium tuberculosis
PADHGRSRCNRHPISP

SEQ ID NO: 166038 - protein, 16 aa, Mycobacterium tuberculosis
ADHGRSRCNRHPISPL

SEQ ID NO: 166039 - protein, 16 aa, Mycobacterium tuberculosis
DHGRSRCNRHPISPLS

SEQ ID NO: 166040 - protein, 16 aa, Mycobacterium tuberculosis
HGRSRCNRHPISPLSL

SEQ ID NO: 166041 - protein, 16 aa, Mycobacterium tuberculosis
GRSRCNRHPISPLSLI

SEQ ID NO: 166042 - protein, 16 aa, Mycobacterium tuberculosis
RSRCNRHPISPLSLIG

SEQ ID NO: 166043 - protein, 16 aa, Mycobacterium tuberculosis
SRCNRHPISPLSLIGN

SEQ ID NO: 166044 - protein, 16 aa, Mycobacterium tuberculosis
RCNRHPISPLSLIGNA

SEQ ID NO: 166045 - protein, 16 aa, Mycobacterium tuberculosis
CNRHPISPLSLIGNAS

SEQ ID NO: 166046 - protein, 16 aa, Mycobacterium tuberculosis
NRHPISPLSLIGNASA

SEQ ID NO: 166047 - protein, 16 aa, Mycobacterium tuberculosis
RHPISPLSLIGNASAT

SEQ ID NO: 166048 - protein, 16 aa, Mycobacterium tuberculosis
HPISPLSLIGNASATS

SEQ ID NO: 166049 - protein, 16 aa, Mycobacterium tuberculosis
PISPLSLIGNASATSG

SEQ ID NO: 166050 - protein, 16 aa, Mycobacterium tuberculosis
ISPLSLIGNASATSGD

SEQ ID NO: 166051 - protein, 16 aa, Mycobacterium tuberculosis
SPLSLIGNASATSGDM

SEQ ID NO: 166052 - protein, 16 aa, Mycobacterium tuberculosis
PLSLIGNASATSGDMS

SEQ ID NO: 166053 - protein, 16 aa, Mycobacterium tuberculosis
LSLIGNASATSGDMSS

SEQ ID NO: 166054 - protein, 16 aa, Mycobacterium tuberculosis
SLIGNASATSGDMSSM

SEQ ID NO: 166055 - protein, 16 aa, Mycobacterium tuberculosis
LIGNASATSGDMSSMT

SEQ ID NO: 166056 - protein, 16 aa, Mycobacterium tuberculosis
IGNASATSGDMSSMTR

SEQ ID NO: 166057 - protein, 16 aa, Mycobacterium tuberculosis
GNASATSGDMSSMTRI

SEQ ID NO: 166058 - protein, 16 aa, Mycobacterium tuberculosis
NASATSGDMSSMTRIA

SEQ ID NO: 166059 - protein, 16 aa, Mycobacterium tuberculosis
ASATSGDMSSMTRIAK

SEQ ID NO: 166060 - protein, 16 aa, Mycobacterium tuberculosis
SATSGDMSSMTRIAKP

SEQ ID NO: 166061 - protein, 16 aa, Mycobacterium tuberculosis
ATSGDMSSMTRIAKPL

SEQ ID NO: 166062 - protein, 16 aa, Mycobacterium tuberculosis
TSGDMSSMTRIAKPLI

SEQ ID NO: 166063 - protein, 16 aa, Mycobacterium tuberculosis
SGDMSSMTRIAKPLIK

SEQ ID NO: 166064 - protein, 16 aa, Mycobacterium tuberculosis
GDMSSMTRIAKPLIKS

SEQ ID NO: 166065 - protein, 16 aa, Mycobacterium tuberculosis
DMSSMTRIAKPLIKSA

SEQ ID NO: 166066 - protein, 16 aa, Mycobacterium tuberculosis
MSSMTRIAKPLIKSAM

SEQ ID NO: 166067 - protein, 16 aa, Mycobacterium tuberculosis
SSMTRIAKPLIKSAMA

SEQ ID NO: 166068 - protein, 16 aa, Mycobacterium tuberculosis
SMTRIAKPLIKSAMAA

SEQ ID NO: 166069 - protein, 16 aa, Mycobacterium tuberculosis
MTRIAKPLIKSAMAAG

SEQ ID NO: 166070 - protein, 16 aa, Mycobacterium tuberculosis
TRIAKPLIKSAMAAGL

SEQ ID NO: 166071 - protein, 16 aa, Mycobacterium tuberculosis
RIAKPLIKSAMAAGLV

SEQ ID NO: 166072 - protein, 16 aa, Mycobacterium tuberculosis
IAKPLIKSAMAAGLVT

SEQ ID NO: 166073 - protein, 16 aa, Mycobacterium tuberculosis
AKPLIKSAMAAGLVTA

SEQ ID NO: 166074 - protein, 16 aa, Mycobacterium tuberculosis
KPLIKSAMAAGLVTAS

SEQ ID NO: 166075 - protein, 16 aa, Mycobacterium tuberculosis
PLIKSAMAAGLVTASM

SEQ ID NO: 166076 - protein, 16 aa, Mycobacterium tuberculosis
LIKSAMAAGLVTASMS

SEQ ID NO: 166077 - protein, 16 aa, Mycobacterium tuberculosis
IKSAMAAGLVTASMSL

SEQ ID NO: 166078 - protein, 16 aa, Mycobacterium tuberculosis
KSAMAAGLVTASMSLS

SEQ ID NO: 166079 - protein, 16 aa, Mycobacterium tuberculosis
SAMAAGLVTASMSLST

SEQ ID NO: 166080 - protein, 16 aa, Mycobacterium tuberculosis
AMAAGLVTASMSLSTA

SEQ ID NO: 166081 - protein, 16 aa, Mycobacterium tuberculosis
MAAGLVTASMSLSTAV

SEQ ID NO: 166082 - protein, 16 aa, Mycobacterium tuberculosis
AAGLVTASMSLSTAVA

SEQ ID NO: 166083 - protein, 16 aa, Mycobacterium tuberculosis
AGLVTASMSLSTAVAH

SEQ ID NO: 166084 - protein, 16 aa, Mycobacterium tuberculosis
GLVTASMSLSTAVAHA

SEQ ID NO: 166085 - protein, 16 aa, Mycobacterium tuberculosis
LVTASMSLSTAVAHAG

SEQ ID NO: 166086 - protein, 16 aa, Mycobacterium tuberculosis
VTASMSLSTAVAHAGP

SEQ ID NO: 166087 - protein, 16 aa, Mycobacterium tuberculosis
TASMSLSTAVAHAGPS

SEQ ID NO: 166088 - protein, 16 aa, Mycobacterium tuberculosis
ASMSLSTAVAHAGPSP

SEQ ID NO: 166089 - protein, 16 aa, Mycobacterium tuberculosis
SMSLSTAVAHAGPSPN

SEQ ID NO: 166090 - protein, 16 aa, Mycobacterium tuberculosis
MSLSTAVAHAGPSPNW

SEQ ID NO: 166091 - protein, 16 aa, Mycobacterium tuberculosis
SLSTAVAHAGPSPNWD

SEQ ID NO: 166092 - protein, 16 aa, Mycobacterium tuberculosis
LSTAVAHAGPSPNWDA

SEQ ID NO: 166093 - protein, 16 aa, Mycobacterium tuberculosis
STAVAHAGPSPNWDAV

SEQ ID NO: 166094 - protein, 16 aa, Mycobacterium tuberculosis
TAVAHAGPSPNWDAVA

SEQ ID NO: 166095 - protein, 16 aa, Mycobacterium tuberculosis
AVAHAGPSPNWDAVAQ

SEQ ID NO: 166096 - protein, 16 aa, Mycobacterium tuberculosis
VAHAGPSPNWDAVAQC

SEQ ID NO: 166097 - protein, 16 aa, Mycobacterium tuberculosis
AHAGPSPNWDAVAQCE

SEQ ID NO: 166098 - protein, 16 aa, Mycobacterium tuberculosis
HAGPSPNWDAVAQCES

SEQ ID NO: 166099 - protein, 16 aa, Mycobacterium tuberculosis
AGPSPNWDAVAQCESG

SEQ ID NO: 166100 - protein, 16 aa, Mycobacterium tuberculosis
GPSPNWDAVAQCESGG

SEQ ID NO: 166101 - protein, 16 aa, Mycobacterium tuberculosis
PSPNWDAVAQCESGGN

SEQ ID NO: 166102 - protein, 16 aa, Mycobacterium tuberculosis
SPNWDAVAQCESGGNW

SEQ ID NO: 166103 - protein, 16 aa, Mycobacterium tuberculosis
PNWDAVAQCESGGNWA

SEQ ID NO: 166104 - protein, 16 aa, Mycobacterium tuberculosis
NWDAVAQCESGGNWAA

SEQ ID NO: 166105 - protein, 16 aa, Mycobacterium tuberculosis
WDAVAQCESGGNWAAN

SEQ ID NO: 166106 - protein, 16 aa, Mycobacterium tuberculosis
DAVAQCESGGNWAANT

SEQ ID NO: 166107 - protein, 16 aa, Mycobacterium tuberculosis
AVAQCESGGNWAANTG

SEQ ID NO: 166108 - protein, 16 aa, Mycobacterium tuberculosis
VAQCESGGNWAANTGN

SEQ ID NO: 166109 - protein, 16 aa, Mycobacterium tuberculosis
AQCESGGNWAANTGNG

SEQ ID NO: 166110 - protein, 16 aa, Mycobacterium tuberculosis
QCESGGNWAANTGNGK

SEQ ID NO: 166111 - protein, 16 aa, Mycobacterium tuberculosis
CESGGNWAANTGNGKY

SEQ ID NO: 166112 - protein, 16 aa, Mycobacterium tuberculosis
ESGGNWAANTGNGKYG

SEQ ID NO: 166113 - protein, 16 aa, Mycobacterium tuberculosis
SGGNWAANTGNGKYGG

SEQ ID NO: 166114 - protein, 16 aa, Mycobacterium tuberculosis
GGNWAANTGNGKYGGL

SEQ ID NO: 166115 - protein, 16 aa, Mycobacterium tuberculosis
GNWAANTGNGKYGGLQ

SEQ ID NO: 166116 - protein, 16 aa, Mycobacterium tuberculosis
NWAANTGNGKYGGLQF

SEQ ID NO: 166117 - protein, 16 aa, Mycobacterium tuberculosis
WAANTGNGKYGGLQFK

SEQ ID NO: 166118 - protein, 16 aa, Mycobacterium tuberculosis
AANTGNGKYGGLQFKP

SEQ ID NO: 166119 - protein, 16 aa, Mycobacterium tuberculosis
ANTGNGKYGGLQFKPA

SEQ ID NO: 166120 - protein, 16 aa, Mycobacterium tuberculosis
NTGNGKYGGLQFKPAT

SEQ ID NO: 166121 - protein, 16 aa, Mycobacterium tuberculosis
TGNGKYGGLQFKPATW

SEQ ID NO: 166122 - protein, 16 aa, Mycobacterium tuberculosis
GNGKYGGLQFKPATWA

SEQ ID NO: 166123 - protein, 16 aa, Mycobacterium tuberculosis
NGKYGGLQFKPATWAA

SEQ ID NO: 166124 - protein, 16 aa, Mycobacterium tuberculosis
GKYGGLQFKPATWAAF

SEQ ID NO: 166125 - protein, 16 aa, Mycobacterium tuberculosis
KYGGLQFKPATWAAFG

SEQ ID NO: 166126 - protein, 16 aa, Mycobacterium tuberculosis
YGGLQFKPATWAAFGG

SEQ ID NO: 166127 - protein, 16 aa, Mycobacterium tuberculosis
GGLQFKPATWAAFGGV

SEQ ID NO: 166128 - protein, 16 aa, Mycobacterium tuberculosis
GLQFKPATWAAFGGVG

SEQ ID NO: 166129 - protein, 16 aa, Mycobacterium tuberculosis
LQFKPATWAAFGGVGN

SEQ ID NO: 166130 - protein, 16 aa, Mycobacterium tuberculosis
QFKPATWAAFGGVGNP

SEQ ID NO: 166131 - protein, 16 aa, Mycobacterium tuberculosis
FKPATWAAFGGVGNPA

SEQ ID NO: 166132 - protein, 16 aa, Mycobacterium tuberculosis
KPATWAAFGGVGNPAA

SEQ ID NO: 166133 - protein, 16 aa, Mycobacterium tuberculosis
PATWAAFGGVGNPAAA

SEQ ID NO: 166134 - protein, 16 aa, Mycobacterium tuberculosis
ATWAAFGGVGNPAAAS

SEQ ID NO: 166135 - protein, 16 aa, Mycobacterium tuberculosis
TWAAFGGVGNPAAASR

SEQ ID NO: 166136 - protein, 16 aa, Mycobacterium tuberculosis
WAAFGGVGNPAAASRE

SEQ ID NO: 166137 - protein, 16 aa, Mycobacterium tuberculosis
AAFGGVGNPAAASREQ

SEQ ID NO: 166138 - protein, 16 aa, Mycobacterium tuberculosis
AFGGVGNPAAASREQQ

SEQ ID NO: 166139 - protein, 16 aa, Mycobacterium tuberculosis
FGGVGNPAAASREQQI

SEQ ID NO: 166140 - protein, 16 aa, Mycobacterium tuberculosis
GGVGNPAAASREQQIA

SEQ ID NO: 166141 - protein, 16 aa, Mycobacterium tuberculosis
GVGNPAAASREQQIAV

SEQ ID NO: 166142 - protein, 16 aa, Mycobacterium tuberculosis
VGNPAAASREQQIAVA

SEQ ID NO: 166143 - protein, 16 aa, Mycobacterium tuberculosis
GNPAAASREQQIAVAN

SEQ ID NO: 166144 - protein, 16 aa, Mycobacterium tuberculosis
NPAAASREQQIAVANR

SEQ ID NO: 166145 - protein, 16 aa, Mycobacterium tuberculosis
PAAASREQQIAVANRV

SEQ ID NO: 166146 - protein, 16 aa, Mycobacterium tuberculosis
AAASREQQIAVANRVL

SEQ ID NO: 166147 - protein, 16 aa, Mycobacterium tuberculosis
AASREQQIAVANRVLA

SEQ ID NO: 166148 - protein, 16 aa, Mycobacterium tuberculosis
ASREQQIAVANRVLAE

SEQ ID NO: 166149 - protein, 16 aa, Mycobacterium tuberculosis
SREQQIAVANRVLAEQ

SEQ ID NO: 166150 - protein, 16 aa, Mycobacterium tuberculosis
REQQIAVANRVLAEQG

SEQ ID NO: 166151 - protein, 16 aa, Mycobacterium tuberculosis
EQQIAVANRVLAEQGL

SEQ ID NO: 166152 - protein, 16 aa, Mycobacterium tuberculosis
QQIAVANRVLAEQGLD

SEQ ID NO: 166153 - protein, 16 aa, Mycobacterium tuberculosis
QIAVANRVLAEQGLDA

SEQ ID NO: 166154 - protein, 16 aa, Mycobacterium tuberculosis
IAVANRVLAEQGLDAW

SEQ ID NO: 166155 - protein, 16 aa, Mycobacterium tuberculosis
AVANRVLAEQGLDAWP

SEQ ID NO: 166156 - protein, 16 aa, Mycobacterium tuberculosis
VANRVLAEQGLDAWPT

SEQ ID NO: 166157 - protein, 16 aa, Mycobacterium tuberculosis
ANRVLAEQGLDAWPTC

SEQ ID NO: 166158 - protein, 16 aa, Mycobacterium tuberculosis
NRVLAEQGLDAWPTCG

SEQ ID NO: 166159 - protein, 16 aa, Mycobacterium tuberculosis
RVLAEQGLDAWPTCGA

SEQ ID NO: 166160 - protein, 16 aa, Mycobacterium tuberculosis
VLAEQGLDAWPTCGAA

SEQ ID NO: 166161 - protein, 16 aa, Mycobacterium tuberculosis
LAEQGLDAWPTCGAAS

SEQ ID NO: 166162 - protein, 16 aa, Mycobacterium tuberculosis
AEQGLDAWPTCGAASG

SEQ ID NO: 166163 - protein, 16 aa, Mycobacterium tuberculosis
EQGLDAWPTCGAASGL

SEQ ID NO: 166164 - protein, 16 aa, Mycobacterium tuberculosis
QGLDAWPTCGAASGLP

SEQ ID NO: 166165 - protein, 16 aa, Mycobacterium tuberculosis
GLDAWPTCGAASGLPI

SEQ ID NO: 166166 - protein, 16 aa, Mycobacterium tuberculosis
LDAWPTCGAASGLPIA

SEQ ID NO: 166167 - protein, 16 aa, Mycobacterium tuberculosis
DAWPTCGAASGLPIAL

SEQ ID NO: 166168 - protein, 16 aa, Mycobacterium tuberculosis
AWPTCGAASGLPIALW

SEQ ID NO: 166169 - protein, 16 aa, Mycobacterium tuberculosis
WPTCGAASGLPIALWS

SEQ ID NO: 166170 - protein, 16 aa, Mycobacterium tuberculosis
PTCGAASGLPIALWSK

SEQ ID NO: 166171 - protein, 16 aa, Mycobacterium tuberculosis
TCGAASGLPIALWSKP

SEQ ID NO: 166172 - protein, 16 aa, Mycobacterium tuberculosis
CGAASGLPIALWSKPA

SEQ ID NO: 166173 - protein, 16 aa, Mycobacterium tuberculosis
GAASGLPIALWSKPAQ

SEQ ID NO: 166174 - protein, 16 aa, Mycobacterium tuberculosis
AASGLPIALWSKPAQG

SEQ ID NO: 166175 - protein, 16 aa, Mycobacterium tuberculosis
ASGLPIALWSKPAQGI

SEQ ID NO: 166176 - protein, 16 aa, Mycobacterium tuberculosis
SGLPIALWSKPAQGIK

SEQ ID NO: 166177 - protein, 16 aa, Mycobacterium tuberculosis
GLPIALWSKPAQGIKQ

SEQ ID NO: 166178 - protein, 16 aa, Mycobacterium tuberculosis
LPIALWSKPAQGIKQI

SEQ ID NO: 166179 - protein, 16 aa, Mycobacterium tuberculosis
PIALWSKPAQGIKQII

SEQ ID NO: 166180 - protein, 16 aa, Mycobacterium tuberculosis
IALWSKPAQGIKQIIN

SEQ ID NO: 166181 - protein, 16 aa, Mycobacterium tuberculosis
ALWSKPAQGIKQIINE

SEQ ID NO: 166182 - protein, 16 aa, Mycobacterium tuberculosis
LWSKPAQGIKQIINEI

SEQ ID NO: 166183 - protein, 16 aa, Mycobacterium tuberculosis
WSKPAQGIKQIINEII

SEQ ID NO: 166184 - protein, 16 aa, Mycobacterium tuberculosis
SKPAQGIKQIINEIIW

SEQ ID NO: 166185 - protein, 16 aa, Mycobacterium tuberculosis
KPAQGIKQIINEIIWA

SEQ ID NO: 166186 - protein, 16 aa, Mycobacterium tuberculosis
PAQGIKQIINEIIWAG

SEQ ID NO: 166187 - protein, 16 aa, Mycobacterium tuberculosis
AQGIKQIINEIIWAGI

SEQ ID NO: 166188 - protein, 16 aa, Mycobacterium tuberculosis
QGIKQIINEIIWAGIQ

SEQ ID NO: 166189 - protein, 16 aa, Mycobacterium tuberculosis
GIKQIINEIIWAGIQA

SEQ ID NO: 166190 - protein, 16 aa, Mycobacterium tuberculosis
IKQIINEIIWAGIQAS

SEQ ID NO: 166191 - protein, 16 aa, Mycobacterium tuberculosis
KQIINEIIWAGIQASI

SEQ ID NO: 166192 - protein, 16 aa, Mycobacterium tuberculosis
QIINEIIWAGIQASIP

SEQ ID NO: 166193 - protein, 16 aa, Mycobacterium tuberculosis
IINEIIWAGIQASIPR

SEQ ID NO: 166194 - protein, 141 aa, Mycobacterium tuberculosis
MSAGPAIEVAVAFVWLGMVVAISFLEAPLKFRAAGVTLQIGLGIGRLVFRALNTVEVGFALVILAIVVVGSTPARIAAAFSVALAALAVQLIAVRPRLTRRSNQVLAGLQAPRSRGHHIYVGLEIVKVVALLVAGILLLNG

SEQ ID NO: 166195 - protein, 8 aa, Mycobacterium tuberculosis
SAGPAIEV

SEQ ID NO: 166196 - protein, 8 aa, Mycobacterium tuberculosis
GPAIEVAV

SEQ ID NO: 166197 - protein, 8 aa, Mycobacterium tuberculosis
AIEVAVAF

SEQ ID NO: 166198 - protein, 8 aa, Mycobacterium tuberculosis
IEVAVAFV

SEQ ID NO: 166199 - protein, 8 aa, Mycobacterium tuberculosis
EVAVAFVW

SEQ ID NO: 166200 - protein, 8 aa, Mycobacterium tuberculosis
VAVAFVWL

SEQ ID NO: 166201 - protein, 8 aa, Mycobacterium tuberculosis
FVWLGMVV

SEQ ID NO: 166202 - protein, 8 aa, Mycobacterium tuberculosis
WLGMVVAI

SEQ ID NO: 166203 - protein, 8 aa, Mycobacterium tuberculosis
GMVVAISF

SEQ ID NO: 166204 - protein, 8 aa, Mycobacterium tuberculosis
MVVAISFL

SEQ ID NO: 166205 - protein, 8 aa, Mycobacterium tuberculosis
VAISFLEA

SEQ ID NO: 166206 - protein, 8 aa, Mycobacterium tuberculosis
SFLEAPLK

SEQ ID NO: 166207 - protein, 8 aa, Mycobacterium tuberculosis
EAPLKFRA

SEQ ID NO: 166208 - protein, 8 aa, Mycobacterium tuberculosis
APLKFRAA

SEQ ID NO: 166209 - protein, 8 aa, Mycobacterium tuberculosis
FRAAGVTL

SEQ ID NO: 166210 - protein, 8 aa, Mycobacterium tuberculosis
TLQIGLGI

SEQ ID NO: 166211 - protein, 8 aa, Mycobacterium tuberculosis
GLGIGRLV

SEQ ID NO: 166212 - protein, 8 aa, Mycobacterium tuberculosis
GIGRLVFR

SEQ ID NO: 166213 - protein, 8 aa, Mycobacterium tuberculosis
GRLVFRAL

SEQ ID NO: 166214 - protein, 8 aa, Mycobacterium tuberculosis
RALNTVEV

SEQ ID NO: 166215 - protein, 8 aa, Mycobacterium tuberculosis
NTVEVGFA

SEQ ID NO: 166216 - protein, 8 aa, Mycobacterium tuberculosis
TVEVGFAL

SEQ ID NO: 166217 - protein, 8 aa, Mycobacterium tuberculosis
VEVGFALV

SEQ ID NO: 166218 - protein, 8 aa, Mycobacterium tuberculosis
EVGFALVI

SEQ ID NO: 166219 - protein, 8 aa, Mycobacterium tuberculosis
FALVILAI

SEQ ID NO: 166220 - protein, 8 aa, Mycobacterium tuberculosis
ALVILAIV

SEQ ID NO: 166221 - protein, 8 aa, Mycobacterium tuberculosis
LVILAIVV

SEQ ID NO: 166222 - protein, 8 aa, Mycobacterium tuberculosis
VILAIVVV

SEQ ID NO: 166223 - protein, 8 aa, Mycobacterium tuberculosis
VVVGSTPA

SEQ ID NO: 166224 - protein, 8 aa, Mycobacterium tuberculosis
VVGSTPAR

SEQ ID NO: 166225 - protein, 8 aa, Mycobacterium tuberculosis
STPARIAA

SEQ ID NO: 166226 - protein, 8 aa, Mycobacterium tuberculosis
TPARIAAA

SEQ ID NO: 166227 - protein, 8 aa, Mycobacterium tuberculosis
RIAAAFSV

SEQ ID NO: 166228 - protein, 8 aa, Mycobacterium tuberculosis
IAAAFSVA

SEQ ID NO: 166229 - protein, 8 aa, Mycobacterium tuberculosis
AAAFSVAL

SEQ ID NO: 166230 - protein, 8 aa, Mycobacterium tuberculosis
FSVALAAL

SEQ ID NO: 166231 - protein, 8 aa, Mycobacterium tuberculosis
SVALAALA

SEQ ID NO: 166232 - protein, 8 aa, Mycobacterium tuberculosis
VALAALAV

SEQ ID NO: 166233 - protein, 8 aa, Mycobacterium tuberculosis
ALAALAVQ

SEQ ID NO: 166234 - protein, 8 aa, Mycobacterium tuberculosis
LAALAVQL

SEQ ID NO: 166235 - protein, 8 aa, Mycobacterium tuberculosis
ALAVQLIA

SEQ ID NO: 166236 - protein, 8 aa, Mycobacterium tuberculosis
LAVQLIAV

SEQ ID NO: 166237 - protein, 8 aa, Mycobacterium tuberculosis
AVQLIAVR

SEQ ID NO: 166238 - protein, 8 aa, Mycobacterium tuberculosis
QLIAVRPR

SEQ ID NO: 166239 - protein, 8 aa, Mycobacterium tuberculosis
LIAVRPRL

SEQ ID NO: 166240 - protein, 8 aa, Mycobacterium tuberculosis
AVRPRLTR

SEQ ID NO: 166241 - protein, 8 aa, Mycobacterium tuberculosis
RPRLTRRS

SEQ ID NO: 166242 - protein, 8 aa, Mycobacterium tuberculosis
LTRRSNQV

SEQ ID NO: 166243 - protein, 8 aa, Mycobacterium tuberculosis
QVLAGLQA

SEQ ID NO: 166244 - protein, 8 aa, Mycobacterium tuberculosis
VLAGLQAP

SEQ ID NO: 166245 - protein, 8 aa, Mycobacterium tuberculosis
LAGLQAPR

SEQ ID NO: 166246 - protein, 8 aa, Mycobacterium tuberculosis
GLQAPRSR

SEQ ID NO: 166247 - protein, 8 aa, Mycobacterium tuberculosis
APRSRGHH

SEQ ID NO: 166248 - protein, 8 aa, Mycobacterium tuberculosis
RSRGHHIY

SEQ ID NO: 166249 - protein, 8 aa, Mycobacterium tuberculosis
SRGHHIYV

SEQ ID NO: 166250 - protein, 8 aa, Mycobacterium tuberculosis
HIYVGLEI

SEQ ID NO: 166251 - protein, 8 aa, Mycobacterium tuberculosis
YVGLEIVK

SEQ ID NO: 166252 - protein, 8 aa, Mycobacterium tuberculosis
VGLEIVKV

SEQ ID NO: 166253 - protein, 8 aa, Mycobacterium tuberculosis
GLEIVKVV

SEQ ID NO: 166254 - protein, 8 aa, Mycobacterium tuberculosis
EIVKVVAL

SEQ ID NO: 166255 - protein, 8 aa, Mycobacterium tuberculosis
KVVALLVA

SEQ ID NO: 166256 - protein, 8 aa, Mycobacterium tuberculosis
ALLVAGIL

SEQ ID NO: 166257 - protein, 8 aa, Mycobacterium tuberculosis
LLVAGILL

SEQ ID NO: 166258 - protein, 8 aa, Mycobacterium tuberculosis
LVAGILLL

SEQ ID NO: 166259 - protein, 9 aa, Mycobacterium tuberculosis
MSAGPAIEV

SEQ ID NO: 166260 - protein, 9 aa, Mycobacterium tuberculosis
PAIEVAVAF

SEQ ID NO: 166261 - protein, 9 aa, Mycobacterium tuberculosis
AIEVAVAFV

SEQ ID NO: 166262 - protein, 9 aa, Mycobacterium tuberculosis
IEVAVAFVW

SEQ ID NO: 166263 - protein, 9 aa, Mycobacterium tuberculosis
EVAVAFVWL

SEQ ID NO: 166264 - protein, 9 aa, Mycobacterium tuberculosis
AVAFVWLGM

SEQ ID NO: 166265 - protein, 9 aa, Mycobacterium tuberculosis
VAFVWLGMV

SEQ ID NO: 166266 - protein, 9 aa, Mycobacterium tuberculosis
AFVWLGMVV

SEQ ID NO: 166267 - protein, 9 aa, Mycobacterium tuberculosis
FVWLGMVVA

SEQ ID NO: 166268 - protein, 9 aa, Mycobacterium tuberculosis
VWLGMVVAI

SEQ ID NO: 166269 - protein, 9 aa, Mycobacterium tuberculosis
LGMVVAISF

SEQ ID NO: 166270 - protein, 9 aa, Mycobacterium tuberculosis
GMVVAISFL

SEQ ID NO: 166271 - protein, 9 aa, Mycobacterium tuberculosis
MVVAISFLE

SEQ ID NO: 166272 - protein, 9 aa, Mycobacterium tuberculosis
VVAISFLEA

SEQ ID NO: 166273 - protein, 9 aa, Mycobacterium tuberculosis
AISFLEAPL

SEQ ID NO: 166274 - protein, 9 aa, Mycobacterium tuberculosis
ISFLEAPLK

SEQ ID NO: 166275 - protein, 9 aa, Mycobacterium tuberculosis
SFLEAPLKF

SEQ ID NO: 166276 - protein, 9 aa, Mycobacterium tuberculosis
APLKFRAAG

SEQ ID NO: 166277 - protein, 9 aa, Mycobacterium tuberculosis
PLKFRAAGV

SEQ ID NO: 166278 - protein, 9 aa, Mycobacterium tuberculosis
KFRAAGVTL

SEQ ID NO: 166279 - protein, 9 aa, Mycobacterium tuberculosis
RAAGVTLQI

SEQ ID NO: 166280 - protein, 9 aa, Mycobacterium tuberculosis
LQIGLGIGR

SEQ ID NO: 166281 - protein, 9 aa, Mycobacterium tuberculosis
LGIGRLVFR

SEQ ID NO: 166282 - protein, 9 aa, Mycobacterium tuberculosis
GIGRLVFRA

SEQ ID NO: 166283 - protein, 9 aa, Mycobacterium tuberculosis
IGRLVFRAL

SEQ ID NO: 166284 - protein, 9 aa, Mycobacterium tuberculosis
RLVFRALNT

SEQ ID NO: 166285 - protein, 9 aa, Mycobacterium tuberculosis
LVFRALNTV

SEQ ID NO: 166286 - protein, 9 aa, Mycobacterium tuberculosis
FRALNTVEV

SEQ ID NO: 166287 - protein, 9 aa, Mycobacterium tuberculosis
ALNTVEVGF

SEQ ID NO: 166288 - protein, 9 aa, Mycobacterium tuberculosis
NTVEVGFAL

SEQ ID NO: 166289 - protein, 9 aa, Mycobacterium tuberculosis
TVEVGFALV

SEQ ID NO: 166290 - protein, 9 aa, Mycobacterium tuberculosis
VEVGFALVI

SEQ ID NO: 166291 - protein, 9 aa, Mycobacterium tuberculosis
EVGFALVIL

SEQ ID NO: 166292 - protein, 9 aa, Mycobacterium tuberculosis
FALVILAIV

SEQ ID NO: 166293 - protein, 9 aa, Mycobacterium tuberculosis
ALVILAIVV

SEQ ID NO: 166294 - protein, 9 aa, Mycobacterium tuberculosis
LVILAIVVV

SEQ ID NO: 166295 - protein, 9 aa, Mycobacterium tuberculosis
ILAIVVVGS

SEQ ID NO: 166296 - protein, 9 aa, Mycobacterium tuberculosis
IVVVGSTPA

SEQ ID NO: 166297 - protein, 9 aa, Mycobacterium tuberculosis
VVVGSTPAR

SEQ ID NO: 166298 - protein, 9 aa, Mycobacterium tuberculosis
VVGSTPARI

SEQ ID NO: 166299 - protein, 9 aa, Mycobacterium tuberculosis
STPARIAAA

SEQ ID NO: 166300 - protein, 9 aa, Mycobacterium tuberculosis
TPARIAAAF

SEQ ID NO: 166301 - protein, 9 aa, Mycobacterium tuberculosis
ARIAAAFSV

SEQ ID NO: 166302 - protein, 9 aa, Mycobacterium tuberculosis
RIAAAFSVA

SEQ ID NO: 166303 - protein, 9 aa, Mycobacterium tuberculosis
IAAAFSVAL

SEQ ID NO: 166304 - protein, 9 aa, Mycobacterium tuberculosis
AAAFSVALA

SEQ ID NO: 166305 - protein, 9 aa, Mycobacterium tuberculosis
AAFSVALAA

SEQ ID NO: 166306 - protein, 9 aa, Mycobacterium tuberculosis
FSVALAALA

SEQ ID NO: 166307 - protein, 9 aa, Mycobacterium tuberculosis
SVALAALAV

SEQ ID NO: 166308 - protein, 9 aa, Mycobacterium tuberculosis
ALAALAVQL

SEQ ID NO: 166309 - protein, 9 aa, Mycobacterium tuberculosis
LAALAVQLI

SEQ ID NO: 166310 - protein, 9 aa, Mycobacterium tuberculosis
ALAVQLIAV

SEQ ID NO: 166311 - protein, 9 aa, Mycobacterium tuberculosis
LAVQLIAVR

SEQ ID NO: 166312 - protein, 9 aa, Mycobacterium tuberculosis
VQLIAVRPR

SEQ ID NO: 166313 - protein, 9 aa, Mycobacterium tuberculosis
QLIAVRPRL

SEQ ID NO: 166314 - protein, 9 aa, Mycobacterium tuberculosis
IAVRPRLTR

SEQ ID NO: 166315 - protein, 9 aa, Mycobacterium tuberculosis
AVRPRLTRR

SEQ ID NO: 166316 - protein, 9 aa, Mycobacterium tuberculosis
RPRLTRRSN

SEQ ID NO: 166317 - protein, 9 aa, Mycobacterium tuberculosis
RLTRRSNQV

SEQ ID NO: 166318 - protein, 9 aa, Mycobacterium tuberculosis
RSNQVLAGL

SEQ ID NO: 166319 - protein, 9 aa, Mycobacterium tuberculosis
NQVLAGLQA

SEQ ID NO: 166320 - protein, 9 aa, Mycobacterium tuberculosis
VLAGLQAPR

SEQ ID NO: 166321 - protein, 9 aa, Mycobacterium tuberculosis
LQAPRSRGH

SEQ ID NO: 166322 - protein, 9 aa, Mycobacterium tuberculosis
APRSRGHHI

SEQ ID NO: 166323 - protein, 9 aa, Mycobacterium tuberculosis
RSRGHHIYV

SEQ ID NO: 166324 - protein, 9 aa, Mycobacterium tuberculosis
HIYVGLEIV

SEQ ID NO: 166325 - protein, 9 aa, Mycobacterium tuberculosis
IYVGLEIVK

SEQ ID NO: 166326 - protein, 9 aa, Mycobacterium tuberculosis
YVGLEIVKV

SEQ ID NO: 166327 - protein, 9 aa, Mycobacterium tuberculosis
GLEIVKVVA

SEQ ID NO: 166328 - protein, 9 aa, Mycobacterium tuberculosis
LEIVKVVAL

SEQ ID NO: 166329 - protein, 9 aa, Mycobacterium tuberculosis
EIVKVVALL

SEQ ID NO: 166330 - protein, 9 aa, Mycobacterium tuberculosis
IVKVVALLV

SEQ ID NO: 166331 - protein, 9 aa, Mycobacterium tuberculosis
VVALLVAGI

SEQ ID NO: 166332 - protein, 9 aa, Mycobacterium tuberculosis
ALLVAGILL

SEQ ID NO: 166333 - protein, 9 aa, Mycobacterium tuberculosis
LLVAGILLL

SEQ ID NO: 166334 - protein, 10 aa, Mycobacterium tuberculosis
MSAGPAIEVA

SEQ ID NO: 166335 - protein, 10 aa, Mycobacterium tuberculosis
SAGPAIEVAV

SEQ ID NO: 166336 - protein, 10 aa, Mycobacterium tuberculosis
GPAIEVAVAF

SEQ ID NO: 166337 - protein, 10 aa, Mycobacterium tuberculosis
PAIEVAVAFV

SEQ ID NO: 166338 - protein, 10 aa, Mycobacterium tuberculosis
IEVAVAFVWL

SEQ ID NO: 166339 - protein, 10 aa, Mycobacterium tuberculosis
EVAVAFVWLG

SEQ ID NO: 166340 - protein, 10 aa, Mycobacterium tuberculosis
VAVAFVWLGM

SEQ ID NO: 166341 - protein, 10 aa, Mycobacterium tuberculosis
AVAFVWLGMV

SEQ ID NO: 166342 - protein, 10 aa, Mycobacterium tuberculosis
VAFVWLGMVV

SEQ ID NO: 166343 - protein, 10 aa, Mycobacterium tuberculosis
FVWLGMVVAI

SEQ ID NO: 166344 - protein, 10 aa, Mycobacterium tuberculosis
WLGMVVAISF

SEQ ID NO: 166345 - protein, 10 aa, Mycobacterium tuberculosis
LGMVVAISFL

SEQ ID NO: 166346 - protein, 10 aa, Mycobacterium tuberculosis
MVVAISFLEA

SEQ ID NO: 166347 - protein, 10 aa, Mycobacterium tuberculosis
VAISFLEAPL

SEQ ID NO: 166348 - protein, 10 aa, Mycobacterium tuberculosis
AISFLEAPLK

SEQ ID NO: 166349 - protein, 10 aa, Mycobacterium tuberculosis
ISFLEAPLKF

SEQ ID NO: 166350 - protein, 10 aa, Mycobacterium tuberculosis
SFLEAPLKFR

SEQ ID NO: 166351 - protein, 10 aa, Mycobacterium tuberculosis
FLEAPLKFRA

SEQ ID NO: 166352 - protein, 10 aa, Mycobacterium tuberculosis
APLKFRAAGV

SEQ ID NO: 166353 - protein, 10 aa, Mycobacterium tuberculosis
KFRAAGVTLQ

SEQ ID NO: 166354 - protein, 10 aa, Mycobacterium tuberculosis
FRAAGVTLQI

SEQ ID NO: 166355 - protein, 10 aa, Mycobacterium tuberculosis
TLQIGLGIGR

SEQ ID NO: 166356 - protein, 10 aa, Mycobacterium tuberculosis
LQIGLGIGRL

SEQ ID NO: 166357 - protein, 10 aa, Mycobacterium tuberculosis
QIGLGIGRLV

SEQ ID NO: 166358 - protein, 10 aa, Mycobacterium tuberculosis
GLGIGRLVFR

SEQ ID NO: 166359 - protein, 10 aa, Mycobacterium tuberculosis
GIGRLVFRAL

SEQ ID NO: 166360 - protein, 10 aa, Mycobacterium tuberculosis
RLVFRALNTV

SEQ ID NO: 166361 - protein, 10 aa, Mycobacterium tuberculosis
RALNTVEVGF

SEQ ID NO: 166362 - protein, 10 aa, Mycobacterium tuberculosis
ALNTVEVGFA

SEQ ID NO: 166363 - protein, 10 aa, Mycobacterium tuberculosis
NTVEVGFALV

SEQ ID NO: 166364 - protein, 10 aa, Mycobacterium tuberculosis
VEVGFALVIL

SEQ ID NO: 166365 - protein, 10 aa, Mycobacterium tuberculosis
EVGFALVILA

SEQ ID NO: 166366 - protein, 10 aa, Mycobacterium tuberculosis
FALVILAIVV

SEQ ID NO: 166367 - protein, 10 aa, Mycobacterium tuberculosis
ALVILAIVVV

SEQ ID NO: 166368 - protein, 10 aa, Mycobacterium tuberculosis
ILAIVVVGST

SEQ ID NO: 166369 - protein, 10 aa, Mycobacterium tuberculosis
AIVVVGSTPA

SEQ ID NO: 166370 - protein, 10 aa, Mycobacterium tuberculosis
IVVVGSTPAR

SEQ ID NO: 166371 - protein, 10 aa, Mycobacterium tuberculosis
VVVGSTPARI

SEQ ID NO: 166372 - protein, 10 aa, Mycobacterium tuberculosis
STPARIAAAF

SEQ ID NO: 166373 - protein, 10 aa, Mycobacterium tuberculosis
RIAAAFSVAL

SEQ ID NO: 166374 - protein, 10 aa, Mycobacterium tuberculosis
IAAAFSVALA

SEQ ID NO: 166375 - protein, 10 aa, Mycobacterium tuberculosis
AAFSVALAAL

SEQ ID NO: 166376 - protein, 10 aa, Mycobacterium tuberculosis
FSVALAALAV

SEQ ID NO: 166377 - protein, 10 aa, Mycobacterium tuberculosis
ALAALAVQLI

SEQ ID NO: 166378 - protein, 10 aa, Mycobacterium tuberculosis
AALAVQLIAV

SEQ ID NO: 166379 - protein, 10 aa, Mycobacterium tuberculosis
ALAVQLIAVR

SEQ ID NO: 166380 - protein, 10 aa, Mycobacterium tuberculosis
AVQLIAVRPR

SEQ ID NO: 166381 - protein, 10 aa, Mycobacterium tuberculosis
VQLIAVRPRL

SEQ ID NO: 166382 - protein, 10 aa, Mycobacterium tuberculosis
LIAVRPRLTR

SEQ ID NO: 166383 - protein, 10 aa, Mycobacterium tuberculosis
IAVRPRLTRR

SEQ ID NO: 166384 - protein, 10 aa, Mycobacterium tuberculosis
RPRLTRRSNQ

SEQ ID NO: 166385 - protein, 10 aa, Mycobacterium tuberculosis
RLTRRSNQVL

SEQ ID NO: 166386 - protein, 10 aa, Mycobacterium tuberculosis
LTRRSNQVLA

SEQ ID NO: 166387 - protein, 10 aa, Mycobacterium tuberculosis
RRSNQVLAGL

SEQ ID NO: 166388 - protein, 10 aa, Mycobacterium tuberculosis
QVLAGLQAPR

SEQ ID NO: 166389 - protein, 10 aa, Mycobacterium tuberculosis
VLAGLQAPRS

SEQ ID NO: 166390 - protein, 10 aa, Mycobacterium tuberculosis
LQAPRSRGHH

SEQ ID NO: 166391 - protein, 10 aa, Mycobacterium tuberculosis
APRSRGHHIY

SEQ ID NO: 166392 - protein, 10 aa, Mycobacterium tuberculosis
HIYVGLEIVK

SEQ ID NO: 166393 - protein, 10 aa, Mycobacterium tuberculosis
IYVGLEIVKV

SEQ ID NO: 166394 - protein, 10 aa, Mycobacterium tuberculosis
YVGLEIVKVV

SEQ ID NO: 166395 - protein, 10 aa, Mycobacterium tuberculosis
GLEIVKVVAL

SEQ ID NO: 166396 - protein, 10 aa, Mycobacterium tuberculosis
LEIVKVVALL

SEQ ID NO: 166397 - protein, 10 aa, Mycobacterium tuberculosis
EIVKVVALLV

SEQ ID NO: 166398 - protein, 10 aa, Mycobacterium tuberculosis
KVVALLVAGI

SEQ ID NO: 166399 - protein, 10 aa, Mycobacterium tuberculosis
ALLVAGILLL

SEQ ID NO: 166400 - protein, 11 aa, Mycobacterium tuberculosis
MSAGPAIEVAV

SEQ ID NO: 166401 - protein, 11 aa, Mycobacterium tuberculosis
PAIEVAVAFVW

SEQ ID NO: 166402 - protein, 11 aa, Mycobacterium tuberculosis
AIEVAVAFVWL

SEQ ID NO: 166403 - protein, 11 aa, Mycobacterium tuberculosis
EVAVAFVWLGM

SEQ ID NO: 166404 - protein, 11 aa, Mycobacterium tuberculosis
VAVAFVWLGMV

SEQ ID NO: 166405 - protein, 11 aa, Mycobacterium tuberculosis
AVAFVWLGMVV

SEQ ID NO: 166406 - protein, 11 aa, Mycobacterium tuberculosis
AFVWLGMVVAI

SEQ ID NO: 166407 - protein, 11 aa, Mycobacterium tuberculosis
VWLGMVVAISF

SEQ ID NO: 166408 - protein, 11 aa, Mycobacterium tuberculosis
WLGMVVAISFL

SEQ ID NO: 166409 - protein, 11 aa, Mycobacterium tuberculosis
GMVVAISFLEA

SEQ ID NO: 166410 - protein, 11 aa, Mycobacterium tuberculosis
VVAISFLEAPL

SEQ ID NO: 166411 - protein, 11 aa, Mycobacterium tuberculosis
VAISFLEAPLK

SEQ ID NO: 166412 - protein, 11 aa, Mycobacterium tuberculosis
ISFLEAPLKFR

SEQ ID NO: 166413 - protein, 11 aa, Mycobacterium tuberculosis
FLEAPLKFRAA

SEQ ID NO: 166414 - protein, 11 aa, Mycobacterium tuberculosis
EAPLKFRAAGV

SEQ ID NO: 166415 - protein, 11 aa, Mycobacterium tuberculosis
APLKFRAAGVT

SEQ ID NO: 166416 - protein, 11 aa, Mycobacterium tuberculosis
PLKFRAAGVTL

SEQ ID NO: 166417 - protein, 11 aa, Mycobacterium tuberculosis
KFRAAGVTLQI

SEQ ID NO: 166418 - protein, 11 aa, Mycobacterium tuberculosis
RAAGVTLQIGL

SEQ ID NO: 166419 - protein, 11 aa, Mycobacterium tuberculosis
VTLQIGLGIGR

SEQ ID NO: 166420 - protein, 11 aa, Mycobacterium tuberculosis
TLQIGLGIGRL

SEQ ID NO: 166421 - protein, 11 aa, Mycobacterium tuberculosis
LQIGLGIGRLV

SEQ ID NO: 166422 - protein, 11 aa, Mycobacterium tuberculosis
IGLGIGRLVFR

SEQ ID NO: 166423 - protein, 11 aa, Mycobacterium tuberculosis
GLGIGRLVFRA

SEQ ID NO: 166424 - protein, 11 aa, Mycobacterium tuberculosis
LVFRALNTVEV

SEQ ID NO: 166425 - protein, 11 aa, Mycobacterium tuberculosis
FRALNTVEVGF

SEQ ID NO: 166426 - protein, 11 aa, Mycobacterium tuberculosis
ALNTVEVGFAL

SEQ ID NO: 166427 - protein, 11 aa, Mycobacterium tuberculosis
NTVEVGFALVI

SEQ ID NO: 166428 - protein, 11 aa, Mycobacterium tuberculosis
TVEVGFALVIL

SEQ ID NO: 166429 - protein, 11 aa, Mycobacterium tuberculosis
VEVGFALVILA

SEQ ID NO: 166430 - protein, 11 aa, Mycobacterium tuberculosis
EVGFALVILAI

SEQ ID NO: 166431 - protein, 11 aa, Mycobacterium tuberculosis
FALVILAIVVV

SEQ ID NO: 166432 - protein, 11 aa, Mycobacterium tuberculosis
LAIVVVGSTPA

SEQ ID NO: 166433 - protein, 11 aa, Mycobacterium tuberculosis
AIVVVGSTPAR

SEQ ID NO: 166434 - protein, 11 aa, Mycobacterium tuberculosis
IVVVGSTPARI

SEQ ID NO: 166435 - protein, 11 aa, Mycobacterium tuberculosis
TPARIAAAFSV

SEQ ID NO: 166436 - protein, 11 aa, Mycobacterium tuberculosis
ARIAAAFSVAL

SEQ ID NO: 166437 - protein, 11 aa, Mycobacterium tuberculosis
RIAAAFSVALA

SEQ ID NO: 166438 - protein, 11 aa, Mycobacterium tuberculosis
IAAAFSVALAA

SEQ ID NO: 166439 - protein, 11 aa, Mycobacterium tuberculosis
AAAFSVALAAL

SEQ ID NO: 166440 - protein, 11 aa, Mycobacterium tuberculosis
SVALAALAVQL

SEQ ID NO: 166441 - protein, 11 aa, Mycobacterium tuberculosis
ALAALAVQLIA

SEQ ID NO: 166442 - protein, 11 aa, Mycobacterium tuberculosis
LAALAVQLIAV

SEQ ID NO: 166443 - protein, 11 aa, Mycobacterium tuberculosis
AALAVQLIAVR

SEQ ID NO: 166444 - protein, 11 aa, Mycobacterium tuberculosis
LAVQLIAVRPR

SEQ ID NO: 166445 - protein, 11 aa, Mycobacterium tuberculosis
QLIAVRPRLTR

SEQ ID NO: 166446 - protein, 11 aa, Mycobacterium tuberculosis
LIAVRPRLTRR

SEQ ID NO: 166447 - protein, 11 aa, Mycobacterium tuberculosis
RPRLTRRSNQV

SEQ ID NO: 166448 - protein, 11 aa, Mycobacterium tuberculosis
RLTRRSNQVLA

SEQ ID NO: 166449 - protein, 11 aa, Mycobacterium tuberculosis
NQVLAGLQAPR

SEQ ID NO: 166450 - protein, 11 aa, Mycobacterium tuberculosis
LQAPRSRGHHI

SEQ ID NO: 166451 - protein, 11 aa, Mycobacterium tuberculosis
QAPRSRGHHIY

SEQ ID NO: 166452 - protein, 11 aa, Mycobacterium tuberculosis
APRSRGHHIYV

SEQ ID NO: 166453 - protein, 11 aa, Mycobacterium tuberculosis
RSRGHHIYVGL

SEQ ID NO: 166454 - protein, 11 aa, Mycobacterium tuberculosis
HIYVGLEIVKV

SEQ ID NO: 166455 - protein, 11 aa, Mycobacterium tuberculosis
GLEIVKVVALL

SEQ ID NO: 166456 - protein, 11 aa, Mycobacterium tuberculosis
KVVALLVAGIL

SEQ ID NO: 166457 - protein, 11 aa, Mycobacterium tuberculosis
VVALLVAGILL

SEQ ID NO: 166458 - protein, 13 aa, Mycobacterium tuberculosis
MSAGPAIEVAVAF

SEQ ID NO: 166459 - protein, 13 aa, Mycobacterium tuberculosis
SAGPAIEVAVAFV

SEQ ID NO: 166460 - protein, 13 aa, Mycobacterium tuberculosis
AGPAIEVAVAFVW

SEQ ID NO: 166461 - protein, 13 aa, Mycobacterium tuberculosis
GPAIEVAVAFVWL

SEQ ID NO: 166462 - protein, 13 aa, Mycobacterium tuberculosis
PAIEVAVAFVWLG

SEQ ID NO: 166463 - protein, 13 aa, Mycobacterium tuberculosis
AIEVAVAFVWLGM

SEQ ID NO: 166464 - protein, 13 aa, Mycobacterium tuberculosis
IEVAVAFVWLGMV

SEQ ID NO: 166465 - protein, 13 aa, Mycobacterium tuberculosis
EVAVAFVWLGMVV

SEQ ID NO: 166466 - protein, 13 aa, Mycobacterium tuberculosis
VAVAFVWLGMVVA

SEQ ID NO: 166467 - protein, 13 aa, Mycobacterium tuberculosis
AVAFVWLGMVVAI

SEQ ID NO: 166468 - protein, 13 aa, Mycobacterium tuberculosis
VAFVWLGMVVAIS

SEQ ID NO: 166469 - protein, 13 aa, Mycobacterium tuberculosis
AFVWLGMVVAISF

SEQ ID NO: 166470 - protein, 13 aa, Mycobacterium tuberculosis
FVWLGMVVAISFL

SEQ ID NO: 166471 - protein, 13 aa, Mycobacterium tuberculosis
VWLGMVVAISFLE

SEQ ID NO: 166472 - protein, 13 aa, Mycobacterium tuberculosis
WLGMVVAISFLEA

SEQ ID NO: 166473 - protein, 13 aa, Mycobacterium tuberculosis
LGMVVAISFLEAP

SEQ ID NO: 166474 - protein, 13 aa, Mycobacterium tuberculosis
GMVVAISFLEAPL

SEQ ID NO: 166475 - protein, 13 aa, Mycobacterium tuberculosis
MVVAISFLEAPLK

SEQ ID NO: 166476 - protein, 13 aa, Mycobacterium tuberculosis
VVAISFLEAPLKF

SEQ ID NO: 166477 - protein, 13 aa, Mycobacterium tuberculosis
VAISFLEAPLKFR

SEQ ID NO: 166478 - protein, 13 aa, Mycobacterium tuberculosis
AISFLEAPLKFRA

SEQ ID NO: 166479 - protein, 13 aa, Mycobacterium tuberculosis
ISFLEAPLKFRAA

SEQ ID NO: 166480 - protein, 13 aa, Mycobacterium tuberculosis
SFLEAPLKFRAAG

SEQ ID NO: 166481 - protein, 13 aa, Mycobacterium tuberculosis
FLEAPLKFRAAGV

SEQ ID NO: 166482 - protein, 13 aa, Mycobacterium tuberculosis
LEAPLKFRAAGVT

SEQ ID NO: 166483 - protein, 13 aa, Mycobacterium tuberculosis
EAPLKFRAAGVTL

SEQ ID NO: 166484 - protein, 13 aa, Mycobacterium tuberculosis
APLKFRAAGVTLQ

SEQ ID NO: 166485 - protein, 13 aa, Mycobacterium tuberculosis
PLKFRAAGVTLQI

SEQ ID NO: 166486 - protein, 13 aa, Mycobacterium tuberculosis
LKFRAAGVTLQIG

SEQ ID NO: 166487 - protein, 13 aa, Mycobacterium tuberculosis
KFRAAGVTLQIGL

SEQ ID NO: 166488 - protein, 13 aa, Mycobacterium tuberculosis
FRAAGVTLQIGLG

SEQ ID NO: 166489 - protein, 13 aa, Mycobacterium tuberculosis
RAAGVTLQIGLGI

SEQ ID NO: 166490 - protein, 13 aa, Mycobacterium tuberculosis
AAGVTLQIGLGIG

SEQ ID NO: 166491 - protein, 13 aa, Mycobacterium tuberculosis
AGVTLQIGLGIGR

SEQ ID NO: 166492 - protein, 13 aa, Mycobacterium tuberculosis
GVTLQIGLGIGRL

SEQ ID NO: 166493 - protein, 13 aa, Mycobacterium tuberculosis
VTLQIGLGIGRLV

SEQ ID NO: 166494 - protein, 13 aa, Mycobacterium tuberculosis
TLQIGLGIGRLVF

SEQ ID NO: 166495 - protein, 13 aa, Mycobacterium tuberculosis
LQIGLGIGRLVFR

SEQ ID NO: 166496 - protein, 13 aa, Mycobacterium tuberculosis
QIGLGIGRLVFRA

SEQ ID NO: 166497 - protein, 13 aa, Mycobacterium tuberculosis
IGLGIGRLVFRAL

SEQ ID NO: 166498 - protein, 13 aa, Mycobacterium tuberculosis
GLGIGRLVFRALN

SEQ ID NO: 166499 - protein, 13 aa, Mycobacterium tuberculosis
LGIGRLVFRALNT

SEQ ID NO: 166500 - protein, 13 aa, Mycobacterium tuberculosis
GIGRLVFRALNTV

SEQ ID NO: 166501 - protein, 13 aa, Mycobacterium tuberculosis
IGRLVFRALNTVE

SEQ ID NO: 166502 - protein, 13 aa, Mycobacterium tuberculosis
GRLVFRALNTVEV

SEQ ID NO: 166503 - protein, 13 aa, Mycobacterium tuberculosis
RLVFRALNTVEVG

SEQ ID NO: 166504 - protein, 13 aa, Mycobacterium tuberculosis
LVFRALNTVEVGF

SEQ ID NO: 166505 - protein, 13 aa, Mycobacterium tuberculosis
VFRALNTVEVGFA

SEQ ID NO: 166506 - protein, 13 aa, Mycobacterium tuberculosis
FRALNTVEVGFAL

SEQ ID NO: 166507 - protein, 13 aa, Mycobacterium tuberculosis
RALNTVEVGFALV

SEQ ID NO: 166508 - protein, 13 aa, Mycobacterium tuberculosis
ALNTVEVGFALVI

SEQ ID NO: 166509 - protein, 13 aa, Mycobacterium tuberculosis
LNTVEVGFALVIL

SEQ ID NO: 166510 - protein, 13 aa, Mycobacterium tuberculosis
NTVEVGFALVILA

SEQ ID NO: 166511 - protein, 13 aa, Mycobacterium tuberculosis
TVEVGFALVILAI

SEQ ID NO: 166512 - protein, 13 aa, Mycobacterium tuberculosis
VEVGFALVILAIV

SEQ ID NO: 166513 - protein, 13 aa, Mycobacterium tuberculosis
EVGFALVILAIVV

SEQ ID NO: 166514 - protein, 13 aa, Mycobacterium tuberculosis
VGFALVILAIVVV

SEQ ID NO: 166515 - protein, 13 aa, Mycobacterium tuberculosis
GFALVILAIVVVG

SEQ ID NO: 166516 - protein, 13 aa, Mycobacterium tuberculosis
FALVILAIVVVGS

SEQ ID NO: 166517 - protein, 13 aa, Mycobacterium tuberculosis
ALVILAIVVVGST

SEQ ID NO: 166518 - protein, 13 aa, Mycobacterium tuberculosis
LVILAIVVVGSTP

SEQ ID NO: 166519 - protein, 13 aa, Mycobacterium tuberculosis
VILAIVVVGSTPA

SEQ ID NO: 166520 - protein, 13 aa, Mycobacterium tuberculosis
ILAIVVVGSTPAR

SEQ ID NO: 166521 - protein, 13 aa, Mycobacterium tuberculosis
LAIVVVGSTPARI

SEQ ID NO: 166522 - protein, 13 aa, Mycobacterium tuberculosis
AIVVVGSTPARIA

SEQ ID NO: 166523 - protein, 13 aa, Mycobacterium tuberculosis
IVVVGSTPARIAA

SEQ ID NO: 166524 - protein, 13 aa, Mycobacterium tuberculosis
VVVGSTPARIAAA

SEQ ID NO: 166525 - protein, 13 aa, Mycobacterium tuberculosis
VVGSTPARIAAAF

SEQ ID NO: 166526 - protein, 13 aa, Mycobacterium tuberculosis
VGSTPARIAAAFS

SEQ ID NO: 166527 - protein, 13 aa, Mycobacterium tuberculosis
GSTPARIAAAFSV

SEQ ID NO: 166528 - protein, 13 aa, Mycobacterium tuberculosis
STPARIAAAFSVA

SEQ ID NO: 166529 - protein, 13 aa, Mycobacterium tuberculosis
TPARIAAAFSVAL

SEQ ID NO: 166530 - protein, 13 aa, Mycobacterium tuberculosis
PARIAAAFSVALA

SEQ ID NO: 166531 - protein, 13 aa, Mycobacterium tuberculosis
ARIAAAFSVALAA

SEQ ID NO: 166532 - protein, 13 aa, Mycobacterium tuberculosis
RIAAAFSVALAAL

SEQ ID NO: 166533 - protein, 13 aa, Mycobacterium tuberculosis
IAAAFSVALAALA

SEQ ID NO: 166534 - protein, 13 aa, Mycobacterium tuberculosis
AAAFSVALAALAV

SEQ ID NO: 166535 - protein, 13 aa, Mycobacterium tuberculosis
AAFSVALAALAVQ

SEQ ID NO: 166536 - protein, 13 aa, Mycobacterium tuberculosis
AFSVALAALAVQL

SEQ ID NO: 166537 - protein, 13 aa, Mycobacterium tuberculosis
FSVALAALAVQLI

SEQ ID NO: 166538 - protein, 13 aa, Mycobacterium tuberculosis
SVALAALAVQLIA

SEQ ID NO: 166539 - protein, 13 aa, Mycobacterium tuberculosis
VALAALAVQLIAV

SEQ ID NO: 166540 - protein, 13 aa, Mycobacterium tuberculosis
ALAALAVQLIAVR

SEQ ID NO: 166541 - protein, 13 aa, Mycobacterium tuberculosis
LAALAVQLIAVRP

SEQ ID NO: 166542 - protein, 13 aa, Mycobacterium tuberculosis
AALAVQLIAVRPR

SEQ ID NO: 166543 - protein, 13 aa, Mycobacterium tuberculosis
ALAVQLIAVRPRL

SEQ ID NO: 166544 - protein, 13 aa, Mycobacterium tuberculosis
LAVQLIAVRPRLT

SEQ ID NO: 166545 - protein, 13 aa, Mycobacterium tuberculosis
AVQLIAVRPRLTR

SEQ ID NO: 166546 - protein, 13 aa, Mycobacterium tuberculosis
VQLIAVRPRLTRR

SEQ ID NO: 166547 - protein, 13 aa, Mycobacterium tuberculosis
QLIAVRPRLTRRS

SEQ ID NO: 166548 - protein, 13 aa, Mycobacterium tuberculosis
LIAVRPRLTRRSN

SEQ ID NO: 166549 - protein, 13 aa, Mycobacterium tuberculosis
IAVRPRLTRRSNQ

SEQ ID NO: 166550 - protein, 13 aa, Mycobacterium tuberculosis
AVRPRLTRRSNQV

SEQ ID NO: 166551 - protein, 13 aa, Mycobacterium tuberculosis
VRPRLTRRSNQVL

SEQ ID NO: 166552 - protein, 13 aa, Mycobacterium tuberculosis
RPRLTRRSNQVLA

SEQ ID NO: 166553 - protein, 13 aa, Mycobacterium tuberculosis
PRLTRRSNQVLAG

SEQ ID NO: 166554 - protein, 13 aa, Mycobacterium tuberculosis
RLTRRSNQVLAGL

SEQ ID NO: 166555 - protein, 13 aa, Mycobacterium tuberculosis
LTRRSNQVLAGLQ

SEQ ID NO: 166556 - protein, 13 aa, Mycobacterium tuberculosis
TRRSNQVLAGLQA

SEQ ID NO: 166557 - protein, 13 aa, Mycobacterium tuberculosis
RRSNQVLAGLQAP

SEQ ID NO: 166558 - protein, 13 aa, Mycobacterium tuberculosis
RSNQVLAGLQAPR

SEQ ID NO: 166559 - protein, 13 aa, Mycobacterium tuberculosis
SNQVLAGLQAPRS

SEQ ID NO: 166560 - protein, 13 aa, Mycobacterium tuberculosis
NQVLAGLQAPRSR

SEQ ID NO: 166561 - protein, 13 aa, Mycobacterium tuberculosis
QVLAGLQAPRSRG

SEQ ID NO: 166562 - protein, 13 aa, Mycobacterium tuberculosis
VLAGLQAPRSRGH

SEQ ID NO: 166563 - protein, 13 aa, Mycobacterium tuberculosis
LAGLQAPRSRGHH

SEQ ID NO: 166564 - protein, 13 aa, Mycobacterium tuberculosis
AGLQAPRSRGHHI

SEQ ID NO: 166565 - protein, 13 aa, Mycobacterium tuberculosis
GLQAPRSRGHHIY

SEQ ID NO: 166566 - protein, 13 aa, Mycobacterium tuberculosis
LQAPRSRGHHIYV

SEQ ID NO: 166567 - protein, 13 aa, Mycobacterium tuberculosis
QAPRSRGHHIYVG

SEQ ID NO: 166568 - protein, 13 aa, Mycobacterium tuberculosis
APRSRGHHIYVGL

SEQ ID NO: 166569 - protein, 13 aa, Mycobacterium tuberculosis
PRSRGHHIYVGLE

SEQ ID NO: 166570 - protein, 13 aa, Mycobacterium tuberculosis
RSRGHHIYVGLEI

SEQ ID NO: 166571 - protein, 13 aa, Mycobacterium tuberculosis
SRGHHIYVGLEIV

SEQ ID NO: 166572 - protein, 13 aa, Mycobacterium tuberculosis
RGHHIYVGLEIVK

SEQ ID NO: 166573 - protein, 13 aa, Mycobacterium tuberculosis
GHHIYVGLEIVKV

SEQ ID NO: 166574 - protein, 13 aa, Mycobacterium tuberculosis
HHIYVGLEIVKVV

SEQ ID NO: 166575 - protein, 13 aa, Mycobacterium tuberculosis
HIYVGLEIVKVVA

SEQ ID NO: 166576 - protein, 13 aa, Mycobacterium tuberculosis
IYVGLEIVKVVAL

SEQ ID NO: 166577 - protein, 13 aa, Mycobacterium tuberculosis
YVGLEIVKVVALL

SEQ ID NO: 166578 - protein, 13 aa, Mycobacterium tuberculosis
VGLEIVKVVALLV

SEQ ID NO: 166579 - protein, 13 aa, Mycobacterium tuberculosis
GLEIVKVVALLVA

SEQ ID NO: 166580 - protein, 13 aa, Mycobacterium tuberculosis
LEIVKVVALLVAG

SEQ ID NO: 166581 - protein, 13 aa, Mycobacterium tuberculosis
EIVKVVALLVAGI

SEQ ID NO: 166582 - protein, 13 aa, Mycobacterium tuberculosis
IVKVVALLVAGIL

SEQ ID NO: 166583 - protein, 13 aa, Mycobacterium tuberculosis
VKVVALLVAGILL

SEQ ID NO: 166584 - protein, 13 aa, Mycobacterium tuberculosis
KVVALLVAGILLL

SEQ ID NO: 166585 - protein, 13 aa, Mycobacterium tuberculosis
VVALLVAGILLLN

SEQ ID NO: 166586 - protein, 13 aa, Mycobacterium tuberculosis
VALLVAGILLLNG

SEQ ID NO: 166587 - protein, 14 aa, Mycobacterium tuberculosis
MSAGPAIEVAVAFV

SEQ ID NO: 166588 - protein, 14 aa, Mycobacterium tuberculosis
SAGPAIEVAVAFVW

SEQ ID NO: 166589 - protein, 14 aa, Mycobacterium tuberculosis
AGPAIEVAVAFVWL

SEQ ID NO: 166590 - protein, 14 aa, Mycobacterium tuberculosis
GPAIEVAVAFVWLG

SEQ ID NO: 166591 - protein, 14 aa, Mycobacterium tuberculosis
PAIEVAVAFVWLGM

SEQ ID NO: 166592 - protein, 14 aa, Mycobacterium tuberculosis
AIEVAVAFVWLGMV

SEQ ID NO: 166593 - protein, 14 aa, Mycobacterium tuberculosis
IEVAVAFVWLGMVV

SEQ ID NO: 166594 - protein, 14 aa, Mycobacterium tuberculosis
EVAVAFVWLGMVVA

SEQ ID NO: 166595 - protein, 14 aa, Mycobacterium tuberculosis
VAVAFVWLGMVVAI

SEQ ID NO: 166596 - protein, 14 aa, Mycobacterium tuberculosis
AVAFVWLGMVVAIS

SEQ ID NO: 166597 - protein, 14 aa, Mycobacterium tuberculosis
VAFVWLGMVVAISF

SEQ ID NO: 166598 - protein, 14 aa, Mycobacterium tuberculosis
AFVWLGMVVAISFL

SEQ ID NO: 166599 - protein, 14 aa, Mycobacterium tuberculosis
FVWLGMVVAISFLE

SEQ ID NO: 166600 - protein, 14 aa, Mycobacterium tuberculosis
VWLGMVVAISFLEA

SEQ ID NO: 166601 - protein, 14 aa, Mycobacterium tuberculosis
WLGMVVAISFLEAP

SEQ ID NO: 166602 - protein, 14 aa, Mycobacterium tuberculosis
LGMVVAISFLEAPL

SEQ ID NO: 166603 - protein, 14 aa, Mycobacterium tuberculosis
GMVVAISFLEAPLK

SEQ ID NO: 166604 - protein, 14 aa, Mycobacterium tuberculosis
MVVAISFLEAPLKF

SEQ ID NO: 166605 - protein, 14 aa, Mycobacterium tuberculosis
VVAISFLEAPLKFR

SEQ ID NO: 166606 - protein, 14 aa, Mycobacterium tuberculosis
VAISFLEAPLKFRA

SEQ ID NO: 166607 - protein, 14 aa, Mycobacterium tuberculosis
AISFLEAPLKFRAA

SEQ ID NO: 166608 - protein, 14 aa, Mycobacterium tuberculosis
ISFLEAPLKFRAAG

SEQ ID NO: 166609 - protein, 14 aa, Mycobacterium tuberculosis
SFLEAPLKFRAAGV

SEQ ID NO: 166610 - protein, 14 aa, Mycobacterium tuberculosis
FLEAPLKFRAAGVT

SEQ ID NO: 166611 - protein, 14 aa, Mycobacterium tuberculosis
LEAPLKFRAAGVTL

SEQ ID NO: 166612 - protein, 14 aa, Mycobacterium tuberculosis
EAPLKFRAAGVTLQ

SEQ ID NO: 166613 - protein, 14 aa, Mycobacterium tuberculosis
APLKFRAAGVTLQI

SEQ ID NO: 166614 - protein, 14 aa, Mycobacterium tuberculosis
PLKFRAAGVTLQIG

SEQ ID NO: 166615 - protein, 14 aa, Mycobacterium tuberculosis
LKFRAAGVTLQIGL

SEQ ID NO: 166616 - protein, 14 aa, Mycobacterium tuberculosis
KFRAAGVTLQIGLG

SEQ ID NO: 166617 - protein, 14 aa, Mycobacterium tuberculosis
FRAAGVTLQIGLGI

SEQ ID NO: 166618 - protein, 14 aa, Mycobacterium tuberculosis
RAAGVTLQIGLGIG

SEQ ID NO: 166619 - protein, 14 aa, Mycobacterium tuberculosis
AAGVTLQIGLGIGR

SEQ ID NO: 166620 - protein, 14 aa, Mycobacterium tuberculosis
AGVTLQIGLGIGRL

SEQ ID NO: 166621 - protein, 14 aa, Mycobacterium tuberculosis
GVTLQIGLGIGRLV

SEQ ID NO: 166622 - protein, 14 aa, Mycobacterium tuberculosis
VTLQIGLGIGRLVF

SEQ ID NO: 166623 - protein, 14 aa, Mycobacterium tuberculosis
TLQIGLGIGRLVFR

SEQ ID NO: 166624 - protein, 14 aa, Mycobacterium tuberculosis
LQIGLGIGRLVFRA

SEQ ID NO: 166625 - protein, 14 aa, Mycobacterium tuberculosis
QIGLGIGRLVFRAL

SEQ ID NO: 166626 - protein, 14 aa, Mycobacterium tuberculosis
IGLGIGRLVFRALN

SEQ ID NO: 166627 - protein, 14 aa, Mycobacterium tuberculosis
GLGIGRLVFRALNT

SEQ ID NO: 166628 - protein, 14 aa, Mycobacterium tuberculosis
LGIGRLVFRALNTV

SEQ ID NO: 166629 - protein, 14 aa, Mycobacterium tuberculosis
GIGRLVFRALNTVE

SEQ ID NO: 166630 - protein, 14 aa, Mycobacterium tuberculosis
IGRLVFRALNTVEV

SEQ ID NO: 166631 - protein, 14 aa, Mycobacterium tuberculosis
GRLVFRALNTVEVG

SEQ ID NO: 166632 - protein, 14 aa, Mycobacterium tuberculosis
RLVFRALNTVEVGF

SEQ ID NO: 166633 - protein, 14 aa, Mycobacterium tuberculosis
LVFRALNTVEVGFA

SEQ ID NO: 166634 - protein, 14 aa, Mycobacterium tuberculosis
VFRALNTVEVGFAL

SEQ ID NO: 166635 - protein, 14 aa, Mycobacterium tuberculosis
FRALNTVEVGFALV

SEQ ID NO: 166636 - protein, 14 aa, Mycobacterium tuberculosis
RALNTVEVGFALVI

SEQ ID NO: 166637 - protein, 14 aa, Mycobacterium tuberculosis
ALNTVEVGFALVIL

SEQ ID NO: 166638 - protein, 14 aa, Mycobacterium tuberculosis
LNTVEVGFALVILA

SEQ ID NO: 166639 - protein, 14 aa, Mycobacterium tuberculosis
NTVEVGFALVILAI

SEQ ID NO: 166640 - protein, 14 aa, Mycobacterium tuberculosis
TVEVGFALVILAIV

SEQ ID NO: 166641 - protein, 14 aa, Mycobacterium tuberculosis
VEVGFALVILAIVV

SEQ ID NO: 166642 - protein, 14 aa, Mycobacterium tuberculosis
EVGFALVILAIVVV

SEQ ID NO: 166643 - protein, 14 aa, Mycobacterium tuberculosis
VGFALVILAIVVVG

SEQ ID NO: 166644 - protein, 14 aa, Mycobacterium tuberculosis
GFALVILAIVVVGS

SEQ ID NO: 166645 - protein, 14 aa, Mycobacterium tuberculosis
FALVILAIVVVGST

SEQ ID NO: 166646 - protein, 14 aa, Mycobacterium tuberculosis
ALVILAIVVVGSTP

SEQ ID NO: 166647 - protein, 14 aa, Mycobacterium tuberculosis
LVILAIVVVGSTPA

SEQ ID NO: 166648 - protein, 14 aa, Mycobacterium tuberculosis
VILAIVVVGSTPAR

SEQ ID NO: 166649 - protein, 14 aa, Mycobacterium tuberculosis
ILAIVVVGSTPARI

SEQ ID NO: 166650 - protein, 14 aa, Mycobacterium tuberculosis
LAIVVVGSTPARIA

SEQ ID NO: 166651 - protein, 14 aa, Mycobacterium tuberculosis
AIVVVGSTPARIAA

SEQ ID NO: 166652 - protein, 14 aa, Mycobacterium tuberculosis
IVVVGSTPARIAAA

SEQ ID NO: 166653 - protein, 14 aa, Mycobacterium tuberculosis
VVVGSTPARIAAAF

SEQ ID NO: 166654 - protein, 14 aa, Mycobacterium tuberculosis
VVGSTPARIAAAFS

SEQ ID NO: 166655 - protein, 14 aa, Mycobacterium tuberculosis
VGSTPARIAAAFSV

SEQ ID NO: 166656 - protein, 14 aa, Mycobacterium tuberculosis
GSTPARIAAAFSVA

SEQ ID NO: 166657 - protein, 14 aa, Mycobacterium tuberculosis
STPARIAAAFSVAL

SEQ ID NO: 166658 - protein, 14 aa, Mycobacterium tuberculosis
TPARIAAAFSVALA

SEQ ID NO: 166659 - protein, 14 aa, Mycobacterium tuberculosis
PARIAAAFSVALAA

SEQ ID NO: 166660 - protein, 14 aa, Mycobacterium tuberculosis
ARIAAAFSVALAAL

SEQ ID NO: 166661 - protein, 14 aa, Mycobacterium tuberculosis
RIAAAFSVALAALA

SEQ ID NO: 166662 - protein, 14 aa, Mycobacterium tuberculosis
IAAAFSVALAALAV

SEQ ID NO: 166663 - protein, 14 aa, Mycobacterium tuberculosis
AAAFSVALAALAVQ

SEQ ID NO: 166664 - protein, 14 aa, Mycobacterium tuberculosis
AAFSVALAALAVQL

SEQ ID NO: 166665 - protein, 14 aa, Mycobacterium tuberculosis
AFSVALAALAVQLI

SEQ ID NO: 166666 - protein, 14 aa, Mycobacterium tuberculosis
FSVALAALAVQLIA

SEQ ID NO: 166667 - protein, 14 aa, Mycobacterium tuberculosis
SVALAALAVQLIAV

SEQ ID NO: 166668 - protein, 14 aa, Mycobacterium tuberculosis
VALAALAVQLIAVR

SEQ ID NO: 166669 - protein, 14 aa, Mycobacterium tuberculosis
ALAALAVQLIAVRP

SEQ ID NO: 166670 - protein, 14 aa, Mycobacterium tuberculosis
LAALAVQLIAVRPR

SEQ ID NO: 166671 - protein, 14 aa, Mycobacterium tuberculosis
AALAVQLIAVRPRL

SEQ ID NO: 166672 - protein, 14 aa, Mycobacterium tuberculosis
ALAVQLIAVRPRLT

SEQ ID NO: 166673 - protein, 14 aa, Mycobacterium tuberculosis
LAVQLIAVRPRLTR

SEQ ID NO: 166674 - protein, 14 aa, Mycobacterium tuberculosis
AVQLIAVRPRLTRR

SEQ ID NO: 166675 - protein, 14 aa, Mycobacterium tuberculosis
VQLIAVRPRLTRRS

SEQ ID NO: 166676 - protein, 14 aa, Mycobacterium tuberculosis
QLIAVRPRLTRRSN

SEQ ID NO: 166677 - protein, 14 aa, Mycobacterium tuberculosis
LIAVRPRLTRRSNQ

SEQ ID NO: 166678 - protein, 14 aa, Mycobacterium tuberculosis
IAVRPRLTRRSNQV

SEQ ID NO: 166679 - protein, 14 aa, Mycobacterium tuberculosis
AVRPRLTRRSNQVL

SEQ ID NO: 166680 - protein, 14 aa, Mycobacterium tuberculosis
VRPRLTRRSNQVLA

SEQ ID NO: 166681 - protein, 14 aa, Mycobacterium tuberculosis
RPRLTRRSNQVLAG

SEQ ID NO: 166682 - protein, 14 aa, Mycobacterium tuberculosis
PRLTRRSNQVLAGL

SEQ ID NO: 166683 - protein, 14 aa, Mycobacterium tuberculosis
RLTRRSNQVLAGLQ

SEQ ID NO: 166684 - protein, 14 aa, Mycobacterium tuberculosis
LTRRSNQVLAGLQA

SEQ ID NO: 166685 - protein, 14 aa, Mycobacterium tuberculosis
TRRSNQVLAGLQAP

SEQ ID NO: 166686 - protein, 14 aa, Mycobacterium tuberculosis
RRSNQVLAGLQAPR

SEQ ID NO: 166687 - protein, 14 aa, Mycobacterium tuberculosis
RSNQVLAGLQAPRS

SEQ ID NO: 166688 - protein, 14 aa, Mycobacterium tuberculosis
SNQVLAGLQAPRSR

SEQ ID NO: 166689 - protein, 14 aa, Mycobacterium tuberculosis
NQVLAGLQAPRSRG

SEQ ID NO: 166690 - protein, 14 aa, Mycobacterium tuberculosis
QVLAGLQAPRSRGH

SEQ ID NO: 166691 - protein, 14 aa, Mycobacterium tuberculosis
VLAGLQAPRSRGHH

SEQ ID NO: 166692 - protein, 14 aa, Mycobacterium tuberculosis
LAGLQAPRSRGHHI

SEQ ID NO: 166693 - protein, 14 aa, Mycobacterium tuberculosis
AGLQAPRSRGHHIY

SEQ ID NO: 166694 - protein, 14 aa, Mycobacterium tuberculosis
GLQAPRSRGHHIYV

SEQ ID NO: 166695 - protein, 14 aa, Mycobacterium tuberculosis
LQAPRSRGHHIYVG

SEQ ID NO: 166696 - protein, 14 aa, Mycobacterium tuberculosis
QAPRSRGHHIYVGL

SEQ ID NO: 166697 - protein, 14 aa, Mycobacterium tuberculosis
APRSRGHHIYVGLE

SEQ ID NO: 166698 - protein, 14 aa, Mycobacterium tuberculosis
PRSRGHHIYVGLEI

SEQ ID NO: 166699 - protein, 14 aa, Mycobacterium tuberculosis
RSRGHHIYVGLEIV

SEQ ID NO: 166700 - protein, 14 aa, Mycobacterium tuberculosis
SRGHHIYVGLEIVK

SEQ ID NO: 166701 - protein, 14 aa, Mycobacterium tuberculosis
RGHHIYVGLEIVKV

SEQ ID NO: 166702 - protein, 14 aa, Mycobacterium tuberculosis
GHHIYVGLEIVKVV

SEQ ID NO: 166703 - protein, 14 aa, Mycobacterium tuberculosis
HHIYVGLEIVKVVA

SEQ ID NO: 166704 - protein, 14 aa, Mycobacterium tuberculosis
HIYVGLEIVKVVAL

SEQ ID NO: 166705 - protein, 14 aa, Mycobacterium tuberculosis
IYVGLEIVKVVALL

SEQ ID NO: 166706 - protein, 14 aa, Mycobacterium tuberculosis
YVGLEIVKVVALLV

SEQ ID NO: 166707 - protein, 14 aa, Mycobacterium tuberculosis
VGLEIVKVVALLVA

SEQ ID NO: 166708 - protein, 14 aa, Mycobacterium tuberculosis
GLEIVKVVALLVAG

SEQ ID NO: 166709 - protein, 14 aa, Mycobacterium tuberculosis
LEIVKVVALLVAGI

SEQ ID NO: 166710 - protein, 14 aa, Mycobacterium tuberculosis
EIVKVVALLVAGIL

SEQ ID NO: 166711 - protein, 14 aa, Mycobacterium tuberculosis
IVKVVALLVAGILL

SEQ ID NO: 166712 - protein, 14 aa, Mycobacterium tuberculosis
VKVVALLVAGILLL

SEQ ID NO: 166713 - protein, 14 aa, Mycobacterium tuberculosis
KVVALLVAGILLLN

SEQ ID NO: 166714 - protein, 14 aa, Mycobacterium tuberculosis
VVALLVAGILLLNG

SEQ ID NO: 166715 - protein, 15 aa, Mycobacterium tuberculosis
MSAGPAIEVAVAFVW

SEQ ID NO: 166716 - protein, 15 aa, Mycobacterium tuberculosis
SAGPAIEVAVAFVWL

SEQ ID NO: 166717 - protein, 15 aa, Mycobacterium tuberculosis
AGPAIEVAVAFVWLG

SEQ ID NO: 166718 - protein, 15 aa, Mycobacterium tuberculosis
GPAIEVAVAFVWLGM

SEQ ID NO: 166719 - protein, 15 aa, Mycobacterium tuberculosis
PAIEVAVAFVWLGMV

SEQ ID NO: 166720 - protein, 15 aa, Mycobacterium tuberculosis
AIEVAVAFVWLGMVV

SEQ ID NO: 166721 - protein, 15 aa, Mycobacterium tuberculosis
IEVAVAFVWLGMVVA

SEQ ID NO: 166722 - protein, 15 aa, Mycobacterium tuberculosis
EVAVAFVWLGMVVAI

SEQ ID NO: 166723 - protein, 15 aa, Mycobacterium tuberculosis
VAVAFVWLGMVVAIS

SEQ ID NO: 166724 - protein, 15 aa, Mycobacterium tuberculosis
AVAFVWLGMVVAISF

SEQ ID NO: 166725 - protein, 15 aa, Mycobacterium tuberculosis
VAFVWLGMVVAISFL

SEQ ID NO: 166726 - protein, 15 aa, Mycobacterium tuberculosis
AFVWLGMVVAISFLE

SEQ ID NO: 166727 - protein, 15 aa, Mycobacterium tuberculosis
FVWLGMVVAISFLEA

SEQ ID NO: 166728 - protein, 15 aa, Mycobacterium tuberculosis
VWLGMVVAISFLEAP

SEQ ID NO: 166729 - protein, 15 aa, Mycobacterium tuberculosis
WLGMVVAISFLEAPL

SEQ ID NO: 166730 - protein, 15 aa, Mycobacterium tuberculosis
LGMVVAISFLEAPLK

SEQ ID NO: 166731 - protein, 15 aa, Mycobacterium tuberculosis
GMVVAISFLEAPLKF

SEQ ID NO: 166732 - protein, 15 aa, Mycobacterium tuberculosis
MVVAISFLEAPLKFR

SEQ ID NO: 166733 - protein, 15 aa, Mycobacterium tuberculosis
VVAISFLEAPLKFRA

SEQ ID NO: 166734 - protein, 15 aa, Mycobacterium tuberculosis
VAISFLEAPLKFRAA

SEQ ID NO: 166735 - protein, 15 aa, Mycobacterium tuberculosis
AISFLEAPLKFRAAG

SEQ ID NO: 166736 - protein, 15 aa, Mycobacterium tuberculosis
ISFLEAPLKFRAAGV

SEQ ID NO: 166737 - protein, 15 aa, Mycobacterium tuberculosis
SFLEAPLKFRAAGVT

SEQ ID NO: 166738 - protein, 15 aa, Mycobacterium tuberculosis
FLEAPLKFRAAGVTL

SEQ ID NO: 166739 - protein, 15 aa, Mycobacterium tuberculosis
LEAPLKFRAAGVTLQ

SEQ ID NO: 166740 - protein, 15 aa, Mycobacterium tuberculosis
EAPLKFRAAGVTLQI

SEQ ID NO: 166741 - protein, 15 aa, Mycobacterium tuberculosis
APLKFRAAGVTLQIG

SEQ ID NO: 166742 - protein, 15 aa, Mycobacterium tuberculosis
PLKFRAAGVTLQIGL

SEQ ID NO: 166743 - protein, 15 aa, Mycobacterium tuberculosis
LKFRAAGVTLQIGLG

SEQ ID NO: 166744 - protein, 15 aa, Mycobacterium tuberculosis
KFRAAGVTLQIGLGI

SEQ ID NO: 166745 - protein, 15 aa, Mycobacterium tuberculosis
FRAAGVTLQIGLGIG

SEQ ID NO: 166746 - protein, 15 aa, Mycobacterium tuberculosis
RAAGVTLQIGLGIGR

SEQ ID NO: 166747 - protein, 15 aa, Mycobacterium tuberculosis
AAGVTLQIGLGIGRL

SEQ ID NO: 166748 - protein, 15 aa, Mycobacterium tuberculosis
AGVTLQIGLGIGRLV

SEQ ID NO: 166749 - protein, 15 aa, Mycobacterium tuberculosis
GVTLQIGLGIGRLVF

SEQ ID NO: 166750 - protein, 15 aa, Mycobacterium tuberculosis
VTLQIGLGIGRLVFR

SEQ ID NO: 166751 - protein, 15 aa, Mycobacterium tuberculosis
TLQIGLGIGRLVFRA

SEQ ID NO: 166752 - protein, 15 aa, Mycobacterium tuberculosis
LQIGLGIGRLVFRAL

SEQ ID NO: 166753 - protein, 15 aa, Mycobacterium tuberculosis
QIGLGIGRLVFRALN

SEQ ID NO: 166754 - protein, 15 aa, Mycobacterium tuberculosis
IGLGIGRLVFRALNT

SEQ ID NO: 166755 - protein, 15 aa, Mycobacterium tuberculosis
GLGIGRLVFRALNTV

SEQ ID NO: 166756 - protein, 15 aa, Mycobacterium tuberculosis
LGIGRLVFRALNTVE

SEQ ID NO: 166757 - protein, 15 aa, Mycobacterium tuberculosis
GIGRLVFRALNTVEV

SEQ ID NO: 166758 - protein, 15 aa, Mycobacterium tuberculosis
IGRLVFRALNTVEVG

SEQ ID NO: 166759 - protein, 15 aa, Mycobacterium tuberculosis
GRLVFRALNTVEVGF

SEQ ID NO: 166760 - protein, 15 aa, Mycobacterium tuberculosis
RLVFRALNTVEVGFA

SEQ ID NO: 166761 - protein, 15 aa, Mycobacterium tuberculosis
LVFRALNTVEVGFAL

SEQ ID NO: 166762 - protein, 15 aa, Mycobacterium tuberculosis
VFRALNTVEVGFALV

SEQ ID NO: 166763 - protein, 15 aa, Mycobacterium tuberculosis
FRALNTVEVGFALVI

SEQ ID NO: 166764 - protein, 15 aa, Mycobacterium tuberculosis
RALNTVEVGFALVIL

SEQ ID NO: 166765 - protein, 15 aa, Mycobacterium tuberculosis
ALNTVEVGFALVILA

SEQ ID NO: 166766 - protein, 15 aa, Mycobacterium tuberculosis
LNTVEVGFALVILAI

SEQ ID NO: 166767 - protein, 15 aa, Mycobacterium tuberculosis
NTVEVGFALVILAIV

SEQ ID NO: 166768 - protein, 15 aa, Mycobacterium tuberculosis
TVEVGFALVILAIVV

SEQ ID NO: 166769 - protein, 15 aa, Mycobacterium tuberculosis
VEVGFALVILAIVVV

SEQ ID NO: 166770 - protein, 15 aa, Mycobacterium tuberculosis
EVGFALVILAIVVVG

SEQ ID NO: 166771 - protein, 15 aa, Mycobacterium tuberculosis
VGFALVILAIVVVGS

SEQ ID NO: 166772 - protein, 15 aa, Mycobacterium tuberculosis
GFALVILAIVVVGST

SEQ ID NO: 166773 - protein, 15 aa, Mycobacterium tuberculosis
FALVILAIVVVGSTP

SEQ ID NO: 166774 - protein, 15 aa, Mycobacterium tuberculosis
ALVILAIVVVGSTPA

SEQ ID NO: 166775 - protein, 15 aa, Mycobacterium tuberculosis
LVILAIVVVGSTPAR

SEQ ID NO: 166776 - protein, 15 aa, Mycobacterium tuberculosis
VILAIVVVGSTPARI

SEQ ID NO: 166777 - protein, 15 aa, Mycobacterium tuberculosis
ILAIVVVGSTPARIA

SEQ ID NO: 166778 - protein, 15 aa, Mycobacterium tuberculosis
LAIVVVGSTPARIAA

SEQ ID NO: 166779 - protein, 15 aa, Mycobacterium tuberculosis
AIVVVGSTPARIAAA

SEQ ID NO: 166780 - protein, 15 aa, Mycobacterium tuberculosis
IVVVGSTPARIAAAF

SEQ ID NO: 166781 - protein, 15 aa, Mycobacterium tuberculosis
VVVGSTPARIAAAFS

SEQ ID NO: 166782 - protein, 15 aa, Mycobacterium tuberculosis
VVGSTPARIAAAFSV

SEQ ID NO: 166783 - protein, 15 aa, Mycobacterium tuberculosis
VGSTPARIAAAFSVA

SEQ ID NO: 166784 - protein, 15 aa, Mycobacterium tuberculosis
GSTPARIAAAFSVAL

SEQ ID NO: 166785 - protein, 15 aa, Mycobacterium tuberculosis
STPARIAAAFSVALA

SEQ ID NO: 166786 - protein, 15 aa, Mycobacterium tuberculosis
TPARIAAAFSVALAA

SEQ ID NO: 166787 - protein, 15 aa, Mycobacterium tuberculosis
PARIAAAFSVALAAL

SEQ ID NO: 166788 - protein, 15 aa, Mycobacterium tuberculosis
ARIAAAFSVALAALA

SEQ ID NO: 166789 - protein, 15 aa, Mycobacterium tuberculosis
RIAAAFSVALAALAV

SEQ ID NO: 166790 - protein, 15 aa, Mycobacterium tuberculosis
IAAAFSVALAALAVQ

SEQ ID NO: 166791 - protein, 15 aa, Mycobacterium tuberculosis
AAAFSVALAALAVQL

SEQ ID NO: 166792 - protein, 15 aa, Mycobacterium tuberculosis
AAFSVALAALAVQLI

SEQ ID NO: 166793 - protein, 15 aa, Mycobacterium tuberculosis
AFSVALAALAVQLIA

SEQ ID NO: 166794 - protein, 15 aa, Mycobacterium tuberculosis
FSVALAALAVQLIAV

SEQ ID NO: 166795 - protein, 15 aa, Mycobacterium tuberculosis
SVALAALAVQLIAVR

SEQ ID NO: 166796 - protein, 15 aa, Mycobacterium tuberculosis
VALAALAVQLIAVRP

SEQ ID NO: 166797 - protein, 15 aa, Mycobacterium tuberculosis
ALAALAVQLIAVRPR

SEQ ID NO: 166798 - protein, 15 aa, Mycobacterium tuberculosis
LAALAVQLIAVRPRL

SEQ ID NO: 166799 - protein, 15 aa, Mycobacterium tuberculosis
AALAVQLIAVRPRLT

SEQ ID NO: 166800 - protein, 15 aa, Mycobacterium tuberculosis
ALAVQLIAVRPRLTR

SEQ ID NO: 166801 - protein, 15 aa, Mycobacterium tuberculosis
LAVQLIAVRPRLTRR

SEQ ID NO: 166802 - protein, 15 aa, Mycobacterium tuberculosis
AVQLIAVRPRLTRRS

SEQ ID NO: 166803 - protein, 15 aa, Mycobacterium tuberculosis
VQLIAVRPRLTRRSN

SEQ ID NO: 166804 - protein, 15 aa, Mycobacterium tuberculosis
QLIAVRPRLTRRSNQ

SEQ ID NO: 166805 - protein, 15 aa, Mycobacterium tuberculosis
LIAVRPRLTRRSNQV

SEQ ID NO: 166806 - protein, 15 aa, Mycobacterium tuberculosis
IAVRPRLTRRSNQVL

SEQ ID NO: 166807 - protein, 15 aa, Mycobacterium tuberculosis
AVRPRLTRRSNQVLA

SEQ ID NO: 166808 - protein, 15 aa, Mycobacterium tuberculosis
VRPRLTRRSNQVLAG

SEQ ID NO: 166809 - protein, 15 aa, Mycobacterium tuberculosis
RPRLTRRSNQVLAGL

SEQ ID NO: 166810 - protein, 15 aa, Mycobacterium tuberculosis
PRLTRRSNQVLAGLQ

SEQ ID NO: 166811 - protein, 15 aa, Mycobacterium tuberculosis
RLTRRSNQVLAGLQA

SEQ ID NO: 166812 - protein, 15 aa, Mycobacterium tuberculosis
LTRRSNQVLAGLQAP

SEQ ID NO: 166813 - protein, 15 aa, Mycobacterium tuberculosis
TRRSNQVLAGLQAPR

SEQ ID NO: 166814 - protein, 15 aa, Mycobacterium tuberculosis
RRSNQVLAGLQAPRS

SEQ ID NO: 166815 - protein, 15 aa, Mycobacterium tuberculosis
RSNQVLAGLQAPRSR

SEQ ID NO: 166816 - protein, 15 aa, Mycobacterium tuberculosis
SNQVLAGLQAPRSRG

SEQ ID NO: 166817 - protein, 15 aa, Mycobacterium tuberculosis
NQVLAGLQAPRSRGH

SEQ ID NO: 166818 - protein, 15 aa, Mycobacterium tuberculosis
QVLAGLQAPRSRGHH

SEQ ID NO: 166819 - protein, 15 aa, Mycobacterium tuberculosis
VLAGLQAPRSRGHHI

SEQ ID NO: 166820 - protein, 15 aa, Mycobacterium tuberculosis
LAGLQAPRSRGHHIY

SEQ ID NO: 166821 - protein, 15 aa, Mycobacterium tuberculosis
AGLQAPRSRGHHIYV

SEQ ID NO: 166822 - protein, 15 aa, Mycobacterium tuberculosis
GLQAPRSRGHHIYVG

SEQ ID NO: 166823 - protein, 15 aa, Mycobacterium tuberculosis
LQAPRSRGHHIYVGL

SEQ ID NO: 166824 - protein, 15 aa, Mycobacterium tuberculosis
QAPRSRGHHIYVGLE

SEQ ID NO: 166825 - protein, 15 aa, Mycobacterium tuberculosis
APRSRGHHIYVGLEI

SEQ ID NO: 166826 - protein, 15 aa, Mycobacterium tuberculosis
PRSRGHHIYVGLEIV

SEQ ID NO: 166827 - protein, 15 aa, Mycobacterium tuberculosis
RSRGHHIYVGLEIVK

SEQ ID NO: 166828 - protein, 15 aa, Mycobacterium tuberculosis
SRGHHIYVGLEIVKV

SEQ ID NO: 166829 - protein, 15 aa, Mycobacterium tuberculosis
RGHHIYVGLEIVKVV

SEQ ID NO: 166830 - protein, 15 aa, Mycobacterium tuberculosis
GHHIYVGLEIVKVVA

SEQ ID NO: 166831 - protein, 15 aa, Mycobacterium tuberculosis
HHIYVGLEIVKVVAL

SEQ ID NO: 166832 - protein, 15 aa, Mycobacterium tuberculosis
HIYVGLEIVKVVALL

SEQ ID NO: 166833 - protein, 15 aa, Mycobacterium tuberculosis
IYVGLEIVKVVALLV

SEQ ID NO: 166834 - protein, 15 aa, Mycobacterium tuberculosis
YVGLEIVKVVALLVA

SEQ ID NO: 166835 - protein, 15 aa, Mycobacterium tuberculosis
VGLEIVKVVALLVAG

SEQ ID NO: 166836 - protein, 15 aa, Mycobacterium tuberculosis
GLEIVKVVALLVAGI

SEQ ID NO: 166837 - protein, 15 aa, Mycobacterium tuberculosis
LEIVKVVALLVAGIL

SEQ ID NO: 166838 - protein, 15 aa, Mycobacterium tuberculosis
EIVKVVALLVAGILL

SEQ ID NO: 166839 - protein, 15 aa, Mycobacterium tuberculosis
IVKVVALLVAGILLL

SEQ ID NO: 166840 - protein, 15 aa, Mycobacterium tuberculosis
VKVVALLVAGILLLN

SEQ ID NO: 166841 - protein, 15 aa, Mycobacterium tuberculosis
KVVALLVAGILLLNG

SEQ ID NO: 166842 - protein, 16 aa, Mycobacterium tuberculosis
MSAGPAIEVAVAFVWL

SEQ ID NO: 166843 - protein, 16 aa, Mycobacterium tuberculosis
SAGPAIEVAVAFVWLG

SEQ ID NO: 166844 - protein, 16 aa, Mycobacterium tuberculosis
AGPAIEVAVAFVWLGM

SEQ ID NO: 166845 - protein, 16 aa, Mycobacterium tuberculosis
GPAIEVAVAFVWLGMV

SEQ ID NO: 166846 - protein, 16 aa, Mycobacterium tuberculosis
PAIEVAVAFVWLGMVV

SEQ ID NO: 166847 - protein, 16 aa, Mycobacterium tuberculosis
AIEVAVAFVWLGMVVA

SEQ ID NO: 166848 - protein, 16 aa, Mycobacterium tuberculosis
IEVAVAFVWLGMVVAI

SEQ ID NO: 166849 - protein, 16 aa, Mycobacterium tuberculosis
EVAVAFVWLGMVVAIS

SEQ ID NO: 166850 - protein, 16 aa, Mycobacterium tuberculosis
VAVAFVWLGMVVAISF

SEQ ID NO: 166851 - protein, 16 aa, Mycobacterium tuberculosis
AVAFVWLGMVVAISFL

SEQ ID NO: 166852 - protein, 16 aa, Mycobacterium tuberculosis
VAFVWLGMVVAISFLE

SEQ ID NO: 166853 - protein, 16 aa, Mycobacterium tuberculosis
AFVWLGMVVAISFLEA

SEQ ID NO: 166854 - protein, 16 aa, Mycobacterium tuberculosis
FVWLGMVVAISFLEAP

SEQ ID NO: 166855 - protein, 16 aa, Mycobacterium tuberculosis
VWLGMVVAISFLEAPL

SEQ ID NO: 166856 - protein, 16 aa, Mycobacterium tuberculosis
WLGMVVAISFLEAPLK

SEQ ID NO: 166857 - protein, 16 aa, Mycobacterium tuberculosis
LGMVVAISFLEAPLKF

SEQ ID NO: 166858 - protein, 16 aa, Mycobacterium tuberculosis
GMVVAISFLEAPLKFR

SEQ ID NO: 166859 - protein, 16 aa, Mycobacterium tuberculosis
MVVAISFLEAPLKFRA

SEQ ID NO: 166860 - protein, 16 aa, Mycobacterium tuberculosis
VVAISFLEAPLKFRAA

SEQ ID NO: 166861 - protein, 16 aa, Mycobacterium tuberculosis
VAISFLEAPLKFRAAG

SEQ ID NO: 166862 - protein, 16 aa, Mycobacterium tuberculosis
AISFLEAPLKFRAAGV

SEQ ID NO: 166863 - protein, 16 aa, Mycobacterium tuberculosis
ISFLEAPLKFRAAGVT

SEQ ID NO: 166864 - protein, 16 aa, Mycobacterium tuberculosis
SFLEAPLKFRAAGVTL

SEQ ID NO: 166865 - protein, 16 aa, Mycobacterium tuberculosis
FLEAPLKFRAAGVTLQ

SEQ ID NO: 166866 - protein, 16 aa, Mycobacterium tuberculosis
LEAPLKFRAAGVTLQI

SEQ ID NO: 166867 - protein, 16 aa, Mycobacterium tuberculosis
EAPLKFRAAGVTLQIG

SEQ ID NO: 166868 - protein, 16 aa, Mycobacterium tuberculosis
APLKFRAAGVTLQIGL

SEQ ID NO: 166869 - protein, 16 aa, Mycobacterium tuberculosis
PLKFRAAGVTLQIGLG

SEQ ID NO: 166870 - protein, 16 aa, Mycobacterium tuberculosis
LKFRAAGVTLQIGLGI

SEQ ID NO: 166871 - protein, 16 aa, Mycobacterium tuberculosis
KFRAAGVTLQIGLGIG

SEQ ID NO: 166872 - protein, 16 aa, Mycobacterium tuberculosis
FRAAGVTLQIGLGIGR

SEQ ID NO: 166873 - protein, 16 aa, Mycobacterium tuberculosis
RAAGVTLQIGLGIGRL

SEQ ID NO: 166874 - protein, 16 aa, Mycobacterium tuberculosis
AAGVTLQIGLGIGRLV

SEQ ID NO: 166875 - protein, 16 aa, Mycobacterium tuberculosis
AGVTLQIGLGIGRLVF

SEQ ID NO: 166876 - protein, 16 aa, Mycobacterium tuberculosis
GVTLQIGLGIGRLVFR

SEQ ID NO: 166877 - protein, 16 aa, Mycobacterium tuberculosis
VTLQIGLGIGRLVFRA

SEQ ID NO: 166878 - protein, 16 aa, Mycobacterium tuberculosis
TLQIGLGIGRLVFRAL

SEQ ID NO: 166879 - protein, 16 aa, Mycobacterium tuberculosis
LQIGLGIGRLVFRALN

SEQ ID NO: 166880 - protein, 16 aa, Mycobacterium tuberculosis
QIGLGIGRLVFRALNT

SEQ ID NO: 166881 - protein, 16 aa, Mycobacterium tuberculosis
IGLGIGRLVFRALNTV

SEQ ID NO: 166882 - protein, 16 aa, Mycobacterium tuberculosis
GLGIGRLVFRALNTVE

SEQ ID NO: 166883 - protein, 16 aa, Mycobacterium tuberculosis
LGIGRLVFRALNTVEV

SEQ ID NO: 166884 - protein, 16 aa, Mycobacterium tuberculosis
GIGRLVFRALNTVEVG

SEQ ID NO: 166885 - protein, 16 aa, Mycobacterium tuberculosis
IGRLVFRALNTVEVGF

SEQ ID NO: 166886 - protein, 16 aa, Mycobacterium tuberculosis
GRLVFRALNTVEVGFA

SEQ ID NO: 166887 - protein, 16 aa, Mycobacterium tuberculosis
RLVFRALNTVEVGFAL

SEQ ID NO: 166888 - protein, 16 aa, Mycobacterium tuberculosis
LVFRALNTVEVGFALV

SEQ ID NO: 166889 - protein, 16 aa, Mycobacterium tuberculosis
VFRALNTVEVGFALVI

SEQ ID NO: 166890 - protein, 16 aa, Mycobacterium tuberculosis
FRALNTVEVGFALVIL

SEQ ID NO: 166891 - protein, 16 aa, Mycobacterium tuberculosis
RALNTVEVGFALVILA

SEQ ID NO: 166892 - protein, 16 aa, Mycobacterium tuberculosis
ALNTVEVGFALVILAI

SEQ ID NO: 166893 - protein, 16 aa, Mycobacterium tuberculosis
LNTVEVGFALVILAIV

SEQ ID NO: 166894 - protein, 16 aa, Mycobacterium tuberculosis
NTVEVGFALVILAIVV

SEQ ID NO: 166895 - protein, 16 aa, Mycobacterium tuberculosis
TVEVGFALVILAIVVV

SEQ ID NO: 166896 - protein, 16 aa, Mycobacterium tuberculosis
VEVGFALVILAIVVVG

SEQ ID NO: 166897 - protein, 16 aa, Mycobacterium tuberculosis
EVGFALVILAIVVVGS

SEQ ID NO: 166898 - protein, 16 aa, Mycobacterium tuberculosis
VGFALVILAIVVVGST

SEQ ID NO: 166899 - protein, 16 aa, Mycobacterium tuberculosis
GFALVILAIVVVGSTP

SEQ ID NO: 166900 - protein, 16 aa, Mycobacterium tuberculosis
FALVILAIVVVGSTPA

SEQ ID NO: 166901 - protein, 16 aa, Mycobacterium tuberculosis
ALVILAIVVVGSTPAR

SEQ ID NO: 166902 - protein, 16 aa, Mycobacterium tuberculosis
LVILAIVVVGSTPARI

SEQ ID NO: 166903 - protein, 16 aa, Mycobacterium tuberculosis
VILAIVVVGSTPARIA

SEQ ID NO: 166904 - protein, 16 aa, Mycobacterium tuberculosis
ILAIVVVGSTPARIAA

SEQ ID NO: 166905 - protein, 16 aa, Mycobacterium tuberculosis
LAIVVVGSTPARIAAA

SEQ ID NO: 166906 - protein, 16 aa, Mycobacterium tuberculosis
AIVVVGSTPARIAAAF

SEQ ID NO: 166907 - protein, 16 aa, Mycobacterium tuberculosis
IVVVGSTPARIAAAFS

SEQ ID NO: 166908 - protein, 16 aa, Mycobacterium tuberculosis
VVVGSTPARIAAAFSV

SEQ ID NO: 166909 - protein, 16 aa, Mycobacterium tuberculosis
VVGSTPARIAAAFSVA

SEQ ID NO: 166910 - protein, 16 aa, Mycobacterium tuberculosis
VGSTPARIAAAFSVAL

SEQ ID NO: 166911 - protein, 16 aa, Mycobacterium tuberculosis
GSTPARIAAAFSVALA

SEQ ID NO: 166912 - protein, 16 aa, Mycobacterium tuberculosis
STPARIAAAFSVALAA

SEQ ID NO: 166913 - protein, 16 aa, Mycobacterium tuberculosis
TPARIAAAFSVALAAL

SEQ ID NO: 166914 - protein, 16 aa, Mycobacterium tuberculosis
PARIAAAFSVALAALA

SEQ ID NO: 166915 - protein, 16 aa, Mycobacterium tuberculosis
ARIAAAFSVALAALAV

SEQ ID NO: 166916 - protein, 16 aa, Mycobacterium tuberculosis
RIAAAFSVALAALAVQ

SEQ ID NO: 166917 - protein, 16 aa, Mycobacterium tuberculosis
IAAAFSVALAALAVQL

SEQ ID NO: 166918 - protein, 16 aa, Mycobacterium tuberculosis
AAAFSVALAALAVQLI

SEQ ID NO: 166919 - protein, 16 aa, Mycobacterium tuberculosis
AAFSVALAALAVQLIA

SEQ ID NO: 166920 - protein, 16 aa, Mycobacterium tuberculosis
AFSVALAALAVQLIAV

SEQ ID NO: 166921 - protein, 16 aa, Mycobacterium tuberculosis
FSVALAALAVQLIAVR

SEQ ID NO: 166922 - protein, 16 aa, Mycobacterium tuberculosis
SVALAALAVQLIAVRP

SEQ ID NO: 166923 - protein, 16 aa, Mycobacterium tuberculosis
VALAALAVQLIAVRPR

SEQ ID NO: 166924 - protein, 16 aa, Mycobacterium tuberculosis
ALAALAVQLIAVRPRL

SEQ ID NO: 166925 - protein, 16 aa, Mycobacterium tuberculosis
LAALAVQLIAVRPRLT

SEQ ID NO: 166926 - protein, 16 aa, Mycobacterium tuberculosis
AALAVQLIAVRPRLTR

SEQ ID NO: 166927 - protein, 16 aa, Mycobacterium tuberculosis
ALAVQLIAVRPRLTRR

SEQ ID NO: 166928 - protein, 16 aa, Mycobacterium tuberculosis
LAVQLIAVRPRLTRRS

SEQ ID NO: 166929 - protein, 16 aa, Mycobacterium tuberculosis
AVQLIAVRPRLTRRSN

SEQ ID NO: 166930 - protein, 16 aa, Mycobacterium tuberculosis
VQLIAVRPRLTRRSNQ

SEQ ID NO: 166931 - protein, 16 aa, Mycobacterium tuberculosis
QLIAVRPRLTRRSNQV

SEQ ID NO: 166932 - protein, 16 aa, Mycobacterium tuberculosis
LIAVRPRLTRRSNQVL

SEQ ID NO: 166933 - protein, 16 aa, Mycobacterium tuberculosis
IAVRPRLTRRSNQVLA

SEQ ID NO: 166934 - protein, 16 aa, Mycobacterium tuberculosis
AVRPRLTRRSNQVLAG

SEQ ID NO: 166935 - protein, 16 aa, Mycobacterium tuberculosis
VRPRLTRRSNQVLAGL

SEQ ID NO: 166936 - protein, 16 aa, Mycobacterium tuberculosis
RPRLTRRSNQVLAGLQ

SEQ ID NO: 166937 - protein, 16 aa, Mycobacterium tuberculosis
PRLTRRSNQVLAGLQA

SEQ ID NO: 166938 - protein, 16 aa, Mycobacterium tuberculosis
RLTRRSNQVLAGLQAP

SEQ ID NO: 166939 - protein, 16 aa, Mycobacterium tuberculosis
LTRRSNQVLAGLQAPR

SEQ ID NO: 166940 - protein, 16 aa, Mycobacterium tuberculosis
TRRSNQVLAGLQAPRS

SEQ ID NO: 166941 - protein, 16 aa, Mycobacterium tuberculosis
RRSNQVLAGLQAPRSR

SEQ ID NO: 166942 - protein, 16 aa, Mycobacterium tuberculosis
RSNQVLAGLQAPRSRG

SEQ ID NO: 166943 - protein, 16 aa, Mycobacterium tuberculosis
SNQVLAGLQAPRSRGH

SEQ ID NO: 166944 - protein, 16 aa, Mycobacterium tuberculosis
NQVLAGLQAPRSRGHH

SEQ ID NO: 166945 - protein, 16 aa, Mycobacterium tuberculosis
QVLAGLQAPRSRGHHI

SEQ ID NO: 166946 - protein, 16 aa, Mycobacterium tuberculosis
VLAGLQAPRSRGHHIY

SEQ ID NO: 166947 - protein, 16 aa, Mycobacterium tuberculosis
LAGLQAPRSRGHHIYV

SEQ ID NO: 166948 - protein, 16 aa, Mycobacterium tuberculosis
AGLQAPRSRGHHIYVG

SEQ ID NO: 166949 - protein, 16 aa, Mycobacterium tuberculosis
GLQAPRSRGHHIYVGL

SEQ ID NO: 166950 - protein, 16 aa, Mycobacterium tuberculosis
LQAPRSRGHHIYVGLE

SEQ ID NO: 166951 - protein, 16 aa, Mycobacterium tuberculosis
QAPRSRGHHIYVGLEI

SEQ ID NO: 166952 - protein, 16 aa, Mycobacterium tuberculosis
APRSRGHHIYVGLEIV

SEQ ID NO: 166953 - protein, 16 aa, Mycobacterium tuberculosis
PRSRGHHIYVGLEIVK

SEQ ID NO: 166954 - protein, 16 aa, Mycobacterium tuberculosis
RSRGHHIYVGLEIVKV

SEQ ID NO: 166955 - protein, 16 aa, Mycobacterium tuberculosis
SRGHHIYVGLEIVKVV

SEQ ID NO: 166956 - protein, 16 aa, Mycobacterium tuberculosis
RGHHIYVGLEIVKVVA

SEQ ID NO: 166957 - protein, 16 aa, Mycobacterium tuberculosis
GHHIYVGLEIVKVVAL

SEQ ID NO: 166958 - protein, 16 aa, Mycobacterium tuberculosis
HHIYVGLEIVKVVALL

SEQ ID NO: 166959 - protein, 16 aa, Mycobacterium tuberculosis
HIYVGLEIVKVVALLV

SEQ ID NO: 166960 - protein, 16 aa, Mycobacterium tuberculosis
IYVGLEIVKVVALLVA

SEQ ID NO: 166961 - protein, 16 aa, Mycobacterium tuberculosis
YVGLEIVKVVALLVAG

SEQ ID NO: 166962 - protein, 16 aa, Mycobacterium tuberculosis
VGLEIVKVVALLVAGI

SEQ ID NO: 166963 - protein, 16 aa, Mycobacterium tuberculosis
GLEIVKVVALLVAGIL

SEQ ID NO: 166964 - protein, 16 aa, Mycobacterium tuberculosis
LEIVKVVALLVAGILL

SEQ ID NO: 166965 - protein, 16 aa, Mycobacterium tuberculosis
EIVKVVALLVAGILLL

SEQ ID NO: 166966 - protein, 16 aa, Mycobacterium tuberculosis
IVKVVALLVAGILLLN

SEQ ID NO: 166967 - protein, 16 aa, Mycobacterium tuberculosis
VKVVALLVAGILLLNG

SEQ ID NO: 166968 - protein, 270 aa, Mycobacterium tuberculosis
MANPFVKAWKYLMALFSSKIDEHADPKVQIQQAIEEAQRTHQALTQQAAQVIGNQRQLEMRLNRQLADIEKLQVNVRQALTLADQATAAGDAAKATEYNNAAEAFAAQLVTAEQSVEDLKTLHDQALSAAAQAKKAVERNAMVLQQKIAERTKLLSQLEQAKMQEQVSASLRSMSELAAPGNTPSLDEVRDKIERRYANAIGSAELAESSVQGRMLEVEQAGIQMAGHSRLEQIRASMRGEALPAGGTTATPRPATETSGGAIAEQPYGQ

SEQ ID NO: 166969 - protein, 8 aa, Mycobacterium tuberculosis
MANPFVKA

SEQ ID NO: 166970 - protein, 8 aa, Mycobacterium tuberculosis
NPFVKAWK

SEQ ID NO: 166971 - protein, 8 aa, Mycobacterium tuberculosis
FVKAWKYL

SEQ ID NO: 166972 - protein, 8 aa, Mycobacterium tuberculosis
KAWKYLMA

SEQ ID NO: 166973 - protein, 8 aa, Mycobacterium tuberculosis
WKYLMALF

SEQ ID NO: 166974 - protein, 8 aa, Mycobacterium tuberculosis
YLMALFSS

SEQ ID NO: 166975 - protein, 8 aa, Mycobacterium tuberculosis
LMALFSSK

SEQ ID NO: 166976 - protein, 8 aa, Mycobacterium tuberculosis
MALFSSKI

SEQ ID NO: 166977 - protein, 8 aa, Mycobacterium tuberculosis
HADPKVQI

SEQ ID NO: 166978 - protein, 8 aa, Mycobacterium tuberculosis
IQQAIEEA

SEQ ID NO: 166979 - protein, 8 aa, Mycobacterium tuberculosis
QAIEEAQR

SEQ ID NO: 166980 - protein, 8 aa, Mycobacterium tuberculosis
AQRTHQAL

SEQ ID NO: 166981 - protein, 8 aa, Mycobacterium tuberculosis
RTHQALTQ

SEQ ID NO: 166982 - protein, 8 aa, Mycobacterium tuberculosis
HQALTQQA

SEQ ID NO: 166983 - protein, 8 aa, Mycobacterium tuberculosis
ALTQQAAQ

SEQ ID NO: 166984 - protein, 8 aa, Mycobacterium tuberculosis
LTQQAAQV

SEQ ID NO: 166985 - protein, 8 aa, Mycobacterium tuberculosis
AQVIGNQR

SEQ ID NO: 166986 - protein, 8 aa, Mycobacterium tuberculosis
VIGNQRQL

SEQ ID NO: 166987 - protein, 8 aa, Mycobacterium tuberculosis
QLEMRLNR

SEQ ID NO: 166988 - protein, 8 aa, Mycobacterium tuberculosis
RQLADIEK

SEQ ID NO: 166989 - protein, 8 aa, Mycobacterium tuberculosis
QLADIEKL

SEQ ID NO: 166990 - protein, 8 aa, Mycobacterium tuberculosis
LQVNVRQA

SEQ ID NO: 166991 - protein, 8 aa, Mycobacterium tuberculosis
QVNVRQAL

SEQ ID NO: 166992 - protein, 8 aa, Mycobacterium tuberculosis
NVRQALTL

SEQ ID NO: 166993 - protein, 8 aa, Mycobacterium tuberculosis
ALTLADQA

SEQ ID NO: 166994 - protein, 8 aa, Mycobacterium tuberculosis
TLADQATA

SEQ ID NO: 166995 - protein, 8 aa, Mycobacterium tuberculosis
LADQATAA

SEQ ID NO: 166996 - protein, 8 aa, Mycobacterium tuberculosis
ATAAGDAA

SEQ ID NO: 166997 - protein, 8 aa, Mycobacterium tuberculosis
TAAGDAAK

SEQ ID NO: 166998 - protein, 8 aa, Mycobacterium tuberculosis
DAAKATEY

SEQ ID NO: 166999 - protein, 8 aa, Mycobacterium tuberculosis
YNNAAEAF

SEQ ID NO: 167000 - protein, 8 aa, Mycobacterium tuberculosis
NAAEAFAA

SEQ ID NO: 167001 - protein, 8 aa, Mycobacterium tuberculosis
AEAFAAQL

SEQ ID NO: 167002 - protein, 8 aa, Mycobacterium tuberculosis
EAFAAQLV

SEQ ID NO: 167003 - protein, 8 aa, Mycobacterium tuberculosis
FAAQLVTA

SEQ ID NO: 167004 - protein, 8 aa, Mycobacterium tuberculosis
LVTAEQSV

SEQ ID NO: 167005 - protein, 8 aa, Mycobacterium tuberculosis
AEQSVEDL

SEQ ID NO: 167006 - protein, 8 aa, Mycobacterium tuberculosis
SVEDLKTL

SEQ ID NO: 167007 - protein, 8 aa, Mycobacterium tuberculosis
KTLHDQAL

SEQ ID NO: 167008 - protein, 8 aa, Mycobacterium tuberculosis
TLHDQALS

SEQ ID NO: 167009 - protein, 8 aa, Mycobacterium tuberculosis
ALSAAAQA

SEQ ID NO: 167010 - protein, 8 aa, Mycobacterium tuberculosis
LSAAAQAK

SEQ ID NO: 167011 - protein, 8 aa, Mycobacterium tuberculosis
SAAAQAKK

SEQ ID NO: 167012 - protein, 8 aa, Mycobacterium tuberculosis
QAKKAVER

SEQ ID NO: 167013 - protein, 8 aa, Mycobacterium tuberculosis
KAVERNAM

SEQ ID NO: 167014 - protein, 8 aa, Mycobacterium tuberculosis
AVERNAMV

SEQ ID NO: 167015 - protein, 8 aa, Mycobacterium tuberculosis
VERNAMVL

SEQ ID NO: 167016 - protein, 8 aa, Mycobacterium tuberculosis
NAMVLQQK

SEQ ID NO: 167017 - protein, 8 aa, Mycobacterium tuberculosis
AMVLQQKI

SEQ ID NO: 167018 - protein, 8 aa, Mycobacterium tuberculosis
LQQKIAER

SEQ ID NO: 167019 - protein, 8 aa, Mycobacterium tuberculosis
KIAERTKL

SEQ ID NO: 167020 - protein, 8 aa, Mycobacterium tuberculosis
KLLSQLEQ

SEQ ID NO: 167021 - protein, 8 aa, Mycobacterium tuberculosis
LLSQLEQA

SEQ ID NO: 167022 - protein, 8 aa, Mycobacterium tuberculosis
LSQLEQAK

SEQ ID NO: 167023 - protein, 8 aa, Mycobacterium tuberculosis
SQLEQAKM

SEQ ID NO: 167024 - protein, 8 aa, Mycobacterium tuberculosis
KMQEQVSA

SEQ ID NO: 167025 - protein, 8 aa, Mycobacterium tuberculosis
QEQVSASL

SEQ ID NO: 167026 - protein, 8 aa, Mycobacterium tuberculosis
EQVSASLR

SEQ ID NO: 167027 - protein, 8 aa, Mycobacterium tuberculosis
SLRSMSEL

SEQ ID NO: 167028 - protein, 8 aa, Mycobacterium tuberculosis
APGNTPSL

SEQ ID NO: 167029 - protein, 8 aa, Mycobacterium tuberculosis
NTPSLDEV

SEQ ID NO: 167030 - protein, 8 aa, Mycobacterium tuberculosis
TPSLDEVR

SEQ ID NO: 167031 - protein, 8 aa, Mycobacterium tuberculosis
SLDEVRDK

SEQ ID NO: 167032 - protein, 8 aa, Mycobacterium tuberculosis
EVRDKIER

SEQ ID NO: 167033 - protein, 8 aa, Mycobacterium tuberculosis
YANAIGSA

SEQ ID NO: 167034 - protein, 8 aa, Mycobacterium tuberculosis
NAIGSAEL

SEQ ID NO: 167035 - protein, 8 aa, Mycobacterium tuberculosis
AELAESSV

SEQ ID NO: 167036 - protein, 8 aa, Mycobacterium tuberculosis
ELAESSVQ

SEQ ID NO: 167037 - protein, 8 aa, Mycobacterium tuberculosis
VQGRMLEV

SEQ ID NO: 167038 - protein, 8 aa, Mycobacterium tuberculosis
RMLEVEQA

SEQ ID NO: 167039 - protein, 8 aa, Mycobacterium tuberculosis
LEVEQAGI

SEQ ID NO: 167040 - protein, 8 aa, Mycobacterium tuberculosis
EQAGIQMA

SEQ ID NO: 167041 - protein, 8 aa, Mycobacterium tuberculosis
IQMAGHSR

SEQ ID NO: 167042 - protein, 8 aa, Mycobacterium tuberculosis
QMAGHSRL

SEQ ID NO: 167043 - protein, 8 aa, Mycobacterium tuberculosis
HSRLEQIR

SEQ ID NO: 167044 - protein, 8 aa, Mycobacterium tuberculosis
EQIRASMR

SEQ ID NO: 167045 - protein, 8 aa, Mycobacterium tuberculosis
ALPAGGTT

SEQ ID NO: 167046 - protein, 8 aa, Mycobacterium tuberculosis
LPAGGTTA

SEQ ID NO: 167047 - protein, 8 aa, Mycobacterium tuberculosis
TTATPRPA

SEQ ID NO: 167048 - protein, 8 aa, Mycobacterium tuberculosis
TPRPATET

SEQ ID NO: 167049 - protein, 8 aa, Mycobacterium tuberculosis
RPATETSG

SEQ ID NO: 167050 - protein, 8 aa, Mycobacterium tuberculosis
ETSGGAIA

SEQ ID NO: 167051 - protein, 8 aa, Mycobacterium tuberculosis
GAIAEQPY

SEQ ID NO: 167052 - protein, 9 aa, Mycobacterium tuberculosis
MANPFVKAW

SEQ ID NO: 167053 - protein, 9 aa, Mycobacterium tuberculosis
NPFVKAWKY

SEQ ID NO: 167054 - protein, 9 aa, Mycobacterium tuberculosis
FVKAWKYLM

SEQ ID NO: 167055 - protein, 9 aa, Mycobacterium tuberculosis
KAWKYLMAL

SEQ ID NO: 167056 - protein, 9 aa, Mycobacterium tuberculosis
AWKYLMALF

SEQ ID NO: 167057 - protein, 9 aa, Mycobacterium tuberculosis
YLMALFSSK

SEQ ID NO: 167058 - protein, 9 aa, Mycobacterium tuberculosis
LMALFSSKI

SEQ ID NO: 167059 - protein, 9 aa, Mycobacterium tuberculosis
FSSKIDEHA

SEQ ID NO: 167060 - protein, 9 aa, Mycobacterium tuberculosis
KIDEHADPK

SEQ ID NO: 167061 - protein, 9 aa, Mycobacterium tuberculosis
VQIQQAIEE

SEQ ID NO: 167062 - protein, 9 aa, Mycobacterium tuberculosis
EEAQRTHQA

SEQ ID NO: 167063 - protein, 9 aa, Mycobacterium tuberculosis
EAQRTHQAL

SEQ ID NO: 167064 - protein, 9 aa, Mycobacterium tuberculosis
HQALTQQAA

SEQ ID NO: 167065 - protein, 9 aa, Mycobacterium tuberculosis
ALTQQAAQV

SEQ ID NO: 167066 - protein, 9 aa, Mycobacterium tuberculosis
AAQVIGNQR

SEQ ID NO: 167067 - protein, 9 aa, Mycobacterium tuberculosis
QVIGNQRQL

SEQ ID NO: 167068 - protein, 9 aa, Mycobacterium tuberculosis
RQLEMRLNR

SEQ ID NO: 167069 - protein, 9 aa, Mycobacterium tuberculosis
LEMRLNRQL

SEQ ID NO: 167070 - protein, 9 aa, Mycobacterium tuberculosis
RLNRQLADI

SEQ ID NO: 167071 - protein, 9 aa, Mycobacterium tuberculosis
RQLADIEKL

SEQ ID NO: 167072 - protein, 9 aa, Mycobacterium tuberculosis
QLADIEKLQ

SEQ ID NO: 167073 - protein, 9 aa, Mycobacterium tuberculosis
LADIEKLQV

SEQ ID NO: 167074 - protein, 9 aa, Mycobacterium tuberculosis
DIEKLQVNV

SEQ ID NO: 167075 - protein, 9 aa, Mycobacterium tuberculosis
KLQVNVRQA

SEQ ID NO: 167076 - protein, 9 aa, Mycobacterium tuberculosis
LQVNVRQAL

SEQ ID NO: 167077 - protein, 9 aa, Mycobacterium tuberculosis
NVRQALTLA

SEQ ID NO: 167078 - protein, 9 aa, Mycobacterium tuberculosis
LTLADQATA

SEQ ID NO: 167079 - protein, 9 aa, Mycobacterium tuberculosis
TLADQATAA

SEQ ID NO: 167080 - protein, 9 aa, Mycobacterium tuberculosis
LADQATAAG

SEQ ID NO: 167081 - protein, 9 aa, Mycobacterium tuberculosis
ATAAGDAAK

SEQ ID NO: 167082 - protein, 9 aa, Mycobacterium tuberculosis
TAAGDAAKA

SEQ ID NO: 167083 - protein, 9 aa, Mycobacterium tuberculosis
KATEYNNAA

SEQ ID NO: 167084 - protein, 9 aa, Mycobacterium tuberculosis
EYNNAAEAF

SEQ ID NO: 167085 - protein, 9 aa, Mycobacterium tuberculosis
NAAEAFAAQ

SEQ ID NO: 167086 - protein, 9 aa, Mycobacterium tuberculosis
AEAFAAQLV

SEQ ID NO: 167087 - protein, 9 aa, Mycobacterium tuberculosis
FAAQLVTAE

SEQ ID NO: 167088 - protein, 9 aa, Mycobacterium tuberculosis
QLVTAEQSV

SEQ ID NO: 167089 - protein, 9 aa, Mycobacterium tuberculosis
TLHDQALSA

SEQ ID NO: 167090 - protein, 9 aa, Mycobacterium tuberculosis
ALSAAAQAK

SEQ ID NO: 167091 - protein, 9 aa, Mycobacterium tuberculosis
LSAAAQAKK

SEQ ID NO: 167092 - protein, 9 aa, Mycobacterium tuberculosis
AAAQAKKAV

SEQ ID NO: 167093 - protein, 9 aa, Mycobacterium tuberculosis
AQAKKAVER

SEQ ID NO: 167094 - protein, 9 aa, Mycobacterium tuberculosis
KAVERNAMV

SEQ ID NO: 167095 - protein, 9 aa, Mycobacterium tuberculosis
NAMVLQQKI

SEQ ID NO: 167096 - protein, 9 aa, Mycobacterium tuberculosis
VLQQKIAER

SEQ ID NO: 167097 - protein, 9 aa, Mycobacterium tuberculosis
KIAERTKLL

SEQ ID NO: 167098 - protein, 9 aa, Mycobacterium tuberculosis
RTKLLSQLE

SEQ ID NO: 167099 - protein, 9 aa, Mycobacterium tuberculosis
KLLSQLEQA

SEQ ID NO: 167100 - protein, 9 aa, Mycobacterium tuberculosis
LLSQLEQAK

SEQ ID NO: 167101 - protein, 9 aa, Mycobacterium tuberculosis
MQEQVSASL

SEQ ID NO: 167102 - protein, 9 aa, Mycobacterium tuberculosis
QVSASLRSM

SEQ ID NO: 167103 - protein, 9 aa, Mycobacterium tuberculosis
SLRSMSELA

SEQ ID NO: 167104 - protein, 9 aa, Mycobacterium tuberculosis
LAAPGNTPS

SEQ ID NO: 167105 - protein, 9 aa, Mycobacterium tuberculosis
AAPGNTPSL

SEQ ID NO: 167106 - protein, 9 aa, Mycobacterium tuberculosis
NTPSLDEVR

SEQ ID NO: 167107 - protein, 9 aa, Mycobacterium tuberculosis
SLDEVRDKI

SEQ ID NO: 167108 - protein, 9 aa, Mycobacterium tuberculosis
EVRDKIERR

SEQ ID NO: 167109 - protein, 9 aa, Mycobacterium tuberculosis
IERRYANAI

SEQ ID NO: 167110 - protein, 9 aa, Mycobacterium tuberculosis
RRYANAIGS

SEQ ID NO: 167111 - protein, 9 aa, Mycobacterium tuberculosis
NAIGSAELA

SEQ ID NO: 167112 - protein, 9 aa, Mycobacterium tuberculosis
LAESSVQGR

SEQ ID NO: 167113 - protein, 9 aa, Mycobacterium tuberculosis
AESSVQGRM

SEQ ID NO: 167114 - protein, 9 aa, Mycobacterium tuberculosis
SVQGRMLEV

SEQ ID NO: 167115 - protein, 9 aa, Mycobacterium tuberculosis
RMLEVEQAG

SEQ ID NO: 167116 - protein, 9 aa, Mycobacterium tuberculosis
MLEVEQAGI

SEQ ID NO: 167117 - protein, 9 aa, Mycobacterium tuberculosis
EVEQAGIQM

SEQ ID NO: 167118 - protein, 9 aa, Mycobacterium tuberculosis
GIQMAGHSR

SEQ ID NO: 167119 - protein, 9 aa, Mycobacterium tuberculosis
IQMAGHSRL

SEQ ID NO: 167120 - protein, 9 aa, Mycobacterium tuberculosis
RLEQIRASM

SEQ ID NO: 167121 - protein, 9 aa, Mycobacterium tuberculosis
RASMRGEAL

SEQ ID NO: 167122 - protein, 9 aa, Mycobacterium tuberculosis
SMRGEALPA

SEQ ID NO: 167123 - protein, 9 aa, Mycobacterium tuberculosis
ALPAGGTTA

SEQ ID NO: 167124 - protein, 9 aa, Mycobacterium tuberculosis
LPAGGTTAT

SEQ ID NO: 167125 - protein, 9 aa, Mycobacterium tuberculosis
TTATPRPAT

SEQ ID NO: 167126 - protein, 9 aa, Mycobacterium tuberculosis
TPRPATETS

SEQ ID NO: 167127 - protein, 10 aa, Mycobacterium tuberculosis
MANPFVKAWK

SEQ ID NO: 167128 - protein, 10 aa, Mycobacterium tuberculosis
FVKAWKYLMA

SEQ ID NO: 167129 - protein, 10 aa, Mycobacterium tuberculosis
KAWKYLMALF

SEQ ID NO: 167130 - protein, 10 aa, Mycobacterium tuberculosis
KYLMALFSSK

SEQ ID NO: 167131 - protein, 10 aa, Mycobacterium tuberculosis
YLMALFSSKI

SEQ ID NO: 167132 - protein, 10 aa, Mycobacterium tuberculosis
KIDEHADPKV

SEQ ID NO: 167133 - protein, 10 aa, Mycobacterium tuberculosis
VQIQQAIEEA

SEQ ID NO: 167134 - protein, 10 aa, Mycobacterium tuberculosis
EEAQRTHQAL

SEQ ID NO: 167135 - protein, 10 aa, Mycobacterium tuberculosis
RTHQALTQQA

SEQ ID NO: 167136 - protein, 10 aa, Mycobacterium tuberculosis
QALTQQAAQV

SEQ ID NO: 167137 - protein, 10 aa, Mycobacterium tuberculosis
ALTQQAAQVI

SEQ ID NO: 167138 - protein, 10 aa, Mycobacterium tuberculosis
QAAQVIGNQR

SEQ ID NO: 167139 - protein, 10 aa, Mycobacterium tuberculosis
AQVIGNQRQL

SEQ ID NO: 167140 - protein, 10 aa, Mycobacterium tuberculosis
QRQLEMRLNR

SEQ ID NO: 167141 - protein, 10 aa, Mycobacterium tuberculosis
RQLEMRLNRQ

SEQ ID NO: 167142 - protein, 10 aa, Mycobacterium tuberculosis
QLEMRLNRQL

SEQ ID NO: 167143 - protein, 10 aa, Mycobacterium tuberculosis
QLADIEKLQV

SEQ ID NO: 167144 - protein, 10 aa, Mycobacterium tuberculosis
DIEKLQVNVR

SEQ ID NO: 167145 - protein, 10 aa, Mycobacterium tuberculosis
KLQVNVRQAL

SEQ ID NO: 167146 - protein, 10 aa, Mycobacterium tuberculosis
LQVNVRQALT

SEQ ID NO: 167147 - protein, 10 aa, Mycobacterium tuberculosis
QVNVRQALTL

SEQ ID NO: 167148 - protein, 10 aa, Mycobacterium tuberculosis
RQALTLADQA

SEQ ID NO: 167149 - protein, 10 aa, Mycobacterium tuberculosis
ALTLADQATA

SEQ ID NO: 167150 - protein, 10 aa, Mycobacterium tuberculosis
LTLADQATAA

SEQ ID NO: 167151 - protein, 10 aa, Mycobacterium tuberculosis
QATAAGDAAK

SEQ ID NO: 167152 - protein, 10 aa, Mycobacterium tuberculosis
ATAAGDAAKA

SEQ ID NO: 167153 - protein, 10 aa, Mycobacterium tuberculosis
TEYNNAAEAF

SEQ ID NO: 167154 - protein, 10 aa, Mycobacterium tuberculosis
NAAEAFAAQL

SEQ ID NO: 167155 - protein, 10 aa, Mycobacterium tuberculosis
AAEAFAAQLV

SEQ ID NO: 167156 - protein, 10 aa, Mycobacterium tuberculosis
AEAFAAQLVT

SEQ ID NO: 167157 - protein, 10 aa, Mycobacterium tuberculosis
EAFAAQLVTA

SEQ ID NO: 167158 - protein, 10 aa, Mycobacterium tuberculosis
FAAQLVTAEQ

SEQ ID NO: 167159 - protein, 10 aa, Mycobacterium tuberculosis
AQLVTAEQSV

SEQ ID NO: 167160 - protein, 10 aa, Mycobacterium tuberculosis
TAEQSVEDLK

SEQ ID NO: 167161 - protein, 10 aa, Mycobacterium tuberculosis
AEQSVEDLKT

SEQ ID NO: 167162 - protein, 10 aa, Mycobacterium tuberculosis
DLKTLHDQAL

SEQ ID NO: 167163 - protein, 10 aa, Mycobacterium tuberculosis
KTLHDQALSA

SEQ ID NO: 167164 - protein, 10 aa, Mycobacterium tuberculosis
TLHDQALSAA

SEQ ID NO: 167165 - protein, 10 aa, Mycobacterium tuberculosis
QALSAAAQAK

SEQ ID NO: 167166 - protein, 10 aa, Mycobacterium tuberculosis
ALSAAAQAKK

SEQ ID NO: 167167 - protein, 10 aa, Mycobacterium tuberculosis
SAAAQAKKAV

SEQ ID NO: 167168 - protein, 10 aa, Mycobacterium tuberculosis
AAQAKKAVER

SEQ ID NO: 167169 - protein, 10 aa, Mycobacterium tuberculosis
KAVERNAMVL

SEQ ID NO: 167170 - protein, 10 aa, Mycobacterium tuberculosis
MVLQQKIAER

SEQ ID NO: 167171 - protein, 10 aa, Mycobacterium tuberculosis
VLQQKIAERT

SEQ ID NO: 167172 - protein, 10 aa, Mycobacterium tuberculosis
AERTKLLSQL

SEQ ID NO: 167173 - protein, 10 aa, Mycobacterium tuberculosis
RTKLLSQLEQ

SEQ ID NO: 167174 - protein, 10 aa, Mycobacterium tuberculosis
KLLSQLEQAK

SEQ ID NO: 167175 - protein, 10 aa, Mycobacterium tuberculosis
LLSQLEQAKM

SEQ ID NO: 167176 - protein, 10 aa, Mycobacterium tuberculosis
KMQEQVSASL

SEQ ID NO: 167177 - protein, 10 aa, Mycobacterium tuberculosis
MQEQVSASLR

SEQ ID NO: 167178 - protein, 10 aa, Mycobacterium tuberculosis
SASLRSMSEL

SEQ ID NO: 167179 - protein, 10 aa, Mycobacterium tuberculosis
SLRSMSELAA

SEQ ID NO: 167180 - protein, 10 aa, Mycobacterium tuberculosis
ELAAPGNTPS

SEQ ID NO: 167181 - protein, 10 aa, Mycobacterium tuberculosis
LAAPGNTPSL

SEQ ID NO: 167182 - protein, 10 aa, Mycobacterium tuberculosis
EVRDKIERRY

SEQ ID NO: 167183 - protein, 10 aa, Mycobacterium tuberculosis
RRYANAIGSA

SEQ ID NO: 167184 - protein, 10 aa, Mycobacterium tuberculosis
YANAIGSAEL

SEQ ID NO: 167185 - protein, 10 aa, Mycobacterium tuberculosis
GSAELAESSV

SEQ ID NO: 167186 - protein, 10 aa, Mycobacterium tuberculosis
ELAESSVQGR

SEQ ID NO: 167187 - protein, 10 aa, Mycobacterium tuberculosis
AESSVQGRML

SEQ ID NO: 167188 - protein, 10 aa, Mycobacterium tuberculosis
SSVQGRMLEV

SEQ ID NO: 167189 - protein, 10 aa, Mycobacterium tuberculosis
RMLEVEQAGI

SEQ ID NO: 167190 - protein, 10 aa, Mycobacterium tuberculosis
LEVEQAGIQM

SEQ ID NO: 167191 - protein, 10 aa, Mycobacterium tuberculosis
GIQMAGHSRL

SEQ ID NO: 167192 - protein, 10 aa, Mycobacterium tuberculosis
IQMAGHSRLE

SEQ ID NO: 167193 - protein, 10 aa, Mycobacterium tuberculosis
QMAGHSRLEQ

SEQ ID NO: 167194 - protein, 10 aa, Mycobacterium tuberculosis
SRLEQIRASM

SEQ ID NO: 167195 - protein, 10 aa, Mycobacterium tuberculosis
RLEQIRASMR

SEQ ID NO: 167196 - protein, 10 aa, Mycobacterium tuberculosis
EALPAGGTTA

SEQ ID NO: 167197 - protein, 10 aa, Mycobacterium tuberculosis
ALPAGGTTAT

SEQ ID NO: 167198 - protein, 10 aa, Mycobacterium tuberculosis
LPAGGTTATP

SEQ ID NO: 167199 - protein, 10 aa, Mycobacterium tuberculosis
TPRPATETSG

SEQ ID NO: 167200 - protein, 10 aa, Mycobacterium tuberculosis
RPATETSGGA

SEQ ID NO: 167201 - protein, 10 aa, Mycobacterium tuberculosis
ETSGGAIAEQ

SEQ ID NO: 167202 - protein, 11 aa, Mycobacterium tuberculosis
MANPFVKAWKY

SEQ ID NO: 167203 - protein, 11 aa, Mycobacterium tuberculosis
NPFVKAWKYLM

SEQ ID NO: 167204 - protein, 11 aa, Mycobacterium tuberculosis
FVKAWKYLMAL

SEQ ID NO: 167205 - protein, 11 aa, Mycobacterium tuberculosis
KYLMALFSSKI

SEQ ID NO: 167206 - protein, 11 aa, Mycobacterium tuberculosis
MALFSSKIDEH

SEQ ID NO: 167207 - protein, 11 aa, Mycobacterium tuberculosis
ALFSSKIDEHA

SEQ ID NO: 167208 - protein, 11 aa, Mycobacterium tuberculosis
SSKIDEHADPK

SEQ ID NO: 167209 - protein, 11 aa, Mycobacterium tuberculosis
QIQQAIEEAQR

SEQ ID NO: 167210 - protein, 11 aa, Mycobacterium tuberculosis
AIEEAQRTHQA

SEQ ID NO: 167211 - protein, 11 aa, Mycobacterium tuberculosis
IEEAQRTHQAL

SEQ ID NO: 167212 - protein, 11 aa, Mycobacterium tuberculosis
EEAQRTHQALT

SEQ ID NO: 167213 - protein, 11 aa, Mycobacterium tuberculosis
RTHQALTQQAA

SEQ ID NO: 167214 - protein, 11 aa, Mycobacterium tuberculosis
HQALTQQAAQV

SEQ ID NO: 167215 - protein, 11 aa, Mycobacterium tuberculosis
QVIGNQRQLEM

SEQ ID NO: 167216 - protein, 11 aa, Mycobacterium tuberculosis
NQRQLEMRLNR

SEQ ID NO: 167217 - protein, 11 aa, Mycobacterium tuberculosis
RQLEMRLNRQL

SEQ ID NO: 167218 - protein, 11 aa, Mycobacterium tuberculosis
RLNRQLADIEK

SEQ ID NO: 167219 - protein, 11 aa, Mycobacterium tuberculosis
RQLADIEKLQV

SEQ ID NO: 167220 - protein, 11 aa, Mycobacterium tuberculosis
LADIEKLQVNV

SEQ ID NO: 167221 - protein, 11 aa, Mycobacterium tuberculosis
LQVNVRQALTL

SEQ ID NO: 167222 - protein, 11 aa, Mycobacterium tuberculosis
QVNVRQALTLA

SEQ ID NO: 167223 - protein, 11 aa, Mycobacterium tuberculosis
RQALTLADQAT

SEQ ID NO: 167224 - protein, 11 aa, Mycobacterium tuberculosis
ALTLADQATAA

SEQ ID NO: 167225 - protein, 11 aa, Mycobacterium tuberculosis
AAGDAAKATEY

SEQ ID NO: 167226 - protein, 11 aa, Mycobacterium tuberculosis
DAAKATEYNNA

SEQ ID NO: 167227 - protein, 11 aa, Mycobacterium tuberculosis
KATEYNNAAEA

SEQ ID NO: 167228 - protein, 11 aa, Mycobacterium tuberculosis
ATEYNNAAEAF

SEQ ID NO: 167229 - protein, 11 aa, Mycobacterium tuberculosis
NAAEAFAAQLV

SEQ ID NO: 167230 - protein, 11 aa, Mycobacterium tuberculosis
AEAFAAQLVTA

SEQ ID NO: 167231 - protein, 11 aa, Mycobacterium tuberculosis
AAQLVTAEQSV

SEQ ID NO: 167232 - protein, 11 aa, Mycobacterium tuberculosis
VTAEQSVEDLK

SEQ ID NO: 167233 - protein, 11 aa, Mycobacterium tuberculosis
AEQSVEDLKTL

SEQ ID NO: 167234 - protein, 11 aa, Mycobacterium tuberculosis
KTLHDQALSAA

SEQ ID NO: 167235 - protein, 11 aa, Mycobacterium tuberculosis
TLHDQALSAAA

SEQ ID NO: 167236 - protein, 11 aa, Mycobacterium tuberculosis
QALSAAAQAKK

SEQ ID NO: 167237 - protein, 11 aa, Mycobacterium tuberculosis
ALSAAAQAKKA

SEQ ID NO: 167238 - protein, 11 aa, Mycobacterium tuberculosis
LSAAAQAKKAV

SEQ ID NO: 167239 - protein, 11 aa, Mycobacterium tuberculosis
AAAQAKKAVER

SEQ ID NO: 167240 - protein, 11 aa, Mycobacterium tuberculosis
QAKKAVERNAM

SEQ ID NO: 167241 - protein, 11 aa, Mycobacterium tuberculosis
KKAVERNAMVL

SEQ ID NO: 167242 - protein, 11 aa, Mycobacterium tuberculosis
AMVLQQKIAER

SEQ ID NO: 167243 - protein, 11 aa, Mycobacterium tuberculosis
KLLSQLEQAKM

SEQ ID NO: 167244 - protein, 11 aa, Mycobacterium tuberculosis
LLSQLEQAKMQ

SEQ ID NO: 167245 - protein, 11 aa, Mycobacterium tuberculosis
QLEQAKMQEQV

SEQ ID NO: 167246 - protein, 11 aa, Mycobacterium tuberculosis
KMQEQVSASLR

SEQ ID NO: 167247 - protein, 11 aa, Mycobacterium tuberculosis
SMSELAAPGNT

SEQ ID NO: 167248 - protein, 11 aa, Mycobacterium tuberculosis
ELAAPGNTPSL

SEQ ID NO: 167249 - protein, 11 aa, Mycobacterium tuberculosis
APGNTPSLDEV

SEQ ID NO: 167250 - protein, 11 aa, Mycobacterium tuberculosis
NTPSLDEVRDK

SEQ ID NO: 167251 - protein, 11 aa, Mycobacterium tuberculosis
TPSLDEVRDKI

SEQ ID NO: 167252 - protein, 11 aa, Mycobacterium tuberculosis
SLDEVRDKIER

SEQ ID NO: 167253 - protein, 11 aa, Mycobacterium tuberculosis
DEVRDKIERRY

SEQ ID NO: 167254 - protein, 11 aa, Mycobacterium tuberculosis
RRYANAIGSAE

SEQ ID NO: 167255 - protein, 11 aa, Mycobacterium tuberculosis
RYANAIGSAEL

SEQ ID NO: 167256 - protein, 11 aa, Mycobacterium tuberculosis
YANAIGSAELA

SEQ ID NO: 167257 - protein, 11 aa, Mycobacterium tuberculosis
ELAESSVQGRM

SEQ ID NO: 167258 - protein, 11 aa, Mycobacterium tuberculosis
ESSVQGRMLEV

SEQ ID NO: 167259 - protein, 11 aa, Mycobacterium tuberculosis
RMLEVEQAGIQ

SEQ ID NO: 167260 - protein, 11 aa, Mycobacterium tuberculosis
MLEVEQAGIQM

SEQ ID NO: 167261 - protein, 11 aa, Mycobacterium tuberculosis
QAGIQMAGHSR

SEQ ID NO: 167262 - protein, 11 aa, Mycobacterium tuberculosis
IQMAGHSRLEQ

SEQ ID NO: 167263 - protein, 11 aa, Mycobacterium tuberculosis
QMAGHSRLEQI

SEQ ID NO: 167264 - protein, 11 aa, Mycobacterium tuberculosis
MAGHSRLEQIR

SEQ ID NO: 167265 - protein, 11 aa, Mycobacterium tuberculosis
QIRASMRGEAL

SEQ ID NO: 167266 - protein, 11 aa, Mycobacterium tuberculosis
RASMRGEALPA

SEQ ID NO: 167267 - protein, 11 aa, Mycobacterium tuberculosis
EALPAGGTTAT

SEQ ID NO: 167268 - protein, 11 aa, Mycobacterium tuberculosis
LPAGGTTATPR

SEQ ID NO: 167269 - protein, 11 aa, Mycobacterium tuberculosis
TTATPRPATET

SEQ ID NO: 167270 - protein, 11 aa, Mycobacterium tuberculosis
RPATETSGGAI

SEQ ID NO: 167271 - protein, 11 aa, Mycobacterium tuberculosis
TSGGAIAEQPY

SEQ ID NO: 167272 - protein, 13 aa, Mycobacterium tuberculosis
MANPFVKAWKYLM

SEQ ID NO: 167273 - protein, 13 aa, Mycobacterium tuberculosis
ANPFVKAWKYLMA

SEQ ID NO: 167274 - protein, 13 aa, Mycobacterium tuberculosis
NPFVKAWKYLMAL

SEQ ID NO: 167275 - protein, 13 aa, Mycobacterium tuberculosis
PFVKAWKYLMALF

SEQ ID NO: 167276 - protein, 13 aa, Mycobacterium tuberculosis
FVKAWKYLMALFS

SEQ ID NO: 167277 - protein, 13 aa, Mycobacterium tuberculosis
VKAWKYLMALFSS

SEQ ID NO: 167278 - protein, 13 aa, Mycobacterium tuberculosis
KAWKYLMALFSSK

SEQ ID NO: 167279 - protein, 13 aa, Mycobacterium tuberculosis
AWKYLMALFSSKI

SEQ ID NO: 167280 - protein, 13 aa, Mycobacterium tuberculosis
WKYLMALFSSKID

SEQ ID NO: 167281 - protein, 13 aa, Mycobacterium tuberculosis
KYLMALFSSKIDE

SEQ ID NO: 167282 - protein, 13 aa, Mycobacterium tuberculosis
YLMALFSSKIDEH

SEQ ID NO: 167283 - protein, 13 aa, Mycobacterium tuberculosis
LMALFSSKIDEHA

SEQ ID NO: 167284 - protein, 13 aa, Mycobacterium tuberculosis
MALFSSKIDEHAD

SEQ ID NO: 167285 - protein, 13 aa, Mycobacterium tuberculosis
ALFSSKIDEHADP

SEQ ID NO: 167286 - protein, 13 aa, Mycobacterium tuberculosis
LFSSKIDEHADPK

SEQ ID NO: 167287 - protein, 13 aa, Mycobacterium tuberculosis
FSSKIDEHADPKV

SEQ ID NO: 167288 - protein, 13 aa, Mycobacterium tuberculosis
SSKIDEHADPKVQ

SEQ ID NO: 167289 - protein, 13 aa, Mycobacterium tuberculosis
SKIDEHADPKVQI

SEQ ID NO: 167290 - protein, 13 aa, Mycobacterium tuberculosis
KIDEHADPKVQIQ

SEQ ID NO: 167291 - protein, 13 aa, Mycobacterium tuberculosis
IDEHADPKVQIQQ

SEQ ID NO: 167292 - protein, 13 aa, Mycobacterium tuberculosis
DEHADPKVQIQQA

SEQ ID NO: 167293 - protein, 13 aa, Mycobacterium tuberculosis
EHADPKVQIQQAI

SEQ ID NO: 167294 - protein, 13 aa, Mycobacterium tuberculosis
HADPKVQIQQAIE

SEQ ID NO: 167295 - protein, 13 aa, Mycobacterium tuberculosis
ADPKVQIQQAIEE

SEQ ID NO: 167296 - protein, 13 aa, Mycobacterium tuberculosis
DPKVQIQQAIEEA

SEQ ID NO: 167297 - protein, 13 aa, Mycobacterium tuberculosis
PKVQIQQAIEEAQ

SEQ ID NO: 167298 - protein, 13 aa, Mycobacterium tuberculosis
KVQIQQAIEEAQR

SEQ ID NO: 167299 - protein, 13 aa, Mycobacterium tuberculosis
VQIQQAIEEAQRT

SEQ ID NO: 167300 - protein, 13 aa, Mycobacterium tuberculosis
QIQQAIEEAQRTH

SEQ ID NO: 167301 - protein, 13 aa, Mycobacterium tuberculosis
IQQAIEEAQRTHQ

SEQ ID NO: 167302 - protein, 13 aa, Mycobacterium tuberculosis
QQAIEEAQRTHQA

SEQ ID NO: 167303 - protein, 13 aa, Mycobacterium tuberculosis
QAIEEAQRTHQAL

SEQ ID NO: 167304 - protein, 13 aa, Mycobacterium tuberculosis
AIEEAQRTHQALT

SEQ ID NO: 167305 - protein, 13 aa, Mycobacterium tuberculosis
IEEAQRTHQALTQ

SEQ ID NO: 167306 - protein, 13 aa, Mycobacterium tuberculosis
EEAQRTHQALTQQ

SEQ ID NO: 167307 - protein, 13 aa, Mycobacterium tuberculosis
EAQRTHQALTQQA

SEQ ID NO: 167308 - protein, 13 aa, Mycobacterium tuberculosis
AQRTHQALTQQAA

SEQ ID NO: 167309 - protein, 13 aa, Mycobacterium tuberculosis
QRTHQALTQQAAQ

SEQ ID NO: 167310 - protein, 13 aa, Mycobacterium tuberculosis
RTHQALTQQAAQV

SEQ ID NO: 167311 - protein, 13 aa, Mycobacterium tuberculosis
THQALTQQAAQVI

SEQ ID NO: 167312 - protein, 13 aa, Mycobacterium tuberculosis
HQALTQQAAQVIG

SEQ ID NO: 167313 - protein, 13 aa, Mycobacterium tuberculosis
QALTQQAAQVIGN

SEQ ID NO: 167314 - protein, 13 aa, Mycobacterium tuberculosis
ALTQQAAQVIGNQ

SEQ ID NO: 167315 - protein, 13 aa, Mycobacterium tuberculosis
LTQQAAQVIGNQR

SEQ ID NO: 167316 - protein, 13 aa, Mycobacterium tuberculosis
TQQAAQVIGNQRQ

SEQ ID NO: 167317 - protein, 13 aa, Mycobacterium tuberculosis
QQAAQVIGNQRQL

SEQ ID NO: 167318 - protein, 13 aa, Mycobacterium tuberculosis
QAAQVIGNQRQLE

SEQ ID NO: 167319 - protein, 13 aa, Mycobacterium tuberculosis
AAQVIGNQRQLEM

SEQ ID NO: 167320 - protein, 13 aa, Mycobacterium tuberculosis
AQVIGNQRQLEMR

SEQ ID NO: 167321 - protein, 13 aa, Mycobacterium tuberculosis
QVIGNQRQLEMRL

SEQ ID NO: 167322 - protein, 13 aa, Mycobacterium tuberculosis
VIGNQRQLEMRLN

SEQ ID NO: 167323 - protein, 13 aa, Mycobacterium tuberculosis
IGNQRQLEMRLNR

SEQ ID NO: 167324 - protein, 13 aa, Mycobacterium tuberculosis
GNQRQLEMRLNRQ

SEQ ID NO: 167325 - protein, 13 aa, Mycobacterium tuberculosis
NQRQLEMRLNRQL

SEQ ID NO: 167326 - protein, 13 aa, Mycobacterium tuberculosis
QRQLEMRLNRQLA

SEQ ID NO: 167327 - protein, 13 aa, Mycobacterium tuberculosis
RQLEMRLNRQLAD

SEQ ID NO: 167328 - protein, 13 aa, Mycobacterium tuberculosis
QLEMRLNRQLADI

SEQ ID NO: 167329 - protein, 13 aa, Mycobacterium tuberculosis
LEMRLNRQLADIE

SEQ ID NO: 167330 - protein, 13 aa, Mycobacterium tuberculosis
EMRLNRQLADIEK

SEQ ID NO: 167331 - protein, 13 aa, Mycobacterium tuberculosis
MRLNRQLADIEKL

SEQ ID NO: 167332 - protein, 13 aa, Mycobacterium tuberculosis
RLNRQLADIEKLQ

SEQ ID NO: 167333 - protein, 13 aa, Mycobacterium tuberculosis
LNRQLADIEKLQV

SEQ ID NO: 167334 - protein, 13 aa, Mycobacterium tuberculosis
NRQLADIEKLQVN

SEQ ID NO: 167335 - protein, 13 aa, Mycobacterium tuberculosis
RQLADIEKLQVNV

SEQ ID NO: 167336 - protein, 13 aa, Mycobacterium tuberculosis
QLADIEKLQVNVR

SEQ ID NO: 167337 - protein, 13 aa, Mycobacterium tuberculosis
LADIEKLQVNVRQ

SEQ ID NO: 167338 - protein, 13 aa, Mycobacterium tuberculosis
ADIEKLQVNVRQA

SEQ ID NO: 167339 - protein, 13 aa, Mycobacterium tuberculosis
DIEKLQVNVRQAL

SEQ ID NO: 167340 - protein, 13 aa, Mycobacterium tuberculosis
IEKLQVNVRQALT

SEQ ID NO: 167341 - protein, 13 aa, Mycobacterium tuberculosis
EKLQVNVRQALTL

SEQ ID NO: 167342 - protein, 13 aa, Mycobacterium tuberculosis
KLQVNVRQALTLA

SEQ ID NO: 167343 - protein, 13 aa, Mycobacterium tuberculosis
LQVNVRQALTLAD

SEQ ID NO: 167344 - protein, 13 aa, Mycobacterium tuberculosis
QVNVRQALTLADQ

SEQ ID NO: 167345 - protein, 13 aa, Mycobacterium tuberculosis
VNVRQALTLADQA

SEQ ID NO: 167346 - protein, 13 aa, Mycobacterium tuberculosis
NVRQALTLADQAT

SEQ ID NO: 167347 - protein, 13 aa, Mycobacterium tuberculosis
VRQALTLADQATA

SEQ ID NO: 167348 - protein, 13 aa, Mycobacterium tuberculosis
RQALTLADQATAA

SEQ ID NO: 167349 - protein, 13 aa, Mycobacterium tuberculosis
QALTLADQATAAG

SEQ ID NO: 167350 - protein, 13 aa, Mycobacterium tuberculosis
ALTLADQATAAGD

SEQ ID NO: 167351 - protein, 13 aa, Mycobacterium tuberculosis
LTLADQATAAGDA

SEQ ID NO: 167352 - protein, 13 aa, Mycobacterium tuberculosis
TLADQATAAGDAA

SEQ ID NO: 167353 - protein, 13 aa, Mycobacterium tuberculosis
LADQATAAGDAAK

SEQ ID NO: 167354 - protein, 13 aa, Mycobacterium tuberculosis
ADQATAAGDAAKA

SEQ ID NO: 167355 - protein, 13 aa, Mycobacterium tuberculosis
DQATAAGDAAKAT

SEQ ID NO: 167356 - protein, 13 aa, Mycobacterium tuberculosis
QATAAGDAAKATE

SEQ ID NO: 167357 - protein, 13 aa, Mycobacterium tuberculosis
ATAAGDAAKATEY

SEQ ID NO: 167358 - protein, 13 aa, Mycobacterium tuberculosis
TAAGDAAKATEYN

SEQ ID NO: 167359 - protein, 13 aa, Mycobacterium tuberculosis
AAGDAAKATEYNN

SEQ ID NO: 167360 - protein, 13 aa, Mycobacterium tuberculosis
AGDAAKATEYNNA

SEQ ID NO: 167361 - protein, 13 aa, Mycobacterium tuberculosis
GDAAKATEYNNAA

SEQ ID NO: 167362 - protein, 13 aa, Mycobacterium tuberculosis
DAAKATEYNNAAE

SEQ ID NO: 167363 - protein, 13 aa, Mycobacterium tuberculosis
AAKATEYNNAAEA

SEQ ID NO: 167364 - protein, 13 aa, Mycobacterium tuberculosis
AKATEYNNAAEAF

SEQ ID NO: 167365 - protein, 13 aa, Mycobacterium tuberculosis
KATEYNNAAEAFA

SEQ ID NO: 167366 - protein, 13 aa, Mycobacterium tuberculosis
ATEYNNAAEAFAA

SEQ ID NO: 167367 - protein, 13 aa, Mycobacterium tuberculosis
TEYNNAAEAFAAQ

SEQ ID NO: 167368 - protein, 13 aa, Mycobacterium tuberculosis
EYNNAAEAFAAQL

SEQ ID NO: 167369 - protein, 13 aa, Mycobacterium tuberculosis
YNNAAEAFAAQLV

SEQ ID NO: 167370 - protein, 13 aa, Mycobacterium tuberculosis
NNAAEAFAAQLVT

SEQ ID NO: 167371 - protein, 13 aa, Mycobacterium tuberculosis
NAAEAFAAQLVTA

SEQ ID NO: 167372 - protein, 13 aa, Mycobacterium tuberculosis
AAEAFAAQLVTAE

SEQ ID NO: 167373 - protein, 13 aa, Mycobacterium tuberculosis
AEAFAAQLVTAEQ

SEQ ID NO: 167374 - protein, 13 aa, Mycobacterium tuberculosis
EAFAAQLVTAEQS

SEQ ID NO: 167375 - protein, 13 aa, Mycobacterium tuberculosis
AFAAQLVTAEQSV

SEQ ID NO: 167376 - protein, 13 aa, Mycobacterium tuberculosis
FAAQLVTAEQSVE

SEQ ID NO: 167377 - protein, 13 aa, Mycobacterium tuberculosis
AAQLVTAEQSVED

SEQ ID NO: 167378 - protein, 13 aa, Mycobacterium tuberculosis
AQLVTAEQSVEDL

SEQ ID NO: 167379 - protein, 13 aa, Mycobacterium tuberculosis
QLVTAEQSVEDLK

SEQ ID NO: 167380 - protein, 13 aa, Mycobacterium tuberculosis
LVTAEQSVEDLKT

SEQ ID NO: 167381 - protein, 13 aa, Mycobacterium tuberculosis
VTAEQSVEDLKTL

SEQ ID NO: 167382 - protein, 13 aa, Mycobacterium tuberculosis
TAEQSVEDLKTLH

SEQ ID NO: 167383 - protein, 13 aa, Mycobacterium tuberculosis
AEQSVEDLKTLHD

SEQ ID NO: 167384 - protein, 13 aa, Mycobacterium tuberculosis
EQSVEDLKTLHDQ

SEQ ID NO: 167385 - protein, 13 aa, Mycobacterium tuberculosis
QSVEDLKTLHDQA

SEQ ID NO: 167386 - protein, 13 aa, Mycobacterium tuberculosis
SVEDLKTLHDQAL

SEQ ID NO: 167387 - protein, 13 aa, Mycobacterium tuberculosis
VEDLKTLHDQALS

SEQ ID NO: 167388 - protein, 13 aa, Mycobacterium tuberculosis
EDLKTLHDQALSA

SEQ ID NO: 167389 - protein, 13 aa, Mycobacterium tuberculosis
DLKTLHDQALSAA

SEQ ID NO: 167390 - protein, 13 aa, Mycobacterium tuberculosis
LKTLHDQALSAAA

SEQ ID NO: 167391 - protein, 13 aa, Mycobacterium tuberculosis
KTLHDQALSAAAQ

SEQ ID NO: 167392 - protein, 13 aa, Mycobacterium tuberculosis
TLHDQALSAAAQA

SEQ ID NO: 167393 - protein, 13 aa, Mycobacterium tuberculosis
LHDQALSAAAQAK

SEQ ID NO: 167394 - protein, 13 aa, Mycobacterium tuberculosis
HDQALSAAAQAKK

SEQ ID NO: 167395 - protein, 13 aa, Mycobacterium tuberculosis
DQALSAAAQAKKA

SEQ ID NO: 167396 - protein, 13 aa, Mycobacterium tuberculosis
QALSAAAQAKKAV

SEQ ID NO: 167397 - protein, 13 aa, Mycobacterium tuberculosis
ALSAAAQAKKAVE

SEQ ID NO: 167398 - protein, 13 aa, Mycobacterium tuberculosis
LSAAAQAKKAVER

SEQ ID NO: 167399 - protein, 13 aa, Mycobacterium tuberculosis
SAAAQAKKAVERN

SEQ ID NO: 167400 - protein, 13 aa, Mycobacterium tuberculosis
AAAQAKKAVERNA

SEQ ID NO: 167401 - protein, 13 aa, Mycobacterium tuberculosis
AAQAKKAVERNAM

SEQ ID NO: 167402 - protein, 13 aa, Mycobacterium tuberculosis
AQAKKAVERNAMV

SEQ ID NO: 167403 - protein, 13 aa, Mycobacterium tuberculosis
QAKKAVERNAMVL

SEQ ID NO: 167404 - protein, 13 aa, Mycobacterium tuberculosis
AKKAVERNAMVLQ

SEQ ID NO: 167405 - protein, 13 aa, Mycobacterium tuberculosis
KKAVERNAMVLQQ

SEQ ID NO: 167406 - protein, 13 aa, Mycobacterium tuberculosis
KAVERNAMVLQQK

SEQ ID NO: 167407 - protein, 13 aa, Mycobacterium tuberculosis
AVERNAMVLQQKI

SEQ ID NO: 167408 - protein, 13 aa, Mycobacterium tuberculosis
VERNAMVLQQKIA

SEQ ID NO: 167409 - protein, 13 aa, Mycobacterium tuberculosis
ERNAMVLQQKIAE

SEQ ID NO: 167410 - protein, 13 aa, Mycobacterium tuberculosis
RNAMVLQQKIAER

SEQ ID NO: 167411 - protein, 13 aa, Mycobacterium tuberculosis
NAMVLQQKIAERT

SEQ ID NO: 167412 - protein, 13 aa, Mycobacterium tuberculosis
AMVLQQKIAERTK

SEQ ID NO: 167413 - protein, 13 aa, Mycobacterium tuberculosis
MVLQQKIAERTKL

SEQ ID NO: 167414 - protein, 13 aa, Mycobacterium tuberculosis
VLQQKIAERTKLL

SEQ ID NO: 167415 - protein, 13 aa, Mycobacterium tuberculosis
LQQKIAERTKLLS

SEQ ID NO: 167416 - protein, 13 aa, Mycobacterium tuberculosis
QQKIAERTKLLSQ

SEQ ID NO: 167417 - protein, 13 aa, Mycobacterium tuberculosis
QKIAERTKLLSQL

SEQ ID NO: 167418 - protein, 13 aa, Mycobacterium tuberculosis
KIAERTKLLSQLE

SEQ ID NO: 167419 - protein, 13 aa, Mycobacterium tuberculosis
IAERTKLLSQLEQ

SEQ ID NO: 167420 - protein, 13 aa, Mycobacterium tuberculosis
AERTKLLSQLEQA

SEQ ID NO: 167421 - protein, 13 aa, Mycobacterium tuberculosis
ERTKLLSQLEQAK

SEQ ID NO: 167422 - protein, 13 aa, Mycobacterium tuberculosis
RTKLLSQLEQAKM

SEQ ID NO: 167423 - protein, 13 aa, Mycobacterium tuberculosis
TKLLSQLEQAKMQ

SEQ ID NO: 167424 - protein, 13 aa, Mycobacterium tuberculosis
KLLSQLEQAKMQE

SEQ ID NO: 167425 - protein, 13 aa, Mycobacterium tuberculosis
LLSQLEQAKMQEQ

SEQ ID NO: 167426 - protein, 13 aa, Mycobacterium tuberculosis
LSQLEQAKMQEQV

SEQ ID NO: 167427 - protein, 13 aa, Mycobacterium tuberculosis
SQLEQAKMQEQVS

SEQ ID NO: 167428 - protein, 13 aa, Mycobacterium tuberculosis
QLEQAKMQEQVSA

SEQ ID NO: 167429 - protein, 13 aa, Mycobacterium tuberculosis
LEQAKMQEQVSAS

SEQ ID NO: 167430 - protein, 13 aa, Mycobacterium tuberculosis
EQAKMQEQVSASL

SEQ ID NO: 167431 - protein, 13 aa, Mycobacterium tuberculosis
QAKMQEQVSASLR

SEQ ID NO: 167432 - protein, 13 aa, Mycobacterium tuberculosis
AKMQEQVSASLRS

SEQ ID NO: 167433 - protein, 13 aa, Mycobacterium tuberculosis
KMQEQVSASLRSM

SEQ ID NO: 167434 - protein, 13 aa, Mycobacterium tuberculosis
MQEQVSASLRSMS

SEQ ID NO: 167435 - protein, 13 aa, Mycobacterium tuberculosis
QEQVSASLRSMSE

SEQ ID NO: 167436 - protein, 13 aa, Mycobacterium tuberculosis
EQVSASLRSMSEL

SEQ ID NO: 167437 - protein, 13 aa, Mycobacterium tuberculosis
QVSASLRSMSELA

SEQ ID NO: 167438 - protein, 13 aa, Mycobacterium tuberculosis
VSASLRSMSELAA

SEQ ID NO: 167439 - protein, 13 aa, Mycobacterium tuberculosis
SASLRSMSELAAP

SEQ ID NO: 167440 - protein, 13 aa, Mycobacterium tuberculosis
ASLRSMSELAAPG

SEQ ID NO: 167441 - protein, 13 aa, Mycobacterium tuberculosis
SLRSMSELAAPGN

SEQ ID NO: 167442 - protein, 13 aa, Mycobacterium tuberculosis
LRSMSELAAPGNT

SEQ ID NO: 167443 - protein, 13 aa, Mycobacterium tuberculosis
RSMSELAAPGNTP

SEQ ID NO: 167444 - protein, 13 aa, Mycobacterium tuberculosis
SMSELAAPGNTPS

SEQ ID NO: 167445 - protein, 13 aa, Mycobacterium tuberculosis
MSELAAPGNTPSL

SEQ ID NO: 167446 - protein, 13 aa, Mycobacterium tuberculosis
SELAAPGNTPSLD

SEQ ID NO: 167447 - protein, 13 aa, Mycobacterium tuberculosis
ELAAPGNTPSLDE

SEQ ID NO: 167448 - protein, 13 aa, Mycobacterium tuberculosis
LAAPGNTPSLDEV

SEQ ID NO: 167449 - protein, 13 aa, Mycobacterium tuberculosis
AAPGNTPSLDEVR

SEQ ID NO: 167450 - protein, 13 aa, Mycobacterium tuberculosis
APGNTPSLDEVRD

SEQ ID NO: 167451 - protein, 13 aa, Mycobacterium tuberculosis
PGNTPSLDEVRDK

SEQ ID NO: 167452 - protein, 13 aa, Mycobacterium tuberculosis
GNTPSLDEVRDKI

SEQ ID NO: 167453 - protein, 13 aa, Mycobacterium tuberculosis
NTPSLDEVRDKIE

SEQ ID NO: 167454 - protein, 13 aa, Mycobacterium tuberculosis
TPSLDEVRDKIER

SEQ ID NO: 167455 - protein, 13 aa, Mycobacterium tuberculosis
PSLDEVRDKIERR

SEQ ID NO: 167456 - protein, 13 aa, Mycobacterium tuberculosis
SLDEVRDKIERRY

SEQ ID NO: 167457 - protein, 13 aa, Mycobacterium tuberculosis
LDEVRDKIERRYA

SEQ ID NO: 167458 - protein, 13 aa, Mycobacterium tuberculosis
DEVRDKIERRYAN

SEQ ID NO: 167459 - protein, 13 aa, Mycobacterium tuberculosis
EVRDKIERRYANA

SEQ ID NO: 167460 - protein, 13 aa, Mycobacterium tuberculosis
VRDKIERRYANAI

SEQ ID NO: 167461 - protein, 13 aa, Mycobacterium tuberculosis
RDKIERRYANAIG

SEQ ID NO: 167462 - protein, 13 aa, Mycobacterium tuberculosis
DKIERRYANAIGS

SEQ ID NO: 167463 - protein, 13 aa, Mycobacterium tuberculosis
KIERRYANAIGSA

SEQ ID NO: 167464 - protein, 13 aa, Mycobacterium tuberculosis
IERRYANAIGSAE

SEQ ID NO: 167465 - protein, 13 aa, Mycobacterium tuberculosis
ERRYANAIGSAEL

SEQ ID NO: 167466 - protein, 13 aa, Mycobacterium tuberculosis
RRYANAIGSAELA

SEQ ID NO: 167467 - protein, 13 aa, Mycobacterium tuberculosis
RYANAIGSAELAE

SEQ ID NO: 167468 - protein, 13 aa, Mycobacterium tuberculosis
YANAIGSAELAES

SEQ ID NO: 167469 - protein, 13 aa, Mycobacterium tuberculosis
ANAIGSAELAESS

SEQ ID NO: 167470 - protein, 13 aa, Mycobacterium tuberculosis
NAIGSAELAESSV

SEQ ID NO: 167471 - protein, 13 aa, Mycobacterium tuberculosis
AIGSAELAESSVQ

SEQ ID NO: 167472 - protein, 13 aa, Mycobacterium tuberculosis
IGSAELAESSVQG

SEQ ID NO: 167473 - protein, 13 aa, Mycobacterium tuberculosis
GSAELAESSVQGR

SEQ ID NO: 167474 - protein, 13 aa, Mycobacterium tuberculosis
SAELAESSVQGRM

SEQ ID NO: 167475 - protein, 13 aa, Mycobacterium tuberculosis
AELAESSVQGRML

SEQ ID NO: 167476 - protein, 13 aa, Mycobacterium tuberculosis
ELAESSVQGRMLE

SEQ ID NO: 167477 - protein, 13 aa, Mycobacterium tuberculosis
LAESSVQGRMLEV

SEQ ID NO: 167478 - protein, 13 aa, Mycobacterium tuberculosis
AESSVQGRMLEVE

SEQ ID NO: 167479 - protein, 13 aa, Mycobacterium tuberculosis
ESSVQGRMLEVEQ

SEQ ID NO: 167480 - protein, 13 aa, Mycobacterium tuberculosis
SSVQGRMLEVEQA

SEQ ID NO: 167481 - protein, 13 aa, Mycobacterium tuberculosis
SVQGRMLEVEQAG

SEQ ID NO: 167482 - protein, 13 aa, Mycobacterium tuberculosis
VQGRMLEVEQAGI

SEQ ID NO: 167483 - protein, 13 aa, Mycobacterium tuberculosis
QGRMLEVEQAGIQ

SEQ ID NO: 167484 - protein, 13 aa, Mycobacterium tuberculosis
GRMLEVEQAGIQM

SEQ ID NO: 167485 - protein, 13 aa, Mycobacterium tuberculosis
RMLEVEQAGIQMA

SEQ ID NO: 167486 - protein, 13 aa, Mycobacterium tuberculosis
MLEVEQAGIQMAG

SEQ ID NO: 167487 - protein, 13 aa, Mycobacterium tuberculosis
LEVEQAGIQMAGH

SEQ ID NO: 167488 - protein, 13 aa, Mycobacterium tuberculosis
EVEQAGIQMAGHS

SEQ ID NO: 167489 - protein, 13 aa, Mycobacterium tuberculosis
VEQAGIQMAGHSR

SEQ ID NO: 167490 - protein, 13 aa, Mycobacterium tuberculosis
EQAGIQMAGHSRL

SEQ ID NO: 167491 - protein, 13 aa, Mycobacterium tuberculosis
QAGIQMAGHSRLE

SEQ ID NO: 167492 - protein, 13 aa, Mycobacterium tuberculosis
AGIQMAGHSRLEQ

SEQ ID NO: 167493 - protein, 13 aa, Mycobacterium tuberculosis
GIQMAGHSRLEQI

SEQ ID NO: 167494 - protein, 13 aa, Mycobacterium tuberculosis
IQMAGHSRLEQIR

SEQ ID NO: 167495 - protein, 13 aa, Mycobacterium tuberculosis
QMAGHSRLEQIRA

SEQ ID NO: 167496 - protein, 13 aa, Mycobacterium tuberculosis
MAGHSRLEQIRAS

SEQ ID NO: 167497 - protein, 13 aa, Mycobacterium tuberculosis
AGHSRLEQIRASM

SEQ ID NO: 167498 - protein, 13 aa, Mycobacterium tuberculosis
GHSRLEQIRASMR

SEQ ID NO: 167499 - protein, 13 aa, Mycobacterium tuberculosis
HSRLEQIRASMRG

SEQ ID NO: 167500 - protein, 13 aa, Mycobacterium tuberculosis
SRLEQIRASMRGE

SEQ ID NO: 167501 - protein, 13 aa, Mycobacterium tuberculosis
RLEQIRASMRGEA

SEQ ID NO: 167502 - protein, 13 aa, Mycobacterium tuberculosis
LEQIRASMRGEAL

SEQ ID NO: 167503 - protein, 13 aa, Mycobacterium tuberculosis
EQIRASMRGEALP

SEQ ID NO: 167504 - protein, 13 aa, Mycobacterium tuberculosis
QIRASMRGEALPA

SEQ ID NO: 167505 - protein, 13 aa, Mycobacterium tuberculosis
IRASMRGEALPAG

SEQ ID NO: 167506 - protein, 13 aa, Mycobacterium tuberculosis
RASMRGEALPAGG

SEQ ID NO: 167507 - protein, 13 aa, Mycobacterium tuberculosis
ASMRGEALPAGGT

SEQ ID NO: 167508 - protein, 13 aa, Mycobacterium tuberculosis
SMRGEALPAGGTT

SEQ ID NO: 167509 - protein, 13 aa, Mycobacterium tuberculosis
MRGEALPAGGTTA

SEQ ID NO: 167510 - protein, 13 aa, Mycobacterium tuberculosis
RGEALPAGGTTAT

SEQ ID NO: 167511 - protein, 13 aa, Mycobacterium tuberculosis
GEALPAGGTTATP

SEQ ID NO: 167512 - protein, 13 aa, Mycobacterium tuberculosis
EALPAGGTTATPR

SEQ ID NO: 167513 - protein, 13 aa, Mycobacterium tuberculosis
ALPAGGTTATPRP

SEQ ID NO: 167514 - protein, 13 aa, Mycobacterium tuberculosis
LPAGGTTATPRPA

SEQ ID NO: 167515 - protein, 13 aa, Mycobacterium tuberculosis
PAGGTTATPRPAT

SEQ ID NO: 167516 - protein, 13 aa, Mycobacterium tuberculosis
AGGTTATPRPATE

SEQ ID NO: 167517 - protein, 13 aa, Mycobacterium tuberculosis
GGTTATPRPATET

SEQ ID NO: 167518 - protein, 13 aa, Mycobacterium tuberculosis
GTTATPRPATETS

SEQ ID NO: 167519 - protein, 13 aa, Mycobacterium tuberculosis
TTATPRPATETSG

SEQ ID NO: 167520 - protein, 13 aa, Mycobacterium tuberculosis
TATPRPATETSGG

SEQ ID NO: 167521 - protein, 13 aa, Mycobacterium tuberculosis
ATPRPATETSGGA

SEQ ID NO: 167522 - protein, 13 aa, Mycobacterium tuberculosis
TPRPATETSGGAI

SEQ ID NO: 167523 - protein, 13 aa, Mycobacterium tuberculosis
PRPATETSGGAIA

SEQ ID NO: 167524 - protein, 13 aa, Mycobacterium tuberculosis
RPATETSGGAIAE

SEQ ID NO: 167525 - protein, 13 aa, Mycobacterium tuberculosis
PATETSGGAIAEQ

SEQ ID NO: 167526 - protein, 13 aa, Mycobacterium tuberculosis
ATETSGGAIAEQP

SEQ ID NO: 167527 - protein, 13 aa, Mycobacterium tuberculosis
TETSGGAIAEQPY

SEQ ID NO: 167528 - protein, 13 aa, Mycobacterium tuberculosis
ETSGGAIAEQPYG

SEQ ID NO: 167529 - protein, 13 aa, Mycobacterium tuberculosis
TSGGAIAEQPYGQ

SEQ ID NO: 167530 - protein, 14 aa, Mycobacterium tuberculosis
MANPFVKAWKYLMA

SEQ ID NO: 167531 - protein, 14 aa, Mycobacterium tuberculosis
ANPFVKAWKYLMAL

SEQ ID NO: 167532 - protein, 14 aa, Mycobacterium tuberculosis
NPFVKAWKYLMALF

SEQ ID NO: 167533 - protein, 14 aa, Mycobacterium tuberculosis
PFVKAWKYLMALFS

SEQ ID NO: 167534 - protein, 14 aa, Mycobacterium tuberculosis
FVKAWKYLMALFSS

SEQ ID NO: 167535 - protein, 14 aa, Mycobacterium tuberculosis
VKAWKYLMALFSSK

SEQ ID NO: 167536 - protein, 14 aa, Mycobacterium tuberculosis
KAWKYLMALFSSKI

SEQ ID NO: 167537 - protein, 14 aa, Mycobacterium tuberculosis
AWKYLMALFSSKID

SEQ ID NO: 167538 - protein, 14 aa, Mycobacterium tuberculosis
WKYLMALFSSKIDE

SEQ ID NO: 167539 - protein, 14 aa, Mycobacterium tuberculosis
KYLMALFSSKIDEH

SEQ ID NO: 167540 - protein, 14 aa, Mycobacterium tuberculosis
YLMALFSSKIDEHA

SEQ ID NO: 167541 - protein, 14 aa, Mycobacterium tuberculosis
LMALFSSKIDEHAD

SEQ ID NO: 167542 - protein, 14 aa, Mycobacterium tuberculosis
MALFSSKIDEHADP

SEQ ID NO: 167543 - protein, 14 aa, Mycobacterium tuberculosis
ALFSSKIDEHADPK

SEQ ID NO: 167544 - protein, 14 aa, Mycobacterium tuberculosis
LFSSKIDEHADPKV

SEQ ID NO: 167545 - protein, 14 aa, Mycobacterium tuberculosis
FSSKIDEHADPKVQ

SEQ ID NO: 167546 - protein, 14 aa, Mycobacterium tuberculosis
SSKIDEHADPKVQI

SEQ ID NO: 167547 - protein, 14 aa, Mycobacterium tuberculosis
SKIDEHADPKVQIQ

SEQ ID NO: 167548 - protein, 14 aa, Mycobacterium tuberculosis
KIDEHADPKVQIQQ

SEQ ID NO: 167549 - protein, 14 aa, Mycobacterium tuberculosis
IDEHADPKVQIQQA

SEQ ID NO: 167550 - protein, 14 aa, Mycobacterium tuberculosis
DEHADPKVQIQQAI

SEQ ID NO: 167551 - protein, 14 aa, Mycobacterium tuberculosis
EHADPKVQIQQAIE

SEQ ID NO: 167552 - protein, 14 aa, Mycobacterium tuberculosis
HADPKVQIQQAIEE

SEQ ID NO: 167553 - protein, 14 aa, Mycobacterium tuberculosis
ADPKVQIQQAIEEA

SEQ ID NO: 167554 - protein, 14 aa, Mycobacterium tuberculosis
DPKVQIQQAIEEAQ

SEQ ID NO: 167555 - protein, 14 aa, Mycobacterium tuberculosis
PKVQIQQAIEEAQR

SEQ ID NO: 167556 - protein, 14 aa, Mycobacterium tuberculosis
KVQIQQAIEEAQRT

SEQ ID NO: 167557 - protein, 14 aa, Mycobacterium tuberculosis
VQIQQAIEEAQRTH

SEQ ID NO: 167558 - protein, 14 aa, Mycobacterium tuberculosis
QIQQAIEEAQRTHQ

SEQ ID NO: 167559 - protein, 14 aa, Mycobacterium tuberculosis
IQQAIEEAQRTHQA

SEQ ID NO: 167560 - protein, 14 aa, Mycobacterium tuberculosis
QQAIEEAQRTHQAL

SEQ ID NO: 167561 - protein, 14 aa, Mycobacterium tuberculosis
QAIEEAQRTHQALT

SEQ ID NO: 167562 - protein, 14 aa, Mycobacterium tuberculosis
AIEEAQRTHQALTQ

SEQ ID NO: 167563 - protein, 14 aa, Mycobacterium tuberculosis
IEEAQRTHQALTQQ

SEQ ID NO: 167564 - protein, 14 aa, Mycobacterium tuberculosis
EEAQRTHQALTQQA

SEQ ID NO: 167565 - protein, 14 aa, Mycobacterium tuberculosis
EAQRTHQALTQQAA

SEQ ID NO: 167566 - protein, 14 aa, Mycobacterium tuberculosis
AQRTHQALTQQAAQ

SEQ ID NO: 167567 - protein, 14 aa, Mycobacterium tuberculosis
QRTHQALTQQAAQV

SEQ ID NO: 167568 - protein, 14 aa, Mycobacterium tuberculosis
RTHQALTQQAAQVI

SEQ ID NO: 167569 - protein, 14 aa, Mycobacterium tuberculosis
THQALTQQAAQVIG

SEQ ID NO: 167570 - protein, 14 aa, Mycobacterium tuberculosis
HQALTQQAAQVIGN

SEQ ID NO: 167571 - protein, 14 aa, Mycobacterium tuberculosis
QALTQQAAQVIGNQ

SEQ ID NO: 167572 - protein, 14 aa, Mycobacterium tuberculosis
ALTQQAAQVIGNQR

SEQ ID NO: 167573 - protein, 14 aa, Mycobacterium tuberculosis
LTQQAAQVIGNQRQ

SEQ ID NO: 167574 - protein, 14 aa, Mycobacterium tuberculosis
TQQAAQVIGNQRQL

SEQ ID NO: 167575 - protein, 14 aa, Mycobacterium tuberculosis
QQAAQVIGNQRQLE

SEQ ID NO: 167576 - protein, 14 aa, Mycobacterium tuberculosis
QAAQVIGNQRQLEM

SEQ ID NO: 167577 - protein, 14 aa, Mycobacterium tuberculosis
AAQVIGNQRQLEMR

SEQ ID NO: 167578 - protein, 14 aa, Mycobacterium tuberculosis
AQVIGNQRQLEMRL

SEQ ID NO: 167579 - protein, 14 aa, Mycobacterium tuberculosis
QVIGNQRQLEMRLN

SEQ ID NO: 167580 - protein, 14 aa, Mycobacterium tuberculosis
VIGNQRQLEMRLNR

SEQ ID NO: 167581 - protein, 14 aa, Mycobacterium tuberculosis
IGNQRQLEMRLNRQ

SEQ ID NO: 167582 - protein, 14 aa, Mycobacterium tuberculosis
GNQRQLEMRLNRQL

SEQ ID NO: 167583 - protein, 14 aa, Mycobacterium tuberculosis
NQRQLEMRLNRQLA

SEQ ID NO: 167584 - protein, 14 aa, Mycobacterium tuberculosis
QRQLEMRLNRQLAD

SEQ ID NO: 167585 - protein, 14 aa, Mycobacterium tuberculosis
RQLEMRLNRQLADI

SEQ ID NO: 167586 - protein, 14 aa, Mycobacterium tuberculosis
QLEMRLNRQLADIE

SEQ ID NO: 167587 - protein, 14 aa, Mycobacterium tuberculosis
LEMRLNRQLADIEK

SEQ ID NO: 167588 - protein, 14 aa, Mycobacterium tuberculosis
EMRLNRQLADIEKL

SEQ ID NO: 167589 - protein, 14 aa, Mycobacterium tuberculosis
MRLNRQLADIEKLQ

SEQ ID NO: 167590 - protein, 14 aa, Mycobacterium tuberculosis
RLNRQLADIEKLQV

SEQ ID NO: 167591 - protein, 14 aa, Mycobacterium tuberculosis
LNRQLADIEKLQVN

SEQ ID NO: 167592 - protein, 14 aa, Mycobacterium tuberculosis
NRQLADIEKLQVNV

SEQ ID NO: 167593 - protein, 14 aa, Mycobacterium tuberculosis
RQLADIEKLQVNVR

SEQ ID NO: 167594 - protein, 14 aa, Mycobacterium tuberculosis
QLADIEKLQVNVRQ

SEQ ID NO: 167595 - protein, 14 aa, Mycobacterium tuberculosis
LADIEKLQVNVRQA

SEQ ID NO: 167596 - protein, 14 aa, Mycobacterium tuberculosis
ADIEKLQVNVRQAL

SEQ ID NO: 167597 - protein, 14 aa, Mycobacterium tuberculosis
DIEKLQVNVRQALT

SEQ ID NO: 167598 - protein, 14 aa, Mycobacterium tuberculosis
IEKLQVNVRQALTL

SEQ ID NO: 167599 - protein, 14 aa, Mycobacterium tuberculosis
EKLQVNVRQALTLA

SEQ ID NO: 167600 - protein, 14 aa, Mycobacterium tuberculosis
KLQVNVRQALTLAD

SEQ ID NO: 167601 - protein, 14 aa, Mycobacterium tuberculosis
LQVNVRQALTLADQ

SEQ ID NO: 167602 - protein, 14 aa, Mycobacterium tuberculosis
QVNVRQALTLADQA

SEQ ID NO: 167603 - protein, 14 aa, Mycobacterium tuberculosis
VNVRQALTLADQAT

SEQ ID NO: 167604 - protein, 14 aa, Mycobacterium tuberculosis
NVRQALTLADQATA

SEQ ID NO: 167605 - protein, 14 aa, Mycobacterium tuberculosis
VRQALTLADQATAA

SEQ ID NO: 167606 - protein, 14 aa, Mycobacterium tuberculosis
RQALTLADQATAAG

SEQ ID NO: 167607 - protein, 14 aa, Mycobacterium tuberculosis
QALTLADQATAAGD

SEQ ID NO: 167608 - protein, 14 aa, Mycobacterium tuberculosis
ALTLADQATAAGDA

SEQ ID NO: 167609 - protein, 14 aa, Mycobacterium tuberculosis
LTLADQATAAGDAA

SEQ ID NO: 167610 - protein, 14 aa, Mycobacterium tuberculosis
TLADQATAAGDAAK

SEQ ID NO: 167611 - protein, 14 aa, Mycobacterium tuberculosis
LADQATAAGDAAKA

SEQ ID NO: 167612 - protein, 14 aa, Mycobacterium tuberculosis
ADQATAAGDAAKAT

SEQ ID NO: 167613 - protein, 14 aa, Mycobacterium tuberculosis
DQATAAGDAAKATE

SEQ ID NO: 167614 - protein, 14 aa, Mycobacterium tuberculosis
QATAAGDAAKATEY

SEQ ID NO: 167615 - protein, 14 aa, Mycobacterium tuberculosis
ATAAGDAAKATEYN

SEQ ID NO: 167616 - protein, 14 aa, Mycobacterium tuberculosis
TAAGDAAKATEYNN

SEQ ID NO: 167617 - protein, 14 aa, Mycobacterium tuberculosis
AAGDAAKATEYNNA

SEQ ID NO: 167618 - protein, 14 aa, Mycobacterium tuberculosis
AGDAAKATEYNNAA

SEQ ID NO: 167619 - protein, 14 aa, Mycobacterium tuberculosis
GDAAKATEYNNAAE

SEQ ID NO: 167620 - protein, 14 aa, Mycobacterium tuberculosis
DAAKATEYNNAAEA

SEQ ID NO: 167621 - protein, 14 aa, Mycobacterium tuberculosis
AAKATEYNNAAEAF

SEQ ID NO: 167622 - protein, 14 aa, Mycobacterium tuberculosis
AKATEYNNAAEAFA

SEQ ID NO: 167623 - protein, 14 aa, Mycobacterium tuberculosis
KATEYNNAAEAFAA

SEQ ID NO: 167624 - protein, 14 aa, Mycobacterium tuberculosis
ATEYNNAAEAFAAQ

SEQ ID NO: 167625 - protein, 14 aa, Mycobacterium tuberculosis
TEYNNAAEAFAAQL

SEQ ID NO: 167626 - protein, 14 aa, Mycobacterium tuberculosis
EYNNAAEAFAAQLV

SEQ ID NO: 167627 - protein, 14 aa, Mycobacterium tuberculosis
YNNAAEAFAAQLVT

SEQ ID NO: 167628 - protein, 14 aa, Mycobacterium tuberculosis
NNAAEAFAAQLVTA

SEQ ID NO: 167629 - protein, 14 aa, Mycobacterium tuberculosis
NAAEAFAAQLVTAE

SEQ ID NO: 167630 - protein, 14 aa, Mycobacterium tuberculosis
AAEAFAAQLVTAEQ

SEQ ID NO: 167631 - protein, 14 aa, Mycobacterium tuberculosis
AEAFAAQLVTAEQS

SEQ ID NO: 167632 - protein, 14 aa, Mycobacterium tuberculosis
EAFAAQLVTAEQSV

SEQ ID NO: 167633 - protein, 14 aa, Mycobacterium tuberculosis
AFAAQLVTAEQSVE

SEQ ID NO: 167634 - protein, 14 aa, Mycobacterium tuberculosis
FAAQLVTAEQSVED

SEQ ID NO: 167635 - protein, 14 aa, Mycobacterium tuberculosis
AAQLVTAEQSVEDL

SEQ ID NO: 167636 - protein, 14 aa, Mycobacterium tuberculosis
AQLVTAEQSVEDLK

SEQ ID NO: 167637 - protein, 14 aa, Mycobacterium tuberculosis
QLVTAEQSVEDLKT

SEQ ID NO: 167638 - protein, 14 aa, Mycobacterium tuberculosis
LVTAEQSVEDLKTL

SEQ ID NO: 167639 - protein, 14 aa, Mycobacterium tuberculosis
VTAEQSVEDLKTLH

SEQ ID NO: 167640 - protein, 14 aa, Mycobacterium tuberculosis
TAEQSVEDLKTLHD

SEQ ID NO: 167641 - protein, 14 aa, Mycobacterium tuberculosis
AEQSVEDLKTLHDQ

SEQ ID NO: 167642 - protein, 14 aa, Mycobacterium tuberculosis
EQSVEDLKTLHDQA

SEQ ID NO: 167643 - protein, 14 aa, Mycobacterium tuberculosis
QSVEDLKTLHDQAL

SEQ ID NO: 167644 - protein, 14 aa, Mycobacterium tuberculosis
SVEDLKTLHDQALS

SEQ ID NO: 167645 - protein, 14 aa, Mycobacterium tuberculosis
VEDLKTLHDQALSA

SEQ ID NO: 167646 - protein, 14 aa, Mycobacterium tuberculosis
EDLKTLHDQALSAA

SEQ ID NO: 167647 - protein, 14 aa, Mycobacterium tuberculosis
DLKTLHDQALSAAA

SEQ ID NO: 167648 - protein, 14 aa, Mycobacterium tuberculosis
LKTLHDQALSAAAQ

SEQ ID NO: 167649 - protein, 14 aa, Mycobacterium tuberculosis
KTLHDQALSAAAQA

SEQ ID NO: 167650 - protein, 14 aa, Mycobacterium tuberculosis
TLHDQALSAAAQAK

SEQ ID NO: 167651 - protein, 14 aa, Mycobacterium tuberculosis
LHDQALSAAAQAKK

SEQ ID NO: 167652 - protein, 14 aa, Mycobacterium tuberculosis
HDQALSAAAQAKKA

SEQ ID NO: 167653 - protein, 14 aa, Mycobacterium tuberculosis
DQALSAAAQAKKAV

SEQ ID NO: 167654 - protein, 14 aa, Mycobacterium tuberculosis
QALSAAAQAKKAVE

SEQ ID NO: 167655 - protein, 14 aa, Mycobacterium tuberculosis
ALSAAAQAKKAVER

SEQ ID NO: 167656 - protein, 14 aa, Mycobacterium tuberculosis
LSAAAQAKKAVERN

SEQ ID NO: 167657 - protein, 14 aa, Mycobacterium tuberculosis
SAAAQAKKAVERNA

SEQ ID NO: 167658 - protein, 14 aa, Mycobacterium tuberculosis
AAAQAKKAVERNAM

SEQ ID NO: 167659 - protein, 14 aa, Mycobacterium tuberculosis
AAQAKKAVERNAMV

SEQ ID NO: 167660 - protein, 14 aa, Mycobacterium tuberculosis
AQAKKAVERNAMVL

SEQ ID NO: 167661 - protein, 14 aa, Mycobacterium tuberculosis
QAKKAVERNAMVLQ

SEQ ID NO: 167662 - protein, 14 aa, Mycobacterium tuberculosis
AKKAVERNAMVLQQ

SEQ ID NO: 167663 - protein, 14 aa, Mycobacterium tuberculosis
KKAVERNAMVLQQK

SEQ ID NO: 167664 - protein, 14 aa, Mycobacterium tuberculosis
KAVERNAMVLQQKI

SEQ ID NO: 167665 - protein, 14 aa, Mycobacterium tuberculosis
AVERNAMVLQQKIA

SEQ ID NO: 167666 - protein, 14 aa, Mycobacterium tuberculosis
VERNAMVLQQKIAE

SEQ ID NO: 167667 - protein, 14 aa, Mycobacterium tuberculosis
ERNAMVLQQKIAER

SEQ ID NO: 167668 - protein, 14 aa, Mycobacterium tuberculosis
RNAMVLQQKIAERT

SEQ ID NO: 167669 - protein, 14 aa, Mycobacterium tuberculosis
NAMVLQQKIAERTK

SEQ ID NO: 167670 - protein, 14 aa, Mycobacterium tuberculosis
AMVLQQKIAERTKL

SEQ ID NO: 167671 - protein, 14 aa, Mycobacterium tuberculosis
MVLQQKIAERTKLL

SEQ ID NO: 167672 - protein, 14 aa, Mycobacterium tuberculosis
VLQQKIAERTKLLS

SEQ ID NO: 167673 - protein, 14 aa, Mycobacterium tuberculosis
LQQKIAERTKLLSQ

SEQ ID NO: 167674 - protein, 14 aa, Mycobacterium tuberculosis
QQKIAERTKLLSQL

SEQ ID NO: 167675 - protein, 14 aa, Mycobacterium tuberculosis
QKIAERTKLLSQLE

SEQ ID NO: 167676 - protein, 14 aa, Mycobacterium tuberculosis
KIAERTKLLSQLEQ

SEQ ID NO: 167677 - protein, 14 aa, Mycobacterium tuberculosis
IAERTKLLSQLEQA

SEQ ID NO: 167678 - protein, 14 aa, Mycobacterium tuberculosis
AERTKLLSQLEQAK

SEQ ID NO: 167679 - protein, 14 aa, Mycobacterium tuberculosis
ERTKLLSQLEQAKM

SEQ ID NO: 167680 - protein, 14 aa, Mycobacterium tuberculosis
RTKLLSQLEQAKMQ

SEQ ID NO: 167681 - protein, 14 aa, Mycobacterium tuberculosis
TKLLSQLEQAKMQE

SEQ ID NO: 167682 - protein, 14 aa, Mycobacterium tuberculosis
KLLSQLEQAKMQEQ

SEQ ID NO: 167683 - protein, 14 aa, Mycobacterium tuberculosis
LLSQLEQAKMQEQV

SEQ ID NO: 167684 - protein, 14 aa, Mycobacterium tuberculosis
LSQLEQAKMQEQVS

SEQ ID NO: 167685 - protein, 14 aa, Mycobacterium tuberculosis
SQLEQAKMQEQVSA

SEQ ID NO: 167686 - protein, 14 aa, Mycobacterium tuberculosis
QLEQAKMQEQVSAS

SEQ ID NO: 167687 - protein, 14 aa, Mycobacterium tuberculosis
LEQAKMQEQVSASL

SEQ ID NO: 167688 - protein, 14 aa, Mycobacterium tuberculosis
EQAKMQEQVSASLR

SEQ ID NO: 167689 - protein, 14 aa, Mycobacterium tuberculosis
QAKMQEQVSASLRS

SEQ ID NO: 167690 - protein, 14 aa, Mycobacterium tuberculosis
AKMQEQVSASLRSM

SEQ ID NO: 167691 - protein, 14 aa, Mycobacterium tuberculosis
KMQEQVSASLRSMS

SEQ ID NO: 167692 - protein, 14 aa, Mycobacterium tuberculosis
MQEQVSASLRSMSE

SEQ ID NO: 167693 - protein, 14 aa, Mycobacterium tuberculosis
QEQVSASLRSMSEL

SEQ ID NO: 167694 - protein, 14 aa, Mycobacterium tuberculosis
EQVSASLRSMSELA

SEQ ID NO: 167695 - protein, 14 aa, Mycobacterium tuberculosis
QVSASLRSMSELAA

SEQ ID NO: 167696 - protein, 14 aa, Mycobacterium tuberculosis
VSASLRSMSELAAP

SEQ ID NO: 167697 - protein, 14 aa, Mycobacterium tuberculosis
SASLRSMSELAAPG

SEQ ID NO: 167698 - protein, 14 aa, Mycobacterium tuberculosis
ASLRSMSELAAPGN

SEQ ID NO: 167699 - protein, 14 aa, Mycobacterium tuberculosis
SLRSMSELAAPGNT

SEQ ID NO: 167700 - protein, 14 aa, Mycobacterium tuberculosis
LRSMSELAAPGNTP

SEQ ID NO: 167701 - protein, 14 aa, Mycobacterium tuberculosis
RSMSELAAPGNTPS

SEQ ID NO: 167702 - protein, 14 aa, Mycobacterium tuberculosis
SMSELAAPGNTPSL

SEQ ID NO: 167703 - protein, 14 aa, Mycobacterium tuberculosis
MSELAAPGNTPSLD

SEQ ID NO: 167704 - protein, 14 aa, Mycobacterium tuberculosis
SELAAPGNTPSLDE

SEQ ID NO: 167705 - protein, 14 aa, Mycobacterium tuberculosis
ELAAPGNTPSLDEV

SEQ ID NO: 167706 - protein, 14 aa, Mycobacterium tuberculosis
LAAPGNTPSLDEVR

SEQ ID NO: 167707 - protein, 14 aa, Mycobacterium tuberculosis
AAPGNTPSLDEVRD

SEQ ID NO: 167708 - protein, 14 aa, Mycobacterium tuberculosis
APGNTPSLDEVRDK

SEQ ID NO: 167709 - protein, 14 aa, Mycobacterium tuberculosis
PGNTPSLDEVRDKI

SEQ ID NO: 167710 - protein, 14 aa, Mycobacterium tuberculosis
GNTPSLDEVRDKIE

SEQ ID NO: 167711 - protein, 14 aa, Mycobacterium tuberculosis
NTPSLDEVRDKIER

SEQ ID NO: 167712 - protein, 14 aa, Mycobacterium tuberculosis
TPSLDEVRDKIERR

SEQ ID NO: 167713 - protein, 14 aa, Mycobacterium tuberculosis
PSLDEVRDKIERRY

SEQ ID NO: 167714 - protein, 14 aa, Mycobacterium tuberculosis
SLDEVRDKIERRYA

SEQ ID NO: 167715 - protein, 14 aa, Mycobacterium tuberculosis
LDEVRDKIERRYAN

SEQ ID NO: 167716 - protein, 14 aa, Mycobacterium tuberculosis
DEVRDKIERRYANA

SEQ ID NO: 167717 - protein, 14 aa, Mycobacterium tuberculosis
EVRDKIERRYANAI

SEQ ID NO: 167718 - protein, 14 aa, Mycobacterium tuberculosis
VRDKIERRYANAIG

SEQ ID NO: 167719 - protein, 14 aa, Mycobacterium tuberculosis
RDKIERRYANAIGS

SEQ ID NO: 167720 - protein, 14 aa, Mycobacterium tuberculosis
DKIERRYANAIGSA

SEQ ID NO: 167721 - protein, 14 aa, Mycobacterium tuberculosis
KIERRYANAIGSAE

SEQ ID NO: 167722 - protein, 14 aa, Mycobacterium tuberculosis
IERRYANAIGSAEL

SEQ ID NO: 167723 - protein, 14 aa, Mycobacterium tuberculosis
ERRYANAIGSAELA

SEQ ID NO: 167724 - protein, 14 aa, Mycobacterium tuberculosis
RRYANAIGSAELAE

SEQ ID NO: 167725 - protein, 14 aa, Mycobacterium tuberculosis
RYANAIGSAELAES

SEQ ID NO: 167726 - protein, 14 aa, Mycobacterium tuberculosis
YANAIGSAELAESS

SEQ ID NO: 167727 - protein, 14 aa, Mycobacterium tuberculosis
ANAIGSAELAESSV

SEQ ID NO: 167728 - protein, 14 aa, Mycobacterium tuberculosis
NAIGSAELAESSVQ

SEQ ID NO: 167729 - protein, 14 aa, Mycobacterium tuberculosis
AIGSAELAESSVQG

SEQ ID NO: 167730 - protein, 14 aa, Mycobacterium tuberculosis
IGSAELAESSVQGR

SEQ ID NO: 167731 - protein, 14 aa, Mycobacterium tuberculosis
GSAELAESSVQGRM

SEQ ID NO: 167732 - protein, 14 aa, Mycobacterium tuberculosis
SAELAESSVQGRML

SEQ ID NO: 167733 - protein, 14 aa, Mycobacterium tuberculosis
AELAESSVQGRMLE

SEQ ID NO: 167734 - protein, 14 aa, Mycobacterium tuberculosis
ELAESSVQGRMLEV

SEQ ID NO: 167735 - protein, 14 aa, Mycobacterium tuberculosis
LAESSVQGRMLEVE

SEQ ID NO: 167736 - protein, 14 aa, Mycobacterium tuberculosis
AESSVQGRMLEVEQ

SEQ ID NO: 167737 - protein, 14 aa, Mycobacterium tuberculosis
ESSVQGRMLEVEQA

SEQ ID NO: 167738 - protein, 14 aa, Mycobacterium tuberculosis
SSVQGRMLEVEQAG

SEQ ID NO: 167739 - protein, 14 aa, Mycobacterium tuberculosis
SVQGRMLEVEQAGI

SEQ ID NO: 167740 - protein, 14 aa, Mycobacterium tuberculosis
VQGRMLEVEQAGIQ

SEQ ID NO: 167741 - protein, 14 aa, Mycobacterium tuberculosis
QGRMLEVEQAGIQM

SEQ ID NO: 167742 - protein, 14 aa, Mycobacterium tuberculosis
GRMLEVEQAGIQMA

SEQ ID NO: 167743 - protein, 14 aa, Mycobacterium tuberculosis
RMLEVEQAGIQMAG

SEQ ID NO: 167744 - protein, 14 aa, Mycobacterium tuberculosis
MLEVEQAGIQMAGH

SEQ ID NO: 167745 - protein, 14 aa, Mycobacterium tuberculosis
LEVEQAGIQMAGHS

SEQ ID NO: 167746 - protein, 14 aa, Mycobacterium tuberculosis
EVEQAGIQMAGHSR

SEQ ID NO: 167747 - protein, 14 aa, Mycobacterium tuberculosis
VEQAGIQMAGHSRL

SEQ ID NO: 167748 - protein, 14 aa, Mycobacterium tuberculosis
EQAGIQMAGHSRLE

SEQ ID NO: 167749 - protein, 14 aa, Mycobacterium tuberculosis
QAGIQMAGHSRLEQ

SEQ ID NO: 167750 - protein, 14 aa, Mycobacterium tuberculosis
AGIQMAGHSRLEQI

SEQ ID NO: 167751 - protein, 14 aa, Mycobacterium tuberculosis
GIQMAGHSRLEQIR

SEQ ID NO: 167752 - protein, 14 aa, Mycobacterium tuberculosis
IQMAGHSRLEQIRA

SEQ ID NO: 167753 - protein, 14 aa, Mycobacterium tuberculosis
QMAGHSRLEQIRAS

SEQ ID NO: 167754 - protein, 14 aa, Mycobacterium tuberculosis
MAGHSRLEQIRASM

SEQ ID NO: 167755 - protein, 14 aa, Mycobacterium tuberculosis
AGHSRLEQIRASMR

SEQ ID NO: 167756 - protein, 14 aa, Mycobacterium tuberculosis
GHSRLEQIRASMRG

SEQ ID NO: 167757 - protein, 14 aa, Mycobacterium tuberculosis
HSRLEQIRASMRGE

SEQ ID NO: 167758 - protein, 14 aa, Mycobacterium tuberculosis
SRLEQIRASMRGEA

SEQ ID NO: 167759 - protein, 14 aa, Mycobacterium tuberculosis
RLEQIRASMRGEAL

SEQ ID NO: 167760 - protein, 14 aa, Mycobacterium tuberculosis
LEQIRASMRGEALP

SEQ ID NO: 167761 - protein, 14 aa, Mycobacterium tuberculosis
EQIRASMRGEALPA

SEQ ID NO: 167762 - protein, 14 aa, Mycobacterium tuberculosis
QIRASMRGEALPAG

SEQ ID NO: 167763 - protein, 14 aa, Mycobacterium tuberculosis
IRASMRGEALPAGG

SEQ ID NO: 167764 - protein, 14 aa, Mycobacterium tuberculosis
RASMRGEALPAGGT

SEQ ID NO: 167765 - protein, 14 aa, Mycobacterium tuberculosis
ASMRGEALPAGGTT

SEQ ID NO: 167766 - protein, 14 aa, Mycobacterium tuberculosis
SMRGEALPAGGTTA

SEQ ID NO: 167767 - protein, 14 aa, Mycobacterium tuberculosis
MRGEALPAGGTTAT

SEQ ID NO: 167768 - protein, 14 aa, Mycobacterium tuberculosis
RGEALPAGGTTATP

SEQ ID NO: 167769 - protein, 14 aa, Mycobacterium tuberculosis
GEALPAGGTTATPR

SEQ ID NO: 167770 - protein, 14 aa, Mycobacterium tuberculosis
EALPAGGTTATPRP

SEQ ID NO: 167771 - protein, 14 aa, Mycobacterium tuberculosis
ALPAGGTTATPRPA

SEQ ID NO: 167772 - protein, 14 aa, Mycobacterium tuberculosis
LPAGGTTATPRPAT

SEQ ID NO: 167773 - protein, 14 aa, Mycobacterium tuberculosis
PAGGTTATPRPATE

SEQ ID NO: 167774 - protein, 14 aa, Mycobacterium tuberculosis
AGGTTATPRPATET

SEQ ID NO: 167775 - protein, 14 aa, Mycobacterium tuberculosis
GGTTATPRPATETS

SEQ ID NO: 167776 - protein, 14 aa, Mycobacterium tuberculosis
GTTATPRPATETSG

SEQ ID NO: 167777 - protein, 14 aa, Mycobacterium tuberculosis
TTATPRPATETSGG

SEQ ID NO: 167778 - protein, 14 aa, Mycobacterium tuberculosis
TATPRPATETSGGA

SEQ ID NO: 167779 - protein, 14 aa, Mycobacterium tuberculosis
ATPRPATETSGGAI

SEQ ID NO: 167780 - protein, 14 aa, Mycobacterium tuberculosis
TPRPATETSGGAIA

SEQ ID NO: 167781 - protein, 14 aa, Mycobacterium tuberculosis
PRPATETSGGAIAE

SEQ ID NO: 167782 - protein, 14 aa, Mycobacterium tuberculosis
RPATETSGGAIAEQ

SEQ ID NO: 167783 - protein, 14 aa, Mycobacterium tuberculosis
PATETSGGAIAEQP

SEQ ID NO: 167784 - protein, 14 aa, Mycobacterium tuberculosis
ATETSGGAIAEQPY

SEQ ID NO: 167785 - protein, 14 aa, Mycobacterium tuberculosis
TETSGGAIAEQPYG

SEQ ID NO: 167786 - protein, 14 aa, Mycobacterium tuberculosis
ETSGGAIAEQPYGQ

SEQ ID NO: 167787 - protein, 15 aa, Mycobacterium tuberculosis
MANPFVKAWKYLMAL

SEQ ID NO: 167788 - protein, 15 aa, Mycobacterium tuberculosis
ANPFVKAWKYLMALF

SEQ ID NO: 167789 - protein, 15 aa, Mycobacterium tuberculosis
NPFVKAWKYLMALFS

SEQ ID NO: 167790 - protein, 15 aa, Mycobacterium tuberculosis
PFVKAWKYLMALFSS

SEQ ID NO: 167791 - protein, 15 aa, Mycobacterium tuberculosis
FVKAWKYLMALFSSK

SEQ ID NO: 167792 - protein, 15 aa, Mycobacterium tuberculosis
VKAWKYLMALFSSKI

SEQ ID NO: 167793 - protein, 15 aa, Mycobacterium tuberculosis
KAWKYLMALFSSKID

SEQ ID NO: 167794 - protein, 15 aa, Mycobacterium tuberculosis
AWKYLMALFSSKIDE

SEQ ID NO: 167795 - protein, 15 aa, Mycobacterium tuberculosis
WKYLMALFSSKIDEH

SEQ ID NO: 167796 - protein, 15 aa, Mycobacterium tuberculosis
KYLMALFSSKIDEHA

SEQ ID NO: 167797 - protein, 15 aa, Mycobacterium tuberculosis
YLMALFSSKIDEHAD

SEQ ID NO: 167798 - protein, 15 aa, Mycobacterium tuberculosis
LMALFSSKIDEHADP

SEQ ID NO: 167799 - protein, 15 aa, Mycobacterium tuberculosis
MALFSSKIDEHADPK

SEQ ID NO: 167800 - protein, 15 aa, Mycobacterium tuberculosis
ALFSSKIDEHADPKV

SEQ ID NO: 167801 - protein, 15 aa, Mycobacterium tuberculosis
LFSSKIDEHADPKVQ

SEQ ID NO: 167802 - protein, 15 aa, Mycobacterium tuberculosis
FSSKIDEHADPKVQI

SEQ ID NO: 167803 - protein, 15 aa, Mycobacterium tuberculosis
SSKIDEHADPKVQIQ

SEQ ID NO: 167804 - protein, 15 aa, Mycobacterium tuberculosis
SKIDEHADPKVQIQQ

SEQ ID NO: 167805 - protein, 15 aa, Mycobacterium tuberculosis
KIDEHADPKVQIQQA

SEQ ID NO: 167806 - protein, 15 aa, Mycobacterium tuberculosis
IDEHADPKVQIQQAI

SEQ ID NO: 167807 - protein, 15 aa, Mycobacterium tuberculosis
DEHADPKVQIQQAIE

SEQ ID NO: 167808 - protein, 15 aa, Mycobacterium tuberculosis
EHADPKVQIQQAIEE

SEQ ID NO: 167809 - protein, 15 aa, Mycobacterium tuberculosis
HADPKVQIQQAIEEA

SEQ ID NO: 167810 - protein, 15 aa, Mycobacterium tuberculosis
ADPKVQIQQAIEEAQ

SEQ ID NO: 167811 - protein, 15 aa, Mycobacterium tuberculosis
DPKVQIQQAIEEAQR

SEQ ID NO: 167812 - protein, 15 aa, Mycobacterium tuberculosis
PKVQIQQAIEEAQRT

SEQ ID NO: 167813 - protein, 15 aa, Mycobacterium tuberculosis
KVQIQQAIEEAQRTH

SEQ ID NO: 167814 - protein, 15 aa, Mycobacterium tuberculosis
VQIQQAIEEAQRTHQ

SEQ ID NO: 167815 - protein, 15 aa, Mycobacterium tuberculosis
QIQQAIEEAQRTHQA

SEQ ID NO: 167816 - protein, 15 aa, Mycobacterium tuberculosis
IQQAIEEAQRTHQAL

SEQ ID NO: 167817 - protein, 15 aa, Mycobacterium tuberculosis
QQAIEEAQRTHQALT

SEQ ID NO: 167818 - protein, 15 aa, Mycobacterium tuberculosis
QAIEEAQRTHQALTQ

SEQ ID NO: 167819 - protein, 15 aa, Mycobacterium tuberculosis
AIEEAQRTHQALTQQ

SEQ ID NO: 167820 - protein, 15 aa, Mycobacterium tuberculosis
IEEAQRTHQALTQQA

SEQ ID NO: 167821 - protein, 15 aa, Mycobacterium tuberculosis
EEAQRTHQALTQQAA

SEQ ID NO: 167822 - protein, 15 aa, Mycobacterium tuberculosis
EAQRTHQALTQQAAQ

SEQ ID NO: 167823 - protein, 15 aa, Mycobacterium tuberculosis
AQRTHQALTQQAAQV

SEQ ID NO: 167824 - protein, 15 aa, Mycobacterium tuberculosis
QRTHQALTQQAAQVI

SEQ ID NO: 167825 - protein, 15 aa, Mycobacterium tuberculosis
RTHQALTQQAAQVIG

SEQ ID NO: 167826 - protein, 15 aa, Mycobacterium tuberculosis
THQALTQQAAQVIGN

SEQ ID NO: 167827 - protein, 15 aa, Mycobacterium tuberculosis
HQALTQQAAQVIGNQ

SEQ ID NO: 167828 - protein, 15 aa, Mycobacterium tuberculosis
QALTQQAAQVIGNQR

SEQ ID NO: 167829 - protein, 15 aa, Mycobacterium tuberculosis
ALTQQAAQVIGNQRQ

SEQ ID NO: 167830 - protein, 15 aa, Mycobacterium tuberculosis
LTQQAAQVIGNQRQL

SEQ ID NO: 167831 - protein, 15 aa, Mycobacterium tuberculosis
TQQAAQVIGNQRQLE

SEQ ID NO: 167832 - protein, 15 aa, Mycobacterium tuberculosis
QQAAQVIGNQRQLEM

SEQ ID NO: 167833 - protein, 15 aa, Mycobacterium tuberculosis
QAAQVIGNQRQLEMR

SEQ ID NO: 167834 - protein, 15 aa, Mycobacterium tuberculosis
AAQVIGNQRQLEMRL

SEQ ID NO: 167835 - protein, 15 aa, Mycobacterium tuberculosis
AQVIGNQRQLEMRLN

SEQ ID NO: 167836 - protein, 15 aa, Mycobacterium tuberculosis
QVIGNQRQLEMRLNR

SEQ ID NO: 167837 - protein, 15 aa, Mycobacterium tuberculosis
VIGNQRQLEMRLNRQ

SEQ ID NO: 167838 - protein, 15 aa, Mycobacterium tuberculosis
IGNQRQLEMRLNRQL

SEQ ID NO: 167839 - protein, 15 aa, Mycobacterium tuberculosis
GNQRQLEMRLNRQLA

SEQ ID NO: 167840 - protein, 15 aa, Mycobacterium tuberculosis
NQRQLEMRLNRQLAD

SEQ ID NO: 167841 - protein, 15 aa, Mycobacterium tuberculosis
QRQLEMRLNRQLADI

SEQ ID NO: 167842 - protein, 15 aa, Mycobacterium tuberculosis
RQLEMRLNRQLADIE

SEQ ID NO: 167843 - protein, 15 aa, Mycobacterium tuberculosis
QLEMRLNRQLADIEK

SEQ ID NO: 167844 - protein, 15 aa, Mycobacterium tuberculosis
LEMRLNRQLADIEKL

SEQ ID NO: 167845 - protein, 15 aa, Mycobacterium tuberculosis
EMRLNRQLADIEKLQ

SEQ ID NO: 167846 - protein, 15 aa, Mycobacterium tuberculosis
MRLNRQLADIEKLQV

SEQ ID NO: 167847 - protein, 15 aa, Mycobacterium tuberculosis
RLNRQLADIEKLQVN

SEQ ID NO: 167848 - protein, 15 aa, Mycobacterium tuberculosis
LNRQLADIEKLQVNV

SEQ ID NO: 167849 - protein, 15 aa, Mycobacterium tuberculosis
NRQLADIEKLQVNVR

SEQ ID NO: 167850 - protein, 15 aa, Mycobacterium tuberculosis
RQLADIEKLQVNVRQ

SEQ ID NO: 167851 - protein, 15 aa, Mycobacterium tuberculosis
QLADIEKLQVNVRQA

SEQ ID NO: 167852 - protein, 15 aa, Mycobacterium tuberculosis
LADIEKLQVNVRQAL

SEQ ID NO: 167853 - protein, 15 aa, Mycobacterium tuberculosis
ADIEKLQVNVRQALT

SEQ ID NO: 167854 - protein, 15 aa, Mycobacterium tuberculosis
DIEKLQVNVRQALTL

SEQ ID NO: 167855 - protein, 15 aa, Mycobacterium tuberculosis
IEKLQVNVRQALTLA

SEQ ID NO: 167856 - protein, 15 aa, Mycobacterium tuberculosis
EKLQVNVRQALTLAD

SEQ ID NO: 167857 - protein, 15 aa, Mycobacterium tuberculosis
KLQVNVRQALTLADQ

SEQ ID NO: 167858 - protein, 15 aa, Mycobacterium tuberculosis
LQVNVRQALTLADQA

SEQ ID NO: 167859 - protein, 15 aa, Mycobacterium tuberculosis
QVNVRQALTLADQAT

SEQ ID NO: 167860 - protein, 15 aa, Mycobacterium tuberculosis
VNVRQALTLADQATA

SEQ ID NO: 167861 - protein, 15 aa, Mycobacterium tuberculosis
NVRQALTLADQATAA

SEQ ID NO: 167862 - protein, 15 aa, Mycobacterium tuberculosis
VRQALTLADQATAAG

SEQ ID NO: 167863 - protein, 15 aa, Mycobacterium tuberculosis
RQALTLADQATAAGD

SEQ ID NO: 167864 - protein, 15 aa, Mycobacterium tuberculosis
QALTLADQATAAGDA

SEQ ID NO: 167865 - protein, 15 aa, Mycobacterium tuberculosis
ALTLADQATAAGDAA

SEQ ID NO: 167866 - protein, 15 aa, Mycobacterium tuberculosis
LTLADQATAAGDAAK

SEQ ID NO: 167867 - protein, 15 aa, Mycobacterium tuberculosis
TLADQATAAGDAAKA

SEQ ID NO: 167868 - protein, 15 aa, Mycobacterium tuberculosis
LADQATAAGDAAKAT

SEQ ID NO: 167869 - protein, 15 aa, Mycobacterium tuberculosis
ADQATAAGDAAKATE

SEQ ID NO: 167870 - protein, 15 aa, Mycobacterium tuberculosis
DQATAAGDAAKATEY

SEQ ID NO: 167871 - protein, 15 aa, Mycobacterium tuberculosis
QATAAGDAAKATEYN

SEQ ID NO: 167872 - protein, 15 aa, Mycobacterium tuberculosis
ATAAGDAAKATEYNN

SEQ ID NO: 167873 - protein, 15 aa, Mycobacterium tuberculosis
TAAGDAAKATEYNNA

SEQ ID NO: 167874 - protein, 15 aa, Mycobacterium tuberculosis
AAGDAAKATEYNNAA

SEQ ID NO: 167875 - protein, 15 aa, Mycobacterium tuberculosis
AGDAAKATEYNNAAE

SEQ ID NO: 167876 - protein, 15 aa, Mycobacterium tuberculosis
GDAAKATEYNNAAEA

SEQ ID NO: 167877 - protein, 15 aa, Mycobacterium tuberculosis
DAAKATEYNNAAEAF

SEQ ID NO: 167878 - protein, 15 aa, Mycobacterium tuberculosis
AAKATEYNNAAEAFA

SEQ ID NO: 167879 - protein, 15 aa, Mycobacterium tuberculosis
AKATEYNNAAEAFAA

SEQ ID NO: 167880 - protein, 15 aa, Mycobacterium tuberculosis
KATEYNNAAEAFAAQ

SEQ ID NO: 167881 - protein, 15 aa, Mycobacterium tuberculosis
ATEYNNAAEAFAAQL

SEQ ID NO: 167882 - protein, 15 aa, Mycobacterium tuberculosis
TEYNNAAEAFAAQLV

SEQ ID NO: 167883 - protein, 15 aa, Mycobacterium tuberculosis
EYNNAAEAFAAQLVT

SEQ ID NO: 167884 - protein, 15 aa, Mycobacterium tuberculosis
YNNAAEAFAAQLVTA

SEQ ID NO: 167885 - protein, 15 aa, Mycobacterium tuberculosis
NNAAEAFAAQLVTAE

SEQ ID NO: 167886 - protein, 15 aa, Mycobacterium tuberculosis
NAAEAFAAQLVTAEQ

SEQ ID NO: 167887 - protein, 15 aa, Mycobacterium tuberculosis
AAEAFAAQLVTAEQS

SEQ ID NO: 167888 - protein, 15 aa, Mycobacterium tuberculosis
AEAFAAQLVTAEQSV

SEQ ID NO: 167889 - protein, 15 aa, Mycobacterium tuberculosis
EAFAAQLVTAEQSVE

SEQ ID NO: 167890 - protein, 15 aa, Mycobacterium tuberculosis
AFAAQLVTAEQSVED

SEQ ID NO: 167891 - protein, 15 aa, Mycobacterium tuberculosis
FAAQLVTAEQSVEDL

SEQ ID NO: 167892 - protein, 15 aa, Mycobacterium tuberculosis
AAQLVTAEQSVEDLK

SEQ ID NO: 167893 - protein, 15 aa, Mycobacterium tuberculosis
AQLVTAEQSVEDLKT

SEQ ID NO: 167894 - protein, 15 aa, Mycobacterium tuberculosis
QLVTAEQSVEDLKTL

SEQ ID NO: 167895 - protein, 15 aa, Mycobacterium tuberculosis
LVTAEQSVEDLKTLH

SEQ ID NO: 167896 - protein, 15 aa, Mycobacterium tuberculosis
VTAEQSVEDLKTLHD

SEQ ID NO: 167897 - protein, 15 aa, Mycobacterium tuberculosis
TAEQSVEDLKTLHDQ

SEQ ID NO: 167898 - protein, 15 aa, Mycobacterium tuberculosis
AEQSVEDLKTLHDQA

SEQ ID NO: 167899 - protein, 15 aa, Mycobacterium tuberculosis
EQSVEDLKTLHDQAL

SEQ ID NO: 167900 - protein, 15 aa, Mycobacterium tuberculosis
QSVEDLKTLHDQALS

SEQ ID NO: 167901 - protein, 15 aa, Mycobacterium tuberculosis
SVEDLKTLHDQALSA

SEQ ID NO: 167902 - protein, 15 aa, Mycobacterium tuberculosis
VEDLKTLHDQALSAA

SEQ ID NO: 167903 - protein, 15 aa, Mycobacterium tuberculosis
EDLKTLHDQALSAAA

SEQ ID NO: 167904 - protein, 15 aa, Mycobacterium tuberculosis
DLKTLHDQALSAAAQ

SEQ ID NO: 167905 - protein, 15 aa, Mycobacterium tuberculosis
LKTLHDQALSAAAQA

SEQ ID NO: 167906 - protein, 15 aa, Mycobacterium tuberculosis
KTLHDQALSAAAQAK

SEQ ID NO: 167907 - protein, 15 aa, Mycobacterium tuberculosis
TLHDQALSAAAQAKK

SEQ ID NO: 167908 - protein, 15 aa, Mycobacterium tuberculosis
LHDQALSAAAQAKKA

SEQ ID NO: 167909 - protein, 15 aa, Mycobacterium tuberculosis
HDQALSAAAQAKKAV

SEQ ID NO: 167910 - protein, 15 aa, Mycobacterium tuberculosis
DQALSAAAQAKKAVE

SEQ ID NO: 167911 - protein, 15 aa, Mycobacterium tuberculosis
QALSAAAQAKKAVER

SEQ ID NO: 167912 - protein, 15 aa, Mycobacterium tuberculosis
ALSAAAQAKKAVERN

SEQ ID NO: 167913 - protein, 15 aa, Mycobacterium tuberculosis
LSAAAQAKKAVERNA

SEQ ID NO: 167914 - protein, 15 aa, Mycobacterium tuberculosis
SAAAQAKKAVERNAM

SEQ ID NO: 167915 - protein, 15 aa, Mycobacterium tuberculosis
AAAQAKKAVERNAMV

SEQ ID NO: 167916 - protein, 15 aa, Mycobacterium tuberculosis
AAQAKKAVERNAMVL

SEQ ID NO: 167917 - protein, 15 aa, Mycobacterium tuberculosis
AQAKKAVERNAMVLQ

SEQ ID NO: 167918 - protein, 15 aa, Mycobacterium tuberculosis
QAKKAVERNAMVLQQ

SEQ ID NO: 167919 - protein, 15 aa, Mycobacterium tuberculosis
AKKAVERNAMVLQQK

SEQ ID NO: 167920 - protein, 15 aa, Mycobacterium tuberculosis
KKAVERNAMVLQQKI

SEQ ID NO: 167921 - protein, 15 aa, Mycobacterium tuberculosis
KAVERNAMVLQQKIA

SEQ ID NO: 167922 - protein, 15 aa, Mycobacterium tuberculosis
AVERNAMVLQQKIAE

SEQ ID NO: 167923 - protein, 15 aa, Mycobacterium tuberculosis
VERNAMVLQQKIAER

SEQ ID NO: 167924 - protein, 15 aa, Mycobacterium tuberculosis
ERNAMVLQQKIAERT

SEQ ID NO: 167925 - protein, 15 aa, Mycobacterium tuberculosis
RNAMVLQQKIAERTK

SEQ ID NO: 167926 - protein, 15 aa, Mycobacterium tuberculosis
NAMVLQQKIAERTKL

SEQ ID NO: 167927 - protein, 15 aa, Mycobacterium tuberculosis
AMVLQQKIAERTKLL

SEQ ID NO: 167928 - protein, 15 aa, Mycobacterium tuberculosis
MVLQQKIAERTKLLS

SEQ ID NO: 167929 - protein, 15 aa, Mycobacterium tuberculosis
VLQQKIAERTKLLSQ

SEQ ID NO: 167930 - protein, 15 aa, Mycobacterium tuberculosis
LQQKIAERTKLLSQL

SEQ ID NO: 167931 - protein, 15 aa, Mycobacterium tuberculosis
QQKIAERTKLLSQLE

SEQ ID NO: 167932 - protein, 15 aa, Mycobacterium tuberculosis
QKIAERTKLLSQLEQ

SEQ ID NO: 167933 - protein, 15 aa, Mycobacterium tuberculosis
KIAERTKLLSQLEQA

SEQ ID NO: 167934 - protein, 15 aa, Mycobacterium tuberculosis
IAERTKLLSQLEQAK

SEQ ID NO: 167935 - protein, 15 aa, Mycobacterium tuberculosis
AERTKLLSQLEQAKM

SEQ ID NO: 167936 - protein, 15 aa, Mycobacterium tuberculosis
ERTKLLSQLEQAKMQ

SEQ ID NO: 167937 - protein, 15 aa, Mycobacterium tuberculosis
RTKLLSQLEQAKMQE

SEQ ID NO: 167938 - protein, 15 aa, Mycobacterium tuberculosis
TKLLSQLEQAKMQEQ

SEQ ID NO: 167939 - protein, 15 aa, Mycobacterium tuberculosis
KLLSQLEQAKMQEQV

SEQ ID NO: 167940 - protein, 15 aa, Mycobacterium tuberculosis
LLSQLEQAKMQEQVS

SEQ ID NO: 167941 - protein, 15 aa, Mycobacterium tuberculosis
LSQLEQAKMQEQVSA

SEQ ID NO: 167942 - protein, 15 aa, Mycobacterium tuberculosis
SQLEQAKMQEQVSAS

SEQ ID NO: 167943 - protein, 15 aa, Mycobacterium tuberculosis
QLEQAKMQEQVSASL

SEQ ID NO: 167944 - protein, 15 aa, Mycobacterium tuberculosis
LEQAKMQEQVSASLR

SEQ ID NO: 167945 - protein, 15 aa, Mycobacterium tuberculosis
EQAKMQEQVSASLRS

SEQ ID NO: 167946 - protein, 15 aa, Mycobacterium tuberculosis
QAKMQEQVSASLRSM

SEQ ID NO: 167947 - protein, 15 aa, Mycobacterium tuberculosis
AKMQEQVSASLRSMS

SEQ ID NO: 167948 - protein, 15 aa, Mycobacterium tuberculosis
KMQEQVSASLRSMSE

SEQ ID NO: 167949 - protein, 15 aa, Mycobacterium tuberculosis
MQEQVSASLRSMSEL

SEQ ID NO: 167950 - protein, 15 aa, Mycobacterium tuberculosis
QEQVSASLRSMSELA

SEQ ID NO: 167951 - protein, 15 aa, Mycobacterium tuberculosis
EQVSASLRSMSELAA

SEQ ID NO: 167952 - protein, 15 aa, Mycobacterium tuberculosis
QVSASLRSMSELAAP

SEQ ID NO: 167953 - protein, 15 aa, Mycobacterium tuberculosis
VSASLRSMSELAAPG

SEQ ID NO: 167954 - protein, 15 aa, Mycobacterium tuberculosis
SASLRSMSELAAPGN

SEQ ID NO: 167955 - protein, 15 aa, Mycobacterium tuberculosis
ASLRSMSELAAPGNT

SEQ ID NO: 167956 - protein, 15 aa, Mycobacterium tuberculosis
SLRSMSELAAPGNTP

SEQ ID NO: 167957 - protein, 15 aa, Mycobacterium tuberculosis
LRSMSELAAPGNTPS

SEQ ID NO: 167958 - protein, 15 aa, Mycobacterium tuberculosis
RSMSELAAPGNTPSL

SEQ ID NO: 167959 - protein, 15 aa, Mycobacterium tuberculosis
SMSELAAPGNTPSLD

SEQ ID NO: 167960 - protein, 15 aa, Mycobacterium tuberculosis
MSELAAPGNTPSLDE

SEQ ID NO: 167961 - protein, 15 aa, Mycobacterium tuberculosis
SELAAPGNTPSLDEV

SEQ ID NO: 167962 - protein, 15 aa, Mycobacterium tuberculosis
ELAAPGNTPSLDEVR

SEQ ID NO: 167963 - protein, 15 aa, Mycobacterium tuberculosis
LAAPGNTPSLDEVRD

SEQ ID NO: 167964 - protein, 15 aa, Mycobacterium tuberculosis
AAPGNTPSLDEVRDK

SEQ ID NO: 167965 - protein, 15 aa, Mycobacterium tuberculosis
APGNTPSLDEVRDKI

SEQ ID NO: 167966 - protein, 15 aa, Mycobacterium tuberculosis
PGNTPSLDEVRDKIE

SEQ ID NO: 167967 - protein, 15 aa, Mycobacterium tuberculosis
GNTPSLDEVRDKIER

SEQ ID NO: 167968 - protein, 15 aa, Mycobacterium tuberculosis
NTPSLDEVRDKIERR

SEQ ID NO: 167969 - protein, 15 aa, Mycobacterium tuberculosis
TPSLDEVRDKIERRY

SEQ ID NO: 167970 - protein, 15 aa, Mycobacterium tuberculosis
PSLDEVRDKIERRYA

SEQ ID NO: 167971 - protein, 15 aa, Mycobacterium tuberculosis
SLDEVRDKIERRYAN

SEQ ID NO: 167972 - protein, 15 aa, Mycobacterium tuberculosis
LDEVRDKIERRYANA

SEQ ID NO: 167973 - protein, 15 aa, Mycobacterium tuberculosis
DEVRDKIERRYANAI

SEQ ID NO: 167974 - protein, 15 aa, Mycobacterium tuberculosis
EVRDKIERRYANAIG

SEQ ID NO: 167975 - protein, 15 aa, Mycobacterium tuberculosis
VRDKIERRYANAIGS

SEQ ID NO: 167976 - protein, 15 aa, Mycobacterium tuberculosis
RDKIERRYANAIGSA

SEQ ID NO: 167977 - protein, 15 aa, Mycobacterium tuberculosis
DKIERRYANAIGSAE

SEQ ID NO: 167978 - protein, 15 aa, Mycobacterium tuberculosis
KIERRYANAIGSAEL

SEQ ID NO: 167979 - protein, 15 aa, Mycobacterium tuberculosis
IERRYANAIGSAELA

SEQ ID NO: 167980 - protein, 15 aa, Mycobacterium tuberculosis
ERRYANAIGSAELAE

SEQ ID NO: 167981 - protein, 15 aa, Mycobacterium tuberculosis
RRYANAIGSAELAES

SEQ ID NO: 167982 - protein, 15 aa, Mycobacterium tuberculosis
RYANAIGSAELAESS

SEQ ID NO: 167983 - protein, 15 aa, Mycobacterium tuberculosis
YANAIGSAELAESSV

SEQ ID NO: 167984 - protein, 15 aa, Mycobacterium tuberculosis
ANAIGSAELAESSVQ

SEQ ID NO: 167985 - protein, 15 aa, Mycobacterium tuberculosis
NAIGSAELAESSVQG

SEQ ID NO: 167986 - protein, 15 aa, Mycobacterium tuberculosis
AIGSAELAESSVQGR

SEQ ID NO: 167987 - protein, 15 aa, Mycobacterium tuberculosis
IGSAELAESSVQGRM

SEQ ID NO: 167988 - protein, 15 aa, Mycobacterium tuberculosis
GSAELAESSVQGRML

SEQ ID NO: 167989 - protein, 15 aa, Mycobacterium tuberculosis
SAELAESSVQGRMLE

SEQ ID NO: 167990 - protein, 15 aa, Mycobacterium tuberculosis
AELAESSVQGRMLEV

SEQ ID NO: 167991 - protein, 15 aa, Mycobacterium tuberculosis
ELAESSVQGRMLEVE

SEQ ID NO: 167992 - protein, 15 aa, Mycobacterium tuberculosis
LAESSVQGRMLEVEQ

SEQ ID NO: 167993 - protein, 15 aa, Mycobacterium tuberculosis
AESSVQGRMLEVEQA

SEQ ID NO: 167994 - protein, 15 aa, Mycobacterium tuberculosis
ESSVQGRMLEVEQAG

SEQ ID NO: 167995 - protein, 15 aa, Mycobacterium tuberculosis
SSVQGRMLEVEQAGI

SEQ ID NO: 167996 - protein, 15 aa, Mycobacterium tuberculosis
SVQGRMLEVEQAGIQ

SEQ ID NO: 167997 - protein, 15 aa, Mycobacterium tuberculosis
VQGRMLEVEQAGIQM

SEQ ID NO: 167998 - protein, 15 aa, Mycobacterium tuberculosis
QGRMLEVEQAGIQMA

SEQ ID NO: 167999 - protein, 15 aa, Mycobacterium tuberculosis
GRMLEVEQAGIQMAG

SEQ ID NO: 168000 - protein, 15 aa, Mycobacterium tuberculosis
RMLEVEQAGIQMAGH

SEQ ID NO: 168001 - protein, 15 aa, Mycobacterium tuberculosis
MLEVEQAGIQMAGHS

SEQ ID NO: 168002 - protein, 15 aa, Mycobacterium tuberculosis
LEVEQAGIQMAGHSR

SEQ ID NO: 168003 - protein, 15 aa, Mycobacterium tuberculosis
EVEQAGIQMAGHSRL

SEQ ID NO: 168004 - protein, 15 aa, Mycobacterium tuberculosis
VEQAGIQMAGHSRLE

SEQ ID NO: 168005 - protein, 15 aa, Mycobacterium tuberculosis
EQAGIQMAGHSRLEQ

SEQ ID NO: 168006 - protein, 15 aa, Mycobacterium tuberculosis
QAGIQMAGHSRLEQI

SEQ ID NO: 168007 - protein, 15 aa, Mycobacterium tuberculosis
AGIQMAGHSRLEQIR

SEQ ID NO: 168008 - protein, 15 aa, Mycobacterium tuberculosis
GIQMAGHSRLEQIRA

SEQ ID NO: 168009 - protein, 15 aa, Mycobacterium tuberculosis
IQMAGHSRLEQIRAS

SEQ ID NO: 168010 - protein, 15 aa, Mycobacterium tuberculosis
QMAGHSRLEQIRASM

SEQ ID NO: 168011 - protein, 15 aa, Mycobacterium tuberculosis
MAGHSRLEQIRASMR

SEQ ID NO: 168012 - protein, 15 aa, Mycobacterium tuberculosis
AGHSRLEQIRASMRG

SEQ ID NO: 168013 - protein, 15 aa, Mycobacterium tuberculosis
GHSRLEQIRASMRGE

SEQ ID NO: 168014 - protein, 15 aa, Mycobacterium tuberculosis
HSRLEQIRASMRGEA

SEQ ID NO: 168015 - protein, 15 aa, Mycobacterium tuberculosis
SRLEQIRASMRGEAL

SEQ ID NO: 168016 - protein, 15 aa, Mycobacterium tuberculosis
RLEQIRASMRGEALP

SEQ ID NO: 168017 - protein, 15 aa, Mycobacterium tuberculosis
LEQIRASMRGEALPA

SEQ ID NO: 168018 - protein, 15 aa, Mycobacterium tuberculosis
EQIRASMRGEALPAG

SEQ ID NO: 168019 - protein, 15 aa, Mycobacterium tuberculosis
QIRASMRGEALPAGG

SEQ ID NO: 168020 - protein, 15 aa, Mycobacterium tuberculosis
IRASMRGEALPAGGT

SEQ ID NO: 168021 - protein, 15 aa, Mycobacterium tuberculosis
RASMRGEALPAGGTT

SEQ ID NO: 168022 - protein, 15 aa, Mycobacterium tuberculosis
ASMRGEALPAGGTTA

SEQ ID NO: 168023 - protein, 15 aa, Mycobacterium tuberculosis
SMRGEALPAGGTTAT

SEQ ID NO: 168024 - protein, 15 aa, Mycobacterium tuberculosis
MRGEALPAGGTTATP

SEQ ID NO: 168025 - protein, 15 aa, Mycobacterium tuberculosis
RGEALPAGGTTATPR

SEQ ID NO: 168026 - protein, 15 aa, Mycobacterium tuberculosis
GEALPAGGTTATPRP

SEQ ID NO: 168027 - protein, 15 aa, Mycobacterium tuberculosis
EALPAGGTTATPRPA

SEQ ID NO: 168028 - protein, 15 aa, Mycobacterium tuberculosis
ALPAGGTTATPRPAT

SEQ ID NO: 168029 - protein, 15 aa, Mycobacterium tuberculosis
LPAGGTTATPRPATE

SEQ ID NO: 168030 - protein, 15 aa, Mycobacterium tuberculosis
PAGGTTATPRPATET

SEQ ID NO: 168031 - protein, 15 aa, Mycobacterium tuberculosis
AGGTTATPRPATETS

SEQ ID NO: 168032 - protein, 15 aa, Mycobacterium tuberculosis
GGTTATPRPATETSG

SEQ ID NO: 168033 - protein, 15 aa, Mycobacterium tuberculosis
GTTATPRPATETSGG

SEQ ID NO: 168034 - protein, 15 aa, Mycobacterium tuberculosis
TTATPRPATETSGGA

SEQ ID NO: 168035 - protein, 15 aa, Mycobacterium tuberculosis
TATPRPATETSGGAI

SEQ ID NO: 168036 - protein, 15 aa, Mycobacterium tuberculosis
ATPRPATETSGGAIA

SEQ ID NO: 168037 - protein, 15 aa, Mycobacterium tuberculosis
TPRPATETSGGAIAE

SEQ ID NO: 168038 - protein, 15 aa, Mycobacterium tuberculosis
PRPATETSGGAIAEQ

SEQ ID NO: 168039 - protein, 15 aa, Mycobacterium tuberculosis
RPATETSGGAIAEQP

SEQ ID NO: 168040 - protein, 15 aa, Mycobacterium tuberculosis
PATETSGGAIAEQPY

SEQ ID NO: 168041 - protein, 15 aa, Mycobacterium tuberculosis
ATETSGGAIAEQPYG

SEQ ID NO: 168042 - protein, 15 aa, Mycobacterium tuberculosis
TETSGGAIAEQPYGQ

SEQ ID NO: 168043 - protein, 16 aa, Mycobacterium tuberculosis
MANPFVKAWKYLMALF

SEQ ID NO: 168044 - protein, 16 aa, Mycobacterium tuberculosis
ANPFVKAWKYLMALFS

SEQ ID NO: 168045 - protein, 16 aa, Mycobacterium tuberculosis
NPFVKAWKYLMALFSS

SEQ ID NO: 168046 - protein, 16 aa, Mycobacterium tuberculosis
PFVKAWKYLMALFSSK

SEQ ID NO: 168047 - protein, 16 aa, Mycobacterium tuberculosis
FVKAWKYLMALFSSKI

SEQ ID NO: 168048 - protein, 16 aa, Mycobacterium tuberculosis
VKAWKYLMALFSSKID

SEQ ID NO: 168049 - protein, 16 aa, Mycobacterium tuberculosis
KAWKYLMALFSSKIDE

SEQ ID NO: 168050 - protein, 16 aa, Mycobacterium tuberculosis
AWKYLMALFSSKIDEH

SEQ ID NO: 168051 - protein, 16 aa, Mycobacterium tuberculosis
WKYLMALFSSKIDEHA

SEQ ID NO: 168052 - protein, 16 aa, Mycobacterium tuberculosis
KYLMALFSSKIDEHAD

SEQ ID NO: 168053 - protein, 16 aa, Mycobacterium tuberculosis
YLMALFSSKIDEHADP

SEQ ID NO: 168054 - protein, 16 aa, Mycobacterium tuberculosis
LMALFSSKIDEHADPK

SEQ ID NO: 168055 - protein, 16 aa, Mycobacterium tuberculosis
MALFSSKIDEHADPKV

SEQ ID NO: 168056 - protein, 16 aa, Mycobacterium tuberculosis
ALFSSKIDEHADPKVQ

SEQ ID NO: 168057 - protein, 16 aa, Mycobacterium tuberculosis
LFSSKIDEHADPKVQI

SEQ ID NO: 168058 - protein, 16 aa, Mycobacterium tuberculosis
FSSKIDEHADPKVQIQ

SEQ ID NO: 168059 - protein, 16 aa, Mycobacterium tuberculosis
SSKIDEHADPKVQIQQ

SEQ ID NO: 168060 - protein, 16 aa, Mycobacterium tuberculosis
SKIDEHADPKVQIQQA

SEQ ID NO: 168061 - protein, 16 aa, Mycobacterium tuberculosis
KIDEHADPKVQIQQAI

SEQ ID NO: 168062 - protein, 16 aa, Mycobacterium tuberculosis
IDEHADPKVQIQQAIE

SEQ ID NO: 168063 - protein, 16 aa, Mycobacterium tuberculosis
DEHADPKVQIQQAIEE

SEQ ID NO: 168064 - protein, 16 aa, Mycobacterium tuberculosis
EHADPKVQIQQAIEEA

SEQ ID NO: 168065 - protein, 16 aa, Mycobacterium tuberculosis
HADPKVQIQQAIEEAQ

SEQ ID NO: 168066 - protein, 16 aa, Mycobacterium tuberculosis
ADPKVQIQQAIEEAQR

SEQ ID NO: 168067 - protein, 16 aa, Mycobacterium tuberculosis
DPKVQIQQAIEEAQRT

SEQ ID NO: 168068 - protein, 16 aa, Mycobacterium tuberculosis
PKVQIQQAIEEAQRTH

SEQ ID NO: 168069 - protein, 16 aa, Mycobacterium tuberculosis
KVQIQQAIEEAQRTHQ

SEQ ID NO: 168070 - protein, 16 aa, Mycobacterium tuberculosis
VQIQQAIEEAQRTHQA

SEQ ID NO: 168071 - protein, 16 aa, Mycobacterium tuberculosis
QIQQAIEEAQRTHQAL

SEQ ID NO: 168072 - protein, 16 aa, Mycobacterium tuberculosis
IQQAIEEAQRTHQALT

SEQ ID NO: 168073 - protein, 16 aa, Mycobacterium tuberculosis
QQAIEEAQRTHQALTQ

SEQ ID NO: 168074 - protein, 16 aa, Mycobacterium tuberculosis
QAIEEAQRTHQALTQQ

SEQ ID NO: 168075 - protein, 16 aa, Mycobacterium tuberculosis
AIEEAQRTHQALTQQA

SEQ ID NO: 168076 - protein, 16 aa, Mycobacterium tuberculosis
IEEAQRTHQALTQQAA

SEQ ID NO: 168077 - protein, 16 aa, Mycobacterium tuberculosis
EEAQRTHQALTQQAAQ

SEQ ID NO: 168078 - protein, 16 aa, Mycobacterium tuberculosis
EAQRTHQALTQQAAQV

SEQ ID NO: 168079 - protein, 16 aa, Mycobacterium tuberculosis
AQRTHQALTQQAAQVI

SEQ ID NO: 168080 - protein, 16 aa, Mycobacterium tuberculosis
QRTHQALTQQAAQVIG

SEQ ID NO: 168081 - protein, 16 aa, Mycobacterium tuberculosis
RTHQALTQQAAQVIGN

SEQ ID NO: 168082 - protein, 16 aa, Mycobacterium tuberculosis
THQALTQQAAQVIGNQ

SEQ ID NO: 168083 - protein, 16 aa, Mycobacterium tuberculosis
HQALTQQAAQVIGNQR

SEQ ID NO: 168084 - protein, 16 aa, Mycobacterium tuberculosis
QALTQQAAQVIGNQRQ

SEQ ID NO: 168085 - protein, 16 aa, Mycobacterium tuberculosis
ALTQQAAQVIGNQRQL

SEQ ID NO: 168086 - protein, 16 aa, Mycobacterium tuberculosis
LTQQAAQVIGNQRQLE

SEQ ID NO: 168087 - protein, 16 aa, Mycobacterium tuberculosis
TQQAAQVIGNQRQLEM

SEQ ID NO: 168088 - protein, 16 aa, Mycobacterium tuberculosis
QQAAQVIGNQRQLEMR

SEQ ID NO: 168089 - protein, 16 aa, Mycobacterium tuberculosis
QAAQVIGNQRQLEMRL

SEQ ID NO: 168090 - protein, 16 aa, Mycobacterium tuberculosis
AAQVIGNQRQLEMRLN

SEQ ID NO: 168091 - protein, 16 aa, Mycobacterium tuberculosis
AQVIGNQRQLEMRLNR

SEQ ID NO: 168092 - protein, 16 aa, Mycobacterium tuberculosis
QVIGNQRQLEMRLNRQ

SEQ ID NO: 168093 - protein, 16 aa, Mycobacterium tuberculosis
VIGNQRQLEMRLNRQL

SEQ ID NO: 168094 - protein, 16 aa, Mycobacterium tuberculosis
IGNQRQLEMRLNRQLA

SEQ ID NO: 168095 - protein, 16 aa, Mycobacterium tuberculosis
GNQRQLEMRLNRQLAD

SEQ ID NO: 168096 - protein, 16 aa, Mycobacterium tuberculosis
NQRQLEMRLNRQLADI

SEQ ID NO: 168097 - protein, 16 aa, Mycobacterium tuberculosis
QRQLEMRLNRQLADIE

SEQ ID NO: 168098 - protein, 16 aa, Mycobacterium tuberculosis
RQLEMRLNRQLADIEK

SEQ ID NO: 168099 - protein, 16 aa, Mycobacterium tuberculosis
QLEMRLNRQLADIEKL

SEQ ID NO: 168100 - protein, 16 aa, Mycobacterium tuberculosis
LEMRLNRQLADIEKLQ

SEQ ID NO: 168101 - protein, 16 aa, Mycobacterium tuberculosis
EMRLNRQLADIEKLQV

SEQ ID NO: 168102 - protein, 16 aa, Mycobacterium tuberculosis
MRLNRQLADIEKLQVN

SEQ ID NO: 168103 - protein, 16 aa, Mycobacterium tuberculosis
RLNRQLADIEKLQVNV

SEQ ID NO: 168104 - protein, 16 aa, Mycobacterium tuberculosis
LNRQLADIEKLQVNVR

SEQ ID NO: 168105 - protein, 16 aa, Mycobacterium tuberculosis
NRQLADIEKLQVNVRQ

SEQ ID NO: 168106 - protein, 16 aa, Mycobacterium tuberculosis
RQLADIEKLQVNVRQA

SEQ ID NO: 168107 - protein, 16 aa, Mycobacterium tuberculosis
QLADIEKLQVNVRQAL

SEQ ID NO: 168108 - protein, 16 aa, Mycobacterium tuberculosis
LADIEKLQVNVRQALT

SEQ ID NO: 168109 - protein, 16 aa, Mycobacterium tuberculosis
ADIEKLQVNVRQALTL

SEQ ID NO: 168110 - protein, 16 aa, Mycobacterium tuberculosis
DIEKLQVNVRQALTLA

SEQ ID NO: 168111 - protein, 16 aa, Mycobacterium tuberculosis
IEKLQVNVRQALTLAD

SEQ ID NO: 168112 - protein, 16 aa, Mycobacterium tuberculosis
EKLQVNVRQALTLADQ

SEQ ID NO: 168113 - protein, 16 aa, Mycobacterium tuberculosis
KLQVNVRQALTLADQA

SEQ ID NO: 168114 - protein, 16 aa, Mycobacterium tuberculosis
LQVNVRQALTLADQAT

SEQ ID NO: 168115 - protein, 16 aa, Mycobacterium tuberculosis
QVNVRQALTLADQATA

SEQ ID NO: 168116 - protein, 16 aa, Mycobacterium tuberculosis
VNVRQALTLADQATAA

SEQ ID NO: 168117 - protein, 16 aa, Mycobacterium tuberculosis
NVRQALTLADQATAAG

SEQ ID NO: 168118 - protein, 16 aa, Mycobacterium tuberculosis
VRQALTLADQATAAGD

SEQ ID NO: 168119 - protein, 16 aa, Mycobacterium tuberculosis
RQALTLADQATAAGDA

SEQ ID NO: 168120 - protein, 16 aa, Mycobacterium tuberculosis
QALTLADQATAAGDAA

SEQ ID NO: 168121 - protein, 16 aa, Mycobacterium tuberculosis
ALTLADQATAAGDAAK

SEQ ID NO: 168122 - protein, 16 aa, Mycobacterium tuberculosis
LTLADQATAAGDAAKA

SEQ ID NO: 168123 - protein, 16 aa, Mycobacterium tuberculosis
TLADQATAAGDAAKAT

SEQ ID NO: 168124 - protein, 16 aa, Mycobacterium tuberculosis
LADQATAAGDAAKATE

SEQ ID NO: 168125 - protein, 16 aa, Mycobacterium tuberculosis
ADQATAAGDAAKATEY

SEQ ID NO: 168126 - protein, 16 aa, Mycobacterium tuberculosis
DQATAAGDAAKATEYN

SEQ ID NO: 168127 - protein, 16 aa, Mycobacterium tuberculosis
QATAAGDAAKATEYNN

SEQ ID NO: 168128 - protein, 16 aa, Mycobacterium tuberculosis
ATAAGDAAKATEYNNA

SEQ ID NO: 168129 - protein, 16 aa, Mycobacterium tuberculosis
TAAGDAAKATEYNNAA

SEQ ID NO: 168130 - protein, 16 aa, Mycobacterium tuberculosis
AAGDAAKATEYNNAAE

SEQ ID NO: 168131 - protein, 16 aa, Mycobacterium tuberculosis
AGDAAKATEYNNAAEA

SEQ ID NO: 168132 - protein, 16 aa, Mycobacterium tuberculosis
GDAAKATEYNNAAEAF

SEQ ID NO: 168133 - protein, 16 aa, Mycobacterium tuberculosis
DAAKATEYNNAAEAFA

SEQ ID NO: 168134 - protein, 16 aa, Mycobacterium tuberculosis
AAKATEYNNAAEAFAA

SEQ ID NO: 168135 - protein, 16 aa, Mycobacterium tuberculosis
AKATEYNNAAEAFAAQ

SEQ ID NO: 168136 - protein, 16 aa, Mycobacterium tuberculosis
KATEYNNAAEAFAAQL

SEQ ID NO: 168137 - protein, 16 aa, Mycobacterium tuberculosis
ATEYNNAAEAFAAQLV

SEQ ID NO: 168138 - protein, 16 aa, Mycobacterium tuberculosis
TEYNNAAEAFAAQLVT

SEQ ID NO: 168139 - protein, 16 aa, Mycobacterium tuberculosis
EYNNAAEAFAAQLVTA

SEQ ID NO: 168140 - protein, 16 aa, Mycobacterium tuberculosis
YNNAAEAFAAQLVTAE

SEQ ID NO: 168141 - protein, 16 aa, Mycobacterium tuberculosis
NNAAEAFAAQLVTAEQ

SEQ ID NO: 168142 - protein, 16 aa, Mycobacterium tuberculosis
NAAEAFAAQLVTAEQS

SEQ ID NO: 168143 - protein, 16 aa, Mycobacterium tuberculosis
AAEAFAAQLVTAEQSV

SEQ ID NO: 168144 - protein, 16 aa, Mycobacterium tuberculosis
AEAFAAQLVTAEQSVE

SEQ ID NO: 168145 - protein, 16 aa, Mycobacterium tuberculosis
EAFAAQLVTAEQSVED

SEQ ID NO: 168146 - protein, 16 aa, Mycobacterium tuberculosis
AFAAQLVTAEQSVEDL

SEQ ID NO: 168147 - protein, 16 aa, Mycobacterium tuberculosis
FAAQLVTAEQSVEDLK

SEQ ID NO: 168148 - protein, 16 aa, Mycobacterium tuberculosis
AAQLVTAEQSVEDLKT

SEQ ID NO: 168149 - protein, 16 aa, Mycobacterium tuberculosis
AQLVTAEQSVEDLKTL

SEQ ID NO: 168150 - protein, 16 aa, Mycobacterium tuberculosis
QLVTAEQSVEDLKTLH

SEQ ID NO: 168151 - protein, 16 aa, Mycobacterium tuberculosis
LVTAEQSVEDLKTLHD

SEQ ID NO: 168152 - protein, 16 aa, Mycobacterium tuberculosis
VTAEQSVEDLKTLHDQ

SEQ ID NO: 168153 - protein, 16 aa, Mycobacterium tuberculosis
TAEQSVEDLKTLHDQA

SEQ ID NO: 168154 - protein, 16 aa, Mycobacterium tuberculosis
AEQSVEDLKTLHDQAL

SEQ ID NO: 168155 - protein, 16 aa, Mycobacterium tuberculosis
EQSVEDLKTLHDQALS

SEQ ID NO: 168156 - protein, 16 aa, Mycobacterium tuberculosis
QSVEDLKTLHDQALSA

SEQ ID NO: 168157 - protein, 16 aa, Mycobacterium tuberculosis
SVEDLKTLHDQALSAA

SEQ ID NO: 168158 - protein, 16 aa, Mycobacterium tuberculosis
VEDLKTLHDQALSAAA

SEQ ID NO: 168159 - protein, 16 aa, Mycobacterium tuberculosis
EDLKTLHDQALSAAAQ

SEQ ID NO: 168160 - protein, 16 aa, Mycobacterium tuberculosis
DLKTLHDQALSAAAQA

SEQ ID NO: 168161 - protein, 16 aa, Mycobacterium tuberculosis
LKTLHDQALSAAAQAK

SEQ ID NO: 168162 - protein, 16 aa, Mycobacterium tuberculosis
KTLHDQALSAAAQAKK

SEQ ID NO: 168163 - protein, 16 aa, Mycobacterium tuberculosis
TLHDQALSAAAQAKKA

SEQ ID NO: 168164 - protein, 16 aa, Mycobacterium tuberculosis
LHDQALSAAAQAKKAV

SEQ ID NO: 168165 - protein, 16 aa, Mycobacterium tuberculosis
HDQALSAAAQAKKAVE

SEQ ID NO: 168166 - protein, 16 aa, Mycobacterium tuberculosis
DQALSAAAQAKKAVER

SEQ ID NO: 168167 - protein, 16 aa, Mycobacterium tuberculosis
QALSAAAQAKKAVERN

SEQ ID NO: 168168 - protein, 16 aa, Mycobacterium tuberculosis
ALSAAAQAKKAVERNA

SEQ ID NO: 168169 - protein, 16 aa, Mycobacterium tuberculosis
LSAAAQAKKAVERNAM

SEQ ID NO: 168170 - protein, 16 aa, Mycobacterium tuberculosis
SAAAQAKKAVERNAMV

SEQ ID NO: 168171 - protein, 16 aa, Mycobacterium tuberculosis
AAAQAKKAVERNAMVL

SEQ ID NO: 168172 - protein, 16 aa, Mycobacterium tuberculosis
AAQAKKAVERNAMVLQ

SEQ ID NO: 168173 - protein, 16 aa, Mycobacterium tuberculosis
AQAKKAVERNAMVLQQ

SEQ ID NO: 168174 - protein, 16 aa, Mycobacterium tuberculosis
QAKKAVERNAMVLQQK

SEQ ID NO: 168175 - protein, 16 aa, Mycobacterium tuberculosis
AKKAVERNAMVLQQKI

SEQ ID NO: 168176 - protein, 16 aa, Mycobacterium tuberculosis
KKAVERNAMVLQQKIA

SEQ ID NO: 168177 - protein, 16 aa, Mycobacterium tuberculosis
KAVERNAMVLQQKIAE

SEQ ID NO: 168178 - protein, 16 aa, Mycobacterium tuberculosis
AVERNAMVLQQKIAER

SEQ ID NO: 168179 - protein, 16 aa, Mycobacterium tuberculosis
VERNAMVLQQKIAERT

SEQ ID NO: 168180 - protein, 16 aa, Mycobacterium tuberculosis
ERNAMVLQQKIAERTK

SEQ ID NO: 168181 - protein, 16 aa, Mycobacterium tuberculosis
RNAMVLQQKIAERTKL

SEQ ID NO: 168182 - protein, 16 aa, Mycobacterium tuberculosis
NAMVLQQKIAERTKLL

SEQ ID NO: 168183 - protein, 16 aa, Mycobacterium tuberculosis
AMVLQQKIAERTKLLS

SEQ ID NO: 168184 - protein, 16 aa, Mycobacterium tuberculosis
MVLQQKIAERTKLLSQ

SEQ ID NO: 168185 - protein, 16 aa, Mycobacterium tuberculosis
VLQQKIAERTKLLSQL

SEQ ID NO: 168186 - protein, 16 aa, Mycobacterium tuberculosis
LQQKIAERTKLLSQLE

SEQ ID NO: 168187 - protein, 16 aa, Mycobacterium tuberculosis
QQKIAERTKLLSQLEQ

SEQ ID NO: 168188 - protein, 16 aa, Mycobacterium tuberculosis
QKIAERTKLLSQLEQA

SEQ ID NO: 168189 - protein, 16 aa, Mycobacterium tuberculosis
KIAERTKLLSQLEQAK

SEQ ID NO: 168190 - protein, 16 aa, Mycobacterium tuberculosis
IAERTKLLSQLEQAKM

SEQ ID NO: 168191 - protein, 16 aa, Mycobacterium tuberculosis
AERTKLLSQLEQAKMQ

SEQ ID NO: 168192 - protein, 16 aa, Mycobacterium tuberculosis
ERTKLLSQLEQAKMQE

SEQ ID NO: 168193 - protein, 16 aa, Mycobacterium tuberculosis
RTKLLSQLEQAKMQEQ

SEQ ID NO: 168194 - protein, 16 aa, Mycobacterium tuberculosis
TKLLSQLEQAKMQEQV

SEQ ID NO: 168195 - protein, 16 aa, Mycobacterium tuberculosis
KLLSQLEQAKMQEQVS

SEQ ID NO: 168196 - protein, 16 aa, Mycobacterium tuberculosis
LLSQLEQAKMQEQVSA

SEQ ID NO: 168197 - protein, 16 aa, Mycobacterium tuberculosis
LSQLEQAKMQEQVSAS

SEQ ID NO: 168198 - protein, 16 aa, Mycobacterium tuberculosis
SQLEQAKMQEQVSASL

SEQ ID NO: 168199 - protein, 16 aa, Mycobacterium tuberculosis
QLEQAKMQEQVSASLR

SEQ ID NO: 168200 - protein, 16 aa, Mycobacterium tuberculosis
LEQAKMQEQVSASLRS

SEQ ID NO: 168201 - protein, 16 aa, Mycobacterium tuberculosis
EQAKMQEQVSASLRSM

SEQ ID NO: 168202 - protein, 16 aa, Mycobacterium tuberculosis
QAKMQEQVSASLRSMS

SEQ ID NO: 168203 - protein, 16 aa, Mycobacterium tuberculosis
AKMQEQVSASLRSMSE

SEQ ID NO: 168204 - protein, 16 aa, Mycobacterium tuberculosis
KMQEQVSASLRSMSEL

SEQ ID NO: 168205 - protein, 16 aa, Mycobacterium tuberculosis
MQEQVSASLRSMSELA

SEQ ID NO: 168206 - protein, 16 aa, Mycobacterium tuberculosis
QEQVSASLRSMSELAA

SEQ ID NO: 168207 - protein, 16 aa, Mycobacterium tuberculosis
EQVSASLRSMSELAAP

SEQ ID NO: 168208 - protein, 16 aa, Mycobacterium tuberculosis
QVSASLRSMSELAAPG

SEQ ID NO: 168209 - protein, 16 aa, Mycobacterium tuberculosis
VSASLRSMSELAAPGN

SEQ ID NO: 168210 - protein, 16 aa, Mycobacterium tuberculosis
SASLRSMSELAAPGNT

SEQ ID NO: 168211 - protein, 16 aa, Mycobacterium tuberculosis
ASLRSMSELAAPGNTP

SEQ ID NO: 168212 - protein, 16 aa, Mycobacterium tuberculosis
SLRSMSELAAPGNTPS

SEQ ID NO: 168213 - protein, 16 aa, Mycobacterium tuberculosis
LRSMSELAAPGNTPSL

SEQ ID NO: 168214 - protein, 16 aa, Mycobacterium tuberculosis
RSMSELAAPGNTPSLD

SEQ ID NO: 168215 - protein, 16 aa, Mycobacterium tuberculosis
SMSELAAPGNTPSLDE

SEQ ID NO: 168216 - protein, 16 aa, Mycobacterium tuberculosis
MSELAAPGNTPSLDEV

SEQ ID NO: 168217 - protein, 16 aa, Mycobacterium tuberculosis
SELAAPGNTPSLDEVR

SEQ ID NO: 168218 - protein, 16 aa, Mycobacterium tuberculosis
ELAAPGNTPSLDEVRD

SEQ ID NO: 168219 - protein, 16 aa, Mycobacterium tuberculosis
LAAPGNTPSLDEVRDK

SEQ ID NO: 168220 - protein, 16 aa, Mycobacterium tuberculosis
AAPGNTPSLDEVRDKI

SEQ ID NO: 168221 - protein, 16 aa, Mycobacterium tuberculosis
APGNTPSLDEVRDKIE

SEQ ID NO: 168222 - protein, 16 aa, Mycobacterium tuberculosis
PGNTPSLDEVRDKIER

SEQ ID NO: 168223 - protein, 16 aa, Mycobacterium tuberculosis
GNTPSLDEVRDKIERR

SEQ ID NO: 168224 - protein, 16 aa, Mycobacterium tuberculosis
NTPSLDEVRDKIERRY

SEQ ID NO: 168225 - protein, 16 aa, Mycobacterium tuberculosis
TPSLDEVRDKIERRYA

SEQ ID NO: 168226 - protein, 16 aa, Mycobacterium tuberculosis
PSLDEVRDKIERRYAN

SEQ ID NO: 168227 - protein, 16 aa, Mycobacterium tuberculosis
SLDEVRDKIERRYANA

SEQ ID NO: 168228 - protein, 16 aa, Mycobacterium tuberculosis
LDEVRDKIERRYANAI

SEQ ID NO: 168229 - protein, 16 aa, Mycobacterium tuberculosis
DEVRDKIERRYANAIG

SEQ ID NO: 168230 - protein, 16 aa, Mycobacterium tuberculosis
EVRDKIERRYANAIGS

SEQ ID NO: 168231 - protein, 16 aa, Mycobacterium tuberculosis
VRDKIERRYANAIGSA

SEQ ID NO: 168232 - protein, 16 aa, Mycobacterium tuberculosis
RDKIERRYANAIGSAE

SEQ ID NO: 168233 - protein, 16 aa, Mycobacterium tuberculosis
DKIERRYANAIGSAEL

SEQ ID NO: 168234 - protein, 16 aa, Mycobacterium tuberculosis
KIERRYANAIGSAELA

SEQ ID NO: 168235 - protein, 16 aa, Mycobacterium tuberculosis
IERRYANAIGSAELAE

SEQ ID NO: 168236 - protein, 16 aa, Mycobacterium tuberculosis
ERRYANAIGSAELAES

SEQ ID NO: 168237 - protein, 16 aa, Mycobacterium tuberculosis
RRYANAIGSAELAESS

SEQ ID NO: 168238 - protein, 16 aa, Mycobacterium tuberculosis
RYANAIGSAELAESSV

SEQ ID NO: 168239 - protein, 16 aa, Mycobacterium tuberculosis
YANAIGSAELAESSVQ

SEQ ID NO: 168240 - protein, 16 aa, Mycobacterium tuberculosis
ANAIGSAELAESSVQG

SEQ ID NO: 168241 - protein, 16 aa, Mycobacterium tuberculosis
NAIGSAELAESSVQGR

SEQ ID NO: 168242 - protein, 16 aa, Mycobacterium tuberculosis
AIGSAELAESSVQGRM

SEQ ID NO: 168243 - protein, 16 aa, Mycobacterium tuberculosis
IGSAELAESSVQGRML

SEQ ID NO: 168244 - protein, 16 aa, Mycobacterium tuberculosis
GSAELAESSVQGRMLE

SEQ ID NO: 168245 - protein, 16 aa, Mycobacterium tuberculosis
SAELAESSVQGRMLEV

SEQ ID NO: 168246 - protein, 16 aa, Mycobacterium tuberculosis
AELAESSVQGRMLEVE

SEQ ID NO: 168247 - protein, 16 aa, Mycobacterium tuberculosis
ELAESSVQGRMLEVEQ

SEQ ID NO: 168248 - protein, 16 aa, Mycobacterium tuberculosis
LAESSVQGRMLEVEQA

SEQ ID NO: 168249 - protein, 16 aa, Mycobacterium tuberculosis
AESSVQGRMLEVEQAG

SEQ ID NO: 168250 - protein, 16 aa, Mycobacterium tuberculosis
ESSVQGRMLEVEQAGI

SEQ ID NO: 168251 - protein, 16 aa, Mycobacterium tuberculosis
SSVQGRMLEVEQAGIQ

SEQ ID NO: 168252 - protein, 16 aa, Mycobacterium tuberculosis
SVQGRMLEVEQAGIQM

SEQ ID NO: 168253 - protein, 16 aa, Mycobacterium tuberculosis
VQGRMLEVEQAGIQMA

SEQ ID NO: 168254 - protein, 16 aa, Mycobacterium tuberculosis
QGRMLEVEQAGIQMAG

SEQ ID NO: 168255 - protein, 16 aa, Mycobacterium tuberculosis
GRMLEVEQAGIQMAGH

SEQ ID NO: 168256 - protein, 16 aa, Mycobacterium tuberculosis
RMLEVEQAGIQMAGHS

SEQ ID NO: 168257 - protein, 16 aa, Mycobacterium tuberculosis
MLEVEQAGIQMAGHSR

SEQ ID NO: 168258 - protein, 16 aa, Mycobacterium tuberculosis
LEVEQAGIQMAGHSRL

SEQ ID NO: 168259 - protein, 16 aa, Mycobacterium tuberculosis
EVEQAGIQMAGHSRLE

SEQ ID NO: 168260 - protein, 16 aa, Mycobacterium tuberculosis
VEQAGIQMAGHSRLEQ

SEQ ID NO: 168261 - protein, 16 aa, Mycobacterium tuberculosis
EQAGIQMAGHSRLEQI

SEQ ID NO: 168262 - protein, 16 aa, Mycobacterium tuberculosis
QAGIQMAGHSRLEQIR

SEQ ID NO: 168263 - protein, 16 aa, Mycobacterium tuberculosis
AGIQMAGHSRLEQIRA

SEQ ID NO: 168264 - protein, 16 aa, Mycobacterium tuberculosis
GIQMAGHSRLEQIRAS

SEQ ID NO: 168265 - protein, 16 aa, Mycobacterium tuberculosis
IQMAGHSRLEQIRASM

SEQ ID NO: 168266 - protein, 16 aa, Mycobacterium tuberculosis
QMAGHSRLEQIRASMR

SEQ ID NO: 168267 - protein, 16 aa, Mycobacterium tuberculosis
MAGHSRLEQIRASMRG

SEQ ID NO: 168268 - protein, 16 aa, Mycobacterium tuberculosis
AGHSRLEQIRASMRGE

SEQ ID NO: 168269 - protein, 16 aa, Mycobacterium tuberculosis
GHSRLEQIRASMRGEA

SEQ ID NO: 168270 - protein, 16 aa, Mycobacterium tuberculosis
HSRLEQIRASMRGEAL

SEQ ID NO: 168271 - protein, 16 aa, Mycobacterium tuberculosis
SRLEQIRASMRGEALP

SEQ ID NO: 168272 - protein, 16 aa, Mycobacterium tuberculosis
RLEQIRASMRGEALPA

SEQ ID NO: 168273 - protein, 16 aa, Mycobacterium tuberculosis
LEQIRASMRGEALPAG

SEQ ID NO: 168274 - protein, 16 aa, Mycobacterium tuberculosis
EQIRASMRGEALPAGG

SEQ ID NO: 168275 - protein, 16 aa, Mycobacterium tuberculosis
QIRASMRGEALPAGGT

SEQ ID NO: 168276 - protein, 16 aa, Mycobacterium tuberculosis
IRASMRGEALPAGGTT

SEQ ID NO: 168277 - protein, 16 aa, Mycobacterium tuberculosis
RASMRGEALPAGGTTA

SEQ ID NO: 168278 - protein, 16 aa, Mycobacterium tuberculosis
ASMRGEALPAGGTTAT

SEQ ID NO: 168279 - protein, 16 aa, Mycobacterium tuberculosis
SMRGEALPAGGTTATP

SEQ ID NO: 168280 - protein, 16 aa, Mycobacterium tuberculosis
MRGEALPAGGTTATPR

SEQ ID NO: 168281 - protein, 16 aa, Mycobacterium tuberculosis
RGEALPAGGTTATPRP

SEQ ID NO: 168282 - protein, 16 aa, Mycobacterium tuberculosis
GEALPAGGTTATPRPA

SEQ ID NO: 168283 - protein, 16 aa, Mycobacterium tuberculosis
EALPAGGTTATPRPAT

SEQ ID NO: 168284 - protein, 16 aa, Mycobacterium tuberculosis
ALPAGGTTATPRPATE

SEQ ID NO: 168285 - protein, 16 aa, Mycobacterium tuberculosis
LPAGGTTATPRPATET

SEQ ID NO: 168286 - protein, 16 aa, Mycobacterium tuberculosis
PAGGTTATPRPATETS

SEQ ID NO: 168287 - protein, 16 aa, Mycobacterium tuberculosis
AGGTTATPRPATETSG

SEQ ID NO: 168288 - protein, 16 aa, Mycobacterium tuberculosis
GGTTATPRPATETSGG

SEQ ID NO: 168289 - protein, 16 aa, Mycobacterium tuberculosis
GTTATPRPATETSGGA

SEQ ID NO: 168290 - protein, 16 aa, Mycobacterium tuberculosis
TTATPRPATETSGGAI

SEQ ID NO: 168291 - protein, 16 aa, Mycobacterium tuberculosis
TATPRPATETSGGAIA

SEQ ID NO: 168292 - protein, 16 aa, Mycobacterium tuberculosis
ATPRPATETSGGAIAE

SEQ ID NO: 168293 - protein, 16 aa, Mycobacterium tuberculosis
TPRPATETSGGAIAEQ

SEQ ID NO: 168294 - protein, 16 aa, Mycobacterium tuberculosis
PRPATETSGGAIAEQP

SEQ ID NO: 168295 - protein, 16 aa, Mycobacterium tuberculosis
RPATETSGGAIAEQPY

SEQ ID NO: 168296 - protein, 16 aa, Mycobacterium tuberculosis
PATETSGGAIAEQPYG

SEQ ID NO: 168297 - protein, 16 aa, Mycobacterium tuberculosis
ATETSGGAIAEQPYGQ

SEQ ID NO: 168298 - protein, 159 aa, Mycobacterium tuberculosis
MKLTTMIKTAVAVVAMAAIATFAAPVALAAYPITGKLGSELTMTDTVGQVVLGWKVSDLKSSTAVIPGYPVAGQVWEATATVNAIRGSVTPAVSQFNARTADGINYRVLWQAAGPDTISGATIPQGEQSTGKIYFDVTGPSPTIVAMNNGMEDLLIWEP

SEQ ID NO: 168299 - protein, 8 aa, Mycobacterium tuberculosis
KLTTMIKT

SEQ ID NO: 168300 - protein, 8 aa, Mycobacterium tuberculosis
TTMIKTAV

SEQ ID NO: 168301 - protein, 8 aa, Mycobacterium tuberculosis
TMIKTAVA

SEQ ID NO: 168302 - protein, 8 aa, Mycobacterium tuberculosis
MIKTAVAV

SEQ ID NO: 168303 - protein, 8 aa, Mycobacterium tuberculosis
TAVAVVAM

SEQ ID NO: 168304 - protein, 8 aa, Mycobacterium tuberculosis
AVAVVAMA

SEQ ID NO: 168305 - protein, 8 aa, Mycobacterium tuberculosis
AVVAMAAI

SEQ ID NO: 168306 - protein, 8 aa, Mycobacterium tuberculosis
AMAAIATF

SEQ ID NO: 168307 - protein, 8 aa, Mycobacterium tuberculosis
MAAIATFA

SEQ ID NO: 168308 - protein, 8 aa, Mycobacterium tuberculosis
AAIATFAA

SEQ ID NO: 168309 - protein, 8 aa, Mycobacterium tuberculosis
IATFAAPV

SEQ ID NO: 168310 - protein, 8 aa, Mycobacterium tuberculosis
FAAPVALA

SEQ ID NO: 168311 - protein, 8 aa, Mycobacterium tuberculosis
APVALAAY

SEQ ID NO: 168312 - protein, 8 aa, Mycobacterium tuberculosis
VALAAYPI

SEQ ID NO: 168313 - protein, 8 aa, Mycobacterium tuberculosis
ALAAYPIT

SEQ ID NO: 168314 - protein, 8 aa, Mycobacterium tuberculosis
AAYPITGK

SEQ ID NO: 168315 - protein, 8 aa, Mycobacterium tuberculosis
AYPITGKL

SEQ ID NO: 168316 - protein, 8 aa, Mycobacterium tuberculosis
YPITGKLG

SEQ ID NO: 168317 - protein, 8 aa, Mycobacterium tuberculosis
KLGSELTM

SEQ ID NO: 168318 - protein, 8 aa, Mycobacterium tuberculosis
ELTMTDTV

SEQ ID NO: 168319 - protein, 8 aa, Mycobacterium tuberculosis
TMTDTVGQ

SEQ ID NO: 168320 - protein, 8 aa, Mycobacterium tuberculosis
MTDTVGQV

SEQ ID NO: 168321 - protein, 8 aa, Mycobacterium tuberculosis
DTVGQVVL

SEQ ID NO: 168322 - protein, 8 aa, Mycobacterium tuberculosis
VGQVVLGW

SEQ ID NO: 168323 - protein, 8 aa, Mycobacterium tuberculosis
GQVVLGWK

SEQ ID NO: 168324 - protein, 8 aa, Mycobacterium tuberculosis
QVVLGWKV

SEQ ID NO: 168325 - protein, 8 aa, Mycobacterium tuberculosis
GWKVSDLK

SEQ ID NO: 168326 - protein, 8 aa, Mycobacterium tuberculosis
DLKSSTAV

SEQ ID NO: 168327 - protein, 8 aa, Mycobacterium tuberculosis
STAVIPGY

SEQ ID NO: 168328 - protein, 8 aa, Mycobacterium tuberculosis
AVIPGYPV

SEQ ID NO: 168329 - protein, 8 aa, Mycobacterium tuberculosis
VIPGYPVA

SEQ ID NO: 168330 - protein, 8 aa, Mycobacterium tuberculosis
GYPVAGQV

SEQ ID NO: 168331 - protein, 8 aa, Mycobacterium tuberculosis
YPVAGQVW

SEQ ID NO: 168332 - protein, 8 aa, Mycobacterium tuberculosis
GQVWEATA

SEQ ID NO: 168333 - protein, 8 aa, Mycobacterium tuberculosis
QVWEATAT

SEQ ID NO: 168334 - protein, 8 aa, Mycobacterium tuberculosis
EATATVNA

SEQ ID NO: 168335 - protein, 8 aa, Mycobacterium tuberculosis
ATATVNAI

SEQ ID NO: 168336 - protein, 8 aa, Mycobacterium tuberculosis
TATVNAIR

SEQ ID NO: 168337 - protein, 8 aa, Mycobacterium tuberculosis
VTPAVSQF

SEQ ID NO: 168338 - protein, 8 aa, Mycobacterium tuberculosis
AVSQFNAR

SEQ ID NO: 168339 - protein, 8 aa, Mycobacterium tuberculosis
SQFNARTA

SEQ ID NO: 168340 - protein, 8 aa, Mycobacterium tuberculosis
RTADGINY

SEQ ID NO: 168341 - protein, 8 aa, Mycobacterium tuberculosis
TADGINYR

SEQ ID NO: 168342 - protein, 8 aa, Mycobacterium tuberculosis
QAAGPDTI

SEQ ID NO: 168343 - protein, 8 aa, Mycobacterium tuberculosis
DTISGATI

SEQ ID NO: 168344 - protein, 8 aa, Mycobacterium tuberculosis
EQSTGKIY

SEQ ID NO: 168345 - protein, 8 aa, Mycobacterium tuberculosis
TGPSPTIV

SEQ ID NO: 168346 - protein, 8 aa, Mycobacterium tuberculosis
IVAMNNGM

SEQ ID NO: 168347 - protein, 9 aa, Mycobacterium tuberculosis
KLTTMIKTA

SEQ ID NO: 168348 - protein, 9 aa, Mycobacterium tuberculosis
LTTMIKTAV

SEQ ID NO: 168349 - protein, 9 aa, Mycobacterium tuberculosis
TTMIKTAVA

SEQ ID NO: 168350 - protein, 9 aa, Mycobacterium tuberculosis
TMIKTAVAV

SEQ ID NO: 168351 - protein, 9 aa, Mycobacterium tuberculosis
MIKTAVAVV

SEQ ID NO: 168352 - protein, 9 aa, Mycobacterium tuberculosis
KTAVAVVAM

SEQ ID NO: 168353 - protein, 9 aa, Mycobacterium tuberculosis
TAVAVVAMA

SEQ ID NO: 168354 - protein, 9 aa, Mycobacterium tuberculosis
AVAVVAMAA

SEQ ID NO: 168355 - protein, 9 aa, Mycobacterium tuberculosis
VAVVAMAAI

SEQ ID NO: 168356 - protein, 9 aa, Mycobacterium tuberculosis
VAMAAIATF

SEQ ID NO: 168357 - protein, 9 aa, Mycobacterium tuberculosis
AMAAIATFA

SEQ ID NO: 168358 - protein, 9 aa, Mycobacterium tuberculosis
MAAIATFAA

SEQ ID NO: 168359 - protein, 9 aa, Mycobacterium tuberculosis
AIATFAAPV

SEQ ID NO: 168360 - protein, 9 aa, Mycobacterium tuberculosis
ATFAAPVAL

SEQ ID NO: 168361 - protein, 9 aa, Mycobacterium tuberculosis
FAAPVALAA

SEQ ID NO: 168362 - protein, 9 aa, Mycobacterium tuberculosis
AAPVALAAY

SEQ ID NO: 168363 - protein, 9 aa, Mycobacterium tuberculosis
PVALAAYPI

SEQ ID NO: 168364 - protein, 9 aa, Mycobacterium tuberculosis
LAAYPITGK

SEQ ID NO: 168365 - protein, 9 aa, Mycobacterium tuberculosis
AAYPITGKL

SEQ ID NO: 168366 - protein, 9 aa, Mycobacterium tuberculosis
YPITGKLGS

SEQ ID NO: 168367 - protein, 9 aa, Mycobacterium tuberculosis
KLGSELTMT

SEQ ID NO: 168368 - protein, 9 aa, Mycobacterium tuberculosis
SELTMTDTV

SEQ ID NO: 168369 - protein, 9 aa, Mycobacterium tuberculosis
TMTDTVGQV

SEQ ID NO: 168370 - protein, 9 aa, Mycobacterium tuberculosis
MTDTVGQVV

SEQ ID NO: 168371 - protein, 9 aa, Mycobacterium tuberculosis
TVGQVVLGW

SEQ ID NO: 168372 - protein, 9 aa, Mycobacterium tuberculosis
GQVVLGWKV

SEQ ID NO: 168373 - protein, 9 aa, Mycobacterium tuberculosis
VLGWKVSDL

SEQ ID NO: 168374 - protein, 9 aa, Mycobacterium tuberculosis
SSTAVIPGY

SEQ ID NO: 168375 - protein, 9 aa, Mycobacterium tuberculosis
TAVIPGYPV

SEQ ID NO: 168376 - protein, 9 aa, Mycobacterium tuberculosis
AVIPGYPVA

SEQ ID NO: 168377 - protein, 9 aa, Mycobacterium tuberculosis
GYPVAGQVW

SEQ ID NO: 168378 - protein, 9 aa, Mycobacterium tuberculosis
PVAGQVWEA

SEQ ID NO: 168379 - protein, 9 aa, Mycobacterium tuberculosis
GQVWEATAT

SEQ ID NO: 168380 - protein, 9 aa, Mycobacterium tuberculosis
QVWEATATV

SEQ ID NO: 168381 - protein, 9 aa, Mycobacterium tuberculosis
EATATVNAI

SEQ ID NO: 168382 - protein, 9 aa, Mycobacterium tuberculosis
ATATVNAIR

SEQ ID NO: 168383 - protein, 9 aa, Mycobacterium tuberculosis
TVNAIRGSV

SEQ ID NO: 168384 - protein, 9 aa, Mycobacterium tuberculosis
AIRGSVTPA

SEQ ID NO: 168385 - protein, 9 aa, Mycobacterium tuberculosis
SVTPAVSQF

SEQ ID NO: 168386 - protein, 9 aa, Mycobacterium tuberculosis
TPAVSQFNA

SEQ ID NO: 168387 - protein, 9 aa, Mycobacterium tuberculosis
RTADGINYR

SEQ ID NO: 168388 - protein, 9 aa, Mycobacterium tuberculosis
TADGINYRV

SEQ ID NO: 168389 - protein, 9 aa, Mycobacterium tuberculosis
WQAAGPDTI

SEQ ID NO: 168390 - protein, 9 aa, Mycobacterium tuberculosis
TIPQGEQST

SEQ ID NO: 168391 - protein, 9 aa, Mycobacterium tuberculosis
EQSTGKIYF

SEQ ID NO: 168392 - protein, 9 aa, Mycobacterium tuberculosis
STGKIYFDV

SEQ ID NO: 168393 - protein, 9 aa, Mycobacterium tuberculosis
DVTGPSPTI

SEQ ID NO: 168394 - protein, 9 aa, Mycobacterium tuberculosis
VTGPSPTIV

SEQ ID NO: 168395 - protein, 9 aa, Mycobacterium tuberculosis
GPSPTIVAM

SEQ ID NO: 168396 - protein, 9 aa, Mycobacterium tuberculosis
TIVAMNNGM

SEQ ID NO: 168397 - protein, 9 aa, Mycobacterium tuberculosis
AMNNGMEDL

SEQ ID NO: 168398 - protein, 9 aa, Mycobacterium tuberculosis
GMEDLLIWE

SEQ ID NO: 168399 - protein, 10 aa, Mycobacterium tuberculosis
KLTTMIKTAV

SEQ ID NO: 168400 - protein, 10 aa, Mycobacterium tuberculosis
TTMIKTAVAV

SEQ ID NO: 168401 - protein, 10 aa, Mycobacterium tuberculosis
TMIKTAVAVV

SEQ ID NO: 168402 - protein, 10 aa, Mycobacterium tuberculosis
MIKTAVAVVA

SEQ ID NO: 168403 - protein, 10 aa, Mycobacterium tuberculosis
KTAVAVVAMA

SEQ ID NO: 168404 - protein, 10 aa, Mycobacterium tuberculosis
TAVAVVAMAA

SEQ ID NO: 168405 - protein, 10 aa, Mycobacterium tuberculosis
AVAVVAMAAI

SEQ ID NO: 168406 - protein, 10 aa, Mycobacterium tuberculosis
VVAMAAIATF

SEQ ID NO: 168407 - protein, 10 aa, Mycobacterium tuberculosis
VAMAAIATFA

SEQ ID NO: 168408 - protein, 10 aa, Mycobacterium tuberculosis
AMAAIATFAA

SEQ ID NO: 168409 - protein, 10 aa, Mycobacterium tuberculosis
AAIATFAAPV

SEQ ID NO: 168410 - protein, 10 aa, Mycobacterium tuberculosis
AIATFAAPVA

SEQ ID NO: 168411 - protein, 10 aa, Mycobacterium tuberculosis
IATFAAPVAL

SEQ ID NO: 168412 - protein, 10 aa, Mycobacterium tuberculosis
ATFAAPVALA

SEQ ID NO: 168413 - protein, 10 aa, Mycobacterium tuberculosis
FAAPVALAAY

SEQ ID NO: 168414 - protein, 10 aa, Mycobacterium tuberculosis
APVALAAYPI

SEQ ID NO: 168415 - protein, 10 aa, Mycobacterium tuberculosis
ALAAYPITGK

SEQ ID NO: 168416 - protein, 10 aa, Mycobacterium tuberculosis
LAAYPITGKL

SEQ ID NO: 168417 - protein, 10 aa, Mycobacterium tuberculosis
YPITGKLGSE

SEQ ID NO: 168418 - protein, 10 aa, Mycobacterium tuberculosis
PITGKLGSEL

SEQ ID NO: 168419 - protein, 10 aa, Mycobacterium tuberculosis
LTMTDTVGQV

SEQ ID NO: 168420 - protein, 10 aa, Mycobacterium tuberculosis
TMTDTVGQVV

SEQ ID NO: 168421 - protein, 10 aa, Mycobacterium tuberculosis
MTDTVGQVVL

SEQ ID NO: 168422 - protein, 10 aa, Mycobacterium tuberculosis
DTVGQVVLGW

SEQ ID NO: 168423 - protein, 10 aa, Mycobacterium tuberculosis
TVGQVVLGWK

SEQ ID NO: 168424 - protein, 10 aa, Mycobacterium tuberculosis
VVLGWKVSDL

SEQ ID NO: 168425 - protein, 10 aa, Mycobacterium tuberculosis
VLGWKVSDLK

SEQ ID NO: 168426 - protein, 10 aa, Mycobacterium tuberculosis
KVSDLKSSTA

SEQ ID NO: 168427 - protein, 10 aa, Mycobacterium tuberculosis
KSSTAVIPGY

SEQ ID NO: 168428 - protein, 10 aa, Mycobacterium tuberculosis
STAVIPGYPV

SEQ ID NO: 168429 - protein, 10 aa, Mycobacterium tuberculosis
VIPGYPVAGQ

SEQ ID NO: 168430 - protein, 10 aa, Mycobacterium tuberculosis
IPGYPVAGQV

SEQ ID NO: 168431 - protein, 10 aa, Mycobacterium tuberculosis
YPVAGQVWEA

SEQ ID NO: 168432 - protein, 10 aa, Mycobacterium tuberculosis
GQVWEATATV

SEQ ID NO: 168433 - protein, 10 aa, Mycobacterium tuberculosis
WEATATVNAI

SEQ ID NO: 168434 - protein, 10 aa, Mycobacterium tuberculosis
EATATVNAIR

SEQ ID NO: 168435 - protein, 10 aa, Mycobacterium tuberculosis
ATVNAIRGSV

SEQ ID NO: 168436 - protein, 10 aa, Mycobacterium tuberculosis
NAIRGSVTPA

SEQ ID NO: 168437 - protein, 10 aa, Mycobacterium tuberculosis
AIRGSVTPAV

SEQ ID NO: 168438 - protein, 10 aa, Mycobacterium tuberculosis
VTPAVSQFNA

SEQ ID NO: 168439 - protein, 10 aa, Mycobacterium tuberculosis
TPAVSQFNAR

SEQ ID NO: 168440 - protein, 10 aa, Mycobacterium tuberculosis
NARTADGINY

SEQ ID NO: 168441 - protein, 10 aa, Mycobacterium tuberculosis
RTADGINYRV

SEQ ID NO: 168442 - protein, 10 aa, Mycobacterium tuberculosis
TADGINYRVL

SEQ ID NO: 168443 - protein, 10 aa, Mycobacterium tuberculosis
GINYRVLWQA

SEQ ID NO: 168444 - protein, 10 aa, Mycobacterium tuberculosis
YRVLWQAAGP

SEQ ID NO: 168445 - protein, 10 aa, Mycobacterium tuberculosis
VLWQAAGPDT

SEQ ID NO: 168446 - protein, 10 aa, Mycobacterium tuberculosis
LWQAAGPDTI

SEQ ID NO: 168447 - protein, 10 aa, Mycobacterium tuberculosis
AAGPDTISGA

SEQ ID NO: 168448 - protein, 10 aa, Mycobacterium tuberculosis
GPDTISGATI

SEQ ID NO: 168449 - protein, 10 aa, Mycobacterium tuberculosis
GEQSTGKIYF

SEQ ID NO: 168450 - protein, 10 aa, Mycobacterium tuberculosis
QSTGKIYFDV

SEQ ID NO: 168451 - protein, 10 aa, Mycobacterium tuberculosis
KIYFDVTGPS

SEQ ID NO: 168452 - protein, 10 aa, Mycobacterium tuberculosis
DVTGPSPTIV

SEQ ID NO: 168453 - protein, 10 aa, Mycobacterium tuberculosis
PTIVAMNNGM

SEQ ID NO: 168454 - protein, 10 aa, Mycobacterium tuberculosis
AMNNGMEDLL

SEQ ID NO: 168455 - protein, 10 aa, Mycobacterium tuberculosis
GMEDLLIWEP

SEQ ID NO: 168456 - protein, 11 aa, Mycobacterium tuberculosis
KLTTMIKTAVA

SEQ ID NO: 168457 - protein, 11 aa, Mycobacterium tuberculosis
LTTMIKTAVAV

SEQ ID NO: 168458 - protein, 11 aa, Mycobacterium tuberculosis
TTMIKTAVAVV

SEQ ID NO: 168459 - protein, 11 aa, Mycobacterium tuberculosis
TMIKTAVAVVA

SEQ ID NO: 168460 - protein, 11 aa, Mycobacterium tuberculosis
MIKTAVAVVAM

SEQ ID NO: 168461 - protein, 11 aa, Mycobacterium tuberculosis
KTAVAVVAMAA

SEQ ID NO: 168462 - protein, 11 aa, Mycobacterium tuberculosis
TAVAVVAMAAI

SEQ ID NO: 168463 - protein, 11 aa, Mycobacterium tuberculosis
VAVVAMAAIAT

SEQ ID NO: 168464 - protein, 11 aa, Mycobacterium tuberculosis
AVVAMAAIATF

SEQ ID NO: 168465 - protein, 11 aa, Mycobacterium tuberculosis
VVAMAAIATFA

SEQ ID NO: 168466 - protein, 11 aa, Mycobacterium tuberculosis
VAMAAIATFAA

SEQ ID NO: 168467 - protein, 11 aa, Mycobacterium tuberculosis
MAAIATFAAPV

SEQ ID NO: 168468 - protein, 11 aa, Mycobacterium tuberculosis
AAIATFAAPVA

SEQ ID NO: 168469 - protein, 11 aa, Mycobacterium tuberculosis
AIATFAAPVAL

SEQ ID NO: 168470 - protein, 11 aa, Mycobacterium tuberculosis
ATFAAPVALAA

SEQ ID NO: 168471 - protein, 11 aa, Mycobacterium tuberculosis
TFAAPVALAAY

SEQ ID NO: 168472 - protein, 11 aa, Mycobacterium tuberculosis
AAPVALAAYPI

SEQ ID NO: 168473 - protein, 11 aa, Mycobacterium tuberculosis
APVALAAYPIT

SEQ ID NO: 168474 - protein, 11 aa, Mycobacterium tuberculosis
VALAAYPITGK

SEQ ID NO: 168475 - protein, 11 aa, Mycobacterium tuberculosis
ALAAYPITGKL

SEQ ID NO: 168476 - protein, 11 aa, Mycobacterium tuberculosis
YPITGKLGSEL

SEQ ID NO: 168477 - protein, 11 aa, Mycobacterium tuberculosis
KLGSELTMTDT

SEQ ID NO: 168478 - protein, 11 aa, Mycobacterium tuberculosis
LGSELTMTDTV

SEQ ID NO: 168479 - protein, 11 aa, Mycobacterium tuberculosis
ELTMTDTVGQV

SEQ ID NO: 168480 - protein, 11 aa, Mycobacterium tuberculosis
LTMTDTVGQVV

SEQ ID NO: 168481 - protein, 11 aa, Mycobacterium tuberculosis
TMTDTVGQVVL

SEQ ID NO: 168482 - protein, 11 aa, Mycobacterium tuberculosis
DTVGQVVLGWK

SEQ ID NO: 168483 - protein, 11 aa, Mycobacterium tuberculosis
TVGQVVLGWKV

SEQ ID NO: 168484 - protein, 11 aa, Mycobacterium tuberculosis
QVVLGWKVSDL

SEQ ID NO: 168485 - protein, 11 aa, Mycobacterium tuberculosis
VVLGWKVSDLK

SEQ ID NO: 168486 - protein, 11 aa, Mycobacterium tuberculosis
KVSDLKSSTAV

SEQ ID NO: 168487 - protein, 11 aa, Mycobacterium tuberculosis
SSTAVIPGYPV

SEQ ID NO: 168488 - protein, 11 aa, Mycobacterium tuberculosis
STAVIPGYPVA

SEQ ID NO: 168489 - protein, 11 aa, Mycobacterium tuberculosis
VIPGYPVAGQV

SEQ ID NO: 168490 - protein, 11 aa, Mycobacterium tuberculosis
IPGYPVAGQVW

SEQ ID NO: 168491 - protein, 11 aa, Mycobacterium tuberculosis
YPVAGQVWEAT

SEQ ID NO: 168492 - protein, 11 aa, Mycobacterium tuberculosis
PVAGQVWEATA

SEQ ID NO: 168493 - protein, 11 aa, Mycobacterium tuberculosis
QVWEATATVNA

SEQ ID NO: 168494 - protein, 11 aa, Mycobacterium tuberculosis
VWEATATVNAI

SEQ ID NO: 168495 - protein, 11 aa, Mycobacterium tuberculosis
TATVNAIRGSV

SEQ ID NO: 168496 - protein, 11 aa, Mycobacterium tuberculosis
NAIRGSVTPAV

SEQ ID NO: 168497 - protein, 11 aa, Mycobacterium tuberculosis
RGSVTPAVSQF

SEQ ID NO: 168498 - protein, 11 aa, Mycobacterium tuberculosis
SVTPAVSQFNA

SEQ ID NO: 168499 - protein, 11 aa, Mycobacterium tuberculosis
VTPAVSQFNAR

SEQ ID NO: 168500 - protein, 11 aa, Mycobacterium tuberculosis
SQFNARTADGI

SEQ ID NO: 168501 - protein, 11 aa, Mycobacterium tuberculosis
NARTADGINYR

SEQ ID NO: 168502 - protein, 11 aa, Mycobacterium tuberculosis
RTADGINYRVL

SEQ ID NO: 168503 - protein, 11 aa, Mycobacterium tuberculosis
TADGINYRVLW

SEQ ID NO: 168504 - protein, 11 aa, Mycobacterium tuberculosis
GINYRVLWQAA

SEQ ID NO: 168505 - protein, 11 aa, Mycobacterium tuberculosis
VLWQAAGPDTI

SEQ ID NO: 168506 - protein, 11 aa, Mycobacterium tuberculosis
QAAGPDTISGA

SEQ ID NO: 168507 - protein, 11 aa, Mycobacterium tuberculosis
TIPQGEQSTGK

SEQ ID NO: 168508 - protein, 11 aa, Mycobacterium tuberculosis
IPQGEQSTGKI

SEQ ID NO: 168509 - protein, 11 aa, Mycobacterium tuberculosis
DVTGPSPTIVA

SEQ ID NO: 168510 - protein, 11 aa, Mycobacterium tuberculosis
VTGPSPTIVAM

SEQ ID NO: 168511 - protein, 11 aa, Mycobacterium tuberculosis
SPTIVAMNNGM

SEQ ID NO: 168512 - protein, 11 aa, Mycobacterium tuberculosis
AMNNGMEDLLI

SEQ ID NO: 168513 - protein, 13 aa, Mycobacterium tuberculosis
MKLTTMIKTAVAV

SEQ ID NO: 168514 - protein, 13 aa, Mycobacterium tuberculosis
KLTTMIKTAVAVV

SEQ ID NO: 168515 - protein, 13 aa, Mycobacterium tuberculosis
LTTMIKTAVAVVA

SEQ ID NO: 168516 - protein, 13 aa, Mycobacterium tuberculosis
TTMIKTAVAVVAM

SEQ ID NO: 168517 - protein, 13 aa, Mycobacterium tuberculosis
TMIKTAVAVVAMA

SEQ ID NO: 168518 - protein, 13 aa, Mycobacterium tuberculosis
MIKTAVAVVAMAA

SEQ ID NO: 168519 - protein, 13 aa, Mycobacterium tuberculosis
IKTAVAVVAMAAI

SEQ ID NO: 168520 - protein, 13 aa, Mycobacterium tuberculosis
KTAVAVVAMAAIA

SEQ ID NO: 168521 - protein, 13 aa, Mycobacterium tuberculosis
TAVAVVAMAAIAT

SEQ ID NO: 168522 - protein, 13 aa, Mycobacterium tuberculosis
AVAVVAMAAIATF

SEQ ID NO: 168523 - protein, 13 aa, Mycobacterium tuberculosis
VAVVAMAAIATFA

SEQ ID NO: 168524 - protein, 13 aa, Mycobacterium tuberculosis
AVVAMAAIATFAA

SEQ ID NO: 168525 - protein, 13 aa, Mycobacterium tuberculosis
VVAMAAIATFAAP

SEQ ID NO: 168526 - protein, 13 aa, Mycobacterium tuberculosis
VAMAAIATFAAPV

SEQ ID NO: 168527 - protein, 13 aa, Mycobacterium tuberculosis
AMAAIATFAAPVA

SEQ ID NO: 168528 - protein, 13 aa, Mycobacterium tuberculosis
MAAIATFAAPVAL

SEQ ID NO: 168529 - protein, 13 aa, Mycobacterium tuberculosis
AAIATFAAPVALA

SEQ ID NO: 168530 - protein, 13 aa, Mycobacterium tuberculosis
AIATFAAPVALAA

SEQ ID NO: 168531 - protein, 13 aa, Mycobacterium tuberculosis
IATFAAPVALAAY

SEQ ID NO: 168532 - protein, 13 aa, Mycobacterium tuberculosis
ATFAAPVALAAYP

SEQ ID NO: 168533 - protein, 13 aa, Mycobacterium tuberculosis
TFAAPVALAAYPI

SEQ ID NO: 168534 - protein, 13 aa, Mycobacterium tuberculosis
FAAPVALAAYPIT

SEQ ID NO: 168535 - protein, 13 aa, Mycobacterium tuberculosis
AAPVALAAYPITG

SEQ ID NO: 168536 - protein, 13 aa, Mycobacterium tuberculosis
APVALAAYPITGK

SEQ ID NO: 168537 - protein, 13 aa, Mycobacterium tuberculosis
PVALAAYPITGKL

SEQ ID NO: 168538 - protein, 13 aa, Mycobacterium tuberculosis
VALAAYPITGKLG

SEQ ID NO: 168539 - protein, 13 aa, Mycobacterium tuberculosis
ALAAYPITGKLGS

SEQ ID NO: 168540 - protein, 13 aa, Mycobacterium tuberculosis
LAAYPITGKLGSE

SEQ ID NO: 168541 - protein, 13 aa, Mycobacterium tuberculosis
AAYPITGKLGSEL

SEQ ID NO: 168542 - protein, 13 aa, Mycobacterium tuberculosis
AYPITGKLGSELT

SEQ ID NO: 168543 - protein, 13 aa, Mycobacterium tuberculosis
YPITGKLGSELTM

SEQ ID NO: 168544 - protein, 13 aa, Mycobacterium tuberculosis
PITGKLGSELTMT

SEQ ID NO: 168545 - protein, 13 aa, Mycobacterium tuberculosis
ITGKLGSELTMTD

SEQ ID NO: 168546 - protein, 13 aa, Mycobacterium tuberculosis
TGKLGSELTMTDT

SEQ ID NO: 168547 - protein, 13 aa, Mycobacterium tuberculosis
GKLGSELTMTDTV

SEQ ID NO: 168548 - protein, 13 aa, Mycobacterium tuberculosis
KLGSELTMTDTVG

SEQ ID NO: 168549 - protein, 13 aa, Mycobacterium tuberculosis
LGSELTMTDTVGQ

SEQ ID NO: 168550 - protein, 13 aa, Mycobacterium tuberculosis
GSELTMTDTVGQV

SEQ ID NO: 168551 - protein, 13 aa, Mycobacterium tuberculosis
SELTMTDTVGQVV

SEQ ID NO: 168552 - protein, 13 aa, Mycobacterium tuberculosis
ELTMTDTVGQVVL

SEQ ID NO: 168553 - protein, 13 aa, Mycobacterium tuberculosis
LTMTDTVGQVVLG

SEQ ID NO: 168554 - protein, 13 aa, Mycobacterium tuberculosis
TMTDTVGQVVLGW

SEQ ID NO: 168555 - protein, 13 aa, Mycobacterium tuberculosis
MTDTVGQVVLGWK

SEQ ID NO: 168556 - protein, 13 aa, Mycobacterium tuberculosis
TDTVGQVVLGWKV

SEQ ID NO: 168557 - protein, 13 aa, Mycobacterium tuberculosis
DTVGQVVLGWKVS

SEQ ID NO: 168558 - protein, 13 aa, Mycobacterium tuberculosis
TVGQVVLGWKVSD

SEQ ID NO: 168559 - protein, 13 aa, Mycobacterium tuberculosis
VGQVVLGWKVSDL

SEQ ID NO: 168560 - protein, 13 aa, Mycobacterium tuberculosis
GQVVLGWKVSDLK

SEQ ID NO: 168561 - protein, 13 aa, Mycobacterium tuberculosis
QVVLGWKVSDLKS

SEQ ID NO: 168562 - protein, 13 aa, Mycobacterium tuberculosis
VVLGWKVSDLKSS

SEQ ID NO: 168563 - protein, 13 aa, Mycobacterium tuberculosis
VLGWKVSDLKSST

SEQ ID NO: 168564 - protein, 13 aa, Mycobacterium tuberculosis
LGWKVSDLKSSTA

SEQ ID NO: 168565 - protein, 13 aa, Mycobacterium tuberculosis
GWKVSDLKSSTAV

SEQ ID NO: 168566 - protein, 13 aa, Mycobacterium tuberculosis
WKVSDLKSSTAVI

SEQ ID NO: 168567 - protein, 13 aa, Mycobacterium tuberculosis
KVSDLKSSTAVIP

SEQ ID NO: 168568 - protein, 13 aa, Mycobacterium tuberculosis
VSDLKSSTAVIPG

SEQ ID NO: 168569 - protein, 13 aa, Mycobacterium tuberculosis
SDLKSSTAVIPGY

SEQ ID NO: 168570 - protein, 13 aa, Mycobacterium tuberculosis
DLKSSTAVIPGYP

SEQ ID NO: 168571 - protein, 13 aa, Mycobacterium tuberculosis
LKSSTAVIPGYPV

SEQ ID NO: 168572 - protein, 13 aa, Mycobacterium tuberculosis
KSSTAVIPGYPVA

SEQ ID NO: 168573 - protein, 13 aa, Mycobacterium tuberculosis
SSTAVIPGYPVAG

SEQ ID NO: 168574 - protein, 13 aa, Mycobacterium tuberculosis
STAVIPGYPVAGQ

SEQ ID NO: 168575 - protein, 13 aa, Mycobacterium tuberculosis
TAVIPGYPVAGQV

SEQ ID NO: 168576 - protein, 13 aa, Mycobacterium tuberculosis
AVIPGYPVAGQVW

SEQ ID NO: 168577 - protein, 13 aa, Mycobacterium tuberculosis
VIPGYPVAGQVWE

SEQ ID NO: 168578 - protein, 13 aa, Mycobacterium tuberculosis
IPGYPVAGQVWEA

SEQ ID NO: 168579 - protein, 13 aa, Mycobacterium tuberculosis
PGYPVAGQVWEAT

SEQ ID NO: 168580 - protein, 13 aa, Mycobacterium tuberculosis
GYPVAGQVWEATA

SEQ ID NO: 168581 - protein, 13 aa, Mycobacterium tuberculosis
YPVAGQVWEATAT

SEQ ID NO: 168582 - protein, 13 aa, Mycobacterium tuberculosis
PVAGQVWEATATV

SEQ ID NO: 168583 - protein, 13 aa, Mycobacterium tuberculosis
VAGQVWEATATVN

SEQ ID NO: 168584 - protein, 13 aa, Mycobacterium tuberculosis
AGQVWEATATVNA

SEQ ID NO: 168585 - protein, 13 aa, Mycobacterium tuberculosis
GQVWEATATVNAI

SEQ ID NO: 168586 - protein, 13 aa, Mycobacterium tuberculosis
QVWEATATVNAIR

SEQ ID NO: 168587 - protein, 13 aa, Mycobacterium tuberculosis
VWEATATVNAIRG

SEQ ID NO: 168588 - protein, 13 aa, Mycobacterium tuberculosis
WEATATVNAIRGS

SEQ ID NO: 168589 - protein, 13 aa, Mycobacterium tuberculosis
EATATVNAIRGSV

SEQ ID NO: 168590 - protein, 13 aa, Mycobacterium tuberculosis
ATATVNAIRGSVT

SEQ ID NO: 168591 - protein, 13 aa, Mycobacterium tuberculosis
TATVNAIRGSVTP

SEQ ID NO: 168592 - protein, 13 aa, Mycobacterium tuberculosis
ATVNAIRGSVTPA

SEQ ID NO: 168593 - protein, 13 aa, Mycobacterium tuberculosis
TVNAIRGSVTPAV

SEQ ID NO: 168594 - protein, 13 aa, Mycobacterium tuberculosis
VNAIRGSVTPAVS

SEQ ID NO: 168595 - protein, 13 aa, Mycobacterium tuberculosis
NAIRGSVTPAVSQ

SEQ ID NO: 168596 - protein, 13 aa, Mycobacterium tuberculosis
AIRGSVTPAVSQF

SEQ ID NO: 168597 - protein, 13 aa, Mycobacterium tuberculosis
IRGSVTPAVSQFN

SEQ ID NO: 168598 - protein, 13 aa, Mycobacterium tuberculosis
RGSVTPAVSQFNA

SEQ ID NO: 168599 - protein, 13 aa, Mycobacterium tuberculosis
GSVTPAVSQFNAR

SEQ ID NO: 168600 - protein, 13 aa, Mycobacterium tuberculosis
SVTPAVSQFNART

SEQ ID NO: 168601 - protein, 13 aa, Mycobacterium tuberculosis
VTPAVSQFNARTA

SEQ ID NO: 168602 - protein, 13 aa, Mycobacterium tuberculosis
TPAVSQFNARTAD

SEQ ID NO: 168603 - protein, 13 aa, Mycobacterium tuberculosis
PAVSQFNARTADG

SEQ ID NO: 168604 - protein, 13 aa, Mycobacterium tuberculosis
AVSQFNARTADGI

SEQ ID NO: 168605 - protein, 13 aa, Mycobacterium tuberculosis
VSQFNARTADGIN

SEQ ID NO: 168606 - protein, 13 aa, Mycobacterium tuberculosis
SQFNARTADGINY

SEQ ID NO: 168607 - protein, 13 aa, Mycobacterium tuberculosis
QFNARTADGINYR

SEQ ID NO: 168608 - protein, 13 aa, Mycobacterium tuberculosis
FNARTADGINYRV

SEQ ID NO: 168609 - protein, 13 aa, Mycobacterium tuberculosis
NARTADGINYRVL

SEQ ID NO: 168610 - protein, 13 aa, Mycobacterium tuberculosis
ARTADGINYRVLW

SEQ ID NO: 168611 - protein, 13 aa, Mycobacterium tuberculosis
RTADGINYRVLWQ

SEQ ID NO: 168612 - protein, 13 aa, Mycobacterium tuberculosis
TADGINYRVLWQA

SEQ ID NO: 168613 - protein, 13 aa, Mycobacterium tuberculosis
ADGINYRVLWQAA

SEQ ID NO: 168614 - protein, 13 aa, Mycobacterium tuberculosis
DGINYRVLWQAAG

SEQ ID NO: 168615 - protein, 13 aa, Mycobacterium tuberculosis
GINYRVLWQAAGP

SEQ ID NO: 168616 - protein, 13 aa, Mycobacterium tuberculosis
INYRVLWQAAGPD

SEQ ID NO: 168617 - protein, 13 aa, Mycobacterium tuberculosis
NYRVLWQAAGPDT

SEQ ID NO: 168618 - protein, 13 aa, Mycobacterium tuberculosis
YRVLWQAAGPDTI

SEQ ID NO: 168619 - protein, 13 aa, Mycobacterium tuberculosis
RVLWQAAGPDTIS

SEQ ID NO: 168620 - protein, 13 aa, Mycobacterium tuberculosis
VLWQAAGPDTISG

SEQ ID NO: 168621 - protein, 13 aa, Mycobacterium tuberculosis
LWQAAGPDTISGA

SEQ ID NO: 168622 - protein, 13 aa, Mycobacterium tuberculosis
WQAAGPDTISGAT

SEQ ID NO: 168623 - protein, 13 aa, Mycobacterium tuberculosis
QAAGPDTISGATI

SEQ ID NO: 168624 - protein, 13 aa, Mycobacterium tuberculosis
AAGPDTISGATIP

SEQ ID NO: 168625 - protein, 13 aa, Mycobacterium tuberculosis
AGPDTISGATIPQ

SEQ ID NO: 168626 - protein, 13 aa, Mycobacterium tuberculosis
GPDTISGATIPQG

SEQ ID NO: 168627 - protein, 13 aa, Mycobacterium tuberculosis
PDTISGATIPQGE

SEQ ID NO: 168628 - protein, 13 aa, Mycobacterium tuberculosis
DTISGATIPQGEQ

SEQ ID NO: 168629 - protein, 13 aa, Mycobacterium tuberculosis
TISGATIPQGEQS

SEQ ID NO: 168630 - protein, 13 aa, Mycobacterium tuberculosis
ISGATIPQGEQST

SEQ ID NO: 168631 - protein, 13 aa, Mycobacterium tuberculosis
SGATIPQGEQSTG

SEQ ID NO: 168632 - protein, 13 aa, Mycobacterium tuberculosis
GATIPQGEQSTGK

SEQ ID NO: 168633 - protein, 13 aa, Mycobacterium tuberculosis
ATIPQGEQSTGKI

SEQ ID NO: 168634 - protein, 13 aa, Mycobacterium tuberculosis
TIPQGEQSTGKIY

SEQ ID NO: 168635 - protein, 13 aa, Mycobacterium tuberculosis
IPQGEQSTGKIYF

SEQ ID NO: 168636 - protein, 13 aa, Mycobacterium tuberculosis
PQGEQSTGKIYFD

SEQ ID NO: 168637 - protein, 13 aa, Mycobacterium tuberculosis
QGEQSTGKIYFDV

SEQ ID NO: 168638 - protein, 13 aa, Mycobacterium tuberculosis
GEQSTGKIYFDVT

SEQ ID NO: 168639 - protein, 13 aa, Mycobacterium tuberculosis
EQSTGKIYFDVTG

SEQ ID NO: 168640 - protein, 13 aa, Mycobacterium tuberculosis
QSTGKIYFDVTGP

SEQ ID NO: 168641 - protein, 13 aa, Mycobacterium tuberculosis
STGKIYFDVTGPS

SEQ ID NO: 168642 - protein, 13 aa, Mycobacterium tuberculosis
TGKIYFDVTGPSP

SEQ ID NO: 168643 - protein, 13 aa, Mycobacterium tuberculosis
GKIYFDVTGPSPT

SEQ ID NO: 168644 - protein, 13 aa, Mycobacterium tuberculosis
KIYFDVTGPSPTI

SEQ ID NO: 168645 - protein, 13 aa, Mycobacterium tuberculosis
IYFDVTGPSPTIV

SEQ ID NO: 168646 - protein, 13 aa, Mycobacterium tuberculosis
YFDVTGPSPTIVA

SEQ ID NO: 168647 - protein, 13 aa, Mycobacterium tuberculosis
FDVTGPSPTIVAM

SEQ ID NO: 168648 - protein, 13 aa, Mycobacterium tuberculosis
DVTGPSPTIVAMN

SEQ ID NO: 168649 - protein, 13 aa, Mycobacterium tuberculosis
VTGPSPTIVAMNN

SEQ ID NO: 168650 - protein, 13 aa, Mycobacterium tuberculosis
TGPSPTIVAMNNG

SEQ ID NO: 168651 - protein, 13 aa, Mycobacterium tuberculosis
GPSPTIVAMNNGM

SEQ ID NO: 168652 - protein, 13 aa, Mycobacterium tuberculosis
PSPTIVAMNNGME

SEQ ID NO: 168653 - protein, 13 aa, Mycobacterium tuberculosis
SPTIVAMNNGMED

SEQ ID NO: 168654 - protein, 13 aa, Mycobacterium tuberculosis
PTIVAMNNGMEDL

SEQ ID NO: 168655 - protein, 13 aa, Mycobacterium tuberculosis
TIVAMNNGMEDLL

SEQ ID NO: 168656 - protein, 13 aa, Mycobacterium tuberculosis
IVAMNNGMEDLLI

SEQ ID NO: 168657 - protein, 13 aa, Mycobacterium tuberculosis
VAMNNGMEDLLIW

SEQ ID NO: 168658 - protein, 13 aa, Mycobacterium tuberculosis
AMNNGMEDLLIWE

SEQ ID NO: 168659 - protein, 13 aa, Mycobacterium tuberculosis
MNNGMEDLLIWEP

SEQ ID NO: 168660 - protein, 14 aa, Mycobacterium tuberculosis
MKLTTMIKTAVAVV

SEQ ID NO: 168661 - protein, 14 aa, Mycobacterium tuberculosis
KLTTMIKTAVAVVA

SEQ ID NO: 168662 - protein, 14 aa, Mycobacterium tuberculosis
LTTMIKTAVAVVAM

SEQ ID NO: 168663 - protein, 14 aa, Mycobacterium tuberculosis
TTMIKTAVAVVAMA

SEQ ID NO: 168664 - protein, 14 aa, Mycobacterium tuberculosis
TMIKTAVAVVAMAA

SEQ ID NO: 168665 - protein, 14 aa, Mycobacterium tuberculosis
MIKTAVAVVAMAAI

SEQ ID NO: 168666 - protein, 14 aa, Mycobacterium tuberculosis
IKTAVAVVAMAAIA

SEQ ID NO: 168667 - protein, 14 aa, Mycobacterium tuberculosis
KTAVAVVAMAAIAT

SEQ ID NO: 168668 - protein, 14 aa, Mycobacterium tuberculosis
TAVAVVAMAAIATF

SEQ ID NO: 168669 - protein, 14 aa, Mycobacterium tuberculosis
AVAVVAMAAIATFA

SEQ ID NO: 168670 - protein, 14 aa, Mycobacterium tuberculosis
VAVVAMAAIATFAA

SEQ ID NO: 168671 - protein, 14 aa, Mycobacterium tuberculosis
AVVAMAAIATFAAP

SEQ ID NO: 168672 - protein, 14 aa, Mycobacterium tuberculosis
VVAMAAIATFAAPV

SEQ ID NO: 168673 - protein, 14 aa, Mycobacterium tuberculosis
VAMAAIATFAAPVA

SEQ ID NO: 168674 - protein, 14 aa, Mycobacterium tuberculosis
AMAAIATFAAPVAL

SEQ ID NO: 168675 - protein, 14 aa, Mycobacterium tuberculosis
MAAIATFAAPVALA

SEQ ID NO: 168676 - protein, 14 aa, Mycobacterium tuberculosis
AAIATFAAPVALAA

SEQ ID NO: 168677 - protein, 14 aa, Mycobacterium tuberculosis
AIATFAAPVALAAY

SEQ ID NO: 168678 - protein, 14 aa, Mycobacterium tuberculosis
IATFAAPVALAAYP

SEQ ID NO: 168679 - protein, 14 aa, Mycobacterium tuberculosis
ATFAAPVALAAYPI

SEQ ID NO: 168680 - protein, 14 aa, Mycobacterium tuberculosis
TFAAPVALAAYPIT

SEQ ID NO: 168681 - protein, 14 aa, Mycobacterium tuberculosis
FAAPVALAAYPITG

SEQ ID NO: 168682 - protein, 14 aa, Mycobacterium tuberculosis
AAPVALAAYPITGK

SEQ ID NO: 168683 - protein, 14 aa, Mycobacterium tuberculosis
APVALAAYPITGKL

SEQ ID NO: 168684 - protein, 14 aa, Mycobacterium tuberculosis
PVALAAYPITGKLG

SEQ ID NO: 168685 - protein, 14 aa, Mycobacterium tuberculosis
VALAAYPITGKLGS

SEQ ID NO: 168686 - protein, 14 aa, Mycobacterium tuberculosis
ALAAYPITGKLGSE

SEQ ID NO: 168687 - protein, 14 aa, Mycobacterium tuberculosis
LAAYPITGKLGSEL

SEQ ID NO: 168688 - protein, 14 aa, Mycobacterium tuberculosis
AAYPITGKLGSELT

SEQ ID NO: 168689 - protein, 14 aa, Mycobacterium tuberculosis
AYPITGKLGSELTM

SEQ ID NO: 168690 - protein, 14 aa, Mycobacterium tuberculosis
YPITGKLGSELTMT

SEQ ID NO: 168691 - protein, 14 aa, Mycobacterium tuberculosis
PITGKLGSELTMTD

SEQ ID NO: 168692 - protein, 14 aa, Mycobacterium tuberculosis
ITGKLGSELTMTDT

SEQ ID NO: 168693 - protein, 14 aa, Mycobacterium tuberculosis
TGKLGSELTMTDTV

SEQ ID NO: 168694 - protein, 14 aa, Mycobacterium tuberculosis
GKLGSELTMTDTVG

SEQ ID NO: 168695 - protein, 14 aa, Mycobacterium tuberculosis
KLGSELTMTDTVGQ

SEQ ID NO: 168696 - protein, 14 aa, Mycobacterium tuberculosis
LGSELTMTDTVGQV

SEQ ID NO: 168697 - protein, 14 aa, Mycobacterium tuberculosis
GSELTMTDTVGQVV

SEQ ID NO: 168698 - protein, 14 aa, Mycobacterium tuberculosis
SELTMTDTVGQVVL

SEQ ID NO: 168699 - protein, 14 aa, Mycobacterium tuberculosis
ELTMTDTVGQVVLG

SEQ ID NO: 168700 - protein, 14 aa, Mycobacterium tuberculosis
LTMTDTVGQVVLGW

SEQ ID NO: 168701 - protein, 14 aa, Mycobacterium tuberculosis
TMTDTVGQVVLGWK

SEQ ID NO: 168702 - protein, 14 aa, Mycobacterium tuberculosis
MTDTVGQVVLGWKV

SEQ ID NO: 168703 - protein, 14 aa, Mycobacterium tuberculosis
TDTVGQVVLGWKVS

SEQ ID NO: 168704 - protein, 14 aa, Mycobacterium tuberculosis
DTVGQVVLGWKVSD

SEQ ID NO: 168705 - protein, 14 aa, Mycobacterium tuberculosis
TVGQVVLGWKVSDL

SEQ ID NO: 168706 - protein, 14 aa, Mycobacterium tuberculosis
VGQVVLGWKVSDLK

SEQ ID NO: 168707 - protein, 14 aa, Mycobacterium tuberculosis
GQVVLGWKVSDLKS

SEQ ID NO: 168708 - protein, 14 aa, Mycobacterium tuberculosis
QVVLGWKVSDLKSS

SEQ ID NO: 168709 - protein, 14 aa, Mycobacterium tuberculosis
VVLGWKVSDLKSST

SEQ ID NO: 168710 - protein, 14 aa, Mycobacterium tuberculosis
VLGWKVSDLKSSTA

SEQ ID NO: 168711 - protein, 14 aa, Mycobacterium tuberculosis
LGWKVSDLKSSTAV

SEQ ID NO: 168712 - protein, 14 aa, Mycobacterium tuberculosis
GWKVSDLKSSTAVI

SEQ ID NO: 168713 - protein, 14 aa, Mycobacterium tuberculosis
WKVSDLKSSTAVIP

SEQ ID NO: 168714 - protein, 14 aa, Mycobacterium tuberculosis
KVSDLKSSTAVIPG

SEQ ID NO: 168715 - protein, 14 aa, Mycobacterium tuberculosis
VSDLKSSTAVIPGY

SEQ ID NO: 168716 - protein, 14 aa, Mycobacterium tuberculosis
SDLKSSTAVIPGYP

SEQ ID NO: 168717 - protein, 14 aa, Mycobacterium tuberculosis
DLKSSTAVIPGYPV

SEQ ID NO: 168718 - protein, 14 aa, Mycobacterium tuberculosis
LKSSTAVIPGYPVA

SEQ ID NO: 168719 - protein, 14 aa, Mycobacterium tuberculosis
KSSTAVIPGYPVAG

SEQ ID NO: 168720 - protein, 14 aa, Mycobacterium tuberculosis
SSTAVIPGYPVAGQ

SEQ ID NO: 168721 - protein, 14 aa, Mycobacterium tuberculosis
STAVIPGYPVAGQV

SEQ ID NO: 168722 - protein, 14 aa, Mycobacterium tuberculosis
TAVIPGYPVAGQVW

SEQ ID NO: 168723 - protein, 14 aa, Mycobacterium tuberculosis
AVIPGYPVAGQVWE

SEQ ID NO: 168724 - protein, 14 aa, Mycobacterium tuberculosis
VIPGYPVAGQVWEA

SEQ ID NO: 168725 - protein, 14 aa, Mycobacterium tuberculosis
IPGYPVAGQVWEAT

SEQ ID NO: 168726 - protein, 14 aa, Mycobacterium tuberculosis
PGYPVAGQVWEATA

SEQ ID NO: 168727 - protein, 14 aa, Mycobacterium tuberculosis
GYPVAGQVWEATAT

SEQ ID NO: 168728 - protein, 14 aa, Mycobacterium tuberculosis
YPVAGQVWEATATV

SEQ ID NO: 168729 - protein, 14 aa, Mycobacterium tuberculosis
PVAGQVWEATATVN

SEQ ID NO: 168730 - protein, 14 aa, Mycobacterium tuberculosis
VAGQVWEATATVNA

SEQ ID NO: 168731 - protein, 14 aa, Mycobacterium tuberculosis
AGQVWEATATVNAI

SEQ ID NO: 168732 - protein, 14 aa, Mycobacterium tuberculosis
GQVWEATATVNAIR

SEQ ID NO: 168733 - protein, 14 aa, Mycobacterium tuberculosis
QVWEATATVNAIRG

SEQ ID NO: 168734 - protein, 14 aa, Mycobacterium tuberculosis
VWEATATVNAIRGS

SEQ ID NO: 168735 - protein, 14 aa, Mycobacterium tuberculosis
WEATATVNAIRGSV

SEQ ID NO: 168736 - protein, 14 aa, Mycobacterium tuberculosis
EATATVNAIRGSVT

SEQ ID NO: 168737 - protein, 14 aa, Mycobacterium tuberculosis
ATATVNAIRGSVTP

SEQ ID NO: 168738 - protein, 14 aa, Mycobacterium tuberculosis
TATVNAIRGSVTPA

SEQ ID NO: 168739 - protein, 14 aa, Mycobacterium tuberculosis
ATVNAIRGSVTPAV

SEQ ID NO: 168740 - protein, 14 aa, Mycobacterium tuberculosis
TVNAIRGSVTPAVS

SEQ ID NO: 168741 - protein, 14 aa, Mycobacterium tuberculosis
VNAIRGSVTPAVSQ

SEQ ID NO: 168742 - protein, 14 aa, Mycobacterium tuberculosis
NAIRGSVTPAVSQF

SEQ ID NO: 168743 - protein, 14 aa, Mycobacterium tuberculosis
AIRGSVTPAVSQFN

SEQ ID NO: 168744 - protein, 14 aa, Mycobacterium tuberculosis
IRGSVTPAVSQFNA

SEQ ID NO: 168745 - protein, 14 aa, Mycobacterium tuberculosis
RGSVTPAVSQFNAR

SEQ ID NO: 168746 - protein, 14 aa, Mycobacterium tuberculosis
GSVTPAVSQFNART

SEQ ID NO: 168747 - protein, 14 aa, Mycobacterium tuberculosis
SVTPAVSQFNARTA

SEQ ID NO: 168748 - protein, 14 aa, Mycobacterium tuberculosis
VTPAVSQFNARTAD

SEQ ID NO: 168749 - protein, 14 aa, Mycobacterium tuberculosis
TPAVSQFNARTADG

SEQ ID NO: 168750 - protein, 14 aa, Mycobacterium tuberculosis
PAVSQFNARTADGI

SEQ ID NO: 168751 - protein, 14 aa, Mycobacterium tuberculosis
AVSQFNARTADGIN

SEQ ID NO: 168752 - protein, 14 aa, Mycobacterium tuberculosis
VSQFNARTADGINY

SEQ ID NO: 168753 - protein, 14 aa, Mycobacterium tuberculosis
SQFNARTADGINYR

SEQ ID NO: 168754 - protein, 14 aa, Mycobacterium tuberculosis
QFNARTADGINYRV

SEQ ID NO: 168755 - protein, 14 aa, Mycobacterium tuberculosis
FNARTADGINYRVL

SEQ ID NO: 168756 - protein, 14 aa, Mycobacterium tuberculosis
NARTADGINYRVLW

SEQ ID NO: 168757 - protein, 14 aa, Mycobacterium tuberculosis
ARTADGINYRVLWQ

SEQ ID NO: 168758 - protein, 14 aa, Mycobacterium tuberculosis
RTADGINYRVLWQA

SEQ ID NO: 168759 - protein, 14 aa, Mycobacterium tuberculosis
TADGINYRVLWQAA

SEQ ID NO: 168760 - protein, 14 aa, Mycobacterium tuberculosis
ADGINYRVLWQAAG

SEQ ID NO: 168761 - protein, 14 aa, Mycobacterium tuberculosis
DGINYRVLWQAAGP

SEQ ID NO: 168762 - protein, 14 aa, Mycobacterium tuberculosis
GINYRVLWQAAGPD

SEQ ID NO: 168763 - protein, 14 aa, Mycobacterium tuberculosis
INYRVLWQAAGPDT

SEQ ID NO: 168764 - protein, 14 aa, Mycobacterium tuberculosis
NYRVLWQAAGPDTI

SEQ ID NO: 168765 - protein, 14 aa, Mycobacterium tuberculosis
YRVLWQAAGPDTIS

SEQ ID NO: 168766 - protein, 14 aa, Mycobacterium tuberculosis
RVLWQAAGPDTISG

SEQ ID NO: 168767 - protein, 14 aa, Mycobacterium tuberculosis
VLWQAAGPDTISGA

SEQ ID NO: 168768 - protein, 14 aa, Mycobacterium tuberculosis
LWQAAGPDTISGAT

SEQ ID NO: 168769 - protein, 14 aa, Mycobacterium tuberculosis
WQAAGPDTISGATI

SEQ ID NO: 168770 - protein, 14 aa, Mycobacterium tuberculosis
QAAGPDTISGATIP

SEQ ID NO: 168771 - protein, 14 aa, Mycobacterium tuberculosis
AAGPDTISGATIPQ

SEQ ID NO: 168772 - protein, 14 aa, Mycobacterium tuberculosis
AGPDTISGATIPQG

SEQ ID NO: 168773 - protein, 14 aa, Mycobacterium tuberculosis
GPDTISGATIPQGE

SEQ ID NO: 168774 - protein, 14 aa, Mycobacterium tuberculosis
PDTISGATIPQGEQ

SEQ ID NO: 168775 - protein, 14 aa, Mycobacterium tuberculosis
DTISGATIPQGEQS

SEQ ID NO: 168776 - protein, 14 aa, Mycobacterium tuberculosis
TISGATIPQGEQST

SEQ ID NO: 168777 - protein, 14 aa, Mycobacterium tuberculosis
ISGATIPQGEQSTG

SEQ ID NO: 168778 - protein, 14 aa, Mycobacterium tuberculosis
SGATIPQGEQSTGK

SEQ ID NO: 168779 - protein, 14 aa, Mycobacterium tuberculosis
GATIPQGEQSTGKI

SEQ ID NO: 168780 - protein, 14 aa, Mycobacterium tuberculosis
ATIPQGEQSTGKIY

SEQ ID NO: 168781 - protein, 14 aa, Mycobacterium tuberculosis
TIPQGEQSTGKIYF

SEQ ID NO: 168782 - protein, 14 aa, Mycobacterium tuberculosis
IPQGEQSTGKIYFD

SEQ ID NO: 168783 - protein, 14 aa, Mycobacterium tuberculosis
PQGEQSTGKIYFDV

SEQ ID NO: 168784 - protein, 14 aa, Mycobacterium tuberculosis
QGEQSTGKIYFDVT

SEQ ID NO: 168785 - protein, 14 aa, Mycobacterium tuberculosis
GEQSTGKIYFDVTG

SEQ ID NO: 168786 - protein, 14 aa, Mycobacterium tuberculosis
EQSTGKIYFDVTGP

SEQ ID NO: 168787 - protein, 14 aa, Mycobacterium tuberculosis
QSTGKIYFDVTGPS

SEQ ID NO: 168788 - protein, 14 aa, Mycobacterium tuberculosis
STGKIYFDVTGPSP

SEQ ID NO: 168789 - protein, 14 aa, Mycobacterium tuberculosis
TGKIYFDVTGPSPT

SEQ ID NO: 168790 - protein, 14 aa, Mycobacterium tuberculosis
GKIYFDVTGPSPTI

SEQ ID NO: 168791 - protein, 14 aa, Mycobacterium tuberculosis
KIYFDVTGPSPTIV

SEQ ID NO: 168792 - protein, 14 aa, Mycobacterium tuberculosis
IYFDVTGPSPTIVA

SEQ ID NO: 168793 - protein, 14 aa, Mycobacterium tuberculosis
YFDVTGPSPTIVAM

SEQ ID NO: 168794 - protein, 14 aa, Mycobacterium tuberculosis
FDVTGPSPTIVAMN

SEQ ID NO: 168795 - protein, 14 aa, Mycobacterium tuberculosis
DVTGPSPTIVAMNN

SEQ ID NO: 168796 - protein, 14 aa, Mycobacterium tuberculosis
VTGPSPTIVAMNNG

SEQ ID NO: 168797 - protein, 14 aa, Mycobacterium tuberculosis
TGPSPTIVAMNNGM

SEQ ID NO: 168798 - protein, 14 aa, Mycobacterium tuberculosis
GPSPTIVAMNNGME

SEQ ID NO: 168799 - protein, 14 aa, Mycobacterium tuberculosis
PSPTIVAMNNGMED

SEQ ID NO: 168800 - protein, 14 aa, Mycobacterium tuberculosis
SPTIVAMNNGMEDL

SEQ ID NO: 168801 - protein, 14 aa, Mycobacterium tuberculosis
PTIVAMNNGMEDLL

SEQ ID NO: 168802 - protein, 14 aa, Mycobacterium tuberculosis
TIVAMNNGMEDLLI

SEQ ID NO: 168803 - protein, 14 aa, Mycobacterium tuberculosis
IVAMNNGMEDLLIW

SEQ ID NO: 168804 - protein, 14 aa, Mycobacterium tuberculosis
VAMNNGMEDLLIWE

SEQ ID NO: 168805 - protein, 14 aa, Mycobacterium tuberculosis
AMNNGMEDLLIWEP

SEQ ID NO: 168806 - protein, 15 aa, Mycobacterium tuberculosis
MKLTTMIKTAVAVVA

SEQ ID NO: 168807 - protein, 15 aa, Mycobacterium tuberculosis
KLTTMIKTAVAVVAM

SEQ ID NO: 168808 - protein, 15 aa, Mycobacterium tuberculosis
LTTMIKTAVAVVAMA

SEQ ID NO: 168809 - protein, 15 aa, Mycobacterium tuberculosis
TTMIKTAVAVVAMAA

SEQ ID NO: 168810 - protein, 15 aa, Mycobacterium tuberculosis
TMIKTAVAVVAMAAI

SEQ ID NO: 168811 - protein, 15 aa, Mycobacterium tuberculosis
MIKTAVAVVAMAAIA

SEQ ID NO: 168812 - protein, 15 aa, Mycobacterium tuberculosis
IKTAVAVVAMAAIAT

SEQ ID NO: 168813 - protein, 15 aa, Mycobacterium tuberculosis
KTAVAVVAMAAIATF

SEQ ID NO: 168814 - protein, 15 aa, Mycobacterium tuberculosis
TAVAVVAMAAIATFA

SEQ ID NO: 168815 - protein, 15 aa, Mycobacterium tuberculosis
AVAVVAMAAIATFAA

SEQ ID NO: 168816 - protein, 15 aa, Mycobacterium tuberculosis
VAVVAMAAIATFAAP

SEQ ID NO: 168817 - protein, 15 aa, Mycobacterium tuberculosis
AVVAMAAIATFAAPV

SEQ ID NO: 168818 - protein, 15 aa, Mycobacterium tuberculosis
VVAMAAIATFAAPVA

SEQ ID NO: 168819 - protein, 15 aa, Mycobacterium tuberculosis
VAMAAIATFAAPVAL

SEQ ID NO: 168820 - protein, 15 aa, Mycobacterium tuberculosis
AMAAIATFAAPVALA

SEQ ID NO: 168821 - protein, 15 aa, Mycobacterium tuberculosis
MAAIATFAAPVALAA

SEQ ID NO: 168822 - protein, 15 aa, Mycobacterium tuberculosis
AAIATFAAPVALAAY

SEQ ID NO: 168823 - protein, 15 aa, Mycobacterium tuberculosis
AIATFAAPVALAAYP

SEQ ID NO: 168824 - protein, 15 aa, Mycobacterium tuberculosis
IATFAAPVALAAYPI

SEQ ID NO: 168825 - protein, 15 aa, Mycobacterium tuberculosis
ATFAAPVALAAYPIT

SEQ ID NO: 168826 - protein, 15 aa, Mycobacterium tuberculosis
TFAAPVALAAYPITG

SEQ ID NO: 168827 - protein, 15 aa, Mycobacterium tuberculosis
FAAPVALAAYPITGK

SEQ ID NO: 168828 - protein, 15 aa, Mycobacterium tuberculosis
AAPVALAAYPITGKL

SEQ ID NO: 168829 - protein, 15 aa, Mycobacterium tuberculosis
APVALAAYPITGKLG

SEQ ID NO: 168830 - protein, 15 aa, Mycobacterium tuberculosis
PVALAAYPITGKLGS

SEQ ID NO: 168831 - protein, 15 aa, Mycobacterium tuberculosis
VALAAYPITGKLGSE

SEQ ID NO: 168832 - protein, 15 aa, Mycobacterium tuberculosis
ALAAYPITGKLGSEL

SEQ ID NO: 168833 - protein, 15 aa, Mycobacterium tuberculosis
LAAYPITGKLGSELT

SEQ ID NO: 168834 - protein, 15 aa, Mycobacterium tuberculosis
AAYPITGKLGSELTM

SEQ ID NO: 168835 - protein, 15 aa, Mycobacterium tuberculosis
AYPITGKLGSELTMT

SEQ ID NO: 168836 - protein, 15 aa, Mycobacterium tuberculosis
YPITGKLGSELTMTD

SEQ ID NO: 168837 - protein, 15 aa, Mycobacterium tuberculosis
PITGKLGSELTMTDT

SEQ ID NO: 168838 - protein, 15 aa, Mycobacterium tuberculosis
ITGKLGSELTMTDTV

SEQ ID NO: 168839 - protein, 15 aa, Mycobacterium tuberculosis
TGKLGSELTMTDTVG

SEQ ID NO: 168840 - protein, 15 aa, Mycobacterium tuberculosis
GKLGSELTMTDTVGQ

SEQ ID NO: 168841 - protein, 15 aa, Mycobacterium tuberculosis
KLGSELTMTDTVGQV

SEQ ID NO: 168842 - protein, 15 aa, Mycobacterium tuberculosis
LGSELTMTDTVGQVV

SEQ ID NO: 168843 - protein, 15 aa, Mycobacterium tuberculosis
GSELTMTDTVGQVVL

SEQ ID NO: 168844 - protein, 15 aa, Mycobacterium tuberculosis
SELTMTDTVGQVVLG

SEQ ID NO: 168845 - protein, 15 aa, Mycobacterium tuberculosis
ELTMTDTVGQVVLGW

SEQ ID NO: 168846 - protein, 15 aa, Mycobacterium tuberculosis
LTMTDTVGQVVLGWK

SEQ ID NO: 168847 - protein, 15 aa, Mycobacterium tuberculosis
TMTDTVGQVVLGWKV

SEQ ID NO: 168848 - protein, 15 aa, Mycobacterium tuberculosis
MTDTVGQVVLGWKVS

SEQ ID NO: 168849 - protein, 15 aa, Mycobacterium tuberculosis
TDTVGQVVLGWKVSD

SEQ ID NO: 168850 - protein, 15 aa, Mycobacterium tuberculosis
DTVGQVVLGWKVSDL

SEQ ID NO: 168851 - protein, 15 aa, Mycobacterium tuberculosis
TVGQVVLGWKVSDLK

SEQ ID NO: 168852 - protein, 15 aa, Mycobacterium tuberculosis
VGQVVLGWKVSDLKS

SEQ ID NO: 168853 - protein, 15 aa, Mycobacterium tuberculosis
GQVVLGWKVSDLKSS

SEQ ID NO: 168854 - protein, 15 aa, Mycobacterium tuberculosis
QVVLGWKVSDLKSST

SEQ ID NO: 168855 - protein, 15 aa, Mycobacterium tuberculosis
VVLGWKVSDLKSSTA

SEQ ID NO: 168856 - protein, 15 aa, Mycobacterium tuberculosis
VLGWKVSDLKSSTAV

SEQ ID NO: 168857 - protein, 15 aa, Mycobacterium tuberculosis
LGWKVSDLKSSTAVI

SEQ ID NO: 168858 - protein, 15 aa, Mycobacterium tuberculosis
GWKVSDLKSSTAVIP

SEQ ID NO: 168859 - protein, 15 aa, Mycobacterium tuberculosis
WKVSDLKSSTAVIPG

SEQ ID NO: 168860 - protein, 15 aa, Mycobacterium tuberculosis
KVSDLKSSTAVIPGY

SEQ ID NO: 168861 - protein, 15 aa, Mycobacterium tuberculosis
VSDLKSSTAVIPGYP

SEQ ID NO: 168862 - protein, 15 aa, Mycobacterium tuberculosis
SDLKSSTAVIPGYPV

SEQ ID NO: 168863 - protein, 15 aa, Mycobacterium tuberculosis
DLKSSTAVIPGYPVA

SEQ ID NO: 168864 - protein, 15 aa, Mycobacterium tuberculosis
LKSSTAVIPGYPVAG

SEQ ID NO: 168865 - protein, 15 aa, Mycobacterium tuberculosis
KSSTAVIPGYPVAGQ

SEQ ID NO: 168866 - protein, 15 aa, Mycobacterium tuberculosis
SSTAVIPGYPVAGQV

SEQ ID NO: 168867 - protein, 15 aa, Mycobacterium tuberculosis
STAVIPGYPVAGQVW

SEQ ID NO: 168868 - protein, 15 aa, Mycobacterium tuberculosis
TAVIPGYPVAGQVWE

SEQ ID NO: 168869 - protein, 15 aa, Mycobacterium tuberculosis
AVIPGYPVAGQVWEA

SEQ ID NO: 168870 - protein, 15 aa, Mycobacterium tuberculosis
VIPGYPVAGQVWEAT

SEQ ID NO: 168871 - protein, 15 aa, Mycobacterium tuberculosis
IPGYPVAGQVWEATA

SEQ ID NO: 168872 - protein, 15 aa, Mycobacterium tuberculosis
PGYPVAGQVWEATAT

SEQ ID NO: 168873 - protein, 15 aa, Mycobacterium tuberculosis
GYPVAGQVWEATATV

SEQ ID NO: 168874 - protein, 15 aa, Mycobacterium tuberculosis
YPVAGQVWEATATVN

SEQ ID NO: 168875 - protein, 15 aa, Mycobacterium tuberculosis
PVAGQVWEATATVNA

SEQ ID NO: 168876 - protein, 15 aa, Mycobacterium tuberculosis
VAGQVWEATATVNAI

SEQ ID NO: 168877 - protein, 15 aa, Mycobacterium tuberculosis
AGQVWEATATVNAIR

SEQ ID NO: 168878 - protein, 15 aa, Mycobacterium tuberculosis
GQVWEATATVNAIRG

SEQ ID NO: 168879 - protein, 15 aa, Mycobacterium tuberculosis
QVWEATATVNAIRGS

SEQ ID NO: 168880 - protein, 15 aa, Mycobacterium tuberculosis
VWEATATVNAIRGSV

SEQ ID NO: 168881 - protein, 15 aa, Mycobacterium tuberculosis
WEATATVNAIRGSVT

SEQ ID NO: 168882 - protein, 15 aa, Mycobacterium tuberculosis
EATATVNAIRGSVTP

SEQ ID NO: 168883 - protein, 15 aa, Mycobacterium tuberculosis
ATATVNAIRGSVTPA

SEQ ID NO: 168884 - protein, 15 aa, Mycobacterium tuberculosis
TATVNAIRGSVTPAV

SEQ ID NO: 168885 - protein, 15 aa, Mycobacterium tuberculosis
ATVNAIRGSVTPAVS

SEQ ID NO: 168886 - protein, 15 aa, Mycobacterium tuberculosis
TVNAIRGSVTPAVSQ

SEQ ID NO: 168887 - protein, 15 aa, Mycobacterium tuberculosis
VNAIRGSVTPAVSQF

SEQ ID NO: 168888 - protein, 15 aa, Mycobacterium tuberculosis
NAIRGSVTPAVSQFN

SEQ ID NO: 168889 - protein, 15 aa, Mycobacterium tuberculosis
AIRGSVTPAVSQFNA

SEQ ID NO: 168890 - protein, 15 aa, Mycobacterium tuberculosis
IRGSVTPAVSQFNAR

SEQ ID NO: 168891 - protein, 15 aa, Mycobacterium tuberculosis
RGSVTPAVSQFNART

SEQ ID NO: 168892 - protein, 15 aa, Mycobacterium tuberculosis
GSVTPAVSQFNARTA

SEQ ID NO: 168893 - protein, 15 aa, Mycobacterium tuberculosis
SVTPAVSQFNARTAD

SEQ ID NO: 168894 - protein, 15 aa, Mycobacterium tuberculosis
VTPAVSQFNARTADG

SEQ ID NO: 168895 - protein, 15 aa, Mycobacterium tuberculosis
TPAVSQFNARTADGI

SEQ ID NO: 168896 - protein, 15 aa, Mycobacterium tuberculosis
PAVSQFNARTADGIN

SEQ ID NO: 168897 - protein, 15 aa, Mycobacterium tuberculosis
AVSQFNARTADGINY

SEQ ID NO: 168898 - protein, 15 aa, Mycobacterium tuberculosis
VSQFNARTADGINYR

SEQ ID NO: 168899 - protein, 15 aa, Mycobacterium tuberculosis
SQFNARTADGINYRV

SEQ ID NO: 168900 - protein, 15 aa, Mycobacterium tuberculosis
QFNARTADGINYRVL

SEQ ID NO: 168901 - protein, 15 aa, Mycobacterium tuberculosis
FNARTADGINYRVLW

SEQ ID NO: 168902 - protein, 15 aa, Mycobacterium tuberculosis
NARTADGINYRVLWQ

SEQ ID NO: 168903 - protein, 15 aa, Mycobacterium tuberculosis
ARTADGINYRVLWQA

SEQ ID NO: 168904 - protein, 15 aa, Mycobacterium tuberculosis
RTADGINYRVLWQAA

SEQ ID NO: 168905 - protein, 15 aa, Mycobacterium tuberculosis
TADGINYRVLWQAAG

SEQ ID NO: 168906 - protein, 15 aa, Mycobacterium tuberculosis
ADGINYRVLWQAAGP

SEQ ID NO: 168907 - protein, 15 aa, Mycobacterium tuberculosis
DGINYRVLWQAAGPD

SEQ ID NO: 168908 - protein, 15 aa, Mycobacterium tuberculosis
GINYRVLWQAAGPDT

SEQ ID NO: 168909 - protein, 15 aa, Mycobacterium tuberculosis
INYRVLWQAAGPDTI

SEQ ID NO: 168910 - protein, 15 aa, Mycobacterium tuberculosis
NYRVLWQAAGPDTIS

SEQ ID NO: 168911 - protein, 15 aa, Mycobacterium tuberculosis
YRVLWQAAGPDTISG

SEQ ID NO: 168912 - protein, 15 aa, Mycobacterium tuberculosis
RVLWQAAGPDTISGA

SEQ ID NO: 168913 - protein, 15 aa, Mycobacterium tuberculosis
VLWQAAGPDTISGAT

SEQ ID NO: 168914 - protein, 15 aa, Mycobacterium tuberculosis
LWQAAGPDTISGATI

SEQ ID NO: 168915 - protein, 15 aa, Mycobacterium tuberculosis
WQAAGPDTISGATIP

SEQ ID NO: 168916 - protein, 15 aa, Mycobacterium tuberculosis
QAAGPDTISGATIPQ

SEQ ID NO: 168917 - protein, 15 aa, Mycobacterium tuberculosis
AAGPDTISGATIPQG

SEQ ID NO: 168918 - protein, 15 aa, Mycobacterium tuberculosis
AGPDTISGATIPQGE

SEQ ID NO: 168919 - protein, 15 aa, Mycobacterium tuberculosis
GPDTISGATIPQGEQ

SEQ ID NO: 168920 - protein, 15 aa, Mycobacterium tuberculosis
PDTISGATIPQGEQS

SEQ ID NO: 168921 - protein, 15 aa, Mycobacterium tuberculosis
DTISGATIPQGEQST

SEQ ID NO: 168922 - protein, 15 aa, Mycobacterium tuberculosis
TISGATIPQGEQSTG

SEQ ID NO: 168923 - protein, 15 aa, Mycobacterium tuberculosis
ISGATIPQGEQSTGK

SEQ ID NO: 168924 - protein, 15 aa, Mycobacterium tuberculosis
SGATIPQGEQSTGKI

SEQ ID NO: 168925 - protein, 15 aa, Mycobacterium tuberculosis
GATIPQGEQSTGKIY

SEQ ID NO: 168926 - protein, 15 aa, Mycobacterium tuberculosis
ATIPQGEQSTGKIYF

SEQ ID NO: 168927 - protein, 15 aa, Mycobacterium tuberculosis
TIPQGEQSTGKIYFD

SEQ ID NO: 168928 - protein, 15 aa, Mycobacterium tuberculosis
IPQGEQSTGKIYFDV

SEQ ID NO: 168929 - protein, 15 aa, Mycobacterium tuberculosis
PQGEQSTGKIYFDVT

SEQ ID NO: 168930 - protein, 15 aa, Mycobacterium tuberculosis
QGEQSTGKIYFDVTG

SEQ ID NO: 168931 - protein, 15 aa, Mycobacterium tuberculosis
GEQSTGKIYFDVTGP

SEQ ID NO: 168932 - protein, 15 aa, Mycobacterium tuberculosis
EQSTGKIYFDVTGPS

SEQ ID NO: 168933 - protein, 15 aa, Mycobacterium tuberculosis
QSTGKIYFDVTGPSP

SEQ ID NO: 168934 - protein, 15 aa, Mycobacterium tuberculosis
STGKIYFDVTGPSPT

SEQ ID NO: 168935 - protein, 15 aa, Mycobacterium tuberculosis
TGKIYFDVTGPSPTI

SEQ ID NO: 168936 - protein, 15 aa, Mycobacterium tuberculosis
GKIYFDVTGPSPTIV

SEQ ID NO: 168937 - protein, 15 aa, Mycobacterium tuberculosis
KIYFDVTGPSPTIVA

SEQ ID NO: 168938 - protein, 15 aa, Mycobacterium tuberculosis
IYFDVTGPSPTIVAM

SEQ ID NO: 168939 - protein, 15 aa, Mycobacterium tuberculosis
YFDVTGPSPTIVAMN

SEQ ID NO: 168940 - protein, 15 aa, Mycobacterium tuberculosis
FDVTGPSPTIVAMNN

SEQ ID NO: 168941 - protein, 15 aa, Mycobacterium tuberculosis
DVTGPSPTIVAMNNG

SEQ ID NO: 168942 - protein, 15 aa, Mycobacterium tuberculosis
VTGPSPTIVAMNNGM

SEQ ID NO: 168943 - protein, 15 aa, Mycobacterium tuberculosis
TGPSPTIVAMNNGME

SEQ ID NO: 168944 - protein, 15 aa, Mycobacterium tuberculosis
GPSPTIVAMNNGMED

SEQ ID NO: 168945 - protein, 15 aa, Mycobacterium tuberculosis
PSPTIVAMNNGMEDL

SEQ ID NO: 168946 - protein, 15 aa, Mycobacterium tuberculosis
SPTIVAMNNGMEDLL

SEQ ID NO: 168947 - protein, 15 aa, Mycobacterium tuberculosis
PTIVAMNNGMEDLLI

SEQ ID NO: 168948 - protein, 15 aa, Mycobacterium tuberculosis
TIVAMNNGMEDLLIW

SEQ ID NO: 168949 - protein, 15 aa, Mycobacterium tuberculosis
IVAMNNGMEDLLIWE

SEQ ID NO: 168950 - protein, 15 aa, Mycobacterium tuberculosis
VAMNNGMEDLLIWEP

SEQ ID NO: 168951 - protein, 16 aa, Mycobacterium tuberculosis
MKLTTMIKTAVAVVAM

SEQ ID NO: 168952 - protein, 16 aa, Mycobacterium tuberculosis
KLTTMIKTAVAVVAMA

SEQ ID NO: 168953 - protein, 16 aa, Mycobacterium tuberculosis
LTTMIKTAVAVVAMAA

SEQ ID NO: 168954 - protein, 16 aa, Mycobacterium tuberculosis
TTMIKTAVAVVAMAAI

SEQ ID NO: 168955 - protein, 16 aa, Mycobacterium tuberculosis
TMIKTAVAVVAMAAIA

SEQ ID NO: 168956 - protein, 16 aa, Mycobacterium tuberculosis
MIKTAVAVVAMAAIAT

SEQ ID NO: 168957 - protein, 16 aa, Mycobacterium tuberculosis
IKTAVAVVAMAAIATF

SEQ ID NO: 168958 - protein, 16 aa, Mycobacterium tuberculosis
KTAVAVVAMAAIATFA

SEQ ID NO: 168959 - protein, 16 aa, Mycobacterium tuberculosis
TAVAVVAMAAIATFAA

SEQ ID NO: 168960 - protein, 16 aa, Mycobacterium tuberculosis
AVAVVAMAAIATFAAP

SEQ ID NO: 168961 - protein, 16 aa, Mycobacterium tuberculosis
VAVVAMAAIATFAAPV

SEQ ID NO: 168962 - protein, 16 aa, Mycobacterium tuberculosis
AVVAMAAIATFAAPVA

SEQ ID NO: 168963 - protein, 16 aa, Mycobacterium tuberculosis
VVAMAAIATFAAPVAL

SEQ ID NO: 168964 - protein, 16 aa, Mycobacterium tuberculosis
VAMAAIATFAAPVALA

SEQ ID NO: 168965 - protein, 16 aa, Mycobacterium tuberculosis
AMAAIATFAAPVALAA

SEQ ID NO: 168966 - protein, 16 aa, Mycobacterium tuberculosis
MAAIATFAAPVALAAY

SEQ ID NO: 168967 - protein, 16 aa, Mycobacterium tuberculosis
AAIATFAAPVALAAYP

SEQ ID NO: 168968 - protein, 16 aa, Mycobacterium tuberculosis
AIATFAAPVALAAYPI

SEQ ID NO: 168969 - protein, 16 aa, Mycobacterium tuberculosis
IATFAAPVALAAYPIT

SEQ ID NO: 168970 - protein, 16 aa, Mycobacterium tuberculosis
ATFAAPVALAAYPITG

SEQ ID NO: 168971 - protein, 16 aa, Mycobacterium tuberculosis
TFAAPVALAAYPITGK

SEQ ID NO: 168972 - protein, 16 aa, Mycobacterium tuberculosis
FAAPVALAAYPITGKL

SEQ ID NO: 168973 - protein, 16 aa, Mycobacterium tuberculosis
AAPVALAAYPITGKLG

SEQ ID NO: 168974 - protein, 16 aa, Mycobacterium tuberculosis
APVALAAYPITGKLGS

SEQ ID NO: 168975 - protein, 16 aa, Mycobacterium tuberculosis
PVALAAYPITGKLGSE

SEQ ID NO: 168976 - protein, 16 aa, Mycobacterium tuberculosis
VALAAYPITGKLGSEL

SEQ ID NO: 168977 - protein, 16 aa, Mycobacterium tuberculosis
ALAAYPITGKLGSELT

SEQ ID NO: 168978 - protein, 16 aa, Mycobacterium tuberculosis
LAAYPITGKLGSELTM

SEQ ID NO: 168979 - protein, 16 aa, Mycobacterium tuberculosis
AAYPITGKLGSELTMT

SEQ ID NO: 168980 - protein, 16 aa, Mycobacterium tuberculosis
AYPITGKLGSELTMTD

SEQ ID NO: 168981 - protein, 16 aa, Mycobacterium tuberculosis
YPITGKLGSELTMTDT

SEQ ID NO: 168982 - protein, 16 aa, Mycobacterium tuberculosis
PITGKLGSELTMTDTV

SEQ ID NO: 168983 - protein, 16 aa, Mycobacterium tuberculosis
ITGKLGSELTMTDTVG

SEQ ID NO: 168984 - protein, 16 aa, Mycobacterium tuberculosis
TGKLGSELTMTDTVGQ

SEQ ID NO: 168985 - protein, 16 aa, Mycobacterium tuberculosis
GKLGSELTMTDTVGQV

SEQ ID NO: 168986 - protein, 16 aa, Mycobacterium tuberculosis
KLGSELTMTDTVGQVV

SEQ ID NO: 168987 - protein, 16 aa, Mycobacterium tuberculosis
LGSELTMTDTVGQVVL

SEQ ID NO: 168988 - protein, 16 aa, Mycobacterium tuberculosis
GSELTMTDTVGQVVLG

SEQ ID NO: 168989 - protein, 16 aa, Mycobacterium tuberculosis
SELTMTDTVGQVVLGW

SEQ ID NO: 168990 - protein, 16 aa, Mycobacterium tuberculosis
ELTMTDTVGQVVLGWK

SEQ ID NO: 168991 - protein, 16 aa, Mycobacterium tuberculosis
LTMTDTVGQVVLGWKV

SEQ ID NO: 168992 - protein, 16 aa, Mycobacterium tuberculosis
TMTDTVGQVVLGWKVS

SEQ ID NO: 168993 - protein, 16 aa, Mycobacterium tuberculosis
MTDTVGQVVLGWKVSD

SEQ ID NO: 168994 - protein, 16 aa, Mycobacterium tuberculosis
TDTVGQVVLGWKVSDL

SEQ ID NO: 168995 - protein, 16 aa, Mycobacterium tuberculosis
DTVGQVVLGWKVSDLK

SEQ ID NO: 168996 - protein, 16 aa, Mycobacterium tuberculosis
TVGQVVLGWKVSDLKS

SEQ ID NO: 168997 - protein, 16 aa, Mycobacterium tuberculosis
VGQVVLGWKVSDLKSS

SEQ ID NO: 168998 - protein, 16 aa, Mycobacterium tuberculosis
GQVVLGWKVSDLKSST

SEQ ID NO: 168999 - protein, 16 aa, Mycobacterium tuberculosis
QVVLGWKVSDLKSSTA

SEQ ID NO: 169000 - protein, 16 aa, Mycobacterium tuberculosis
VVLGWKVSDLKSSTAV

SEQ ID NO: 169001 - protein, 16 aa, Mycobacterium tuberculosis
VLGWKVSDLKSSTAVI

SEQ ID NO: 169002 - protein, 16 aa, Mycobacterium tuberculosis
LGWKVSDLKSSTAVIP

SEQ ID NO: 169003 - protein, 16 aa, Mycobacterium tuberculosis
GWKVSDLKSSTAVIPG

SEQ ID NO: 169004 - protein, 16 aa, Mycobacterium tuberculosis
WKVSDLKSSTAVIPGY

SEQ ID NO: 169005 - protein, 16 aa, Mycobacterium tuberculosis
KVSDLKSSTAVIPGYP

SEQ ID NO: 169006 - protein, 16 aa, Mycobacterium tuberculosis
VSDLKSSTAVIPGYPV

SEQ ID NO: 169007 - protein, 16 aa, Mycobacterium tuberculosis
SDLKSSTAVIPGYPVA

SEQ ID NO: 169008 - protein, 16 aa, Mycobacterium tuberculosis
DLKSSTAVIPGYPVAG

SEQ ID NO: 169009 - protein, 16 aa, Mycobacterium tuberculosis
LKSSTAVIPGYPVAGQ

SEQ ID NO: 169010 - protein, 16 aa, Mycobacterium tuberculosis
KSSTAVIPGYPVAGQV

SEQ ID NO: 169011 - protein, 16 aa, Mycobacterium tuberculosis
SSTAVIPGYPVAGQVW

SEQ ID NO: 169012 - protein, 16 aa, Mycobacterium tuberculosis
STAVIPGYPVAGQVWE

SEQ ID NO: 169013 - protein, 16 aa, Mycobacterium tuberculosis
TAVIPGYPVAGQVWEA

SEQ ID NO: 169014 - protein, 16 aa, Mycobacterium tuberculosis
AVIPGYPVAGQVWEAT

SEQ ID NO: 169015 - protein, 16 aa, Mycobacterium tuberculosis
VIPGYPVAGQVWEATA

SEQ ID NO: 169016 - protein, 16 aa, Mycobacterium tuberculosis
IPGYPVAGQVWEATAT

SEQ ID NO: 169017 - protein, 16 aa, Mycobacterium tuberculosis
PGYPVAGQVWEATATV

SEQ ID NO: 169018 - protein, 16 aa, Mycobacterium tuberculosis
GYPVAGQVWEATATVN

SEQ ID NO: 169019 - protein, 16 aa, Mycobacterium tuberculosis
YPVAGQVWEATATVNA

SEQ ID NO: 169020 - protein, 16 aa, Mycobacterium tuberculosis
PVAGQVWEATATVNAI

SEQ ID NO: 169021 - protein, 16 aa, Mycobacterium tuberculosis
VAGQVWEATATVNAIR

SEQ ID NO: 169022 - protein, 16 aa, Mycobacterium tuberculosis
AGQVWEATATVNAIRG

SEQ ID NO: 169023 - protein, 16 aa, Mycobacterium tuberculosis
GQVWEATATVNAIRGS

SEQ ID NO: 169024 - protein, 16 aa, Mycobacterium tuberculosis
QVWEATATVNAIRGSV

SEQ ID NO: 169025 - protein, 16 aa, Mycobacterium tuberculosis
VWEATATVNAIRGSVT

SEQ ID NO: 169026 - protein, 16 aa, Mycobacterium tuberculosis
WEATATVNAIRGSVTP

SEQ ID NO: 169027 - protein, 16 aa, Mycobacterium tuberculosis
EATATVNAIRGSVTPA

SEQ ID NO: 169028 - protein, 16 aa, Mycobacterium tuberculosis
ATATVNAIRGSVTPAV

SEQ ID NO: 169029 - protein, 16 aa, Mycobacterium tuberculosis
TATVNAIRGSVTPAVS

SEQ ID NO: 169030 - protein, 16 aa, Mycobacterium tuberculosis
ATVNAIRGSVTPAVSQ

SEQ ID NO: 169031 - protein, 16 aa, Mycobacterium tuberculosis
TVNAIRGSVTPAVSQF

SEQ ID NO: 169032 - protein, 16 aa, Mycobacterium tuberculosis
VNAIRGSVTPAVSQFN

SEQ ID NO: 169033 - protein, 16 aa, Mycobacterium tuberculosis
NAIRGSVTPAVSQFNA

SEQ ID NO: 169034 - protein, 16 aa, Mycobacterium tuberculosis
AIRGSVTPAVSQFNAR

SEQ ID NO: 169035 - protein, 16 aa, Mycobacterium tuberculosis
IRGSVTPAVSQFNART

SEQ ID NO: 169036 - protein, 16 aa, Mycobacterium tuberculosis
RGSVTPAVSQFNARTA

SEQ ID NO: 169037 - protein, 16 aa, Mycobacterium tuberculosis
GSVTPAVSQFNARTAD

SEQ ID NO: 169038 - protein, 16 aa, Mycobacterium tuberculosis
SVTPAVSQFNARTADG

SEQ ID NO: 169039 - protein, 16 aa, Mycobacterium tuberculosis
VTPAVSQFNARTADGI

SEQ ID NO: 169040 - protein, 16 aa, Mycobacterium tuberculosis
TPAVSQFNARTADGIN

SEQ ID NO: 169041 - protein, 16 aa, Mycobacterium tuberculosis
PAVSQFNARTADGINY

SEQ ID NO: 169042 - protein, 16 aa, Mycobacterium tuberculosis
AVSQFNARTADGINYR

SEQ ID NO: 169043 - protein, 16 aa, Mycobacterium tuberculosis
VSQFNARTADGINYRV

SEQ ID NO: 169044 - protein, 16 aa, Mycobacterium tuberculosis
SQFNARTADGINYRVL

SEQ ID NO: 169045 - protein, 16 aa, Mycobacterium tuberculosis
QFNARTADGINYRVLW

SEQ ID NO: 169046 - protein, 16 aa, Mycobacterium tuberculosis
FNARTADGINYRVLWQ

SEQ ID NO: 169047 - protein, 16 aa, Mycobacterium tuberculosis
NARTADGINYRVLWQA

SEQ ID NO: 169048 - protein, 16 aa, Mycobacterium tuberculosis
ARTADGINYRVLWQAA

SEQ ID NO: 169049 - protein, 16 aa, Mycobacterium tuberculosis
RTADGINYRVLWQAAG

SEQ ID NO: 169050 - protein, 16 aa, Mycobacterium tuberculosis
TADGINYRVLWQAAGP

SEQ ID NO: 169051 - protein, 16 aa, Mycobacterium tuberculosis
ADGINYRVLWQAAGPD

SEQ ID NO: 169052 - protein, 16 aa, Mycobacterium tuberculosis
DGINYRVLWQAAGPDT

SEQ ID NO: 169053 - protein, 16 aa, Mycobacterium tuberculosis
GINYRVLWQAAGPDTI

SEQ ID NO: 169054 - protein, 16 aa, Mycobacterium tuberculosis
INYRVLWQAAGPDTIS

SEQ ID NO: 169055 - protein, 16 aa, Mycobacterium tuberculosis
NYRVLWQAAGPDTISG

SEQ ID NO: 169056 - protein, 16 aa, Mycobacterium tuberculosis
YRVLWQAAGPDTISGA

SEQ ID NO: 169057 - protein, 16 aa, Mycobacterium tuberculosis
RVLWQAAGPDTISGAT

SEQ ID NO: 169058 - protein, 16 aa, Mycobacterium tuberculosis
VLWQAAGPDTISGATI

SEQ ID NO: 169059 - protein, 16 aa, Mycobacterium tuberculosis
LWQAAGPDTISGATIP

SEQ ID NO: 169060 - protein, 16 aa, Mycobacterium tuberculosis
WQAAGPDTISGATIPQ

SEQ ID NO: 169061 - protein, 16 aa, Mycobacterium tuberculosis
QAAGPDTISGATIPQG

SEQ ID NO: 169062 - protein, 16 aa, Mycobacterium tuberculosis
AAGPDTISGATIPQGE

SEQ ID NO: 169063 - protein, 16 aa, Mycobacterium tuberculosis
AGPDTISGATIPQGEQ

SEQ ID NO: 169064 - protein, 16 aa, Mycobacterium tuberculosis
GPDTISGATIPQGEQS

SEQ ID NO: 169065 - protein, 16 aa, Mycobacterium tuberculosis
PDTISGATIPQGEQST

SEQ ID NO: 169066 - protein, 16 aa, Mycobacterium tuberculosis
DTISGATIPQGEQSTG

SEQ ID NO: 169067 - protein, 16 aa, Mycobacterium tuberculosis
TISGATIPQGEQSTGK

SEQ ID NO: 169068 - protein, 16 aa, Mycobacterium tuberculosis
ISGATIPQGEQSTGKI

SEQ ID NO: 169069 - protein, 16 aa, Mycobacterium tuberculosis
SGATIPQGEQSTGKIY

SEQ ID NO: 169070 - protein, 16 aa, Mycobacterium tuberculosis
GATIPQGEQSTGKIYF

SEQ ID NO: 169071 - protein, 16 aa, Mycobacterium tuberculosis
ATIPQGEQSTGKIYFD

SEQ ID NO: 169072 - protein, 16 aa, Mycobacterium tuberculosis
TIPQGEQSTGKIYFDV

SEQ ID NO: 169073 - protein, 16 aa, Mycobacterium tuberculosis
IPQGEQSTGKIYFDVT

SEQ ID NO: 169074 - protein, 16 aa, Mycobacterium tuberculosis
PQGEQSTGKIYFDVTG

SEQ ID NO: 169075 - protein, 16 aa, Mycobacterium tuberculosis
QGEQSTGKIYFDVTGP

SEQ ID NO: 169076 - protein, 16 aa, Mycobacterium tuberculosis
GEQSTGKIYFDVTGPS

SEQ ID NO: 169077 - protein, 16 aa, Mycobacterium tuberculosis
EQSTGKIYFDVTGPSP

SEQ ID NO: 169078 - protein, 16 aa, Mycobacterium tuberculosis
QSTGKIYFDVTGPSPT

SEQ ID NO: 169079 - protein, 16 aa, Mycobacterium tuberculosis
STGKIYFDVTGPSPTI

SEQ ID NO: 169080 - protein, 16 aa, Mycobacterium tuberculosis
TGKIYFDVTGPSPTIV

SEQ ID NO: 169081 - protein, 16 aa, Mycobacterium tuberculosis
GKIYFDVTGPSPTIVA

SEQ ID NO: 169082 - protein, 16 aa, Mycobacterium tuberculosis
KIYFDVTGPSPTIVAM

SEQ ID NO: 169083 - protein, 16 aa, Mycobacterium tuberculosis
IYFDVTGPSPTIVAMN

SEQ ID NO: 169084 - protein, 16 aa, Mycobacterium tuberculosis
YFDVTGPSPTIVAMNN

SEQ ID NO: 169085 - protein, 16 aa, Mycobacterium tuberculosis
FDVTGPSPTIVAMNNG

SEQ ID NO: 169086 - protein, 16 aa, Mycobacterium tuberculosis
DVTGPSPTIVAMNNGM

SEQ ID NO: 169087 - protein, 16 aa, Mycobacterium tuberculosis
VTGPSPTIVAMNNGME

SEQ ID NO: 169088 - protein, 16 aa, Mycobacterium tuberculosis
TGPSPTIVAMNNGMED

SEQ ID NO: 169089 - protein, 16 aa, Mycobacterium tuberculosis
GPSPTIVAMNNGMEDL

SEQ ID NO: 169090 - protein, 16 aa, Mycobacterium tuberculosis
PSPTIVAMNNGMEDLL

SEQ ID NO: 169091 - protein, 16 aa, Mycobacterium tuberculosis
SPTIVAMNNGMEDLLI

SEQ ID NO: 169092 - protein, 16 aa, Mycobacterium tuberculosis
PTIVAMNNGMEDLLIW

SEQ ID NO: 169093 - protein, 16 aa, Mycobacterium tuberculosis
TIVAMNNGMEDLLIWE

SEQ ID NO: 169094 - protein, 16 aa, Mycobacterium tuberculosis
IVAMNNGMEDLLIWEP

SEQ ID NO: 169095 - protein, 681 aa, Mycobacterium tuberculosis
MLMTAAADVTRRSPRRVFRDRREAGRVLAELLAAYRDQPDVIVLGLARGGLPVAWEVAAALHAPLDAFVVRKLGAPGHDEFAVGALASGGRVVVNDDVVRGLRITPQQLRDIAEREGRELLRRESAYRGERPPTDITGKTVIVVDDGLATGASMFAAVQALRDAQPAQIVIAVPAAPESTCREFAGLVDDVVCATMPTPFLAVGESFWDFRQVTDEEVRRLLATPTAGPSLRRPAASTAADVLRRVAIDAPGGVPTHEVLAELVGDARIVLIGESSHGTHEFYQARAAMTQWLIEEKGFGAVAAEADWPDAYRVNRYVRGLGEDTNADEALSGFERFPAWMWRNTVVRDFVEWLRTRNQRYESGALRQAGFYGLDLYSLHRSIQEVISYLDKVDPRAAARARARYACFDHACADDGQAYGFAAAFGAGPSCEREAVEQLVDVQRNALAYARQDGLLAEDELFYAQQNAQTVRDAEVYYRAMFSGRVTSWNLRDQHMAQTLGSLLTHLDRHLDAPPARIVVWAHNSHVGDARATEVWADGQLTLGQIVRERYGDESRSIGFSTYTGTVTAASEWGGIAQRKAVRPALHGSVEELFHQTADSFLVSARLSRDAEAPLDVVRLGRAIGVVYLPATERQSHYLHVRPADQFDAMIHIDQTRALEPLEVTSRWIAGENPETYPTGL

SEQ ID NO: 169096 - protein, 8 aa, Mycobacterium tuberculosis
LMTAAADV

SEQ ID NO: 169097 - protein, 8 aa, Mycobacterium tuberculosis
MTAAADVT

SEQ ID NO: 169098 - protein, 8 aa, Mycobacterium tuberculosis
TAAADVTR

SEQ ID NO: 169099 - protein, 8 aa, Mycobacterium tuberculosis
AAADVTRR

SEQ ID NO: 169100 - protein, 8 aa, Mycobacterium tuberculosis
DVTRRSPR

SEQ ID NO: 169101 - protein, 8 aa, Mycobacterium tuberculosis
VTRRSPRR

SEQ ID NO: 169102 - protein, 8 aa, Mycobacterium tuberculosis
RRSPRRVF

SEQ ID NO: 169103 - protein, 8 aa, Mycobacterium tuberculosis
RSPRRVFR

SEQ ID NO: 169104 - protein, 8 aa, Mycobacterium tuberculosis
RRVFRDRR

SEQ ID NO: 169105 - protein, 8 aa, Mycobacterium tuberculosis
RREAGRVL

SEQ ID NO: 169106 - protein, 8 aa, Mycobacterium tuberculosis
RVLAELLA

SEQ ID NO: 169107 - protein, 8 aa, Mycobacterium tuberculosis
VLAELLAA

SEQ ID NO: 169108 - protein, 8 aa, Mycobacterium tuberculosis
LAELLAAY

SEQ ID NO: 169109 - protein, 8 aa, Mycobacterium tuberculosis
LARGGLPV

SEQ ID NO: 169110 - protein, 8 aa, Mycobacterium tuberculosis
RGGLPVAW

SEQ ID NO: 169111 - protein, 8 aa, Mycobacterium tuberculosis
GLPVAWEV

SEQ ID NO: 169112 - protein, 8 aa, Mycobacterium tuberculosis
LPVAWEVA

SEQ ID NO: 169113 - protein, 8 aa, Mycobacterium tuberculosis
VAWEVAAA

SEQ ID NO: 169114 - protein, 8 aa, Mycobacterium tuberculosis
EVAAALHA

SEQ ID NO: 169115 - protein, 8 aa, Mycobacterium tuberculosis
AAALHAPL

SEQ ID NO: 169116 - protein, 8 aa, Mycobacterium tuberculosis
ALHAPLDA

SEQ ID NO: 169117 - protein, 8 aa, Mycobacterium tuberculosis
LHAPLDAF

SEQ ID NO: 169118 - protein, 8 aa, Mycobacterium tuberculosis
HAPLDAFV

SEQ ID NO: 169119 - protein, 8 aa, Mycobacterium tuberculosis
APLDAFVV

SEQ ID NO: 169120 - protein, 8 aa, Mycobacterium tuberculosis
FVVRKLGA

SEQ ID NO: 169121 - protein, 8 aa, Mycobacterium tuberculosis
DEFAVGAL

SEQ ID NO: 169122 - protein, 8 aa, Mycobacterium tuberculosis
FAVGALAS

SEQ ID NO: 169123 - protein, 8 aa, Mycobacterium tuberculosis
ALASGGRV

SEQ ID NO: 169124 - protein, 8 aa, Mycobacterium tuberculosis
LASGGRVV

SEQ ID NO: 169125 - protein, 8 aa, Mycobacterium tuberculosis
RVVVNDDV

SEQ ID NO: 169126 - protein, 8 aa, Mycobacterium tuberculosis
VVVNDDVV

SEQ ID NO: 169127 - protein, 8 aa, Mycobacterium tuberculosis
VVNDDVVR

SEQ ID NO: 169128 - protein, 8 aa, Mycobacterium tuberculosis
RITPQQLR

SEQ ID NO: 169129 - protein, 8 aa, Mycobacterium tuberculosis
QLRDIAER

SEQ ID NO: 169130 - protein, 8 aa, Mycobacterium tuberculosis
DIAEREGR

SEQ ID NO: 169131 - protein, 8 aa, Mycobacterium tuberculosis
AEREGREL

SEQ ID NO: 169132 - protein, 8 aa, Mycobacterium tuberculosis
ELLRRESA

SEQ ID NO: 169133 - protein, 8 aa, Mycobacterium tuberculosis
LLRRESAY

SEQ ID NO: 169134 - protein, 8 aa, Mycobacterium tuberculosis
ESAYRGER

SEQ ID NO: 169135 - protein, 8 aa, Mycobacterium tuberculosis
ITGKTVIV

SEQ ID NO: 169136 - protein, 8 aa, Mycobacterium tuberculosis
VVDDGLAT

SEQ ID NO: 169137 - protein, 8 aa, Mycobacterium tuberculosis
GLATGASM

SEQ ID NO: 169138 - protein, 8 aa, Mycobacterium tuberculosis
LATGASMF

SEQ ID NO: 169139 - protein, 8 aa, Mycobacterium tuberculosis
TGASMFAA

SEQ ID NO: 169140 - protein, 8 aa, Mycobacterium tuberculosis
GASMFAAV

SEQ ID NO: 169141 - protein, 8 aa, Mycobacterium tuberculosis
SMFAAVQA

SEQ ID NO: 169142 - protein, 8 aa, Mycobacterium tuberculosis
MFAAVQAL

SEQ ID NO: 169143 - protein, 8 aa, Mycobacterium tuberculosis
FAAVQALR

SEQ ID NO: 169144 - protein, 8 aa, Mycobacterium tuberculosis
ALRDAQPA

SEQ ID NO: 169145 - protein, 8 aa, Mycobacterium tuberculosis
AQPAQIVI

SEQ ID NO: 169146 - protein, 8 aa, Mycobacterium tuberculosis
QPAQIVIA

SEQ ID NO: 169147 - protein, 8 aa, Mycobacterium tuberculosis
QIVIAVPA

SEQ ID NO: 169148 - protein, 8 aa, Mycobacterium tuberculosis
IVIAVPAA

SEQ ID NO: 169149 - protein, 8 aa, Mycobacterium tuberculosis
ESTCREFA

SEQ ID NO: 169150 - protein, 8 aa, Mycobacterium tuberculosis
GLVDDVVC

SEQ ID NO: 169151 - protein, 8 aa, Mycobacterium tuberculosis
LVDDVVCA

SEQ ID NO: 169152 - protein, 8 aa, Mycobacterium tuberculosis
CATMPTPF

SEQ ID NO: 169153 - protein, 8 aa, Mycobacterium tuberculosis
ATMPTPFL

SEQ ID NO: 169154 - protein, 8 aa, Mycobacterium tuberculosis
TMPTPFLA

SEQ ID NO: 169155 - protein, 8 aa, Mycobacterium tuberculosis
MPTPFLAV

SEQ ID NO: 169156 - protein, 8 aa, Mycobacterium tuberculosis
FLAVGESF

SEQ ID NO: 169157 - protein, 8 aa, Mycobacterium tuberculosis
LAVGESFW

SEQ ID NO: 169158 - protein, 8 aa, Mycobacterium tuberculosis
ESFWDFRQ

SEQ ID NO: 169159 - protein, 8 aa, Mycobacterium tuberculosis
SFWDFRQV

SEQ ID NO: 169160 - protein, 8 aa, Mycobacterium tuberculosis
RQVTDEEV

SEQ ID NO: 169161 - protein, 8 aa, Mycobacterium tuberculosis
QVTDEEVR

SEQ ID NO: 169162 - protein, 8 aa, Mycobacterium tuberculosis
EEVRRLLA

SEQ ID NO: 169163 - protein, 8 aa, Mycobacterium tuberculosis
RRLLATPT

SEQ ID NO: 169164 - protein, 8 aa, Mycobacterium tuberculosis
RLLATPTA

SEQ ID NO: 169165 - protein, 8 aa, Mycobacterium tuberculosis
TPTAGPSL

SEQ ID NO: 169166 - protein, 8 aa, Mycobacterium tuberculosis
PTAGPSLR

SEQ ID NO: 169167 - protein, 8 aa, Mycobacterium tuberculosis
TAGPSLRR

SEQ ID NO: 169168 - protein, 8 aa, Mycobacterium tuberculosis
GPSLRRPA

SEQ ID NO: 169169 - protein, 8 aa, Mycobacterium tuberculosis
RPAASTAA

SEQ ID NO: 169170 - protein, 8 aa, Mycobacterium tuberculosis
STAADVLR

SEQ ID NO: 169171 - protein, 8 aa, Mycobacterium tuberculosis
TAADVLRR

SEQ ID NO: 169172 - protein, 8 aa, Mycobacterium tuberculosis
AADVLRRV

SEQ ID NO: 169173 - protein, 8 aa, Mycobacterium tuberculosis
DVLRRVAI

SEQ ID NO: 169174 - protein, 8 aa, Mycobacterium tuberculosis
AIDAPGGV

SEQ ID NO: 169175 - protein, 8 aa, Mycobacterium tuberculosis
GGVPTHEV

SEQ ID NO: 169176 - protein, 8 aa, Mycobacterium tuberculosis
GVPTHEVL

SEQ ID NO: 169177 - protein, 8 aa, Mycobacterium tuberculosis
VPTHEVLA

SEQ ID NO: 169178 - protein, 8 aa, Mycobacterium tuberculosis
THEVLAEL

SEQ ID NO: 169179 - protein, 8 aa, Mycobacterium tuberculosis
HEVLAELV

SEQ ID NO: 169180 - protein, 8 aa, Mycobacterium tuberculosis
ELVGDARI

SEQ ID NO: 169181 - protein, 8 aa, Mycobacterium tuberculosis
LVGDARIV

SEQ ID NO: 169182 - protein, 8 aa, Mycobacterium tuberculosis
SSHGTHEF

SEQ ID NO: 169183 - protein, 8 aa, Mycobacterium tuberculosis
FYQARAAM

SEQ ID NO: 169184 - protein, 8 aa, Mycobacterium tuberculosis
YQARAAMT

SEQ ID NO: 169185 - protein, 8 aa, Mycobacterium tuberculosis
RAAMTQWL

SEQ ID NO: 169186 - protein, 8 aa, Mycobacterium tuberculosis
AAMTQWLI

SEQ ID NO: 169187 - protein, 8 aa, Mycobacterium tuberculosis
TQWLIEEK

SEQ ID NO: 169188 - protein, 8 aa, Mycobacterium tuberculosis
WLIEEKGF

SEQ ID NO: 169189 - protein, 8 aa, Mycobacterium tuberculosis
EEKGFGAV

SEQ ID NO: 169190 - protein, 8 aa, Mycobacterium tuberculosis
FGAVAAEA

SEQ ID NO: 169191 - protein, 8 aa, Mycobacterium tuberculosis
AVAAEADW

SEQ ID NO: 169192 - protein, 8 aa, Mycobacterium tuberculosis
AEADWPDA

SEQ ID NO: 169193 - protein, 8 aa, Mycobacterium tuberculosis
EADWPDAY

SEQ ID NO: 169194 - protein, 8 aa, Mycobacterium tuberculosis
DAYRVNRY

SEQ ID NO: 169195 - protein, 8 aa, Mycobacterium tuberculosis
YRVNRYVR

SEQ ID NO: 169196 - protein, 8 aa, Mycobacterium tuberculosis
GLGEDTNA

SEQ ID NO: 169197 - protein, 8 aa, Mycobacterium tuberculosis
DTNADEAL

SEQ ID NO: 169198 - protein, 8 aa, Mycobacterium tuberculosis
EALSGFER

SEQ ID NO: 169199 - protein, 8 aa, Mycobacterium tuberculosis
ALSGFERF

SEQ ID NO: 169200 - protein, 8 aa, Mycobacterium tuberculosis
SGFERFPA

SEQ ID NO: 169201 - protein, 8 aa, Mycobacterium tuberculosis
FERFPAWM

SEQ ID NO: 169202 - protein, 8 aa, Mycobacterium tuberculosis
RFPAWMWR

SEQ ID NO: 169203 - protein, 8 aa, Mycobacterium tuberculosis
FPAWMWRN

SEQ ID NO: 169204 - protein, 8 aa, Mycobacterium tuberculosis
AWMWRNTV

SEQ ID NO: 169205 - protein, 8 aa, Mycobacterium tuberculosis
WMWRNTVV

SEQ ID NO: 169206 - protein, 8 aa, Mycobacterium tuberculosis
MWRNTVVR

SEQ ID NO: 169207 - protein, 8 aa, Mycobacterium tuberculosis
NTVVRDFV

SEQ ID NO: 169208 - protein, 8 aa, Mycobacterium tuberculosis
FVEWLRTR

SEQ ID NO: 169209 - protein, 8 aa, Mycobacterium tuberculosis
WLRTRNQR

SEQ ID NO: 169210 - protein, 8 aa, Mycobacterium tuberculosis
RTRNQRYE

SEQ ID NO: 169211 - protein, 8 aa, Mycobacterium tuberculosis
QRYESGAL

SEQ ID NO: 169212 - protein, 8 aa, Mycobacterium tuberculosis
RYESGALR

SEQ ID NO: 169213 - protein, 8 aa, Mycobacterium tuberculosis
ALRQAGFY

SEQ ID NO: 169214 - protein, 8 aa, Mycobacterium tuberculosis
RQAGFYGL

SEQ ID NO: 169215 - protein, 8 aa, Mycobacterium tuberculosis
GFYGLDLY

SEQ ID NO: 169216 - protein, 8 aa, Mycobacterium tuberculosis
YGLDLYSL

SEQ ID NO: 169217 - protein, 8 aa, Mycobacterium tuberculosis
LYSLHRSI

SEQ ID NO: 169218 - protein, 8 aa, Mycobacterium tuberculosis
SIQEVISY

SEQ ID NO: 169219 - protein, 8 aa, Mycobacterium tuberculosis
IQEVISYL

SEQ ID NO: 169220 - protein, 8 aa, Mycobacterium tuberculosis
EVISYLDK

SEQ ID NO: 169221 - protein, 8 aa, Mycobacterium tuberculosis
VISYLDKV

SEQ ID NO: 169222 - protein, 8 aa, Mycobacterium tuberculosis
YLDKVDPR

SEQ ID NO: 169223 - protein, 8 aa, Mycobacterium tuberculosis
KVDPRAAA

SEQ ID NO: 169224 - protein, 8 aa, Mycobacterium tuberculosis
AAARARAR

SEQ ID NO: 169225 - protein, 8 aa, Mycobacterium tuberculosis
AARARARY

SEQ ID NO: 169226 - protein, 8 aa, Mycobacterium tuberculosis
RARARYAC

SEQ ID NO: 169227 - protein, 8 aa, Mycobacterium tuberculosis
CADDGQAY

SEQ ID NO: 169228 - protein, 8 aa, Mycobacterium tuberculosis
GQAYGFAA

SEQ ID NO: 169229 - protein, 8 aa, Mycobacterium tuberculosis
QAYGFAAA

SEQ ID NO: 169230 - protein, 8 aa, Mycobacterium tuberculosis
AYGFAAAF

SEQ ID NO: 169231 - protein, 8 aa, Mycobacterium tuberculosis
REAVEQLV

SEQ ID NO: 169232 - protein, 8 aa, Mycobacterium tuberculosis
AVEQLVDV

SEQ ID NO: 169233 - protein, 8 aa, Mycobacterium tuberculosis
VQRNALAY

SEQ ID NO: 169234 - protein, 8 aa, Mycobacterium tuberculosis
RNALAYAR

SEQ ID NO: 169235 - protein, 8 aa, Mycobacterium tuberculosis
AYARQDGL

SEQ ID NO: 169236 - protein, 8 aa, Mycobacterium tuberculosis
YARQDGLL

SEQ ID NO: 169237 - protein, 8 aa, Mycobacterium tuberculosis
RQDGLLAE

SEQ ID NO: 169238 - protein, 8 aa, Mycobacterium tuberculosis
GLLAEDEL

SEQ ID NO: 169239 - protein, 8 aa, Mycobacterium tuberculosis
LLAEDELF

SEQ ID NO: 169240 - protein, 8 aa, Mycobacterium tuberculosis
LAEDELFY

SEQ ID NO: 169241 - protein, 8 aa, Mycobacterium tuberculosis
AEDELFYA

SEQ ID NO: 169242 - protein, 8 aa, Mycobacterium tuberculosis
AQQNAQTV

SEQ ID NO: 169243 - protein, 8 aa, Mycobacterium tuberculosis
QQNAQTVR

SEQ ID NO: 169244 - protein, 8 aa, Mycobacterium tuberculosis
QTVRDAEV

SEQ ID NO: 169245 - protein, 8 aa, Mycobacterium tuberculosis
TVRDAEVY

SEQ ID NO: 169246 - protein, 8 aa, Mycobacterium tuberculosis
RDAEVYYR

SEQ ID NO: 169247 - protein, 8 aa, Mycobacterium tuberculosis
AEVYYRAM

SEQ ID NO: 169248 - protein, 8 aa, Mycobacterium tuberculosis
EVYYRAMF

SEQ ID NO: 169249 - protein, 8 aa, Mycobacterium tuberculosis
YRAMFSGR

SEQ ID NO: 169250 - protein, 8 aa, Mycobacterium tuberculosis
RAMFSGRV

SEQ ID NO: 169251 - protein, 8 aa, Mycobacterium tuberculosis
AMFSGRVT

SEQ ID NO: 169252 - protein, 8 aa, Mycobacterium tuberculosis
FSGRVTSW

SEQ ID NO: 169253 - protein, 8 aa, Mycobacterium tuberculosis
RVTSWNLR

SEQ ID NO: 169254 - protein, 8 aa, Mycobacterium tuberculosis
NLRDQHMA

SEQ ID NO: 169255 - protein, 8 aa, Mycobacterium tuberculosis
HMAQTLGS

SEQ ID NO: 169256 - protein, 8 aa, Mycobacterium tuberculosis
MAQTLGSL

SEQ ID NO: 169257 - protein, 8 aa, Mycobacterium tuberculosis
AQTLGSLL

SEQ ID NO: 169258 - protein, 8 aa, Mycobacterium tuberculosis
QTLGSLLT

SEQ ID NO: 169259 - protein, 8 aa, Mycobacterium tuberculosis
SLLTHLDR

SEQ ID NO: 169260 - protein, 8 aa, Mycobacterium tuberculosis
HLDRHLDA

SEQ ID NO: 169261 - protein, 8 aa, Mycobacterium tuberculosis
APPARIVV

SEQ ID NO: 169262 - protein, 8 aa, Mycobacterium tuberculosis
PPARIVVW

SEQ ID NO: 169263 - protein, 8 aa, Mycobacterium tuberculosis
VWAHNSHV

SEQ ID NO: 169264 - protein, 8 aa, Mycobacterium tuberculosis
NSHVGDAR

SEQ ID NO: 169265 - protein, 8 aa, Mycobacterium tuberculosis
EVWADGQL

SEQ ID NO: 169266 - protein, 8 aa, Mycobacterium tuberculosis
WADGQLTL

SEQ ID NO: 169267 - protein, 8 aa, Mycobacterium tuberculosis
GQLTLGQI

SEQ ID NO: 169268 - protein, 8 aa, Mycobacterium tuberculosis
QLTLGQIV

SEQ ID NO: 169269 - protein, 8 aa, Mycobacterium tuberculosis
LTLGQIVR

SEQ ID NO: 169270 - protein, 8 aa, Mycobacterium tuberculosis
GQIVRERY

SEQ ID NO: 169271 - protein, 8 aa, Mycobacterium tuberculosis
ERYGDESR

SEQ ID NO: 169272 - protein, 8 aa, Mycobacterium tuberculosis
DESRSIGF

SEQ ID NO: 169273 - protein, 8 aa, Mycobacterium tuberculosis
RSIGFSTY

SEQ ID NO: 169274 - protein, 8 aa, Mycobacterium tuberculosis
FSTYTGTV

SEQ ID NO: 169275 - protein, 8 aa, Mycobacterium tuberculosis
YTGTVTAA

SEQ ID NO: 169276 - protein, 8 aa, Mycobacterium tuberculosis
TVTAASEW

SEQ ID NO: 169277 - protein, 8 aa, Mycobacterium tuberculosis
AASEWGGI

SEQ ID NO: 169278 - protein, 8 aa, Mycobacterium tuberculosis
EWGGIAQR

SEQ ID NO: 169279 - protein, 8 aa, Mycobacterium tuberculosis
GIAQRKAV

SEQ ID NO: 169280 - protein, 8 aa, Mycobacterium tuberculosis
IAQRKAVR

SEQ ID NO: 169281 - protein, 8 aa, Mycobacterium tuberculosis
RPALHGSV

SEQ ID NO: 169282 - protein, 8 aa, Mycobacterium tuberculosis
EELFHQTA

SEQ ID NO: 169283 - protein, 8 aa, Mycobacterium tuberculosis
FHQTADSF

SEQ ID NO: 169284 - protein, 8 aa, Mycobacterium tuberculosis
HQTADSFL

SEQ ID NO: 169285 - protein, 8 aa, Mycobacterium tuberculosis
QTADSFLV

SEQ ID NO: 169286 - protein, 8 aa, Mycobacterium tuberculosis
DSFLVSAR

SEQ ID NO: 169287 - protein, 8 aa, Mycobacterium tuberculosis
LVSARLSR

SEQ ID NO: 169288 - protein, 8 aa, Mycobacterium tuberculosis
RLSRDAEA

SEQ ID NO: 169289 - protein, 8 aa, Mycobacterium tuberculosis
SRDAEAPL

SEQ ID NO: 169290 - protein, 8 aa, Mycobacterium tuberculosis
AEAPLDVV

SEQ ID NO: 169291 - protein, 8 aa, Mycobacterium tuberculosis
EAPLDVVR

SEQ ID NO: 169292 - protein, 8 aa, Mycobacterium tuberculosis
APLDVVRL

SEQ ID NO: 169293 - protein, 8 aa, Mycobacterium tuberculosis
VVRLGRAI

SEQ ID NO: 169294 - protein, 8 aa, Mycobacterium tuberculosis
RLGRAIGV

SEQ ID NO: 169295 - protein, 8 aa, Mycobacterium tuberculosis
GRAIGVVY

SEQ ID NO: 169296 - protein, 8 aa, Mycobacterium tuberculosis
RAIGVVYL

SEQ ID NO: 169297 - protein, 8 aa, Mycobacterium tuberculosis
VYLPATER

SEQ ID NO: 169298 - protein, 8 aa, Mycobacterium tuberculosis
YLPATERQ

SEQ ID NO: 169299 - protein, 8 aa, Mycobacterium tuberculosis
ATERQSHY

SEQ ID NO: 169300 - protein, 8 aa, Mycobacterium tuberculosis
TERQSHYL

SEQ ID NO: 169301 - protein, 8 aa, Mycobacterium tuberculosis
RQSHYLHV

SEQ ID NO: 169302 - protein, 8 aa, Mycobacterium tuberculosis
QSHYLHVR

SEQ ID NO: 169303 - protein, 8 aa, Mycobacterium tuberculosis
HVRPADQF

SEQ ID NO: 169304 - protein, 8 aa, Mycobacterium tuberculosis
PADQFDAM

SEQ ID NO: 169305 - protein, 8 aa, Mycobacterium tuberculosis
AMIHIDQT

SEQ ID NO: 169306 - protein, 8 aa, Mycobacterium tuberculosis
MIHIDQTR

SEQ ID NO: 169307 - protein, 8 aa, Mycobacterium tuberculosis
HIDQTRAL

SEQ ID NO: 169308 - protein, 8 aa, Mycobacterium tuberculosis
QTRALEPL

SEQ ID NO: 169309 - protein, 8 aa, Mycobacterium tuberculosis
RALEPLEV

SEQ ID NO: 169310 - protein, 8 aa, Mycobacterium tuberculosis
ALEPLEVT

SEQ ID NO: 169311 - protein, 8 aa, Mycobacterium tuberculosis
EPLEVTSR

SEQ ID NO: 169312 - protein, 8 aa, Mycobacterium tuberculosis
EVTSRWIA

SEQ ID NO: 169313 - protein, 8 aa, Mycobacterium tuberculosis
PETYPTGL

SEQ ID NO: 169314 - protein, 9 aa, Mycobacterium tuberculosis
MLMTAAADV

SEQ ID NO: 169315 - protein, 9 aa, Mycobacterium tuberculosis
MTAAADVTR

SEQ ID NO: 169316 - protein, 9 aa, Mycobacterium tuberculosis
TAAADVTRR

SEQ ID NO: 169317 - protein, 9 aa, Mycobacterium tuberculosis
DVTRRSPRR

SEQ ID NO: 169318 - protein, 9 aa, Mycobacterium tuberculosis
RRSPRRVFR

SEQ ID NO: 169319 - protein, 9 aa, Mycobacterium tuberculosis
EAGRVLAEL

SEQ ID NO: 169320 - protein, 9 aa, Mycobacterium tuberculosis
RVLAELLAA

SEQ ID NO: 169321 - protein, 9 aa, Mycobacterium tuberculosis
VLAELLAAY

SEQ ID NO: 169322 - protein, 9 aa, Mycobacterium tuberculosis
LAELLAAYR

SEQ ID NO: 169323 - protein, 9 aa, Mycobacterium tuberculosis
AAYRDQPDV

SEQ ID NO: 169324 - protein, 9 aa, Mycobacterium tuberculosis
AYRDQPDVI

SEQ ID NO: 169325 - protein, 9 aa, Mycobacterium tuberculosis
YRDQPDVIV

SEQ ID NO: 169326 - protein, 9 aa, Mycobacterium tuberculosis
DVIVLGLAR

SEQ ID NO: 169327 - protein, 9 aa, Mycobacterium tuberculosis
VLGLARGGL

SEQ ID NO: 169328 - protein, 9 aa, Mycobacterium tuberculosis
GLARGGLPV

SEQ ID NO: 169329 - protein, 9 aa, Mycobacterium tuberculosis
GGLPVAWEV

SEQ ID NO: 169330 - protein, 9 aa, Mycobacterium tuberculosis
GLPVAWEVA

SEQ ID NO: 169331 - protein, 9 aa, Mycobacterium tuberculosis
LPVAWEVAA

SEQ ID NO: 169332 - protein, 9 aa, Mycobacterium tuberculosis
VAWEVAAAL

SEQ ID NO: 169333 - protein, 9 aa, Mycobacterium tuberculosis
VAAALHAPL

SEQ ID NO: 169334 - protein, 9 aa, Mycobacterium tuberculosis
ALHAPLDAF

SEQ ID NO: 169335 - protein, 9 aa, Mycobacterium tuberculosis
HAPLDAFVV

SEQ ID NO: 169336 - protein, 9 aa, Mycobacterium tuberculosis
PLDAFVVRK

SEQ ID NO: 169337 - protein, 9 aa, Mycobacterium tuberculosis
LGAPGHDEF

SEQ ID NO: 169338 - protein, 9 aa, Mycobacterium tuberculosis
APGHDEFAV

SEQ ID NO: 169339 - protein, 9 aa, Mycobacterium tuberculosis
ALASGGRVV

SEQ ID NO: 169340 - protein, 9 aa, Mycobacterium tuberculosis
LASGGRVVV

SEQ ID NO: 169341 - protein, 9 aa, Mycobacterium tuberculosis
RVVVNDDVV

SEQ ID NO: 169342 - protein, 9 aa, Mycobacterium tuberculosis
VVVNDDVVR

SEQ ID NO: 169343 - protein, 9 aa, Mycobacterium tuberculosis
GLRITPQQL

SEQ ID NO: 169344 - protein, 9 aa, Mycobacterium tuberculosis
TPQQLRDIA

SEQ ID NO: 169345 - protein, 9 aa, Mycobacterium tuberculosis
QQLRDIAER

SEQ ID NO: 169346 - protein, 9 aa, Mycobacterium tuberculosis
AEREGRELL

SEQ ID NO: 169347 - protein, 9 aa, Mycobacterium tuberculosis
ELLRRESAY

SEQ ID NO: 169348 - protein, 9 aa, Mycobacterium tuberculosis
LLRRESAYR

SEQ ID NO: 169349 - protein, 9 aa, Mycobacterium tuberculosis
RESAYRGER

SEQ ID NO: 169350 - protein, 9 aa, Mycobacterium tuberculosis
AYRGERPPT

SEQ ID NO: 169351 - protein, 9 aa, Mycobacterium tuberculosis
DITGKTVIV

SEQ ID NO: 169352 - protein, 9 aa, Mycobacterium tuberculosis
ITGKTVIVV

SEQ ID NO: 169353 - protein, 9 aa, Mycobacterium tuberculosis
TVIVVDDGL

SEQ ID NO: 169354 - protein, 9 aa, Mycobacterium tuberculosis
VVDDGLATG

SEQ ID NO: 169355 - protein, 9 aa, Mycobacterium tuberculosis
GLATGASMF

SEQ ID NO: 169356 - protein, 9 aa, Mycobacterium tuberculosis
LATGASMFA

SEQ ID NO: 169357 - protein, 9 aa, Mycobacterium tuberculosis
ATGASMFAA

SEQ ID NO: 169358 - protein, 9 aa, Mycobacterium tuberculosis
TGASMFAAV

SEQ ID NO: 169359 - protein, 9 aa, Mycobacterium tuberculosis
SMFAAVQAL

SEQ ID NO: 169360 - protein, 9 aa, Mycobacterium tuberculosis
MFAAVQALR

SEQ ID NO: 169361 - protein, 9 aa, Mycobacterium tuberculosis
ALRDAQPAQ

SEQ ID NO: 169362 - protein, 9 aa, Mycobacterium tuberculosis
AQPAQIVIA

SEQ ID NO: 169363 - protein, 9 aa, Mycobacterium tuberculosis
QPAQIVIAV

SEQ ID NO: 169364 - protein, 9 aa, Mycobacterium tuberculosis
AQIVIAVPA

SEQ ID NO: 169365 - protein, 9 aa, Mycobacterium tuberculosis
APESTCREF

SEQ ID NO: 169366 - protein, 9 aa, Mycobacterium tuberculosis
STCREFAGL

SEQ ID NO: 169367 - protein, 9 aa, Mycobacterium tuberculosis
FAGLVDDVV

SEQ ID NO: 169368 - protein, 9 aa, Mycobacterium tuberculosis
GLVDDVVCA

SEQ ID NO: 169369 - protein, 9 aa, Mycobacterium tuberculosis
LVDDVVCAT

SEQ ID NO: 169370 - protein, 9 aa, Mycobacterium tuberculosis
DVVCATMPT

SEQ ID NO: 169371 - protein, 9 aa, Mycobacterium tuberculosis
VCATMPTPF

SEQ ID NO: 169372 - protein, 9 aa, Mycobacterium tuberculosis
ATMPTPFLA

SEQ ID NO: 169373 - protein, 9 aa, Mycobacterium tuberculosis
TMPTPFLAV

SEQ ID NO: 169374 - protein, 9 aa, Mycobacterium tuberculosis
MPTPFLAVG

SEQ ID NO: 169375 - protein, 9 aa, Mycobacterium tuberculosis
TPFLAVGES

SEQ ID NO: 169376 - protein, 9 aa, Mycobacterium tuberculosis
PFLAVGESF

SEQ ID NO: 169377 - protein, 9 aa, Mycobacterium tuberculosis
FLAVGESFW

SEQ ID NO: 169378 - protein, 9 aa, Mycobacterium tuberculosis
AVGESFWDF

SEQ ID NO: 169379 - protein, 9 aa, Mycobacterium tuberculosis
ESFWDFRQV

SEQ ID NO: 169380 - protein, 9 aa, Mycobacterium tuberculosis
SFWDFRQVT

SEQ ID NO: 169381 - protein, 9 aa, Mycobacterium tuberculosis
QVTDEEVRR

SEQ ID NO: 169382 - protein, 9 aa, Mycobacterium tuberculosis
VTDEEVRRL

SEQ ID NO: 169383 - protein, 9 aa, Mycobacterium tuberculosis
EEVRRLLAT

SEQ ID NO: 169384 - protein, 9 aa, Mycobacterium tuberculosis
RRLLATPTA

SEQ ID NO: 169385 - protein, 9 aa, Mycobacterium tuberculosis
TPTAGPSLR

SEQ ID NO: 169386 - protein, 9 aa, Mycobacterium tuberculosis
GPSLRRPAA

SEQ ID NO: 169387 - protein, 9 aa, Mycobacterium tuberculosis
SLRRPAAST

SEQ ID NO: 169388 - protein, 9 aa, Mycobacterium tuberculosis
RPAASTAAD

SEQ ID NO: 169389 - protein, 9 aa, Mycobacterium tuberculosis
AASTAADVL

SEQ ID NO: 169390 - protein, 9 aa, Mycobacterium tuberculosis
ASTAADVLR

SEQ ID NO: 169391 - protein, 9 aa, Mycobacterium tuberculosis
STAADVLRR

SEQ ID NO: 169392 - protein, 9 aa, Mycobacterium tuberculosis
TAADVLRRV

SEQ ID NO: 169393 - protein, 9 aa, Mycobacterium tuberculosis
VLRRVAIDA

SEQ ID NO: 169394 - protein, 9 aa, Mycobacterium tuberculosis
VAIDAPGGV

SEQ ID NO: 169395 - protein, 9 aa, Mycobacterium tuberculosis
VLAELVGDA

SEQ ID NO: 169396 - protein, 9 aa, Mycobacterium tuberculosis
LAELVGDAR

SEQ ID NO: 169397 - protein, 9 aa, Mycobacterium tuberculosis
AELVGDARI

SEQ ID NO: 169398 - protein, 9 aa, Mycobacterium tuberculosis
ELVGDARIV

SEQ ID NO: 169399 - protein, 9 aa, Mycobacterium tuberculosis
LVGDARIVL

SEQ ID NO: 169400 - protein, 9 aa, Mycobacterium tuberculosis
ESSHGTHEF

SEQ ID NO: 169401 - protein, 9 aa, Mycobacterium tuberculosis
SSHGTHEFY

SEQ ID NO: 169402 - protein, 9 aa, Mycobacterium tuberculosis
GTHEFYQAR

SEQ ID NO: 169403 - protein, 9 aa, Mycobacterium tuberculosis
EFYQARAAM

SEQ ID NO: 169404 - protein, 9 aa, Mycobacterium tuberculosis
YQARAAMTQ

SEQ ID NO: 169405 - protein, 9 aa, Mycobacterium tuberculosis
QARAAMTQW

SEQ ID NO: 169406 - protein, 9 aa, Mycobacterium tuberculosis
RAAMTQWLI

SEQ ID NO: 169407 - protein, 9 aa, Mycobacterium tuberculosis
AMTQWLIEE

SEQ ID NO: 169408 - protein, 9 aa, Mycobacterium tuberculosis
MTQWLIEEK

SEQ ID NO: 169409 - protein, 9 aa, Mycobacterium tuberculosis
QWLIEEKGF

SEQ ID NO: 169410 - protein, 9 aa, Mycobacterium tuberculosis
IEEKGFGAV

SEQ ID NO: 169411 - protein, 9 aa, Mycobacterium tuberculosis
EEKGFGAVA

SEQ ID NO: 169412 - protein, 9 aa, Mycobacterium tuberculosis
GAVAAEADW

SEQ ID NO: 169413 - protein, 9 aa, Mycobacterium tuberculosis
AEADWPDAY

SEQ ID NO: 169414 - protein, 9 aa, Mycobacterium tuberculosis
EADWPDAYR

SEQ ID NO: 169415 - protein, 9 aa, Mycobacterium tuberculosis
ADWPDAYRV

SEQ ID NO: 169416 - protein, 9 aa, Mycobacterium tuberculosis
DAYRVNRYV

SEQ ID NO: 169417 - protein, 9 aa, Mycobacterium tuberculosis
AYRVNRYVR

SEQ ID NO: 169418 - protein, 9 aa, Mycobacterium tuberculosis
RVNRYVRGL

SEQ ID NO: 169419 - protein, 9 aa, Mycobacterium tuberculosis
NADEALSGF

SEQ ID NO: 169420 - protein, 9 aa, Mycobacterium tuberculosis
DEALSGFER

SEQ ID NO: 169421 - protein, 9 aa, Mycobacterium tuberculosis
EALSGFERF

SEQ ID NO: 169422 - protein, 9 aa, Mycobacterium tuberculosis
SGFERFPAW

SEQ ID NO: 169423 - protein, 9 aa, Mycobacterium tuberculosis
FERFPAWMW

SEQ ID NO: 169424 - protein, 9 aa, Mycobacterium tuberculosis
ERFPAWMWR

SEQ ID NO: 169425 - protein, 9 aa, Mycobacterium tuberculosis
FPAWMWRNT

SEQ ID NO: 169426 - protein, 9 aa, Mycobacterium tuberculosis
PAWMWRNTV

SEQ ID NO: 169427 - protein, 9 aa, Mycobacterium tuberculosis
AWMWRNTVV

SEQ ID NO: 169428 - protein, 9 aa, Mycobacterium tuberculosis
WMWRNTVVR

SEQ ID NO: 169429 - protein, 9 aa, Mycobacterium tuberculosis
WRNTVVRDF

SEQ ID NO: 169430 - protein, 9 aa, Mycobacterium tuberculosis
TVVRDFVEW

SEQ ID NO: 169431 - protein, 9 aa, Mycobacterium tuberculosis
VVRDFVEWL

SEQ ID NO: 169432 - protein, 9 aa, Mycobacterium tuberculosis
DFVEWLRTR

SEQ ID NO: 169433 - protein, 9 aa, Mycobacterium tuberculosis
EWLRTRNQR

SEQ ID NO: 169434 - protein, 9 aa, Mycobacterium tuberculosis
WLRTRNQRY

SEQ ID NO: 169435 - protein, 9 aa, Mycobacterium tuberculosis
RTRNQRYES

SEQ ID NO: 169436 - protein, 9 aa, Mycobacterium tuberculosis
NQRYESGAL

SEQ ID NO: 169437 - protein, 9 aa, Mycobacterium tuberculosis
QRYESGALR

SEQ ID NO: 169438 - protein, 9 aa, Mycobacterium tuberculosis
FYGLDLYSL

SEQ ID NO: 169439 - protein, 9 aa, Mycobacterium tuberculosis
DLYSLHRSI

SEQ ID NO: 169440 - protein, 9 aa, Mycobacterium tuberculosis
SLHRSIQEV

SEQ ID NO: 169441 - protein, 9 aa, Mycobacterium tuberculosis
RSIQEVISY

SEQ ID NO: 169442 - protein, 9 aa, Mycobacterium tuberculosis
SIQEVISYL

SEQ ID NO: 169443 - protein, 9 aa, Mycobacterium tuberculosis
EVISYLDKV

SEQ ID NO: 169444 - protein, 9 aa, Mycobacterium tuberculosis
SYLDKVDPR

SEQ ID NO: 169445 - protein, 9 aa, Mycobacterium tuberculosis
YLDKVDPRA

SEQ ID NO: 169446 - protein, 9 aa, Mycobacterium tuberculosis
KVDPRAAAR

SEQ ID NO: 169447 - protein, 9 aa, Mycobacterium tuberculosis
DPRAAARAR

SEQ ID NO: 169448 - protein, 9 aa, Mycobacterium tuberculosis
RAAARARAR

SEQ ID NO: 169449 - protein, 9 aa, Mycobacterium tuberculosis
RARARYACF

SEQ ID NO: 169450 - protein, 9 aa, Mycobacterium tuberculosis
ACADDGQAY

SEQ ID NO: 169451 - protein, 9 aa, Mycobacterium tuberculosis
GQAYGFAAA

SEQ ID NO: 169452 - protein, 9 aa, Mycobacterium tuberculosis
QAYGFAAAF

SEQ ID NO: 169453 - protein, 9 aa, Mycobacterium tuberculosis
YGFAAAFGA

SEQ ID NO: 169454 - protein, 9 aa, Mycobacterium tuberculosis
FGAGPSCER

SEQ ID NO: 169455 - protein, 9 aa, Mycobacterium tuberculosis
GPSCEREAV

SEQ ID NO: 169456 - protein, 9 aa, Mycobacterium tuberculosis
CEREAVEQL

SEQ ID NO: 169457 - protein, 9 aa, Mycobacterium tuberculosis
EAVEQLVDV

SEQ ID NO: 169458 - protein, 9 aa, Mycobacterium tuberculosis
QLVDVQRNA

SEQ ID NO: 169459 - protein, 9 aa, Mycobacterium tuberculosis
LVDVQRNAL

SEQ ID NO: 169460 - protein, 9 aa, Mycobacterium tuberculosis
DVQRNALAY

SEQ ID NO: 169461 - protein, 9 aa, Mycobacterium tuberculosis
VQRNALAYA

SEQ ID NO: 169462 - protein, 9 aa, Mycobacterium tuberculosis
QRNALAYAR

SEQ ID NO: 169463 - protein, 9 aa, Mycobacterium tuberculosis
LAYARQDGL

SEQ ID NO: 169464 - protein, 9 aa, Mycobacterium tuberculosis
AYARQDGLL

SEQ ID NO: 169465 - protein, 9 aa, Mycobacterium tuberculosis
GLLAEDELF

SEQ ID NO: 169466 - protein, 9 aa, Mycobacterium tuberculosis
LLAEDELFY

SEQ ID NO: 169467 - protein, 9 aa, Mycobacterium tuberculosis
LAEDELFYA

SEQ ID NO: 169468 - protein, 9 aa, Mycobacterium tuberculosis
AEDELFYAQ

SEQ ID NO: 169469 - protein, 9 aa, Mycobacterium tuberculosis
ELFYAQQNA

SEQ ID NO: 169470 - protein, 9 aa, Mycobacterium tuberculosis
YAQQNAQTV

SEQ ID NO: 169471 - protein, 9 aa, Mycobacterium tuberculosis
AQQNAQTVR

SEQ ID NO: 169472 - protein, 9 aa, Mycobacterium tuberculosis
AQTVRDAEV

SEQ ID NO: 169473 - protein, 9 aa, Mycobacterium tuberculosis
QTVRDAEVY

SEQ ID NO: 169474 - protein, 9 aa, Mycobacterium tuberculosis
TVRDAEVYY

SEQ ID NO: 169475 - protein, 9 aa, Mycobacterium tuberculosis
DAEVYYRAM

SEQ ID NO: 169476 - protein, 9 aa, Mycobacterium tuberculosis
AEVYYRAMF

SEQ ID NO: 169477 - protein, 9 aa, Mycobacterium tuberculosis
EVYYRAMFS

SEQ ID NO: 169478 - protein, 9 aa, Mycobacterium tuberculosis
YYRAMFSGR

SEQ ID NO: 169479 - protein, 9 aa, Mycobacterium tuberculosis
YRAMFSGRV

SEQ ID NO: 169480 - protein, 9 aa, Mycobacterium tuberculosis
RAMFSGRVT

SEQ ID NO: 169481 - protein, 9 aa, Mycobacterium tuberculosis
AMFSGRVTS

SEQ ID NO: 169482 - protein, 9 aa, Mycobacterium tuberculosis
NLRDQHMAQ

SEQ ID NO: 169483 - protein, 9 aa, Mycobacterium tuberculosis
HMAQTLGSL

SEQ ID NO: 169484 - protein, 9 aa, Mycobacterium tuberculosis
MAQTLGSLL

SEQ ID NO: 169485 - protein, 9 aa, Mycobacterium tuberculosis
AQTLGSLLT

SEQ ID NO: 169486 - protein, 9 aa, Mycobacterium tuberculosis
TLGSLLTHL

SEQ ID NO: 169487 - protein, 9 aa, Mycobacterium tuberculosis
GSLLTHLDR

SEQ ID NO: 169488 - protein, 9 aa, Mycobacterium tuberculosis
LLTHLDRHL

SEQ ID NO: 169489 - protein, 9 aa, Mycobacterium tuberculosis
HLDAPPARI

SEQ ID NO: 169490 - protein, 9 aa, Mycobacterium tuberculosis
DAPPARIVV

SEQ ID NO: 169491 - protein, 9 aa, Mycobacterium tuberculosis
APPARIVVW

SEQ ID NO: 169492 - protein, 9 aa, Mycobacterium tuberculosis
PPARIVVWA

SEQ ID NO: 169493 - protein, 9 aa, Mycobacterium tuberculosis
VVWAHNSHV

SEQ ID NO: 169494 - protein, 9 aa, Mycobacterium tuberculosis
TEVWADGQL

SEQ ID NO: 169495 - protein, 9 aa, Mycobacterium tuberculosis
EVWADGQLT

SEQ ID NO: 169496 - protein, 9 aa, Mycobacterium tuberculosis
VWADGQLTL

SEQ ID NO: 169497 - protein, 9 aa, Mycobacterium tuberculosis
GQLTLGQIV

SEQ ID NO: 169498 - protein, 9 aa, Mycobacterium tuberculosis
QLTLGQIVR

SEQ ID NO: 169499 - protein, 9 aa, Mycobacterium tuberculosis
TLGQIVRER

SEQ ID NO: 169500 - protein, 9 aa, Mycobacterium tuberculosis
RYGDESRSI

SEQ ID NO: 169501 - protein, 9 aa, Mycobacterium tuberculosis
STYTGTVTA

SEQ ID NO: 169502 - protein, 9 aa, Mycobacterium tuberculosis
GTVTAASEW

SEQ ID NO: 169503 - protein, 9 aa, Mycobacterium tuberculosis
TAASEWGGI

SEQ ID NO: 169504 - protein, 9 aa, Mycobacterium tuberculosis
SEWGGIAQR

SEQ ID NO: 169505 - protein, 9 aa, Mycobacterium tuberculosis
GIAQRKAVR

SEQ ID NO: 169506 - protein, 9 aa, Mycobacterium tuberculosis
AQRKAVRPA

SEQ ID NO: 169507 - protein, 9 aa, Mycobacterium tuberculosis
QRKAVRPAL

SEQ ID NO: 169508 - protein, 9 aa, Mycobacterium tuberculosis
RPALHGSVE

SEQ ID NO: 169509 - protein, 9 aa, Mycobacterium tuberculosis
ALHGSVEEL

SEQ ID NO: 169510 - protein, 9 aa, Mycobacterium tuberculosis
SVEELFHQT

SEQ ID NO: 169511 - protein, 9 aa, Mycobacterium tuberculosis
LFHQTADSF

SEQ ID NO: 169512 - protein, 9 aa, Mycobacterium tuberculosis
HQTADSFLV

SEQ ID NO: 169513 - protein, 9 aa, Mycobacterium tuberculosis
QTADSFLVS

SEQ ID NO: 169514 - protein, 9 aa, Mycobacterium tuberculosis
TADSFLVSA

SEQ ID NO: 169515 - protein, 9 aa, Mycobacterium tuberculosis
DSFLVSARL

SEQ ID NO: 169516 - protein, 9 aa, Mycobacterium tuberculosis
FLVSARLSR

SEQ ID NO: 169517 - protein, 9 aa, Mycobacterium tuberculosis
EAPLDVVRL

SEQ ID NO: 169518 - protein, 9 aa, Mycobacterium tuberculosis
RLGRAIGVV

SEQ ID NO: 169519 - protein, 9 aa, Mycobacterium tuberculosis
LGRAIGVVY

SEQ ID NO: 169520 - protein, 9 aa, Mycobacterium tuberculosis
GRAIGVVYL

SEQ ID NO: 169521 - protein, 9 aa, Mycobacterium tuberculosis
VVYLPATER

SEQ ID NO: 169522 - protein, 9 aa, Mycobacterium tuberculosis
YLPATERQS

SEQ ID NO: 169523 - protein, 9 aa, Mycobacterium tuberculosis
LPATERQSH

SEQ ID NO: 169524 - protein, 9 aa, Mycobacterium tuberculosis
ATERQSHYL

SEQ ID NO: 169525 - protein, 9 aa, Mycobacterium tuberculosis
RQSHYLHVR

SEQ ID NO: 169526 - protein, 9 aa, Mycobacterium tuberculosis
RPADQFDAM

SEQ ID NO: 169527 - protein, 9 aa, Mycobacterium tuberculosis
DQFDAMIHI

SEQ ID NO: 169528 - protein, 9 aa, Mycobacterium tuberculosis
AMIHIDQTR

SEQ ID NO: 169529 - protein, 9 aa, Mycobacterium tuberculosis
MIHIDQTRA

SEQ ID NO: 169530 - protein, 9 aa, Mycobacterium tuberculosis
IHIDQTRAL

SEQ ID NO: 169531 - protein, 9 aa, Mycobacterium tuberculosis
RALEPLEVT

SEQ ID NO: 169532 - protein, 9 aa, Mycobacterium tuberculosis
ALEPLEVTS

SEQ ID NO: 169533 - protein, 9 aa, Mycobacterium tuberculosis
EPLEVTSRW

SEQ ID NO: 169534 - protein, 9 aa, Mycobacterium tuberculosis
IAGENPETY

SEQ ID NO: 169535 - protein, 9 aa, Mycobacterium tuberculosis
NPETYPTGL

SEQ ID NO: 169536 - protein, 10 aa, Mycobacterium tuberculosis
MLMTAAADVT

SEQ ID NO: 169537 - protein, 10 aa, Mycobacterium tuberculosis
LMTAAADVTR

SEQ ID NO: 169538 - protein, 10 aa, Mycobacterium tuberculosis
MTAAADVTRR

SEQ ID NO: 169539 - protein, 10 aa, Mycobacterium tuberculosis
AADVTRRSPR

SEQ ID NO: 169540 - protein, 10 aa, Mycobacterium tuberculosis
VTRRSPRRVF

SEQ ID NO: 169541 - protein, 10 aa, Mycobacterium tuberculosis
TRRSPRRVFR

SEQ ID NO: 169542 - protein, 10 aa, Mycobacterium tuberculosis
RSPRRVFRDR

SEQ ID NO: 169543 - protein, 10 aa, Mycobacterium tuberculosis
SPRRVFRDRR

SEQ ID NO: 169544 - protein, 10 aa, Mycobacterium tuberculosis
VFRDRREAGR

SEQ ID NO: 169545 - protein, 10 aa, Mycobacterium tuberculosis
RDRREAGRVL

SEQ ID NO: 169546 - protein, 10 aa, Mycobacterium tuberculosis
REAGRVLAEL

SEQ ID NO: 169547 - protein, 10 aa, Mycobacterium tuberculosis
EAGRVLAELL

SEQ ID NO: 169548 - protein, 10 aa, Mycobacterium tuberculosis
RVLAELLAAY

SEQ ID NO: 169549 - protein, 10 aa, Mycobacterium tuberculosis
VLAELLAAYR

SEQ ID NO: 169550 - protein, 10 aa, Mycobacterium tuberculosis
YRDQPDVIVL

SEQ ID NO: 169551 - protein, 10 aa, Mycobacterium tuberculosis
QPDVIVLGLA

SEQ ID NO: 169552 - protein, 10 aa, Mycobacterium tuberculosis
IVLGLARGGL

SEQ ID NO: 169553 - protein, 10 aa, Mycobacterium tuberculosis
GLARGGLPVA

SEQ ID NO: 169554 - protein, 10 aa, Mycobacterium tuberculosis
LARGGLPVAW

SEQ ID NO: 169555 - protein, 10 aa, Mycobacterium tuberculosis
GLPVAWEVAA

SEQ ID NO: 169556 - protein, 10 aa, Mycobacterium tuberculosis
LPVAWEVAAA

SEQ ID NO: 169557 - protein, 10 aa, Mycobacterium tuberculosis
PVAWEVAAAL

SEQ ID NO: 169558 - protein, 10 aa, Mycobacterium tuberculosis
VAWEVAAALH

SEQ ID NO: 169559 - protein, 10 aa, Mycobacterium tuberculosis
WEVAAALHAP

SEQ ID NO: 169560 - protein, 10 aa, Mycobacterium tuberculosis
EVAAALHAPL

SEQ ID NO: 169561 - protein, 10 aa, Mycobacterium tuberculosis
AALHAPLDAF

SEQ ID NO: 169562 - protein, 10 aa, Mycobacterium tuberculosis
ALHAPLDAFV

SEQ ID NO: 169563 - protein, 10 aa, Mycobacterium tuberculosis
HAPLDAFVVR

SEQ ID NO: 169564 - protein, 10 aa, Mycobacterium tuberculosis
APLDAFVVRK

SEQ ID NO: 169565 - protein, 10 aa, Mycobacterium tuberculosis
PLDAFVVRKL

SEQ ID NO: 169566 - protein, 10 aa, Mycobacterium tuberculosis
KLGAPGHDEF

SEQ ID NO: 169567 - protein, 10 aa, Mycobacterium tuberculosis
GAPGHDEFAV

SEQ ID NO: 169568 - protein, 10 aa, Mycobacterium tuberculosis
GHDEFAVGAL

SEQ ID NO: 169569 - protein, 10 aa, Mycobacterium tuberculosis
AVGALASGGR

SEQ ID NO: 169570 - protein, 10 aa, Mycobacterium tuberculosis
ALASGGRVVV

SEQ ID NO: 169571 - protein, 10 aa, Mycobacterium tuberculosis
RVVVNDDVVR

SEQ ID NO: 169572 - protein, 10 aa, Mycobacterium tuberculosis
VVNDDVVRGL

SEQ ID NO: 169573 - protein, 10 aa, Mycobacterium tuberculosis
DIAEREGREL

SEQ ID NO: 169574 - protein, 10 aa, Mycobacterium tuberculosis
RELLRRESAY

SEQ ID NO: 169575 - protein, 10 aa, Mycobacterium tuberculosis
ELLRRESAYR

SEQ ID NO: 169576 - protein, 10 aa, Mycobacterium tuberculosis
RRESAYRGER

SEQ ID NO: 169577 - protein, 10 aa, Mycobacterium tuberculosis
DITGKTVIVV

SEQ ID NO: 169578 - protein, 10 aa, Mycobacterium tuberculosis
KTVIVVDDGL

SEQ ID NO: 169579 - protein, 10 aa, Mycobacterium tuberculosis
TVIVVDDGLA

SEQ ID NO: 169580 - protein, 10 aa, Mycobacterium tuberculosis
VVDDGLATGA

SEQ ID NO: 169581 - protein, 10 aa, Mycobacterium tuberculosis
GLATGASMFA

SEQ ID NO: 169582 - protein, 10 aa, Mycobacterium tuberculosis
LATGASMFAA

SEQ ID NO: 169583 - protein, 10 aa, Mycobacterium tuberculosis
ATGASMFAAV

SEQ ID NO: 169584 - protein, 10 aa, Mycobacterium tuberculosis
ASMFAAVQAL

SEQ ID NO: 169585 - protein, 10 aa, Mycobacterium tuberculosis
SMFAAVQALR

SEQ ID NO: 169586 - protein, 10 aa, Mycobacterium tuberculosis
VQALRDAQPA

SEQ ID NO: 169587 - protein, 10 aa, Mycobacterium tuberculosis
ALRDAQPAQI

SEQ ID NO: 169588 - protein, 10 aa, Mycobacterium tuberculosis
AQPAQIVIAV

SEQ ID NO: 169589 - protein, 10 aa, Mycobacterium tuberculosis
AQIVIAVPAA

SEQ ID NO: 169590 - protein, 10 aa, Mycobacterium tuberculosis
AAPESTCREF

SEQ ID NO: 169591 - protein, 10 aa, Mycobacterium tuberculosis
ESTCREFAGL

SEQ ID NO: 169592 - protein, 10 aa, Mycobacterium tuberculosis
STCREFAGLV

SEQ ID NO: 169593 - protein, 10 aa, Mycobacterium tuberculosis
REFAGLVDDV

SEQ ID NO: 169594 - protein, 10 aa, Mycobacterium tuberculosis
EFAGLVDDVV

SEQ ID NO: 169595 - protein, 10 aa, Mycobacterium tuberculosis
GLVDDVVCAT

SEQ ID NO: 169596 - protein, 10 aa, Mycobacterium tuberculosis
LVDDVVCATM

SEQ ID NO: 169597 - protein, 10 aa, Mycobacterium tuberculosis
VVCATMPTPF

SEQ ID NO: 169598 - protein, 10 aa, Mycobacterium tuberculosis
ATMPTPFLAV

SEQ ID NO: 169599 - protein, 10 aa, Mycobacterium tuberculosis
MPTPFLAVGE

SEQ ID NO: 169600 - protein, 10 aa, Mycobacterium tuberculosis
TPFLAVGESF

SEQ ID NO: 169601 - protein, 10 aa, Mycobacterium tuberculosis
LAVGESFWDF

SEQ ID NO: 169602 - protein, 10 aa, Mycobacterium tuberculosis
AVGESFWDFR

SEQ ID NO: 169603 - protein, 10 aa, Mycobacterium tuberculosis
QVTDEEVRRL

SEQ ID NO: 169604 - protein, 10 aa, Mycobacterium tuberculosis
VTDEEVRRLL

SEQ ID NO: 169605 - protein, 10 aa, Mycobacterium tuberculosis
ATPTAGPSLR

SEQ ID NO: 169606 - protein, 10 aa, Mycobacterium tuberculosis
TPTAGPSLRR

SEQ ID NO: 169607 - protein, 10 aa, Mycobacterium tuberculosis
GPSLRRPAAS

SEQ ID NO: 169608 - protein, 10 aa, Mycobacterium tuberculosis
SLRRPAASTA

SEQ ID NO: 169609 - protein, 10 aa, Mycobacterium tuberculosis
RPAASTAADV

SEQ ID NO: 169610 - protein, 10 aa, Mycobacterium tuberculosis
AASTAADVLR

SEQ ID NO: 169611 - protein, 10 aa, Mycobacterium tuberculosis
ASTAADVLRR

SEQ ID NO: 169612 - protein, 10 aa, Mycobacterium tuberculosis
STAADVLRRV

SEQ ID NO: 169613 - protein, 10 aa, Mycobacterium tuberculosis
TAADVLRRVA

SEQ ID NO: 169614 - protein, 10 aa, Mycobacterium tuberculosis
RVAIDAPGGV

SEQ ID NO: 169615 - protein, 10 aa, Mycobacterium tuberculosis
APGGVPTHEV

SEQ ID NO: 169616 - protein, 10 aa, Mycobacterium tuberculosis
VPTHEVLAEL

SEQ ID NO: 169617 - protein, 10 aa, Mycobacterium tuberculosis
PTHEVLAELV

SEQ ID NO: 169618 - protein, 10 aa, Mycobacterium tuberculosis
EVLAELVGDA

SEQ ID NO: 169619 - protein, 10 aa, Mycobacterium tuberculosis
AELVGDARIV

SEQ ID NO: 169620 - protein, 10 aa, Mycobacterium tuberculosis
ELVGDARIVL

SEQ ID NO: 169621 - protein, 10 aa, Mycobacterium tuberculosis
LVGDARIVLI

SEQ ID NO: 169622 - protein, 10 aa, Mycobacterium tuberculosis
VLIGESSHGT

SEQ ID NO: 169623 - protein, 10 aa, Mycobacterium tuberculosis
GESSHGTHEF

SEQ ID NO: 169624 - protein, 10 aa, Mycobacterium tuberculosis
ESSHGTHEFY

SEQ ID NO: 169625 - protein, 10 aa, Mycobacterium tuberculosis
HEFYQARAAM

SEQ ID NO: 169626 - protein, 10 aa, Mycobacterium tuberculosis
YQARAAMTQW

SEQ ID NO: 169627 - protein, 10 aa, Mycobacterium tuberculosis
AMTQWLIEEK

SEQ ID NO: 169628 - protein, 10 aa, Mycobacterium tuberculosis
TQWLIEEKGF

SEQ ID NO: 169629 - protein, 10 aa, Mycobacterium tuberculosis
WLIEEKGFGA

SEQ ID NO: 169630 - protein, 10 aa, Mycobacterium tuberculosis
LIEEKGFGAV

SEQ ID NO: 169631 - protein, 10 aa, Mycobacterium tuberculosis
EEKGFGAVAA

SEQ ID NO: 169632 - protein, 10 aa, Mycobacterium tuberculosis
FGAVAAEADW

SEQ ID NO: 169633 - protein, 10 aa, Mycobacterium tuberculosis
AAEADWPDAY

SEQ ID NO: 169634 - protein, 10 aa, Mycobacterium tuberculosis
EADWPDAYRV

SEQ ID NO: 169635 - protein, 10 aa, Mycobacterium tuberculosis
DWPDAYRVNR

SEQ ID NO: 169636 - protein, 10 aa, Mycobacterium tuberculosis
WPDAYRVNRY

SEQ ID NO: 169637 - protein, 10 aa, Mycobacterium tuberculosis
DAYRVNRYVR

SEQ ID NO: 169638 - protein, 10 aa, Mycobacterium tuberculosis
YRVNRYVRGL

SEQ ID NO: 169639 - protein, 10 aa, Mycobacterium tuberculosis
GEDTNADEAL

SEQ ID NO: 169640 - protein, 10 aa, Mycobacterium tuberculosis
DEALSGFERF

SEQ ID NO: 169641 - protein, 10 aa, Mycobacterium tuberculosis
ALSGFERFPA

SEQ ID NO: 169642 - protein, 10 aa, Mycobacterium tuberculosis
LSGFERFPAW

SEQ ID NO: 169643 - protein, 10 aa, Mycobacterium tuberculosis
GFERFPAWMW

SEQ ID NO: 169644 - protein, 10 aa, Mycobacterium tuberculosis
FPAWMWRNTV

SEQ ID NO: 169645 - protein, 10 aa, Mycobacterium tuberculosis
PAWMWRNTVV

SEQ ID NO: 169646 - protein, 10 aa, Mycobacterium tuberculosis
AWMWRNTVVR

SEQ ID NO: 169647 - protein, 10 aa, Mycobacterium tuberculosis
MWRNTVVRDF

SEQ ID NO: 169648 - protein, 10 aa, Mycobacterium tuberculosis
WRNTVVRDFV

SEQ ID NO: 169649 - protein, 10 aa, Mycobacterium tuberculosis
NTVVRDFVEW

SEQ ID NO: 169650 - protein, 10 aa, Mycobacterium tuberculosis
TVVRDFVEWL

SEQ ID NO: 169651 - protein, 10 aa, Mycobacterium tuberculosis
VVRDFVEWLR

SEQ ID NO: 169652 - protein, 10 aa, Mycobacterium tuberculosis
SGALRQAGFY

SEQ ID NO: 169653 - protein, 10 aa, Mycobacterium tuberculosis
ALRQAGFYGL

SEQ ID NO: 169654 - protein, 10 aa, Mycobacterium tuberculosis
RQAGFYGLDL

SEQ ID NO: 169655 - protein, 10 aa, Mycobacterium tuberculosis
QAGFYGLDLY

SEQ ID NO: 169656 - protein, 10 aa, Mycobacterium tuberculosis
GFYGLDLYSL

SEQ ID NO: 169657 - protein, 10 aa, Mycobacterium tuberculosis
GLDLYSLHRS

SEQ ID NO: 169658 - protein, 10 aa, Mycobacterium tuberculosis
YSLHRSIQEV

SEQ ID NO: 169659 - protein, 10 aa, Mycobacterium tuberculosis
SLHRSIQEVI

SEQ ID NO: 169660 - protein, 10 aa, Mycobacterium tuberculosis
HRSIQEVISY

SEQ ID NO: 169661 - protein, 10 aa, Mycobacterium tuberculosis
RSIQEVISYL

SEQ ID NO: 169662 - protein, 10 aa, Mycobacterium tuberculosis
IQEVISYLDK

SEQ ID NO: 169663 - protein, 10 aa, Mycobacterium tuberculosis
QEVISYLDKV

SEQ ID NO: 169664 - protein, 10 aa, Mycobacterium tuberculosis
ISYLDKVDPR

SEQ ID NO: 169665 - protein, 10 aa, Mycobacterium tuberculosis
YLDKVDPRAA

SEQ ID NO: 169666 - protein, 10 aa, Mycobacterium tuberculosis
KVDPRAAARA

SEQ ID NO: 169667 - protein, 10 aa, Mycobacterium tuberculosis
RAAARARARY

SEQ ID NO: 169668 - protein, 10 aa, Mycobacterium tuberculosis
AARARARYAC

SEQ ID NO: 169669 - protein, 10 aa, Mycobacterium tuberculosis
ARARARYACF

SEQ ID NO: 169670 - protein, 10 aa, Mycobacterium tuberculosis
HACADDGQAY

SEQ ID NO: 169671 - protein, 10 aa, Mycobacterium tuberculosis
CADDGQAYGF

SEQ ID NO: 169672 - protein, 10 aa, Mycobacterium tuberculosis
GQAYGFAAAF

SEQ ID NO: 169673 - protein, 10 aa, Mycobacterium tuberculosis
FAAAFGAGPS

SEQ ID NO: 169674 - protein, 10 aa, Mycobacterium tuberculosis
AFGAGPSCER

SEQ ID NO: 169675 - protein, 10 aa, Mycobacterium tuberculosis
REAVEQLVDV

SEQ ID NO: 169676 - protein, 10 aa, Mycobacterium tuberculosis
AVEQLVDVQR

SEQ ID NO: 169677 - protein, 10 aa, Mycobacterium tuberculosis
QLVDVQRNAL

SEQ ID NO: 169678 - protein, 10 aa, Mycobacterium tuberculosis
VQRNALAYAR

SEQ ID NO: 169679 - protein, 10 aa, Mycobacterium tuberculosis
ALAYARQDGL

SEQ ID NO: 169680 - protein, 10 aa, Mycobacterium tuberculosis
LAYARQDGLL

SEQ ID NO: 169681 - protein, 10 aa, Mycobacterium tuberculosis
GLLAEDELFY

SEQ ID NO: 169682 - protein, 10 aa, Mycobacterium tuberculosis
LLAEDELFYA

SEQ ID NO: 169683 - protein, 10 aa, Mycobacterium tuberculosis
FYAQQNAQTV

SEQ ID NO: 169684 - protein, 10 aa, Mycobacterium tuberculosis
YAQQNAQTVR

SEQ ID NO: 169685 - protein, 10 aa, Mycobacterium tuberculosis
NAQTVRDAEV

SEQ ID NO: 169686 - protein, 10 aa, Mycobacterium tuberculosis
AQTVRDAEVY

SEQ ID NO: 169687 - protein, 10 aa, Mycobacterium tuberculosis
QTVRDAEVYY

SEQ ID NO: 169688 - protein, 10 aa, Mycobacterium tuberculosis
TVRDAEVYYR

SEQ ID NO: 169689 - protein, 10 aa, Mycobacterium tuberculosis
DAEVYYRAMF

SEQ ID NO: 169690 - protein, 10 aa, Mycobacterium tuberculosis
AEVYYRAMFS

SEQ ID NO: 169691 - protein, 10 aa, Mycobacterium tuberculosis
VYYRAMFSGR

SEQ ID NO: 169692 - protein, 10 aa, Mycobacterium tuberculosis
YYRAMFSGRV

SEQ ID NO: 169693 - protein, 10 aa, Mycobacterium tuberculosis
AMFSGRVTSW

SEQ ID NO: 169694 - protein, 10 aa, Mycobacterium tuberculosis
SGRVTSWNLR

SEQ ID NO: 169695 - protein, 10 aa, Mycobacterium tuberculosis
NLRDQHMAQT

SEQ ID NO: 169696 - protein, 10 aa, Mycobacterium tuberculosis
HMAQTLGSLL

SEQ ID NO: 169697 - protein, 10 aa, Mycobacterium tuberculosis
QTLGSLLTHL

SEQ ID NO: 169698 - protein, 10 aa, Mycobacterium tuberculosis
SLLTHLDRHL

SEQ ID NO: 169699 - protein, 10 aa, Mycobacterium tuberculosis
HLDAPPARIV

SEQ ID NO: 169700 - protein, 10 aa, Mycobacterium tuberculosis
DAPPARIVVW

SEQ ID NO: 169701 - protein, 10 aa, Mycobacterium tuberculosis
APPARIVVWA

SEQ ID NO: 169702 - protein, 10 aa, Mycobacterium tuberculosis
IVVWAHNSHV

SEQ ID NO: 169703 - protein, 10 aa, Mycobacterium tuberculosis
HVGDARATEV

SEQ ID NO: 169704 - protein, 10 aa, Mycobacterium tuberculosis
VGDARATEVW

SEQ ID NO: 169705 - protein, 10 aa, Mycobacterium tuberculosis
EVWADGQLTL

SEQ ID NO: 169706 - protein, 10 aa, Mycobacterium tuberculosis
LTLGQIVRER

SEQ ID NO: 169707 - protein, 10 aa, Mycobacterium tuberculosis
ESRSIGFSTY

SEQ ID NO: 169708 - protein, 10 aa, Mycobacterium tuberculosis
FSTYTGTVTA

SEQ ID NO: 169709 - protein, 10 aa, Mycobacterium tuberculosis
STYTGTVTAA

SEQ ID NO: 169710 - protein, 10 aa, Mycobacterium tuberculosis
TGTVTAASEW

SEQ ID NO: 169711 - protein, 10 aa, Mycobacterium tuberculosis
VTAASEWGGI

SEQ ID NO: 169712 - protein, 10 aa, Mycobacterium tuberculosis
AQRKAVRPAL

SEQ ID NO: 169713 - protein, 10 aa, Mycobacterium tuberculosis
AVRPALHGSV

SEQ ID NO: 169714 - protein, 10 aa, Mycobacterium tuberculosis
RPALHGSVEE

SEQ ID NO: 169715 - protein, 10 aa, Mycobacterium tuberculosis
ALHGSVEELF

SEQ ID NO: 169716 - protein, 10 aa, Mycobacterium tuberculosis
SVEELFHQTA

SEQ ID NO: 169717 - protein, 10 aa, Mycobacterium tuberculosis
EELFHQTADS

SEQ ID NO: 169718 - protein, 10 aa, Mycobacterium tuberculosis
ELFHQTADSF

SEQ ID NO: 169719 - protein, 10 aa, Mycobacterium tuberculosis
QTADSFLVSA

SEQ ID NO: 169720 - protein, 10 aa, Mycobacterium tuberculosis
TADSFLVSAR

SEQ ID NO: 169721 - protein, 10 aa, Mycobacterium tuberculosis
SFLVSARLSR

SEQ ID NO: 169722 - protein, 10 aa, Mycobacterium tuberculosis
RLSRDAEAPL

SEQ ID NO: 169723 - protein, 10 aa, Mycobacterium tuberculosis
DAEAPLDVVR

SEQ ID NO: 169724 - protein, 10 aa, Mycobacterium tuberculosis
AEAPLDVVRL

SEQ ID NO: 169725 - protein, 10 aa, Mycobacterium tuberculosis
APLDVVRLGR

SEQ ID NO: 169726 - protein, 10 aa, Mycobacterium tuberculosis
PLDVVRLGRA

SEQ ID NO: 169727 - protein, 10 aa, Mycobacterium tuberculosis
VVRLGRAIGV

SEQ ID NO: 169728 - protein, 10 aa, Mycobacterium tuberculosis
RLGRAIGVVY

SEQ ID NO: 169729 - protein, 10 aa, Mycobacterium tuberculosis
RAIGVVYLPA

SEQ ID NO: 169730 - protein, 10 aa, Mycobacterium tuberculosis
GVVYLPATER

SEQ ID NO: 169731 - protein, 10 aa, Mycobacterium tuberculosis
LPATERQSHY

SEQ ID NO: 169732 - protein, 10 aa, Mycobacterium tuberculosis
TERQSHYLHV

SEQ ID NO: 169733 - protein, 10 aa, Mycobacterium tuberculosis
YLHVRPADQF

SEQ ID NO: 169734 - protein, 10 aa, Mycobacterium tuberculosis
RPADQFDAMI

SEQ ID NO: 169735 - protein, 10 aa, Mycobacterium tuberculosis
DAMIHIDQTR

SEQ ID NO: 169736 - protein, 10 aa, Mycobacterium tuberculosis
AMIHIDQTRA

SEQ ID NO: 169737 - protein, 10 aa, Mycobacterium tuberculosis
MIHIDQTRAL

SEQ ID NO: 169738 - protein, 10 aa, Mycobacterium tuberculosis
EPLEVTSRWI

SEQ ID NO: 169739 - protein, 10 aa, Mycobacterium tuberculosis
EVTSRWIAGE

SEQ ID NO: 169740 - protein, 10 aa, Mycobacterium tuberculosis
WIAGENPETY

SEQ ID NO: 169741 - protein, 11 aa, Mycobacterium tuberculosis
MLMTAAADVTR

SEQ ID NO: 169742 - protein, 11 aa, Mycobacterium tuberculosis
LMTAAADVTRR

SEQ ID NO: 169743 - protein, 11 aa, Mycobacterium tuberculosis
MTAAADVTRRS

SEQ ID NO: 169744 - protein, 11 aa, Mycobacterium tuberculosis
AAADVTRRSPR

SEQ ID NO: 169745 - protein, 11 aa, Mycobacterium tuberculosis
DVTRRSPRRVF

SEQ ID NO: 169746 - protein, 11 aa, Mycobacterium tuberculosis
VTRRSPRRVFR

SEQ ID NO: 169747 - protein, 11 aa, Mycobacterium tuberculosis
RRSPRRVFRDR

SEQ ID NO: 169748 - protein, 11 aa, Mycobacterium tuberculosis
RSPRRVFRDRR

SEQ ID NO: 169749 - protein, 11 aa, Mycobacterium tuberculosis
RVFRDRREAGR

SEQ ID NO: 169750 - protein, 11 aa, Mycobacterium tuberculosis
FRDRREAGRVL

SEQ ID NO: 169751 - protein, 11 aa, Mycobacterium tuberculosis
RREAGRVLAEL

SEQ ID NO: 169752 - protein, 11 aa, Mycobacterium tuberculosis
REAGRVLAELL

SEQ ID NO: 169753 - protein, 11 aa, Mycobacterium tuberculosis
GRVLAELLAAY

SEQ ID NO: 169754 - protein, 11 aa, Mycobacterium tuberculosis
RVLAELLAAYR

SEQ ID NO: 169755 - protein, 11 aa, Mycobacterium tuberculosis
LLAAYRDQPDV

SEQ ID NO: 169756 - protein, 11 aa, Mycobacterium tuberculosis
LAAYRDQPDVI

SEQ ID NO: 169757 - protein, 11 aa, Mycobacterium tuberculosis
AAYRDQPDVIV

SEQ ID NO: 169758 - protein, 11 aa, Mycobacterium tuberculosis
AYRDQPDVIVL

SEQ ID NO: 169759 - protein, 11 aa, Mycobacterium tuberculosis
VIVLGLARGGL

SEQ ID NO: 169760 - protein, 11 aa, Mycobacterium tuberculosis
VLGLARGGLPV

SEQ ID NO: 169761 - protein, 11 aa, Mycobacterium tuberculosis
GLARGGLPVAW

SEQ ID NO: 169762 - protein, 11 aa, Mycobacterium tuberculosis
ARGGLPVAWEV

SEQ ID NO: 169763 - protein, 11 aa, Mycobacterium tuberculosis
GLPVAWEVAAA

SEQ ID NO: 169764 - protein, 11 aa, Mycobacterium tuberculosis
LPVAWEVAAAL

SEQ ID NO: 169765 - protein, 11 aa, Mycobacterium tuberculosis
VAWEVAAALHA

SEQ ID NO: 169766 - protein, 11 aa, Mycobacterium tuberculosis
WEVAAALHAPL

SEQ ID NO: 169767 - protein, 11 aa, Mycobacterium tuberculosis
AAALHAPLDAF

SEQ ID NO: 169768 - protein, 11 aa, Mycobacterium tuberculosis
AALHAPLDAFV

SEQ ID NO: 169769 - protein, 11 aa, Mycobacterium tuberculosis
ALHAPLDAFVV

SEQ ID NO: 169770 - protein, 11 aa, Mycobacterium tuberculosis
HAPLDAFVVRK

SEQ ID NO: 169771 - protein, 11 aa, Mycobacterium tuberculosis
APLDAFVVRKL

SEQ ID NO: 169772 - protein, 11 aa, Mycobacterium tuberculosis
KLGAPGHDEFA

SEQ ID NO: 169773 - protein, 11 aa, Mycobacterium tuberculosis
LGAPGHDEFAV

SEQ ID NO: 169774 - protein, 11 aa, Mycobacterium tuberculosis
APGHDEFAVGA

SEQ ID NO: 169775 - protein, 11 aa, Mycobacterium tuberculosis
FAVGALASGGR

SEQ ID NO: 169776 - protein, 11 aa, Mycobacterium tuberculosis
AVGALASGGRV

SEQ ID NO: 169777 - protein, 11 aa, Mycobacterium tuberculosis
GALASGGRVVV

SEQ ID NO: 169778 - protein, 11 aa, Mycobacterium tuberculosis
VVNDDVVRGLR

SEQ ID NO: 169779 - protein, 11 aa, Mycobacterium tuberculosis
RGLRITPQQLR

SEQ ID NO: 169780 - protein, 11 aa, Mycobacterium tuberculosis
RITPQQLRDIA

SEQ ID NO: 169781 - protein, 11 aa, Mycobacterium tuberculosis
TPQQLRDIAER

SEQ ID NO: 169782 - protein, 11 aa, Mycobacterium tuberculosis
QLRDIAEREGR

SEQ ID NO: 169783 - protein, 11 aa, Mycobacterium tuberculosis
DIAEREGRELL

SEQ ID NO: 169784 - protein, 11 aa, Mycobacterium tuberculosis
GRELLRRESAY

SEQ ID NO: 169785 - protein, 11 aa, Mycobacterium tuberculosis
RELLRRESAYR

SEQ ID NO: 169786 - protein, 11 aa, Mycobacterium tuberculosis
AYRGERPPTDI

SEQ ID NO: 169787 - protein, 11 aa, Mycobacterium tuberculosis
RPPTDITGKTV

SEQ ID NO: 169788 - protein, 11 aa, Mycobacterium tuberculosis
PPTDITGKTVI

SEQ ID NO: 169789 - protein, 11 aa, Mycobacterium tuberculosis
IVVDDGLATGA

SEQ ID NO: 169790 - protein, 11 aa, Mycobacterium tuberculosis
GLATGASMFAA

SEQ ID NO: 169791 - protein, 11 aa, Mycobacterium tuberculosis
LATGASMFAAV

SEQ ID NO: 169792 - protein, 11 aa, Mycobacterium tuberculosis
TGASMFAAVQA

SEQ ID NO: 169793 - protein, 11 aa, Mycobacterium tuberculosis
ASMFAAVQALR

SEQ ID NO: 169794 - protein, 11 aa, Mycobacterium tuberculosis
QALRDAQPAQI

SEQ ID NO: 169795 - protein, 11 aa, Mycobacterium tuberculosis
ALRDAQPAQIV

SEQ ID NO: 169796 - protein, 11 aa, Mycobacterium tuberculosis
DAQPAQIVIAV

SEQ ID NO: 169797 - protein, 11 aa, Mycobacterium tuberculosis
QPAQIVIAVPA

SEQ ID NO: 169798 - protein, 11 aa, Mycobacterium tuberculosis
PESTCREFAGL

SEQ ID NO: 169799 - protein, 11 aa, Mycobacterium tuberculosis
ESTCREFAGLV

SEQ ID NO: 169800 - protein, 11 aa, Mycobacterium tuberculosis
REFAGLVDDVV

SEQ ID NO: 169801 - protein, 11 aa, Mycobacterium tuberculosis
GLVDDVVCATM

SEQ ID NO: 169802 - protein, 11 aa, Mycobacterium tuberculosis
DVVCATMPTPF

SEQ ID NO: 169803 - protein, 11 aa, Mycobacterium tuberculosis
VVCATMPTPFL

SEQ ID NO: 169804 - protein, 11 aa, Mycobacterium tuberculosis
CATMPTPFLAV

SEQ ID NO: 169805 - protein, 11 aa, Mycobacterium tuberculosis
MPTPFLAVGES

SEQ ID NO: 169806 - protein, 11 aa, Mycobacterium tuberculosis
TPFLAVGESFW

SEQ ID NO: 169807 - protein, 11 aa, Mycobacterium tuberculosis
FLAVGESFWDF

SEQ ID NO: 169808 - protein, 11 aa, Mycobacterium tuberculosis
LAVGESFWDFR

SEQ ID NO: 169809 - protein, 11 aa, Mycobacterium tuberculosis
DFRQVTDEEVR

SEQ ID NO: 169810 - protein, 11 aa, Mycobacterium tuberculosis
RQVTDEEVRRL

SEQ ID NO: 169811 - protein, 11 aa, Mycobacterium tuberculosis
QVTDEEVRRLL

SEQ ID NO: 169812 - protein, 11 aa, Mycobacterium tuberculosis
EEVRRLLATPT

SEQ ID NO: 169813 - protein, 11 aa, Mycobacterium tuberculosis
RRLLATPTAGP

SEQ ID NO: 169814 - protein, 11 aa, Mycobacterium tuberculosis
LLATPTAGPSL

SEQ ID NO: 169815 - protein, 11 aa, Mycobacterium tuberculosis
LATPTAGPSLR

SEQ ID NO: 169816 - protein, 11 aa, Mycobacterium tuberculosis
ATPTAGPSLRR

SEQ ID NO: 169817 - protein, 11 aa, Mycobacterium tuberculosis
GPSLRRPAAST

SEQ ID NO: 169818 - protein, 11 aa, Mycobacterium tuberculosis
SLRRPAASTAA

SEQ ID NO: 169819 - protein, 11 aa, Mycobacterium tuberculosis
RPAASTAADVL

SEQ ID NO: 169820 - protein, 11 aa, Mycobacterium tuberculosis
PAASTAADVLR

SEQ ID NO: 169821 - protein, 11 aa, Mycobacterium tuberculosis
AASTAADVLRR

SEQ ID NO: 169822 - protein, 11 aa, Mycobacterium tuberculosis
STAADVLRRVA

SEQ ID NO: 169823 - protein, 11 aa, Mycobacterium tuberculosis
TAADVLRRVAI

SEQ ID NO: 169824 - protein, 11 aa, Mycobacterium tuberculosis
RRVAIDAPGGV

SEQ ID NO: 169825 - protein, 11 aa, Mycobacterium tuberculosis
DAPGGVPTHEV

SEQ ID NO: 169826 - protein, 11 aa, Mycobacterium tuberculosis
APGGVPTHEVL

SEQ ID NO: 169827 - protein, 11 aa, Mycobacterium tuberculosis
GVPTHEVLAEL

SEQ ID NO: 169828 - protein, 11 aa, Mycobacterium tuberculosis
VPTHEVLAELV

SEQ ID NO: 169829 - protein, 11 aa, Mycobacterium tuberculosis
EVLAELVGDAR

SEQ ID NO: 169830 - protein, 11 aa, Mycobacterium tuberculosis
VLAELVGDARI

SEQ ID NO: 169831 - protein, 11 aa, Mycobacterium tuberculosis
AELVGDARIVL

SEQ ID NO: 169832 - protein, 11 aa, Mycobacterium tuberculosis
ELVGDARIVLI

SEQ ID NO: 169833 - protein, 11 aa, Mycobacterium tuberculosis
GESSHGTHEFY

SEQ ID NO: 169834 - protein, 11 aa, Mycobacterium tuberculosis
THEFYQARAAM

SEQ ID NO: 169835 - protein, 11 aa, Mycobacterium tuberculosis
HEFYQARAAMT

SEQ ID NO: 169836 - protein, 11 aa, Mycobacterium tuberculosis
FYQARAAMTQW

SEQ ID NO: 169837 - protein, 11 aa, Mycobacterium tuberculosis
YQARAAMTQWL

SEQ ID NO: 169838 - protein, 11 aa, Mycobacterium tuberculosis
AAMTQWLIEEK

SEQ ID NO: 169839 - protein, 11 aa, Mycobacterium tuberculosis
MTQWLIEEKGF

SEQ ID NO: 169840 - protein, 11 aa, Mycobacterium tuberculosis
WLIEEKGFGAV

SEQ ID NO: 169841 - protein, 11 aa, Mycobacterium tuberculosis
GFGAVAAEADW

SEQ ID NO: 169842 - protein, 11 aa, Mycobacterium tuberculosis
VAAEADWPDAY

SEQ ID NO: 169843 - protein, 11 aa, Mycobacterium tuberculosis
AAEADWPDAYR

SEQ ID NO: 169844 - protein, 11 aa, Mycobacterium tuberculosis
AEADWPDAYRV

SEQ ID NO: 169845 - protein, 11 aa, Mycobacterium tuberculosis
WPDAYRVNRYV

SEQ ID NO: 169846 - protein, 11 aa, Mycobacterium tuberculosis
AYRVNRYVRGL

SEQ ID NO: 169847 - protein, 11 aa, Mycobacterium tuberculosis
GLGEDTNADEA

SEQ ID NO: 169848 - protein, 11 aa, Mycobacterium tuberculosis
DTNADEALSGF

SEQ ID NO: 169849 - protein, 11 aa, Mycobacterium tuberculosis
NADEALSGFER

SEQ ID NO: 169850 - protein, 11 aa, Mycobacterium tuberculosis
EALSGFERFPA

SEQ ID NO: 169851 - protein, 11 aa, Mycobacterium tuberculosis
SGFERFPAWMW

SEQ ID NO: 169852 - protein, 11 aa, Mycobacterium tuberculosis
GFERFPAWMWR

SEQ ID NO: 169853 - protein, 11 aa, Mycobacterium tuberculosis
RFPAWMWRNTV

SEQ ID NO: 169854 - protein, 11 aa, Mycobacterium tuberculosis
FPAWMWRNTVV

SEQ ID NO: 169855 - protein, 11 aa, Mycobacterium tuberculosis
PAWMWRNTVVR

SEQ ID NO: 169856 - protein, 11 aa, Mycobacterium tuberculosis
WMWRNTVVRDF

SEQ ID NO: 169857 - protein, 11 aa, Mycobacterium tuberculosis
RNTVVRDFVEW

SEQ ID NO: 169858 - protein, 11 aa, Mycobacterium tuberculosis
NTVVRDFVEWL

SEQ ID NO: 169859 - protein, 11 aa, Mycobacterium tuberculosis
TVVRDFVEWLR

SEQ ID NO: 169860 - protein, 11 aa, Mycobacterium tuberculosis
FVEWLRTRNQR

SEQ ID NO: 169861 - protein, 11 aa, Mycobacterium tuberculosis
RTRNQRYESGA

SEQ ID NO: 169862 - protein, 11 aa, Mycobacterium tuberculosis
RNQRYESGALR

SEQ ID NO: 169863 - protein, 11 aa, Mycobacterium tuberculosis
YESGALRQAGF

SEQ ID NO: 169864 - protein, 11 aa, Mycobacterium tuberculosis
ESGALRQAGFY

SEQ ID NO: 169865 - protein, 11 aa, Mycobacterium tuberculosis
RQAGFYGLDLY

SEQ ID NO: 169866 - protein, 11 aa, Mycobacterium tuberculosis
AGFYGLDLYSL

SEQ ID NO: 169867 - protein, 11 aa, Mycobacterium tuberculosis
FYGLDLYSLHR

SEQ ID NO: 169868 - protein, 11 aa, Mycobacterium tuberculosis
GLDLYSLHRSI

SEQ ID NO: 169869 - protein, 11 aa, Mycobacterium tuberculosis
HRSIQEVISYL

SEQ ID NO: 169870 - protein, 11 aa, Mycobacterium tuberculosis
SIQEVISYLDK

SEQ ID NO: 169871 - protein, 11 aa, Mycobacterium tuberculosis
IQEVISYLDKV

SEQ ID NO: 169872 - protein, 11 aa, Mycobacterium tuberculosis
VISYLDKVDPR

SEQ ID NO: 169873 - protein, 11 aa, Mycobacterium tuberculosis
YLDKVDPRAAA

SEQ ID NO: 169874 - protein, 11 aa, Mycobacterium tuberculosis
KVDPRAAARAR

SEQ ID NO: 169875 - protein, 11 aa, Mycobacterium tuberculosis
DPRAAARARAR

SEQ ID NO: 169876 - protein, 11 aa, Mycobacterium tuberculosis
AARARARYACF

SEQ ID NO: 169877 - protein, 11 aa, Mycobacterium tuberculosis
DHACADDGQAY

SEQ ID NO: 169878 - protein, 11 aa, Mycobacterium tuberculosis
CADDGQAYGFA

SEQ ID NO: 169879 - protein, 11 aa, Mycobacterium tuberculosis
QAYGFAAAFGA

SEQ ID NO: 169880 - protein, 11 aa, Mycobacterium tuberculosis
AAFGAGPSCER

SEQ ID NO: 169881 - protein, 11 aa, Mycobacterium tuberculosis
EAVEQLVDVQR

SEQ ID NO: 169882 - protein, 11 aa, Mycobacterium tuberculosis
QLVDVQRNALA

SEQ ID NO: 169883 - protein, 11 aa, Mycobacterium tuberculosis
LVDVQRNALAY

SEQ ID NO: 169884 - protein, 11 aa, Mycobacterium tuberculosis
DVQRNALAYAR

SEQ ID NO: 169885 - protein, 11 aa, Mycobacterium tuberculosis
ALAYARQDGLL

SEQ ID NO: 169886 - protein, 11 aa, Mycobacterium tuberculosis
RQDGLLAEDEL

SEQ ID NO: 169887 - protein, 11 aa, Mycobacterium tuberculosis
GLLAEDELFYA

SEQ ID NO: 169888 - protein, 11 aa, Mycobacterium tuberculosis
LLAEDELFYAQ

SEQ ID NO: 169889 - protein, 11 aa, Mycobacterium tuberculosis
ELFYAQQNAQT

SEQ ID NO: 169890 - protein, 11 aa, Mycobacterium tuberculosis
LFYAQQNAQTV

SEQ ID NO: 169891 - protein, 11 aa, Mycobacterium tuberculosis
FYAQQNAQTVR

SEQ ID NO: 169892 - protein, 11 aa, Mycobacterium tuberculosis
NAQTVRDAEVY

SEQ ID NO: 169893 - protein, 11 aa, Mycobacterium tuberculosis
AQTVRDAEVYY

SEQ ID NO: 169894 - protein, 11 aa, Mycobacterium tuberculosis
QTVRDAEVYYR

SEQ ID NO: 169895 - protein, 11 aa, Mycobacterium tuberculosis
TVRDAEVYYRA

SEQ ID NO: 169896 - protein, 11 aa, Mycobacterium tuberculosis
AEVYYRAMFSG

SEQ ID NO: 169897 - protein, 11 aa, Mycobacterium tuberculosis
EVYYRAMFSGR

SEQ ID NO: 169898 - protein, 11 aa, Mycobacterium tuberculosis
VYYRAMFSGRV

SEQ ID NO: 169899 - protein, 11 aa, Mycobacterium tuberculosis
RAMFSGRVTSW

SEQ ID NO: 169900 - protein, 11 aa, Mycobacterium tuberculosis
MFSGRVTSWNL

SEQ ID NO: 169901 - protein, 11 aa, Mycobacterium tuberculosis
FSGRVTSWNLR

SEQ ID NO: 169902 - protein, 11 aa, Mycobacterium tuberculosis
NLRDQHMAQTL

SEQ ID NO: 169903 - protein, 11 aa, Mycobacterium tuberculosis
HMAQTLGSLLT

SEQ ID NO: 169904 - protein, 11 aa, Mycobacterium tuberculosis
MAQTLGSLLTH

SEQ ID NO: 169905 - protein, 11 aa, Mycobacterium tuberculosis
AQTLGSLLTHL

SEQ ID NO: 169906 - protein, 11 aa, Mycobacterium tuberculosis
LLTHLDRHLDA

SEQ ID NO: 169907 - protein, 11 aa, Mycobacterium tuberculosis
HLDRHLDAPPA

SEQ ID NO: 169908 - protein, 11 aa, Mycobacterium tuberculosis
HLDAPPARIVV

SEQ ID NO: 169909 - protein, 11 aa, Mycobacterium tuberculosis
DAPPARIVVWA

SEQ ID NO: 169910 - protein, 11 aa, Mycobacterium tuberculosis
RIVVWAHNSHV

SEQ ID NO: 169911 - protein, 11 aa, Mycobacterium tuberculosis
WAHNSHVGDAR

SEQ ID NO: 169912 - protein, 11 aa, Mycobacterium tuberculosis
HVGDARATEVW

SEQ ID NO: 169913 - protein, 11 aa, Mycobacterium tuberculosis
TEVWADGQLTL

SEQ ID NO: 169914 - protein, 11 aa, Mycobacterium tuberculosis
WADGQLTLGQI

SEQ ID NO: 169915 - protein, 11 aa, Mycobacterium tuberculosis
QLTLGQIVRER

SEQ ID NO: 169916 - protein, 11 aa, Mycobacterium tuberculosis
IVRERYGDESR

SEQ ID NO: 169917 - protein, 11 aa, Mycobacterium tuberculosis
RYGDESRSIGF

SEQ ID NO: 169918 - protein, 11 aa, Mycobacterium tuberculosis
DESRSIGFSTY

SEQ ID NO: 169919 - protein, 11 aa, Mycobacterium tuberculosis
SIGFSTYTGTV

SEQ ID NO: 169920 - protein, 11 aa, Mycobacterium tuberculosis
FSTYTGTVTAA

SEQ ID NO: 169921 - protein, 11 aa, Mycobacterium tuberculosis
YTGTVTAASEW

SEQ ID NO: 169922 - protein, 11 aa, Mycobacterium tuberculosis
TVTAASEWGGI

SEQ ID NO: 169923 - protein, 11 aa, Mycobacterium tuberculosis
AASEWGGIAQR

SEQ ID NO: 169924 - protein, 11 aa, Mycobacterium tuberculosis
ASEWGGIAQRK

SEQ ID NO: 169925 - protein, 11 aa, Mycobacterium tuberculosis
GIAQRKAVRPA

SEQ ID NO: 169926 - protein, 11 aa, Mycobacterium tuberculosis
IAQRKAVRPAL

SEQ ID NO: 169927 - protein, 11 aa, Mycobacterium tuberculosis
KAVRPALHGSV

SEQ ID NO: 169928 - protein, 11 aa, Mycobacterium tuberculosis
RPALHGSVEEL

SEQ ID NO: 169929 - protein, 11 aa, Mycobacterium tuberculosis
EELFHQTADSF

SEQ ID NO: 169930 - protein, 11 aa, Mycobacterium tuberculosis
ELFHQTADSFL

SEQ ID NO: 169931 - protein, 11 aa, Mycobacterium tuberculosis
LFHQTADSFLV

SEQ ID NO: 169932 - protein, 11 aa, Mycobacterium tuberculosis
HQTADSFLVSA

SEQ ID NO: 169933 - protein, 11 aa, Mycobacterium tuberculosis
QTADSFLVSAR

SEQ ID NO: 169934 - protein, 11 aa, Mycobacterium tuberculosis
TADSFLVSARL

SEQ ID NO: 169935 - protein, 11 aa, Mycobacterium tuberculosis
DSFLVSARLSR

SEQ ID NO: 169936 - protein, 11 aa, Mycobacterium tuberculosis
FLVSARLSRDA

SEQ ID NO: 169937 - protein, 11 aa, Mycobacterium tuberculosis
ARLSRDAEAPL

SEQ ID NO: 169938 - protein, 11 aa, Mycobacterium tuberculosis
EAPLDVVRLGR

SEQ ID NO: 169939 - protein, 11 aa, Mycobacterium tuberculosis
APLDVVRLGRA

SEQ ID NO: 169940 - protein, 11 aa, Mycobacterium tuberculosis
PLDVVRLGRAI

SEQ ID NO: 169941 - protein, 11 aa, Mycobacterium tuberculosis
DVVRLGRAIGV

SEQ ID NO: 169942 - protein, 11 aa, Mycobacterium tuberculosis
VVRLGRAIGVV

SEQ ID NO: 169943 - protein, 11 aa, Mycobacterium tuberculosis
VRLGRAIGVVY

SEQ ID NO: 169944 - protein, 11 aa, Mycobacterium tuberculosis
RLGRAIGVVYL

SEQ ID NO: 169945 - protein, 11 aa, Mycobacterium tuberculosis
RAIGVVYLPAT

SEQ ID NO: 169946 - protein, 11 aa, Mycobacterium tuberculosis
YLPATERQSHY

SEQ ID NO: 169947 - protein, 11 aa, Mycobacterium tuberculosis
LPATERQSHYL

SEQ ID NO: 169948 - protein, 11 aa, Mycobacterium tuberculosis
ATERQSHYLHV

SEQ ID NO: 169949 - protein, 11 aa, Mycobacterium tuberculosis
TERQSHYLHVR

SEQ ID NO: 169950 - protein, 11 aa, Mycobacterium tuberculosis
RQSHYLHVRPA

SEQ ID NO: 169951 - protein, 11 aa, Mycobacterium tuberculosis
HYLHVRPADQF

SEQ ID NO: 169952 - protein, 11 aa, Mycobacterium tuberculosis
HVRPADQFDAM

SEQ ID NO: 169953 - protein, 11 aa, Mycobacterium tuberculosis
RPADQFDAMIH

SEQ ID NO: 169954 - protein, 11 aa, Mycobacterium tuberculosis
FDAMIHIDQTR

SEQ ID NO: 169955 - protein, 11 aa, Mycobacterium tuberculosis
AMIHIDQTRAL

SEQ ID NO: 169956 - protein, 11 aa, Mycobacterium tuberculosis
HIDQTRALEPL

SEQ ID NO: 169957 - protein, 11 aa, Mycobacterium tuberculosis
RALEPLEVTSR

SEQ ID NO: 169958 - protein, 11 aa, Mycobacterium tuberculosis
EPLEVTSRWIA

SEQ ID NO: 169959 - protein, 11 aa, Mycobacterium tuberculosis
RWIAGENPETY

SEQ ID NO: 169960 - protein, 11 aa, Mycobacterium tuberculosis
GENPETYPTGL

SEQ ID NO: 169961 - protein, 13 aa, Mycobacterium tuberculosis
MLMTAAADVTRRS

SEQ ID NO: 169962 - protein, 13 aa, Mycobacterium tuberculosis
LMTAAADVTRRSP

SEQ ID NO: 169963 - protein, 13 aa, Mycobacterium tuberculosis
MTAAADVTRRSPR

SEQ ID NO: 169964 - protein, 13 aa, Mycobacterium tuberculosis
TAAADVTRRSPRR

SEQ ID NO: 169965 - protein, 13 aa, Mycobacterium tuberculosis
AAADVTRRSPRRV

SEQ ID NO: 169966 - protein, 13 aa, Mycobacterium tuberculosis
AADVTRRSPRRVF

SEQ ID NO: 169967 - protein, 13 aa, Mycobacterium tuberculosis
ADVTRRSPRRVFR

SEQ ID NO: 169968 - protein, 13 aa, Mycobacterium tuberculosis
DVTRRSPRRVFRD

SEQ ID NO: 169969 - protein, 13 aa, Mycobacterium tuberculosis
VTRRSPRRVFRDR

SEQ ID NO: 169970 - protein, 13 aa, Mycobacterium tuberculosis
TRRSPRRVFRDRR

SEQ ID NO: 169971 - protein, 13 aa, Mycobacterium tuberculosis
RRSPRRVFRDRRE

SEQ ID NO: 169972 - protein, 13 aa, Mycobacterium tuberculosis
RSPRRVFRDRREA

SEQ ID NO: 169973 - protein, 13 aa, Mycobacterium tuberculosis
SPRRVFRDRREAG

SEQ ID NO: 169974 - protein, 13 aa, Mycobacterium tuberculosis
PRRVFRDRREAGR

SEQ ID NO: 169975 - protein, 13 aa, Mycobacterium tuberculosis
RRVFRDRREAGRV

SEQ ID NO: 169976 - protein, 13 aa, Mycobacterium tuberculosis
RVFRDRREAGRVL

SEQ ID NO: 169977 - protein, 13 aa, Mycobacterium tuberculosis
VFRDRREAGRVLA

SEQ ID NO: 169978 - protein, 13 aa, Mycobacterium tuberculosis
FRDRREAGRVLAE

SEQ ID NO: 169979 - protein, 13 aa, Mycobacterium tuberculosis
RDRREAGRVLAEL

SEQ ID NO: 169980 - protein, 13 aa, Mycobacterium tuberculosis
DRREAGRVLAELL

SEQ ID NO: 169981 - protein, 13 aa, Mycobacterium tuberculosis
RREAGRVLAELLA

SEQ ID NO: 169982 - protein, 13 aa, Mycobacterium tuberculosis
REAGRVLAELLAA

SEQ ID NO: 169983 - protein, 13 aa, Mycobacterium tuberculosis
EAGRVLAELLAAY

SEQ ID NO: 169984 - protein, 13 aa, Mycobacterium tuberculosis
AGRVLAELLAAYR

SEQ ID NO: 169985 - protein, 13 aa, Mycobacterium tuberculosis
GRVLAELLAAYRD

SEQ ID NO: 169986 - protein, 13 aa, Mycobacterium tuberculosis
RVLAELLAAYRDQ

SEQ ID NO: 169987 - protein, 13 aa, Mycobacterium tuberculosis
VLAELLAAYRDQP

SEQ ID NO: 169988 - protein, 13 aa, Mycobacterium tuberculosis
LAELLAAYRDQPD

SEQ ID NO: 169989 - protein, 13 aa, Mycobacterium tuberculosis
AELLAAYRDQPDV

SEQ ID NO: 169990 - protein, 13 aa, Mycobacterium tuberculosis
ELLAAYRDQPDVI

SEQ ID NO: 169991 - protein, 13 aa, Mycobacterium tuberculosis
LLAAYRDQPDVIV

SEQ ID NO: 169992 - protein, 13 aa, Mycobacterium tuberculosis
LAAYRDQPDVIVL

SEQ ID NO: 169993 - protein, 13 aa, Mycobacterium tuberculosis
AAYRDQPDVIVLG

SEQ ID NO: 169994 - protein, 13 aa, Mycobacterium tuberculosis
AYRDQPDVIVLGL

SEQ ID NO: 169995 - protein, 13 aa, Mycobacterium tuberculosis
YRDQPDVIVLGLA

SEQ ID NO: 169996 - protein, 13 aa, Mycobacterium tuberculosis
RDQPDVIVLGLAR

SEQ ID NO: 169997 - protein, 13 aa, Mycobacterium tuberculosis
DQPDVIVLGLARG

SEQ ID NO: 169998 - protein, 13 aa, Mycobacterium tuberculosis
QPDVIVLGLARGG

SEQ ID NO: 169999 - protein, 13 aa, Mycobacterium tuberculosis
PDVIVLGLARGGL

SEQ ID NO: 170000 - protein, 13 aa, Mycobacterium tuberculosis
DVIVLGLARGGLP

SEQ ID NO: 170001 - protein, 13 aa, Mycobacterium tuberculosis
VIVLGLARGGLPV

SEQ ID NO: 170002 - protein, 13 aa, Mycobacterium tuberculosis
IVLGLARGGLPVA

SEQ ID NO: 170003 - protein, 13 aa, Mycobacterium tuberculosis
VLGLARGGLPVAW

SEQ ID NO: 170004 - protein, 13 aa, Mycobacterium tuberculosis
LGLARGGLPVAWE

SEQ ID NO: 170005 - protein, 13 aa, Mycobacterium tuberculosis
GLARGGLPVAWEV

SEQ ID NO: 170006 - protein, 13 aa, Mycobacterium tuberculosis
LARGGLPVAWEVA

SEQ ID NO: 170007 - protein, 13 aa, Mycobacterium tuberculosis
ARGGLPVAWEVAA

SEQ ID NO: 170008 - protein, 13 aa, Mycobacterium tuberculosis
RGGLPVAWEVAAA

SEQ ID NO: 170009 - protein, 13 aa, Mycobacterium tuberculosis
GGLPVAWEVAAAL

SEQ ID NO: 170010 - protein, 13 aa, Mycobacterium tuberculosis
GLPVAWEVAAALH

SEQ ID NO: 170011 - protein, 13 aa, Mycobacterium tuberculosis
LPVAWEVAAALHA

SEQ ID NO: 170012 - protein, 13 aa, Mycobacterium tuberculosis
PVAWEVAAALHAP

SEQ ID NO: 170013 - protein, 13 aa, Mycobacterium tuberculosis
VAWEVAAALHAPL

SEQ ID NO: 170014 - protein, 13 aa, Mycobacterium tuberculosis
AWEVAAALHAPLD

SEQ ID NO: 170015 - protein, 13 aa, Mycobacterium tuberculosis
WEVAAALHAPLDA

SEQ ID NO: 170016 - protein, 13 aa, Mycobacterium tuberculosis
EVAAALHAPLDAF

SEQ ID NO: 170017 - protein, 13 aa, Mycobacterium tuberculosis
VAAALHAPLDAFV

SEQ ID NO: 170018 - protein, 13 aa, Mycobacterium tuberculosis
AAALHAPLDAFVV

SEQ ID NO: 170019 - protein, 13 aa, Mycobacterium tuberculosis
AALHAPLDAFVVR

SEQ ID NO: 170020 - protein, 13 aa, Mycobacterium tuberculosis
ALHAPLDAFVVRK

SEQ ID NO: 170021 - protein, 13 aa, Mycobacterium tuberculosis
LHAPLDAFVVRKL

SEQ ID NO: 170022 - protein, 13 aa, Mycobacterium tuberculosis
HAPLDAFVVRKLG

SEQ ID NO: 170023 - protein, 13 aa, Mycobacterium tuberculosis
APLDAFVVRKLGA

SEQ ID NO: 170024 - protein, 13 aa, Mycobacterium tuberculosis
PLDAFVVRKLGAP

SEQ ID NO: 170025 - protein, 13 aa, Mycobacterium tuberculosis
LDAFVVRKLGAPG

SEQ ID NO: 170026 - protein, 13 aa, Mycobacterium tuberculosis
DAFVVRKLGAPGH

SEQ ID NO: 170027 - protein, 13 aa, Mycobacterium tuberculosis
AFVVRKLGAPGHD

SEQ ID NO: 170028 - protein, 13 aa, Mycobacterium tuberculosis
FVVRKLGAPGHDE

SEQ ID NO: 170029 - protein, 13 aa, Mycobacterium tuberculosis
VVRKLGAPGHDEF

SEQ ID NO: 170030 - protein, 13 aa, Mycobacterium tuberculosis
VRKLGAPGHDEFA

SEQ ID NO: 170031 - protein, 13 aa, Mycobacterium tuberculosis
RKLGAPGHDEFAV

SEQ ID NO: 170032 - protein, 13 aa, Mycobacterium tuberculosis
KLGAPGHDEFAVG

SEQ ID NO: 170033 - protein, 13 aa, Mycobacterium tuberculosis
LGAPGHDEFAVGA

SEQ ID NO: 170034 - protein, 13 aa, Mycobacterium tuberculosis
GAPGHDEFAVGAL

SEQ ID NO: 170035 - protein, 13 aa, Mycobacterium tuberculosis
APGHDEFAVGALA

SEQ ID NO: 170036 - protein, 13 aa, Mycobacterium tuberculosis
PGHDEFAVGALAS

SEQ ID NO: 170037 - protein, 13 aa, Mycobacterium tuberculosis
GHDEFAVGALASG

SEQ ID NO: 170038 - protein, 13 aa, Mycobacterium tuberculosis
HDEFAVGALASGG

SEQ ID NO: 170039 - protein, 13 aa, Mycobacterium tuberculosis
DEFAVGALASGGR

SEQ ID NO: 170040 - protein, 13 aa, Mycobacterium tuberculosis
EFAVGALASGGRV

SEQ ID NO: 170041 - protein, 13 aa, Mycobacterium tuberculosis
FAVGALASGGRVV

SEQ ID NO: 170042 - protein, 13 aa, Mycobacterium tuberculosis
AVGALASGGRVVV

SEQ ID NO: 170043 - protein, 13 aa, Mycobacterium tuberculosis
VGALASGGRVVVN

SEQ ID NO: 170044 - protein, 13 aa, Mycobacterium tuberculosis
GALASGGRVVVND

SEQ ID NO: 170045 - protein, 13 aa, Mycobacterium tuberculosis
ALASGGRVVVNDD

SEQ ID NO: 170046 - protein, 13 aa, Mycobacterium tuberculosis
LASGGRVVVNDDV

SEQ ID NO: 170047 - protein, 13 aa, Mycobacterium tuberculosis
ASGGRVVVNDDVV

SEQ ID NO: 170048 - protein, 13 aa, Mycobacterium tuberculosis
SGGRVVVNDDVVR

SEQ ID NO: 170049 - protein, 13 aa, Mycobacterium tuberculosis
GGRVVVNDDVVRG

SEQ ID NO: 170050 - protein, 13 aa, Mycobacterium tuberculosis
GRVVVNDDVVRGL

SEQ ID NO: 170051 - protein, 13 aa, Mycobacterium tuberculosis
RVVVNDDVVRGLR

SEQ ID NO: 170052 - protein, 13 aa, Mycobacterium tuberculosis
VVVNDDVVRGLRI

SEQ ID NO: 170053 - protein, 13 aa, Mycobacterium tuberculosis
VVNDDVVRGLRIT

SEQ ID NO: 170054 - protein, 13 aa, Mycobacterium tuberculosis
VNDDVVRGLRITP

SEQ ID NO: 170055 - protein, 13 aa, Mycobacterium tuberculosis
NDDVVRGLRITPQ

SEQ ID NO: 170056 - protein, 13 aa, Mycobacterium tuberculosis
DDVVRGLRITPQQ

SEQ ID NO: 170057 - protein, 13 aa, Mycobacterium tuberculosis
DVVRGLRITPQQL

SEQ ID NO: 170058 - protein, 13 aa, Mycobacterium tuberculosis
VVRGLRITPQQLR

SEQ ID NO: 170059 - protein, 13 aa, Mycobacterium tuberculosis
VRGLRITPQQLRD

SEQ ID NO: 170060 - protein, 13 aa, Mycobacterium tuberculosis
RGLRITPQQLRDI

SEQ ID NO: 170061 - protein, 13 aa, Mycobacterium tuberculosis
GLRITPQQLRDIA

SEQ ID NO: 170062 - protein, 13 aa, Mycobacterium tuberculosis
LRITPQQLRDIAE

SEQ ID NO: 170063 - protein, 13 aa, Mycobacterium tuberculosis
RITPQQLRDIAER

SEQ ID NO: 170064 - protein, 13 aa, Mycobacterium tuberculosis
ITPQQLRDIAERE

SEQ ID NO: 170065 - protein, 13 aa, Mycobacterium tuberculosis
TPQQLRDIAEREG

SEQ ID NO: 170066 - protein, 13 aa, Mycobacterium tuberculosis
PQQLRDIAEREGR

SEQ ID NO: 170067 - protein, 13 aa, Mycobacterium tuberculosis
QQLRDIAEREGRE

SEQ ID NO: 170068 - protein, 13 aa, Mycobacterium tuberculosis
QLRDIAEREGREL

SEQ ID NO: 170069 - protein, 13 aa, Mycobacterium tuberculosis
LRDIAEREGRELL

SEQ ID NO: 170070 - protein, 13 aa, Mycobacterium tuberculosis
RDIAEREGRELLR

SEQ ID NO: 170071 - protein, 13 aa, Mycobacterium tuberculosis
DIAEREGRELLRR

SEQ ID NO: 170072 - protein, 13 aa, Mycobacterium tuberculosis
IAEREGRELLRRE

SEQ ID NO: 170073 - protein, 13 aa, Mycobacterium tuberculosis
AEREGRELLRRES

SEQ ID NO: 170074 - protein, 13 aa, Mycobacterium tuberculosis
EREGRELLRRESA

SEQ ID NO: 170075 - protein, 13 aa, Mycobacterium tuberculosis
REGRELLRRESAY

SEQ ID NO: 170076 - protein, 13 aa, Mycobacterium tuberculosis
EGRELLRRESAYR

SEQ ID NO: 170077 - protein, 13 aa, Mycobacterium tuberculosis
GRELLRRESAYRG

SEQ ID NO: 170078 - protein, 13 aa, Mycobacterium tuberculosis
RELLRRESAYRGE

SEQ ID NO: 170079 - protein, 13 aa, Mycobacterium tuberculosis
ELLRRESAYRGER

SEQ ID NO: 170080 - protein, 13 aa, Mycobacterium tuberculosis
LLRRESAYRGERP

SEQ ID NO: 170081 - protein, 13 aa, Mycobacterium tuberculosis
LRRESAYRGERPP

SEQ ID NO: 170082 - protein, 13 aa, Mycobacterium tuberculosis
RRESAYRGERPPT

SEQ ID NO: 170083 - protein, 13 aa, Mycobacterium tuberculosis
RESAYRGERPPTD

SEQ ID NO: 170084 - protein, 13 aa, Mycobacterium tuberculosis
ESAYRGERPPTDI

SEQ ID NO: 170085 - protein, 13 aa, Mycobacterium tuberculosis
SAYRGERPPTDIT

SEQ ID NO: 170086 - protein, 13 aa, Mycobacterium tuberculosis
AYRGERPPTDITG

SEQ ID NO: 170087 - protein, 13 aa, Mycobacterium tuberculosis
YRGERPPTDITGK

SEQ ID NO: 170088 - protein, 13 aa, Mycobacterium tuberculosis
RGERPPTDITGKT

SEQ ID NO: 170089 - protein, 13 aa, Mycobacterium tuberculosis
GERPPTDITGKTV

SEQ ID NO: 170090 - protein, 13 aa, Mycobacterium tuberculosis
ERPPTDITGKTVI

SEQ ID NO: 170091 - protein, 13 aa, Mycobacterium tuberculosis
RPPTDITGKTVIV

SEQ ID NO: 170092 - protein, 13 aa, Mycobacterium tuberculosis
PPTDITGKTVIVV

SEQ ID NO: 170093 - protein, 13 aa, Mycobacterium tuberculosis
PTDITGKTVIVVD

SEQ ID NO: 170094 - protein, 13 aa, Mycobacterium tuberculosis
TDITGKTVIVVDD

SEQ ID NO: 170095 - protein, 13 aa, Mycobacterium tuberculosis
DITGKTVIVVDDG

SEQ ID NO: 170096 - protein, 13 aa, Mycobacterium tuberculosis
ITGKTVIVVDDGL

SEQ ID NO: 170097 - protein, 13 aa, Mycobacterium tuberculosis
TGKTVIVVDDGLA

SEQ ID NO: 170098 - protein, 13 aa, Mycobacterium tuberculosis
GKTVIVVDDGLAT

SEQ ID NO: 170099 - protein, 13 aa, Mycobacterium tuberculosis
KTVIVVDDGLATG

SEQ ID NO: 170100 - protein, 13 aa, Mycobacterium tuberculosis
TVIVVDDGLATGA

SEQ ID NO: 170101 - protein, 13 aa, Mycobacterium tuberculosis
VIVVDDGLATGAS

SEQ ID NO: 170102 - protein, 13 aa, Mycobacterium tuberculosis
IVVDDGLATGASM

SEQ ID NO: 170103 - protein, 13 aa, Mycobacterium tuberculosis
VVDDGLATGASMF

SEQ ID NO: 170104 - protein, 13 aa, Mycobacterium tuberculosis
VDDGLATGASMFA

SEQ ID NO: 170105 - protein, 13 aa, Mycobacterium tuberculosis
DDGLATGASMFAA

SEQ ID NO: 170106 - protein, 13 aa, Mycobacterium tuberculosis
DGLATGASMFAAV

SEQ ID NO: 170107 - protein, 13 aa, Mycobacterium tuberculosis
GLATGASMFAAVQ

SEQ ID NO: 170108 - protein, 13 aa, Mycobacterium tuberculosis
LATGASMFAAVQA

SEQ ID NO: 170109 - protein, 13 aa, Mycobacterium tuberculosis
ATGASMFAAVQAL

SEQ ID NO: 170110 - protein, 13 aa, Mycobacterium tuberculosis
TGASMFAAVQALR

SEQ ID NO: 170111 - protein, 13 aa, Mycobacterium tuberculosis
GASMFAAVQALRD

SEQ ID NO: 170112 - protein, 13 aa, Mycobacterium tuberculosis
ASMFAAVQALRDA

SEQ ID NO: 170113 - protein, 13 aa, Mycobacterium tuberculosis
SMFAAVQALRDAQ

SEQ ID NO: 170114 - protein, 13 aa, Mycobacterium tuberculosis
MFAAVQALRDAQP

SEQ ID NO: 170115 - protein, 13 aa, Mycobacterium tuberculosis
FAAVQALRDAQPA

SEQ ID NO: 170116 - protein, 13 aa, Mycobacterium tuberculosis
AAVQALRDAQPAQ

SEQ ID NO: 170117 - protein, 13 aa, Mycobacterium tuberculosis
AVQALRDAQPAQI

SEQ ID NO: 170118 - protein, 13 aa, Mycobacterium tuberculosis
VQALRDAQPAQIV

SEQ ID NO: 170119 - protein, 13 aa, Mycobacterium tuberculosis
QALRDAQPAQIVI

SEQ ID NO: 170120 - protein, 13 aa, Mycobacterium tuberculosis
ALRDAQPAQIVIA

SEQ ID NO: 170121 - protein, 13 aa, Mycobacterium tuberculosis
LRDAQPAQIVIAV

SEQ ID NO: 170122 - protein, 13 aa, Mycobacterium tuberculosis
RDAQPAQIVIAVP

SEQ ID NO: 170123 - protein, 13 aa, Mycobacterium tuberculosis
DAQPAQIVIAVPA

SEQ ID NO: 170124 - protein, 13 aa, Mycobacterium tuberculosis
AQPAQIVIAVPAA

SEQ ID NO: 170125 - protein, 13 aa, Mycobacterium tuberculosis
QPAQIVIAVPAAP

SEQ ID NO: 170126 - protein, 13 aa, Mycobacterium tuberculosis
PAQIVIAVPAAPE

SEQ ID NO: 170127 - protein, 13 aa, Mycobacterium tuberculosis
AQIVIAVPAAPES

SEQ ID NO: 170128 - protein, 13 aa, Mycobacterium tuberculosis
QIVIAVPAAPEST

SEQ ID NO: 170129 - protein, 13 aa, Mycobacterium tuberculosis
IVIAVPAAPESTC

SEQ ID NO: 170130 - protein, 13 aa, Mycobacterium tuberculosis
VIAVPAAPESTCR

SEQ ID NO: 170131 - protein, 13 aa, Mycobacterium tuberculosis
IAVPAAPESTCRE

SEQ ID NO: 170132 - protein, 13 aa, Mycobacterium tuberculosis
AVPAAPESTCREF

SEQ ID NO: 170133 - protein, 13 aa, Mycobacterium tuberculosis
VPAAPESTCREFA

SEQ ID NO: 170134 - protein, 13 aa, Mycobacterium tuberculosis
PAAPESTCREFAG

SEQ ID NO: 170135 - protein, 13 aa, Mycobacterium tuberculosis
AAPESTCREFAGL

SEQ ID NO: 170136 - protein, 13 aa, Mycobacterium tuberculosis
APESTCREFAGLV

SEQ ID NO: 170137 - protein, 13 aa, Mycobacterium tuberculosis
PESTCREFAGLVD

SEQ ID NO: 170138 - protein, 13 aa, Mycobacterium tuberculosis
ESTCREFAGLVDD

SEQ ID NO: 170139 - protein, 13 aa, Mycobacterium tuberculosis
STCREFAGLVDDV

SEQ ID NO: 170140 - protein, 13 aa, Mycobacterium tuberculosis
TCREFAGLVDDVV

SEQ ID NO: 170141 - protein, 13 aa, Mycobacterium tuberculosis
CREFAGLVDDVVC

SEQ ID NO: 170142 - protein, 13 aa, Mycobacterium tuberculosis
REFAGLVDDVVCA

SEQ ID NO: 170143 - protein, 13 aa, Mycobacterium tuberculosis
EFAGLVDDVVCAT

SEQ ID NO: 170144 - protein, 13 aa, Mycobacterium tuberculosis
FAGLVDDVVCATM

SEQ ID NO: 170145 - protein, 13 aa, Mycobacterium tuberculosis
AGLVDDVVCATMP

SEQ ID NO: 170146 - protein, 13 aa, Mycobacterium tuberculosis
GLVDDVVCATMPT

SEQ ID NO: 170147 - protein, 13 aa, Mycobacterium tuberculosis
LVDDVVCATMPTP

SEQ ID NO: 170148 - protein, 13 aa, Mycobacterium tuberculosis
VDDVVCATMPTPF

SEQ ID NO: 170149 - protein, 13 aa, Mycobacterium tuberculosis
DDVVCATMPTPFL

SEQ ID NO: 170150 - protein, 13 aa, Mycobacterium tuberculosis
DVVCATMPTPFLA

SEQ ID NO: 170151 - protein, 13 aa, Mycobacterium tuberculosis
VVCATMPTPFLAV

SEQ ID NO: 170152 - protein, 13 aa, Mycobacterium tuberculosis
VCATMPTPFLAVG

SEQ ID NO: 170153 - protein, 13 aa, Mycobacterium tuberculosis
CATMPTPFLAVGE

SEQ ID NO: 170154 - protein, 13 aa, Mycobacterium tuberculosis
ATMPTPFLAVGES

SEQ ID NO: 170155 - protein, 13 aa, Mycobacterium tuberculosis
TMPTPFLAVGESF

SEQ ID NO: 170156 - protein, 13 aa, Mycobacterium tuberculosis
MPTPFLAVGESFW

SEQ ID NO: 170157 - protein, 13 aa, Mycobacterium tuberculosis
PTPFLAVGESFWD

SEQ ID NO: 170158 - protein, 13 aa, Mycobacterium tuberculosis
TPFLAVGESFWDF

SEQ ID NO: 170159 - protein, 13 aa, Mycobacterium tuberculosis
PFLAVGESFWDFR

SEQ ID NO: 170160 - protein, 13 aa, Mycobacterium tuberculosis
FLAVGESFWDFRQ

SEQ ID NO: 170161 - protein, 13 aa, Mycobacterium tuberculosis
LAVGESFWDFRQV

SEQ ID NO: 170162 - protein, 13 aa, Mycobacterium tuberculosis
AVGESFWDFRQVT

SEQ ID NO: 170163 - protein, 13 aa, Mycobacterium tuberculosis
VGESFWDFRQVTD

SEQ ID NO: 170164 - protein, 13 aa, Mycobacterium tuberculosis
GESFWDFRQVTDE

SEQ ID NO: 170165 - protein, 13 aa, Mycobacterium tuberculosis
ESFWDFRQVTDEE

SEQ ID NO: 170166 - protein, 13 aa, Mycobacterium tuberculosis
SFWDFRQVTDEEV

SEQ ID NO: 170167 - protein, 13 aa, Mycobacterium tuberculosis
FWDFRQVTDEEVR

SEQ ID NO: 170168 - protein, 13 aa, Mycobacterium tuberculosis
WDFRQVTDEEVRR

SEQ ID NO: 170169 - protein, 13 aa, Mycobacterium tuberculosis
DFRQVTDEEVRRL

SEQ ID NO: 170170 - protein, 13 aa, Mycobacterium tuberculosis
FRQVTDEEVRRLL

SEQ ID NO: 170171 - protein, 13 aa, Mycobacterium tuberculosis
RQVTDEEVRRLLA

SEQ ID NO: 170172 - protein, 13 aa, Mycobacterium tuberculosis
QVTDEEVRRLLAT

SEQ ID NO: 170173 - protein, 13 aa, Mycobacterium tuberculosis
VTDEEVRRLLATP

SEQ ID NO: 170174 - protein, 13 aa, Mycobacterium tuberculosis
TDEEVRRLLATPT

SEQ ID NO: 170175 - protein, 13 aa, Mycobacterium tuberculosis
DEEVRRLLATPTA

SEQ ID NO: 170176 - protein, 13 aa, Mycobacterium tuberculosis
EEVRRLLATPTAG

SEQ ID NO: 170177 - protein, 13 aa, Mycobacterium tuberculosis
EVRRLLATPTAGP

SEQ ID NO: 170178 - protein, 13 aa, Mycobacterium tuberculosis
VRRLLATPTAGPS

SEQ ID NO: 170179 - protein, 13 aa, Mycobacterium tuberculosis
RRLLATPTAGPSL

SEQ ID NO: 170180 - protein, 13 aa, Mycobacterium tuberculosis
RLLATPTAGPSLR

SEQ ID NO: 170181 - protein, 13 aa, Mycobacterium tuberculosis
LLATPTAGPSLRR

SEQ ID NO: 170182 - protein, 13 aa, Mycobacterium tuberculosis
LATPTAGPSLRRP

SEQ ID NO: 170183 - protein, 13 aa, Mycobacterium tuberculosis
ATPTAGPSLRRPA

SEQ ID NO: 170184 - protein, 13 aa, Mycobacterium tuberculosis
TPTAGPSLRRPAA

SEQ ID NO: 170185 - protein, 13 aa, Mycobacterium tuberculosis
PTAGPSLRRPAAS

SEQ ID NO: 170186 - protein, 13 aa, Mycobacterium tuberculosis
TAGPSLRRPAAST

SEQ ID NO: 170187 - protein, 13 aa, Mycobacterium tuberculosis
AGPSLRRPAASTA

SEQ ID NO: 170188 - protein, 13 aa, Mycobacterium tuberculosis
GPSLRRPAASTAA

SEQ ID NO: 170189 - protein, 13 aa, Mycobacterium tuberculosis
PSLRRPAASTAAD

SEQ ID NO: 170190 - protein, 13 aa, Mycobacterium tuberculosis
SLRRPAASTAADV

SEQ ID NO: 170191 - protein, 13 aa, Mycobacterium tuberculosis
LRRPAASTAADVL

SEQ ID NO: 170192 - protein, 13 aa, Mycobacterium tuberculosis
RRPAASTAADVLR

SEQ ID NO: 170193 - protein, 13 aa, Mycobacterium tuberculosis
RPAASTAADVLRR

SEQ ID NO: 170194 - protein, 13 aa, Mycobacterium tuberculosis
PAASTAADVLRRV

SEQ ID NO: 170195 - protein, 13 aa, Mycobacterium tuberculosis
AASTAADVLRRVA

SEQ ID NO: 170196 - protein, 13 aa, Mycobacterium tuberculosis
ASTAADVLRRVAI

SEQ ID NO: 170197 - protein, 13 aa, Mycobacterium tuberculosis
STAADVLRRVAID

SEQ ID NO: 170198 - protein, 13 aa, Mycobacterium tuberculosis
TAADVLRRVAIDA

SEQ ID NO: 170199 - protein, 13 aa, Mycobacterium tuberculosis
AADVLRRVAIDAP

SEQ ID NO: 170200 - protein, 13 aa, Mycobacterium tuberculosis
ADVLRRVAIDAPG

SEQ ID NO: 170201 - protein, 13 aa, Mycobacterium tuberculosis
DVLRRVAIDAPGG

SEQ ID NO: 170202 - protein, 13 aa, Mycobacterium tuberculosis
VLRRVAIDAPGGV

SEQ ID NO: 170203 - protein, 13 aa, Mycobacterium tuberculosis
LRRVAIDAPGGVP

SEQ ID NO: 170204 - protein, 13 aa, Mycobacterium tuberculosis
RRVAIDAPGGVPT

SEQ ID NO: 170205 - protein, 13 aa, Mycobacterium tuberculosis
RVAIDAPGGVPTH

SEQ ID NO: 170206 - protein, 13 aa, Mycobacterium tuberculosis
VAIDAPGGVPTHE

SEQ ID NO: 170207 - protein, 13 aa, Mycobacterium tuberculosis
AIDAPGGVPTHEV

SEQ ID NO: 170208 - protein, 13 aa, Mycobacterium tuberculosis
IDAPGGVPTHEVL

SEQ ID NO: 170209 - protein, 13 aa, Mycobacterium tuberculosis
DAPGGVPTHEVLA

SEQ ID NO: 170210 - protein, 13 aa, Mycobacterium tuberculosis
APGGVPTHEVLAE

SEQ ID NO: 170211 - protein, 13 aa, Mycobacterium tuberculosis
PGGVPTHEVLAEL

SEQ ID NO: 170212 - protein, 13 aa, Mycobacterium tuberculosis
GGVPTHEVLAELV

SEQ ID NO: 170213 - protein, 13 aa, Mycobacterium tuberculosis
GVPTHEVLAELVG

SEQ ID NO: 170214 - protein, 13 aa, Mycobacterium tuberculosis
VPTHEVLAELVGD

SEQ ID NO: 170215 - protein, 13 aa, Mycobacterium tuberculosis
PTHEVLAELVGDA

SEQ ID NO: 170216 - protein, 13 aa, Mycobacterium tuberculosis
THEVLAELVGDAR

SEQ ID NO: 170217 - protein, 13 aa, Mycobacterium tuberculosis
HEVLAELVGDARI

SEQ ID NO: 170218 - protein, 13 aa, Mycobacterium tuberculosis
EVLAELVGDARIV

SEQ ID NO: 170219 - protein, 13 aa, Mycobacterium tuberculosis
VLAELVGDARIVL

SEQ ID NO: 170220 - protein, 13 aa, Mycobacterium tuberculosis
LAELVGDARIVLI

SEQ ID NO: 170221 - protein, 13 aa, Mycobacterium tuberculosis
AELVGDARIVLIG

SEQ ID NO: 170222 - protein, 13 aa, Mycobacterium tuberculosis
ELVGDARIVLIGE

SEQ ID NO: 170223 - protein, 13 aa, Mycobacterium tuberculosis
LVGDARIVLIGES

SEQ ID NO: 170224 - protein, 13 aa, Mycobacterium tuberculosis
VGDARIVLIGESS

SEQ ID NO: 170225 - protein, 13 aa, Mycobacterium tuberculosis
GDARIVLIGESSH

SEQ ID NO: 170226 - protein, 13 aa, Mycobacterium tuberculosis
DARIVLIGESSHG

SEQ ID NO: 170227 - protein, 13 aa, Mycobacterium tuberculosis
ARIVLIGESSHGT

SEQ ID NO: 170228 - protein, 13 aa, Mycobacterium tuberculosis
RIVLIGESSHGTH

SEQ ID NO: 170229 - protein, 13 aa, Mycobacterium tuberculosis
IVLIGESSHGTHE

SEQ ID NO: 170230 - protein, 13 aa, Mycobacterium tuberculosis
VLIGESSHGTHEF

SEQ ID NO: 170231 - protein, 13 aa, Mycobacterium tuberculosis
LIGESSHGTHEFY

SEQ ID NO: 170232 - protein, 13 aa, Mycobacterium tuberculosis
IGESSHGTHEFYQ

SEQ ID NO: 170233 - protein, 13 aa, Mycobacterium tuberculosis
GESSHGTHEFYQA

SEQ ID NO: 170234 - protein, 13 aa, Mycobacterium tuberculosis
ESSHGTHEFYQAR

SEQ ID NO: 170235 - protein, 13 aa, Mycobacterium tuberculosis
SSHGTHEFYQARA

SEQ ID NO: 170236 - protein, 13 aa, Mycobacterium tuberculosis
SHGTHEFYQARAA

SEQ ID NO: 170237 - protein, 13 aa, Mycobacterium tuberculosis
HGTHEFYQARAAM

SEQ ID NO: 170238 - protein, 13 aa, Mycobacterium tuberculosis
GTHEFYQARAAMT

SEQ ID NO: 170239 - protein, 13 aa, Mycobacterium tuberculosis
THEFYQARAAMTQ

SEQ ID NO: 170240 - protein, 13 aa, Mycobacterium tuberculosis
HEFYQARAAMTQW

SEQ ID NO: 170241 - protein, 13 aa, Mycobacterium tuberculosis
EFYQARAAMTQWL

SEQ ID NO: 170242 - protein, 13 aa, Mycobacterium tuberculosis
FYQARAAMTQWLI

SEQ ID NO: 170243 - protein, 13 aa, Mycobacterium tuberculosis
YQARAAMTQWLIE

SEQ ID NO: 170244 - protein, 13 aa, Mycobacterium tuberculosis
QARAAMTQWLIEE

SEQ ID NO: 170245 - protein, 13 aa, Mycobacterium tuberculosis
ARAAMTQWLIEEK

SEQ ID NO: 170246 - protein, 13 aa, Mycobacterium tuberculosis
RAAMTQWLIEEKG

SEQ ID NO: 170247 - protein, 13 aa, Mycobacterium tuberculosis
AAMTQWLIEEKGF

SEQ ID NO: 170248 - protein, 13 aa, Mycobacterium tuberculosis
AMTQWLIEEKGFG

SEQ ID NO: 170249 - protein, 13 aa, Mycobacterium tuberculosis
MTQWLIEEKGFGA

SEQ ID NO: 170250 - protein, 13 aa, Mycobacterium tuberculosis
TQWLIEEKGFGAV

SEQ ID NO: 170251 - protein, 13 aa, Mycobacterium tuberculosis
QWLIEEKGFGAVA

SEQ ID NO: 170252 - protein, 13 aa, Mycobacterium tuberculosis
WLIEEKGFGAVAA

SEQ ID NO: 170253 - protein, 13 aa, Mycobacterium tuberculosis
LIEEKGFGAVAAE

SEQ ID NO: 170254 - protein, 13 aa, Mycobacterium tuberculosis
IEEKGFGAVAAEA

SEQ ID NO: 170255 - protein, 13 aa, Mycobacterium tuberculosis
EEKGFGAVAAEAD

SEQ ID NO: 170256 - protein, 13 aa, Mycobacterium tuberculosis
EKGFGAVAAEADW

SEQ ID NO: 170257 - protein, 13 aa, Mycobacterium tuberculosis
KGFGAVAAEADWP

SEQ ID NO: 170258 - protein, 13 aa, Mycobacterium tuberculosis
GFGAVAAEADWPD

SEQ ID NO: 170259 - protein, 13 aa, Mycobacterium tuberculosis
FGAVAAEADWPDA

SEQ ID NO: 170260 - protein, 13 aa, Mycobacterium tuberculosis
GAVAAEADWPDAY

SEQ ID NO: 170261 - protein, 13 aa, Mycobacterium tuberculosis
AVAAEADWPDAYR

SEQ ID NO: 170262 - protein, 13 aa, Mycobacterium tuberculosis
VAAEADWPDAYRV

SEQ ID NO: 170263 - protein, 13 aa, Mycobacterium tuberculosis
AAEADWPDAYRVN

SEQ ID NO: 170264 - protein, 13 aa, Mycobacterium tuberculosis
AEADWPDAYRVNR

SEQ ID NO: 170265 - protein, 13 aa, Mycobacterium tuberculosis
EADWPDAYRVNRY

SEQ ID NO: 170266 - protein, 13 aa, Mycobacterium tuberculosis
ADWPDAYRVNRYV

SEQ ID NO: 170267 - protein, 13 aa, Mycobacterium tuberculosis
DWPDAYRVNRYVR

SEQ ID NO: 170268 - protein, 13 aa, Mycobacterium tuberculosis
WPDAYRVNRYVRG

SEQ ID NO: 170269 - protein, 13 aa, Mycobacterium tuberculosis
PDAYRVNRYVRGL

SEQ ID NO: 170270 - protein, 13 aa, Mycobacterium tuberculosis
DAYRVNRYVRGLG

SEQ ID NO: 170271 - protein, 13 aa, Mycobacterium tuberculosis
AYRVNRYVRGLGE

SEQ ID NO: 170272 - protein, 13 aa, Mycobacterium tuberculosis
YRVNRYVRGLGED

SEQ ID NO: 170273 - protein, 13 aa, Mycobacterium tuberculosis
RVNRYVRGLGEDT

SEQ ID NO: 170274 - protein, 13 aa, Mycobacterium tuberculosis
VNRYVRGLGEDTN

SEQ ID NO: 170275 - protein, 13 aa, Mycobacterium tuberculosis
NRYVRGLGEDTNA

SEQ ID NO: 170276 - protein, 13 aa, Mycobacterium tuberculosis
RYVRGLGEDTNAD

SEQ ID NO: 170277 - protein, 13 aa, Mycobacterium tuberculosis
YVRGLGEDTNADE

SEQ ID NO: 170278 - protein, 13 aa, Mycobacterium tuberculosis
VRGLGEDTNADEA

SEQ ID NO: 170279 - protein, 13 aa, Mycobacterium tuberculosis
RGLGEDTNADEAL

SEQ ID NO: 170280 - protein, 13 aa, Mycobacterium tuberculosis
GLGEDTNADEALS

SEQ ID NO: 170281 - protein, 13 aa, Mycobacterium tuberculosis
LGEDTNADEALSG

SEQ ID NO: 170282 - protein, 13 aa, Mycobacterium tuberculosis
GEDTNADEALSGF

SEQ ID NO: 170283 - protein, 13 aa, Mycobacterium tuberculosis
EDTNADEALSGFE

SEQ ID NO: 170284 - protein, 13 aa, Mycobacterium tuberculosis
DTNADEALSGFER

SEQ ID NO: 170285 - protein, 13 aa, Mycobacterium tuberculosis
TNADEALSGFERF

SEQ ID NO: 170286 - protein, 13 aa, Mycobacterium tuberculosis
NADEALSGFERFP

SEQ ID NO: 170287 - protein, 13 aa, Mycobacterium tuberculosis
ADEALSGFERFPA

SEQ ID NO: 170288 - protein, 13 aa, Mycobacterium tuberculosis
DEALSGFERFPAW

SEQ ID NO: 170289 - protein, 13 aa, Mycobacterium tuberculosis
EALSGFERFPAWM

SEQ ID NO: 170290 - protein, 13 aa, Mycobacterium tuberculosis
ALSGFERFPAWMW

SEQ ID NO: 170291 - protein, 13 aa, Mycobacterium tuberculosis
LSGFERFPAWMWR

SEQ ID NO: 170292 - protein, 13 aa, Mycobacterium tuberculosis
SGFERFPAWMWRN

SEQ ID NO: 170293 - protein, 13 aa, Mycobacterium tuberculosis
GFERFPAWMWRNT

SEQ ID NO: 170294 - protein, 13 aa, Mycobacterium tuberculosis
FERFPAWMWRNTV

SEQ ID NO: 170295 - protein, 13 aa, Mycobacterium tuberculosis
ERFPAWMWRNTVV

SEQ ID NO: 170296 - protein, 13 aa, Mycobacterium tuberculosis
RFPAWMWRNTVVR

SEQ ID NO: 170297 - protein, 13 aa, Mycobacterium tuberculosis
FPAWMWRNTVVRD

SEQ ID NO: 170298 - protein, 13 aa, Mycobacterium tuberculosis
PAWMWRNTVVRDF

SEQ ID NO: 170299 - protein, 13 aa, Mycobacterium tuberculosis
AWMWRNTVVRDFV

SEQ ID NO: 170300 - protein, 13 aa, Mycobacterium tuberculosis
WMWRNTVVRDFVE

SEQ ID NO: 170301 - protein, 13 aa, Mycobacterium tuberculosis
MWRNTVVRDFVEW

SEQ ID NO: 170302 - protein, 13 aa, Mycobacterium tuberculosis
WRNTVVRDFVEWL

SEQ ID NO: 170303 - protein, 13 aa, Mycobacterium tuberculosis
RNTVVRDFVEWLR

SEQ ID NO: 170304 - protein, 13 aa, Mycobacterium tuberculosis
NTVVRDFVEWLRT

SEQ ID NO: 170305 - protein, 13 aa, Mycobacterium tuberculosis
TVVRDFVEWLRTR

SEQ ID NO: 170306 - protein, 13 aa, Mycobacterium tuberculosis
VVRDFVEWLRTRN

SEQ ID NO: 170307 - protein, 13 aa, Mycobacterium tuberculosis
VRDFVEWLRTRNQ

SEQ ID NO: 170308 - protein, 13 aa, Mycobacterium tuberculosis
RDFVEWLRTRNQR

SEQ ID NO: 170309 - protein, 13 aa, Mycobacterium tuberculosis
DFVEWLRTRNQRY

SEQ ID NO: 170310 - protein, 13 aa, Mycobacterium tuberculosis
FVEWLRTRNQRYE

SEQ ID NO: 170311 - protein, 13 aa, Mycobacterium tuberculosis
VEWLRTRNQRYES

SEQ ID NO: 170312 - protein, 13 aa, Mycobacterium tuberculosis
EWLRTRNQRYESG

SEQ ID NO: 170313 - protein, 13 aa, Mycobacterium tuberculosis
WLRTRNQRYESGA

SEQ ID NO: 170314 - protein, 13 aa, Mycobacterium tuberculosis
LRTRNQRYESGAL

SEQ ID NO: 170315 - protein, 13 aa, Mycobacterium tuberculosis
RTRNQRYESGALR

SEQ ID NO: 170316 - protein, 13 aa, Mycobacterium tuberculosis
TRNQRYESGALRQ

SEQ ID NO: 170317 - protein, 13 aa, Mycobacterium tuberculosis
RNQRYESGALRQA

SEQ ID NO: 170318 - protein, 13 aa, Mycobacterium tuberculosis
NQRYESGALRQAG

SEQ ID NO: 170319 - protein, 13 aa, Mycobacterium tuberculosis
QRYESGALRQAGF

SEQ ID NO: 170320 - protein, 13 aa, Mycobacterium tuberculosis
RYESGALRQAGFY

SEQ ID NO: 170321 - protein, 13 aa, Mycobacterium tuberculosis
YESGALRQAGFYG

SEQ ID NO: 170322 - protein, 13 aa, Mycobacterium tuberculosis
ESGALRQAGFYGL

SEQ ID NO: 170323 - protein, 13 aa, Mycobacterium tuberculosis
SGALRQAGFYGLD

SEQ ID NO: 170324 - protein, 13 aa, Mycobacterium tuberculosis
GALRQAGFYGLDL

SEQ ID NO: 170325 - protein, 13 aa, Mycobacterium tuberculosis
ALRQAGFYGLDLY

SEQ ID NO: 170326 - protein, 13 aa, Mycobacterium tuberculosis
LRQAGFYGLDLYS

SEQ ID NO: 170327 - protein, 13 aa, Mycobacterium tuberculosis
RQAGFYGLDLYSL

SEQ ID NO: 170328 - protein, 13 aa, Mycobacterium tuberculosis
QAGFYGLDLYSLH

SEQ ID NO: 170329 - protein, 13 aa, Mycobacterium tuberculosis
AGFYGLDLYSLHR

SEQ ID NO: 170330 - protein, 13 aa, Mycobacterium tuberculosis
GFYGLDLYSLHRS

SEQ ID NO: 170331 - protein, 13 aa, Mycobacterium tuberculosis
FYGLDLYSLHRSI

SEQ ID NO: 170332 - protein, 13 aa, Mycobacterium tuberculosis
YGLDLYSLHRSIQ

SEQ ID NO: 170333 - protein, 13 aa, Mycobacterium tuberculosis
GLDLYSLHRSIQE

SEQ ID NO: 170334 - protein, 13 aa, Mycobacterium tuberculosis
LDLYSLHRSIQEV

SEQ ID NO: 170335 - protein, 13 aa, Mycobacterium tuberculosis
DLYSLHRSIQEVI

SEQ ID NO: 170336 - protein, 13 aa, Mycobacterium tuberculosis
LYSLHRSIQEVIS

SEQ ID NO: 170337 - protein, 13 aa, Mycobacterium tuberculosis
YSLHRSIQEVISY

SEQ ID NO: 170338 - protein, 13 aa, Mycobacterium tuberculosis
SLHRSIQEVISYL

SEQ ID NO: 170339 - protein, 13 aa, Mycobacterium tuberculosis
LHRSIQEVISYLD

SEQ ID NO: 170340 - protein, 13 aa, Mycobacterium tuberculosis
HRSIQEVISYLDK

SEQ ID NO: 170341 - protein, 13 aa, Mycobacterium tuberculosis
RSIQEVISYLDKV

SEQ ID NO: 170342 - protein, 13 aa, Mycobacterium tuberculosis
SIQEVISYLDKVD

SEQ ID NO: 170343 - protein, 13 aa, Mycobacterium tuberculosis
IQEVISYLDKVDP

SEQ ID NO: 170344 - protein, 13 aa, Mycobacterium tuberculosis
QEVISYLDKVDPR

SEQ ID NO: 170345 - protein, 13 aa, Mycobacterium tuberculosis
EVISYLDKVDPRA

SEQ ID NO: 170346 - protein, 13 aa, Mycobacterium tuberculosis
VISYLDKVDPRAA

SEQ ID NO: 170347 - protein, 13 aa, Mycobacterium tuberculosis
ISYLDKVDPRAAA

SEQ ID NO: 170348 - protein, 13 aa, Mycobacterium tuberculosis
SYLDKVDPRAAAR

SEQ ID NO: 170349 - protein, 13 aa, Mycobacterium tuberculosis
YLDKVDPRAAARA

SEQ ID NO: 170350 - protein, 13 aa, Mycobacterium tuberculosis
LDKVDPRAAARAR

SEQ ID NO: 170351 - protein, 13 aa, Mycobacterium tuberculosis
DKVDPRAAARARA

SEQ ID NO: 170352 - protein, 13 aa, Mycobacterium tuberculosis
KVDPRAAARARAR

SEQ ID NO: 170353 - protein, 13 aa, Mycobacterium tuberculosis
VDPRAAARARARY

SEQ ID NO: 170354 - protein, 13 aa, Mycobacterium tuberculosis
DPRAAARARARYA

SEQ ID NO: 170355 - protein, 13 aa, Mycobacterium tuberculosis
PRAAARARARYAC

SEQ ID NO: 170356 - protein, 13 aa, Mycobacterium tuberculosis
RAAARARARYACF

SEQ ID NO: 170357 - protein, 13 aa, Mycobacterium tuberculosis
AAARARARYACFD

SEQ ID NO: 170358 - protein, 13 aa, Mycobacterium tuberculosis
AARARARYACFDH

SEQ ID NO: 170359 - protein, 13 aa, Mycobacterium tuberculosis
ARARARYACFDHA

SEQ ID NO: 170360 - protein, 13 aa, Mycobacterium tuberculosis
RARARYACFDHAC

SEQ ID NO: 170361 - protein, 13 aa, Mycobacterium tuberculosis
ARARYACFDHACA

SEQ ID NO: 170362 - protein, 13 aa, Mycobacterium tuberculosis
RARYACFDHACAD

SEQ ID NO: 170363 - protein, 13 aa, Mycobacterium tuberculosis
ARYACFDHACADD

SEQ ID NO: 170364 - protein, 13 aa, Mycobacterium tuberculosis
RYACFDHACADDG

SEQ ID NO: 170365 - protein, 13 aa, Mycobacterium tuberculosis
YACFDHACADDGQ

SEQ ID NO: 170366 - protein, 13 aa, Mycobacterium tuberculosis
ACFDHACADDGQA

SEQ ID NO: 170367 - protein, 13 aa, Mycobacterium tuberculosis
CFDHACADDGQAY

SEQ ID NO: 170368 - protein, 13 aa, Mycobacterium tuberculosis
FDHACADDGQAYG

SEQ ID NO: 170369 - protein, 13 aa, Mycobacterium tuberculosis
DHACADDGQAYGF

SEQ ID NO: 170370 - protein, 13 aa, Mycobacterium tuberculosis
HACADDGQAYGFA

SEQ ID NO: 170371 - protein, 13 aa, Mycobacterium tuberculosis
ACADDGQAYGFAA

SEQ ID NO: 170372 - protein, 13 aa, Mycobacterium tuberculosis
CADDGQAYGFAAA

SEQ ID NO: 170373 - protein, 13 aa, Mycobacterium tuberculosis
ADDGQAYGFAAAF

SEQ ID NO: 170374 - protein, 13 aa, Mycobacterium tuberculosis
DDGQAYGFAAAFG

SEQ ID NO: 170375 - protein, 13 aa, Mycobacterium tuberculosis
DGQAYGFAAAFGA

SEQ ID NO: 170376 - protein, 13 aa, Mycobacterium tuberculosis
GQAYGFAAAFGAG

SEQ ID NO: 170377 - protein, 13 aa, Mycobacterium tuberculosis
QAYGFAAAFGAGP

SEQ ID NO: 170378 - protein, 13 aa, Mycobacterium tuberculosis
AYGFAAAFGAGPS

SEQ ID NO: 170379 - protein, 13 aa, Mycobacterium tuberculosis
YGFAAAFGAGPSC

SEQ ID NO: 170380 - protein, 13 aa, Mycobacterium tuberculosis
GFAAAFGAGPSCE

SEQ ID NO: 170381 - protein, 13 aa, Mycobacterium tuberculosis
FAAAFGAGPSCER

SEQ ID NO: 170382 - protein, 13 aa, Mycobacterium tuberculosis
AAAFGAGPSCERE

SEQ ID NO: 170383 - protein, 13 aa, Mycobacterium tuberculosis
AAFGAGPSCEREA

SEQ ID NO: 170384 - protein, 13 aa, Mycobacterium tuberculosis
AFGAGPSCEREAV

SEQ ID NO: 170385 - protein, 13 aa, Mycobacterium tuberculosis
FGAGPSCEREAVE

SEQ ID NO: 170386 - protein, 13 aa, Mycobacterium tuberculosis
GAGPSCEREAVEQ

SEQ ID NO: 170387 - protein, 13 aa, Mycobacterium tuberculosis
AGPSCEREAVEQL

SEQ ID NO: 170388 - protein, 13 aa, Mycobacterium tuberculosis
GPSCEREAVEQLV

SEQ ID NO: 170389 - protein, 13 aa, Mycobacterium tuberculosis
PSCEREAVEQLVD

SEQ ID NO: 170390 - protein, 13 aa, Mycobacterium tuberculosis
SCEREAVEQLVDV

SEQ ID NO: 170391 - protein, 13 aa, Mycobacterium tuberculosis
CEREAVEQLVDVQ

SEQ ID NO: 170392 - protein, 13 aa, Mycobacterium tuberculosis
EREAVEQLVDVQR

SEQ ID NO: 170393 - protein, 13 aa, Mycobacterium tuberculosis
REAVEQLVDVQRN

SEQ ID NO: 170394 - protein, 13 aa, Mycobacterium tuberculosis
EAVEQLVDVQRNA

SEQ ID NO: 170395 - protein, 13 aa, Mycobacterium tuberculosis
AVEQLVDVQRNAL

SEQ ID NO: 170396 - protein, 13 aa, Mycobacterium tuberculosis
VEQLVDVQRNALA

SEQ ID NO: 170397 - protein, 13 aa, Mycobacterium tuberculosis
EQLVDVQRNALAY

SEQ ID NO: 170398 - protein, 13 aa, Mycobacterium tuberculosis
QLVDVQRNALAYA

SEQ ID NO: 170399 - protein, 13 aa, Mycobacterium tuberculosis
LVDVQRNALAYAR

SEQ ID NO: 170400 - protein, 13 aa, Mycobacterium tuberculosis
VDVQRNALAYARQ

SEQ ID NO: 170401 - protein, 13 aa, Mycobacterium tuberculosis
DVQRNALAYARQD

SEQ ID NO: 170402 - protein, 13 aa, Mycobacterium tuberculosis
VQRNALAYARQDG

SEQ ID NO: 170403 - protein, 13 aa, Mycobacterium tuberculosis
QRNALAYARQDGL

SEQ ID NO: 170404 - protein, 13 aa, Mycobacterium tuberculosis
RNALAYARQDGLL

SEQ ID NO: 170405 - protein, 13 aa, Mycobacterium tuberculosis
NALAYARQDGLLA

SEQ ID NO: 170406 - protein, 13 aa, Mycobacterium tuberculosis
ALAYARQDGLLAE

SEQ ID NO: 170407 - protein, 13 aa, Mycobacterium tuberculosis
LAYARQDGLLAED

SEQ ID NO: 170408 - protein, 13 aa, Mycobacterium tuberculosis
AYARQDGLLAEDE

SEQ ID NO: 170409 - protein, 13 aa, Mycobacterium tuberculosis
YARQDGLLAEDEL

SEQ ID NO: 170410 - protein, 13 aa, Mycobacterium tuberculosis
ARQDGLLAEDELF

SEQ ID NO: 170411 - protein, 13 aa, Mycobacterium tuberculosis
RQDGLLAEDELFY

SEQ ID NO: 170412 - protein, 13 aa, Mycobacterium tuberculosis
QDGLLAEDELFYA

SEQ ID NO: 170413 - protein, 13 aa, Mycobacterium tuberculosis
DGLLAEDELFYAQ

SEQ ID NO: 170414 - protein, 13 aa, Mycobacterium tuberculosis
GLLAEDELFYAQQ

SEQ ID NO: 170415 - protein, 13 aa, Mycobacterium tuberculosis
LLAEDELFYAQQN

SEQ ID NO: 170416 - protein, 13 aa, Mycobacterium tuberculosis
LAEDELFYAQQNA

SEQ ID NO: 170417 - protein, 13 aa, Mycobacterium tuberculosis
AEDELFYAQQNAQ

SEQ ID NO: 170418 - protein, 13 aa, Mycobacterium tuberculosis
EDELFYAQQNAQT

SEQ ID NO: 170419 - protein, 13 aa, Mycobacterium tuberculosis
DELFYAQQNAQTV

SEQ ID NO: 170420 - protein, 13 aa, Mycobacterium tuberculosis
ELFYAQQNAQTVR

SEQ ID NO: 170421 - protein, 13 aa, Mycobacterium tuberculosis
LFYAQQNAQTVRD

SEQ ID NO: 170422 - protein, 13 aa, Mycobacterium tuberculosis
FYAQQNAQTVRDA

SEQ ID NO: 170423 - protein, 13 aa, Mycobacterium tuberculosis
YAQQNAQTVRDAE

SEQ ID NO: 170424 - protein, 13 aa, Mycobacterium tuberculosis
AQQNAQTVRDAEV

SEQ ID NO: 170425 - protein, 13 aa, Mycobacterium tuberculosis
QQNAQTVRDAEVY

SEQ ID NO: 170426 - protein, 13 aa, Mycobacterium tuberculosis
QNAQTVRDAEVYY

SEQ ID NO: 170427 - protein, 13 aa, Mycobacterium tuberculosis
NAQTVRDAEVYYR

SEQ ID NO: 170428 - protein, 13 aa, Mycobacterium tuberculosis
AQTVRDAEVYYRA

SEQ ID NO: 170429 - protein, 13 aa, Mycobacterium tuberculosis
QTVRDAEVYYRAM

SEQ ID NO: 170430 - protein, 13 aa, Mycobacterium tuberculosis
TVRDAEVYYRAMF

SEQ ID NO: 170431 - protein, 13 aa, Mycobacterium tuberculosis
VRDAEVYYRAMFS

SEQ ID NO: 170432 - protein, 13 aa, Mycobacterium tuberculosis
RDAEVYYRAMFSG

SEQ ID NO: 170433 - protein, 13 aa, Mycobacterium tuberculosis
DAEVYYRAMFSGR

SEQ ID NO: 170434 - protein, 13 aa, Mycobacterium tuberculosis
AEVYYRAMFSGRV

SEQ ID NO: 170435 - protein, 13 aa, Mycobacterium tuberculosis
EVYYRAMFSGRVT

SEQ ID NO: 170436 - protein, 13 aa, Mycobacterium tuberculosis
VYYRAMFSGRVTS

SEQ ID NO: 170437 - protein, 13 aa, Mycobacterium tuberculosis
YYRAMFSGRVTSW

SEQ ID NO: 170438 - protein, 13 aa, Mycobacterium tuberculosis
YRAMFSGRVTSWN

SEQ ID NO: 170439 - protein, 13 aa, Mycobacterium tuberculosis
RAMFSGRVTSWNL

SEQ ID NO: 170440 - protein, 13 aa, Mycobacterium tuberculosis
AMFSGRVTSWNLR

SEQ ID NO: 170441 - protein, 13 aa, Mycobacterium tuberculosis
MFSGRVTSWNLRD

SEQ ID NO: 170442 - protein, 13 aa, Mycobacterium tuberculosis
FSGRVTSWNLRDQ

SEQ ID NO: 170443 - protein, 13 aa, Mycobacterium tuberculosis
SGRVTSWNLRDQH

SEQ ID NO: 170444 - protein, 13 aa, Mycobacterium tuberculosis
GRVTSWNLRDQHM

SEQ ID NO: 170445 - protein, 13 aa, Mycobacterium tuberculosis
RVTSWNLRDQHMA

SEQ ID NO: 170446 - protein, 13 aa, Mycobacterium tuberculosis
VTSWNLRDQHMAQ

SEQ ID NO: 170447 - protein, 13 aa, Mycobacterium tuberculosis
TSWNLRDQHMAQT

SEQ ID NO: 170448 - protein, 13 aa, Mycobacterium tuberculosis
SWNLRDQHMAQTL

SEQ ID NO: 170449 - protein, 13 aa, Mycobacterium tuberculosis
WNLRDQHMAQTLG

SEQ ID NO: 170450 - protein, 13 aa, Mycobacterium tuberculosis
NLRDQHMAQTLGS

SEQ ID NO: 170451 - protein, 13 aa, Mycobacterium tuberculosis
LRDQHMAQTLGSL

SEQ ID NO: 170452 - protein, 13 aa, Mycobacterium tuberculosis
RDQHMAQTLGSLL

SEQ ID NO: 170453 - protein, 13 aa, Mycobacterium tuberculosis
DQHMAQTLGSLLT

SEQ ID NO: 170454 - protein, 13 aa, Mycobacterium tuberculosis
QHMAQTLGSLLTH

SEQ ID NO: 170455 - protein, 13 aa, Mycobacterium tuberculosis
HMAQTLGSLLTHL

SEQ ID NO: 170456 - protein, 13 aa, Mycobacterium tuberculosis
MAQTLGSLLTHLD

SEQ ID NO: 170457 - protein, 13 aa, Mycobacterium tuberculosis
AQTLGSLLTHLDR

SEQ ID NO: 170458 - protein, 13 aa, Mycobacterium tuberculosis
QTLGSLLTHLDRH

SEQ ID NO: 170459 - protein, 13 aa, Mycobacterium tuberculosis
TLGSLLTHLDRHL

SEQ ID NO: 170460 - protein, 13 aa, Mycobacterium tuberculosis
LGSLLTHLDRHLD

SEQ ID NO: 170461 - protein, 13 aa, Mycobacterium tuberculosis
GSLLTHLDRHLDA

SEQ ID NO: 170462 - protein, 13 aa, Mycobacterium tuberculosis
SLLTHLDRHLDAP

SEQ ID NO: 170463 - protein, 13 aa, Mycobacterium tuberculosis
LLTHLDRHLDAPP

SEQ ID NO: 170464 - protein, 13 aa, Mycobacterium tuberculosis
LTHLDRHLDAPPA

SEQ ID NO: 170465 - protein, 13 aa, Mycobacterium tuberculosis
THLDRHLDAPPAR

SEQ ID NO: 170466 - protein, 13 aa, Mycobacterium tuberculosis
HLDRHLDAPPARI

SEQ ID NO: 170467 - protein, 13 aa, Mycobacterium tuberculosis
LDRHLDAPPARIV

SEQ ID NO: 170468 - protein, 13 aa, Mycobacterium tuberculosis
DRHLDAPPARIVV

SEQ ID NO: 170469 - protein, 13 aa, Mycobacterium tuberculosis
RHLDAPPARIVVW

SEQ ID NO: 170470 - protein, 13 aa, Mycobacterium tuberculosis
HLDAPPARIVVWA

SEQ ID NO: 170471 - protein, 13 aa, Mycobacterium tuberculosis
LDAPPARIVVWAH

SEQ ID NO: 170472 - protein, 13 aa, Mycobacterium tuberculosis
DAPPARIVVWAHN

SEQ ID NO: 170473 - protein, 13 aa, Mycobacterium tuberculosis
APPARIVVWAHNS

SEQ ID NO: 170474 - protein, 13 aa, Mycobacterium tuberculosis
PPARIVVWAHNSH

SEQ ID NO: 170475 - protein, 13 aa, Mycobacterium tuberculosis
PARIVVWAHNSHV

SEQ ID NO: 170476 - protein, 13 aa, Mycobacterium tuberculosis
ARIVVWAHNSHVG

SEQ ID NO: 170477 - protein, 13 aa, Mycobacterium tuberculosis
RIVVWAHNSHVGD

SEQ ID NO: 170478 - protein, 13 aa, Mycobacterium tuberculosis
IVVWAHNSHVGDA

SEQ ID NO: 170479 - protein, 13 aa, Mycobacterium tuberculosis
VVWAHNSHVGDAR

SEQ ID NO: 170480 - protein, 13 aa, Mycobacterium tuberculosis
VWAHNSHVGDARA

SEQ ID NO: 170481 - protein, 13 aa, Mycobacterium tuberculosis
WAHNSHVGDARAT

SEQ ID NO: 170482 - protein, 13 aa, Mycobacterium tuberculosis
AHNSHVGDARATE

SEQ ID NO: 170483 - protein, 13 aa, Mycobacterium tuberculosis
HNSHVGDARATEV

SEQ ID NO: 170484 - protein, 13 aa, Mycobacterium tuberculosis
NSHVGDARATEVW

SEQ ID NO: 170485 - protein, 13 aa, Mycobacterium tuberculosis
SHVGDARATEVWA

SEQ ID NO: 170486 - protein, 13 aa, Mycobacterium tuberculosis
HVGDARATEVWAD

SEQ ID NO: 170487 - protein, 13 aa, Mycobacterium tuberculosis
VGDARATEVWADG

SEQ ID NO: 170488 - protein, 13 aa, Mycobacterium tuberculosis
GDARATEVWADGQ

SEQ ID NO: 170489 - protein, 13 aa, Mycobacterium tuberculosis
DARATEVWADGQL

SEQ ID NO: 170490 - protein, 13 aa, Mycobacterium tuberculosis
ARATEVWADGQLT

SEQ ID NO: 170491 - protein, 13 aa, Mycobacterium tuberculosis
RATEVWADGQLTL

SEQ ID NO: 170492 - protein, 13 aa, Mycobacterium tuberculosis
ATEVWADGQLTLG

SEQ ID NO: 170493 - protein, 13 aa, Mycobacterium tuberculosis
TEVWADGQLTLGQ

SEQ ID NO: 170494 - protein, 13 aa, Mycobacterium tuberculosis
EVWADGQLTLGQI

SEQ ID NO: 170495 - protein, 13 aa, Mycobacterium tuberculosis
VWADGQLTLGQIV

SEQ ID NO: 170496 - protein, 13 aa, Mycobacterium tuberculosis
WADGQLTLGQIVR

SEQ ID NO: 170497 - protein, 13 aa, Mycobacterium tuberculosis
ADGQLTLGQIVRE

SEQ ID NO: 170498 - protein, 13 aa, Mycobacterium tuberculosis
DGQLTLGQIVRER

SEQ ID NO: 170499 - protein, 13 aa, Mycobacterium tuberculosis
GQLTLGQIVRERY

SEQ ID NO: 170500 - protein, 13 aa, Mycobacterium tuberculosis
QLTLGQIVRERYG

SEQ ID NO: 170501 - protein, 13 aa, Mycobacterium tuberculosis
LTLGQIVRERYGD

SEQ ID NO: 170502 - protein, 13 aa, Mycobacterium tuberculosis
TLGQIVRERYGDE

SEQ ID NO: 170503 - protein, 13 aa, Mycobacterium tuberculosis
LGQIVRERYGDES

SEQ ID NO: 170504 - protein, 13 aa, Mycobacterium tuberculosis
GQIVRERYGDESR

SEQ ID NO: 170505 - protein, 13 aa, Mycobacterium tuberculosis
QIVRERYGDESRS

SEQ ID NO: 170506 - protein, 13 aa, Mycobacterium tuberculosis
IVRERYGDESRSI

SEQ ID NO: 170507 - protein, 13 aa, Mycobacterium tuberculosis
VRERYGDESRSIG

SEQ ID NO: 170508 - protein, 13 aa, Mycobacterium tuberculosis
RERYGDESRSIGF

SEQ ID NO: 170509 - protein, 13 aa, Mycobacterium tuberculosis
ERYGDESRSIGFS

SEQ ID NO: 170510 - protein, 13 aa, Mycobacterium tuberculosis
RYGDESRSIGFST

SEQ ID NO: 170511 - protein, 13 aa, Mycobacterium tuberculosis
YGDESRSIGFSTY

SEQ ID NO: 170512 - protein, 13 aa, Mycobacterium tuberculosis
GDESRSIGFSTYT

SEQ ID NO: 170513 - protein, 13 aa, Mycobacterium tuberculosis
DESRSIGFSTYTG

SEQ ID NO: 170514 - protein, 13 aa, Mycobacterium tuberculosis
ESRSIGFSTYTGT

SEQ ID NO: 170515 - protein, 13 aa, Mycobacterium tuberculosis
SRSIGFSTYTGTV

SEQ ID NO: 170516 - protein, 13 aa, Mycobacterium tuberculosis
RSIGFSTYTGTVT

SEQ ID NO: 170517 - protein, 13 aa, Mycobacterium tuberculosis
SIGFSTYTGTVTA

SEQ ID NO: 170518 - protein, 13 aa, Mycobacterium tuberculosis
IGFSTYTGTVTAA

SEQ ID NO: 170519 - protein, 13 aa, Mycobacterium tuberculosis
GFSTYTGTVTAAS

SEQ ID NO: 170520 - protein, 13 aa, Mycobacterium tuberculosis
FSTYTGTVTAASE

SEQ ID NO: 170521 - protein, 13 aa, Mycobacterium tuberculosis
STYTGTVTAASEW

SEQ ID NO: 170522 - protein, 13 aa, Mycobacterium tuberculosis
TYTGTVTAASEWG

SEQ ID NO: 170523 - protein, 13 aa, Mycobacterium tuberculosis
YTGTVTAASEWGG

SEQ ID NO: 170524 - protein, 13 aa, Mycobacterium tuberculosis
TGTVTAASEWGGI

SEQ ID NO: 170525 - protein, 13 aa, Mycobacterium tuberculosis
GTVTAASEWGGIA

SEQ ID NO: 170526 - protein, 13 aa, Mycobacterium tuberculosis
TVTAASEWGGIAQ

SEQ ID NO: 170527 - protein, 13 aa, Mycobacterium tuberculosis
VTAASEWGGIAQR

SEQ ID NO: 170528 - protein, 13 aa, Mycobacterium tuberculosis
TAASEWGGIAQRK

SEQ ID NO: 170529 - protein, 13 aa, Mycobacterium tuberculosis
AASEWGGIAQRKA

SEQ ID NO: 170530 - protein, 13 aa, Mycobacterium tuberculosis
ASEWGGIAQRKAV

SEQ ID NO: 170531 - protein, 13 aa, Mycobacterium tuberculosis
SEWGGIAQRKAVR

SEQ ID NO: 170532 - protein, 13 aa, Mycobacterium tuberculosis
EWGGIAQRKAVRP

SEQ ID NO: 170533 - protein, 13 aa, Mycobacterium tuberculosis
WGGIAQRKAVRPA

SEQ ID NO: 170534 - protein, 13 aa, Mycobacterium tuberculosis
GGIAQRKAVRPAL

SEQ ID NO: 170535 - protein, 13 aa, Mycobacterium tuberculosis
GIAQRKAVRPALH

SEQ ID NO: 170536 - protein, 13 aa, Mycobacterium tuberculosis
IAQRKAVRPALHG

SEQ ID NO: 170537 - protein, 13 aa, Mycobacterium tuberculosis
AQRKAVRPALHGS

SEQ ID NO: 170538 - protein, 13 aa, Mycobacterium tuberculosis
QRKAVRPALHGSV

SEQ ID NO: 170539 - protein, 13 aa, Mycobacterium tuberculosis
RKAVRPALHGSVE

SEQ ID NO: 170540 - protein, 13 aa, Mycobacterium tuberculosis
KAVRPALHGSVEE

SEQ ID NO: 170541 - protein, 13 aa, Mycobacterium tuberculosis
AVRPALHGSVEEL

SEQ ID NO: 170542 - protein, 13 aa, Mycobacterium tuberculosis
VRPALHGSVEELF

SEQ ID NO: 170543 - protein, 13 aa, Mycobacterium tuberculosis
RPALHGSVEELFH

SEQ ID NO: 170544 - protein, 13 aa, Mycobacterium tuberculosis
PALHGSVEELFHQ

SEQ ID NO: 170545 - protein, 13 aa, Mycobacterium tuberculosis
ALHGSVEELFHQT

SEQ ID NO: 170546 - protein, 13 aa, Mycobacterium tuberculosis
LHGSVEELFHQTA

SEQ ID NO: 170547 - protein, 13 aa, Mycobacterium tuberculosis
HGSVEELFHQTAD

SEQ ID NO: 170548 - protein, 13 aa, Mycobacterium tuberculosis
GSVEELFHQTADS

SEQ ID NO: 170549 - protein, 13 aa, Mycobacterium tuberculosis
SVEELFHQTADSF

SEQ ID NO: 170550 - protein, 13 aa, Mycobacterium tuberculosis
VEELFHQTADSFL

SEQ ID NO: 170551 - protein, 13 aa, Mycobacterium tuberculosis
EELFHQTADSFLV

SEQ ID NO: 170552 - protein, 13 aa, Mycobacterium tuberculosis
ELFHQTADSFLVS

SEQ ID NO: 170553 - protein, 13 aa, Mycobacterium tuberculosis
LFHQTADSFLVSA

SEQ ID NO: 170554 - protein, 13 aa, Mycobacterium tuberculosis
FHQTADSFLVSAR

SEQ ID NO: 170555 - protein, 13 aa, Mycobacterium tuberculosis
HQTADSFLVSARL

SEQ ID NO: 170556 - protein, 13 aa, Mycobacterium tuberculosis
QTADSFLVSARLS

SEQ ID NO: 170557 - protein, 13 aa, Mycobacterium tuberculosis
TADSFLVSARLSR

SEQ ID NO: 170558 - protein, 13 aa, Mycobacterium tuberculosis
ADSFLVSARLSRD

SEQ ID NO: 170559 - protein, 13 aa, Mycobacterium tuberculosis
DSFLVSARLSRDA

SEQ ID NO: 170560 - protein, 13 aa, Mycobacterium tuberculosis
SFLVSARLSRDAE

SEQ ID NO: 170561 - protein, 13 aa, Mycobacterium tuberculosis
FLVSARLSRDAEA

SEQ ID NO: 170562 - protein, 13 aa, Mycobacterium tuberculosis
LVSARLSRDAEAP

SEQ ID NO: 170563 - protein, 13 aa, Mycobacterium tuberculosis
VSARLSRDAEAPL

SEQ ID NO: 170564 - protein, 13 aa, Mycobacterium tuberculosis
SARLSRDAEAPLD

SEQ ID NO: 170565 - protein, 13 aa, Mycobacterium tuberculosis
ARLSRDAEAPLDV

SEQ ID NO: 170566 - protein, 13 aa, Mycobacterium tuberculosis
RLSRDAEAPLDVV

SEQ ID NO: 170567 - protein, 13 aa, Mycobacterium tuberculosis
LSRDAEAPLDVVR

SEQ ID NO: 170568 - protein, 13 aa, Mycobacterium tuberculosis
SRDAEAPLDVVRL

SEQ ID NO: 170569 - protein, 13 aa, Mycobacterium tuberculosis
RDAEAPLDVVRLG

SEQ ID NO: 170570 - protein, 13 aa, Mycobacterium tuberculosis
DAEAPLDVVRLGR

SEQ ID NO: 170571 - protein, 13 aa, Mycobacterium tuberculosis
AEAPLDVVRLGRA

SEQ ID NO: 170572 - protein, 13 aa, Mycobacterium tuberculosis
EAPLDVVRLGRAI

SEQ ID NO: 170573 - protein, 13 aa, Mycobacterium tuberculosis
APLDVVRLGRAIG

SEQ ID NO: 170574 - protein, 13 aa, Mycobacterium tuberculosis
PLDVVRLGRAIGV

SEQ ID NO: 170575 - protein, 13 aa, Mycobacterium tuberculosis
LDVVRLGRAIGVV

SEQ ID NO: 170576 - protein, 13 aa, Mycobacterium tuberculosis
DVVRLGRAIGVVY

SEQ ID NO: 170577 - protein, 13 aa, Mycobacterium tuberculosis
VVRLGRAIGVVYL

SEQ ID NO: 170578 - protein, 13 aa, Mycobacterium tuberculosis
VRLGRAIGVVYLP

SEQ ID NO: 170579 - protein, 13 aa, Mycobacterium tuberculosis
RLGRAIGVVYLPA

SEQ ID NO: 170580 - protein, 13 aa, Mycobacterium tuberculosis
LGRAIGVVYLPAT

SEQ ID NO: 170581 - protein, 13 aa, Mycobacterium tuberculosis
GRAIGVVYLPATE

SEQ ID NO: 170582 - protein, 13 aa, Mycobacterium tuberculosis
RAIGVVYLPATER

SEQ ID NO: 170583 - protein, 13 aa, Mycobacterium tuberculosis
AIGVVYLPATERQ

SEQ ID NO: 170584 - protein, 13 aa, Mycobacterium tuberculosis
IGVVYLPATERQS

SEQ ID NO: 170585 - protein, 13 aa, Mycobacterium tuberculosis
GVVYLPATERQSH

SEQ ID NO: 170586 - protein, 13 aa, Mycobacterium tuberculosis
VVYLPATERQSHY

SEQ ID NO: 170587 - protein, 13 aa, Mycobacterium tuberculosis
VYLPATERQSHYL

SEQ ID NO: 170588 - protein, 13 aa, Mycobacterium tuberculosis
YLPATERQSHYLH

SEQ ID NO: 170589 - protein, 13 aa, Mycobacterium tuberculosis
LPATERQSHYLHV

SEQ ID NO: 170590 - protein, 13 aa, Mycobacterium tuberculosis
PATERQSHYLHVR

SEQ ID NO: 170591 - protein, 13 aa, Mycobacterium tuberculosis
ATERQSHYLHVRP

SEQ ID NO: 170592 - protein, 13 aa, Mycobacterium tuberculosis
TERQSHYLHVRPA

SEQ ID NO: 170593 - protein, 13 aa, Mycobacterium tuberculosis
ERQSHYLHVRPAD

SEQ ID NO: 170594 - protein, 13 aa, Mycobacterium tuberculosis
RQSHYLHVRPADQ

SEQ ID NO: 170595 - protein, 13 aa, Mycobacterium tuberculosis
QSHYLHVRPADQF

SEQ ID NO: 170596 - protein, 13 aa, Mycobacterium tuberculosis
SHYLHVRPADQFD

SEQ ID NO: 170597 - protein, 13 aa, Mycobacterium tuberculosis
HYLHVRPADQFDA

SEQ ID NO: 170598 - protein, 13 aa, Mycobacterium tuberculosis
YLHVRPADQFDAM

SEQ ID NO: 170599 - protein, 13 aa, Mycobacterium tuberculosis
LHVRPADQFDAMI

SEQ ID NO: 170600 - protein, 13 aa, Mycobacterium tuberculosis
HVRPADQFDAMIH

SEQ ID NO: 170601 - protein, 13 aa, Mycobacterium tuberculosis
VRPADQFDAMIHI

SEQ ID NO: 170602 - protein, 13 aa, Mycobacterium tuberculosis
RPADQFDAMIHID

SEQ ID NO: 170603 - protein, 13 aa, Mycobacterium tuberculosis
PADQFDAMIHIDQ

SEQ ID NO: 170604 - protein, 13 aa, Mycobacterium tuberculosis
ADQFDAMIHIDQT

SEQ ID NO: 170605 - protein, 13 aa, Mycobacterium tuberculosis
DQFDAMIHIDQTR

SEQ ID NO: 170606 - protein, 13 aa, Mycobacterium tuberculosis
QFDAMIHIDQTRA

SEQ ID NO: 170607 - protein, 13 aa, Mycobacterium tuberculosis
FDAMIHIDQTRAL

SEQ ID NO: 170608 - protein, 13 aa, Mycobacterium tuberculosis
DAMIHIDQTRALE

SEQ ID NO: 170609 - protein, 13 aa, Mycobacterium tuberculosis
AMIHIDQTRALEP

SEQ ID NO: 170610 - protein, 13 aa, Mycobacterium tuberculosis
MIHIDQTRALEPL

SEQ ID NO: 170611 - protein, 13 aa, Mycobacterium tuberculosis
IHIDQTRALEPLE

SEQ ID NO: 170612 - protein, 13 aa, Mycobacterium tuberculosis
HIDQTRALEPLEV

SEQ ID NO: 170613 - protein, 13 aa, Mycobacterium tuberculosis
IDQTRALEPLEVT

SEQ ID NO: 170614 - protein, 13 aa, Mycobacterium tuberculosis
DQTRALEPLEVTS

SEQ ID NO: 170615 - protein, 13 aa, Mycobacterium tuberculosis
QTRALEPLEVTSR

SEQ ID NO: 170616 - protein, 13 aa, Mycobacterium tuberculosis
TRALEPLEVTSRW

SEQ ID NO: 170617 - protein, 13 aa, Mycobacterium tuberculosis
RALEPLEVTSRWI

SEQ ID NO: 170618 - protein, 13 aa, Mycobacterium tuberculosis
ALEPLEVTSRWIA

SEQ ID NO: 170619 - protein, 13 aa, Mycobacterium tuberculosis
LEPLEVTSRWIAG

SEQ ID NO: 170620 - protein, 13 aa, Mycobacterium tuberculosis
EPLEVTSRWIAGE

SEQ ID NO: 170621 - protein, 13 aa, Mycobacterium tuberculosis
PLEVTSRWIAGEN

SEQ ID NO: 170622 - protein, 13 aa, Mycobacterium tuberculosis
LEVTSRWIAGENP

SEQ ID NO: 170623 - protein, 13 aa, Mycobacterium tuberculosis
EVTSRWIAGENPE

SEQ ID NO: 170624 - protein, 13 aa, Mycobacterium tuberculosis
VTSRWIAGENPET

SEQ ID NO: 170625 - protein, 13 aa, Mycobacterium tuberculosis
TSRWIAGENPETY

SEQ ID NO: 170626 - protein, 13 aa, Mycobacterium tuberculosis
SRWIAGENPETYP

SEQ ID NO: 170627 - protein, 13 aa, Mycobacterium tuberculosis
RWIAGENPETYPT

SEQ ID NO: 170628 - protein, 13 aa, Mycobacterium tuberculosis
WIAGENPETYPTG

SEQ ID NO: 170629 - protein, 13 aa, Mycobacterium tuberculosis
IAGENPETYPTGL

SEQ ID NO: 170630 - protein, 14 aa, Mycobacterium tuberculosis
MLMTAAADVTRRSP

SEQ ID NO: 170631 - protein, 14 aa, Mycobacterium tuberculosis
LMTAAADVTRRSPR

SEQ ID NO: 170632 - protein, 14 aa, Mycobacterium tuberculosis
MTAAADVTRRSPRR

SEQ ID NO: 170633 - protein, 14 aa, Mycobacterium tuberculosis
TAAADVTRRSPRRV

SEQ ID NO: 170634 - protein, 14 aa, Mycobacterium tuberculosis
AAADVTRRSPRRVF

SEQ ID NO: 170635 - protein, 14 aa, Mycobacterium tuberculosis
AADVTRRSPRRVFR

SEQ ID NO: 170636 - protein, 14 aa, Mycobacterium tuberculosis
ADVTRRSPRRVFRD

SEQ ID NO: 170637 - protein, 14 aa, Mycobacterium tuberculosis
DVTRRSPRRVFRDR

SEQ ID NO: 170638 - protein, 14 aa, Mycobacterium tuberculosis
VTRRSPRRVFRDRR

SEQ ID NO: 170639 - protein, 14 aa, Mycobacterium tuberculosis
TRRSPRRVFRDRRE

SEQ ID NO: 170640 - protein, 14 aa, Mycobacterium tuberculosis
RRSPRRVFRDRREA

SEQ ID NO: 170641 - protein, 14 aa, Mycobacterium tuberculosis
RSPRRVFRDRREAG

SEQ ID NO: 170642 - protein, 14 aa, Mycobacterium tuberculosis
SPRRVFRDRREAGR

SEQ ID NO: 170643 - protein, 14 aa, Mycobacterium tuberculosis
PRRVFRDRREAGRV

SEQ ID NO: 170644 - protein, 14 aa, Mycobacterium tuberculosis
RRVFRDRREAGRVL

SEQ ID NO: 170645 - protein, 14 aa, Mycobacterium tuberculosis
RVFRDRREAGRVLA

SEQ ID NO: 170646 - protein, 14 aa, Mycobacterium tuberculosis
VFRDRREAGRVLAE

SEQ ID NO: 170647 - protein, 14 aa, Mycobacterium tuberculosis
FRDRREAGRVLAEL

SEQ ID NO: 170648 - protein, 14 aa, Mycobacterium tuberculosis
RDRREAGRVLAELL

SEQ ID NO: 170649 - protein, 14 aa, Mycobacterium tuberculosis
DRREAGRVLAELLA

SEQ ID NO: 170650 - protein, 14 aa, Mycobacterium tuberculosis
RREAGRVLAELLAA

SEQ ID NO: 170651 - protein, 14 aa, Mycobacterium tuberculosis
REAGRVLAELLAAY

SEQ ID NO: 170652 - protein, 14 aa, Mycobacterium tuberculosis
EAGRVLAELLAAYR

SEQ ID NO: 170653 - protein, 14 aa, Mycobacterium tuberculosis
AGRVLAELLAAYRD

SEQ ID NO: 170654 - protein, 14 aa, Mycobacterium tuberculosis
GRVLAELLAAYRDQ

SEQ ID NO: 170655 - protein, 14 aa, Mycobacterium tuberculosis
RVLAELLAAYRDQP

SEQ ID NO: 170656 - protein, 14 aa, Mycobacterium tuberculosis
VLAELLAAYRDQPD

SEQ ID NO: 170657 - protein, 14 aa, Mycobacterium tuberculosis
LAELLAAYRDQPDV

SEQ ID NO: 170658 - protein, 14 aa, Mycobacterium tuberculosis
AELLAAYRDQPDVI

SEQ ID NO: 170659 - protein, 14 aa, Mycobacterium tuberculosis
ELLAAYRDQPDVIV

SEQ ID NO: 170660 - protein, 14 aa, Mycobacterium tuberculosis
LLAAYRDQPDVIVL

SEQ ID NO: 170661 - protein, 14 aa, Mycobacterium tuberculosis
LAAYRDQPDVIVLG

SEQ ID NO: 170662 - protein, 14 aa, Mycobacterium tuberculosis
AAYRDQPDVIVLGL

SEQ ID NO: 170663 - protein, 14 aa, Mycobacterium tuberculosis
AYRDQPDVIVLGLA

SEQ ID NO: 170664 - protein, 14 aa, Mycobacterium tuberculosis
YRDQPDVIVLGLAR

SEQ ID NO: 170665 - protein, 14 aa, Mycobacterium tuberculosis
RDQPDVIVLGLARG

SEQ ID NO: 170666 - protein, 14 aa, Mycobacterium tuberculosis
DQPDVIVLGLARGG

SEQ ID NO: 170667 - protein, 14 aa, Mycobacterium tuberculosis
QPDVIVLGLARGGL

SEQ ID NO: 170668 - protein, 14 aa, Mycobacterium tuberculosis
PDVIVLGLARGGLP

SEQ ID NO: 170669 - protein, 14 aa, Mycobacterium tuberculosis
DVIVLGLARGGLPV

SEQ ID NO: 170670 - protein, 14 aa, Mycobacterium tuberculosis
VIVLGLARGGLPVA

SEQ ID NO: 170671 - protein, 14 aa, Mycobacterium tuberculosis
IVLGLARGGLPVAW

SEQ ID NO: 170672 - protein, 14 aa, Mycobacterium tuberculosis
VLGLARGGLPVAWE

SEQ ID NO: 170673 - protein, 14 aa, Mycobacterium tuberculosis
LGLARGGLPVAWEV

SEQ ID NO: 170674 - protein, 14 aa, Mycobacterium tuberculosis
GLARGGLPVAWEVA

SEQ ID NO: 170675 - protein, 14 aa, Mycobacterium tuberculosis
LARGGLPVAWEVAA

SEQ ID NO: 170676 - protein, 14 aa, Mycobacterium tuberculosis
ARGGLPVAWEVAAA

SEQ ID NO: 170677 - protein, 14 aa, Mycobacterium tuberculosis
RGGLPVAWEVAAAL

SEQ ID NO: 170678 - protein, 14 aa, Mycobacterium tuberculosis
GGLPVAWEVAAALH

SEQ ID NO: 170679 - protein, 14 aa, Mycobacterium tuberculosis
GLPVAWEVAAALHA

SEQ ID NO: 170680 - protein, 14 aa, Mycobacterium tuberculosis
LPVAWEVAAALHAP

SEQ ID NO: 170681 - protein, 14 aa, Mycobacterium tuberculosis
PVAWEVAAALHAPL

SEQ ID NO: 170682 - protein, 14 aa, Mycobacterium tuberculosis
VAWEVAAALHAPLD

SEQ ID NO: 170683 - protein, 14 aa, Mycobacterium tuberculosis
AWEVAAALHAPLDA

SEQ ID NO: 170684 - protein, 14 aa, Mycobacterium tuberculosis
WEVAAALHAPLDAF

SEQ ID NO: 170685 - protein, 14 aa, Mycobacterium tuberculosis
EVAAALHAPLDAFV

SEQ ID NO: 170686 - protein, 14 aa, Mycobacterium tuberculosis
VAAALHAPLDAFVV

SEQ ID NO: 170687 - protein, 14 aa, Mycobacterium tuberculosis
AAALHAPLDAFVVR

SEQ ID NO: 170688 - protein, 14 aa, Mycobacterium tuberculosis
AALHAPLDAFVVRK

SEQ ID NO: 170689 - protein, 14 aa, Mycobacterium tuberculosis
ALHAPLDAFVVRKL

SEQ ID NO: 170690 - protein, 14 aa, Mycobacterium tuberculosis
LHAPLDAFVVRKLG

SEQ ID NO: 170691 - protein, 14 aa, Mycobacterium tuberculosis
HAPLDAFVVRKLGA

SEQ ID NO: 170692 - protein, 14 aa, Mycobacterium tuberculosis
APLDAFVVRKLGAP

SEQ ID NO: 170693 - protein, 14 aa, Mycobacterium tuberculosis
PLDAFVVRKLGAPG

SEQ ID NO: 170694 - protein, 14 aa, Mycobacterium tuberculosis
LDAFVVRKLGAPGH

SEQ ID NO: 170695 - protein, 14 aa, Mycobacterium tuberculosis
DAFVVRKLGAPGHD

SEQ ID NO: 170696 - protein, 14 aa, Mycobacterium tuberculosis
AFVVRKLGAPGHDE

SEQ ID NO: 170697 - protein, 14 aa, Mycobacterium tuberculosis
FVVRKLGAPGHDEF

SEQ ID NO: 170698 - protein, 14 aa, Mycobacterium tuberculosis
VVRKLGAPGHDEFA

SEQ ID NO: 170699 - protein, 14 aa, Mycobacterium tuberculosis
VRKLGAPGHDEFAV

SEQ ID NO: 170700 - protein, 14 aa, Mycobacterium tuberculosis
RKLGAPGHDEFAVG

SEQ ID NO: 170701 - protein, 14 aa, Mycobacterium tuberculosis
KLGAPGHDEFAVGA

SEQ ID NO: 170702 - protein, 14 aa, Mycobacterium tuberculosis
LGAPGHDEFAVGAL

SEQ ID NO: 170703 - protein, 14 aa, Mycobacterium tuberculosis
GAPGHDEFAVGALA

SEQ ID NO: 170704 - protein, 14 aa, Mycobacterium tuberculosis
APGHDEFAVGALAS

SEQ ID NO: 170705 - protein, 14 aa, Mycobacterium tuberculosis
PGHDEFAVGALASG

SEQ ID NO: 170706 - protein, 14 aa, Mycobacterium tuberculosis
GHDEFAVGALASGG

SEQ ID NO: 170707 - protein, 14 aa, Mycobacterium tuberculosis
HDEFAVGALASGGR

SEQ ID NO: 170708 - protein, 14 aa, Mycobacterium tuberculosis
DEFAVGALASGGRV

SEQ ID NO: 170709 - protein, 14 aa, Mycobacterium tuberculosis
EFAVGALASGGRVV

SEQ ID NO: 170710 - protein, 14 aa, Mycobacterium tuberculosis
FAVGALASGGRVVV

SEQ ID NO: 170711 - protein, 14 aa, Mycobacterium tuberculosis
AVGALASGGRVVVN

SEQ ID NO: 170712 - protein, 14 aa, Mycobacterium tuberculosis
VGALASGGRVVVND

SEQ ID NO: 170713 - protein, 14 aa, Mycobacterium tuberculosis
GALASGGRVVVNDD

SEQ ID NO: 170714 - protein, 14 aa, Mycobacterium tuberculosis
ALASGGRVVVNDDV

SEQ ID NO: 170715 - protein, 14 aa, Mycobacterium tuberculosis
LASGGRVVVNDDVV

SEQ ID NO: 170716 - protein, 14 aa, Mycobacterium tuberculosis
ASGGRVVVNDDVVR

SEQ ID NO: 170717 - protein, 14 aa, Mycobacterium tuberculosis
SGGRVVVNDDVVRG

SEQ ID NO: 170718 - protein, 14 aa, Mycobacterium tuberculosis
GGRVVVNDDVVRGL

SEQ ID NO: 170719 - protein, 14 aa, Mycobacterium tuberculosis
GRVVVNDDVVRGLR

SEQ ID NO: 170720 - protein, 14 aa, Mycobacterium tuberculosis
RVVVNDDVVRGLRI

SEQ ID NO: 170721 - protein, 14 aa, Mycobacterium tuberculosis
VVVNDDVVRGLRIT

SEQ ID NO: 170722 - protein, 14 aa, Mycobacterium tuberculosis
VVNDDVVRGLRITP

SEQ ID NO: 170723 - protein, 14 aa, Mycobacterium tuberculosis
VNDDVVRGLRITPQ

SEQ ID NO: 170724 - protein, 14 aa, Mycobacterium tuberculosis
NDDVVRGLRITPQQ

SEQ ID NO: 170725 - protein, 14 aa, Mycobacterium tuberculosis
DDVVRGLRITPQQL

SEQ ID NO: 170726 - protein, 14 aa, Mycobacterium tuberculosis
DVVRGLRITPQQLR

SEQ ID NO: 170727 - protein, 14 aa, Mycobacterium tuberculosis
VVRGLRITPQQLRD

SEQ ID NO: 170728 - protein, 14 aa, Mycobacterium tuberculosis
VRGLRITPQQLRDI

SEQ ID NO: 170729 - protein, 14 aa, Mycobacterium tuberculosis
RGLRITPQQLRDIA

SEQ ID NO: 170730 - protein, 14 aa, Mycobacterium tuberculosis
GLRITPQQLRDIAE

SEQ ID NO: 170731 - protein, 14 aa, Mycobacterium tuberculosis
LRITPQQLRDIAER

SEQ ID NO: 170732 - protein, 14 aa, Mycobacterium tuberculosis
RITPQQLRDIAERE

SEQ ID NO: 170733 - protein, 14 aa, Mycobacterium tuberculosis
ITPQQLRDIAEREG

SEQ ID NO: 170734 - protein, 14 aa, Mycobacterium tuberculosis
TPQQLRDIAEREGR

SEQ ID NO: 170735 - protein, 14 aa, Mycobacterium tuberculosis
PQQLRDIAEREGRE

SEQ ID NO: 170736 - protein, 14 aa, Mycobacterium tuberculosis
QQLRDIAEREGREL

SEQ ID NO: 170737 - protein, 14 aa, Mycobacterium tuberculosis
QLRDIAEREGRELL

SEQ ID NO: 170738 - protein, 14 aa, Mycobacterium tuberculosis
LRDIAEREGRELLR

SEQ ID NO: 170739 - protein, 14 aa, Mycobacterium tuberculosis
RDIAEREGRELLRR

SEQ ID NO: 170740 - protein, 14 aa, Mycobacterium tuberculosis
DIAEREGRELLRRE

SEQ ID NO: 170741 - protein, 14 aa, Mycobacterium tuberculosis
IAEREGRELLRRES

SEQ ID NO: 170742 - protein, 14 aa, Mycobacterium tuberculosis
AEREGRELLRRESA

SEQ ID NO: 170743 - protein, 14 aa, Mycobacterium tuberculosis
EREGRELLRRESAY

SEQ ID NO: 170744 - protein, 14 aa, Mycobacterium tuberculosis
REGRELLRRESAYR

SEQ ID NO: 170745 - protein, 14 aa, Mycobacterium tuberculosis
EGRELLRRESAYRG

SEQ ID NO: 170746 - protein, 14 aa, Mycobacterium tuberculosis
GRELLRRESAYRGE

SEQ ID NO: 170747 - protein, 14 aa, Mycobacterium tuberculosis
RELLRRESAYRGER

SEQ ID NO: 170748 - protein, 14 aa, Mycobacterium tuberculosis
ELLRRESAYRGERP

SEQ ID NO: 170749 - protein, 14 aa, Mycobacterium tuberculosis
LLRRESAYRGERPP

SEQ ID NO: 170750 - protein, 14 aa, Mycobacterium tuberculosis
LRRESAYRGERPPT

SEQ ID NO: 170751 - protein, 14 aa, Mycobacterium tuberculosis
RRESAYRGERPPTD

SEQ ID NO: 170752 - protein, 14 aa, Mycobacterium tuberculosis
RESAYRGERPPTDI

SEQ ID NO: 170753 - protein, 14 aa, Mycobacterium tuberculosis
ESAYRGERPPTDIT

SEQ ID NO: 170754 - protein, 14 aa, Mycobacterium tuberculosis
SAYRGERPPTDITG

SEQ ID NO: 170755 - protein, 14 aa, Mycobacterium tuberculosis
AYRGERPPTDITGK

SEQ ID NO: 170756 - protein, 14 aa, Mycobacterium tuberculosis
YRGERPPTDITGKT

SEQ ID NO: 170757 - protein, 14 aa, Mycobacterium tuberculosis
RGERPPTDITGKTV

SEQ ID NO: 170758 - protein, 14 aa, Mycobacterium tuberculosis
GERPPTDITGKTVI

SEQ ID NO: 170759 - protein, 14 aa, Mycobacterium tuberculosis
ERPPTDITGKTVIV

SEQ ID NO: 170760 - protein, 14 aa, Mycobacterium tuberculosis
RPPTDITGKTVIVV

SEQ ID NO: 170761 - protein, 14 aa, Mycobacterium tuberculosis
PPTDITGKTVIVVD

SEQ ID NO: 170762 - protein, 14 aa, Mycobacterium tuberculosis
PTDITGKTVIVVDD

SEQ ID NO: 170763 - protein, 14 aa, Mycobacterium tuberculosis
TDITGKTVIVVDDG

SEQ ID NO: 170764 - protein, 14 aa, Mycobacterium tuberculosis
DITGKTVIVVDDGL

SEQ ID NO: 170765 - protein, 14 aa, Mycobacterium tuberculosis
ITGKTVIVVDDGLA

SEQ ID NO: 170766 - protein, 14 aa, Mycobacterium tuberculosis
TGKTVIVVDDGLAT

SEQ ID NO: 170767 - protein, 14 aa, Mycobacterium tuberculosis
GKTVIVVDDGLATG

SEQ ID NO: 170768 - protein, 14 aa, Mycobacterium tuberculosis
KTVIVVDDGLATGA

SEQ ID NO: 170769 - protein, 14 aa, Mycobacterium tuberculosis
TVIVVDDGLATGAS

SEQ ID NO: 170770 - protein, 14 aa, Mycobacterium tuberculosis
VIVVDDGLATGASM

SEQ ID NO: 170771 - protein, 14 aa, Mycobacterium tuberculosis
IVVDDGLATGASMF

SEQ ID NO: 170772 - protein, 14 aa, Mycobacterium tuberculosis
VVDDGLATGASMFA

SEQ ID NO: 170773 - protein, 14 aa, Mycobacterium tuberculosis
VDDGLATGASMFAA

SEQ ID NO: 170774 - protein, 14 aa, Mycobacterium tuberculosis
DDGLATGASMFAAV

SEQ ID NO: 170775 - protein, 14 aa, Mycobacterium tuberculosis
DGLATGASMFAAVQ

SEQ ID NO: 170776 - protein, 14 aa, Mycobacterium tuberculosis
GLATGASMFAAVQA

SEQ ID NO: 170777 - protein, 14 aa, Mycobacterium tuberculosis
LATGASMFAAVQAL

SEQ ID NO: 170778 - protein, 14 aa, Mycobacterium tuberculosis
ATGASMFAAVQALR

SEQ ID NO: 170779 - protein, 14 aa, Mycobacterium tuberculosis
TGASMFAAVQALRD

SEQ ID NO: 170780 - protein, 14 aa, Mycobacterium tuberculosis
GASMFAAVQALRDA

SEQ ID NO: 170781 - protein, 14 aa, Mycobacterium tuberculosis
ASMFAAVQALRDAQ

SEQ ID NO: 170782 - protein, 14 aa, Mycobacterium tuberculosis
SMFAAVQALRDAQP

SEQ ID NO: 170783 - protein, 14 aa, Mycobacterium tuberculosis
MFAAVQALRDAQPA

SEQ ID NO: 170784 - protein, 14 aa, Mycobacterium tuberculosis
FAAVQALRDAQPAQ

SEQ ID NO: 170785 - protein, 14 aa, Mycobacterium tuberculosis
AAVQALRDAQPAQI

SEQ ID NO: 170786 - protein, 14 aa, Mycobacterium tuberculosis
AVQALRDAQPAQIV

SEQ ID NO: 170787 - protein, 14 aa, Mycobacterium tuberculosis
VQALRDAQPAQIVI

SEQ ID NO: 170788 - protein, 14 aa, Mycobacterium tuberculosis
QALRDAQPAQIVIA

SEQ ID NO: 170789 - protein, 14 aa, Mycobacterium tuberculosis
ALRDAQPAQIVIAV

SEQ ID NO: 170790 - protein, 14 aa, Mycobacterium tuberculosis
LRDAQPAQIVIAVP

SEQ ID NO: 170791 - protein, 14 aa, Mycobacterium tuberculosis
RDAQPAQIVIAVPA

SEQ ID NO: 170792 - protein, 14 aa, Mycobacterium tuberculosis
DAQPAQIVIAVPAA

SEQ ID NO: 170793 - protein, 14 aa, Mycobacterium tuberculosis
AQPAQIVIAVPAAP

SEQ ID NO: 170794 - protein, 14 aa, Mycobacterium tuberculosis
QPAQIVIAVPAAPE

SEQ ID NO: 170795 - protein, 14 aa, Mycobacterium tuberculosis
PAQIVIAVPAAPES

SEQ ID NO: 170796 - protein, 14 aa, Mycobacterium tuberculosis
AQIVIAVPAAPEST

SEQ ID NO: 170797 - protein, 14 aa, Mycobacterium tuberculosis
QIVIAVPAAPESTC

SEQ ID NO: 170798 - protein, 14 aa, Mycobacterium tuberculosis
IVIAVPAAPESTCR

SEQ ID NO: 170799 - protein, 14 aa, Mycobacterium tuberculosis
VIAVPAAPESTCRE

SEQ ID NO: 170800 - protein, 14 aa, Mycobacterium tuberculosis
IAVPAAPESTCREF

SEQ ID NO: 170801 - protein, 14 aa, Mycobacterium tuberculosis
AVPAAPESTCREFA

SEQ ID NO: 170802 - protein, 14 aa, Mycobacterium tuberculosis
VPAAPESTCREFAG

SEQ ID NO: 170803 - protein, 14 aa, Mycobacterium tuberculosis
PAAPESTCREFAGL

SEQ ID NO: 170804 - protein, 14 aa, Mycobacterium tuberculosis
AAPESTCREFAGLV

SEQ ID NO: 170805 - protein, 14 aa, Mycobacterium tuberculosis
APESTCREFAGLVD

SEQ ID NO: 170806 - protein, 14 aa, Mycobacterium tuberculosis
PESTCREFAGLVDD

SEQ ID NO: 170807 - protein, 14 aa, Mycobacterium tuberculosis
ESTCREFAGLVDDV

SEQ ID NO: 170808 - protein, 14 aa, Mycobacterium tuberculosis
STCREFAGLVDDVV

SEQ ID NO: 170809 - protein, 14 aa, Mycobacterium tuberculosis
TCREFAGLVDDVVC

SEQ ID NO: 170810 - protein, 14 aa, Mycobacterium tuberculosis
CREFAGLVDDVVCA

SEQ ID NO: 170811 - protein, 14 aa, Mycobacterium tuberculosis
REFAGLVDDVVCAT

SEQ ID NO: 170812 - protein, 14 aa, Mycobacterium tuberculosis
EFAGLVDDVVCATM

SEQ ID NO: 170813 - protein, 14 aa, Mycobacterium tuberculosis
FAGLVDDVVCATMP

SEQ ID NO: 170814 - protein, 14 aa, Mycobacterium tuberculosis
AGLVDDVVCATMPT

SEQ ID NO: 170815 - protein, 14 aa, Mycobacterium tuberculosis
GLVDDVVCATMPTP

SEQ ID NO: 170816 - protein, 14 aa, Mycobacterium tuberculosis
LVDDVVCATMPTPF

SEQ ID NO: 170817 - protein, 14 aa, Mycobacterium tuberculosis
VDDVVCATMPTPFL

SEQ ID NO: 170818 - protein, 14 aa, Mycobacterium tuberculosis
DDVVCATMPTPFLA

SEQ ID NO: 170819 - protein, 14 aa, Mycobacterium tuberculosis
DVVCATMPTPFLAV

SEQ ID NO: 170820 - protein, 14 aa, Mycobacterium tuberculosis
VVCATMPTPFLAVG

SEQ ID NO: 170821 - protein, 14 aa, Mycobacterium tuberculosis
VCATMPTPFLAVGE

SEQ ID NO: 170822 - protein, 14 aa, Mycobacterium tuberculosis
CATMPTPFLAVGES

SEQ ID NO: 170823 - protein, 14 aa, Mycobacterium tuberculosis
ATMPTPFLAVGESF

SEQ ID NO: 170824 - protein, 14 aa, Mycobacterium tuberculosis
TMPTPFLAVGESFW

SEQ ID NO: 170825 - protein, 14 aa, Mycobacterium tuberculosis
MPTPFLAVGESFWD

SEQ ID NO: 170826 - protein, 14 aa, Mycobacterium tuberculosis
PTPFLAVGESFWDF

SEQ ID NO: 170827 - protein, 14 aa, Mycobacterium tuberculosis
TPFLAVGESFWDFR

SEQ ID NO: 170828 - protein, 14 aa, Mycobacterium tuberculosis
PFLAVGESFWDFRQ

SEQ ID NO: 170829 - protein, 14 aa, Mycobacterium tuberculosis
FLAVGESFWDFRQV

SEQ ID NO: 170830 - protein, 14 aa, Mycobacterium tuberculosis
LAVGESFWDFRQVT

SEQ ID NO: 170831 - protein, 14 aa, Mycobacterium tuberculosis
AVGESFWDFRQVTD

SEQ ID NO: 170832 - protein, 14 aa, Mycobacterium tuberculosis
VGESFWDFRQVTDE

SEQ ID NO: 170833 - protein, 14 aa, Mycobacterium tuberculosis
GESFWDFRQVTDEE

SEQ ID NO: 170834 - protein, 14 aa, Mycobacterium tuberculosis
ESFWDFRQVTDEEV

SEQ ID NO: 170835 - protein, 14 aa, Mycobacterium tuberculosis
SFWDFRQVTDEEVR

SEQ ID NO: 170836 - protein, 14 aa, Mycobacterium tuberculosis
FWDFRQVTDEEVRR

SEQ ID NO: 170837 - protein, 14 aa, Mycobacterium tuberculosis
WDFRQVTDEEVRRL

SEQ ID NO: 170838 - protein, 14 aa, Mycobacterium tuberculosis
DFRQVTDEEVRRLL

SEQ ID NO: 170839 - protein, 14 aa, Mycobacterium tuberculosis
FRQVTDEEVRRLLA

SEQ ID NO: 170840 - protein, 14 aa, Mycobacterium tuberculosis
RQVTDEEVRRLLAT

SEQ ID NO: 170841 - protein, 14 aa, Mycobacterium tuberculosis
QVTDEEVRRLLATP

SEQ ID NO: 170842 - protein, 14 aa, Mycobacterium tuberculosis
VTDEEVRRLLATPT

SEQ ID NO: 170843 - protein, 14 aa, Mycobacterium tuberculosis
TDEEVRRLLATPTA

SEQ ID NO: 170844 - protein, 14 aa, Mycobacterium tuberculosis
DEEVRRLLATPTAG

SEQ ID NO: 170845 - protein, 14 aa, Mycobacterium tuberculosis
EEVRRLLATPTAGP

SEQ ID NO: 170846 - protein, 14 aa, Mycobacterium tuberculosis
EVRRLLATPTAGPS

SEQ ID NO: 170847 - protein, 14 aa, Mycobacterium tuberculosis
VRRLLATPTAGPSL

SEQ ID NO: 170848 - protein, 14 aa, Mycobacterium tuberculosis
RRLLATPTAGPSLR

SEQ ID NO: 170849 - protein, 14 aa, Mycobacterium tuberculosis
RLLATPTAGPSLRR

SEQ ID NO: 170850 - protein, 14 aa, Mycobacterium tuberculosis
LLATPTAGPSLRRP

SEQ ID NO: 170851 - protein, 14 aa, Mycobacterium tuberculosis
LATPTAGPSLRRPA

SEQ ID NO: 170852 - protein, 14 aa, Mycobacterium tuberculosis
ATPTAGPSLRRPAA

SEQ ID NO: 170853 - protein, 14 aa, Mycobacterium tuberculosis
TPTAGPSLRRPAAS

SEQ ID NO: 170854 - protein, 14 aa, Mycobacterium tuberculosis
PTAGPSLRRPAAST

SEQ ID NO: 170855 - protein, 14 aa, Mycobacterium tuberculosis
TAGPSLRRPAASTA

SEQ ID NO: 170856 - protein, 14 aa, Mycobacterium tuberculosis
AGPSLRRPAASTAA

SEQ ID NO: 170857 - protein, 14 aa, Mycobacterium tuberculosis
GPSLRRPAASTAAD

SEQ ID NO: 170858 - protein, 14 aa, Mycobacterium tuberculosis
PSLRRPAASTAADV

SEQ ID NO: 170859 - protein, 14 aa, Mycobacterium tuberculosis
SLRRPAASTAADVL

SEQ ID NO: 170860 - protein, 14 aa, Mycobacterium tuberculosis
LRRPAASTAADVLR

SEQ ID NO: 170861 - protein, 14 aa, Mycobacterium tuberculosis
RRPAASTAADVLRR

SEQ ID NO: 170862 - protein, 14 aa, Mycobacterium tuberculosis
RPAASTAADVLRRV

SEQ ID NO: 170863 - protein, 14 aa, Mycobacterium tuberculosis
PAASTAADVLRRVA

SEQ ID NO: 170864 - protein, 14 aa, Mycobacterium tuberculosis
AASTAADVLRRVAI

SEQ ID NO: 170865 - protein, 14 aa, Mycobacterium tuberculosis
ASTAADVLRRVAID

SEQ ID NO: 170866 - protein, 14 aa, Mycobacterium tuberculosis
STAADVLRRVAIDA

SEQ ID NO: 170867 - protein, 14 aa, Mycobacterium tuberculosis
TAADVLRRVAIDAP

SEQ ID NO: 170868 - protein, 14 aa, Mycobacterium tuberculosis
AADVLRRVAIDAPG

SEQ ID NO: 170869 - protein, 14 aa, Mycobacterium tuberculosis
ADVLRRVAIDAPGG

SEQ ID NO: 170870 - protein, 14 aa, Mycobacterium tuberculosis
DVLRRVAIDAPGGV

SEQ ID NO: 170871 - protein, 14 aa, Mycobacterium tuberculosis
VLRRVAIDAPGGVP

SEQ ID NO: 170872 - protein, 14 aa, Mycobacterium tuberculosis
LRRVAIDAPGGVPT

SEQ ID NO: 170873 - protein, 14 aa, Mycobacterium tuberculosis
RRVAIDAPGGVPTH

SEQ ID NO: 170874 - protein, 14 aa, Mycobacterium tuberculosis
RVAIDAPGGVPTHE

SEQ ID NO: 170875 - protein, 14 aa, Mycobacterium tuberculosis
VAIDAPGGVPTHEV

SEQ ID NO: 170876 - protein, 14 aa, Mycobacterium tuberculosis
AIDAPGGVPTHEVL

SEQ ID NO: 170877 - protein, 14 aa, Mycobacterium tuberculosis
IDAPGGVPTHEVLA

SEQ ID NO: 170878 - protein, 14 aa, Mycobacterium tuberculosis
DAPGGVPTHEVLAE

SEQ ID NO: 170879 - protein, 14 aa, Mycobacterium tuberculosis
APGGVPTHEVLAEL

SEQ ID NO: 170880 - protein, 14 aa, Mycobacterium tuberculosis
PGGVPTHEVLAELV

SEQ ID NO: 170881 - protein, 14 aa, Mycobacterium tuberculosis
GGVPTHEVLAELVG

SEQ ID NO: 170882 - protein, 14 aa, Mycobacterium tuberculosis
GVPTHEVLAELVGD

SEQ ID NO: 170883 - protein, 14 aa, Mycobacterium tuberculosis
VPTHEVLAELVGDA

SEQ ID NO: 170884 - protein, 14 aa, Mycobacterium tuberculosis
PTHEVLAELVGDAR

SEQ ID NO: 170885 - protein, 14 aa, Mycobacterium tuberculosis
THEVLAELVGDARI

SEQ ID NO: 170886 - protein, 14 aa, Mycobacterium tuberculosis
HEVLAELVGDARIV

SEQ ID NO: 170887 - protein, 14 aa, Mycobacterium tuberculosis
EVLAELVGDARIVL

SEQ ID NO: 170888 - protein, 14 aa, Mycobacterium tuberculosis
VLAELVGDARIVLI

SEQ ID NO: 170889 - protein, 14 aa, Mycobacterium tuberculosis
LAELVGDARIVLIG

SEQ ID NO: 170890 - protein, 14 aa, Mycobacterium tuberculosis
AELVGDARIVLIGE

SEQ ID NO: 170891 - protein, 14 aa, Mycobacterium tuberculosis
ELVGDARIVLIGES

SEQ ID NO: 170892 - protein, 14 aa, Mycobacterium tuberculosis
LVGDARIVLIGESS

SEQ ID NO: 170893 - protein, 14 aa, Mycobacterium tuberculosis
VGDARIVLIGESSH

SEQ ID NO: 170894 - protein, 14 aa, Mycobacterium tuberculosis
GDARIVLIGESSHG

SEQ ID NO: 170895 - protein, 14 aa, Mycobacterium tuberculosis
DARIVLIGESSHGT

SEQ ID NO: 170896 - protein, 14 aa, Mycobacterium tuberculosis
ARIVLIGESSHGTH

SEQ ID NO: 170897 - protein, 14 aa, Mycobacterium tuberculosis
RIVLIGESSHGTHE

SEQ ID NO: 170898 - protein, 14 aa, Mycobacterium tuberculosis
IVLIGESSHGTHEF

SEQ ID NO: 170899 - protein, 14 aa, Mycobacterium tuberculosis
VLIGESSHGTHEFY

SEQ ID NO: 170900 - protein, 14 aa, Mycobacterium tuberculosis
LIGESSHGTHEFYQ

SEQ ID NO: 170901 - protein, 14 aa, Mycobacterium tuberculosis
IGESSHGTHEFYQA

SEQ ID NO: 170902 - protein, 14 aa, Mycobacterium tuberculosis
GESSHGTHEFYQAR

SEQ ID NO: 170903 - protein, 14 aa, Mycobacterium tuberculosis
ESSHGTHEFYQARA

SEQ ID NO: 170904 - protein, 14 aa, Mycobacterium tuberculosis
SSHGTHEFYQARAA

SEQ ID NO: 170905 - protein, 14 aa, Mycobacterium tuberculosis
SHGTHEFYQARAAM

SEQ ID NO: 170906 - protein, 14 aa, Mycobacterium tuberculosis
HGTHEFYQARAAMT

SEQ ID NO: 170907 - protein, 14 aa, Mycobacterium tuberculosis
GTHEFYQARAAMTQ

SEQ ID NO: 170908 - protein, 14 aa, Mycobacterium tuberculosis
THEFYQARAAMTQW

SEQ ID NO: 170909 - protein, 14 aa, Mycobacterium tuberculosis
HEFYQARAAMTQWL

SEQ ID NO: 170910 - protein, 14 aa, Mycobacterium tuberculosis
EFYQARAAMTQWLI

SEQ ID NO: 170911 - protein, 14 aa, Mycobacterium tuberculosis
FYQARAAMTQWLIE

SEQ ID NO: 170912 - protein, 14 aa, Mycobacterium tuberculosis
YQARAAMTQWLIEE

SEQ ID NO: 170913 - protein, 14 aa, Mycobacterium tuberculosis
QARAAMTQWLIEEK

SEQ ID NO: 170914 - protein, 14 aa, Mycobacterium tuberculosis
ARAAMTQWLIEEKG

SEQ ID NO: 170915 - protein, 14 aa, Mycobacterium tuberculosis
RAAMTQWLIEEKGF

SEQ ID NO: 170916 - protein, 14 aa, Mycobacterium tuberculosis
AAMTQWLIEEKGFG

SEQ ID NO: 170917 - protein, 14 aa, Mycobacterium tuberculosis
AMTQWLIEEKGFGA

SEQ ID NO: 170918 - protein, 14 aa, Mycobacterium tuberculosis
MTQWLIEEKGFGAV

SEQ ID NO: 170919 - protein, 14 aa, Mycobacterium tuberculosis
TQWLIEEKGFGAVA

SEQ ID NO: 170920 - protein, 14 aa, Mycobacterium tuberculosis
QWLIEEKGFGAVAA

SEQ ID NO: 170921 - protein, 14 aa, Mycobacterium tuberculosis
WLIEEKGFGAVAAE

SEQ ID NO: 170922 - protein, 14 aa, Mycobacterium tuberculosis
LIEEKGFGAVAAEA

SEQ ID NO: 170923 - protein, 14 aa, Mycobacterium tuberculosis
IEEKGFGAVAAEAD

SEQ ID NO: 170924 - protein, 14 aa, Mycobacterium tuberculosis
EEKGFGAVAAEADW

SEQ ID NO: 170925 - protein, 14 aa, Mycobacterium tuberculosis
EKGFGAVAAEADWP

SEQ ID NO: 170926 - protein, 14 aa, Mycobacterium tuberculosis
KGFGAVAAEADWPD

SEQ ID NO: 170927 - protein, 14 aa, Mycobacterium tuberculosis
GFGAVAAEADWPDA

SEQ ID NO: 170928 - protein, 14 aa, Mycobacterium tuberculosis
FGAVAAEADWPDAY

SEQ ID NO: 170929 - protein, 14 aa, Mycobacterium tuberculosis
GAVAAEADWPDAYR

SEQ ID NO: 170930 - protein, 14 aa, Mycobacterium tuberculosis
AVAAEADWPDAYRV

SEQ ID NO: 170931 - protein, 14 aa, Mycobacterium tuberculosis
VAAEADWPDAYRVN

SEQ ID NO: 170932 - protein, 14 aa, Mycobacterium tuberculosis
AAEADWPDAYRVNR

SEQ ID NO: 170933 - protein, 14 aa, Mycobacterium tuberculosis
AEADWPDAYRVNRY

SEQ ID NO: 170934 - protein, 14 aa, Mycobacterium tuberculosis
EADWPDAYRVNRYV

SEQ ID NO: 170935 - protein, 14 aa, Mycobacterium tuberculosis
ADWPDAYRVNRYVR

SEQ ID NO: 170936 - protein, 14 aa, Mycobacterium tuberculosis
DWPDAYRVNRYVRG

SEQ ID NO: 170937 - protein, 14 aa, Mycobacterium tuberculosis
WPDAYRVNRYVRGL

SEQ ID NO: 170938 - protein, 14 aa, Mycobacterium tuberculosis
PDAYRVNRYVRGLG

SEQ ID NO: 170939 - protein, 14 aa, Mycobacterium tuberculosis
DAYRVNRYVRGLGE

SEQ ID NO: 170940 - protein, 14 aa, Mycobacterium tuberculosis
AYRVNRYVRGLGED

SEQ ID NO: 170941 - protein, 14 aa, Mycobacterium tuberculosis
YRVNRYVRGLGEDT

SEQ ID NO: 170942 - protein, 14 aa, Mycobacterium tuberculosis
RVNRYVRGLGEDTN

SEQ ID NO: 170943 - protein, 14 aa, Mycobacterium tuberculosis
VNRYVRGLGEDTNA

SEQ ID NO: 170944 - protein, 14 aa, Mycobacterium tuberculosis
NRYVRGLGEDTNAD

SEQ ID NO: 170945 - protein, 14 aa, Mycobacterium tuberculosis
RYVRGLGEDTNADE

SEQ ID NO: 170946 - protein, 14 aa, Mycobacterium tuberculosis
YVRGLGEDTNADEA

SEQ ID NO: 170947 - protein, 14 aa, Mycobacterium tuberculosis
VRGLGEDTNADEAL

SEQ ID NO: 170948 - protein, 14 aa, Mycobacterium tuberculosis
RGLGEDTNADEALS

SEQ ID NO: 170949 - protein, 14 aa, Mycobacterium tuberculosis
GLGEDTNADEALSG

SEQ ID NO: 170950 - protein, 14 aa, Mycobacterium tuberculosis
LGEDTNADEALSGF

SEQ ID NO: 170951 - protein, 14 aa, Mycobacterium tuberculosis
GEDTNADEALSGFE

SEQ ID NO: 170952 - protein, 14 aa, Mycobacterium tuberculosis
EDTNADEALSGFER

SEQ ID NO: 170953 - protein, 14 aa, Mycobacterium tuberculosis
DTNADEALSGFERF

SEQ ID NO: 170954 - protein, 14 aa, Mycobacterium tuberculosis
TNADEALSGFERFP

SEQ ID NO: 170955 - protein, 14 aa, Mycobacterium tuberculosis
NADEALSGFERFPA

SEQ ID NO: 170956 - protein, 14 aa, Mycobacterium tuberculosis
ADEALSGFERFPAW

SEQ ID NO: 170957 - protein, 14 aa, Mycobacterium tuberculosis
DEALSGFERFPAWM

SEQ ID NO: 170958 - protein, 14 aa, Mycobacterium tuberculosis
EALSGFERFPAWMW

SEQ ID NO: 170959 - protein, 14 aa, Mycobacterium tuberculosis
ALSGFERFPAWMWR

SEQ ID NO: 170960 - protein, 14 aa, Mycobacterium tuberculosis
LSGFERFPAWMWRN

SEQ ID NO: 170961 - protein, 14 aa, Mycobacterium tuberculosis
SGFERFPAWMWRNT

SEQ ID NO: 170962 - protein, 14 aa, Mycobacterium tuberculosis
GFERFPAWMWRNTV

SEQ ID NO: 170963 - protein, 14 aa, Mycobacterium tuberculosis
FERFPAWMWRNTVV

SEQ ID NO: 170964 - protein, 14 aa, Mycobacterium tuberculosis
ERFPAWMWRNTVVR

SEQ ID NO: 170965 - protein, 14 aa, Mycobacterium tuberculosis
RFPAWMWRNTVVRD

SEQ ID NO: 170966 - protein, 14 aa, Mycobacterium tuberculosis
FPAWMWRNTVVRDF

SEQ ID NO: 170967 - protein, 14 aa, Mycobacterium tuberculosis
PAWMWRNTVVRDFV

SEQ ID NO: 170968 - protein, 14 aa, Mycobacterium tuberculosis
AWMWRNTVVRDFVE

SEQ ID NO: 170969 - protein, 14 aa, Mycobacterium tuberculosis
WMWRNTVVRDFVEW

SEQ ID NO: 170970 - protein, 14 aa, Mycobacterium tuberculosis
MWRNTVVRDFVEWL

SEQ ID NO: 170971 - protein, 14 aa, Mycobacterium tuberculosis
WRNTVVRDFVEWLR

SEQ ID NO: 170972 - protein, 14 aa, Mycobacterium tuberculosis
RNTVVRDFVEWLRT

SEQ ID NO: 170973 - protein, 14 aa, Mycobacterium tuberculosis
NTVVRDFVEWLRTR

SEQ ID NO: 170974 - protein, 14 aa, Mycobacterium tuberculosis
TVVRDFVEWLRTRN

SEQ ID NO: 170975 - protein, 14 aa, Mycobacterium tuberculosis
VVRDFVEWLRTRNQ

SEQ ID NO: 170976 - protein, 14 aa, Mycobacterium tuberculosis
VRDFVEWLRTRNQR

SEQ ID NO: 170977 - protein, 14 aa, Mycobacterium tuberculosis
RDFVEWLRTRNQRY

SEQ ID NO: 170978 - protein, 14 aa, Mycobacterium tuberculosis
DFVEWLRTRNQRYE

SEQ ID NO: 170979 - protein, 14 aa, Mycobacterium tuberculosis
FVEWLRTRNQRYES

SEQ ID NO: 170980 - protein, 14 aa, Mycobacterium tuberculosis
VEWLRTRNQRYESG

SEQ ID NO: 170981 - protein, 14 aa, Mycobacterium tuberculosis
EWLRTRNQRYESGA

SEQ ID NO: 170982 - protein, 14 aa, Mycobacterium tuberculosis
WLRTRNQRYESGAL

SEQ ID NO: 170983 - protein, 14 aa, Mycobacterium tuberculosis
LRTRNQRYESGALR

SEQ ID NO: 170984 - protein, 14 aa, Mycobacterium tuberculosis
RTRNQRYESGALRQ

SEQ ID NO: 170985 - protein, 14 aa, Mycobacterium tuberculosis
TRNQRYESGALRQA

SEQ ID NO: 170986 - protein, 14 aa, Mycobacterium tuberculosis
RNQRYESGALRQAG

SEQ ID NO: 170987 - protein, 14 aa, Mycobacterium tuberculosis
NQRYESGALRQAGF

SEQ ID NO: 170988 - protein, 14 aa, Mycobacterium tuberculosis
QRYESGALRQAGFY

SEQ ID NO: 170989 - protein, 14 aa, Mycobacterium tuberculosis
RYESGALRQAGFYG

SEQ ID NO: 170990 - protein, 14 aa, Mycobacterium tuberculosis
YESGALRQAGFYGL

SEQ ID NO: 170991 - protein, 14 aa, Mycobacterium tuberculosis
ESGALRQAGFYGLD

SEQ ID NO: 170992 - protein, 14 aa, Mycobacterium tuberculosis
SGALRQAGFYGLDL

SEQ ID NO: 170993 - protein, 14 aa, Mycobacterium tuberculosis
GALRQAGFYGLDLY

SEQ ID NO: 170994 - protein, 14 aa, Mycobacterium tuberculosis
ALRQAGFYGLDLYS

SEQ ID NO: 170995 - protein, 14 aa, Mycobacterium tuberculosis
LRQAGFYGLDLYSL

SEQ ID NO: 170996 - protein, 14 aa, Mycobacterium tuberculosis
RQAGFYGLDLYSLH

SEQ ID NO: 170997 - protein, 14 aa, Mycobacterium tuberculosis
QAGFYGLDLYSLHR

SEQ ID NO: 170998 - protein, 14 aa, Mycobacterium tuberculosis
AGFYGLDLYSLHRS

SEQ ID NO: 170999 - protein, 14 aa, Mycobacterium tuberculosis
GFYGLDLYSLHRSI

SEQ ID NO: 171000 - protein, 14 aa, Mycobacterium tuberculosis
FYGLDLYSLHRSIQ

SEQ ID NO: 171001 - protein, 14 aa, Mycobacterium tuberculosis
YGLDLYSLHRSIQE

SEQ ID NO: 171002 - protein, 14 aa, Mycobacterium tuberculosis
GLDLYSLHRSIQEV

SEQ ID NO: 171003 - protein, 14 aa, Mycobacterium tuberculosis
LDLYSLHRSIQEVI

SEQ ID NO: 171004 - protein, 14 aa, Mycobacterium tuberculosis
DLYSLHRSIQEVIS

SEQ ID NO: 171005 - protein, 14 aa, Mycobacterium tuberculosis
LYSLHRSIQEVISY

SEQ ID NO: 171006 - protein, 14 aa, Mycobacterium tuberculosis
YSLHRSIQEVISYL

SEQ ID NO: 171007 - protein, 14 aa, Mycobacterium tuberculosis
SLHRSIQEVISYLD

SEQ ID NO: 171008 - protein, 14 aa, Mycobacterium tuberculosis
LHRSIQEVISYLDK

SEQ ID NO: 171009 - protein, 14 aa, Mycobacterium tuberculosis
HRSIQEVISYLDKV

SEQ ID NO: 171010 - protein, 14 aa, Mycobacterium tuberculosis
RSIQEVISYLDKVD

SEQ ID NO: 171011 - protein, 14 aa, Mycobacterium tuberculosis
SIQEVISYLDKVDP

SEQ ID NO: 171012 - protein, 14 aa, Mycobacterium tuberculosis
IQEVISYLDKVDPR

SEQ ID NO: 171013 - protein, 14 aa, Mycobacterium tuberculosis
QEVISYLDKVDPRA

SEQ ID NO: 171014 - protein, 14 aa, Mycobacterium tuberculosis
EVISYLDKVDPRAA

SEQ ID NO: 171015 - protein, 14 aa, Mycobacterium tuberculosis
VISYLDKVDPRAAA

SEQ ID NO: 171016 - protein, 14 aa, Mycobacterium tuberculosis
ISYLDKVDPRAAAR

SEQ ID NO: 171017 - protein, 14 aa, Mycobacterium tuberculosis
SYLDKVDPRAAARA

SEQ ID NO: 171018 - protein, 14 aa, Mycobacterium tuberculosis
YLDKVDPRAAARAR

SEQ ID NO: 171019 - protein, 14 aa, Mycobacterium tuberculosis
LDKVDPRAAARARA

SEQ ID NO: 171020 - protein, 14 aa, Mycobacterium tuberculosis
DKVDPRAAARARAR

SEQ ID NO: 171021 - protein, 14 aa, Mycobacterium tuberculosis
KVDPRAAARARARY

SEQ ID NO: 171022 - protein, 14 aa, Mycobacterium tuberculosis
VDPRAAARARARYA

SEQ ID NO: 171023 - protein, 14 aa, Mycobacterium tuberculosis
DPRAAARARARYAC

SEQ ID NO: 171024 - protein, 14 aa, Mycobacterium tuberculosis
PRAAARARARYACF

SEQ ID NO: 171025 - protein, 14 aa, Mycobacterium tuberculosis
RAAARARARYACFD

SEQ ID NO: 171026 - protein, 14 aa, Mycobacterium tuberculosis
AAARARARYACFDH

SEQ ID NO: 171027 - protein, 14 aa, Mycobacterium tuberculosis
AARARARYACFDHA

SEQ ID NO: 171028 - protein, 14 aa, Mycobacterium tuberculosis
ARARARYACFDHAC

SEQ ID NO: 171029 - protein, 14 aa, Mycobacterium tuberculosis
RARARYACFDHACA

SEQ ID NO: 171030 - protein, 14 aa, Mycobacterium tuberculosis
ARARYACFDHACAD

SEQ ID NO: 171031 - protein, 14 aa, Mycobacterium tuberculosis
RARYACFDHACADD

SEQ ID NO: 171032 - protein, 14 aa, Mycobacterium tuberculosis
ARYACFDHACADDG

SEQ ID NO: 171033 - protein, 14 aa, Mycobacterium tuberculosis
RYACFDHACADDGQ

SEQ ID NO: 171034 - protein, 14 aa, Mycobacterium tuberculosis
YACFDHACADDGQA

SEQ ID NO: 171035 - protein, 14 aa, Mycobacterium tuberculosis
ACFDHACADDGQAY

SEQ ID NO: 171036 - protein, 14 aa, Mycobacterium tuberculosis
CFDHACADDGQAYG

SEQ ID NO: 171037 - protein, 14 aa, Mycobacterium tuberculosis
FDHACADDGQAYGF

SEQ ID NO: 171038 - protein, 14 aa, Mycobacterium tuberculosis
DHACADDGQAYGFA

SEQ ID NO: 171039 - protein, 14 aa, Mycobacterium tuberculosis
HACADDGQAYGFAA

SEQ ID NO: 171040 - protein, 14 aa, Mycobacterium tuberculosis
ACADDGQAYGFAAA

SEQ ID NO: 171041 - protein, 14 aa, Mycobacterium tuberculosis
CADDGQAYGFAAAF

SEQ ID NO: 171042 - protein, 14 aa, Mycobacterium tuberculosis
ADDGQAYGFAAAFG

SEQ ID NO: 171043 - protein, 14 aa, Mycobacterium tuberculosis
DDGQAYGFAAAFGA

SEQ ID NO: 171044 - protein, 14 aa, Mycobacterium tuberculosis
DGQAYGFAAAFGAG

SEQ ID NO: 171045 - protein, 14 aa, Mycobacterium tuberculosis
GQAYGFAAAFGAGP

SEQ ID NO: 171046 - protein, 14 aa, Mycobacterium tuberculosis
QAYGFAAAFGAGPS

SEQ ID NO: 171047 - protein, 14 aa, Mycobacterium tuberculosis
AYGFAAAFGAGPSC

SEQ ID NO: 171048 - protein, 14 aa, Mycobacterium tuberculosis
YGFAAAFGAGPSCE

SEQ ID NO: 171049 - protein, 14 aa, Mycobacterium tuberculosis
GFAAAFGAGPSCER

SEQ ID NO: 171050 - protein, 14 aa, Mycobacterium tuberculosis
FAAAFGAGPSCERE

SEQ ID NO: 171051 - protein, 14 aa, Mycobacterium tuberculosis
AAAFGAGPSCEREA

SEQ ID NO: 171052 - protein, 14 aa, Mycobacterium tuberculosis
AAFGAGPSCEREAV

SEQ ID NO: 171053 - protein, 14 aa, Mycobacterium tuberculosis
AFGAGPSCEREAVE

SEQ ID NO: 171054 - protein, 14 aa, Mycobacterium tuberculosis
FGAGPSCEREAVEQ

SEQ ID NO: 171055 - protein, 14 aa, Mycobacterium tuberculosis
GAGPSCEREAVEQL

SEQ ID NO: 171056 - protein, 14 aa, Mycobacterium tuberculosis
AGPSCEREAVEQLV

SEQ ID NO: 171057 - protein, 14 aa, Mycobacterium tuberculosis
GPSCEREAVEQLVD

SEQ ID NO: 171058 - protein, 14 aa, Mycobacterium tuberculosis
PSCEREAVEQLVDV

SEQ ID NO: 171059 - protein, 14 aa, Mycobacterium tuberculosis
SCEREAVEQLVDVQ

SEQ ID NO: 171060 - protein, 14 aa, Mycobacterium tuberculosis
CEREAVEQLVDVQR

SEQ ID NO: 171061 - protein, 14 aa, Mycobacterium tuberculosis
EREAVEQLVDVQRN

SEQ ID NO: 171062 - protein, 14 aa, Mycobacterium tuberculosis
REAVEQLVDVQRNA

SEQ ID NO: 171063 - protein, 14 aa, Mycobacterium tuberculosis
EAVEQLVDVQRNAL

SEQ ID NO: 171064 - protein, 14 aa, Mycobacterium tuberculosis
AVEQLVDVQRNALA

SEQ ID NO: 171065 - protein, 14 aa, Mycobacterium tuberculosis
VEQLVDVQRNALAY

SEQ ID NO: 171066 - protein, 14 aa, Mycobacterium tuberculosis
EQLVDVQRNALAYA

SEQ ID NO: 171067 - protein, 14 aa, Mycobacterium tuberculosis
QLVDVQRNALAYAR

SEQ ID NO: 171068 - protein, 14 aa, Mycobacterium tuberculosis
LVDVQRNALAYARQ

SEQ ID NO: 171069 - protein, 14 aa, Mycobacterium tuberculosis
VDVQRNALAYARQD

SEQ ID NO: 171070 - protein, 14 aa, Mycobacterium tuberculosis
DVQRNALAYARQDG

SEQ ID NO: 171071 - protein, 14 aa, Mycobacterium tuberculosis
VQRNALAYARQDGL

SEQ ID NO: 171072 - protein, 14 aa, Mycobacterium tuberculosis
QRNALAYARQDGLL

SEQ ID NO: 171073 - protein, 14 aa, Mycobacterium tuberculosis
RNALAYARQDGLLA

SEQ ID NO: 171074 - protein, 14 aa, Mycobacterium tuberculosis
NALAYARQDGLLAE

SEQ ID NO: 171075 - protein, 14 aa, Mycobacterium tuberculosis
ALAYARQDGLLAED

SEQ ID NO: 171076 - protein, 14 aa, Mycobacterium tuberculosis
LAYARQDGLLAEDE

SEQ ID NO: 171077 - protein, 14 aa, Mycobacterium tuberculosis
AYARQDGLLAEDEL

SEQ ID NO: 171078 - protein, 14 aa, Mycobacterium tuberculosis
YARQDGLLAEDELF

SEQ ID NO: 171079 - protein, 14 aa, Mycobacterium tuberculosis
ARQDGLLAEDELFY

SEQ ID NO: 171080 - protein, 14 aa, Mycobacterium tuberculosis
RQDGLLAEDELFYA

SEQ ID NO: 171081 - protein, 14 aa, Mycobacterium tuberculosis
QDGLLAEDELFYAQ

SEQ ID NO: 171082 - protein, 14 aa, Mycobacterium tuberculosis
DGLLAEDELFYAQQ

SEQ ID NO: 171083 - protein, 14 aa, Mycobacterium tuberculosis
GLLAEDELFYAQQN

SEQ ID NO: 171084 - protein, 14 aa, Mycobacterium tuberculosis
LLAEDELFYAQQNA

SEQ ID NO: 171085 - protein, 14 aa, Mycobacterium tuberculosis
LAEDELFYAQQNAQ

SEQ ID NO: 171086 - protein, 14 aa, Mycobacterium tuberculosis
AEDELFYAQQNAQT

SEQ ID NO: 171087 - protein, 14 aa, Mycobacterium tuberculosis
EDELFYAQQNAQTV

SEQ ID NO: 171088 - protein, 14 aa, Mycobacterium tuberculosis
DELFYAQQNAQTVR

SEQ ID NO: 171089 - protein, 14 aa, Mycobacterium tuberculosis
ELFYAQQNAQTVRD

SEQ ID NO: 171090 - protein, 14 aa, Mycobacterium tuberculosis
LFYAQQNAQTVRDA

SEQ ID NO: 171091 - protein, 14 aa, Mycobacterium tuberculosis
FYAQQNAQTVRDAE

SEQ ID NO: 171092 - protein, 14 aa, Mycobacterium tuberculosis
YAQQNAQTVRDAEV

SEQ ID NO: 171093 - protein, 14 aa, Mycobacterium tuberculosis
AQQNAQTVRDAEVY

SEQ ID NO: 171094 - protein, 14 aa, Mycobacterium tuberculosis
QQNAQTVRDAEVYY

SEQ ID NO: 171095 - protein, 14 aa, Mycobacterium tuberculosis
QNAQTVRDAEVYYR

SEQ ID NO: 171096 - protein, 14 aa, Mycobacterium tuberculosis
NAQTVRDAEVYYRA

SEQ ID NO: 171097 - protein, 14 aa, Mycobacterium tuberculosis
AQTVRDAEVYYRAM

SEQ ID NO: 171098 - protein, 14 aa, Mycobacterium tuberculosis
QTVRDAEVYYRAMF

SEQ ID NO: 171099 - protein, 14 aa, Mycobacterium tuberculosis
TVRDAEVYYRAMFS

SEQ ID NO: 171100 - protein, 14 aa, Mycobacterium tuberculosis
VRDAEVYYRAMFSG

SEQ ID NO: 171101 - protein, 14 aa, Mycobacterium tuberculosis
RDAEVYYRAMFSGR

SEQ ID NO: 171102 - protein, 14 aa, Mycobacterium tuberculosis
DAEVYYRAMFSGRV

SEQ ID NO: 171103 - protein, 14 aa, Mycobacterium tuberculosis
AEVYYRAMFSGRVT

SEQ ID NO: 171104 - protein, 14 aa, Mycobacterium tuberculosis
EVYYRAMFSGRVTS

SEQ ID NO: 171105 - protein, 14 aa, Mycobacterium tuberculosis
VYYRAMFSGRVTSW

SEQ ID NO: 171106 - protein, 14 aa, Mycobacterium tuberculosis
YYRAMFSGRVTSWN

SEQ ID NO: 171107 - protein, 14 aa, Mycobacterium tuberculosis
YRAMFSGRVTSWNL

SEQ ID NO: 171108 - protein, 14 aa, Mycobacterium tuberculosis
RAMFSGRVTSWNLR

SEQ ID NO: 171109 - protein, 14 aa, Mycobacterium tuberculosis
AMFSGRVTSWNLRD

SEQ ID NO: 171110 - protein, 14 aa, Mycobacterium tuberculosis
MFSGRVTSWNLRDQ

SEQ ID NO: 171111 - protein, 14 aa, Mycobacterium tuberculosis
FSGRVTSWNLRDQH

SEQ ID NO: 171112 - protein, 14 aa, Mycobacterium tuberculosis
SGRVTSWNLRDQHM

SEQ ID NO: 171113 - protein, 14 aa, Mycobacterium tuberculosis
GRVTSWNLRDQHMA

SEQ ID NO: 171114 - protein, 14 aa, Mycobacterium tuberculosis
RVTSWNLRDQHMAQ

SEQ ID NO: 171115 - protein, 14 aa, Mycobacterium tuberculosis
VTSWNLRDQHMAQT

SEQ ID NO: 171116 - protein, 14 aa, Mycobacterium tuberculosis
TSWNLRDQHMAQTL

SEQ ID NO: 171117 - protein, 14 aa, Mycobacterium tuberculosis
SWNLRDQHMAQTLG

SEQ ID NO: 171118 - protein, 14 aa, Mycobacterium tuberculosis
WNLRDQHMAQTLGS

SEQ ID NO: 171119 - protein, 14 aa, Mycobacterium tuberculosis
NLRDQHMAQTLGSL

SEQ ID NO: 171120 - protein, 14 aa, Mycobacterium tuberculosis
LRDQHMAQTLGSLL

SEQ ID NO: 171121 - protein, 14 aa, Mycobacterium tuberculosis
RDQHMAQTLGSLLT

SEQ ID NO: 171122 - protein, 14 aa, Mycobacterium tuberculosis
DQHMAQTLGSLLTH

SEQ ID NO: 171123 - protein, 14 aa, Mycobacterium tuberculosis
QHMAQTLGSLLTHL

SEQ ID NO: 171124 - protein, 14 aa, Mycobacterium tuberculosis
HMAQTLGSLLTHLD

SEQ ID NO: 171125 - protein, 14 aa, Mycobacterium tuberculosis
MAQTLGSLLTHLDR

SEQ ID NO: 171126 - protein, 14 aa, Mycobacterium tuberculosis
AQTLGSLLTHLDRH

SEQ ID NO: 171127 - protein, 14 aa, Mycobacterium tuberculosis
QTLGSLLTHLDRHL

SEQ ID NO: 171128 - protein, 14 aa, Mycobacterium tuberculosis
TLGSLLTHLDRHLD

SEQ ID NO: 171129 - protein, 14 aa, Mycobacterium tuberculosis
LGSLLTHLDRHLDA

SEQ ID NO: 171130 - protein, 14 aa, Mycobacterium tuberculosis
GSLLTHLDRHLDAP

SEQ ID NO: 171131 - protein, 14 aa, Mycobacterium tuberculosis
SLLTHLDRHLDAPP

SEQ ID NO: 171132 - protein, 14 aa, Mycobacterium tuberculosis
LLTHLDRHLDAPPA

SEQ ID NO: 171133 - protein, 14 aa, Mycobacterium tuberculosis
LTHLDRHLDAPPAR

SEQ ID NO: 171134 - protein, 14 aa, Mycobacterium tuberculosis
THLDRHLDAPPARI

SEQ ID NO: 171135 - protein, 14 aa, Mycobacterium tuberculosis
HLDRHLDAPPARIV

SEQ ID NO: 171136 - protein, 14 aa, Mycobacterium tuberculosis
LDRHLDAPPARIVV

SEQ ID NO: 171137 - protein, 14 aa, Mycobacterium tuberculosis
DRHLDAPPARIVVW

SEQ ID NO: 171138 - protein, 14 aa, Mycobacterium tuberculosis
RHLDAPPARIVVWA

SEQ ID NO: 171139 - protein, 14 aa, Mycobacterium tuberculosis
HLDAPPARIVVWAH

SEQ ID NO: 171140 - protein, 14 aa, Mycobacterium tuberculosis
LDAPPARIVVWAHN

SEQ ID NO: 171141 - protein, 14 aa, Mycobacterium tuberculosis
DAPPARIVVWAHNS

SEQ ID NO: 171142 - protein, 14 aa, Mycobacterium tuberculosis
APPARIVVWAHNSH

SEQ ID NO: 171143 - protein, 14 aa, Mycobacterium tuberculosis
PPARIVVWAHNSHV

SEQ ID NO: 171144 - protein, 14 aa, Mycobacterium tuberculosis
PARIVVWAHNSHVG

SEQ ID NO: 171145 - protein, 14 aa, Mycobacterium tuberculosis
ARIVVWAHNSHVGD

SEQ ID NO: 171146 - protein, 14 aa, Mycobacterium tuberculosis
RIVVWAHNSHVGDA

SEQ ID NO: 171147 - protein, 14 aa, Mycobacterium tuberculosis
IVVWAHNSHVGDAR

SEQ ID NO: 171148 - protein, 14 aa, Mycobacterium tuberculosis
VVWAHNSHVGDARA

SEQ ID NO: 171149 - protein, 14 aa, Mycobacterium tuberculosis
VWAHNSHVGDARAT

SEQ ID NO: 171150 - protein, 14 aa, Mycobacterium tuberculosis
WAHNSHVGDARATE

SEQ ID NO: 171151 - protein, 14 aa, Mycobacterium tuberculosis
AHNSHVGDARATEV

SEQ ID NO: 171152 - protein, 14 aa, Mycobacterium tuberculosis
HNSHVGDARATEVW

SEQ ID NO: 171153 - protein, 14 aa, Mycobacterium tuberculosis
NSHVGDARATEVWA

SEQ ID NO: 171154 - protein, 14 aa, Mycobacterium tuberculosis
SHVGDARATEVWAD

SEQ ID NO: 171155 - protein, 14 aa, Mycobacterium tuberculosis
HVGDARATEVWADG

SEQ ID NO: 171156 - protein, 14 aa, Mycobacterium tuberculosis
VGDARATEVWADGQ

SEQ ID NO: 171157 - protein, 14 aa, Mycobacterium tuberculosis
GDARATEVWADGQL

SEQ ID NO: 171158 - protein, 14 aa, Mycobacterium tuberculosis
DARATEVWADGQLT

SEQ ID NO: 171159 - protein, 14 aa, Mycobacterium tuberculosis
ARATEVWADGQLTL

SEQ ID NO: 171160 - protein, 14 aa, Mycobacterium tuberculosis
RATEVWADGQLTLG

SEQ ID NO: 171161 - protein, 14 aa, Mycobacterium tuberculosis
ATEVWADGQLTLGQ

SEQ ID NO: 171162 - protein, 14 aa, Mycobacterium tuberculosis
TEVWADGQLTLGQI

SEQ ID NO: 171163 - protein, 14 aa, Mycobacterium tuberculosis
EVWADGQLTLGQIV

SEQ ID NO: 171164 - protein, 14 aa, Mycobacterium tuberculosis
VWADGQLTLGQIVR

SEQ ID NO: 171165 - protein, 14 aa, Mycobacterium tuberculosis
WADGQLTLGQIVRE

SEQ ID NO: 171166 - protein, 14 aa, Mycobacterium tuberculosis
ADGQLTLGQIVRER

SEQ ID NO: 171167 - protein, 14 aa, Mycobacterium tuberculosis
DGQLTLGQIVRERY

SEQ ID NO: 171168 - protein, 14 aa, Mycobacterium tuberculosis
GQLTLGQIVRERYG

SEQ ID NO: 171169 - protein, 14 aa, Mycobacterium tuberculosis
QLTLGQIVRERYGD

SEQ ID NO: 171170 - protein, 14 aa, Mycobacterium tuberculosis
LTLGQIVRERYGDE

SEQ ID NO: 171171 - protein, 14 aa, Mycobacterium tuberculosis
TLGQIVRERYGDES

SEQ ID NO: 171172 - protein, 14 aa, Mycobacterium tuberculosis
LGQIVRERYGDESR

SEQ ID NO: 171173 - protein, 14 aa, Mycobacterium tuberculosis
GQIVRERYGDESRS

SEQ ID NO: 171174 - protein, 14 aa, Mycobacterium tuberculosis
QIVRERYGDESRSI

SEQ ID NO: 171175 - protein, 14 aa, Mycobacterium tuberculosis
IVRERYGDESRSIG

SEQ ID NO: 171176 - protein, 14 aa, Mycobacterium tuberculosis
VRERYGDESRSIGF

SEQ ID NO: 171177 - protein, 14 aa, Mycobacterium tuberculosis
RERYGDESRSIGFS

SEQ ID NO: 171178 - protein, 14 aa, Mycobacterium tuberculosis
ERYGDESRSIGFST

SEQ ID NO: 171179 - protein, 14 aa, Mycobacterium tuberculosis
RYGDESRSIGFSTY

SEQ ID NO: 171180 - protein, 14 aa, Mycobacterium tuberculosis
YGDESRSIGFSTYT

SEQ ID NO: 171181 - protein, 14 aa, Mycobacterium tuberculosis
GDESRSIGFSTYTG

SEQ ID NO: 171182 - protein, 14 aa, Mycobacterium tuberculosis
DESRSIGFSTYTGT

SEQ ID NO: 171183 - protein, 14 aa, Mycobacterium tuberculosis
ESRSIGFSTYTGTV

SEQ ID NO: 171184 - protein, 14 aa, Mycobacterium tuberculosis
SRSIGFSTYTGTVT

SEQ ID NO: 171185 - protein, 14 aa, Mycobacterium tuberculosis
RSIGFSTYTGTVTA

SEQ ID NO: 171186 - protein, 14 aa, Mycobacterium tuberculosis
SIGFSTYTGTVTAA

SEQ ID NO: 171187 - protein, 14 aa, Mycobacterium tuberculosis
IGFSTYTGTVTAAS

SEQ ID NO: 171188 - protein, 14 aa, Mycobacterium tuberculosis
GFSTYTGTVTAASE

SEQ ID NO: 171189 - protein, 14 aa, Mycobacterium tuberculosis
FSTYTGTVTAASEW

SEQ ID NO: 171190 - protein, 14 aa, Mycobacterium tuberculosis
STYTGTVTAASEWG

SEQ ID NO: 171191 - protein, 14 aa, Mycobacterium tuberculosis
TYTGTVTAASEWGG

SEQ ID NO: 171192 - protein, 14 aa, Mycobacterium tuberculosis
YTGTVTAASEWGGI

SEQ ID NO: 171193 - protein, 14 aa, Mycobacterium tuberculosis
TGTVTAASEWGGIA

SEQ ID NO: 171194 - protein, 14 aa, Mycobacterium tuberculosis
GTVTAASEWGGIAQ

SEQ ID NO: 171195 - protein, 14 aa, Mycobacterium tuberculosis
TVTAASEWGGIAQR

SEQ ID NO: 171196 - protein, 14 aa, Mycobacterium tuberculosis
VTAASEWGGIAQRK

SEQ ID NO: 171197 - protein, 14 aa, Mycobacterium tuberculosis
TAASEWGGIAQRKA

SEQ ID NO: 171198 - protein, 14 aa, Mycobacterium tuberculosis
AASEWGGIAQRKAV

SEQ ID NO: 171199 - protein, 14 aa, Mycobacterium tuberculosis
ASEWGGIAQRKAVR

SEQ ID NO: 171200 - protein, 14 aa, Mycobacterium tuberculosis
SEWGGIAQRKAVRP

SEQ ID NO: 171201 - protein, 14 aa, Mycobacterium tuberculosis
EWGGIAQRKAVRPA

SEQ ID NO: 171202 - protein, 14 aa, Mycobacterium tuberculosis
WGGIAQRKAVRPAL

SEQ ID NO: 171203 - protein, 14 aa, Mycobacterium tuberculosis
GGIAQRKAVRPALH

SEQ ID NO: 171204 - protein, 14 aa, Mycobacterium tuberculosis
GIAQRKAVRPALHG

SEQ ID NO: 171205 - protein, 14 aa, Mycobacterium tuberculosis
IAQRKAVRPALHGS

SEQ ID NO: 171206 - protein, 14 aa, Mycobacterium tuberculosis
AQRKAVRPALHGSV

SEQ ID NO: 171207 - protein, 14 aa, Mycobacterium tuberculosis
QRKAVRPALHGSVE

SEQ ID NO: 171208 - protein, 14 aa, Mycobacterium tuberculosis
RKAVRPALHGSVEE

SEQ ID NO: 171209 - protein, 14 aa, Mycobacterium tuberculosis
KAVRPALHGSVEEL

SEQ ID NO: 171210 - protein, 14 aa, Mycobacterium tuberculosis
AVRPALHGSVEELF

SEQ ID NO: 171211 - protein, 14 aa, Mycobacterium tuberculosis
VRPALHGSVEELFH

SEQ ID NO: 171212 - protein, 14 aa, Mycobacterium tuberculosis
RPALHGSVEELFHQ

SEQ ID NO: 171213 - protein, 14 aa, Mycobacterium tuberculosis
PALHGSVEELFHQT

SEQ ID NO: 171214 - protein, 14 aa, Mycobacterium tuberculosis
ALHGSVEELFHQTA

SEQ ID NO: 171215 - protein, 14 aa, Mycobacterium tuberculosis
LHGSVEELFHQTAD

SEQ ID NO: 171216 - protein, 14 aa, Mycobacterium tuberculosis
HGSVEELFHQTADS

SEQ ID NO: 171217 - protein, 14 aa, Mycobacterium tuberculosis
GSVEELFHQTADSF

SEQ ID NO: 171218 - protein, 14 aa, Mycobacterium tuberculosis
SVEELFHQTADSFL

SEQ ID NO: 171219 - protein, 14 aa, Mycobacterium tuberculosis
VEELFHQTADSFLV

SEQ ID NO: 171220 - protein, 14 aa, Mycobacterium tuberculosis
EELFHQTADSFLVS

SEQ ID NO: 171221 - protein, 14 aa, Mycobacterium tuberculosis
ELFHQTADSFLVSA

SEQ ID NO: 171222 - protein, 14 aa, Mycobacterium tuberculosis
LFHQTADSFLVSAR

SEQ ID NO: 171223 - protein, 14 aa, Mycobacterium tuberculosis
FHQTADSFLVSARL

SEQ ID NO: 171224 - protein, 14 aa, Mycobacterium tuberculosis
HQTADSFLVSARLS

SEQ ID NO: 171225 - protein, 14 aa, Mycobacterium tuberculosis
QTADSFLVSARLSR

SEQ ID NO: 171226 - protein, 14 aa, Mycobacterium tuberculosis
TADSFLVSARLSRD

SEQ ID NO: 171227 - protein, 14 aa, Mycobacterium tuberculosis
ADSFLVSARLSRDA

SEQ ID NO: 171228 - protein, 14 aa, Mycobacterium tuberculosis
DSFLVSARLSRDAE

SEQ ID NO: 171229 - protein, 14 aa, Mycobacterium tuberculosis
SFLVSARLSRDAEA

SEQ ID NO: 171230 - protein, 14 aa, Mycobacterium tuberculosis
FLVSARLSRDAEAP

SEQ ID NO: 171231 - protein, 14 aa, Mycobacterium tuberculosis
LVSARLSRDAEAPL

SEQ ID NO: 171232 - protein, 14 aa, Mycobacterium tuberculosis
VSARLSRDAEAPLD

SEQ ID NO: 171233 - protein, 14 aa, Mycobacterium tuberculosis
SARLSRDAEAPLDV

SEQ ID NO: 171234 - protein, 14 aa, Mycobacterium tuberculosis
ARLSRDAEAPLDVV

SEQ ID NO: 171235 - protein, 14 aa, Mycobacterium tuberculosis
RLSRDAEAPLDVVR

SEQ ID NO: 171236 - protein, 14 aa, Mycobacterium tuberculosis
LSRDAEAPLDVVRL

SEQ ID NO: 171237 - protein, 14 aa, Mycobacterium tuberculosis
SRDAEAPLDVVRLG

SEQ ID NO: 171238 - protein, 14 aa, Mycobacterium tuberculosis
RDAEAPLDVVRLGR

SEQ ID NO: 171239 - protein, 14 aa, Mycobacterium tuberculosis
DAEAPLDVVRLGRA

SEQ ID NO: 171240 - protein, 14 aa, Mycobacterium tuberculosis
AEAPLDVVRLGRAI

SEQ ID NO: 171241 - protein, 14 aa, Mycobacterium tuberculosis
EAPLDVVRLGRAIG

SEQ ID NO: 171242 - protein, 14 aa, Mycobacterium tuberculosis
APLDVVRLGRAIGV

SEQ ID NO: 171243 - protein, 14 aa, Mycobacterium tuberculosis
PLDVVRLGRAIGVV

SEQ ID NO: 171244 - protein, 14 aa, Mycobacterium tuberculosis
LDVVRLGRAIGVVY

SEQ ID NO: 171245 - protein, 14 aa, Mycobacterium tuberculosis
DVVRLGRAIGVVYL

SEQ ID NO: 171246 - protein, 14 aa, Mycobacterium tuberculosis
VVRLGRAIGVVYLP

SEQ ID NO: 171247 - protein, 14 aa, Mycobacterium tuberculosis
VRLGRAIGVVYLPA

SEQ ID NO: 171248 - protein, 14 aa, Mycobacterium tuberculosis
RLGRAIGVVYLPAT

SEQ ID NO: 171249 - protein, 14 aa, Mycobacterium tuberculosis
LGRAIGVVYLPATE

SEQ ID NO: 171250 - protein, 14 aa, Mycobacterium tuberculosis
GRAIGVVYLPATER

SEQ ID NO: 171251 - protein, 14 aa, Mycobacterium tuberculosis
RAIGVVYLPATERQ

SEQ ID NO: 171252 - protein, 14 aa, Mycobacterium tuberculosis
AIGVVYLPATERQS

SEQ ID NO: 171253 - protein, 14 aa, Mycobacterium tuberculosis
IGVVYLPATERQSH

SEQ ID NO: 171254 - protein, 14 aa, Mycobacterium tuberculosis
GVVYLPATERQSHY

SEQ ID NO: 171255 - protein, 14 aa, Mycobacterium tuberculosis
VVYLPATERQSHYL

SEQ ID NO: 171256 - protein, 14 aa, Mycobacterium tuberculosis
VYLPATERQSHYLH

SEQ ID NO: 171257 - protein, 14 aa, Mycobacterium tuberculosis
YLPATERQSHYLHV

SEQ ID NO: 171258 - protein, 14 aa, Mycobacterium tuberculosis
LPATERQSHYLHVR

SEQ ID NO: 171259 - protein, 14 aa, Mycobacterium tuberculosis
PATERQSHYLHVRP

SEQ ID NO: 171260 - protein, 14 aa, Mycobacterium tuberculosis
ATERQSHYLHVRPA

SEQ ID NO: 171261 - protein, 14 aa, Mycobacterium tuberculosis
TERQSHYLHVRPAD

SEQ ID NO: 171262 - protein, 14 aa, Mycobacterium tuberculosis
ERQSHYLHVRPADQ

SEQ ID NO: 171263 - protein, 14 aa, Mycobacterium tuberculosis
RQSHYLHVRPADQF

SEQ ID NO: 171264 - protein, 14 aa, Mycobacterium tuberculosis
QSHYLHVRPADQFD

SEQ ID NO: 171265 - protein, 14 aa, Mycobacterium tuberculosis
SHYLHVRPADQFDA

SEQ ID NO: 171266 - protein, 14 aa, Mycobacterium tuberculosis
HYLHVRPADQFDAM

SEQ ID NO: 171267 - protein, 14 aa, Mycobacterium tuberculosis
YLHVRPADQFDAMI

SEQ ID NO: 171268 - protein, 14 aa, Mycobacterium tuberculosis
LHVRPADQFDAMIH

SEQ ID NO: 171269 - protein, 14 aa, Mycobacterium tuberculosis
HVRPADQFDAMIHI

SEQ ID NO: 171270 - protein, 14 aa, Mycobacterium tuberculosis
VRPADQFDAMIHID

SEQ ID NO: 171271 - protein, 14 aa, Mycobacterium tuberculosis
RPADQFDAMIHIDQ

SEQ ID NO: 171272 - protein, 14 aa, Mycobacterium tuberculosis
PADQFDAMIHIDQT

SEQ ID NO: 171273 - protein, 14 aa, Mycobacterium tuberculosis
ADQFDAMIHIDQTR

SEQ ID NO: 171274 - protein, 14 aa, Mycobacterium tuberculosis
DQFDAMIHIDQTRA

SEQ ID NO: 171275 - protein, 14 aa, Mycobacterium tuberculosis
QFDAMIHIDQTRAL

SEQ ID NO: 171276 - protein, 14 aa, Mycobacterium tuberculosis
FDAMIHIDQTRALE

SEQ ID NO: 171277 - protein, 14 aa, Mycobacterium tuberculosis
DAMIHIDQTRALEP

SEQ ID NO: 171278 - protein, 14 aa, Mycobacterium tuberculosis
AMIHIDQTRALEPL

SEQ ID NO: 171279 - protein, 14 aa, Mycobacterium tuberculosis
MIHIDQTRALEPLE

SEQ ID NO: 171280 - protein, 14 aa, Mycobacterium tuberculosis
IHIDQTRALEPLEV

SEQ ID NO: 171281 - protein, 14 aa, Mycobacterium tuberculosis
HIDQTRALEPLEVT

SEQ ID NO: 171282 - protein, 14 aa, Mycobacterium tuberculosis
IDQTRALEPLEVTS

SEQ ID NO: 171283 - protein, 14 aa, Mycobacterium tuberculosis
DQTRALEPLEVTSR

SEQ ID NO: 171284 - protein, 14 aa, Mycobacterium tuberculosis
QTRALEPLEVTSRW

SEQ ID NO: 171285 - protein, 14 aa, Mycobacterium tuberculosis
TRALEPLEVTSRWI

SEQ ID NO: 171286 - protein, 14 aa, Mycobacterium tuberculosis
RALEPLEVTSRWIA

SEQ ID NO: 171287 - protein, 14 aa, Mycobacterium tuberculosis
ALEPLEVTSRWIAG

SEQ ID NO: 171288 - protein, 14 aa, Mycobacterium tuberculosis
LEPLEVTSRWIAGE

SEQ ID NO: 171289 - protein, 14 aa, Mycobacterium tuberculosis
EPLEVTSRWIAGEN

SEQ ID NO: 171290 - protein, 14 aa, Mycobacterium tuberculosis
PLEVTSRWIAGENP

SEQ ID NO: 171291 - protein, 14 aa, Mycobacterium tuberculosis
LEVTSRWIAGENPE

SEQ ID NO: 171292 - protein, 14 aa, Mycobacterium tuberculosis
EVTSRWIAGENPET

SEQ ID NO: 171293 - protein, 14 aa, Mycobacterium tuberculosis
VTSRWIAGENPETY

SEQ ID NO: 171294 - protein, 14 aa, Mycobacterium tuberculosis
TSRWIAGENPETYP

SEQ ID NO: 171295 - protein, 14 aa, Mycobacterium tuberculosis
SRWIAGENPETYPT

SEQ ID NO: 171296 - protein, 14 aa, Mycobacterium tuberculosis
RWIAGENPETYPTG

SEQ ID NO: 171297 - protein, 14 aa, Mycobacterium tuberculosis
WIAGENPETYPTGL

SEQ ID NO: 171298 - protein, 15 aa, Mycobacterium tuberculosis
MLMTAAADVTRRSPR

SEQ ID NO: 171299 - protein, 15 aa, Mycobacterium tuberculosis
LMTAAADVTRRSPRR

SEQ ID NO: 171300 - protein, 15 aa, Mycobacterium tuberculosis
MTAAADVTRRSPRRV

SEQ ID NO: 171301 - protein, 15 aa, Mycobacterium tuberculosis
TAAADVTRRSPRRVF

SEQ ID NO: 171302 - protein, 15 aa, Mycobacterium tuberculosis
AAADVTRRSPRRVFR

SEQ ID NO: 171303 - protein, 15 aa, Mycobacterium tuberculosis
AADVTRRSPRRVFRD

SEQ ID NO: 171304 - protein, 15 aa, Mycobacterium tuberculosis
ADVTRRSPRRVFRDR

SEQ ID NO: 171305 - protein, 15 aa, Mycobacterium tuberculosis
DVTRRSPRRVFRDRR

SEQ ID NO: 171306 - protein, 15 aa, Mycobacterium tuberculosis
VTRRSPRRVFRDRRE

SEQ ID NO: 171307 - protein, 15 aa, Mycobacterium tuberculosis
TRRSPRRVFRDRREA

SEQ ID NO: 171308 - protein, 15 aa, Mycobacterium tuberculosis
RRSPRRVFRDRREAG

SEQ ID NO: 171309 - protein, 15 aa, Mycobacterium tuberculosis
RSPRRVFRDRREAGR

SEQ ID NO: 171310 - protein, 15 aa, Mycobacterium tuberculosis
SPRRVFRDRREAGRV

SEQ ID NO: 171311 - protein, 15 aa, Mycobacterium tuberculosis
PRRVFRDRREAGRVL

SEQ ID NO: 171312 - protein, 15 aa, Mycobacterium tuberculosis
RRVFRDRREAGRVLA

SEQ ID NO: 171313 - protein, 15 aa, Mycobacterium tuberculosis
RVFRDRREAGRVLAE

SEQ ID NO: 171314 - protein, 15 aa, Mycobacterium tuberculosis
VFRDRREAGRVLAEL

SEQ ID NO: 171315 - protein, 15 aa, Mycobacterium tuberculosis
FRDRREAGRVLAELL

SEQ ID NO: 171316 - protein, 15 aa, Mycobacterium tuberculosis
RDRREAGRVLAELLA

SEQ ID NO: 171317 - protein, 15 aa, Mycobacterium tuberculosis
DRREAGRVLAELLAA

SEQ ID NO: 171318 - protein, 15 aa, Mycobacterium tuberculosis
RREAGRVLAELLAAY

SEQ ID NO: 171319 - protein, 15 aa, Mycobacterium tuberculosis
REAGRVLAELLAAYR

SEQ ID NO: 171320 - protein, 15 aa, Mycobacterium tuberculosis
EAGRVLAELLAAYRD

SEQ ID NO: 171321 - protein, 15 aa, Mycobacterium tuberculosis
AGRVLAELLAAYRDQ

SEQ ID NO: 171322 - protein, 15 aa, Mycobacterium tuberculosis
GRVLAELLAAYRDQP

SEQ ID NO: 171323 - protein, 15 aa, Mycobacterium tuberculosis
RVLAELLAAYRDQPD

SEQ ID NO: 171324 - protein, 15 aa, Mycobacterium tuberculosis
VLAELLAAYRDQPDV

SEQ ID NO: 171325 - protein, 15 aa, Mycobacterium tuberculosis
LAELLAAYRDQPDVI

SEQ ID NO: 171326 - protein, 15 aa, Mycobacterium tuberculosis
AELLAAYRDQPDVIV

SEQ ID NO: 171327 - protein, 15 aa, Mycobacterium tuberculosis
ELLAAYRDQPDVIVL

SEQ ID NO: 171328 - protein, 15 aa, Mycobacterium tuberculosis
LLAAYRDQPDVIVLG

SEQ ID NO: 171329 - protein, 15 aa, Mycobacterium tuberculosis
LAAYRDQPDVIVLGL

SEQ ID NO: 171330 - protein, 15 aa, Mycobacterium tuberculosis
AAYRDQPDVIVLGLA

SEQ ID NO: 171331 - protein, 15 aa, Mycobacterium tuberculosis
AYRDQPDVIVLGLAR

SEQ ID NO: 171332 - protein, 15 aa, Mycobacterium tuberculosis
YRDQPDVIVLGLARG

SEQ ID NO: 171333 - protein, 15 aa, Mycobacterium tuberculosis
RDQPDVIVLGLARGG

SEQ ID NO: 171334 - protein, 15 aa, Mycobacterium tuberculosis
DQPDVIVLGLARGGL

SEQ ID NO: 171335 - protein, 15 aa, Mycobacterium tuberculosis
QPDVIVLGLARGGLP

SEQ ID NO: 171336 - protein, 15 aa, Mycobacterium tuberculosis
PDVIVLGLARGGLPV

SEQ ID NO: 171337 - protein, 15 aa, Mycobacterium tuberculosis
DVIVLGLARGGLPVA

SEQ ID NO: 171338 - protein, 15 aa, Mycobacterium tuberculosis
VIVLGLARGGLPVAW

SEQ ID NO: 171339 - protein, 15 aa, Mycobacterium tuberculosis
IVLGLARGGLPVAWE

SEQ ID NO: 171340 - protein, 15 aa, Mycobacterium tuberculosis
VLGLARGGLPVAWEV

SEQ ID NO: 171341 - protein, 15 aa, Mycobacterium tuberculosis
LGLARGGLPVAWEVA

SEQ ID NO: 171342 - protein, 15 aa, Mycobacterium tuberculosis
GLARGGLPVAWEVAA

SEQ ID NO: 171343 - protein, 15 aa, Mycobacterium tuberculosis
LARGGLPVAWEVAAA

SEQ ID NO: 171344 - protein, 15 aa, Mycobacterium tuberculosis
ARGGLPVAWEVAAAL

SEQ ID NO: 171345 - protein, 15 aa, Mycobacterium tuberculosis
RGGLPVAWEVAAALH

SEQ ID NO: 171346 - protein, 15 aa, Mycobacterium tuberculosis
GGLPVAWEVAAALHA

SEQ ID NO: 171347 - protein, 15 aa, Mycobacterium tuberculosis
GLPVAWEVAAALHAP

SEQ ID NO: 171348 - protein, 15 aa, Mycobacterium tuberculosis
LPVAWEVAAALHAPL

SEQ ID NO: 171349 - protein, 15 aa, Mycobacterium tuberculosis
PVAWEVAAALHAPLD

SEQ ID NO: 171350 - protein, 15 aa, Mycobacterium tuberculosis
VAWEVAAALHAPLDA

SEQ ID NO: 171351 - protein, 15 aa, Mycobacterium tuberculosis
AWEVAAALHAPLDAF

SEQ ID NO: 171352 - protein, 15 aa, Mycobacterium tuberculosis
WEVAAALHAPLDAFV

SEQ ID NO: 171353 - protein, 15 aa, Mycobacterium tuberculosis
EVAAALHAPLDAFVV

SEQ ID NO: 171354 - protein, 15 aa, Mycobacterium tuberculosis
VAAALHAPLDAFVVR

SEQ ID NO: 171355 - protein, 15 aa, Mycobacterium tuberculosis
AAALHAPLDAFVVRK

SEQ ID NO: 171356 - protein, 15 aa, Mycobacterium tuberculosis
AALHAPLDAFVVRKL

SEQ ID NO: 171357 - protein, 15 aa, Mycobacterium tuberculosis
ALHAPLDAFVVRKLG

SEQ ID NO: 171358 - protein, 15 aa, Mycobacterium tuberculosis
LHAPLDAFVVRKLGA

SEQ ID NO: 171359 - protein, 15 aa, Mycobacterium tuberculosis
HAPLDAFVVRKLGAP

SEQ ID NO: 171360 - protein, 15 aa, Mycobacterium tuberculosis
APLDAFVVRKLGAPG

SEQ ID NO: 171361 - protein, 15 aa, Mycobacterium tuberculosis
PLDAFVVRKLGAPGH

SEQ ID NO: 171362 - protein, 15 aa, Mycobacterium tuberculosis
LDAFVVRKLGAPGHD

SEQ ID NO: 171363 - protein, 15 aa, Mycobacterium tuberculosis
DAFVVRKLGAPGHDE

SEQ ID NO: 171364 - protein, 15 aa, Mycobacterium tuberculosis
AFVVRKLGAPGHDEF

SEQ ID NO: 171365 - protein, 15 aa, Mycobacterium tuberculosis
FVVRKLGAPGHDEFA

SEQ ID NO: 171366 - protein, 15 aa, Mycobacterium tuberculosis
VVRKLGAPGHDEFAV

SEQ ID NO: 171367 - protein, 15 aa, Mycobacterium tuberculosis
VRKLGAPGHDEFAVG

SEQ ID NO: 171368 - protein, 15 aa, Mycobacterium tuberculosis
RKLGAPGHDEFAVGA

SEQ ID NO: 171369 - protein, 15 aa, Mycobacterium tuberculosis
KLGAPGHDEFAVGAL

SEQ ID NO: 171370 - protein, 15 aa, Mycobacterium tuberculosis
LGAPGHDEFAVGALA

SEQ ID NO: 171371 - protein, 15 aa, Mycobacterium tuberculosis
GAPGHDEFAVGALAS

SEQ ID NO: 171372 - protein, 15 aa, Mycobacterium tuberculosis
APGHDEFAVGALASG

SEQ ID NO: 171373 - protein, 15 aa, Mycobacterium tuberculosis
PGHDEFAVGALASGG

SEQ ID NO: 171374 - protein, 15 aa, Mycobacterium tuberculosis
GHDEFAVGALASGGR

SEQ ID NO: 171375 - protein, 15 aa, Mycobacterium tuberculosis
HDEFAVGALASGGRV

SEQ ID NO: 171376 - protein, 15 aa, Mycobacterium tuberculosis
DEFAVGALASGGRVV

SEQ ID NO: 171377 - protein, 15 aa, Mycobacterium tuberculosis
EFAVGALASGGRVVV

SEQ ID NO: 171378 - protein, 15 aa, Mycobacterium tuberculosis
FAVGALASGGRVVVN

SEQ ID NO: 171379 - protein, 15 aa, Mycobacterium tuberculosis
AVGALASGGRVVVND

SEQ ID NO: 171380 - protein, 15 aa, Mycobacterium tuberculosis
VGALASGGRVVVNDD

SEQ ID NO: 171381 - protein, 15 aa, Mycobacterium tuberculosis
GALASGGRVVVNDDV

SEQ ID NO: 171382 - protein, 15 aa, Mycobacterium tuberculosis
ALASGGRVVVNDDVV

SEQ ID NO: 171383 - protein, 15 aa, Mycobacterium tuberculosis
LASGGRVVVNDDVVR

SEQ ID NO: 171384 - protein, 15 aa, Mycobacterium tuberculosis
ASGGRVVVNDDVVRG

SEQ ID NO: 171385 - protein, 15 aa, Mycobacterium tuberculosis
SGGRVVVNDDVVRGL

SEQ ID NO: 171386 - protein, 15 aa, Mycobacterium tuberculosis
GGRVVVNDDVVRGLR

SEQ ID NO: 171387 - protein, 15 aa, Mycobacterium tuberculosis
GRVVVNDDVVRGLRI

SEQ ID NO: 171388 - protein, 15 aa, Mycobacterium tuberculosis
RVVVNDDVVRGLRIT

SEQ ID NO: 171389 - protein, 15 aa, Mycobacterium tuberculosis
VVVNDDVVRGLRITP

SEQ ID NO: 171390 - protein, 15 aa, Mycobacterium tuberculosis
VVNDDVVRGLRITPQ

SEQ ID NO: 171391 - protein, 15 aa, Mycobacterium tuberculosis
VNDDVVRGLRITPQQ

SEQ ID NO: 171392 - protein, 15 aa, Mycobacterium tuberculosis
NDDVVRGLRITPQQL

SEQ ID NO: 171393 - protein, 15 aa, Mycobacterium tuberculosis
DDVVRGLRITPQQLR

SEQ ID NO: 171394 - protein, 15 aa, Mycobacterium tuberculosis
DVVRGLRITPQQLRD

SEQ ID NO: 171395 - protein, 15 aa, Mycobacterium tuberculosis
VVRGLRITPQQLRDI

SEQ ID NO: 171396 - protein, 15 aa, Mycobacterium tuberculosis
VRGLRITPQQLRDIA

SEQ ID NO: 171397 - protein, 15 aa, Mycobacterium tuberculosis
RGLRITPQQLRDIAE

SEQ ID NO: 171398 - protein, 15 aa, Mycobacterium tuberculosis
GLRITPQQLRDIAER

SEQ ID NO: 171399 - protein, 15 aa, Mycobacterium tuberculosis
LRITPQQLRDIAERE

SEQ ID NO: 171400 - protein, 15 aa, Mycobacterium tuberculosis
RITPQQLRDIAEREG

SEQ ID NO: 171401 - protein, 15 aa, Mycobacterium tuberculosis
ITPQQLRDIAEREGR

SEQ ID NO: 171402 - protein, 15 aa, Mycobacterium tuberculosis
TPQQLRDIAEREGRE

SEQ ID NO: 171403 - protein, 15 aa, Mycobacterium tuberculosis
PQQLRDIAEREGREL

SEQ ID NO: 171404 - protein, 15 aa, Mycobacterium tuberculosis
QQLRDIAEREGRELL

SEQ ID NO: 171405 - protein, 15 aa, Mycobacterium tuberculosis
QLRDIAEREGRELLR

SEQ ID NO: 171406 - protein, 15 aa, Mycobacterium tuberculosis
LRDIAEREGRELLRR

SEQ ID NO: 171407 - protein, 15 aa, Mycobacterium tuberculosis
RDIAEREGRELLRRE

SEQ ID NO: 171408 - protein, 15 aa, Mycobacterium tuberculosis
DIAEREGRELLRRES

SEQ ID NO: 171409 - protein, 15 aa, Mycobacterium tuberculosis
IAEREGRELLRRESA

SEQ ID NO: 171410 - protein, 15 aa, Mycobacterium tuberculosis
AEREGRELLRRESAY

SEQ ID NO: 171411 - protein, 15 aa, Mycobacterium tuberculosis
EREGRELLRRESAYR

SEQ ID NO: 171412 - protein, 15 aa, Mycobacterium tuberculosis
REGRELLRRESAYRG

SEQ ID NO: 171413 - protein, 15 aa, Mycobacterium tuberculosis
EGRELLRRESAYRGE

SEQ ID NO: 171414 - protein, 15 aa, Mycobacterium tuberculosis
GRELLRRESAYRGER

SEQ ID NO: 171415 - protein, 15 aa, Mycobacterium tuberculosis
RELLRRESAYRGERP

SEQ ID NO: 171416 - protein, 15 aa, Mycobacterium tuberculosis
ELLRRESAYRGERPP

SEQ ID NO: 171417 - protein, 15 aa, Mycobacterium tuberculosis
LLRRESAYRGERPPT

SEQ ID NO: 171418 - protein, 15 aa, Mycobacterium tuberculosis
LRRESAYRGERPPTD

SEQ ID NO: 171419 - protein, 15 aa, Mycobacterium tuberculosis
RRESAYRGERPPTDI

SEQ ID NO: 171420 - protein, 15 aa, Mycobacterium tuberculosis
RESAYRGERPPTDIT

SEQ ID NO: 171421 - protein, 15 aa, Mycobacterium tuberculosis
ESAYRGERPPTDITG

SEQ ID NO: 171422 - protein, 15 aa, Mycobacterium tuberculosis
SAYRGERPPTDITGK

SEQ ID NO: 171423 - protein, 15 aa, Mycobacterium tuberculosis
AYRGERPPTDITGKT

SEQ ID NO: 171424 - protein, 15 aa, Mycobacterium tuberculosis
YRGERPPTDITGKTV

SEQ ID NO: 171425 - protein, 15 aa, Mycobacterium tuberculosis
RGERPPTDITGKTVI

SEQ ID NO: 171426 - protein, 15 aa, Mycobacterium tuberculosis
GERPPTDITGKTVIV

SEQ ID NO: 171427 - protein, 15 aa, Mycobacterium tuberculosis
ERPPTDITGKTVIVV

SEQ ID NO: 171428 - protein, 15 aa, Mycobacterium tuberculosis
RPPTDITGKTVIVVD

SEQ ID NO: 171429 - protein, 15 aa, Mycobacterium tuberculosis
PPTDITGKTVIVVDD

SEQ ID NO: 171430 - protein, 15 aa, Mycobacterium tuberculosis
PTDITGKTVIVVDDG

SEQ ID NO: 171431 - protein, 15 aa, Mycobacterium tuberculosis
TDITGKTVIVVDDGL

SEQ ID NO: 171432 - protein, 15 aa, Mycobacterium tuberculosis
DITGKTVIVVDDGLA

SEQ ID NO: 171433 - protein, 15 aa, Mycobacterium tuberculosis
ITGKTVIVVDDGLAT

SEQ ID NO: 171434 - protein, 15 aa, Mycobacterium tuberculosis
TGKTVIVVDDGLATG

SEQ ID NO: 171435 - protein, 15 aa, Mycobacterium tuberculosis
GKTVIVVDDGLATGA

SEQ ID NO: 171436 - protein, 15 aa, Mycobacterium tuberculosis
KTVIVVDDGLATGAS

SEQ ID NO: 171437 - protein, 15 aa, Mycobacterium tuberculosis
TVIVVDDGLATGASM

SEQ ID NO: 171438 - protein, 15 aa, Mycobacterium tuberculosis
VIVVDDGLATGASMF

SEQ ID NO: 171439 - protein, 15 aa, Mycobacterium tuberculosis
IVVDDGLATGASMFA

SEQ ID NO: 171440 - protein, 15 aa, Mycobacterium tuberculosis
VVDDGLATGASMFAA

SEQ ID NO: 171441 - protein, 15 aa, Mycobacterium tuberculosis
VDDGLATGASMFAAV

SEQ ID NO: 171442 - protein, 15 aa, Mycobacterium tuberculosis
DDGLATGASMFAAVQ

SEQ ID NO: 171443 - protein, 15 aa, Mycobacterium tuberculosis
DGLATGASMFAAVQA

SEQ ID NO: 171444 - protein, 15 aa, Mycobacterium tuberculosis
GLATGASMFAAVQAL

SEQ ID NO: 171445 - protein, 15 aa, Mycobacterium tuberculosis
LATGASMFAAVQALR

SEQ ID NO: 171446 - protein, 15 aa, Mycobacterium tuberculosis
ATGASMFAAVQALRD

SEQ ID NO: 171447 - protein, 15 aa, Mycobacterium tuberculosis
TGASMFAAVQALRDA

SEQ ID NO: 171448 - protein, 15 aa, Mycobacterium tuberculosis
GASMFAAVQALRDAQ

SEQ ID NO: 171449 - protein, 15 aa, Mycobacterium tuberculosis
ASMFAAVQALRDAQP

SEQ ID NO: 171450 - protein, 15 aa, Mycobacterium tuberculosis
SMFAAVQALRDAQPA

SEQ ID NO: 171451 - protein, 15 aa, Mycobacterium tuberculosis
MFAAVQALRDAQPAQ

SEQ ID NO: 171452 - protein, 15 aa, Mycobacterium tuberculosis
FAAVQALRDAQPAQI

SEQ ID NO: 171453 - protein, 15 aa, Mycobacterium tuberculosis
AAVQALRDAQPAQIV

SEQ ID NO: 171454 - protein, 15 aa, Mycobacterium tuberculosis
AVQALRDAQPAQIVI

SEQ ID NO: 171455 - protein, 15 aa, Mycobacterium tuberculosis
VQALRDAQPAQIVIA

SEQ ID NO: 171456 - protein, 15 aa, Mycobacterium tuberculosis
QALRDAQPAQIVIAV

SEQ ID NO: 171457 - protein, 15 aa, Mycobacterium tuberculosis
ALRDAQPAQIVIAVP

SEQ ID NO: 171458 - protein, 15 aa, Mycobacterium tuberculosis
LRDAQPAQIVIAVPA

SEQ ID NO: 171459 - protein, 15 aa, Mycobacterium tuberculosis
RDAQPAQIVIAVPAA

SEQ ID NO: 171460 - protein, 15 aa, Mycobacterium tuberculosis
DAQPAQIVIAVPAAP

SEQ ID NO: 171461 - protein, 15 aa, Mycobacterium tuberculosis
AQPAQIVIAVPAAPE

SEQ ID NO: 171462 - protein, 15 aa, Mycobacterium tuberculosis
QPAQIVIAVPAAPES

SEQ ID NO: 171463 - protein, 15 aa, Mycobacterium tuberculosis
PAQIVIAVPAAPEST

SEQ ID NO: 171464 - protein, 15 aa, Mycobacterium tuberculosis
AQIVIAVPAAPESTC

SEQ ID NO: 171465 - protein, 15 aa, Mycobacterium tuberculosis
QIVIAVPAAPESTCR

SEQ ID NO: 171466 - protein, 15 aa, Mycobacterium tuberculosis
IVIAVPAAPESTCRE

SEQ ID NO: 171467 - protein, 15 aa, Mycobacterium tuberculosis
VIAVPAAPESTCREF

SEQ ID NO: 171468 - protein, 15 aa, Mycobacterium tuberculosis
IAVPAAPESTCREFA

SEQ ID NO: 171469 - protein, 15 aa, Mycobacterium tuberculosis
AVPAAPESTCREFAG

SEQ ID NO: 171470 - protein, 15 aa, Mycobacterium tuberculosis
VPAAPESTCREFAGL

SEQ ID NO: 171471 - protein, 15 aa, Mycobacterium tuberculosis
PAAPESTCREFAGLV

SEQ ID NO: 171472 - protein, 15 aa, Mycobacterium tuberculosis
AAPESTCREFAGLVD

SEQ ID NO: 171473 - protein, 15 aa, Mycobacterium tuberculosis
APESTCREFAGLVDD

SEQ ID NO: 171474 - protein, 15 aa, Mycobacterium tuberculosis
PESTCREFAGLVDDV

SEQ ID NO: 171475 - protein, 15 aa, Mycobacterium tuberculosis
ESTCREFAGLVDDVV

SEQ ID NO: 171476 - protein, 15 aa, Mycobacterium tuberculosis
STCREFAGLVDDVVC

SEQ ID NO: 171477 - protein, 15 aa, Mycobacterium tuberculosis
TCREFAGLVDDVVCA

SEQ ID NO: 171478 - protein, 15 aa, Mycobacterium tuberculosis
CREFAGLVDDVVCAT

SEQ ID NO: 171479 - protein, 15 aa, Mycobacterium tuberculosis
REFAGLVDDVVCATM

SEQ ID NO: 171480 - protein, 15 aa, Mycobacterium tuberculosis
EFAGLVDDVVCATMP

SEQ ID NO: 171481 - protein, 15 aa, Mycobacterium tuberculosis
FAGLVDDVVCATMPT

SEQ ID NO: 171482 - protein, 15 aa, Mycobacterium tuberculosis
AGLVDDVVCATMPTP

SEQ ID NO: 171483 - protein, 15 aa, Mycobacterium tuberculosis
GLVDDVVCATMPTPF

SEQ ID NO: 171484 - protein, 15 aa, Mycobacterium tuberculosis
LVDDVVCATMPTPFL

SEQ ID NO: 171485 - protein, 15 aa, Mycobacterium tuberculosis
VDDVVCATMPTPFLA

SEQ ID NO: 171486 - protein, 15 aa, Mycobacterium tuberculosis
DDVVCATMPTPFLAV

SEQ ID NO: 171487 - protein, 15 aa, Mycobacterium tuberculosis
DVVCATMPTPFLAVG

SEQ ID NO: 171488 - protein, 15 aa, Mycobacterium tuberculosis
VVCATMPTPFLAVGE

SEQ ID NO: 171489 - protein, 15 aa, Mycobacterium tuberculosis
VCATMPTPFLAVGES

SEQ ID NO: 171490 - protein, 15 aa, Mycobacterium tuberculosis
CATMPTPFLAVGESF

SEQ ID NO: 171491 - protein, 15 aa, Mycobacterium tuberculosis
ATMPTPFLAVGESFW

SEQ ID NO: 171492 - protein, 15 aa, Mycobacterium tuberculosis
TMPTPFLAVGESFWD

SEQ ID NO: 171493 - protein, 15 aa, Mycobacterium tuberculosis
MPTPFLAVGESFWDF

SEQ ID NO: 171494 - protein, 15 aa, Mycobacterium tuberculosis
PTPFLAVGESFWDFR

SEQ ID NO: 171495 - protein, 15 aa, Mycobacterium tuberculosis
TPFLAVGESFWDFRQ

SEQ ID NO: 171496 - protein, 15 aa, Mycobacterium tuberculosis
PFLAVGESFWDFRQV

SEQ ID NO: 171497 - protein, 15 aa, Mycobacterium tuberculosis
FLAVGESFWDFRQVT

SEQ ID NO: 171498 - protein, 15 aa, Mycobacterium tuberculosis
LAVGESFWDFRQVTD

SEQ ID NO: 171499 - protein, 15 aa, Mycobacterium tuberculosis
AVGESFWDFRQVTDE

SEQ ID NO: 171500 - protein, 15 aa, Mycobacterium tuberculosis
VGESFWDFRQVTDEE

SEQ ID NO: 171501 - protein, 15 aa, Mycobacterium tuberculosis
GESFWDFRQVTDEEV

SEQ ID NO: 171502 - protein, 15 aa, Mycobacterium tuberculosis
ESFWDFRQVTDEEVR

SEQ ID NO: 171503 - protein, 15 aa, Mycobacterium tuberculosis
SFWDFRQVTDEEVRR

SEQ ID NO: 171504 - protein, 15 aa, Mycobacterium tuberculosis
FWDFRQVTDEEVRRL

SEQ ID NO: 171505 - protein, 15 aa, Mycobacterium tuberculosis
WDFRQVTDEEVRRLL

SEQ ID NO: 171506 - protein, 15 aa, Mycobacterium tuberculosis
DFRQVTDEEVRRLLA

SEQ ID NO: 171507 - protein, 15 aa, Mycobacterium tuberculosis
FRQVTDEEVRRLLAT

SEQ ID NO: 171508 - protein, 15 aa, Mycobacterium tuberculosis
RQVTDEEVRRLLATP

SEQ ID NO: 171509 - protein, 15 aa, Mycobacterium tuberculosis
QVTDEEVRRLLATPT

SEQ ID NO: 171510 - protein, 15 aa, Mycobacterium tuberculosis
VTDEEVRRLLATPTA

SEQ ID NO: 171511 - protein, 15 aa, Mycobacterium tuberculosis
TDEEVRRLLATPTAG

SEQ ID NO: 171512 - protein, 15 aa, Mycobacterium tuberculosis
DEEVRRLLATPTAGP

SEQ ID NO: 171513 - protein, 15 aa, Mycobacterium tuberculosis
EEVRRLLATPTAGPS

SEQ ID NO: 171514 - protein, 15 aa, Mycobacterium tuberculosis
EVRRLLATPTAGPSL

SEQ ID NO: 171515 - protein, 15 aa, Mycobacterium tuberculosis
VRRLLATPTAGPSLR

SEQ ID NO: 171516 - protein, 15 aa, Mycobacterium tuberculosis
RRLLATPTAGPSLRR

SEQ ID NO: 171517 - protein, 15 aa, Mycobacterium tuberculosis
RLLATPTAGPSLRRP

SEQ ID NO: 171518 - protein, 15 aa, Mycobacterium tuberculosis
LLATPTAGPSLRRPA

SEQ ID NO: 171519 - protein, 15 aa, Mycobacterium tuberculosis
LATPTAGPSLRRPAA

SEQ ID NO: 171520 - protein, 15 aa, Mycobacterium tuberculosis
ATPTAGPSLRRPAAS

SEQ ID NO: 171521 - protein, 15 aa, Mycobacterium tuberculosis
TPTAGPSLRRPAAST

SEQ ID NO: 171522 - protein, 15 aa, Mycobacterium tuberculosis
PTAGPSLRRPAASTA

SEQ ID NO: 171523 - protein, 15 aa, Mycobacterium tuberculosis
TAGPSLRRPAASTAA

SEQ ID NO: 171524 - protein, 15 aa, Mycobacterium tuberculosis
AGPSLRRPAASTAAD

SEQ ID NO: 171525 - protein, 15 aa, Mycobacterium tuberculosis
GPSLRRPAASTAADV

SEQ ID NO: 171526 - protein, 15 aa, Mycobacterium tuberculosis
PSLRRPAASTAADVL

SEQ ID NO: 171527 - protein, 15 aa, Mycobacterium tuberculosis
SLRRPAASTAADVLR

SEQ ID NO: 171528 - protein, 15 aa, Mycobacterium tuberculosis
LRRPAASTAADVLRR

SEQ ID NO: 171529 - protein, 15 aa, Mycobacterium tuberculosis
RRPAASTAADVLRRV

SEQ ID NO: 171530 - protein, 15 aa, Mycobacterium tuberculosis
RPAASTAADVLRRVA

SEQ ID NO: 171531 - protein, 15 aa, Mycobacterium tuberculosis
PAASTAADVLRRVAI

SEQ ID NO: 171532 - protein, 15 aa, Mycobacterium tuberculosis
AASTAADVLRRVAID

SEQ ID NO: 171533 - protein, 15 aa, Mycobacterium tuberculosis
ASTAADVLRRVAIDA

SEQ ID NO: 171534 - protein, 15 aa, Mycobacterium tuberculosis
STAADVLRRVAIDAP

SEQ ID NO: 171535 - protein, 15 aa, Mycobacterium tuberculosis
TAADVLRRVAIDAPG

SEQ ID NO: 171536 - protein, 15 aa, Mycobacterium tuberculosis
AADVLRRVAIDAPGG

SEQ ID NO: 171537 - protein, 15 aa, Mycobacterium tuberculosis
ADVLRRVAIDAPGGV

SEQ ID NO: 171538 - protein, 15 aa, Mycobacterium tuberculosis
DVLRRVAIDAPGGVP

SEQ ID NO: 171539 - protein, 15 aa, Mycobacterium tuberculosis
VLRRVAIDAPGGVPT

SEQ ID NO: 171540 - protein, 15 aa, Mycobacterium tuberculosis
LRRVAIDAPGGVPTH

SEQ ID NO: 171541 - protein, 15 aa, Mycobacterium tuberculosis
RRVAIDAPGGVPTHE

SEQ ID NO: 171542 - protein, 15 aa, Mycobacterium tuberculosis
RVAIDAPGGVPTHEV

SEQ ID NO: 171543 - protein, 15 aa, Mycobacterium tuberculosis
VAIDAPGGVPTHEVL

SEQ ID NO: 171544 - protein, 15 aa, Mycobacterium tuberculosis
AIDAPGGVPTHEVLA

SEQ ID NO: 171545 - protein, 15 aa, Mycobacterium tuberculosis
IDAPGGVPTHEVLAE

SEQ ID NO: 171546 - protein, 15 aa, Mycobacterium tuberculosis
DAPGGVPTHEVLAEL

SEQ ID NO: 171547 - protein, 15 aa, Mycobacterium tuberculosis
APGGVPTHEVLAELV

SEQ ID NO: 171548 - protein, 15 aa, Mycobacterium tuberculosis
PGGVPTHEVLAELVG

SEQ ID NO: 171549 - protein, 15 aa, Mycobacterium tuberculosis
GGVPTHEVLAELVGD

SEQ ID NO: 171550 - protein, 15 aa, Mycobacterium tuberculosis
GVPTHEVLAELVGDA

SEQ ID NO: 171551 - protein, 15 aa, Mycobacterium tuberculosis
VPTHEVLAELVGDAR

SEQ ID NO: 171552 - protein, 15 aa, Mycobacterium tuberculosis
PTHEVLAELVGDARI

SEQ ID NO: 171553 - protein, 15 aa, Mycobacterium tuberculosis
THEVLAELVGDARIV

SEQ ID NO: 171554 - protein, 15 aa, Mycobacterium tuberculosis
HEVLAELVGDARIVL

SEQ ID NO: 171555 - protein, 15 aa, Mycobacterium tuberculosis
EVLAELVGDARIVLI

SEQ ID NO: 171556 - protein, 15 aa, Mycobacterium tuberculosis
VLAELVGDARIVLIG

SEQ ID NO: 171557 - protein, 15 aa, Mycobacterium tuberculosis
LAELVGDARIVLIGE

SEQ ID NO: 171558 - protein, 15 aa, Mycobacterium tuberculosis
AELVGDARIVLIGES

SEQ ID NO: 171559 - protein, 15 aa, Mycobacterium tuberculosis
ELVGDARIVLIGESS

SEQ ID NO: 171560 - protein, 15 aa, Mycobacterium tuberculosis
LVGDARIVLIGESSH

SEQ ID NO: 171561 - protein, 15 aa, Mycobacterium tuberculosis
VGDARIVLIGESSHG

SEQ ID NO: 171562 - protein, 15 aa, Mycobacterium tuberculosis
GDARIVLIGESSHGT

SEQ ID NO: 171563 - protein, 15 aa, Mycobacterium tuberculosis
DARIVLIGESSHGTH

SEQ ID NO: 171564 - protein, 15 aa, Mycobacterium tuberculosis
ARIVLIGESSHGTHE

SEQ ID NO: 171565 - protein, 15 aa, Mycobacterium tuberculosis
RIVLIGESSHGTHEF

SEQ ID NO: 171566 - protein, 15 aa, Mycobacterium tuberculosis
IVLIGESSHGTHEFY

SEQ ID NO: 171567 - protein, 15 aa, Mycobacterium tuberculosis
VLIGESSHGTHEFYQ

SEQ ID NO: 171568 - protein, 15 aa, Mycobacterium tuberculosis
LIGESSHGTHEFYQA

SEQ ID NO: 171569 - protein, 15 aa, Mycobacterium tuberculosis
IGESSHGTHEFYQAR

SEQ ID NO: 171570 - protein, 15 aa, Mycobacterium tuberculosis
GESSHGTHEFYQARA

SEQ ID NO: 171571 - protein, 15 aa, Mycobacterium tuberculosis
ESSHGTHEFYQARAA

SEQ ID NO: 171572 - protein, 15 aa, Mycobacterium tuberculosis
SSHGTHEFYQARAAM

SEQ ID NO: 171573 - protein, 15 aa, Mycobacterium tuberculosis
SHGTHEFYQARAAMT

SEQ ID NO: 171574 - protein, 15 aa, Mycobacterium tuberculosis
HGTHEFYQARAAMTQ

SEQ ID NO: 171575 - protein, 15 aa, Mycobacterium tuberculosis
GTHEFYQARAAMTQW

SEQ ID NO: 171576 - protein, 15 aa, Mycobacterium tuberculosis
THEFYQARAAMTQWL

SEQ ID NO: 171577 - protein, 15 aa, Mycobacterium tuberculosis
HEFYQARAAMTQWLI

SEQ ID NO: 171578 - protein, 15 aa, Mycobacterium tuberculosis
EFYQARAAMTQWLIE

SEQ ID NO: 171579 - protein, 15 aa, Mycobacterium tuberculosis
FYQARAAMTQWLIEE

SEQ ID NO: 171580 - protein, 15 aa, Mycobacterium tuberculosis
YQARAAMTQWLIEEK

SEQ ID NO: 171581 - protein, 15 aa, Mycobacterium tuberculosis
QARAAMTQWLIEEKG

SEQ ID NO: 171582 - protein, 15 aa, Mycobacterium tuberculosis
ARAAMTQWLIEEKGF

SEQ ID NO: 171583 - protein, 15 aa, Mycobacterium tuberculosis
RAAMTQWLIEEKGFG

SEQ ID NO: 171584 - protein, 15 aa, Mycobacterium tuberculosis
AAMTQWLIEEKGFGA

SEQ ID NO: 171585 - protein, 15 aa, Mycobacterium tuberculosis
AMTQWLIEEKGFGAV

SEQ ID NO: 171586 - protein, 15 aa, Mycobacterium tuberculosis
MTQWLIEEKGFGAVA

SEQ ID NO: 171587 - protein, 15 aa, Mycobacterium tuberculosis
TQWLIEEKGFGAVAA

SEQ ID NO: 171588 - protein, 15 aa, Mycobacterium tuberculosis
QWLIEEKGFGAVAAE

SEQ ID NO: 171589 - protein, 15 aa, Mycobacterium tuberculosis
WLIEEKGFGAVAAEA

SEQ ID NO: 171590 - protein, 15 aa, Mycobacterium tuberculosis
LIEEKGFGAVAAEAD

SEQ ID NO: 171591 - protein, 15 aa, Mycobacterium tuberculosis
IEEKGFGAVAAEADW

SEQ ID NO: 171592 - protein, 15 aa, Mycobacterium tuberculosis
EEKGFGAVAAEADWP

SEQ ID NO: 171593 - protein, 15 aa, Mycobacterium tuberculosis
EKGFGAVAAEADWPD

SEQ ID NO: 171594 - protein, 15 aa, Mycobacterium tuberculosis
KGFGAVAAEADWPDA

SEQ ID NO: 171595 - protein, 15 aa, Mycobacterium tuberculosis
GFGAVAAEADWPDAY

SEQ ID NO: 171596 - protein, 15 aa, Mycobacterium tuberculosis
FGAVAAEADWPDAYR

SEQ ID NO: 171597 - protein, 15 aa, Mycobacterium tuberculosis
GAVAAEADWPDAYRV

SEQ ID NO: 171598 - protein, 15 aa, Mycobacterium tuberculosis
AVAAEADWPDAYRVN

SEQ ID NO: 171599 - protein, 15 aa, Mycobacterium tuberculosis
VAAEADWPDAYRVNR

SEQ ID NO: 171600 - protein, 15 aa, Mycobacterium tuberculosis
AAEADWPDAYRVNRY

SEQ ID NO: 171601 - protein, 15 aa, Mycobacterium tuberculosis
AEADWPDAYRVNRYV

SEQ ID NO: 171602 - protein, 15 aa, Mycobacterium tuberculosis
EADWPDAYRVNRYVR

SEQ ID NO: 171603 - protein, 15 aa, Mycobacterium tuberculosis
ADWPDAYRVNRYVRG

SEQ ID NO: 171604 - protein, 15 aa, Mycobacterium tuberculosis
DWPDAYRVNRYVRGL

SEQ ID NO: 171605 - protein, 15 aa, Mycobacterium tuberculosis
WPDAYRVNRYVRGLG

SEQ ID NO: 171606 - protein, 15 aa, Mycobacterium tuberculosis
PDAYRVNRYVRGLGE

SEQ ID NO: 171607 - protein, 15 aa, Mycobacterium tuberculosis
DAYRVNRYVRGLGED

SEQ ID NO: 171608 - protein, 15 aa, Mycobacterium tuberculosis
AYRVNRYVRGLGEDT

SEQ ID NO: 171609 - protein, 15 aa, Mycobacterium tuberculosis
YRVNRYVRGLGEDTN

SEQ ID NO: 171610 - protein, 15 aa, Mycobacterium tuberculosis
RVNRYVRGLGEDTNA

SEQ ID NO: 171611 - protein, 15 aa, Mycobacterium tuberculosis
VNRYVRGLGEDTNAD

SEQ ID NO: 171612 - protein, 15 aa, Mycobacterium tuberculosis
NRYVRGLGEDTNADE

SEQ ID NO: 171613 - protein, 15 aa, Mycobacterium tuberculosis
RYVRGLGEDTNADEA

SEQ ID NO: 171614 - protein, 15 aa, Mycobacterium tuberculosis
YVRGLGEDTNADEAL

SEQ ID NO: 171615 - protein, 15 aa, Mycobacterium tuberculosis
VRGLGEDTNADEALS

SEQ ID NO: 171616 - protein, 15 aa, Mycobacterium tuberculosis
RGLGEDTNADEALSG

SEQ ID NO: 171617 - protein, 15 aa, Mycobacterium tuberculosis
GLGEDTNADEALSGF

SEQ ID NO: 171618 - protein, 15 aa, Mycobacterium tuberculosis
LGEDTNADEALSGFE

SEQ ID NO: 171619 - protein, 15 aa, Mycobacterium tuberculosis
GEDTNADEALSGFER

SEQ ID NO: 171620 - protein, 15 aa, Mycobacterium tuberculosis
EDTNADEALSGFERF

SEQ ID NO: 171621 - protein, 15 aa, Mycobacterium tuberculosis
DTNADEALSGFERFP

SEQ ID NO: 171622 - protein, 15 aa, Mycobacterium tuberculosis
TNADEALSGFERFPA

SEQ ID NO: 171623 - protein, 15 aa, Mycobacterium tuberculosis
NADEALSGFERFPAW

SEQ ID NO: 171624 - protein, 15 aa, Mycobacterium tuberculosis
ADEALSGFERFPAWM

SEQ ID NO: 171625 - protein, 15 aa, Mycobacterium tuberculosis
DEALSGFERFPAWMW

SEQ ID NO: 171626 - protein, 15 aa, Mycobacterium tuberculosis
EALSGFERFPAWMWR

SEQ ID NO: 171627 - protein, 15 aa, Mycobacterium tuberculosis
ALSGFERFPAWMWRN

SEQ ID NO: 171628 - protein, 15 aa, Mycobacterium tuberculosis
LSGFERFPAWMWRNT

SEQ ID NO: 171629 - protein, 15 aa, Mycobacterium tuberculosis
SGFERFPAWMWRNTV

SEQ ID NO: 171630 - protein, 15 aa, Mycobacterium tuberculosis
GFERFPAWMWRNTVV

SEQ ID NO: 171631 - protein, 15 aa, Mycobacterium tuberculosis
FERFPAWMWRNTVVR

SEQ ID NO: 171632 - protein, 15 aa, Mycobacterium tuberculosis
ERFPAWMWRNTVVRD

SEQ ID NO: 171633 - protein, 15 aa, Mycobacterium tuberculosis
RFPAWMWRNTVVRDF

SEQ ID NO: 171634 - protein, 15 aa, Mycobacterium tuberculosis
FPAWMWRNTVVRDFV

SEQ ID NO: 171635 - protein, 15 aa, Mycobacterium tuberculosis
PAWMWRNTVVRDFVE

SEQ ID NO: 171636 - protein, 15 aa, Mycobacterium tuberculosis
AWMWRNTVVRDFVEW

SEQ ID NO: 171637 - protein, 15 aa, Mycobacterium tuberculosis
WMWRNTVVRDFVEWL

SEQ ID NO: 171638 - protein, 15 aa, Mycobacterium tuberculosis
MWRNTVVRDFVEWLR

SEQ ID NO: 171639 - protein, 15 aa, Mycobacterium tuberculosis
WRNTVVRDFVEWLRT

SEQ ID NO: 171640 - protein, 15 aa, Mycobacterium tuberculosis
RNTVVRDFVEWLRTR

SEQ ID NO: 171641 - protein, 15 aa, Mycobacterium tuberculosis
NTVVRDFVEWLRTRN

SEQ ID NO: 171642 - protein, 15 aa, Mycobacterium tuberculosis
TVVRDFVEWLRTRNQ

SEQ ID NO: 171643 - protein, 15 aa, Mycobacterium tuberculosis
VVRDFVEWLRTRNQR

SEQ ID NO: 171644 - protein, 15 aa, Mycobacterium tuberculosis
VRDFVEWLRTRNQRY

SEQ ID NO: 171645 - protein, 15 aa, Mycobacterium tuberculosis
RDFVEWLRTRNQRYE

SEQ ID NO: 171646 - protein, 15 aa, Mycobacterium tuberculosis
DFVEWLRTRNQRYES

SEQ ID NO: 171647 - protein, 15 aa, Mycobacterium tuberculosis
FVEWLRTRNQRYESG

SEQ ID NO: 171648 - protein, 15 aa, Mycobacterium tuberculosis
VEWLRTRNQRYESGA

SEQ ID NO: 171649 - protein, 15 aa, Mycobacterium tuberculosis
EWLRTRNQRYESGAL

SEQ ID NO: 171650 - protein, 15 aa, Mycobacterium tuberculosis
WLRTRNQRYESGALR

SEQ ID NO: 171651 - protein, 15 aa, Mycobacterium tuberculosis
LRTRNQRYESGALRQ

SEQ ID NO: 171652 - protein, 15 aa, Mycobacterium tuberculosis
RTRNQRYESGALRQA

SEQ ID NO: 171653 - protein, 15 aa, Mycobacterium tuberculosis
TRNQRYESGALRQAG

SEQ ID NO: 171654 - protein, 15 aa, Mycobacterium tuberculosis
RNQRYESGALRQAGF

SEQ ID NO: 171655 - protein, 15 aa, Mycobacterium tuberculosis
NQRYESGALRQAGFY

SEQ ID NO: 171656 - protein, 15 aa, Mycobacterium tuberculosis
QRYESGALRQAGFYG

SEQ ID NO: 171657 - protein, 15 aa, Mycobacterium tuberculosis
RYESGALRQAGFYGL

SEQ ID NO: 171658 - protein, 15 aa, Mycobacterium tuberculosis
YESGALRQAGFYGLD

SEQ ID NO: 171659 - protein, 15 aa, Mycobacterium tuberculosis
ESGALRQAGFYGLDL

SEQ ID NO: 171660 - protein, 15 aa, Mycobacterium tuberculosis
SGALRQAGFYGLDLY

SEQ ID NO: 171661 - protein, 15 aa, Mycobacterium tuberculosis
GALRQAGFYGLDLYS

SEQ ID NO: 171662 - protein, 15 aa, Mycobacterium tuberculosis
ALRQAGFYGLDLYSL

SEQ ID NO: 171663 - protein, 15 aa, Mycobacterium tuberculosis
LRQAGFYGLDLYSLH

SEQ ID NO: 171664 - protein, 15 aa, Mycobacterium tuberculosis
RQAGFYGLDLYSLHR

SEQ ID NO: 171665 - protein, 15 aa, Mycobacterium tuberculosis
QAGFYGLDLYSLHRS

SEQ ID NO: 171666 - protein, 15 aa, Mycobacterium tuberculosis
AGFYGLDLYSLHRSI

SEQ ID NO: 171667 - protein, 15 aa, Mycobacterium tuberculosis
GFYGLDLYSLHRSIQ

SEQ ID NO: 171668 - protein, 15 aa, Mycobacterium tuberculosis
FYGLDLYSLHRSIQE

SEQ ID NO: 171669 - protein, 15 aa, Mycobacterium tuberculosis
YGLDLYSLHRSIQEV

SEQ ID NO: 171670 - protein, 15 aa, Mycobacterium tuberculosis
GLDLYSLHRSIQEVI

SEQ ID NO: 171671 - protein, 15 aa, Mycobacterium tuberculosis
LDLYSLHRSIQEVIS

SEQ ID NO: 171672 - protein, 15 aa, Mycobacterium tuberculosis
DLYSLHRSIQEVISY

SEQ ID NO: 171673 - protein, 15 aa, Mycobacterium tuberculosis
LYSLHRSIQEVISYL

SEQ ID NO: 171674 - protein, 15 aa, Mycobacterium tuberculosis
YSLHRSIQEVISYLD

SEQ ID NO: 171675 - protein, 15 aa, Mycobacterium tuberculosis
SLHRSIQEVISYLDK

SEQ ID NO: 171676 - protein, 15 aa, Mycobacterium tuberculosis
LHRSIQEVISYLDKV

SEQ ID NO: 171677 - protein, 15 aa, Mycobacterium tuberculosis
HRSIQEVISYLDKVD

SEQ ID NO: 171678 - protein, 15 aa, Mycobacterium tuberculosis
RSIQEVISYLDKVDP

SEQ ID NO: 171679 - protein, 15 aa, Mycobacterium tuberculosis
SIQEVISYLDKVDPR

SEQ ID NO: 171680 - protein, 15 aa, Mycobacterium tuberculosis
IQEVISYLDKVDPRA

SEQ ID NO: 171681 - protein, 15 aa, Mycobacterium tuberculosis
QEVISYLDKVDPRAA

SEQ ID NO: 171682 - protein, 15 aa, Mycobacterium tuberculosis
EVISYLDKVDPRAAA

SEQ ID NO: 171683 - protein, 15 aa, Mycobacterium tuberculosis
VISYLDKVDPRAAAR

SEQ ID NO: 171684 - protein, 15 aa, Mycobacterium tuberculosis
ISYLDKVDPRAAARA

SEQ ID NO: 171685 - protein, 15 aa, Mycobacterium tuberculosis
SYLDKVDPRAAARAR

SEQ ID NO: 171686 - protein, 15 aa, Mycobacterium tuberculosis
YLDKVDPRAAARARA

SEQ ID NO: 171687 - protein, 15 aa, Mycobacterium tuberculosis
LDKVDPRAAARARAR

SEQ ID NO: 171688 - protein, 15 aa, Mycobacterium tuberculosis
DKVDPRAAARARARY

SEQ ID NO: 171689 - protein, 15 aa, Mycobacterium tuberculosis
KVDPRAAARARARYA

SEQ ID NO: 171690 - protein, 15 aa, Mycobacterium tuberculosis
VDPRAAARARARYAC

SEQ ID NO: 171691 - protein, 15 aa, Mycobacterium tuberculosis
DPRAAARARARYACF

SEQ ID NO: 171692 - protein, 15 aa, Mycobacterium tuberculosis
PRAAARARARYACFD

SEQ ID NO: 171693 - protein, 15 aa, Mycobacterium tuberculosis
RAAARARARYACFDH

SEQ ID NO: 171694 - protein, 15 aa, Mycobacterium tuberculosis
AAARARARYACFDHA

SEQ ID NO: 171695 - protein, 15 aa, Mycobacterium tuberculosis
AARARARYACFDHAC

SEQ ID NO: 171696 - protein, 15 aa, Mycobacterium tuberculosis
ARARARYACFDHACA

SEQ ID NO: 171697 - protein, 15 aa, Mycobacterium tuberculosis
RARARYACFDHACAD

SEQ ID NO: 171698 - protein, 15 aa, Mycobacterium tuberculosis
ARARYACFDHACADD

SEQ ID NO: 171699 - protein, 15 aa, Mycobacterium tuberculosis
RARYACFDHACADDG

SEQ ID NO: 171700 - protein, 15 aa, Mycobacterium tuberculosis
ARYACFDHACADDGQ

SEQ ID NO: 171701 - protein, 15 aa, Mycobacterium tuberculosis
RYACFDHACADDGQA

SEQ ID NO: 171702 - protein, 15 aa, Mycobacterium tuberculosis
YACFDHACADDGQAY

SEQ ID NO: 171703 - protein, 15 aa, Mycobacterium tuberculosis
ACFDHACADDGQAYG

SEQ ID NO: 171704 - protein, 15 aa, Mycobacterium tuberculosis
CFDHACADDGQAYGF

SEQ ID NO: 171705 - protein, 15 aa, Mycobacterium tuberculosis
FDHACADDGQAYGFA

SEQ ID NO: 171706 - protein, 15 aa, Mycobacterium tuberculosis
DHACADDGQAYGFAA

SEQ ID NO: 171707 - protein, 15 aa, Mycobacterium tuberculosis
HACADDGQAYGFAAA

SEQ ID NO: 171708 - protein, 15 aa, Mycobacterium tuberculosis
ACADDGQAYGFAAAF

SEQ ID NO: 171709 - protein, 15 aa, Mycobacterium tuberculosis
CADDGQAYGFAAAFG

SEQ ID NO: 171710 - protein, 15 aa, Mycobacterium tuberculosis
ADDGQAYGFAAAFGA

SEQ ID NO: 171711 - protein, 15 aa, Mycobacterium tuberculosis
DDGQAYGFAAAFGAG

SEQ ID NO: 171712 - protein, 15 aa, Mycobacterium tuberculosis
DGQAYGFAAAFGAGP

SEQ ID NO: 171713 - protein, 15 aa, Mycobacterium tuberculosis
GQAYGFAAAFGAGPS

SEQ ID NO: 171714 - protein, 15 aa, Mycobacterium tuberculosis
QAYGFAAAFGAGPSC

SEQ ID NO: 171715 - protein, 15 aa, Mycobacterium tuberculosis
AYGFAAAFGAGPSCE

SEQ ID NO: 171716 - protein, 15 aa, Mycobacterium tuberculosis
YGFAAAFGAGPSCER

SEQ ID NO: 171717 - protein, 15 aa, Mycobacterium tuberculosis
GFAAAFGAGPSCERE

SEQ ID NO: 171718 - protein, 15 aa, Mycobacterium tuberculosis
FAAAFGAGPSCEREA

SEQ ID NO: 171719 - protein, 15 aa, Mycobacterium tuberculosis
AAAFGAGPSCEREAV

SEQ ID NO: 171720 - protein, 15 aa, Mycobacterium tuberculosis
AAFGAGPSCEREAVE

SEQ ID NO: 171721 - protein, 15 aa, Mycobacterium tuberculosis
AFGAGPSCEREAVEQ

SEQ ID NO: 171722 - protein, 15 aa, Mycobacterium tuberculosis
FGAGPSCEREAVEQL

SEQ ID NO: 171723 - protein, 15 aa, Mycobacterium tuberculosis
GAGPSCEREAVEQLV

SEQ ID NO: 171724 - protein, 15 aa, Mycobacterium tuberculosis
AGPSCEREAVEQLVD

SEQ ID NO: 171725 - protein, 15 aa, Mycobacterium tuberculosis
GPSCEREAVEQLVDV

SEQ ID NO: 171726 - protein, 15 aa, Mycobacterium tuberculosis
PSCEREAVEQLVDVQ

SEQ ID NO: 171727 - protein, 15 aa, Mycobacterium tuberculosis
SCEREAVEQLVDVQR

SEQ ID NO: 171728 - protein, 15 aa, Mycobacterium tuberculosis
CEREAVEQLVDVQRN

SEQ ID NO: 171729 - protein, 15 aa, Mycobacterium tuberculosis
EREAVEQLVDVQRNA

SEQ ID NO: 171730 - protein, 15 aa, Mycobacterium tuberculosis
REAVEQLVDVQRNAL

SEQ ID NO: 171731 - protein, 15 aa, Mycobacterium tuberculosis
EAVEQLVDVQRNALA

SEQ ID NO: 171732 - protein, 15 aa, Mycobacterium tuberculosis
AVEQLVDVQRNALAY

SEQ ID NO: 171733 - protein, 15 aa, Mycobacterium tuberculosis
VEQLVDVQRNALAYA

SEQ ID NO: 171734 - protein, 15 aa, Mycobacterium tuberculosis
EQLVDVQRNALAYAR

SEQ ID NO: 171735 - protein, 15 aa, Mycobacterium tuberculosis
QLVDVQRNALAYARQ

SEQ ID NO: 171736 - protein, 15 aa, Mycobacterium tuberculosis
LVDVQRNALAYARQD

SEQ ID NO: 171737 - protein, 15 aa, Mycobacterium tuberculosis
VDVQRNALAYARQDG

SEQ ID NO: 171738 - protein, 15 aa, Mycobacterium tuberculosis
DVQRNALAYARQDGL

SEQ ID NO: 171739 - protein, 15 aa, Mycobacterium tuberculosis
VQRNALAYARQDGLL

SEQ ID NO: 171740 - protein, 15 aa, Mycobacterium tuberculosis
QRNALAYARQDGLLA

SEQ ID NO: 171741 - protein, 15 aa, Mycobacterium tuberculosis
RNALAYARQDGLLAE

SEQ ID NO: 171742 - protein, 15 aa, Mycobacterium tuberculosis
NALAYARQDGLLAED

SEQ ID NO: 171743 - protein, 15 aa, Mycobacterium tuberculosis
ALAYARQDGLLAEDE

SEQ ID NO: 171744 - protein, 15 aa, Mycobacterium tuberculosis
LAYARQDGLLAEDEL

SEQ ID NO: 171745 - protein, 15 aa, Mycobacterium tuberculosis
AYARQDGLLAEDELF

SEQ ID NO: 171746 - protein, 15 aa, Mycobacterium tuberculosis
YARQDGLLAEDELFY

SEQ ID NO: 171747 - protein, 15 aa, Mycobacterium tuberculosis
ARQDGLLAEDELFYA

SEQ ID NO: 171748 - protein, 15 aa, Mycobacterium tuberculosis
RQDGLLAEDELFYAQ

SEQ ID NO: 171749 - protein, 15 aa, Mycobacterium tuberculosis
QDGLLAEDELFYAQQ

SEQ ID NO: 171750 - protein, 15 aa, Mycobacterium tuberculosis
DGLLAEDELFYAQQN

SEQ ID NO: 171751 - protein, 15 aa, Mycobacterium tuberculosis
GLLAEDELFYAQQNA

SEQ ID NO: 171752 - protein, 15 aa, Mycobacterium tuberculosis
LLAEDELFYAQQNAQ

SEQ ID NO: 171753 - protein, 15 aa, Mycobacterium tuberculosis
LAEDELFYAQQNAQT

SEQ ID NO: 171754 - protein, 15 aa, Mycobacterium tuberculosis
AEDELFYAQQNAQTV

SEQ ID NO: 171755 - protein, 15 aa, Mycobacterium tuberculosis
EDELFYAQQNAQTVR

SEQ ID NO: 171756 - protein, 15 aa, Mycobacterium tuberculosis
DELFYAQQNAQTVRD

SEQ ID NO: 171757 - protein, 15 aa, Mycobacterium tuberculosis
ELFYAQQNAQTVRDA

SEQ ID NO: 171758 - protein, 15 aa, Mycobacterium tuberculosis
LFYAQQNAQTVRDAE

SEQ ID NO: 171759 - protein, 15 aa, Mycobacterium tuberculosis
FYAQQNAQTVRDAEV

SEQ ID NO: 171760 - protein, 15 aa, Mycobacterium tuberculosis
YAQQNAQTVRDAEVY

SEQ ID NO: 171761 - protein, 15 aa, Mycobacterium tuberculosis
AQQNAQTVRDAEVYY

SEQ ID NO: 171762 - protein, 15 aa, Mycobacterium tuberculosis
QQNAQTVRDAEVYYR

SEQ ID NO: 171763 - protein, 15 aa, Mycobacterium tuberculosis
QNAQTVRDAEVYYRA

SEQ ID NO: 171764 - protein, 15 aa, Mycobacterium tuberculosis
NAQTVRDAEVYYRAM

SEQ ID NO: 171765 - protein, 15 aa, Mycobacterium tuberculosis
AQTVRDAEVYYRAMF

SEQ ID NO: 171766 - protein, 15 aa, Mycobacterium tuberculosis
QTVRDAEVYYRAMFS

SEQ ID NO: 171767 - protein, 15 aa, Mycobacterium tuberculosis
TVRDAEVYYRAMFSG

SEQ ID NO: 171768 - protein, 15 aa, Mycobacterium tuberculosis
VRDAEVYYRAMFSGR

SEQ ID NO: 171769 - protein, 15 aa, Mycobacterium tuberculosis
RDAEVYYRAMFSGRV

SEQ ID NO: 171770 - protein, 15 aa, Mycobacterium tuberculosis
DAEVYYRAMFSGRVT

SEQ ID NO: 171771 - protein, 15 aa, Mycobacterium tuberculosis
AEVYYRAMFSGRVTS

SEQ ID NO: 171772 - protein, 15 aa, Mycobacterium tuberculosis
EVYYRAMFSGRVTSW

SEQ ID NO: 171773 - protein, 15 aa, Mycobacterium tuberculosis
VYYRAMFSGRVTSWN

SEQ ID NO: 171774 - protein, 15 aa, Mycobacterium tuberculosis
YYRAMFSGRVTSWNL

SEQ ID NO: 171775 - protein, 15 aa, Mycobacterium tuberculosis
YRAMFSGRVTSWNLR

SEQ ID NO: 171776 - protein, 15 aa, Mycobacterium tuberculosis
RAMFSGRVTSWNLRD

SEQ ID NO: 171777 - protein, 15 aa, Mycobacterium tuberculosis
AMFSGRVTSWNLRDQ

SEQ ID NO: 171778 - protein, 15 aa, Mycobacterium tuberculosis
MFSGRVTSWNLRDQH

SEQ ID NO: 171779 - protein, 15 aa, Mycobacterium tuberculosis
FSGRVTSWNLRDQHM

SEQ ID NO: 171780 - protein, 15 aa, Mycobacterium tuberculosis
SGRVTSWNLRDQHMA

SEQ ID NO: 171781 - protein, 15 aa, Mycobacterium tuberculosis
GRVTSWNLRDQHMAQ

SEQ ID NO: 171782 - protein, 15 aa, Mycobacterium tuberculosis
RVTSWNLRDQHMAQT

SEQ ID NO: 171783 - protein, 15 aa, Mycobacterium tuberculosis
VTSWNLRDQHMAQTL

SEQ ID NO: 171784 - protein, 15 aa, Mycobacterium tuberculosis
TSWNLRDQHMAQTLG

SEQ ID NO: 171785 - protein, 15 aa, Mycobacterium tuberculosis
SWNLRDQHMAQTLGS

SEQ ID NO: 171786 - protein, 15 aa, Mycobacterium tuberculosis
WNLRDQHMAQTLGSL

SEQ ID NO: 171787 - protein, 15 aa, Mycobacterium tuberculosis
NLRDQHMAQTLGSLL

SEQ ID NO: 171788 - protein, 15 aa, Mycobacterium tuberculosis
LRDQHMAQTLGSLLT

SEQ ID NO: 171789 - protein, 15 aa, Mycobacterium tuberculosis
RDQHMAQTLGSLLTH

SEQ ID NO: 171790 - protein, 15 aa, Mycobacterium tuberculosis
DQHMAQTLGSLLTHL

SEQ ID NO: 171791 - protein, 15 aa, Mycobacterium tuberculosis
QHMAQTLGSLLTHLD

SEQ ID NO: 171792 - protein, 15 aa, Mycobacterium tuberculosis
HMAQTLGSLLTHLDR

SEQ ID NO: 171793 - protein, 15 aa, Mycobacterium tuberculosis
MAQTLGSLLTHLDRH

SEQ ID NO: 171794 - protein, 15 aa, Mycobacterium tuberculosis
AQTLGSLLTHLDRHL

SEQ ID NO: 171795 - protein, 15 aa, Mycobacterium tuberculosis
QTLGSLLTHLDRHLD

SEQ ID NO: 171796 - protein, 15 aa, Mycobacterium tuberculosis
TLGSLLTHLDRHLDA

SEQ ID NO: 171797 - protein, 15 aa, Mycobacterium tuberculosis
LGSLLTHLDRHLDAP

SEQ ID NO: 171798 - protein, 15 aa, Mycobacterium tuberculosis
GSLLTHLDRHLDAPP

SEQ ID NO: 171799 - protein, 15 aa, Mycobacterium tuberculosis
SLLTHLDRHLDAPPA

SEQ ID NO: 171800 - protein, 15 aa, Mycobacterium tuberculosis
LLTHLDRHLDAPPAR

SEQ ID NO: 171801 - protein, 15 aa, Mycobacterium tuberculosis
LTHLDRHLDAPPARI

SEQ ID NO: 171802 - protein, 15 aa, Mycobacterium tuberculosis
THLDRHLDAPPARIV

SEQ ID NO: 171803 - protein, 15 aa, Mycobacterium tuberculosis
HLDRHLDAPPARIVV

SEQ ID NO: 171804 - protein, 15 aa, Mycobacterium tuberculosis
LDRHLDAPPARIVVW

SEQ ID NO: 171805 - protein, 15 aa, Mycobacterium tuberculosis
DRHLDAPPARIVVWA

SEQ ID NO: 171806 - protein, 15 aa, Mycobacterium tuberculosis
RHLDAPPARIVVWAH

SEQ ID NO: 171807 - protein, 15 aa, Mycobacterium tuberculosis
HLDAPPARIVVWAHN

SEQ ID NO: 171808 - protein, 15 aa, Mycobacterium tuberculosis
LDAPPARIVVWAHNS

SEQ ID NO: 171809 - protein, 15 aa, Mycobacterium tuberculosis
DAPPARIVVWAHNSH

SEQ ID NO: 171810 - protein, 15 aa, Mycobacterium tuberculosis
APPARIVVWAHNSHV

SEQ ID NO: 171811 - protein, 15 aa, Mycobacterium tuberculosis
PPARIVVWAHNSHVG

SEQ ID NO: 171812 - protein, 15 aa, Mycobacterium tuberculosis
PARIVVWAHNSHVGD

SEQ ID NO: 171813 - protein, 15 aa, Mycobacterium tuberculosis
ARIVVWAHNSHVGDA

SEQ ID NO: 171814 - protein, 15 aa, Mycobacterium tuberculosis
RIVVWAHNSHVGDAR

SEQ ID NO: 171815 - protein, 15 aa, Mycobacterium tuberculosis
IVVWAHNSHVGDARA

SEQ ID NO: 171816 - protein, 15 aa, Mycobacterium tuberculosis
VVWAHNSHVGDARAT

SEQ ID NO: 171817 - protein, 15 aa, Mycobacterium tuberculosis
VWAHNSHVGDARATE

SEQ ID NO: 171818 - protein, 15 aa, Mycobacterium tuberculosis
WAHNSHVGDARATEV

SEQ ID NO: 171819 - protein, 15 aa, Mycobacterium tuberculosis
AHNSHVGDARATEVW

SEQ ID NO: 171820 - protein, 15 aa, Mycobacterium tuberculosis
HNSHVGDARATEVWA

SEQ ID NO: 171821 - protein, 15 aa, Mycobacterium tuberculosis
NSHVGDARATEVWAD

SEQ ID NO: 171822 - protein, 15 aa, Mycobacterium tuberculosis
SHVGDARATEVWADG

SEQ ID NO: 171823 - protein, 15 aa, Mycobacterium tuberculosis
HVGDARATEVWADGQ

SEQ ID NO: 171824 - protein, 15 aa, Mycobacterium tuberculosis
VGDARATEVWADGQL

SEQ ID NO: 171825 - protein, 15 aa, Mycobacterium tuberculosis
GDARATEVWADGQLT

SEQ ID NO: 171826 - protein, 15 aa, Mycobacterium tuberculosis
DARATEVWADGQLTL

SEQ ID NO: 171827 - protein, 15 aa, Mycobacterium tuberculosis
ARATEVWADGQLTLG

SEQ ID NO: 171828 - protein, 15 aa, Mycobacterium tuberculosis
RATEVWADGQLTLGQ

SEQ ID NO: 171829 - protein, 15 aa, Mycobacterium tuberculosis
ATEVWADGQLTLGQI

SEQ ID NO: 171830 - protein, 15 aa, Mycobacterium tuberculosis
TEVWADGQLTLGQIV

SEQ ID NO: 171831 - protein, 15 aa, Mycobacterium tuberculosis
EVWADGQLTLGQIVR

SEQ ID NO: 171832 - protein, 15 aa, Mycobacterium tuberculosis
VWADGQLTLGQIVRE

SEQ ID NO: 171833 - protein, 15 aa, Mycobacterium tuberculosis
WADGQLTLGQIVRER

SEQ ID NO: 171834 - protein, 15 aa, Mycobacterium tuberculosis
ADGQLTLGQIVRERY

SEQ ID NO: 171835 - protein, 15 aa, Mycobacterium tuberculosis
DGQLTLGQIVRERYG

SEQ ID NO: 171836 - protein, 15 aa, Mycobacterium tuberculosis
GQLTLGQIVRERYGD

SEQ ID NO: 171837 - protein, 15 aa, Mycobacterium tuberculosis
QLTLGQIVRERYGDE

SEQ ID NO: 171838 - protein, 15 aa, Mycobacterium tuberculosis
LTLGQIVRERYGDES

SEQ ID NO: 171839 - protein, 15 aa, Mycobacterium tuberculosis
TLGQIVRERYGDESR

SEQ ID NO: 171840 - protein, 15 aa, Mycobacterium tuberculosis
LGQIVRERYGDESRS

SEQ ID NO: 171841 - protein, 15 aa, Mycobacterium tuberculosis
GQIVRERYGDESRSI

SEQ ID NO: 171842 - protein, 15 aa, Mycobacterium tuberculosis
QIVRERYGDESRSIG

SEQ ID NO: 171843 - protein, 15 aa, Mycobacterium tuberculosis
IVRERYGDESRSIGF

SEQ ID NO: 171844 - protein, 15 aa, Mycobacterium tuberculosis
VRERYGDESRSIGFS

SEQ ID NO: 171845 - protein, 15 aa, Mycobacterium tuberculosis
RERYGDESRSIGFST

SEQ ID NO: 171846 - protein, 15 aa, Mycobacterium tuberculosis
ERYGDESRSIGFSTY

SEQ ID NO: 171847 - protein, 15 aa, Mycobacterium tuberculosis
RYGDESRSIGFSTYT

SEQ ID NO: 171848 - protein, 15 aa, Mycobacterium tuberculosis
YGDESRSIGFSTYTG

SEQ ID NO: 171849 - protein, 15 aa, Mycobacterium tuberculosis
GDESRSIGFSTYTGT

SEQ ID NO: 171850 - protein, 15 aa, Mycobacterium tuberculosis
DESRSIGFSTYTGTV

SEQ ID NO: 171851 - protein, 15 aa, Mycobacterium tuberculosis
ESRSIGFSTYTGTVT

SEQ ID NO: 171852 - protein, 15 aa, Mycobacterium tuberculosis
SRSIGFSTYTGTVTA

SEQ ID NO: 171853 - protein, 15 aa, Mycobacterium tuberculosis
RSIGFSTYTGTVTAA

SEQ ID NO: 171854 - protein, 15 aa, Mycobacterium tuberculosis
SIGFSTYTGTVTAAS

SEQ ID NO: 171855 - protein, 15 aa, Mycobacterium tuberculosis
IGFSTYTGTVTAASE

SEQ ID NO: 171856 - protein, 15 aa, Mycobacterium tuberculosis
GFSTYTGTVTAASEW

SEQ ID NO: 171857 - protein, 15 aa, Mycobacterium tuberculosis
FSTYTGTVTAASEWG

SEQ ID NO: 171858 - protein, 15 aa, Mycobacterium tuberculosis
STYTGTVTAASEWGG

SEQ ID NO: 171859 - protein, 15 aa, Mycobacterium tuberculosis
TYTGTVTAASEWGGI

SEQ ID NO: 171860 - protein, 15 aa, Mycobacterium tuberculosis
YTGTVTAASEWGGIA

SEQ ID NO: 171861 - protein, 15 aa, Mycobacterium tuberculosis
TGTVTAASEWGGIAQ

SEQ ID NO: 171862 - protein, 15 aa, Mycobacterium tuberculosis
GTVTAASEWGGIAQR

SEQ ID NO: 171863 - protein, 15 aa, Mycobacterium tuberculosis
TVTAASEWGGIAQRK

SEQ ID NO: 171864 - protein, 15 aa, Mycobacterium tuberculosis
VTAASEWGGIAQRKA

SEQ ID NO: 171865 - protein, 15 aa, Mycobacterium tuberculosis
TAASEWGGIAQRKAV

SEQ ID NO: 171866 - protein, 15 aa, Mycobacterium tuberculosis
AASEWGGIAQRKAVR

SEQ ID NO: 171867 - protein, 15 aa, Mycobacterium tuberculosis
ASEWGGIAQRKAVRP

SEQ ID NO: 171868 - protein, 15 aa, Mycobacterium tuberculosis
SEWGGIAQRKAVRPA

SEQ ID NO: 171869 - protein, 15 aa, Mycobacterium tuberculosis
EWGGIAQRKAVRPAL

SEQ ID NO: 171870 - protein, 15 aa, Mycobacterium tuberculosis
WGGIAQRKAVRPALH

SEQ ID NO: 171871 - protein, 15 aa, Mycobacterium tuberculosis
GGIAQRKAVRPALHG

SEQ ID NO: 171872 - protein, 15 aa, Mycobacterium tuberculosis
GIAQRKAVRPALHGS

SEQ ID NO: 171873 - protein, 15 aa, Mycobacterium tuberculosis
IAQRKAVRPALHGSV

SEQ ID NO: 171874 - protein, 15 aa, Mycobacterium tuberculosis
AQRKAVRPALHGSVE

SEQ ID NO: 171875 - protein, 15 aa, Mycobacterium tuberculosis
QRKAVRPALHGSVEE

SEQ ID NO: 171876 - protein, 15 aa, Mycobacterium tuberculosis
RKAVRPALHGSVEEL

SEQ ID NO: 171877 - protein, 15 aa, Mycobacterium tuberculosis
KAVRPALHGSVEELF

SEQ ID NO: 171878 - protein, 15 aa, Mycobacterium tuberculosis
AVRPALHGSVEELFH

SEQ ID NO: 171879 - protein, 15 aa, Mycobacterium tuberculosis
VRPALHGSVEELFHQ

SEQ ID NO: 171880 - protein, 15 aa, Mycobacterium tuberculosis
RPALHGSVEELFHQT

SEQ ID NO: 171881 - protein, 15 aa, Mycobacterium tuberculosis
PALHGSVEELFHQTA

SEQ ID NO: 171882 - protein, 15 aa, Mycobacterium tuberculosis
ALHGSVEELFHQTAD

SEQ ID NO: 171883 - protein, 15 aa, Mycobacterium tuberculosis
LHGSVEELFHQTADS

SEQ ID NO: 171884 - protein, 15 aa, Mycobacterium tuberculosis
HGSVEELFHQTADSF

SEQ ID NO: 171885 - protein, 15 aa, Mycobacterium tuberculosis
GSVEELFHQTADSFL

SEQ ID NO: 171886 - protein, 15 aa, Mycobacterium tuberculosis
SVEELFHQTADSFLV

SEQ ID NO: 171887 - protein, 15 aa, Mycobacterium tuberculosis
VEELFHQTADSFLVS

SEQ ID NO: 171888 - protein, 15 aa, Mycobacterium tuberculosis
EELFHQTADSFLVSA

SEQ ID NO: 171889 - protein, 15 aa, Mycobacterium tuberculosis
ELFHQTADSFLVSAR

SEQ ID NO: 171890 - protein, 15 aa, Mycobacterium tuberculosis
LFHQTADSFLVSARL

SEQ ID NO: 171891 - protein, 15 aa, Mycobacterium tuberculosis
FHQTADSFLVSARLS

SEQ ID NO: 171892 - protein, 15 aa, Mycobacterium tuberculosis
HQTADSFLVSARLSR

SEQ ID NO: 171893 - protein, 15 aa, Mycobacterium tuberculosis
QTADSFLVSARLSRD

SEQ ID NO: 171894 - protein, 15 aa, Mycobacterium tuberculosis
TADSFLVSARLSRDA

SEQ ID NO: 171895 - protein, 15 aa, Mycobacterium tuberculosis
ADSFLVSARLSRDAE

SEQ ID NO: 171896 - protein, 15 aa, Mycobacterium tuberculosis
DSFLVSARLSRDAEA

SEQ ID NO: 171897 - protein, 15 aa, Mycobacterium tuberculosis
SFLVSARLSRDAEAP

SEQ ID NO: 171898 - protein, 15 aa, Mycobacterium tuberculosis
FLVSARLSRDAEAPL

SEQ ID NO: 171899 - protein, 15 aa, Mycobacterium tuberculosis
LVSARLSRDAEAPLD

SEQ ID NO: 171900 - protein, 15 aa, Mycobacterium tuberculosis
VSARLSRDAEAPLDV

SEQ ID NO: 171901 - protein, 15 aa, Mycobacterium tuberculosis
SARLSRDAEAPLDVV

SEQ ID NO: 171902 - protein, 15 aa, Mycobacterium tuberculosis
ARLSRDAEAPLDVVR

SEQ ID NO: 171903 - protein, 15 aa, Mycobacterium tuberculosis
RLSRDAEAPLDVVRL

SEQ ID NO: 171904 - protein, 15 aa, Mycobacterium tuberculosis
LSRDAEAPLDVVRLG

SEQ ID NO: 171905 - protein, 15 aa, Mycobacterium tuberculosis
SRDAEAPLDVVRLGR

SEQ ID NO: 171906 - protein, 15 aa, Mycobacterium tuberculosis
RDAEAPLDVVRLGRA

SEQ ID NO: 171907 - protein, 15 aa, Mycobacterium tuberculosis
DAEAPLDVVRLGRAI

SEQ ID NO: 171908 - protein, 15 aa, Mycobacterium tuberculosis
AEAPLDVVRLGRAIG

SEQ ID NO: 171909 - protein, 15 aa, Mycobacterium tuberculosis
EAPLDVVRLGRAIGV

SEQ ID NO: 171910 - protein, 15 aa, Mycobacterium tuberculosis
APLDVVRLGRAIGVV

SEQ ID NO: 171911 - protein, 15 aa, Mycobacterium tuberculosis
PLDVVRLGRAIGVVY

SEQ ID NO: 171912 - protein, 15 aa, Mycobacterium tuberculosis
LDVVRLGRAIGVVYL

SEQ ID NO: 171913 - protein, 15 aa, Mycobacterium tuberculosis
DVVRLGRAIGVVYLP

SEQ ID NO: 171914 - protein, 15 aa, Mycobacterium tuberculosis
VVRLGRAIGVVYLPA

SEQ ID NO: 171915 - protein, 15 aa, Mycobacterium tuberculosis
VRLGRAIGVVYLPAT

SEQ ID NO: 171916 - protein, 15 aa, Mycobacterium tuberculosis
RLGRAIGVVYLPATE

SEQ ID NO: 171917 - protein, 15 aa, Mycobacterium tuberculosis
LGRAIGVVYLPATER

SEQ ID NO: 171918 - protein, 15 aa, Mycobacterium tuberculosis
GRAIGVVYLPATERQ

SEQ ID NO: 171919 - protein, 15 aa, Mycobacterium tuberculosis
RAIGVVYLPATERQS

SEQ ID NO: 171920 - protein, 15 aa, Mycobacterium tuberculosis
AIGVVYLPATERQSH

SEQ ID NO: 171921 - protein, 15 aa, Mycobacterium tuberculosis
IGVVYLPATERQSHY

SEQ ID NO: 171922 - protein, 15 aa, Mycobacterium tuberculosis
GVVYLPATERQSHYL

SEQ ID NO: 171923 - protein, 15 aa, Mycobacterium tuberculosis
VVYLPATERQSHYLH

SEQ ID NO: 171924 - protein, 15 aa, Mycobacterium tuberculosis
VYLPATERQSHYLHV

SEQ ID NO: 171925 - protein, 15 aa, Mycobacterium tuberculosis
YLPATERQSHYLHVR

SEQ ID NO: 171926 - protein, 15 aa, Mycobacterium tuberculosis
LPATERQSHYLHVRP

SEQ ID NO: 171927 - protein, 15 aa, Mycobacterium tuberculosis
PATERQSHYLHVRPA

SEQ ID NO: 171928 - protein, 15 aa, Mycobacterium tuberculosis
ATERQSHYLHVRPAD

SEQ ID NO: 171929 - protein, 15 aa, Mycobacterium tuberculosis
TERQSHYLHVRPADQ

SEQ ID NO: 171930 - protein, 15 aa, Mycobacterium tuberculosis
ERQSHYLHVRPADQF

SEQ ID NO: 171931 - protein, 15 aa, Mycobacterium tuberculosis
RQSHYLHVRPADQFD

SEQ ID NO: 171932 - protein, 15 aa, Mycobacterium tuberculosis
QSHYLHVRPADQFDA

SEQ ID NO: 171933 - protein, 15 aa, Mycobacterium tuberculosis
SHYLHVRPADQFDAM

SEQ ID NO: 171934 - protein, 15 aa, Mycobacterium tuberculosis
HYLHVRPADQFDAMI

SEQ ID NO: 171935 - protein, 15 aa, Mycobacterium tuberculosis
YLHVRPADQFDAMIH

SEQ ID NO: 171936 - protein, 15 aa, Mycobacterium tuberculosis
LHVRPADQFDAMIHI

SEQ ID NO: 171937 - protein, 15 aa, Mycobacterium tuberculosis
HVRPADQFDAMIHID

SEQ ID NO: 171938 - protein, 15 aa, Mycobacterium tuberculosis
VRPADQFDAMIHIDQ

SEQ ID NO: 171939 - protein, 15 aa, Mycobacterium tuberculosis
RPADQFDAMIHIDQT

SEQ ID NO: 171940 - protein, 15 aa, Mycobacterium tuberculosis
PADQFDAMIHIDQTR

SEQ ID NO: 171941 - protein, 15 aa, Mycobacterium tuberculosis
ADQFDAMIHIDQTRA

SEQ ID NO: 171942 - protein, 15 aa, Mycobacterium tuberculosis
DQFDAMIHIDQTRAL

SEQ ID NO: 171943 - protein, 15 aa, Mycobacterium tuberculosis
QFDAMIHIDQTRALE

SEQ ID NO: 171944 - protein, 15 aa, Mycobacterium tuberculosis
FDAMIHIDQTRALEP

SEQ ID NO: 171945 - protein, 15 aa, Mycobacterium tuberculosis
DAMIHIDQTRALEPL

SEQ ID NO: 171946 - protein, 15 aa, Mycobacterium tuberculosis
AMIHIDQTRALEPLE

SEQ ID NO: 171947 - protein, 15 aa, Mycobacterium tuberculosis
MIHIDQTRALEPLEV

SEQ ID NO: 171948 - protein, 15 aa, Mycobacterium tuberculosis
IHIDQTRALEPLEVT

SEQ ID NO: 171949 - protein, 15 aa, Mycobacterium tuberculosis
HIDQTRALEPLEVTS

SEQ ID NO: 171950 - protein, 15 aa, Mycobacterium tuberculosis
IDQTRALEPLEVTSR

SEQ ID NO: 171951 - protein, 15 aa, Mycobacterium tuberculosis
DQTRALEPLEVTSRW

SEQ ID NO: 171952 - protein, 15 aa, Mycobacterium tuberculosis
QTRALEPLEVTSRWI

SEQ ID NO: 171953 - protein, 15 aa, Mycobacterium tuberculosis
TRALEPLEVTSRWIA

SEQ ID NO: 171954 - protein, 15 aa, Mycobacterium tuberculosis
RALEPLEVTSRWIAG

SEQ ID NO: 171955 - protein, 15 aa, Mycobacterium tuberculosis
ALEPLEVTSRWIAGE

SEQ ID NO: 171956 - protein, 15 aa, Mycobacterium tuberculosis
LEPLEVTSRWIAGEN

SEQ ID NO: 171957 - protein, 15 aa, Mycobacterium tuberculosis
EPLEVTSRWIAGENP

SEQ ID NO: 171958 - protein, 15 aa, Mycobacterium tuberculosis
PLEVTSRWIAGENPE

SEQ ID NO: 171959 - protein, 15 aa, Mycobacterium tuberculosis
LEVTSRWIAGENPET

SEQ ID NO: 171960 - protein, 15 aa, Mycobacterium tuberculosis
EVTSRWIAGENPETY

SEQ ID NO: 171961 - protein, 15 aa, Mycobacterium tuberculosis
VTSRWIAGENPETYP

SEQ ID NO: 171962 - protein, 15 aa, Mycobacterium tuberculosis
TSRWIAGENPETYPT

SEQ ID NO: 171963 - protein, 15 aa, Mycobacterium tuberculosis
SRWIAGENPETYPTG

SEQ ID NO: 171964 - protein, 15 aa, Mycobacterium tuberculosis
RWIAGENPETYPTGL

SEQ ID NO: 171965 - protein, 16 aa, Mycobacterium tuberculosis
MLMTAAADVTRRSPRR

SEQ ID NO: 171966 - protein, 16 aa, Mycobacterium tuberculosis
LMTAAADVTRRSPRRV

SEQ ID NO: 171967 - protein, 16 aa, Mycobacterium tuberculosis
MTAAADVTRRSPRRVF

SEQ ID NO: 171968 - protein, 16 aa, Mycobacterium tuberculosis
TAAADVTRRSPRRVFR

SEQ ID NO: 171969 - protein, 16 aa, Mycobacterium tuberculosis
AAADVTRRSPRRVFRD

SEQ ID NO: 171970 - protein, 16 aa, Mycobacterium tuberculosis
AADVTRRSPRRVFRDR

SEQ ID NO: 171971 - protein, 16 aa, Mycobacterium tuberculosis
ADVTRRSPRRVFRDRR

SEQ ID NO: 171972 - protein, 16 aa, Mycobacterium tuberculosis
DVTRRSPRRVFRDRRE

SEQ ID NO: 171973 - protein, 16 aa, Mycobacterium tuberculosis
VTRRSPRRVFRDRREA

SEQ ID NO: 171974 - protein, 16 aa, Mycobacterium tuberculosis
TRRSPRRVFRDRREAG

SEQ ID NO: 171975 - protein, 16 aa, Mycobacterium tuberculosis
RRSPRRVFRDRREAGR

SEQ ID NO: 171976 - protein, 16 aa, Mycobacterium tuberculosis
RSPRRVFRDRREAGRV

SEQ ID NO: 171977 - protein, 16 aa, Mycobacterium tuberculosis
SPRRVFRDRREAGRVL

SEQ ID NO: 171978 - protein, 16 aa, Mycobacterium tuberculosis
PRRVFRDRREAGRVLA

SEQ ID NO: 171979 - protein, 16 aa, Mycobacterium tuberculosis
RRVFRDRREAGRVLAE

SEQ ID NO: 171980 - protein, 16 aa, Mycobacterium tuberculosis
RVFRDRREAGRVLAEL

SEQ ID NO: 171981 - protein, 16 aa, Mycobacterium tuberculosis
VFRDRREAGRVLAELL

SEQ ID NO: 171982 - protein, 16 aa, Mycobacterium tuberculosis
FRDRREAGRVLAELLA

SEQ ID NO: 171983 - protein, 16 aa, Mycobacterium tuberculosis
RDRREAGRVLAELLAA

SEQ ID NO: 171984 - protein, 16 aa, Mycobacterium tuberculosis
DRREAGRVLAELLAAY

SEQ ID NO: 171985 - protein, 16 aa, Mycobacterium tuberculosis
RREAGRVLAELLAAYR

SEQ ID NO: 171986 - protein, 16 aa, Mycobacterium tuberculosis
REAGRVLAELLAAYRD

SEQ ID NO: 171987 - protein, 16 aa, Mycobacterium tuberculosis
EAGRVLAELLAAYRDQ

SEQ ID NO: 171988 - protein, 16 aa, Mycobacterium tuberculosis
AGRVLAELLAAYRDQP

SEQ ID NO: 171989 - protein, 16 aa, Mycobacterium tuberculosis
GRVLAELLAAYRDQPD

SEQ ID NO: 171990 - protein, 16 aa, Mycobacterium tuberculosis
RVLAELLAAYRDQPDV

SEQ ID NO: 171991 - protein, 16 aa, Mycobacterium tuberculosis
VLAELLAAYRDQPDVI

SEQ ID NO: 171992 - protein, 16 aa, Mycobacterium tuberculosis
LAELLAAYRDQPDVIV

SEQ ID NO: 171993 - protein, 16 aa, Mycobacterium tuberculosis
AELLAAYRDQPDVIVL

SEQ ID NO: 171994 - protein, 16 aa, Mycobacterium tuberculosis
ELLAAYRDQPDVIVLG

SEQ ID NO: 171995 - protein, 16 aa, Mycobacterium tuberculosis
LLAAYRDQPDVIVLGL

SEQ ID NO: 171996 - protein, 16 aa, Mycobacterium tuberculosis
LAAYRDQPDVIVLGLA

SEQ ID NO: 171997 - protein, 16 aa, Mycobacterium tuberculosis
AAYRDQPDVIVLGLAR

SEQ ID NO: 171998 - protein, 16 aa, Mycobacterium tuberculosis
AYRDQPDVIVLGLARG

SEQ ID NO: 171999 - protein, 16 aa, Mycobacterium tuberculosis
YRDQPDVIVLGLARGG

SEQ ID NO: 172000 - protein, 16 aa, Mycobacterium tuberculosis
RDQPDVIVLGLARGGL

SEQ ID NO: 172001 - protein, 16 aa, Mycobacterium tuberculosis
DQPDVIVLGLARGGLP

SEQ ID NO: 172002 - protein, 16 aa, Mycobacterium tuberculosis
QPDVIVLGLARGGLPV

SEQ ID NO: 172003 - protein, 16 aa, Mycobacterium tuberculosis
PDVIVLGLARGGLPVA

SEQ ID NO: 172004 - protein, 16 aa, Mycobacterium tuberculosis
DVIVLGLARGGLPVAW

SEQ ID NO: 172005 - protein, 16 aa, Mycobacterium tuberculosis
VIVLGLARGGLPVAWE

SEQ ID NO: 172006 - protein, 16 aa, Mycobacterium tuberculosis
IVLGLARGGLPVAWEV

SEQ ID NO: 172007 - protein, 16 aa, Mycobacterium tuberculosis
VLGLARGGLPVAWEVA

SEQ ID NO: 172008 - protein, 16 aa, Mycobacterium tuberculosis
LGLARGGLPVAWEVAA

SEQ ID NO: 172009 - protein, 16 aa, Mycobacterium tuberculosis
GLARGGLPVAWEVAAA

SEQ ID NO: 172010 - protein, 16 aa, Mycobacterium tuberculosis
LARGGLPVAWEVAAAL

SEQ ID NO: 172011 - protein, 16 aa, Mycobacterium tuberculosis
ARGGLPVAWEVAAALH

SEQ ID NO: 172012 - protein, 16 aa, Mycobacterium tuberculosis
RGGLPVAWEVAAALHA

SEQ ID NO: 172013 - protein, 16 aa, Mycobacterium tuberculosis
GGLPVAWEVAAALHAP

SEQ ID NO: 172014 - protein, 16 aa, Mycobacterium tuberculosis
GLPVAWEVAAALHAPL

SEQ ID NO: 172015 - protein, 16 aa, Mycobacterium tuberculosis
LPVAWEVAAALHAPLD

SEQ ID NO: 172016 - protein, 16 aa, Mycobacterium tuberculosis
PVAWEVAAALHAPLDA

SEQ ID NO: 172017 - protein, 16 aa, Mycobacterium tuberculosis
VAWEVAAALHAPLDAF

SEQ ID NO: 172018 - protein, 16 aa, Mycobacterium tuberculosis
AWEVAAALHAPLDAFV

SEQ ID NO: 172019 - protein, 16 aa, Mycobacterium tuberculosis
WEVAAALHAPLDAFVV

SEQ ID NO: 172020 - protein, 16 aa, Mycobacterium tuberculosis
EVAAALHAPLDAFVVR

SEQ ID NO: 172021 - protein, 16 aa, Mycobacterium tuberculosis
VAAALHAPLDAFVVRK

SEQ ID NO: 172022 - protein, 16 aa, Mycobacterium tuberculosis
AAALHAPLDAFVVRKL

SEQ ID NO: 172023 - protein, 16 aa, Mycobacterium tuberculosis
AALHAPLDAFVVRKLG

SEQ ID NO: 172024 - protein, 16 aa, Mycobacterium tuberculosis
ALHAPLDAFVVRKLGA

SEQ ID NO: 172025 - protein, 16 aa, Mycobacterium tuberculosis
LHAPLDAFVVRKLGAP

SEQ ID NO: 172026 - protein, 16 aa, Mycobacterium tuberculosis
HAPLDAFVVRKLGAPG

SEQ ID NO: 172027 - protein, 16 aa, Mycobacterium tuberculosis
APLDAFVVRKLGAPGH

SEQ ID NO: 172028 - protein, 16 aa, Mycobacterium tuberculosis
PLDAFVVRKLGAPGHD

SEQ ID NO: 172029 - protein, 16 aa, Mycobacterium tuberculosis
LDAFVVRKLGAPGHDE

SEQ ID NO: 172030 - protein, 16 aa, Mycobacterium tuberculosis
DAFVVRKLGAPGHDEF

SEQ ID NO: 172031 - protein, 16 aa, Mycobacterium tuberculosis
AFVVRKLGAPGHDEFA

SEQ ID NO: 172032 - protein, 16 aa, Mycobacterium tuberculosis
FVVRKLGAPGHDEFAV

SEQ ID NO: 172033 - protein, 16 aa, Mycobacterium tuberculosis
VVRKLGAPGHDEFAVG

SEQ ID NO: 172034 - protein, 16 aa, Mycobacterium tuberculosis
VRKLGAPGHDEFAVGA

SEQ ID NO: 172035 - protein, 16 aa, Mycobacterium tuberculosis
RKLGAPGHDEFAVGAL

SEQ ID NO: 172036 - protein, 16 aa, Mycobacterium tuberculosis
KLGAPGHDEFAVGALA

SEQ ID NO: 172037 - protein, 16 aa, Mycobacterium tuberculosis
LGAPGHDEFAVGALAS

SEQ ID NO: 172038 - protein, 16 aa, Mycobacterium tuberculosis
GAPGHDEFAVGALASG

SEQ ID NO: 172039 - protein, 16 aa, Mycobacterium tuberculosis
APGHDEFAVGALASGG

SEQ ID NO: 172040 - protein, 16 aa, Mycobacterium tuberculosis
PGHDEFAVGALASGGR

SEQ ID NO: 172041 - protein, 16 aa, Mycobacterium tuberculosis
GHDEFAVGALASGGRV

SEQ ID NO: 172042 - protein, 16 aa, Mycobacterium tuberculosis
HDEFAVGALASGGRVV

SEQ ID NO: 172043 - protein, 16 aa, Mycobacterium tuberculosis
DEFAVGALASGGRVVV

SEQ ID NO: 172044 - protein, 16 aa, Mycobacterium tuberculosis
EFAVGALASGGRVVVN

SEQ ID NO: 172045 - protein, 16 aa, Mycobacterium tuberculosis
FAVGALASGGRVVVND

SEQ ID NO: 172046 - protein, 16 aa, Mycobacterium tuberculosis
AVGALASGGRVVVNDD

SEQ ID NO: 172047 - protein, 16 aa, Mycobacterium tuberculosis
VGALASGGRVVVNDDV

SEQ ID NO: 172048 - protein, 16 aa, Mycobacterium tuberculosis
GALASGGRVVVNDDVV

SEQ ID NO: 172049 - protein, 16 aa, Mycobacterium tuberculosis
ALASGGRVVVNDDVVR

SEQ ID NO: 172050 - protein, 16 aa, Mycobacterium tuberculosis
LASGGRVVVNDDVVRG

SEQ ID NO: 172051 - protein, 16 aa, Mycobacterium tuberculosis
ASGGRVVVNDDVVRGL

SEQ ID NO: 172052 - protein, 16 aa, Mycobacterium tuberculosis
SGGRVVVNDDVVRGLR

SEQ ID NO: 172053 - protein, 16 aa, Mycobacterium tuberculosis
GGRVVVNDDVVRGLRI

SEQ ID NO: 172054 - protein, 16 aa, Mycobacterium tuberculosis
GRVVVNDDVVRGLRIT

SEQ ID NO: 172055 - protein, 16 aa, Mycobacterium tuberculosis
RVVVNDDVVRGLRITP

SEQ ID NO: 172056 - protein, 16 aa, Mycobacterium tuberculosis
VVVNDDVVRGLRITPQ

SEQ ID NO: 172057 - protein, 16 aa, Mycobacterium tuberculosis
VVNDDVVRGLRITPQQ

SEQ ID NO: 172058 - protein, 16 aa, Mycobacterium tuberculosis
VNDDVVRGLRITPQQL

SEQ ID NO: 172059 - protein, 16 aa, Mycobacterium tuberculosis
NDDVVRGLRITPQQLR

SEQ ID NO: 172060 - protein, 16 aa, Mycobacterium tuberculosis
DDVVRGLRITPQQLRD

SEQ ID NO: 172061 - protein, 16 aa, Mycobacterium tuberculosis
DVVRGLRITPQQLRDI

SEQ ID NO: 172062 - protein, 16 aa, Mycobacterium tuberculosis
VVRGLRITPQQLRDIA

SEQ ID NO: 172063 - protein, 16 aa, Mycobacterium tuberculosis
VRGLRITPQQLRDIAE

SEQ ID NO: 172064 - protein, 16 aa, Mycobacterium tuberculosis
RGLRITPQQLRDIAER

SEQ ID NO: 172065 - protein, 16 aa, Mycobacterium tuberculosis
GLRITPQQLRDIAERE

SEQ ID NO: 172066 - protein, 16 aa, Mycobacterium tuberculosis
LRITPQQLRDIAEREG

SEQ ID NO: 172067 - protein, 16 aa, Mycobacterium tuberculosis
RITPQQLRDIAEREGR

SEQ ID NO: 172068 - protein, 16 aa, Mycobacterium tuberculosis
ITPQQLRDIAEREGRE

SEQ ID NO: 172069 - protein, 16 aa, Mycobacterium tuberculosis
TPQQLRDIAEREGREL

SEQ ID NO: 172070 - protein, 16 aa, Mycobacterium tuberculosis
PQQLRDIAEREGRELL

SEQ ID NO: 172071 - protein, 16 aa, Mycobacterium tuberculosis
QQLRDIAEREGRELLR

SEQ ID NO: 172072 - protein, 16 aa, Mycobacterium tuberculosis
QLRDIAEREGRELLRR

SEQ ID NO: 172073 - protein, 16 aa, Mycobacterium tuberculosis
LRDIAEREGRELLRRE

SEQ ID NO: 172074 - protein, 16 aa, Mycobacterium tuberculosis
RDIAEREGRELLRRES

SEQ ID NO: 172075 - protein, 16 aa, Mycobacterium tuberculosis
DIAEREGRELLRRESA

SEQ ID NO: 172076 - protein, 16 aa, Mycobacterium tuberculosis
IAEREGRELLRRESAY

SEQ ID NO: 172077 - protein, 16 aa, Mycobacterium tuberculosis
AEREGRELLRRESAYR

SEQ ID NO: 172078 - protein, 16 aa, Mycobacterium tuberculosis
EREGRELLRRESAYRG

SEQ ID NO: 172079 - protein, 16 aa, Mycobacterium tuberculosis
REGRELLRRESAYRGE

SEQ ID NO: 172080 - protein, 16 aa, Mycobacterium tuberculosis
EGRELLRRESAYRGER

SEQ ID NO: 172081 - protein, 16 aa, Mycobacterium tuberculosis
GRELLRRESAYRGERP

SEQ ID NO: 172082 - protein, 16 aa, Mycobacterium tuberculosis
RELLRRESAYRGERPP

SEQ ID NO: 172083 - protein, 16 aa, Mycobacterium tuberculosis
ELLRRESAYRGERPPT

SEQ ID NO: 172084 - protein, 16 aa, Mycobacterium tuberculosis
LLRRESAYRGERPPTD

SEQ ID NO: 172085 - protein, 16 aa, Mycobacterium tuberculosis
LRRESAYRGERPPTDI

SEQ ID NO: 172086 - protein, 16 aa, Mycobacterium tuberculosis
RRESAYRGERPPTDIT

SEQ ID NO: 172087 - protein, 16 aa, Mycobacterium tuberculosis
RESAYRGERPPTDITG

SEQ ID NO: 172088 - protein, 16 aa, Mycobacterium tuberculosis
ESAYRGERPPTDITGK

SEQ ID NO: 172089 - protein, 16 aa, Mycobacterium tuberculosis
SAYRGERPPTDITGKT

SEQ ID NO: 172090 - protein, 16 aa, Mycobacterium tuberculosis
AYRGERPPTDITGKTV

SEQ ID NO: 172091 - protein, 16 aa, Mycobacterium tuberculosis
YRGERPPTDITGKTVI

SEQ ID NO: 172092 - protein, 16 aa, Mycobacterium tuberculosis
RGERPPTDITGKTVIV

SEQ ID NO: 172093 - protein, 16 aa, Mycobacterium tuberculosis
GERPPTDITGKTVIVV

SEQ ID NO: 172094 - protein, 16 aa, Mycobacterium tuberculosis
ERPPTDITGKTVIVVD

SEQ ID NO: 172095 - protein, 16 aa, Mycobacterium tuberculosis
RPPTDITGKTVIVVDD

SEQ ID NO: 172096 - protein, 16 aa, Mycobacterium tuberculosis
PPTDITGKTVIVVDDG

SEQ ID NO: 172097 - protein, 16 aa, Mycobacterium tuberculosis
PTDITGKTVIVVDDGL

SEQ ID NO: 172098 - protein, 16 aa, Mycobacterium tuberculosis
TDITGKTVIVVDDGLA

SEQ ID NO: 172099 - protein, 16 aa, Mycobacterium tuberculosis
DITGKTVIVVDDGLAT

SEQ ID NO: 172100 - protein, 16 aa, Mycobacterium tuberculosis
ITGKTVIVVDDGLATG

SEQ ID NO: 172101 - protein, 16 aa, Mycobacterium tuberculosis
TGKTVIVVDDGLATGA

SEQ ID NO: 172102 - protein, 16 aa, Mycobacterium tuberculosis
GKTVIVVDDGLATGAS

SEQ ID NO: 172103 - protein, 16 aa, Mycobacterium tuberculosis
KTVIVVDDGLATGASM

SEQ ID NO: 172104 - protein, 16 aa, Mycobacterium tuberculosis
TVIVVDDGLATGASMF

SEQ ID NO: 172105 - protein, 16 aa, Mycobacterium tuberculosis
VIVVDDGLATGASMFA

SEQ ID NO: 172106 - protein, 16 aa, Mycobacterium tuberculosis
IVVDDGLATGASMFAA

SEQ ID NO: 172107 - protein, 16 aa, Mycobacterium tuberculosis
VVDDGLATGASMFAAV

SEQ ID NO: 172108 - protein, 16 aa, Mycobacterium tuberculosis
VDDGLATGASMFAAVQ

SEQ ID NO: 172109 - protein, 16 aa, Mycobacterium tuberculosis
DDGLATGASMFAAVQA

SEQ ID NO: 172110 - protein, 16 aa, Mycobacterium tuberculosis
DGLATGASMFAAVQAL

SEQ ID NO: 172111 - protein, 16 aa, Mycobacterium tuberculosis
GLATGASMFAAVQALR

SEQ ID NO: 172112 - protein, 16 aa, Mycobacterium tuberculosis
LATGASMFAAVQALRD

SEQ ID NO: 172113 - protein, 16 aa, Mycobacterium tuberculosis
ATGASMFAAVQALRDA

SEQ ID NO: 172114 - protein, 16 aa, Mycobacterium tuberculosis
TGASMFAAVQALRDAQ

SEQ ID NO: 172115 - protein, 16 aa, Mycobacterium tuberculosis
GASMFAAVQALRDAQP

SEQ ID NO: 172116 - protein, 16 aa, Mycobacterium tuberculosis
ASMFAAVQALRDAQPA

SEQ ID NO: 172117 - protein, 16 aa, Mycobacterium tuberculosis
SMFAAVQALRDAQPAQ

SEQ ID NO: 172118 - protein, 16 aa, Mycobacterium tuberculosis
MFAAVQALRDAQPAQI

SEQ ID NO: 172119 - protein, 16 aa, Mycobacterium tuberculosis
FAAVQALRDAQPAQIV

SEQ ID NO: 172120 - protein, 16 aa, Mycobacterium tuberculosis
AAVQALRDAQPAQIVI

SEQ ID NO: 172121 - protein, 16 aa, Mycobacterium tuberculosis
AVQALRDAQPAQIVIA

SEQ ID NO: 172122 - protein, 16 aa, Mycobacterium tuberculosis
VQALRDAQPAQIVIAV

SEQ ID NO: 172123 - protein, 16 aa, Mycobacterium tuberculosis
QALRDAQPAQIVIAVP

SEQ ID NO: 172124 - protein, 16 aa, Mycobacterium tuberculosis
ALRDAQPAQIVIAVPA

SEQ ID NO: 172125 - protein, 16 aa, Mycobacterium tuberculosis
LRDAQPAQIVIAVPAA

SEQ ID NO: 172126 - protein, 16 aa, Mycobacterium tuberculosis
RDAQPAQIVIAVPAAP

SEQ ID NO: 172127 - protein, 16 aa, Mycobacterium tuberculosis
DAQPAQIVIAVPAAPE

SEQ ID NO: 172128 - protein, 16 aa, Mycobacterium tuberculosis
AQPAQIVIAVPAAPES

SEQ ID NO: 172129 - protein, 16 aa, Mycobacterium tuberculosis
QPAQIVIAVPAAPEST

SEQ ID NO: 172130 - protein, 16 aa, Mycobacterium tuberculosis
PAQIVIAVPAAPESTC

SEQ ID NO: 172131 - protein, 16 aa, Mycobacterium tuberculosis
AQIVIAVPAAPESTCR

SEQ ID NO: 172132 - protein, 16 aa, Mycobacterium tuberculosis
QIVIAVPAAPESTCRE

SEQ ID NO: 172133 - protein, 16 aa, Mycobacterium tuberculosis
IVIAVPAAPESTCREF

SEQ ID NO: 172134 - protein, 16 aa, Mycobacterium tuberculosis
VIAVPAAPESTCREFA

SEQ ID NO: 172135 - protein, 16 aa, Mycobacterium tuberculosis
IAVPAAPESTCREFAG

SEQ ID NO: 172136 - protein, 16 aa, Mycobacterium tuberculosis
AVPAAPESTCREFAGL

SEQ ID NO: 172137 - protein, 16 aa, Mycobacterium tuberculosis
VPAAPESTCREFAGLV

SEQ ID NO: 172138 - protein, 16 aa, Mycobacterium tuberculosis
PAAPESTCREFAGLVD

SEQ ID NO: 172139 - protein, 16 aa, Mycobacterium tuberculosis
AAPESTCREFAGLVDD

SEQ ID NO: 172140 - protein, 16 aa, Mycobacterium tuberculosis
APESTCREFAGLVDDV

SEQ ID NO: 172141 - protein, 16 aa, Mycobacterium tuberculosis
PESTCREFAGLVDDVV

SEQ ID NO: 172142 - protein, 16 aa, Mycobacterium tuberculosis
ESTCREFAGLVDDVVC

SEQ ID NO: 172143 - protein, 16 aa, Mycobacterium tuberculosis
STCREFAGLVDDVVCA

SEQ ID NO: 172144 - protein, 16 aa, Mycobacterium tuberculosis
TCREFAGLVDDVVCAT

SEQ ID NO: 172145 - protein, 16 aa, Mycobacterium tuberculosis
CREFAGLVDDVVCATM

SEQ ID NO: 172146 - protein, 16 aa, Mycobacterium tuberculosis
REFAGLVDDVVCATMP

SEQ ID NO: 172147 - protein, 16 aa, Mycobacterium tuberculosis
EFAGLVDDVVCATMPT

SEQ ID NO: 172148 - protein, 16 aa, Mycobacterium tuberculosis
FAGLVDDVVCATMPTP

SEQ ID NO: 172149 - protein, 16 aa, Mycobacterium tuberculosis
AGLVDDVVCATMPTPF

SEQ ID NO: 172150 - protein, 16 aa, Mycobacterium tuberculosis
GLVDDVVCATMPTPFL

SEQ ID NO: 172151 - protein, 16 aa, Mycobacterium tuberculosis
LVDDVVCATMPTPFLA

SEQ ID NO: 172152 - protein, 16 aa, Mycobacterium tuberculosis
VDDVVCATMPTPFLAV

SEQ ID NO: 172153 - protein, 16 aa, Mycobacterium tuberculosis
DDVVCATMPTPFLAVG

SEQ ID NO: 172154 - protein, 16 aa, Mycobacterium tuberculosis
DVVCATMPTPFLAVGE

SEQ ID NO: 172155 - protein, 16 aa, Mycobacterium tuberculosis
VVCATMPTPFLAVGES

SEQ ID NO: 172156 - protein, 16 aa, Mycobacterium tuberculosis
VCATMPTPFLAVGESF

SEQ ID NO: 172157 - protein, 16 aa, Mycobacterium tuberculosis
CATMPTPFLAVGESFW

SEQ ID NO: 172158 - protein, 16 aa, Mycobacterium tuberculosis
ATMPTPFLAVGESFWD

SEQ ID NO: 172159 - protein, 16 aa, Mycobacterium tuberculosis
TMPTPFLAVGESFWDF

SEQ ID NO: 172160 - protein, 16 aa, Mycobacterium tuberculosis
MPTPFLAVGESFWDFR

SEQ ID NO: 172161 - protein, 16 aa, Mycobacterium tuberculosis
PTPFLAVGESFWDFRQ

SEQ ID NO: 172162 - protein, 16 aa, Mycobacterium tuberculosis
TPFLAVGESFWDFRQV

SEQ ID NO: 172163 - protein, 16 aa, Mycobacterium tuberculosis
PFLAVGESFWDFRQVT

SEQ ID NO: 172164 - protein, 16 aa, Mycobacterium tuberculosis
FLAVGESFWDFRQVTD

SEQ ID NO: 172165 - protein, 16 aa, Mycobacterium tuberculosis
LAVGESFWDFRQVTDE

SEQ ID NO: 172166 - protein, 16 aa, Mycobacterium tuberculosis
AVGESFWDFRQVTDEE

SEQ ID NO: 172167 - protein, 16 aa, Mycobacterium tuberculosis
VGESFWDFRQVTDEEV

SEQ ID NO: 172168 - protein, 16 aa, Mycobacterium tuberculosis
GESFWDFRQVTDEEVR

SEQ ID NO: 172169 - protein, 16 aa, Mycobacterium tuberculosis
ESFWDFRQVTDEEVRR

SEQ ID NO: 172170 - protein, 16 aa, Mycobacterium tuberculosis
SFWDFRQVTDEEVRRL

SEQ ID NO: 172171 - protein, 16 aa, Mycobacterium tuberculosis
FWDFRQVTDEEVRRLL

SEQ ID NO: 172172 - protein, 16 aa, Mycobacterium tuberculosis
WDFRQVTDEEVRRLLA

SEQ ID NO: 172173 - protein, 16 aa, Mycobacterium tuberculosis
DFRQVTDEEVRRLLAT

SEQ ID NO: 172174 - protein, 16 aa, Mycobacterium tuberculosis
FRQVTDEEVRRLLATP

SEQ ID NO: 172175 - protein, 16 aa, Mycobacterium tuberculosis
RQVTDEEVRRLLATPT

SEQ ID NO: 172176 - protein, 16 aa, Mycobacterium tuberculosis
QVTDEEVRRLLATPTA

SEQ ID NO: 172177 - protein, 16 aa, Mycobacterium tuberculosis
VTDEEVRRLLATPTAG

SEQ ID NO: 172178 - protein, 16 aa, Mycobacterium tuberculosis
TDEEVRRLLATPTAGP

SEQ ID NO: 172179 - protein, 16 aa, Mycobacterium tuberculosis
DEEVRRLLATPTAGPS

SEQ ID NO: 172180 - protein, 16 aa, Mycobacterium tuberculosis
EEVRRLLATPTAGPSL

SEQ ID NO: 172181 - protein, 16 aa, Mycobacterium tuberculosis
EVRRLLATPTAGPSLR

SEQ ID NO: 172182 - protein, 16 aa, Mycobacterium tuberculosis
VRRLLATPTAGPSLRR

SEQ ID NO: 172183 - protein, 16 aa, Mycobacterium tuberculosis
RRLLATPTAGPSLRRP

SEQ ID NO: 172184 - protein, 16 aa, Mycobacterium tuberculosis
RLLATPTAGPSLRRPA

SEQ ID NO: 172185 - protein, 16 aa, Mycobacterium tuberculosis
LLATPTAGPSLRRPAA

SEQ ID NO: 172186 - protein, 16 aa, Mycobacterium tuberculosis
LATPTAGPSLRRPAAS

SEQ ID NO: 172187 - protein, 16 aa, Mycobacterium tuberculosis
ATPTAGPSLRRPAAST

SEQ ID NO: 172188 - protein, 16 aa, Mycobacterium tuberculosis
TPTAGPSLRRPAASTA

SEQ ID NO: 172189 - protein, 16 aa, Mycobacterium tuberculosis
PTAGPSLRRPAASTAA

SEQ ID NO: 172190 - protein, 16 aa, Mycobacterium tuberculosis
TAGPSLRRPAASTAAD

SEQ ID NO: 172191 - protein, 16 aa, Mycobacterium tuberculosis
AGPSLRRPAASTAADV

SEQ ID NO: 172192 - protein, 16 aa, Mycobacterium tuberculosis
GPSLRRPAASTAADVL

SEQ ID NO: 172193 - protein, 16 aa, Mycobacterium tuberculosis
PSLRRPAASTAADVLR

SEQ ID NO: 172194 - protein, 16 aa, Mycobacterium tuberculosis
SLRRPAASTAADVLRR

SEQ ID NO: 172195 - protein, 16 aa, Mycobacterium tuberculosis
LRRPAASTAADVLRRV

SEQ ID NO: 172196 - protein, 16 aa, Mycobacterium tuberculosis
RRPAASTAADVLRRVA

SEQ ID NO: 172197 - protein, 16 aa, Mycobacterium tuberculosis
RPAASTAADVLRRVAI

SEQ ID NO: 172198 - protein, 16 aa, Mycobacterium tuberculosis
PAASTAADVLRRVAID

SEQ ID NO: 172199 - protein, 16 aa, Mycobacterium tuberculosis
AASTAADVLRRVAIDA

SEQ ID NO: 172200 - protein, 16 aa, Mycobacterium tuberculosis
ASTAADVLRRVAIDAP

SEQ ID NO: 172201 - protein, 16 aa, Mycobacterium tuberculosis
STAADVLRRVAIDAPG

SEQ ID NO: 172202 - protein, 16 aa, Mycobacterium tuberculosis
TAADVLRRVAIDAPGG

SEQ ID NO: 172203 - protein, 16 aa, Mycobacterium tuberculosis
AADVLRRVAIDAPGGV

SEQ ID NO: 172204 - protein, 16 aa, Mycobacterium tuberculosis
ADVLRRVAIDAPGGVP

SEQ ID NO: 172205 - protein, 16 aa, Mycobacterium tuberculosis
DVLRRVAIDAPGGVPT

SEQ ID NO: 172206 - protein, 16 aa, Mycobacterium tuberculosis
VLRRVAIDAPGGVPTH

SEQ ID NO: 172207 - protein, 16 aa, Mycobacterium tuberculosis
LRRVAIDAPGGVPTHE

SEQ ID NO: 172208 - protein, 16 aa, Mycobacterium tuberculosis
RRVAIDAPGGVPTHEV

SEQ ID NO: 172209 - protein, 16 aa, Mycobacterium tuberculosis
RVAIDAPGGVPTHEVL

SEQ ID NO: 172210 - protein, 16 aa, Mycobacterium tuberculosis
VAIDAPGGVPTHEVLA

SEQ ID NO: 172211 - protein, 16 aa, Mycobacterium tuberculosis
AIDAPGGVPTHEVLAE

SEQ ID NO: 172212 - protein, 16 aa, Mycobacterium tuberculosis
IDAPGGVPTHEVLAEL

SEQ ID NO: 172213 - protein, 16 aa, Mycobacterium tuberculosis
DAPGGVPTHEVLAELV

SEQ ID NO: 172214 - protein, 16 aa, Mycobacterium tuberculosis
APGGVPTHEVLAELVG

SEQ ID NO: 172215 - protein, 16 aa, Mycobacterium tuberculosis
PGGVPTHEVLAELVGD

SEQ ID NO: 172216 - protein, 16 aa, Mycobacterium tuberculosis
GGVPTHEVLAELVGDA

SEQ ID NO: 172217 - protein, 16 aa, Mycobacterium tuberculosis
GVPTHEVLAELVGDAR

SEQ ID NO: 172218 - protein, 16 aa, Mycobacterium tuberculosis
VPTHEVLAELVGDARI

SEQ ID NO: 172219 - protein, 16 aa, Mycobacterium tuberculosis
PTHEVLAELVGDARIV

SEQ ID NO: 172220 - protein, 16 aa, Mycobacterium tuberculosis
THEVLAELVGDARIVL

SEQ ID NO: 172221 - protein, 16 aa, Mycobacterium tuberculosis
HEVLAELVGDARIVLI

SEQ ID NO: 172222 - protein, 16 aa, Mycobacterium tuberculosis
EVLAELVGDARIVLIG

SEQ ID NO: 172223 - protein, 16 aa, Mycobacterium tuberculosis
VLAELVGDARIVLIGE

SEQ ID NO: 172224 - protein, 16 aa, Mycobacterium tuberculosis
LAELVGDARIVLIGES

SEQ ID NO: 172225 - protein, 16 aa, Mycobacterium tuberculosis
AELVGDARIVLIGESS

SEQ ID NO: 172226 - protein, 16 aa, Mycobacterium tuberculosis
ELVGDARIVLIGESSH

SEQ ID NO: 172227 - protein, 16 aa, Mycobacterium tuberculosis
LVGDARIVLIGESSHG

SEQ ID NO: 172228 - protein, 16 aa, Mycobacterium tuberculosis
VGDARIVLIGESSHGT

SEQ ID NO: 172229 - protein, 16 aa, Mycobacterium tuberculosis
GDARIVLIGESSHGTH

SEQ ID NO: 172230 - protein, 16 aa, Mycobacterium tuberculosis
DARIVLIGESSHGTHE

SEQ ID NO: 172231 - protein, 16 aa, Mycobacterium tuberculosis
ARIVLIGESSHGTHEF

SEQ ID NO: 172232 - protein, 16 aa, Mycobacterium tuberculosis
RIVLIGESSHGTHEFY

SEQ ID NO: 172233 - protein, 16 aa, Mycobacterium tuberculosis
IVLIGESSHGTHEFYQ

SEQ ID NO: 172234 - protein, 16 aa, Mycobacterium tuberculosis
VLIGESSHGTHEFYQA

SEQ ID NO: 172235 - protein, 16 aa, Mycobacterium tuberculosis
LIGESSHGTHEFYQAR

SEQ ID NO: 172236 - protein, 16 aa, Mycobacterium tuberculosis
IGESSHGTHEFYQARA

SEQ ID NO: 172237 - protein, 16 aa, Mycobacterium tuberculosis
GESSHGTHEFYQARAA

SEQ ID NO: 172238 - protein, 16 aa, Mycobacterium tuberculosis
ESSHGTHEFYQARAAM

SEQ ID NO: 172239 - protein, 16 aa, Mycobacterium tuberculosis
SSHGTHEFYQARAAMT

SEQ ID NO: 172240 - protein, 16 aa, Mycobacterium tuberculosis
SHGTHEFYQARAAMTQ

SEQ ID NO: 172241 - protein, 16 aa, Mycobacterium tuberculosis
HGTHEFYQARAAMTQW

SEQ ID NO: 172242 - protein, 16 aa, Mycobacterium tuberculosis
GTHEFYQARAAMTQWL

SEQ ID NO: 172243 - protein, 16 aa, Mycobacterium tuberculosis
THEFYQARAAMTQWLI

SEQ ID NO: 172244 - protein, 16 aa, Mycobacterium tuberculosis
HEFYQARAAMTQWLIE

SEQ ID NO: 172245 - protein, 16 aa, Mycobacterium tuberculosis
EFYQARAAMTQWLIEE

SEQ ID NO: 172246 - protein, 16 aa, Mycobacterium tuberculosis
FYQARAAMTQWLIEEK

SEQ ID NO: 172247 - protein, 16 aa, Mycobacterium tuberculosis
YQARAAMTQWLIEEKG

SEQ ID NO: 172248 - protein, 16 aa, Mycobacterium tuberculosis
QARAAMTQWLIEEKGF

SEQ ID NO: 172249 - protein, 16 aa, Mycobacterium tuberculosis
ARAAMTQWLIEEKGFG

SEQ ID NO: 172250 - protein, 16 aa, Mycobacterium tuberculosis
RAAMTQWLIEEKGFGA

SEQ ID NO: 172251 - protein, 16 aa, Mycobacterium tuberculosis
AAMTQWLIEEKGFGAV

SEQ ID NO: 172252 - protein, 16 aa, Mycobacterium tuberculosis
AMTQWLIEEKGFGAVA

SEQ ID NO: 172253 - protein, 16 aa, Mycobacterium tuberculosis
MTQWLIEEKGFGAVAA

SEQ ID NO: 172254 - protein, 16 aa, Mycobacterium tuberculosis
TQWLIEEKGFGAVAAE

SEQ ID NO: 172255 - protein, 16 aa, Mycobacterium tuberculosis
QWLIEEKGFGAVAAEA

SEQ ID NO: 172256 - protein, 16 aa, Mycobacterium tuberculosis
WLIEEKGFGAVAAEAD

SEQ ID NO: 172257 - protein, 16 aa, Mycobacterium tuberculosis
LIEEKGFGAVAAEADW

SEQ ID NO: 172258 - protein, 16 aa, Mycobacterium tuberculosis
IEEKGFGAVAAEADWP

SEQ ID NO: 172259 - protein, 16 aa, Mycobacterium tuberculosis
EEKGFGAVAAEADWPD

SEQ ID NO: 172260 - protein, 16 aa, Mycobacterium tuberculosis
EKGFGAVAAEADWPDA

SEQ ID NO: 172261 - protein, 16 aa, Mycobacterium tuberculosis
KGFGAVAAEADWPDAY

SEQ ID NO: 172262 - protein, 16 aa, Mycobacterium tuberculosis
GFGAVAAEADWPDAYR

SEQ ID NO: 172263 - protein, 16 aa, Mycobacterium tuberculosis
FGAVAAEADWPDAYRV

SEQ ID NO: 172264 - protein, 16 aa, Mycobacterium tuberculosis
GAVAAEADWPDAYRVN

SEQ ID NO: 172265 - protein, 16 aa, Mycobacterium tuberculosis
AVAAEADWPDAYRVNR

SEQ ID NO: 172266 - protein, 16 aa, Mycobacterium tuberculosis
VAAEADWPDAYRVNRY

SEQ ID NO: 172267 - protein, 16 aa, Mycobacterium tuberculosis
AAEADWPDAYRVNRYV

SEQ ID NO: 172268 - protein, 16 aa, Mycobacterium tuberculosis
AEADWPDAYRVNRYVR

SEQ ID NO: 172269 - protein, 16 aa, Mycobacterium tuberculosis
EADWPDAYRVNRYVRG

SEQ ID NO: 172270 - protein, 16 aa, Mycobacterium tuberculosis
ADWPDAYRVNRYVRGL

SEQ ID NO: 172271 - protein, 16 aa, Mycobacterium tuberculosis
DWPDAYRVNRYVRGLG

SEQ ID NO: 172272 - protein, 16 aa, Mycobacterium tuberculosis
WPDAYRVNRYVRGLGE

SEQ ID NO: 172273 - protein, 16 aa, Mycobacterium tuberculosis
PDAYRVNRYVRGLGED

SEQ ID NO: 172274 - protein, 16 aa, Mycobacterium tuberculosis
DAYRVNRYVRGLGEDT

SEQ ID NO: 172275 - protein, 16 aa, Mycobacterium tuberculosis
AYRVNRYVRGLGEDTN

SEQ ID NO: 172276 - protein, 16 aa, Mycobacterium tuberculosis
YRVNRYVRGLGEDTNA

SEQ ID NO: 172277 - protein, 16 aa, Mycobacterium tuberculosis
RVNRYVRGLGEDTNAD

SEQ ID NO: 172278 - protein, 16 aa, Mycobacterium tuberculosis
VNRYVRGLGEDTNADE

SEQ ID NO: 172279 - protein, 16 aa, Mycobacterium tuberculosis
NRYVRGLGEDTNADEA

SEQ ID NO: 172280 - protein, 16 aa, Mycobacterium tuberculosis
RYVRGLGEDTNADEAL

SEQ ID NO: 172281 - protein, 16 aa, Mycobacterium tuberculosis
YVRGLGEDTNADEALS

SEQ ID NO: 172282 - protein, 16 aa, Mycobacterium tuberculosis
VRGLGEDTNADEALSG

SEQ ID NO: 172283 - protein, 16 aa, Mycobacterium tuberculosis
RGLGEDTNADEALSGF

SEQ ID NO: 172284 - protein, 16 aa, Mycobacterium tuberculosis
GLGEDTNADEALSGFE

SEQ ID NO: 172285 - protein, 16 aa, Mycobacterium tuberculosis
LGEDTNADEALSGFER

SEQ ID NO: 172286 - protein, 16 aa, Mycobacterium tuberculosis
GEDTNADEALSGFERF

SEQ ID NO: 172287 - protein, 16 aa, Mycobacterium tuberculosis
EDTNADEALSGFERFP

SEQ ID NO: 172288 - protein, 16 aa, Mycobacterium tuberculosis
DTNADEALSGFERFPA

SEQ ID NO: 172289 - protein, 16 aa, Mycobacterium tuberculosis
TNADEALSGFERFPAW

SEQ ID NO: 172290 - protein, 16 aa, Mycobacterium tuberculosis
NADEALSGFERFPAWM

SEQ ID NO: 172291 - protein, 16 aa, Mycobacterium tuberculosis
ADEALSGFERFPAWMW

SEQ ID NO: 172292 - protein, 16 aa, Mycobacterium tuberculosis
DEALSGFERFPAWMWR

SEQ ID NO: 172293 - protein, 16 aa, Mycobacterium tuberculosis
EALSGFERFPAWMWRN

SEQ ID NO: 172294 - protein, 16 aa, Mycobacterium tuberculosis
ALSGFERFPAWMWRNT

SEQ ID NO: 172295 - protein, 16 aa, Mycobacterium tuberculosis
LSGFERFPAWMWRNTV

SEQ ID NO: 172296 - protein, 16 aa, Mycobacterium tuberculosis
SGFERFPAWMWRNTVV

SEQ ID NO: 172297 - protein, 16 aa, Mycobacterium tuberculosis
GFERFPAWMWRNTVVR

SEQ ID NO: 172298 - protein, 16 aa, Mycobacterium tuberculosis
FERFPAWMWRNTVVRD

SEQ ID NO: 172299 - protein, 16 aa, Mycobacterium tuberculosis
ERFPAWMWRNTVVRDF

SEQ ID NO: 172300 - protein, 16 aa, Mycobacterium tuberculosis
RFPAWMWRNTVVRDFV

SEQ ID NO: 172301 - protein, 16 aa, Mycobacterium tuberculosis
FPAWMWRNTVVRDFVE

SEQ ID NO: 172302 - protein, 16 aa, Mycobacterium tuberculosis
PAWMWRNTVVRDFVEW

SEQ ID NO: 172303 - protein, 16 aa, Mycobacterium tuberculosis
AWMWRNTVVRDFVEWL

SEQ ID NO: 172304 - protein, 16 aa, Mycobacterium tuberculosis
WMWRNTVVRDFVEWLR

SEQ ID NO: 172305 - protein, 16 aa, Mycobacterium tuberculosis
MWRNTVVRDFVEWLRT

SEQ ID NO: 172306 - protein, 16 aa, Mycobacterium tuberculosis
WRNTVVRDFVEWLRTR

SEQ ID NO: 172307 - protein, 16 aa, Mycobacterium tuberculosis
RNTVVRDFVEWLRTRN

SEQ ID NO: 172308 - protein, 16 aa, Mycobacterium tuberculosis
NTVVRDFVEWLRTRNQ

SEQ ID NO: 172309 - protein, 16 aa, Mycobacterium tuberculosis
TVVRDFVEWLRTRNQR

SEQ ID NO: 172310 - protein, 16 aa, Mycobacterium tuberculosis
VVRDFVEWLRTRNQRY

SEQ ID NO: 172311 - protein, 16 aa, Mycobacterium tuberculosis
VRDFVEWLRTRNQRYE

SEQ ID NO: 172312 - protein, 16 aa, Mycobacterium tuberculosis
RDFVEWLRTRNQRYES

SEQ ID NO: 172313 - protein, 16 aa, Mycobacterium tuberculosis
DFVEWLRTRNQRYESG

SEQ ID NO: 172314 - protein, 16 aa, Mycobacterium tuberculosis
FVEWLRTRNQRYESGA

SEQ ID NO: 172315 - protein, 16 aa, Mycobacterium tuberculosis
VEWLRTRNQRYESGAL

SEQ ID NO: 172316 - protein, 16 aa, Mycobacterium tuberculosis
EWLRTRNQRYESGALR

SEQ ID NO: 172317 - protein, 16 aa, Mycobacterium tuberculosis
WLRTRNQRYESGALRQ

SEQ ID NO: 172318 - protein, 16 aa, Mycobacterium tuberculosis
LRTRNQRYESGALRQA

SEQ ID NO: 172319 - protein, 16 aa, Mycobacterium tuberculosis
RTRNQRYESGALRQAG

SEQ ID NO: 172320 - protein, 16 aa, Mycobacterium tuberculosis
TRNQRYESGALRQAGF

SEQ ID NO: 172321 - protein, 16 aa, Mycobacterium tuberculosis
RNQRYESGALRQAGFY

SEQ ID NO: 172322 - protein, 16 aa, Mycobacterium tuberculosis
NQRYESGALRQAGFYG

SEQ ID NO: 172323 - protein, 16 aa, Mycobacterium tuberculosis
QRYESGALRQAGFYGL

SEQ ID NO: 172324 - protein, 16 aa, Mycobacterium tuberculosis
RYESGALRQAGFYGLD

SEQ ID NO: 172325 - protein, 16 aa, Mycobacterium tuberculosis
YESGALRQAGFYGLDL

SEQ ID NO: 172326 - protein, 16 aa, Mycobacterium tuberculosis
ESGALRQAGFYGLDLY

SEQ ID NO: 172327 - protein, 16 aa, Mycobacterium tuberculosis
SGALRQAGFYGLDLYS

SEQ ID NO: 172328 - protein, 16 aa, Mycobacterium tuberculosis
GALRQAGFYGLDLYSL

SEQ ID NO: 172329 - protein, 16 aa, Mycobacterium tuberculosis
ALRQAGFYGLDLYSLH

SEQ ID NO: 172330 - protein, 16 aa, Mycobacterium tuberculosis
LRQAGFYGLDLYSLHR

SEQ ID NO: 172331 - protein, 16 aa, Mycobacterium tuberculosis
RQAGFYGLDLYSLHRS

SEQ ID NO: 172332 - protein, 16 aa, Mycobacterium tuberculosis
QAGFYGLDLYSLHRSI

SEQ ID NO: 172333 - protein, 16 aa, Mycobacterium tuberculosis
AGFYGLDLYSLHRSIQ

SEQ ID NO: 172334 - protein, 16 aa, Mycobacterium tuberculosis
GFYGLDLYSLHRSIQE

SEQ ID NO: 172335 - protein, 16 aa, Mycobacterium tuberculosis
FYGLDLYSLHRSIQEV

SEQ ID NO: 172336 - protein, 16 aa, Mycobacterium tuberculosis
YGLDLYSLHRSIQEVI

SEQ ID NO: 172337 - protein, 16 aa, Mycobacterium tuberculosis
GLDLYSLHRSIQEVIS

SEQ ID NO: 172338 - protein, 16 aa, Mycobacterium tuberculosis
LDLYSLHRSIQEVISY

SEQ ID NO: 172339 - protein, 16 aa, Mycobacterium tuberculosis
DLYSLHRSIQEVISYL

SEQ ID NO: 172340 - protein, 16 aa, Mycobacterium tuberculosis
LYSLHRSIQEVISYLD

SEQ ID NO: 172341 - protein, 16 aa, Mycobacterium tuberculosis
YSLHRSIQEVISYLDK

SEQ ID NO: 172342 - protein, 16 aa, Mycobacterium tuberculosis
SLHRSIQEVISYLDKV

SEQ ID NO: 172343 - protein, 16 aa, Mycobacterium tuberculosis
LHRSIQEVISYLDKVD

SEQ ID NO: 172344 - protein, 16 aa, Mycobacterium tuberculosis
HRSIQEVISYLDKVDP

SEQ ID NO: 172345 - protein, 16 aa, Mycobacterium tuberculosis
RSIQEVISYLDKVDPR

SEQ ID NO: 172346 - protein, 16 aa, Mycobacterium tuberculosis
SIQEVISYLDKVDPRA

SEQ ID NO: 172347 - protein, 16 aa, Mycobacterium tuberculosis
IQEVISYLDKVDPRAA

SEQ ID NO: 172348 - protein, 16 aa, Mycobacterium tuberculosis
QEVISYLDKVDPRAAA

SEQ ID NO: 172349 - protein, 16 aa, Mycobacterium tuberculosis
EVISYLDKVDPRAAAR

SEQ ID NO: 172350 - protein, 16 aa, Mycobacterium tuberculosis
VISYLDKVDPRAAARA

SEQ ID NO: 172351 - protein, 16 aa, Mycobacterium tuberculosis
ISYLDKVDPRAAARAR

SEQ ID NO: 172352 - protein, 16 aa, Mycobacterium tuberculosis
SYLDKVDPRAAARARA

SEQ ID NO: 172353 - protein, 16 aa, Mycobacterium tuberculosis
YLDKVDPRAAARARAR

SEQ ID NO: 172354 - protein, 16 aa, Mycobacterium tuberculosis
LDKVDPRAAARARARY

SEQ ID NO: 172355 - protein, 16 aa, Mycobacterium tuberculosis
DKVDPRAAARARARYA

SEQ ID NO: 172356 - protein, 16 aa, Mycobacterium tuberculosis
KVDPRAAARARARYAC

SEQ ID NO: 172357 - protein, 16 aa, Mycobacterium tuberculosis
VDPRAAARARARYACF

SEQ ID NO: 172358 - protein, 16 aa, Mycobacterium tuberculosis
DPRAAARARARYACFD

SEQ ID NO: 172359 - protein, 16 aa, Mycobacterium tuberculosis
PRAAARARARYACFDH

SEQ ID NO: 172360 - protein, 16 aa, Mycobacterium tuberculosis
RAAARARARYACFDHA

SEQ ID NO: 172361 - protein, 16 aa, Mycobacterium tuberculosis
AAARARARYACFDHAC

SEQ ID NO: 172362 - protein, 16 aa, Mycobacterium tuberculosis
AARARARYACFDHACA

SEQ ID NO: 172363 - protein, 16 aa, Mycobacterium tuberculosis
ARARARYACFDHACAD

SEQ ID NO: 172364 - protein, 16 aa, Mycobacterium tuberculosis
RARARYACFDHACADD

SEQ ID NO: 172365 - protein, 16 aa, Mycobacterium tuberculosis
ARARYACFDHACADDG

SEQ ID NO: 172366 - protein, 16 aa, Mycobacterium tuberculosis
RARYACFDHACADDGQ

SEQ ID NO: 172367 - protein, 16 aa, Mycobacterium tuberculosis
ARYACFDHACADDGQA

SEQ ID NO: 172368 - protein, 16 aa, Mycobacterium tuberculosis
RYACFDHACADDGQAY

SEQ ID NO: 172369 - protein, 16 aa, Mycobacterium tuberculosis
YACFDHACADDGQAYG

SEQ ID NO: 172370 - protein, 16 aa, Mycobacterium tuberculosis
ACFDHACADDGQAYGF

SEQ ID NO: 172371 - protein, 16 aa, Mycobacterium tuberculosis
CFDHACADDGQAYGFA

SEQ ID NO: 172372 - protein, 16 aa, Mycobacterium tuberculosis
FDHACADDGQAYGFAA

SEQ ID NO: 172373 - protein, 16 aa, Mycobacterium tuberculosis
DHACADDGQAYGFAAA

SEQ ID NO: 172374 - protein, 16 aa, Mycobacterium tuberculosis
HACADDGQAYGFAAAF

SEQ ID NO: 172375 - protein, 16 aa, Mycobacterium tuberculosis
ACADDGQAYGFAAAFG

SEQ ID NO: 172376 - protein, 16 aa, Mycobacterium tuberculosis
CADDGQAYGFAAAFGA

SEQ ID NO: 172377 - protein, 16 aa, Mycobacterium tuberculosis
ADDGQAYGFAAAFGAG

SEQ ID NO: 172378 - protein, 16 aa, Mycobacterium tuberculosis
DDGQAYGFAAAFGAGP

SEQ ID NO: 172379 - protein, 16 aa, Mycobacterium tuberculosis
DGQAYGFAAAFGAGPS

SEQ ID NO: 172380 - protein, 16 aa, Mycobacterium tuberculosis
GQAYGFAAAFGAGPSC

SEQ ID NO: 172381 - protein, 16 aa, Mycobacterium tuberculosis
QAYGFAAAFGAGPSCE

SEQ ID NO: 172382 - protein, 16 aa, Mycobacterium tuberculosis
AYGFAAAFGAGPSCER

SEQ ID NO: 172383 - protein, 16 aa, Mycobacterium tuberculosis
YGFAAAFGAGPSCERE

SEQ ID NO: 172384 - protein, 16 aa, Mycobacterium tuberculosis
GFAAAFGAGPSCEREA

SEQ ID NO: 172385 - protein, 16 aa, Mycobacterium tuberculosis
FAAAFGAGPSCEREAV

SEQ ID NO: 172386 - protein, 16 aa, Mycobacterium tuberculosis
AAAFGAGPSCEREAVE

SEQ ID NO: 172387 - protein, 16 aa, Mycobacterium tuberculosis
AAFGAGPSCEREAVEQ

SEQ ID NO: 172388 - protein, 16 aa, Mycobacterium tuberculosis
AFGAGPSCEREAVEQL

SEQ ID NO: 172389 - protein, 16 aa, Mycobacterium tuberculosis
FGAGPSCEREAVEQLV

SEQ ID NO: 172390 - protein, 16 aa, Mycobacterium tuberculosis
GAGPSCEREAVEQLVD

SEQ ID NO: 172391 - protein, 16 aa, Mycobacterium tuberculosis
AGPSCEREAVEQLVDV

SEQ ID NO: 172392 - protein, 16 aa, Mycobacterium tuberculosis
GPSCEREAVEQLVDVQ

SEQ ID NO: 172393 - protein, 16 aa, Mycobacterium tuberculosis
PSCEREAVEQLVDVQR

SEQ ID NO: 172394 - protein, 16 aa, Mycobacterium tuberculosis
SCEREAVEQLVDVQRN

SEQ ID NO: 172395 - protein, 16 aa, Mycobacterium tuberculosis
CEREAVEQLVDVQRNA

SEQ ID NO: 172396 - protein, 16 aa, Mycobacterium tuberculosis
EREAVEQLVDVQRNAL

SEQ ID NO: 172397 - protein, 16 aa, Mycobacterium tuberculosis
REAVEQLVDVQRNALA

SEQ ID NO: 172398 - protein, 16 aa, Mycobacterium tuberculosis
EAVEQLVDVQRNALAY

SEQ ID NO: 172399 - protein, 16 aa, Mycobacterium tuberculosis
AVEQLVDVQRNALAYA

SEQ ID NO: 172400 - protein, 16 aa, Mycobacterium tuberculosis
VEQLVDVQRNALAYAR

SEQ ID NO: 172401 - protein, 16 aa, Mycobacterium tuberculosis
EQLVDVQRNALAYARQ

SEQ ID NO: 172402 - protein, 16 aa, Mycobacterium tuberculosis
QLVDVQRNALAYARQD

SEQ ID NO: 172403 - protein, 16 aa, Mycobacterium tuberculosis
LVDVQRNALAYARQDG

SEQ ID NO: 172404 - protein, 16 aa, Mycobacterium tuberculosis
VDVQRNALAYARQDGL

SEQ ID NO: 172405 - protein, 16 aa, Mycobacterium tuberculosis
DVQRNALAYARQDGLL

SEQ ID NO: 172406 - protein, 16 aa, Mycobacterium tuberculosis
VQRNALAYARQDGLLA

SEQ ID NO: 172407 - protein, 16 aa, Mycobacterium tuberculosis
QRNALAYARQDGLLAE

SEQ ID NO: 172408 - protein, 16 aa, Mycobacterium tuberculosis
RNALAYARQDGLLAED

SEQ ID NO: 172409 - protein, 16 aa, Mycobacterium tuberculosis
NALAYARQDGLLAEDE

SEQ ID NO: 172410 - protein, 16 aa, Mycobacterium tuberculosis
ALAYARQDGLLAEDEL

SEQ ID NO: 172411 - protein, 16 aa, Mycobacterium tuberculosis
LAYARQDGLLAEDELF

SEQ ID NO: 172412 - protein, 16 aa, Mycobacterium tuberculosis
AYARQDGLLAEDELFY

SEQ ID NO: 172413 - protein, 16 aa, Mycobacterium tuberculosis
YARQDGLLAEDELFYA

SEQ ID NO: 172414 - protein, 16 aa, Mycobacterium tuberculosis
ARQDGLLAEDELFYAQ

SEQ ID NO: 172415 - protein, 16 aa, Mycobacterium tuberculosis
RQDGLLAEDELFYAQQ

SEQ ID NO: 172416 - protein, 16 aa, Mycobacterium tuberculosis
QDGLLAEDELFYAQQN

SEQ ID NO: 172417 - protein, 16 aa, Mycobacterium tuberculosis
DGLLAEDELFYAQQNA

SEQ ID NO: 172418 - protein, 16 aa, Mycobacterium tuberculosis
GLLAEDELFYAQQNAQ

SEQ ID NO: 172419 - protein, 16 aa, Mycobacterium tuberculosis
LLAEDELFYAQQNAQT

SEQ ID NO: 172420 - protein, 16 aa, Mycobacterium tuberculosis
LAEDELFYAQQNAQTV

SEQ ID NO: 172421 - protein, 16 aa, Mycobacterium tuberculosis
AEDELFYAQQNAQTVR

SEQ ID NO: 172422 - protein, 16 aa, Mycobacterium tuberculosis
EDELFYAQQNAQTVRD

SEQ ID NO: 172423 - protein, 16 aa, Mycobacterium tuberculosis
DELFYAQQNAQTVRDA

SEQ ID NO: 172424 - protein, 16 aa, Mycobacterium tuberculosis
ELFYAQQNAQTVRDAE

SEQ ID NO: 172425 - protein, 16 aa, Mycobacterium tuberculosis
LFYAQQNAQTVRDAEV

SEQ ID NO: 172426 - protein, 16 aa, Mycobacterium tuberculosis
FYAQQNAQTVRDAEVY

SEQ ID NO: 172427 - protein, 16 aa, Mycobacterium tuberculosis
YAQQNAQTVRDAEVYY

SEQ ID NO: 172428 - protein, 16 aa, Mycobacterium tuberculosis
AQQNAQTVRDAEVYYR

SEQ ID NO: 172429 - protein, 16 aa, Mycobacterium tuberculosis
QQNAQTVRDAEVYYRA

SEQ ID NO: 172430 - protein, 16 aa, Mycobacterium tuberculosis
QNAQTVRDAEVYYRAM

SEQ ID NO: 172431 - protein, 16 aa, Mycobacterium tuberculosis
NAQTVRDAEVYYRAMF

SEQ ID NO: 172432 - protein, 16 aa, Mycobacterium tuberculosis
AQTVRDAEVYYRAMFS

SEQ ID NO: 172433 - protein, 16 aa, Mycobacterium tuberculosis
QTVRDAEVYYRAMFSG

SEQ ID NO: 172434 - protein, 16 aa, Mycobacterium tuberculosis
TVRDAEVYYRAMFSGR

SEQ ID NO: 172435 - protein, 16 aa, Mycobacterium tuberculosis
VRDAEVYYRAMFSGRV

SEQ ID NO: 172436 - protein, 16 aa, Mycobacterium tuberculosis
RDAEVYYRAMFSGRVT

SEQ ID NO: 172437 - protein, 16 aa, Mycobacterium tuberculosis
DAEVYYRAMFSGRVTS

SEQ ID NO: 172438 - protein, 16 aa, Mycobacterium tuberculosis
AEVYYRAMFSGRVTSW

SEQ ID NO: 172439 - protein, 16 aa, Mycobacterium tuberculosis
EVYYRAMFSGRVTSWN

SEQ ID NO: 172440 - protein, 16 aa, Mycobacterium tuberculosis
VYYRAMFSGRVTSWNL

SEQ ID NO: 172441 - protein, 16 aa, Mycobacterium tuberculosis
YYRAMFSGRVTSWNLR

SEQ ID NO: 172442 - protein, 16 aa, Mycobacterium tuberculosis
YRAMFSGRVTSWNLRD

SEQ ID NO: 172443 - protein, 16 aa, Mycobacterium tuberculosis
RAMFSGRVTSWNLRDQ

SEQ ID NO: 172444 - protein, 16 aa, Mycobacterium tuberculosis
AMFSGRVTSWNLRDQH

SEQ ID NO: 172445 - protein, 16 aa, Mycobacterium tuberculosis
MFSGRVTSWNLRDQHM

SEQ ID NO: 172446 - protein, 16 aa, Mycobacterium tuberculosis
FSGRVTSWNLRDQHMA

SEQ ID NO: 172447 - protein, 16 aa, Mycobacterium tuberculosis
SGRVTSWNLRDQHMAQ

SEQ ID NO: 172448 - protein, 16 aa, Mycobacterium tuberculosis
GRVTSWNLRDQHMAQT

SEQ ID NO: 172449 - protein, 16 aa, Mycobacterium tuberculosis
RVTSWNLRDQHMAQTL

SEQ ID NO: 172450 - protein, 16 aa, Mycobacterium tuberculosis
VTSWNLRDQHMAQTLG

SEQ ID NO: 172451 - protein, 16 aa, Mycobacterium tuberculosis
TSWNLRDQHMAQTLGS

SEQ ID NO: 172452 - protein, 16 aa, Mycobacterium tuberculosis
SWNLRDQHMAQTLGSL

SEQ ID NO: 172453 - protein, 16 aa, Mycobacterium tuberculosis
WNLRDQHMAQTLGSLL

SEQ ID NO: 172454 - protein, 16 aa, Mycobacterium tuberculosis
NLRDQHMAQTLGSLLT

SEQ ID NO: 172455 - protein, 16 aa, Mycobacterium tuberculosis
LRDQHMAQTLGSLLTH

SEQ ID NO: 172456 - protein, 16 aa, Mycobacterium tuberculosis
RDQHMAQTLGSLLTHL

SEQ ID NO: 172457 - protein, 16 aa, Mycobacterium tuberculosis
DQHMAQTLGSLLTHLD

SEQ ID NO: 172458 - protein, 16 aa, Mycobacterium tuberculosis
QHMAQTLGSLLTHLDR

SEQ ID NO: 172459 - protein, 16 aa, Mycobacterium tuberculosis
HMAQTLGSLLTHLDRH

SEQ ID NO: 172460 - protein, 16 aa, Mycobacterium tuberculosis
MAQTLGSLLTHLDRHL

SEQ ID NO: 172461 - protein, 16 aa, Mycobacterium tuberculosis
AQTLGSLLTHLDRHLD

SEQ ID NO: 172462 - protein, 16 aa, Mycobacterium tuberculosis
QTLGSLLTHLDRHLDA

SEQ ID NO: 172463 - protein, 16 aa, Mycobacterium tuberculosis
TLGSLLTHLDRHLDAP

SEQ ID NO: 172464 - protein, 16 aa, Mycobacterium tuberculosis
LGSLLTHLDRHLDAPP

SEQ ID NO: 172465 - protein, 16 aa, Mycobacterium tuberculosis
GSLLTHLDRHLDAPPA

SEQ ID NO: 172466 - protein, 16 aa, Mycobacterium tuberculosis
SLLTHLDRHLDAPPAR

SEQ ID NO: 172467 - protein, 16 aa, Mycobacterium tuberculosis
LLTHLDRHLDAPPARI

SEQ ID NO: 172468 - protein, 16 aa, Mycobacterium tuberculosis
LTHLDRHLDAPPARIV

SEQ ID NO: 172469 - protein, 16 aa, Mycobacterium tuberculosis
THLDRHLDAPPARIVV

SEQ ID NO: 172470 - protein, 16 aa, Mycobacterium tuberculosis
HLDRHLDAPPARIVVW

SEQ ID NO: 172471 - protein, 16 aa, Mycobacterium tuberculosis
LDRHLDAPPARIVVWA

SEQ ID NO: 172472 - protein, 16 aa, Mycobacterium tuberculosis
DRHLDAPPARIVVWAH

SEQ ID NO: 172473 - protein, 16 aa, Mycobacterium tuberculosis
RHLDAPPARIVVWAHN

SEQ ID NO: 172474 - protein, 16 aa, Mycobacterium tuberculosis
HLDAPPARIVVWAHNS

SEQ ID NO: 172475 - protein, 16 aa, Mycobacterium tuberculosis
LDAPPARIVVWAHNSH

SEQ ID NO: 172476 - protein, 16 aa, Mycobacterium tuberculosis
DAPPARIVVWAHNSHV

SEQ ID NO: 172477 - protein, 16 aa, Mycobacterium tuberculosis
APPARIVVWAHNSHVG

SEQ ID NO: 172478 - protein, 16 aa, Mycobacterium tuberculosis
PPARIVVWAHNSHVGD

SEQ ID NO: 172479 - protein, 16 aa, Mycobacterium tuberculosis
PARIVVWAHNSHVGDA

SEQ ID NO: 172480 - protein, 16 aa, Mycobacterium tuberculosis
ARIVVWAHNSHVGDAR

SEQ ID NO: 172481 - protein, 16 aa, Mycobacterium tuberculosis
RIVVWAHNSHVGDARA

SEQ ID NO: 172482 - protein, 16 aa, Mycobacterium tuberculosis
IVVWAHNSHVGDARAT

SEQ ID NO: 172483 - protein, 16 aa, Mycobacterium tuberculosis
VVWAHNSHVGDARATE

SEQ ID NO: 172484 - protein, 16 aa, Mycobacterium tuberculosis
VWAHNSHVGDARATEV

SEQ ID NO: 172485 - protein, 16 aa, Mycobacterium tuberculosis
WAHNSHVGDARATEVW

SEQ ID NO: 172486 - protein, 16 aa, Mycobacterium tuberculosis
AHNSHVGDARATEVWA

SEQ ID NO: 172487 - protein, 16 aa, Mycobacterium tuberculosis
HNSHVGDARATEVWAD

SEQ ID NO: 172488 - protein, 16 aa, Mycobacterium tuberculosis
NSHVGDARATEVWADG

SEQ ID NO: 172489 - protein, 16 aa, Mycobacterium tuberculosis
SHVGDARATEVWADGQ

SEQ ID NO: 172490 - protein, 16 aa, Mycobacterium tuberculosis
HVGDARATEVWADGQL

SEQ ID NO: 172491 - protein, 16 aa, Mycobacterium tuberculosis
VGDARATEVWADGQLT

SEQ ID NO: 172492 - protein, 16 aa, Mycobacterium tuberculosis
GDARATEVWADGQLTL

SEQ ID NO: 172493 - protein, 16 aa, Mycobacterium tuberculosis
DARATEVWADGQLTLG

SEQ ID NO: 172494 - protein, 16 aa, Mycobacterium tuberculosis
ARATEVWADGQLTLGQ

SEQ ID NO: 172495 - protein, 16 aa, Mycobacterium tuberculosis
RATEVWADGQLTLGQI

SEQ ID NO: 172496 - protein, 16 aa, Mycobacterium tuberculosis
ATEVWADGQLTLGQIV

SEQ ID NO: 172497 - protein, 16 aa, Mycobacterium tuberculosis
TEVWADGQLTLGQIVR

SEQ ID NO: 172498 - protein, 16 aa, Mycobacterium tuberculosis
EVWADGQLTLGQIVRE

SEQ ID NO: 172499 - protein, 16 aa, Mycobacterium tuberculosis
VWADGQLTLGQIVRER

SEQ ID NO: 172500 - protein, 16 aa, Mycobacterium tuberculosis
WADGQLTLGQIVRERY

SEQ ID NO: 172501 - protein, 16 aa, Mycobacterium tuberculosis
ADGQLTLGQIVRERYG

SEQ ID NO: 172502 - protein, 16 aa, Mycobacterium tuberculosis
DGQLTLGQIVRERYGD

SEQ ID NO: 172503 - protein, 16 aa, Mycobacterium tuberculosis
GQLTLGQIVRERYGDE

SEQ ID NO: 172504 - protein, 16 aa, Mycobacterium tuberculosis
QLTLGQIVRERYGDES

SEQ ID NO: 172505 - protein, 16 aa, Mycobacterium tuberculosis
LTLGQIVRERYGDESR

SEQ ID NO: 172506 - protein, 16 aa, Mycobacterium tuberculosis
TLGQIVRERYGDESRS

SEQ ID NO: 172507 - protein, 16 aa, Mycobacterium tuberculosis
LGQIVRERYGDESRSI

SEQ ID NO: 172508 - protein, 16 aa, Mycobacterium tuberculosis
GQIVRERYGDESRSIG

SEQ ID NO: 172509 - protein, 16 aa, Mycobacterium tuberculosis
QIVRERYGDESRSIGF

SEQ ID NO: 172510 - protein, 16 aa, Mycobacterium tuberculosis
IVRERYGDESRSIGFS

SEQ ID NO: 172511 - protein, 16 aa, Mycobacterium tuberculosis
VRERYGDESRSIGFST

SEQ ID NO: 172512 - protein, 16 aa, Mycobacterium tuberculosis
RERYGDESRSIGFSTY

SEQ ID NO: 172513 - protein, 16 aa, Mycobacterium tuberculosis
ERYGDESRSIGFSTYT

SEQ ID NO: 172514 - protein, 16 aa, Mycobacterium tuberculosis
RYGDESRSIGFSTYTG

SEQ ID NO: 172515 - protein, 16 aa, Mycobacterium tuberculosis
YGDESRSIGFSTYTGT

SEQ ID NO: 172516 - protein, 16 aa, Mycobacterium tuberculosis
GDESRSIGFSTYTGTV

SEQ ID NO: 172517 - protein, 16 aa, Mycobacterium tuberculosis
DESRSIGFSTYTGTVT

SEQ ID NO: 172518 - protein, 16 aa, Mycobacterium tuberculosis
ESRSIGFSTYTGTVTA

SEQ ID NO: 172519 - protein, 16 aa, Mycobacterium tuberculosis
SRSIGFSTYTGTVTAA

SEQ ID NO: 172520 - protein, 16 aa, Mycobacterium tuberculosis
RSIGFSTYTGTVTAAS

SEQ ID NO: 172521 - protein, 16 aa, Mycobacterium tuberculosis
SIGFSTYTGTVTAASE

SEQ ID NO: 172522 - protein, 16 aa, Mycobacterium tuberculosis
IGFSTYTGTVTAASEW

SEQ ID NO: 172523 - protein, 16 aa, Mycobacterium tuberculosis
GFSTYTGTVTAASEWG

SEQ ID NO: 172524 - protein, 16 aa, Mycobacterium tuberculosis
FSTYTGTVTAASEWGG

SEQ ID NO: 172525 - protein, 16 aa, Mycobacterium tuberculosis
STYTGTVTAASEWGGI

SEQ ID NO: 172526 - protein, 16 aa, Mycobacterium tuberculosis
TYTGTVTAASEWGGIA

SEQ ID NO: 172527 - protein, 16 aa, Mycobacterium tuberculosis
YTGTVTAASEWGGIAQ

SEQ ID NO: 172528 - protein, 16 aa, Mycobacterium tuberculosis
TGTVTAASEWGGIAQR

SEQ ID NO: 172529 - protein, 16 aa, Mycobacterium tuberculosis
GTVTAASEWGGIAQRK

SEQ ID NO: 172530 - protein, 16 aa, Mycobacterium tuberculosis
TVTAASEWGGIAQRKA

SEQ ID NO: 172531 - protein, 16 aa, Mycobacterium tuberculosis
VTAASEWGGIAQRKAV

SEQ ID NO: 172532 - protein, 16 aa, Mycobacterium tuberculosis
TAASEWGGIAQRKAVR

SEQ ID NO: 172533 - protein, 16 aa, Mycobacterium tuberculosis
AASEWGGIAQRKAVRP

SEQ ID NO: 172534 - protein, 16 aa, Mycobacterium tuberculosis
ASEWGGIAQRKAVRPA

SEQ ID NO: 172535 - protein, 16 aa, Mycobacterium tuberculosis
SEWGGIAQRKAVRPAL

SEQ ID NO: 172536 - protein, 16 aa, Mycobacterium tuberculosis
EWGGIAQRKAVRPALH

SEQ ID NO: 172537 - protein, 16 aa, Mycobacterium tuberculosis
WGGIAQRKAVRPALHG

SEQ ID NO: 172538 - protein, 16 aa, Mycobacterium tuberculosis
GGIAQRKAVRPALHGS

SEQ ID NO: 172539 - protein, 16 aa, Mycobacterium tuberculosis
GIAQRKAVRPALHGSV

SEQ ID NO: 172540 - protein, 16 aa, Mycobacterium tuberculosis
IAQRKAVRPALHGSVE

SEQ ID NO: 172541 - protein, 16 aa, Mycobacterium tuberculosis
AQRKAVRPALHGSVEE

SEQ ID NO: 172542 - protein, 16 aa, Mycobacterium tuberculosis
QRKAVRPALHGSVEEL

SEQ ID NO: 172543 - protein, 16 aa, Mycobacterium tuberculosis
RKAVRPALHGSVEELF

SEQ ID NO: 172544 - protein, 16 aa, Mycobacterium tuberculosis
KAVRPALHGSVEELFH

SEQ ID NO: 172545 - protein, 16 aa, Mycobacterium tuberculosis
AVRPALHGSVEELFHQ

SEQ ID NO: 172546 - protein, 16 aa, Mycobacterium tuberculosis
VRPALHGSVEELFHQT

SEQ ID NO: 172547 - protein, 16 aa, Mycobacterium tuberculosis
RPALHGSVEELFHQTA

SEQ ID NO: 172548 - protein, 16 aa, Mycobacterium tuberculosis
PALHGSVEELFHQTAD

SEQ ID NO: 172549 - protein, 16 aa, Mycobacterium tuberculosis
ALHGSVEELFHQTADS

SEQ ID NO: 172550 - protein, 16 aa, Mycobacterium tuberculosis
LHGSVEELFHQTADSF

SEQ ID NO: 172551 - protein, 16 aa, Mycobacterium tuberculosis
HGSVEELFHQTADSFL

SEQ ID NO: 172552 - protein, 16 aa, Mycobacterium tuberculosis
GSVEELFHQTADSFLV

SEQ ID NO: 172553 - protein, 16 aa, Mycobacterium tuberculosis
SVEELFHQTADSFLVS

SEQ ID NO: 172554 - protein, 16 aa, Mycobacterium tuberculosis
VEELFHQTADSFLVSA

SEQ ID NO: 172555 - protein, 16 aa, Mycobacterium tuberculosis
EELFHQTADSFLVSAR

SEQ ID NO: 172556 - protein, 16 aa, Mycobacterium tuberculosis
ELFHQTADSFLVSARL

SEQ ID NO: 172557 - protein, 16 aa, Mycobacterium tuberculosis
LFHQTADSFLVSARLS

SEQ ID NO: 172558 - protein, 16 aa, Mycobacterium tuberculosis
FHQTADSFLVSARLSR

SEQ ID NO: 172559 - protein, 16 aa, Mycobacterium tuberculosis
HQTADSFLVSARLSRD

SEQ ID NO: 172560 - protein, 16 aa, Mycobacterium tuberculosis
QTADSFLVSARLSRDA

SEQ ID NO: 172561 - protein, 16 aa, Mycobacterium tuberculosis
TADSFLVSARLSRDAE

SEQ ID NO: 172562 - protein, 16 aa, Mycobacterium tuberculosis
ADSFLVSARLSRDAEA

SEQ ID NO: 172563 - protein, 16 aa, Mycobacterium tuberculosis
DSFLVSARLSRDAEAP

SEQ ID NO: 172564 - protein, 16 aa, Mycobacterium tuberculosis
SFLVSARLSRDAEAPL

SEQ ID NO: 172565 - protein, 16 aa, Mycobacterium tuberculosis
FLVSARLSRDAEAPLD

SEQ ID NO: 172566 - protein, 16 aa, Mycobacterium tuberculosis
LVSARLSRDAEAPLDV

SEQ ID NO: 172567 - protein, 16 aa, Mycobacterium tuberculosis
VSARLSRDAEAPLDVV

SEQ ID NO: 172568 - protein, 16 aa, Mycobacterium tuberculosis
SARLSRDAEAPLDVVR

SEQ ID NO: 172569 - protein, 16 aa, Mycobacterium tuberculosis
ARLSRDAEAPLDVVRL

SEQ ID NO: 172570 - protein, 16 aa, Mycobacterium tuberculosis
RLSRDAEAPLDVVRLG

SEQ ID NO: 172571 - protein, 16 aa, Mycobacterium tuberculosis
LSRDAEAPLDVVRLGR

SEQ ID NO: 172572 - protein, 16 aa, Mycobacterium tuberculosis
SRDAEAPLDVVRLGRA

SEQ ID NO: 172573 - protein, 16 aa, Mycobacterium tuberculosis
RDAEAPLDVVRLGRAI

SEQ ID NO: 172574 - protein, 16 aa, Mycobacterium tuberculosis
DAEAPLDVVRLGRAIG

SEQ ID NO: 172575 - protein, 16 aa, Mycobacterium tuberculosis
AEAPLDVVRLGRAIGV

SEQ ID NO: 172576 - protein, 16 aa, Mycobacterium tuberculosis
EAPLDVVRLGRAIGVV

SEQ ID NO: 172577 - protein, 16 aa, Mycobacterium tuberculosis
APLDVVRLGRAIGVVY

SEQ ID NO: 172578 - protein, 16 aa, Mycobacterium tuberculosis
PLDVVRLGRAIGVVYL

SEQ ID NO: 172579 - protein, 16 aa, Mycobacterium tuberculosis
LDVVRLGRAIGVVYLP

SEQ ID NO: 172580 - protein, 16 aa, Mycobacterium tuberculosis
DVVRLGRAIGVVYLPA

SEQ ID NO: 172581 - protein, 16 aa, Mycobacterium tuberculosis
VVRLGRAIGVVYLPAT

SEQ ID NO: 172582 - protein, 16 aa, Mycobacterium tuberculosis
VRLGRAIGVVYLPATE

SEQ ID NO: 172583 - protein, 16 aa, Mycobacterium tuberculosis
RLGRAIGVVYLPATER

SEQ ID NO: 172584 - protein, 16 aa, Mycobacterium tuberculosis
LGRAIGVVYLPATERQ

SEQ ID NO: 172585 - protein, 16 aa, Mycobacterium tuberculosis
GRAIGVVYLPATERQS

SEQ ID NO: 172586 - protein, 16 aa, Mycobacterium tuberculosis
RAIGVVYLPATERQSH

SEQ ID NO: 172587 - protein, 16 aa, Mycobacterium tuberculosis
AIGVVYLPATERQSHY

SEQ ID NO: 172588 - protein, 16 aa, Mycobacterium tuberculosis
IGVVYLPATERQSHYL

SEQ ID NO: 172589 - protein, 16 aa, Mycobacterium tuberculosis
GVVYLPATERQSHYLH

SEQ ID NO: 172590 - protein, 16 aa, Mycobacterium tuberculosis
VVYLPATERQSHYLHV

SEQ ID NO: 172591 - protein, 16 aa, Mycobacterium tuberculosis
VYLPATERQSHYLHVR

SEQ ID NO: 172592 - protein, 16 aa, Mycobacterium tuberculosis
YLPATERQSHYLHVRP

SEQ ID NO: 172593 - protein, 16 aa, Mycobacterium tuberculosis
LPATERQSHYLHVRPA

SEQ ID NO: 172594 - protein, 16 aa, Mycobacterium tuberculosis
PATERQSHYLHVRPAD

SEQ ID NO: 172595 - protein, 16 aa, Mycobacterium tuberculosis
ATERQSHYLHVRPADQ

SEQ ID NO: 172596 - protein, 16 aa, Mycobacterium tuberculosis
TERQSHYLHVRPADQF

SEQ ID NO: 172597 - protein, 16 aa, Mycobacterium tuberculosis
ERQSHYLHVRPADQFD

SEQ ID NO: 172598 - protein, 16 aa, Mycobacterium tuberculosis
RQSHYLHVRPADQFDA

SEQ ID NO: 172599 - protein, 16 aa, Mycobacterium tuberculosis
QSHYLHVRPADQFDAM

SEQ ID NO: 172600 - protein, 16 aa, Mycobacterium tuberculosis
SHYLHVRPADQFDAMI

SEQ ID NO: 172601 - protein, 16 aa, Mycobacterium tuberculosis
HYLHVRPADQFDAMIH

SEQ ID NO: 172602 - protein, 16 aa, Mycobacterium tuberculosis
YLHVRPADQFDAMIHI

SEQ ID NO: 172603 - protein, 16 aa, Mycobacterium tuberculosis
LHVRPADQFDAMIHID

SEQ ID NO: 172604 - protein, 16 aa, Mycobacterium tuberculosis
HVRPADQFDAMIHIDQ

SEQ ID NO: 172605 - protein, 16 aa, Mycobacterium tuberculosis
VRPADQFDAMIHIDQT

SEQ ID NO: 172606 - protein, 16 aa, Mycobacterium tuberculosis
RPADQFDAMIHIDQTR

SEQ ID NO: 172607 - protein, 16 aa, Mycobacterium tuberculosis
PADQFDAMIHIDQTRA

SEQ ID NO: 172608 - protein, 16 aa, Mycobacterium tuberculosis
ADQFDAMIHIDQTRAL

SEQ ID NO: 172609 - protein, 16 aa, Mycobacterium tuberculosis
DQFDAMIHIDQTRALE

SEQ ID NO: 172610 - protein, 16 aa, Mycobacterium tuberculosis
QFDAMIHIDQTRALEP

SEQ ID NO: 172611 - protein, 16 aa, Mycobacterium tuberculosis
FDAMIHIDQTRALEPL

SEQ ID NO: 172612 - protein, 16 aa, Mycobacterium tuberculosis
DAMIHIDQTRALEPLE

SEQ ID NO: 172613 - protein, 16 aa, Mycobacterium tuberculosis
AMIHIDQTRALEPLEV

SEQ ID NO: 172614 - protein, 16 aa, Mycobacterium tuberculosis
MIHIDQTRALEPLEVT

SEQ ID NO: 172615 - protein, 16 aa, Mycobacterium tuberculosis
IHIDQTRALEPLEVTS

SEQ ID NO: 172616 - protein, 16 aa, Mycobacterium tuberculosis
HIDQTRALEPLEVTSR

SEQ ID NO: 172617 - protein, 16 aa, Mycobacterium tuberculosis
IDQTRALEPLEVTSRW

SEQ ID NO: 172618 - protein, 16 aa, Mycobacterium tuberculosis
DQTRALEPLEVTSRWI

SEQ ID NO: 172619 - protein, 16 aa, Mycobacterium tuberculosis
QTRALEPLEVTSRWIA

SEQ ID NO: 172620 - protein, 16 aa, Mycobacterium tuberculosis
TRALEPLEVTSRWIAG

SEQ ID NO: 172621 - protein, 16 aa, Mycobacterium tuberculosis
RALEPLEVTSRWIAGE

SEQ ID NO: 172622 - protein, 16 aa, Mycobacterium tuberculosis
ALEPLEVTSRWIAGEN

SEQ ID NO: 172623 - protein, 16 aa, Mycobacterium tuberculosis
LEPLEVTSRWIAGENP

SEQ ID NO: 172624 - protein, 16 aa, Mycobacterium tuberculosis
EPLEVTSRWIAGENPE

SEQ ID NO: 172625 - protein, 16 aa, Mycobacterium tuberculosis
PLEVTSRWIAGENPET

SEQ ID NO: 172626 - protein, 16 aa, Mycobacterium tuberculosis
LEVTSRWIAGENPETY

SEQ ID NO: 172627 - protein, 16 aa, Mycobacterium tuberculosis
EVTSRWIAGENPETYP

SEQ ID NO: 172628 - protein, 16 aa, Mycobacterium tuberculosis
VTSRWIAGENPETYPT

SEQ ID NO: 172629 - protein, 16 aa, Mycobacterium tuberculosis
TSRWIAGENPETYPTG

SEQ ID NO: 172630 - protein, 16 aa, Mycobacterium tuberculosis
SRWIAGENPETYPTGL

SEQ ID NO: 172631 - protein, 578 aa, Mycobacterium tuberculosis
MTTGGLVDENDGAAMRPLRHTLSQLRLHELLVEVQDRVEQIVEGRDRLDGLVEAMLVVTAGLDLEATLRAIVHSATSLVDARYGAMEVHDRQHRVLHFVYEGIDEETVRRIGHLPKGLGVIGLLIEDPKPLRLDDVSAHPASIGFPPYHPPMRTFLGVPVRVRDESFGTLYLTDKTNGQPFSDDDEVLVQALAAAAGIAVANARLYQQAKARQSWIEATRDIATELLSGTEPATVFRLVAAEALKLTAADAALVAVPVDEDMPAADVGELLVIETVGSAVASIVGRTIPVAGAVLREVFVNGIPRRVDRVDLEGLDELADAGPALLLPLRARGTVAGVVVVLSQGGPGAFTDEQLEMMAAFADQAALAWQLATSQRRMRELDVLTDRDRIARDLHDHVIQRLFAIGLALQGAVPHERNPEVQQRLSDVVDDLQDVIQEIRTTIYDLHGASQGITRLRQRIDAAVAQFADSGLRTSVQFVGPLSVVDSALADQAEAVVREAVSNAVRHAKASTLTVRVKVDDDLCIEVTDNGRGLPDEFTGSGLTNLRQRAEQAGGEFTLASVPGASGTVLRWSAPLSQ

SEQ ID NO: 172632 - protein, 8 aa, Mycobacterium tuberculosis
LVDENDGA

SEQ ID NO: 172633 - protein, 8 aa, Mycobacterium tuberculosis
DENDGAAM

SEQ ID NO: 172634 - protein, 8 aa, Mycobacterium tuberculosis
ENDGAAMR

SEQ ID NO: 172635 - protein, 8 aa, Mycobacterium tuberculosis
DGAAMRPL

SEQ ID NO: 172636 - protein, 8 aa, Mycobacterium tuberculosis
GAAMRPLR

SEQ ID NO: 172637 - protein, 8 aa, Mycobacterium tuberculosis
RPLRHTLS

SEQ ID NO: 172638 - protein, 8 aa, Mycobacterium tuberculosis
HTLSQLRL

SEQ ID NO: 172639 - protein, 8 aa, Mycobacterium tuberculosis
SQLRLHEL

SEQ ID NO: 172640 - protein, 8 aa, Mycobacterium tuberculosis
QLRLHELL

SEQ ID NO: 172641 - protein, 8 aa, Mycobacterium tuberculosis
LLVEVQDR

SEQ ID NO: 172642 - protein, 8 aa, Mycobacterium tuberculosis
LVEVQDRV

SEQ ID NO: 172643 - protein, 8 aa, Mycobacterium tuberculosis
VQDRVEQI

SEQ ID NO: 172644 - protein, 8 aa, Mycobacterium tuberculosis
QIVEGRDR

SEQ ID NO: 172645 - protein, 8 aa, Mycobacterium tuberculosis
RLDGLVEA

SEQ ID NO: 172646 - protein, 8 aa, Mycobacterium tuberculosis
GLVEAMLV

SEQ ID NO: 172647 - protein, 8 aa, Mycobacterium tuberculosis
LVEAMLVV

SEQ ID NO: 172648 - protein, 8 aa, Mycobacterium tuberculosis
EAMLVVTA

SEQ ID NO: 172649 - protein, 8 aa, Mycobacterium tuberculosis
MLVVTAGL

SEQ ID NO: 172650 - protein, 8 aa, Mycobacterium tuberculosis
GLDLEATL

SEQ ID NO: 172651 - protein, 8 aa, Mycobacterium tuberculosis
EATLRAIV

SEQ ID NO: 172652 - protein, 8 aa, Mycobacterium tuberculosis
IVHSATSL

SEQ ID NO: 172653 - protein, 8 aa, Mycobacterium tuberculosis
ATSLVDAR

SEQ ID NO: 172654 - protein, 8 aa, Mycobacterium tuberculosis
SLVDARYG

SEQ ID NO: 172655 - protein, 8 aa, Mycobacterium tuberculosis
LVDARYGA

SEQ ID NO: 172656 - protein, 8 aa, Mycobacterium tuberculosis
ARYGAMEV

SEQ ID NO: 172657 - protein, 8 aa, Mycobacterium tuberculosis
GAMEVHDR

SEQ ID NO: 172658 - protein, 8 aa, Mycobacterium tuberculosis
EVHDRQHR

SEQ ID NO: 172659 - protein, 8 aa, Mycobacterium tuberculosis
RQHRVLHF

SEQ ID NO: 172660 - protein, 8 aa, Mycobacterium tuberculosis
HRVLHFVY

SEQ ID NO: 172661 - protein, 8 aa, Mycobacterium tuberculosis
EGIDEETV

SEQ ID NO: 172662 - protein, 8 aa, Mycobacterium tuberculosis
ETVRRIGH

SEQ ID NO: 172663 - protein, 8 aa, Mycobacterium tuberculosis
TVRRIGHL

SEQ ID NO: 172664 - protein, 8 aa, Mycobacterium tuberculosis
RRIGHLPK

SEQ ID NO: 172665 - protein, 8 aa, Mycobacterium tuberculosis
HLPKGLGV

SEQ ID NO: 172666 - protein, 8 aa, Mycobacterium tuberculosis
LPKGLGVI

SEQ ID NO: 172667 - protein, 8 aa, Mycobacterium tuberculosis
GLGVIGLL

SEQ ID NO: 172668 - protein, 8 aa, Mycobacterium tuberculosis
GLLIEDPK

SEQ ID NO: 172669 - protein, 8 aa, Mycobacterium tuberculosis
LIEDPKPL

SEQ ID NO: 172670 - protein, 8 aa, Mycobacterium tuberculosis
RLDDVSAH

SEQ ID NO: 172671 - protein, 8 aa, Mycobacterium tuberculosis
AHPASIGF

SEQ ID NO: 172672 - protein, 8 aa, Mycobacterium tuberculosis
ASIGFPPY

SEQ ID NO: 172673 - protein, 8 aa, Mycobacterium tuberculosis
FPPYHPPM

SEQ ID NO: 172674 - protein, 8 aa, Mycobacterium tuberculosis
YHPPMRTF

SEQ ID NO: 172675 - protein, 8 aa, Mycobacterium tuberculosis
HPPMRTFL

SEQ ID NO: 172676 - protein, 8 aa, Mycobacterium tuberculosis
PMRTFLGV

SEQ ID NO: 172677 - protein, 8 aa, Mycobacterium tuberculosis
RTFLGVPV

SEQ ID NO: 172678 - protein, 8 aa, Mycobacterium tuberculosis
TFLGVPVR

SEQ ID NO: 172679 - protein, 8 aa, Mycobacterium tuberculosis
FLGVPVRV

SEQ ID NO: 172680 - protein, 8 aa, Mycobacterium tuberculosis
DESFGTLY

SEQ ID NO: 172681 - protein, 8 aa, Mycobacterium tuberculosis
ESFGTLYL

SEQ ID NO: 172682 - protein, 8 aa, Mycobacterium tuberculosis
GTLYLTDK

SEQ ID NO: 172683 - protein, 8 aa, Mycobacterium tuberculosis
YLTDKTNG

SEQ ID NO: 172684 - protein, 8 aa, Mycobacterium tuberculosis
FSDDDEVL

SEQ ID NO: 172685 - protein, 8 aa, Mycobacterium tuberculosis
SDDDEVLV

SEQ ID NO: 172686 - protein, 8 aa, Mycobacterium tuberculosis
DEVLVQAL

SEQ ID NO: 172687 - protein, 8 aa, Mycobacterium tuberculosis
EVLVQALA

SEQ ID NO: 172688 - protein, 8 aa, Mycobacterium tuberculosis
VLVQALAA

SEQ ID NO: 172689 - protein, 8 aa, Mycobacterium tuberculosis
LVQALAAA

SEQ ID NO: 172690 - protein, 8 aa, Mycobacterium tuberculosis
VQALAAAA

SEQ ID NO: 172691 - protein, 8 aa, Mycobacterium tuberculosis
ALAAAAGI

SEQ ID NO: 172692 - protein, 8 aa, Mycobacterium tuberculosis
AAAAGIAV

SEQ ID NO: 172693 - protein, 8 aa, Mycobacterium tuberculosis
GIAVANAR

SEQ ID NO: 172694 - protein, 8 aa, Mycobacterium tuberculosis
AVANARLY

SEQ ID NO: 172695 - protein, 8 aa, Mycobacterium tuberculosis
ARLYQQAK

SEQ ID NO: 172696 - protein, 8 aa, Mycobacterium tuberculosis
RLYQQAKA

SEQ ID NO: 172697 - protein, 8 aa, Mycobacterium tuberculosis
LYQQAKAR

SEQ ID NO: 172698 - protein, 8 aa, Mycobacterium tuberculosis
QAKARQSW

SEQ ID NO: 172699 - protein, 8 aa, Mycobacterium tuberculosis
RQSWIEAT

SEQ ID NO: 172700 - protein, 8 aa, Mycobacterium tuberculosis
QSWIEATR

SEQ ID NO: 172701 - protein, 8 aa, Mycobacterium tuberculosis
TRDIATEL

SEQ ID NO: 172702 - protein, 8 aa, Mycobacterium tuberculosis
LLSGTEPA

SEQ ID NO: 172703 - protein, 8 aa, Mycobacterium tuberculosis
SGTEPATV

SEQ ID NO: 172704 - protein, 8 aa, Mycobacterium tuberculosis
TEPATVFR

SEQ ID NO: 172705 - protein, 8 aa, Mycobacterium tuberculosis
EPATVFRL

SEQ ID NO: 172706 - protein, 8 aa, Mycobacterium tuberculosis
TVFRLVAA

SEQ ID NO: 172707 - protein, 8 aa, Mycobacterium tuberculosis
RLVAAEAL

SEQ ID NO: 172708 - protein, 8 aa, Mycobacterium tuberculosis
LVAAEALK

SEQ ID NO: 172709 - protein, 8 aa, Mycobacterium tuberculosis
AEALKLTA

SEQ ID NO: 172710 - protein, 8 aa, Mycobacterium tuberculosis
EALKLTAA

SEQ ID NO: 172711 - protein, 8 aa, Mycobacterium tuberculosis
KLTAADAA

SEQ ID NO: 172712 - protein, 8 aa, Mycobacterium tuberculosis
LTAADAAL

SEQ ID NO: 172713 - protein, 8 aa, Mycobacterium tuberculosis
TAADAALV

SEQ ID NO: 172714 - protein, 8 aa, Mycobacterium tuberculosis
ADAALVAV

SEQ ID NO: 172715 - protein, 8 aa, Mycobacterium tuberculosis
AALVAVPV

SEQ ID NO: 172716 - protein, 8 aa, Mycobacterium tuberculosis
PVDEDMPA

SEQ ID NO: 172717 - protein, 8 aa, Mycobacterium tuberculosis
ELLVIETV

SEQ ID NO: 172718 - protein, 8 aa, Mycobacterium tuberculosis
ETVGSAVA

SEQ ID NO: 172719 - protein, 8 aa, Mycobacterium tuberculosis
AVASIVGR

SEQ ID NO: 172720 - protein, 8 aa, Mycobacterium tuberculosis
IVGRTIPV

SEQ ID NO: 172721 - protein, 8 aa, Mycobacterium tuberculosis
RTIPVAGA

SEQ ID NO: 172722 - protein, 8 aa, Mycobacterium tuberculosis
TIPVAGAV

SEQ ID NO: 172723 - protein, 8 aa, Mycobacterium tuberculosis
IPVAGAVL

SEQ ID NO: 172724 - protein, 8 aa, Mycobacterium tuberculosis
PVAGAVLR

SEQ ID NO: 172725 - protein, 8 aa, Mycobacterium tuberculosis
AVLREVFV

SEQ ID NO: 172726 - protein, 8 aa, Mycobacterium tuberculosis
REVFVNGI

SEQ ID NO: 172727 - protein, 8 aa, Mycobacterium tuberculosis
VFVNGIPR

SEQ ID NO: 172728 - protein, 8 aa, Mycobacterium tuberculosis
FVNGIPRR

SEQ ID NO: 172729 - protein, 8 aa, Mycobacterium tuberculosis
IPRRVDRV

SEQ ID NO: 172730 - protein, 8 aa, Mycobacterium tuberculosis
RRVDRVDL

SEQ ID NO: 172731 - protein, 8 aa, Mycobacterium tuberculosis
DLEGLDEL

SEQ ID NO: 172732 - protein, 8 aa, Mycobacterium tuberculosis
GLDELADA

SEQ ID NO: 172733 - protein, 8 aa, Mycobacterium tuberculosis
ELADAGPA

SEQ ID NO: 172734 - protein, 8 aa, Mycobacterium tuberculosis
LADAGPAL

SEQ ID NO: 172735 - protein, 8 aa, Mycobacterium tuberculosis
GPALLLPL

SEQ ID NO: 172736 - protein, 8 aa, Mycobacterium tuberculosis
ALLLPLRA

SEQ ID NO: 172737 - protein, 8 aa, Mycobacterium tuberculosis
LLLPLRAR

SEQ ID NO: 172738 - protein, 8 aa, Mycobacterium tuberculosis
LPLRARGT

SEQ ID NO: 172739 - protein, 8 aa, Mycobacterium tuberculosis
PLRARGTV

SEQ ID NO: 172740 - protein, 8 aa, Mycobacterium tuberculosis
GTVAGVVV

SEQ ID NO: 172741 - protein, 8 aa, Mycobacterium tuberculosis
TVAGVVVV

SEQ ID NO: 172742 - protein, 8 aa, Mycobacterium tuberculosis
SQGGPGAF

SEQ ID NO: 172743 - protein, 8 aa, Mycobacterium tuberculosis
FTDEQLEM

SEQ ID NO: 172744 - protein, 8 aa, Mycobacterium tuberculosis
EQLEMMAA

SEQ ID NO: 172745 - protein, 8 aa, Mycobacterium tuberculosis
QLEMMAAF

SEQ ID NO: 172746 - protein, 8 aa, Mycobacterium tuberculosis
MMAAFADQ

SEQ ID NO: 172747 - protein, 8 aa, Mycobacterium tuberculosis
MAAFADQA

SEQ ID NO: 172748 - protein, 8 aa, Mycobacterium tuberculosis
FADQAALA

SEQ ID NO: 172749 - protein, 8 aa, Mycobacterium tuberculosis
QAALAWQL

SEQ ID NO: 172750 - protein, 8 aa, Mycobacterium tuberculosis
AALAWQLA

SEQ ID NO: 172751 - protein, 8 aa, Mycobacterium tuberculosis
ALAWQLAT

SEQ ID NO: 172752 - protein, 8 aa, Mycobacterium tuberculosis
LAWQLATS

SEQ ID NO: 172753 - protein, 8 aa, Mycobacterium tuberculosis
WQLATSQR

SEQ ID NO: 172754 - protein, 8 aa, Mycobacterium tuberculosis
QLATSQRR

SEQ ID NO: 172755 - protein, 8 aa, Mycobacterium tuberculosis
ATSQRRMR

SEQ ID NO: 172756 - protein, 8 aa, Mycobacterium tuberculosis
SQRRMREL

SEQ ID NO: 172757 - protein, 8 aa, Mycobacterium tuberculosis
RRMRELDV

SEQ ID NO: 172758 - protein, 8 aa, Mycobacterium tuberculosis
RMRELDVL

SEQ ID NO: 172759 - protein, 8 aa, Mycobacterium tuberculosis
DVLTDRDR

SEQ ID NO: 172760 - protein, 8 aa, Mycobacterium tuberculosis
VLTDRDRI

SEQ ID NO: 172761 - protein, 8 aa, Mycobacterium tuberculosis
DLHDHVIQ

SEQ ID NO: 172762 - protein, 8 aa, Mycobacterium tuberculosis
HVIQRLFA

SEQ ID NO: 172763 - protein, 8 aa, Mycobacterium tuberculosis
VIQRLFAI

SEQ ID NO: 172764 - protein, 8 aa, Mycobacterium tuberculosis
QRLFAIGL

SEQ ID NO: 172765 - protein, 8 aa, Mycobacterium tuberculosis
RLFAIGLA

SEQ ID NO: 172766 - protein, 8 aa, Mycobacterium tuberculosis
GLALQGAV

SEQ ID NO: 172767 - protein, 8 aa, Mycobacterium tuberculosis
VVDDLQDV

SEQ ID NO: 172768 - protein, 8 aa, Mycobacterium tuberculosis
LQDVIQEI

SEQ ID NO: 172769 - protein, 8 aa, Mycobacterium tuberculosis
IQEIRTTI

SEQ ID NO: 172770 - protein, 8 aa, Mycobacterium tuberculosis
QEIRTTIY

SEQ ID NO: 172771 - protein, 8 aa, Mycobacterium tuberculosis
TIYDLHGA

SEQ ID NO: 172772 - protein, 8 aa, Mycobacterium tuberculosis
SQGITRLR

SEQ ID NO: 172773 - protein, 8 aa, Mycobacterium tuberculosis
GITRLRQR

SEQ ID NO: 172774 - protein, 8 aa, Mycobacterium tuberculosis
ITRLRQRI

SEQ ID NO: 172775 - protein, 8 aa, Mycobacterium tuberculosis
RLRQRIDA

SEQ ID NO: 172776 - protein, 8 aa, Mycobacterium tuberculosis
RQRIDAAV

SEQ ID NO: 172777 - protein, 8 aa, Mycobacterium tuberculosis
DAAVAQFA

SEQ ID NO: 172778 - protein, 8 aa, Mycobacterium tuberculosis
AQFADSGL

SEQ ID NO: 172779 - protein, 8 aa, Mycobacterium tuberculosis
QFADSGLR

SEQ ID NO: 172780 - protein, 8 aa, Mycobacterium tuberculosis
GLRTSVQF

SEQ ID NO: 172781 - protein, 8 aa, Mycobacterium tuberculosis
SVQFVGPL

SEQ ID NO: 172782 - protein, 8 aa, Mycobacterium tuberculosis
QFVGPLSV

SEQ ID NO: 172783 - protein, 8 aa, Mycobacterium tuberculosis
FVGPLSVV

SEQ ID NO: 172784 - protein, 8 aa, Mycobacterium tuberculosis
PLSVVDSA

SEQ ID NO: 172785 - protein, 8 aa, Mycobacterium tuberculosis
SVVDSALA

SEQ ID NO: 172786 - protein, 8 aa, Mycobacterium tuberculosis
ALADQAEA

SEQ ID NO: 172787 - protein, 8 aa, Mycobacterium tuberculosis
LADQAEAV

SEQ ID NO: 172788 - protein, 8 aa, Mycobacterium tuberculosis
DQAEAVVR

SEQ ID NO: 172789 - protein, 8 aa, Mycobacterium tuberculosis
AEAVVREA

SEQ ID NO: 172790 - protein, 8 aa, Mycobacterium tuberculosis
EAVVREAV

SEQ ID NO: 172791 - protein, 8 aa, Mycobacterium tuberculosis
REAVSNAV

SEQ ID NO: 172792 - protein, 8 aa, Mycobacterium tuberculosis
EAVSNAVR

SEQ ID NO: 172793 - protein, 8 aa, Mycobacterium tuberculosis
RHAKASTL

SEQ ID NO: 172794 - protein, 8 aa, Mycobacterium tuberculosis
AKASTLTV

SEQ ID NO: 172795 - protein, 8 aa, Mycobacterium tuberculosis
KASTLTVR

SEQ ID NO: 172796 - protein, 8 aa, Mycobacterium tuberculosis
STLTVRVK

SEQ ID NO: 172797 - protein, 8 aa, Mycobacterium tuberculosis
TLTVRVKV

SEQ ID NO: 172798 - protein, 8 aa, Mycobacterium tuberculosis
KVDDDLCI

SEQ ID NO: 172799 - protein, 8 aa, Mycobacterium tuberculosis
GLPDEFTG

SEQ ID NO: 172800 - protein, 8 aa, Mycobacterium tuberculosis
LPDEFTGS

SEQ ID NO: 172801 - protein, 8 aa, Mycobacterium tuberculosis
DEFTGSGL

SEQ ID NO: 172802 - protein, 8 aa, Mycobacterium tuberculosis
TGSGLTNL

SEQ ID NO: 172803 - protein, 8 aa, Mycobacterium tuberculosis
GSGLTNLR

SEQ ID NO: 172804 - protein, 8 aa, Mycobacterium tuberculosis
GLTNLRQR

SEQ ID NO: 172805 - protein, 8 aa, Mycobacterium tuberculosis
AEQAGGEF

SEQ ID NO: 172806 - protein, 8 aa, Mycobacterium tuberculosis
GEFTLASV

SEQ ID NO: 172807 - protein, 8 aa, Mycobacterium tuberculosis
TLASVPGA

SEQ ID NO: 172808 - protein, 8 aa, Mycobacterium tuberculosis
VPGASGTV

SEQ ID NO: 172809 - protein, 8 aa, Mycobacterium tuberculosis
GASGTVLR

SEQ ID NO: 172810 - protein, 8 aa, Mycobacterium tuberculosis
ASGTVLRW

SEQ ID NO: 172811 - protein, 8 aa, Mycobacterium tuberculosis
GTVLRWSA

SEQ ID NO: 172812 - protein, 8 aa, Mycobacterium tuberculosis
VLRWSAPL

SEQ ID NO: 172813 - protein, 9 aa, Mycobacterium tuberculosis
GLVDENDGA

SEQ ID NO: 172814 - protein, 9 aa, Mycobacterium tuberculosis
DENDGAAMR

SEQ ID NO: 172815 - protein, 9 aa, Mycobacterium tuberculosis
DGAAMRPLR

SEQ ID NO: 172816 - protein, 9 aa, Mycobacterium tuberculosis
AMRPLRHTL

SEQ ID NO: 172817 - protein, 9 aa, Mycobacterium tuberculosis
RPLRHTLSQ

SEQ ID NO: 172818 - protein, 9 aa, Mycobacterium tuberculosis
PLRHTLSQL

SEQ ID NO: 172819 - protein, 9 aa, Mycobacterium tuberculosis
SQLRLHELL

SEQ ID NO: 172820 - protein, 9 aa, Mycobacterium tuberculosis
QLRLHELLV

SEQ ID NO: 172821 - protein, 9 aa, Mycobacterium tuberculosis
RLHELLVEV

SEQ ID NO: 172822 - protein, 9 aa, Mycobacterium tuberculosis
LLVEVQDRV

SEQ ID NO: 172823 - protein, 9 aa, Mycobacterium tuberculosis
EVQDRVEQI

SEQ ID NO: 172824 - protein, 9 aa, Mycobacterium tuberculosis
VQDRVEQIV

SEQ ID NO: 172825 - protein, 9 aa, Mycobacterium tuberculosis
RVEQIVEGR

SEQ ID NO: 172826 - protein, 9 aa, Mycobacterium tuberculosis
QIVEGRDRL

SEQ ID NO: 172827 - protein, 9 aa, Mycobacterium tuberculosis
RLDGLVEAM

SEQ ID NO: 172828 - protein, 9 aa, Mycobacterium tuberculosis
GLVEAMLVV

SEQ ID NO: 172829 - protein, 9 aa, Mycobacterium tuberculosis
AMLVVTAGL

SEQ ID NO: 172830 - protein, 9 aa, Mycobacterium tuberculosis
TLRAIVHSA

SEQ ID NO: 172831 - protein, 9 aa, Mycobacterium tuberculosis
AIVHSATSL

SEQ ID NO: 172832 - protein, 9 aa, Mycobacterium tuberculosis
IVHSATSLV

SEQ ID NO: 172833 - protein, 9 aa, Mycobacterium tuberculosis
SATSLVDAR

SEQ ID NO: 172834 - protein, 9 aa, Mycobacterium tuberculosis
ATSLVDARY

SEQ ID NO: 172835 - protein, 9 aa, Mycobacterium tuberculosis
SLVDARYGA

SEQ ID NO: 172836 - protein, 9 aa, Mycobacterium tuberculosis
LVDARYGAM

SEQ ID NO: 172837 - protein, 9 aa, Mycobacterium tuberculosis
MEVHDRQHR

SEQ ID NO: 172838 - protein, 9 aa, Mycobacterium tuberculosis
EVHDRQHRV

SEQ ID NO: 172839 - protein, 9 aa, Mycobacterium tuberculosis
VHDRQHRVL

SEQ ID NO: 172840 - protein, 9 aa, Mycobacterium tuberculosis
RQHRVLHFV

SEQ ID NO: 172841 - protein, 9 aa, Mycobacterium tuberculosis
QHRVLHFVY

SEQ ID NO: 172842 - protein, 9 aa, Mycobacterium tuberculosis
VLHFVYEGI

SEQ ID NO: 172843 - protein, 9 aa, Mycobacterium tuberculosis
FVYEGIDEE

SEQ ID NO: 172844 - protein, 9 aa, Mycobacterium tuberculosis
EGIDEETVR

SEQ ID NO: 172845 - protein, 9 aa, Mycobacterium tuberculosis
ETVRRIGHL

SEQ ID NO: 172846 - protein, 9 aa, Mycobacterium tuberculosis
VRRIGHLPK

SEQ ID NO: 172847 - protein, 9 aa, Mycobacterium tuberculosis
RIGHLPKGL

SEQ ID NO: 172848 - protein, 9 aa, Mycobacterium tuberculosis
HLPKGLGVI

SEQ ID NO: 172849 - protein, 9 aa, Mycobacterium tuberculosis
LPKGLGVIG

SEQ ID NO: 172850 - protein, 9 aa, Mycobacterium tuberculosis
GLGVIGLLI

SEQ ID NO: 172851 - protein, 9 aa, Mycobacterium tuberculosis
LLIEDPKPL

SEQ ID NO: 172852 - protein, 9 aa, Mycobacterium tuberculosis
LIEDPKPLR

SEQ ID NO: 172853 - protein, 9 aa, Mycobacterium tuberculosis
IEDPKPLRL

SEQ ID NO: 172854 - protein, 9 aa, Mycobacterium tuberculosis
RLDDVSAHP

SEQ ID NO: 172855 - protein, 9 aa, Mycobacterium tuberculosis
DVSAHPASI

SEQ ID NO: 172856 - protein, 9 aa, Mycobacterium tuberculosis
SAHPASIGF

SEQ ID NO: 172857 - protein, 9 aa, Mycobacterium tuberculosis
HPASIGFPP

SEQ ID NO: 172858 - protein, 9 aa, Mycobacterium tuberculosis
PASIGFPPY

SEQ ID NO: 172859 - protein, 9 aa, Mycobacterium tuberculosis
ASIGFPPYH

SEQ ID NO: 172860 - protein, 9 aa, Mycobacterium tuberculosis
FPPYHPPMR

SEQ ID NO: 172861 - protein, 9 aa, Mycobacterium tuberculosis
PYHPPMRTF

SEQ ID NO: 172862 - protein, 9 aa, Mycobacterium tuberculosis
YHPPMRTFL

SEQ ID NO: 172863 - protein, 9 aa, Mycobacterium tuberculosis
PPMRTFLGV

SEQ ID NO: 172864 - protein, 9 aa, Mycobacterium tuberculosis
MRTFLGVPV

SEQ ID NO: 172865 - protein, 9 aa, Mycobacterium tuberculosis
RTFLGVPVR

SEQ ID NO: 172866 - protein, 9 aa, Mycobacterium tuberculosis
TFLGVPVRV

SEQ ID NO: 172867 - protein, 9 aa, Mycobacterium tuberculosis
VPVRVRDES

SEQ ID NO: 172868 - protein, 9 aa, Mycobacterium tuberculosis
RVRDESFGT

SEQ ID NO: 172869 - protein, 9 aa, Mycobacterium tuberculosis
VRDESFGTL

SEQ ID NO: 172870 - protein, 9 aa, Mycobacterium tuberculosis
DESFGTLYL

SEQ ID NO: 172871 - protein, 9 aa, Mycobacterium tuberculosis
ESFGTLYLT

SEQ ID NO: 172872 - protein, 9 aa, Mycobacterium tuberculosis
YLTDKTNGQ

SEQ ID NO: 172873 - protein, 9 aa, Mycobacterium tuberculosis
FSDDDEVLV

SEQ ID NO: 172874 - protein, 9 aa, Mycobacterium tuberculosis
EVLVQALAA

SEQ ID NO: 172875 - protein, 9 aa, Mycobacterium tuberculosis
VLVQALAAA

SEQ ID NO: 172876 - protein, 9 aa, Mycobacterium tuberculosis
QALAAAAGI

SEQ ID NO: 172877 - protein, 9 aa, Mycobacterium tuberculosis
ALAAAAGIA

SEQ ID NO: 172878 - protein, 9 aa, Mycobacterium tuberculosis
LAAAAGIAV

SEQ ID NO: 172879 - protein, 9 aa, Mycobacterium tuberculosis
AAAAGIAVA

SEQ ID NO: 172880 - protein, 9 aa, Mycobacterium tuberculosis
GIAVANARL

SEQ ID NO: 172881 - protein, 9 aa, Mycobacterium tuberculosis
IAVANARLY

SEQ ID NO: 172882 - protein, 9 aa, Mycobacterium tuberculosis
NARLYQQAK

SEQ ID NO: 172883 - protein, 9 aa, Mycobacterium tuberculosis
RLYQQAKAR

SEQ ID NO: 172884 - protein, 9 aa, Mycobacterium tuberculosis
QQAKARQSW

SEQ ID NO: 172885 - protein, 9 aa, Mycobacterium tuberculosis
KARQSWIEA

SEQ ID NO: 172886 - protein, 9 aa, Mycobacterium tuberculosis
RQSWIEATR

SEQ ID NO: 172887 - protein, 9 aa, Mycobacterium tuberculosis
SWIEATRDI

SEQ ID NO: 172888 - protein, 9 aa, Mycobacterium tuberculosis
ATRDIATEL

SEQ ID NO: 172889 - protein, 9 aa, Mycobacterium tuberculosis
TRDIATELL

SEQ ID NO: 172890 - protein, 9 aa, Mycobacterium tuberculosis
ELLSGTEPA

SEQ ID NO: 172891 - protein, 9 aa, Mycobacterium tuberculosis
LLSGTEPAT

SEQ ID NO: 172892 - protein, 9 aa, Mycobacterium tuberculosis
GTEPATVFR

SEQ ID NO: 172893 - protein, 9 aa, Mycobacterium tuberculosis
EPATVFRLV

SEQ ID NO: 172894 - protein, 9 aa, Mycobacterium tuberculosis
ATVFRLVAA

SEQ ID NO: 172895 - protein, 9 aa, Mycobacterium tuberculosis
FRLVAAEAL

SEQ ID NO: 172896 - protein, 9 aa, Mycobacterium tuberculosis
RLVAAEALK

SEQ ID NO: 172897 - protein, 9 aa, Mycobacterium tuberculosis
LVAAEALKL

SEQ ID NO: 172898 - protein, 9 aa, Mycobacterium tuberculosis
AEALKLTAA

SEQ ID NO: 172899 - protein, 9 aa, Mycobacterium tuberculosis
KLTAADAAL

SEQ ID NO: 172900 - protein, 9 aa, Mycobacterium tuberculosis
LTAADAALV

SEQ ID NO: 172901 - protein, 9 aa, Mycobacterium tuberculosis
TAADAALVA

SEQ ID NO: 172902 - protein, 9 aa, Mycobacterium tuberculosis
AADAALVAV

SEQ ID NO: 172903 - protein, 9 aa, Mycobacterium tuberculosis
DAALVAVPV

SEQ ID NO: 172904 - protein, 9 aa, Mycobacterium tuberculosis
VAVPVDEDM

SEQ ID NO: 172905 - protein, 9 aa, Mycobacterium tuberculosis
VPVDEDMPA

SEQ ID NO: 172906 - protein, 9 aa, Mycobacterium tuberculosis
PVDEDMPAA

SEQ ID NO: 172907 - protein, 9 aa, Mycobacterium tuberculosis
MPAADVGEL

SEQ ID NO: 172908 - protein, 9 aa, Mycobacterium tuberculosis
AADVGELLV

SEQ ID NO: 172909 - protein, 9 aa, Mycobacterium tuberculosis
GELLVIETV

SEQ ID NO: 172910 - protein, 9 aa, Mycobacterium tuberculosis
LLVIETVGS

SEQ ID NO: 172911 - protein, 9 aa, Mycobacterium tuberculosis
LVIETVGSA

SEQ ID NO: 172912 - protein, 9 aa, Mycobacterium tuberculosis
VIETVGSAV

SEQ ID NO: 172913 - protein, 9 aa, Mycobacterium tuberculosis
ETVGSAVAS

SEQ ID NO: 172914 - protein, 9 aa, Mycobacterium tuberculosis
TVGSAVASI

SEQ ID NO: 172915 - protein, 9 aa, Mycobacterium tuberculosis
SAVASIVGR

SEQ ID NO: 172916 - protein, 9 aa, Mycobacterium tuberculosis
AVASIVGRT

SEQ ID NO: 172917 - protein, 9 aa, Mycobacterium tuberculosis
SIVGRTIPV

SEQ ID NO: 172918 - protein, 9 aa, Mycobacterium tuberculosis
RTIPVAGAV

SEQ ID NO: 172919 - protein, 9 aa, Mycobacterium tuberculosis
TIPVAGAVL

SEQ ID NO: 172920 - protein, 9 aa, Mycobacterium tuberculosis
IPVAGAVLR

SEQ ID NO: 172921 - protein, 9 aa, Mycobacterium tuberculosis
VAGAVLREV

SEQ ID NO: 172922 - protein, 9 aa, Mycobacterium tuberculosis
GAVLREVFV

SEQ ID NO: 172923 - protein, 9 aa, Mycobacterium tuberculosis
EVFVNGIPR

SEQ ID NO: 172924 - protein, 9 aa, Mycobacterium tuberculosis
VFVNGIPRR

SEQ ID NO: 172925 - protein, 9 aa, Mycobacterium tuberculosis
FVNGIPRRV

SEQ ID NO: 172926 - protein, 9 aa, Mycobacterium tuberculosis
GIPRRVDRV

SEQ ID NO: 172927 - protein, 9 aa, Mycobacterium tuberculosis
DLEGLDELA

SEQ ID NO: 172928 - protein, 9 aa, Mycobacterium tuberculosis
ELADAGPAL

SEQ ID NO: 172929 - protein, 9 aa, Mycobacterium tuberculosis
LADAGPALL

SEQ ID NO: 172930 - protein, 9 aa, Mycobacterium tuberculosis
ALLLPLRAR

SEQ ID NO: 172931 - protein, 9 aa, Mycobacterium tuberculosis
LLLPLRARG

SEQ ID NO: 172932 - protein, 9 aa, Mycobacterium tuberculosis
LPLRARGTV

SEQ ID NO: 172933 - protein, 9 aa, Mycobacterium tuberculosis
RARGTVAGV

SEQ ID NO: 172934 - protein, 9 aa, Mycobacterium tuberculosis
GTVAGVVVV

SEQ ID NO: 172935 - protein, 9 aa, Mycobacterium tuberculosis
TVAGVVVVL

SEQ ID NO: 172936 - protein, 9 aa, Mycobacterium tuberculosis
VLSQGGPGA

SEQ ID NO: 172937 - protein, 9 aa, Mycobacterium tuberculosis
LSQGGPGAF

SEQ ID NO: 172938 - protein, 9 aa, Mycobacterium tuberculosis
FTDEQLEMM

SEQ ID NO: 172939 - protein, 9 aa, Mycobacterium tuberculosis
EQLEMMAAF

SEQ ID NO: 172940 - protein, 9 aa, Mycobacterium tuberculosis
QLEMMAAFA

SEQ ID NO: 172941 - protein, 9 aa, Mycobacterium tuberculosis
MMAAFADQA

SEQ ID NO: 172942 - protein, 9 aa, Mycobacterium tuberculosis
MAAFADQAA

SEQ ID NO: 172943 - protein, 9 aa, Mycobacterium tuberculosis
AAFADQAAL

SEQ ID NO: 172944 - protein, 9 aa, Mycobacterium tuberculosis
FADQAALAW

SEQ ID NO: 172945 - protein, 9 aa, Mycobacterium tuberculosis
QAALAWQLA

SEQ ID NO: 172946 - protein, 9 aa, Mycobacterium tuberculosis
AALAWQLAT

SEQ ID NO: 172947 - protein, 9 aa, Mycobacterium tuberculosis
ALAWQLATS

SEQ ID NO: 172948 - protein, 9 aa, Mycobacterium tuberculosis
AWQLATSQR

SEQ ID NO: 172949 - protein, 9 aa, Mycobacterium tuberculosis
LATSQRRMR

SEQ ID NO: 172950 - protein, 9 aa, Mycobacterium tuberculosis
RRMRELDVL

SEQ ID NO: 172951 - protein, 9 aa, Mycobacterium tuberculosis
RMRELDVLT

SEQ ID NO: 172952 - protein, 9 aa, Mycobacterium tuberculosis
VLTDRDRIA

SEQ ID NO: 172953 - protein, 9 aa, Mycobacterium tuberculosis
LTDRDRIAR

SEQ ID NO: 172954 - protein, 9 aa, Mycobacterium tuberculosis
IARDLHDHV

SEQ ID NO: 172955 - protein, 9 aa, Mycobacterium tuberculosis
DLHDHVIQR

SEQ ID NO: 172956 - protein, 9 aa, Mycobacterium tuberculosis
LHDHVIQRL

SEQ ID NO: 172957 - protein, 9 aa, Mycobacterium tuberculosis
HVIQRLFAI

SEQ ID NO: 172958 - protein, 9 aa, Mycobacterium tuberculosis
IQRLFAIGL

SEQ ID NO: 172959 - protein, 9 aa, Mycobacterium tuberculosis
RLFAIGLAL

SEQ ID NO: 172960 - protein, 9 aa, Mycobacterium tuberculosis
AIGLALQGA

SEQ ID NO: 172961 - protein, 9 aa, Mycobacterium tuberculosis
LALQGAVPH

SEQ ID NO: 172962 - protein, 9 aa, Mycobacterium tuberculosis
LQGAVPHER

SEQ ID NO: 172963 - protein, 9 aa, Mycobacterium tuberculosis
EVQQRLSDV

SEQ ID NO: 172964 - protein, 9 aa, Mycobacterium tuberculosis
VQQRLSDVV

SEQ ID NO: 172965 - protein, 9 aa, Mycobacterium tuberculosis
RLSDVVDDL

SEQ ID NO: 172966 - protein, 9 aa, Mycobacterium tuberculosis
DVVDDLQDV

SEQ ID NO: 172967 - protein, 9 aa, Mycobacterium tuberculosis
VVDDLQDVI

SEQ ID NO: 172968 - protein, 9 aa, Mycobacterium tuberculosis
DLQDVIQEI

SEQ ID NO: 172969 - protein, 9 aa, Mycobacterium tuberculosis
VIQEIRTTI

SEQ ID NO: 172970 - protein, 9 aa, Mycobacterium tuberculosis
IQEIRTTIY

SEQ ID NO: 172971 - protein, 9 aa, Mycobacterium tuberculosis
EIRTTIYDL

SEQ ID NO: 172972 - protein, 9 aa, Mycobacterium tuberculosis
TTIYDLHGA

SEQ ID NO: 172973 - protein, 9 aa, Mycobacterium tuberculosis
DLHGASQGI

SEQ ID NO: 172974 - protein, 9 aa, Mycobacterium tuberculosis
GASQGITRL

SEQ ID NO: 172975 - protein, 9 aa, Mycobacterium tuberculosis
ASQGITRLR

SEQ ID NO: 172976 - protein, 9 aa, Mycobacterium tuberculosis
GITRLRQRI

SEQ ID NO: 172977 - protein, 9 aa, Mycobacterium tuberculosis
RLRQRIDAA

SEQ ID NO: 172978 - protein, 9 aa, Mycobacterium tuberculosis
AQFADSGLR

SEQ ID NO: 172979 - protein, 9 aa, Mycobacterium tuberculosis
GLRTSVQFV

SEQ ID NO: 172980 - protein, 9 aa, Mycobacterium tuberculosis
TSVQFVGPL

SEQ ID NO: 172981 - protein, 9 aa, Mycobacterium tuberculosis
VQFVGPLSV

SEQ ID NO: 172982 - protein, 9 aa, Mycobacterium tuberculosis
GPLSVVDSA

SEQ ID NO: 172983 - protein, 9 aa, Mycobacterium tuberculosis
PLSVVDSAL

SEQ ID NO: 172984 - protein, 9 aa, Mycobacterium tuberculosis
ALADQAEAV

SEQ ID NO: 172985 - protein, 9 aa, Mycobacterium tuberculosis
LADQAEAVV

SEQ ID NO: 172986 - protein, 9 aa, Mycobacterium tuberculosis
AEAVVREAV

SEQ ID NO: 172987 - protein, 9 aa, Mycobacterium tuberculosis
VVREAVSNA

SEQ ID NO: 172988 - protein, 9 aa, Mycobacterium tuberculosis
VSNAVRHAK

SEQ ID NO: 172989 - protein, 9 aa, Mycobacterium tuberculosis
AVRHAKAST

SEQ ID NO: 172990 - protein, 9 aa, Mycobacterium tuberculosis
HAKASTLTV

SEQ ID NO: 172991 - protein, 9 aa, Mycobacterium tuberculosis
KASTLTVRV

SEQ ID NO: 172992 - protein, 9 aa, Mycobacterium tuberculosis
ASTLTVRVK

SEQ ID NO: 172993 - protein, 9 aa, Mycobacterium tuberculosis
STLTVRVKV

SEQ ID NO: 172994 - protein, 9 aa, Mycobacterium tuberculosis
VDDDLCIEV

SEQ ID NO: 172995 - protein, 9 aa, Mycobacterium tuberculosis
CIEVTDNGR

SEQ ID NO: 172996 - protein, 9 aa, Mycobacterium tuberculosis
EVTDNGRGL

SEQ ID NO: 172997 - protein, 9 aa, Mycobacterium tuberculosis
GLPDEFTGS

SEQ ID NO: 172998 - protein, 9 aa, Mycobacterium tuberculosis
FTGSGLTNL

SEQ ID NO: 172999 - protein, 9 aa, Mycobacterium tuberculosis
TGSGLTNLR

SEQ ID NO: 173000 - protein, 9 aa, Mycobacterium tuberculosis
GLTNLRQRA

SEQ ID NO: 173001 - protein, 9 aa, Mycobacterium tuberculosis
NLRQRAEQA

SEQ ID NO: 173002 - protein, 9 aa, Mycobacterium tuberculosis
RAEQAGGEF

SEQ ID NO: 173003 - protein, 9 aa, Mycobacterium tuberculosis
AEQAGGEFT

SEQ ID NO: 173004 - protein, 9 aa, Mycobacterium tuberculosis
EQAGGEFTL

SEQ ID NO: 173005 - protein, 9 aa, Mycobacterium tuberculosis
FTLASVPGA

SEQ ID NO: 173006 - protein, 9 aa, Mycobacterium tuberculosis
SVPGASGTV

SEQ ID NO: 173007 - protein, 9 aa, Mycobacterium tuberculosis
VPGASGTVL

SEQ ID NO: 173008 - protein, 9 aa, Mycobacterium tuberculosis
GASGTVLRW

SEQ ID NO: 173009 - protein, 9 aa, Mycobacterium tuberculosis
TVLRWSAPL

SEQ ID NO: 173010 - protein, 9 aa, Mycobacterium tuberculosis
LRWSAPLSQ

SEQ ID NO: 173011 - protein, 10 aa, Mycobacterium tuberculosis
GLVDENDGAA

SEQ ID NO: 173012 - protein, 10 aa, Mycobacterium tuberculosis
LVDENDGAAM

SEQ ID NO: 173013 - protein, 10 aa, Mycobacterium tuberculosis
AAMRPLRHTL

SEQ ID NO: 173014 - protein, 10 aa, Mycobacterium tuberculosis
AMRPLRHTLS

SEQ ID NO: 173015 - protein, 10 aa, Mycobacterium tuberculosis
RPLRHTLSQL

SEQ ID NO: 173016 - protein, 10 aa, Mycobacterium tuberculosis
TLSQLRLHEL

SEQ ID NO: 173017 - protein, 10 aa, Mycobacterium tuberculosis
SQLRLHELLV

SEQ ID NO: 173018 - protein, 10 aa, Mycobacterium tuberculosis
RLHELLVEVQ

SEQ ID NO: 173019 - protein, 10 aa, Mycobacterium tuberculosis
ELLVEVQDRV

SEQ ID NO: 173020 - protein, 10 aa, Mycobacterium tuberculosis
VEVQDRVEQI

SEQ ID NO: 173021 - protein, 10 aa, Mycobacterium tuberculosis
EVQDRVEQIV

SEQ ID NO: 173022 - protein, 10 aa, Mycobacterium tuberculosis
RLDGLVEAML

SEQ ID NO: 173023 - protein, 10 aa, Mycobacterium tuberculosis
GLVEAMLVVT

SEQ ID NO: 173024 - protein, 10 aa, Mycobacterium tuberculosis
EAMLVVTAGL

SEQ ID NO: 173025 - protein, 10 aa, Mycobacterium tuberculosis
MLVVTAGLDL

SEQ ID NO: 173026 - protein, 10 aa, Mycobacterium tuberculosis
VVTAGLDLEA

SEQ ID NO: 173027 - protein, 10 aa, Mycobacterium tuberculosis
TAGLDLEATL

SEQ ID NO: 173028 - protein, 10 aa, Mycobacterium tuberculosis
GLDLEATLRA

SEQ ID NO: 173029 - protein, 10 aa, Mycobacterium tuberculosis
DLEATLRAIV

SEQ ID NO: 173030 - protein, 10 aa, Mycobacterium tuberculosis
ATLRAIVHSA

SEQ ID NO: 173031 - protein, 10 aa, Mycobacterium tuberculosis
TLRAIVHSAT

SEQ ID NO: 173032 - protein, 10 aa, Mycobacterium tuberculosis
RAIVHSATSL

SEQ ID NO: 173033 - protein, 10 aa, Mycobacterium tuberculosis
AIVHSATSLV

SEQ ID NO: 173034 - protein, 10 aa, Mycobacterium tuberculosis
HSATSLVDAR

SEQ ID NO: 173035 - protein, 10 aa, Mycobacterium tuberculosis
SATSLVDARY

SEQ ID NO: 173036 - protein, 10 aa, Mycobacterium tuberculosis
SLVDARYGAM

SEQ ID NO: 173037 - protein, 10 aa, Mycobacterium tuberculosis
RYGAMEVHDR

SEQ ID NO: 173038 - protein, 10 aa, Mycobacterium tuberculosis
AMEVHDRQHR

SEQ ID NO: 173039 - protein, 10 aa, Mycobacterium tuberculosis
MEVHDRQHRV

SEQ ID NO: 173040 - protein, 10 aa, Mycobacterium tuberculosis
EVHDRQHRVL

SEQ ID NO: 173041 - protein, 10 aa, Mycobacterium tuberculosis
RQHRVLHFVY

SEQ ID NO: 173042 - protein, 10 aa, Mycobacterium tuberculosis
RVLHFVYEGI

SEQ ID NO: 173043 - protein, 10 aa, Mycobacterium tuberculosis
FVYEGIDEET

SEQ ID NO: 173044 - protein, 10 aa, Mycobacterium tuberculosis
EGIDEETVRR

SEQ ID NO: 173045 - protein, 10 aa, Mycobacterium tuberculosis
GIDEETVRRI

SEQ ID NO: 173046 - protein, 10 aa, Mycobacterium tuberculosis
TVRRIGHLPK

SEQ ID NO: 173047 - protein, 10 aa, Mycobacterium tuberculosis
RRIGHLPKGL

SEQ ID NO: 173048 - protein, 10 aa, Mycobacterium tuberculosis
LPKGLGVIGL

SEQ ID NO: 173049 - protein, 10 aa, Mycobacterium tuberculosis
VIGLLIEDPK

SEQ ID NO: 173050 - protein, 10 aa, Mycobacterium tuberculosis
GLLIEDPKPL

SEQ ID NO: 173051 - protein, 10 aa, Mycobacterium tuberculosis
LLIEDPKPLR

SEQ ID NO: 173052 - protein, 10 aa, Mycobacterium tuberculosis
LIEDPKPLRL

SEQ ID NO: 173053 - protein, 10 aa, Mycobacterium tuberculosis
KPLRLDDVSA

SEQ ID NO: 173054 - protein, 10 aa, Mycobacterium tuberculosis
RLDDVSAHPA

SEQ ID NO: 173055 - protein, 10 aa, Mycobacterium tuberculosis
VSAHPASIGF

SEQ ID NO: 173056 - protein, 10 aa, Mycobacterium tuberculosis
HPASIGFPPY

SEQ ID NO: 173057 - protein, 10 aa, Mycobacterium tuberculosis
FPPYHPPMRT

SEQ ID NO: 173058 - protein, 10 aa, Mycobacterium tuberculosis
PYHPPMRTFL

SEQ ID NO: 173059 - protein, 10 aa, Mycobacterium tuberculosis
HPPMRTFLGV

SEQ ID NO: 173060 - protein, 10 aa, Mycobacterium tuberculosis
PMRTFLGVPV

SEQ ID NO: 173061 - protein, 10 aa, Mycobacterium tuberculosis
MRTFLGVPVR

SEQ ID NO: 173062 - protein, 10 aa, Mycobacterium tuberculosis
RTFLGVPVRV

SEQ ID NO: 173063 - protein, 10 aa, Mycobacterium tuberculosis
TFLGVPVRVR

SEQ ID NO: 173064 - protein, 10 aa, Mycobacterium tuberculosis
VPVRVRDESF

SEQ ID NO: 173065 - protein, 10 aa, Mycobacterium tuberculosis
RVRDESFGTL

SEQ ID NO: 173066 - protein, 10 aa, Mycobacterium tuberculosis
YLTDKTNGQP

SEQ ID NO: 173067 - protein, 10 aa, Mycobacterium tuberculosis
LTDKTNGQPF

SEQ ID NO: 173068 - protein, 10 aa, Mycobacterium tuberculosis
GQPFSDDDEV

SEQ ID NO: 173069 - protein, 10 aa, Mycobacterium tuberculosis
QPFSDDDEVL

SEQ ID NO: 173070 - protein, 10 aa, Mycobacterium tuberculosis
PFSDDDEVLV

SEQ ID NO: 173071 - protein, 10 aa, Mycobacterium tuberculosis
EVLVQALAAA

SEQ ID NO: 173072 - protein, 10 aa, Mycobacterium tuberculosis
VLVQALAAAA

SEQ ID NO: 173073 - protein, 10 aa, Mycobacterium tuberculosis
VQALAAAAGI

SEQ ID NO: 173074 - protein, 10 aa, Mycobacterium tuberculosis
ALAAAAGIAV

SEQ ID NO: 173075 - protein, 10 aa, Mycobacterium tuberculosis
LAAAAGIAVA

SEQ ID NO: 173076 - protein, 10 aa, Mycobacterium tuberculosis
AAAGIAVANA

SEQ ID NO: 173077 - protein, 10 aa, Mycobacterium tuberculosis
AAGIAVANAR

SEQ ID NO: 173078 - protein, 10 aa, Mycobacterium tuberculosis
GIAVANARLY

SEQ ID NO: 173079 - protein, 10 aa, Mycobacterium tuberculosis
RLYQQAKARQ

SEQ ID NO: 173080 - protein, 10 aa, Mycobacterium tuberculosis
YQQAKARQSW

SEQ ID NO: 173081 - protein, 10 aa, Mycobacterium tuberculosis
QQAKARQSWI

SEQ ID NO: 173082 - protein, 10 aa, Mycobacterium tuberculosis
ARQSWIEATR

SEQ ID NO: 173083 - protein, 10 aa, Mycobacterium tuberculosis
EATRDIATEL

SEQ ID NO: 173084 - protein, 10 aa, Mycobacterium tuberculosis
ATRDIATELL

SEQ ID NO: 173085 - protein, 10 aa, Mycobacterium tuberculosis
ELLSGTEPAT

SEQ ID NO: 173086 - protein, 10 aa, Mycobacterium tuberculosis
LLSGTEPATV

SEQ ID NO: 173087 - protein, 10 aa, Mycobacterium tuberculosis
LSGTEPATVF

SEQ ID NO: 173088 - protein, 10 aa, Mycobacterium tuberculosis
SGTEPATVFR

SEQ ID NO: 173089 - protein, 10 aa, Mycobacterium tuberculosis
EPATVFRLVA

SEQ ID NO: 173090 - protein, 10 aa, Mycobacterium tuberculosis
TVFRLVAAEA

SEQ ID NO: 173091 - protein, 10 aa, Mycobacterium tuberculosis
FRLVAAEALK

SEQ ID NO: 173092 - protein, 10 aa, Mycobacterium tuberculosis
RLVAAEALKL

SEQ ID NO: 173093 - protein, 10 aa, Mycobacterium tuberculosis
EALKLTAADA

SEQ ID NO: 173094 - protein, 10 aa, Mycobacterium tuberculosis
ALKLTAADAA

SEQ ID NO: 173095 - protein, 10 aa, Mycobacterium tuberculosis
KLTAADAALV

SEQ ID NO: 173096 - protein, 10 aa, Mycobacterium tuberculosis
TAADAALVAV

SEQ ID NO: 173097 - protein, 10 aa, Mycobacterium tuberculosis
VPVDEDMPAA

SEQ ID NO: 173098 - protein, 10 aa, Mycobacterium tuberculosis
DMPAADVGEL

SEQ ID NO: 173099 - protein, 10 aa, Mycobacterium tuberculosis
MPAADVGELL

SEQ ID NO: 173100 - protein, 10 aa, Mycobacterium tuberculosis
PAADVGELLV

SEQ ID NO: 173101 - protein, 10 aa, Mycobacterium tuberculosis
LLVIETVGSA

SEQ ID NO: 173102 - protein, 10 aa, Mycobacterium tuberculosis
LVIETVGSAV

SEQ ID NO: 173103 - protein, 10 aa, Mycobacterium tuberculosis
ETVGSAVASI

SEQ ID NO: 173104 - protein, 10 aa, Mycobacterium tuberculosis
TVGSAVASIV

SEQ ID NO: 173105 - protein, 10 aa, Mycobacterium tuberculosis
GSAVASIVGR

SEQ ID NO: 173106 - protein, 10 aa, Mycobacterium tuberculosis
AVASIVGRTI

SEQ ID NO: 173107 - protein, 10 aa, Mycobacterium tuberculosis
ASIVGRTIPV

SEQ ID NO: 173108 - protein, 10 aa, Mycobacterium tuberculosis
SIVGRTIPVA

SEQ ID NO: 173109 - protein, 10 aa, Mycobacterium tuberculosis
RTIPVAGAVL

SEQ ID NO: 173110 - protein, 10 aa, Mycobacterium tuberculosis
TIPVAGAVLR

SEQ ID NO: 173111 - protein, 10 aa, Mycobacterium tuberculosis
PVAGAVLREV

SEQ ID NO: 173112 - protein, 10 aa, Mycobacterium tuberculosis
VAGAVLREVF

SEQ ID NO: 173113 - protein, 10 aa, Mycobacterium tuberculosis
VLREVFVNGI

SEQ ID NO: 173114 - protein, 10 aa, Mycobacterium tuberculosis
REVFVNGIPR

SEQ ID NO: 173115 - protein, 10 aa, Mycobacterium tuberculosis
EVFVNGIPRR

SEQ ID NO: 173116 - protein, 10 aa, Mycobacterium tuberculosis
VNGIPRRVDR

SEQ ID NO: 173117 - protein, 10 aa, Mycobacterium tuberculosis
NGIPRRVDRV

SEQ ID NO: 173118 - protein, 10 aa, Mycobacterium tuberculosis
IPRRVDRVDL

SEQ ID NO: 173119 - protein, 10 aa, Mycobacterium tuberculosis
RVDRVDLEGL

SEQ ID NO: 173120 - protein, 10 aa, Mycobacterium tuberculosis
RVDLEGLDEL

SEQ ID NO: 173121 - protein, 10 aa, Mycobacterium tuberculosis
DELADAGPAL

SEQ ID NO: 173122 - protein, 10 aa, Mycobacterium tuberculosis
ELADAGPALL

SEQ ID NO: 173123 - protein, 10 aa, Mycobacterium tuberculosis
LADAGPALLL

SEQ ID NO: 173124 - protein, 10 aa, Mycobacterium tuberculosis
DAGPALLLPL

SEQ ID NO: 173125 - protein, 10 aa, Mycobacterium tuberculosis
GPALLLPLRA

SEQ ID NO: 173126 - protein, 10 aa, Mycobacterium tuberculosis
LLLPLRARGT

SEQ ID NO: 173127 - protein, 10 aa, Mycobacterium tuberculosis
LLPLRARGTV

SEQ ID NO: 173128 - protein, 10 aa, Mycobacterium tuberculosis
LPLRARGTVA

SEQ ID NO: 173129 - protein, 10 aa, Mycobacterium tuberculosis
LRARGTVAGV

SEQ ID NO: 173130 - protein, 10 aa, Mycobacterium tuberculosis
RARGTVAGVV

SEQ ID NO: 173131 - protein, 10 aa, Mycobacterium tuberculosis
TVAGVVVVLS

SEQ ID NO: 173132 - protein, 10 aa, Mycobacterium tuberculosis
VLSQGGPGAF

SEQ ID NO: 173133 - protein, 10 aa, Mycobacterium tuberculosis
FTDEQLEMMA

SEQ ID NO: 173134 - protein, 10 aa, Mycobacterium tuberculosis
DEQLEMMAAF

SEQ ID NO: 173135 - protein, 10 aa, Mycobacterium tuberculosis
EQLEMMAAFA

SEQ ID NO: 173136 - protein, 10 aa, Mycobacterium tuberculosis
EMMAAFADQA

SEQ ID NO: 173137 - protein, 10 aa, Mycobacterium tuberculosis
MMAAFADQAA

SEQ ID NO: 173138 - protein, 10 aa, Mycobacterium tuberculosis
MAAFADQAAL

SEQ ID NO: 173139 - protein, 10 aa, Mycobacterium tuberculosis
AFADQAALAW

SEQ ID NO: 173140 - protein, 10 aa, Mycobacterium tuberculosis
ALAWQLATSQ

SEQ ID NO: 173141 - protein, 10 aa, Mycobacterium tuberculosis
LAWQLATSQR

SEQ ID NO: 173142 - protein, 10 aa, Mycobacterium tuberculosis
AWQLATSQRR

SEQ ID NO: 173143 - protein, 10 aa, Mycobacterium tuberculosis
WQLATSQRRM

SEQ ID NO: 173144 - protein, 10 aa, Mycobacterium tuberculosis
QLATSQRRMR

SEQ ID NO: 173145 - protein, 10 aa, Mycobacterium tuberculosis
VLTDRDRIAR

SEQ ID NO: 173146 - protein, 10 aa, Mycobacterium tuberculosis
RIARDLHDHV

SEQ ID NO: 173147 - protein, 10 aa, Mycobacterium tuberculosis
DLHDHVIQRL

SEQ ID NO: 173148 - protein, 10 aa, Mycobacterium tuberculosis
VIQRLFAIGL

SEQ ID NO: 173149 - protein, 10 aa, Mycobacterium tuberculosis
QRLFAIGLAL

SEQ ID NO: 173150 - protein, 10 aa, Mycobacterium tuberculosis
RLFAIGLALQ

SEQ ID NO: 173151 - protein, 10 aa, Mycobacterium tuberculosis
FAIGLALQGA

SEQ ID NO: 173152 - protein, 10 aa, Mycobacterium tuberculosis
AIGLALQGAV

SEQ ID NO: 173153 - protein, 10 aa, Mycobacterium tuberculosis
ALQGAVPHER

SEQ ID NO: 173154 - protein, 10 aa, Mycobacterium tuberculosis
AVPHERNPEV

SEQ ID NO: 173155 - protein, 10 aa, Mycobacterium tuberculosis
EVQQRLSDVV

SEQ ID NO: 173156 - protein, 10 aa, Mycobacterium tuberculosis
RLSDVVDDLQ

SEQ ID NO: 173157 - protein, 10 aa, Mycobacterium tuberculosis
DVVDDLQDVI

SEQ ID NO: 173158 - protein, 10 aa, Mycobacterium tuberculosis
DLQDVIQEIR

SEQ ID NO: 173159 - protein, 10 aa, Mycobacterium tuberculosis
DVIQEIRTTI

SEQ ID NO: 173160 - protein, 10 aa, Mycobacterium tuberculosis
VIQEIRTTIY

SEQ ID NO: 173161 - protein, 10 aa, Mycobacterium tuberculosis
QEIRTTIYDL

SEQ ID NO: 173162 - protein, 10 aa, Mycobacterium tuberculosis
TTIYDLHGAS

SEQ ID NO: 173163 - protein, 10 aa, Mycobacterium tuberculosis
TIYDLHGASQ

SEQ ID NO: 173164 - protein, 10 aa, Mycobacterium tuberculosis
GASQGITRLR

SEQ ID NO: 173165 - protein, 10 aa, Mycobacterium tuberculosis
SQGITRLRQR

SEQ ID NO: 173166 - protein, 10 aa, Mycobacterium tuberculosis
RLRQRIDAAV

SEQ ID NO: 173167 - protein, 10 aa, Mycobacterium tuberculosis
QRIDAAVAQF

SEQ ID NO: 173168 - protein, 10 aa, Mycobacterium tuberculosis
RIDAAVAQFA

SEQ ID NO: 173169 - protein, 10 aa, Mycobacterium tuberculosis
AVAQFADSGL

SEQ ID NO: 173170 - protein, 10 aa, Mycobacterium tuberculosis
VAQFADSGLR

SEQ ID NO: 173171 - protein, 10 aa, Mycobacterium tuberculosis
AQFADSGLRT

SEQ ID NO: 173172 - protein, 10 aa, Mycobacterium tuberculosis
FADSGLRTSV

SEQ ID NO: 173173 - protein, 10 aa, Mycobacterium tuberculosis
SGLRTSVQFV

SEQ ID NO: 173174 - protein, 10 aa, Mycobacterium tuberculosis
RTSVQFVGPL

SEQ ID NO: 173175 - protein, 10 aa, Mycobacterium tuberculosis
SVQFVGPLSV

SEQ ID NO: 173176 - protein, 10 aa, Mycobacterium tuberculosis
VQFVGPLSVV

SEQ ID NO: 173177 - protein, 10 aa, Mycobacterium tuberculosis
GPLSVVDSAL

SEQ ID NO: 173178 - protein, 10 aa, Mycobacterium tuberculosis
PLSVVDSALA

SEQ ID NO: 173179 - protein, 10 aa, Mycobacterium tuberculosis
DSALADQAEA

SEQ ID NO: 173180 - protein, 10 aa, Mycobacterium tuberculosis
SALADQAEAV

SEQ ID NO: 173181 - protein, 10 aa, Mycobacterium tuberculosis
ALADQAEAVV

SEQ ID NO: 173182 - protein, 10 aa, Mycobacterium tuberculosis
QAEAVVREAV

SEQ ID NO: 173183 - protein, 10 aa, Mycobacterium tuberculosis
AEAVVREAVS

SEQ ID NO: 173184 - protein, 10 aa, Mycobacterium tuberculosis
VVREAVSNAV

SEQ ID NO: 173185 - protein, 10 aa, Mycobacterium tuberculosis
AVSNAVRHAK

SEQ ID NO: 173186 - protein, 10 aa, Mycobacterium tuberculosis
AVRHAKASTL

SEQ ID NO: 173187 - protein, 10 aa, Mycobacterium tuberculosis
HAKASTLTVR

SEQ ID NO: 173188 - protein, 10 aa, Mycobacterium tuberculosis
KASTLTVRVK

SEQ ID NO: 173189 - protein, 10 aa, Mycobacterium tuberculosis
KVDDDLCIEV

SEQ ID NO: 173190 - protein, 10 aa, Mycobacterium tuberculosis
IEVTDNGRGL

SEQ ID NO: 173191 - protein, 10 aa, Mycobacterium tuberculosis
LPDEFTGSGL

SEQ ID NO: 173192 - protein, 10 aa, Mycobacterium tuberculosis
FTGSGLTNLR

SEQ ID NO: 173193 - protein, 10 aa, Mycobacterium tuberculosis
AEQAGGEFTL

SEQ ID NO: 173194 - protein, 10 aa, Mycobacterium tuberculosis
EQAGGEFTLA

SEQ ID NO: 173195 - protein, 10 aa, Mycobacterium tuberculosis
AGGEFTLASV

SEQ ID NO: 173196 - protein, 10 aa, Mycobacterium tuberculosis
ASVPGASGTV

SEQ ID NO: 173197 - protein, 10 aa, Mycobacterium tuberculosis
SVPGASGTVL

SEQ ID NO: 173198 - protein, 10 aa, Mycobacterium tuberculosis
GTVLRWSAPL

SEQ ID NO: 173199 - protein, 11 aa, Mycobacterium tuberculosis
GLVDENDGAAM

SEQ ID NO: 173200 - protein, 11 aa, Mycobacterium tuberculosis
LVDENDGAAMR

SEQ ID NO: 173201 - protein, 11 aa, Mycobacterium tuberculosis
DENDGAAMRPL

SEQ ID NO: 173202 - protein, 11 aa, Mycobacterium tuberculosis
ENDGAAMRPLR

SEQ ID NO: 173203 - protein, 11 aa, Mycobacterium tuberculosis
GAAMRPLRHTL

SEQ ID NO: 173204 - protein, 11 aa, Mycobacterium tuberculosis
AMRPLRHTLSQ

SEQ ID NO: 173205 - protein, 11 aa, Mycobacterium tuberculosis
RPLRHTLSQLR

SEQ ID NO: 173206 - protein, 11 aa, Mycobacterium tuberculosis
PLRHTLSQLRL

SEQ ID NO: 173207 - protein, 11 aa, Mycobacterium tuberculosis
HTLSQLRLHEL

SEQ ID NO: 173208 - protein, 11 aa, Mycobacterium tuberculosis
TLSQLRLHELL

SEQ ID NO: 173209 - protein, 11 aa, Mycobacterium tuberculosis
QLRLHELLVEV

SEQ ID NO: 173210 - protein, 11 aa, Mycobacterium tuberculosis
LLVEVQDRVEQ

SEQ ID NO: 173211 - protein, 11 aa, Mycobacterium tuberculosis
VEVQDRVEQIV

SEQ ID NO: 173212 - protein, 11 aa, Mycobacterium tuberculosis
RLDGLVEAMLV

SEQ ID NO: 173213 - protein, 11 aa, Mycobacterium tuberculosis
GLVEAMLVVTA

SEQ ID NO: 173214 - protein, 11 aa, Mycobacterium tuberculosis
VEAMLVVTAGL

SEQ ID NO: 173215 - protein, 11 aa, Mycobacterium tuberculosis
AMLVVTAGLDL

SEQ ID NO: 173216 - protein, 11 aa, Mycobacterium tuberculosis
VTAGLDLEATL

SEQ ID NO: 173217 - protein, 11 aa, Mycobacterium tuberculosis
TAGLDLEATLR

SEQ ID NO: 173218 - protein, 11 aa, Mycobacterium tuberculosis
GLDLEATLRAI

SEQ ID NO: 173219 - protein, 11 aa, Mycobacterium tuberculosis
EATLRAIVHSA

SEQ ID NO: 173220 - protein, 11 aa, Mycobacterium tuberculosis
TLRAIVHSATS

SEQ ID NO: 173221 - protein, 11 aa, Mycobacterium tuberculosis
LRAIVHSATSL

SEQ ID NO: 173222 - protein, 11 aa, Mycobacterium tuberculosis
RAIVHSATSLV

SEQ ID NO: 173223 - protein, 11 aa, Mycobacterium tuberculosis
HSATSLVDARY

SEQ ID NO: 173224 - protein, 11 aa, Mycobacterium tuberculosis
ATSLVDARYGA

SEQ ID NO: 173225 - protein, 11 aa, Mycobacterium tuberculosis
SLVDARYGAME

SEQ ID NO: 173226 - protein, 11 aa, Mycobacterium tuberculosis
LVDARYGAMEV

SEQ ID NO: 173227 - protein, 11 aa, Mycobacterium tuberculosis
GAMEVHDRQHR

SEQ ID NO: 173228 - protein, 11 aa, Mycobacterium tuberculosis
AMEVHDRQHRV

SEQ ID NO: 173229 - protein, 11 aa, Mycobacterium tuberculosis
MEVHDRQHRVL

SEQ ID NO: 173230 - protein, 11 aa, Mycobacterium tuberculosis
RQHRVLHFVYE

SEQ ID NO: 173231 - protein, 11 aa, Mycobacterium tuberculosis
HRVLHFVYEGI

SEQ ID NO: 173232 - protein, 11 aa, Mycobacterium tuberculosis
FVYEGIDEETV

SEQ ID NO: 173233 - protein, 11 aa, Mycobacterium tuberculosis
ETVRRIGHLPK

SEQ ID NO: 173234 - protein, 11 aa, Mycobacterium tuberculosis
RIGHLPKGLGV

SEQ ID NO: 173235 - protein, 11 aa, Mycobacterium tuberculosis
HLPKGLGVIGL

SEQ ID NO: 173236 - protein, 11 aa, Mycobacterium tuberculosis
LPKGLGVIGLL

SEQ ID NO: 173237 - protein, 11 aa, Mycobacterium tuberculosis
GVIGLLIEDPK

SEQ ID NO: 173238 - protein, 11 aa, Mycobacterium tuberculosis
LLIEDPKPLRL

SEQ ID NO: 173239 - protein, 11 aa, Mycobacterium tuberculosis
KPLRLDDVSAH

SEQ ID NO: 173240 - protein, 11 aa, Mycobacterium tuberculosis
RLDDVSAHPAS

SEQ ID NO: 173241 - protein, 11 aa, Mycobacterium tuberculosis
DVSAHPASIGF

SEQ ID NO: 173242 - protein, 11 aa, Mycobacterium tuberculosis
HPASIGFPPYH

SEQ ID NO: 173243 - protein, 11 aa, Mycobacterium tuberculosis
IGFPPYHPPMR

SEQ ID NO: 173244 - protein, 11 aa, Mycobacterium tuberculosis
FPPYHPPMRTF

SEQ ID NO: 173245 - protein, 11 aa, Mycobacterium tuberculosis
PPYHPPMRTFL

SEQ ID NO: 173246 - protein, 11 aa, Mycobacterium tuberculosis
YHPPMRTFLGV

SEQ ID NO: 173247 - protein, 11 aa, Mycobacterium tuberculosis
PPMRTFLGVPV

SEQ ID NO: 173248 - protein, 11 aa, Mycobacterium tuberculosis
PMRTFLGVPVR

SEQ ID NO: 173249 - protein, 11 aa, Mycobacterium tuberculosis
MRTFLGVPVRV

SEQ ID NO: 173250 - protein, 11 aa, Mycobacterium tuberculosis
RTFLGVPVRVR

SEQ ID NO: 173251 - protein, 11 aa, Mycobacterium tuberculosis
RVRDESFGTLY

SEQ ID NO: 173252 - protein, 11 aa, Mycobacterium tuberculosis
VRDESFGTLYL

SEQ ID NO: 173253 - protein, 11 aa, Mycobacterium tuberculosis
ESFGTLYLTDK

SEQ ID NO: 173254 - protein, 11 aa, Mycobacterium tuberculosis
YLTDKTNGQPF

SEQ ID NO: 173255 - protein, 11 aa, Mycobacterium tuberculosis
FSDDDEVLVQA

SEQ ID NO: 173256 - protein, 11 aa, Mycobacterium tuberculosis
EVLVQALAAAA

SEQ ID NO: 173257 - protein, 11 aa, Mycobacterium tuberculosis
LVQALAAAAGI

SEQ ID NO: 173258 - protein, 11 aa, Mycobacterium tuberculosis
VQALAAAAGIA

SEQ ID NO: 173259 - protein, 11 aa, Mycobacterium tuberculosis
QALAAAAGIAV

SEQ ID NO: 173260 - protein, 11 aa, Mycobacterium tuberculosis
ALAAAAGIAVA

SEQ ID NO: 173261 - protein, 11 aa, Mycobacterium tuberculosis
AAAAGIAVANA

SEQ ID NO: 173262 - protein, 11 aa, Mycobacterium tuberculosis
AAAGIAVANAR

SEQ ID NO: 173263 - protein, 11 aa, Mycobacterium tuberculosis
AVANARLYQQA

SEQ ID NO: 173264 - protein, 11 aa, Mycobacterium tuberculosis
VANARLYQQAK

SEQ ID NO: 173265 - protein, 11 aa, Mycobacterium tuberculosis
NARLYQQAKAR

SEQ ID NO: 173266 - protein, 11 aa, Mycobacterium tuberculosis
LYQQAKARQSW

SEQ ID NO: 173267 - protein, 11 aa, Mycobacterium tuberculosis
YQQAKARQSWI

SEQ ID NO: 173268 - protein, 11 aa, Mycobacterium tuberculosis
KARQSWIEATR

SEQ ID NO: 173269 - protein, 11 aa, Mycobacterium tuberculosis
RQSWIEATRDI

SEQ ID NO: 173270 - protein, 11 aa, Mycobacterium tuberculosis
IEATRDIATEL

SEQ ID NO: 173271 - protein, 11 aa, Mycobacterium tuberculosis
EATRDIATELL

SEQ ID NO: 173272 - protein, 11 aa, Mycobacterium tuberculosis
ELLSGTEPATV

SEQ ID NO: 173273 - protein, 11 aa, Mycobacterium tuberculosis
LLSGTEPATVF

SEQ ID NO: 173274 - protein, 11 aa, Mycobacterium tuberculosis
LSGTEPATVFR

SEQ ID NO: 173275 - protein, 11 aa, Mycobacterium tuberculosis
GTEPATVFRLV

SEQ ID NO: 173276 - protein, 11 aa, Mycobacterium tuberculosis
EPATVFRLVAA

SEQ ID NO: 173277 - protein, 11 aa, Mycobacterium tuberculosis
ATVFRLVAAEA

SEQ ID NO: 173278 - protein, 11 aa, Mycobacterium tuberculosis
TVFRLVAAEAL

SEQ ID NO: 173279 - protein, 11 aa, Mycobacterium tuberculosis
VFRLVAAEALK

SEQ ID NO: 173280 - protein, 11 aa, Mycobacterium tuberculosis
FRLVAAEALKL

SEQ ID NO: 173281 - protein, 11 aa, Mycobacterium tuberculosis
RLVAAEALKLT

SEQ ID NO: 173282 - protein, 11 aa, Mycobacterium tuberculosis
VAAEALKLTAA

SEQ ID NO: 173283 - protein, 11 aa, Mycobacterium tuberculosis
AEALKLTAADA

SEQ ID NO: 173284 - protein, 11 aa, Mycobacterium tuberculosis
EALKLTAADAA

SEQ ID NO: 173285 - protein, 11 aa, Mycobacterium tuberculosis
ALKLTAADAAL

SEQ ID NO: 173286 - protein, 11 aa, Mycobacterium tuberculosis
KLTAADAALVA

SEQ ID NO: 173287 - protein, 11 aa, Mycobacterium tuberculosis
LTAADAALVAV

SEQ ID NO: 173288 - protein, 11 aa, Mycobacterium tuberculosis
AADAALVAVPV

SEQ ID NO: 173289 - protein, 11 aa, Mycobacterium tuberculosis
VPVDEDMPAAD

SEQ ID NO: 173290 - protein, 11 aa, Mycobacterium tuberculosis
PVDEDMPAADV

SEQ ID NO: 173291 - protein, 11 aa, Mycobacterium tuberculosis
DMPAADVGELL

SEQ ID NO: 173292 - protein, 11 aa, Mycobacterium tuberculosis
MPAADVGELLV

SEQ ID NO: 173293 - protein, 11 aa, Mycobacterium tuberculosis
DVGELLVIETV

SEQ ID NO: 173294 - protein, 11 aa, Mycobacterium tuberculosis
ELLVIETVGSA

SEQ ID NO: 173295 - protein, 11 aa, Mycobacterium tuberculosis
LLVIETVGSAV

SEQ ID NO: 173296 - protein, 11 aa, Mycobacterium tuberculosis
LVIETVGSAVA

SEQ ID NO: 173297 - protein, 11 aa, Mycobacterium tuberculosis
IETVGSAVASI

SEQ ID NO: 173298 - protein, 11 aa, Mycobacterium tuberculosis
ETVGSAVASIV

SEQ ID NO: 173299 - protein, 11 aa, Mycobacterium tuberculosis
RTIPVAGAVLR

SEQ ID NO: 173300 - protein, 11 aa, Mycobacterium tuberculosis
IPVAGAVLREV

SEQ ID NO: 173301 - protein, 11 aa, Mycobacterium tuberculosis
VAGAVLREVFV

SEQ ID NO: 173302 - protein, 11 aa, Mycobacterium tuberculosis
AVLREVFVNGI

SEQ ID NO: 173303 - protein, 11 aa, Mycobacterium tuberculosis
EVFVNGIPRRV

SEQ ID NO: 173304 - protein, 11 aa, Mycobacterium tuberculosis
FVNGIPRRVDR

SEQ ID NO: 173305 - protein, 11 aa, Mycobacterium tuberculosis
RRVDRVDLEGL

SEQ ID NO: 173306 - protein, 11 aa, Mycobacterium tuberculosis
GLDELADAGPA

SEQ ID NO: 173307 - protein, 11 aa, Mycobacterium tuberculosis
DELADAGPALL

SEQ ID NO: 173308 - protein, 11 aa, Mycobacterium tuberculosis
ELADAGPALLL

SEQ ID NO: 173309 - protein, 11 aa, Mycobacterium tuberculosis
DAGPALLLPLR

SEQ ID NO: 173310 - protein, 11 aa, Mycobacterium tuberculosis
LLLPLRARGTV

SEQ ID NO: 173311 - protein, 11 aa, Mycobacterium tuberculosis
LLPLRARGTVA

SEQ ID NO: 173312 - protein, 11 aa, Mycobacterium tuberculosis
LPLRARGTVAG

SEQ ID NO: 173313 - protein, 11 aa, Mycobacterium tuberculosis
PLRARGTVAGV

SEQ ID NO: 173314 - protein, 11 aa, Mycobacterium tuberculosis
RARGTVAGVVV

SEQ ID NO: 173315 - protein, 11 aa, Mycobacterium tuberculosis
TVAGVVVVLSQ

SEQ ID NO: 173316 - protein, 11 aa, Mycobacterium tuberculosis
VVLSQGGPGAF

SEQ ID NO: 173317 - protein, 11 aa, Mycobacterium tuberculosis
VLSQGGPGAFT

SEQ ID NO: 173318 - protein, 11 aa, Mycobacterium tuberculosis
FTDEQLEMMAA

SEQ ID NO: 173319 - protein, 11 aa, Mycobacterium tuberculosis
EMMAAFADQAA

SEQ ID NO: 173320 - protein, 11 aa, Mycobacterium tuberculosis
MMAAFADQAAL

SEQ ID NO: 173321 - protein, 11 aa, Mycobacterium tuberculosis
MAAFADQAALA

SEQ ID NO: 173322 - protein, 11 aa, Mycobacterium tuberculosis
AAFADQAALAW

SEQ ID NO: 173323 - protein, 11 aa, Mycobacterium tuberculosis
FADQAALAWQL

SEQ ID NO: 173324 - protein, 11 aa, Mycobacterium tuberculosis
ALAWQLATSQR

SEQ ID NO: 173325 - protein, 11 aa, Mycobacterium tuberculosis
LAWQLATSQRR

SEQ ID NO: 173326 - protein, 11 aa, Mycobacterium tuberculosis
WQLATSQRRMR

SEQ ID NO: 173327 - protein, 11 aa, Mycobacterium tuberculosis
RMRELDVLTDR

SEQ ID NO: 173328 - protein, 11 aa, Mycobacterium tuberculosis
ELDVLTDRDRI

SEQ ID NO: 173329 - protein, 11 aa, Mycobacterium tuberculosis
DVLTDRDRIAR

SEQ ID NO: 173330 - protein, 11 aa, Mycobacterium tuberculosis
RIARDLHDHVI

SEQ ID NO: 173331 - protein, 11 aa, Mycobacterium tuberculosis
DLHDHVIQRLF

SEQ ID NO: 173332 - protein, 11 aa, Mycobacterium tuberculosis
HVIQRLFAIGL

SEQ ID NO: 173333 - protein, 11 aa, Mycobacterium tuberculosis
VIQRLFAIGLA

SEQ ID NO: 173334 - protein, 11 aa, Mycobacterium tuberculosis
IQRLFAIGLAL

SEQ ID NO: 173335 - protein, 11 aa, Mycobacterium tuberculosis
RLFAIGLALQG

SEQ ID NO: 173336 - protein, 11 aa, Mycobacterium tuberculosis
FAIGLALQGAV

SEQ ID NO: 173337 - protein, 11 aa, Mycobacterium tuberculosis
LALQGAVPHER

SEQ ID NO: 173338 - protein, 11 aa, Mycobacterium tuberculosis
GAVPHERNPEV

SEQ ID NO: 173339 - protein, 11 aa, Mycobacterium tuberculosis
HERNPEVQQRL

SEQ ID NO: 173340 - protein, 11 aa, Mycobacterium tuberculosis
DLQDVIQEIRT

SEQ ID NO: 173341 - protein, 11 aa, Mycobacterium tuberculosis
DVIQEIRTTIY

SEQ ID NO: 173342 - protein, 11 aa, Mycobacterium tuberculosis
IYDLHGASQGI

SEQ ID NO: 173343 - protein, 11 aa, Mycobacterium tuberculosis
DLHGASQGITR

SEQ ID NO: 173344 - protein, 11 aa, Mycobacterium tuberculosis
HGASQGITRLR

SEQ ID NO: 173345 - protein, 11 aa, Mycobacterium tuberculosis
ASQGITRLRQR

SEQ ID NO: 173346 - protein, 11 aa, Mycobacterium tuberculosis
RLRQRIDAAVA

SEQ ID NO: 173347 - protein, 11 aa, Mycobacterium tuberculosis
RQRIDAAVAQF

SEQ ID NO: 173348 - protein, 11 aa, Mycobacterium tuberculosis
AAVAQFADSGL

SEQ ID NO: 173349 - protein, 11 aa, Mycobacterium tuberculosis
AVAQFADSGLR

SEQ ID NO: 173350 - protein, 11 aa, Mycobacterium tuberculosis
AQFADSGLRTS

SEQ ID NO: 173351 - protein, 11 aa, Mycobacterium tuberculosis
QFADSGLRTSV

SEQ ID NO: 173352 - protein, 11 aa, Mycobacterium tuberculosis
TSVQFVGPLSV

SEQ ID NO: 173353 - protein, 11 aa, Mycobacterium tuberculosis
SVQFVGPLSVV

SEQ ID NO: 173354 - protein, 11 aa, Mycobacterium tuberculosis
FVGPLSVVDSA

SEQ ID NO: 173355 - protein, 11 aa, Mycobacterium tuberculosis
GPLSVVDSALA

SEQ ID NO: 173356 - protein, 11 aa, Mycobacterium tuberculosis
SVVDSALADQA

SEQ ID NO: 173357 - protein, 11 aa, Mycobacterium tuberculosis
DSALADQAEAV

SEQ ID NO: 173358 - protein, 11 aa, Mycobacterium tuberculosis
SALADQAEAVV

SEQ ID NO: 173359 - protein, 11 aa, Mycobacterium tuberculosis
DQAEAVVREAV

SEQ ID NO: 173360 - protein, 11 aa, Mycobacterium tuberculosis
AVVREAVSNAV

SEQ ID NO: 173361 - protein, 11 aa, Mycobacterium tuberculosis
VVREAVSNAVR

SEQ ID NO: 173362 - protein, 11 aa, Mycobacterium tuberculosis
EAVSNAVRHAK

SEQ ID NO: 173363 - protein, 11 aa, Mycobacterium tuberculosis
AVRHAKASTLT

SEQ ID NO: 173364 - protein, 11 aa, Mycobacterium tuberculosis
HAKASTLTVRV

SEQ ID NO: 173365 - protein, 11 aa, Mycobacterium tuberculosis
KASTLTVRVKV

SEQ ID NO: 173366 - protein, 11 aa, Mycobacterium tuberculosis
VKVDDDLCIEV

SEQ ID NO: 173367 - protein, 11 aa, Mycobacterium tuberculosis
KVDDDLCIEVT

SEQ ID NO: 173368 - protein, 11 aa, Mycobacterium tuberculosis
DLCIEVTDNGR

SEQ ID NO: 173369 - protein, 11 aa, Mycobacterium tuberculosis
GLPDEFTGSGL

SEQ ID NO: 173370 - protein, 11 aa, Mycobacterium tuberculosis
LPDEFTGSGLT

SEQ ID NO: 173371 - protein, 11 aa, Mycobacterium tuberculosis
DEFTGSGLTNL

SEQ ID NO: 173372 - protein, 11 aa, Mycobacterium tuberculosis
EFTGSGLTNLR

SEQ ID NO: 173373 - protein, 11 aa, Mycobacterium tuberculosis
TGSGLTNLRQR

SEQ ID NO: 173374 - protein, 11 aa, Mycobacterium tuberculosis
GLTNLRQRAEQ

SEQ ID NO: 173375 - protein, 11 aa, Mycobacterium tuberculosis
RQRAEQAGGEF

SEQ ID NO: 173376 - protein, 11 aa, Mycobacterium tuberculosis
AEQAGGEFTLA

SEQ ID NO: 173377 - protein, 11 aa, Mycobacterium tuberculosis
QAGGEFTLASV

SEQ ID NO: 173378 - protein, 11 aa, Mycobacterium tuberculosis
GEFTLASVPGA

SEQ ID NO: 173379 - protein, 11 aa, Mycobacterium tuberculosis
TLASVPGASGT

SEQ ID NO: 173380 - protein, 11 aa, Mycobacterium tuberculosis
LASVPGASGTV

SEQ ID NO: 173381 - protein, 11 aa, Mycobacterium tuberculosis
SVPGASGTVLR

SEQ ID NO: 173382 - protein, 11 aa, Mycobacterium tuberculosis
VPGASGTVLRW

SEQ ID NO: 173383 - protein, 13 aa, Mycobacterium tuberculosis
MTTGGLVDENDGA

SEQ ID NO: 173384 - protein, 13 aa, Mycobacterium tuberculosis
TTGGLVDENDGAA

SEQ ID NO: 173385 - protein, 13 aa, Mycobacterium tuberculosis
TGGLVDENDGAAM

SEQ ID NO: 173386 - protein, 13 aa, Mycobacterium tuberculosis
GGLVDENDGAAMR

SEQ ID NO: 173387 - protein, 13 aa, Mycobacterium tuberculosis
GLVDENDGAAMRP

SEQ ID NO: 173388 - protein, 13 aa, Mycobacterium tuberculosis
LVDENDGAAMRPL

SEQ ID NO: 173389 - protein, 13 aa, Mycobacterium tuberculosis
VDENDGAAMRPLR

SEQ ID NO: 173390 - protein, 13 aa, Mycobacterium tuberculosis
DENDGAAMRPLRH

SEQ ID NO: 173391 - protein, 13 aa, Mycobacterium tuberculosis
ENDGAAMRPLRHT

SEQ ID NO: 173392 - protein, 13 aa, Mycobacterium tuberculosis
NDGAAMRPLRHTL

SEQ ID NO: 173393 - protein, 13 aa, Mycobacterium tuberculosis
DGAAMRPLRHTLS

SEQ ID NO: 173394 - protein, 13 aa, Mycobacterium tuberculosis
GAAMRPLRHTLSQ

SEQ ID NO: 173395 - protein, 13 aa, Mycobacterium tuberculosis
AAMRPLRHTLSQL

SEQ ID NO: 173396 - protein, 13 aa, Mycobacterium tuberculosis
AMRPLRHTLSQLR

SEQ ID NO: 173397 - protein, 13 aa, Mycobacterium tuberculosis
MRPLRHTLSQLRL

SEQ ID NO: 173398 - protein, 13 aa, Mycobacterium tuberculosis
RPLRHTLSQLRLH

SEQ ID NO: 173399 - protein, 13 aa, Mycobacterium tuberculosis
PLRHTLSQLRLHE

SEQ ID NO: 173400 - protein, 13 aa, Mycobacterium tuberculosis
LRHTLSQLRLHEL

SEQ ID NO: 173401 - protein, 13 aa, Mycobacterium tuberculosis
RHTLSQLRLHELL

SEQ ID NO: 173402 - protein, 13 aa, Mycobacterium tuberculosis
HTLSQLRLHELLV

SEQ ID NO: 173403 - protein, 13 aa, Mycobacterium tuberculosis
TLSQLRLHELLVE

SEQ ID NO: 173404 - protein, 13 aa, Mycobacterium tuberculosis
LSQLRLHELLVEV

SEQ ID NO: 173405 - protein, 13 aa, Mycobacterium tuberculosis
SQLRLHELLVEVQ

SEQ ID NO: 173406 - protein, 13 aa, Mycobacterium tuberculosis
QLRLHELLVEVQD

SEQ ID NO: 173407 - protein, 13 aa, Mycobacterium tuberculosis
LRLHELLVEVQDR

SEQ ID NO: 173408 - protein, 13 aa, Mycobacterium tuberculosis
RLHELLVEVQDRV

SEQ ID NO: 173409 - protein, 13 aa, Mycobacterium tuberculosis
LHELLVEVQDRVE

SEQ ID NO: 173410 - protein, 13 aa, Mycobacterium tuberculosis
HELLVEVQDRVEQ

SEQ ID NO: 173411 - protein, 13 aa, Mycobacterium tuberculosis
ELLVEVQDRVEQI

SEQ ID NO: 173412 - protein, 13 aa, Mycobacterium tuberculosis
LLVEVQDRVEQIV

SEQ ID NO: 173413 - protein, 13 aa, Mycobacterium tuberculosis
LVEVQDRVEQIVE

SEQ ID NO: 173414 - protein, 13 aa, Mycobacterium tuberculosis
VEVQDRVEQIVEG

SEQ ID NO: 173415 - protein, 13 aa, Mycobacterium tuberculosis
EVQDRVEQIVEGR

SEQ ID NO: 173416 - protein, 13 aa, Mycobacterium tuberculosis
VQDRVEQIVEGRD

SEQ ID NO: 173417 - protein, 13 aa, Mycobacterium tuberculosis
QDRVEQIVEGRDR

SEQ ID NO: 173418 - protein, 13 aa, Mycobacterium tuberculosis
DRVEQIVEGRDRL

SEQ ID NO: 173419 - protein, 13 aa, Mycobacterium tuberculosis
RVEQIVEGRDRLD

SEQ ID NO: 173420 - protein, 13 aa, Mycobacterium tuberculosis
VEQIVEGRDRLDG

SEQ ID NO: 173421 - protein, 13 aa, Mycobacterium tuberculosis
EQIVEGRDRLDGL

SEQ ID NO: 173422 - protein, 13 aa, Mycobacterium tuberculosis
QIVEGRDRLDGLV

SEQ ID NO: 173423 - protein, 13 aa, Mycobacterium tuberculosis
IVEGRDRLDGLVE

SEQ ID NO: 173424 - protein, 13 aa, Mycobacterium tuberculosis
VEGRDRLDGLVEA

SEQ ID NO: 173425 - protein, 13 aa, Mycobacterium tuberculosis
EGRDRLDGLVEAM

SEQ ID NO: 173426 - protein, 13 aa, Mycobacterium tuberculosis
GRDRLDGLVEAML

SEQ ID NO: 173427 - protein, 13 aa, Mycobacterium tuberculosis
RDRLDGLVEAMLV

SEQ ID NO: 173428 - protein, 13 aa, Mycobacterium tuberculosis
DRLDGLVEAMLVV

SEQ ID NO: 173429 - protein, 13 aa, Mycobacterium tuberculosis
RLDGLVEAMLVVT

SEQ ID NO: 173430 - protein, 13 aa, Mycobacterium tuberculosis
LDGLVEAMLVVTA

SEQ ID NO: 173431 - protein, 13 aa, Mycobacterium tuberculosis
DGLVEAMLVVTAG

SEQ ID NO: 173432 - protein, 13 aa, Mycobacterium tuberculosis
GLVEAMLVVTAGL

SEQ ID NO: 173433 - protein, 13 aa, Mycobacterium tuberculosis
LVEAMLVVTAGLD

SEQ ID NO: 173434 - protein, 13 aa, Mycobacterium tuberculosis
VEAMLVVTAGLDL

SEQ ID NO: 173435 - protein, 13 aa, Mycobacterium tuberculosis
EAMLVVTAGLDLE

SEQ ID NO: 173436 - protein, 13 aa, Mycobacterium tuberculosis
AMLVVTAGLDLEA

SEQ ID NO: 173437 - protein, 13 aa, Mycobacterium tuberculosis
MLVVTAGLDLEAT

SEQ ID NO: 173438 - protein, 13 aa, Mycobacterium tuberculosis
LVVTAGLDLEATL

SEQ ID NO: 173439 - protein, 13 aa, Mycobacterium tuberculosis
VVTAGLDLEATLR

SEQ ID NO: 173440 - protein, 13 aa, Mycobacterium tuberculosis
VTAGLDLEATLRA

SEQ ID NO: 173441 - protein, 13 aa, Mycobacterium tuberculosis
TAGLDLEATLRAI

SEQ ID NO: 173442 - protein, 13 aa, Mycobacterium tuberculosis
AGLDLEATLRAIV

SEQ ID NO: 173443 - protein, 13 aa, Mycobacterium tuberculosis
GLDLEATLRAIVH

SEQ ID NO: 173444 - protein, 13 aa, Mycobacterium tuberculosis
LDLEATLRAIVHS

SEQ ID NO: 173445 - protein, 13 aa, Mycobacterium tuberculosis
DLEATLRAIVHSA

SEQ ID NO: 173446 - protein, 13 aa, Mycobacterium tuberculosis
LEATLRAIVHSAT

SEQ ID NO: 173447 - protein, 13 aa, Mycobacterium tuberculosis
EATLRAIVHSATS

SEQ ID NO: 173448 - protein, 13 aa, Mycobacterium tuberculosis
ATLRAIVHSATSL

SEQ ID NO: 173449 - protein, 13 aa, Mycobacterium tuberculosis
TLRAIVHSATSLV

SEQ ID NO: 173450 - protein, 13 aa, Mycobacterium tuberculosis
LRAIVHSATSLVD

SEQ ID NO: 173451 - protein, 13 aa, Mycobacterium tuberculosis
RAIVHSATSLVDA

SEQ ID NO: 173452 - protein, 13 aa, Mycobacterium tuberculosis
AIVHSATSLVDAR

SEQ ID NO: 173453 - protein, 13 aa, Mycobacterium tuberculosis
IVHSATSLVDARY

SEQ ID NO: 173454 - protein, 13 aa, Mycobacterium tuberculosis
VHSATSLVDARYG

SEQ ID NO: 173455 - protein, 13 aa, Mycobacterium tuberculosis
HSATSLVDARYGA

SEQ ID NO: 173456 - protein, 13 aa, Mycobacterium tuberculosis
SATSLVDARYGAM

SEQ ID NO: 173457 - protein, 13 aa, Mycobacterium tuberculosis
ATSLVDARYGAME

SEQ ID NO: 173458 - protein, 13 aa, Mycobacterium tuberculosis
TSLVDARYGAMEV

SEQ ID NO: 173459 - protein, 13 aa, Mycobacterium tuberculosis
SLVDARYGAMEVH

SEQ ID NO: 173460 - protein, 13 aa, Mycobacterium tuberculosis
LVDARYGAMEVHD

SEQ ID NO: 173461 - protein, 13 aa, Mycobacterium tuberculosis
VDARYGAMEVHDR

SEQ ID NO: 173462 - protein, 13 aa, Mycobacterium tuberculosis
DARYGAMEVHDRQ

SEQ ID NO: 173463 - protein, 13 aa, Mycobacterium tuberculosis
ARYGAMEVHDRQH

SEQ ID NO: 173464 - protein, 13 aa, Mycobacterium tuberculosis
RYGAMEVHDRQHR

SEQ ID NO: 173465 - protein, 13 aa, Mycobacterium tuberculosis
YGAMEVHDRQHRV

SEQ ID NO: 173466 - protein, 13 aa, Mycobacterium tuberculosis
GAMEVHDRQHRVL

SEQ ID NO: 173467 - protein, 13 aa, Mycobacterium tuberculosis
AMEVHDRQHRVLH

SEQ ID NO: 173468 - protein, 13 aa, Mycobacterium tuberculosis
MEVHDRQHRVLHF

SEQ ID NO: 173469 - protein, 13 aa, Mycobacterium tuberculosis
EVHDRQHRVLHFV

SEQ ID NO: 173470 - protein, 13 aa, Mycobacterium tuberculosis
VHDRQHRVLHFVY

SEQ ID NO: 173471 - protein, 13 aa, Mycobacterium tuberculosis
HDRQHRVLHFVYE

SEQ ID NO: 173472 - protein, 13 aa, Mycobacterium tuberculosis
DRQHRVLHFVYEG

SEQ ID NO: 173473 - protein, 13 aa, Mycobacterium tuberculosis
RQHRVLHFVYEGI

SEQ ID NO: 173474 - protein, 13 aa, Mycobacterium tuberculosis
QHRVLHFVYEGID

SEQ ID NO: 173475 - protein, 13 aa, Mycobacterium tuberculosis
HRVLHFVYEGIDE

SEQ ID NO: 173476 - protein, 13 aa, Mycobacterium tuberculosis
RVLHFVYEGIDEE

SEQ ID NO: 173477 - protein, 13 aa, Mycobacterium tuberculosis
VLHFVYEGIDEET

SEQ ID NO: 173478 - protein, 13 aa, Mycobacterium tuberculosis
LHFVYEGIDEETV

SEQ ID NO: 173479 - protein, 13 aa, Mycobacterium tuberculosis
HFVYEGIDEETVR

SEQ ID NO: 173480 - protein, 13 aa, Mycobacterium tuberculosis
FVYEGIDEETVRR

SEQ ID NO: 173481 - protein, 13 aa, Mycobacterium tuberculosis
VYEGIDEETVRRI

SEQ ID NO: 173482 - protein, 13 aa, Mycobacterium tuberculosis
YEGIDEETVRRIG

SEQ ID NO: 173483 - protein, 13 aa, Mycobacterium tuberculosis
EGIDEETVRRIGH

SEQ ID NO: 173484 - protein, 13 aa, Mycobacterium tuberculosis
GIDEETVRRIGHL

SEQ ID NO: 173485 - protein, 13 aa, Mycobacterium tuberculosis
IDEETVRRIGHLP

SEQ ID NO: 173486 - protein, 13 aa, Mycobacterium tuberculosis
DEETVRRIGHLPK

SEQ ID NO: 173487 - protein, 13 aa, Mycobacterium tuberculosis
EETVRRIGHLPKG

SEQ ID NO: 173488 - protein, 13 aa, Mycobacterium tuberculosis
ETVRRIGHLPKGL

SEQ ID NO: 173489 - protein, 13 aa, Mycobacterium tuberculosis
TVRRIGHLPKGLG

SEQ ID NO: 173490 - protein, 13 aa, Mycobacterium tuberculosis
VRRIGHLPKGLGV

SEQ ID NO: 173491 - protein, 13 aa, Mycobacterium tuberculosis
RRIGHLPKGLGVI

SEQ ID NO: 173492 - protein, 13 aa, Mycobacterium tuberculosis
RIGHLPKGLGVIG

SEQ ID NO: 173493 - protein, 13 aa, Mycobacterium tuberculosis
IGHLPKGLGVIGL

SEQ ID NO: 173494 - protein, 13 aa, Mycobacterium tuberculosis
GHLPKGLGVIGLL

SEQ ID NO: 173495 - protein, 13 aa, Mycobacterium tuberculosis
HLPKGLGVIGLLI

SEQ ID NO: 173496 - protein, 13 aa, Mycobacterium tuberculosis
LPKGLGVIGLLIE

SEQ ID NO: 173497 - protein, 13 aa, Mycobacterium tuberculosis
PKGLGVIGLLIED

SEQ ID NO: 173498 - protein, 13 aa, Mycobacterium tuberculosis
KGLGVIGLLIEDP

SEQ ID NO: 173499 - protein, 13 aa, Mycobacterium tuberculosis
GLGVIGLLIEDPK

SEQ ID NO: 173500 - protein, 13 aa, Mycobacterium tuberculosis
LGVIGLLIEDPKP

SEQ ID NO: 173501 - protein, 13 aa, Mycobacterium tuberculosis
GVIGLLIEDPKPL

SEQ ID NO: 173502 - protein, 13 aa, Mycobacterium tuberculosis
VIGLLIEDPKPLR

SEQ ID NO: 173503 - protein, 13 aa, Mycobacterium tuberculosis
IGLLIEDPKPLRL

SEQ ID NO: 173504 - protein, 13 aa, Mycobacterium tuberculosis
GLLIEDPKPLRLD

SEQ ID NO: 173505 - protein, 13 aa, Mycobacterium tuberculosis
LLIEDPKPLRLDD

SEQ ID NO: 173506 - protein, 13 aa, Mycobacterium tuberculosis
LIEDPKPLRLDDV

SEQ ID NO: 173507 - protein, 13 aa, Mycobacterium tuberculosis
IEDPKPLRLDDVS

SEQ ID NO: 173508 - protein, 13 aa, Mycobacterium tuberculosis
EDPKPLRLDDVSA

SEQ ID NO: 173509 - protein, 13 aa, Mycobacterium tuberculosis
DPKPLRLDDVSAH

SEQ ID NO: 173510 - protein, 13 aa, Mycobacterium tuberculosis
PKPLRLDDVSAHP

SEQ ID NO: 173511 - protein, 13 aa, Mycobacterium tuberculosis
KPLRLDDVSAHPA

SEQ ID NO: 173512 - protein, 13 aa, Mycobacterium tuberculosis
PLRLDDVSAHPAS

SEQ ID NO: 173513 - protein, 13 aa, Mycobacterium tuberculosis
LRLDDVSAHPASI

SEQ ID NO: 173514 - protein, 13 aa, Mycobacterium tuberculosis
RLDDVSAHPASIG

SEQ ID NO: 173515 - protein, 13 aa, Mycobacterium tuberculosis
LDDVSAHPASIGF

SEQ ID NO: 173516 - protein, 13 aa, Mycobacterium tuberculosis
DDVSAHPASIGFP

SEQ ID NO: 173517 - protein, 13 aa, Mycobacterium tuberculosis
DVSAHPASIGFPP

SEQ ID NO: 173518 - protein, 13 aa, Mycobacterium tuberculosis
VSAHPASIGFPPY

SEQ ID NO: 173519 - protein, 13 aa, Mycobacterium tuberculosis
SAHPASIGFPPYH

SEQ ID NO: 173520 - protein, 13 aa, Mycobacterium tuberculosis
AHPASIGFPPYHP

SEQ ID NO: 173521 - protein, 13 aa, Mycobacterium tuberculosis
HPASIGFPPYHPP

SEQ ID NO: 173522 - protein, 13 aa, Mycobacterium tuberculosis
PASIGFPPYHPPM

SEQ ID NO: 173523 - protein, 13 aa, Mycobacterium tuberculosis
ASIGFPPYHPPMR

SEQ ID NO: 173524 - protein, 13 aa, Mycobacterium tuberculosis
SIGFPPYHPPMRT

SEQ ID NO: 173525 - protein, 13 aa, Mycobacterium tuberculosis
IGFPPYHPPMRTF

SEQ ID NO: 173526 - protein, 13 aa, Mycobacterium tuberculosis
GFPPYHPPMRTFL

SEQ ID NO: 173527 - protein, 13 aa, Mycobacterium tuberculosis
FPPYHPPMRTFLG

SEQ ID NO: 173528 - protein, 13 aa, Mycobacterium tuberculosis
PPYHPPMRTFLGV

SEQ ID NO: 173529 - protein, 13 aa, Mycobacterium tuberculosis
PYHPPMRTFLGVP

SEQ ID NO: 173530 - protein, 13 aa, Mycobacterium tuberculosis
YHPPMRTFLGVPV

SEQ ID NO: 173531 - protein, 13 aa, Mycobacterium tuberculosis
HPPMRTFLGVPVR

SEQ ID NO: 173532 - protein, 13 aa, Mycobacterium tuberculosis
PPMRTFLGVPVRV

SEQ ID NO: 173533 - protein, 13 aa, Mycobacterium tuberculosis
PMRTFLGVPVRVR

SEQ ID NO: 173534 - protein, 13 aa, Mycobacterium tuberculosis
MRTFLGVPVRVRD

SEQ ID NO: 173535 - protein, 13 aa, Mycobacterium tuberculosis
RTFLGVPVRVRDE

SEQ ID NO: 173536 - protein, 13 aa, Mycobacterium tuberculosis
TFLGVPVRVRDES

SEQ ID NO: 173537 - protein, 13 aa, Mycobacterium tuberculosis
FLGVPVRVRDESF

SEQ ID NO: 173538 - protein, 13 aa, Mycobacterium tuberculosis
LGVPVRVRDESFG

SEQ ID NO: 173539 - protein, 13 aa, Mycobacterium tuberculosis
GVPVRVRDESFGT

SEQ ID NO: 173540 - protein, 13 aa, Mycobacterium tuberculosis
VPVRVRDESFGTL

SEQ ID NO: 173541 - protein, 13 aa, Mycobacterium tuberculosis
PVRVRDESFGTLY

SEQ ID NO: 173542 - protein, 13 aa, Mycobacterium tuberculosis
VRVRDESFGTLYL

SEQ ID NO: 173543 - protein, 13 aa, Mycobacterium tuberculosis
RVRDESFGTLYLT

SEQ ID NO: 173544 - protein, 13 aa, Mycobacterium tuberculosis
VRDESFGTLYLTD

SEQ ID NO: 173545 - protein, 13 aa, Mycobacterium tuberculosis
RDESFGTLYLTDK

SEQ ID NO: 173546 - protein, 13 aa, Mycobacterium tuberculosis
DESFGTLYLTDKT

SEQ ID NO: 173547 - protein, 13 aa, Mycobacterium tuberculosis
ESFGTLYLTDKTN

SEQ ID NO: 173548 - protein, 13 aa, Mycobacterium tuberculosis
SFGTLYLTDKTNG

SEQ ID NO: 173549 - protein, 13 aa, Mycobacterium tuberculosis
FGTLYLTDKTNGQ

SEQ ID NO: 173550 - protein, 13 aa, Mycobacterium tuberculosis
GTLYLTDKTNGQP

SEQ ID NO: 173551 - protein, 13 aa, Mycobacterium tuberculosis
TLYLTDKTNGQPF

SEQ ID NO: 173552 - protein, 13 aa, Mycobacterium tuberculosis
LYLTDKTNGQPFS

SEQ ID NO: 173553 - protein, 13 aa, Mycobacterium tuberculosis
YLTDKTNGQPFSD

SEQ ID NO: 173554 - protein, 13 aa, Mycobacterium tuberculosis
LTDKTNGQPFSDD

SEQ ID NO: 173555 - protein, 13 aa, Mycobacterium tuberculosis
TDKTNGQPFSDDD

SEQ ID NO: 173556 - protein, 13 aa, Mycobacterium tuberculosis
DKTNGQPFSDDDE

SEQ ID NO: 173557 - protein, 13 aa, Mycobacterium tuberculosis
KTNGQPFSDDDEV

SEQ ID NO: 173558 - protein, 13 aa, Mycobacterium tuberculosis
TNGQPFSDDDEVL

SEQ ID NO: 173559 - protein, 13 aa, Mycobacterium tuberculosis
NGQPFSDDDEVLV

SEQ ID NO: 173560 - protein, 13 aa, Mycobacterium tuberculosis
GQPFSDDDEVLVQ

SEQ ID NO: 173561 - protein, 13 aa, Mycobacterium tuberculosis
QPFSDDDEVLVQA

SEQ ID NO: 173562 - protein, 13 aa, Mycobacterium tuberculosis
PFSDDDEVLVQAL

SEQ ID NO: 173563 - protein, 13 aa, Mycobacterium tuberculosis
FSDDDEVLVQALA

SEQ ID NO: 173564 - protein, 13 aa, Mycobacterium tuberculosis
SDDDEVLVQALAA

SEQ ID NO: 173565 - protein, 13 aa, Mycobacterium tuberculosis
DDDEVLVQALAAA

SEQ ID NO: 173566 - protein, 13 aa, Mycobacterium tuberculosis
DDEVLVQALAAAA

SEQ ID NO: 173567 - protein, 13 aa, Mycobacterium tuberculosis
DEVLVQALAAAAG

SEQ ID NO: 173568 - protein, 13 aa, Mycobacterium tuberculosis
EVLVQALAAAAGI

SEQ ID NO: 173569 - protein, 13 aa, Mycobacterium tuberculosis
VLVQALAAAAGIA

SEQ ID NO: 173570 - protein, 13 aa, Mycobacterium tuberculosis
LVQALAAAAGIAV

SEQ ID NO: 173571 - protein, 13 aa, Mycobacterium tuberculosis
VQALAAAAGIAVA

SEQ ID NO: 173572 - protein, 13 aa, Mycobacterium tuberculosis
QALAAAAGIAVAN

SEQ ID NO: 173573 - protein, 13 aa, Mycobacterium tuberculosis
ALAAAAGIAVANA

SEQ ID NO: 173574 - protein, 13 aa, Mycobacterium tuberculosis
LAAAAGIAVANAR

SEQ ID NO: 173575 - protein, 13 aa, Mycobacterium tuberculosis
AAAAGIAVANARL

SEQ ID NO: 173576 - protein, 13 aa, Mycobacterium tuberculosis
AAAGIAVANARLY

SEQ ID NO: 173577 - protein, 13 aa, Mycobacterium tuberculosis
AAGIAVANARLYQ

SEQ ID NO: 173578 - protein, 13 aa, Mycobacterium tuberculosis
AGIAVANARLYQQ

SEQ ID NO: 173579 - protein, 13 aa, Mycobacterium tuberculosis
GIAVANARLYQQA

SEQ ID NO: 173580 - protein, 13 aa, Mycobacterium tuberculosis
IAVANARLYQQAK

SEQ ID NO: 173581 - protein, 13 aa, Mycobacterium tuberculosis
AVANARLYQQAKA

SEQ ID NO: 173582 - protein, 13 aa, Mycobacterium tuberculosis
VANARLYQQAKAR

SEQ ID NO: 173583 - protein, 13 aa, Mycobacterium tuberculosis
ANARLYQQAKARQ

SEQ ID NO: 173584 - protein, 13 aa, Mycobacterium tuberculosis
NARLYQQAKARQS

SEQ ID NO: 173585 - protein, 13 aa, Mycobacterium tuberculosis
ARLYQQAKARQSW

SEQ ID NO: 173586 - protein, 13 aa, Mycobacterium tuberculosis
RLYQQAKARQSWI

SEQ ID NO: 173587 - protein, 13 aa, Mycobacterium tuberculosis
LYQQAKARQSWIE

SEQ ID NO: 173588 - protein, 13 aa, Mycobacterium tuberculosis
YQQAKARQSWIEA

SEQ ID NO: 173589 - protein, 13 aa, Mycobacterium tuberculosis
QQAKARQSWIEAT

SEQ ID NO: 173590 - protein, 13 aa, Mycobacterium tuberculosis
QAKARQSWIEATR

SEQ ID NO: 173591 - protein, 13 aa, Mycobacterium tuberculosis
AKARQSWIEATRD

SEQ ID NO: 173592 - protein, 13 aa, Mycobacterium tuberculosis
KARQSWIEATRDI

SEQ ID NO: 173593 - protein, 13 aa, Mycobacterium tuberculosis
ARQSWIEATRDIA

SEQ ID NO: 173594 - protein, 13 aa, Mycobacterium tuberculosis
RQSWIEATRDIAT

SEQ ID NO: 173595 - protein, 13 aa, Mycobacterium tuberculosis
QSWIEATRDIATE

SEQ ID NO: 173596 - protein, 13 aa, Mycobacterium tuberculosis
SWIEATRDIATEL

SEQ ID NO: 173597 - protein, 13 aa, Mycobacterium tuberculosis
WIEATRDIATELL

SEQ ID NO: 173598 - protein, 13 aa, Mycobacterium tuberculosis
IEATRDIATELLS

SEQ ID NO: 173599 - protein, 13 aa, Mycobacterium tuberculosis
EATRDIATELLSG

SEQ ID NO: 173600 - protein, 13 aa, Mycobacterium tuberculosis
ATRDIATELLSGT

SEQ ID NO: 173601 - protein, 13 aa, Mycobacterium tuberculosis
TRDIATELLSGTE

SEQ ID NO: 173602 - protein, 13 aa, Mycobacterium tuberculosis
RDIATELLSGTEP

SEQ ID NO: 173603 - protein, 13 aa, Mycobacterium tuberculosis
DIATELLSGTEPA

SEQ ID NO: 173604 - protein, 13 aa, Mycobacterium tuberculosis
IATELLSGTEPAT

SEQ ID NO: 173605 - protein, 13 aa, Mycobacterium tuberculosis
ATELLSGTEPATV

SEQ ID NO: 173606 - protein, 13 aa, Mycobacterium tuberculosis
TELLSGTEPATVF

SEQ ID NO: 173607 - protein, 13 aa, Mycobacterium tuberculosis
ELLSGTEPATVFR

SEQ ID NO: 173608 - protein, 13 aa, Mycobacterium tuberculosis
LLSGTEPATVFRL

SEQ ID NO: 173609 - protein, 13 aa, Mycobacterium tuberculosis
LSGTEPATVFRLV

SEQ ID NO: 173610 - protein, 13 aa, Mycobacterium tuberculosis
SGTEPATVFRLVA

SEQ ID NO: 173611 - protein, 13 aa, Mycobacterium tuberculosis
GTEPATVFRLVAA

SEQ ID NO: 173612 - protein, 13 aa, Mycobacterium tuberculosis
TEPATVFRLVAAE

SEQ ID NO: 173613 - protein, 13 aa, Mycobacterium tuberculosis
EPATVFRLVAAEA

SEQ ID NO: 173614 - protein, 13 aa, Mycobacterium tuberculosis
PATVFRLVAAEAL

SEQ ID NO: 173615 - protein, 13 aa, Mycobacterium tuberculosis
ATVFRLVAAEALK

SEQ ID NO: 173616 - protein, 13 aa, Mycobacterium tuberculosis
TVFRLVAAEALKL

SEQ ID NO: 173617 - protein, 13 aa, Mycobacterium tuberculosis
VFRLVAAEALKLT

SEQ ID NO: 173618 - protein, 13 aa, Mycobacterium tuberculosis
FRLVAAEALKLTA

SEQ ID NO: 173619 - protein, 13 aa, Mycobacterium tuberculosis
RLVAAEALKLTAA

SEQ ID NO: 173620 - protein, 13 aa, Mycobacterium tuberculosis
LVAAEALKLTAAD

SEQ ID NO: 173621 - protein, 13 aa, Mycobacterium tuberculosis
VAAEALKLTAADA

SEQ ID NO: 173622 - protein, 13 aa, Mycobacterium tuberculosis
AAEALKLTAADAA

SEQ ID NO: 173623 - protein, 13 aa, Mycobacterium tuberculosis
AEALKLTAADAAL

SEQ ID NO: 173624 - protein, 13 aa, Mycobacterium tuberculosis
EALKLTAADAALV

SEQ ID NO: 173625 - protein, 13 aa, Mycobacterium tuberculosis
ALKLTAADAALVA

SEQ ID NO: 173626 - protein, 13 aa, Mycobacterium tuberculosis
LKLTAADAALVAV

SEQ ID NO: 173627 - protein, 13 aa, Mycobacterium tuberculosis
KLTAADAALVAVP

SEQ ID NO: 173628 - protein, 13 aa, Mycobacterium tuberculosis
LTAADAALVAVPV

SEQ ID NO: 173629 - protein, 13 aa, Mycobacterium tuberculosis
TAADAALVAVPVD

SEQ ID NO: 173630 - protein, 13 aa, Mycobacterium tuberculosis
AADAALVAVPVDE

SEQ ID NO: 173631 - protein, 13 aa, Mycobacterium tuberculosis
ADAALVAVPVDED

SEQ ID NO: 173632 - protein, 13 aa, Mycobacterium tuberculosis
DAALVAVPVDEDM

SEQ ID NO: 173633 - protein, 13 aa, Mycobacterium tuberculosis
AALVAVPVDEDMP

SEQ ID NO: 173634 - protein, 13 aa, Mycobacterium tuberculosis
ALVAVPVDEDMPA

SEQ ID NO: 173635 - protein, 13 aa, Mycobacterium tuberculosis
LVAVPVDEDMPAA

SEQ ID NO: 173636 - protein, 13 aa, Mycobacterium tuberculosis
VAVPVDEDMPAAD

SEQ ID NO: 173637 - protein, 13 aa, Mycobacterium tuberculosis
AVPVDEDMPAADV

SEQ ID NO: 173638 - protein, 13 aa, Mycobacterium tuberculosis
VPVDEDMPAADVG

SEQ ID NO: 173639 - protein, 13 aa, Mycobacterium tuberculosis
PVDEDMPAADVGE

SEQ ID NO: 173640 - protein, 13 aa, Mycobacterium tuberculosis
VDEDMPAADVGEL

SEQ ID NO: 173641 - protein, 13 aa, Mycobacterium tuberculosis
DEDMPAADVGELL

SEQ ID NO: 173642 - protein, 13 aa, Mycobacterium tuberculosis
EDMPAADVGELLV

SEQ ID NO: 173643 - protein, 13 aa, Mycobacterium tuberculosis
DMPAADVGELLVI

SEQ ID NO: 173644 - protein, 13 aa, Mycobacterium tuberculosis
MPAADVGELLVIE

SEQ ID NO: 173645 - protein, 13 aa, Mycobacterium tuberculosis
PAADVGELLVIET

SEQ ID NO: 173646 - protein, 13 aa, Mycobacterium tuberculosis
AADVGELLVIETV

SEQ ID NO: 173647 - protein, 13 aa, Mycobacterium tuberculosis
ADVGELLVIETVG

SEQ ID NO: 173648 - protein, 13 aa, Mycobacterium tuberculosis
DVGELLVIETVGS

SEQ ID NO: 173649 - protein, 13 aa, Mycobacterium tuberculosis
VGELLVIETVGSA

SEQ ID NO: 173650 - protein, 13 aa, Mycobacterium tuberculosis
GELLVIETVGSAV

SEQ ID NO: 173651 - protein, 13 aa, Mycobacterium tuberculosis
ELLVIETVGSAVA

SEQ ID NO: 173652 - protein, 13 aa, Mycobacterium tuberculosis
LLVIETVGSAVAS

SEQ ID NO: 173653 - protein, 13 aa, Mycobacterium tuberculosis
LVIETVGSAVASI

SEQ ID NO: 173654 - protein, 13 aa, Mycobacterium tuberculosis
VIETVGSAVASIV

SEQ ID NO: 173655 - protein, 13 aa, Mycobacterium tuberculosis
IETVGSAVASIVG

SEQ ID NO: 173656 - protein, 13 aa, Mycobacterium tuberculosis
ETVGSAVASIVGR

SEQ ID NO: 173657 - protein, 13 aa, Mycobacterium tuberculosis
TVGSAVASIVGRT

SEQ ID NO: 173658 - protein, 13 aa, Mycobacterium tuberculosis
VGSAVASIVGRTI

SEQ ID NO: 173659 - protein, 13 aa, Mycobacterium tuberculosis
GSAVASIVGRTIP

SEQ ID NO: 173660 - protein, 13 aa, Mycobacterium tuberculosis
SAVASIVGRTIPV

SEQ ID NO: 173661 - protein, 13 aa, Mycobacterium tuberculosis
AVASIVGRTIPVA

SEQ ID NO: 173662 - protein, 13 aa, Mycobacterium tuberculosis
VASIVGRTIPVAG

SEQ ID NO: 173663 - protein, 13 aa, Mycobacterium tuberculosis
ASIVGRTIPVAGA

SEQ ID NO: 173664 - protein, 13 aa, Mycobacterium tuberculosis
SIVGRTIPVAGAV

SEQ ID NO: 173665 - protein, 13 aa, Mycobacterium tuberculosis
IVGRTIPVAGAVL

SEQ ID NO: 173666 - protein, 13 aa, Mycobacterium tuberculosis
VGRTIPVAGAVLR

SEQ ID NO: 173667 - protein, 13 aa, Mycobacterium tuberculosis
GRTIPVAGAVLRE

SEQ ID NO: 173668 - protein, 13 aa, Mycobacterium tuberculosis
RTIPVAGAVLREV

SEQ ID NO: 173669 - protein, 13 aa, Mycobacterium tuberculosis
TIPVAGAVLREVF

SEQ ID NO: 173670 - protein, 13 aa, Mycobacterium tuberculosis
IPVAGAVLREVFV

SEQ ID NO: 173671 - protein, 13 aa, Mycobacterium tuberculosis
PVAGAVLREVFVN

SEQ ID NO: 173672 - protein, 13 aa, Mycobacterium tuberculosis
VAGAVLREVFVNG

SEQ ID NO: 173673 - protein, 13 aa, Mycobacterium tuberculosis
AGAVLREVFVNGI

SEQ ID NO: 173674 - protein, 13 aa, Mycobacterium tuberculosis
GAVLREVFVNGIP

SEQ ID NO: 173675 - protein, 13 aa, Mycobacterium tuberculosis
AVLREVFVNGIPR

SEQ ID NO: 173676 - protein, 13 aa, Mycobacterium tuberculosis
VLREVFVNGIPRR

SEQ ID NO: 173677 - protein, 13 aa, Mycobacterium tuberculosis
LREVFVNGIPRRV

SEQ ID NO: 173678 - protein, 13 aa, Mycobacterium tuberculosis
REVFVNGIPRRVD

SEQ ID NO: 173679 - protein, 13 aa, Mycobacterium tuberculosis
EVFVNGIPRRVDR

SEQ ID NO: 173680 - protein, 13 aa, Mycobacterium tuberculosis
VFVNGIPRRVDRV

SEQ ID NO: 173681 - protein, 13 aa, Mycobacterium tuberculosis
FVNGIPRRVDRVD

SEQ ID NO: 173682 - protein, 13 aa, Mycobacterium tuberculosis
VNGIPRRVDRVDL

SEQ ID NO: 173683 - protein, 13 aa, Mycobacterium tuberculosis
NGIPRRVDRVDLE

SEQ ID NO: 173684 - protein, 13 aa, Mycobacterium tuberculosis
GIPRRVDRVDLEG

SEQ ID NO: 173685 - protein, 13 aa, Mycobacterium tuberculosis
IPRRVDRVDLEGL

SEQ ID NO: 173686 - protein, 13 aa, Mycobacterium tuberculosis
PRRVDRVDLEGLD

SEQ ID NO: 173687 - protein, 13 aa, Mycobacterium tuberculosis
RRVDRVDLEGLDE

SEQ ID NO: 173688 - protein, 13 aa, Mycobacterium tuberculosis
RVDRVDLEGLDEL

SEQ ID NO: 173689 - protein, 13 aa, Mycobacterium tuberculosis
VDRVDLEGLDELA

SEQ ID NO: 173690 - protein, 13 aa, Mycobacterium tuberculosis
DRVDLEGLDELAD

SEQ ID NO: 173691 - protein, 13 aa, Mycobacterium tuberculosis
RVDLEGLDELADA

SEQ ID NO: 173692 - protein, 13 aa, Mycobacterium tuberculosis
VDLEGLDELADAG

SEQ ID NO: 173693 - protein, 13 aa, Mycobacterium tuberculosis
DLEGLDELADAGP

SEQ ID NO: 173694 - protein, 13 aa, Mycobacterium tuberculosis
LEGLDELADAGPA

SEQ ID NO: 173695 - protein, 13 aa, Mycobacterium tuberculosis
EGLDELADAGPAL

SEQ ID NO: 173696 - protein, 13 aa, Mycobacterium tuberculosis
GLDELADAGPALL

SEQ ID NO: 173697 - protein, 13 aa, Mycobacterium tuberculosis
LDELADAGPALLL

SEQ ID NO: 173698 - protein, 13 aa, Mycobacterium tuberculosis
DELADAGPALLLP

SEQ ID NO: 173699 - protein, 13 aa, Mycobacterium tuberculosis
ELADAGPALLLPL

SEQ ID NO: 173700 - protein, 13 aa, Mycobacterium tuberculosis
LADAGPALLLPLR

SEQ ID NO: 173701 - protein, 13 aa, Mycobacterium tuberculosis
ADAGPALLLPLRA

SEQ ID NO: 173702 - protein, 13 aa, Mycobacterium tuberculosis
DAGPALLLPLRAR

SEQ ID NO: 173703 - protein, 13 aa, Mycobacterium tuberculosis
AGPALLLPLRARG

SEQ ID NO: 173704 - protein, 13 aa, Mycobacterium tuberculosis
GPALLLPLRARGT

SEQ ID NO: 173705 - protein, 13 aa, Mycobacterium tuberculosis
PALLLPLRARGTV

SEQ ID NO: 173706 - protein, 13 aa, Mycobacterium tuberculosis
ALLLPLRARGTVA

SEQ ID NO: 173707 - protein, 13 aa, Mycobacterium tuberculosis
LLLPLRARGTVAG

SEQ ID NO: 173708 - protein, 13 aa, Mycobacterium tuberculosis
LLPLRARGTVAGV

SEQ ID NO: 173709 - protein, 13 aa, Mycobacterium tuberculosis
LPLRARGTVAGVV

SEQ ID NO: 173710 - protein, 13 aa, Mycobacterium tuberculosis
PLRARGTVAGVVV

SEQ ID NO: 173711 - protein, 13 aa, Mycobacterium tuberculosis
LRARGTVAGVVVV

SEQ ID NO: 173712 - protein, 13 aa, Mycobacterium tuberculosis
RARGTVAGVVVVL

SEQ ID NO: 173713 - protein, 13 aa, Mycobacterium tuberculosis
ARGTVAGVVVVLS

SEQ ID NO: 173714 - protein, 13 aa, Mycobacterium tuberculosis
RGTVAGVVVVLSQ

SEQ ID NO: 173715 - protein, 13 aa, Mycobacterium tuberculosis
GTVAGVVVVLSQG

SEQ ID NO: 173716 - protein, 13 aa, Mycobacterium tuberculosis
TVAGVVVVLSQGG

SEQ ID NO: 173717 - protein, 13 aa, Mycobacterium tuberculosis
VAGVVVVLSQGGP

SEQ ID NO: 173718 - protein, 13 aa, Mycobacterium tuberculosis
AGVVVVLSQGGPG

SEQ ID NO: 173719 - protein, 13 aa, Mycobacterium tuberculosis
GVVVVLSQGGPGA

SEQ ID NO: 173720 - protein, 13 aa, Mycobacterium tuberculosis
VVVVLSQGGPGAF

SEQ ID NO: 173721 - protein, 13 aa, Mycobacterium tuberculosis
VVVLSQGGPGAFT

SEQ ID NO: 173722 - protein, 13 aa, Mycobacterium tuberculosis
VVLSQGGPGAFTD

SEQ ID NO: 173723 - protein, 13 aa, Mycobacterium tuberculosis
VLSQGGPGAFTDE

SEQ ID NO: 173724 - protein, 13 aa, Mycobacterium tuberculosis
LSQGGPGAFTDEQ

SEQ ID NO: 173725 - protein, 13 aa, Mycobacterium tuberculosis
SQGGPGAFTDEQL

SEQ ID NO: 173726 - protein, 13 aa, Mycobacterium tuberculosis
QGGPGAFTDEQLE

SEQ ID NO: 173727 - protein, 13 aa, Mycobacterium tuberculosis
GGPGAFTDEQLEM

SEQ ID NO: 173728 - protein, 13 aa, Mycobacterium tuberculosis
GPGAFTDEQLEMM

SEQ ID NO: 173729 - protein, 13 aa, Mycobacterium tuberculosis
PGAFTDEQLEMMA

SEQ ID NO: 173730 - protein, 13 aa, Mycobacterium tuberculosis
GAFTDEQLEMMAA

SEQ ID NO: 173731 - protein, 13 aa, Mycobacterium tuberculosis
AFTDEQLEMMAAF

SEQ ID NO: 173732 - protein, 13 aa, Mycobacterium tuberculosis
FTDEQLEMMAAFA

SEQ ID NO: 173733 - protein, 13 aa, Mycobacterium tuberculosis
TDEQLEMMAAFAD

SEQ ID NO: 173734 - protein, 13 aa, Mycobacterium tuberculosis
DEQLEMMAAFADQ

SEQ ID NO: 173735 - protein, 13 aa, Mycobacterium tuberculosis
EQLEMMAAFADQA

SEQ ID NO: 173736 - protein, 13 aa, Mycobacterium tuberculosis
QLEMMAAFADQAA

SEQ ID NO: 173737 - protein, 13 aa, Mycobacterium tuberculosis
LEMMAAFADQAAL

SEQ ID NO: 173738 - protein, 13 aa, Mycobacterium tuberculosis
EMMAAFADQAALA

SEQ ID NO: 173739 - protein, 13 aa, Mycobacterium tuberculosis
MMAAFADQAALAW

SEQ ID NO: 173740 - protein, 13 aa, Mycobacterium tuberculosis
MAAFADQAALAWQ

SEQ ID NO: 173741 - protein, 13 aa, Mycobacterium tuberculosis
AAFADQAALAWQL

SEQ ID NO: 173742 - protein, 13 aa, Mycobacterium tuberculosis
AFADQAALAWQLA

SEQ ID NO: 173743 - protein, 13 aa, Mycobacterium tuberculosis
FADQAALAWQLAT

SEQ ID NO: 173744 - protein, 13 aa, Mycobacterium tuberculosis
ADQAALAWQLATS

SEQ ID NO: 173745 - protein, 13 aa, Mycobacterium tuberculosis
DQAALAWQLATSQ

SEQ ID NO: 173746 - protein, 13 aa, Mycobacterium tuberculosis
QAALAWQLATSQR

SEQ ID NO: 173747 - protein, 13 aa, Mycobacterium tuberculosis
AALAWQLATSQRR

SEQ ID NO: 173748 - protein, 13 aa, Mycobacterium tuberculosis
ALAWQLATSQRRM

SEQ ID NO: 173749 - protein, 13 aa, Mycobacterium tuberculosis
LAWQLATSQRRMR

SEQ ID NO: 173750 - protein, 13 aa, Mycobacterium tuberculosis
AWQLATSQRRMRE

SEQ ID NO: 173751 - protein, 13 aa, Mycobacterium tuberculosis
WQLATSQRRMREL

SEQ ID NO: 173752 - protein, 13 aa, Mycobacterium tuberculosis
QLATSQRRMRELD

SEQ ID NO: 173753 - protein, 13 aa, Mycobacterium tuberculosis
LATSQRRMRELDV

SEQ ID NO: 173754 - protein, 13 aa, Mycobacterium tuberculosis
ATSQRRMRELDVL

SEQ ID NO: 173755 - protein, 13 aa, Mycobacterium tuberculosis
TSQRRMRELDVLT

SEQ ID NO: 173756 - protein, 13 aa, Mycobacterium tuberculosis
SQRRMRELDVLTD

SEQ ID NO: 173757 - protein, 13 aa, Mycobacterium tuberculosis
QRRMRELDVLTDR

SEQ ID NO: 173758 - protein, 13 aa, Mycobacterium tuberculosis
RRMRELDVLTDRD

SEQ ID NO: 173759 - protein, 13 aa, Mycobacterium tuberculosis
RMRELDVLTDRDR

SEQ ID NO: 173760 - protein, 13 aa, Mycobacterium tuberculosis
MRELDVLTDRDRI

SEQ ID NO: 173761 - protein, 13 aa, Mycobacterium tuberculosis
RELDVLTDRDRIA

SEQ ID NO: 173762 - protein, 13 aa, Mycobacterium tuberculosis
ELDVLTDRDRIAR

SEQ ID NO: 173763 - protein, 13 aa, Mycobacterium tuberculosis
LDVLTDRDRIARD

SEQ ID NO: 173764 - protein, 13 aa, Mycobacterium tuberculosis
DVLTDRDRIARDL

SEQ ID NO: 173765 - protein, 13 aa, Mycobacterium tuberculosis
VLTDRDRIARDLH

SEQ ID NO: 173766 - protein, 13 aa, Mycobacterium tuberculosis
LTDRDRIARDLHD

SEQ ID NO: 173767 - protein, 13 aa, Mycobacterium tuberculosis
TDRDRIARDLHDH

SEQ ID NO: 173768 - protein, 13 aa, Mycobacterium tuberculosis
DRDRIARDLHDHV

SEQ ID NO: 173769 - protein, 13 aa, Mycobacterium tuberculosis
RDRIARDLHDHVI

SEQ ID NO: 173770 - protein, 13 aa, Mycobacterium tuberculosis
DRIARDLHDHVIQ

SEQ ID NO: 173771 - protein, 13 aa, Mycobacterium tuberculosis
RIARDLHDHVIQR

SEQ ID NO: 173772 - protein, 13 aa, Mycobacterium tuberculosis
IARDLHDHVIQRL

SEQ ID NO: 173773 - protein, 13 aa, Mycobacterium tuberculosis
ARDLHDHVIQRLF

SEQ ID NO: 173774 - protein, 13 aa, Mycobacterium tuberculosis
RDLHDHVIQRLFA

SEQ ID NO: 173775 - protein, 13 aa, Mycobacterium tuberculosis
DLHDHVIQRLFAI

SEQ ID NO: 173776 - protein, 13 aa, Mycobacterium tuberculosis
LHDHVIQRLFAIG

SEQ ID NO: 173777 - protein, 13 aa, Mycobacterium tuberculosis
HDHVIQRLFAIGL

SEQ ID NO: 173778 - protein, 13 aa, Mycobacterium tuberculosis
DHVIQRLFAIGLA

SEQ ID NO: 173779 - protein, 13 aa, Mycobacterium tuberculosis
HVIQRLFAIGLAL

SEQ ID NO: 173780 - protein, 13 aa, Mycobacterium tuberculosis
VIQRLFAIGLALQ

SEQ ID NO: 173781 - protein, 13 aa, Mycobacterium tuberculosis
IQRLFAIGLALQG

SEQ ID NO: 173782 - protein, 13 aa, Mycobacterium tuberculosis
QRLFAIGLALQGA

SEQ ID NO: 173783 - protein, 13 aa, Mycobacterium tuberculosis
RLFAIGLALQGAV

SEQ ID NO: 173784 - protein, 13 aa, Mycobacterium tuberculosis
LFAIGLALQGAVP

SEQ ID NO: 173785 - protein, 13 aa, Mycobacterium tuberculosis
FAIGLALQGAVPH

SEQ ID NO: 173786 - protein, 13 aa, Mycobacterium tuberculosis
AIGLALQGAVPHE

SEQ ID NO: 173787 - protein, 13 aa, Mycobacterium tuberculosis
IGLALQGAVPHER

SEQ ID NO: 173788 - protein, 13 aa, Mycobacterium tuberculosis
GLALQGAVPHERN

SEQ ID NO: 173789 - protein, 13 aa, Mycobacterium tuberculosis
LALQGAVPHERNP

SEQ ID NO: 173790 - protein, 13 aa, Mycobacterium tuberculosis
ALQGAVPHERNPE

SEQ ID NO: 173791 - protein, 13 aa, Mycobacterium tuberculosis
LQGAVPHERNPEV

SEQ ID NO: 173792 - protein, 13 aa, Mycobacterium tuberculosis
QGAVPHERNPEVQ

SEQ ID NO: 173793 - protein, 13 aa, Mycobacterium tuberculosis
GAVPHERNPEVQQ

SEQ ID NO: 173794 - protein, 13 aa, Mycobacterium tuberculosis
AVPHERNPEVQQR

SEQ ID NO: 173795 - protein, 13 aa, Mycobacterium tuberculosis
VPHERNPEVQQRL

SEQ ID NO: 173796 - protein, 13 aa, Mycobacterium tuberculosis
PHERNPEVQQRLS

SEQ ID NO: 173797 - protein, 13 aa, Mycobacterium tuberculosis
HERNPEVQQRLSD

SEQ ID NO: 173798 - protein, 13 aa, Mycobacterium tuberculosis
ERNPEVQQRLSDV

SEQ ID NO: 173799 - protein, 13 aa, Mycobacterium tuberculosis
RNPEVQQRLSDVV

SEQ ID NO: 173800 - protein, 13 aa, Mycobacterium tuberculosis
NPEVQQRLSDVVD

SEQ ID NO: 173801 - protein, 13 aa, Mycobacterium tuberculosis
PEVQQRLSDVVDD

SEQ ID NO: 173802 - protein, 13 aa, Mycobacterium tuberculosis
EVQQRLSDVVDDL

SEQ ID NO: 173803 - protein, 13 aa, Mycobacterium tuberculosis
VQQRLSDVVDDLQ

SEQ ID NO: 173804 - protein, 13 aa, Mycobacterium tuberculosis
QQRLSDVVDDLQD

SEQ ID NO: 173805 - protein, 13 aa, Mycobacterium tuberculosis
QRLSDVVDDLQDV

SEQ ID NO: 173806 - protein, 13 aa, Mycobacterium tuberculosis
RLSDVVDDLQDVI

SEQ ID NO: 173807 - protein, 13 aa, Mycobacterium tuberculosis
LSDVVDDLQDVIQ

SEQ ID NO: 173808 - protein, 13 aa, Mycobacterium tuberculosis
SDVVDDLQDVIQE

SEQ ID NO: 173809 - protein, 13 aa, Mycobacterium tuberculosis
DVVDDLQDVIQEI

SEQ ID NO: 173810 - protein, 13 aa, Mycobacterium tuberculosis
VVDDLQDVIQEIR

SEQ ID NO: 173811 - protein, 13 aa, Mycobacterium tuberculosis
VDDLQDVIQEIRT

SEQ ID NO: 173812 - protein, 13 aa, Mycobacterium tuberculosis
DDLQDVIQEIRTT

SEQ ID NO: 173813 - protein, 13 aa, Mycobacterium tuberculosis
DLQDVIQEIRTTI

SEQ ID NO: 173814 - protein, 13 aa, Mycobacterium tuberculosis
LQDVIQEIRTTIY

SEQ ID NO: 173815 - protein, 13 aa, Mycobacterium tuberculosis
QDVIQEIRTTIYD

SEQ ID NO: 173816 - protein, 13 aa, Mycobacterium tuberculosis
DVIQEIRTTIYDL

SEQ ID NO: 173817 - protein, 13 aa, Mycobacterium tuberculosis
VIQEIRTTIYDLH

SEQ ID NO: 173818 - protein, 13 aa, Mycobacterium tuberculosis
IQEIRTTIYDLHG

SEQ ID NO: 173819 - protein, 13 aa, Mycobacterium tuberculosis
QEIRTTIYDLHGA

SEQ ID NO: 173820 - protein, 13 aa, Mycobacterium tuberculosis
EIRTTIYDLHGAS

SEQ ID NO: 173821 - protein, 13 aa, Mycobacterium tuberculosis
IRTTIYDLHGASQ

SEQ ID NO: 173822 - protein, 13 aa, Mycobacterium tuberculosis
RTTIYDLHGASQG

SEQ ID NO: 173823 - protein, 13 aa, Mycobacterium tuberculosis
TTIYDLHGASQGI

SEQ ID NO: 173824 - protein, 13 aa, Mycobacterium tuberculosis
TIYDLHGASQGIT

SEQ ID NO: 173825 - protein, 13 aa, Mycobacterium tuberculosis
IYDLHGASQGITR

SEQ ID NO: 173826 - protein, 13 aa, Mycobacterium tuberculosis
YDLHGASQGITRL

SEQ ID NO: 173827 - protein, 13 aa, Mycobacterium tuberculosis
DLHGASQGITRLR

SEQ ID NO: 173828 - protein, 13 aa, Mycobacterium tuberculosis
LHGASQGITRLRQ

SEQ ID NO: 173829 - protein, 13 aa, Mycobacterium tuberculosis
HGASQGITRLRQR

SEQ ID NO: 173830 - protein, 13 aa, Mycobacterium tuberculosis
GASQGITRLRQRI

SEQ ID NO: 173831 - protein, 13 aa, Mycobacterium tuberculosis
ASQGITRLRQRID

SEQ ID NO: 173832 - protein, 13 aa, Mycobacterium tuberculosis
SQGITRLRQRIDA

SEQ ID NO: 173833 - protein, 13 aa, Mycobacterium tuberculosis
QGITRLRQRIDAA

SEQ ID NO: 173834 - protein, 13 aa, Mycobacterium tuberculosis
GITRLRQRIDAAV

SEQ ID NO: 173835 - protein, 13 aa, Mycobacterium tuberculosis
ITRLRQRIDAAVA

SEQ ID NO: 173836 - protein, 13 aa, Mycobacterium tuberculosis
TRLRQRIDAAVAQ

SEQ ID NO: 173837 - protein, 13 aa, Mycobacterium tuberculosis
RLRQRIDAAVAQF

SEQ ID NO: 173838 - protein, 13 aa, Mycobacterium tuberculosis
LRQRIDAAVAQFA

SEQ ID NO: 173839 - protein, 13 aa, Mycobacterium tuberculosis
RQRIDAAVAQFAD

SEQ ID NO: 173840 - protein, 13 aa, Mycobacterium tuberculosis
QRIDAAVAQFADS

SEQ ID NO: 173841 - protein, 13 aa, Mycobacterium tuberculosis
RIDAAVAQFADSG

SEQ ID NO: 173842 - protein, 13 aa, Mycobacterium tuberculosis
IDAAVAQFADSGL

SEQ ID NO: 173843 - protein, 13 aa, Mycobacterium tuberculosis
DAAVAQFADSGLR

SEQ ID NO: 173844 - protein, 13 aa, Mycobacterium tuberculosis
AAVAQFADSGLRT

SEQ ID NO: 173845 - protein, 13 aa, Mycobacterium tuberculosis
AVAQFADSGLRTS

SEQ ID NO: 173846 - protein, 13 aa, Mycobacterium tuberculosis
VAQFADSGLRTSV

SEQ ID NO: 173847 - protein, 13 aa, Mycobacterium tuberculosis
AQFADSGLRTSVQ

SEQ ID NO: 173848 - protein, 13 aa, Mycobacterium tuberculosis
QFADSGLRTSVQF

SEQ ID NO: 173849 - protein, 13 aa, Mycobacterium tuberculosis
FADSGLRTSVQFV

SEQ ID NO: 173850 - protein, 13 aa, Mycobacterium tuberculosis
ADSGLRTSVQFVG

SEQ ID NO: 173851 - protein, 13 aa, Mycobacterium tuberculosis
DSGLRTSVQFVGP

SEQ ID NO: 173852 - protein, 13 aa, Mycobacterium tuberculosis
SGLRTSVQFVGPL

SEQ ID NO: 173853 - protein, 13 aa, Mycobacterium tuberculosis
GLRTSVQFVGPLS

SEQ ID NO: 173854 - protein, 13 aa, Mycobacterium tuberculosis
LRTSVQFVGPLSV

SEQ ID NO: 173855 - protein, 13 aa, Mycobacterium tuberculosis
RTSVQFVGPLSVV

SEQ ID NO: 173856 - protein, 13 aa, Mycobacterium tuberculosis
TSVQFVGPLSVVD

SEQ ID NO: 173857 - protein, 13 aa, Mycobacterium tuberculosis
SVQFVGPLSVVDS

SEQ ID NO: 173858 - protein, 13 aa, Mycobacterium tuberculosis
VQFVGPLSVVDSA

SEQ ID NO: 173859 - protein, 13 aa, Mycobacterium tuberculosis
QFVGPLSVVDSAL

SEQ ID NO: 173860 - protein, 13 aa, Mycobacterium tuberculosis
FVGPLSVVDSALA

SEQ ID NO: 173861 - protein, 13 aa, Mycobacterium tuberculosis
VGPLSVVDSALAD

SEQ ID NO: 173862 - protein, 13 aa, Mycobacterium tuberculosis
GPLSVVDSALADQ

SEQ ID NO: 173863 - protein, 13 aa, Mycobacterium tuberculosis
PLSVVDSALADQA

SEQ ID NO: 173864 - protein, 13 aa, Mycobacterium tuberculosis
LSVVDSALADQAE

SEQ ID NO: 173865 - protein, 13 aa, Mycobacterium tuberculosis
SVVDSALADQAEA

SEQ ID NO: 173866 - protein, 13 aa, Mycobacterium tuberculosis
VVDSALADQAEAV

SEQ ID NO: 173867 - protein, 13 aa, Mycobacterium tuberculosis
VDSALADQAEAVV

SEQ ID NO: 173868 - protein, 13 aa, Mycobacterium tuberculosis
DSALADQAEAVVR

SEQ ID NO: 173869 - protein, 13 aa, Mycobacterium tuberculosis
SALADQAEAVVRE

SEQ ID NO: 173870 - protein, 13 aa, Mycobacterium tuberculosis
ALADQAEAVVREA

SEQ ID NO: 173871 - protein, 13 aa, Mycobacterium tuberculosis
LADQAEAVVREAV

SEQ ID NO: 173872 - protein, 13 aa, Mycobacterium tuberculosis
ADQAEAVVREAVS

SEQ ID NO: 173873 - protein, 13 aa, Mycobacterium tuberculosis
DQAEAVVREAVSN

SEQ ID NO: 173874 - protein, 13 aa, Mycobacterium tuberculosis
QAEAVVREAVSNA

SEQ ID NO: 173875 - protein, 13 aa, Mycobacterium tuberculosis
AEAVVREAVSNAV

SEQ ID NO: 173876 - protein, 13 aa, Mycobacterium tuberculosis
EAVVREAVSNAVR

SEQ ID NO: 173877 - protein, 13 aa, Mycobacterium tuberculosis
AVVREAVSNAVRH

SEQ ID NO: 173878 - protein, 13 aa, Mycobacterium tuberculosis
VVREAVSNAVRHA

SEQ ID NO: 173879 - protein, 13 aa, Mycobacterium tuberculosis
VREAVSNAVRHAK

SEQ ID NO: 173880 - protein, 13 aa, Mycobacterium tuberculosis
REAVSNAVRHAKA

SEQ ID NO: 173881 - protein, 13 aa, Mycobacterium tuberculosis
EAVSNAVRHAKAS

SEQ ID NO: 173882 - protein, 13 aa, Mycobacterium tuberculosis
AVSNAVRHAKAST

SEQ ID NO: 173883 - protein, 13 aa, Mycobacterium tuberculosis
VSNAVRHAKASTL

SEQ ID NO: 173884 - protein, 13 aa, Mycobacterium tuberculosis
SNAVRHAKASTLT

SEQ ID NO: 173885 - protein, 13 aa, Mycobacterium tuberculosis
NAVRHAKASTLTV

SEQ ID NO: 173886 - protein, 13 aa, Mycobacterium tuberculosis
AVRHAKASTLTVR

SEQ ID NO: 173887 - protein, 13 aa, Mycobacterium tuberculosis
VRHAKASTLTVRV

SEQ ID NO: 173888 - protein, 13 aa, Mycobacterium tuberculosis
RHAKASTLTVRVK

SEQ ID NO: 173889 - protein, 13 aa, Mycobacterium tuberculosis
HAKASTLTVRVKV

SEQ ID NO: 173890 - protein, 13 aa, Mycobacterium tuberculosis
AKASTLTVRVKVD

SEQ ID NO: 173891 - protein, 13 aa, Mycobacterium tuberculosis
KASTLTVRVKVDD

SEQ ID NO: 173892 - protein, 13 aa, Mycobacterium tuberculosis
ASTLTVRVKVDDD

SEQ ID NO: 173893 - protein, 13 aa, Mycobacterium tuberculosis
STLTVRVKVDDDL

SEQ ID NO: 173894 - protein, 13 aa, Mycobacterium tuberculosis
TLTVRVKVDDDLC

SEQ ID NO: 173895 - protein, 13 aa, Mycobacterium tuberculosis
LTVRVKVDDDLCI

SEQ ID NO: 173896 - protein, 13 aa, Mycobacterium tuberculosis
TVRVKVDDDLCIE

SEQ ID NO: 173897 - protein, 13 aa, Mycobacterium tuberculosis
VRVKVDDDLCIEV

SEQ ID NO: 173898 - protein, 13 aa, Mycobacterium tuberculosis
RVKVDDDLCIEVT

SEQ ID NO: 173899 - protein, 13 aa, Mycobacterium tuberculosis
VKVDDDLCIEVTD

SEQ ID NO: 173900 - protein, 13 aa, Mycobacterium tuberculosis
KVDDDLCIEVTDN

SEQ ID NO: 173901 - protein, 13 aa, Mycobacterium tuberculosis
VDDDLCIEVTDNG

SEQ ID NO: 173902 - protein, 13 aa, Mycobacterium tuberculosis
DDDLCIEVTDNGR

SEQ ID NO: 173903 - protein, 13 aa, Mycobacterium tuberculosis
DDLCIEVTDNGRG

SEQ ID NO: 173904 - protein, 13 aa, Mycobacterium tuberculosis
DLCIEVTDNGRGL

SEQ ID NO: 173905 - protein, 13 aa, Mycobacterium tuberculosis
LCIEVTDNGRGLP

SEQ ID NO: 173906 - protein, 13 aa, Mycobacterium tuberculosis
CIEVTDNGRGLPD

SEQ ID NO: 173907 - protein, 13 aa, Mycobacterium tuberculosis
IEVTDNGRGLPDE

SEQ ID NO: 173908 - protein, 13 aa, Mycobacterium tuberculosis
EVTDNGRGLPDEF

SEQ ID NO: 173909 - protein, 13 aa, Mycobacterium tuberculosis
VTDNGRGLPDEFT

SEQ ID NO: 173910 - protein, 13 aa, Mycobacterium tuberculosis
TDNGRGLPDEFTG

SEQ ID NO: 173911 - protein, 13 aa, Mycobacterium tuberculosis
DNGRGLPDEFTGS

SEQ ID NO: 173912 - protein, 13 aa, Mycobacterium tuberculosis
NGRGLPDEFTGSG

SEQ ID NO: 173913 - protein, 13 aa, Mycobacterium tuberculosis
GRGLPDEFTGSGL

SEQ ID NO: 173914 - protein, 13 aa, Mycobacterium tuberculosis
RGLPDEFTGSGLT

SEQ ID NO: 173915 - protein, 13 aa, Mycobacterium tuberculosis
GLPDEFTGSGLTN

SEQ ID NO: 173916 - protein, 13 aa, Mycobacterium tuberculosis
LPDEFTGSGLTNL

SEQ ID NO: 173917 - protein, 13 aa, Mycobacterium tuberculosis
PDEFTGSGLTNLR

SEQ ID NO: 173918 - protein, 13 aa, Mycobacterium tuberculosis
DEFTGSGLTNLRQ

SEQ ID NO: 173919 - protein, 13 aa, Mycobacterium tuberculosis
EFTGSGLTNLRQR

SEQ ID NO: 173920 - protein, 13 aa, Mycobacterium tuberculosis
FTGSGLTNLRQRA

SEQ ID NO: 173921 - protein, 13 aa, Mycobacterium tuberculosis
TGSGLTNLRQRAE

SEQ ID NO: 173922 - protein, 13 aa, Mycobacterium tuberculosis
GSGLTNLRQRAEQ

SEQ ID NO: 173923 - protein, 13 aa, Mycobacterium tuberculosis
SGLTNLRQRAEQA

SEQ ID NO: 173924 - protein, 13 aa, Mycobacterium tuberculosis
GLTNLRQRAEQAG

SEQ ID NO: 173925 - protein, 13 aa, Mycobacterium tuberculosis
LTNLRQRAEQAGG

SEQ ID NO: 173926 - protein, 13 aa, Mycobacterium tuberculosis
TNLRQRAEQAGGE

SEQ ID NO: 173927 - protein, 13 aa, Mycobacterium tuberculosis
NLRQRAEQAGGEF

SEQ ID NO: 173928 - protein, 13 aa, Mycobacterium tuberculosis
LRQRAEQAGGEFT

SEQ ID NO: 173929 - protein, 13 aa, Mycobacterium tuberculosis
RQRAEQAGGEFTL

SEQ ID NO: 173930 - protein, 13 aa, Mycobacterium tuberculosis
QRAEQAGGEFTLA

SEQ ID NO: 173931 - protein, 13 aa, Mycobacterium tuberculosis
RAEQAGGEFTLAS

SEQ ID NO: 173932 - protein, 13 aa, Mycobacterium tuberculosis
AEQAGGEFTLASV

SEQ ID NO: 173933 - protein, 13 aa, Mycobacterium tuberculosis
EQAGGEFTLASVP

SEQ ID NO: 173934 - protein, 13 aa, Mycobacterium tuberculosis
QAGGEFTLASVPG

SEQ ID NO: 173935 - protein, 13 aa, Mycobacterium tuberculosis
AGGEFTLASVPGA

SEQ ID NO: 173936 - protein, 13 aa, Mycobacterium tuberculosis
GGEFTLASVPGAS

SEQ ID NO: 173937 - protein, 13 aa, Mycobacterium tuberculosis
GEFTLASVPGASG

SEQ ID NO: 173938 - protein, 13 aa, Mycobacterium tuberculosis
EFTLASVPGASGT

SEQ ID NO: 173939 - protein, 13 aa, Mycobacterium tuberculosis
FTLASVPGASGTV

SEQ ID NO: 173940 - protein, 13 aa, Mycobacterium tuberculosis
TLASVPGASGTVL

SEQ ID NO: 173941 - protein, 13 aa, Mycobacterium tuberculosis
LASVPGASGTVLR

SEQ ID NO: 173942 - protein, 13 aa, Mycobacterium tuberculosis
ASVPGASGTVLRW

SEQ ID NO: 173943 - protein, 13 aa, Mycobacterium tuberculosis
SVPGASGTVLRWS

SEQ ID NO: 173944 - protein, 13 aa, Mycobacterium tuberculosis
VPGASGTVLRWSA

SEQ ID NO: 173945 - protein, 13 aa, Mycobacterium tuberculosis
PGASGTVLRWSAP

SEQ ID NO: 173946 - protein, 13 aa, Mycobacterium tuberculosis
GASGTVLRWSAPL

SEQ ID NO: 173947 - protein, 13 aa, Mycobacterium tuberculosis
ASGTVLRWSAPLS

SEQ ID NO: 173948 - protein, 13 aa, Mycobacterium tuberculosis
SGTVLRWSAPLSQ

SEQ ID NO: 173949 - protein, 14 aa, Mycobacterium tuberculosis
MTTGGLVDENDGAA

SEQ ID NO: 173950 - protein, 14 aa, Mycobacterium tuberculosis
TTGGLVDENDGAAM

SEQ ID NO: 173951 - protein, 14 aa, Mycobacterium tuberculosis
TGGLVDENDGAAMR

SEQ ID NO: 173952 - protein, 14 aa, Mycobacterium tuberculosis
GGLVDENDGAAMRP

SEQ ID NO: 173953 - protein, 14 aa, Mycobacterium tuberculosis
GLVDENDGAAMRPL

SEQ ID NO: 173954 - protein, 14 aa, Mycobacterium tuberculosis
LVDENDGAAMRPLR

SEQ ID NO: 173955 - protein, 14 aa, Mycobacterium tuberculosis
VDENDGAAMRPLRH

SEQ ID NO: 173956 - protein, 14 aa, Mycobacterium tuberculosis
DENDGAAMRPLRHT

SEQ ID NO: 173957 - protein, 14 aa, Mycobacterium tuberculosis
ENDGAAMRPLRHTL

SEQ ID NO: 173958 - protein, 14 aa, Mycobacterium tuberculosis
NDGAAMRPLRHTLS

SEQ ID NO: 173959 - protein, 14 aa, Mycobacterium tuberculosis
DGAAMRPLRHTLSQ

SEQ ID NO: 173960 - protein, 14 aa, Mycobacterium tuberculosis
GAAMRPLRHTLSQL

SEQ ID NO: 173961 - protein, 14 aa, Mycobacterium tuberculosis
AAMRPLRHTLSQLR

SEQ ID NO: 173962 - protein, 14 aa, Mycobacterium tuberculosis
AMRPLRHTLSQLRL

SEQ ID NO: 173963 - protein, 14 aa, Mycobacterium tuberculosis
MRPLRHTLSQLRLH

SEQ ID NO: 173964 - protein, 14 aa, Mycobacterium tuberculosis
RPLRHTLSQLRLHE

SEQ ID NO: 173965 - protein, 14 aa, Mycobacterium tuberculosis
PLRHTLSQLRLHEL

SEQ ID NO: 173966 - protein, 14 aa, Mycobacterium tuberculosis
LRHTLSQLRLHELL

SEQ ID NO: 173967 - protein, 14 aa, Mycobacterium tuberculosis
RHTLSQLRLHELLV

SEQ ID NO: 173968 - protein, 14 aa, Mycobacterium tuberculosis
HTLSQLRLHELLVE

SEQ ID NO: 173969 - protein, 14 aa, Mycobacterium tuberculosis
TLSQLRLHELLVEV

SEQ ID NO: 173970 - protein, 14 aa, Mycobacterium tuberculosis
LSQLRLHELLVEVQ

SEQ ID NO: 173971 - protein, 14 aa, Mycobacterium tuberculosis
SQLRLHELLVEVQD

SEQ ID NO: 173972 - protein, 14 aa, Mycobacterium tuberculosis
QLRLHELLVEVQDR

SEQ ID NO: 173973 - protein, 14 aa, Mycobacterium tuberculosis
LRLHELLVEVQDRV

SEQ ID NO: 173974 - protein, 14 aa, Mycobacterium tuberculosis
RLHELLVEVQDRVE

SEQ ID NO: 173975 - protein, 14 aa, Mycobacterium tuberculosis
LHELLVEVQDRVEQ

SEQ ID NO: 173976 - protein, 14 aa, Mycobacterium tuberculosis
HELLVEVQDRVEQI

SEQ ID NO: 173977 - protein, 14 aa, Mycobacterium tuberculosis
ELLVEVQDRVEQIV

SEQ ID NO: 173978 - protein, 14 aa, Mycobacterium tuberculosis
LLVEVQDRVEQIVE

SEQ ID NO: 173979 - protein, 14 aa, Mycobacterium tuberculosis
LVEVQDRVEQIVEG

SEQ ID NO: 173980 - protein, 14 aa, Mycobacterium tuberculosis
VEVQDRVEQIVEGR

SEQ ID NO: 173981 - protein, 14 aa, Mycobacterium tuberculosis
EVQDRVEQIVEGRD

SEQ ID NO: 173982 - protein, 14 aa, Mycobacterium tuberculosis
VQDRVEQIVEGRDR

SEQ ID NO: 173983 - protein, 14 aa, Mycobacterium tuberculosis
QDRVEQIVEGRDRL

SEQ ID NO: 173984 - protein, 14 aa, Mycobacterium tuberculosis
DRVEQIVEGRDRLD

SEQ ID NO: 173985 - protein, 14 aa, Mycobacterium tuberculosis
RVEQIVEGRDRLDG

SEQ ID NO: 173986 - protein, 14 aa, Mycobacterium tuberculosis
VEQIVEGRDRLDGL

SEQ ID NO: 173987 - protein, 14 aa, Mycobacterium tuberculosis
EQIVEGRDRLDGLV

SEQ ID NO: 173988 - protein, 14 aa, Mycobacterium tuberculosis
QIVEGRDRLDGLVE

SEQ ID NO: 173989 - protein, 14 aa, Mycobacterium tuberculosis
IVEGRDRLDGLVEA

SEQ ID NO: 173990 - protein, 14 aa, Mycobacterium tuberculosis
VEGRDRLDGLVEAM

SEQ ID NO: 173991 - protein, 14 aa, Mycobacterium tuberculosis
EGRDRLDGLVEAML

SEQ ID NO: 173992 - protein, 14 aa, Mycobacterium tuberculosis
GRDRLDGLVEAMLV

SEQ ID NO: 173993 - protein, 14 aa, Mycobacterium tuberculosis
RDRLDGLVEAMLVV

SEQ ID NO: 173994 - protein, 14 aa, Mycobacterium tuberculosis
DRLDGLVEAMLVVT

SEQ ID NO: 173995 - protein, 14 aa, Mycobacterium tuberculosis
RLDGLVEAMLVVTA

SEQ ID NO: 173996 - protein, 14 aa, Mycobacterium tuberculosis
LDGLVEAMLVVTAG

SEQ ID NO: 173997 - protein, 14 aa, Mycobacterium tuberculosis
DGLVEAMLVVTAGL

SEQ ID NO: 173998 - protein, 14 aa, Mycobacterium tuberculosis
GLVEAMLVVTAGLD

SEQ ID NO: 173999 - protein, 14 aa, Mycobacterium tuberculosis
LVEAMLVVTAGLDL

SEQ ID NO: 174000 - protein, 14 aa, Mycobacterium tuberculosis
VEAMLVVTAGLDLE

SEQ ID NO: 174001 - protein, 14 aa, Mycobacterium tuberculosis
EAMLVVTAGLDLEA

SEQ ID NO: 174002 - protein, 14 aa, Mycobacterium tuberculosis
AMLVVTAGLDLEAT

SEQ ID NO: 174003 - protein, 14 aa, Mycobacterium tuberculosis
MLVVTAGLDLEATL

SEQ ID NO: 174004 - protein, 14 aa, Mycobacterium tuberculosis
LVVTAGLDLEATLR

SEQ ID NO: 174005 - protein, 14 aa, Mycobacterium tuberculosis
VVTAGLDLEATLRA

SEQ ID NO: 174006 - protein, 14 aa, Mycobacterium tuberculosis
VTAGLDLEATLRAI

SEQ ID NO: 174007 - protein, 14 aa, Mycobacterium tuberculosis
TAGLDLEATLRAIV

SEQ ID NO: 174008 - protein, 14 aa, Mycobacterium tuberculosis
AGLDLEATLRAIVH

SEQ ID NO: 174009 - protein, 14 aa, Mycobacterium tuberculosis
GLDLEATLRAIVHS

SEQ ID NO: 174010 - protein, 14 aa, Mycobacterium tuberculosis
LDLEATLRAIVHSA

SEQ ID NO: 174011 - protein, 14 aa, Mycobacterium tuberculosis
DLEATLRAIVHSAT

SEQ ID NO: 174012 - protein, 14 aa, Mycobacterium tuberculosis
LEATLRAIVHSATS

SEQ ID NO: 174013 - protein, 14 aa, Mycobacterium tuberculosis
EATLRAIVHSATSL

SEQ ID NO: 174014 - protein, 14 aa, Mycobacterium tuberculosis
ATLRAIVHSATSLV

SEQ ID NO: 174015 - protein, 14 aa, Mycobacterium tuberculosis
TLRAIVHSATSLVD

SEQ ID NO: 174016 - protein, 14 aa, Mycobacterium tuberculosis
LRAIVHSATSLVDA

SEQ ID NO: 174017 - protein, 14 aa, Mycobacterium tuberculosis
RAIVHSATSLVDAR

SEQ ID NO: 174018 - protein, 14 aa, Mycobacterium tuberculosis
AIVHSATSLVDARY

SEQ ID NO: 174019 - protein, 14 aa, Mycobacterium tuberculosis
IVHSATSLVDARYG

SEQ ID NO: 174020 - protein, 14 aa, Mycobacterium tuberculosis
VHSATSLVDARYGA

SEQ ID NO: 174021 - protein, 14 aa, Mycobacterium tuberculosis
HSATSLVDARYGAM

SEQ ID NO: 174022 - protein, 14 aa, Mycobacterium tuberculosis
SATSLVDARYGAME

SEQ ID NO: 174023 - protein, 14 aa, Mycobacterium tuberculosis
ATSLVDARYGAMEV

SEQ ID NO: 174024 - protein, 14 aa, Mycobacterium tuberculosis
TSLVDARYGAMEVH

SEQ ID NO: 174025 - protein, 14 aa, Mycobacterium tuberculosis
SLVDARYGAMEVHD

SEQ ID NO: 174026 - protein, 14 aa, Mycobacterium tuberculosis
LVDARYGAMEVHDR

SEQ ID NO: 174027 - protein, 14 aa, Mycobacterium tuberculosis
VDARYGAMEVHDRQ

SEQ ID NO: 174028 - protein, 14 aa, Mycobacterium tuberculosis
DARYGAMEVHDRQH

SEQ ID NO: 174029 - protein, 14 aa, Mycobacterium tuberculosis
ARYGAMEVHDRQHR

SEQ ID NO: 174030 - protein, 14 aa, Mycobacterium tuberculosis
RYGAMEVHDRQHRV

SEQ ID NO: 174031 - protein, 14 aa, Mycobacterium tuberculosis
YGAMEVHDRQHRVL

SEQ ID NO: 174032 - protein, 14 aa, Mycobacterium tuberculosis
GAMEVHDRQHRVLH

SEQ ID NO: 174033 - protein, 14 aa, Mycobacterium tuberculosis
AMEVHDRQHRVLHF

SEQ ID NO: 174034 - protein, 14 aa, Mycobacterium tuberculosis
MEVHDRQHRVLHFV

SEQ ID NO: 174035 - protein, 14 aa, Mycobacterium tuberculosis
EVHDRQHRVLHFVY

SEQ ID NO: 174036 - protein, 14 aa, Mycobacterium tuberculosis
VHDRQHRVLHFVYE

SEQ ID NO: 174037 - protein, 14 aa, Mycobacterium tuberculosis
HDRQHRVLHFVYEG

SEQ ID NO: 174038 - protein, 14 aa, Mycobacterium tuberculosis
DRQHRVLHFVYEGI

SEQ ID NO: 174039 - protein, 14 aa, Mycobacterium tuberculosis
RQHRVLHFVYEGID

SEQ ID NO: 174040 - protein, 14 aa, Mycobacterium tuberculosis
QHRVLHFVYEGIDE

SEQ ID NO: 174041 - protein, 14 aa, Mycobacterium tuberculosis
HRVLHFVYEGIDEE

SEQ ID NO: 174042 - protein, 14 aa, Mycobacterium tuberculosis
RVLHFVYEGIDEET

SEQ ID NO: 174043 - protein, 14 aa, Mycobacterium tuberculosis
VLHFVYEGIDEETV

SEQ ID NO: 174044 - protein, 14 aa, Mycobacterium tuberculosis
LHFVYEGIDEETVR

SEQ ID NO: 174045 - protein, 14 aa, Mycobacterium tuberculosis
HFVYEGIDEETVRR

SEQ ID NO: 174046 - protein, 14 aa, Mycobacterium tuberculosis
FVYEGIDEETVRRI

SEQ ID NO: 174047 - protein, 14 aa, Mycobacterium tuberculosis
VYEGIDEETVRRIG

SEQ ID NO: 174048 - protein, 14 aa, Mycobacterium tuberculosis
YEGIDEETVRRIGH

SEQ ID NO: 174049 - protein, 14 aa, Mycobacterium tuberculosis
EGIDEETVRRIGHL

SEQ ID NO: 174050 - protein, 14 aa, Mycobacterium tuberculosis
GIDEETVRRIGHLP

SEQ ID NO: 174051 - protein, 14 aa, Mycobacterium tuberculosis
IDEETVRRIGHLPK

SEQ ID NO: 174052 - protein, 14 aa, Mycobacterium tuberculosis
DEETVRRIGHLPKG

SEQ ID NO: 174053 - protein, 14 aa, Mycobacterium tuberculosis
EETVRRIGHLPKGL

SEQ ID NO: 174054 - protein, 14 aa, Mycobacterium tuberculosis
ETVRRIGHLPKGLG

SEQ ID NO: 174055 - protein, 14 aa, Mycobacterium tuberculosis
TVRRIGHLPKGLGV

SEQ ID NO: 174056 - protein, 14 aa, Mycobacterium tuberculosis
VRRIGHLPKGLGVI

SEQ ID NO: 174057 - protein, 14 aa, Mycobacterium tuberculosis
RRIGHLPKGLGVIG

SEQ ID NO: 174058 - protein, 14 aa, Mycobacterium tuberculosis
RIGHLPKGLGVIGL

SEQ ID NO: 174059 - protein, 14 aa, Mycobacterium tuberculosis
IGHLPKGLGVIGLL

SEQ ID NO: 174060 - protein, 14 aa, Mycobacterium tuberculosis
GHLPKGLGVIGLLI

SEQ ID NO: 174061 - protein, 14 aa, Mycobacterium tuberculosis
HLPKGLGVIGLLIE

SEQ ID NO: 174062 - protein, 14 aa, Mycobacterium tuberculosis
LPKGLGVIGLLIED

SEQ ID NO: 174063 - protein, 14 aa, Mycobacterium tuberculosis
PKGLGVIGLLIEDP

SEQ ID NO: 174064 - protein, 14 aa, Mycobacterium tuberculosis
KGLGVIGLLIEDPK

SEQ ID NO: 174065 - protein, 14 aa, Mycobacterium tuberculosis
GLGVIGLLIEDPKP

SEQ ID NO: 174066 - protein, 14 aa, Mycobacterium tuberculosis
LGVIGLLIEDPKPL

SEQ ID NO: 174067 - protein, 14 aa, Mycobacterium tuberculosis
GVIGLLIEDPKPLR

SEQ ID NO: 174068 - protein, 14 aa, Mycobacterium tuberculosis
VIGLLIEDPKPLRL

SEQ ID NO: 174069 - protein, 14 aa, Mycobacterium tuberculosis
IGLLIEDPKPLRLD

SEQ ID NO: 174070 - protein, 14 aa, Mycobacterium tuberculosis
GLLIEDPKPLRLDD

SEQ ID NO: 174071 - protein, 14 aa, Mycobacterium tuberculosis
LLIEDPKPLRLDDV

SEQ ID NO: 174072 - protein, 14 aa, Mycobacterium tuberculosis
LIEDPKPLRLDDVS

SEQ ID NO: 174073 - protein, 14 aa, Mycobacterium tuberculosis
IEDPKPLRLDDVSA

SEQ ID NO: 174074 - protein, 14 aa, Mycobacterium tuberculosis
EDPKPLRLDDVSAH

SEQ ID NO: 174075 - protein, 14 aa, Mycobacterium tuberculosis
DPKPLRLDDVSAHP

SEQ ID NO: 174076 - protein, 14 aa, Mycobacterium tuberculosis
PKPLRLDDVSAHPA

SEQ ID NO: 174077 - protein, 14 aa, Mycobacterium tuberculosis
KPLRLDDVSAHPAS

SEQ ID NO: 174078 - protein, 14 aa, Mycobacterium tuberculosis
PLRLDDVSAHPASI

SEQ ID NO: 174079 - protein, 14 aa, Mycobacterium tuberculosis
LRLDDVSAHPASIG

SEQ ID NO: 174080 - protein, 14 aa, Mycobacterium tuberculosis
RLDDVSAHPASIGF

SEQ ID NO: 174081 - protein, 14 aa, Mycobacterium tuberculosis
LDDVSAHPASIGFP

SEQ ID NO: 174082 - protein, 14 aa, Mycobacterium tuberculosis
DDVSAHPASIGFPP

SEQ ID NO: 174083 - protein, 14 aa, Mycobacterium tuberculosis
DVSAHPASIGFPPY

SEQ ID NO: 174084 - protein, 14 aa, Mycobacterium tuberculosis
VSAHPASIGFPPYH

SEQ ID NO: 174085 - protein, 14 aa, Mycobacterium tuberculosis
SAHPASIGFPPYHP

SEQ ID NO: 174086 - protein, 14 aa, Mycobacterium tuberculosis
AHPASIGFPPYHPP

SEQ ID NO: 174087 - protein, 14 aa, Mycobacterium tuberculosis
HPASIGFPPYHPPM

SEQ ID NO: 174088 - protein, 14 aa, Mycobacterium tuberculosis
PASIGFPPYHPPMR

SEQ ID NO: 174089 - protein, 14 aa, Mycobacterium tuberculosis
ASIGFPPYHPPMRT

SEQ ID NO: 174090 - protein, 14 aa, Mycobacterium tuberculosis
SIGFPPYHPPMRTF

SEQ ID NO: 174091 - protein, 14 aa, Mycobacterium tuberculosis
IGFPPYHPPMRTFL

SEQ ID NO: 174092 - protein, 14 aa, Mycobacterium tuberculosis
GFPPYHPPMRTFLG

SEQ ID NO: 174093 - protein, 14 aa, Mycobacterium tuberculosis
FPPYHPPMRTFLGV

SEQ ID NO: 174094 - protein, 14 aa, Mycobacterium tuberculosis
PPYHPPMRTFLGVP

SEQ ID NO: 174095 - protein, 14 aa, Mycobacterium tuberculosis
PYHPPMRTFLGVPV

SEQ ID NO: 174096 - protein, 14 aa, Mycobacterium tuberculosis
YHPPMRTFLGVPVR

SEQ ID NO: 174097 - protein, 14 aa, Mycobacterium tuberculosis
HPPMRTFLGVPVRV

SEQ ID NO: 174098 - protein, 14 aa, Mycobacterium tuberculosis
PPMRTFLGVPVRVR

SEQ ID NO: 174099 - protein, 14 aa, Mycobacterium tuberculosis
PMRTFLGVPVRVRD

SEQ ID NO: 174100 - protein, 14 aa, Mycobacterium tuberculosis
MRTFLGVPVRVRDE

SEQ ID NO: 174101 - protein, 14 aa, Mycobacterium tuberculosis
RTFLGVPVRVRDES

SEQ ID NO: 174102 - protein, 14 aa, Mycobacterium tuberculosis
TFLGVPVRVRDESF

SEQ ID NO: 174103 - protein, 14 aa, Mycobacterium tuberculosis
FLGVPVRVRDESFG

SEQ ID NO: 174104 - protein, 14 aa, Mycobacterium tuberculosis
LGVPVRVRDESFGT

SEQ ID NO: 174105 - protein, 14 aa, Mycobacterium tuberculosis
GVPVRVRDESFGTL

SEQ ID NO: 174106 - protein, 14 aa, Mycobacterium tuberculosis
VPVRVRDESFGTLY

SEQ ID NO: 174107 - protein, 14 aa, Mycobacterium tuberculosis
PVRVRDESFGTLYL

SEQ ID NO: 174108 - protein, 14 aa, Mycobacterium tuberculosis
VRVRDESFGTLYLT

SEQ ID NO: 174109 - protein, 14 aa, Mycobacterium tuberculosis
RVRDESFGTLYLTD

SEQ ID NO: 174110 - protein, 14 aa, Mycobacterium tuberculosis
VRDESFGTLYLTDK

SEQ ID NO: 174111 - protein, 14 aa, Mycobacterium tuberculosis
RDESFGTLYLTDKT

SEQ ID NO: 174112 - protein, 14 aa, Mycobacterium tuberculosis
DESFGTLYLTDKTN

SEQ ID NO: 174113 - protein, 14 aa, Mycobacterium tuberculosis
ESFGTLYLTDKTNG

SEQ ID NO: 174114 - protein, 14 aa, Mycobacterium tuberculosis
SFGTLYLTDKTNGQ

SEQ ID NO: 174115 - protein, 14 aa, Mycobacterium tuberculosis
FGTLYLTDKTNGQP

SEQ ID NO: 174116 - protein, 14 aa, Mycobacterium tuberculosis
GTLYLTDKTNGQPF

SEQ ID NO: 174117 - protein, 14 aa, Mycobacterium tuberculosis
TLYLTDKTNGQPFS

SEQ ID NO: 174118 - protein, 14 aa, Mycobacterium tuberculosis
LYLTDKTNGQPFSD

SEQ ID NO: 174119 - protein, 14 aa, Mycobacterium tuberculosis
YLTDKTNGQPFSDD

SEQ ID NO: 174120 - protein, 14 aa, Mycobacterium tuberculosis
LTDKTNGQPFSDDD

SEQ ID NO: 174121 - protein, 14 aa, Mycobacterium tuberculosis
TDKTNGQPFSDDDE

SEQ ID NO: 174122 - protein, 14 aa, Mycobacterium tuberculosis
DKTNGQPFSDDDEV

SEQ ID NO: 174123 - protein, 14 aa, Mycobacterium tuberculosis
KTNGQPFSDDDEVL

SEQ ID NO: 174124 - protein, 14 aa, Mycobacterium tuberculosis
TNGQPFSDDDEVLV

SEQ ID NO: 174125 - protein, 14 aa, Mycobacterium tuberculosis
NGQPFSDDDEVLVQ

SEQ ID NO: 174126 - protein, 14 aa, Mycobacterium tuberculosis
GQPFSDDDEVLVQA

SEQ ID NO: 174127 - protein, 14 aa, Mycobacterium tuberculosis
QPFSDDDEVLVQAL

SEQ ID NO: 174128 - protein, 14 aa, Mycobacterium tuberculosis
PFSDDDEVLVQALA

SEQ ID NO: 174129 - protein, 14 aa, Mycobacterium tuberculosis
FSDDDEVLVQALAA

SEQ ID NO: 174130 - protein, 14 aa, Mycobacterium tuberculosis
SDDDEVLVQALAAA

SEQ ID NO: 174131 - protein, 14 aa, Mycobacterium tuberculosis
DDDEVLVQALAAAA

SEQ ID NO: 174132 - protein, 14 aa, Mycobacterium tuberculosis
DDEVLVQALAAAAG

SEQ ID NO: 174133 - protein, 14 aa, Mycobacterium tuberculosis
DEVLVQALAAAAGI

SEQ ID NO: 174134 - protein, 14 aa, Mycobacterium tuberculosis
EVLVQALAAAAGIA

SEQ ID NO: 174135 - protein, 14 aa, Mycobacterium tuberculosis
VLVQALAAAAGIAV

SEQ ID NO: 174136 - protein, 14 aa, Mycobacterium tuberculosis
LVQALAAAAGIAVA

SEQ ID NO: 174137 - protein, 14 aa, Mycobacterium tuberculosis
VQALAAAAGIAVAN

SEQ ID NO: 174138 - protein, 14 aa, Mycobacterium tuberculosis
QALAAAAGIAVANA

SEQ ID NO: 174139 - protein, 14 aa, Mycobacterium tuberculosis
ALAAAAGIAVANAR

SEQ ID NO: 174140 - protein, 14 aa, Mycobacterium tuberculosis
LAAAAGIAVANARL

SEQ ID NO: 174141 - protein, 14 aa, Mycobacterium tuberculosis
AAAAGIAVANARLY

SEQ ID NO: 174142 - protein, 14 aa, Mycobacterium tuberculosis
AAAGIAVANARLYQ

SEQ ID NO: 174143 - protein, 14 aa, Mycobacterium tuberculosis
AAGIAVANARLYQQ

SEQ ID NO: 174144 - protein, 14 aa, Mycobacterium tuberculosis
AGIAVANARLYQQA

SEQ ID NO: 174145 - protein, 14 aa, Mycobacterium tuberculosis
GIAVANARLYQQAK

SEQ ID NO: 174146 - protein, 14 aa, Mycobacterium tuberculosis
IAVANARLYQQAKA

SEQ ID NO: 174147 - protein, 14 aa, Mycobacterium tuberculosis
AVANARLYQQAKAR

SEQ ID NO: 174148 - protein, 14 aa, Mycobacterium tuberculosis
VANARLYQQAKARQ

SEQ ID NO: 174149 - protein, 14 aa, Mycobacterium tuberculosis
ANARLYQQAKARQS

SEQ ID NO: 174150 - protein, 14 aa, Mycobacterium tuberculosis
NARLYQQAKARQSW

SEQ ID NO: 174151 - protein, 14 aa, Mycobacterium tuberculosis
ARLYQQAKARQSWI

SEQ ID NO: 174152 - protein, 14 aa, Mycobacterium tuberculosis
RLYQQAKARQSWIE

SEQ ID NO: 174153 - protein, 14 aa, Mycobacterium tuberculosis
LYQQAKARQSWIEA

SEQ ID NO: 174154 - protein, 14 aa, Mycobacterium tuberculosis
YQQAKARQSWIEAT

SEQ ID NO: 174155 - protein, 14 aa, Mycobacterium tuberculosis
QQAKARQSWIEATR

SEQ ID NO: 174156 - protein, 14 aa, Mycobacterium tuberculosis
QAKARQSWIEATRD

SEQ ID NO: 174157 - protein, 14 aa, Mycobacterium tuberculosis
AKARQSWIEATRDI

SEQ ID NO: 174158 - protein, 14 aa, Mycobacterium tuberculosis
KARQSWIEATRDIA

SEQ ID NO: 174159 - protein, 14 aa, Mycobacterium tuberculosis
ARQSWIEATRDIAT

SEQ ID NO: 174160 - protein, 14 aa, Mycobacterium tuberculosis
RQSWIEATRDIATE

SEQ ID NO: 174161 - protein, 14 aa, Mycobacterium tuberculosis
QSWIEATRDIATEL

SEQ ID NO: 174162 - protein, 14 aa, Mycobacterium tuberculosis
SWIEATRDIATELL

SEQ ID NO: 174163 - protein, 14 aa, Mycobacterium tuberculosis
WIEATRDIATELLS

SEQ ID NO: 174164 - protein, 14 aa, Mycobacterium tuberculosis
IEATRDIATELLSG

SEQ ID NO: 174165 - protein, 14 aa, Mycobacterium tuberculosis
EATRDIATELLSGT

SEQ ID NO: 174166 - protein, 14 aa, Mycobacterium tuberculosis
ATRDIATELLSGTE

SEQ ID NO: 174167 - protein, 14 aa, Mycobacterium tuberculosis
TRDIATELLSGTEP

SEQ ID NO: 174168 - protein, 14 aa, Mycobacterium tuberculosis
RDIATELLSGTEPA

SEQ ID NO: 174169 - protein, 14 aa, Mycobacterium tuberculosis
DIATELLSGTEPAT

SEQ ID NO: 174170 - protein, 14 aa, Mycobacterium tuberculosis
IATELLSGTEPATV

SEQ ID NO: 174171 - protein, 14 aa, Mycobacterium tuberculosis
ATELLSGTEPATVF

SEQ ID NO: 174172 - protein, 14 aa, Mycobacterium tuberculosis
TELLSGTEPATVFR

SEQ ID NO: 174173 - protein, 14 aa, Mycobacterium tuberculosis
ELLSGTEPATVFRL

SEQ ID NO: 174174 - protein, 14 aa, Mycobacterium tuberculosis
LLSGTEPATVFRLV

SEQ ID NO: 174175 - protein, 14 aa, Mycobacterium tuberculosis
LSGTEPATVFRLVA

SEQ ID NO: 174176 - protein, 14 aa, Mycobacterium tuberculosis
SGTEPATVFRLVAA

SEQ ID NO: 174177 - protein, 14 aa, Mycobacterium tuberculosis
GTEPATVFRLVAAE

SEQ ID NO: 174178 - protein, 14 aa, Mycobacterium tuberculosis
TEPATVFRLVAAEA

SEQ ID NO: 174179 - protein, 14 aa, Mycobacterium tuberculosis
EPATVFRLVAAEAL

SEQ ID NO: 174180 - protein, 14 aa, Mycobacterium tuberculosis
PATVFRLVAAEALK

SEQ ID NO: 174181 - protein, 14 aa, Mycobacterium tuberculosis
ATVFRLVAAEALKL

SEQ ID NO: 174182 - protein, 14 aa, Mycobacterium tuberculosis
TVFRLVAAEALKLT

SEQ ID NO: 174183 - protein, 14 aa, Mycobacterium tuberculosis
VFRLVAAEALKLTA

SEQ ID NO: 174184 - protein, 14 aa, Mycobacterium tuberculosis
FRLVAAEALKLTAA

SEQ ID NO: 174185 - protein, 14 aa, Mycobacterium tuberculosis
RLVAAEALKLTAAD

SEQ ID NO: 174186 - protein, 14 aa, Mycobacterium tuberculosis
LVAAEALKLTAADA

SEQ ID NO: 174187 - protein, 14 aa, Mycobacterium tuberculosis
VAAEALKLTAADAA

SEQ ID NO: 174188 - protein, 14 aa, Mycobacterium tuberculosis
AAEALKLTAADAAL

SEQ ID NO: 174189 - protein, 14 aa, Mycobacterium tuberculosis
AEALKLTAADAALV

SEQ ID NO: 174190 - protein, 14 aa, Mycobacterium tuberculosis
EALKLTAADAALVA

SEQ ID NO: 174191 - protein, 14 aa, Mycobacterium tuberculosis
ALKLTAADAALVAV

SEQ ID NO: 174192 - protein, 14 aa, Mycobacterium tuberculosis
LKLTAADAALVAVP

SEQ ID NO: 174193 - protein, 14 aa, Mycobacterium tuberculosis
KLTAADAALVAVPV

SEQ ID NO: 174194 - protein, 14 aa, Mycobacterium tuberculosis
LTAADAALVAVPVD

SEQ ID NO: 174195 - protein, 14 aa, Mycobacterium tuberculosis
TAADAALVAVPVDE

SEQ ID NO: 174196 - protein, 14 aa, Mycobacterium tuberculosis
AADAALVAVPVDED

SEQ ID NO: 174197 - protein, 14 aa, Mycobacterium tuberculosis
ADAALVAVPVDEDM

SEQ ID NO: 174198 - protein, 14 aa, Mycobacterium tuberculosis
DAALVAVPVDEDMP

SEQ ID NO: 174199 - protein, 14 aa, Mycobacterium tuberculosis
AALVAVPVDEDMPA

SEQ ID NO: 174200 - protein, 14 aa, Mycobacterium tuberculosis
ALVAVPVDEDMPAA

SEQ ID NO: 174201 - protein, 14 aa, Mycobacterium tuberculosis
LVAVPVDEDMPAAD

SEQ ID NO: 174202 - protein, 14 aa, Mycobacterium tuberculosis
VAVPVDEDMPAADV

SEQ ID NO: 174203 - protein, 14 aa, Mycobacterium tuberculosis
AVPVDEDMPAADVG

SEQ ID NO: 174204 - protein, 14 aa, Mycobacterium tuberculosis
VPVDEDMPAADVGE

SEQ ID NO: 174205 - protein, 14 aa, Mycobacterium tuberculosis
PVDEDMPAADVGEL

SEQ ID NO: 174206 - protein, 14 aa, Mycobacterium tuberculosis
VDEDMPAADVGELL

SEQ ID NO: 174207 - protein, 14 aa, Mycobacterium tuberculosis
DEDMPAADVGELLV

SEQ ID NO: 174208 - protein, 14 aa, Mycobacterium tuberculosis
EDMPAADVGELLVI

SEQ ID NO: 174209 - protein, 14 aa, Mycobacterium tuberculosis
DMPAADVGELLVIE

SEQ ID NO: 174210 - protein, 14 aa, Mycobacterium tuberculosis
MPAADVGELLVIET

SEQ ID NO: 174211 - protein, 14 aa, Mycobacterium tuberculosis
PAADVGELLVIETV

SEQ ID NO: 174212 - protein, 14 aa, Mycobacterium tuberculosis
AADVGELLVIETVG

SEQ ID NO: 174213 - protein, 14 aa, Mycobacterium tuberculosis
ADVGELLVIETVGS

SEQ ID NO: 174214 - protein, 14 aa, Mycobacterium tuberculosis
DVGELLVIETVGSA

SEQ ID NO: 174215 - protein, 14 aa, Mycobacterium tuberculosis
VGELLVIETVGSAV

SEQ ID NO: 174216 - protein, 14 aa, Mycobacterium tuberculosis
GELLVIETVGSAVA

SEQ ID NO: 174217 - protein, 14 aa, Mycobacterium tuberculosis
ELLVIETVGSAVAS

SEQ ID NO: 174218 - protein, 14 aa, Mycobacterium tuberculosis
LLVIETVGSAVASI

SEQ ID NO: 174219 - protein, 14 aa, Mycobacterium tuberculosis
LVIETVGSAVASIV

SEQ ID NO: 174220 - protein, 14 aa, Mycobacterium tuberculosis
VIETVGSAVASIVG

SEQ ID NO: 174221 - protein, 14 aa, Mycobacterium tuberculosis
IETVGSAVASIVGR

SEQ ID NO: 174222 - protein, 14 aa, Mycobacterium tuberculosis
ETVGSAVASIVGRT

SEQ ID NO: 174223 - protein, 14 aa, Mycobacterium tuberculosis
TVGSAVASIVGRTI

SEQ ID NO: 174224 - protein, 14 aa, Mycobacterium tuberculosis
VGSAVASIVGRTIP

SEQ ID NO: 174225 - protein, 14 aa, Mycobacterium tuberculosis
GSAVASIVGRTIPV

SEQ ID NO: 174226 - protein, 14 aa, Mycobacterium tuberculosis
SAVASIVGRTIPVA

SEQ ID NO: 174227 - protein, 14 aa, Mycobacterium tuberculosis
AVASIVGRTIPVAG

SEQ ID NO: 174228 - protein, 14 aa, Mycobacterium tuberculosis
VASIVGRTIPVAGA

SEQ ID NO: 174229 - protein, 14 aa, Mycobacterium tuberculosis
ASIVGRTIPVAGAV

SEQ ID NO: 174230 - protein, 14 aa, Mycobacterium tuberculosis
SIVGRTIPVAGAVL

SEQ ID NO: 174231 - protein, 14 aa, Mycobacterium tuberculosis
IVGRTIPVAGAVLR

SEQ ID NO: 174232 - protein, 14 aa, Mycobacterium tuberculosis
VGRTIPVAGAVLRE

SEQ ID NO: 174233 - protein, 14 aa, Mycobacterium tuberculosis
GRTIPVAGAVLREV

SEQ ID NO: 174234 - protein, 14 aa, Mycobacterium tuberculosis
RTIPVAGAVLREVF

SEQ ID NO: 174235 - protein, 14 aa, Mycobacterium tuberculosis
TIPVAGAVLREVFV

SEQ ID NO: 174236 - protein, 14 aa, Mycobacterium tuberculosis
IPVAGAVLREVFVN

SEQ ID NO: 174237 - protein, 14 aa, Mycobacterium tuberculosis
PVAGAVLREVFVNG

SEQ ID NO: 174238 - protein, 14 aa, Mycobacterium tuberculosis
VAGAVLREVFVNGI

SEQ ID NO: 174239 - protein, 14 aa, Mycobacterium tuberculosis
AGAVLREVFVNGIP

SEQ ID NO: 174240 - protein, 14 aa, Mycobacterium tuberculosis
GAVLREVFVNGIPR

SEQ ID NO: 174241 - protein, 14 aa, Mycobacterium tuberculosis
AVLREVFVNGIPRR

SEQ ID NO: 174242 - protein, 14 aa, Mycobacterium tuberculosis
VLREVFVNGIPRRV

SEQ ID NO: 174243 - protein, 14 aa, Mycobacterium tuberculosis
LREVFVNGIPRRVD

SEQ ID NO: 174244 - protein, 14 aa, Mycobacterium tuberculosis
REVFVNGIPRRVDR

SEQ ID NO: 174245 - protein, 14 aa, Mycobacterium tuberculosis
EVFVNGIPRRVDRV

SEQ ID NO: 174246 - protein, 14 aa, Mycobacterium tuberculosis
VFVNGIPRRVDRVD

SEQ ID NO: 174247 - protein, 14 aa, Mycobacterium tuberculosis
FVNGIPRRVDRVDL

SEQ ID NO: 174248 - protein, 14 aa, Mycobacterium tuberculosis
VNGIPRRVDRVDLE

SEQ ID NO: 174249 - protein, 14 aa, Mycobacterium tuberculosis
NGIPRRVDRVDLEG

SEQ ID NO: 174250 - protein, 14 aa, Mycobacterium tuberculosis
GIPRRVDRVDLEGL

SEQ ID NO: 174251 - protein, 14 aa, Mycobacterium tuberculosis
IPRRVDRVDLEGLD

SEQ ID NO: 174252 - protein, 14 aa, Mycobacterium tuberculosis
PRRVDRVDLEGLDE

SEQ ID NO: 174253 - protein, 14 aa, Mycobacterium tuberculosis
RRVDRVDLEGLDEL

SEQ ID NO: 174254 - protein, 14 aa, Mycobacterium tuberculosis
RVDRVDLEGLDELA

SEQ ID NO: 174255 - protein, 14 aa, Mycobacterium tuberculosis
VDRVDLEGLDELAD

SEQ ID NO: 174256 - protein, 14 aa, Mycobacterium tuberculosis
DRVDLEGLDELADA

SEQ ID NO: 174257 - protein, 14 aa, Mycobacterium tuberculosis
RVDLEGLDELADAG

SEQ ID NO: 174258 - protein, 14 aa, Mycobacterium tuberculosis
VDLEGLDELADAGP

SEQ ID NO: 174259 - protein, 14 aa, Mycobacterium tuberculosis
DLEGLDELADAGPA

SEQ ID NO: 174260 - protein, 14 aa, Mycobacterium tuberculosis
LEGLDELADAGPAL

SEQ ID NO: 174261 - protein, 14 aa, Mycobacterium tuberculosis
EGLDELADAGPALL

SEQ ID NO: 174262 - protein, 14 aa, Mycobacterium tuberculosis
GLDELADAGPALLL

SEQ ID NO: 174263 - protein, 14 aa, Mycobacterium tuberculosis
LDELADAGPALLLP

SEQ ID NO: 174264 - protein, 14 aa, Mycobacterium tuberculosis
DELADAGPALLLPL

SEQ ID NO: 174265 - protein, 14 aa, Mycobacterium tuberculosis
ELADAGPALLLPLR

SEQ ID NO: 174266 - protein, 14 aa, Mycobacterium tuberculosis
LADAGPALLLPLRA

SEQ ID NO: 174267 - protein, 14 aa, Mycobacterium tuberculosis
ADAGPALLLPLRAR

SEQ ID NO: 174268 - protein, 14 aa, Mycobacterium tuberculosis
DAGPALLLPLRARG

SEQ ID NO: 174269 - protein, 14 aa, Mycobacterium tuberculosis
AGPALLLPLRARGT

SEQ ID NO: 174270 - protein, 14 aa, Mycobacterium tuberculosis
GPALLLPLRARGTV

SEQ ID NO: 174271 - protein, 14 aa, Mycobacterium tuberculosis
PALLLPLRARGTVA

SEQ ID NO: 174272 - protein, 14 aa, Mycobacterium tuberculosis
ALLLPLRARGTVAG

SEQ ID NO: 174273 - protein, 14 aa, Mycobacterium tuberculosis
LLLPLRARGTVAGV

SEQ ID NO: 174274 - protein, 14 aa, Mycobacterium tuberculosis
LLPLRARGTVAGVV

SEQ ID NO: 174275 - protein, 14 aa, Mycobacterium tuberculosis
LPLRARGTVAGVVV

SEQ ID NO: 174276 - protein, 14 aa, Mycobacterium tuberculosis
PLRARGTVAGVVVV

SEQ ID NO: 174277 - protein, 14 aa, Mycobacterium tuberculosis
LRARGTVAGVVVVL

SEQ ID NO: 174278 - protein, 14 aa, Mycobacterium tuberculosis
RARGTVAGVVVVLS

SEQ ID NO: 174279 - protein, 14 aa, Mycobacterium tuberculosis
ARGTVAGVVVVLSQ

SEQ ID NO: 174280 - protein, 14 aa, Mycobacterium tuberculosis
RGTVAGVVVVLSQG

SEQ ID NO: 174281 - protein, 14 aa, Mycobacterium tuberculosis
GTVAGVVVVLSQGG

SEQ ID NO: 174282 - protein, 14 aa, Mycobacterium tuberculosis
TVAGVVVVLSQGGP

SEQ ID NO: 174283 - protein, 14 aa, Mycobacterium tuberculosis
VAGVVVVLSQGGPG

SEQ ID NO: 174284 - protein, 14 aa, Mycobacterium tuberculosis
AGVVVVLSQGGPGA

SEQ ID NO: 174285 - protein, 14 aa, Mycobacterium tuberculosis
GVVVVLSQGGPGAF

SEQ ID NO: 174286 - protein, 14 aa, Mycobacterium tuberculosis
VVVVLSQGGPGAFT

SEQ ID NO: 174287 - protein, 14 aa, Mycobacterium tuberculosis
VVVLSQGGPGAFTD

SEQ ID NO: 174288 - protein, 14 aa, Mycobacterium tuberculosis
VVLSQGGPGAFTDE

SEQ ID NO: 174289 - protein, 14 aa, Mycobacterium tuberculosis
VLSQGGPGAFTDEQ

SEQ ID NO: 174290 - protein, 14 aa, Mycobacterium tuberculosis
LSQGGPGAFTDEQL

SEQ ID NO: 174291 - protein, 14 aa, Mycobacterium tuberculosis
SQGGPGAFTDEQLE

SEQ ID NO: 174292 - protein, 14 aa, Mycobacterium tuberculosis
QGGPGAFTDEQLEM

SEQ ID NO: 174293 - protein, 14 aa, Mycobacterium tuberculosis
GGPGAFTDEQLEMM

SEQ ID NO: 174294 - protein, 14 aa, Mycobacterium tuberculosis
GPGAFTDEQLEMMA

SEQ ID NO: 174295 - protein, 14 aa, Mycobacterium tuberculosis
PGAFTDEQLEMMAA

SEQ ID NO: 174296 - protein, 14 aa, Mycobacterium tuberculosis
GAFTDEQLEMMAAF

SEQ ID NO: 174297 - protein, 14 aa, Mycobacterium tuberculosis
AFTDEQLEMMAAFA

SEQ ID NO: 174298 - protein, 14 aa, Mycobacterium tuberculosis
FTDEQLEMMAAFAD

SEQ ID NO: 174299 - protein, 14 aa, Mycobacterium tuberculosis
TDEQLEMMAAFADQ

SEQ ID NO: 174300 - protein, 14 aa, Mycobacterium tuberculosis
DEQLEMMAAFADQA

SEQ ID NO: 174301 - protein, 14 aa, Mycobacterium tuberculosis
EQLEMMAAFADQAA

SEQ ID NO: 174302 - protein, 14 aa, Mycobacterium tuberculosis
QLEMMAAFADQAAL

SEQ ID NO: 174303 - protein, 14 aa, Mycobacterium tuberculosis
LEMMAAFADQAALA

SEQ ID NO: 174304 - protein, 14 aa, Mycobacterium tuberculosis
EMMAAFADQAALAW

SEQ ID NO: 174305 - protein, 14 aa, Mycobacterium tuberculosis
MMAAFADQAALAWQ

SEQ ID NO: 174306 - protein, 14 aa, Mycobacterium tuberculosis
MAAFADQAALAWQL

SEQ ID NO: 174307 - protein, 14 aa, Mycobacterium tuberculosis
AAFADQAALAWQLA

SEQ ID NO: 174308 - protein, 14 aa, Mycobacterium tuberculosis
AFADQAALAWQLAT

SEQ ID NO: 174309 - protein, 14 aa, Mycobacterium tuberculosis
FADQAALAWQLATS

SEQ ID NO: 174310 - protein, 14 aa, Mycobacterium tuberculosis
ADQAALAWQLATSQ

SEQ ID NO: 174311 - protein, 14 aa, Mycobacterium tuberculosis
DQAALAWQLATSQR

SEQ ID NO: 174312 - protein, 14 aa, Mycobacterium tuberculosis
QAALAWQLATSQRR

SEQ ID NO: 174313 - protein, 14 aa, Mycobacterium tuberculosis
AALAWQLATSQRRM

SEQ ID NO: 174314 - protein, 14 aa, Mycobacterium tuberculosis
ALAWQLATSQRRMR

SEQ ID NO: 174315 - protein, 14 aa, Mycobacterium tuberculosis
LAWQLATSQRRMRE

SEQ ID NO: 174316 - protein, 14 aa, Mycobacterium tuberculosis
AWQLATSQRRMREL

SEQ ID NO: 174317 - protein, 14 aa, Mycobacterium tuberculosis
WQLATSQRRMRELD

SEQ ID NO: 174318 - protein, 14 aa, Mycobacterium tuberculosis
QLATSQRRMRELDV

SEQ ID NO: 174319 - protein, 14 aa, Mycobacterium tuberculosis
LATSQRRMRELDVL

SEQ ID NO: 174320 - protein, 14 aa, Mycobacterium tuberculosis
ATSQRRMRELDVLT

SEQ ID NO: 174321 - protein, 14 aa, Mycobacterium tuberculosis
TSQRRMRELDVLTD

SEQ ID NO: 174322 - protein, 14 aa, Mycobacterium tuberculosis
SQRRMRELDVLTDR

SEQ ID NO: 174323 - protein, 14 aa, Mycobacterium tuberculosis
QRRMRELDVLTDRD

SEQ ID NO: 174324 - protein, 14 aa, Mycobacterium tuberculosis
RRMRELDVLTDRDR

SEQ ID NO: 174325 - protein, 14 aa, Mycobacterium tuberculosis
RMRELDVLTDRDRI

SEQ ID NO: 174326 - protein, 14 aa, Mycobacterium tuberculosis
MRELDVLTDRDRIA

SEQ ID NO: 174327 - protein, 14 aa, Mycobacterium tuberculosis
RELDVLTDRDRIAR

SEQ ID NO: 174328 - protein, 14 aa, Mycobacterium tuberculosis
ELDVLTDRDRIARD

SEQ ID NO: 174329 - protein, 14 aa, Mycobacterium tuberculosis
LDVLTDRDRIARDL

SEQ ID NO: 174330 - protein, 14 aa, Mycobacterium tuberculosis
DVLTDRDRIARDLH

SEQ ID NO: 174331 - protein, 14 aa, Mycobacterium tuberculosis
VLTDRDRIARDLHD

SEQ ID NO: 174332 - protein, 14 aa, Mycobacterium tuberculosis
LTDRDRIARDLHDH

SEQ ID NO: 174333 - protein, 14 aa, Mycobacterium tuberculosis
TDRDRIARDLHDHV

SEQ ID NO: 174334 - protein, 14 aa, Mycobacterium tuberculosis
DRDRIARDLHDHVI

SEQ ID NO: 174335 - protein, 14 aa, Mycobacterium tuberculosis
RDRIARDLHDHVIQ

SEQ ID NO: 174336 - protein, 14 aa, Mycobacterium tuberculosis
DRIARDLHDHVIQR

SEQ ID NO: 174337 - protein, 14 aa, Mycobacterium tuberculosis
RIARDLHDHVIQRL

SEQ ID NO: 174338 - protein, 14 aa, Mycobacterium tuberculosis
IARDLHDHVIQRLF

SEQ ID NO: 174339 - protein, 14 aa, Mycobacterium tuberculosis
ARDLHDHVIQRLFA

SEQ ID NO: 174340 - protein, 14 aa, Mycobacterium tuberculosis
RDLHDHVIQRLFAI

SEQ ID NO: 174341 - protein, 14 aa, Mycobacterium tuberculosis
DLHDHVIQRLFAIG

SEQ ID NO: 174342 - protein, 14 aa, Mycobacterium tuberculosis
LHDHVIQRLFAIGL

SEQ ID NO: 174343 - protein, 14 aa, Mycobacterium tuberculosis
HDHVIQRLFAIGLA

SEQ ID NO: 174344 - protein, 14 aa, Mycobacterium tuberculosis
DHVIQRLFAIGLAL

SEQ ID NO: 174345 - protein, 14 aa, Mycobacterium tuberculosis
HVIQRLFAIGLALQ

SEQ ID NO: 174346 - protein, 14 aa, Mycobacterium tuberculosis
VIQRLFAIGLALQG

SEQ ID NO: 174347 - protein, 14 aa, Mycobacterium tuberculosis
IQRLFAIGLALQGA

SEQ ID NO: 174348 - protein, 14 aa, Mycobacterium tuberculosis
QRLFAIGLALQGAV

SEQ ID NO: 174349 - protein, 14 aa, Mycobacterium tuberculosis
RLFAIGLALQGAVP

SEQ ID NO: 174350 - protein, 14 aa, Mycobacterium tuberculosis
LFAIGLALQGAVPH

SEQ ID NO: 174351 - protein, 14 aa, Mycobacterium tuberculosis
FAIGLALQGAVPHE

SEQ ID NO: 174352 - protein, 14 aa, Mycobacterium tuberculosis
AIGLALQGAVPHER

SEQ ID NO: 174353 - protein, 14 aa, Mycobacterium tuberculosis
IGLALQGAVPHERN

SEQ ID NO: 174354 - protein, 14 aa, Mycobacterium tuberculosis
GLALQGAVPHERNP

SEQ ID NO: 174355 - protein, 14 aa, Mycobacterium tuberculosis
LALQGAVPHERNPE

SEQ ID NO: 174356 - protein, 14 aa, Mycobacterium tuberculosis
ALQGAVPHERNPEV

SEQ ID NO: 174357 - protein, 14 aa, Mycobacterium tuberculosis
LQGAVPHERNPEVQ

SEQ ID NO: 174358 - protein, 14 aa, Mycobacterium tuberculosis
QGAVPHERNPEVQQ

SEQ ID NO: 174359 - protein, 14 aa, Mycobacterium tuberculosis
GAVPHERNPEVQQR

SEQ ID NO: 174360 - protein, 14 aa, Mycobacterium tuberculosis
AVPHERNPEVQQRL

SEQ ID NO: 174361 - protein, 14 aa, Mycobacterium tuberculosis
VPHERNPEVQQRLS

SEQ ID NO: 174362 - protein, 14 aa, Mycobacterium tuberculosis
PHERNPEVQQRLSD

SEQ ID NO: 174363 - protein, 14 aa, Mycobacterium tuberculosis
HERNPEVQQRLSDV

SEQ ID NO: 174364 - protein, 14 aa, Mycobacterium tuberculosis
ERNPEVQQRLSDVV

SEQ ID NO: 174365 - protein, 14 aa, Mycobacterium tuberculosis
RNPEVQQRLSDVVD

SEQ ID NO: 174366 - protein, 14 aa, Mycobacterium tuberculosis
NPEVQQRLSDVVDD

SEQ ID NO: 174367 - protein, 14 aa, Mycobacterium tuberculosis
PEVQQRLSDVVDDL

SEQ ID NO: 174368 - protein, 14 aa, Mycobacterium tuberculosis
EVQQRLSDVVDDLQ

SEQ ID NO: 174369 - protein, 14 aa, Mycobacterium tuberculosis
VQQRLSDVVDDLQD

SEQ ID NO: 174370 - protein, 14 aa, Mycobacterium tuberculosis
QQRLSDVVDDLQDV

SEQ ID NO: 174371 - protein, 14 aa, Mycobacterium tuberculosis
QRLSDVVDDLQDVI

SEQ ID NO: 174372 - protein, 14 aa, Mycobacterium tuberculosis
RLSDVVDDLQDVIQ

SEQ ID NO: 174373 - protein, 14 aa, Mycobacterium tuberculosis
LSDVVDDLQDVIQE

SEQ ID NO: 174374 - protein, 14 aa, Mycobacterium tuberculosis
SDVVDDLQDVIQEI

SEQ ID NO: 174375 - protein, 14 aa, Mycobacterium tuberculosis
DVVDDLQDVIQEIR

SEQ ID NO: 174376 - protein, 14 aa, Mycobacterium tuberculosis
VVDDLQDVIQEIRT

SEQ ID NO: 174377 - protein, 14 aa, Mycobacterium tuberculosis
VDDLQDVIQEIRTT

SEQ ID NO: 174378 - protein, 14 aa, Mycobacterium tuberculosis
DDLQDVIQEIRTTI

SEQ ID NO: 174379 - protein, 14 aa, Mycobacterium tuberculosis
DLQDVIQEIRTTIY

SEQ ID NO: 174380 - protein, 14 aa, Mycobacterium tuberculosis
LQDVIQEIRTTIYD

SEQ ID NO: 174381 - protein, 14 aa, Mycobacterium tuberculosis
QDVIQEIRTTIYDL

SEQ ID NO: 174382 - protein, 14 aa, Mycobacterium tuberculosis
DVIQEIRTTIYDLH

SEQ ID NO: 174383 - protein, 14 aa, Mycobacterium tuberculosis
VIQEIRTTIYDLHG

SEQ ID NO: 174384 - protein, 14 aa, Mycobacterium tuberculosis
IQEIRTTIYDLHGA

SEQ ID NO: 174385 - protein, 14 aa, Mycobacterium tuberculosis
QEIRTTIYDLHGAS

SEQ ID NO: 174386 - protein, 14 aa, Mycobacterium tuberculosis
EIRTTIYDLHGASQ

SEQ ID NO: 174387 - protein, 14 aa, Mycobacterium tuberculosis
IRTTIYDLHGASQG

SEQ ID NO: 174388 - protein, 14 aa, Mycobacterium tuberculosis
RTTIYDLHGASQGI

SEQ ID NO: 174389 - protein, 14 aa, Mycobacterium tuberculosis
TTIYDLHGASQGIT

SEQ ID NO: 174390 - protein, 14 aa, Mycobacterium tuberculosis
TIYDLHGASQGITR

SEQ ID NO: 174391 - protein, 14 aa, Mycobacterium tuberculosis
IYDLHGASQGITRL

SEQ ID NO: 174392 - protein, 14 aa, Mycobacterium tuberculosis
YDLHGASQGITRLR

SEQ ID NO: 174393 - protein, 14 aa, Mycobacterium tuberculosis
DLHGASQGITRLRQ

SEQ ID NO: 174394 - protein, 14 aa, Mycobacterium tuberculosis
LHGASQGITRLRQR

SEQ ID NO: 174395 - protein, 14 aa, Mycobacterium tuberculosis
HGASQGITRLRQRI

SEQ ID NO: 174396 - protein, 14 aa, Mycobacterium tuberculosis
GASQGITRLRQRID

SEQ ID NO: 174397 - protein, 14 aa, Mycobacterium tuberculosis
ASQGITRLRQRIDA

SEQ ID NO: 174398 - protein, 14 aa, Mycobacterium tuberculosis
SQGITRLRQRIDAA

SEQ ID NO: 174399 - protein, 14 aa, Mycobacterium tuberculosis
QGITRLRQRIDAAV

SEQ ID NO: 174400 - protein, 14 aa, Mycobacterium tuberculosis
GITRLRQRIDAAVA

SEQ ID NO: 174401 - protein, 14 aa, Mycobacterium tuberculosis
ITRLRQRIDAAVAQ

SEQ ID NO: 174402 - protein, 14 aa, Mycobacterium tuberculosis
TRLRQRIDAAVAQF

SEQ ID NO: 174403 - protein, 14 aa, Mycobacterium tuberculosis
RLRQRIDAAVAQFA

SEQ ID NO: 174404 - protein, 14 aa, Mycobacterium tuberculosis
LRQRIDAAVAQFAD

SEQ ID NO: 174405 - protein, 14 aa, Mycobacterium tuberculosis
RQRIDAAVAQFADS

SEQ ID NO: 174406 - protein, 14 aa, Mycobacterium tuberculosis
QRIDAAVAQFADSG

SEQ ID NO: 174407 - protein, 14 aa, Mycobacterium tuberculosis
RIDAAVAQFADSGL

SEQ ID NO: 174408 - protein, 14 aa, Mycobacterium tuberculosis
IDAAVAQFADSGLR

SEQ ID NO: 174409 - protein, 14 aa, Mycobacterium tuberculosis
DAAVAQFADSGLRT

SEQ ID NO: 174410 - protein, 14 aa, Mycobacterium tuberculosis
AAVAQFADSGLRTS

SEQ ID NO: 174411 - protein, 14 aa, Mycobacterium tuberculosis
AVAQFADSGLRTSV

SEQ ID NO: 174412 - protein, 14 aa, Mycobacterium tuberculosis
VAQFADSGLRTSVQ

SEQ ID NO: 174413 - protein, 14 aa, Mycobacterium tuberculosis
AQFADSGLRTSVQF

SEQ ID NO: 174414 - protein, 14 aa, Mycobacterium tuberculosis
QFADSGLRTSVQFV

SEQ ID NO: 174415 - protein, 14 aa, Mycobacterium tuberculosis
FADSGLRTSVQFVG

SEQ ID NO: 174416 - protein, 14 aa, Mycobacterium tuberculosis
ADSGLRTSVQFVGP

SEQ ID NO: 174417 - protein, 14 aa, Mycobacterium tuberculosis
DSGLRTSVQFVGPL

SEQ ID NO: 174418 - protein, 14 aa, Mycobacterium tuberculosis
SGLRTSVQFVGPLS

SEQ ID NO: 174419 - protein, 14 aa, Mycobacterium tuberculosis
GLRTSVQFVGPLSV

SEQ ID NO: 174420 - protein, 14 aa, Mycobacterium tuberculosis
LRTSVQFVGPLSVV

SEQ ID NO: 174421 - protein, 14 aa, Mycobacterium tuberculosis
RTSVQFVGPLSVVD

SEQ ID NO: 174422 - protein, 14 aa, Mycobacterium tuberculosis
TSVQFVGPLSVVDS

SEQ ID NO: 174423 - protein, 14 aa, Mycobacterium tuberculosis
SVQFVGPLSVVDSA

SEQ ID NO: 174424 - protein, 14 aa, Mycobacterium tuberculosis
VQFVGPLSVVDSAL

SEQ ID NO: 174425 - protein, 14 aa, Mycobacterium tuberculosis
QFVGPLSVVDSALA

SEQ ID NO: 174426 - protein, 14 aa, Mycobacterium tuberculosis
FVGPLSVVDSALAD

SEQ ID NO: 174427 - protein, 14 aa, Mycobacterium tuberculosis
VGPLSVVDSALADQ

SEQ ID NO: 174428 - protein, 14 aa, Mycobacterium tuberculosis
GPLSVVDSALADQA

SEQ ID NO: 174429 - protein, 14 aa, Mycobacterium tuberculosis
PLSVVDSALADQAE

SEQ ID NO: 174430 - protein, 14 aa, Mycobacterium tuberculosis
LSVVDSALADQAEA

SEQ ID NO: 174431 - protein, 14 aa, Mycobacterium tuberculosis
SVVDSALADQAEAV

SEQ ID NO: 174432 - protein, 14 aa, Mycobacterium tuberculosis
VVDSALADQAEAVV

SEQ ID NO: 174433 - protein, 14 aa, Mycobacterium tuberculosis
VDSALADQAEAVVR

SEQ ID NO: 174434 - protein, 14 aa, Mycobacterium tuberculosis
DSALADQAEAVVRE

SEQ ID NO: 174435 - protein, 14 aa, Mycobacterium tuberculosis
SALADQAEAVVREA

SEQ ID NO: 174436 - protein, 14 aa, Mycobacterium tuberculosis
ALADQAEAVVREAV

SEQ ID NO: 174437 - protein, 14 aa, Mycobacterium tuberculosis
LADQAEAVVREAVS

SEQ ID NO: 174438 - protein, 14 aa, Mycobacterium tuberculosis
ADQAEAVVREAVSN

SEQ ID NO: 174439 - protein, 14 aa, Mycobacterium tuberculosis
DQAEAVVREAVSNA

SEQ ID NO: 174440 - protein, 14 aa, Mycobacterium tuberculosis
QAEAVVREAVSNAV

SEQ ID NO: 174441 - protein, 14 aa, Mycobacterium tuberculosis
AEAVVREAVSNAVR

SEQ ID NO: 174442 - protein, 14 aa, Mycobacterium tuberculosis
EAVVREAVSNAVRH

SEQ ID NO: 174443 - protein, 14 aa, Mycobacterium tuberculosis
AVVREAVSNAVRHA

SEQ ID NO: 174444 - protein, 14 aa, Mycobacterium tuberculosis
VVREAVSNAVRHAK

SEQ ID NO: 174445 - protein, 14 aa, Mycobacterium tuberculosis
VREAVSNAVRHAKA

SEQ ID NO: 174446 - protein, 14 aa, Mycobacterium tuberculosis
REAVSNAVRHAKAS

SEQ ID NO: 174447 - protein, 14 aa, Mycobacterium tuberculosis
EAVSNAVRHAKAST

SEQ ID NO: 174448 - protein, 14 aa, Mycobacterium tuberculosis
AVSNAVRHAKASTL

SEQ ID NO: 174449 - protein, 14 aa, Mycobacterium tuberculosis
VSNAVRHAKASTLT

SEQ ID NO: 174450 - protein, 14 aa, Mycobacterium tuberculosis
SNAVRHAKASTLTV

SEQ ID NO: 174451 - protein, 14 aa, Mycobacterium tuberculosis
NAVRHAKASTLTVR

SEQ ID NO: 174452 - protein, 14 aa, Mycobacterium tuberculosis
AVRHAKASTLTVRV

SEQ ID NO: 174453 - protein, 14 aa, Mycobacterium tuberculosis
VRHAKASTLTVRVK

SEQ ID NO: 174454 - protein, 14 aa, Mycobacterium tuberculosis
RHAKASTLTVRVKV

SEQ ID NO: 174455 - protein, 14 aa, Mycobacterium tuberculosis
HAKASTLTVRVKVD

SEQ ID NO: 174456 - protein, 14 aa, Mycobacterium tuberculosis
AKASTLTVRVKVDD

SEQ ID NO: 174457 - protein, 14 aa, Mycobacterium tuberculosis
KASTLTVRVKVDDD

SEQ ID NO: 174458 - protein, 14 aa, Mycobacterium tuberculosis
ASTLTVRVKVDDDL

SEQ ID NO: 174459 - protein, 14 aa, Mycobacterium tuberculosis
STLTVRVKVDDDLC

SEQ ID NO: 174460 - protein, 14 aa, Mycobacterium tuberculosis
TLTVRVKVDDDLCI

SEQ ID NO: 174461 - protein, 14 aa, Mycobacterium tuberculosis
LTVRVKVDDDLCIE

SEQ ID NO: 174462 - protein, 14 aa, Mycobacterium tuberculosis
TVRVKVDDDLCIEV

SEQ ID NO: 174463 - protein, 14 aa, Mycobacterium tuberculosis
VRVKVDDDLCIEVT

SEQ ID NO: 174464 - protein, 14 aa, Mycobacterium tuberculosis
RVKVDDDLCIEVTD

SEQ ID NO: 174465 - protein, 14 aa, Mycobacterium tuberculosis
VKVDDDLCIEVTDN

SEQ ID NO: 174466 - protein, 14 aa, Mycobacterium tuberculosis
KVDDDLCIEVTDNG

SEQ ID NO: 174467 - protein, 14 aa, Mycobacterium tuberculosis
VDDDLCIEVTDNGR

SEQ ID NO: 174468 - protein, 14 aa, Mycobacterium tuberculosis
DDDLCIEVTDNGRG

SEQ ID NO: 174469 - protein, 14 aa, Mycobacterium tuberculosis
DDLCIEVTDNGRGL

SEQ ID NO: 174470 - protein, 14 aa, Mycobacterium tuberculosis
DLCIEVTDNGRGLP

SEQ ID NO: 174471 - protein, 14 aa, Mycobacterium tuberculosis
LCIEVTDNGRGLPD

SEQ ID NO: 174472 - protein, 14 aa, Mycobacterium tuberculosis
CIEVTDNGRGLPDE

SEQ ID NO: 174473 - protein, 14 aa, Mycobacterium tuberculosis
IEVTDNGRGLPDEF

SEQ ID NO: 174474 - protein, 14 aa, Mycobacterium tuberculosis
EVTDNGRGLPDEFT

SEQ ID NO: 174475 - protein, 14 aa, Mycobacterium tuberculosis
VTDNGRGLPDEFTG

SEQ ID NO: 174476 - protein, 14 aa, Mycobacterium tuberculosis
TDNGRGLPDEFTGS

SEQ ID NO: 174477 - protein, 14 aa, Mycobacterium tuberculosis
DNGRGLPDEFTGSG

SEQ ID NO: 174478 - protein, 14 aa, Mycobacterium tuberculosis
NGRGLPDEFTGSGL

SEQ ID NO: 174479 - protein, 14 aa, Mycobacterium tuberculosis
GRGLPDEFTGSGLT

SEQ ID NO: 174480 - protein, 14 aa, Mycobacterium tuberculosis
RGLPDEFTGSGLTN

SEQ ID NO: 174481 - protein, 14 aa, Mycobacterium tuberculosis
GLPDEFTGSGLTNL

SEQ ID NO: 174482 - protein, 14 aa, Mycobacterium tuberculosis
LPDEFTGSGLTNLR

SEQ ID NO: 174483 - protein, 14 aa, Mycobacterium tuberculosis
PDEFTGSGLTNLRQ

SEQ ID NO: 174484 - protein, 14 aa, Mycobacterium tuberculosis
DEFTGSGLTNLRQR

SEQ ID NO: 174485 - protein, 14 aa, Mycobacterium tuberculosis
EFTGSGLTNLRQRA

SEQ ID NO: 174486 - protein, 14 aa, Mycobacterium tuberculosis
FTGSGLTNLRQRAE

SEQ ID NO: 174487 - protein, 14 aa, Mycobacterium tuberculosis
TGSGLTNLRQRAEQ

SEQ ID NO: 174488 - protein, 14 aa, Mycobacterium tuberculosis
GSGLTNLRQRAEQA

SEQ ID NO: 174489 - protein, 14 aa, Mycobacterium tuberculosis
SGLTNLRQRAEQAG

SEQ ID NO: 174490 - protein, 14 aa, Mycobacterium tuberculosis
GLTNLRQRAEQAGG

SEQ ID NO: 174491 - protein, 14 aa, Mycobacterium tuberculosis
LTNLRQRAEQAGGE

SEQ ID NO: 174492 - protein, 14 aa, Mycobacterium tuberculosis
TNLRQRAEQAGGEF

SEQ ID NO: 174493 - protein, 14 aa, Mycobacterium tuberculosis
NLRQRAEQAGGEFT

SEQ ID NO: 174494 - protein, 14 aa, Mycobacterium tuberculosis
LRQRAEQAGGEFTL

SEQ ID NO: 174495 - protein, 14 aa, Mycobacterium tuberculosis
RQRAEQAGGEFTLA

SEQ ID NO: 174496 - protein, 14 aa, Mycobacterium tuberculosis
QRAEQAGGEFTLAS

SEQ ID NO: 174497 - protein, 14 aa, Mycobacterium tuberculosis
RAEQAGGEFTLASV

SEQ ID NO: 174498 - protein, 14 aa, Mycobacterium tuberculosis
AEQAGGEFTLASVP

SEQ ID NO: 174499 - protein, 14 aa, Mycobacterium tuberculosis
EQAGGEFTLASVPG

SEQ ID NO: 174500 - protein, 14 aa, Mycobacterium tuberculosis
QAGGEFTLASVPGA

SEQ ID NO: 174501 - protein, 14 aa, Mycobacterium tuberculosis
AGGEFTLASVPGAS

SEQ ID NO: 174502 - protein, 14 aa, Mycobacterium tuberculosis
GGEFTLASVPGASG

SEQ ID NO: 174503 - protein, 14 aa, Mycobacterium tuberculosis
GEFTLASVPGASGT

SEQ ID NO: 174504 - protein, 14 aa, Mycobacterium tuberculosis
EFTLASVPGASGTV

SEQ ID NO: 174505 - protein, 14 aa, Mycobacterium tuberculosis
FTLASVPGASGTVL

SEQ ID NO: 174506 - protein, 14 aa, Mycobacterium tuberculosis
TLASVPGASGTVLR

SEQ ID NO: 174507 - protein, 14 aa, Mycobacterium tuberculosis
LASVPGASGTVLRW

SEQ ID NO: 174508 - protein, 14 aa, Mycobacterium tuberculosis
ASVPGASGTVLRWS

SEQ ID NO: 174509 - protein, 14 aa, Mycobacterium tuberculosis
SVPGASGTVLRWSA

SEQ ID NO: 174510 - protein, 14 aa, Mycobacterium tuberculosis
VPGASGTVLRWSAP

SEQ ID NO: 174511 - protein, 14 aa, Mycobacterium tuberculosis
PGASGTVLRWSAPL

SEQ ID NO: 174512 - protein, 14 aa, Mycobacterium tuberculosis
GASGTVLRWSAPLS

SEQ ID NO: 174513 - protein, 14 aa, Mycobacterium tuberculosis
ASGTVLRWSAPLSQ

SEQ ID NO: 174514 - protein, 15 aa, Mycobacterium tuberculosis
MTTGGLVDENDGAAM

SEQ ID NO: 174515 - protein, 15 aa, Mycobacterium tuberculosis
TTGGLVDENDGAAMR

SEQ ID NO: 174516 - protein, 15 aa, Mycobacterium tuberculosis
TGGLVDENDGAAMRP

SEQ ID NO: 174517 - protein, 15 aa, Mycobacterium tuberculosis
GGLVDENDGAAMRPL

SEQ ID NO: 174518 - protein, 15 aa, Mycobacterium tuberculosis
GLVDENDGAAMRPLR

SEQ ID NO: 174519 - protein, 15 aa, Mycobacterium tuberculosis
LVDENDGAAMRPLRH

SEQ ID NO: 174520 - protein, 15 aa, Mycobacterium tuberculosis
VDENDGAAMRPLRHT

SEQ ID NO: 174521 - protein, 15 aa, Mycobacterium tuberculosis
DENDGAAMRPLRHTL

SEQ ID NO: 174522 - protein, 15 aa, Mycobacterium tuberculosis
ENDGAAMRPLRHTLS

SEQ ID NO: 174523 - protein, 15 aa, Mycobacterium tuberculosis
NDGAAMRPLRHTLSQ

SEQ ID NO: 174524 - protein, 15 aa, Mycobacterium tuberculosis
DGAAMRPLRHTLSQL

SEQ ID NO: 174525 - protein, 15 aa, Mycobacterium tuberculosis
GAAMRPLRHTLSQLR

SEQ ID NO: 174526 - protein, 15 aa, Mycobacterium tuberculosis
AAMRPLRHTLSQLRL

SEQ ID NO: 174527 - protein, 15 aa, Mycobacterium tuberculosis
AMRPLRHTLSQLRLH

SEQ ID NO: 174528 - protein, 15 aa, Mycobacterium tuberculosis
MRPLRHTLSQLRLHE

SEQ ID NO: 174529 - protein, 15 aa, Mycobacterium tuberculosis
RPLRHTLSQLRLHEL

SEQ ID NO: 174530 - protein, 15 aa, Mycobacterium tuberculosis
PLRHTLSQLRLHELL

SEQ ID NO: 174531 - protein, 15 aa, Mycobacterium tuberculosis
LRHTLSQLRLHELLV

SEQ ID NO: 174532 - protein, 15 aa, Mycobacterium tuberculosis
RHTLSQLRLHELLVE

SEQ ID NO: 174533 - protein, 15 aa, Mycobacterium tuberculosis
HTLSQLRLHELLVEV

SEQ ID NO: 174534 - protein, 15 aa, Mycobacterium tuberculosis
TLSQLRLHELLVEVQ

SEQ ID NO: 174535 - protein, 15 aa, Mycobacterium tuberculosis
LSQLRLHELLVEVQD

SEQ ID NO: 174536 - protein, 15 aa, Mycobacterium tuberculosis
SQLRLHELLVEVQDR

SEQ ID NO: 174537 - protein, 15 aa, Mycobacterium tuberculosis
QLRLHELLVEVQDRV

SEQ ID NO: 174538 - protein, 15 aa, Mycobacterium tuberculosis
LRLHELLVEVQDRVE

SEQ ID NO: 174539 - protein, 15 aa, Mycobacterium tuberculosis
RLHELLVEVQDRVEQ

SEQ ID NO: 174540 - protein, 15 aa, Mycobacterium tuberculosis
LHELLVEVQDRVEQI

SEQ ID NO: 174541 - protein, 15 aa, Mycobacterium tuberculosis
HELLVEVQDRVEQIV

SEQ ID NO: 174542 - protein, 15 aa, Mycobacterium tuberculosis
ELLVEVQDRVEQIVE

SEQ ID NO: 174543 - protein, 15 aa, Mycobacterium tuberculosis
LLVEVQDRVEQIVEG

SEQ ID NO: 174544 - protein, 15 aa, Mycobacterium tuberculosis
LVEVQDRVEQIVEGR

SEQ ID NO: 174545 - protein, 15 aa, Mycobacterium tuberculosis
VEVQDRVEQIVEGRD

SEQ ID NO: 174546 - protein, 15 aa, Mycobacterium tuberculosis
EVQDRVEQIVEGRDR

SEQ ID NO: 174547 - protein, 15 aa, Mycobacterium tuberculosis
VQDRVEQIVEGRDRL

SEQ ID NO: 174548 - protein, 15 aa, Mycobacterium tuberculosis
QDRVEQIVEGRDRLD

SEQ ID NO: 174549 - protein, 15 aa, Mycobacterium tuberculosis
DRVEQIVEGRDRLDG

SEQ ID NO: 174550 - protein, 15 aa, Mycobacterium tuberculosis
RVEQIVEGRDRLDGL

SEQ ID NO: 174551 - protein, 15 aa, Mycobacterium tuberculosis
VEQIVEGRDRLDGLV

SEQ ID NO: 174552 - protein, 15 aa, Mycobacterium tuberculosis
EQIVEGRDRLDGLVE

SEQ ID NO: 174553 - protein, 15 aa, Mycobacterium tuberculosis
QIVEGRDRLDGLVEA

SEQ ID NO: 174554 - protein, 15 aa, Mycobacterium tuberculosis
IVEGRDRLDGLVEAM

SEQ ID NO: 174555 - protein, 15 aa, Mycobacterium tuberculosis
VEGRDRLDGLVEAML

SEQ ID NO: 174556 - protein, 15 aa, Mycobacterium tuberculosis
EGRDRLDGLVEAMLV

SEQ ID NO: 174557 - protein, 15 aa, Mycobacterium tuberculosis
GRDRLDGLVEAMLVV

SEQ ID NO: 174558 - protein, 15 aa, Mycobacterium tuberculosis
RDRLDGLVEAMLVVT

SEQ ID NO: 174559 - protein, 15 aa, Mycobacterium tuberculosis
DRLDGLVEAMLVVTA

SEQ ID NO: 174560 - protein, 15 aa, Mycobacterium tuberculosis
RLDGLVEAMLVVTAG

SEQ ID NO: 174561 - protein, 15 aa, Mycobacterium tuberculosis
LDGLVEAMLVVTAGL

SEQ ID NO: 174562 - protein, 15 aa, Mycobacterium tuberculosis
DGLVEAMLVVTAGLD

SEQ ID NO: 174563 - protein, 15 aa, Mycobacterium tuberculosis
GLVEAMLVVTAGLDL

SEQ ID NO: 174564 - protein, 15 aa, Mycobacterium tuberculosis
LVEAMLVVTAGLDLE

SEQ ID NO: 174565 - protein, 15 aa, Mycobacterium tuberculosis
VEAMLVVTAGLDLEA

SEQ ID NO: 174566 - protein, 15 aa, Mycobacterium tuberculosis
EAMLVVTAGLDLEAT

SEQ ID NO: 174567 - protein, 15 aa, Mycobacterium tuberculosis
AMLVVTAGLDLEATL

SEQ ID NO: 174568 - protein, 15 aa, Mycobacterium tuberculosis
MLVVTAGLDLEATLR

SEQ ID NO: 174569 - protein, 15 aa, Mycobacterium tuberculosis
LVVTAGLDLEATLRA

SEQ ID NO: 174570 - protein, 15 aa, Mycobacterium tuberculosis
VVTAGLDLEATLRAI

SEQ ID NO: 174571 - protein, 15 aa, Mycobacterium tuberculosis
VTAGLDLEATLRAIV

SEQ ID NO: 174572 - protein, 15 aa, Mycobacterium tuberculosis
TAGLDLEATLRAIVH

SEQ ID NO: 174573 - protein, 15 aa, Mycobacterium tuberculosis
AGLDLEATLRAIVHS

SEQ ID NO: 174574 - protein, 15 aa, Mycobacterium tuberculosis
GLDLEATLRAIVHSA

SEQ ID NO: 174575 - protein, 15 aa, Mycobacterium tuberculosis
LDLEATLRAIVHSAT

SEQ ID NO: 174576 - protein, 15 aa, Mycobacterium tuberculosis
DLEATLRAIVHSATS

SEQ ID NO: 174577 - protein, 15 aa, Mycobacterium tuberculosis
LEATLRAIVHSATSL

SEQ ID NO: 174578 - protein, 15 aa, Mycobacterium tuberculosis
EATLRAIVHSATSLV

SEQ ID NO: 174579 - protein, 15 aa, Mycobacterium tuberculosis
ATLRAIVHSATSLVD

SEQ ID NO: 174580 - protein, 15 aa, Mycobacterium tuberculosis
TLRAIVHSATSLVDA

SEQ ID NO: 174581 - protein, 15 aa, Mycobacterium tuberculosis
LRAIVHSATSLVDAR

SEQ ID NO: 174582 - protein, 15 aa, Mycobacterium tuberculosis
RAIVHSATSLVDARY

SEQ ID NO: 174583 - protein, 15 aa, Mycobacterium tuberculosis
AIVHSATSLVDARYG

SEQ ID NO: 174584 - protein, 15 aa, Mycobacterium tuberculosis
IVHSATSLVDARYGA

SEQ ID NO: 174585 - protein, 15 aa, Mycobacterium tuberculosis
VHSATSLVDARYGAM

SEQ ID NO: 174586 - protein, 15 aa, Mycobacterium tuberculosis
HSATSLVDARYGAME

SEQ ID NO: 174587 - protein, 15 aa, Mycobacterium tuberculosis
SATSLVDARYGAMEV

SEQ ID NO: 174588 - protein, 15 aa, Mycobacterium tuberculosis
ATSLVDARYGAMEVH

SEQ ID NO: 174589 - protein, 15 aa, Mycobacterium tuberculosis
TSLVDARYGAMEVHD

SEQ ID NO: 174590 - protein, 15 aa, Mycobacterium tuberculosis
SLVDARYGAMEVHDR

SEQ ID NO: 174591 - protein, 15 aa, Mycobacterium tuberculosis
LVDARYGAMEVHDRQ

SEQ ID NO: 174592 - protein, 15 aa, Mycobacterium tuberculosis
VDARYGAMEVHDRQH

SEQ ID NO: 174593 - protein, 15 aa, Mycobacterium tuberculosis
DARYGAMEVHDRQHR

SEQ ID NO: 174594 - protein, 15 aa, Mycobacterium tuberculosis
ARYGAMEVHDRQHRV

SEQ ID NO: 174595 - protein, 15 aa, Mycobacterium tuberculosis
RYGAMEVHDRQHRVL

SEQ ID NO: 174596 - protein, 15 aa, Mycobacterium tuberculosis
YGAMEVHDRQHRVLH

SEQ ID NO: 174597 - protein, 15 aa, Mycobacterium tuberculosis
GAMEVHDRQHRVLHF

SEQ ID NO: 174598 - protein, 15 aa, Mycobacterium tuberculosis
AMEVHDRQHRVLHFV

SEQ ID NO: 174599 - protein, 15 aa, Mycobacterium tuberculosis
MEVHDRQHRVLHFVY

SEQ ID NO: 174600 - protein, 15 aa, Mycobacterium tuberculosis
EVHDRQHRVLHFVYE

SEQ ID NO: 174601 - protein, 15 aa, Mycobacterium tuberculosis
VHDRQHRVLHFVYEG

SEQ ID NO: 174602 - protein, 15 aa, Mycobacterium tuberculosis
HDRQHRVLHFVYEGI

SEQ ID NO: 174603 - protein, 15 aa, Mycobacterium tuberculosis
DRQHRVLHFVYEGID

SEQ ID NO: 174604 - protein, 15 aa, Mycobacterium tuberculosis
RQHRVLHFVYEGIDE

SEQ ID NO: 174605 - protein, 15 aa, Mycobacterium tuberculosis
QHRVLHFVYEGIDEE

SEQ ID NO: 174606 - protein, 15 aa, Mycobacterium tuberculosis
HRVLHFVYEGIDEET

SEQ ID NO: 174607 - protein, 15 aa, Mycobacterium tuberculosis
RVLHFVYEGIDEETV

SEQ ID NO: 174608 - protein, 15 aa, Mycobacterium tuberculosis
VLHFVYEGIDEETVR

SEQ ID NO: 174609 - protein, 15 aa, Mycobacterium tuberculosis
LHFVYEGIDEETVRR

SEQ ID NO: 174610 - protein, 15 aa, Mycobacterium tuberculosis
HFVYEGIDEETVRRI

SEQ ID NO: 174611 - protein, 15 aa, Mycobacterium tuberculosis
FVYEGIDEETVRRIG

SEQ ID NO: 174612 - protein, 15 aa, Mycobacterium tuberculosis
VYEGIDEETVRRIGH

SEQ ID NO: 174613 - protein, 15 aa, Mycobacterium tuberculosis
YEGIDEETVRRIGHL

SEQ ID NO: 174614 - protein, 15 aa, Mycobacterium tuberculosis
EGIDEETVRRIGHLP

SEQ ID NO: 174615 - protein, 15 aa, Mycobacterium tuberculosis
GIDEETVRRIGHLPK

SEQ ID NO: 174616 - protein, 15 aa, Mycobacterium tuberculosis
IDEETVRRIGHLPKG

SEQ ID NO: 174617 - protein, 15 aa, Mycobacterium tuberculosis
DEETVRRIGHLPKGL

SEQ ID NO: 174618 - protein, 15 aa, Mycobacterium tuberculosis
EETVRRIGHLPKGLG

SEQ ID NO: 174619 - protein, 15 aa, Mycobacterium tuberculosis
ETVRRIGHLPKGLGV

SEQ ID NO: 174620 - protein, 15 aa, Mycobacterium tuberculosis
TVRRIGHLPKGLGVI

SEQ ID NO: 174621 - protein, 15 aa, Mycobacterium tuberculosis
VRRIGHLPKGLGVIG

SEQ ID NO: 174622 - protein, 15 aa, Mycobacterium tuberculosis
RRIGHLPKGLGVIGL

SEQ ID NO: 174623 - protein, 15 aa, Mycobacterium tuberculosis
RIGHLPKGLGVIGLL

SEQ ID NO: 174624 - protein, 15 aa, Mycobacterium tuberculosis
IGHLPKGLGVIGLLI

SEQ ID NO: 174625 - protein, 15 aa, Mycobacterium tuberculosis
GHLPKGLGVIGLLIE

SEQ ID NO: 174626 - protein, 15 aa, Mycobacterium tuberculosis
HLPKGLGVIGLLIED

SEQ ID NO: 174627 - protein, 15 aa, Mycobacterium tuberculosis
LPKGLGVIGLLIEDP

SEQ ID NO: 174628 - protein, 15 aa, Mycobacterium tuberculosis
PKGLGVIGLLIEDPK

SEQ ID NO: 174629 - protein, 15 aa, Mycobacterium tuberculosis
KGLGVIGLLIEDPKP

SEQ ID NO: 174630 - protein, 15 aa, Mycobacterium tuberculosis
GLGVIGLLIEDPKPL

SEQ ID NO: 174631 - protein, 15 aa, Mycobacterium tuberculosis
LGVIGLLIEDPKPLR

SEQ ID NO: 174632 - protein, 15 aa, Mycobacterium tuberculosis
GVIGLLIEDPKPLRL

SEQ ID NO: 174633 - protein, 15 aa, Mycobacterium tuberculosis
VIGLLIEDPKPLRLD

SEQ ID NO: 174634 - protein, 15 aa, Mycobacterium tuberculosis
IGLLIEDPKPLRLDD

SEQ ID NO: 174635 - protein, 15 aa, Mycobacterium tuberculosis
GLLIEDPKPLRLDDV

SEQ ID NO: 174636 - protein, 15 aa, Mycobacterium tuberculosis
LLIEDPKPLRLDDVS

SEQ ID NO: 174637 - protein, 15 aa, Mycobacterium tuberculosis
LIEDPKPLRLDDVSA

SEQ ID NO: 174638 - protein, 15 aa, Mycobacterium tuberculosis
IEDPKPLRLDDVSAH

SEQ ID NO: 174639 - protein, 15 aa, Mycobacterium tuberculosis
EDPKPLRLDDVSAHP

SEQ ID NO: 174640 - protein, 15 aa, Mycobacterium tuberculosis
DPKPLRLDDVSAHPA

SEQ ID NO: 174641 - protein, 15 aa, Mycobacterium tuberculosis
PKPLRLDDVSAHPAS

SEQ ID NO: 174642 - protein, 15 aa, Mycobacterium tuberculosis
KPLRLDDVSAHPASI

SEQ ID NO: 174643 - protein, 15 aa, Mycobacterium tuberculosis
PLRLDDVSAHPASIG

SEQ ID NO: 174644 - protein, 15 aa, Mycobacterium tuberculosis
LRLDDVSAHPASIGF

SEQ ID NO: 174645 - protein, 15 aa, Mycobacterium tuberculosis
RLDDVSAHPASIGFP

SEQ ID NO: 174646 - protein, 15 aa, Mycobacterium tuberculosis
LDDVSAHPASIGFPP

SEQ ID NO: 174647 - protein, 15 aa, Mycobacterium tuberculosis
DDVSAHPASIGFPPY

SEQ ID NO: 174648 - protein, 15 aa, Mycobacterium tuberculosis
DVSAHPASIGFPPYH

SEQ ID NO: 174649 - protein, 15 aa, Mycobacterium tuberculosis
VSAHPASIGFPPYHP

SEQ ID NO: 174650 - protein, 15 aa, Mycobacterium tuberculosis
SAHPASIGFPPYHPP

SEQ ID NO: 174651 - protein, 15 aa, Mycobacterium tuberculosis
AHPASIGFPPYHPPM

SEQ ID NO: 174652 - protein, 15 aa, Mycobacterium tuberculosis
HPASIGFPPYHPPMR

SEQ ID NO: 174653 - protein, 15 aa, Mycobacterium tuberculosis
PASIGFPPYHPPMRT

SEQ ID NO: 174654 - protein, 15 aa, Mycobacterium tuberculosis
ASIGFPPYHPPMRTF

SEQ ID NO: 174655 - protein, 15 aa, Mycobacterium tuberculosis
SIGFPPYHPPMRTFL

SEQ ID NO: 174656 - protein, 15 aa, Mycobacterium tuberculosis
IGFPPYHPPMRTFLG

SEQ ID NO: 174657 - protein, 15 aa, Mycobacterium tuberculosis
GFPPYHPPMRTFLGV

SEQ ID NO: 174658 - protein, 15 aa, Mycobacterium tuberculosis
FPPYHPPMRTFLGVP

SEQ ID NO: 174659 - protein, 15 aa, Mycobacterium tuberculosis
PPYHPPMRTFLGVPV

SEQ ID NO: 174660 - protein, 15 aa, Mycobacterium tuberculosis
PYHPPMRTFLGVPVR

SEQ ID NO: 174661 - protein, 15 aa, Mycobacterium tuberculosis
YHPPMRTFLGVPVRV

SEQ ID NO: 174662 - protein, 15 aa, Mycobacterium tuberculosis
HPPMRTFLGVPVRVR

SEQ ID NO: 174663 - protein, 15 aa, Mycobacterium tuberculosis
PPMRTFLGVPVRVRD

SEQ ID NO: 174664 - protein, 15 aa, Mycobacterium tuberculosis
PMRTFLGVPVRVRDE

SEQ ID NO: 174665 - protein, 15 aa, Mycobacterium tuberculosis
MRTFLGVPVRVRDES

SEQ ID NO: 174666 - protein, 15 aa, Mycobacterium tuberculosis
RTFLGVPVRVRDESF

SEQ ID NO: 174667 - protein, 15 aa, Mycobacterium tuberculosis
TFLGVPVRVRDESFG

SEQ ID NO: 174668 - protein, 15 aa, Mycobacterium tuberculosis
FLGVPVRVRDESFGT

SEQ ID NO: 174669 - protein, 15 aa, Mycobacterium tuberculosis
LGVPVRVRDESFGTL

SEQ ID NO: 174670 - protein, 15 aa, Mycobacterium tuberculosis
GVPVRVRDESFGTLY

SEQ ID NO: 174671 - protein, 15 aa, Mycobacterium tuberculosis
VPVRVRDESFGTLYL

SEQ ID NO: 174672 - protein, 15 aa, Mycobacterium tuberculosis
PVRVRDESFGTLYLT

SEQ ID NO: 174673 - protein, 15 aa, Mycobacterium tuberculosis
VRVRDESFGTLYLTD

SEQ ID NO: 174674 - protein, 15 aa, Mycobacterium tuberculosis
RVRDESFGTLYLTDK

SEQ ID NO: 174675 - protein, 15 aa, Mycobacterium tuberculosis
VRDESFGTLYLTDKT

SEQ ID NO: 174676 - protein, 15 aa, Mycobacterium tuberculosis
RDESFGTLYLTDKTN

SEQ ID NO: 174677 - protein, 15 aa, Mycobacterium tuberculosis
DESFGTLYLTDKTNG

SEQ ID NO: 174678 - protein, 15 aa, Mycobacterium tuberculosis
ESFGTLYLTDKTNGQ

SEQ ID NO: 174679 - protein, 15 aa, Mycobacterium tuberculosis
SFGTLYLTDKTNGQP

SEQ ID NO: 174680 - protein, 15 aa, Mycobacterium tuberculosis
FGTLYLTDKTNGQPF

SEQ ID NO: 174681 - protein, 15 aa, Mycobacterium tuberculosis
GTLYLTDKTNGQPFS

SEQ ID NO: 174682 - protein, 15 aa, Mycobacterium tuberculosis
TLYLTDKTNGQPFSD

SEQ ID NO: 174683 - protein, 15 aa, Mycobacterium tuberculosis
LYLTDKTNGQPFSDD

SEQ ID NO: 174684 - protein, 15 aa, Mycobacterium tuberculosis
YLTDKTNGQPFSDDD

SEQ ID NO: 174685 - protein, 15 aa, Mycobacterium tuberculosis
LTDKTNGQPFSDDDE

SEQ ID NO: 174686 - protein, 15 aa, Mycobacterium tuberculosis
TDKTNGQPFSDDDEV

SEQ ID NO: 174687 - protein, 15 aa, Mycobacterium tuberculosis
DKTNGQPFSDDDEVL

SEQ ID NO: 174688 - protein, 15 aa, Mycobacterium tuberculosis
KTNGQPFSDDDEVLV

SEQ ID NO: 174689 - protein, 15 aa, Mycobacterium tuberculosis
TNGQPFSDDDEVLVQ

SEQ ID NO: 174690 - protein, 15 aa, Mycobacterium tuberculosis
NGQPFSDDDEVLVQA

SEQ ID NO: 174691 - protein, 15 aa, Mycobacterium tuberculosis
GQPFSDDDEVLVQAL

SEQ ID NO: 174692 - protein, 15 aa, Mycobacterium tuberculosis
QPFSDDDEVLVQALA

SEQ ID NO: 174693 - protein, 15 aa, Mycobacterium tuberculosis
PFSDDDEVLVQALAA

SEQ ID NO: 174694 - protein, 15 aa, Mycobacterium tuberculosis
FSDDDEVLVQALAAA

SEQ ID NO: 174695 - protein, 15 aa, Mycobacterium tuberculosis
SDDDEVLVQALAAAA

SEQ ID NO: 174696 - protein, 15 aa, Mycobacterium tuberculosis
DDDEVLVQALAAAAG

SEQ ID NO: 174697 - protein, 15 aa, Mycobacterium tuberculosis
DDEVLVQALAAAAGI

SEQ ID NO: 174698 - protein, 15 aa, Mycobacterium tuberculosis
DEVLVQALAAAAGIA

SEQ ID NO: 174699 - protein, 15 aa, Mycobacterium tuberculosis
EVLVQALAAAAGIAV

SEQ ID NO: 174700 - protein, 15 aa, Mycobacterium tuberculosis
VLVQALAAAAGIAVA

SEQ ID NO: 174701 - protein, 15 aa, Mycobacterium tuberculosis
LVQALAAAAGIAVAN

SEQ ID NO: 174702 - protein, 15 aa, Mycobacterium tuberculosis
VQALAAAAGIAVANA

SEQ ID NO: 174703 - protein, 15 aa, Mycobacterium tuberculosis
QALAAAAGIAVANAR

SEQ ID NO: 174704 - protein, 15 aa, Mycobacterium tuberculosis
ALAAAAGIAVANARL

SEQ ID NO: 174705 - protein, 15 aa, Mycobacterium tuberculosis
LAAAAGIAVANARLY

SEQ ID NO: 174706 - protein, 15 aa, Mycobacterium tuberculosis
AAAAGIAVANARLYQ

SEQ ID NO: 174707 - protein, 15 aa, Mycobacterium tuberculosis
AAAGIAVANARLYQQ

SEQ ID NO: 174708 - protein, 15 aa, Mycobacterium tuberculosis
AAGIAVANARLYQQA

SEQ ID NO: 174709 - protein, 15 aa, Mycobacterium tuberculosis
AGIAVANARLYQQAK

SEQ ID NO: 174710 - protein, 15 aa, Mycobacterium tuberculosis
GIAVANARLYQQAKA

SEQ ID NO: 174711 - protein, 15 aa, Mycobacterium tuberculosis
IAVANARLYQQAKAR

SEQ ID NO: 174712 - protein, 15 aa, Mycobacterium tuberculosis
AVANARLYQQAKARQ

SEQ ID NO: 174713 - protein, 15 aa, Mycobacterium tuberculosis
VANARLYQQAKARQS

SEQ ID NO: 174714 - protein, 15 aa, Mycobacterium tuberculosis
ANARLYQQAKARQSW

SEQ ID NO: 174715 - protein, 15 aa, Mycobacterium tuberculosis
NARLYQQAKARQSWI

SEQ ID NO: 174716 - protein, 15 aa, Mycobacterium tuberculosis
ARLYQQAKARQSWIE

SEQ ID NO: 174717 - protein, 15 aa, Mycobacterium tuberculosis
RLYQQAKARQSWIEA

SEQ ID NO: 174718 - protein, 15 aa, Mycobacterium tuberculosis
LYQQAKARQSWIEAT

SEQ ID NO: 174719 - protein, 15 aa, Mycobacterium tuberculosis
YQQAKARQSWIEATR

SEQ ID NO: 174720 - protein, 15 aa, Mycobacterium tuberculosis
QQAKARQSWIEATRD

SEQ ID NO: 174721 - protein, 15 aa, Mycobacterium tuberculosis
QAKARQSWIEATRDI

SEQ ID NO: 174722 - protein, 15 aa, Mycobacterium tuberculosis
AKARQSWIEATRDIA

SEQ ID NO: 174723 - protein, 15 aa, Mycobacterium tuberculosis
KARQSWIEATRDIAT

SEQ ID NO: 174724 - protein, 15 aa, Mycobacterium tuberculosis
ARQSWIEATRDIATE

SEQ ID NO: 174725 - protein, 15 aa, Mycobacterium tuberculosis
RQSWIEATRDIATEL

SEQ ID NO: 174726 - protein, 15 aa, Mycobacterium tuberculosis
QSWIEATRDIATELL

SEQ ID NO: 174727 - protein, 15 aa, Mycobacterium tuberculosis
SWIEATRDIATELLS

SEQ ID NO: 174728 - protein, 15 aa, Mycobacterium tuberculosis
WIEATRDIATELLSG

SEQ ID NO: 174729 - protein, 15 aa, Mycobacterium tuberculosis
IEATRDIATELLSGT

SEQ ID NO: 174730 - protein, 15 aa, Mycobacterium tuberculosis
EATRDIATELLSGTE

SEQ ID NO: 174731 - protein, 15 aa, Mycobacterium tuberculosis
ATRDIATELLSGTEP

SEQ ID NO: 174732 - protein, 15 aa, Mycobacterium tuberculosis
TRDIATELLSGTEPA

SEQ ID NO: 174733 - protein, 15 aa, Mycobacterium tuberculosis
RDIATELLSGTEPAT

SEQ ID NO: 174734 - protein, 15 aa, Mycobacterium tuberculosis
DIATELLSGTEPATV

SEQ ID NO: 174735 - protein, 15 aa, Mycobacterium tuberculosis
IATELLSGTEPATVF

SEQ ID NO: 174736 - protein, 15 aa, Mycobacterium tuberculosis
ATELLSGTEPATVFR

SEQ ID NO: 174737 - protein, 15 aa, Mycobacterium tuberculosis
TELLSGTEPATVFRL

SEQ ID NO: 174738 - protein, 15 aa, Mycobacterium tuberculosis
ELLSGTEPATVFRLV

SEQ ID NO: 174739 - protein, 15 aa, Mycobacterium tuberculosis
LLSGTEPATVFRLVA

SEQ ID NO: 174740 - protein, 15 aa, Mycobacterium tuberculosis
LSGTEPATVFRLVAA

SEQ ID NO: 174741 - protein, 15 aa, Mycobacterium tuberculosis
SGTEPATVFRLVAAE

SEQ ID NO: 174742 - protein, 15 aa, Mycobacterium tuberculosis
GTEPATVFRLVAAEA

SEQ ID NO: 174743 - protein, 15 aa, Mycobacterium tuberculosis
TEPATVFRLVAAEAL

SEQ ID NO: 174744 - protein, 15 aa, Mycobacterium tuberculosis
EPATVFRLVAAEALK

SEQ ID NO: 174745 - protein, 15 aa, Mycobacterium tuberculosis
PATVFRLVAAEALKL

SEQ ID NO: 174746 - protein, 15 aa, Mycobacterium tuberculosis
ATVFRLVAAEALKLT

SEQ ID NO: 174747 - protein, 15 aa, Mycobacterium tuberculosis
TVFRLVAAEALKLTA

SEQ ID NO: 174748 - protein, 15 aa, Mycobacterium tuberculosis
VFRLVAAEALKLTAA

SEQ ID NO: 174749 - protein, 15 aa, Mycobacterium tuberculosis
FRLVAAEALKLTAAD

SEQ ID NO: 174750 - protein, 15 aa, Mycobacterium tuberculosis
RLVAAEALKLTAADA

SEQ ID NO: 174751 - protein, 15 aa, Mycobacterium tuberculosis
LVAAEALKLTAADAA

SEQ ID NO: 174752 - protein, 15 aa, Mycobacterium tuberculosis
VAAEALKLTAADAAL

SEQ ID NO: 174753 - protein, 15 aa, Mycobacterium tuberculosis
AAEALKLTAADAALV

SEQ ID NO: 174754 - protein, 15 aa, Mycobacterium tuberculosis
AEALKLTAADAALVA

SEQ ID NO: 174755 - protein, 15 aa, Mycobacterium tuberculosis
EALKLTAADAALVAV

SEQ ID NO: 174756 - protein, 15 aa, Mycobacterium tuberculosis
ALKLTAADAALVAVP

SEQ ID NO: 174757 - protein, 15 aa, Mycobacterium tuberculosis
LKLTAADAALVAVPV

SEQ ID NO: 174758 - protein, 15 aa, Mycobacterium tuberculosis
KLTAADAALVAVPVD

SEQ ID NO: 174759 - protein, 15 aa, Mycobacterium tuberculosis
LTAADAALVAVPVDE

SEQ ID NO: 174760 - protein, 15 aa, Mycobacterium tuberculosis
TAADAALVAVPVDED

SEQ ID NO: 174761 - protein, 15 aa, Mycobacterium tuberculosis
AADAALVAVPVDEDM

SEQ ID NO: 174762 - protein, 15 aa, Mycobacterium tuberculosis
ADAALVAVPVDEDMP

SEQ ID NO: 174763 - protein, 15 aa, Mycobacterium tuberculosis
DAALVAVPVDEDMPA

SEQ ID NO: 174764 - protein, 15 aa, Mycobacterium tuberculosis
AALVAVPVDEDMPAA

SEQ ID NO: 174765 - protein, 15 aa, Mycobacterium tuberculosis
ALVAVPVDEDMPAAD

SEQ ID NO: 174766 - protein, 15 aa, Mycobacterium tuberculosis
LVAVPVDEDMPAADV

SEQ ID NO: 174767 - protein, 15 aa, Mycobacterium tuberculosis
VAVPVDEDMPAADVG

SEQ ID NO: 174768 - protein, 15 aa, Mycobacterium tuberculosis
AVPVDEDMPAADVGE

SEQ ID NO: 174769 - protein, 15 aa, Mycobacterium tuberculosis
VPVDEDMPAADVGEL

SEQ ID NO: 174770 - protein, 15 aa, Mycobacterium tuberculosis
PVDEDMPAADVGELL

SEQ ID NO: 174771 - protein, 15 aa, Mycobacterium tuberculosis
VDEDMPAADVGELLV

SEQ ID NO: 174772 - protein, 15 aa, Mycobacterium tuberculosis
DEDMPAADVGELLVI

SEQ ID NO: 174773 - protein, 15 aa, Mycobacterium tuberculosis
EDMPAADVGELLVIE

SEQ ID NO: 174774 - protein, 15 aa, Mycobacterium tuberculosis
DMPAADVGELLVIET

SEQ ID NO: 174775 - protein, 15 aa, Mycobacterium tuberculosis
MPAADVGELLVIETV

SEQ ID NO: 174776 - protein, 15 aa, Mycobacterium tuberculosis
PAADVGELLVIETVG

SEQ ID NO: 174777 - protein, 15 aa, Mycobacterium tuberculosis
AADVGELLVIETVGS

SEQ ID NO: 174778 - protein, 15 aa, Mycobacterium tuberculosis
ADVGELLVIETVGSA

SEQ ID NO: 174779 - protein, 15 aa, Mycobacterium tuberculosis
DVGELLVIETVGSAV

SEQ ID NO: 174780 - protein, 15 aa, Mycobacterium tuberculosis
VGELLVIETVGSAVA

SEQ ID NO: 174781 - protein, 15 aa, Mycobacterium tuberculosis
GELLVIETVGSAVAS

SEQ ID NO: 174782 - protein, 15 aa, Mycobacterium tuberculosis
ELLVIETVGSAVASI

SEQ ID NO: 174783 - protein, 15 aa, Mycobacterium tuberculosis
LLVIETVGSAVASIV

SEQ ID NO: 174784 - protein, 15 aa, Mycobacterium tuberculosis
LVIETVGSAVASIVG

SEQ ID NO: 174785 - protein, 15 aa, Mycobacterium tuberculosis
VIETVGSAVASIVGR

SEQ ID NO: 174786 - protein, 15 aa, Mycobacterium tuberculosis
IETVGSAVASIVGRT

SEQ ID NO: 174787 - protein, 15 aa, Mycobacterium tuberculosis
ETVGSAVASIVGRTI

SEQ ID NO: 174788 - protein, 15 aa, Mycobacterium tuberculosis
TVGSAVASIVGRTIP

SEQ ID NO: 174789 - protein, 15 aa, Mycobacterium tuberculosis
VGSAVASIVGRTIPV

SEQ ID NO: 174790 - protein, 15 aa, Mycobacterium tuberculosis
GSAVASIVGRTIPVA

SEQ ID NO: 174791 - protein, 15 aa, Mycobacterium tuberculosis
SAVASIVGRTIPVAG

SEQ ID NO: 174792 - protein, 15 aa, Mycobacterium tuberculosis
AVASIVGRTIPVAGA

SEQ ID NO: 174793 - protein, 15 aa, Mycobacterium tuberculosis
VASIVGRTIPVAGAV

SEQ ID NO: 174794 - protein, 15 aa, Mycobacterium tuberculosis
ASIVGRTIPVAGAVL

SEQ ID NO: 174795 - protein, 15 aa, Mycobacterium tuberculosis
SIVGRTIPVAGAVLR

SEQ ID NO: 174796 - protein, 15 aa, Mycobacterium tuberculosis
IVGRTIPVAGAVLRE

SEQ ID NO: 174797 - protein, 15 aa, Mycobacterium tuberculosis
VGRTIPVAGAVLREV

SEQ ID NO: 174798 - protein, 15 aa, Mycobacterium tuberculosis
GRTIPVAGAVLREVF

SEQ ID NO: 174799 - protein, 15 aa, Mycobacterium tuberculosis
RTIPVAGAVLREVFV

SEQ ID NO: 174800 - protein, 15 aa, Mycobacterium tuberculosis
TIPVAGAVLREVFVN

SEQ ID NO: 174801 - protein, 15 aa, Mycobacterium tuberculosis
IPVAGAVLREVFVNG

SEQ ID NO: 174802 - protein, 15 aa, Mycobacterium tuberculosis
PVAGAVLREVFVNGI

SEQ ID NO: 174803 - protein, 15 aa, Mycobacterium tuberculosis
VAGAVLREVFVNGIP

SEQ ID NO: 174804 - protein, 15 aa, Mycobacterium tuberculosis
AGAVLREVFVNGIPR

SEQ ID NO: 174805 - protein, 15 aa, Mycobacterium tuberculosis
GAVLREVFVNGIPRR

SEQ ID NO: 174806 - protein, 15 aa, Mycobacterium tuberculosis
AVLREVFVNGIPRRV

SEQ ID NO: 174807 - protein, 15 aa, Mycobacterium tuberculosis
VLREVFVNGIPRRVD

SEQ ID NO: 174808 - protein, 15 aa, Mycobacterium tuberculosis
LREVFVNGIPRRVDR

SEQ ID NO: 174809 - protein, 15 aa, Mycobacterium tuberculosis
REVFVNGIPRRVDRV

SEQ ID NO: 174810 - protein, 15 aa, Mycobacterium tuberculosis
EVFVNGIPRRVDRVD

SEQ ID NO: 174811 - protein, 15 aa, Mycobacterium tuberculosis
VFVNGIPRRVDRVDL

SEQ ID NO: 174812 - protein, 15 aa, Mycobacterium tuberculosis
FVNGIPRRVDRVDLE

SEQ ID NO: 174813 - protein, 15 aa, Mycobacterium tuberculosis
VNGIPRRVDRVDLEG

SEQ ID NO: 174814 - protein, 15 aa, Mycobacterium tuberculosis
NGIPRRVDRVDLEGL

SEQ ID NO: 174815 - protein, 15 aa, Mycobacterium tuberculosis
GIPRRVDRVDLEGLD

SEQ ID NO: 174816 - protein, 15 aa, Mycobacterium tuberculosis
IPRRVDRVDLEGLDE

SEQ ID NO: 174817 - protein, 15 aa, Mycobacterium tuberculosis
PRRVDRVDLEGLDEL

SEQ ID NO: 174818 - protein, 15 aa, Mycobacterium tuberculosis
RRVDRVDLEGLDELA

SEQ ID NO: 174819 - protein, 15 aa, Mycobacterium tuberculosis
RVDRVDLEGLDELAD

SEQ ID NO: 174820 - protein, 15 aa, Mycobacterium tuberculosis
VDRVDLEGLDELADA

SEQ ID NO: 174821 - protein, 15 aa, Mycobacterium tuberculosis
DRVDLEGLDELADAG

SEQ ID NO: 174822 - protein, 15 aa, Mycobacterium tuberculosis
RVDLEGLDELADAGP

SEQ ID NO: 174823 - protein, 15 aa, Mycobacterium tuberculosis
VDLEGLDELADAGPA

SEQ ID NO: 174824 - protein, 15 aa, Mycobacterium tuberculosis
DLEGLDELADAGPAL

SEQ ID NO: 174825 - protein, 15 aa, Mycobacterium tuberculosis
LEGLDELADAGPALL

SEQ ID NO: 174826 - protein, 15 aa, Mycobacterium tuberculosis
EGLDELADAGPALLL

SEQ ID NO: 174827 - protein, 15 aa, Mycobacterium tuberculosis
GLDELADAGPALLLP

SEQ ID NO: 174828 - protein, 15 aa, Mycobacterium tuberculosis
LDELADAGPALLLPL

SEQ ID NO: 174829 - protein, 15 aa, Mycobacterium tuberculosis
DELADAGPALLLPLR

SEQ ID NO: 174830 - protein, 15 aa, Mycobacterium tuberculosis
ELADAGPALLLPLRA

SEQ ID NO: 174831 - protein, 15 aa, Mycobacterium tuberculosis
LADAGPALLLPLRAR

SEQ ID NO: 174832 - protein, 15 aa, Mycobacterium tuberculosis
ADAGPALLLPLRARG

SEQ ID NO: 174833 - protein, 15 aa, Mycobacterium tuberculosis
DAGPALLLPLRARGT

SEQ ID NO: 174834 - protein, 15 aa, Mycobacterium tuberculosis
AGPALLLPLRARGTV

SEQ ID NO: 174835 - protein, 15 aa, Mycobacterium tuberculosis
GPALLLPLRARGTVA

SEQ ID NO: 174836 - protein, 15 aa, Mycobacterium tuberculosis
PALLLPLRARGTVAG

SEQ ID NO: 174837 - protein, 15 aa, Mycobacterium tuberculosis
ALLLPLRARGTVAGV

SEQ ID NO: 174838 - protein, 15 aa, Mycobacterium tuberculosis
LLLPLRARGTVAGVV

SEQ ID NO: 174839 - protein, 15 aa, Mycobacterium tuberculosis
LLPLRARGTVAGVVV

SEQ ID NO: 174840 - protein, 15 aa, Mycobacterium tuberculosis
LPLRARGTVAGVVVV

SEQ ID NO: 174841 - protein, 15 aa, Mycobacterium tuberculosis
PLRARGTVAGVVVVL

SEQ ID NO: 174842 - protein, 15 aa, Mycobacterium tuberculosis
LRARGTVAGVVVVLS

SEQ ID NO: 174843 - protein, 15 aa, Mycobacterium tuberculosis
RARGTVAGVVVVLSQ

SEQ ID NO: 174844 - protein, 15 aa, Mycobacterium tuberculosis
ARGTVAGVVVVLSQG

SEQ ID NO: 174845 - protein, 15 aa, Mycobacterium tuberculosis
RGTVAGVVVVLSQGG

SEQ ID NO: 174846 - protein, 15 aa, Mycobacterium tuberculosis
GTVAGVVVVLSQGGP

SEQ ID NO: 174847 - protein, 15 aa, Mycobacterium tuberculosis
TVAGVVVVLSQGGPG

SEQ ID NO: 174848 - protein, 15 aa, Mycobacterium tuberculosis
VAGVVVVLSQGGPGA

SEQ ID NO: 174849 - protein, 15 aa, Mycobacterium tuberculosis
AGVVVVLSQGGPGAF

SEQ ID NO: 174850 - protein, 15 aa, Mycobacterium tuberculosis
GVVVVLSQGGPGAFT

SEQ ID NO: 174851 - protein, 15 aa, Mycobacterium tuberculosis
VVVVLSQGGPGAFTD

SEQ ID NO: 174852 - protein, 15 aa, Mycobacterium tuberculosis
VVVLSQGGPGAFTDE

SEQ ID NO: 174853 - protein, 15 aa, Mycobacterium tuberculosis
VVLSQGGPGAFTDEQ

SEQ ID NO: 174854 - protein, 15 aa, Mycobacterium tuberculosis
VLSQGGPGAFTDEQL

SEQ ID NO: 174855 - protein, 15 aa, Mycobacterium tuberculosis
LSQGGPGAFTDEQLE

SEQ ID NO: 174856 - protein, 15 aa, Mycobacterium tuberculosis
SQGGPGAFTDEQLEM

SEQ ID NO: 174857 - protein, 15 aa, Mycobacterium tuberculosis
QGGPGAFTDEQLEMM

SEQ ID NO: 174858 - protein, 15 aa, Mycobacterium tuberculosis
GGPGAFTDEQLEMMA

SEQ ID NO: 174859 - protein, 15 aa, Mycobacterium tuberculosis
GPGAFTDEQLEMMAA

SEQ ID NO: 174860 - protein, 15 aa, Mycobacterium tuberculosis
PGAFTDEQLEMMAAF

SEQ ID NO: 174861 - protein, 15 aa, Mycobacterium tuberculosis
GAFTDEQLEMMAAFA

SEQ ID NO: 174862 - protein, 15 aa, Mycobacterium tuberculosis
AFTDEQLEMMAAFAD

SEQ ID NO: 174863 - protein, 15 aa, Mycobacterium tuberculosis
FTDEQLEMMAAFADQ

SEQ ID NO: 174864 - protein, 15 aa, Mycobacterium tuberculosis
TDEQLEMMAAFADQA

SEQ ID NO: 174865 - protein, 15 aa, Mycobacterium tuberculosis
DEQLEMMAAFADQAA

SEQ ID NO: 174866 - protein, 15 aa, Mycobacterium tuberculosis
EQLEMMAAFADQAAL

SEQ ID NO: 174867 - protein, 15 aa, Mycobacterium tuberculosis
QLEMMAAFADQAALA

SEQ ID NO: 174868 - protein, 15 aa, Mycobacterium tuberculosis
LEMMAAFADQAALAW

SEQ ID NO: 174869 - protein, 15 aa, Mycobacterium tuberculosis
EMMAAFADQAALAWQ

SEQ ID NO: 174870 - protein, 15 aa, Mycobacterium tuberculosis
MMAAFADQAALAWQL

SEQ ID NO: 174871 - protein, 15 aa, Mycobacterium tuberculosis
MAAFADQAALAWQLA

SEQ ID NO: 174872 - protein, 15 aa, Mycobacterium tuberculosis
AAFADQAALAWQLAT

SEQ ID NO: 174873 - protein, 15 aa, Mycobacterium tuberculosis
AFADQAALAWQLATS

SEQ ID NO: 174874 - protein, 15 aa, Mycobacterium tuberculosis
FADQAALAWQLATSQ

SEQ ID NO: 174875 - protein, 15 aa, Mycobacterium tuberculosis
ADQAALAWQLATSQR

SEQ ID NO: 174876 - protein, 15 aa, Mycobacterium tuberculosis
DQAALAWQLATSQRR

SEQ ID NO: 174877 - protein, 15 aa, Mycobacterium tuberculosis
QAALAWQLATSQRRM

SEQ ID NO: 174878 - protein, 15 aa, Mycobacterium tuberculosis
AALAWQLATSQRRMR

SEQ ID NO: 174879 - protein, 15 aa, Mycobacterium tuberculosis
ALAWQLATSQRRMRE

SEQ ID NO: 174880 - protein, 15 aa, Mycobacterium tuberculosis
LAWQLATSQRRMREL

SEQ ID NO: 174881 - protein, 15 aa, Mycobacterium tuberculosis
AWQLATSQRRMRELD

SEQ ID NO: 174882 - protein, 15 aa, Mycobacterium tuberculosis
WQLATSQRRMRELDV

SEQ ID NO: 174883 - protein, 15 aa, Mycobacterium tuberculosis
QLATSQRRMRELDVL

SEQ ID NO: 174884 - protein, 15 aa, Mycobacterium tuberculosis
LATSQRRMRELDVLT

SEQ ID NO: 174885 - protein, 15 aa, Mycobacterium tuberculosis
ATSQRRMRELDVLTD

SEQ ID NO: 174886 - protein, 15 aa, Mycobacterium tuberculosis
TSQRRMRELDVLTDR

SEQ ID NO: 174887 - protein, 15 aa, Mycobacterium tuberculosis
SQRRMRELDVLTDRD

SEQ ID NO: 174888 - protein, 15 aa, Mycobacterium tuberculosis
QRRMRELDVLTDRDR

SEQ ID NO: 174889 - protein, 15 aa, Mycobacterium tuberculosis
RRMRELDVLTDRDRI

SEQ ID NO: 174890 - protein, 15 aa, Mycobacterium tuberculosis
RMRELDVLTDRDRIA

SEQ ID NO: 174891 - protein, 15 aa, Mycobacterium tuberculosis
MRELDVLTDRDRIAR

SEQ ID NO: 174892 - protein, 15 aa, Mycobacterium tuberculosis
RELDVLTDRDRIARD

SEQ ID NO: 174893 - protein, 15 aa, Mycobacterium tuberculosis
ELDVLTDRDRIARDL

SEQ ID NO: 174894 - protein, 15 aa, Mycobacterium tuberculosis
LDVLTDRDRIARDLH

SEQ ID NO: 174895 - protein, 15 aa, Mycobacterium tuberculosis
DVLTDRDRIARDLHD

SEQ ID NO: 174896 - protein, 15 aa, Mycobacterium tuberculosis
VLTDRDRIARDLHDH

SEQ ID NO: 174897 - protein, 15 aa, Mycobacterium tuberculosis
LTDRDRIARDLHDHV

SEQ ID NO: 174898 - protein, 15 aa, Mycobacterium tuberculosis
TDRDRIARDLHDHVI

SEQ ID NO: 174899 - protein, 15 aa, Mycobacterium tuberculosis
DRDRIARDLHDHVIQ

SEQ ID NO: 174900 - protein, 15 aa, Mycobacterium tuberculosis
RDRIARDLHDHVIQR

SEQ ID NO: 174901 - protein, 15 aa, Mycobacterium tuberculosis
DRIARDLHDHVIQRL

SEQ ID NO: 174902 - protein, 15 aa, Mycobacterium tuberculosis
RIARDLHDHVIQRLF

SEQ ID NO: 174903 - protein, 15 aa, Mycobacterium tuberculosis
IARDLHDHVIQRLFA

SEQ ID NO: 174904 - protein, 15 aa, Mycobacterium tuberculosis
ARDLHDHVIQRLFAI

SEQ ID NO: 174905 - protein, 15 aa, Mycobacterium tuberculosis
RDLHDHVIQRLFAIG

SEQ ID NO: 174906 - protein, 15 aa, Mycobacterium tuberculosis
DLHDHVIQRLFAIGL

SEQ ID NO: 174907 - protein, 15 aa, Mycobacterium tuberculosis
LHDHVIQRLFAIGLA

SEQ ID NO: 174908 - protein, 15 aa, Mycobacterium tuberculosis
HDHVIQRLFAIGLAL

SEQ ID NO: 174909 - protein, 15 aa, Mycobacterium tuberculosis
DHVIQRLFAIGLALQ

SEQ ID NO: 174910 - protein, 15 aa, Mycobacterium tuberculosis
HVIQRLFAIGLALQG

SEQ ID NO: 174911 - protein, 15 aa, Mycobacterium tuberculosis
VIQRLFAIGLALQGA

SEQ ID NO: 174912 - protein, 15 aa, Mycobacterium tuberculosis
IQRLFAIGLALQGAV

SEQ ID NO: 174913 - protein, 15 aa, Mycobacterium tuberculosis
QRLFAIGLALQGAVP

SEQ ID NO: 174914 - protein, 15 aa, Mycobacterium tuberculosis
RLFAIGLALQGAVPH

SEQ ID NO: 174915 - protein, 15 aa, Mycobacterium tuberculosis
LFAIGLALQGAVPHE

SEQ ID NO: 174916 - protein, 15 aa, Mycobacterium tuberculosis
FAIGLALQGAVPHER

SEQ ID NO: 174917 - protein, 15 aa, Mycobacterium tuberculosis
AIGLALQGAVPHERN

SEQ ID NO: 174918 - protein, 15 aa, Mycobacterium tuberculosis
IGLALQGAVPHERNP

SEQ ID NO: 174919 - protein, 15 aa, Mycobacterium tuberculosis
GLALQGAVPHERNPE

SEQ ID NO: 174920 - protein, 15 aa, Mycobacterium tuberculosis
LALQGAVPHERNPEV

SEQ ID NO: 174921 - protein, 15 aa, Mycobacterium tuberculosis
ALQGAVPHERNPEVQ

SEQ ID NO: 174922 - protein, 15 aa, Mycobacterium tuberculosis
LQGAVPHERNPEVQQ

SEQ ID NO: 174923 - protein, 15 aa, Mycobacterium tuberculosis
QGAVPHERNPEVQQR

SEQ ID NO: 174924 - protein, 15 aa, Mycobacterium tuberculosis
GAVPHERNPEVQQRL

SEQ ID NO: 174925 - protein, 15 aa, Mycobacterium tuberculosis
AVPHERNPEVQQRLS

SEQ ID NO: 174926 - protein, 15 aa, Mycobacterium tuberculosis
VPHERNPEVQQRLSD

SEQ ID NO: 174927 - protein, 15 aa, Mycobacterium tuberculosis
PHERNPEVQQRLSDV

SEQ ID NO: 174928 - protein, 15 aa, Mycobacterium tuberculosis
HERNPEVQQRLSDVV

SEQ ID NO: 174929 - protein, 15 aa, Mycobacterium tuberculosis
ERNPEVQQRLSDVVD

SEQ ID NO: 174930 - protein, 15 aa, Mycobacterium tuberculosis
RNPEVQQRLSDVVDD

SEQ ID NO: 174931 - protein, 15 aa, Mycobacterium tuberculosis
NPEVQQRLSDVVDDL

SEQ ID NO: 174932 - protein, 15 aa, Mycobacterium tuberculosis
PEVQQRLSDVVDDLQ

SEQ ID NO: 174933 - protein, 15 aa, Mycobacterium tuberculosis
EVQQRLSDVVDDLQD

SEQ ID NO: 174934 - protein, 15 aa, Mycobacterium tuberculosis
VQQRLSDVVDDLQDV

SEQ ID NO: 174935 - protein, 15 aa, Mycobacterium tuberculosis
QQRLSDVVDDLQDVI

SEQ ID NO: 174936 - protein, 15 aa, Mycobacterium tuberculosis
QRLSDVVDDLQDVIQ

SEQ ID NO: 174937 - protein, 15 aa, Mycobacterium tuberculosis
RLSDVVDDLQDVIQE

SEQ ID NO: 174938 - protein, 15 aa, Mycobacterium tuberculosis
LSDVVDDLQDVIQEI

SEQ ID NO: 174939 - protein, 15 aa, Mycobacterium tuberculosis
SDVVDDLQDVIQEIR

SEQ ID NO: 174940 - protein, 15 aa, Mycobacterium tuberculosis
DVVDDLQDVIQEIRT

SEQ ID NO: 174941 - protein, 15 aa, Mycobacterium tuberculosis
VVDDLQDVIQEIRTT

SEQ ID NO: 174942 - protein, 15 aa, Mycobacterium tuberculosis
VDDLQDVIQEIRTTI

SEQ ID NO: 174943 - protein, 15 aa, Mycobacterium tuberculosis
DDLQDVIQEIRTTIY

SEQ ID NO: 174944 - protein, 15 aa, Mycobacterium tuberculosis
DLQDVIQEIRTTIYD

SEQ ID NO: 174945 - protein, 15 aa, Mycobacterium tuberculosis
LQDVIQEIRTTIYDL

SEQ ID NO: 174946 - protein, 15 aa, Mycobacterium tuberculosis
QDVIQEIRTTIYDLH

SEQ ID NO: 174947 - protein, 15 aa, Mycobacterium tuberculosis
DVIQEIRTTIYDLHG

SEQ ID NO: 174948 - protein, 15 aa, Mycobacterium tuberculosis
VIQEIRTTIYDLHGA

SEQ ID NO: 174949 - protein, 15 aa, Mycobacterium tuberculosis
IQEIRTTIYDLHGAS

SEQ ID NO: 174950 - protein, 15 aa, Mycobacterium tuberculosis
QEIRTTIYDLHGASQ

SEQ ID NO: 174951 - protein, 15 aa, Mycobacterium tuberculosis
EIRTTIYDLHGASQG

SEQ ID NO: 174952 - protein, 15 aa, Mycobacterium tuberculosis
IRTTIYDLHGASQGI

SEQ ID NO: 174953 - protein, 15 aa, Mycobacterium tuberculosis
RTTIYDLHGASQGIT

SEQ ID NO: 174954 - protein, 15 aa, Mycobacterium tuberculosis
TTIYDLHGASQGITR

SEQ ID NO: 174955 - protein, 15 aa, Mycobacterium tuberculosis
TIYDLHGASQGITRL

SEQ ID NO: 174956 - protein, 15 aa, Mycobacterium tuberculosis
IYDLHGASQGITRLR

SEQ ID NO: 174957 - protein, 15 aa, Mycobacterium tuberculosis
YDLHGASQGITRLRQ

SEQ ID NO: 174958 - protein, 15 aa, Mycobacterium tuberculosis
DLHGASQGITRLRQR

SEQ ID NO: 174959 - protein, 15 aa, Mycobacterium tuberculosis
LHGASQGITRLRQRI

SEQ ID NO: 174960 - protein, 15 aa, Mycobacterium tuberculosis
HGASQGITRLRQRID

SEQ ID NO: 174961 - protein, 15 aa, Mycobacterium tuberculosis
GASQGITRLRQRIDA

SEQ ID NO: 174962 - protein, 15 aa, Mycobacterium tuberculosis
ASQGITRLRQRIDAA

SEQ ID NO: 174963 - protein, 15 aa, Mycobacterium tuberculosis
SQGITRLRQRIDAAV

SEQ ID NO: 174964 - protein, 15 aa, Mycobacterium tuberculosis
QGITRLRQRIDAAVA

SEQ ID NO: 174965 - protein, 15 aa, Mycobacterium tuberculosis
GITRLRQRIDAAVAQ

SEQ ID NO: 174966 - protein, 15 aa, Mycobacterium tuberculosis
ITRLRQRIDAAVAQF

SEQ ID NO: 174967 - protein, 15 aa, Mycobacterium tuberculosis
TRLRQRIDAAVAQFA

SEQ ID NO: 174968 - protein, 15 aa, Mycobacterium tuberculosis
RLRQRIDAAVAQFAD

SEQ ID NO: 174969 - protein, 15 aa, Mycobacterium tuberculosis
LRQRIDAAVAQFADS

SEQ ID NO: 174970 - protein, 15 aa, Mycobacterium tuberculosis
RQRIDAAVAQFADSG

SEQ ID NO: 174971 - protein, 15 aa, Mycobacterium tuberculosis
QRIDAAVAQFADSGL

SEQ ID NO: 174972 - protein, 15 aa, Mycobacterium tuberculosis
RIDAAVAQFADSGLR

SEQ ID NO: 174973 - protein, 15 aa, Mycobacterium tuberculosis
IDAAVAQFADSGLRT

SEQ ID NO: 174974 - protein, 15 aa, Mycobacterium tuberculosis
DAAVAQFADSGLRTS

SEQ ID NO: 174975 - protein, 15 aa, Mycobacterium tuberculosis
AAVAQFADSGLRTSV

SEQ ID NO: 174976 - protein, 15 aa, Mycobacterium tuberculosis
AVAQFADSGLRTSVQ

SEQ ID NO: 174977 - protein, 15 aa, Mycobacterium tuberculosis
VAQFADSGLRTSVQF

SEQ ID NO: 174978 - protein, 15 aa, Mycobacterium tuberculosis
AQFADSGLRTSVQFV

SEQ ID NO: 174979 - protein, 15 aa, Mycobacterium tuberculosis
QFADSGLRTSVQFVG

SEQ ID NO: 174980 - protein, 15 aa, Mycobacterium tuberculosis
FADSGLRTSVQFVGP

SEQ ID NO: 174981 - protein, 15 aa, Mycobacterium tuberculosis
ADSGLRTSVQFVGPL

SEQ ID NO: 174982 - protein, 15 aa, Mycobacterium tuberculosis
DSGLRTSVQFVGPLS

SEQ ID NO: 174983 - protein, 15 aa, Mycobacterium tuberculosis
SGLRTSVQFVGPLSV

SEQ ID NO: 174984 - protein, 15 aa, Mycobacterium tuberculosis
GLRTSVQFVGPLSVV

SEQ ID NO: 174985 - protein, 15 aa, Mycobacterium tuberculosis
LRTSVQFVGPLSVVD

SEQ ID NO: 174986 - protein, 15 aa, Mycobacterium tuberculosis
RTSVQFVGPLSVVDS

SEQ ID NO: 174987 - protein, 15 aa, Mycobacterium tuberculosis
TSVQFVGPLSVVDSA

SEQ ID NO: 174988 - protein, 15 aa, Mycobacterium tuberculosis
SVQFVGPLSVVDSAL

SEQ ID NO: 174989 - protein, 15 aa, Mycobacterium tuberculosis
VQFVGPLSVVDSALA

SEQ ID NO: 174990 - protein, 15 aa, Mycobacterium tuberculosis
QFVGPLSVVDSALAD

SEQ ID NO: 174991 - protein, 15 aa, Mycobacterium tuberculosis
FVGPLSVVDSALADQ

SEQ ID NO: 174992 - protein, 15 aa, Mycobacterium tuberculosis
VGPLSVVDSALADQA

SEQ ID NO: 174993 - protein, 15 aa, Mycobacterium tuberculosis
GPLSVVDSALADQAE

SEQ ID NO: 174994 - protein, 15 aa, Mycobacterium tuberculosis
PLSVVDSALADQAEA

SEQ ID NO: 174995 - protein, 15 aa, Mycobacterium tuberculosis
LSVVDSALADQAEAV

SEQ ID NO: 174996 - protein, 15 aa, Mycobacterium tuberculosis
SVVDSALADQAEAVV

SEQ ID NO: 174997 - protein, 15 aa, Mycobacterium tuberculosis
VVDSALADQAEAVVR

SEQ ID NO: 174998 - protein, 15 aa, Mycobacterium tuberculosis
VDSALADQAEAVVRE

SEQ ID NO: 174999 - protein, 15 aa, Mycobacterium tuberculosis
DSALADQAEAVVREA

SEQ ID NO: 175000 - protein, 15 aa, Mycobacterium tuberculosis
SALADQAEAVVREAV

SEQ ID NO: 175001 - protein, 15 aa, Mycobacterium tuberculosis
ALADQAEAVVREAVS

SEQ ID NO: 175002 - protein, 15 aa, Mycobacterium tuberculosis
LADQAEAVVREAVSN

SEQ ID NO: 175003 - protein, 15 aa, Mycobacterium tuberculosis
ADQAEAVVREAVSNA

SEQ ID NO: 175004 - protein, 15 aa, Mycobacterium tuberculosis
DQAEAVVREAVSNAV

SEQ ID NO: 175005 - protein, 15 aa, Mycobacterium tuberculosis
QAEAVVREAVSNAVR

SEQ ID NO: 175006 - protein, 15 aa, Mycobacterium tuberculosis
AEAVVREAVSNAVRH

SEQ ID NO: 175007 - protein, 15 aa, Mycobacterium tuberculosis
EAVVREAVSNAVRHA

SEQ ID NO: 175008 - protein, 15 aa, Mycobacterium tuberculosis
AVVREAVSNAVRHAK

SEQ ID NO: 175009 - protein, 15 aa, Mycobacterium tuberculosis
VVREAVSNAVRHAKA

SEQ ID NO: 175010 - protein, 15 aa, Mycobacterium tuberculosis
VREAVSNAVRHAKAS

SEQ ID NO: 175011 - protein, 15 aa, Mycobacterium tuberculosis
REAVSNAVRHAKAST

SEQ ID NO: 175012 - protein, 15 aa, Mycobacterium tuberculosis
EAVSNAVRHAKASTL

SEQ ID NO: 175013 - protein, 15 aa, Mycobacterium tuberculosis
AVSNAVRHAKASTLT

SEQ ID NO: 175014 - protein, 15 aa, Mycobacterium tuberculosis
VSNAVRHAKASTLTV

SEQ ID NO: 175015 - protein, 15 aa, Mycobacterium tuberculosis
SNAVRHAKASTLTVR

SEQ ID NO: 175016 - protein, 15 aa, Mycobacterium tuberculosis
NAVRHAKASTLTVRV

SEQ ID NO: 175017 - protein, 15 aa, Mycobacterium tuberculosis
AVRHAKASTLTVRVK

SEQ ID NO: 175018 - protein, 15 aa, Mycobacterium tuberculosis
VRHAKASTLTVRVKV

SEQ ID NO: 175019 - protein, 15 aa, Mycobacterium tuberculosis
RHAKASTLTVRVKVD

SEQ ID NO: 175020 - protein, 15 aa, Mycobacterium tuberculosis
HAKASTLTVRVKVDD

SEQ ID NO: 175021 - protein, 15 aa, Mycobacterium tuberculosis
AKASTLTVRVKVDDD

SEQ ID NO: 175022 - protein, 15 aa, Mycobacterium tuberculosis
KASTLTVRVKVDDDL

SEQ ID NO: 175023 - protein, 15 aa, Mycobacterium tuberculosis
ASTLTVRVKVDDDLC

SEQ ID NO: 175024 - protein, 15 aa, Mycobacterium tuberculosis
STLTVRVKVDDDLCI

SEQ ID NO: 175025 - protein, 15 aa, Mycobacterium tuberculosis
TLTVRVKVDDDLCIE

SEQ ID NO: 175026 - protein, 15 aa, Mycobacterium tuberculosis
LTVRVKVDDDLCIEV

SEQ ID NO: 175027 - protein, 15 aa, Mycobacterium tuberculosis
TVRVKVDDDLCIEVT

SEQ ID NO: 175028 - protein, 15 aa, Mycobacterium tuberculosis
VRVKVDDDLCIEVTD

SEQ ID NO: 175029 - protein, 15 aa, Mycobacterium tuberculosis
RVKVDDDLCIEVTDN

SEQ ID NO: 175030 - protein, 15 aa, Mycobacterium tuberculosis
VKVDDDLCIEVTDNG

SEQ ID NO: 175031 - protein, 15 aa, Mycobacterium tuberculosis
KVDDDLCIEVTDNGR

SEQ ID NO: 175032 - protein, 15 aa, Mycobacterium tuberculosis
VDDDLCIEVTDNGRG

SEQ ID NO: 175033 - protein, 15 aa, Mycobacterium tuberculosis
DDDLCIEVTDNGRGL

SEQ ID NO: 175034 - protein, 15 aa, Mycobacterium tuberculosis
DDLCIEVTDNGRGLP

SEQ ID NO: 175035 - protein, 15 aa, Mycobacterium tuberculosis
DLCIEVTDNGRGLPD

SEQ ID NO: 175036 - protein, 15 aa, Mycobacterium tuberculosis
LCIEVTDNGRGLPDE

SEQ ID NO: 175037 - protein, 15 aa, Mycobacterium tuberculosis
CIEVTDNGRGLPDEF

SEQ ID NO: 175038 - protein, 15 aa, Mycobacterium tuberculosis
IEVTDNGRGLPDEFT

SEQ ID NO: 175039 - protein, 15 aa, Mycobacterium tuberculosis
EVTDNGRGLPDEFTG

SEQ ID NO: 175040 - protein, 15 aa, Mycobacterium tuberculosis
VTDNGRGLPDEFTGS

SEQ ID NO: 175041 - protein, 15 aa, Mycobacterium tuberculosis
TDNGRGLPDEFTGSG

SEQ ID NO: 175042 - protein, 15 aa, Mycobacterium tuberculosis
DNGRGLPDEFTGSGL

SEQ ID NO: 175043 - protein, 15 aa, Mycobacterium tuberculosis
NGRGLPDEFTGSGLT

SEQ ID NO: 175044 - protein, 15 aa, Mycobacterium tuberculosis
GRGLPDEFTGSGLTN

SEQ ID NO: 175045 - protein, 15 aa, Mycobacterium tuberculosis
RGLPDEFTGSGLTNL

SEQ ID NO: 175046 - protein, 15 aa, Mycobacterium tuberculosis
GLPDEFTGSGLTNLR

SEQ ID NO: 175047 - protein, 15 aa, Mycobacterium tuberculosis
LPDEFTGSGLTNLRQ

SEQ ID NO: 175048 - protein, 15 aa, Mycobacterium tuberculosis
PDEFTGSGLTNLRQR

SEQ ID NO: 175049 - protein, 15 aa, Mycobacterium tuberculosis
DEFTGSGLTNLRQRA

SEQ ID NO: 175050 - protein, 15 aa, Mycobacterium tuberculosis
EFTGSGLTNLRQRAE

SEQ ID NO: 175051 - protein, 15 aa, Mycobacterium tuberculosis
FTGSGLTNLRQRAEQ

SEQ ID NO: 175052 - protein, 15 aa, Mycobacterium tuberculosis
TGSGLTNLRQRAEQA

SEQ ID NO: 175053 - protein, 15 aa, Mycobacterium tuberculosis
GSGLTNLRQRAEQAG

SEQ ID NO: 175054 - protein, 15 aa, Mycobacterium tuberculosis
SGLTNLRQRAEQAGG

SEQ ID NO: 175055 - protein, 15 aa, Mycobacterium tuberculosis
GLTNLRQRAEQAGGE

SEQ ID NO: 175056 - protein, 15 aa, Mycobacterium tuberculosis
LTNLRQRAEQAGGEF

SEQ ID NO: 175057 - protein, 15 aa, Mycobacterium tuberculosis
TNLRQRAEQAGGEFT

SEQ ID NO: 175058 - protein, 15 aa, Mycobacterium tuberculosis
NLRQRAEQAGGEFTL

SEQ ID NO: 175059 - protein, 15 aa, Mycobacterium tuberculosis
LRQRAEQAGGEFTLA

SEQ ID NO: 175060 - protein, 15 aa, Mycobacterium tuberculosis
RQRAEQAGGEFTLAS

SEQ ID NO: 175061 - protein, 15 aa, Mycobacterium tuberculosis
QRAEQAGGEFTLASV

SEQ ID NO: 175062 - protein, 15 aa, Mycobacterium tuberculosis
RAEQAGGEFTLASVP

SEQ ID NO: 175063 - protein, 15 aa, Mycobacterium tuberculosis
AEQAGGEFTLASVPG

SEQ ID NO: 175064 - protein, 15 aa, Mycobacterium tuberculosis
EQAGGEFTLASVPGA

SEQ ID NO: 175065 - protein, 15 aa, Mycobacterium tuberculosis
QAGGEFTLASVPGAS

SEQ ID NO: 175066 - protein, 15 aa, Mycobacterium tuberculosis
AGGEFTLASVPGASG

SEQ ID NO: 175067 - protein, 15 aa, Mycobacterium tuberculosis
GGEFTLASVPGASGT

SEQ ID NO: 175068 - protein, 15 aa, Mycobacterium tuberculosis
GEFTLASVPGASGTV

SEQ ID NO: 175069 - protein, 15 aa, Mycobacterium tuberculosis
EFTLASVPGASGTVL

SEQ ID NO: 175070 - protein, 15 aa, Mycobacterium tuberculosis
FTLASVPGASGTVLR

SEQ ID NO: 175071 - protein, 15 aa, Mycobacterium tuberculosis
TLASVPGASGTVLRW

SEQ ID NO: 175072 - protein, 15 aa, Mycobacterium tuberculosis
LASVPGASGTVLRWS

SEQ ID NO: 175073 - protein, 15 aa, Mycobacterium tuberculosis
ASVPGASGTVLRWSA

SEQ ID NO: 175074 - protein, 15 aa, Mycobacterium tuberculosis
SVPGASGTVLRWSAP

SEQ ID NO: 175075 - protein, 15 aa, Mycobacterium tuberculosis
VPGASGTVLRWSAPL

SEQ ID NO: 175076 - protein, 15 aa, Mycobacterium tuberculosis
PGASGTVLRWSAPLS

SEQ ID NO: 175077 - protein, 15 aa, Mycobacterium tuberculosis
GASGTVLRWSAPLSQ

SEQ ID NO: 175078 - protein, 16 aa, Mycobacterium tuberculosis
MTTGGLVDENDGAAMR

SEQ ID NO: 175079 - protein, 16 aa, Mycobacterium tuberculosis
TTGGLVDENDGAAMRP

SEQ ID NO: 175080 - protein, 16 aa, Mycobacterium tuberculosis
TGGLVDENDGAAMRPL

SEQ ID NO: 175081 - protein, 16 aa, Mycobacterium tuberculosis
GGLVDENDGAAMRPLR

SEQ ID NO: 175082 - protein, 16 aa, Mycobacterium tuberculosis
GLVDENDGAAMRPLRH

SEQ ID NO: 175083 - protein, 16 aa, Mycobacterium tuberculosis
LVDENDGAAMRPLRHT

SEQ ID NO: 175084 - protein, 16 aa, Mycobacterium tuberculosis
VDENDGAAMRPLRHTL

SEQ ID NO: 175085 - protein, 16 aa, Mycobacterium tuberculosis
DENDGAAMRPLRHTLS

SEQ ID NO: 175086 - protein, 16 aa, Mycobacterium tuberculosis
ENDGAAMRPLRHTLSQ

SEQ ID NO: 175087 - protein, 16 aa, Mycobacterium tuberculosis
NDGAAMRPLRHTLSQL

SEQ ID NO: 175088 - protein, 16 aa, Mycobacterium tuberculosis
DGAAMRPLRHTLSQLR

SEQ ID NO: 175089 - protein, 16 aa, Mycobacterium tuberculosis
GAAMRPLRHTLSQLRL

SEQ ID NO: 175090 - protein, 16 aa, Mycobacterium tuberculosis
AAMRPLRHTLSQLRLH

SEQ ID NO: 175091 - protein, 16 aa, Mycobacterium tuberculosis
AMRPLRHTLSQLRLHE

SEQ ID NO: 175092 - protein, 16 aa, Mycobacterium tuberculosis
MRPLRHTLSQLRLHEL

SEQ ID NO: 175093 - protein, 16 aa, Mycobacterium tuberculosis
RPLRHTLSQLRLHELL

SEQ ID NO: 175094 - protein, 16 aa, Mycobacterium tuberculosis
PLRHTLSQLRLHELLV

SEQ ID NO: 175095 - protein, 16 aa, Mycobacterium tuberculosis
LRHTLSQLRLHELLVE

SEQ ID NO: 175096 - protein, 16 aa, Mycobacterium tuberculosis
RHTLSQLRLHELLVEV

SEQ ID NO: 175097 - protein, 16 aa, Mycobacterium tuberculosis
HTLSQLRLHELLVEVQ

SEQ ID NO: 175098 - protein, 16 aa, Mycobacterium tuberculosis
TLSQLRLHELLVEVQD

SEQ ID NO: 175099 - protein, 16 aa, Mycobacterium tuberculosis
LSQLRLHELLVEVQDR

SEQ ID NO: 175100 - protein, 16 aa, Mycobacterium tuberculosis
SQLRLHELLVEVQDRV

SEQ ID NO: 175101 - protein, 16 aa, Mycobacterium tuberculosis
QLRLHELLVEVQDRVE

SEQ ID NO: 175102 - protein, 16 aa, Mycobacterium tuberculosis
LRLHELLVEVQDRVEQ

SEQ ID NO: 175103 - protein, 16 aa, Mycobacterium tuberculosis
RLHELLVEVQDRVEQI

SEQ ID NO: 175104 - protein, 16 aa, Mycobacterium tuberculosis
LHELLVEVQDRVEQIV

SEQ ID NO: 175105 - protein, 16 aa, Mycobacterium tuberculosis
HELLVEVQDRVEQIVE

SEQ ID NO: 175106 - protein, 16 aa, Mycobacterium tuberculosis
ELLVEVQDRVEQIVEG

SEQ ID NO: 175107 - protein, 16 aa, Mycobacterium tuberculosis
LLVEVQDRVEQIVEGR

SEQ ID NO: 175108 - protein, 16 aa, Mycobacterium tuberculosis
LVEVQDRVEQIVEGRD

SEQ ID NO: 175109 - protein, 16 aa, Mycobacterium tuberculosis
VEVQDRVEQIVEGRDR

SEQ ID NO: 175110 - protein, 16 aa, Mycobacterium tuberculosis
EVQDRVEQIVEGRDRL

SEQ ID NO: 175111 - protein, 16 aa, Mycobacterium tuberculosis
VQDRVEQIVEGRDRLD

SEQ ID NO: 175112 - protein, 16 aa, Mycobacterium tuberculosis
QDRVEQIVEGRDRLDG

SEQ ID NO: 175113 - protein, 16 aa, Mycobacterium tuberculosis
DRVEQIVEGRDRLDGL

SEQ ID NO: 175114 - protein, 16 aa, Mycobacterium tuberculosis
RVEQIVEGRDRLDGLV

SEQ ID NO: 175115 - protein, 16 aa, Mycobacterium tuberculosis
VEQIVEGRDRLDGLVE

SEQ ID NO: 175116 - protein, 16 aa, Mycobacterium tuberculosis
EQIVEGRDRLDGLVEA

SEQ ID NO: 175117 - protein, 16 aa, Mycobacterium tuberculosis
QIVEGRDRLDGLVEAM

SEQ ID NO: 175118 - protein, 16 aa, Mycobacterium tuberculosis
IVEGRDRLDGLVEAML

SEQ ID NO: 175119 - protein, 16 aa, Mycobacterium tuberculosis
VEGRDRLDGLVEAMLV

SEQ ID NO: 175120 - protein, 16 aa, Mycobacterium tuberculosis
EGRDRLDGLVEAMLVV

SEQ ID NO: 175121 - protein, 16 aa, Mycobacterium tuberculosis
GRDRLDGLVEAMLVVT

SEQ ID NO: 175122 - protein, 16 aa, Mycobacterium tuberculosis
RDRLDGLVEAMLVVTA

SEQ ID NO: 175123 - protein, 16 aa, Mycobacterium tuberculosis
DRLDGLVEAMLVVTAG

SEQ ID NO: 175124 - protein, 16 aa, Mycobacterium tuberculosis
RLDGLVEAMLVVTAGL

SEQ ID NO: 175125 - protein, 16 aa, Mycobacterium tuberculosis
LDGLVEAMLVVTAGLD

SEQ ID NO: 175126 - protein, 16 aa, Mycobacterium tuberculosis
DGLVEAMLVVTAGLDL

SEQ ID NO: 175127 - protein, 16 aa, Mycobacterium tuberculosis
GLVEAMLVVTAGLDLE

SEQ ID NO: 175128 - protein, 16 aa, Mycobacterium tuberculosis
LVEAMLVVTAGLDLEA

SEQ ID NO: 175129 - protein, 16 aa, Mycobacterium tuberculosis
VEAMLVVTAGLDLEAT

SEQ ID NO: 175130 - protein, 16 aa, Mycobacterium tuberculosis
EAMLVVTAGLDLEATL

SEQ ID NO: 175131 - protein, 16 aa, Mycobacterium tuberculosis
AMLVVTAGLDLEATLR

SEQ ID NO: 175132 - protein, 16 aa, Mycobacterium tuberculosis
MLVVTAGLDLEATLRA

SEQ ID NO: 175133 - protein, 16 aa, Mycobacterium tuberculosis
LVVTAGLDLEATLRAI

SEQ ID NO: 175134 - protein, 16 aa, Mycobacterium tuberculosis
VVTAGLDLEATLRAIV

SEQ ID NO: 175135 - protein, 16 aa, Mycobacterium tuberculosis
VTAGLDLEATLRAIVH

SEQ ID NO: 175136 - protein, 16 aa, Mycobacterium tuberculosis
TAGLDLEATLRAIVHS

SEQ ID NO: 175137 - protein, 16 aa, Mycobacterium tuberculosis
AGLDLEATLRAIVHSA

SEQ ID NO: 175138 - protein, 16 aa, Mycobacterium tuberculosis
GLDLEATLRAIVHSAT

SEQ ID NO: 175139 - protein, 16 aa, Mycobacterium tuberculosis
LDLEATLRAIVHSATS

SEQ ID NO: 175140 - protein, 16 aa, Mycobacterium tuberculosis
DLEATLRAIVHSATSL

SEQ ID NO: 175141 - protein, 16 aa, Mycobacterium tuberculosis
LEATLRAIVHSATSLV

SEQ ID NO: 175142 - protein, 16 aa, Mycobacterium tuberculosis
EATLRAIVHSATSLVD

SEQ ID NO: 175143 - protein, 16 aa, Mycobacterium tuberculosis
ATLRAIVHSATSLVDA

SEQ ID NO: 175144 - protein, 16 aa, Mycobacterium tuberculosis
TLRAIVHSATSLVDAR

SEQ ID NO: 175145 - protein, 16 aa, Mycobacterium tuberculosis
LRAIVHSATSLVDARY

SEQ ID NO: 175146 - protein, 16 aa, Mycobacterium tuberculosis
RAIVHSATSLVDARYG

SEQ ID NO: 175147 - protein, 16 aa, Mycobacterium tuberculosis
AIVHSATSLVDARYGA

SEQ ID NO: 175148 - protein, 16 aa, Mycobacterium tuberculosis
IVHSATSLVDARYGAM

SEQ ID NO: 175149 - protein, 16 aa, Mycobacterium tuberculosis
VHSATSLVDARYGAME

SEQ ID NO: 175150 - protein, 16 aa, Mycobacterium tuberculosis
HSATSLVDARYGAMEV

SEQ ID NO: 175151 - protein, 16 aa, Mycobacterium tuberculosis
SATSLVDARYGAMEVH

SEQ ID NO: 175152 - protein, 16 aa, Mycobacterium tuberculosis
ATSLVDARYGAMEVHD

SEQ ID NO: 175153 - protein, 16 aa, Mycobacterium tuberculosis
TSLVDARYGAMEVHDR

SEQ ID NO: 175154 - protein, 16 aa, Mycobacterium tuberculosis
SLVDARYGAMEVHDRQ

SEQ ID NO: 175155 - protein, 16 aa, Mycobacterium tuberculosis
LVDARYGAMEVHDRQH

SEQ ID NO: 175156 - protein, 16 aa, Mycobacterium tuberculosis
VDARYGAMEVHDRQHR

SEQ ID NO: 175157 - protein, 16 aa, Mycobacterium tuberculosis
DARYGAMEVHDRQHRV

SEQ ID NO: 175158 - protein, 16 aa, Mycobacterium tuberculosis
ARYGAMEVHDRQHRVL

SEQ ID NO: 175159 - protein, 16 aa, Mycobacterium tuberculosis
RYGAMEVHDRQHRVLH

SEQ ID NO: 175160 - protein, 16 aa, Mycobacterium tuberculosis
YGAMEVHDRQHRVLHF

SEQ ID NO: 175161 - protein, 16 aa, Mycobacterium tuberculosis
GAMEVHDRQHRVLHFV

SEQ ID NO: 175162 - protein, 16 aa, Mycobacterium tuberculosis
AMEVHDRQHRVLHFVY

SEQ ID NO: 175163 - protein, 16 aa, Mycobacterium tuberculosis
MEVHDRQHRVLHFVYE

SEQ ID NO: 175164 - protein, 16 aa, Mycobacterium tuberculosis
EVHDRQHRVLHFVYEG

SEQ ID NO: 175165 - protein, 16 aa, Mycobacterium tuberculosis
VHDRQHRVLHFVYEGI

SEQ ID NO: 175166 - protein, 16 aa, Mycobacterium tuberculosis
HDRQHRVLHFVYEGID

SEQ ID NO: 175167 - protein, 16 aa, Mycobacterium tuberculosis
DRQHRVLHFVYEGIDE

SEQ ID NO: 175168 - protein, 16 aa, Mycobacterium tuberculosis
RQHRVLHFVYEGIDEE

SEQ ID NO: 175169 - protein, 16 aa, Mycobacterium tuberculosis
QHRVLHFVYEGIDEET

SEQ ID NO: 175170 - protein, 16 aa, Mycobacterium tuberculosis
HRVLHFVYEGIDEETV

SEQ ID NO: 175171 - protein, 16 aa, Mycobacterium tuberculosis
RVLHFVYEGIDEETVR

SEQ ID NO: 175172 - protein, 16 aa, Mycobacterium tuberculosis
VLHFVYEGIDEETVRR

SEQ ID NO: 175173 - protein, 16 aa, Mycobacterium tuberculosis
LHFVYEGIDEETVRRI

SEQ ID NO: 175174 - protein, 16 aa, Mycobacterium tuberculosis
HFVYEGIDEETVRRIG

SEQ ID NO: 175175 - protein, 16 aa, Mycobacterium tuberculosis
FVYEGIDEETVRRIGH

SEQ ID NO: 175176 - protein, 16 aa, Mycobacterium tuberculosis
VYEGIDEETVRRIGHL

SEQ ID NO: 175177 - protein, 16 aa, Mycobacterium tuberculosis
YEGIDEETVRRIGHLP

SEQ ID NO: 175178 - protein, 16 aa, Mycobacterium tuberculosis
EGIDEETVRRIGHLPK

SEQ ID NO: 175179 - protein, 16 aa, Mycobacterium tuberculosis
GIDEETVRRIGHLPKG

SEQ ID NO: 175180 - protein, 16 aa, Mycobacterium tuberculosis
IDEETVRRIGHLPKGL

SEQ ID NO: 175181 - protein, 16 aa, Mycobacterium tuberculosis
DEETVRRIGHLPKGLG

SEQ ID NO: 175182 - protein, 16 aa, Mycobacterium tuberculosis
EETVRRIGHLPKGLGV

SEQ ID NO: 175183 - protein, 16 aa, Mycobacterium tuberculosis
ETVRRIGHLPKGLGVI

SEQ ID NO: 175184 - protein, 16 aa, Mycobacterium tuberculosis
TVRRIGHLPKGLGVIG

SEQ ID NO: 175185 - protein, 16 aa, Mycobacterium tuberculosis
VRRIGHLPKGLGVIGL

SEQ ID NO: 175186 - protein, 16 aa, Mycobacterium tuberculosis
RRIGHLPKGLGVIGLL

SEQ ID NO: 175187 - protein, 16 aa, Mycobacterium tuberculosis
RIGHLPKGLGVIGLLI

SEQ ID NO: 175188 - protein, 16 aa, Mycobacterium tuberculosis
IGHLPKGLGVIGLLIE

SEQ ID NO: 175189 - protein, 16 aa, Mycobacterium tuberculosis
GHLPKGLGVIGLLIED

SEQ ID NO: 175190 - protein, 16 aa, Mycobacterium tuberculosis
HLPKGLGVIGLLIEDP

SEQ ID NO: 175191 - protein, 16 aa, Mycobacterium tuberculosis
LPKGLGVIGLLIEDPK

SEQ ID NO: 175192 - protein, 16 aa, Mycobacterium tuberculosis
PKGLGVIGLLIEDPKP

SEQ ID NO: 175193 - protein, 16 aa, Mycobacterium tuberculosis
KGLGVIGLLIEDPKPL

SEQ ID NO: 175194 - protein, 16 aa, Mycobacterium tuberculosis
GLGVIGLLIEDPKPLR

SEQ ID NO: 175195 - protein, 16 aa, Mycobacterium tuberculosis
LGVIGLLIEDPKPLRL

SEQ ID NO: 175196 - protein, 16 aa, Mycobacterium tuberculosis
GVIGLLIEDPKPLRLD

SEQ ID NO: 175197 - protein, 16 aa, Mycobacterium tuberculosis
VIGLLIEDPKPLRLDD

SEQ ID NO: 175198 - protein, 16 aa, Mycobacterium tuberculosis
IGLLIEDPKPLRLDDV

SEQ ID NO: 175199 - protein, 16 aa, Mycobacterium tuberculosis
GLLIEDPKPLRLDDVS

SEQ ID NO: 175200 - protein, 16 aa, Mycobacterium tuberculosis
LLIEDPKPLRLDDVSA

SEQ ID NO: 175201 - protein, 16 aa, Mycobacterium tuberculosis
LIEDPKPLRLDDVSAH

SEQ ID NO: 175202 - protein, 16 aa, Mycobacterium tuberculosis
IEDPKPLRLDDVSAHP

SEQ ID NO: 175203 - protein, 16 aa, Mycobacterium tuberculosis
EDPKPLRLDDVSAHPA

SEQ ID NO: 175204 - protein, 16 aa, Mycobacterium tuberculosis
DPKPLRLDDVSAHPAS

SEQ ID NO: 175205 - protein, 16 aa, Mycobacterium tuberculosis
PKPLRLDDVSAHPASI

SEQ ID NO: 175206 - protein, 16 aa, Mycobacterium tuberculosis
KPLRLDDVSAHPASIG

SEQ ID NO: 175207 - protein, 16 aa, Mycobacterium tuberculosis
PLRLDDVSAHPASIGF

SEQ ID NO: 175208 - protein, 16 aa, Mycobacterium tuberculosis
LRLDDVSAHPASIGFP

SEQ ID NO: 175209 - protein, 16 aa, Mycobacterium tuberculosis
RLDDVSAHPASIGFPP

SEQ ID NO: 175210 - protein, 16 aa, Mycobacterium tuberculosis
LDDVSAHPASIGFPPY

SEQ ID NO: 175211 - protein, 16 aa, Mycobacterium tuberculosis
DDVSAHPASIGFPPYH

SEQ ID NO: 175212 - protein, 16 aa, Mycobacterium tuberculosis
DVSAHPASIGFPPYHP

SEQ ID NO: 175213 - protein, 16 aa, Mycobacterium tuberculosis
VSAHPASIGFPPYHPP

SEQ ID NO: 175214 - protein, 16 aa, Mycobacterium tuberculosis
SAHPASIGFPPYHPPM

SEQ ID NO: 175215 - protein, 16 aa, Mycobacterium tuberculosis
AHPASIGFPPYHPPMR

SEQ ID NO: 175216 - protein, 16 aa, Mycobacterium tuberculosis
HPASIGFPPYHPPMRT

SEQ ID NO: 175217 - protein, 16 aa, Mycobacterium tuberculosis
PASIGFPPYHPPMRTF

SEQ ID NO: 175218 - protein, 16 aa, Mycobacterium tuberculosis
ASIGFPPYHPPMRTFL

SEQ ID NO: 175219 - protein, 16 aa, Mycobacterium tuberculosis
SIGFPPYHPPMRTFLG

SEQ ID NO: 175220 - protein, 16 aa, Mycobacterium tuberculosis
IGFPPYHPPMRTFLGV

SEQ ID NO: 175221 - protein, 16 aa, Mycobacterium tuberculosis
GFPPYHPPMRTFLGVP

SEQ ID NO: 175222 - protein, 16 aa, Mycobacterium tuberculosis
FPPYHPPMRTFLGVPV

SEQ ID NO: 175223 - protein, 16 aa, Mycobacterium tuberculosis
PPYHPPMRTFLGVPVR

SEQ ID NO: 175224 - protein, 16 aa, Mycobacterium tuberculosis
PYHPPMRTFLGVPVRV

SEQ ID NO: 175225 - protein, 16 aa, Mycobacterium tuberculosis
YHPPMRTFLGVPVRVR

SEQ ID NO: 175226 - protein, 16 aa, Mycobacterium tuberculosis
HPPMRTFLGVPVRVRD

SEQ ID NO: 175227 - protein, 16 aa, Mycobacterium tuberculosis
PPMRTFLGVPVRVRDE

SEQ ID NO: 175228 - protein, 16 aa, Mycobacterium tuberculosis
PMRTFLGVPVRVRDES

SEQ ID NO: 175229 - protein, 16 aa, Mycobacterium tuberculosis
MRTFLGVPVRVRDESF

SEQ ID NO: 175230 - protein, 16 aa, Mycobacterium tuberculosis
RTFLGVPVRVRDESFG

SEQ ID NO: 175231 - protein, 16 aa, Mycobacterium tuberculosis
TFLGVPVRVRDESFGT

SEQ ID NO: 175232 - protein, 16 aa, Mycobacterium tuberculosis
FLGVPVRVRDESFGTL

SEQ ID NO: 175233 - protein, 16 aa, Mycobacterium tuberculosis
LGVPVRVRDESFGTLY

SEQ ID NO: 175234 - protein, 16 aa, Mycobacterium tuberculosis
GVPVRVRDESFGTLYL

SEQ ID NO: 175235 - protein, 16 aa, Mycobacterium tuberculosis
VPVRVRDESFGTLYLT

SEQ ID NO: 175236 - protein, 16 aa, Mycobacterium tuberculosis
PVRVRDESFGTLYLTD

SEQ ID NO: 175237 - protein, 16 aa, Mycobacterium tuberculosis
VRVRDESFGTLYLTDK

SEQ ID NO: 175238 - protein, 16 aa, Mycobacterium tuberculosis
RVRDESFGTLYLTDKT

SEQ ID NO: 175239 - protein, 16 aa, Mycobacterium tuberculosis
VRDESFGTLYLTDKTN

SEQ ID NO: 175240 - protein, 16 aa, Mycobacterium tuberculosis
RDESFGTLYLTDKTNG

SEQ ID NO: 175241 - protein, 16 aa, Mycobacterium tuberculosis
DESFGTLYLTDKTNGQ

SEQ ID NO: 175242 - protein, 16 aa, Mycobacterium tuberculosis
ESFGTLYLTDKTNGQP

SEQ ID NO: 175243 - protein, 16 aa, Mycobacterium tuberculosis
SFGTLYLTDKTNGQPF

SEQ ID NO: 175244 - protein, 16 aa, Mycobacterium tuberculosis
FGTLYLTDKTNGQPFS

SEQ ID NO: 175245 - protein, 16 aa, Mycobacterium tuberculosis
GTLYLTDKTNGQPFSD

SEQ ID NO: 175246 - protein, 16 aa, Mycobacterium tuberculosis
TLYLTDKTNGQPFSDD

SEQ ID NO: 175247 - protein, 16 aa, Mycobacterium tuberculosis
LYLTDKTNGQPFSDDD

SEQ ID NO: 175248 - protein, 16 aa, Mycobacterium tuberculosis
YLTDKTNGQPFSDDDE

SEQ ID NO: 175249 - protein, 16 aa, Mycobacterium tuberculosis
LTDKTNGQPFSDDDEV

SEQ ID NO: 175250 - protein, 16 aa, Mycobacterium tuberculosis
TDKTNGQPFSDDDEVL

SEQ ID NO: 175251 - protein, 16 aa, Mycobacterium tuberculosis
DKTNGQPFSDDDEVLV

SEQ ID NO: 175252 - protein, 16 aa, Mycobacterium tuberculosis
KTNGQPFSDDDEVLVQ

SEQ ID NO: 175253 - protein, 16 aa, Mycobacterium tuberculosis
TNGQPFSDDDEVLVQA

SEQ ID NO: 175254 - protein, 16 aa, Mycobacterium tuberculosis
NGQPFSDDDEVLVQAL

SEQ ID NO: 175255 - protein, 16 aa, Mycobacterium tuberculosis
GQPFSDDDEVLVQALA

SEQ ID NO: 175256 - protein, 16 aa, Mycobacterium tuberculosis
QPFSDDDEVLVQALAA

SEQ ID NO: 175257 - protein, 16 aa, Mycobacterium tuberculosis
PFSDDDEVLVQALAAA

SEQ ID NO: 175258 - protein, 16 aa, Mycobacterium tuberculosis
FSDDDEVLVQALAAAA

SEQ ID NO: 175259 - protein, 16 aa, Mycobacterium tuberculosis
SDDDEVLVQALAAAAG

SEQ ID NO: 175260 - protein, 16 aa, Mycobacterium tuberculosis
DDDEVLVQALAAAAGI

SEQ ID NO: 175261 - protein, 16 aa, Mycobacterium tuberculosis
DDEVLVQALAAAAGIA

SEQ ID NO: 175262 - protein, 16 aa, Mycobacterium tuberculosis
DEVLVQALAAAAGIAV

SEQ ID NO: 175263 - protein, 16 aa, Mycobacterium tuberculosis
EVLVQALAAAAGIAVA

SEQ ID NO: 175264 - protein, 16 aa, Mycobacterium tuberculosis
VLVQALAAAAGIAVAN

SEQ ID NO: 175265 - protein, 16 aa, Mycobacterium tuberculosis
LVQALAAAAGIAVANA

SEQ ID NO: 175266 - protein, 16 aa, Mycobacterium tuberculosis
VQALAAAAGIAVANAR

SEQ ID NO: 175267 - protein, 16 aa, Mycobacterium tuberculosis
QALAAAAGIAVANARL

SEQ ID NO: 175268 - protein, 16 aa, Mycobacterium tuberculosis
ALAAAAGIAVANARLY

SEQ ID NO: 175269 - protein, 16 aa, Mycobacterium tuberculosis
LAAAAGIAVANARLYQ

SEQ ID NO: 175270 - protein, 16 aa, Mycobacterium tuberculosis
AAAAGIAVANARLYQQ

SEQ ID NO: 175271 - protein, 16 aa, Mycobacterium tuberculosis
AAAGIAVANARLYQQA

SEQ ID NO: 175272 - protein, 16 aa, Mycobacterium tuberculosis
AAGIAVANARLYQQAK

SEQ ID NO: 175273 - protein, 16 aa, Mycobacterium tuberculosis
AGIAVANARLYQQAKA

SEQ ID NO: 175274 - protein, 16 aa, Mycobacterium tuberculosis
GIAVANARLYQQAKAR

SEQ ID NO: 175275 - protein, 16 aa, Mycobacterium tuberculosis
IAVANARLYQQAKARQ

SEQ ID NO: 175276 - protein, 16 aa, Mycobacterium tuberculosis
AVANARLYQQAKARQS

SEQ ID NO: 175277 - protein, 16 aa, Mycobacterium tuberculosis
VANARLYQQAKARQSW

SEQ ID NO: 175278 - protein, 16 aa, Mycobacterium tuberculosis
ANARLYQQAKARQSWI

SEQ ID NO: 175279 - protein, 16 aa, Mycobacterium tuberculosis
NARLYQQAKARQSWIE

SEQ ID NO: 175280 - protein, 16 aa, Mycobacterium tuberculosis
ARLYQQAKARQSWIEA

SEQ ID NO: 175281 - protein, 16 aa, Mycobacterium tuberculosis
RLYQQAKARQSWIEAT

SEQ ID NO: 175282 - protein, 16 aa, Mycobacterium tuberculosis
LYQQAKARQSWIEATR

SEQ ID NO: 175283 - protein, 16 aa, Mycobacterium tuberculosis
YQQAKARQSWIEATRD

SEQ ID NO: 175284 - protein, 16 aa, Mycobacterium tuberculosis
QQAKARQSWIEATRDI

SEQ ID NO: 175285 - protein, 16 aa, Mycobacterium tuberculosis
QAKARQSWIEATRDIA

SEQ ID NO: 175286 - protein, 16 aa, Mycobacterium tuberculosis
AKARQSWIEATRDIAT

SEQ ID NO: 175287 - protein, 16 aa, Mycobacterium tuberculosis
KARQSWIEATRDIATE

SEQ ID NO: 175288 - protein, 16 aa, Mycobacterium tuberculosis
ARQSWIEATRDIATEL

SEQ ID NO: 175289 - protein, 16 aa, Mycobacterium tuberculosis
RQSWIEATRDIATELL

SEQ ID NO: 175290 - protein, 16 aa, Mycobacterium tuberculosis
QSWIEATRDIATELLS

SEQ ID NO: 175291 - protein, 16 aa, Mycobacterium tuberculosis
SWIEATRDIATELLSG

SEQ ID NO: 175292 - protein, 16 aa, Mycobacterium tuberculosis
WIEATRDIATELLSGT

SEQ ID NO: 175293 - protein, 16 aa, Mycobacterium tuberculosis
IEATRDIATELLSGTE

SEQ ID NO: 175294 - protein, 16 aa, Mycobacterium tuberculosis
EATRDIATELLSGTEP

SEQ ID NO: 175295 - protein, 16 aa, Mycobacterium tuberculosis
ATRDIATELLSGTEPA

SEQ ID NO: 175296 - protein, 16 aa, Mycobacterium tuberculosis
TRDIATELLSGTEPAT

SEQ ID NO: 175297 - protein, 16 aa, Mycobacterium tuberculosis
RDIATELLSGTEPATV

SEQ ID NO: 175298 - protein, 16 aa, Mycobacterium tuberculosis
DIATELLSGTEPATVF

SEQ ID NO: 175299 - protein, 16 aa, Mycobacterium tuberculosis
IATELLSGTEPATVFR

SEQ ID NO: 175300 - protein, 16 aa, Mycobacterium tuberculosis
ATELLSGTEPATVFRL

SEQ ID NO: 175301 - protein, 16 aa, Mycobacterium tuberculosis
TELLSGTEPATVFRLV

SEQ ID NO: 175302 - protein, 16 aa, Mycobacterium tuberculosis
ELLSGTEPATVFRLVA

SEQ ID NO: 175303 - protein, 16 aa, Mycobacterium tuberculosis
LLSGTEPATVFRLVAA

SEQ ID NO: 175304 - protein, 16 aa, Mycobacterium tuberculosis
LSGTEPATVFRLVAAE

SEQ ID NO: 175305 - protein, 16 aa, Mycobacterium tuberculosis
SGTEPATVFRLVAAEA

SEQ ID NO: 175306 - protein, 16 aa, Mycobacterium tuberculosis
GTEPATVFRLVAAEAL

SEQ ID NO: 175307 - protein, 16 aa, Mycobacterium tuberculosis
TEPATVFRLVAAEALK

SEQ ID NO: 175308 - protein, 16 aa, Mycobacterium tuberculosis
EPATVFRLVAAEALKL

SEQ ID NO: 175309 - protein, 16 aa, Mycobacterium tuberculosis
PATVFRLVAAEALKLT

SEQ ID NO: 175310 - protein, 16 aa, Mycobacterium tuberculosis
ATVFRLVAAEALKLTA

SEQ ID NO: 175311 - protein, 16 aa, Mycobacterium tuberculosis
TVFRLVAAEALKLTAA

SEQ ID NO: 175312 - protein, 16 aa, Mycobacterium tuberculosis
VFRLVAAEALKLTAAD

SEQ ID NO: 175313 - protein, 16 aa, Mycobacterium tuberculosis
FRLVAAEALKLTAADA

SEQ ID NO: 175314 - protein, 16 aa, Mycobacterium tuberculosis
RLVAAEALKLTAADAA

SEQ ID NO: 175315 - protein, 16 aa, Mycobacterium tuberculosis
LVAAEALKLTAADAAL

SEQ ID NO: 175316 - protein, 16 aa, Mycobacterium tuberculosis
VAAEALKLTAADAALV

SEQ ID NO: 175317 - protein, 16 aa, Mycobacterium tuberculosis
AAEALKLTAADAALVA

SEQ ID NO: 175318 - protein, 16 aa, Mycobacterium tuberculosis
AEALKLTAADAALVAV

SEQ ID NO: 175319 - protein, 16 aa, Mycobacterium tuberculosis
EALKLTAADAALVAVP

SEQ ID NO: 175320 - protein, 16 aa, Mycobacterium tuberculosis
ALKLTAADAALVAVPV

SEQ ID NO: 175321 - protein, 16 aa, Mycobacterium tuberculosis
LKLTAADAALVAVPVD

SEQ ID NO: 175322 - protein, 16 aa, Mycobacterium tuberculosis
KLTAADAALVAVPVDE

SEQ ID NO: 175323 - protein, 16 aa, Mycobacterium tuberculosis
LTAADAALVAVPVDED

SEQ ID NO: 175324 - protein, 16 aa, Mycobacterium tuberculosis
TAADAALVAVPVDEDM

SEQ ID NO: 175325 - protein, 16 aa, Mycobacterium tuberculosis
AADAALVAVPVDEDMP

SEQ ID NO: 175326 - protein, 16 aa, Mycobacterium tuberculosis
ADAALVAVPVDEDMPA

SEQ ID NO: 175327 - protein, 16 aa, Mycobacterium tuberculosis
DAALVAVPVDEDMPAA

SEQ ID NO: 175328 - protein, 16 aa, Mycobacterium tuberculosis
AALVAVPVDEDMPAAD

SEQ ID NO: 175329 - protein, 16 aa, Mycobacterium tuberculosis
ALVAVPVDEDMPAADV

SEQ ID NO: 175330 - protein, 16 aa, Mycobacterium tuberculosis
LVAVPVDEDMPAADVG

SEQ ID NO: 175331 - protein, 16 aa, Mycobacterium tuberculosis
VAVPVDEDMPAADVGE

SEQ ID NO: 175332 - protein, 16 aa, Mycobacterium tuberculosis
AVPVDEDMPAADVGEL

SEQ ID NO: 175333 - protein, 16 aa, Mycobacterium tuberculosis
VPVDEDMPAADVGELL

SEQ ID NO: 175334 - protein, 16 aa, Mycobacterium tuberculosis
PVDEDMPAADVGELLV

SEQ ID NO: 175335 - protein, 16 aa, Mycobacterium tuberculosis
VDEDMPAADVGELLVI

SEQ ID NO: 175336 - protein, 16 aa, Mycobacterium tuberculosis
DEDMPAADVGELLVIE

SEQ ID NO: 175337 - protein, 16 aa, Mycobacterium tuberculosis
EDMPAADVGELLVIET

SEQ ID NO: 175338 - protein, 16 aa, Mycobacterium tuberculosis
DMPAADVGELLVIETV

SEQ ID NO: 175339 - protein, 16 aa, Mycobacterium tuberculosis
MPAADVGELLVIETVG

SEQ ID NO: 175340 - protein, 16 aa, Mycobacterium tuberculosis
PAADVGELLVIETVGS

SEQ ID NO: 175341 - protein, 16 aa, Mycobacterium tuberculosis
AADVGELLVIETVGSA

SEQ ID NO: 175342 - protein, 16 aa, Mycobacterium tuberculosis
ADVGELLVIETVGSAV

SEQ ID NO: 175343 - protein, 16 aa, Mycobacterium tuberculosis
DVGELLVIETVGSAVA

SEQ ID NO: 175344 - protein, 16 aa, Mycobacterium tuberculosis
VGELLVIETVGSAVAS

SEQ ID NO: 175345 - protein, 16 aa, Mycobacterium tuberculosis
GELLVIETVGSAVASI

SEQ ID NO: 175346 - protein, 16 aa, Mycobacterium tuberculosis
ELLVIETVGSAVASIV

SEQ ID NO: 175347 - protein, 16 aa, Mycobacterium tuberculosis
LLVIETVGSAVASIVG

SEQ ID NO: 175348 - protein, 16 aa, Mycobacterium tuberculosis
LVIETVGSAVASIVGR

SEQ ID NO: 175349 - protein, 16 aa, Mycobacterium tuberculosis
VIETVGSAVASIVGRT

SEQ ID NO: 175350 - protein, 16 aa, Mycobacterium tuberculosis
IETVGSAVASIVGRTI

SEQ ID NO: 175351 - protein, 16 aa, Mycobacterium tuberculosis
ETVGSAVASIVGRTIP

SEQ ID NO: 175352 - protein, 16 aa, Mycobacterium tuberculosis
TVGSAVASIVGRTIPV

SEQ ID NO: 175353 - protein, 16 aa, Mycobacterium tuberculosis
VGSAVASIVGRTIPVA

SEQ ID NO: 175354 - protein, 16 aa, Mycobacterium tuberculosis
GSAVASIVGRTIPVAG

SEQ ID NO: 175355 - protein, 16 aa, Mycobacterium tuberculosis
SAVASIVGRTIPVAGA

SEQ ID NO: 175356 - protein, 16 aa, Mycobacterium tuberculosis
AVASIVGRTIPVAGAV

SEQ ID NO: 175357 - protein, 16 aa, Mycobacterium tuberculosis
VASIVGRTIPVAGAVL

SEQ ID NO: 175358 - protein, 16 aa, Mycobacterium tuberculosis
ASIVGRTIPVAGAVLR

SEQ ID NO: 175359 - protein, 16 aa, Mycobacterium tuberculosis
SIVGRTIPVAGAVLRE

SEQ ID NO: 175360 - protein, 16 aa, Mycobacterium tuberculosis
IVGRTIPVAGAVLREV

SEQ ID NO: 175361 - protein, 16 aa, Mycobacterium tuberculosis
VGRTIPVAGAVLREVF

SEQ ID NO: 175362 - protein, 16 aa, Mycobacterium tuberculosis
GRTIPVAGAVLREVFV

SEQ ID NO: 175363 - protein, 16 aa, Mycobacterium tuberculosis
RTIPVAGAVLREVFVN

SEQ ID NO: 175364 - protein, 16 aa, Mycobacterium tuberculosis
TIPVAGAVLREVFVNG

SEQ ID NO: 175365 - protein, 16 aa, Mycobacterium tuberculosis
IPVAGAVLREVFVNGI

SEQ ID NO: 175366 - protein, 16 aa, Mycobacterium tuberculosis
PVAGAVLREVFVNGIP

SEQ ID NO: 175367 - protein, 16 aa, Mycobacterium tuberculosis
VAGAVLREVFVNGIPR

SEQ ID NO: 175368 - protein, 16 aa, Mycobacterium tuberculosis
AGAVLREVFVNGIPRR

SEQ ID NO: 175369 - protein, 16 aa, Mycobacterium tuberculosis
GAVLREVFVNGIPRRV

SEQ ID NO: 175370 - protein, 16 aa, Mycobacterium tuberculosis
AVLREVFVNGIPRRVD

SEQ ID NO: 175371 - protein, 16 aa, Mycobacterium tuberculosis
VLREVFVNGIPRRVDR

SEQ ID NO: 175372 - protein, 16 aa, Mycobacterium tuberculosis
LREVFVNGIPRRVDRV

SEQ ID NO: 175373 - protein, 16 aa, Mycobacterium tuberculosis
REVFVNGIPRRVDRVD

SEQ ID NO: 175374 - protein, 16 aa, Mycobacterium tuberculosis
EVFVNGIPRRVDRVDL

SEQ ID NO: 175375 - protein, 16 aa, Mycobacterium tuberculosis
VFVNGIPRRVDRVDLE

SEQ ID NO: 175376 - protein, 16 aa, Mycobacterium tuberculosis
FVNGIPRRVDRVDLEG

SEQ ID NO: 175377 - protein, 16 aa, Mycobacterium tuberculosis
VNGIPRRVDRVDLEGL

SEQ ID NO: 175378 - protein, 16 aa, Mycobacterium tuberculosis
NGIPRRVDRVDLEGLD

SEQ ID NO: 175379 - protein, 16 aa, Mycobacterium tuberculosis
GIPRRVDRVDLEGLDE

SEQ ID NO: 175380 - protein, 16 aa, Mycobacterium tuberculosis
IPRRVDRVDLEGLDEL

SEQ ID NO: 175381 - protein, 16 aa, Mycobacterium tuberculosis
PRRVDRVDLEGLDELA

SEQ ID NO: 175382 - protein, 16 aa, Mycobacterium tuberculosis
RRVDRVDLEGLDELAD

SEQ ID NO: 175383 - protein, 16 aa, Mycobacterium tuberculosis
RVDRVDLEGLDELADA

SEQ ID NO: 175384 - protein, 16 aa, Mycobacterium tuberculosis
VDRVDLEGLDELADAG

SEQ ID NO: 175385 - protein, 16 aa, Mycobacterium tuberculosis
DRVDLEGLDELADAGP

SEQ ID NO: 175386 - protein, 16 aa, Mycobacterium tuberculosis
RVDLEGLDELADAGPA

SEQ ID NO: 175387 - protein, 16 aa, Mycobacterium tuberculosis
VDLEGLDELADAGPAL

SEQ ID NO: 175388 - protein, 16 aa, Mycobacterium tuberculosis
DLEGLDELADAGPALL

SEQ ID NO: 175389 - protein, 16 aa, Mycobacterium tuberculosis
LEGLDELADAGPALLL

SEQ ID NO: 175390 - protein, 16 aa, Mycobacterium tuberculosis
EGLDELADAGPALLLP

SEQ ID NO: 175391 - protein, 16 aa, Mycobacterium tuberculosis
GLDELADAGPALLLPL

SEQ ID NO: 175392 - protein, 16 aa, Mycobacterium tuberculosis
LDELADAGPALLLPLR

SEQ ID NO: 175393 - protein, 16 aa, Mycobacterium tuberculosis
DELADAGPALLLPLRA

SEQ ID NO: 175394 - protein, 16 aa, Mycobacterium tuberculosis
ELADAGPALLLPLRAR

SEQ ID NO: 175395 - protein, 16 aa, Mycobacterium tuberculosis
LADAGPALLLPLRARG

SEQ ID NO: 175396 - protein, 16 aa, Mycobacterium tuberculosis
ADAGPALLLPLRARGT

SEQ ID NO: 175397 - protein, 16 aa, Mycobacterium tuberculosis
DAGPALLLPLRARGTV

SEQ ID NO: 175398 - protein, 16 aa, Mycobacterium tuberculosis
AGPALLLPLRARGTVA

SEQ ID NO: 175399 - protein, 16 aa, Mycobacterium tuberculosis
GPALLLPLRARGTVAG

SEQ ID NO: 175400 - protein, 16 aa, Mycobacterium tuberculosis
PALLLPLRARGTVAGV

SEQ ID NO: 175401 - protein, 16 aa, Mycobacterium tuberculosis
ALLLPLRARGTVAGVV

SEQ ID NO: 175402 - protein, 16 aa, Mycobacterium tuberculosis
LLLPLRARGTVAGVVV

SEQ ID NO: 175403 - protein, 16 aa, Mycobacterium tuberculosis
LLPLRARGTVAGVVVV

SEQ ID NO: 175404 - protein, 16 aa, Mycobacterium tuberculosis
LPLRARGTVAGVVVVL

SEQ ID NO: 175405 - protein, 16 aa, Mycobacterium tuberculosis
PLRARGTVAGVVVVLS

SEQ ID NO: 175406 - protein, 16 aa, Mycobacterium tuberculosis
LRARGTVAGVVVVLSQ

SEQ ID NO: 175407 - protein, 16 aa, Mycobacterium tuberculosis
RARGTVAGVVVVLSQG

SEQ ID NO: 175408 - protein, 16 aa, Mycobacterium tuberculosis
ARGTVAGVVVVLSQGG

SEQ ID NO: 175409 - protein, 16 aa, Mycobacterium tuberculosis
RGTVAGVVVVLSQGGP

SEQ ID NO: 175410 - protein, 16 aa, Mycobacterium tuberculosis
GTVAGVVVVLSQGGPG

SEQ ID NO: 175411 - protein, 16 aa, Mycobacterium tuberculosis
TVAGVVVVLSQGGPGA

SEQ ID NO: 175412 - protein, 16 aa, Mycobacterium tuberculosis
VAGVVVVLSQGGPGAF

SEQ ID NO: 175413 - protein, 16 aa, Mycobacterium tuberculosis
AGVVVVLSQGGPGAFT

SEQ ID NO: 175414 - protein, 16 aa, Mycobacterium tuberculosis
GVVVVLSQGGPGAFTD

SEQ ID NO: 175415 - protein, 16 aa, Mycobacterium tuberculosis
VVVVLSQGGPGAFTDE

SEQ ID NO: 175416 - protein, 16 aa, Mycobacterium tuberculosis
VVVLSQGGPGAFTDEQ

SEQ ID NO: 175417 - protein, 16 aa, Mycobacterium tuberculosis
VVLSQGGPGAFTDEQL

SEQ ID NO: 175418 - protein, 16 aa, Mycobacterium tuberculosis
VLSQGGPGAFTDEQLE

SEQ ID NO: 175419 - protein, 16 aa, Mycobacterium tuberculosis
LSQGGPGAFTDEQLEM

SEQ ID NO: 175420 - protein, 16 aa, Mycobacterium tuberculosis
SQGGPGAFTDEQLEMM

SEQ ID NO: 175421 - protein, 16 aa, Mycobacterium tuberculosis
QGGPGAFTDEQLEMMA

SEQ ID NO: 175422 - protein, 16 aa, Mycobacterium tuberculosis
GGPGAFTDEQLEMMAA

SEQ ID NO: 175423 - protein, 16 aa, Mycobacterium tuberculosis
GPGAFTDEQLEMMAAF

SEQ ID NO: 175424 - protein, 16 aa, Mycobacterium tuberculosis
PGAFTDEQLEMMAAFA

SEQ ID NO: 175425 - protein, 16 aa, Mycobacterium tuberculosis
GAFTDEQLEMMAAFAD

SEQ ID NO: 175426 - protein, 16 aa, Mycobacterium tuberculosis
AFTDEQLEMMAAFADQ

SEQ ID NO: 175427 - protein, 16 aa, Mycobacterium tuberculosis
FTDEQLEMMAAFADQA

SEQ ID NO: 175428 - protein, 16 aa, Mycobacterium tuberculosis
TDEQLEMMAAFADQAA

SEQ ID NO: 175429 - protein, 16 aa, Mycobacterium tuberculosis
DEQLEMMAAFADQAAL

SEQ ID NO: 175430 - protein, 16 aa, Mycobacterium tuberculosis
EQLEMMAAFADQAALA

SEQ ID NO: 175431 - protein, 16 aa, Mycobacterium tuberculosis
QLEMMAAFADQAALAW

SEQ ID NO: 175432 - protein, 16 aa, Mycobacterium tuberculosis
LEMMAAFADQAALAWQ

SEQ ID NO: 175433 - protein, 16 aa, Mycobacterium tuberculosis
EMMAAFADQAALAWQL

SEQ ID NO: 175434 - protein, 16 aa, Mycobacterium tuberculosis
MMAAFADQAALAWQLA

SEQ ID NO: 175435 - protein, 16 aa, Mycobacterium tuberculosis
MAAFADQAALAWQLAT

SEQ ID NO: 175436 - protein, 16 aa, Mycobacterium tuberculosis
AAFADQAALAWQLATS

SEQ ID NO: 175437 - protein, 16 aa, Mycobacterium tuberculosis
AFADQAALAWQLATSQ

SEQ ID NO: 175438 - protein, 16 aa, Mycobacterium tuberculosis
FADQAALAWQLATSQR

SEQ ID NO: 175439 - protein, 16 aa, Mycobacterium tuberculosis
ADQAALAWQLATSQRR

SEQ ID NO: 175440 - protein, 16 aa, Mycobacterium tuberculosis
DQAALAWQLATSQRRM

SEQ ID NO: 175441 - protein, 16 aa, Mycobacterium tuberculosis
QAALAWQLATSQRRMR

SEQ ID NO: 175442 - protein, 16 aa, Mycobacterium tuberculosis
AALAWQLATSQRRMRE

SEQ ID NO: 175443 - protein, 16 aa, Mycobacterium tuberculosis
ALAWQLATSQRRMREL

SEQ ID NO: 175444 - protein, 16 aa, Mycobacterium tuberculosis
LAWQLATSQRRMRELD

SEQ ID NO: 175445 - protein, 16 aa, Mycobacterium tuberculosis
AWQLATSQRRMRELDV

SEQ ID NO: 175446 - protein, 16 aa, Mycobacterium tuberculosis
WQLATSQRRMRELDVL

SEQ ID NO: 175447 - protein, 16 aa, Mycobacterium tuberculosis
QLATSQRRMRELDVLT

SEQ ID NO: 175448 - protein, 16 aa, Mycobacterium tuberculosis
LATSQRRMRELDVLTD

SEQ ID NO: 175449 - protein, 16 aa, Mycobacterium tuberculosis
ATSQRRMRELDVLTDR

SEQ ID NO: 175450 - protein, 16 aa, Mycobacterium tuberculosis
TSQRRMRELDVLTDRD

SEQ ID NO: 175451 - protein, 16 aa, Mycobacterium tuberculosis
SQRRMRELDVLTDRDR

SEQ ID NO: 175452 - protein, 16 aa, Mycobacterium tuberculosis
QRRMRELDVLTDRDRI

SEQ ID NO: 175453 - protein, 16 aa, Mycobacterium tuberculosis
RRMRELDVLTDRDRIA

SEQ ID NO: 175454 - protein, 16 aa, Mycobacterium tuberculosis
RMRELDVLTDRDRIAR

SEQ ID NO: 175455 - protein, 16 aa, Mycobacterium tuberculosis
MRELDVLTDRDRIARD

SEQ ID NO: 175456 - protein, 16 aa, Mycobacterium tuberculosis
RELDVLTDRDRIARDL

SEQ ID NO: 175457 - protein, 16 aa, Mycobacterium tuberculosis
ELDVLTDRDRIARDLH

SEQ ID NO: 175458 - protein, 16 aa, Mycobacterium tuberculosis
LDVLTDRDRIARDLHD

SEQ ID NO: 175459 - protein, 16 aa, Mycobacterium tuberculosis
DVLTDRDRIARDLHDH

SEQ ID NO: 175460 - protein, 16 aa, Mycobacterium tuberculosis
VLTDRDRIARDLHDHV

SEQ ID NO: 175461 - protein, 16 aa, Mycobacterium tuberculosis
LTDRDRIARDLHDHVI

SEQ ID NO: 175462 - protein, 16 aa, Mycobacterium tuberculosis
TDRDRIARDLHDHVIQ

SEQ ID NO: 175463 - protein, 16 aa, Mycobacterium tuberculosis
DRDRIARDLHDHVIQR

SEQ ID NO: 175464 - protein, 16 aa, Mycobacterium tuberculosis
RDRIARDLHDHVIQRL

SEQ ID NO: 175465 - protein, 16 aa, Mycobacterium tuberculosis
DRIARDLHDHVIQRLF

SEQ ID NO: 175466 - protein, 16 aa, Mycobacterium tuberculosis
RIARDLHDHVIQRLFA

SEQ ID NO: 175467 - protein, 16 aa, Mycobacterium tuberculosis
IARDLHDHVIQRLFAI

SEQ ID NO: 175468 - protein, 16 aa, Mycobacterium tuberculosis
ARDLHDHVIQRLFAIG

SEQ ID NO: 175469 - protein, 16 aa, Mycobacterium tuberculosis
RDLHDHVIQRLFAIGL

SEQ ID NO: 175470 - protein, 16 aa, Mycobacterium tuberculosis
DLHDHVIQRLFAIGLA

SEQ ID NO: 175471 - protein, 16 aa, Mycobacterium tuberculosis
LHDHVIQRLFAIGLAL

SEQ ID NO: 175472 - protein, 16 aa, Mycobacterium tuberculosis
HDHVIQRLFAIGLALQ

SEQ ID NO: 175473 - protein, 16 aa, Mycobacterium tuberculosis
DHVIQRLFAIGLALQG

SEQ ID NO: 175474 - protein, 16 aa, Mycobacterium tuberculosis
HVIQRLFAIGLALQGA

SEQ ID NO: 175475 - protein, 16 aa, Mycobacterium tuberculosis
VIQRLFAIGLALQGAV

SEQ ID NO: 175476 - protein, 16 aa, Mycobacterium tuberculosis
IQRLFAIGLALQGAVP

SEQ ID NO: 175477 - protein, 16 aa, Mycobacterium tuberculosis
QRLFAIGLALQGAVPH

SEQ ID NO: 175478 - protein, 16 aa, Mycobacterium tuberculosis
RLFAIGLALQGAVPHE

SEQ ID NO: 175479 - protein, 16 aa, Mycobacterium tuberculosis
LFAIGLALQGAVPHER

SEQ ID NO: 175480 - protein, 16 aa, Mycobacterium tuberculosis
FAIGLALQGAVPHERN

SEQ ID NO: 175481 - protein, 16 aa, Mycobacterium tuberculosis
AIGLALQGAVPHERNP

SEQ ID NO: 175482 - protein, 16 aa, Mycobacterium tuberculosis
IGLALQGAVPHERNPE

SEQ ID NO: 175483 - protein, 16 aa, Mycobacterium tuberculosis
GLALQGAVPHERNPEV

SEQ ID NO: 175484 - protein, 16 aa, Mycobacterium tuberculosis
LALQGAVPHERNPEVQ

SEQ ID NO: 175485 - protein, 16 aa, Mycobacterium tuberculosis
ALQGAVPHERNPEVQQ

SEQ ID NO: 175486 - protein, 16 aa, Mycobacterium tuberculosis
LQGAVPHERNPEVQQR

SEQ ID NO: 175487 - protein, 16 aa, Mycobacterium tuberculosis
QGAVPHERNPEVQQRL

SEQ ID NO: 175488 - protein, 16 aa, Mycobacterium tuberculosis
GAVPHERNPEVQQRLS

SEQ ID NO: 175489 - protein, 16 aa, Mycobacterium tuberculosis
AVPHERNPEVQQRLSD

SEQ ID NO: 175490 - protein, 16 aa, Mycobacterium tuberculosis
VPHERNPEVQQRLSDV

SEQ ID NO: 175491 - protein, 16 aa, Mycobacterium tuberculosis
PHERNPEVQQRLSDVV

SEQ ID NO: 175492 - protein, 16 aa, Mycobacterium tuberculosis
HERNPEVQQRLSDVVD

SEQ ID NO: 175493 - protein, 16 aa, Mycobacterium tuberculosis
ERNPEVQQRLSDVVDD

SEQ ID NO: 175494 - protein, 16 aa, Mycobacterium tuberculosis
RNPEVQQRLSDVVDDL

SEQ ID NO: 175495 - protein, 16 aa, Mycobacterium tuberculosis
NPEVQQRLSDVVDDLQ

SEQ ID NO: 175496 - protein, 16 aa, Mycobacterium tuberculosis
PEVQQRLSDVVDDLQD

SEQ ID NO: 175497 - protein, 16 aa, Mycobacterium tuberculosis
EVQQRLSDVVDDLQDV

SEQ ID NO: 175498 - protein, 16 aa, Mycobacterium tuberculosis
VQQRLSDVVDDLQDVI

SEQ ID NO: 175499 - protein, 16 aa, Mycobacterium tuberculosis
QQRLSDVVDDLQDVIQ

SEQ ID NO: 175500 - protein, 16 aa, Mycobacterium tuberculosis
QRLSDVVDDLQDVIQE

SEQ ID NO: 175501 - protein, 16 aa, Mycobacterium tuberculosis
RLSDVVDDLQDVIQEI

SEQ ID NO: 175502 - protein, 16 aa, Mycobacterium tuberculosis
LSDVVDDLQDVIQEIR

SEQ ID NO: 175503 - protein, 16 aa, Mycobacterium tuberculosis
SDVVDDLQDVIQEIRT

SEQ ID NO: 175504 - protein, 16 aa, Mycobacterium tuberculosis
DVVDDLQDVIQEIRTT

SEQ ID NO: 175505 - protein, 16 aa, Mycobacterium tuberculosis
VVDDLQDVIQEIRTTI

SEQ ID NO: 175506 - protein, 16 aa, Mycobacterium tuberculosis
VDDLQDVIQEIRTTIY

SEQ ID NO: 175507 - protein, 16 aa, Mycobacterium tuberculosis
DDLQDVIQEIRTTIYD

SEQ ID NO: 175508 - protein, 16 aa, Mycobacterium tuberculosis
DLQDVIQEIRTTIYDL

SEQ ID NO: 175509 - protein, 16 aa, Mycobacterium tuberculosis
LQDVIQEIRTTIYDLH

SEQ ID NO: 175510 - protein, 16 aa, Mycobacterium tuberculosis
QDVIQEIRTTIYDLHG

SEQ ID NO: 175511 - protein, 16 aa, Mycobacterium tuberculosis
DVIQEIRTTIYDLHGA

SEQ ID NO: 175512 - protein, 16 aa, Mycobacterium tuberculosis
VIQEIRTTIYDLHGAS

SEQ ID NO: 175513 - protein, 16 aa, Mycobacterium tuberculosis
IQEIRTTIYDLHGASQ

SEQ ID NO: 175514 - protein, 16 aa, Mycobacterium tuberculosis
QEIRTTIYDLHGASQG

SEQ ID NO: 175515 - protein, 16 aa, Mycobacterium tuberculosis
EIRTTIYDLHGASQGI

SEQ ID NO: 175516 - protein, 16 aa, Mycobacterium tuberculosis
IRTTIYDLHGASQGIT

SEQ ID NO: 175517 - protein, 16 aa, Mycobacterium tuberculosis
RTTIYDLHGASQGITR

SEQ ID NO: 175518 - protein, 16 aa, Mycobacterium tuberculosis
TTIYDLHGASQGITRL

SEQ ID NO: 175519 - protein, 16 aa, Mycobacterium tuberculosis
TIYDLHGASQGITRLR

SEQ ID NO: 175520 - protein, 16 aa, Mycobacterium tuberculosis
IYDLHGASQGITRLRQ

SEQ ID NO: 175521 - protein, 16 aa, Mycobacterium tuberculosis
YDLHGASQGITRLRQR

SEQ ID NO: 175522 - protein, 16 aa, Mycobacterium tuberculosis
DLHGASQGITRLRQRI

SEQ ID NO: 175523 - protein, 16 aa, Mycobacterium tuberculosis
LHGASQGITRLRQRID

SEQ ID NO: 175524 - protein, 16 aa, Mycobacterium tuberculosis
HGASQGITRLRQRIDA

SEQ ID NO: 175525 - protein, 16 aa, Mycobacterium tuberculosis
GASQGITRLRQRIDAA

SEQ ID NO: 175526 - protein, 16 aa, Mycobacterium tuberculosis
ASQGITRLRQRIDAAV

SEQ ID NO: 175527 - protein, 16 aa, Mycobacterium tuberculosis
SQGITRLRQRIDAAVA

SEQ ID NO: 175528 - protein, 16 aa, Mycobacterium tuberculosis
QGITRLRQRIDAAVAQ

SEQ ID NO: 175529 - protein, 16 aa, Mycobacterium tuberculosis
GITRLRQRIDAAVAQF

SEQ ID NO: 175530 - protein, 16 aa, Mycobacterium tuberculosis
ITRLRQRIDAAVAQFA

SEQ ID NO: 175531 - protein, 16 aa, Mycobacterium tuberculosis
TRLRQRIDAAVAQFAD

SEQ ID NO: 175532 - protein, 16 aa, Mycobacterium tuberculosis
RLRQRIDAAVAQFADS

SEQ ID NO: 175533 - protein, 16 aa, Mycobacterium tuberculosis
LRQRIDAAVAQFADSG

SEQ ID NO: 175534 - protein, 16 aa, Mycobacterium tuberculosis
RQRIDAAVAQFADSGL

SEQ ID NO: 175535 - protein, 16 aa, Mycobacterium tuberculosis
QRIDAAVAQFADSGLR

SEQ ID NO: 175536 - protein, 16 aa, Mycobacterium tuberculosis
RIDAAVAQFADSGLRT

SEQ ID NO: 175537 - protein, 16 aa, Mycobacterium tuberculosis
IDAAVAQFADSGLRTS

SEQ ID NO: 175538 - protein, 16 aa, Mycobacterium tuberculosis
DAAVAQFADSGLRTSV

SEQ ID NO: 175539 - protein, 16 aa, Mycobacterium tuberculosis
AAVAQFADSGLRTSVQ

SEQ ID NO: 175540 - protein, 16 aa, Mycobacterium tuberculosis
AVAQFADSGLRTSVQF

SEQ ID NO: 175541 - protein, 16 aa, Mycobacterium tuberculosis
VAQFADSGLRTSVQFV

SEQ ID NO: 175542 - protein, 16 aa, Mycobacterium tuberculosis
AQFADSGLRTSVQFVG

SEQ ID NO: 175543 - protein, 16 aa, Mycobacterium tuberculosis
QFADSGLRTSVQFVGP

SEQ ID NO: 175544 - protein, 16 aa, Mycobacterium tuberculosis
FADSGLRTSVQFVGPL

SEQ ID NO: 175545 - protein, 16 aa, Mycobacterium tuberculosis
ADSGLRTSVQFVGPLS

SEQ ID NO: 175546 - protein, 16 aa, Mycobacterium tuberculosis
DSGLRTSVQFVGPLSV

SEQ ID NO: 175547 - protein, 16 aa, Mycobacterium tuberculosis
SGLRTSVQFVGPLSVV

SEQ ID NO: 175548 - protein, 16 aa, Mycobacterium tuberculosis
GLRTSVQFVGPLSVVD

SEQ ID NO: 175549 - protein, 16 aa, Mycobacterium tuberculosis
LRTSVQFVGPLSVVDS

SEQ ID NO: 175550 - protein, 16 aa, Mycobacterium tuberculosis
RTSVQFVGPLSVVDSA

SEQ ID NO: 175551 - protein, 16 aa, Mycobacterium tuberculosis
TSVQFVGPLSVVDSAL

SEQ ID NO: 175552 - protein, 16 aa, Mycobacterium tuberculosis
SVQFVGPLSVVDSALA

SEQ ID NO: 175553 - protein, 16 aa, Mycobacterium tuberculosis
VQFVGPLSVVDSALAD

SEQ ID NO: 175554 - protein, 16 aa, Mycobacterium tuberculosis
QFVGPLSVVDSALADQ

SEQ ID NO: 175555 - protein, 16 aa, Mycobacterium tuberculosis
FVGPLSVVDSALADQA

SEQ ID NO: 175556 - protein, 16 aa, Mycobacterium tuberculosis
VGPLSVVDSALADQAE

SEQ ID NO: 175557 - protein, 16 aa, Mycobacterium tuberculosis
GPLSVVDSALADQAEA

SEQ ID NO: 175558 - protein, 16 aa, Mycobacterium tuberculosis
PLSVVDSALADQAEAV

SEQ ID NO: 175559 - protein, 16 aa, Mycobacterium tuberculosis
LSVVDSALADQAEAVV

SEQ ID NO: 175560 - protein, 16 aa, Mycobacterium tuberculosis
SVVDSALADQAEAVVR

SEQ ID NO: 175561 - protein, 16 aa, Mycobacterium tuberculosis
VVDSALADQAEAVVRE

SEQ ID NO: 175562 - protein, 16 aa, Mycobacterium tuberculosis
VDSALADQAEAVVREA

SEQ ID NO: 175563 - protein, 16 aa, Mycobacterium tuberculosis
DSALADQAEAVVREAV

SEQ ID NO: 175564 - protein, 16 aa, Mycobacterium tuberculosis
SALADQAEAVVREAVS

SEQ ID NO: 175565 - protein, 16 aa, Mycobacterium tuberculosis
ALADQAEAVVREAVSN

SEQ ID NO: 175566 - protein, 16 aa, Mycobacterium tuberculosis
LADQAEAVVREAVSNA

SEQ ID NO: 175567 - protein, 16 aa, Mycobacterium tuberculosis
ADQAEAVVREAVSNAV

SEQ ID NO: 175568 - protein, 16 aa, Mycobacterium tuberculosis
DQAEAVVREAVSNAVR

SEQ ID NO: 175569 - protein, 16 aa, Mycobacterium tuberculosis
QAEAVVREAVSNAVRH

SEQ ID NO: 175570 - protein, 16 aa, Mycobacterium tuberculosis
AEAVVREAVSNAVRHA

SEQ ID NO: 175571 - protein, 16 aa, Mycobacterium tuberculosis
EAVVREAVSNAVRHAK

SEQ ID NO: 175572 - protein, 16 aa, Mycobacterium tuberculosis
AVVREAVSNAVRHAKA

SEQ ID NO: 175573 - protein, 16 aa, Mycobacterium tuberculosis
VVREAVSNAVRHAKAS

SEQ ID NO: 175574 - protein, 16 aa, Mycobacterium tuberculosis
VREAVSNAVRHAKAST

SEQ ID NO: 175575 - protein, 16 aa, Mycobacterium tuberculosis
REAVSNAVRHAKASTL

SEQ ID NO: 175576 - protein, 16 aa, Mycobacterium tuberculosis
EAVSNAVRHAKASTLT

SEQ ID NO: 175577 - protein, 16 aa, Mycobacterium tuberculosis
AVSNAVRHAKASTLTV

SEQ ID NO: 175578 - protein, 16 aa, Mycobacterium tuberculosis
VSNAVRHAKASTLTVR

SEQ ID NO: 175579 - protein, 16 aa, Mycobacterium tuberculosis
SNAVRHAKASTLTVRV

SEQ ID NO: 175580 - protein, 16 aa, Mycobacterium tuberculosis
NAVRHAKASTLTVRVK

SEQ ID NO: 175581 - protein, 16 aa, Mycobacterium tuberculosis
AVRHAKASTLTVRVKV

SEQ ID NO: 175582 - protein, 16 aa, Mycobacterium tuberculosis
VRHAKASTLTVRVKVD

SEQ ID NO: 175583 - protein, 16 aa, Mycobacterium tuberculosis
RHAKASTLTVRVKVDD

SEQ ID NO: 175584 - protein, 16 aa, Mycobacterium tuberculosis
HAKASTLTVRVKVDDD

SEQ ID NO: 175585 - protein, 16 aa, Mycobacterium tuberculosis
AKASTLTVRVKVDDDL

SEQ ID NO: 175586 - protein, 16 aa, Mycobacterium tuberculosis
KASTLTVRVKVDDDLC

SEQ ID NO: 175587 - protein, 16 aa, Mycobacterium tuberculosis
ASTLTVRVKVDDDLCI

SEQ ID NO: 175588 - protein, 16 aa, Mycobacterium tuberculosis
STLTVRVKVDDDLCIE

SEQ ID NO: 175589 - protein, 16 aa, Mycobacterium tuberculosis
TLTVRVKVDDDLCIEV

SEQ ID NO: 175590 - protein, 16 aa, Mycobacterium tuberculosis
LTVRVKVDDDLCIEVT

SEQ ID NO: 175591 - protein, 16 aa, Mycobacterium tuberculosis
TVRVKVDDDLCIEVTD

SEQ ID NO: 175592 - protein, 16 aa, Mycobacterium tuberculosis
VRVKVDDDLCIEVTDN

SEQ ID NO: 175593 - protein, 16 aa, Mycobacterium tuberculosis
RVKVDDDLCIEVTDNG

SEQ ID NO: 175594 - protein, 16 aa, Mycobacterium tuberculosis
VKVDDDLCIEVTDNGR

SEQ ID NO: 175595 - protein, 16 aa, Mycobacterium tuberculosis
KVDDDLCIEVTDNGRG

SEQ ID NO: 175596 - protein, 16 aa, Mycobacterium tuberculosis
VDDDLCIEVTDNGRGL

SEQ ID NO: 175597 - protein, 16 aa, Mycobacterium tuberculosis
DDDLCIEVTDNGRGLP

SEQ ID NO: 175598 - protein, 16 aa, Mycobacterium tuberculosis
DDLCIEVTDNGRGLPD

SEQ ID NO: 175599 - protein, 16 aa, Mycobacterium tuberculosis
DLCIEVTDNGRGLPDE

SEQ ID NO: 175600 - protein, 16 aa, Mycobacterium tuberculosis
LCIEVTDNGRGLPDEF

SEQ ID NO: 175601 - protein, 16 aa, Mycobacterium tuberculosis
CIEVTDNGRGLPDEFT

SEQ ID NO: 175602 - protein, 16 aa, Mycobacterium tuberculosis
IEVTDNGRGLPDEFTG

SEQ ID NO: 175603 - protein, 16 aa, Mycobacterium tuberculosis
EVTDNGRGLPDEFTGS

SEQ ID NO: 175604 - protein, 16 aa, Mycobacterium tuberculosis
VTDNGRGLPDEFTGSG

SEQ ID NO: 175605 - protein, 16 aa, Mycobacterium tuberculosis
TDNGRGLPDEFTGSGL

SEQ ID NO: 175606 - protein, 16 aa, Mycobacterium tuberculosis
DNGRGLPDEFTGSGLT

SEQ ID NO: 175607 - protein, 16 aa, Mycobacterium tuberculosis
NGRGLPDEFTGSGLTN

SEQ ID NO: 175608 - protein, 16 aa, Mycobacterium tuberculosis
GRGLPDEFTGSGLTNL

SEQ ID NO: 175609 - protein, 16 aa, Mycobacterium tuberculosis
RGLPDEFTGSGLTNLR

SEQ ID NO: 175610 - protein, 16 aa, Mycobacterium tuberculosis
GLPDEFTGSGLTNLRQ

SEQ ID NO: 175611 - protein, 16 aa, Mycobacterium tuberculosis
LPDEFTGSGLTNLRQR

SEQ ID NO: 175612 - protein, 16 aa, Mycobacterium tuberculosis
PDEFTGSGLTNLRQRA

SEQ ID NO: 175613 - protein, 16 aa, Mycobacterium tuberculosis
DEFTGSGLTNLRQRAE

SEQ ID NO: 175614 - protein, 16 aa, Mycobacterium tuberculosis
EFTGSGLTNLRQRAEQ

SEQ ID NO: 175615 - protein, 16 aa, Mycobacterium tuberculosis
FTGSGLTNLRQRAEQA

SEQ ID NO: 175616 - protein, 16 aa, Mycobacterium tuberculosis
TGSGLTNLRQRAEQAG

SEQ ID NO: 175617 - protein, 16 aa, Mycobacterium tuberculosis
GSGLTNLRQRAEQAGG

SEQ ID NO: 175618 - protein, 16 aa, Mycobacterium tuberculosis
SGLTNLRQRAEQAGGE

SEQ ID NO: 175619 - protein, 16 aa, Mycobacterium tuberculosis
GLTNLRQRAEQAGGEF

SEQ ID NO: 175620 - protein, 16 aa, Mycobacterium tuberculosis
LTNLRQRAEQAGGEFT

SEQ ID NO: 175621 - protein, 16 aa, Mycobacterium tuberculosis
TNLRQRAEQAGGEFTL

SEQ ID NO: 175622 - protein, 16 aa, Mycobacterium tuberculosis
NLRQRAEQAGGEFTLA

SEQ ID NO: 175623 - protein, 16 aa, Mycobacterium tuberculosis
LRQRAEQAGGEFTLAS

SEQ ID NO: 175624 - protein, 16 aa, Mycobacterium tuberculosis
RQRAEQAGGEFTLASV

SEQ ID NO: 175625 - protein, 16 aa, Mycobacterium tuberculosis
QRAEQAGGEFTLASVP

SEQ ID NO: 175626 - protein, 16 aa, Mycobacterium tuberculosis
RAEQAGGEFTLASVPG

SEQ ID NO: 175627 - protein, 16 aa, Mycobacterium tuberculosis
AEQAGGEFTLASVPGA

SEQ ID NO: 175628 - protein, 16 aa, Mycobacterium tuberculosis
EQAGGEFTLASVPGAS

SEQ ID NO: 175629 - protein, 16 aa, Mycobacterium tuberculosis
QAGGEFTLASVPGASG

SEQ ID NO: 175630 - protein, 16 aa, Mycobacterium tuberculosis
AGGEFTLASVPGASGT

SEQ ID NO: 175631 - protein, 16 aa, Mycobacterium tuberculosis
GGEFTLASVPGASGTV

SEQ ID NO: 175632 - protein, 16 aa, Mycobacterium tuberculosis
GEFTLASVPGASGTVL

SEQ ID NO: 175633 - protein, 16 aa, Mycobacterium tuberculosis
EFTLASVPGASGTVLR

SEQ ID NO: 175634 - protein, 16 aa, Mycobacterium tuberculosis
FTLASVPGASGTVLRW

SEQ ID NO: 175635 - protein, 16 aa, Mycobacterium tuberculosis
TLASVPGASGTVLRWS

SEQ ID NO: 175636 - protein, 16 aa, Mycobacterium tuberculosis
LASVPGASGTVLRWSA

SEQ ID NO: 175637 - protein, 16 aa, Mycobacterium tuberculosis
ASVPGASGTVLRWSAP

SEQ ID NO: 175638 - protein, 16 aa, Mycobacterium tuberculosis
SVPGASGTVLRWSAPL

SEQ ID NO: 175639 - protein, 16 aa, Mycobacterium tuberculosis
VPGASGTVLRWSAPLS

SEQ ID NO: 175640 - protein, 16 aa, Mycobacterium tuberculosis
PGASGTVLRWSAPLSQ

SEQ ID NO: 175641 - protein, 3157 aa, Mycobacterium tuberculosis
MNFPVLPPEINSVLMYSGAGSSPLLAAAAAWDGLAEELGSAAVSFGQVTSGLTAGVWQGAAAAAMAAAAAPYAGWLGSVAAQAVAVAGQARAAVAAFEAALAATVDPAAVAVNRMAMRALAMSNLLGQNAAAIAAVEAEYELMWAADVAAMAGYHSGASAAAAALPAFSPPAQALGGGVGAFLNALFAGPAKMLRLNAGLGNVGNYNVGLGNVGIFNLGAANVGAQNLGAANAGSGNFGFGNIGNANFGFGNSGLGLPPGMGNIGLGNAGSSNYGLANLGVGNIGFANTGSNNIGIGLTGDNLTGIGGLNSGTGNLGLFNSGTGNIGFFNSGTGNFGVFNSGSYNTGVGNAGTASTGLFNVGGFNTGVANVGSYNTGSFNAGNTNTGGFNPGNVNTGWLNTGNTNTGIANSGNVNTGAFISGNFSNGVLWRGDYEGLWGLSGGSTIPAIPIGLELNGGVGPITVLPIQILPTIPLNIHQTFSLGPLVVPDIVIPAFGGGTAIPISVGPITISPITLFPAQNFNTTFPVGPFFGLGVVNISGIEIKDLAGNVTLQLGNLNIDTRINQSFPVTVNWSTPAVTIFPNGISIPNNPLALLASASIGTLGFTIPGFTIPAAPLPLTIDIDGQIDGFSTPPITIDRIPLNLGASVTVGPILINGVNIPATPGFGNTTTAPSSGFFNSGDGGVSGFGNFGAGSSGWWNQAQTEVAGAGSGFANFGSLGSGVLNFGSGVSGLYNTGGLPPGTPAVVSGIGNVGEQLSGLSSAGTALNQSLIINLGLADVGSVNVGFGNVGDFNLGAANIGDLNVGLGNVGGGNVGFGNIGDANFGLGNAGLAAGLAGVGNIGLGNAGSGNVGFGNMGVGNIGFGNTGTNNLGIGLTGDNQTGIGGLNSGAGNIGLFNSGTGNVGLFNSGTGNFGLFNSGSFNTGIGNGGTGSTGLFNAGNFNTGVANPGSYNTGSFNVGDTNTGGFNPGSINTGWFNTGNANTGVANSGNVDTGALMSGNFSNGILWRGNFEGLFGLNVGITIPEFPIHWTSTGGIGPIIIPDTTILPPIHLGLTGQANYGFAVPDIPIPAIHIDFDGAADAGFTAPATTLLSALGITGQFRFGPITVSNVQLNPFNVNLKLQFLHDAFPNEFPDPTISVQIQVAIPLTSATLGGLALPLQQTIDAIELPAISFSQSIPIDIPPIDIPASTINGISMSEVVPIDVSVDIPAVTITGTRIDPIPLNFDVLSSAGPINISIIDIPALPGFGNSTELPSSGFFNTGGGGGSGIANFGAGVSGLLNQASSPMVGTLSGLGNAGSLASGVLNSGVDISGMFNVSTLGSAPAVISGFGNLGNHVSGVSIDGLLAMLTSGGSGGSGQPSIIDAAIAELRHLNPLNIVNLGNVGSYNLGFANVGDVNLGAGNLGNLNLGGGNLGGQNLGLGNLGDGNVGFGNLGHGNVGFGNSGLGALPGIGNIGLGNAGSNNVGFGNMGLGNIGFGNTGTNNLGIGLTGDNQTGFGGLNSGAGNLGLFNSGTGNIGFFNTGTGNWGLFNSGSYNTGIGNSGTGSTGLFNAGSFNTGLANAGSYNTGSLNAGNTNTGGFNPGNVNTGWFNAGHTNTGGFNTGNVNTGAFNSGSFNNGALWTGDHHGLVGFSYSIEITGSTLVDINETLNLGPVHIDQIDIPGMSLFDIHELVNIGPFRIEPIDVPAVVLDIHETMVIPPIVFLPSMTIGGQTYTIPLDTPPAPAPPPFRLPLLFVNALGDNWIVGASNSTGMSGGFVTAPTQGILIHTGPSSATTGSLALTLPTVTIPTITTSPIPLKIDVSGGLPAFTLFPGGLNIPQNAIPLTIDASGVLDPITIFPGGFTIDPLPLSLALNISVPDSSVPIIIVPPTPGFGNATATPSSGFFNSGAGGVSGFGNFGAGSSGWWNQAHAALAGAGSGVLNVGTLNSGVLNVGSGISGLYNTAIVGLGTPALVSGAGNVGQQLSGVLAAGTALTQSPIINLGLADVGNYNLGLGNVGDFNLGAANLGDLNLGLGNIGNANVGFGNIGHGNVGFGNSGLGAALGIGNIGLGNAGSTNVGLANMGVGNIGFANTGTNNLGIGLTGDNQTGIGGLNSGAGNIGLFNSGTGNIGFFNSGTGNWGLFNSGSFNTGIGNSGTGSTGLFNAGGFTTGLANAGSYNTGSFNVGDTNTGGFNPGSINTGWFNTGNANTGIANSGNVDTGALMSGNFSNGILWRGNYEGLFSYSYSLDVPRITILDAHFTGAFGPVVVPPIPVLAINAHLTGNAAMGAFTIPQIDIPALNPNVTGSVGFGPIAVPSVTIPALTAARAVLDMAASVGATSEIEPFIVWTSSGAIGPTWYSVGRIYNAGDLFVGGNIISGIPTLSTTGPVHAVFNAASQAFNTPALNIHQIPLGFQVPGSIDAITLFPGGLTFPANSLLNLDVFVGTPGATIPAITFPEIPANADGELYVIAGDIPLINIPPTPGIGNTTTVPSSGFFNTGAGGGSGFGNFGANMSGWWNQAHTALAGAGSGIANVGTLHSGVLNLGSGLSGIYNTSTLPLGTPALVSGLGNVGDHLSGLLASNVGQNPITIVNIGLANVGNGNVGLGNIGNLNLGAANIGDVNLGFGNIGDVNLGFGNIGGGNVGFGNIGDANFGFGNSGLAAGLAGMGNIGLGNAGSGNVGWANMGLGNIGFGNTGTNNLGIGLTGDNQSGIGGLNSGTGNIGLFNSGTGNIGFFNSGTANFGLFNSGSYNTGIGNSGVASTGLVNAGGFNTGVANAGSYNTGSFNAGDTNTGGFNPGSTNTGWFNTGNANTGVANAGNVNTGALITGNFSNGILWRGNYEGLAGFSFGYPIPLFPAVGADVTGDIGPATIIPPIHIPSIPLGFAAIGHIGPISIPNIAIPSIHLGIDPTFDVGPITVDPITLTIPGLSLDAAVSEIRMTSGSSSGFKVRPSFSFFAVGPDGMPGGEVSILQPFTVAPINLNPTTLHFPGFTIPTGPIHIGLPLSLTIPGFTIPGGTLIPQLPLGLGLSGGTPPFDLPTVVIDRIPVELHASTTIGPVSLPIFGFGGAPGFGNDTTAPSSGFFNTGGGGGSGFSNSGSGMSGVLNAISDPLLGSASGFANFGTQLSGILNRGAGISGVYNTGTLGLVTSAFVSGFMNVGQQLSGLLFAGTGP

SEQ ID NO: 175642 - protein, 8 aa, Mycobacterium tuberculosis
FPVLPPEI

SEQ ID NO: 175643 - protein, 8 aa, Mycobacterium tuberculosis
VLPPEINS

SEQ ID NO: 175644 - protein, 8 aa, Mycobacterium tuberculosis
LPPEINSV

SEQ ID NO: 175645 - protein, 8 aa, Mycobacterium tuberculosis
EINSVLMY

SEQ ID NO: 175646 - protein, 8 aa, Mycobacterium tuberculosis
SVLMYSGA

SEQ ID NO: 175647 - protein, 8 aa, Mycobacterium tuberculosis
LMYSGAGS

SEQ ID NO: 175648 - protein, 8 aa, Mycobacterium tuberculosis
SGAGSSPL

SEQ ID NO: 175649 - protein, 8 aa, Mycobacterium tuberculosis
SPLLAAAA

SEQ ID NO: 175650 - protein, 8 aa, Mycobacterium tuberculosis
PLLAAAAA

SEQ ID NO: 175651 - protein, 8 aa, Mycobacterium tuberculosis
LLAAAAAW

SEQ ID NO: 175652 - protein, 8 aa, Mycobacterium tuberculosis
AAAAWDGL

SEQ ID NO: 175653 - protein, 8 aa, Mycobacterium tuberculosis
GLAEELGS

SEQ ID NO: 175654 - protein, 8 aa, Mycobacterium tuberculosis
AEELGSAA

SEQ ID NO: 175655 - protein, 8 aa, Mycobacterium tuberculosis
EELGSAAV

SEQ ID NO: 175656 - protein, 8 aa, Mycobacterium tuberculosis
AAVSFGQV

SEQ ID NO: 175657 - protein, 8 aa, Mycobacterium tuberculosis
TSGLTAGV

SEQ ID NO: 175658 - protein, 8 aa, Mycobacterium tuberculosis
SGLTAGVW

SEQ ID NO: 175659 - protein, 8 aa, Mycobacterium tuberculosis
GLTAGVWQ

SEQ ID NO: 175660 - protein, 8 aa, Mycobacterium tuberculosis
GVWQGAAA

SEQ ID NO: 175661 - protein, 8 aa, Mycobacterium tuberculosis
WQGAAAAA

SEQ ID NO: 175662 - protein, 8 aa, Mycobacterium tuberculosis
QGAAAAAM

SEQ ID NO: 175663 - protein, 8 aa, Mycobacterium tuberculosis
AAAAAMAA

SEQ ID NO: 175664 - protein, 8 aa, Mycobacterium tuberculosis
AAAAMAAA

SEQ ID NO: 175665 - protein, 8 aa, Mycobacterium tuberculosis
AAMAAAAA

SEQ ID NO: 175666 - protein, 8 aa, Mycobacterium tuberculosis
MAAAAAPY

SEQ ID NO: 175667 - protein, 8 aa, Mycobacterium tuberculosis
AAAAAPYA

SEQ ID NO: 175668 - protein, 8 aa, Mycobacterium tuberculosis
AAAPYAGW

SEQ ID NO: 175669 - protein, 8 aa, Mycobacterium tuberculosis
YAGWLGSV

SEQ ID NO: 175670 - protein, 8 aa, Mycobacterium tuberculosis
WLGSVAAQ

SEQ ID NO: 175671 - protein, 8 aa, Mycobacterium tuberculosis
SVAAQAVA

SEQ ID NO: 175672 - protein, 8 aa, Mycobacterium tuberculosis
VAAQAVAV

SEQ ID NO: 175673 - protein, 8 aa, Mycobacterium tuberculosis
VAVAGQAR

SEQ ID NO: 175674 - protein, 8 aa, Mycobacterium tuberculosis
GQARAAVA

SEQ ID NO: 175675 - protein, 8 aa, Mycobacterium tuberculosis
ARAAVAAF

SEQ ID NO: 175676 - protein, 8 aa, Mycobacterium tuberculosis
AAVAAFEA

SEQ ID NO: 175677 - protein, 8 aa, Mycobacterium tuberculosis
AVAAFEAA

SEQ ID NO: 175678 - protein, 8 aa, Mycobacterium tuberculosis
VAAFEAAL

SEQ ID NO: 175679 - protein, 8 aa, Mycobacterium tuberculosis
AAFEAALA

SEQ ID NO: 175680 - protein, 8 aa, Mycobacterium tuberculosis
FEAALAAT

SEQ ID NO: 175681 - protein, 8 aa, Mycobacterium tuberculosis
EAALAATV

SEQ ID NO: 175682 - protein, 8 aa, Mycobacterium tuberculosis
LAATVDPA

SEQ ID NO: 175683 - protein, 8 aa, Mycobacterium tuberculosis
ATVDPAAV

SEQ ID NO: 175684 - protein, 8 aa, Mycobacterium tuberculosis
TVDPAAVA

SEQ ID NO: 175685 - protein, 8 aa, Mycobacterium tuberculosis
VAVNRMAM

SEQ ID NO: 175686 - protein, 8 aa, Mycobacterium tuberculosis
AVNRMAMR

SEQ ID NO: 175687 - protein, 8 aa, Mycobacterium tuberculosis
NRMAMRAL

SEQ ID NO: 175688 - protein, 8 aa, Mycobacterium tuberculosis
RMAMRALA

SEQ ID NO: 175689 - protein, 8 aa, Mycobacterium tuberculosis
MAMRALAM

SEQ ID NO: 175690 - protein, 8 aa, Mycobacterium tuberculosis
RALAMSNL

SEQ ID NO: 175691 - protein, 8 aa, Mycobacterium tuberculosis
ALAMSNLL

SEQ ID NO: 175692 - protein, 8 aa, Mycobacterium tuberculosis
AMSNLLGQ

SEQ ID NO: 175693 - protein, 8 aa, Mycobacterium tuberculosis
NLLGQNAA

SEQ ID NO: 175694 - protein, 8 aa, Mycobacterium tuberculosis
LLGQNAAA

SEQ ID NO: 175695 - protein, 8 aa, Mycobacterium tuberculosis
GQNAAAIA

SEQ ID NO: 175696 - protein, 8 aa, Mycobacterium tuberculosis
NAAAIAAV

SEQ ID NO: 175697 - protein, 8 aa, Mycobacterium tuberculosis
AAIAAVEA

SEQ ID NO: 175698 - protein, 8 aa, Mycobacterium tuberculosis
IAAVEAEY

SEQ ID NO: 175699 - protein, 8 aa, Mycobacterium tuberculosis
AVEAEYEL

SEQ ID NO: 175700 - protein, 8 aa, Mycobacterium tuberculosis
VEAEYELM

SEQ ID NO: 175701 - protein, 8 aa, Mycobacterium tuberculosis
EAEYELMW

SEQ ID NO: 175702 - protein, 8 aa, Mycobacterium tuberculosis
AEYELMWA

SEQ ID NO: 175703 - protein, 8 aa, Mycobacterium tuberculosis
ELMWAADV

SEQ ID NO: 175704 - protein, 8 aa, Mycobacterium tuberculosis
LMWAADVA

SEQ ID NO: 175705 - protein, 8 aa, Mycobacterium tuberculosis
WAADVAAM

SEQ ID NO: 175706 - protein, 8 aa, Mycobacterium tuberculosis
DVAAMAGY

SEQ ID NO: 175707 - protein, 8 aa, Mycobacterium tuberculosis
AMAGYHSG

SEQ ID NO: 175708 - protein, 8 aa, Mycobacterium tuberculosis
MAGYHSGA

SEQ ID NO: 175709 - protein, 8 aa, Mycobacterium tuberculosis
ASAAAAAL

SEQ ID NO: 175710 - protein, 8 aa, Mycobacterium tuberculosis
AAAAALPA

SEQ ID NO: 175711 - protein, 8 aa, Mycobacterium tuberculosis
AAAALPAF

SEQ ID NO: 175712 - protein, 8 aa, Mycobacterium tuberculosis
LPAFSPPA

SEQ ID NO: 175713 - protein, 8 aa, Mycobacterium tuberculosis
FSPPAQAL

SEQ ID NO: 175714 - protein, 8 aa, Mycobacterium tuberculosis
AQALGGGV

SEQ ID NO: 175715 - protein, 8 aa, Mycobacterium tuberculosis
ALGGGVGA

SEQ ID NO: 175716 - protein, 8 aa, Mycobacterium tuberculosis
FLNALFAG

SEQ ID NO: 175717 - protein, 8 aa, Mycobacterium tuberculosis
NALFAGPA

SEQ ID NO: 175718 - protein, 8 aa, Mycobacterium tuberculosis
ALFAGPAK

SEQ ID NO: 175719 - protein, 8 aa, Mycobacterium tuberculosis
GPAKMLRL

SEQ ID NO: 175720 - protein, 8 aa, Mycobacterium tuberculosis
MLRLNAGL

SEQ ID NO: 175721 - protein, 8 aa, Mycobacterium tuberculosis
GIFNLGAA

SEQ ID NO: 175722 - protein, 8 aa, Mycobacterium tuberculosis
IGNANFGF

SEQ ID NO: 175723 - protein, 8 aa, Mycobacterium tuberculosis
FGFGNSGL

SEQ ID NO: 175724 - protein, 8 aa, Mycobacterium tuberculosis
FGNSGLGL

SEQ ID NO: 175725 - protein, 8 aa, Mycobacterium tuberculosis
LPPGMGNI

SEQ ID NO: 175726 - protein, 8 aa, Mycobacterium tuberculosis
YGLANLGV

SEQ ID NO: 175727 - protein, 8 aa, Mycobacterium tuberculosis
GLTGDNLT

SEQ ID NO: 175728 - protein, 8 aa, Mycobacterium tuberculosis
NLTGIGGL

SEQ ID NO: 175729 - protein, 8 aa, Mycobacterium tuberculosis
GTGNIGFF

SEQ ID NO: 175730 - protein, 8 aa, Mycobacterium tuberculosis
SGTGNFGV

SEQ ID NO: 175731 - protein, 8 aa, Mycobacterium tuberculosis
GVFNSGSY

SEQ ID NO: 175732 - protein, 8 aa, Mycobacterium tuberculosis
SGSYNTGV

SEQ ID NO: 175733 - protein, 8 aa, Mycobacterium tuberculosis
GTASTGLF

SEQ ID NO: 175734 - protein, 8 aa, Mycobacterium tuberculosis
ASTGLFNV

SEQ ID NO: 175735 - protein, 8 aa, Mycobacterium tuberculosis
GLFNVGGF

SEQ ID NO: 175736 - protein, 8 aa, Mycobacterium tuberculosis
GVANVGSY

SEQ ID NO: 175737 - protein, 8 aa, Mycobacterium tuberculosis
GSYNTGSF

SEQ ID NO: 175738 - protein, 8 aa, Mycobacterium tuberculosis
GIANSGNV

SEQ ID NO: 175739 - protein, 8 aa, Mycobacterium tuberculosis
NVNTGAFI

SEQ ID NO: 175740 - protein, 8 aa, Mycobacterium tuberculosis
SGNFSNGV

SEQ ID NO: 175741 - protein, 8 aa, Mycobacterium tuberculosis
FSNGVLWR

SEQ ID NO: 175742 - protein, 8 aa, Mycobacterium tuberculosis
VLWRGDYE

SEQ ID NO: 175743 - protein, 8 aa, Mycobacterium tuberculosis
RGDYEGLW

SEQ ID NO: 175744 - protein, 8 aa, Mycobacterium tuberculosis
DYEGLWGL

SEQ ID NO: 175745 - protein, 8 aa, Mycobacterium tuberculosis
GLWGLSGG

SEQ ID NO: 175746 - protein, 8 aa, Mycobacterium tuberculosis
GLSGGSTI

SEQ ID NO: 175747 - protein, 8 aa, Mycobacterium tuberculosis
STIPAIPI

SEQ ID NO: 175748 - protein, 8 aa, Mycobacterium tuberculosis
IPAIPIGL

SEQ ID NO: 175749 - protein, 8 aa, Mycobacterium tuberculosis
AIPIGLEL

SEQ ID NO: 175750 - protein, 8 aa, Mycobacterium tuberculosis
GLELNGGV

SEQ ID NO: 175751 - protein, 8 aa, Mycobacterium tuberculosis
GVGPITVL

SEQ ID NO: 175752 - protein, 8 aa, Mycobacterium tuberculosis
GPITVLPI

SEQ ID NO: 175753 - protein, 8 aa, Mycobacterium tuberculosis
ITVLPIQI

SEQ ID NO: 175754 - protein, 8 aa, Mycobacterium tuberculosis
TVLPIQIL

SEQ ID NO: 175755 - protein, 8 aa, Mycobacterium tuberculosis
LPIQILPT

SEQ ID NO: 175756 - protein, 8 aa, Mycobacterium tuberculosis
QILPTIPL

SEQ ID NO: 175757 - protein, 8 aa, Mycobacterium tuberculosis
LPTIPLNI

SEQ ID NO: 175758 - protein, 8 aa, Mycobacterium tuberculosis
IPLNIHQT

SEQ ID NO: 175759 - protein, 8 aa, Mycobacterium tuberculosis
NIHQTFSL

SEQ ID NO: 175760 - protein, 8 aa, Mycobacterium tuberculosis
QTFSLGPL

SEQ ID NO: 175761 - protein, 8 aa, Mycobacterium tuberculosis
FSLGPLVV

SEQ ID NO: 175762 - protein, 8 aa, Mycobacterium tuberculosis
SLGPLVVP

SEQ ID NO: 175763 - protein, 8 aa, Mycobacterium tuberculosis
GPLVVPDI

SEQ ID NO: 175764 - protein, 8 aa, Mycobacterium tuberculosis
PLVVPDIV

SEQ ID NO: 175765 - protein, 8 aa, Mycobacterium tuberculosis
LVVPDIVI

SEQ ID NO: 175766 - protein, 8 aa, Mycobacterium tuberculosis
VPDIVIPA

SEQ ID NO: 175767 - protein, 8 aa, Mycobacterium tuberculosis
IPAFGGGT

SEQ ID NO: 175768 - protein, 8 aa, Mycobacterium tuberculosis
GTAIPISV

SEQ ID NO: 175769 - protein, 8 aa, Mycobacterium tuberculosis
IPISVGPI

SEQ ID NO: 175770 - protein, 8 aa, Mycobacterium tuberculosis
GPITISPI

SEQ ID NO: 175771 - protein, 8 aa, Mycobacterium tuberculosis
ITISPITL

SEQ ID NO: 175772 - protein, 8 aa, Mycobacterium tuberculosis
TISPITLF

SEQ ID NO: 175773 - protein, 8 aa, Mycobacterium tuberculosis
SPITLFPA

SEQ ID NO: 175774 - protein, 8 aa, Mycobacterium tuberculosis
TLFPAQNF

SEQ ID NO: 175775 - protein, 8 aa, Mycobacterium tuberculosis
FPAQNFNT

SEQ ID NO: 175776 - protein, 8 aa, Mycobacterium tuberculosis
AQNFNTTF

SEQ ID NO: 175777 - protein, 8 aa, Mycobacterium tuberculosis
TTFPVGPF

SEQ ID NO: 175778 - protein, 8 aa, Mycobacterium tuberculosis
TFPVGPFF

SEQ ID NO: 175779 - protein, 8 aa, Mycobacterium tuberculosis
FPVGPFFG

SEQ ID NO: 175780 - protein, 8 aa, Mycobacterium tuberculosis
PVGPFFGL

SEQ ID NO: 175781 - protein, 8 aa, Mycobacterium tuberculosis
GPFFGLGV

SEQ ID NO: 175782 - protein, 8 aa, Mycobacterium tuberculosis
GVVNISGI

SEQ ID NO: 175783 - protein, 8 aa, Mycobacterium tuberculosis
NISGIEIK

SEQ ID NO: 175784 - protein, 8 aa, Mycobacterium tuberculosis
DLAGNVTL

SEQ ID NO: 175785 - protein, 8 aa, Mycobacterium tuberculosis
LQLGNLNI

SEQ ID NO: 175786 - protein, 8 aa, Mycobacterium tuberculosis
NLNIDTRI

SEQ ID NO: 175787 - protein, 8 aa, Mycobacterium tuberculosis
DTRINQSF

SEQ ID NO: 175788 - protein, 8 aa, Mycobacterium tuberculosis
RINQSFPV

SEQ ID NO: 175789 - protein, 8 aa, Mycobacterium tuberculosis
NQSFPVTV

SEQ ID NO: 175790 - protein, 8 aa, Mycobacterium tuberculosis
SFPVTVNW

SEQ ID NO: 175791 - protein, 8 aa, Mycobacterium tuberculosis
FPVTVNWS

SEQ ID NO: 175792 - protein, 8 aa, Mycobacterium tuberculosis
TVNWSTPA

SEQ ID NO: 175793 - protein, 8 aa, Mycobacterium tuberculosis
VNWSTPAV

SEQ ID NO: 175794 - protein, 8 aa, Mycobacterium tuberculosis
STPAVTIF

SEQ ID NO: 175795 - protein, 8 aa, Mycobacterium tuberculosis
VTIFPNGI

SEQ ID NO: 175796 - protein, 8 aa, Mycobacterium tuberculosis
IFPNGISI

SEQ ID NO: 175797 - protein, 8 aa, Mycobacterium tuberculosis
FPNGISIP

SEQ ID NO: 175798 - protein, 8 aa, Mycobacterium tuberculosis
ISIPNNPL

SEQ ID NO: 175799 - protein, 8 aa, Mycobacterium tuberculosis
SIPNNPLA

SEQ ID NO: 175800 - protein, 8 aa, Mycobacterium tuberculosis
IPNNPLAL

SEQ ID NO: 175801 - protein, 8 aa, Mycobacterium tuberculosis
NPLALLAS

SEQ ID NO: 175802 - protein, 8 aa, Mycobacterium tuberculosis
PLALLASA

SEQ ID NO: 175803 - protein, 8 aa, Mycobacterium tuberculosis
ALLASASI

SEQ ID NO: 175804 - protein, 8 aa, Mycobacterium tuberculosis
ASIGTLGF

SEQ ID NO: 175805 - protein, 8 aa, Mycobacterium tuberculosis
FTIPGFTI

SEQ ID NO: 175806 - protein, 8 aa, Mycobacterium tuberculosis
IPGFTIPA

SEQ ID NO: 175807 - protein, 8 aa, Mycobacterium tuberculosis
FTIPAAPL

SEQ ID NO: 175808 - protein, 8 aa, Mycobacterium tuberculosis
IPAAPLPL

SEQ ID NO: 175809 - protein, 8 aa, Mycobacterium tuberculosis
LPLTIDID

SEQ ID NO: 175810 - protein, 8 aa, Mycobacterium tuberculosis
TIDIDGQI

SEQ ID NO: 175811 - protein, 8 aa, Mycobacterium tuberculosis
GQIDGFST

SEQ ID NO: 175812 - protein, 8 aa, Mycobacterium tuberculosis
FSTPPITI

SEQ ID NO: 175813 - protein, 8 aa, Mycobacterium tuberculosis
PPITIDRI

SEQ ID NO: 175814 - protein, 8 aa, Mycobacterium tuberculosis
ITIDRIPL

SEQ ID NO: 175815 - protein, 8 aa, Mycobacterium tuberculosis
RIPLNLGA

SEQ ID NO: 175816 - protein, 8 aa, Mycobacterium tuberculosis
IPLNLGAS

SEQ ID NO: 175817 - protein, 8 aa, Mycobacterium tuberculosis
PLNLGASV

SEQ ID NO: 175818 - protein, 8 aa, Mycobacterium tuberculosis
NLGASVTV

SEQ ID NO: 175819 - protein, 8 aa, Mycobacterium tuberculosis
SVTVGPIL

SEQ ID NO: 175820 - protein, 8 aa, Mycobacterium tuberculosis
VTVGPILI

SEQ ID NO: 175821 - protein, 8 aa, Mycobacterium tuberculosis
GPILINGV

SEQ ID NO: 175822 - protein, 8 aa, Mycobacterium tuberculosis
ILINGVNI

SEQ ID NO: 175823 - protein, 8 aa, Mycobacterium tuberculosis
NIPATPGF

SEQ ID NO: 175824 - protein, 8 aa, Mycobacterium tuberculosis
TPGFGNTT

SEQ ID NO: 175825 - protein, 8 aa, Mycobacterium tuberculosis
TTAPSSGF

SEQ ID NO: 175826 - protein, 8 aa, Mycobacterium tuberculosis
SGFGNFGA

SEQ ID NO: 175827 - protein, 8 aa, Mycobacterium tuberculosis
FGAGSSGW

SEQ ID NO: 175828 - protein, 8 aa, Mycobacterium tuberculosis
NQAQTEVA

SEQ ID NO: 175829 - protein, 8 aa, Mycobacterium tuberculosis
AQTEVAGA

SEQ ID NO: 175830 - protein, 8 aa, Mycobacterium tuberculosis
FGSLGSGV

SEQ ID NO: 175831 - protein, 8 aa, Mycobacterium tuberculosis
VLNFGSGV

SEQ ID NO: 175832 - protein, 8 aa, Mycobacterium tuberculosis
FGSGVSGL

SEQ ID NO: 175833 - protein, 8 aa, Mycobacterium tuberculosis
GSGVSGLY

SEQ ID NO: 175834 - protein, 8 aa, Mycobacterium tuberculosis
GLYNTGGL

SEQ ID NO: 175835 - protein, 8 aa, Mycobacterium tuberculosis
GLPPGTPA

SEQ ID NO: 175836 - protein, 8 aa, Mycobacterium tuberculosis
LPPGTPAV

SEQ ID NO: 175837 - protein, 8 aa, Mycobacterium tuberculosis
PPGTPAVV

SEQ ID NO: 175838 - protein, 8 aa, Mycobacterium tuberculosis
TPAVVSGI

SEQ ID NO: 175839 - protein, 8 aa, Mycobacterium tuberculosis
VVSGIGNV

SEQ ID NO: 175840 - protein, 8 aa, Mycobacterium tuberculosis
QLSGLSSA

SEQ ID NO: 175841 - protein, 8 aa, Mycobacterium tuberculosis
GLSSAGTA

SEQ ID NO: 175842 - protein, 8 aa, Mycobacterium tuberculosis
LSSAGTAL

SEQ ID NO: 175843 - protein, 8 aa, Mycobacterium tuberculosis
GTALNQSL

SEQ ID NO: 175844 - protein, 8 aa, Mycobacterium tuberculosis
ALNQSLII

SEQ ID NO: 175845 - protein, 8 aa, Mycobacterium tuberculosis
NQSLIINL

SEQ ID NO: 175846 - protein, 8 aa, Mycobacterium tuberculosis
SLIINLGL

SEQ ID NO: 175847 - protein, 8 aa, Mycobacterium tuberculosis
LIINLGLA

SEQ ID NO: 175848 - protein, 8 aa, Mycobacterium tuberculosis
GLADVGSV

SEQ ID NO: 175849 - protein, 8 aa, Mycobacterium tuberculosis
GFGNVGDF

SEQ ID NO: 175850 - protein, 8 aa, Mycobacterium tuberculosis
GLGNAGLA

SEQ ID NO: 175851 - protein, 8 aa, Mycobacterium tuberculosis
LAAGLAGV

SEQ ID NO: 175852 - protein, 8 aa, Mycobacterium tuberculosis
GLAGVGNI

SEQ ID NO: 175853 - protein, 8 aa, Mycobacterium tuberculosis
VGFGNMGV

SEQ ID NO: 175854 - protein, 8 aa, Mycobacterium tuberculosis
GLTGDNQT

SEQ ID NO: 175855 - protein, 8 aa, Mycobacterium tuberculosis
SGAGNIGL

SEQ ID NO: 175856 - protein, 8 aa, Mycobacterium tuberculosis
SGTGNFGL

SEQ ID NO: 175857 - protein, 8 aa, Mycobacterium tuberculosis
GLFNSGSF

SEQ ID NO: 175858 - protein, 8 aa, Mycobacterium tuberculosis
SGSFNTGI

SEQ ID NO: 175859 - protein, 8 aa, Mycobacterium tuberculosis
GLFNAGNF

SEQ ID NO: 175860 - protein, 8 aa, Mycobacterium tuberculosis
GVANPGSY

SEQ ID NO: 175861 - protein, 8 aa, Mycobacterium tuberculosis
GSYNTGSF

SEQ ID NO: 175862 - protein, 8 aa, Mycobacterium tuberculosis
GSINTGWF

SEQ ID NO: 175863 - protein, 8 aa, Mycobacterium tuberculosis
TGNANTGV

SEQ ID NO: 175864 - protein, 8 aa, Mycobacterium tuberculosis
GVANSGNV

SEQ ID NO: 175865 - protein, 8 aa, Mycobacterium tuberculosis
NVDTGALM

SEQ ID NO: 175866 - protein, 8 aa, Mycobacterium tuberculosis
ALMSGNFS

SEQ ID NO: 175867 - protein, 8 aa, Mycobacterium tuberculosis
FSNGILWR

SEQ ID NO: 175868 - protein, 8 aa, Mycobacterium tuberculosis
ILWRGNFE

SEQ ID NO: 175869 - protein, 8 aa, Mycobacterium tuberculosis
EGLFGLNV

SEQ ID NO: 175870 - protein, 8 aa, Mycobacterium tuberculosis
GLNVGITI

SEQ ID NO: 175871 - protein, 8 aa, Mycobacterium tuberculosis
VGITIPEF

SEQ ID NO: 175872 - protein, 8 aa, Mycobacterium tuberculosis
ITIPEFPI

SEQ ID NO: 175873 - protein, 8 aa, Mycobacterium tuberculosis
IPEFPIHW

SEQ ID NO: 175874 - protein, 8 aa, Mycobacterium tuberculosis
FPIHWTST

SEQ ID NO: 175875 - protein, 8 aa, Mycobacterium tuberculosis
STGGIGPI

SEQ ID NO: 175876 - protein, 8 aa, Mycobacterium tuberculosis
IIIPDTTI

SEQ ID NO: 175877 - protein, 8 aa, Mycobacterium tuberculosis
IIPDTTIL

SEQ ID NO: 175878 - protein, 8 aa, Mycobacterium tuberculosis
DTTILPPI

SEQ ID NO: 175879 - protein, 8 aa, Mycobacterium tuberculosis
TILPPIHL

SEQ ID NO: 175880 - protein, 8 aa, Mycobacterium tuberculosis
ILPPIHLG

SEQ ID NO: 175881 - protein, 8 aa, Mycobacterium tuberculosis
LPPIHLGL

SEQ ID NO: 175882 - protein, 8 aa, Mycobacterium tuberculosis
HLGLTGQA

SEQ ID NO: 175883 - protein, 8 aa, Mycobacterium tuberculosis
GQANYGFA

SEQ ID NO: 175884 - protein, 8 aa, Mycobacterium tuberculosis
QANYGFAV

SEQ ID NO: 175885 - protein, 8 aa, Mycobacterium tuberculosis
FAVPDIPI

SEQ ID NO: 175886 - protein, 8 aa, Mycobacterium tuberculosis
VPDIPIPA

SEQ ID NO: 175887 - protein, 8 aa, Mycobacterium tuberculosis
IPIPAIHI

SEQ ID NO: 175888 - protein, 8 aa, Mycobacterium tuberculosis
IPAIHIDF

SEQ ID NO: 175889 - protein, 8 aa, Mycobacterium tuberculosis
AADAGFTA

SEQ ID NO: 175890 - protein, 8 aa, Mycobacterium tuberculosis
FTAPATTL

SEQ ID NO: 175891 - protein, 8 aa, Mycobacterium tuberculosis
TAPATTLL

SEQ ID NO: 175892 - protein, 8 aa, Mycobacterium tuberculosis
TLLSALGI

SEQ ID NO: 175893 - protein, 8 aa, Mycobacterium tuberculosis
LLSALGIT

SEQ ID NO: 175894 - protein, 8 aa, Mycobacterium tuberculosis
GQFRFGPI

SEQ ID NO: 175895 - protein, 8 aa, Mycobacterium tuberculosis
FRFGPITV

SEQ ID NO: 175896 - protein, 8 aa, Mycobacterium tuberculosis
GPITVSNV

SEQ ID NO: 175897 - protein, 8 aa, Mycobacterium tuberculosis
VQLNPFNV

SEQ ID NO: 175898 - protein, 8 aa, Mycobacterium tuberculosis
NPFNVNLK

SEQ ID NO: 175899 - protein, 8 aa, Mycobacterium tuberculosis
KLQFLHDA

SEQ ID NO: 175900 - protein, 8 aa, Mycobacterium tuberculosis
LQFLHDAF

SEQ ID NO: 175901 - protein, 8 aa, Mycobacterium tuberculosis
FLHDAFPN

SEQ ID NO: 175902 - protein, 8 aa, Mycobacterium tuberculosis
FPNEFPDP

SEQ ID NO: 175903 - protein, 8 aa, Mycobacterium tuberculosis
NEFPDPTI

SEQ ID NO: 175904 - protein, 8 aa, Mycobacterium tuberculosis
FPDPTISV

SEQ ID NO: 175905 - protein, 8 aa, Mycobacterium tuberculosis
TISVQIQV

SEQ ID NO: 175906 - protein, 8 aa, Mycobacterium tuberculosis
SVQIQVAI

SEQ ID NO: 175907 - protein, 8 aa, Mycobacterium tuberculosis
IQVAIPLT

SEQ ID NO: 175908 - protein, 8 aa, Mycobacterium tuberculosis
VAIPLTSA

SEQ ID NO: 175909 - protein, 8 aa, Mycobacterium tuberculosis
IPLTSATL

SEQ ID NO: 175910 - protein, 8 aa, Mycobacterium tuberculosis
TSATLGGL

SEQ ID NO: 175911 - protein, 8 aa, Mycobacterium tuberculosis
ATLGGLAL

SEQ ID NO: 175912 - protein, 8 aa, Mycobacterium tuberculosis
GLALPLQQ

SEQ ID NO: 175913 - protein, 8 aa, Mycobacterium tuberculosis
ALPLQQTI

SEQ ID NO: 175914 - protein, 8 aa, Mycobacterium tuberculosis
LQQTIDAI

SEQ ID NO: 175915 - protein, 8 aa, Mycobacterium tuberculosis
QTIDAIEL

SEQ ID NO: 175916 - protein, 8 aa, Mycobacterium tuberculosis
DAIELPAI

SEQ ID NO: 175917 - protein, 8 aa, Mycobacterium tuberculosis
IELPAISF

SEQ ID NO: 175918 - protein, 8 aa, Mycobacterium tuberculosis
ELPAISFS

SEQ ID NO: 175919 - protein, 8 aa, Mycobacterium tuberculosis
LPAISFSQ

SEQ ID NO: 175920 - protein, 8 aa, Mycobacterium tuberculosis
AISFSQSI

SEQ ID NO: 175921 - protein, 8 aa, Mycobacterium tuberculosis
IPIDIPPI

SEQ ID NO: 175922 - protein, 8 aa, Mycobacterium tuberculosis
IPPIDIPA

SEQ ID NO: 175923 - protein, 8 aa, Mycobacterium tuberculosis
STINGISM

SEQ ID NO: 175924 - protein, 8 aa, Mycobacterium tuberculosis
NGISMSEV

SEQ ID NO: 175925 - protein, 8 aa, Mycobacterium tuberculosis
GISMSEVV

SEQ ID NO: 175926 - protein, 8 aa, Mycobacterium tuberculosis
SMSEVVPI

SEQ ID NO: 175927 - protein, 8 aa, Mycobacterium tuberculosis
SEVVPIDV

SEQ ID NO: 175928 - protein, 8 aa, Mycobacterium tuberculosis
EVVPIDVS

SEQ ID NO: 175929 - protein, 8 aa, Mycobacterium tuberculosis
VVPIDVSV

SEQ ID NO: 175930 - protein, 8 aa, Mycobacterium tuberculosis
DVSVDIPA

SEQ ID NO: 175931 - protein, 8 aa, Mycobacterium tuberculosis
VSVDIPAV

SEQ ID NO: 175932 - protein, 8 aa, Mycobacterium tuberculosis
AVTITGTR

SEQ ID NO: 175933 - protein, 8 aa, Mycobacterium tuberculosis
TGTRIDPI

SEQ ID NO: 175934 - protein, 8 aa, Mycobacterium tuberculosis
TRIDPIPL

SEQ ID NO: 175935 - protein, 8 aa, Mycobacterium tuberculosis
PIPLNFDV

SEQ ID NO: 175936 - protein, 8 aa, Mycobacterium tuberculosis
IPLNFDVL

SEQ ID NO: 175937 - protein, 8 aa, Mycobacterium tuberculosis
VLSSAGPI

SEQ ID NO: 175938 - protein, 8 aa, Mycobacterium tuberculosis
SSAGPINI

SEQ ID NO: 175939 - protein, 8 aa, Mycobacterium tuberculosis
GPINISII

SEQ ID NO: 175940 - protein, 8 aa, Mycobacterium tuberculosis
SIIDIPAL

SEQ ID NO: 175941 - protein, 8 aa, Mycobacterium tuberculosis
DIPALPGF

SEQ ID NO: 175942 - protein, 8 aa, Mycobacterium tuberculosis
LPGFGNST

SEQ ID NO: 175943 - protein, 8 aa, Mycobacterium tuberculosis
GFGNSTEL

SEQ ID NO: 175944 - protein, 8 aa, Mycobacterium tuberculosis
TELPSSGF

SEQ ID NO: 175945 - protein, 8 aa, Mycobacterium tuberculosis
ELPSSGFF

SEQ ID NO: 175946 - protein, 8 aa, Mycobacterium tuberculosis
SGIANFGA

SEQ ID NO: 175947 - protein, 8 aa, Mycobacterium tuberculosis
IANFGAGV

SEQ ID NO: 175948 - protein, 8 aa, Mycobacterium tuberculosis
FGAGVSGL

SEQ ID NO: 175949 - protein, 8 aa, Mycobacterium tuberculosis
NQASSPMV

SEQ ID NO: 175950 - protein, 8 aa, Mycobacterium tuberculosis
MVGTLSGL

SEQ ID NO: 175951 - protein, 8 aa, Mycobacterium tuberculosis
TLSGLGNA

SEQ ID NO: 175952 - protein, 8 aa, Mycobacterium tuberculosis
GLGNAGSL

SEQ ID NO: 175953 - protein, 8 aa, Mycobacterium tuberculosis
SLASGVLN

SEQ ID NO: 175954 - protein, 8 aa, Mycobacterium tuberculosis
SGVLNSGV

SEQ ID NO: 175955 - protein, 8 aa, Mycobacterium tuberculosis
VLNSGVDI

SEQ ID NO: 175956 - protein, 8 aa, Mycobacterium tuberculosis
DISGMFNV

SEQ ID NO: 175957 - protein, 8 aa, Mycobacterium tuberculosis
GMFNVSTL

SEQ ID NO: 175958 - protein, 8 aa, Mycobacterium tuberculosis
NVSTLGSA

SEQ ID NO: 175959 - protein, 8 aa, Mycobacterium tuberculosis
STLGSAPA

SEQ ID NO: 175960 - protein, 8 aa, Mycobacterium tuberculosis
TLGSAPAV

SEQ ID NO: 175961 - protein, 8 aa, Mycobacterium tuberculosis
APAVISGF

SEQ ID NO: 175962 - protein, 8 aa, Mycobacterium tuberculosis
VISGFGNL

SEQ ID NO: 175963 - protein, 8 aa, Mycobacterium tuberculosis
SGVSIDGL

SEQ ID NO: 175964 - protein, 8 aa, Mycobacterium tuberculosis
SIDGLLAM

SEQ ID NO: 175965 - protein, 8 aa, Mycobacterium tuberculosis
GLLAMLTS

SEQ ID NO: 175966 - protein, 8 aa, Mycobacterium tuberculosis
LLAMLTSG

SEQ ID NO: 175967 - protein, 8 aa, Mycobacterium tuberculosis
QPSIIDAA

SEQ ID NO: 175968 - protein, 8 aa, Mycobacterium tuberculosis
SIIDAAIA

SEQ ID NO: 175969 - protein, 8 aa, Mycobacterium tuberculosis
DAAIAELR

SEQ ID NO: 175970 - protein, 8 aa, Mycobacterium tuberculosis
AIAELRHL

SEQ ID NO: 175971 - protein, 8 aa, Mycobacterium tuberculosis
ELRHLNPL

SEQ ID NO: 175972 - protein, 8 aa, Mycobacterium tuberculosis
HLNPLNIV

SEQ ID NO: 175973 - protein, 8 aa, Mycobacterium tuberculosis
NPLNIVNL

SEQ ID NO: 175974 - protein, 8 aa, Mycobacterium tuberculosis
NIVNLGNV

SEQ ID NO: 175975 - protein, 8 aa, Mycobacterium tuberculosis
YNLGFANV

SEQ ID NO: 175976 - protein, 8 aa, Mycobacterium tuberculosis
GLGALPGI

SEQ ID NO: 175977 - protein, 8 aa, Mycobacterium tuberculosis
ALPGIGNI

SEQ ID NO: 175978 - protein, 8 aa, Mycobacterium tuberculosis
GLTGDNQT

SEQ ID NO: 175979 - protein, 8 aa, Mycobacterium tuberculosis
NQTGFGGL

SEQ ID NO: 175980 - protein, 8 aa, Mycobacterium tuberculosis
GTGNIGFF

SEQ ID NO: 175981 - protein, 8 aa, Mycobacterium tuberculosis
TGTGNWGL

SEQ ID NO: 175982 - protein, 8 aa, Mycobacterium tuberculosis
GLFNSGSY

SEQ ID NO: 175983 - protein, 8 aa, Mycobacterium tuberculosis
SGSYNTGI

SEQ ID NO: 175984 - protein, 8 aa, Mycobacterium tuberculosis
GLFNAGSF

SEQ ID NO: 175985 - protein, 8 aa, Mycobacterium tuberculosis
GLANAGSY

SEQ ID NO: 175986 - protein, 8 aa, Mycobacterium tuberculosis
GAFNSGSF

SEQ ID NO: 175987 - protein, 8 aa, Mycobacterium tuberculosis
WTGDHHGL

SEQ ID NO: 175988 - protein, 8 aa, Mycobacterium tuberculosis
GLVGFSYS

SEQ ID NO: 175989 - protein, 8 aa, Mycobacterium tuberculosis
LVGFSYSI

SEQ ID NO: 175990 - protein, 8 aa, Mycobacterium tuberculosis
IEITGSTL

SEQ ID NO: 175991 - protein, 8 aa, Mycobacterium tuberculosis
EITGSTLV

SEQ ID NO: 175992 - protein, 8 aa, Mycobacterium tuberculosis
TLVDINET

SEQ ID NO: 175993 - protein, 8 aa, Mycobacterium tuberculosis
LVDINETL

SEQ ID NO: 175994 - protein, 8 aa, Mycobacterium tuberculosis
DINETLNL

SEQ ID NO: 175995 - protein, 8 aa, Mycobacterium tuberculosis
ETLNLGPV

SEQ ID NO: 175996 - protein, 8 aa, Mycobacterium tuberculosis
DIPGMSLF

SEQ ID NO: 175997 - protein, 8 aa, Mycobacterium tuberculosis
SLFDIHEL

SEQ ID NO: 175998 - protein, 8 aa, Mycobacterium tuberculosis
LFDIHELV

SEQ ID NO: 175999 - protein, 8 aa, Mycobacterium tuberculosis
DIHELVNI

SEQ ID NO: 176000 - protein, 8 aa, Mycobacterium tuberculosis
ELVNIGPF

SEQ ID NO: 176001 - protein, 8 aa, Mycobacterium tuberculosis
LVNIGPFR

SEQ ID NO: 176002 - protein, 8 aa, Mycobacterium tuberculosis
GPFRIEPI

SEQ ID NO: 176003 - protein, 8 aa, Mycobacterium tuberculosis
EPIDVPAV

SEQ ID NO: 176004 - protein, 8 aa, Mycobacterium tuberculosis
PIDVPAVV

SEQ ID NO: 176005 - protein, 8 aa, Mycobacterium tuberculosis
IDVPAVVL

SEQ ID NO: 176006 - protein, 8 aa, Mycobacterium tuberculosis
VPAVVLDI

SEQ ID NO: 176007 - protein, 8 aa, Mycobacterium tuberculosis
VVLDIHET

SEQ ID NO: 176008 - protein, 8 aa, Mycobacterium tuberculosis
VLDIHETM

SEQ ID NO: 176009 - protein, 8 aa, Mycobacterium tuberculosis
ETMVIPPI

SEQ ID NO: 176010 - protein, 8 aa, Mycobacterium tuberculosis
TMVIPPIV

SEQ ID NO: 176011 - protein, 8 aa, Mycobacterium tuberculosis
MVIPPIVF

SEQ ID NO: 176012 - protein, 8 aa, Mycobacterium tuberculosis
VIPPIVFL

SEQ ID NO: 176013 - protein, 8 aa, Mycobacterium tuberculosis
IPPIVFLP

SEQ ID NO: 176014 - protein, 8 aa, Mycobacterium tuberculosis
PIVFLPSM

SEQ ID NO: 176015 - protein, 8 aa, Mycobacterium tuberculosis
VFLPSMTI

SEQ ID NO: 176016 - protein, 8 aa, Mycobacterium tuberculosis
SMTIGGQT

SEQ ID NO: 176017 - protein, 8 aa, Mycobacterium tuberculosis
MTIGGQTY

SEQ ID NO: 176018 - protein, 8 aa, Mycobacterium tuberculosis
TIGGQTYT

SEQ ID NO: 176019 - protein, 8 aa, Mycobacterium tuberculosis
GQTYTIPL

SEQ ID NO: 176020 - protein, 8 aa, Mycobacterium tuberculosis
IPLDTPPA

SEQ ID NO: 176021 - protein, 8 aa, Mycobacterium tuberculosis
PPPFRLPL

SEQ ID NO: 176022 - protein, 8 aa, Mycobacterium tuberculosis
PFRLPLLF

SEQ ID NO: 176023 - protein, 8 aa, Mycobacterium tuberculosis
FRLPLLFV

SEQ ID NO: 176024 - protein, 8 aa, Mycobacterium tuberculosis
LPLLFVNA

SEQ ID NO: 176025 - protein, 8 aa, Mycobacterium tuberculosis
PLLFVNAL

SEQ ID NO: 176026 - protein, 8 aa, Mycobacterium tuberculosis
ALGDNWIV

SEQ ID NO: 176027 - protein, 8 aa, Mycobacterium tuberculosis
TGMSGGFV

SEQ ID NO: 176028 - protein, 8 aa, Mycobacterium tuberculosis
GMSGGFVT

SEQ ID NO: 176029 - protein, 8 aa, Mycobacterium tuberculosis
VTAPTQGI

SEQ ID NO: 176030 - protein, 8 aa, Mycobacterium tuberculosis
APTQGILI

SEQ ID NO: 176031 - protein, 8 aa, Mycobacterium tuberculosis
SSATTGSL

SEQ ID NO: 176032 - protein, 8 aa, Mycobacterium tuberculosis
ATTGSLAL

SEQ ID NO: 176033 - protein, 8 aa, Mycobacterium tuberculosis
SLALTLPT

SEQ ID NO: 176034 - protein, 8 aa, Mycobacterium tuberculosis
LALTLPTV

SEQ ID NO: 176035 - protein, 8 aa, Mycobacterium tuberculosis
LTLPTVTI

SEQ ID NO: 176036 - protein, 8 aa, Mycobacterium tuberculosis
LPTVTIPT

SEQ ID NO: 176037 - protein, 8 aa, Mycobacterium tuberculosis
VTIPTITT

SEQ ID NO: 176038 - protein, 8 aa, Mycobacterium tuberculosis
ITTSPIPL

SEQ ID NO: 176039 - protein, 8 aa, Mycobacterium tuberculosis
TTSPIPLK

SEQ ID NO: 176040 - protein, 8 aa, Mycobacterium tuberculosis
IPLKIDVS

SEQ ID NO: 176041 - protein, 8 aa, Mycobacterium tuberculosis
KIDVSGGL

SEQ ID NO: 176042 - protein, 8 aa, Mycobacterium tuberculosis
GLPAFTLF

SEQ ID NO: 176043 - protein, 8 aa, Mycobacterium tuberculosis
LPAFTLFP

SEQ ID NO: 176044 - protein, 8 aa, Mycobacterium tuberculosis
FTLFPGGL

SEQ ID NO: 176045 - protein, 8 aa, Mycobacterium tuberculosis
TLFPGGLN

SEQ ID NO: 176046 - protein, 8 aa, Mycobacterium tuberculosis
FPGGLNIP

SEQ ID NO: 176047 - protein, 8 aa, Mycobacterium tuberculosis
GLNIPQNA

SEQ ID NO: 176048 - protein, 8 aa, Mycobacterium tuberculosis
IPQNAIPL

SEQ ID NO: 176049 - protein, 8 aa, Mycobacterium tuberculosis
IPLTIDAS

SEQ ID NO: 176050 - protein, 8 aa, Mycobacterium tuberculosis
LTIDASGV

SEQ ID NO: 176051 - protein, 8 aa, Mycobacterium tuberculosis
TIDASGVL

SEQ ID NO: 176052 - protein, 8 aa, Mycobacterium tuberculosis
GVLDPITI

SEQ ID NO: 176053 - protein, 8 aa, Mycobacterium tuberculosis
VLDPITIF

SEQ ID NO: 176054 - protein, 8 aa, Mycobacterium tuberculosis
ITIFPGGF

SEQ ID NO: 176055 - protein, 8 aa, Mycobacterium tuberculosis
TIFPGGFT

SEQ ID NO: 176056 - protein, 8 aa, Mycobacterium tuberculosis
IFPGGFTI

SEQ ID NO: 176057 - protein, 8 aa, Mycobacterium tuberculosis
FPGGFTID

SEQ ID NO: 176058 - protein, 8 aa, Mycobacterium tuberculosis
FTIDPLPL

SEQ ID NO: 176059 - protein, 8 aa, Mycobacterium tuberculosis
DPLPLSLA

SEQ ID NO: 176060 - protein, 8 aa, Mycobacterium tuberculosis
PLPLSLAL

SEQ ID NO: 176061 - protein, 8 aa, Mycobacterium tuberculosis
LPLSLALN

SEQ ID NO: 176062 - protein, 8 aa, Mycobacterium tuberculosis
PLSLALNI

SEQ ID NO: 176063 - protein, 8 aa, Mycobacterium tuberculosis
SLALNISV

SEQ ID NO: 176064 - protein, 8 aa, Mycobacterium tuberculosis
ISVPDSSV

SEQ ID NO: 176065 - protein, 8 aa, Mycobacterium tuberculosis
VPDSSVPI

SEQ ID NO: 176066 - protein, 8 aa, Mycobacterium tuberculosis
SSVPIIIV

SEQ ID NO: 176067 - protein, 8 aa, Mycobacterium tuberculosis
VPIIIVPP

SEQ ID NO: 176068 - protein, 8 aa, Mycobacterium tuberculosis
IVPPTPGF

SEQ ID NO: 176069 - protein, 8 aa, Mycobacterium tuberculosis
TPGFGNAT

SEQ ID NO: 176070 - protein, 8 aa, Mycobacterium tuberculosis
TATPSSGF

SEQ ID NO: 176071 - protein, 8 aa, Mycobacterium tuberculosis
ATPSSGFF

SEQ ID NO: 176072 - protein, 8 aa, Mycobacterium tuberculosis
SGFFNSGA

SEQ ID NO: 176073 - protein, 8 aa, Mycobacterium tuberculosis
SGFGNFGA

SEQ ID NO: 176074 - protein, 8 aa, Mycobacterium tuberculosis
FGAGSSGW

SEQ ID NO: 176075 - protein, 8 aa, Mycobacterium tuberculosis
NQAHAALA

SEQ ID NO: 176076 - protein, 8 aa, Mycobacterium tuberculosis
LAGAGSGV

SEQ ID NO: 176077 - protein, 8 aa, Mycobacterium tuberculosis
GVLNVGTL

SEQ ID NO: 176078 - protein, 8 aa, Mycobacterium tuberculosis
VLNVGSGI

SEQ ID NO: 176079 - protein, 8 aa, Mycobacterium tuberculosis
GSGISGLY

SEQ ID NO: 176080 - protein, 8 aa, Mycobacterium tuberculosis
GLYNTAIV

SEQ ID NO: 176081 - protein, 8 aa, Mycobacterium tuberculosis
GLGTPALV

SEQ ID NO: 176082 - protein, 8 aa, Mycobacterium tuberculosis
TPALVSGA

SEQ ID NO: 176083 - protein, 8 aa, Mycobacterium tuberculosis
LVSGAGNV

SEQ ID NO: 176084 - protein, 8 aa, Mycobacterium tuberculosis
GQQLSGVL

SEQ ID NO: 176085 - protein, 8 aa, Mycobacterium tuberculosis
QQLSGVLA

SEQ ID NO: 176086 - protein, 8 aa, Mycobacterium tuberculosis
QLSGVLAA

SEQ ID NO: 176087 - protein, 8 aa, Mycobacterium tuberculosis
VLAAGTAL

SEQ ID NO: 176088 - protein, 8 aa, Mycobacterium tuberculosis
TALTQSPI

SEQ ID NO: 176089 - protein, 8 aa, Mycobacterium tuberculosis
ALTQSPII

SEQ ID NO: 176090 - protein, 8 aa, Mycobacterium tuberculosis
TQSPIINL

SEQ ID NO: 176091 - protein, 8 aa, Mycobacterium tuberculosis
SPIINLGL

SEQ ID NO: 176092 - protein, 8 aa, Mycobacterium tuberculosis
GLADVGNY

SEQ ID NO: 176093 - protein, 8 aa, Mycobacterium tuberculosis
GLGNIGNA

SEQ ID NO: 176094 - protein, 8 aa, Mycobacterium tuberculosis
GLGAALGI

SEQ ID NO: 176095 - protein, 8 aa, Mycobacterium tuberculosis
GLTGDNQT

SEQ ID NO: 176096 - protein, 8 aa, Mycobacterium tuberculosis
SGAGNIGL

SEQ ID NO: 176097 - protein, 8 aa, Mycobacterium tuberculosis
GTGNIGFF

SEQ ID NO: 176098 - protein, 8 aa, Mycobacterium tuberculosis
GLFNSGSF

SEQ ID NO: 176099 - protein, 8 aa, Mycobacterium tuberculosis
SGSFNTGI

SEQ ID NO: 176100 - protein, 8 aa, Mycobacterium tuberculosis
GLFNAGGF

SEQ ID NO: 176101 - protein, 8 aa, Mycobacterium tuberculosis
FTTGLANA

SEQ ID NO: 176102 - protein, 8 aa, Mycobacterium tuberculosis
GLANAGSY

SEQ ID NO: 176103 - protein, 8 aa, Mycobacterium tuberculosis
GSYNTGSF

SEQ ID NO: 176104 - protein, 8 aa, Mycobacterium tuberculosis
GSINTGWF

SEQ ID NO: 176105 - protein, 8 aa, Mycobacterium tuberculosis
TGNANTGI

SEQ ID NO: 176106 - protein, 8 aa, Mycobacterium tuberculosis
GIANSGNV

SEQ ID NO: 176107 - protein, 8 aa, Mycobacterium tuberculosis
NVDTGALM

SEQ ID NO: 176108 - protein, 8 aa, Mycobacterium tuberculosis
ALMSGNFS

SEQ ID NO: 176109 - protein, 8 aa, Mycobacterium tuberculosis
FSNGILWR

SEQ ID NO: 176110 - protein, 8 aa, Mycobacterium tuberculosis
ILWRGNYE

SEQ ID NO: 176111 - protein, 8 aa, Mycobacterium tuberculosis
NYEGLFSY

SEQ ID NO: 176112 - protein, 8 aa, Mycobacterium tuberculosis
GLFSYSYS

SEQ ID NO: 176113 - protein, 8 aa, Mycobacterium tuberculosis
SYSYSLDV

SEQ ID NO: 176114 - protein, 8 aa, Mycobacterium tuberculosis
SYSLDVPR

SEQ ID NO: 176115 - protein, 8 aa, Mycobacterium tuberculosis
YSLDVPRI

SEQ ID NO: 176116 - protein, 8 aa, Mycobacterium tuberculosis
SLDVPRIT

SEQ ID NO: 176117 - protein, 8 aa, Mycobacterium tuberculosis
DVPRITIL

SEQ ID NO: 176118 - protein, 8 aa, Mycobacterium tuberculosis
ITILDAHF

SEQ ID NO: 176119 - protein, 8 aa, Mycobacterium tuberculosis
TILDAHFT

SEQ ID NO: 176120 - protein, 8 aa, Mycobacterium tuberculosis
ILDAHFTG

SEQ ID NO: 176121 - protein, 8 aa, Mycobacterium tuberculosis
DAHFTGAF

SEQ ID NO: 176122 - protein, 8 aa, Mycobacterium tuberculosis
FTGAFGPV

SEQ ID NO: 176123 - protein, 8 aa, Mycobacterium tuberculosis
TGAFGPVV

SEQ ID NO: 176124 - protein, 8 aa, Mycobacterium tuberculosis
GAFGPVVV

SEQ ID NO: 176125 - protein, 8 aa, Mycobacterium tuberculosis
GPVVVPPI

SEQ ID NO: 176126 - protein, 8 aa, Mycobacterium tuberculosis
VVVPPIPV

SEQ ID NO: 176127 - protein, 8 aa, Mycobacterium tuberculosis
VVPPIPVL

SEQ ID NO: 176128 - protein, 8 aa, Mycobacterium tuberculosis
VPPIPVLA

SEQ ID NO: 176129 - protein, 8 aa, Mycobacterium tuberculosis
PPIPVLAI

SEQ ID NO: 176130 - protein, 8 aa, Mycobacterium tuberculosis
IPVLAINA

SEQ ID NO: 176131 - protein, 8 aa, Mycobacterium tuberculosis
VLAINAHL

SEQ ID NO: 176132 - protein, 8 aa, Mycobacterium tuberculosis
HLTGNAAM

SEQ ID NO: 176133 - protein, 8 aa, Mycobacterium tuberculosis
AAMGAFTI

SEQ ID NO: 176134 - protein, 8 aa, Mycobacterium tuberculosis
FTIPQIDI

SEQ ID NO: 176135 - protein, 8 aa, Mycobacterium tuberculosis
IPQIDIPA

SEQ ID NO: 176136 - protein, 8 aa, Mycobacterium tuberculosis
PQIDIPAL

SEQ ID NO: 176137 - protein, 8 aa, Mycobacterium tuberculosis
IPALNPNV

SEQ ID NO: 176138 - protein, 8 aa, Mycobacterium tuberculosis
NPNVTGSV

SEQ ID NO: 176139 - protein, 8 aa, Mycobacterium tuberculosis
VGFGPIAV

SEQ ID NO: 176140 - protein, 8 aa, Mycobacterium tuberculosis
GPIAVPSV

SEQ ID NO: 176141 - protein, 8 aa, Mycobacterium tuberculosis
IAVPSVTI

SEQ ID NO: 176142 - protein, 8 aa, Mycobacterium tuberculosis
VPSVTIPA

SEQ ID NO: 176143 - protein, 8 aa, Mycobacterium tuberculosis
VTIPALTA

SEQ ID NO: 176144 - protein, 8 aa, Mycobacterium tuberculosis
TIPALTAA

SEQ ID NO: 176145 - protein, 8 aa, Mycobacterium tuberculosis
IPALTAAR

SEQ ID NO: 176146 - protein, 8 aa, Mycobacterium tuberculosis
ALTAARAV

SEQ ID NO: 176147 - protein, 8 aa, Mycobacterium tuberculosis
LTAARAVL

SEQ ID NO: 176148 - protein, 8 aa, Mycobacterium tuberculosis
AARAVLDM

SEQ ID NO: 176149 - protein, 8 aa, Mycobacterium tuberculosis
RAVLDMAA

SEQ ID NO: 176150 - protein, 8 aa, Mycobacterium tuberculosis
VLDMAASV

SEQ ID NO: 176151 - protein, 8 aa, Mycobacterium tuberculosis
DMAASVGA

SEQ ID NO: 176152 - protein, 8 aa, Mycobacterium tuberculosis
MAASVGAT

SEQ ID NO: 176153 - protein, 8 aa, Mycobacterium tuberculosis
SVGATSEI

SEQ ID NO: 176154 - protein, 8 aa, Mycobacterium tuberculosis
ATSEIEPF

SEQ ID NO: 176155 - protein, 8 aa, Mycobacterium tuberculosis
SEIEPFIV

SEQ ID NO: 176156 - protein, 8 aa, Mycobacterium tuberculosis
EIEPFIVW

SEQ ID NO: 176157 - protein, 8 aa, Mycobacterium tuberculosis
IVWTSSGA

SEQ ID NO: 176158 - protein, 8 aa, Mycobacterium tuberculosis
VWTSSGAI

SEQ ID NO: 176159 - protein, 8 aa, Mycobacterium tuberculosis
SGAIGPTW

SEQ ID NO: 176160 - protein, 8 aa, Mycobacterium tuberculosis
PTWYSVGR

SEQ ID NO: 176161 - protein, 8 aa, Mycobacterium tuberculosis
TWYSVGRI

SEQ ID NO: 176162 - protein, 8 aa, Mycobacterium tuberculosis
RIYNAGDL

SEQ ID NO: 176163 - protein, 8 aa, Mycobacterium tuberculosis
IYNAGDLF

SEQ ID NO: 176164 - protein, 8 aa, Mycobacterium tuberculosis
YNAGDLFV

SEQ ID NO: 176165 - protein, 8 aa, Mycobacterium tuberculosis
DLFVGGNI

SEQ ID NO: 176166 - protein, 8 aa, Mycobacterium tuberculosis
IISGIPTL

SEQ ID NO: 176167 - protein, 8 aa, Mycobacterium tuberculosis
TLSTTGPV

SEQ ID NO: 176168 - protein, 8 aa, Mycobacterium tuberculosis
TTGPVHAV

SEQ ID NO: 176169 - protein, 8 aa, Mycobacterium tuberculosis
FNAASQAF

SEQ ID NO: 176170 - protein, 8 aa, Mycobacterium tuberculosis
SQAFNTPA

SEQ ID NO: 176171 - protein, 8 aa, Mycobacterium tuberculosis
QAFNTPAL

SEQ ID NO: 176172 - protein, 8 aa, Mycobacterium tuberculosis
HQIPLGFQ

SEQ ID NO: 176173 - protein, 8 aa, Mycobacterium tuberculosis
QIPLGFQV

SEQ ID NO: 176174 - protein, 8 aa, Mycobacterium tuberculosis
FQVPGSID

SEQ ID NO: 176175 - protein, 8 aa, Mycobacterium tuberculosis
VPGSIDAI

SEQ ID NO: 176176 - protein, 8 aa, Mycobacterium tuberculosis
GSIDAITL

SEQ ID NO: 176177 - protein, 8 aa, Mycobacterium tuberculosis
SIDAITLF

SEQ ID NO: 176178 - protein, 8 aa, Mycobacterium tuberculosis
ITLFPGGL

SEQ ID NO: 176179 - protein, 8 aa, Mycobacterium tuberculosis
TLFPGGLT

SEQ ID NO: 176180 - protein, 8 aa, Mycobacterium tuberculosis
LFPGGLTF

SEQ ID NO: 176181 - protein, 8 aa, Mycobacterium tuberculosis
FPGGLTFP

SEQ ID NO: 176182 - protein, 8 aa, Mycobacterium tuberculosis
LTFPANSL

SEQ ID NO: 176183 - protein, 8 aa, Mycobacterium tuberculosis
TFPANSLL

SEQ ID NO: 176184 - protein, 8 aa, Mycobacterium tuberculosis
FPANSLLN

SEQ ID NO: 176185 - protein, 8 aa, Mycobacterium tuberculosis
SLLNLDVF

SEQ ID NO: 176186 - protein, 8 aa, Mycobacterium tuberculosis
LLNLDVFV

SEQ ID NO: 176187 - protein, 8 aa, Mycobacterium tuberculosis
NLDVFVGT

SEQ ID NO: 176188 - protein, 8 aa, Mycobacterium tuberculosis
TPGATIPA

SEQ ID NO: 176189 - protein, 8 aa, Mycobacterium tuberculosis
ATIPAITF

SEQ ID NO: 176190 - protein, 8 aa, Mycobacterium tuberculosis
IPAITFPE

SEQ ID NO: 176191 - protein, 8 aa, Mycobacterium tuberculosis
ITFPEIPA

SEQ ID NO: 176192 - protein, 8 aa, Mycobacterium tuberculosis
FPEIPANA

SEQ ID NO: 176193 - protein, 8 aa, Mycobacterium tuberculosis
NADGELYV

SEQ ID NO: 176194 - protein, 8 aa, Mycobacterium tuberculosis
LYVIAGDI

SEQ ID NO: 176195 - protein, 8 aa, Mycobacterium tuberculosis
VIAGDIPL

SEQ ID NO: 176196 - protein, 8 aa, Mycobacterium tuberculosis
IPLINIPP

SEQ ID NO: 176197 - protein, 8 aa, Mycobacterium tuberculosis
NIPPTPGI

SEQ ID NO: 176198 - protein, 8 aa, Mycobacterium tuberculosis
IPPTPGIG

SEQ ID NO: 176199 - protein, 8 aa, Mycobacterium tuberculosis
TPGIGNTT

SEQ ID NO: 176200 - protein, 8 aa, Mycobacterium tuberculosis
GIGNTTTV

SEQ ID NO: 176201 - protein, 8 aa, Mycobacterium tuberculosis
TTVPSSGF

SEQ ID NO: 176202 - protein, 8 aa, Mycobacterium tuberculosis
TVPSSGFF

SEQ ID NO: 176203 - protein, 8 aa, Mycobacterium tuberculosis
SGFFNTGA

SEQ ID NO: 176204 - protein, 8 aa, Mycobacterium tuberculosis
SGFGNFGA

SEQ ID NO: 176205 - protein, 8 aa, Mycobacterium tuberculosis
FGANMSGW

SEQ ID NO: 176206 - protein, 8 aa, Mycobacterium tuberculosis
GANMSGWW

SEQ ID NO: 176207 - protein, 8 aa, Mycobacterium tuberculosis
NMSGWWNQ

SEQ ID NO: 176208 - protein, 8 aa, Mycobacterium tuberculosis
NQAHTALA

SEQ ID NO: 176209 - protein, 8 aa, Mycobacterium tuberculosis
GIANVGTL

SEQ ID NO: 176210 - protein, 8 aa, Mycobacterium tuberculosis
LHSGVLNL

SEQ ID NO: 176211 - protein, 8 aa, Mycobacterium tuberculosis
VLNLGSGL

SEQ ID NO: 176212 - protein, 8 aa, Mycobacterium tuberculosis
GLSGIYNT

SEQ ID NO: 176213 - protein, 8 aa, Mycobacterium tuberculosis
GIYNTSTL

SEQ ID NO: 176214 - protein, 8 aa, Mycobacterium tuberculosis
TLPLGTPA

SEQ ID NO: 176215 - protein, 8 aa, Mycobacterium tuberculosis
LPLGTPAL

SEQ ID NO: 176216 - protein, 8 aa, Mycobacterium tuberculosis
PLGTPALV

SEQ ID NO: 176217 - protein, 8 aa, Mycobacterium tuberculosis
TPALVSGL

SEQ ID NO: 176218 - protein, 8 aa, Mycobacterium tuberculosis
LVSGLGNV

SEQ ID NO: 176219 - protein, 8 aa, Mycobacterium tuberculosis
HLSGLLAS

SEQ ID NO: 176220 - protein, 8 aa, Mycobacterium tuberculosis
LLASNVGQ

SEQ ID NO: 176221 - protein, 8 aa, Mycobacterium tuberculosis
GQNPITIV

SEQ ID NO: 176222 - protein, 8 aa, Mycobacterium tuberculosis
NPITIVNI

SEQ ID NO: 176223 - protein, 8 aa, Mycobacterium tuberculosis
ITIVNIGL

SEQ ID NO: 176224 - protein, 8 aa, Mycobacterium tuberculosis
TIVNIGLA

SEQ ID NO: 176225 - protein, 8 aa, Mycobacterium tuberculosis
GLGNIGNL

SEQ ID NO: 176226 - protein, 8 aa, Mycobacterium tuberculosis
FGFGNSGL

SEQ ID NO: 176227 - protein, 8 aa, Mycobacterium tuberculosis
LAAGLAGM

SEQ ID NO: 176228 - protein, 8 aa, Mycobacterium tuberculosis
GLAGMGNI

SEQ ID NO: 176229 - protein, 8 aa, Mycobacterium tuberculosis
NQSGIGGL

SEQ ID NO: 176230 - protein, 8 aa, Mycobacterium tuberculosis
GTGNIGFF

SEQ ID NO: 176231 - protein, 8 aa, Mycobacterium tuberculosis
SGTANFGL

SEQ ID NO: 176232 - protein, 8 aa, Mycobacterium tuberculosis
GTANFGLF

SEQ ID NO: 176233 - protein, 8 aa, Mycobacterium tuberculosis
GLFNSGSY

SEQ ID NO: 176234 - protein, 8 aa, Mycobacterium tuberculosis
SGSYNTGI

SEQ ID NO: 176235 - protein, 8 aa, Mycobacterium tuberculosis
TGIGNSGV

SEQ ID NO: 176236 - protein, 8 aa, Mycobacterium tuberculosis
GVASTGLV

SEQ ID NO: 176237 - protein, 8 aa, Mycobacterium tuberculosis
GVANAGSY

SEQ ID NO: 176238 - protein, 8 aa, Mycobacterium tuberculosis
GSYNTGSF

SEQ ID NO: 176239 - protein, 8 aa, Mycobacterium tuberculosis
TGNANTGV

SEQ ID NO: 176240 - protein, 8 aa, Mycobacterium tuberculosis
GVANAGNV

SEQ ID NO: 176241 - protein, 8 aa, Mycobacterium tuberculosis
NVNTGALI

SEQ ID NO: 176242 - protein, 8 aa, Mycobacterium tuberculosis
GALITGNF

SEQ ID NO: 176243 - protein, 8 aa, Mycobacterium tuberculosis
TGNFSNGI

SEQ ID NO: 176244 - protein, 8 aa, Mycobacterium tuberculosis
FSNGILWR

SEQ ID NO: 176245 - protein, 8 aa, Mycobacterium tuberculosis
ILWRGNYE

SEQ ID NO: 176246 - protein, 8 aa, Mycobacterium tuberculosis
NYEGLAGF

SEQ ID NO: 176247 - protein, 8 aa, Mycobacterium tuberculosis
GLAGFSFG

SEQ ID NO: 176248 - protein, 8 aa, Mycobacterium tuberculosis
LAGFSFGY

SEQ ID NO: 176249 - protein, 8 aa, Mycobacterium tuberculosis
FGYPIPLF

SEQ ID NO: 176250 - protein, 8 aa, Mycobacterium tuberculosis
YPIPLFPA

SEQ ID NO: 176251 - protein, 8 aa, Mycobacterium tuberculosis
PIPLFPAV

SEQ ID NO: 176252 - protein, 8 aa, Mycobacterium tuberculosis
PLFPAVGA

SEQ ID NO: 176253 - protein, 8 aa, Mycobacterium tuberculosis
FPAVGADV

SEQ ID NO: 176254 - protein, 8 aa, Mycobacterium tuberculosis
TIIPPIHI

SEQ ID NO: 176255 - protein, 8 aa, Mycobacterium tuberculosis
PPIHIPSI

SEQ ID NO: 176256 - protein, 8 aa, Mycobacterium tuberculosis
IHIPSIPL

SEQ ID NO: 176257 - protein, 8 aa, Mycobacterium tuberculosis
IPSIPLGF

SEQ ID NO: 176258 - protein, 8 aa, Mycobacterium tuberculosis
SIPLGFAA

SEQ ID NO: 176259 - protein, 8 aa, Mycobacterium tuberculosis
IPLGFAAI

SEQ ID NO: 176260 - protein, 8 aa, Mycobacterium tuberculosis
AIGHIGPI

SEQ ID NO: 176261 - protein, 8 aa, Mycobacterium tuberculosis
GPISIPNI

SEQ ID NO: 176262 - protein, 8 aa, Mycobacterium tuberculosis
ISIPNIAI

SEQ ID NO: 176263 - protein, 8 aa, Mycobacterium tuberculosis
IPNIAIPS

SEQ ID NO: 176264 - protein, 8 aa, Mycobacterium tuberculosis
IAIPSIHL

SEQ ID NO: 176265 - protein, 8 aa, Mycobacterium tuberculosis
IPSIHLGI

SEQ ID NO: 176266 - protein, 8 aa, Mycobacterium tuberculosis
GIDPTFDV

SEQ ID NO: 176267 - protein, 8 aa, Mycobacterium tuberculosis
PTFDVGPI

SEQ ID NO: 176268 - protein, 8 aa, Mycobacterium tuberculosis
FDVGPITV

SEQ ID NO: 176269 - protein, 8 aa, Mycobacterium tuberculosis
GPITVDPI

SEQ ID NO: 176270 - protein, 8 aa, Mycobacterium tuberculosis
ITVDPITL

SEQ ID NO: 176271 - protein, 8 aa, Mycobacterium tuberculosis
TVDPITLT

SEQ ID NO: 176272 - protein, 8 aa, Mycobacterium tuberculosis
ITLTIPGL

SEQ ID NO: 176273 - protein, 8 aa, Mycobacterium tuberculosis
LTIPGLSL

SEQ ID NO: 176274 - protein, 8 aa, Mycobacterium tuberculosis
IPGLSLDA

SEQ ID NO: 176275 - protein, 8 aa, Mycobacterium tuberculosis
GLSLDAAV

SEQ ID NO: 176276 - protein, 8 aa, Mycobacterium tuberculosis
SLDAAVSE

SEQ ID NO: 176277 - protein, 8 aa, Mycobacterium tuberculosis
DAAVSEIR

SEQ ID NO: 176278 - protein, 8 aa, Mycobacterium tuberculosis
SGSSSGFK

SEQ ID NO: 176279 - protein, 8 aa, Mycobacterium tuberculosis
SSSGFKVR

SEQ ID NO: 176280 - protein, 8 aa, Mycobacterium tuberculosis
GFKVRPSF

SEQ ID NO: 176281 - protein, 8 aa, Mycobacterium tuberculosis
KVRPSFSF

SEQ ID NO: 176282 - protein, 8 aa, Mycobacterium tuberculosis
RPSFSFFA

SEQ ID NO: 176283 - protein, 8 aa, Mycobacterium tuberculosis
PSFSFFAV

SEQ ID NO: 176284 - protein, 8 aa, Mycobacterium tuberculosis
FAVGPDGM

SEQ ID NO: 176285 - protein, 8 aa, Mycobacterium tuberculosis
DGMPGGEV

SEQ ID NO: 176286 - protein, 8 aa, Mycobacterium tuberculosis
MPGGEVSI

SEQ ID NO: 176287 - protein, 8 aa, Mycobacterium tuberculosis
EVSILQPF

SEQ ID NO: 176288 - protein, 8 aa, Mycobacterium tuberculosis
SILQPFTV

SEQ ID NO: 176289 - protein, 8 aa, Mycobacterium tuberculosis
ILQPFTVA

SEQ ID NO: 176290 - protein, 8 aa, Mycobacterium tuberculosis
QPFTVAPI

SEQ ID NO: 176291 - protein, 8 aa, Mycobacterium tuberculosis
FTVAPINL

SEQ ID NO: 176292 - protein, 8 aa, Mycobacterium tuberculosis
APINLNPT

SEQ ID NO: 176293 - protein, 8 aa, Mycobacterium tuberculosis
TTLHFPGF

SEQ ID NO: 176294 - protein, 8 aa, Mycobacterium tuberculosis
FPGFTIPT

SEQ ID NO: 176295 - protein, 8 aa, Mycobacterium tuberculosis
FTIPTGPI

SEQ ID NO: 176296 - protein, 8 aa, Mycobacterium tuberculosis
IPTGPIHI

SEQ ID NO: 176297 - protein, 8 aa, Mycobacterium tuberculosis
HIGLPLSL

SEQ ID NO: 176298 - protein, 8 aa, Mycobacterium tuberculosis
GLPLSLTI

SEQ ID NO: 176299 - protein, 8 aa, Mycobacterium tuberculosis
LPLSLTIP

SEQ ID NO: 176300 - protein, 8 aa, Mycobacterium tuberculosis
LSLTIPGF

SEQ ID NO: 176301 - protein, 8 aa, Mycobacterium tuberculosis
SLTIPGFT

SEQ ID NO: 176302 - protein, 8 aa, Mycobacterium tuberculosis
LTIPGFTI

SEQ ID NO: 176303 - protein, 8 aa, Mycobacterium tuberculosis
FTIPGGTL

SEQ ID NO: 176304 - protein, 8 aa, Mycobacterium tuberculosis
TIPGGTLI

SEQ ID NO: 176305 - protein, 8 aa, Mycobacterium tuberculosis
TLIPQLPL

SEQ ID NO: 176306 - protein, 8 aa, Mycobacterium tuberculosis
IPQLPLGL

SEQ ID NO: 176307 - protein, 8 aa, Mycobacterium tuberculosis
QLPLGLGL

SEQ ID NO: 176308 - protein, 8 aa, Mycobacterium tuberculosis
LPLGLGLS

SEQ ID NO: 176309 - protein, 8 aa, Mycobacterium tuberculosis
LSGGTPPF

SEQ ID NO: 176310 - protein, 8 aa, Mycobacterium tuberculosis
TPPFDLPT

SEQ ID NO: 176311 - protein, 8 aa, Mycobacterium tuberculosis
PPFDLPTV

SEQ ID NO: 176312 - protein, 8 aa, Mycobacterium tuberculosis
VVIDRIPV

SEQ ID NO: 176313 - protein, 8 aa, Mycobacterium tuberculosis
IPVELHAS

SEQ ID NO: 176314 - protein, 8 aa, Mycobacterium tuberculosis
VELHASTT

SEQ ID NO: 176315 - protein, 8 aa, Mycobacterium tuberculosis
ELHASTTI

SEQ ID NO: 176316 - protein, 8 aa, Mycobacterium tuberculosis
TTIGPVSL

SEQ ID NO: 176317 - protein, 8 aa, Mycobacterium tuberculosis
GPVSLPIF

SEQ ID NO: 176318 - protein, 8 aa, Mycobacterium tuberculosis
VSLPIFGF

SEQ ID NO: 176319 - protein, 8 aa, Mycobacterium tuberculosis
LPIFGFGG

SEQ ID NO: 176320 - protein, 8 aa, Mycobacterium tuberculosis
GFGGAPGF

SEQ ID NO: 176321 - protein, 8 aa, Mycobacterium tuberculosis
TTAPSSGF

SEQ ID NO: 176322 - protein, 8 aa, Mycobacterium tuberculosis
FSNSGSGM

SEQ ID NO: 176323 - protein, 8 aa, Mycobacterium tuberculosis
SGSGMSGV

SEQ ID NO: 176324 - protein, 8 aa, Mycobacterium tuberculosis
GMSGVLNA

SEQ ID NO: 176325 - protein, 8 aa, Mycobacterium tuberculosis
MSGVLNAI

SEQ ID NO: 176326 - protein, 8 aa, Mycobacterium tuberculosis
DPLLGSAS

SEQ ID NO: 176327 - protein, 8 aa, Mycobacterium tuberculosis
SASGFANF

SEQ ID NO: 176328 - protein, 8 aa, Mycobacterium tuberculosis
FANFGTQL

SEQ ID NO: 176329 - protein, 8 aa, Mycobacterium tuberculosis
QLSGILNR

SEQ ID NO: 176330 - protein, 8 aa, Mycobacterium tuberculosis
ILNRGAGI

SEQ ID NO: 176331 - protein, 8 aa, Mycobacterium tuberculosis
RGAGISGV

SEQ ID NO: 176332 - protein, 8 aa, Mycobacterium tuberculosis
GVYNTGTL

SEQ ID NO: 176333 - protein, 8 aa, Mycobacterium tuberculosis
NTGTLGLV

SEQ ID NO: 176334 - protein, 8 aa, Mycobacterium tuberculosis
TLGLVTSA

SEQ ID NO: 176335 - protein, 8 aa, Mycobacterium tuberculosis
GLVTSAFV

SEQ ID NO: 176336 - protein, 8 aa, Mycobacterium tuberculosis
TSAFVSGF

SEQ ID NO: 176337 - protein, 8 aa, Mycobacterium tuberculosis
SAFVSGFM

SEQ ID NO: 176338 - protein, 8 aa, Mycobacterium tuberculosis
FVSGFMNV

SEQ ID NO: 176339 - protein, 8 aa, Mycobacterium tuberculosis
FMNVGQQL

SEQ ID NO: 176340 - protein, 8 aa, Mycobacterium tuberculosis
QQLSGLLF

SEQ ID NO: 176341 - protein, 8 aa, Mycobacterium tuberculosis
QLSGLLFA

SEQ ID NO: 176342 - protein, 9 aa, Mycobacterium tuberculosis
NFPVLPPEI

SEQ ID NO: 176343 - protein, 9 aa, Mycobacterium tuberculosis
FPVLPPEIN

SEQ ID NO: 176344 - protein, 9 aa, Mycobacterium tuberculosis
VLPPEINSV

SEQ ID NO: 176345 - protein, 9 aa, Mycobacterium tuberculosis
LPPEINSVL

SEQ ID NO: 176346 - protein, 9 aa, Mycobacterium tuberculosis
PPEINSVLM

SEQ ID NO: 176347 - protein, 9 aa, Mycobacterium tuberculosis
PEINSVLMY

SEQ ID NO: 176348 - protein, 9 aa, Mycobacterium tuberculosis
NSVLMYSGA

SEQ ID NO: 176349 - protein, 9 aa, Mycobacterium tuberculosis
LMYSGAGSS

SEQ ID NO: 176350 - protein, 9 aa, Mycobacterium tuberculosis
YSGAGSSPL

SEQ ID NO: 176351 - protein, 9 aa, Mycobacterium tuberculosis
SPLLAAAAA

SEQ ID NO: 176352 - protein, 9 aa, Mycobacterium tuberculosis
AAAAAWDGL

SEQ ID NO: 176353 - protein, 9 aa, Mycobacterium tuberculosis
AAWDGLAEE

SEQ ID NO: 176354 - protein, 9 aa, Mycobacterium tuberculosis
GLAEELGSA

SEQ ID NO: 176355 - protein, 9 aa, Mycobacterium tuberculosis
LAEELGSAA

SEQ ID NO: 176356 - protein, 9 aa, Mycobacterium tuberculosis
AEELGSAAV

SEQ ID NO: 176357 - protein, 9 aa, Mycobacterium tuberculosis
SAAVSFGQV

SEQ ID NO: 176358 - protein, 9 aa, Mycobacterium tuberculosis
SFGQVTSGL

SEQ ID NO: 176359 - protein, 9 aa, Mycobacterium tuberculosis
GQVTSGLTA

SEQ ID NO: 176360 - protein, 9 aa, Mycobacterium tuberculosis
VTSGLTAGV

SEQ ID NO: 176361 - protein, 9 aa, Mycobacterium tuberculosis
TSGLTAGVW

SEQ ID NO: 176362 - protein, 9 aa, Mycobacterium tuberculosis
GLTAGVWQG

SEQ ID NO: 176363 - protein, 9 aa, Mycobacterium tuberculosis
LTAGVWQGA

SEQ ID NO: 176364 - protein, 9 aa, Mycobacterium tuberculosis
GVWQGAAAA

SEQ ID NO: 176365 - protein, 9 aa, Mycobacterium tuberculosis
WQGAAAAAM

SEQ ID NO: 176366 - protein, 9 aa, Mycobacterium tuberculosis
QGAAAAAMA

SEQ ID NO: 176367 - protein, 9 aa, Mycobacterium tuberculosis
AAAAAMAAA

SEQ ID NO: 176368 - protein, 9 aa, Mycobacterium tuberculosis
AAAAMAAAA

SEQ ID NO: 176369 - protein, 9 aa, Mycobacterium tuberculosis
AAAMAAAAA

SEQ ID NO: 176370 - protein, 9 aa, Mycobacterium tuberculosis
AMAAAAAPY

SEQ ID NO: 176371 - protein, 9 aa, Mycobacterium tuberculosis
MAAAAAPYA

SEQ ID NO: 176372 - protein, 9 aa, Mycobacterium tuberculosis
AAAAPYAGW

SEQ ID NO: 176373 - protein, 9 aa, Mycobacterium tuberculosis
AAAPYAGWL

SEQ ID NO: 176374 - protein, 9 aa, Mycobacterium tuberculosis
PYAGWLGSV

SEQ ID NO: 176375 - protein, 9 aa, Mycobacterium tuberculosis
YAGWLGSVA

SEQ ID NO: 176376 - protein, 9 aa, Mycobacterium tuberculosis
WLGSVAAQA

SEQ ID NO: 176377 - protein, 9 aa, Mycobacterium tuberculosis
SVAAQAVAV

SEQ ID NO: 176378 - protein, 9 aa, Mycobacterium tuberculosis
QAVAVAGQA

SEQ ID NO: 176379 - protein, 9 aa, Mycobacterium tuberculosis
VAGQARAAV

SEQ ID NO: 176380 - protein, 9 aa, Mycobacterium tuberculosis
GQARAAVAA

SEQ ID NO: 176381 - protein, 9 aa, Mycobacterium tuberculosis
QARAAVAAF

SEQ ID NO: 176382 - protein, 9 aa, Mycobacterium tuberculosis
RAAVAAFEA

SEQ ID NO: 176383 - protein, 9 aa, Mycobacterium tuberculosis
AAVAAFEAA

SEQ ID NO: 176384 - protein, 9 aa, Mycobacterium tuberculosis
AVAAFEAAL

SEQ ID NO: 176385 - protein, 9 aa, Mycobacterium tuberculosis
AAFEAALAA

SEQ ID NO: 176386 - protein, 9 aa, Mycobacterium tuberculosis
FEAALAATV

SEQ ID NO: 176387 - protein, 9 aa, Mycobacterium tuberculosis
ALAATVDPA

SEQ ID NO: 176388 - protein, 9 aa, Mycobacterium tuberculosis
LAATVDPAA

SEQ ID NO: 176389 - protein, 9 aa, Mycobacterium tuberculosis
ATVDPAAVA

SEQ ID NO: 176390 - protein, 9 aa, Mycobacterium tuberculosis
TVDPAAVAV

SEQ ID NO: 176391 - protein, 9 aa, Mycobacterium tuberculosis
DPAAVAVNR

SEQ ID NO: 176392 - protein, 9 aa, Mycobacterium tuberculosis
AVAVNRMAM

SEQ ID NO: 176393 - protein, 9 aa, Mycobacterium tuberculosis
VAVNRMAMR

SEQ ID NO: 176394 - protein, 9 aa, Mycobacterium tuberculosis
VNRMAMRAL

SEQ ID NO: 176395 - protein, 9 aa, Mycobacterium tuberculosis
NRMAMRALA

SEQ ID NO: 176396 - protein, 9 aa, Mycobacterium tuberculosis
RMAMRALAM

SEQ ID NO: 176397 - protein, 9 aa, Mycobacterium tuberculosis
MRALAMSNL

SEQ ID NO: 176398 - protein, 9 aa, Mycobacterium tuberculosis
RALAMSNLL

SEQ ID NO: 176399 - protein, 9 aa, Mycobacterium tuberculosis
NLLGQNAAA

SEQ ID NO: 176400 - protein, 9 aa, Mycobacterium tuberculosis
LLGQNAAAI

SEQ ID NO: 176401 - protein, 9 aa, Mycobacterium tuberculosis
GQNAAAIAA

SEQ ID NO: 176402 - protein, 9 aa, Mycobacterium tuberculosis
QNAAAIAAV

SEQ ID NO: 176403 - protein, 9 aa, Mycobacterium tuberculosis
AIAAVEAEY

SEQ ID NO: 176404 - protein, 9 aa, Mycobacterium tuberculosis
AAVEAEYEL

SEQ ID NO: 176405 - protein, 9 aa, Mycobacterium tuberculosis
AVEAEYELM

SEQ ID NO: 176406 - protein, 9 aa, Mycobacterium tuberculosis
VEAEYELMW

SEQ ID NO: 176407 - protein, 9 aa, Mycobacterium tuberculosis
AEYELMWAA

SEQ ID NO: 176408 - protein, 9 aa, Mycobacterium tuberculosis
YELMWAADV

SEQ ID NO: 176409 - protein, 9 aa, Mycobacterium tuberculosis
ELMWAADVA

SEQ ID NO: 176410 - protein, 9 aa, Mycobacterium tuberculosis
LMWAADVAA

SEQ ID NO: 176411 - protein, 9 aa, Mycobacterium tuberculosis
MWAADVAAM

SEQ ID NO: 176412 - protein, 9 aa, Mycobacterium tuberculosis
WAADVAAMA

SEQ ID NO: 176413 - protein, 9 aa, Mycobacterium tuberculosis
DVAAMAGYH

SEQ ID NO: 176414 - protein, 9 aa, Mycobacterium tuberculosis
AMAGYHSGA

SEQ ID NO: 176415 - protein, 9 aa, Mycobacterium tuberculosis
GASAAAAAL

SEQ ID NO: 176416 - protein, 9 aa, Mycobacterium tuberculosis
SAAAAALPA

SEQ ID NO: 176417 - protein, 10 aa, Mycobacterium tuberculosis
MNFPVLPPEI

SEQ ID NO: 176418 - protein, 10 aa, Mycobacterium tuberculosis
FPVLPPEINS

SEQ ID NO: 176419 - protein, 10 aa, Mycobacterium tuberculosis
PVLPPEINSV

SEQ ID NO: 176420 - protein, 10 aa, Mycobacterium tuberculosis
VLPPEINSVL

SEQ ID NO: 176421 - protein, 10 aa, Mycobacterium tuberculosis
LPPEINSVLM

SEQ ID NO: 176422 - protein, 10 aa, Mycobacterium tuberculosis
PPEINSVLMY

SEQ ID NO: 176423 - protein, 10 aa, Mycobacterium tuberculosis
MYSGAGSSPL

SEQ ID NO: 176424 - protein, 10 aa, Mycobacterium tuberculosis
SPLLAAAAAW

SEQ ID NO: 176425 - protein, 10 aa, Mycobacterium tuberculosis
LAAAAAWDGL

SEQ ID NO: 176426 - protein, 10 aa, Mycobacterium tuberculosis
AAWDGLAEEL

SEQ ID NO: 176427 - protein, 10 aa, Mycobacterium tuberculosis
GLAEELGSAA

SEQ ID NO: 176428 - protein, 10 aa, Mycobacterium tuberculosis
LAEELGSAAV

SEQ ID NO: 176429 - protein, 10 aa, Mycobacterium tuberculosis
AEELGSAAVS

SEQ ID NO: 176430 - protein, 10 aa, Mycobacterium tuberculosis
EELGSAAVSF

SEQ ID NO: 176431 - protein, 10 aa, Mycobacterium tuberculosis
GSAAVSFGQV

SEQ ID NO: 176432 - protein, 10 aa, Mycobacterium tuberculosis
VSFGQVTSGL

SEQ ID NO: 176433 - protein, 10 aa, Mycobacterium tuberculosis
QVTSGLTAGV

SEQ ID NO: 176434 - protein, 10 aa, Mycobacterium tuberculosis
VTSGLTAGVW

SEQ ID NO: 176435 - protein, 10 aa, Mycobacterium tuberculosis
GLTAGVWQGA

SEQ ID NO: 176436 - protein, 10 aa, Mycobacterium tuberculosis
LTAGVWQGAA

SEQ ID NO: 176437 - protein, 10 aa, Mycobacterium tuberculosis
GVWQGAAAAA

SEQ ID NO: 176438 - protein, 10 aa, Mycobacterium tuberculosis
WQGAAAAAMA

SEQ ID NO: 176439 - protein, 10 aa, Mycobacterium tuberculosis
QGAAAAAMAA

SEQ ID NO: 176440 - protein, 10 aa, Mycobacterium tuberculosis
GAAAAAMAAA

SEQ ID NO: 176441 - protein, 10 aa, Mycobacterium tuberculosis
AAAAAMAAAA

SEQ ID NO: 176442 - protein, 10 aa, Mycobacterium tuberculosis
AAAAMAAAAA

SEQ ID NO: 176443 - protein, 10 aa, Mycobacterium tuberculosis
AAMAAAAAPY

SEQ ID NO: 176444 - protein, 10 aa, Mycobacterium tuberculosis
AMAAAAAPYA

SEQ ID NO: 176445 - protein, 10 aa, Mycobacterium tuberculosis
AAAAAPYAGW

SEQ ID NO: 176446 - protein, 10 aa, Mycobacterium tuberculosis
AAAAPYAGWL

SEQ ID NO: 176447 - protein, 10 aa, Mycobacterium tuberculosis
APYAGWLGSV

SEQ ID NO: 176448 - protein, 10 aa, Mycobacterium tuberculosis
YAGWLGSVAA

SEQ ID NO: 176449 - protein, 10 aa, Mycobacterium tuberculosis
WLGSVAAQAV

SEQ ID NO: 176450 - protein, 10 aa, Mycobacterium tuberculosis
SVAAQAVAVA

SEQ ID NO: 176451 - protein, 10 aa, Mycobacterium tuberculosis
AQAVAVAGQA

SEQ ID NO: 176452 - protein, 10 aa, Mycobacterium tuberculosis
QAVAVAGQAR

SEQ ID NO: 176453 - protein, 10 aa, Mycobacterium tuberculosis
AVAGQARAAV

SEQ ID NO: 176454 - protein, 10 aa, Mycobacterium tuberculosis
GQARAAVAAF

SEQ ID NO: 176455 - protein, 10 aa, Mycobacterium tuberculosis
RAAVAAFEAA

SEQ ID NO: 176456 - protein, 10 aa, Mycobacterium tuberculosis
AAVAAFEAAL

SEQ ID NO: 176457 - protein, 10 aa, Mycobacterium tuberculosis
AVAAFEAALA

SEQ ID NO: 176458 - protein, 10 aa, Mycobacterium tuberculosis
AAFEAALAAT

SEQ ID NO: 176459 - protein, 10 aa, Mycobacterium tuberculosis
AALAATVDPA

SEQ ID NO: 176460 - protein, 10 aa, Mycobacterium tuberculosis
ALAATVDPAA

SEQ ID NO: 176461 - protein, 10 aa, Mycobacterium tuberculosis
LAATVDPAAV

SEQ ID NO: 176462 - protein, 10 aa, Mycobacterium tuberculosis
ATVDPAAVAV

SEQ ID NO: 176463 - protein, 10 aa, Mycobacterium tuberculosis
DPAAVAVNRM

SEQ ID NO: 176464 - protein, 10 aa, Mycobacterium tuberculosis
AAVAVNRMAM

SEQ ID NO: 176465 - protein, 10 aa, Mycobacterium tuberculosis
AVAVNRMAMR

SEQ ID NO: 176466 - protein, 10 aa, Mycobacterium tuberculosis
AVNRMAMRAL

SEQ ID NO: 176467 - protein, 10 aa, Mycobacterium tuberculosis
NRMAMRALAM

SEQ ID NO: 176468 - protein, 10 aa, Mycobacterium tuberculosis
RMAMRALAMS

SEQ ID NO: 176469 - protein, 10 aa, Mycobacterium tuberculosis
AMRALAMSNL

SEQ ID NO: 176470 - protein, 10 aa, Mycobacterium tuberculosis
MRALAMSNLL

SEQ ID NO: 176471 - protein, 10 aa, Mycobacterium tuberculosis
ALAMSNLLGQ

SEQ ID NO: 176472 - protein, 10 aa, Mycobacterium tuberculosis
AMSNLLGQNA

SEQ ID NO: 176473 - protein, 10 aa, Mycobacterium tuberculosis
NLLGQNAAAI

SEQ ID NO: 176474 - protein, 10 aa, Mycobacterium tuberculosis
LLGQNAAAIA

SEQ ID NO: 176475 - protein, 10 aa, Mycobacterium tuberculosis
GQNAAAIAAV

SEQ ID NO: 176476 - protein, 10 aa, Mycobacterium tuberculosis
NAAAIAAVEA

SEQ ID NO: 176477 - protein, 10 aa, Mycobacterium tuberculosis
AAIAAVEAEY

SEQ ID NO: 176478 - protein, 10 aa, Mycobacterium tuberculosis
IAAVEAEYEL

SEQ ID NO: 176479 - protein, 10 aa, Mycobacterium tuberculosis
AAVEAEYELM

SEQ ID NO: 176480 - protein, 10 aa, Mycobacterium tuberculosis
ELMWAADVAA

SEQ ID NO: 176481 - protein, 10 aa, Mycobacterium tuberculosis
LMWAADVAAM

SEQ ID NO: 176482 - protein, 10 aa, Mycobacterium tuberculosis
WAADVAAMAG

SEQ ID NO: 176483 - protein, 10 aa, Mycobacterium tuberculosis
AADVAAMAGY

SEQ ID NO: 176484 - protein, 10 aa, Mycobacterium tuberculosis
AAMAGYHSGA

SEQ ID NO: 176485 - protein, 10 aa, Mycobacterium tuberculosis
AMAGYHSGAS

SEQ ID NO: 176486 - protein, 10 aa, Mycobacterium tuberculosis
SGASAAAAAL

SEQ ID NO: 176487 - protein, 10 aa, Mycobacterium tuberculosis
SAAAAALPAF

SEQ ID NO: 176488 - protein, 10 aa, Mycobacterium tuberculosis
AALPAFSPPA

SEQ ID NO: 176489 - protein, 10 aa, Mycobacterium tuberculosis
ALPAFSPPAQ

SEQ ID NO: 176490 - protein, 10 aa, Mycobacterium tuberculosis
LPAFSPPAQA

SEQ ID NO: 176491 - protein, 10 aa, Mycobacterium tuberculosis
AQALGGGVGA

SEQ ID NO: 176492 - protein, 10 aa, Mycobacterium tuberculosis
QALGGGVGAF

SEQ ID NO: 176493 - protein, 10 aa, Mycobacterium tuberculosis
ALGGGVGAFL

SEQ ID NO: 176494 - protein, 10 aa, Mycobacterium tuberculosis
FLNALFAGPA

SEQ ID NO: 176495 - protein, 10 aa, Mycobacterium tuberculosis
NALFAGPAKM

SEQ ID NO: 176496 - protein, 10 aa, Mycobacterium tuberculosis
ALFAGPAKML

SEQ ID NO: 176497 - protein, 10 aa, Mycobacterium tuberculosis
LFAGPAKMLR

SEQ ID NO: 176498 - protein, 10 aa, Mycobacterium tuberculosis
FAGPAKMLRL

SEQ ID NO: 176499 - protein, 10 aa, Mycobacterium tuberculosis
GLGNVGNYNV

SEQ ID NO: 176500 - protein, 10 aa, Mycobacterium tuberculosis
GLGNVGIFNL

SEQ ID NO: 176501 - protein, 10 aa, Mycobacterium tuberculosis
GIFNLGAANV

SEQ ID NO: 176502 - protein, 10 aa, Mycobacterium tuberculosis
GFGNIGNANF

SEQ ID NO: 176503 - protein, 10 aa, Mycobacterium tuberculosis
ANFGFGNSGL

SEQ ID NO: 176504 - protein, 10 aa, Mycobacterium tuberculosis
LPPGMGNIGL

SEQ ID NO: 176505 - protein, 10 aa, Mycobacterium tuberculosis
GMGNIGLGNA

SEQ ID NO: 176506 - protein, 10 aa, Mycobacterium tuberculosis
GLGNAGSSNY

SEQ ID NO: 176507 - protein, 10 aa, Mycobacterium tuberculosis
SNYGLANLGV

SEQ ID NO: 176508 - protein, 10 aa, Mycobacterium tuberculosis
GLANLGVGNI

SEQ ID NO: 176509 - protein, 10 aa, Mycobacterium tuberculosis
NLGVGNIGFA

SEQ ID NO: 176510 - protein, 10 aa, Mycobacterium tuberculosis
GLTGDNLTGI

SEQ ID NO: 176511 - protein, 10 aa, Mycobacterium tuberculosis
GLFNSGTGNI

SEQ ID NO: 176512 - protein, 10 aa, Mycobacterium tuberculosis
FNSGTGNIGF

SEQ ID NO: 176513 - protein, 10 aa, Mycobacterium tuberculosis
GFFNSGTGNF

SEQ ID NO: 176514 - protein, 10 aa, Mycobacterium tuberculosis
FNSGTGNFGV

SEQ ID NO: 176515 - protein, 10 aa, Mycobacterium tuberculosis
NFGVFNSGSY

SEQ ID NO: 176516 - protein, 10 aa, Mycobacterium tuberculosis
FNSGSYNTGV

SEQ ID NO: 176517 - protein, 10 aa, Mycobacterium tuberculosis
NAGTASTGLF

SEQ ID NO: 176518 - protein, 10 aa, Mycobacterium tuberculosis
GTASTGLFNV

SEQ ID NO: 176519 - protein, 10 aa, Mycobacterium tuberculosis
GLFNVGGFNT

SEQ ID NO: 176520 - protein, 10 aa, Mycobacterium tuberculosis
FNVGGFNTGV

SEQ ID NO: 176521 - protein, 10 aa, Mycobacterium tuberculosis
NTGVANVGSY

SEQ ID NO: 176522 - protein, 10 aa, Mycobacterium tuberculosis
NAGNTNTGGF

SEQ ID NO: 176523 - protein, 10 aa, Mycobacterium tuberculosis
NTGGFNPGNV

SEQ ID NO: 176524 - protein, 10 aa, Mycobacterium tuberculosis
NPGNVNTGWL

SEQ ID NO: 176525 - protein, 10 aa, Mycobacterium tuberculosis
NTGIANSGNV

SEQ ID NO: 176526 - protein, 10 aa, Mycobacterium tuberculosis
TGAFISGNFS

SEQ ID NO: 176527 - protein, 10 aa, Mycobacterium tuberculosis
FISGNFSNGV

SEQ ID NO: 176528 - protein, 10 aa, Mycobacterium tuberculosis
SGNFSNGVLW

SEQ ID NO: 176529 - protein, 10 aa, Mycobacterium tuberculosis
VLWRGDYEGL

SEQ ID NO: 176530 - protein, 10 aa, Mycobacterium tuberculosis
GLWGLSGGST

SEQ ID NO: 176531 - protein, 10 aa, Mycobacterium tuberculosis
GLSGGSTIPA

SEQ ID NO: 176532 - protein, 10 aa, Mycobacterium tuberculosis
STIPAIPIGL

SEQ ID NO: 176533 - protein, 10 aa, Mycobacterium tuberculosis
IPAIPIGLEL

SEQ ID NO: 176534 - protein, 10 aa, Mycobacterium tuberculosis
IPIGLELNGG

SEQ ID NO: 176535 - protein, 10 aa, Mycobacterium tuberculosis
LELNGGVGPI

SEQ ID NO: 176536 - protein, 10 aa, Mycobacterium tuberculosis
ELNGGVGPIT

SEQ ID NO: 176537 - protein, 10 aa, Mycobacterium tuberculosis
GVGPITVLPI

SEQ ID NO: 176538 - protein, 10 aa, Mycobacterium tuberculosis
GPITVLPIQI

SEQ ID NO: 176539 - protein, 10 aa, Mycobacterium tuberculosis
VLPIQILPTI

SEQ ID NO: 176540 - protein, 10 aa, Mycobacterium tuberculosis
LPIQILPTIP

SEQ ID NO: 176541 - protein, 10 aa, Mycobacterium tuberculosis
QILPTIPLNI

SEQ ID NO: 176542 - protein, 10 aa, Mycobacterium tuberculosis
TIPLNIHQTF

SEQ ID NO: 176543 - protein, 10 aa, Mycobacterium tuberculosis
PLNIHQTFSL

SEQ ID NO: 176544 - protein, 10 aa, Mycobacterium tuberculosis
HQTFSLGPLV

SEQ ID NO: 176545 - protein, 10 aa, Mycobacterium tuberculosis
QTFSLGPLVV

SEQ ID NO: 176546 - protein, 10 aa, Mycobacterium tuberculosis
SLGPLVVPDI

SEQ ID NO: 176547 - protein, 10 aa, Mycobacterium tuberculosis
GPLVVPDIVI

SEQ ID NO: 176548 - protein, 10 aa, Mycobacterium tuberculosis
LVVPDIVIPA

SEQ ID NO: 176549 - protein, 10 aa, Mycobacterium tuberculosis
VVPDIVIPAF

SEQ ID NO: 176550 - protein, 10 aa, Mycobacterium tuberculosis
IVIPAFGGGT

SEQ ID NO: 176551 - protein, 10 aa, Mycobacterium tuberculosis
IPAFGGGTAI

SEQ ID NO: 176552 - protein, 10 aa, Mycobacterium tuberculosis
TAIPISVGPI

SEQ ID NO: 176553 - protein, 10 aa, Mycobacterium tuberculosis
IPISVGPITI

SEQ ID NO: 176554 - protein, 10 aa, Mycobacterium tuberculosis
SVGPITISPI

SEQ ID NO: 176555 - protein, 10 aa, Mycobacterium tuberculosis
GPITISPITL

SEQ ID NO: 176556 - protein, 10 aa, Mycobacterium tuberculosis
TISPITLFPA

SEQ ID NO: 176557 - protein, 10 aa, Mycobacterium tuberculosis
TLFPAQNFNT

SEQ ID NO: 176558 - protein, 10 aa, Mycobacterium tuberculosis
FPAQNFNTTF

SEQ ID NO: 176559 - protein, 10 aa, Mycobacterium tuberculosis
AQNFNTTFPV

SEQ ID NO: 176560 - protein, 10 aa, Mycobacterium tuberculosis
NTTFPVGPFF

SEQ ID NO: 176561 - protein, 10 aa, Mycobacterium tuberculosis
TFPVGPFFGL

SEQ ID NO: 176562 - protein, 10 aa, Mycobacterium tuberculosis
FPVGPFFGLG

SEQ ID NO: 176563 - protein, 10 aa, Mycobacterium tuberculosis
PVGPFFGLGV

SEQ ID NO: 176564 - protein, 10 aa, Mycobacterium tuberculosis
GLGVVNISGI

SEQ ID NO: 176565 - protein, 10 aa, Mycobacterium tuberculosis
GVVNISGIEI

SEQ ID NO: 176566 - protein, 10 aa, Mycobacterium tuberculosis
VVNISGIEIK

SEQ ID NO: 176567 - protein, 10 aa, Mycobacterium tuberculosis
IKDLAGNVTL

SEQ ID NO: 176568 - protein, 10 aa, Mycobacterium tuberculosis
DLAGNVTLQL

SEQ ID NO: 176569 - protein, 10 aa, Mycobacterium tuberculosis
VTLQLGNLNI

SEQ ID NO: 176570 - protein, 10 aa, Mycobacterium tuberculosis
NIDTRINQSF

SEQ ID NO: 176571 - protein, 10 aa, Mycobacterium tuberculosis
DTRINQSFPV

SEQ ID NO: 176572 - protein, 10 aa, Mycobacterium tuberculosis
RINQSFPVTV

SEQ ID NO: 176573 - protein, 10 aa, Mycobacterium tuberculosis
FPVTVNWSTP

SEQ ID NO: 176574 - protein, 10 aa, Mycobacterium tuberculosis
VTVNWSTPAV

SEQ ID NO: 176575 - protein, 10 aa, Mycobacterium tuberculosis
NWSTPAVTIF

SEQ ID NO: 176576 - protein, 10 aa, Mycobacterium tuberculosis
VTIFPNGISI

SEQ ID NO: 176577 - protein, 10 aa, Mycobacterium tuberculosis
FPNGISIPNN

SEQ ID NO: 176578 - protein, 10 aa, Mycobacterium tuberculosis
NGISIPNNPL

SEQ ID NO: 176579 - protein, 10 aa, Mycobacterium tuberculosis
ISIPNNPLAL

SEQ ID NO: 176580 - protein, 10 aa, Mycobacterium tuberculosis
SIPNNPLALL

SEQ ID NO: 176581 - protein, 10 aa, Mycobacterium tuberculosis
IPNNPLALLA

SEQ ID NO: 176582 - protein, 10 aa, Mycobacterium tuberculosis
NPLALLASAS

SEQ ID NO: 176583 - protein, 10 aa, Mycobacterium tuberculosis
PLALLASASI

SEQ ID NO: 176584 - protein, 10 aa, Mycobacterium tuberculosis
ALLASASIGT

SEQ ID NO: 176585 - protein, 10 aa, Mycobacterium tuberculosis
LLASASIGTL

SEQ ID NO: 176586 - protein, 10 aa, Mycobacterium tuberculosis
ASASIGTLGF

SEQ ID NO: 176587 - protein, 10 aa, Mycobacterium tuberculosis
ASIGTLGFTI

SEQ ID NO: 176588 - protein, 10 aa, Mycobacterium tuberculosis
GTLGFTIPGF

SEQ ID NO: 176589 - protein, 10 aa, Mycobacterium tuberculosis
TLGFTIPGFT

SEQ ID NO: 176590 - protein, 10 aa, Mycobacterium tuberculosis
LGFTIPGFTI

SEQ ID NO: 176591 - protein, 10 aa, Mycobacterium tuberculosis
FTIPGFTIPA

SEQ ID NO: 176592 - protein, 10 aa, Mycobacterium tuberculosis
TIPGFTIPAA

SEQ ID NO: 176593 - protein, 10 aa, Mycobacterium tuberculosis
FTIPAAPLPL

SEQ ID NO: 176594 - protein, 10 aa, Mycobacterium tuberculosis
IPAAPLPLTI

SEQ ID NO: 176595 - protein, 10 aa, Mycobacterium tuberculosis
PLTIDIDGQI

SEQ ID NO: 176596 - protein, 10 aa, Mycobacterium tuberculosis
GQIDGFSTPP

SEQ ID NO: 176597 - protein, 10 aa, Mycobacterium tuberculosis
QIDGFSTPPI

SEQ ID NO: 176598 - protein, 10 aa, Mycobacterium tuberculosis
FSTPPITIDR

SEQ ID NO: 176599 - protein, 10 aa, Mycobacterium tuberculosis
STPPITIDRI

SEQ ID NO: 176600 - protein, 10 aa, Mycobacterium tuberculosis
ITIDRIPLNL

SEQ ID NO: 176601 - protein, 10 aa, Mycobacterium tuberculosis
RIPLNLGASV

SEQ ID NO: 176602 - protein, 10 aa, Mycobacterium tuberculosis
IPLNLGASVT

SEQ ID NO: 176603 - protein, 10 aa, Mycobacterium tuberculosis
PLNLGASVTV

SEQ ID NO: 176604 - protein, 10 aa, Mycobacterium tuberculosis
LGASVTVGPI

SEQ ID NO: 176605 - protein, 10 aa, Mycobacterium tuberculosis
TVGPILINGV

SEQ ID NO: 176606 - protein, 10 aa, Mycobacterium tuberculosis
GPILINGVNI

SEQ ID NO: 176607 - protein, 10 aa, Mycobacterium tuberculosis
ILINGVNIPA

SEQ ID NO: 176608 - protein, 10 aa, Mycobacterium tuberculosis
GVNIPATPGF

SEQ ID NO: 176609 - protein, 10 aa, Mycobacterium tuberculosis
IPATPGFGNT

SEQ ID NO: 176610 - protein, 10 aa, Mycobacterium tuberculosis
TPGFGNTTTA

SEQ ID NO: 176611 - protein, 10 aa, Mycobacterium tuberculosis
TTTAPSSGFF

SEQ ID NO: 176612 - protein, 10 aa, Mycobacterium tuberculosis
TTAPSSGFFN

SEQ ID NO: 176613 - protein, 10 aa, Mycobacterium tuberculosis
GVSGFGNFGA

SEQ ID NO: 176614 - protein, 10 aa, Mycobacterium tuberculosis
GWWNQAQTEV

SEQ ID NO: 176615 - protein, 10 aa, Mycobacterium tuberculosis
NQAQTEVAGA

SEQ ID NO: 176616 - protein, 10 aa, Mycobacterium tuberculosis
AQTEVAGAGS

SEQ ID NO: 176617 - protein, 10 aa, Mycobacterium tuberculosis
TEVAGAGSGF

SEQ ID NO: 176618 - protein, 10 aa, Mycobacterium tuberculosis
EVAGAGSGFA

SEQ ID NO: 176619 - protein, 10 aa, Mycobacterium tuberculosis
SLGSGVLNFG

SEQ ID NO: 176620 - protein, 10 aa, Mycobacterium tuberculosis
SGVLNFGSGV

SEQ ID NO: 176621 - protein, 10 aa, Mycobacterium tuberculosis
LNFGSGVSGL

SEQ ID NO: 176622 - protein, 10 aa, Mycobacterium tuberculosis
GGLPPGTPAV

SEQ ID NO: 176623 - protein, 10 aa, Mycobacterium tuberculosis
GLPPGTPAVV

SEQ ID NO: 176624 - protein, 10 aa, Mycobacterium tuberculosis
LPPGTPAVVS

SEQ ID NO: 176625 - protein, 10 aa, Mycobacterium tuberculosis
QLSGLSSAGT

SEQ ID NO: 176626 - protein, 10 aa, Mycobacterium tuberculosis
ALNQSLIINL

SEQ ID NO: 176627 - protein, 10 aa, Mycobacterium tuberculosis
NQSLIINLGL

SEQ ID NO: 176628 - protein, 10 aa, Mycobacterium tuberculosis
LIINLGLADV

SEQ ID NO: 176629 - protein, 10 aa, Mycobacterium tuberculosis
NLGLADVGSV

SEQ ID NO: 176630 - protein, 10 aa, Mycobacterium tuberculosis
GLADVGSVNV

SEQ ID NO: 176631 - protein, 10 aa, Mycobacterium tuberculosis
GFGNVGDFNL

SEQ ID NO: 176632 - protein, 10 aa, Mycobacterium tuberculosis
NVGDFNLGAA

SEQ ID NO: 176633 - protein, 10 aa, Mycobacterium tuberculosis
NLGAANIGDL

SEQ ID NO: 176634 - protein, 10 aa, Mycobacterium tuberculosis
GLGNVGGGNV

SEQ ID NO: 176635 - protein, 10 aa, Mycobacterium tuberculosis
GFGNIGDANF

SEQ ID NO: 176636 - protein, 10 aa, Mycobacterium tuberculosis
GNIGDANFGL

SEQ ID NO: 176637 - protein, 10 aa, Mycobacterium tuberculosis
ANFGLGNAGL

SEQ ID NO: 176638 - protein, 10 aa, Mycobacterium tuberculosis
GLAGVGNIGL

SEQ ID NO: 176639 - protein, 10 aa, Mycobacterium tuberculosis
GLGNAGSGNV

SEQ ID NO: 176640 - protein, 10 aa, Mycobacterium tuberculosis
GFGNTGTNNL

SEQ ID NO: 176641 - protein, 10 aa, Mycobacterium tuberculosis
GLTGDNQTGI

SEQ ID NO: 176642 - protein, 10 aa, Mycobacterium tuberculosis
TGIGGLNSGA

SEQ ID NO: 176643 - protein, 10 aa, Mycobacterium tuberculosis
GLFNSGTGNV

SEQ ID NO: 176644 - protein, 10 aa, Mycobacterium tuberculosis
FNSGTGNVGL

SEQ ID NO: 176645 - protein, 10 aa, Mycobacterium tuberculosis
GLFNSGTGNF

SEQ ID NO: 176646 - protein, 10 aa, Mycobacterium tuberculosis
FNSGTGNFGL

SEQ ID NO: 176647 - protein, 10 aa, Mycobacterium tuberculosis
NFGLFNSGSF

SEQ ID NO: 176648 - protein, 10 aa, Mycobacterium tuberculosis
GLFNSGSFNT

SEQ ID NO: 176649 - protein, 10 aa, Mycobacterium tuberculosis
FNSGSFNTGI

SEQ ID NO: 176650 - protein, 10 aa, Mycobacterium tuberculosis
GLFNAGNFNT

SEQ ID NO: 176651 - protein, 10 aa, Mycobacterium tuberculosis
FNAGNFNTGV

SEQ ID NO: 176652 - protein, 10 aa, Mycobacterium tuberculosis
NPGSYNTGSF

SEQ ID NO: 176653 - protein, 10 aa, Mycobacterium tuberculosis
NTGGFNPGSI

SEQ ID NO: 176654 - protein, 10 aa, Mycobacterium tuberculosis
NPGSINTGWF

SEQ ID NO: 176655 - protein, 10 aa, Mycobacterium tuberculosis
NTGWFNTGNA

SEQ ID NO: 176656 - protein, 10 aa, Mycobacterium tuberculosis
FNTGNANTGV

SEQ ID NO: 176657 - protein, 10 aa, Mycobacterium tuberculosis
NTGVANSGNV

SEQ ID NO: 176658 - protein, 10 aa, Mycobacterium tuberculosis
DTGALMSGNF

SEQ ID NO: 176659 - protein, 10 aa, Mycobacterium tuberculosis
ALMSGNFSNG

SEQ ID NO: 176660 - protein, 10 aa, Mycobacterium tuberculosis
LMSGNFSNGI

SEQ ID NO: 176661 - protein, 10 aa, Mycobacterium tuberculosis
SGNFSNGILW

SEQ ID NO: 176662 - protein, 10 aa, Mycobacterium tuberculosis
ILWRGNFEGL

SEQ ID NO: 176663 - protein, 10 aa, Mycobacterium tuberculosis
LWRGNFEGLF

SEQ ID NO: 176664 - protein, 10 aa, Mycobacterium tuberculosis
GLFGLNVGIT

SEQ ID NO: 176665 - protein, 10 aa, Mycobacterium tuberculosis
VGITIPEFPI

SEQ ID NO: 176666 - protein, 10 aa, Mycobacterium tuberculosis
ITIPEFPIHW

SEQ ID NO: 176667 - protein, 10 aa, Mycobacterium tuberculosis
TIPEFPIHWT

SEQ ID NO: 176668 - protein, 10 aa, Mycobacterium tuberculosis
FPIHWTSTGG

SEQ ID NO: 176669 - protein, 10 aa, Mycobacterium tuberculosis
WTSTGGIGPI

SEQ ID NO: 176670 - protein, 10 aa, Mycobacterium tuberculosis
GPIIIPDTTI

SEQ ID NO: 176671 - protein, 10 aa, Mycobacterium tuberculosis
PIIIPDTTIL

SEQ ID NO: 176672 - protein, 10 aa, Mycobacterium tuberculosis
IPDTTILPPI

SEQ ID NO: 176673 - protein, 10 aa, Mycobacterium tuberculosis
DTTILPPIHL

SEQ ID NO: 176674 - protein, 10 aa, Mycobacterium tuberculosis
TILPPIHLGL

SEQ ID NO: 176675 - protein, 10 aa, Mycobacterium tuberculosis
ILPPIHLGLT

SEQ ID NO: 176676 - protein, 10 aa, Mycobacterium tuberculosis
LPPIHLGLTG

SEQ ID NO: 176677 - protein, 10 aa, Mycobacterium tuberculosis
HLGLTGQANY

SEQ ID NO: 176678 - protein, 10 aa, Mycobacterium tuberculosis
GLTGQANYGF

SEQ ID NO: 176679 - protein, 10 aa, Mycobacterium tuberculosis
TGQANYGFAV

SEQ ID NO: 176680 - protein, 10 aa, Mycobacterium tuberculosis
YGFAVPDIPI

SEQ ID NO: 176681 - protein, 10 aa, Mycobacterium tuberculosis
FAVPDIPIPA

SEQ ID NO: 176682 - protein, 10 aa, Mycobacterium tuberculosis
AVPDIPIPAI

SEQ ID NO: 176683 - protein, 10 aa, Mycobacterium tuberculosis
IPIPAIHIDF

SEQ ID NO: 176684 - protein, 10 aa, Mycobacterium tuberculosis
DFDGAADAGF

SEQ ID NO: 176685 - protein, 10 aa, Mycobacterium tuberculosis
AADAGFTAPA

SEQ ID NO: 176686 - protein, 10 aa, Mycobacterium tuberculosis
FTAPATTLLS

SEQ ID NO: 176687 - protein, 10 aa, Mycobacterium tuberculosis
APATTLLSAL

SEQ ID NO: 176688 - protein, 10 aa, Mycobacterium tuberculosis
LLSALGITGQ

SEQ ID NO: 176689 - protein, 10 aa, Mycobacterium tuberculosis
LSALGITGQF

SEQ ID NO: 176690 - protein, 10 aa, Mycobacterium tuberculosis
SALGITGQFR

SEQ ID NO: 176691 - protein, 10 aa, Mycobacterium tuberculosis
ITGQFRFGPI

SEQ ID NO: 176692 - protein, 10 aa, Mycobacterium tuberculosis
GQFRFGPITV

SEQ ID NO: 176693 - protein, 10 aa, Mycobacterium tuberculosis
FRFGPITVSN

SEQ ID NO: 176694 - protein, 10 aa, Mycobacterium tuberculosis
RFGPITVSNV

SEQ ID NO: 176695 - protein, 10 aa, Mycobacterium tuberculosis
GPITVSNVQL

SEQ ID NO: 176696 - protein, 10 aa, Mycobacterium tuberculosis
TVSNVQLNPF

SEQ ID NO: 176697 - protein, 10 aa, Mycobacterium tuberculosis
VQLNPFNVNL

SEQ ID NO: 176698 - protein, 10 aa, Mycobacterium tuberculosis
QLNPFNVNLK

SEQ ID NO: 176699 - protein, 10 aa, Mycobacterium tuberculosis
PFNVNLKLQF

SEQ ID NO: 176700 - protein, 10 aa, Mycobacterium tuberculosis
FNVNLKLQFL

SEQ ID NO: 176701 - protein, 10 aa, Mycobacterium tuberculosis
NLKLQFLHDA

SEQ ID NO: 176702 - protein, 10 aa, Mycobacterium tuberculosis
FLHDAFPNEF

SEQ ID NO: 176703 - protein, 10 aa, Mycobacterium tuberculosis
FPNEFPDPTI

SEQ ID NO: 176704 - protein, 10 aa, Mycobacterium tuberculosis
NEFPDPTISV

SEQ ID NO: 176705 - protein, 10 aa, Mycobacterium tuberculosis
FPDPTISVQI

SEQ ID NO: 176706 - protein, 10 aa, Mycobacterium tuberculosis
TISVQIQVAI

SEQ ID NO: 176707 - protein, 10 aa, Mycobacterium tuberculosis
SVQIQVAIPL

SEQ ID NO: 176708 - protein, 10 aa, Mycobacterium tuberculosis
VQIQVAIPLT

SEQ ID NO: 176709 - protein, 10 aa, Mycobacterium tuberculosis
IQVAIPLTSA

SEQ ID NO: 176710 - protein, 10 aa, Mycobacterium tuberculosis
QVAIPLTSAT

SEQ ID NO: 176711 - protein, 10 aa, Mycobacterium tuberculosis
VAIPLTSATL

SEQ ID NO: 176712 - protein, 10 aa, Mycobacterium tuberculosis
PLTSATLGGL

SEQ ID NO: 176713 - protein, 10 aa, Mycobacterium tuberculosis
LTSATLGGLA

SEQ ID NO: 176714 - protein, 10 aa, Mycobacterium tuberculosis
ATLGGLALPL

SEQ ID NO: 176715 - protein, 10 aa, Mycobacterium tuberculosis
TLGGLALPLQ

SEQ ID NO: 176716 - protein, 10 aa, Mycobacterium tuberculosis
GLALPLQQTI

SEQ ID NO: 176717 - protein, 10 aa, Mycobacterium tuberculosis
ALPLQQTIDA

SEQ ID NO: 176718 - protein, 10 aa, Mycobacterium tuberculosis
LPLQQTIDAI

SEQ ID NO: 176719 - protein, 10 aa, Mycobacterium tuberculosis
LQQTIDAIEL

SEQ ID NO: 176720 - protein, 10 aa, Mycobacterium tuberculosis
QTIDAIELPA

SEQ ID NO: 176721 - protein, 10 aa, Mycobacterium tuberculosis
TIDAIELPAI

SEQ ID NO: 176722 - protein, 10 aa, Mycobacterium tuberculosis
DAIELPAISF

SEQ ID NO: 176723 - protein, 10 aa, Mycobacterium tuberculosis
ELPAISFSQS

SEQ ID NO: 176724 - protein, 10 aa, Mycobacterium tuberculosis
LPAISFSQSI

SEQ ID NO: 176725 - protein, 10 aa, Mycobacterium tuberculosis
AISFSQSIPI

SEQ ID NO: 176726 - protein, 10 aa, Mycobacterium tuberculosis
QSIPIDIPPI

SEQ ID NO: 176727 - protein, 10 aa, Mycobacterium tuberculosis
IPIDIPPIDI

SEQ ID NO: 176728 - protein, 10 aa, Mycobacterium tuberculosis
IPPIDIPAST

SEQ ID NO: 176729 - protein, 10 aa, Mycobacterium tuberculosis
PPIDIPASTI

SEQ ID NO: 176730 - protein, 10 aa, Mycobacterium tuberculosis
DIPASTINGI

SEQ ID NO: 176731 - protein, 10 aa, Mycobacterium tuberculosis
IPASTINGIS

SEQ ID NO: 176732 - protein, 10 aa, Mycobacterium tuberculosis
TINGISMSEV

SEQ ID NO: 176733 - protein, 10 aa, Mycobacterium tuberculosis
GISMSEVVPI

SEQ ID NO: 176734 - protein, 10 aa, Mycobacterium tuberculosis
SMSEVVPIDV

SEQ ID NO: 176735 - protein, 10 aa, Mycobacterium tuberculosis
SEVVPIDVSV

SEQ ID NO: 176736 - protein, 10 aa, Mycobacterium tuberculosis
VPIDVSVDIP

SEQ ID NO: 176737 - protein, 10 aa, Mycobacterium tuberculosis
IPAVTITGTR

SEQ ID NO: 176738 - protein, 10 aa, Mycobacterium tuberculosis
TITGTRIDPI

SEQ ID NO: 176739 - protein, 10 aa, Mycobacterium tuberculosis
DPIPLNFDVL

SEQ ID NO: 176740 - protein, 10 aa, Mycobacterium tuberculosis
PLNFDVLSSA

SEQ ID NO: 176741 - protein, 10 aa, Mycobacterium tuberculosis
VLSSAGPINI

SEQ ID NO: 176742 - protein, 10 aa, Mycobacterium tuberculosis
SSAGPINISI

SEQ ID NO: 176743 - protein, 10 aa, Mycobacterium tuberculosis
GPINISIIDI

SEQ ID NO: 176744 - protein, 10 aa, Mycobacterium tuberculosis
NISIIDIPAL

SEQ ID NO: 176745 - protein, 10 aa, Mycobacterium tuberculosis
IIDIPALPGF

SEQ ID NO: 176746 - protein, 10 aa, Mycobacterium tuberculosis
IPALPGFGNS

SEQ ID NO: 176747 - protein, 10 aa, Mycobacterium tuberculosis
ALPGFGNSTE

SEQ ID NO: 176748 - protein, 10 aa, Mycobacterium tuberculosis
LPGFGNSTEL

SEQ ID NO: 176749 - protein, 10 aa, Mycobacterium tuberculosis
STELPSSGFF

SEQ ID NO: 176750 - protein, 10 aa, Mycobacterium tuberculosis
LPSSGFFNTG

SEQ ID NO: 176751 - protein, 10 aa, Mycobacterium tuberculosis
SGIANFGAGV

SEQ ID NO: 176752 - protein, 10 aa, Mycobacterium tuberculosis
GLLNQASSPM

SEQ ID NO: 176753 - protein, 10 aa, Mycobacterium tuberculosis
LLNQASSPMV

SEQ ID NO: 176754 - protein, 10 aa, Mycobacterium tuberculosis
SPMVGTLSGL

SEQ ID NO: 176755 - protein, 10 aa, Mycobacterium tuberculosis
SLASGVLNSG

SEQ ID NO: 176756 - protein, 10 aa, Mycobacterium tuberculosis
LASGVLNSGV

SEQ ID NO: 176757 - protein, 10 aa, Mycobacterium tuberculosis
GVDISGMFNV

SEQ ID NO: 176758 - protein, 10 aa, Mycobacterium tuberculosis
NVSTLGSAPA

SEQ ID NO: 176759 - protein, 10 aa, Mycobacterium tuberculosis
STLGSAPAVI

SEQ ID NO: 176760 - protein, 10 aa, Mycobacterium tuberculosis
GSAPAVISGF

SEQ ID NO: 176761 - protein, 10 aa, Mycobacterium tuberculosis
HVSGVSIDGL

SEQ ID NO: 176762 - protein, 10 aa, Mycobacterium tuberculosis
GVSIDGLLAM

SEQ ID NO: 176763 - protein, 10 aa, Mycobacterium tuberculosis
VSIDGLLAML

SEQ ID NO: 176764 - protein, 10 aa, Mycobacterium tuberculosis
SIDGLLAMLT

SEQ ID NO: 176765 - protein, 10 aa, Mycobacterium tuberculosis
LLAMLTSGGS

SEQ ID NO: 176766 - protein, 10 aa, Mycobacterium tuberculosis
GQPSIIDAAI

SEQ ID NO: 176767 - protein, 10 aa, Mycobacterium tuberculosis
QPSIIDAAIA

SEQ ID NO: 176768 - protein, 10 aa, Mycobacterium tuberculosis
SIIDAAIAEL

SEQ ID NO: 176769 - protein, 10 aa, Mycobacterium tuberculosis
IIDAAIAELR

SEQ ID NO: 176770 - protein, 10 aa, Mycobacterium tuberculosis
HLNPLNIVNL

SEQ ID NO: 176771 - protein, 10 aa, Mycobacterium tuberculosis
PLNIVNLGNV

SEQ ID NO: 176772 - protein, 10 aa, Mycobacterium tuberculosis
IVNLGNVGSY

SEQ ID NO: 176773 - protein, 10 aa, Mycobacterium tuberculosis
NLGNVGSYNL

SEQ ID NO: 176774 - protein, 10 aa, Mycobacterium tuberculosis
GSYNLGFANV

SEQ ID NO: 176775 - protein, 10 aa, Mycobacterium tuberculosis
NLGFANVGDV

SEQ ID NO: 176776 - protein, 10 aa, Mycobacterium tuberculosis
NLGAGNLGNL

SEQ ID NO: 176777 - protein, 10 aa, Mycobacterium tuberculosis
NLGGGNLGGQ

SEQ ID NO: 176778 - protein, 10 aa, Mycobacterium tuberculosis
GLGNLGDGNV

SEQ ID NO: 176779 - protein, 10 aa, Mycobacterium tuberculosis
ALPGIGNIGL

SEQ ID NO: 176780 - protein, 10 aa, Mycobacterium tuberculosis
GIGNIGLGNA

SEQ ID NO: 176781 - protein, 10 aa, Mycobacterium tuberculosis
GLGNAGSNNV

SEQ ID NO: 176782 - protein, 10 aa, Mycobacterium tuberculosis
GLGNIGFGNT

SEQ ID NO: 176783 - protein, 10 aa, Mycobacterium tuberculosis
GFGNTGTNNL

SEQ ID NO: 176784 - protein, 10 aa, Mycobacterium tuberculosis
GLTGDNQTGF

SEQ ID NO: 176785 - protein, 10 aa, Mycobacterium tuberculosis
TGFGGLNSGA

SEQ ID NO: 176786 - protein, 10 aa, Mycobacterium tuberculosis
GLFNSGTGNI

SEQ ID NO: 176787 - protein, 10 aa, Mycobacterium tuberculosis
FNSGTGNIGF

SEQ ID NO: 176788 - protein, 10 aa, Mycobacterium tuberculosis
GFFNTGTGNW

SEQ ID NO: 176789 - protein, 10 aa, Mycobacterium tuberculosis
NWGLFNSGSY

SEQ ID NO: 176790 - protein, 10 aa, Mycobacterium tuberculosis
GLFNSGSYNT

SEQ ID NO: 176791 - protein, 10 aa, Mycobacterium tuberculosis
FNSGSYNTGI

SEQ ID NO: 176792 - protein, 10 aa, Mycobacterium tuberculosis
GLFNAGSFNT

SEQ ID NO: 176793 - protein, 10 aa, Mycobacterium tuberculosis
FNAGSFNTGL

SEQ ID NO: 176794 - protein, 10 aa, Mycobacterium tuberculosis
NTGLANAGSY

SEQ ID NO: 176795 - protein, 10 aa, Mycobacterium tuberculosis
GLANAGSYNT

SEQ ID NO: 176796 - protein, 10 aa, Mycobacterium tuberculosis
NAGNTNTGGF

SEQ ID NO: 176797 - protein, 10 aa, Mycobacterium tuberculosis
NTGGFNPGNV

SEQ ID NO: 176798 - protein, 10 aa, Mycobacterium tuberculosis
NPGNVNTGWF

SEQ ID NO: 176799 - protein, 10 aa, Mycobacterium tuberculosis
NTGGFNTGNV

SEQ ID NO: 176800 - protein, 10 aa, Mycobacterium tuberculosis
ALWTGDHHGL

SEQ ID NO: 176801 - protein, 10 aa, Mycobacterium tuberculosis
YSIEITGSTL

SEQ ID NO: 176802 - protein, 10 aa, Mycobacterium tuberculosis
SIEITGSTLV

SEQ ID NO: 176803 - protein, 10 aa, Mycobacterium tuberculosis
STLVDINETL

SEQ ID NO: 176804 - protein, 10 aa, Mycobacterium tuberculosis
LVDINETLNL

SEQ ID NO: 176805 - protein, 10 aa, Mycobacterium tuberculosis
ETLNLGPVHI

SEQ ID NO: 176806 - protein, 10 aa, Mycobacterium tuberculosis
NLGPVHIDQI

SEQ ID NO: 176807 - protein, 10 aa, Mycobacterium tuberculosis
GPVHIDQIDI

SEQ ID NO: 176808 - protein, 10 aa, Mycobacterium tuberculosis
HIDQIDIPGM

SEQ ID NO: 176809 - protein, 10 aa, Mycobacterium tuberculosis
QIDIPGMSLF

SEQ ID NO: 176810 - protein, 10 aa, Mycobacterium tuberculosis
GMSLFDIHEL

SEQ ID NO: 176811 - protein, 10 aa, Mycobacterium tuberculosis
MSLFDIHELV

SEQ ID NO: 176812 - protein, 10 aa, Mycobacterium tuberculosis
SLFDIHELVN

SEQ ID NO: 176813 - protein, 10 aa, Mycobacterium tuberculosis
ELVNIGPFRI

SEQ ID NO: 176814 - protein, 10 aa, Mycobacterium tuberculosis
NIGPFRIEPI

SEQ ID NO: 176815 - protein, 10 aa, Mycobacterium tuberculosis
FRIEPIDVPA

SEQ ID NO: 176816 - protein, 10 aa, Mycobacterium tuberculosis
RIEPIDVPAV

SEQ ID NO: 176817 - protein, 10 aa, Mycobacterium tuberculosis
EPIDVPAVVL

SEQ ID NO: 176818 - protein, 10 aa, Mycobacterium tuberculosis
AVVLDIHETM

SEQ ID NO: 176819 - protein, 10 aa, Mycobacterium tuberculosis
VVLDIHETMV

SEQ ID NO: 176820 - protein, 10 aa, Mycobacterium tuberculosis
VLDIHETMVI

SEQ ID NO: 176821 - protein, 10 aa, Mycobacterium tuberculosis
ETMVIPPIVF

SEQ ID NO: 176822 - protein, 10 aa, Mycobacterium tuberculosis
TMVIPPIVFL

SEQ ID NO: 176823 - protein, 10 aa, Mycobacterium tuberculosis
IPPIVFLPSM

SEQ ID NO: 176824 - protein, 10 aa, Mycobacterium tuberculosis
FLPSMTIGGQ

SEQ ID NO: 176825 - protein, 10 aa, Mycobacterium tuberculosis
LPSMTIGGQT

SEQ ID NO: 176826 - protein, 10 aa, Mycobacterium tuberculosis
SMTIGGQTYT

SEQ ID NO: 176827 - protein, 10 aa, Mycobacterium tuberculosis
MTIGGQTYTI

SEQ ID NO: 176828 - protein, 10 aa, Mycobacterium tuberculosis
YTIPLDTPPA

SEQ ID NO: 176829 - protein, 10 aa, Mycobacterium tuberculosis
IPLDTPPAPA

SEQ ID NO: 176830 - protein, 10 aa, Mycobacterium tuberculosis
TPPAPAPPPF

SEQ ID NO: 176831 - protein, 10 aa, Mycobacterium tuberculosis
APPPFRLPLL

SEQ ID NO: 176832 - protein, 10 aa, Mycobacterium tuberculosis
PPFRLPLLFV

SEQ ID NO: 176833 - protein, 10 aa, Mycobacterium tuberculosis
RLPLLFVNAL

SEQ ID NO: 176834 - protein, 10 aa, Mycobacterium tuberculosis
LPLLFVNALG

SEQ ID NO: 176835 - protein, 10 aa, Mycobacterium tuberculosis
FVNALGDNWI

SEQ ID NO: 176836 - protein, 10 aa, Mycobacterium tuberculosis
ALGDNWIVGA

SEQ ID NO: 176837 - protein, 10 aa, Mycobacterium tuberculosis
NSTGMSGGFV

SEQ ID NO: 176838 - protein, 10 aa, Mycobacterium tuberculosis
GMSGGFVTAP

SEQ ID NO: 176839 - protein, 10 aa, Mycobacterium tuberculosis
MSGGFVTAPT

SEQ ID NO: 176840 - protein, 10 aa, Mycobacterium tuberculosis
FVTAPTQGIL

SEQ ID NO: 176841 - protein, 10 aa, Mycobacterium tuberculosis
VTAPTQGILI

SEQ ID NO: 176842 - protein, 10 aa, Mycobacterium tuberculosis
ILIHTGPSSA

SEQ ID NO: 176843 - protein, 10 aa, Mycobacterium tuberculosis
GPSSATTGSL

SEQ ID NO: 176844 - protein, 10 aa, Mycobacterium tuberculosis
ATTGSLALTL

SEQ ID NO: 176845 - protein, 10 aa, Mycobacterium tuberculosis
GSLALTLPTV

SEQ ID NO: 176846 - protein, 10 aa, Mycobacterium tuberculosis
SLALTLPTVT

SEQ ID NO: 176847 - protein, 10 aa, Mycobacterium tuberculosis
LALTLPTVTI

SEQ ID NO: 176848 - protein, 10 aa, Mycobacterium tuberculosis
LTLPTVTIPT

SEQ ID NO: 176849 - protein, 10 aa, Mycobacterium tuberculosis
TLPTVTIPTI

SEQ ID NO: 176850 - protein, 10 aa, Mycobacterium tuberculosis
LPTVTIPTIT

SEQ ID NO: 176851 - protein, 10 aa, Mycobacterium tuberculosis
TIPTITTSPI

SEQ ID NO: 176852 - protein, 10 aa, Mycobacterium tuberculosis
IPTITTSPIP

SEQ ID NO: 176853 - protein, 10 aa, Mycobacterium tuberculosis
PTITTSPIPL

SEQ ID NO: 176854 - protein, 10 aa, Mycobacterium tuberculosis
TITTSPIPLK

SEQ ID NO: 176855 - protein, 10 aa, Mycobacterium tuberculosis
KIDVSGGLPA

SEQ ID NO: 176856 - protein, 10 aa, Mycobacterium tuberculosis
IDVSGGLPAF

SEQ ID NO: 176857 - protein, 10 aa, Mycobacterium tuberculosis
GLPAFTLFPG

SEQ ID NO: 176858 - protein, 10 aa, Mycobacterium tuberculosis
LPAFTLFPGG

SEQ ID NO: 176859 - protein, 10 aa, Mycobacterium tuberculosis
FTLFPGGLNI

SEQ ID NO: 176860 - protein, 10 aa, Mycobacterium tuberculosis
TLFPGGLNIP

SEQ ID NO: 176861 - protein, 10 aa, Mycobacterium tuberculosis
FPGGLNIPQN

SEQ ID NO: 176862 - protein, 10 aa, Mycobacterium tuberculosis
IPQNAIPLTI

SEQ ID NO: 176863 - protein, 10 aa, Mycobacterium tuberculosis
IPLTIDASGV

SEQ ID NO: 176864 - protein, 10 aa, Mycobacterium tuberculosis
PLTIDASGVL

SEQ ID NO: 176865 - protein, 10 aa, Mycobacterium tuberculosis
VLDPITIFPG

SEQ ID NO: 176866 - protein, 10 aa, Mycobacterium tuberculosis
DPITIFPGGF

SEQ ID NO: 176867 - protein, 10 aa, Mycobacterium tuberculosis
ITIFPGGFTI

SEQ ID NO: 176868 - protein, 10 aa, Mycobacterium tuberculosis
FPGGFTIDPL

SEQ ID NO: 176869 - protein, 10 aa, Mycobacterium tuberculosis
FTIDPLPLSL

SEQ ID NO: 176870 - protein, 10 aa, Mycobacterium tuberculosis
TIDPLPLSLA

SEQ ID NO: 176871 - protein, 10 aa, Mycobacterium tuberculosis
PLPLSLALNI

SEQ ID NO: 176872 - protein, 10 aa, Mycobacterium tuberculosis
LPLSLALNIS

SEQ ID NO: 176873 - protein, 10 aa, Mycobacterium tuberculosis
PLSLALNISV

SEQ ID NO: 176874 - protein, 10 aa, Mycobacterium tuberculosis
LNISVPDSSV

SEQ ID NO: 176875 - protein, 10 aa, Mycobacterium tuberculosis
ISVPDSSVPI

SEQ ID NO: 176876 - protein, 10 aa, Mycobacterium tuberculosis
SVPDSSVPII

SEQ ID NO: 176877 - protein, 10 aa, Mycobacterium tuberculosis
VPDSSVPIII

SEQ ID NO: 176878 - protein, 10 aa, Mycobacterium tuberculosis
SVPIIIVPPT

SEQ ID NO: 176879 - protein, 10 aa, Mycobacterium tuberculosis
VPIIIVPPTP

SEQ ID NO: 176880 - protein, 10 aa, Mycobacterium tuberculosis
IIIVPPTPGF

SEQ ID NO: 176881 - protein, 10 aa, Mycobacterium tuberculosis
VPPTPGFGNA

SEQ ID NO: 176882 - protein, 10 aa, Mycobacterium tuberculosis
PPTPGFGNAT

SEQ ID NO: 176883 - protein, 10 aa, Mycobacterium tuberculosis
TPGFGNATAT

SEQ ID NO: 176884 - protein, 10 aa, Mycobacterium tuberculosis
ATATPSSGFF

SEQ ID NO: 176885 - protein, 10 aa, Mycobacterium tuberculosis
GVSGFGNFGA

SEQ ID NO: 176886 - protein, 10 aa, Mycobacterium tuberculosis
NQAHAALAGA

SEQ ID NO: 176887 - protein, 10 aa, Mycobacterium tuberculosis
AALAGAGSGV

SEQ ID NO: 176888 - protein, 10 aa, Mycobacterium tuberculosis
ALAGAGSGVL

SEQ ID NO: 176889 - protein, 10 aa, Mycobacterium tuberculosis
GTLNSGVLNV

SEQ ID NO: 176890 - protein, 10 aa, Mycobacterium tuberculosis
NVGSGISGLY

SEQ ID NO: 176891 - protein, 10 aa, Mycobacterium tuberculosis
GISGLYNTAI

SEQ ID NO: 176892 - protein, 10 aa, Mycobacterium tuberculosis
GLYNTAIVGL

SEQ ID NO: 176893 - protein, 10 aa, Mycobacterium tuberculosis
TAIVGLGTPA

SEQ ID NO: 176894 - protein, 10 aa, Mycobacterium tuberculosis
AIVGLGTPAL

SEQ ID NO: 176895 - protein, 10 aa, Mycobacterium tuberculosis
IVGLGTPALV

SEQ ID NO: 176896 - protein, 10 aa, Mycobacterium tuberculosis
GQQLSGVLAA

SEQ ID NO: 176897 - protein, 10 aa, Mycobacterium tuberculosis
QLSGVLAAGT

SEQ ID NO: 176898 - protein, 10 aa, Mycobacterium tuberculosis
VLAAGTALTQ

SEQ ID NO: 176899 - protein, 10 aa, Mycobacterium tuberculosis
ALTQSPIINL

SEQ ID NO: 176900 - protein, 10 aa, Mycobacterium tuberculosis
TQSPIINLGL

SEQ ID NO: 176901 - protein, 10 aa, Mycobacterium tuberculosis
PIINLGLADV

SEQ ID NO: 176902 - protein, 10 aa, Mycobacterium tuberculosis
GLADVGNYNL

SEQ ID NO: 176903 - protein, 10 aa, Mycobacterium tuberculosis
GLGNVGDFNL

SEQ ID NO: 176904 - protein, 10 aa, Mycobacterium tuberculosis
NVGDFNLGAA

SEQ ID NO: 176905 - protein, 10 aa, Mycobacterium tuberculosis
NLGAANLGDL

SEQ ID NO: 176906 - protein, 10 aa, Mycobacterium tuberculosis
GAANLGDLNL

SEQ ID NO: 176907 - protein, 10 aa, Mycobacterium tuberculosis
ANLGDLNLGL

SEQ ID NO: 176908 - protein, 10 aa, Mycobacterium tuberculosis
NLGLGNIGNA

SEQ ID NO: 176909 - protein, 10 aa, Mycobacterium tuberculosis
GLGNIGNANV

SEQ ID NO: 176910 - protein, 10 aa, Mycobacterium tuberculosis
AALGIGNIGL

SEQ ID NO: 176911 - protein, 10 aa, Mycobacterium tuberculosis
GIGNIGLGNA

SEQ ID NO: 176912 - protein, 10 aa, Mycobacterium tuberculosis
GLGNAGSTNV

SEQ ID NO: 176913 - protein, 10 aa, Mycobacterium tuberculosis
TNVGLANMGV

SEQ ID NO: 176914 - protein, 10 aa, Mycobacterium tuberculosis
GLANMGVGNI

SEQ ID NO: 176915 - protein, 10 aa, Mycobacterium tuberculosis
NMGVGNIGFA

SEQ ID NO: 176916 - protein, 10 aa, Mycobacterium tuberculosis
GFANTGTNNL

SEQ ID NO: 176917 - protein, 10 aa, Mycobacterium tuberculosis
GLTGDNQTGI

SEQ ID NO: 176918 - protein, 10 aa, Mycobacterium tuberculosis
TGIGGLNSGA

SEQ ID NO: 176919 - protein, 10 aa, Mycobacterium tuberculosis
GLFNSGTGNI

SEQ ID NO: 176920 - protein, 10 aa, Mycobacterium tuberculosis
FNSGTGNIGF

SEQ ID NO: 176921 - protein, 10 aa, Mycobacterium tuberculosis
GFFNSGTGNW

SEQ ID NO: 176922 - protein, 10 aa, Mycobacterium tuberculosis
FNSGTGNWGL

SEQ ID NO: 176923 - protein, 10 aa, Mycobacterium tuberculosis
NWGLFNSGSF

SEQ ID NO: 176924 - protein, 10 aa, Mycobacterium tuberculosis
GLFNSGSFNT

SEQ ID NO: 176925 - protein, 10 aa, Mycobacterium tuberculosis
FNSGSFNTGI

SEQ ID NO: 176926 - protein, 10 aa, Mycobacterium tuberculosis
GLFNAGGFTT

SEQ ID NO: 176927 - protein, 10 aa, Mycobacterium tuberculosis
FNAGGFTTGL

SEQ ID NO: 176928 - protein, 10 aa, Mycobacterium tuberculosis
FTTGLANAGS

SEQ ID NO: 176929 - protein, 10 aa, Mycobacterium tuberculosis
TTGLANAGSY

SEQ ID NO: 176930 - protein, 10 aa, Mycobacterium tuberculosis
GLANAGSYNT

SEQ ID NO: 176931 - protein, 10 aa, Mycobacterium tuberculosis
NAGSYNTGSF

SEQ ID NO: 176932 - protein, 10 aa, Mycobacterium tuberculosis
NTGGFNPGSI

SEQ ID NO: 176933 - protein, 10 aa, Mycobacterium tuberculosis
NPGSINTGWF

SEQ ID NO: 176934 - protein, 10 aa, Mycobacterium tuberculosis
NTGWFNTGNA

SEQ ID NO: 176935 - protein, 10 aa, Mycobacterium tuberculosis
NTGIANSGNV

SEQ ID NO: 176936 - protein, 10 aa, Mycobacterium tuberculosis
DTGALMSGNF

SEQ ID NO: 176937 - protein, 10 aa, Mycobacterium tuberculosis
ALMSGNFSNG

SEQ ID NO: 176938 - protein, 10 aa, Mycobacterium tuberculosis
LMSGNFSNGI

SEQ ID NO: 176939 - protein, 10 aa, Mycobacterium tuberculosis
SGNFSNGILW

SEQ ID NO: 176940 - protein, 10 aa, Mycobacterium tuberculosis
ILWRGNYEGL

SEQ ID NO: 176941 - protein, 10 aa, Mycobacterium tuberculosis
LWRGNYEGLF

SEQ ID NO: 176942 - protein, 10 aa, Mycobacterium tuberculosis
RGNYEGLFSY

SEQ ID NO: 176943 - protein, 10 aa, Mycobacterium tuberculosis
NYEGLFSYSY

SEQ ID NO: 176944 - protein, 10 aa, Mycobacterium tuberculosis
EGLFSYSYSL

SEQ ID NO: 176945 - protein, 10 aa, Mycobacterium tuberculosis
SYSYSLDVPR

SEQ ID NO: 176946 - protein, 10 aa, Mycobacterium tuberculosis
YSYSLDVPRI

SEQ ID NO: 176947 - protein, 10 aa, Mycobacterium tuberculosis
YSLDVPRITI

SEQ ID NO: 176948 - protein, 10 aa, Mycobacterium tuberculosis
SLDVPRITIL

SEQ ID NO: 176949 - protein, 10 aa, Mycobacterium tuberculosis
TILDAHFTGA

SEQ ID NO: 176950 - protein, 10 aa, Mycobacterium tuberculosis
ILDAHFTGAF

SEQ ID NO: 176951 - protein, 10 aa, Mycobacterium tuberculosis
FTGAFGPVVV

SEQ ID NO: 176952 - protein, 10 aa, Mycobacterium tuberculosis
GPVVVPPIPV

SEQ ID NO: 176953 - protein, 10 aa, Mycobacterium tuberculosis
VVVPPIPVLA

SEQ ID NO: 176954 - protein, 10 aa, Mycobacterium tuberculosis
VVPPIPVLAI

SEQ ID NO: 176955 - protein, 10 aa, Mycobacterium tuberculosis
PPIPVLAINA

SEQ ID NO: 176956 - protein, 10 aa, Mycobacterium tuberculosis
IPVLAINAHL

SEQ ID NO: 176957 - protein, 10 aa, Mycobacterium tuberculosis
AINAHLTGNA

SEQ ID NO: 176958 - protein, 10 aa, Mycobacterium tuberculosis
NAHLTGNAAM

SEQ ID NO: 176959 - protein, 10 aa, Mycobacterium tuberculosis
HLTGNAAMGA

SEQ ID NO: 176960 - protein, 10 aa, Mycobacterium tuberculosis
LTGNAAMGAF

SEQ ID NO: 176961 - protein, 10 aa, Mycobacterium tuberculosis
AMGAFTIPQI

SEQ ID NO: 176962 - protein, 10 aa, Mycobacterium tuberculosis
FTIPQIDIPA

SEQ ID NO: 176963 - protein, 10 aa, Mycobacterium tuberculosis
TIPQIDIPAL

SEQ ID NO: 176964 - protein, 10 aa, Mycobacterium tuberculosis
ALNPNVTGSV

SEQ ID NO: 176965 - protein, 10 aa, Mycobacterium tuberculosis
NPNVTGSVGF

SEQ ID NO: 176966 - protein, 10 aa, Mycobacterium tuberculosis
GFGPIAVPSV

SEQ ID NO: 176967 - protein, 10 aa, Mycobacterium tuberculosis
GPIAVPSVTI

SEQ ID NO: 176968 - protein, 10 aa, Mycobacterium tuberculosis
IAVPSVTIPA

SEQ ID NO: 176969 - protein, 10 aa, Mycobacterium tuberculosis
AVPSVTIPAL

SEQ ID NO: 176970 - protein, 10 aa, Mycobacterium tuberculosis
VPSVTIPALT

SEQ ID NO: 176971 - protein, 10 aa, Mycobacterium tuberculosis
VTIPALTAAR

SEQ ID NO: 176972 - protein, 10 aa, Mycobacterium tuberculosis
TIPALTAARA

SEQ ID NO: 176973 - protein, 10 aa, Mycobacterium tuberculosis
IPALTAARAV

SEQ ID NO: 176974 - protein, 10 aa, Mycobacterium tuberculosis
LTAARAVLDM

SEQ ID NO: 176975 - protein, 10 aa, Mycobacterium tuberculosis
TAARAVLDMA

SEQ ID NO: 176976 - protein, 10 aa, Mycobacterium tuberculosis
RAVLDMAASV

SEQ ID NO: 176977 - protein, 10 aa, Mycobacterium tuberculosis
VLDMAASVGA

SEQ ID NO: 176978 - protein, 10 aa, Mycobacterium tuberculosis
ATSEIEPFIV

SEQ ID NO: 176979 - protein, 10 aa, Mycobacterium tuberculosis
TSEIEPFIVW

SEQ ID NO: 176980 - protein, 10 aa, Mycobacterium tuberculosis
SEIEPFIVWT

SEQ ID NO: 176981 - protein, 10 aa, Mycobacterium tuberculosis
FIVWTSSGAI

SEQ ID NO: 176982 - protein, 10 aa, Mycobacterium tuberculosis
WTSSGAIGPT

SEQ ID NO: 176983 - protein, 10 aa, Mycobacterium tuberculosis
TSSGAIGPTW

SEQ ID NO: 176984 - protein, 10 aa, Mycobacterium tuberculosis
GAIGPTWYSV

SEQ ID NO: 176985 - protein, 10 aa, Mycobacterium tuberculosis
GPTWYSVGRI

SEQ ID NO: 176986 - protein, 10 aa, Mycobacterium tuberculosis
PTWYSVGRIY

SEQ ID NO: 176987 - protein, 10 aa, Mycobacterium tuberculosis
RIYNAGDLFV

SEQ ID NO: 176988 - protein, 10 aa, Mycobacterium tuberculosis
FVGGNIISGI

SEQ ID NO: 176989 - protein, 10 aa, Mycobacterium tuberculosis
IISGIPTLST

SEQ ID NO: 176990 - protein, 10 aa, Mycobacterium tuberculosis
IPTLSTTGPV

SEQ ID NO: 176991 - protein, 10 aa, Mycobacterium tuberculosis
TLSTTGPVHA

SEQ ID NO: 176992 - protein, 10 aa, Mycobacterium tuberculosis
LSTTGPVHAV

SEQ ID NO: 176993 - protein, 10 aa, Mycobacterium tuberculosis
STTGPVHAVF

SEQ ID NO: 176994 - protein, 10 aa, Mycobacterium tuberculosis
GPVHAVFNAA

SEQ ID NO: 176995 - protein, 10 aa, Mycobacterium tuberculosis
AVFNAASQAF

SEQ ID NO: 176996 - protein, 10 aa, Mycobacterium tuberculosis
AASQAFNTPA

SEQ ID NO: 176997 - protein, 10 aa, Mycobacterium tuberculosis
QAFNTPALNI

SEQ ID NO: 176998 - protein, 10 aa, Mycobacterium tuberculosis
NTPALNIHQI

SEQ ID NO: 176999 - protein, 10 aa, Mycobacterium tuberculosis
IPLGFQVPGS

SEQ ID NO: 177000 - protein, 10 aa, Mycobacterium tuberculosis
FQVPGSIDAI

SEQ ID NO: 177001 - protein, 10 aa, Mycobacterium tuberculosis
VPGSIDAITL

SEQ ID NO: 177002 - protein, 10 aa, Mycobacterium tuberculosis
DAITLFPGGL

SEQ ID NO: 177003 - protein, 10 aa, Mycobacterium tuberculosis
ITLFPGGLTF

SEQ ID NO: 177004 - protein, 10 aa, Mycobacterium tuberculosis
TLFPGGLTFP

SEQ ID NO: 177005 - protein, 10 aa, Mycobacterium tuberculosis
FPGGLTFPAN

SEQ ID NO: 177006 - protein, 10 aa, Mycobacterium tuberculosis
GLTFPANSLL

SEQ ID NO: 177007 - protein, 10 aa, Mycobacterium tuberculosis
TFPANSLLNL

SEQ ID NO: 177008 - protein, 10 aa, Mycobacterium tuberculosis
FPANSLLNLD

SEQ ID NO: 177009 - protein, 10 aa, Mycobacterium tuberculosis
NSLLNLDVFV

SEQ ID NO: 177010 - protein, 10 aa, Mycobacterium tuberculosis
SLLNLDVFVG

SEQ ID NO: 177011 - protein, 10 aa, Mycobacterium tuberculosis
LLNLDVFVGT

SEQ ID NO: 177012 - protein, 10 aa, Mycobacterium tuberculosis
GTPGATIPAI

SEQ ID NO: 177013 - protein, 10 aa, Mycobacterium tuberculosis
TPGATIPAIT

SEQ ID NO: 177014 - protein, 10 aa, Mycobacterium tuberculosis
ATIPAITFPE

SEQ ID NO: 177015 - protein, 10 aa, Mycobacterium tuberculosis
TIPAITFPEI

SEQ ID NO: 177016 - protein, 10 aa, Mycobacterium tuberculosis
ITFPEIPANA

SEQ ID NO: 177017 - protein, 10 aa, Mycobacterium tuberculosis
EIPANADGEL

SEQ ID NO: 177018 - protein, 10 aa, Mycobacterium tuberculosis
IPANADGELY

SEQ ID NO: 177019 - protein, 10 aa, Mycobacterium tuberculosis
GELYVIAGDI

SEQ ID NO: 177020 - protein, 10 aa, Mycobacterium tuberculosis
LYVIAGDIPL

SEQ ID NO: 177021 - protein, 10 aa, Mycobacterium tuberculosis
YVIAGDIPLI

SEQ ID NO: 177022 - protein, 10 aa, Mycobacterium tuberculosis
LINIPPTPGI

SEQ ID NO: 177023 - protein, 10 aa, Mycobacterium tuberculosis
IPPTPGIGNT

SEQ ID NO: 177024 - protein, 10 aa, Mycobacterium tuberculosis
TPGIGNTTTV

SEQ ID NO: 177025 - protein, 10 aa, Mycobacterium tuberculosis
TTTVPSSGFF

SEQ ID NO: 177026 - protein, 10 aa, Mycobacterium tuberculosis
TVPSSGFFNT

SEQ ID NO: 177027 - protein, 10 aa, Mycobacterium tuberculosis
NFGANMSGWW

SEQ ID NO: 177028 - protein, 10 aa, Mycobacterium tuberculosis
NMSGWWNQAH

SEQ ID NO: 177029 - protein, 10 aa, Mycobacterium tuberculosis
NQAHTALAGA

SEQ ID NO: 177030 - protein, 10 aa, Mycobacterium tuberculosis
TALAGAGSGI

SEQ ID NO: 177031 - protein, 10 aa, Mycobacterium tuberculosis
ALAGAGSGIA

SEQ ID NO: 177032 - protein, 10 aa, Mycobacterium tuberculosis
GLSGIYNTST

SEQ ID NO: 177033 - protein, 10 aa, Mycobacterium tuberculosis
GIYNTSTLPL

SEQ ID NO: 177034 - protein, 10 aa, Mycobacterium tuberculosis
STLPLGTPAL

SEQ ID NO: 177035 - protein, 10 aa, Mycobacterium tuberculosis
TLPLGTPALV

SEQ ID NO: 177036 - protein, 10 aa, Mycobacterium tuberculosis
LPLGTPALVS

SEQ ID NO: 177037 - protein, 10 aa, Mycobacterium tuberculosis
NVGDHLSGLL

SEQ ID NO: 177038 - protein, 10 aa, Mycobacterium tuberculosis
HLSGLLASNV

SEQ ID NO: 177039 - protein, 10 aa, Mycobacterium tuberculosis
NVGQNPITIV

SEQ ID NO: 177040 - protein, 10 aa, Mycobacterium tuberculosis
GQNPITIVNI

SEQ ID NO: 177041 - protein, 10 aa, Mycobacterium tuberculosis
NPITIVNIGL

SEQ ID NO: 177042 - protein, 10 aa, Mycobacterium tuberculosis
TIVNIGLANV

SEQ ID NO: 177043 - protein, 10 aa, Mycobacterium tuberculosis
GLANVGNGNV

SEQ ID NO: 177044 - protein, 10 aa, Mycobacterium tuberculosis
GLGNIGNLNL

SEQ ID NO: 177045 - protein, 10 aa, Mycobacterium tuberculosis
NLGAANIGDV

SEQ ID NO: 177046 - protein, 10 aa, Mycobacterium tuberculosis
NLGFGNIGDV

SEQ ID NO: 177047 - protein, 10 aa, Mycobacterium tuberculosis
GNIGGGNVGF

SEQ ID NO: 177048 - protein, 10 aa, Mycobacterium tuberculosis
GFGNIGDANF

SEQ ID NO: 177049 - protein, 10 aa, Mycobacterium tuberculosis
ANFGFGNSGL

SEQ ID NO: 177050 - protein, 10 aa, Mycobacterium tuberculosis
GLAGMGNIGL

SEQ ID NO: 177051 - protein, 10 aa, Mycobacterium tuberculosis
GMGNIGLGNA

SEQ ID NO: 177052 - protein, 10 aa, Mycobacterium tuberculosis
GLGNAGSGNV

SEQ ID NO: 177053 - protein, 10 aa, Mycobacterium tuberculosis
GLGNIGFGNT

SEQ ID NO: 177054 - protein, 10 aa, Mycobacterium tuberculosis
GFGNTGTNNL

SEQ ID NO: 177055 - protein, 10 aa, Mycobacterium tuberculosis
GLTGDNQSGI

SEQ ID NO: 177056 - protein, 10 aa, Mycobacterium tuberculosis
GLFNSGTGNI

SEQ ID NO: 177057 - protein, 10 aa, Mycobacterium tuberculosis
FNSGTGNIGF

SEQ ID NO: 177058 - protein, 10 aa, Mycobacterium tuberculosis
GFFNSGTANF

SEQ ID NO: 177059 - protein, 10 aa, Mycobacterium tuberculosis
FNSGTANFGL

SEQ ID NO: 177060 - protein, 10 aa, Mycobacterium tuberculosis
NFGLFNSGSY

SEQ ID NO: 177061 - protein, 10 aa, Mycobacterium tuberculosis
GLFNSGSYNT

SEQ ID NO: 177062 - protein, 10 aa, Mycobacterium tuberculosis
FNSGSYNTGI

SEQ ID NO: 177063 - protein, 10 aa, Mycobacterium tuberculosis
GVASTGLVNA

SEQ ID NO: 177064 - protein, 10 aa, Mycobacterium tuberculosis
VNAGGFNTGV

SEQ ID NO: 177065 - protein, 10 aa, Mycobacterium tuberculosis
NTGVANAGSY

SEQ ID NO: 177066 - protein, 10 aa, Mycobacterium tuberculosis
NAGSYNTGSF

SEQ ID NO: 177067 - protein, 10 aa, Mycobacterium tuberculosis
NAGDTNTGGF

SEQ ID NO: 177068 - protein, 10 aa, Mycobacterium tuberculosis
NPGSTNTGWF

SEQ ID NO: 177069 - protein, 10 aa, Mycobacterium tuberculosis
NTGWFNTGNA

SEQ ID NO: 177070 - protein, 10 aa, Mycobacterium tuberculosis
FNTGNANTGV

SEQ ID NO: 177071 - protein, 10 aa, Mycobacterium tuberculosis
NTGVANAGNV

SEQ ID NO: 177072 - protein, 10 aa, Mycobacterium tuberculosis
NAGNVNTGAL

SEQ ID NO: 177073 - protein, 10 aa, Mycobacterium tuberculosis
LITGNFSNGI

SEQ ID NO: 177074 - protein, 10 aa, Mycobacterium tuberculosis
TGNFSNGILW

SEQ ID NO: 177075 - protein, 10 aa, Mycobacterium tuberculosis
ILWRGNYEGL

SEQ ID NO: 177076 - protein, 10 aa, Mycobacterium tuberculosis
NYEGLAGFSF

SEQ ID NO: 177077 - protein, 10 aa, Mycobacterium tuberculosis
EGLAGFSFGY

SEQ ID NO: 177078 - protein, 10 aa, Mycobacterium tuberculosis
LAGFSFGYPI

SEQ ID NO: 177079 - protein, 10 aa, Mycobacterium tuberculosis
FSFGYPIPLF

SEQ ID NO: 177080 - protein, 10 aa, Mycobacterium tuberculosis
FGYPIPLFPA

SEQ ID NO: 177081 - protein, 10 aa, Mycobacterium tuberculosis
GYPIPLFPAV

SEQ ID NO: 177082 - protein, 10 aa, Mycobacterium tuberculosis
YPIPLFPAVG

SEQ ID NO: 177083 - protein, 10 aa, Mycobacterium tuberculosis
PLFPAVGADV

SEQ ID NO: 177084 - protein, 10 aa, Mycobacterium tuberculosis
FPAVGADVTG

SEQ ID NO: 177085 - protein, 10 aa, Mycobacterium tuberculosis
VTGDIGPATI

SEQ ID NO: 177086 - protein, 10 aa, Mycobacterium tuberculosis
TIIPPIHIPS

SEQ ID NO: 177087 - protein, 10 aa, Mycobacterium tuberculosis
IIPPIHIPSI

SEQ ID NO: 177088 - protein, 10 aa, Mycobacterium tuberculosis
PPIHIPSIPL

SEQ ID NO: 177089 - protein, 10 aa, Mycobacterium tuberculosis
IHIPSIPLGF

SEQ ID NO: 177090 - protein, 10 aa, Mycobacterium tuberculosis
HIPSIPLGFA

SEQ ID NO: 177091 - protein, 10 aa, Mycobacterium tuberculosis
IPSIPLGFAA

SEQ ID NO: 177092 - protein, 10 aa, Mycobacterium tuberculosis
IPLGFAAIGH

SEQ ID NO: 177093 - protein, 10 aa, Mycobacterium tuberculosis
FAAIGHIGPI

SEQ ID NO: 177094 - protein, 10 aa, Mycobacterium tuberculosis
AIGHIGPISI

SEQ ID NO: 177095 - protein, 10 aa, Mycobacterium tuberculosis
HIGPISIPNI

SEQ ID NO: 177096 - protein, 10 aa, Mycobacterium tuberculosis
GPISIPNIAI

SEQ ID NO: 177097 - protein, 10 aa, Mycobacterium tuberculosis
SIPNIAIPSI

SEQ ID NO: 177098 - protein, 10 aa, Mycobacterium tuberculosis
IPNIAIPSIH

SEQ ID NO: 177099 - protein, 10 aa, Mycobacterium tuberculosis
IAIPSIHLGI

SEQ ID NO: 177100 - protein, 10 aa, Mycobacterium tuberculosis
HLGIDPTFDV

SEQ ID NO: 177101 - protein, 10 aa, Mycobacterium tuberculosis
PTFDVGPITV

SEQ ID NO: 177102 - protein, 10 aa, Mycobacterium tuberculosis
DVGPITVDPI

SEQ ID NO: 177103 - protein, 10 aa, Mycobacterium tuberculosis
GPITVDPITL

SEQ ID NO: 177104 - protein, 10 aa, Mycobacterium tuberculosis
ITVDPITLTI

SEQ ID NO: 177105 - protein, 10 aa, Mycobacterium tuberculosis
DPITLTIPGL

SEQ ID NO: 177106 - protein, 10 aa, Mycobacterium tuberculosis
LTIPGLSLDA

SEQ ID NO: 177107 - protein, 10 aa, Mycobacterium tuberculosis
TIPGLSLDAA

SEQ ID NO: 177108 - protein, 10 aa, Mycobacterium tuberculosis
IPGLSLDAAV

SEQ ID NO: 177109 - protein, 10 aa, Mycobacterium tuberculosis
SEIRMTSGSS

SEQ ID NO: 177110 - protein, 10 aa, Mycobacterium tuberculosis
RMTSGSSSGF

SEQ ID NO: 177111 - protein, 10 aa, Mycobacterium tuberculosis
MTSGSSSGFK

SEQ ID NO: 177112 - protein, 10 aa, Mycobacterium tuberculosis
GFKVRPSFSF

SEQ ID NO: 177113 - protein, 10 aa, Mycobacterium tuberculosis
FKVRPSFSFF

SEQ ID NO: 177114 - protein, 10 aa, Mycobacterium tuberculosis
KVRPSFSFFA

SEQ ID NO: 177115 - protein, 10 aa, Mycobacterium tuberculosis
RPSFSFFAVG

SEQ ID NO: 177116 - protein, 10 aa, Mycobacterium tuberculosis
GMPGGEVSIL

SEQ ID NO: 177117 - protein, 10 aa, Mycobacterium tuberculosis
EVSILQPFTV

SEQ ID NO: 177118 - protein, 10 aa, Mycobacterium tuberculosis
ILQPFTVAPI

SEQ ID NO: 177119 - protein, 10 aa, Mycobacterium tuberculosis
QPFTVAPINL

SEQ ID NO: 177120 - protein, 10 aa, Mycobacterium tuberculosis
TVAPINLNPT

SEQ ID NO: 177121 - protein, 10 aa, Mycobacterium tuberculosis
APINLNPTTL

SEQ ID NO: 177122 - protein, 10 aa, Mycobacterium tuberculosis
NLNPTTLHFP

SEQ ID NO: 177123 - protein, 10 aa, Mycobacterium tuberculosis
NPTTLHFPGF

SEQ ID NO: 177124 - protein, 10 aa, Mycobacterium tuberculosis
TTLHFPGFTI

SEQ ID NO: 177125 - protein, 10 aa, Mycobacterium tuberculosis
FPGFTIPTGP

SEQ ID NO: 177126 - protein, 10 aa, Mycobacterium tuberculosis
FTIPTGPIHI

SEQ ID NO: 177127 - protein, 10 aa, Mycobacterium tuberculosis
IPTGPIHIGL

SEQ ID NO: 177128 - protein, 10 aa, Mycobacterium tuberculosis
PIHIGLPLSL

SEQ ID NO: 177129 - protein, 10 aa, Mycobacterium tuberculosis
LPLSLTIPGF

SEQ ID NO: 177130 - protein, 10 aa, Mycobacterium tuberculosis
IPGFTIPGGT

SEQ ID NO: 177131 - protein, 10 aa, Mycobacterium tuberculosis
FTIPGGTLIP

SEQ ID NO: 177132 - protein, 10 aa, Mycobacterium tuberculosis
TIPGGTLIPQ

SEQ ID NO: 177133 - protein, 10 aa, Mycobacterium tuberculosis
IPGGTLIPQL

SEQ ID NO: 177134 - protein, 10 aa, Mycobacterium tuberculosis
TLIPQLPLGL

SEQ ID NO: 177135 - protein, 10 aa, Mycobacterium tuberculosis
IPQLPLGLGL

SEQ ID NO: 177136 - protein, 10 aa, Mycobacterium tuberculosis
LPLGLGLSGG

SEQ ID NO: 177137 - protein, 10 aa, Mycobacterium tuberculosis
LGLSGGTPPF

SEQ ID NO: 177138 - protein, 10 aa, Mycobacterium tuberculosis
GTPPFDLPTV

SEQ ID NO: 177139 - protein, 10 aa, Mycobacterium tuberculosis
TPPFDLPTVV

SEQ ID NO: 177140 - protein, 10 aa, Mycobacterium tuberculosis
PPFDLPTVVI

SEQ ID NO: 177141 - protein, 10 aa, Mycobacterium tuberculosis
DLPTVVIDRI

SEQ ID NO: 177142 - protein, 10 aa, Mycobacterium tuberculosis
LPTVVIDRIP

SEQ ID NO: 177143 - protein, 10 aa, Mycobacterium tuberculosis
VVIDRIPVEL

SEQ ID NO: 177144 - protein, 10 aa, Mycobacterium tuberculosis
IPVELHASTT

SEQ ID NO: 177145 - protein, 10 aa, Mycobacterium tuberculosis
TTIGPVSLPI

SEQ ID NO: 177146 - protein, 10 aa, Mycobacterium tuberculosis
TIGPVSLPIF

SEQ ID NO: 177147 - protein, 10 aa, Mycobacterium tuberculosis
GPVSLPIFGF

SEQ ID NO: 177148 - protein, 10 aa, Mycobacterium tuberculosis
SLPIFGFGGA

SEQ ID NO: 177149 - protein, 10 aa, Mycobacterium tuberculosis
LPIFGFGGAP

SEQ ID NO: 177150 - protein, 10 aa, Mycobacterium tuberculosis
IFGFGGAPGF

SEQ ID NO: 177151 - protein, 10 aa, Mycobacterium tuberculosis
DTTAPSSGFF

SEQ ID NO: 177152 - protein, 10 aa, Mycobacterium tuberculosis
TTAPSSGFFN

SEQ ID NO: 177153 - protein, 10 aa, Mycobacterium tuberculosis
SGMSGVLNAI

SEQ ID NO: 177154 - protein, 10 aa, Mycobacterium tuberculosis
GVLNAISDPL

SEQ ID NO: 177155 - protein, 10 aa, Mycobacterium tuberculosis
VLNAISDPLL

SEQ ID NO: 177156 - protein, 10 aa, Mycobacterium tuberculosis
AISDPLLGSA

SEQ ID NO: 177157 - protein, 10 aa, Mycobacterium tuberculosis
DPLLGSASGF

SEQ ID NO: 177158 - protein, 10 aa, Mycobacterium tuberculosis
PLLGSASGFA

SEQ ID NO: 177159 - protein, 10 aa, Mycobacterium tuberculosis
GTQLSGILNR

SEQ ID NO: 177160 - protein, 10 aa, Mycobacterium tuberculosis
QLSGILNRGA

SEQ ID NO: 177161 - protein, 10 aa, Mycobacterium tuberculosis
GVYNTGTLGL

SEQ ID NO: 177162 - protein, 10 aa, Mycobacterium tuberculosis
VYNTGTLGLV

SEQ ID NO: 177163 - protein, 10 aa, Mycobacterium tuberculosis
GTLGLVTSAF

SEQ ID NO: 177164 - protein, 10 aa, Mycobacterium tuberculosis
TLGLVTSAFV

SEQ ID NO: 177165 - protein, 10 aa, Mycobacterium tuberculosis
VTSAFVSGFM

SEQ ID NO: 177166 - protein, 10 aa, Mycobacterium tuberculosis
SAFVSGFMNV

SEQ ID NO: 177167 - protein, 10 aa, Mycobacterium tuberculosis
FVSGFMNVGQ

SEQ ID NO: 177168 - protein, 10 aa, Mycobacterium tuberculosis
FMNVGQQLSG

SEQ ID NO: 177169 - protein, 10 aa, Mycobacterium tuberculosis
GQQLSGLLFA

SEQ ID NO: 177170 - protein, 10 aa, Mycobacterium tuberculosis
QQLSGLLFAG

SEQ ID NO: 177171 - protein, 10 aa, Mycobacterium tuberculosis
QLSGLLFAGT

SEQ ID NO: 177172 - protein, 11 aa, Mycobacterium tuberculosis
FPVLPPEINSV

SEQ ID NO: 177173 - protein, 11 aa, Mycobacterium tuberculosis
PVLPPEINSVL

SEQ ID NO: 177174 - protein, 11 aa, Mycobacterium tuberculosis
VLPPEINSVLM

SEQ ID NO: 177175 - protein, 11 aa, Mycobacterium tuberculosis
LPPEINSVLMY

SEQ ID NO: 177176 - protein, 11 aa, Mycobacterium tuberculosis
EINSVLMYSGA

SEQ ID NO: 177177 - protein, 11 aa, Mycobacterium tuberculosis
LMYSGAGSSPL

SEQ ID NO: 177178 - protein, 11 aa, Mycobacterium tuberculosis
MYSGAGSSPLL

SEQ ID NO: 177179 - protein, 11 aa, Mycobacterium tuberculosis
LLAAAAAWDGL

SEQ ID NO: 177180 - protein, 11 aa, Mycobacterium tuberculosis
AAAWDGLAEEL

SEQ ID NO: 177181 - protein, 11 aa, Mycobacterium tuberculosis
GLAEELGSAAV

SEQ ID NO: 177182 - protein, 11 aa, Mycobacterium tuberculosis
AEELGSAAVSF

SEQ ID NO: 177183 - protein, 11 aa, Mycobacterium tuberculosis
ELGSAAVSFGQ

SEQ ID NO: 177184 - protein, 11 aa, Mycobacterium tuberculosis
LGSAAVSFGQV

SEQ ID NO: 177185 - protein, 11 aa, Mycobacterium tuberculosis
AVSFGQVTSGL

SEQ ID NO: 177186 - protein, 11 aa, Mycobacterium tuberculosis
GQVTSGLTAGV

SEQ ID NO: 177187 - protein, 11 aa, Mycobacterium tuberculosis
QVTSGLTAGVW

SEQ ID NO: 177188 - protein, 11 aa, Mycobacterium tuberculosis
GLTAGVWQGAA

SEQ ID NO: 177189 - protein, 11 aa, Mycobacterium tuberculosis
LTAGVWQGAAA

SEQ ID NO: 177190 - protein, 11 aa, Mycobacterium tuberculosis
GVWQGAAAAAM

SEQ ID NO: 177191 - protein, 11 aa, Mycobacterium tuberculosis
WQGAAAAAMAA

SEQ ID NO: 177192 - protein, 11 aa, Mycobacterium tuberculosis
QGAAAAAMAAA

SEQ ID NO: 177193 - protein, 11 aa, Mycobacterium tuberculosis
AAAAAMAAAAA

SEQ ID NO: 177194 - protein, 11 aa, Mycobacterium tuberculosis
AAAMAAAAAPY

SEQ ID NO: 177195 - protein, 11 aa, Mycobacterium tuberculosis
AAMAAAAAPYA

SEQ ID NO: 177196 - protein, 11 aa, Mycobacterium tuberculosis
MAAAAAPYAGW

SEQ ID NO: 177197 - protein, 11 aa, Mycobacterium tuberculosis
AAAAAPYAGWL

SEQ ID NO: 177198 - protein, 11 aa, Mycobacterium tuberculosis
AAPYAGWLGSV

SEQ ID NO: 177199 - protein, 11 aa, Mycobacterium tuberculosis
APYAGWLGSVA

SEQ ID NO: 177200 - protein, 11 aa, Mycobacterium tuberculosis
YAGWLGSVAAQ

SEQ ID NO: 177201 - protein, 11 aa, Mycobacterium tuberculosis
WLGSVAAQAVA

SEQ ID NO: 177202 - protein, 11 aa, Mycobacterium tuberculosis
AQAVAVAGQAR

SEQ ID NO: 177203 - protein, 11 aa, Mycobacterium tuberculosis
QAVAVAGQARA

SEQ ID NO: 177204 - protein, 11 aa, Mycobacterium tuberculosis
VAVAGQARAAV

SEQ ID NO: 177205 - protein, 11 aa, Mycobacterium tuberculosis
AGQARAAVAAF

SEQ ID NO: 177206 - protein, 11 aa, Mycobacterium tuberculosis
RAAVAAFEAAL

SEQ ID NO: 177207 - protein, 11 aa, Mycobacterium tuberculosis
AAVAAFEAALA

SEQ ID NO: 177208 - protein, 11 aa, Mycobacterium tuberculosis
AVAAFEAALAA

SEQ ID NO: 177209 - protein, 11 aa, Mycobacterium tuberculosis
AAFEAALAATV

SEQ ID NO: 177210 - protein, 11 aa, Mycobacterium tuberculosis
EAALAATVDPA

SEQ ID NO: 177211 - protein, 11 aa, Mycobacterium tuberculosis
AALAATVDPAA

SEQ ID NO: 177212 - protein, 11 aa, Mycobacterium tuberculosis
ALAATVDPAAV

SEQ ID NO: 177213 - protein, 11 aa, Mycobacterium tuberculosis
TVDPAAVAVNR

SEQ ID NO: 177214 - protein, 11 aa, Mycobacterium tuberculosis
PAAVAVNRMAM

SEQ ID NO: 177215 - protein, 11 aa, Mycobacterium tuberculosis
AAVAVNRMAMR

SEQ ID NO: 177216 - protein, 11 aa, Mycobacterium tuberculosis
AVAVNRMAMRA

SEQ ID NO: 177217 - protein, 11 aa, Mycobacterium tuberculosis
VAVNRMAMRAL

SEQ ID NO: 177218 - protein, 11 aa, Mycobacterium tuberculosis
AVNRMAMRALA

SEQ ID NO: 177219 - protein, 11 aa, Mycobacterium tuberculosis
RMAMRALAMSN

SEQ ID NO: 177220 - protein, 11 aa, Mycobacterium tuberculosis
MAMRALAMSNL

SEQ ID NO: 177221 - protein, 11 aa, Mycobacterium tuberculosis
AMRALAMSNLL

SEQ ID NO: 177222 - protein, 11 aa, Mycobacterium tuberculosis
AMSNLLGQNAA

SEQ ID NO: 177223 - protein, 11 aa, Mycobacterium tuberculosis
MSNLLGQNAAA

SEQ ID NO: 177224 - protein, 11 aa, Mycobacterium tuberculosis
NLLGQNAAAIA

SEQ ID NO: 177225 - protein, 11 aa, Mycobacterium tuberculosis
LLGQNAAAIAA

SEQ ID NO: 177226 - protein, 11 aa, Mycobacterium tuberculosis
AAAIAAVEAEY

SEQ ID NO: 177227 - protein, 11 aa, Mycobacterium tuberculosis
AIAAVEAEYEL

SEQ ID NO: 177228 - protein, 11 aa, Mycobacterium tuberculosis
IAAVEAEYELM

SEQ ID NO: 177229 - protein, 11 aa, Mycobacterium tuberculosis
AAVEAEYELMW

SEQ ID NO: 177230 - protein, 11 aa, Mycobacterium tuberculosis
VEAEYELMWAA

SEQ ID NO: 177231 - protein, 11 aa, Mycobacterium tuberculosis
AEYELMWAADV

SEQ ID NO: 177232 - protein, 11 aa, Mycobacterium tuberculosis
YELMWAADVAA

SEQ ID NO: 177233 - protein, 11 aa, Mycobacterium tuberculosis
ELMWAADVAAM

SEQ ID NO: 177234 - protein, 11 aa, Mycobacterium tuberculosis
LMWAADVAAMA

SEQ ID NO: 177235 - protein, 11 aa, Mycobacterium tuberculosis
WAADVAAMAGY

SEQ ID NO: 177236 - protein, 11 aa, Mycobacterium tuberculosis
AMAGYHSGASA

SEQ ID NO: 177237 - protein, 11 aa, Mycobacterium tuberculosis
MAGYHSGASAA

SEQ ID NO: 177238 - protein, 11 aa, Mycobacterium tuberculosis
ASAAAAALPAF

SEQ ID NO: 177239 - protein, 11 aa, Mycobacterium tuberculosis
AAALPAFSPPA

SEQ ID NO: 177240 - protein, 11 aa, Mycobacterium tuberculosis
ALPAFSPPAQA

SEQ ID NO: 177241 - protein, 11 aa, Mycobacterium tuberculosis
LPAFSPPAQAL

SEQ ID NO: 177242 - protein, 11 aa, Mycobacterium tuberculosis
AQALGGGVGAF

SEQ ID NO: 177243 - protein, 11 aa, Mycobacterium tuberculosis
QALGGGVGAFL

SEQ ID NO: 177244 - protein, 11 aa, Mycobacterium tuberculosis
ALGGGVGAFLN

SEQ ID NO: 177245 - protein, 11 aa, Mycobacterium tuberculosis
FLNALFAGPAK

SEQ ID NO: 177246 - protein, 11 aa, Mycobacterium tuberculosis
NALFAGPAKML

SEQ ID NO: 177247 - protein, 11 aa, Mycobacterium tuberculosis
ALFAGPAKMLR

SEQ ID NO: 177248 - protein, 11 aa, Mycobacterium tuberculosis
MLRLNAGLGNV

SEQ ID NO: 177249 - protein, 11 aa, Mycobacterium tuberculosis
YNVGLGNVGIF

SEQ ID NO: 177250 - protein, 11 aa, Mycobacterium tuberculosis
AANAGSGNFGF

SEQ ID NO: 177251 - protein, 11 aa, Mycobacterium tuberculosis
NANFGFGNSGL

SEQ ID NO: 177252 - protein, 11 aa, Mycobacterium tuberculosis
GLGLPPGMGNI

SEQ ID NO: 177253 - protein, 11 aa, Mycobacterium tuberculosis
GLPPGMGNIGL

SEQ ID NO: 177254 - protein, 11 aa, Mycobacterium tuberculosis
LPPGMGNIGLG

SEQ ID NO: 177255 - protein, 11 aa, Mycobacterium tuberculosis
LGNAGSSNYGL

SEQ ID NO: 177256 - protein, 11 aa, Mycobacterium tuberculosis
SSNYGLANLGV

SEQ ID NO: 177257 - protein, 11 aa, Mycobacterium tuberculosis
LANLGVGNIGF

SEQ ID NO: 177258 - protein, 11 aa, Mycobacterium tuberculosis
FANTGSNNIGI

SEQ ID NO: 177259 - protein, 11 aa, Mycobacterium tuberculosis
NTGSNNIGIGL

SEQ ID NO: 177260 - protein, 11 aa, Mycobacterium tuberculosis
GLNSGTGNLGL

SEQ ID NO: 177261 - protein, 11 aa, Mycobacterium tuberculosis
LFNSGTGNIGF

SEQ ID NO: 177262 - protein, 11 aa, Mycobacterium tuberculosis
FFNSGTGNFGV

SEQ ID NO: 177263 - protein, 11 aa, Mycobacterium tuberculosis
FNSGTGNFGVF

SEQ ID NO: 177264 - protein, 11 aa, Mycobacterium tuberculosis
GNFGVFNSGSY

SEQ ID NO: 177265 - protein, 11 aa, Mycobacterium tuberculosis
VFNSGSYNTGV

SEQ ID NO: 177266 - protein, 11 aa, Mycobacterium tuberculosis
TNTGGFNPGNV

SEQ ID NO: 177267 - protein, 11 aa, Mycobacterium tuberculosis
GFNPGNVNTGW

SEQ ID NO: 177268 - protein, 11 aa, Mycobacterium tuberculosis
WLNTGNTNTGI

SEQ ID NO: 177269 - protein, 11 aa, Mycobacterium tuberculosis
TNTGIANSGNV

SEQ ID NO: 177270 - protein, 11 aa, Mycobacterium tuberculosis
AFISGNFSNGV

SEQ ID NO: 177271 - protein, 11 aa, Mycobacterium tuberculosis
FISGNFSNGVL

SEQ ID NO: 177272 - protein, 11 aa, Mycobacterium tuberculosis
ISGNFSNGVLW

SEQ ID NO: 177273 - protein, 11 aa, Mycobacterium tuberculosis
FSNGVLWRGDY

SEQ ID NO: 177274 - protein, 11 aa, Mycobacterium tuberculosis
GVLWRGDYEGL

SEQ ID NO: 177275 - protein, 11 aa, Mycobacterium tuberculosis
VLWRGDYEGLW

SEQ ID NO: 177276 - protein, 11 aa, Mycobacterium tuberculosis
GLWGLSGGSTI

SEQ ID NO: 177277 - protein, 11 aa, Mycobacterium tuberculosis
GLSGGSTIPAI

SEQ ID NO: 177278 - protein, 11 aa, Mycobacterium tuberculosis
TIPAIPIGLEL

SEQ ID NO: 177279 - protein, 11 aa, Mycobacterium tuberculosis
IPIGLELNGGV

SEQ ID NO: 177280 - protein, 11 aa, Mycobacterium tuberculosis
GLELNGGVGPI

SEQ ID NO: 177281 - protein, 11 aa, Mycobacterium tuberculosis
ELNGGVGPITV

SEQ ID NO: 177282 - protein, 11 aa, Mycobacterium tuberculosis
GPITVLPIQIL

SEQ ID NO: 177283 - protein, 11 aa, Mycobacterium tuberculosis
TVLPIQILPTI

SEQ ID NO: 177284 - protein, 11 aa, Mycobacterium tuberculosis
LPIQILPTIPL

SEQ ID NO: 177285 - protein, 11 aa, Mycobacterium tuberculosis
IQILPTIPLNI

SEQ ID NO: 177286 - protein, 11 aa, Mycobacterium tuberculosis
ILPTIPLNIHQ

SEQ ID NO: 177287 - protein, 11 aa, Mycobacterium tuberculosis
LPTIPLNIHQT

SEQ ID NO: 177288 - protein, 11 aa, Mycobacterium tuberculosis
PTIPLNIHQTF

SEQ ID NO: 177289 - protein, 11 aa, Mycobacterium tuberculosis
IPLNIHQTFSL

SEQ ID NO: 177290 - protein, 11 aa, Mycobacterium tuberculosis
NIHQTFSLGPL

SEQ ID NO: 177291 - protein, 11 aa, Mycobacterium tuberculosis
HQTFSLGPLVV

SEQ ID NO: 177292 - protein, 11 aa, Mycobacterium tuberculosis
SLGPLVVPDIV

SEQ ID NO: 177293 - protein, 11 aa, Mycobacterium tuberculosis
PLVVPDIVIPA

SEQ ID NO: 177294 - protein, 11 aa, Mycobacterium tuberculosis
LVVPDIVIPAF

SEQ ID NO: 177295 - protein, 11 aa, Mycobacterium tuberculosis
IVIPAFGGGTA

SEQ ID NO: 177296 - protein, 11 aa, Mycobacterium tuberculosis
VIPAFGGGTAI

SEQ ID NO: 177297 - protein, 11 aa, Mycobacterium tuberculosis
FGGGTAIPISV

SEQ ID NO: 177298 - protein, 11 aa, Mycobacterium tuberculosis
GTAIPISVGPI

SEQ ID NO: 177299 - protein, 11 aa, Mycobacterium tuberculosis
AIPISVGPITI

SEQ ID NO: 177300 - protein, 11 aa, Mycobacterium tuberculosis
IPISVGPITIS

SEQ ID NO: 177301 - protein, 11 aa, Mycobacterium tuberculosis
ISVGPITISPI

SEQ ID NO: 177302 - protein, 11 aa, Mycobacterium tuberculosis
GPITISPITLF

SEQ ID NO: 177303 - protein, 11 aa, Mycobacterium tuberculosis
ITISPITLFPA

SEQ ID NO: 177304 - protein, 11 aa, Mycobacterium tuberculosis
SPITLFPAQNF

SEQ ID NO: 177305 - protein, 11 aa, Mycobacterium tuberculosis
TLFPAQNFNTT

SEQ ID NO: 177306 - protein, 11 aa, Mycobacterium tuberculosis
LFPAQNFNTTF

SEQ ID NO: 177307 - protein, 11 aa, Mycobacterium tuberculosis
FPAQNFNTTFP

SEQ ID NO: 177308 - protein, 11 aa, Mycobacterium tuberculosis
PAQNFNTTFPV

SEQ ID NO: 177309 - protein, 11 aa, Mycobacterium tuberculosis
NFNTTFPVGPF

SEQ ID NO: 177310 - protein, 11 aa, Mycobacterium tuberculosis
TTFPVGPFFGL

SEQ ID NO: 177311 - protein, 11 aa, Mycobacterium tuberculosis
FPVGPFFGLGV

SEQ ID NO: 177312 - protein, 11 aa, Mycobacterium tuberculosis
PVGPFFGLGVV

SEQ ID NO: 177313 - protein, 11 aa, Mycobacterium tuberculosis
GPFFGLGVVNI

SEQ ID NO: 177314 - protein, 11 aa, Mycobacterium tuberculosis
FGLGVVNISGI

SEQ ID NO: 177315 - protein, 11 aa, Mycobacterium tuberculosis
GVVNISGIEIK

SEQ ID NO: 177316 - protein, 11 aa, Mycobacterium tuberculosis
NISGIEIKDLA

SEQ ID NO: 177317 - protein, 11 aa, Mycobacterium tuberculosis
EIKDLAGNVTL

SEQ ID NO: 177318 - protein, 11 aa, Mycobacterium tuberculosis
LQLGNLNIDTR

SEQ ID NO: 177319 - protein, 11 aa, Mycobacterium tuberculosis
QLGNLNIDTRI

SEQ ID NO: 177320 - protein, 11 aa, Mycobacterium tuberculosis
LNIDTRINQSF

SEQ ID NO: 177321 - protein, 11 aa, Mycobacterium tuberculosis
TRINQSFPVTV

SEQ ID NO: 177322 - protein, 11 aa, Mycobacterium tuberculosis
QSFPVTVNWST

SEQ ID NO: 177323 - protein, 11 aa, Mycobacterium tuberculosis
FPVTVNWSTPA

SEQ ID NO: 177324 - protein, 11 aa, Mycobacterium tuberculosis
PVTVNWSTPAV

SEQ ID NO: 177325 - protein, 11 aa, Mycobacterium tuberculosis
TVNWSTPAVTI

SEQ ID NO: 177326 - protein, 11 aa, Mycobacterium tuberculosis
TPAVTIFPNGI

SEQ ID NO: 177327 - protein, 11 aa, Mycobacterium tuberculosis
FPNGISIPNNP

SEQ ID NO: 177328 - protein, 11 aa, Mycobacterium tuberculosis
SIPNNPLALLA

SEQ ID NO: 177329 - protein, 11 aa, Mycobacterium tuberculosis
IPNNPLALLAS

SEQ ID NO: 177330 - protein, 11 aa, Mycobacterium tuberculosis
NPLALLASASI

SEQ ID NO: 177331 - protein, 11 aa, Mycobacterium tuberculosis
ALLASASIGTL

SEQ ID NO: 177332 - protein, 11 aa, Mycobacterium tuberculosis
LLASASIGTLG

SEQ ID NO: 177333 - protein, 11 aa, Mycobacterium tuberculosis
LASASIGTLGF

SEQ ID NO: 177334 - protein, 11 aa, Mycobacterium tuberculosis
SASIGTLGFTI

SEQ ID NO: 177335 - protein, 11 aa, Mycobacterium tuberculosis
TLGFTIPGFTI

SEQ ID NO: 177336 - protein, 11 aa, Mycobacterium tuberculosis
FTIPGFTIPAA

SEQ ID NO: 177337 - protein, 11 aa, Mycobacterium tuberculosis
IPGFTIPAAPL

SEQ ID NO: 177338 - protein, 11 aa, Mycobacterium tuberculosis
FTIPAAPLPLT

SEQ ID NO: 177339 - protein, 11 aa, Mycobacterium tuberculosis
TIPAAPLPLTI

SEQ ID NO: 177340 - protein, 11 aa, Mycobacterium tuberculosis
LPLTIDIDGQI

SEQ ID NO: 177341 - protein, 11 aa, Mycobacterium tuberculosis
TIDIDGQIDGF

SEQ ID NO: 177342 - protein, 11 aa, Mycobacterium tuberculosis
GQIDGFSTPPI

SEQ ID NO: 177343 - protein, 11 aa, Mycobacterium tuberculosis
GFSTPPITIDR

SEQ ID NO: 177344 - protein, 11 aa, Mycobacterium tuberculosis
FSTPPITIDRI

SEQ ID NO: 177345 - protein, 11 aa, Mycobacterium tuberculosis
TPPITIDRIPL

SEQ ID NO: 177346 - protein, 11 aa, Mycobacterium tuberculosis
TIDRIPLNLGA

SEQ ID NO: 177347 - protein, 11 aa, Mycobacterium tuberculosis
IPLNLGASVTV

SEQ ID NO: 177348 - protein, 11 aa, Mycobacterium tuberculosis
NLGASVTVGPI

SEQ ID NO: 177349 - protein, 11 aa, Mycobacterium tuberculosis
VTVGPILINGV

SEQ ID NO: 177350 - protein, 11 aa, Mycobacterium tuberculosis
ILINGVNIPAT

SEQ ID NO: 177351 - protein, 11 aa, Mycobacterium tuberculosis
IPATPGFGNTT

SEQ ID NO: 177352 - protein, 11 aa, Mycobacterium tuberculosis
NTTTAPSSGFF

SEQ ID NO: 177353 - protein, 11 aa, Mycobacterium tuberculosis
TTAPSSGFFNS

SEQ ID NO: 177354 - protein, 11 aa, Mycobacterium tuberculosis
SGFFNSGDGGV

SEQ ID NO: 177355 - protein, 11 aa, Mycobacterium tuberculosis
FGNFGAGSSGW

SEQ ID NO: 177356 - protein, 11 aa, Mycobacterium tuberculosis
SGWWNQAQTEV

SEQ ID NO: 177357 - protein, 11 aa, Mycobacterium tuberculosis
QTEVAGAGSGF

SEQ ID NO: 177358 - protein, 11 aa, Mycobacterium tuberculosis
FANFGSLGSGV

SEQ ID NO: 177359 - protein, 11 aa, Mycobacterium tuberculosis
SLGSGVLNFGS

SEQ ID NO: 177360 - protein, 11 aa, Mycobacterium tuberculosis
VLNFGSGVSGL

SEQ ID NO: 177361 - protein, 11 aa, Mycobacterium tuberculosis
LNFGSGVSGLY

SEQ ID NO: 177362 - protein, 11 aa, Mycobacterium tuberculosis
GVSGLYNTGGL

SEQ ID NO: 177363 - protein, 11 aa, Mycobacterium tuberculosis
NTGGLPPGTPA

SEQ ID NO: 177364 - protein, 11 aa, Mycobacterium tuberculosis
GLPPGTPAVVS

SEQ ID NO: 177365 - protein, 11 aa, Mycobacterium tuberculosis
LPPGTPAVVSG

SEQ ID NO: 177366 - protein, 11 aa, Mycobacterium tuberculosis
PPGTPAVVSGI

SEQ ID NO: 177367 - protein, 11 aa, Mycobacterium tuberculosis
TPAVVSGIGNV

SEQ ID NO: 177368 - protein, 11 aa, Mycobacterium tuberculosis
QLSGLSSAGTA

SEQ ID NO: 177369 - protein, 11 aa, Mycobacterium tuberculosis
SSAGTALNQSL

SEQ ID NO: 177370 - protein, 11 aa, Mycobacterium tuberculosis
TALNQSLIINL

SEQ ID NO: 177371 - protein, 11 aa, Mycobacterium tuberculosis
NQSLIINLGLA

SEQ ID NO: 177372 - protein, 11 aa, Mycobacterium tuberculosis
SLIINLGLADV

SEQ ID NO: 177373 - protein, 11 aa, Mycobacterium tuberculosis
LADVGSVNVGF

SEQ ID NO: 177374 - protein, 11 aa, Mycobacterium tuberculosis
FGNIGDANFGL

SEQ ID NO: 177375 - protein, 11 aa, Mycobacterium tuberculosis
GLGNAGLAAGL

SEQ ID NO: 177376 - protein, 11 aa, Mycobacterium tuberculosis
NAGLAAGLAGV

SEQ ID NO: 177377 - protein, 11 aa, Mycobacterium tuberculosis
LAAGLAGVGNI

SEQ ID NO: 177378 - protein, 11 aa, Mycobacterium tuberculosis
SGNVGFGNMGV

SEQ ID NO: 177379 - protein, 11 aa, Mycobacterium tuberculosis
NTGTNNLGIGL

SEQ ID NO: 177380 - protein, 11 aa, Mycobacterium tuberculosis
GLNSGAGNIGL

SEQ ID NO: 177381 - protein, 11 aa, Mycobacterium tuberculosis
LFNAGNFNTGV

SEQ ID NO: 177382 - protein, 11 aa, Mycobacterium tuberculosis
GFNPGSINTGW

SEQ ID NO: 177383 - protein, 11 aa, Mycobacterium tuberculosis
ALMSGNFSNGI

SEQ ID NO: 177384 - protein, 11 aa, Mycobacterium tuberculosis
LMSGNFSNGIL

SEQ ID NO: 177385 - protein, 11 aa, Mycobacterium tuberculosis
MSGNFSNGILW

SEQ ID NO: 177386 - protein, 11 aa, Mycobacterium tuberculosis
FSNGILWRGNF

SEQ ID NO: 177387 - protein, 11 aa, Mycobacterium tuberculosis
GILWRGNFEGL

SEQ ID NO: 177388 - protein, 11 aa, Mycobacterium tuberculosis
ILWRGNFEGLF

SEQ ID NO: 177389 - protein, 11 aa, Mycobacterium tuberculosis
GNFEGLFGLNV

SEQ ID NO: 177390 - protein, 11 aa, Mycobacterium tuberculosis
FEGLFGLNVGI

SEQ ID NO: 177391 - protein, 11 aa, Mycobacterium tuberculosis
GLFGLNVGITI

SEQ ID NO: 177392 - protein, 11 aa, Mycobacterium tuberculosis
GLNVGITIPEF

SEQ ID NO: 177393 - protein, 11 aa, Mycobacterium tuberculosis
NVGITIPEFPI

SEQ ID NO: 177394 - protein, 11 aa, Mycobacterium tuberculosis
GITIPEFPIHW

SEQ ID NO: 177395 - protein, 11 aa, Mycobacterium tuberculosis
TIPEFPIHWTS

SEQ ID NO: 177396 - protein, 11 aa, Mycobacterium tuberculosis
FPIHWTSTGGI

SEQ ID NO: 177397 - protein, 11 aa, Mycobacterium tuberculosis
WTSTGGIGPII

SEQ ID NO: 177398 - protein, 11 aa, Mycobacterium tuberculosis
GPIIIPDTTIL

SEQ ID NO: 177399 - protein, 11 aa, Mycobacterium tuberculosis
IIPDTTILPPI

SEQ ID NO: 177400 - protein, 11 aa, Mycobacterium tuberculosis
IPDTTILPPIH

SEQ ID NO: 177401 - protein, 11 aa, Mycobacterium tuberculosis
TTILPPIHLGL

SEQ ID NO: 177402 - protein, 11 aa, Mycobacterium tuberculosis
TILPPIHLGLT

SEQ ID NO: 177403 - protein, 11 aa, Mycobacterium tuberculosis
ILPPIHLGLTG

SEQ ID NO: 177404 - protein, 11 aa, Mycobacterium tuberculosis
PPIHLGLTGQA

SEQ ID NO: 177405 - protein, 11 aa, Mycobacterium tuberculosis
GLTGQANYGFA

SEQ ID NO: 177406 - protein, 11 aa, Mycobacterium tuberculosis
LTGQANYGFAV

SEQ ID NO: 177407 - protein, 11 aa, Mycobacterium tuberculosis
NYGFAVPDIPI

SEQ ID NO: 177408 - protein, 11 aa, Mycobacterium tuberculosis
FAVPDIPIPAI

SEQ ID NO: 177409 - protein, 11 aa, Mycobacterium tuberculosis
VPDIPIPAIHI

SEQ ID NO: 177410 - protein, 11 aa, Mycobacterium tuberculosis
DIPIPAIHIDF

SEQ ID NO: 177411 - protein, 11 aa, Mycobacterium tuberculosis
IPAIHIDFDGA

SEQ ID NO: 177412 - protein, 11 aa, Mycobacterium tuberculosis
GAADAGFTAPA

SEQ ID NO: 177413 - protein, 11 aa, Mycobacterium tuberculosis
AADAGFTAPAT

SEQ ID NO: 177414 - protein, 11 aa, Mycobacterium tuberculosis
AGFTAPATTLL

SEQ ID NO: 177415 - protein, 11 aa, Mycobacterium tuberculosis
FTAPATTLLSA

SEQ ID NO: 177416 - protein, 11 aa, Mycobacterium tuberculosis
TAPATTLLSAL

SEQ ID NO: 177417 - protein, 11 aa, Mycobacterium tuberculosis
TLLSALGITGQ

SEQ ID NO: 177418 - protein, 11 aa, Mycobacterium tuberculosis
LLSALGITGQF

SEQ ID NO: 177419 - protein, 11 aa, Mycobacterium tuberculosis
LSALGITGQFR

SEQ ID NO: 177420 - protein, 11 aa, Mycobacterium tuberculosis
SALGITGQFRF

SEQ ID NO: 177421 - protein, 11 aa, Mycobacterium tuberculosis
GITGQFRFGPI

SEQ ID NO: 177422 - protein, 11 aa, Mycobacterium tuberculosis
TGQFRFGPITV

SEQ ID NO: 177423 - protein, 11 aa, Mycobacterium tuberculosis
FRFGPITVSNV

SEQ ID NO: 177424 - protein, 11 aa, Mycobacterium tuberculosis
ITVSNVQLNPF

SEQ ID NO: 177425 - protein, 11 aa, Mycobacterium tuberculosis
NVQLNPFNVNL

SEQ ID NO: 177426 - protein, 11 aa, Mycobacterium tuberculosis
VQLNPFNVNLK

SEQ ID NO: 177427 - protein, 11 aa, Mycobacterium tuberculosis
QLNPFNVNLKL

SEQ ID NO: 177428 - protein, 11 aa, Mycobacterium tuberculosis
NPFNVNLKLQF

SEQ ID NO: 177429 - protein, 11 aa, Mycobacterium tuberculosis
NLKLQFLHDAF

SEQ ID NO: 177430 - protein, 11 aa, Mycobacterium tuberculosis
LQFLHDAFPNE

SEQ ID NO: 177431 - protein, 11 aa, Mycobacterium tuberculosis
QFLHDAFPNEF

SEQ ID NO: 177432 - protein, 11 aa, Mycobacterium tuberculosis
FLHDAFPNEFP

SEQ ID NO: 177433 - protein, 11 aa, Mycobacterium tuberculosis
AFPNEFPDPTI

SEQ ID NO: 177434 - protein, 11 aa, Mycobacterium tuberculosis
FPNEFPDPTIS

SEQ ID NO: 177435 - protein, 11 aa, Mycobacterium tuberculosis
FPDPTISVQIQ

SEQ ID NO: 177436 - protein, 11 aa, Mycobacterium tuberculosis
PTISVQIQVAI

SEQ ID NO: 177437 - protein, 11 aa, Mycobacterium tuberculosis
ISVQIQVAIPL

SEQ ID NO: 177438 - protein, 11 aa, Mycobacterium tuberculosis
VQIQVAIPLTS

SEQ ID NO: 177439 - protein, 11 aa, Mycobacterium tuberculosis
IQVAIPLTSAT

SEQ ID NO: 177440 - protein, 11 aa, Mycobacterium tuberculosis
QVAIPLTSATL

SEQ ID NO: 177441 - protein, 11 aa, Mycobacterium tuberculosis
IPLTSATLGGL

SEQ ID NO: 177442 - protein, 11 aa, Mycobacterium tuberculosis
PLTSATLGGLA

SEQ ID NO: 177443 - protein, 11 aa, Mycobacterium tuberculosis
LTSATLGGLAL

SEQ ID NO: 177444 - protein, 11 aa, Mycobacterium tuberculosis
SATLGGLALPL

SEQ ID NO: 177445 - protein, 11 aa, Mycobacterium tuberculosis
TLGGLALPLQQ

SEQ ID NO: 177446 - protein, 11 aa, Mycobacterium tuberculosis
ALPLQQTIDAI

SEQ ID NO: 177447 - protein, 11 aa, Mycobacterium tuberculosis
LPLQQTIDAIE

SEQ ID NO: 177448 - protein, 11 aa, Mycobacterium tuberculosis
PLQQTIDAIEL

SEQ ID NO: 177449 - protein, 11 aa, Mycobacterium tuberculosis
QTIDAIELPAI

SEQ ID NO: 177450 - protein, 11 aa, Mycobacterium tuberculosis
ELPAISFSQSI

SEQ ID NO: 177451 - protein, 11 aa, Mycobacterium tuberculosis
LPAISFSQSIP

SEQ ID NO: 177452 - protein, 11 aa, Mycobacterium tuberculosis
SQSIPIDIPPI

SEQ ID NO: 177453 - protein, 11 aa, Mycobacterium tuberculosis
IPIDIPPIDIP

SEQ ID NO: 177454 - protein, 11 aa, Mycobacterium tuberculosis
DIPPIDIPAST

SEQ ID NO: 177455 - protein, 11 aa, Mycobacterium tuberculosis
IPPIDIPASTI

SEQ ID NO: 177456 - protein, 11 aa, Mycobacterium tuberculosis
IPASTINGISM

SEQ ID NO: 177457 - protein, 11 aa, Mycobacterium tuberculosis
STINGISMSEV

SEQ ID NO: 177458 - protein, 11 aa, Mycobacterium tuberculosis
TINGISMSEVV

SEQ ID NO: 177459 - protein, 11 aa, Mycobacterium tuberculosis
NGISMSEVVPI

SEQ ID NO: 177460 - protein, 11 aa, Mycobacterium tuberculosis
MSEVVPIDVSV

SEQ ID NO: 177461 - protein, 11 aa, Mycobacterium tuberculosis
EVVPIDVSVDI

SEQ ID NO: 177462 - protein, 11 aa, Mycobacterium tuberculosis
VPIDVSVDIPA

SEQ ID NO: 177463 - protein, 11 aa, Mycobacterium tuberculosis
PIDVSVDIPAV

SEQ ID NO: 177464 - protein, 11 aa, Mycobacterium tuberculosis
DVSVDIPAVTI

SEQ ID NO: 177465 - protein, 11 aa, Mycobacterium tuberculosis
DIPAVTITGTR

SEQ ID NO: 177466 - protein, 11 aa, Mycobacterium tuberculosis
IPAVTITGTRI

SEQ ID NO: 177467 - protein, 11 aa, Mycobacterium tuberculosis
VTITGTRIDPI

SEQ ID NO: 177468 - protein, 11 aa, Mycobacterium tuberculosis
RIDPIPLNFDV

SEQ ID NO: 177469 - protein, 11 aa, Mycobacterium tuberculosis
IPLNFDVLSSA

SEQ ID NO: 177470 - protein, 11 aa, Mycobacterium tuberculosis
DVLSSAGPINI

SEQ ID NO: 177471 - protein, 11 aa, Mycobacterium tuberculosis
LSSAGPINISI

SEQ ID NO: 177472 - protein, 11 aa, Mycobacterium tuberculosis
SSAGPINISII

SEQ ID NO: 177473 - protein, 11 aa, Mycobacterium tuberculosis
SIIDIPALPGF

SEQ ID NO: 177474 - protein, 11 aa, Mycobacterium tuberculosis
IPALPGFGNST

SEQ ID NO: 177475 - protein, 11 aa, Mycobacterium tuberculosis
ALPGFGNSTEL

SEQ ID NO: 177476 - protein, 11 aa, Mycobacterium tuberculosis
IANFGAGVSGL

SEQ ID NO: 177477 - protein, 11 aa, Mycobacterium tuberculosis
GLLNQASSPMV

SEQ ID NO: 177478 - protein, 11 aa, Mycobacterium tuberculosis
NQASSPMVGTL

SEQ ID NO: 177479 - protein, 11 aa, Mycobacterium tuberculosis
MVGTLSGLGNA

SEQ ID NO: 177480 - protein, 11 aa, Mycobacterium tuberculosis
TLSGLGNAGSL

SEQ ID NO: 177481 - protein, 11 aa, Mycobacterium tuberculosis
SLASGVLNSGV

SEQ ID NO: 177482 - protein, 11 aa, Mycobacterium tuberculosis
VLNSGVDISGM

SEQ ID NO: 177483 - protein, 11 aa, Mycobacterium tuberculosis
SGVDISGMFNV

SEQ ID NO: 177484 - protein, 11 aa, Mycobacterium tuberculosis
DISGMFNVSTL

SEQ ID NO: 177485 - protein, 11 aa, Mycobacterium tuberculosis
GMFNVSTLGSA

SEQ ID NO: 177486 - protein, 11 aa, Mycobacterium tuberculosis
NVSTLGSAPAV

SEQ ID NO: 177487 - protein, 11 aa, Mycobacterium tuberculosis
APAVISGFGNL

SEQ ID NO: 177488 - protein, 11 aa, Mycobacterium tuberculosis
FGNLGNHVSGV

SEQ ID NO: 177489 - protein, 11 aa, Mycobacterium tuberculosis
NLGNHVSGVSI

SEQ ID NO: 177490 - protein, 11 aa, Mycobacterium tuberculosis
HVSGVSIDGLL

SEQ ID NO: 177491 - protein, 11 aa, Mycobacterium tuberculosis
GVSIDGLLAML

SEQ ID NO: 177492 - protein, 11 aa, Mycobacterium tuberculosis
SIDGLLAMLTS

SEQ ID NO: 177493 - protein, 11 aa, Mycobacterium tuberculosis
GQPSIIDAAIA

SEQ ID NO: 177494 - protein, 11 aa, Mycobacterium tuberculosis
QPSIIDAAIAE

SEQ ID NO: 177495 - protein, 11 aa, Mycobacterium tuberculosis
SIIDAAIAELR

SEQ ID NO: 177496 - protein, 11 aa, Mycobacterium tuberculosis
AIAELRHLNPL

SEQ ID NO: 177497 - protein, 11 aa, Mycobacterium tuberculosis
AELRHLNPLNI

SEQ ID NO: 177498 - protein, 11 aa, Mycobacterium tuberculosis
ELRHLNPLNIV

SEQ ID NO: 177499 - protein, 11 aa, Mycobacterium tuberculosis
RHLNPLNIVNL

SEQ ID NO: 177500 - protein, 11 aa, Mycobacterium tuberculosis
NPLNIVNLGNV

SEQ ID NO: 177501 - protein, 11 aa, Mycobacterium tuberculosis
NIVNLGNVGSY

SEQ ID NO: 177502 - protein, 11 aa, Mycobacterium tuberculosis
FANVGDVNLGA

SEQ ID NO: 177503 - protein, 11 aa, Mycobacterium tuberculosis
NLGDGNVGFGN

SEQ ID NO: 177504 - protein, 11 aa, Mycobacterium tuberculosis
GLGALPGIGNI

SEQ ID NO: 177505 - protein, 11 aa, Mycobacterium tuberculosis
GALPGIGNIGL

SEQ ID NO: 177506 - protein, 11 aa, Mycobacterium tuberculosis
NTGTNNLGIGL

SEQ ID NO: 177507 - protein, 11 aa, Mycobacterium tuberculosis
GLNSGAGNLGL

SEQ ID NO: 177508 - protein, 11 aa, Mycobacterium tuberculosis
LFNSGTGNIGF

SEQ ID NO: 177509 - protein, 11 aa, Mycobacterium tuberculosis
IGFFNTGTGNW

SEQ ID NO: 177510 - protein, 11 aa, Mycobacterium tuberculosis
FFNTGTGNWGL

SEQ ID NO: 177511 - protein, 11 aa, Mycobacterium tuberculosis
FNAGSFNTGLA

SEQ ID NO: 177512 - protein, 11 aa, Mycobacterium tuberculosis
TNTGGFNPGNV

SEQ ID NO: 177513 - protein, 11 aa, Mycobacterium tuberculosis
GFNPGNVNTGW

SEQ ID NO: 177514 - protein, 11 aa, Mycobacterium tuberculosis
TNTGGFNTGNV

SEQ ID NO: 177515 - protein, 11 aa, Mycobacterium tuberculosis
FNSGSFNNGAL

SEQ ID NO: 177516 - protein, 11 aa, Mycobacterium tuberculosis
NSGSFNNGALW

SEQ ID NO: 177517 - protein, 11 aa, Mycobacterium tuberculosis
ALWTGDHHGLV

SEQ ID NO: 177518 - protein, 11 aa, Mycobacterium tuberculosis
WTGDHHGLVGF

SEQ ID NO: 177519 - protein, 11 aa, Mycobacterium tuberculosis
GLVGFSYSIEI

SEQ ID NO: 177520 - protein, 11 aa, Mycobacterium tuberculosis
SYSIEITGSTL

SEQ ID NO: 177521 - protein, 11 aa, Mycobacterium tuberculosis
YSIEITGSTLV

SEQ ID NO: 177522 - protein, 11 aa, Mycobacterium tuberculosis
IEITGSTLVDI

SEQ ID NO: 177523 - protein, 11 aa, Mycobacterium tuberculosis
TLVDINETLNL

SEQ ID NO: 177524 - protein, 11 aa, Mycobacterium tuberculosis
DINETLNLGPV

SEQ ID NO: 177525 - protein, 11 aa, Mycobacterium tuberculosis
GMSLFDIHELV

SEQ ID NO: 177526 - protein, 11 aa, Mycobacterium tuberculosis
SLFDIHELVNI

SEQ ID NO: 177527 - protein, 11 aa, Mycobacterium tuberculosis
DIHELVNIGPF

SEQ ID NO: 177528 - protein, 11 aa, Mycobacterium tuberculosis
HELVNIGPFRI

SEQ ID NO: 177529 - protein, 11 aa, Mycobacterium tuberculosis
FRIEPIDVPAV

SEQ ID NO: 177530 - protein, 11 aa, Mycobacterium tuberculosis
RIEPIDVPAVV

SEQ ID NO: 177531 - protein, 11 aa, Mycobacterium tuberculosis
IEPIDVPAVVL

SEQ ID NO: 177532 - protein, 11 aa, Mycobacterium tuberculosis
VPAVVLDIHET

SEQ ID NO: 177533 - protein, 11 aa, Mycobacterium tuberculosis
AVVLDIHETMV

SEQ ID NO: 177534 - protein, 11 aa, Mycobacterium tuberculosis
VVLDIHETMVI

SEQ ID NO: 177535 - protein, 11 aa, Mycobacterium tuberculosis
DIHETMVIPPI

SEQ ID NO: 177536 - protein, 11 aa, Mycobacterium tuberculosis
HETMVIPPIVF

SEQ ID NO: 177537 - protein, 11 aa, Mycobacterium tuberculosis
ETMVIPPIVFL

SEQ ID NO: 177538 - protein, 11 aa, Mycobacterium tuberculosis
MVIPPIVFLPS

SEQ ID NO: 177539 - protein, 11 aa, Mycobacterium tuberculosis
VIPPIVFLPSM

SEQ ID NO: 177540 - protein, 11 aa, Mycobacterium tuberculosis
IPPIVFLPSMT

SEQ ID NO: 177541 - protein, 11 aa, Mycobacterium tuberculosis
PPIVFLPSMTI

SEQ ID NO: 177542 - protein, 11 aa, Mycobacterium tuberculosis
FLPSMTIGGQT

SEQ ID NO: 177543 - protein, 11 aa, Mycobacterium tuberculosis
LPSMTIGGQTY

SEQ ID NO: 177544 - protein, 11 aa, Mycobacterium tuberculosis
SMTIGGQTYTI

SEQ ID NO: 177545 - protein, 11 aa, Mycobacterium tuberculosis
TIGGQTYTIPL

SEQ ID NO: 177546 - protein, 11 aa, Mycobacterium tuberculosis
TIPLDTPPAPA

SEQ ID NO: 177547 - protein, 11 aa, Mycobacterium tuberculosis
IPLDTPPAPAP

SEQ ID NO: 177548 - protein, 11 aa, Mycobacterium tuberculosis
DTPPAPAPPPF

SEQ ID NO: 177549 - protein, 11 aa, Mycobacterium tuberculosis
TPPAPAPPPFR

SEQ ID NO: 177550 - protein, 11 aa, Mycobacterium tuberculosis
APAPPPFRLPL

SEQ ID NO: 177551 - protein, 11 aa, Mycobacterium tuberculosis
APPPFRLPLLF

SEQ ID NO: 177552 - protein, 11 aa, Mycobacterium tuberculosis
PPPFRLPLLFV

SEQ ID NO: 177553 - protein, 11 aa, Mycobacterium tuberculosis
FRLPLLFVNAL

SEQ ID NO: 177554 - protein, 11 aa, Mycobacterium tuberculosis
LPLLFVNALGD

SEQ ID NO: 177555 - protein, 11 aa, Mycobacterium tuberculosis
LLFVNALGDNW

SEQ ID NO: 177556 - protein, 11 aa, Mycobacterium tuberculosis
FVNALGDNWIV

SEQ ID NO: 177557 - protein, 11 aa, Mycobacterium tuberculosis
NALGDNWIVGA

SEQ ID NO: 177558 - protein, 11 aa, Mycobacterium tuberculosis
ALGDNWIVGAS

SEQ ID NO: 177559 - protein, 11 aa, Mycobacterium tuberculosis
WIVGASNSTGM

SEQ ID NO: 177560 - protein, 11 aa, Mycobacterium tuberculosis
GMSGGFVTAPT

SEQ ID NO: 177561 - protein, 11 aa, Mycobacterium tuberculosis
FVTAPTQGILI

SEQ ID NO: 177562 - protein, 11 aa, Mycobacterium tuberculosis
GILIHTGPSSA

SEQ ID NO: 177563 - protein, 11 aa, Mycobacterium tuberculosis
LIHTGPSSATT

SEQ ID NO: 177564 - protein, 11 aa, Mycobacterium tuberculosis
GPSSATTGSLA

SEQ ID NO: 177565 - protein, 11 aa, Mycobacterium tuberculosis
SATTGSLALTL

SEQ ID NO: 177566 - protein, 11 aa, Mycobacterium tuberculosis
SLALTLPTVTI

SEQ ID NO: 177567 - protein, 11 aa, Mycobacterium tuberculosis
ALTLPTVTIPT

SEQ ID NO: 177568 - protein, 11 aa, Mycobacterium tuberculosis
LTLPTVTIPTI

SEQ ID NO: 177569 - protein, 11 aa, Mycobacterium tuberculosis
TLPTVTIPTIT

SEQ ID NO: 177570 - protein, 11 aa, Mycobacterium tuberculosis
LPTVTIPTITT

SEQ ID NO: 177571 - protein, 11 aa, Mycobacterium tuberculosis
VTIPTITTSPI

SEQ ID NO: 177572 - protein, 11 aa, Mycobacterium tuberculosis
IPTITTSPIPL

SEQ ID NO: 177573 - protein, 11 aa, Mycobacterium tuberculosis
PTITTSPIPLK

SEQ ID NO: 177574 - protein, 11 aa, Mycobacterium tuberculosis
TTSPIPLKIDV

SEQ ID NO: 177575 - protein, 11 aa, Mycobacterium tuberculosis
IPLKIDVSGGL

SEQ ID NO: 177576 - protein, 11 aa, Mycobacterium tuberculosis
KIDVSGGLPAF

SEQ ID NO: 177577 - protein, 11 aa, Mycobacterium tuberculosis
DVSGGLPAFTL

SEQ ID NO: 177578 - protein, 11 aa, Mycobacterium tuberculosis
LPAFTLFPGGL

SEQ ID NO: 177579 - protein, 11 aa, Mycobacterium tuberculosis
TLFPGGLNIPQ

SEQ ID NO: 177580 - protein, 11 aa, Mycobacterium tuberculosis
FPGGLNIPQNA

SEQ ID NO: 177581 - protein, 11 aa, Mycobacterium tuberculosis
GLNIPQNAIPL

SEQ ID NO: 177582 - protein, 11 aa, Mycobacterium tuberculosis
NIPQNAIPLTI

SEQ ID NO: 177583 - protein, 11 aa, Mycobacterium tuberculosis
AIPLTIDASGV

SEQ ID NO: 177584 - protein, 11 aa, Mycobacterium tuberculosis
IPLTIDASGVL

SEQ ID NO: 177585 - protein, 11 aa, Mycobacterium tuberculosis
TIDASGVLDPI

SEQ ID NO: 177586 - protein, 11 aa, Mycobacterium tuberculosis
DASGVLDPITI

SEQ ID NO: 177587 - protein, 11 aa, Mycobacterium tuberculosis
VLDPITIFPGG

SEQ ID NO: 177588 - protein, 11 aa, Mycobacterium tuberculosis
DPITIFPGGFT

SEQ ID NO: 177589 - protein, 11 aa, Mycobacterium tuberculosis
FPGGFTIDPLP

SEQ ID NO: 177590 - protein, 11 aa, Mycobacterium tuberculosis
FTIDPLPLSLA

SEQ ID NO: 177591 - protein, 11 aa, Mycobacterium tuberculosis
TIDPLPLSLAL

SEQ ID NO: 177592 - protein, 11 aa, Mycobacterium tuberculosis
DPLPLSLALNI

SEQ ID NO: 177593 - protein, 11 aa, Mycobacterium tuberculosis
LPLSLALNISV

SEQ ID NO: 177594 - protein, 11 aa, Mycobacterium tuberculosis
ALNISVPDSSV

SEQ ID NO: 177595 - protein, 11 aa, Mycobacterium tuberculosis
NISVPDSSVPI

SEQ ID NO: 177596 - protein, 11 aa, Mycobacterium tuberculosis
SVPDSSVPIII

SEQ ID NO: 177597 - protein, 11 aa, Mycobacterium tuberculosis
VPDSSVPIIIV

SEQ ID NO: 177598 - protein, 11 aa, Mycobacterium tuberculosis
SSVPIIIVPPT

SEQ ID NO: 177599 - protein, 11 aa, Mycobacterium tuberculosis
VPIIIVPPTPG

SEQ ID NO: 177600 - protein, 11 aa, Mycobacterium tuberculosis
PIIIVPPTPGF

SEQ ID NO: 177601 - protein, 11 aa, Mycobacterium tuberculosis
IVPPTPGFGNA

SEQ ID NO: 177602 - protein, 11 aa, Mycobacterium tuberculosis
VPPTPGFGNAT

SEQ ID NO: 177603 - protein, 11 aa, Mycobacterium tuberculosis
TPSSGFFNSGA

SEQ ID NO: 177604 - protein, 11 aa, Mycobacterium tuberculosis
SGFFNSGAGGV

SEQ ID NO: 177605 - protein, 11 aa, Mycobacterium tuberculosis
FGNFGAGSSGW

SEQ ID NO: 177606 - protein, 11 aa, Mycobacterium tuberculosis
HAALAGAGSGV

SEQ ID NO: 177607 - protein, 11 aa, Mycobacterium tuberculosis
LAGAGSGVLNV

SEQ ID NO: 177608 - protein, 11 aa, Mycobacterium tuberculosis
VLNVGTLNSGV

SEQ ID NO: 177609 - protein, 11 aa, Mycobacterium tuberculosis
TLNSGVLNVGS

SEQ ID NO: 177610 - protein, 11 aa, Mycobacterium tuberculosis
VLNVGSGISGL

SEQ ID NO: 177611 - protein, 11 aa, Mycobacterium tuberculosis
GISGLYNTAIV

SEQ ID NO: 177612 - protein, 11 aa, Mycobacterium tuberculosis
NTAIVGLGTPA

SEQ ID NO: 177613 - protein, 11 aa, Mycobacterium tuberculosis
TAIVGLGTPAL

SEQ ID NO: 177614 - protein, 11 aa, Mycobacterium tuberculosis
AIVGLGTPALV

SEQ ID NO: 177615 - protein, 11 aa, Mycobacterium tuberculosis
GLGTPALVSGA

SEQ ID NO: 177616 - protein, 11 aa, Mycobacterium tuberculosis
TPALVSGAGNV

SEQ ID NO: 177617 - protein, 11 aa, Mycobacterium tuberculosis
ALVSGAGNVGQ

SEQ ID NO: 177618 - protein, 11 aa, Mycobacterium tuberculosis
QQLSGVLAAGT

SEQ ID NO: 177619 - protein, 11 aa, Mycobacterium tuberculosis
QLSGVLAAGTA

SEQ ID NO: 177620 - protein, 11 aa, Mycobacterium tuberculosis
VLAAGTALTQS

SEQ ID NO: 177621 - protein, 11 aa, Mycobacterium tuberculosis
TALTQSPIINL

SEQ ID NO: 177622 - protein, 11 aa, Mycobacterium tuberculosis
LTQSPIINLGL

SEQ ID NO: 177623 - protein, 11 aa, Mycobacterium tuberculosis
TQSPIINLGLA

SEQ ID NO: 177624 - protein, 11 aa, Mycobacterium tuberculosis
SPIINLGLADV

SEQ ID NO: 177625 - protein, 11 aa, Mycobacterium tuberculosis
GLADVGNYNLG

SEQ ID NO: 177626 - protein, 11 aa, Mycobacterium tuberculosis
LADVGNYNLGL

SEQ ID NO: 177627 - protein, 11 aa, Mycobacterium tuberculosis
GLGAALGIGNI

SEQ ID NO: 177628 - protein, 11 aa, Mycobacterium tuberculosis
STNVGLANMGV

SEQ ID NO: 177629 - protein, 11 aa, Mycobacterium tuberculosis
LANMGVGNIGF

SEQ ID NO: 177630 - protein, 11 aa, Mycobacterium tuberculosis
FANTGTNNLGI

SEQ ID NO: 177631 - protein, 11 aa, Mycobacterium tuberculosis
NTGTNNLGIGL

SEQ ID NO: 177632 - protein, 11 aa, Mycobacterium tuberculosis
GLNSGAGNIGL

SEQ ID NO: 177633 - protein, 11 aa, Mycobacterium tuberculosis
LFNSGTGNIGF

SEQ ID NO: 177634 - protein, 11 aa, Mycobacterium tuberculosis
IGFFNSGTGNW

SEQ ID NO: 177635 - protein, 11 aa, Mycobacterium tuberculosis
FFNSGTGNWGL

SEQ ID NO: 177636 - protein, 11 aa, Mycobacterium tuberculosis
FTTGLANAGSY

SEQ ID NO: 177637 - protein, 11 aa, Mycobacterium tuberculosis
ANAGSYNTGSF

SEQ ID NO: 177638 - protein, 11 aa, Mycobacterium tuberculosis
GFNPGSINTGW

SEQ ID NO: 177639 - protein, 11 aa, Mycobacterium tuberculosis
ALMSGNFSNGI

SEQ ID NO: 177640 - protein, 11 aa, Mycobacterium tuberculosis
LMSGNFSNGIL

SEQ ID NO: 177641 - protein, 11 aa, Mycobacterium tuberculosis
MSGNFSNGILW

SEQ ID NO: 177642 - protein, 11 aa, Mycobacterium tuberculosis
FSNGILWRGNY

SEQ ID NO: 177643 - protein, 11 aa, Mycobacterium tuberculosis
GILWRGNYEGL

SEQ ID NO: 177644 - protein, 11 aa, Mycobacterium tuberculosis
ILWRGNYEGLF

SEQ ID NO: 177645 - protein, 11 aa, Mycobacterium tuberculosis
YEGLFSYSYSL

SEQ ID NO: 177646 - protein, 11 aa, Mycobacterium tuberculosis
GLFSYSYSLDV

SEQ ID NO: 177647 - protein, 11 aa, Mycobacterium tuberculosis
FSYSYSLDVPR

SEQ ID NO: 177648 - protein, 11 aa, Mycobacterium tuberculosis
SYSYSLDVPRI

SEQ ID NO: 177649 - protein, 11 aa, Mycobacterium tuberculosis
SYSLDVPRITI

SEQ ID NO: 177650 - protein, 11 aa, Mycobacterium tuberculosis
SLDVPRITILD

SEQ ID NO: 177651 - protein, 11 aa, Mycobacterium tuberculosis
DVPRITILDAH

SEQ ID NO: 177652 - protein, 11 aa, Mycobacterium tuberculosis
VPRITILDAHF

SEQ ID NO: 177653 - protein, 11 aa, Mycobacterium tuberculosis
ITILDAHFTGA

SEQ ID NO: 177654 - protein, 11 aa, Mycobacterium tuberculosis
TILDAHFTGAF

SEQ ID NO: 177655 - protein, 11 aa, Mycobacterium tuberculosis
DAHFTGAFGPV

SEQ ID NO: 177656 - protein, 11 aa, Mycobacterium tuberculosis
FGPVVVPPIPV

SEQ ID NO: 177657 - protein, 11 aa, Mycobacterium tuberculosis
GPVVVPPIPVL

SEQ ID NO: 177658 - protein, 11 aa, Mycobacterium tuberculosis
VVVPPIPVLAI

SEQ ID NO: 177659 - protein, 11 aa, Mycobacterium tuberculosis
VPPIPVLAINA

SEQ ID NO: 177660 - protein, 11 aa, Mycobacterium tuberculosis
PPIPVLAINAH

SEQ ID NO: 177661 - protein, 11 aa, Mycobacterium tuberculosis
IPVLAINAHLT

SEQ ID NO: 177662 - protein, 11 aa, Mycobacterium tuberculosis
AINAHLTGNAA

SEQ ID NO: 177663 - protein, 11 aa, Mycobacterium tuberculosis
HLTGNAAMGAF

SEQ ID NO: 177664 - protein, 11 aa, Mycobacterium tuberculosis
TGNAAMGAFTI

SEQ ID NO: 177665 - protein, 11 aa, Mycobacterium tuberculosis
AAMGAFTIPQI

SEQ ID NO: 177666 - protein, 11 aa, Mycobacterium tuberculosis
MGAFTIPQIDI

SEQ ID NO: 177667 - protein, 11 aa, Mycobacterium tuberculosis
FTIPQIDIPAL

SEQ ID NO: 177668 - protein, 11 aa, Mycobacterium tuberculosis
QIDIPALNPNV

SEQ ID NO: 177669 - protein, 11 aa, Mycobacterium tuberculosis
IPALNPNVTGS

SEQ ID NO: 177670 - protein, 11 aa, Mycobacterium tuberculosis
PALNPNVTGSV

SEQ ID NO: 177671 - protein, 11 aa, Mycobacterium tuberculosis
NVTGSVGFGPI

SEQ ID NO: 177672 - protein, 11 aa, Mycobacterium tuberculosis
TGSVGFGPIAV

SEQ ID NO: 177673 - protein, 11 aa, Mycobacterium tuberculosis
VGFGPIAVPSV

SEQ ID NO: 177674 - protein, 11 aa, Mycobacterium tuberculosis
IAVPSVTIPAL

SEQ ID NO: 177675 - protein, 11 aa, Mycobacterium tuberculosis
VPSVTIPALTA

SEQ ID NO: 177676 - protein, 11 aa, Mycobacterium tuberculosis
SVTIPALTAAR

SEQ ID NO: 177677 - protein, 11 aa, Mycobacterium tuberculosis
VTIPALTAARA

SEQ ID NO: 177678 - protein, 11 aa, Mycobacterium tuberculosis
TIPALTAARAV

SEQ ID NO: 177679 - protein, 11 aa, Mycobacterium tuberculosis
IPALTAARAVL

SEQ ID NO: 177680 - protein, 11 aa, Mycobacterium tuberculosis
ALTAARAVLDM

SEQ ID NO: 177681 - protein, 11 aa, Mycobacterium tuberculosis
LTAARAVLDMA

SEQ ID NO: 177682 - protein, 11 aa, Mycobacterium tuberculosis
TAARAVLDMAA

SEQ ID NO: 177683 - protein, 11 aa, Mycobacterium tuberculosis
AVLDMAASVGA

SEQ ID NO: 177684 - protein, 11 aa, Mycobacterium tuberculosis
VLDMAASVGAT

SEQ ID NO: 177685 - protein, 11 aa, Mycobacterium tuberculosis
MAASVGATSEI

SEQ ID NO: 177686 - protein, 11 aa, Mycobacterium tuberculosis
SVGATSEIEPF

SEQ ID NO: 177687 - protein, 11 aa, Mycobacterium tuberculosis
ATSEIEPFIVW

SEQ ID NO: 177688 - protein, 11 aa, Mycobacterium tuberculosis
SEIEPFIVWTS

SEQ ID NO: 177689 - protein, 11 aa, Mycobacterium tuberculosis
EPFIVWTSSGA

SEQ ID NO: 177690 - protein, 11 aa, Mycobacterium tuberculosis
WTSSGAIGPTW

SEQ ID NO: 177691 - protein, 11 aa, Mycobacterium tuberculosis
TSSGAIGPTWY

SEQ ID NO: 177692 - protein, 11 aa, Mycobacterium tuberculosis
SGAIGPTWYSV

SEQ ID NO: 177693 - protein, 11 aa, Mycobacterium tuberculosis
AIGPTWYSVGR

SEQ ID NO: 177694 - protein, 11 aa, Mycobacterium tuberculosis
GPTWYSVGRIY

SEQ ID NO: 177695 - protein, 11 aa, Mycobacterium tuberculosis
NAGDLFVGGNI

SEQ ID NO: 177696 - protein, 11 aa, Mycobacterium tuberculosis
NIISGIPTLST

SEQ ID NO: 177697 - protein, 11 aa, Mycobacterium tuberculosis
IISGIPTLSTT

SEQ ID NO: 177698 - protein, 11 aa, Mycobacterium tuberculosis
GIPTLSTTGPV

SEQ ID NO: 177699 - protein, 11 aa, Mycobacterium tuberculosis
IPTLSTTGPVH

SEQ ID NO: 177700 - protein, 11 aa, Mycobacterium tuberculosis
PTLSTTGPVHA

SEQ ID NO: 177701 - protein, 11 aa, Mycobacterium tuberculosis
TLSTTGPVHAV

SEQ ID NO: 177702 - protein, 11 aa, Mycobacterium tuberculosis
LSTTGPVHAVF

SEQ ID NO: 177703 - protein, 11 aa, Mycobacterium tuberculosis
TTGPVHAVFNA

SEQ ID NO: 177704 - protein, 11 aa, Mycobacterium tuberculosis
HAVFNAASQAF

SEQ ID NO: 177705 - protein, 11 aa, Mycobacterium tuberculosis
NAASQAFNTPA

SEQ ID NO: 177706 - protein, 11 aa, Mycobacterium tuberculosis
AASQAFNTPAL

SEQ ID NO: 177707 - protein, 11 aa, Mycobacterium tuberculosis
SQAFNTPALNI

SEQ ID NO: 177708 - protein, 11 aa, Mycobacterium tuberculosis
TPALNIHQIPL

SEQ ID NO: 177709 - protein, 11 aa, Mycobacterium tuberculosis
NIHQIPLGFQV

SEQ ID NO: 177710 - protein, 11 aa, Mycobacterium tuberculosis
IPLGFQVPGSI

SEQ ID NO: 177711 - protein, 11 aa, Mycobacterium tuberculosis
FQVPGSIDAIT

SEQ ID NO: 177712 - protein, 11 aa, Mycobacterium tuberculosis
QVPGSIDAITL

SEQ ID NO: 177713 - protein, 11 aa, Mycobacterium tuberculosis
VPGSIDAITLF

SEQ ID NO: 177714 - protein, 11 aa, Mycobacterium tuberculosis
TLFPGGLTFPA

SEQ ID NO: 177715 - protein, 11 aa, Mycobacterium tuberculosis
FPGGLTFPANS

SEQ ID NO: 177716 - protein, 11 aa, Mycobacterium tuberculosis
LTFPANSLLNL

SEQ ID NO: 177717 - protein, 11 aa, Mycobacterium tuberculosis
FPANSLLNLDV

SEQ ID NO: 177718 - protein, 11 aa, Mycobacterium tuberculosis
PANSLLNLDVF

SEQ ID NO: 177719 - protein, 11 aa, Mycobacterium tuberculosis
SLLNLDVFVGT

SEQ ID NO: 177720 - protein, 11 aa, Mycobacterium tuberculosis
NLDVFVGTPGA

SEQ ID NO: 177721 - protein, 11 aa, Mycobacterium tuberculosis
DVFVGTPGATI

SEQ ID NO: 177722 - protein, 11 aa, Mycobacterium tuberculosis
FVGTPGATIPA

SEQ ID NO: 177723 - protein, 11 aa, Mycobacterium tuberculosis
TPGATIPAITF

SEQ ID NO: 177724 - protein, 11 aa, Mycobacterium tuberculosis
ATIPAITFPEI

SEQ ID NO: 177725 - protein, 11 aa, Mycobacterium tuberculosis
IPAITFPEIPA

SEQ ID NO: 177726 - protein, 11 aa, Mycobacterium tuberculosis
PEIPANADGEL

SEQ ID NO: 177727 - protein, 11 aa, Mycobacterium tuberculosis
EIPANADGELY

SEQ ID NO: 177728 - protein, 11 aa, Mycobacterium tuberculosis
IPANADGELYV

SEQ ID NO: 177729 - protein, 11 aa, Mycobacterium tuberculosis
ELYVIAGDIPL

SEQ ID NO: 177730 - protein, 11 aa, Mycobacterium tuberculosis
LYVIAGDIPLI

SEQ ID NO: 177731 - protein, 11 aa, Mycobacterium tuberculosis
VIAGDIPLINI

SEQ ID NO: 177732 - protein, 11 aa, Mycobacterium tuberculosis
PLINIPPTPGI

SEQ ID NO: 177733 - protein, 11 aa, Mycobacterium tuberculosis
IPPTPGIGNTT

SEQ ID NO: 177734 - protein, 11 aa, Mycobacterium tuberculosis
PTPGIGNTTTV

SEQ ID NO: 177735 - protein, 11 aa, Mycobacterium tuberculosis
NTTTVPSSGFF

SEQ ID NO: 177736 - protein, 11 aa, Mycobacterium tuberculosis
TTVPSSGFFNT

SEQ ID NO: 177737 - protein, 11 aa, Mycobacterium tuberculosis
VPSSGFFNTGA

SEQ ID NO: 177738 - protein, 11 aa, Mycobacterium tuberculosis
NMSGWWNQAHT

SEQ ID NO: 177739 - protein, 11 aa, Mycobacterium tuberculosis
HTALAGAGSGI

SEQ ID NO: 177740 - protein, 11 aa, Mycobacterium tuberculosis
LAGAGSGIANV

SEQ ID NO: 177741 - protein, 11 aa, Mycobacterium tuberculosis
IANVGTLHSGV

SEQ ID NO: 177742 - protein, 11 aa, Mycobacterium tuberculosis
VLNLGSGLSGI

SEQ ID NO: 177743 - protein, 11 aa, Mycobacterium tuberculosis
GLSGIYNTSTL

SEQ ID NO: 177744 - protein, 11 aa, Mycobacterium tuberculosis
SGIYNTSTLPL

SEQ ID NO: 177745 - protein, 11 aa, Mycobacterium tuberculosis
NTSTLPLGTPA

SEQ ID NO: 177746 - protein, 11 aa, Mycobacterium tuberculosis
STLPLGTPALV

SEQ ID NO: 177747 - protein, 11 aa, Mycobacterium tuberculosis
LPLGTPALVSG

SEQ ID NO: 177748 - protein, 11 aa, Mycobacterium tuberculosis
PLGTPALVSGL

SEQ ID NO: 177749 - protein, 11 aa, Mycobacterium tuberculosis
TPALVSGLGNV

SEQ ID NO: 177750 - protein, 11 aa, Mycobacterium tuberculosis
LLASNVGQNPI

SEQ ID NO: 177751 - protein, 11 aa, Mycobacterium tuberculosis
NPITIVNIGLA

SEQ ID NO: 177752 - protein, 11 aa, Mycobacterium tuberculosis
ITIVNIGLANV

SEQ ID NO: 177753 - protein, 11 aa, Mycobacterium tuberculosis
AANIGDVNLGF

SEQ ID NO: 177754 - protein, 11 aa, Mycobacterium tuberculosis
DANFGFGNSGL

SEQ ID NO: 177755 - protein, 11 aa, Mycobacterium tuberculosis
LAAGLAGMGNI

SEQ ID NO: 177756 - protein, 11 aa, Mycobacterium tuberculosis
LGNAGSGNVGW

SEQ ID NO: 177757 - protein, 11 aa, Mycobacterium tuberculosis
WANMGLGNIGF

SEQ ID NO: 177758 - protein, 11 aa, Mycobacterium tuberculosis
NTGTNNLGIGL

SEQ ID NO: 177759 - protein, 11 aa, Mycobacterium tuberculosis
GLNSGTGNIGL

SEQ ID NO: 177760 - protein, 11 aa, Mycobacterium tuberculosis
LFNSGTGNIGF

SEQ ID NO: 177761 - protein, 11 aa, Mycobacterium tuberculosis
FFNSGTANFGL

SEQ ID NO: 177762 - protein, 11 aa, Mycobacterium tuberculosis
ANFGLFNSGSY

SEQ ID NO: 177763 - protein, 11 aa, Mycobacterium tuberculosis
SYNTGIGNSGV

SEQ ID NO: 177764 - protein, 11 aa, Mycobacterium tuberculosis
LVNAGGFNTGV

SEQ ID NO: 177765 - protein, 11 aa, Mycobacterium tuberculosis
ANAGSYNTGSF

SEQ ID NO: 177766 - protein, 11 aa, Mycobacterium tuberculosis
GFNPGSTNTGW

SEQ ID NO: 177767 - protein, 11 aa, Mycobacterium tuberculosis
ALITGNFSNGI

SEQ ID NO: 177768 - protein, 11 aa, Mycobacterium tuberculosis
ITGNFSNGILW

SEQ ID NO: 177769 - protein, 11 aa, Mycobacterium tuberculosis
TGNFSNGILWR

SEQ ID NO: 177770 - protein, 11 aa, Mycobacterium tuberculosis
FSNGILWRGNY

SEQ ID NO: 177771 - protein, 11 aa, Mycobacterium tuberculosis
GILWRGNYEGL

SEQ ID NO: 177772 - protein, 11 aa, Mycobacterium tuberculosis
ILWRGNYEGLA

SEQ ID NO: 177773 - protein, 11 aa, Mycobacterium tuberculosis
YEGLAGFSFGY

SEQ ID NO: 177774 - protein, 11 aa, Mycobacterium tuberculosis
GLAGFSFGYPI

SEQ ID NO: 177775 - protein, 11 aa, Mycobacterium tuberculosis
GFSFGYPIPLF

SEQ ID NO: 177776 - protein, 11 aa, Mycobacterium tuberculosis
FGYPIPLFPAV

SEQ ID NO: 177777 - protein, 11 aa, Mycobacterium tuberculosis
YPIPLFPAVGA

SEQ ID NO: 177778 - protein, 11 aa, Mycobacterium tuberculosis
IPLFPAVGADV

SEQ ID NO: 177779 - protein, 11 aa, Mycobacterium tuberculosis
PLFPAVGADVT

SEQ ID NO: 177780 - protein, 11 aa, Mycobacterium tuberculosis
FPAVGADVTGD

SEQ ID NO: 177781 - protein, 11 aa, Mycobacterium tuberculosis
DVTGDIGPATI

SEQ ID NO: 177782 - protein, 11 aa, Mycobacterium tuberculosis
DIGPATIIPPI

SEQ ID NO: 177783 - protein, 11 aa, Mycobacterium tuberculosis
GPATIIPPIHI

SEQ ID NO: 177784 - protein, 11 aa, Mycobacterium tuberculosis
TIIPPIHIPSI

SEQ ID NO: 177785 - protein, 11 aa, Mycobacterium tuberculosis
IPPIHIPSIPL

SEQ ID NO: 177786 - protein, 11 aa, Mycobacterium tuberculosis
HIPSIPLGFAA

SEQ ID NO: 177787 - protein, 11 aa, Mycobacterium tuberculosis
IPSIPLGFAAI

SEQ ID NO: 177788 - protein, 11 aa, Mycobacterium tuberculosis
IPLGFAAIGHI

SEQ ID NO: 177789 - protein, 11 aa, Mycobacterium tuberculosis
AAIGHIGPISI

SEQ ID NO: 177790 - protein, 11 aa, Mycobacterium tuberculosis
HIGPISIPNIA

SEQ ID NO: 177791 - protein, 11 aa, Mycobacterium tuberculosis
ISIPNIAIPSI

SEQ ID NO: 177792 - protein, 11 aa, Mycobacterium tuberculosis
IPNIAIPSIHL

SEQ ID NO: 177793 - protein, 11 aa, Mycobacterium tuberculosis
NIAIPSIHLGI

SEQ ID NO: 177794 - protein, 11 aa, Mycobacterium tuberculosis
IPSIHLGIDPT

SEQ ID NO: 177795 - protein, 11 aa, Mycobacterium tuberculosis
GIDPTFDVGPI

SEQ ID NO: 177796 - protein, 11 aa, Mycobacterium tuberculosis
DPTFDVGPITV

SEQ ID NO: 177797 - protein, 11 aa, Mycobacterium tuberculosis
FDVGPITVDPI

SEQ ID NO: 177798 - protein, 11 aa, Mycobacterium tuberculosis
TLTIPGLSLDA

SEQ ID NO: 177799 - protein, 11 aa, Mycobacterium tuberculosis
LTIPGLSLDAA

SEQ ID NO: 177800 - protein, 11 aa, Mycobacterium tuberculosis
TIPGLSLDAAV

SEQ ID NO: 177801 - protein, 11 aa, Mycobacterium tuberculosis
GLSLDAAVSEI

SEQ ID NO: 177802 - protein, 11 aa, Mycobacterium tuberculosis
LSLDAAVSEIR

SEQ ID NO: 177803 - protein, 11 aa, Mycobacterium tuberculosis
SLDAAVSEIRM

SEQ ID NO: 177804 - protein, 11 aa, Mycobacterium tuberculosis
SEIRMTSGSSS

SEQ ID NO: 177805 - protein, 11 aa, Mycobacterium tuberculosis
IRMTSGSSSGF

SEQ ID NO: 177806 - protein, 11 aa, Mycobacterium tuberculosis
RMTSGSSSGFK

SEQ ID NO: 177807 - protein, 11 aa, Mycobacterium tuberculosis
MTSGSSSGFKV

SEQ ID NO: 177808 - protein, 11 aa, Mycobacterium tuberculosis
TSGSSSGFKVR

SEQ ID NO: 177809 - protein, 11 aa, Mycobacterium tuberculosis
SSSGFKVRPSF

SEQ ID NO: 177810 - protein, 11 aa, Mycobacterium tuberculosis
SGFKVRPSFSF

SEQ ID NO: 177811 - protein, 11 aa, Mycobacterium tuberculosis
GFKVRPSFSFF

SEQ ID NO: 177812 - protein, 11 aa, Mycobacterium tuberculosis
FKVRPSFSFFA

SEQ ID NO: 177813 - protein, 11 aa, Mycobacterium tuberculosis
KVRPSFSFFAV

SEQ ID NO: 177814 - protein, 11 aa, Mycobacterium tuberculosis
FSFFAVGPDGM

SEQ ID NO: 177815 - protein, 11 aa, Mycobacterium tuberculosis
VGPDGMPGGEV

SEQ ID NO: 177816 - protein, 11 aa, Mycobacterium tuberculosis
GMPGGEVSILQ

SEQ ID NO: 177817 - protein, 11 aa, Mycobacterium tuberculosis
GEVSILQPFTV

SEQ ID NO: 177818 - protein, 11 aa, Mycobacterium tuberculosis
EVSILQPFTVA

SEQ ID NO: 177819 - protein, 11 aa, Mycobacterium tuberculosis
SILQPFTVAPI

SEQ ID NO: 177820 - protein, 11 aa, Mycobacterium tuberculosis
LQPFTVAPINL

SEQ ID NO: 177821 - protein, 11 aa, Mycobacterium tuberculosis
FTVAPINLNPT

SEQ ID NO: 177822 - protein, 11 aa, Mycobacterium tuberculosis
TVAPINLNPTT

SEQ ID NO: 177823 - protein, 11 aa, Mycobacterium tuberculosis
TLHFPGFTIPT

SEQ ID NO: 177824 - protein, 11 aa, Mycobacterium tuberculosis
FPGFTIPTGPI

SEQ ID NO: 177825 - protein, 11 aa, Mycobacterium tuberculosis
TIPTGPIHIGL

SEQ ID NO: 177826 - protein, 11 aa, Mycobacterium tuberculosis
IPTGPIHIGLP

SEQ ID NO: 177827 - protein, 11 aa, Mycobacterium tuberculosis
GPIHIGLPLSL

SEQ ID NO: 177828 - protein, 11 aa, Mycobacterium tuberculosis
LPLSLTIPGFT

SEQ ID NO: 177829 - protein, 11 aa, Mycobacterium tuberculosis
PLSLTIPGFTI

SEQ ID NO: 177830 - protein, 11 aa, Mycobacterium tuberculosis
TIPGFTIPGGT

SEQ ID NO: 177831 - protein, 11 aa, Mycobacterium tuberculosis
IPGFTIPGGTL

SEQ ID NO: 177832 - protein, 11 aa, Mycobacterium tuberculosis
FTIPGGTLIPQ

SEQ ID NO: 177833 - protein, 11 aa, Mycobacterium tuberculosis
TIPGGTLIPQL

SEQ ID NO: 177834 - protein, 11 aa, Mycobacterium tuberculosis
LIPQLPLGLGL

SEQ ID NO: 177835 - protein, 11 aa, Mycobacterium tuberculosis
LPLGLGLSGGT

SEQ ID NO: 177836 - protein, 11 aa, Mycobacterium tuberculosis
GLGLSGGTPPF

SEQ ID NO: 177837 - protein, 11 aa, Mycobacterium tuberculosis
GLSGGTPPFDL

SEQ ID NO: 177838 - protein, 11 aa, Mycobacterium tuberculosis
GTPPFDLPTVV

SEQ ID NO: 177839 - protein, 11 aa, Mycobacterium tuberculosis
TPPFDLPTVVI

SEQ ID NO: 177840 - protein, 11 aa, Mycobacterium tuberculosis
LPTVVIDRIPV

SEQ ID NO: 177841 - protein, 11 aa, Mycobacterium tuberculosis
TVVIDRIPVEL

SEQ ID NO: 177842 - protein, 11 aa, Mycobacterium tuberculosis
VIDRIPVELHA

SEQ ID NO: 177843 - protein, 11 aa, Mycobacterium tuberculosis
IPVELHASTTI

SEQ ID NO: 177844 - protein, 11 aa, Mycobacterium tuberculosis
ELHASTTIGPV

SEQ ID NO: 177845 - protein, 11 aa, Mycobacterium tuberculosis
HASTTIGPVSL

SEQ ID NO: 177846 - protein, 11 aa, Mycobacterium tuberculosis
STTIGPVSLPI

SEQ ID NO: 177847 - protein, 11 aa, Mycobacterium tuberculosis
TTIGPVSLPIF

SEQ ID NO: 177848 - protein, 11 aa, Mycobacterium tuberculosis
LPIFGFGGAPG

SEQ ID NO: 177849 - protein, 11 aa, Mycobacterium tuberculosis
TTAPSSGFFNT

SEQ ID NO: 177850 - protein, 11 aa, Mycobacterium tuberculosis
FSNSGSGMSGV

SEQ ID NO: 177851 - protein, 11 aa, Mycobacterium tuberculosis
SGVLNAISDPL

SEQ ID NO: 177852 - protein, 11 aa, Mycobacterium tuberculosis
GVLNAISDPLL

SEQ ID NO: 177853 - protein, 11 aa, Mycobacterium tuberculosis
FANFGTQLSGI

SEQ ID NO: 177854 - protein, 11 aa, Mycobacterium tuberculosis
TQLSGILNRGA

SEQ ID NO: 177855 - protein, 11 aa, Mycobacterium tuberculosis
ILNRGAGISGV

SEQ ID NO: 177856 - protein, 11 aa, Mycobacterium tuberculosis
LNRGAGISGVY

SEQ ID NO: 177857 - protein, 11 aa, Mycobacterium tuberculosis
GISGVYNTGTL

SEQ ID NO: 177858 - protein, 11 aa, Mycobacterium tuberculosis
GVYNTGTLGLV

SEQ ID NO: 177859 - protein, 11 aa, Mycobacterium tuberculosis
GTLGLVTSAFV

SEQ ID NO: 177860 - protein, 11 aa, Mycobacterium tuberculosis
GLVTSAFVSGF

SEQ ID NO: 177861 - protein, 11 aa, Mycobacterium tuberculosis
LVTSAFVSGFM

SEQ ID NO: 177862 - protein, 11 aa, Mycobacterium tuberculosis
TSAFVSGFMNV

SEQ ID NO: 177863 - protein, 11 aa, Mycobacterium tuberculosis
FMNVGQQLSGL

SEQ ID NO: 177864 - protein, 11 aa, Mycobacterium tuberculosis
NVGQQLSGLLF

SEQ ID NO: 177865 - protein, 11 aa, Mycobacterium tuberculosis
QQLSGLLFAGT

SEQ ID NO: 177866 - protein, 13 aa, Mycobacterium tuberculosis
MNFPVLPPEINSV

SEQ ID NO: 177867 - protein, 13 aa, Mycobacterium tuberculosis
NFPVLPPEINSVL

SEQ ID NO: 177868 - protein, 13 aa, Mycobacterium tuberculosis
FPVLPPEINSVLM

SEQ ID NO: 177869 - protein, 13 aa, Mycobacterium tuberculosis
PVLPPEINSVLMY

SEQ ID NO: 177870 - protein, 13 aa, Mycobacterium tuberculosis
VLPPEINSVLMYS

SEQ ID NO: 177871 - protein, 13 aa, Mycobacterium tuberculosis
LPPEINSVLMYSG

SEQ ID NO: 177872 - protein, 13 aa, Mycobacterium tuberculosis
PPEINSVLMYSGA

SEQ ID NO: 177873 - protein, 13 aa, Mycobacterium tuberculosis
PEINSVLMYSGAG

SEQ ID NO: 177874 - protein, 13 aa, Mycobacterium tuberculosis
EINSVLMYSGAGS

SEQ ID NO: 177875 - protein, 13 aa, Mycobacterium tuberculosis
INSVLMYSGAGSS

SEQ ID NO: 177876 - protein, 13 aa, Mycobacterium tuberculosis
NSVLMYSGAGSSP

SEQ ID NO: 177877 - protein, 13 aa, Mycobacterium tuberculosis
SVLMYSGAGSSPL

SEQ ID NO: 177878 - protein, 13 aa, Mycobacterium tuberculosis
VLMYSGAGSSPLL

SEQ ID NO: 177879 - protein, 13 aa, Mycobacterium tuberculosis
LMYSGAGSSPLLA

SEQ ID NO: 177880 - protein, 13 aa, Mycobacterium tuberculosis
MYSGAGSSPLLAA

SEQ ID NO: 177881 - protein, 13 aa, Mycobacterium tuberculosis
YSGAGSSPLLAAA

SEQ ID NO: 177882 - protein, 13 aa, Mycobacterium tuberculosis
SGAGSSPLLAAAA

SEQ ID NO: 177883 - protein, 13 aa, Mycobacterium tuberculosis
GAGSSPLLAAAAA

SEQ ID NO: 177884 - protein, 13 aa, Mycobacterium tuberculosis
AGSSPLLAAAAAW

SEQ ID NO: 177885 - protein, 13 aa, Mycobacterium tuberculosis
GSSPLLAAAAAWD

SEQ ID NO: 177886 - protein, 13 aa, Mycobacterium tuberculosis
SSPLLAAAAAWDG

SEQ ID NO: 177887 - protein, 13 aa, Mycobacterium tuberculosis
SPLLAAAAAWDGL

SEQ ID NO: 177888 - protein, 13 aa, Mycobacterium tuberculosis
PLLAAAAAWDGLA

SEQ ID NO: 177889 - protein, 13 aa, Mycobacterium tuberculosis
LLAAAAAWDGLAE

SEQ ID NO: 177890 - protein, 13 aa, Mycobacterium tuberculosis
LAAAAAWDGLAEE

SEQ ID NO: 177891 - protein, 13 aa, Mycobacterium tuberculosis
AAAAAWDGLAEEL

SEQ ID NO: 177892 - protein, 13 aa, Mycobacterium tuberculosis
AAAAWDGLAEELG

SEQ ID NO: 177893 - protein, 13 aa, Mycobacterium tuberculosis
AAAWDGLAEELGS

SEQ ID NO: 177894 - protein, 13 aa, Mycobacterium tuberculosis
AAWDGLAEELGSA

SEQ ID NO: 177895 - protein, 13 aa, Mycobacterium tuberculosis
AWDGLAEELGSAA

SEQ ID NO: 177896 - protein, 13 aa, Mycobacterium tuberculosis
WDGLAEELGSAAV

SEQ ID NO: 177897 - protein, 13 aa, Mycobacterium tuberculosis
DGLAEELGSAAVS

SEQ ID NO: 177898 - protein, 13 aa, Mycobacterium tuberculosis
GLAEELGSAAVSF

SEQ ID NO: 177899 - protein, 13 aa, Mycobacterium tuberculosis
LAEELGSAAVSFG

SEQ ID NO: 177900 - protein, 13 aa, Mycobacterium tuberculosis
AEELGSAAVSFGQ

SEQ ID NO: 177901 - protein, 13 aa, Mycobacterium tuberculosis
EELGSAAVSFGQV

SEQ ID NO: 177902 - protein, 13 aa, Mycobacterium tuberculosis
ELGSAAVSFGQVT

SEQ ID NO: 177903 - protein, 13 aa, Mycobacterium tuberculosis
LGSAAVSFGQVTS

SEQ ID NO: 177904 - protein, 13 aa, Mycobacterium tuberculosis
GSAAVSFGQVTSG

SEQ ID NO: 177905 - protein, 13 aa, Mycobacterium tuberculosis
SAAVSFGQVTSGL

SEQ ID NO: 177906 - protein, 13 aa, Mycobacterium tuberculosis
AAVSFGQVTSGLT

SEQ ID NO: 177907 - protein, 13 aa, Mycobacterium tuberculosis
AVSFGQVTSGLTA

SEQ ID NO: 177908 - protein, 13 aa, Mycobacterium tuberculosis
VSFGQVTSGLTAG

SEQ ID NO: 177909 - protein, 13 aa, Mycobacterium tuberculosis
SFGQVTSGLTAGV

SEQ ID NO: 177910 - protein, 13 aa, Mycobacterium tuberculosis
FGQVTSGLTAGVW

SEQ ID NO: 177911 - protein, 13 aa, Mycobacterium tuberculosis
GQVTSGLTAGVWQ

SEQ ID NO: 177912 - protein, 13 aa, Mycobacterium tuberculosis
QVTSGLTAGVWQG

SEQ ID NO: 177913 - protein, 13 aa, Mycobacterium tuberculosis
VTSGLTAGVWQGA

SEQ ID NO: 177914 - protein, 13 aa, Mycobacterium tuberculosis
TSGLTAGVWQGAA

SEQ ID NO: 177915 - protein, 13 aa, Mycobacterium tuberculosis
SGLTAGVWQGAAA

SEQ ID NO: 177916 - protein, 13 aa, Mycobacterium tuberculosis
GLTAGVWQGAAAA

SEQ ID NO: 177917 - protein, 13 aa, Mycobacterium tuberculosis
LTAGVWQGAAAAA

SEQ ID NO: 177918 - protein, 13 aa, Mycobacterium tuberculosis
TAGVWQGAAAAAM

SEQ ID NO: 177919 - protein, 13 aa, Mycobacterium tuberculosis
AGVWQGAAAAAMA

SEQ ID NO: 177920 - protein, 13 aa, Mycobacterium tuberculosis
GVWQGAAAAAMAA

SEQ ID NO: 177921 - protein, 13 aa, Mycobacterium tuberculosis
VWQGAAAAAMAAA

SEQ ID NO: 177922 - protein, 13 aa, Mycobacterium tuberculosis
WQGAAAAAMAAAA

SEQ ID NO: 177923 - protein, 13 aa, Mycobacterium tuberculosis
QGAAAAAMAAAAA

SEQ ID NO: 177924 - protein, 13 aa, Mycobacterium tuberculosis
GAAAAAMAAAAAP

SEQ ID NO: 177925 - protein, 13 aa, Mycobacterium tuberculosis
AAAAAMAAAAAPY

SEQ ID NO: 177926 - protein, 13 aa, Mycobacterium tuberculosis
AAAAMAAAAAPYA

SEQ ID NO: 177927 - protein, 13 aa, Mycobacterium tuberculosis
AAAMAAAAAPYAG

SEQ ID NO: 177928 - protein, 13 aa, Mycobacterium tuberculosis
AAMAAAAAPYAGW

SEQ ID NO: 177929 - protein, 13 aa, Mycobacterium tuberculosis
AMAAAAAPYAGWL

SEQ ID NO: 177930 - protein, 13 aa, Mycobacterium tuberculosis
MAAAAAPYAGWLG

SEQ ID NO: 177931 - protein, 13 aa, Mycobacterium tuberculosis
AAAAAPYAGWLGS

SEQ ID NO: 177932 - protein, 13 aa, Mycobacterium tuberculosis
AAAAPYAGWLGSV

SEQ ID NO: 177933 - protein, 13 aa, Mycobacterium tuberculosis
AAAPYAGWLGSVA

SEQ ID NO: 177934 - protein, 13 aa, Mycobacterium tuberculosis
AAPYAGWLGSVAA

SEQ ID NO: 177935 - protein, 13 aa, Mycobacterium tuberculosis
APYAGWLGSVAAQ

SEQ ID NO: 177936 - protein, 13 aa, Mycobacterium tuberculosis
PYAGWLGSVAAQA

SEQ ID NO: 177937 - protein, 13 aa, Mycobacterium tuberculosis
YAGWLGSVAAQAV

SEQ ID NO: 177938 - protein, 13 aa, Mycobacterium tuberculosis
AGWLGSVAAQAVA

SEQ ID NO: 177939 - protein, 13 aa, Mycobacterium tuberculosis
GWLGSVAAQAVAV

SEQ ID NO: 177940 - protein, 13 aa, Mycobacterium tuberculosis
WLGSVAAQAVAVA

SEQ ID NO: 177941 - protein, 13 aa, Mycobacterium tuberculosis
LGSVAAQAVAVAG

SEQ ID NO: 177942 - protein, 13 aa, Mycobacterium tuberculosis
GSVAAQAVAVAGQ

SEQ ID NO: 177943 - protein, 13 aa, Mycobacterium tuberculosis
SVAAQAVAVAGQA

SEQ ID NO: 177944 - protein, 13 aa, Mycobacterium tuberculosis
VAAQAVAVAGQAR

SEQ ID NO: 177945 - protein, 13 aa, Mycobacterium tuberculosis
AAQAVAVAGQARA

SEQ ID NO: 177946 - protein, 13 aa, Mycobacterium tuberculosis
AQAVAVAGQARAA

SEQ ID NO: 177947 - protein, 13 aa, Mycobacterium tuberculosis
QAVAVAGQARAAV

SEQ ID NO: 177948 - protein, 13 aa, Mycobacterium tuberculosis
AVAVAGQARAAVA

SEQ ID NO: 177949 - protein, 13 aa, Mycobacterium tuberculosis
VAVAGQARAAVAA

SEQ ID NO: 177950 - protein, 13 aa, Mycobacterium tuberculosis
AVAGQARAAVAAF

SEQ ID NO: 177951 - protein, 13 aa, Mycobacterium tuberculosis
VAGQARAAVAAFE

SEQ ID NO: 177952 - protein, 13 aa, Mycobacterium tuberculosis
AGQARAAVAAFEA

SEQ ID NO: 177953 - protein, 13 aa, Mycobacterium tuberculosis
GQARAAVAAFEAA

SEQ ID NO: 177954 - protein, 13 aa, Mycobacterium tuberculosis
QARAAVAAFEAAL

SEQ ID NO: 177955 - protein, 13 aa, Mycobacterium tuberculosis
ARAAVAAFEAALA

SEQ ID NO: 177956 - protein, 13 aa, Mycobacterium tuberculosis
RAAVAAFEAALAA

SEQ ID NO: 177957 - protein, 13 aa, Mycobacterium tuberculosis
AAVAAFEAALAAT

SEQ ID NO: 177958 - protein, 13 aa, Mycobacterium tuberculosis
AVAAFEAALAATV

SEQ ID NO: 177959 - protein, 13 aa, Mycobacterium tuberculosis
VAAFEAALAATVD

SEQ ID NO: 177960 - protein, 13 aa, Mycobacterium tuberculosis
AAFEAALAATVDP

SEQ ID NO: 177961 - protein, 13 aa, Mycobacterium tuberculosis
AFEAALAATVDPA

SEQ ID NO: 177962 - protein, 13 aa, Mycobacterium tuberculosis
FEAALAATVDPAA

SEQ ID NO: 177963 - protein, 13 aa, Mycobacterium tuberculosis
EAALAATVDPAAV

SEQ ID NO: 177964 - protein, 13 aa, Mycobacterium tuberculosis
AALAATVDPAAVA

SEQ ID NO: 177965 - protein, 13 aa, Mycobacterium tuberculosis
ALAATVDPAAVAV

SEQ ID NO: 177966 - protein, 13 aa, Mycobacterium tuberculosis
LAATVDPAAVAVN

SEQ ID NO: 177967 - protein, 13 aa, Mycobacterium tuberculosis
AATVDPAAVAVNR

SEQ ID NO: 177968 - protein, 13 aa, Mycobacterium tuberculosis
ATVDPAAVAVNRM

SEQ ID NO: 177969 - protein, 13 aa, Mycobacterium tuberculosis
TVDPAAVAVNRMA

SEQ ID NO: 177970 - protein, 13 aa, Mycobacterium tuberculosis
VDPAAVAVNRMAM

SEQ ID NO: 177971 - protein, 13 aa, Mycobacterium tuberculosis
DPAAVAVNRMAMR

SEQ ID NO: 177972 - protein, 13 aa, Mycobacterium tuberculosis
PAAVAVNRMAMRA

SEQ ID NO: 177973 - protein, 13 aa, Mycobacterium tuberculosis
AAVAVNRMAMRAL

SEQ ID NO: 177974 - protein, 13 aa, Mycobacterium tuberculosis
AVAVNRMAMRALA

SEQ ID NO: 177975 - protein, 13 aa, Mycobacterium tuberculosis
VAVNRMAMRALAM

SEQ ID NO: 177976 - protein, 13 aa, Mycobacterium tuberculosis
AVNRMAMRALAMS

SEQ ID NO: 177977 - protein, 13 aa, Mycobacterium tuberculosis
VNRMAMRALAMSN

SEQ ID NO: 177978 - protein, 13 aa, Mycobacterium tuberculosis
NRMAMRALAMSNL

SEQ ID NO: 177979 - protein, 13 aa, Mycobacterium tuberculosis
RMAMRALAMSNLL

SEQ ID NO: 177980 - protein, 13 aa, Mycobacterium tuberculosis
MAMRALAMSNLLG

SEQ ID NO: 177981 - protein, 13 aa, Mycobacterium tuberculosis
AMRALAMSNLLGQ

SEQ ID NO: 177982 - protein, 13 aa, Mycobacterium tuberculosis
MRALAMSNLLGQN

SEQ ID NO: 177983 - protein, 13 aa, Mycobacterium tuberculosis
RALAMSNLLGQNA

SEQ ID NO: 177984 - protein, 13 aa, Mycobacterium tuberculosis
ALAMSNLLGQNAA

SEQ ID NO: 177985 - protein, 13 aa, Mycobacterium tuberculosis
LAMSNLLGQNAAA

SEQ ID NO: 177986 - protein, 13 aa, Mycobacterium tuberculosis
AMSNLLGQNAAAI

SEQ ID NO: 177987 - protein, 13 aa, Mycobacterium tuberculosis
MSNLLGQNAAAIA

SEQ ID NO: 177988 - protein, 13 aa, Mycobacterium tuberculosis
SNLLGQNAAAIAA

SEQ ID NO: 177989 - protein, 13 aa, Mycobacterium tuberculosis
NLLGQNAAAIAAV

SEQ ID NO: 177990 - protein, 13 aa, Mycobacterium tuberculosis
LLGQNAAAIAAVE

SEQ ID NO: 177991 - protein, 13 aa, Mycobacterium tuberculosis
LGQNAAAIAAVEA

SEQ ID NO: 177992 - protein, 13 aa, Mycobacterium tuberculosis
GQNAAAIAAVEAE

SEQ ID NO: 177993 - protein, 13 aa, Mycobacterium tuberculosis
QNAAAIAAVEAEY

SEQ ID NO: 177994 - protein, 13 aa, Mycobacterium tuberculosis
NAAAIAAVEAEYE

SEQ ID NO: 177995 - protein, 13 aa, Mycobacterium tuberculosis
AAAIAAVEAEYEL

SEQ ID NO: 177996 - protein, 13 aa, Mycobacterium tuberculosis
AAIAAVEAEYELM

SEQ ID NO: 177997 - protein, 13 aa, Mycobacterium tuberculosis
AIAAVEAEYELMW

SEQ ID NO: 177998 - protein, 13 aa, Mycobacterium tuberculosis
IAAVEAEYELMWA

SEQ ID NO: 177999 - protein, 13 aa, Mycobacterium tuberculosis
AAVEAEYELMWAA

SEQ ID NO: 178000 - protein, 13 aa, Mycobacterium tuberculosis
AVEAEYELMWAAD

SEQ ID NO: 178001 - protein, 13 aa, Mycobacterium tuberculosis
VEAEYELMWAADV

SEQ ID NO: 178002 - protein, 13 aa, Mycobacterium tuberculosis
EAEYELMWAADVA

SEQ ID NO: 178003 - protein, 13 aa, Mycobacterium tuberculosis
AEYELMWAADVAA

SEQ ID NO: 178004 - protein, 13 aa, Mycobacterium tuberculosis
EYELMWAADVAAM

SEQ ID NO: 178005 - protein, 13 aa, Mycobacterium tuberculosis
YELMWAADVAAMA

SEQ ID NO: 178006 - protein, 13 aa, Mycobacterium tuberculosis
ELMWAADVAAMAG

SEQ ID NO: 178007 - protein, 13 aa, Mycobacterium tuberculosis
LMWAADVAAMAGY

SEQ ID NO: 178008 - protein, 13 aa, Mycobacterium tuberculosis
MWAADVAAMAGYH

SEQ ID NO: 178009 - protein, 13 aa, Mycobacterium tuberculosis
WAADVAAMAGYHS

SEQ ID NO: 178010 - protein, 13 aa, Mycobacterium tuberculosis
AADVAAMAGYHSG

SEQ ID NO: 178011 - protein, 13 aa, Mycobacterium tuberculosis
ADVAAMAGYHSGA

SEQ ID NO: 178012 - protein, 13 aa, Mycobacterium tuberculosis
DVAAMAGYHSGAS

SEQ ID NO: 178013 - protein, 13 aa, Mycobacterium tuberculosis
VAAMAGYHSGASA

SEQ ID NO: 178014 - protein, 13 aa, Mycobacterium tuberculosis
AAMAGYHSGASAA

SEQ ID NO: 178015 - protein, 13 aa, Mycobacterium tuberculosis
AMAGYHSGASAAA

SEQ ID NO: 178016 - protein, 13 aa, Mycobacterium tuberculosis
MAGYHSGASAAAA

SEQ ID NO: 178017 - protein, 13 aa, Mycobacterium tuberculosis
AGYHSGASAAAAA

SEQ ID NO: 178018 - protein, 13 aa, Mycobacterium tuberculosis
GYHSGASAAAAAL

SEQ ID NO: 178019 - protein, 13 aa, Mycobacterium tuberculosis
YHSGASAAAAALP

SEQ ID NO: 178020 - protein, 13 aa, Mycobacterium tuberculosis
HSGASAAAAALPA

SEQ ID NO: 178021 - protein, 13 aa, Mycobacterium tuberculosis
SGASAAAAALPAF

SEQ ID NO: 178022 - protein, 13 aa, Mycobacterium tuberculosis
GASAAAAALPAFS

SEQ ID NO: 178023 - protein, 13 aa, Mycobacterium tuberculosis
ASAAAAALPAFSP

SEQ ID NO: 178024 - protein, 13 aa, Mycobacterium tuberculosis
SAAAAALPAFSPP

SEQ ID NO: 178025 - protein, 13 aa, Mycobacterium tuberculosis
AAAAALPAFSPPA

SEQ ID NO: 178026 - protein, 13 aa, Mycobacterium tuberculosis
AAAALPAFSPPAQ

SEQ ID NO: 178027 - protein, 13 aa, Mycobacterium tuberculosis
AAALPAFSPPAQA

SEQ ID NO: 178028 - protein, 13 aa, Mycobacterium tuberculosis
AALPAFSPPAQAL

SEQ ID NO: 178029 - protein, 13 aa, Mycobacterium tuberculosis
ALPAFSPPAQALG

SEQ ID NO: 178030 - protein, 13 aa, Mycobacterium tuberculosis
LPAFSPPAQALGG

SEQ ID NO: 178031 - protein, 13 aa, Mycobacterium tuberculosis
PAFSPPAQALGGG

SEQ ID NO: 178032 - protein, 13 aa, Mycobacterium tuberculosis
AFSPPAQALGGGV

SEQ ID NO: 178033 - protein, 13 aa, Mycobacterium tuberculosis
FSPPAQALGGGVG

SEQ ID NO: 178034 - protein, 13 aa, Mycobacterium tuberculosis
SPPAQALGGGVGA

SEQ ID NO: 178035 - protein, 13 aa, Mycobacterium tuberculosis
PPAQALGGGVGAF

SEQ ID NO: 178036 - protein, 13 aa, Mycobacterium tuberculosis
PAQALGGGVGAFL

SEQ ID NO: 178037 - protein, 13 aa, Mycobacterium tuberculosis
AQALGGGVGAFLN

SEQ ID NO: 178038 - protein, 13 aa, Mycobacterium tuberculosis
QALGGGVGAFLNA

SEQ ID NO: 178039 - protein, 13 aa, Mycobacterium tuberculosis
ALGGGVGAFLNAL

SEQ ID NO: 178040 - protein, 13 aa, Mycobacterium tuberculosis
LGGGVGAFLNALF

SEQ ID NO: 178041 - protein, 13 aa, Mycobacterium tuberculosis
GGGVGAFLNALFA

SEQ ID NO: 178042 - protein, 13 aa, Mycobacterium tuberculosis
GGVGAFLNALFAG

SEQ ID NO: 178043 - protein, 13 aa, Mycobacterium tuberculosis
GVGAFLNALFAGP

SEQ ID NO: 178044 - protein, 13 aa, Mycobacterium tuberculosis
VGAFLNALFAGPA

SEQ ID NO: 178045 - protein, 13 aa, Mycobacterium tuberculosis
GAFLNALFAGPAK

SEQ ID NO: 178046 - protein, 13 aa, Mycobacterium tuberculosis
AFLNALFAGPAKM

SEQ ID NO: 178047 - protein, 13 aa, Mycobacterium tuberculosis
FLNALFAGPAKML

SEQ ID NO: 178048 - protein, 13 aa, Mycobacterium tuberculosis
LNALFAGPAKMLR

SEQ ID NO: 178049 - protein, 13 aa, Mycobacterium tuberculosis
NALFAGPAKMLRL

SEQ ID NO: 178050 - protein, 13 aa, Mycobacterium tuberculosis
ALFAGPAKMLRLN

SEQ ID NO: 178051 - protein, 13 aa, Mycobacterium tuberculosis
LFAGPAKMLRLNA

SEQ ID NO: 178052 - protein, 13 aa, Mycobacterium tuberculosis
FAGPAKMLRLNAG

SEQ ID NO: 178053 - protein, 13 aa, Mycobacterium tuberculosis
AGPAKMLRLNAGL

SEQ ID NO: 178054 - protein, 13 aa, Mycobacterium tuberculosis
GPAKMLRLNAGLG

SEQ ID NO: 178055 - protein, 13 aa, Mycobacterium tuberculosis
PAKMLRLNAGLGN

SEQ ID NO: 178056 - protein, 13 aa, Mycobacterium tuberculosis
AKMLRLNAGLGNV

SEQ ID NO: 178057 - protein, 13 aa, Mycobacterium tuberculosis
KMLRLNAGLGNVG

SEQ ID NO: 178058 - protein, 13 aa, Mycobacterium tuberculosis
MLRLNAGLGNVGN

SEQ ID NO: 178059 - protein, 13 aa, Mycobacterium tuberculosis
LRLNAGLGNVGNY

SEQ ID NO: 178060 - protein, 13 aa, Mycobacterium tuberculosis
RLNAGLGNVGNYN

SEQ ID NO: 178061 - protein, 13 aa, Mycobacterium tuberculosis
LNAGLGNVGNYNV

SEQ ID NO: 178062 - protein, 13 aa, Mycobacterium tuberculosis
NAGLGNVGNYNVG

SEQ ID NO: 178063 - protein, 13 aa, Mycobacterium tuberculosis
AGLGNVGNYNVGL

SEQ ID NO: 178064 - protein, 13 aa, Mycobacterium tuberculosis
GLGNVGNYNVGLG

SEQ ID NO: 178065 - protein, 13 aa, Mycobacterium tuberculosis
LGNVGNYNVGLGN

SEQ ID NO: 178066 - protein, 13 aa, Mycobacterium tuberculosis
GNVGNYNVGLGNV

SEQ ID NO: 178067 - protein, 13 aa, Mycobacterium tuberculosis
NVGNYNVGLGNVG

SEQ ID NO: 178068 - protein, 13 aa, Mycobacterium tuberculosis
VGNYNVGLGNVGI

SEQ ID NO: 178069 - protein, 13 aa, Mycobacterium tuberculosis
GNYNVGLGNVGIF

SEQ ID NO: 178070 - protein, 13 aa, Mycobacterium tuberculosis
NYNVGLGNVGIFN

SEQ ID NO: 178071 - protein, 13 aa, Mycobacterium tuberculosis
YNVGLGNVGIFNL

SEQ ID NO: 178072 - protein, 13 aa, Mycobacterium tuberculosis
NVGLGNVGIFNLG

SEQ ID NO: 178073 - protein, 13 aa, Mycobacterium tuberculosis
VGLGNVGIFNLGA

SEQ ID NO: 178074 - protein, 13 aa, Mycobacterium tuberculosis
GLGNVGIFNLGAA

SEQ ID NO: 178075 - protein, 13 aa, Mycobacterium tuberculosis
LGNVGIFNLGAAN

SEQ ID NO: 178076 - protein, 13 aa, Mycobacterium tuberculosis
GNVGIFNLGAANV

SEQ ID NO: 178077 - protein, 13 aa, Mycobacterium tuberculosis
NVGIFNLGAANVG

SEQ ID NO: 178078 - protein, 13 aa, Mycobacterium tuberculosis
VGIFNLGAANVGA

SEQ ID NO: 178079 - protein, 13 aa, Mycobacterium tuberculosis
GIFNLGAANVGAQ

SEQ ID NO: 178080 - protein, 13 aa, Mycobacterium tuberculosis
IFNLGAANVGAQN

SEQ ID NO: 178081 - protein, 13 aa, Mycobacterium tuberculosis
FNLGAANVGAQNL

SEQ ID NO: 178082 - protein, 13 aa, Mycobacterium tuberculosis
NLGAANVGAQNLG

SEQ ID NO: 178083 - protein, 13 aa, Mycobacterium tuberculosis
LGAANVGAQNLGA

SEQ ID NO: 178084 - protein, 13 aa, Mycobacterium tuberculosis
GAANVGAQNLGAA

SEQ ID NO: 178085 - protein, 13 aa, Mycobacterium tuberculosis
AANVGAQNLGAAN

SEQ ID NO: 178086 - protein, 13 aa, Mycobacterium tuberculosis
ANVGAQNLGAANA

SEQ ID NO: 178087 - protein, 13 aa, Mycobacterium tuberculosis
NVGAQNLGAANAG

SEQ ID NO: 178088 - protein, 13 aa, Mycobacterium tuberculosis
VGAQNLGAANAGS

SEQ ID NO: 178089 - protein, 13 aa, Mycobacterium tuberculosis
GAQNLGAANAGSG

SEQ ID NO: 178090 - protein, 13 aa, Mycobacterium tuberculosis
AQNLGAANAGSGN

SEQ ID NO: 178091 - protein, 13 aa, Mycobacterium tuberculosis
QNLGAANAGSGNF

SEQ ID NO: 178092 - protein, 13 aa, Mycobacterium tuberculosis
NLGAANAGSGNFG

SEQ ID NO: 178093 - protein, 13 aa, Mycobacterium tuberculosis
LGAANAGSGNFGF

SEQ ID NO: 178094 - protein, 13 aa, Mycobacterium tuberculosis
GAANAGSGNFGFG

SEQ ID NO: 178095 - protein, 13 aa, Mycobacterium tuberculosis
AANAGSGNFGFGN

SEQ ID NO: 178096 - protein, 13 aa, Mycobacterium tuberculosis
ANAGSGNFGFGNI

SEQ ID NO: 178097 - protein, 13 aa, Mycobacterium tuberculosis
NAGSGNFGFGNIG

SEQ ID NO: 178098 - protein, 13 aa, Mycobacterium tuberculosis
AGSGNFGFGNIGN

SEQ ID NO: 178099 - protein, 13 aa, Mycobacterium tuberculosis
GSGNFGFGNIGNA

SEQ ID NO: 178100 - protein, 13 aa, Mycobacterium tuberculosis
SGNFGFGNIGNAN

SEQ ID NO: 178101 - protein, 13 aa, Mycobacterium tuberculosis
GNFGFGNIGNANF

SEQ ID NO: 178102 - protein, 13 aa, Mycobacterium tuberculosis
NFGFGNIGNANFG

SEQ ID NO: 178103 - protein, 13 aa, Mycobacterium tuberculosis
FGFGNIGNANFGF

SEQ ID NO: 178104 - protein, 13 aa, Mycobacterium tuberculosis
GFGNIGNANFGFG

SEQ ID NO: 178105 - protein, 13 aa, Mycobacterium tuberculosis
FGNIGNANFGFGN

SEQ ID NO: 178106 - protein, 13 aa, Mycobacterium tuberculosis
GNIGNANFGFGNS

SEQ ID NO: 178107 - protein, 13 aa, Mycobacterium tuberculosis
NIGNANFGFGNSG

SEQ ID NO: 178108 - protein, 13 aa, Mycobacterium tuberculosis
IGNANFGFGNSGL

SEQ ID NO: 178109 - protein, 13 aa, Mycobacterium tuberculosis
GNANFGFGNSGLG

SEQ ID NO: 178110 - protein, 13 aa, Mycobacterium tuberculosis
NANFGFGNSGLGL

SEQ ID NO: 178111 - protein, 13 aa, Mycobacterium tuberculosis
ANFGFGNSGLGLP

SEQ ID NO: 178112 - protein, 13 aa, Mycobacterium tuberculosis
NFGFGNSGLGLPP

SEQ ID NO: 178113 - protein, 13 aa, Mycobacterium tuberculosis
FGFGNSGLGLPPG

SEQ ID NO: 178114 - protein, 13 aa, Mycobacterium tuberculosis
GFGNSGLGLPPGM

SEQ ID NO: 178115 - protein, 13 aa, Mycobacterium tuberculosis
FGNSGLGLPPGMG

SEQ ID NO: 178116 - protein, 13 aa, Mycobacterium tuberculosis
GNSGLGLPPGMGN

SEQ ID NO: 178117 - protein, 13 aa, Mycobacterium tuberculosis
NSGLGLPPGMGNI

SEQ ID NO: 178118 - protein, 13 aa, Mycobacterium tuberculosis
SGLGLPPGMGNIG

SEQ ID NO: 178119 - protein, 13 aa, Mycobacterium tuberculosis
GLGLPPGMGNIGL

SEQ ID NO: 178120 - protein, 13 aa, Mycobacterium tuberculosis
LGLPPGMGNIGLG

SEQ ID NO: 178121 - protein, 13 aa, Mycobacterium tuberculosis
GLPPGMGNIGLGN

SEQ ID NO: 178122 - protein, 13 aa, Mycobacterium tuberculosis
LPPGMGNIGLGNA

SEQ ID NO: 178123 - protein, 13 aa, Mycobacterium tuberculosis
PPGMGNIGLGNAG

SEQ ID NO: 178124 - protein, 13 aa, Mycobacterium tuberculosis
PGMGNIGLGNAGS

SEQ ID NO: 178125 - protein, 13 aa, Mycobacterium tuberculosis
GMGNIGLGNAGSS

SEQ ID NO: 178126 - protein, 13 aa, Mycobacterium tuberculosis
MGNIGLGNAGSSN

SEQ ID NO: 178127 - protein, 13 aa, Mycobacterium tuberculosis
GNIGLGNAGSSNY

SEQ ID NO: 178128 - protein, 13 aa, Mycobacterium tuberculosis
NIGLGNAGSSNYG

SEQ ID NO: 178129 - protein, 13 aa, Mycobacterium tuberculosis
IGLGNAGSSNYGL

SEQ ID NO: 178130 - protein, 13 aa, Mycobacterium tuberculosis
GLGNAGSSNYGLA

SEQ ID NO: 178131 - protein, 13 aa, Mycobacterium tuberculosis
LGNAGSSNYGLAN

SEQ ID NO: 178132 - protein, 13 aa, Mycobacterium tuberculosis
GNAGSSNYGLANL

SEQ ID NO: 178133 - protein, 13 aa, Mycobacterium tuberculosis
NAGSSNYGLANLG

SEQ ID NO: 178134 - protein, 13 aa, Mycobacterium tuberculosis
AGSSNYGLANLGV

SEQ ID NO: 178135 - protein, 13 aa, Mycobacterium tuberculosis
GSSNYGLANLGVG

SEQ ID NO: 178136 - protein, 13 aa, Mycobacterium tuberculosis
SSNYGLANLGVGN

SEQ ID NO: 178137 - protein, 13 aa, Mycobacterium tuberculosis
SNYGLANLGVGNI

SEQ ID NO: 178138 - protein, 13 aa, Mycobacterium tuberculosis
NYGLANLGVGNIG

SEQ ID NO: 178139 - protein, 13 aa, Mycobacterium tuberculosis
YGLANLGVGNIGF

SEQ ID NO: 178140 - protein, 13 aa, Mycobacterium tuberculosis
GLANLGVGNIGFA

SEQ ID NO: 178141 - protein, 13 aa, Mycobacterium tuberculosis
LANLGVGNIGFAN

SEQ ID NO: 178142 - protein, 13 aa, Mycobacterium tuberculosis
ANLGVGNIGFANT

SEQ ID NO: 178143 - protein, 13 aa, Mycobacterium tuberculosis
NLGVGNIGFANTG

SEQ ID NO: 178144 - protein, 13 aa, Mycobacterium tuberculosis
LGVGNIGFANTGS

SEQ ID NO: 178145 - protein, 13 aa, Mycobacterium tuberculosis
GVGNIGFANTGSN

SEQ ID NO: 178146 - protein, 13 aa, Mycobacterium tuberculosis
VGNIGFANTGSNN

SEQ ID NO: 178147 - protein, 13 aa, Mycobacterium tuberculosis
GNIGFANTGSNNI

SEQ ID NO: 178148 - protein, 13 aa, Mycobacterium tuberculosis
NIGFANTGSNNIG

SEQ ID NO: 178149 - protein, 13 aa, Mycobacterium tuberculosis
IGFANTGSNNIGI

SEQ ID NO: 178150 - protein, 13 aa, Mycobacterium tuberculosis
GFANTGSNNIGIG

SEQ ID NO: 178151 - protein, 13 aa, Mycobacterium tuberculosis
FANTGSNNIGIGL

SEQ ID NO: 178152 - protein, 13 aa, Mycobacterium tuberculosis
ANTGSNNIGIGLT

SEQ ID NO: 178153 - protein, 13 aa, Mycobacterium tuberculosis
NTGSNNIGIGLTG

SEQ ID NO: 178154 - protein, 13 aa, Mycobacterium tuberculosis
TGSNNIGIGLTGD

SEQ ID NO: 178155 - protein, 13 aa, Mycobacterium tuberculosis
GSNNIGIGLTGDN

SEQ ID NO: 178156 - protein, 13 aa, Mycobacterium tuberculosis
SNNIGIGLTGDNL

SEQ ID NO: 178157 - protein, 13 aa, Mycobacterium tuberculosis
NNIGIGLTGDNLT

SEQ ID NO: 178158 - protein, 13 aa, Mycobacterium tuberculosis
NIGIGLTGDNLTG

SEQ ID NO: 178159 - protein, 13 aa, Mycobacterium tuberculosis
IGIGLTGDNLTGI

SEQ ID NO: 178160 - protein, 13 aa, Mycobacterium tuberculosis
GIGLTGDNLTGIG

SEQ ID NO: 178161 - protein, 13 aa, Mycobacterium tuberculosis
IGLTGDNLTGIGG

SEQ ID NO: 178162 - protein, 13 aa, Mycobacterium tuberculosis
GLTGDNLTGIGGL

SEQ ID NO: 178163 - protein, 13 aa, Mycobacterium tuberculosis
LTGDNLTGIGGLN

SEQ ID NO: 178164 - protein, 13 aa, Mycobacterium tuberculosis
TGDNLTGIGGLNS

SEQ ID NO: 178165 - protein, 13 aa, Mycobacterium tuberculosis
GDNLTGIGGLNSG

SEQ ID NO: 178166 - protein, 13 aa, Mycobacterium tuberculosis
DNLTGIGGLNSGT

SEQ ID NO: 178167 - protein, 13 aa, Mycobacterium tuberculosis
NLTGIGGLNSGTG

SEQ ID NO: 178168 - protein, 13 aa, Mycobacterium tuberculosis
LTGIGGLNSGTGN

SEQ ID NO: 178169 - protein, 13 aa, Mycobacterium tuberculosis
TGIGGLNSGTGNL

SEQ ID NO: 178170 - protein, 13 aa, Mycobacterium tuberculosis
GIGGLNSGTGNLG

SEQ ID NO: 178171 - protein, 13 aa, Mycobacterium tuberculosis
IGGLNSGTGNLGL

SEQ ID NO: 178172 - protein, 13 aa, Mycobacterium tuberculosis
GGLNSGTGNLGLF

SEQ ID NO: 178173 - protein, 13 aa, Mycobacterium tuberculosis
GLNSGTGNLGLFN

SEQ ID NO: 178174 - protein, 13 aa, Mycobacterium tuberculosis
LNSGTGNLGLFNS

SEQ ID NO: 178175 - protein, 13 aa, Mycobacterium tuberculosis
NSGTGNLGLFNSG

SEQ ID NO: 178176 - protein, 13 aa, Mycobacterium tuberculosis
SGTGNLGLFNSGT

SEQ ID NO: 178177 - protein, 13 aa, Mycobacterium tuberculosis
GTGNLGLFNSGTG

SEQ ID NO: 178178 - protein, 13 aa, Mycobacterium tuberculosis
TGNLGLFNSGTGN

SEQ ID NO: 178179 - protein, 13 aa, Mycobacterium tuberculosis
GNLGLFNSGTGNI

SEQ ID NO: 178180 - protein, 13 aa, Mycobacterium tuberculosis
NLGLFNSGTGNIG

SEQ ID NO: 178181 - protein, 13 aa, Mycobacterium tuberculosis
LGLFNSGTGNIGF

SEQ ID NO: 178182 - protein, 13 aa, Mycobacterium tuberculosis
GLFNSGTGNIGFF

SEQ ID NO: 178183 - protein, 13 aa, Mycobacterium tuberculosis
LFNSGTGNIGFFN

SEQ ID NO: 178184 - protein, 13 aa, Mycobacterium tuberculosis
FNSGTGNIGFFNS

SEQ ID NO: 178185 - protein, 13 aa, Mycobacterium tuberculosis
NSGTGNIGFFNSG

SEQ ID NO: 178186 - protein, 13 aa, Mycobacterium tuberculosis
SGTGNIGFFNSGT

SEQ ID NO: 178187 - protein, 13 aa, Mycobacterium tuberculosis
GTGNIGFFNSGTG

SEQ ID NO: 178188 - protein, 13 aa, Mycobacterium tuberculosis
TGNIGFFNSGTGN

SEQ ID NO: 178189 - protein, 13 aa, Mycobacterium tuberculosis
GNIGFFNSGTGNF

SEQ ID NO: 178190 - protein, 13 aa, Mycobacterium tuberculosis
NIGFFNSGTGNFG

SEQ ID NO: 178191 - protein, 13 aa, Mycobacterium tuberculosis
IGFFNSGTGNFGV

SEQ ID NO: 178192 - protein, 13 aa, Mycobacterium tuberculosis
GFFNSGTGNFGVF

SEQ ID NO: 178193 - protein, 13 aa, Mycobacterium tuberculosis
FFNSGTGNFGVFN

SEQ ID NO: 178194 - protein, 13 aa, Mycobacterium tuberculosis
FNSGTGNFGVFNS

SEQ ID NO: 178195 - protein, 13 aa, Mycobacterium tuberculosis
NSGTGNFGVFNSG

SEQ ID NO: 178196 - protein, 13 aa, Mycobacterium tuberculosis
SGTGNFGVFNSGS

SEQ ID NO: 178197 - protein, 13 aa, Mycobacterium tuberculosis
GTGNFGVFNSGSY

SEQ ID NO: 178198 - protein, 13 aa, Mycobacterium tuberculosis
TGNFGVFNSGSYN

SEQ ID NO: 178199 - protein, 13 aa, Mycobacterium tuberculosis
GNFGVFNSGSYNT

SEQ ID NO: 178200 - protein, 13 aa, Mycobacterium tuberculosis
NFGVFNSGSYNTG

SEQ ID NO: 178201 - protein, 13 aa, Mycobacterium tuberculosis
FGVFNSGSYNTGV

SEQ ID NO: 178202 - protein, 13 aa, Mycobacterium tuberculosis
GVFNSGSYNTGVG

SEQ ID NO: 178203 - protein, 13 aa, Mycobacterium tuberculosis
VFNSGSYNTGVGN

SEQ ID NO: 178204 - protein, 13 aa, Mycobacterium tuberculosis
FNSGSYNTGVGNA

SEQ ID NO: 178205 - protein, 13 aa, Mycobacterium tuberculosis
NSGSYNTGVGNAG

SEQ ID NO: 178206 - protein, 13 aa, Mycobacterium tuberculosis
SGSYNTGVGNAGT

SEQ ID NO: 178207 - protein, 13 aa, Mycobacterium tuberculosis
GSYNTGVGNAGTA

SEQ ID NO: 178208 - protein, 13 aa, Mycobacterium tuberculosis
SYNTGVGNAGTAS

SEQ ID NO: 178209 - protein, 13 aa, Mycobacterium tuberculosis
YNTGVGNAGTAST

SEQ ID NO: 178210 - protein, 13 aa, Mycobacterium tuberculosis
NTGVGNAGTASTG

SEQ ID NO: 178211 - protein, 13 aa, Mycobacterium tuberculosis
TGVGNAGTASTGL

SEQ ID NO: 178212 - protein, 13 aa, Mycobacterium tuberculosis
GVGNAGTASTGLF

SEQ ID NO: 178213 - protein, 13 aa, Mycobacterium tuberculosis
VGNAGTASTGLFN

SEQ ID NO: 178214 - protein, 13 aa, Mycobacterium tuberculosis
GNAGTASTGLFNV

SEQ ID NO: 178215 - protein, 13 aa, Mycobacterium tuberculosis
NAGTASTGLFNVG

SEQ ID NO: 178216 - protein, 13 aa, Mycobacterium tuberculosis
AGTASTGLFNVGG

SEQ ID NO: 178217 - protein, 13 aa, Mycobacterium tuberculosis
GTASTGLFNVGGF

SEQ ID NO: 178218 - protein, 13 aa, Mycobacterium tuberculosis
TASTGLFNVGGFN

SEQ ID NO: 178219 - protein, 13 aa, Mycobacterium tuberculosis
ASTGLFNVGGFNT

SEQ ID NO: 178220 - protein, 13 aa, Mycobacterium tuberculosis
STGLFNVGGFNTG

SEQ ID NO: 178221 - protein, 13 aa, Mycobacterium tuberculosis
TGLFNVGGFNTGV

SEQ ID NO: 178222 - protein, 13 aa, Mycobacterium tuberculosis
GLFNVGGFNTGVA

SEQ ID NO: 178223 - protein, 13 aa, Mycobacterium tuberculosis
LFNVGGFNTGVAN

SEQ ID NO: 178224 - protein, 13 aa, Mycobacterium tuberculosis
FNVGGFNTGVANV

SEQ ID NO: 178225 - protein, 13 aa, Mycobacterium tuberculosis
NVGGFNTGVANVG

SEQ ID NO: 178226 - protein, 13 aa, Mycobacterium tuberculosis
VGGFNTGVANVGS

SEQ ID NO: 178227 - protein, 13 aa, Mycobacterium tuberculosis
GGFNTGVANVGSY

SEQ ID NO: 178228 - protein, 13 aa, Mycobacterium tuberculosis
GFNTGVANVGSYN

SEQ ID NO: 178229 - protein, 13 aa, Mycobacterium tuberculosis
FNTGVANVGSYNT

SEQ ID NO: 178230 - protein, 13 aa, Mycobacterium tuberculosis
NTGVANVGSYNTG

SEQ ID NO: 178231 - protein, 13 aa, Mycobacterium tuberculosis
TGVANVGSYNTGS

SEQ ID NO: 178232 - protein, 13 aa, Mycobacterium tuberculosis
GVANVGSYNTGSF

SEQ ID NO: 178233 - protein, 13 aa, Mycobacterium tuberculosis
VANVGSYNTGSFN

SEQ ID NO: 178234 - protein, 13 aa, Mycobacterium tuberculosis
ANVGSYNTGSFNA

SEQ ID NO: 178235 - protein, 13 aa, Mycobacterium tuberculosis
NVGSYNTGSFNAG

SEQ ID NO: 178236 - protein, 13 aa, Mycobacterium tuberculosis
VGSYNTGSFNAGN

SEQ ID NO: 178237 - protein, 13 aa, Mycobacterium tuberculosis
GSYNTGSFNAGNT

SEQ ID NO: 178238 - protein, 13 aa, Mycobacterium tuberculosis
SYNTGSFNAGNTN

SEQ ID NO: 178239 - protein, 13 aa, Mycobacterium tuberculosis
YNTGSFNAGNTNT

SEQ ID NO: 178240 - protein, 13 aa, Mycobacterium tuberculosis
NTGSFNAGNTNTG

SEQ ID NO: 178241 - protein, 13 aa, Mycobacterium tuberculosis
TGSFNAGNTNTGG

SEQ ID NO: 178242 - protein, 13 aa, Mycobacterium tuberculosis
GSFNAGNTNTGGF

SEQ ID NO: 178243 - protein, 13 aa, Mycobacterium tuberculosis
SFNAGNTNTGGFN

SEQ ID NO: 178244 - protein, 13 aa, Mycobacterium tuberculosis
FNAGNTNTGGFNP

SEQ ID NO: 178245 - protein, 13 aa, Mycobacterium tuberculosis
NAGNTNTGGFNPG

SEQ ID NO: 178246 - protein, 13 aa, Mycobacterium tuberculosis
AGNTNTGGFNPGN

SEQ ID NO: 178247 - protein, 13 aa, Mycobacterium tuberculosis
GNTNTGGFNPGNV

SEQ ID NO: 178248 - protein, 13 aa, Mycobacterium tuberculosis
NTNTGGFNPGNVN

SEQ ID NO: 178249 - protein, 13 aa, Mycobacterium tuberculosis
TNTGGFNPGNVNT

SEQ ID NO: 178250 - protein, 13 aa, Mycobacterium tuberculosis
NTGGFNPGNVNTG

SEQ ID NO: 178251 - protein, 13 aa, Mycobacterium tuberculosis
TGGFNPGNVNTGW

SEQ ID NO: 178252 - protein, 13 aa, Mycobacterium tuberculosis
GGFNPGNVNTGWL

SEQ ID NO: 178253 - protein, 13 aa, Mycobacterium tuberculosis
GFNPGNVNTGWLN

SEQ ID NO: 178254 - protein, 13 aa, Mycobacterium tuberculosis
FNPGNVNTGWLNT

SEQ ID NO: 178255 - protein, 13 aa, Mycobacterium tuberculosis
NPGNVNTGWLNTG

SEQ ID NO: 178256 - protein, 13 aa, Mycobacterium tuberculosis
PGNVNTGWLNTGN

SEQ ID NO: 178257 - protein, 13 aa, Mycobacterium tuberculosis
GNVNTGWLNTGNT

SEQ ID NO: 178258 - protein, 13 aa, Mycobacterium tuberculosis
NVNTGWLNTGNTN

SEQ ID NO: 178259 - protein, 13 aa, Mycobacterium tuberculosis
VNTGWLNTGNTNT

SEQ ID NO: 178260 - protein, 13 aa, Mycobacterium tuberculosis
NTGWLNTGNTNTG

SEQ ID NO: 178261 - protein, 13 aa, Mycobacterium tuberculosis
TGWLNTGNTNTGI

SEQ ID NO: 178262 - protein, 13 aa, Mycobacterium tuberculosis
GWLNTGNTNTGIA

SEQ ID NO: 178263 - protein, 13 aa, Mycobacterium tuberculosis
WLNTGNTNTGIAN

SEQ ID NO: 178264 - protein, 13 aa, Mycobacterium tuberculosis
LNTGNTNTGIANS

SEQ ID NO: 178265 - protein, 13 aa, Mycobacterium tuberculosis
NTGNTNTGIANSG

SEQ ID NO: 178266 - protein, 13 aa, Mycobacterium tuberculosis
TGNTNTGIANSGN

SEQ ID NO: 178267 - protein, 13 aa, Mycobacterium tuberculosis
GNTNTGIANSGNV

SEQ ID NO: 178268 - protein, 13 aa, Mycobacterium tuberculosis
NTNTGIANSGNVN

SEQ ID NO: 178269 - protein, 13 aa, Mycobacterium tuberculosis
TNTGIANSGNVNT

SEQ ID NO: 178270 - protein, 13 aa, Mycobacterium tuberculosis
NTGIANSGNVNTG

SEQ ID NO: 178271 - protein, 13 aa, Mycobacterium tuberculosis
TGIANSGNVNTGA

SEQ ID NO: 178272 - protein, 13 aa, Mycobacterium tuberculosis
GIANSGNVNTGAF

SEQ ID NO: 178273 - protein, 13 aa, Mycobacterium tuberculosis
IANSGNVNTGAFI

SEQ ID NO: 178274 - protein, 13 aa, Mycobacterium tuberculosis
ANSGNVNTGAFIS

SEQ ID NO: 178275 - protein, 13 aa, Mycobacterium tuberculosis
NSGNVNTGAFISG

SEQ ID NO: 178276 - protein, 13 aa, Mycobacterium tuberculosis
SGNVNTGAFISGN

SEQ ID NO: 178277 - protein, 13 aa, Mycobacterium tuberculosis
GNVNTGAFISGNF

SEQ ID NO: 178278 - protein, 13 aa, Mycobacterium tuberculosis
NVNTGAFISGNFS

SEQ ID NO: 178279 - protein, 13 aa, Mycobacterium tuberculosis
VNTGAFISGNFSN

SEQ ID NO: 178280 - protein, 13 aa, Mycobacterium tuberculosis
NTGAFISGNFSNG

SEQ ID NO: 178281 - protein, 13 aa, Mycobacterium tuberculosis
TGAFISGNFSNGV

SEQ ID NO: 178282 - protein, 13 aa, Mycobacterium tuberculosis
GAFISGNFSNGVL

SEQ ID NO: 178283 - protein, 13 aa, Mycobacterium tuberculosis
AFISGNFSNGVLW

SEQ ID NO: 178284 - protein, 13 aa, Mycobacterium tuberculosis
FISGNFSNGVLWR

SEQ ID NO: 178285 - protein, 13 aa, Mycobacterium tuberculosis
ISGNFSNGVLWRG

SEQ ID NO: 178286 - protein, 13 aa, Mycobacterium tuberculosis
SGNFSNGVLWRGD

SEQ ID NO: 178287 - protein, 13 aa, Mycobacterium tuberculosis
GNFSNGVLWRGDY

SEQ ID NO: 178288 - protein, 13 aa, Mycobacterium tuberculosis
NFSNGVLWRGDYE

SEQ ID NO: 178289 - protein, 13 aa, Mycobacterium tuberculosis
FSNGVLWRGDYEG

SEQ ID NO: 178290 - protein, 13 aa, Mycobacterium tuberculosis
SNGVLWRGDYEGL

SEQ ID NO: 178291 - protein, 13 aa, Mycobacterium tuberculosis
NGVLWRGDYEGLW

SEQ ID NO: 178292 - protein, 13 aa, Mycobacterium tuberculosis
GVLWRGDYEGLWG

SEQ ID NO: 178293 - protein, 13 aa, Mycobacterium tuberculosis
VLWRGDYEGLWGL

SEQ ID NO: 178294 - protein, 13 aa, Mycobacterium tuberculosis
LWRGDYEGLWGLS

SEQ ID NO: 178295 - protein, 13 aa, Mycobacterium tuberculosis
WRGDYEGLWGLSG

SEQ ID NO: 178296 - protein, 13 aa, Mycobacterium tuberculosis
RGDYEGLWGLSGG

SEQ ID NO: 178297 - protein, 13 aa, Mycobacterium tuberculosis
GDYEGLWGLSGGS

SEQ ID NO: 178298 - protein, 13 aa, Mycobacterium tuberculosis
DYEGLWGLSGGST

SEQ ID NO: 178299 - protein, 13 aa, Mycobacterium tuberculosis
YEGLWGLSGGSTI

SEQ ID NO: 178300 - protein, 13 aa, Mycobacterium tuberculosis
EGLWGLSGGSTIP

SEQ ID NO: 178301 - protein, 13 aa, Mycobacterium tuberculosis
GLWGLSGGSTIPA

SEQ ID NO: 178302 - protein, 13 aa, Mycobacterium tuberculosis
LWGLSGGSTIPAI

SEQ ID NO: 178303 - protein, 13 aa, Mycobacterium tuberculosis
WGLSGGSTIPAIP

SEQ ID NO: 178304 - protein, 13 aa, Mycobacterium tuberculosis
GLSGGSTIPAIPI

SEQ ID NO: 178305 - protein, 13 aa, Mycobacterium tuberculosis
LSGGSTIPAIPIG

SEQ ID NO: 178306 - protein, 13 aa, Mycobacterium tuberculosis
SGGSTIPAIPIGL

SEQ ID NO: 178307 - protein, 13 aa, Mycobacterium tuberculosis
GGSTIPAIPIGLE

SEQ ID NO: 178308 - protein, 13 aa, Mycobacterium tuberculosis
GSTIPAIPIGLEL

SEQ ID NO: 178309 - protein, 13 aa, Mycobacterium tuberculosis
STIPAIPIGLELN

SEQ ID NO: 178310 - protein, 13 aa, Mycobacterium tuberculosis
TIPAIPIGLELNG

SEQ ID NO: 178311 - protein, 13 aa, Mycobacterium tuberculosis
IPAIPIGLELNGG

SEQ ID NO: 178312 - protein, 13 aa, Mycobacterium tuberculosis
PAIPIGLELNGGV

SEQ ID NO: 178313 - protein, 13 aa, Mycobacterium tuberculosis
AIPIGLELNGGVG

SEQ ID NO: 178314 - protein, 13 aa, Mycobacterium tuberculosis
IPIGLELNGGVGP

SEQ ID NO: 178315 - protein, 13 aa, Mycobacterium tuberculosis
PIGLELNGGVGPI

SEQ ID NO: 178316 - protein, 13 aa, Mycobacterium tuberculosis
IGLELNGGVGPIT

SEQ ID NO: 178317 - protein, 13 aa, Mycobacterium tuberculosis
GLELNGGVGPITV

SEQ ID NO: 178318 - protein, 13 aa, Mycobacterium tuberculosis
LELNGGVGPITVL

SEQ ID NO: 178319 - protein, 13 aa, Mycobacterium tuberculosis
ELNGGVGPITVLP

SEQ ID NO: 178320 - protein, 13 aa, Mycobacterium tuberculosis
LNGGVGPITVLPI

SEQ ID NO: 178321 - protein, 13 aa, Mycobacterium tuberculosis
NGGVGPITVLPIQ

SEQ ID NO: 178322 - protein, 13 aa, Mycobacterium tuberculosis
GGVGPITVLPIQI

SEQ ID NO: 178323 - protein, 13 aa, Mycobacterium tuberculosis
GVGPITVLPIQIL

SEQ ID NO: 178324 - protein, 13 aa, Mycobacterium tuberculosis
VGPITVLPIQILP

SEQ ID NO: 178325 - protein, 13 aa, Mycobacterium tuberculosis
GPITVLPIQILPT

SEQ ID NO: 178326 - protein, 13 aa, Mycobacterium tuberculosis
PITVLPIQILPTI

SEQ ID NO: 178327 - protein, 13 aa, Mycobacterium tuberculosis
ITVLPIQILPTIP

SEQ ID NO: 178328 - protein, 13 aa, Mycobacterium tuberculosis
TVLPIQILPTIPL

SEQ ID NO: 178329 - protein, 13 aa, Mycobacterium tuberculosis
VLPIQILPTIPLN

SEQ ID NO: 178330 - protein, 13 aa, Mycobacterium tuberculosis
LPIQILPTIPLNI

SEQ ID NO: 178331 - protein, 13 aa, Mycobacterium tuberculosis
PIQILPTIPLNIH

SEQ ID NO: 178332 - protein, 13 aa, Mycobacterium tuberculosis
IQILPTIPLNIHQ

SEQ ID NO: 178333 - protein, 13 aa, Mycobacterium tuberculosis
QILPTIPLNIHQT

SEQ ID NO: 178334 - protein, 13 aa, Mycobacterium tuberculosis
ILPTIPLNIHQTF

SEQ ID NO: 178335 - protein, 13 aa, Mycobacterium tuberculosis
LPTIPLNIHQTFS

SEQ ID NO: 178336 - protein, 13 aa, Mycobacterium tuberculosis
PTIPLNIHQTFSL

SEQ ID NO: 178337 - protein, 13 aa, Mycobacterium tuberculosis
TIPLNIHQTFSLG

SEQ ID NO: 178338 - protein, 13 aa, Mycobacterium tuberculosis
IPLNIHQTFSLGP

SEQ ID NO: 178339 - protein, 13 aa, Mycobacterium tuberculosis
PLNIHQTFSLGPL

SEQ ID NO: 178340 - protein, 13 aa, Mycobacterium tuberculosis
LNIHQTFSLGPLV

SEQ ID NO: 178341 - protein, 13 aa, Mycobacterium tuberculosis
NIHQTFSLGPLVV

SEQ ID NO: 178342 - protein, 13 aa, Mycobacterium tuberculosis
IHQTFSLGPLVVP

SEQ ID NO: 178343 - protein, 13 aa, Mycobacterium tuberculosis
HQTFSLGPLVVPD

SEQ ID NO: 178344 - protein, 13 aa, Mycobacterium tuberculosis
QTFSLGPLVVPDI

SEQ ID NO: 178345 - protein, 13 aa, Mycobacterium tuberculosis
TFSLGPLVVPDIV

SEQ ID NO: 178346 - protein, 13 aa, Mycobacterium tuberculosis
FSLGPLVVPDIVI

SEQ ID NO: 178347 - protein, 13 aa, Mycobacterium tuberculosis
SLGPLVVPDIVIP

SEQ ID NO: 178348 - protein, 13 aa, Mycobacterium tuberculosis
LGPLVVPDIVIPA

SEQ ID NO: 178349 - protein, 13 aa, Mycobacterium tuberculosis
GPLVVPDIVIPAF

SEQ ID NO: 178350 - protein, 13 aa, Mycobacterium tuberculosis
PLVVPDIVIPAFG

SEQ ID NO: 178351 - protein, 13 aa, Mycobacterium tuberculosis
LVVPDIVIPAFGG

SEQ ID NO: 178352 - protein, 13 aa, Mycobacterium tuberculosis
VVPDIVIPAFGGG

SEQ ID NO: 178353 - protein, 13 aa, Mycobacterium tuberculosis
VPDIVIPAFGGGT

SEQ ID NO: 178354 - protein, 13 aa, Mycobacterium tuberculosis
PDIVIPAFGGGTA

SEQ ID NO: 178355 - protein, 13 aa, Mycobacterium tuberculosis
DIVIPAFGGGTAI

SEQ ID NO: 178356 - protein, 13 aa, Mycobacterium tuberculosis
IVIPAFGGGTAIP

SEQ ID NO: 178357 - protein, 13 aa, Mycobacterium tuberculosis
VIPAFGGGTAIPI

SEQ ID NO: 178358 - protein, 13 aa, Mycobacterium tuberculosis
IPAFGGGTAIPIS

SEQ ID NO: 178359 - protein, 13 aa, Mycobacterium tuberculosis
PAFGGGTAIPISV

SEQ ID NO: 178360 - protein, 13 aa, Mycobacterium tuberculosis
AFGGGTAIPISVG

SEQ ID NO: 178361 - protein, 13 aa, Mycobacterium tuberculosis
FGGGTAIPISVGP

SEQ ID NO: 178362 - protein, 13 aa, Mycobacterium tuberculosis
GGGTAIPISVGPI

SEQ ID NO: 178363 - protein, 13 aa, Mycobacterium tuberculosis
GGTAIPISVGPIT

SEQ ID NO: 178364 - protein, 13 aa, Mycobacterium tuberculosis
GTAIPISVGPITI

SEQ ID NO: 178365 - protein, 13 aa, Mycobacterium tuberculosis
TAIPISVGPITIS

SEQ ID NO: 178366 - protein, 13 aa, Mycobacterium tuberculosis
AIPISVGPITISP

SEQ ID NO: 178367 - protein, 13 aa, Mycobacterium tuberculosis
IPISVGPITISPI

SEQ ID NO: 178368 - protein, 13 aa, Mycobacterium tuberculosis
PISVGPITISPIT

SEQ ID NO: 178369 - protein, 13 aa, Mycobacterium tuberculosis
ISVGPITISPITL

SEQ ID NO: 178370 - protein, 13 aa, Mycobacterium tuberculosis
SVGPITISPITLF

SEQ ID NO: 178371 - protein, 13 aa, Mycobacterium tuberculosis
VGPITISPITLFP

SEQ ID NO: 178372 - protein, 13 aa, Mycobacterium tuberculosis
GPITISPITLFPA

SEQ ID NO: 178373 - protein, 13 aa, Mycobacterium tuberculosis
PITISPITLFPAQ

SEQ ID NO: 178374 - protein, 13 aa, Mycobacterium tuberculosis
ITISPITLFPAQN

SEQ ID NO: 178375 - protein, 13 aa, Mycobacterium tuberculosis
TISPITLFPAQNF

SEQ ID NO: 178376 - protein, 13 aa, Mycobacterium tuberculosis
ISPITLFPAQNFN

SEQ ID NO: 178377 - protein, 13 aa, Mycobacterium tuberculosis
SPITLFPAQNFNT

SEQ ID NO: 178378 - protein, 13 aa, Mycobacterium tuberculosis
PITLFPAQNFNTT

SEQ ID NO: 178379 - protein, 13 aa, Mycobacterium tuberculosis
ITLFPAQNFNTTF

SEQ ID NO: 178380 - protein, 13 aa, Mycobacterium tuberculosis
TLFPAQNFNTTFP

SEQ ID NO: 178381 - protein, 13 aa, Mycobacterium tuberculosis
LFPAQNFNTTFPV

SEQ ID NO: 178382 - protein, 13 aa, Mycobacterium tuberculosis
FPAQNFNTTFPVG

SEQ ID NO: 178383 - protein, 13 aa, Mycobacterium tuberculosis
PAQNFNTTFPVGP

SEQ ID NO: 178384 - protein, 13 aa, Mycobacterium tuberculosis
AQNFNTTFPVGPF

SEQ ID NO: 178385 - protein, 13 aa, Mycobacterium tuberculosis
QNFNTTFPVGPFF

SEQ ID NO: 178386 - protein, 13 aa, Mycobacterium tuberculosis
NFNTTFPVGPFFG

SEQ ID NO: 178387 - protein, 13 aa, Mycobacterium tuberculosis
FNTTFPVGPFFGL

SEQ ID NO: 178388 - protein, 13 aa, Mycobacterium tuberculosis
NTTFPVGPFFGLG

SEQ ID NO: 178389 - protein, 13 aa, Mycobacterium tuberculosis
TTFPVGPFFGLGV

SEQ ID NO: 178390 - protein, 13 aa, Mycobacterium tuberculosis
TFPVGPFFGLGVV

SEQ ID NO: 178391 - protein, 13 aa, Mycobacterium tuberculosis
FPVGPFFGLGVVN

SEQ ID NO: 178392 - protein, 13 aa, Mycobacterium tuberculosis
PVGPFFGLGVVNI

SEQ ID NO: 178393 - protein, 13 aa, Mycobacterium tuberculosis
VGPFFGLGVVNIS

SEQ ID NO: 178394 - protein, 13 aa, Mycobacterium tuberculosis
GPFFGLGVVNISG

SEQ ID NO: 178395 - protein, 13 aa, Mycobacterium tuberculosis
PFFGLGVVNISGI

SEQ ID NO: 178396 - protein, 13 aa, Mycobacterium tuberculosis
FFGLGVVNISGIE

SEQ ID NO: 178397 - protein, 13 aa, Mycobacterium tuberculosis
FGLGVVNISGIEI

SEQ ID NO: 178398 - protein, 13 aa, Mycobacterium tuberculosis
GLGVVNISGIEIK

SEQ ID NO: 178399 - protein, 13 aa, Mycobacterium tuberculosis
LGVVNISGIEIKD

SEQ ID NO: 178400 - protein, 13 aa, Mycobacterium tuberculosis
GVVNISGIEIKDL

SEQ ID NO: 178401 - protein, 13 aa, Mycobacterium tuberculosis
VVNISGIEIKDLA

SEQ ID NO: 178402 - protein, 13 aa, Mycobacterium tuberculosis
VNISGIEIKDLAG

SEQ ID NO: 178403 - protein, 13 aa, Mycobacterium tuberculosis
NISGIEIKDLAGN

SEQ ID NO: 178404 - protein, 13 aa, Mycobacterium tuberculosis
ISGIEIKDLAGNV

SEQ ID NO: 178405 - protein, 13 aa, Mycobacterium tuberculosis
SGIEIKDLAGNVT

SEQ ID NO: 178406 - protein, 13 aa, Mycobacterium tuberculosis
GIEIKDLAGNVTL

SEQ ID NO: 178407 - protein, 13 aa, Mycobacterium tuberculosis
IEIKDLAGNVTLQ

SEQ ID NO: 178408 - protein, 13 aa, Mycobacterium tuberculosis
EIKDLAGNVTLQL

SEQ ID NO: 178409 - protein, 13 aa, Mycobacterium tuberculosis
IKDLAGNVTLQLG

SEQ ID NO: 178410 - protein, 13 aa, Mycobacterium tuberculosis
KDLAGNVTLQLGN

SEQ ID NO: 178411 - protein, 13 aa, Mycobacterium tuberculosis
DLAGNVTLQLGNL

SEQ ID NO: 178412 - protein, 13 aa, Mycobacterium tuberculosis
LAGNVTLQLGNLN

SEQ ID NO: 178413 - protein, 13 aa, Mycobacterium tuberculosis
AGNVTLQLGNLNI

SEQ ID NO: 178414 - protein, 13 aa, Mycobacterium tuberculosis
GNVTLQLGNLNID

SEQ ID NO: 178415 - protein, 13 aa, Mycobacterium tuberculosis
NVTLQLGNLNIDT

SEQ ID NO: 178416 - protein, 13 aa, Mycobacterium tuberculosis
VTLQLGNLNIDTR

SEQ ID NO: 178417 - protein, 13 aa, Mycobacterium tuberculosis
TLQLGNLNIDTRI

SEQ ID NO: 178418 - protein, 13 aa, Mycobacterium tuberculosis
LQLGNLNIDTRIN

SEQ ID NO: 178419 - protein, 13 aa, Mycobacterium tuberculosis
QLGNLNIDTRINQ

SEQ ID NO: 178420 - protein, 13 aa, Mycobacterium tuberculosis
LGNLNIDTRINQS

SEQ ID NO: 178421 - protein, 13 aa, Mycobacterium tuberculosis
GNLNIDTRINQSF

SEQ ID NO: 178422 - protein, 13 aa, Mycobacterium tuberculosis
NLNIDTRINQSFP

SEQ ID NO: 178423 - protein, 13 aa, Mycobacterium tuberculosis
LNIDTRINQSFPV

SEQ ID NO: 178424 - protein, 13 aa, Mycobacterium tuberculosis
NIDTRINQSFPVT

SEQ ID NO: 178425 - protein, 13 aa, Mycobacterium tuberculosis
IDTRINQSFPVTV

SEQ ID NO: 178426 - protein, 13 aa, Mycobacterium tuberculosis
DTRINQSFPVTVN

SEQ ID NO: 178427 - protein, 13 aa, Mycobacterium tuberculosis
TRINQSFPVTVNW

SEQ ID NO: 178428 - protein, 13 aa, Mycobacterium tuberculosis
RINQSFPVTVNWS

SEQ ID NO: 178429 - protein, 13 aa, Mycobacterium tuberculosis
INQSFPVTVNWST

SEQ ID NO: 178430 - protein, 13 aa, Mycobacterium tuberculosis
NQSFPVTVNWSTP

SEQ ID NO: 178431 - protein, 13 aa, Mycobacterium tuberculosis
QSFPVTVNWSTPA

SEQ ID NO: 178432 - protein, 13 aa, Mycobacterium tuberculosis
SFPVTVNWSTPAV

SEQ ID NO: 178433 - protein, 13 aa, Mycobacterium tuberculosis
FPVTVNWSTPAVT

SEQ ID NO: 178434 - protein, 13 aa, Mycobacterium tuberculosis
PVTVNWSTPAVTI

SEQ ID NO: 178435 - protein, 13 aa, Mycobacterium tuberculosis
VTVNWSTPAVTIF

SEQ ID NO: 178436 - protein, 13 aa, Mycobacterium tuberculosis
TVNWSTPAVTIFP

SEQ ID NO: 178437 - protein, 13 aa, Mycobacterium tuberculosis
VNWSTPAVTIFPN

SEQ ID NO: 178438 - protein, 13 aa, Mycobacterium tuberculosis
NWSTPAVTIFPNG

SEQ ID NO: 178439 - protein, 13 aa, Mycobacterium tuberculosis
WSTPAVTIFPNGI

SEQ ID NO: 178440 - protein, 13 aa, Mycobacterium tuberculosis
STPAVTIFPNGIS

SEQ ID NO: 178441 - protein, 13 aa, Mycobacterium tuberculosis
TPAVTIFPNGISI

SEQ ID NO: 178442 - protein, 13 aa, Mycobacterium tuberculosis
PAVTIFPNGISIP

SEQ ID NO: 178443 - protein, 13 aa, Mycobacterium tuberculosis
AVTIFPNGISIPN

SEQ ID NO: 178444 - protein, 13 aa, Mycobacterium tuberculosis
VTIFPNGISIPNN

SEQ ID NO: 178445 - protein, 13 aa, Mycobacterium tuberculosis
TIFPNGISIPNNP

SEQ ID NO: 178446 - protein, 13 aa, Mycobacterium tuberculosis
IFPNGISIPNNPL

SEQ ID NO: 178447 - protein, 13 aa, Mycobacterium tuberculosis
FPNGISIPNNPLA

SEQ ID NO: 178448 - protein, 13 aa, Mycobacterium tuberculosis
PNGISIPNNPLAL

SEQ ID NO: 178449 - protein, 13 aa, Mycobacterium tuberculosis
NGISIPNNPLALL

SEQ ID NO: 178450 - protein, 13 aa, Mycobacterium tuberculosis
GISIPNNPLALLA

SEQ ID NO: 178451 - protein, 13 aa, Mycobacterium tuberculosis
ISIPNNPLALLAS

SEQ ID NO: 178452 - protein, 13 aa, Mycobacterium tuberculosis
SIPNNPLALLASA

SEQ ID NO: 178453 - protein, 13 aa, Mycobacterium tuberculosis
IPNNPLALLASAS

SEQ ID NO: 178454 - protein, 13 aa, Mycobacterium tuberculosis
PNNPLALLASASI

SEQ ID NO: 178455 - protein, 13 aa, Mycobacterium tuberculosis
NNPLALLASASIG

SEQ ID NO: 178456 - protein, 13 aa, Mycobacterium tuberculosis
NPLALLASASIGT

SEQ ID NO: 178457 - protein, 13 aa, Mycobacterium tuberculosis
PLALLASASIGTL

SEQ ID NO: 178458 - protein, 13 aa, Mycobacterium tuberculosis
LALLASASIGTLG

SEQ ID NO: 178459 - protein, 13 aa, Mycobacterium tuberculosis
ALLASASIGTLGF

SEQ ID NO: 178460 - protein, 13 aa, Mycobacterium tuberculosis
LLASASIGTLGFT

SEQ ID NO: 178461 - protein, 13 aa, Mycobacterium tuberculosis
LASASIGTLGFTI

SEQ ID NO: 178462 - protein, 13 aa, Mycobacterium tuberculosis
ASASIGTLGFTIP

SEQ ID NO: 178463 - protein, 13 aa, Mycobacterium tuberculosis
SASIGTLGFTIPG

SEQ ID NO: 178464 - protein, 13 aa, Mycobacterium tuberculosis
ASIGTLGFTIPGF

SEQ ID NO: 178465 - protein, 13 aa, Mycobacterium tuberculosis
SIGTLGFTIPGFT

SEQ ID NO: 178466 - protein, 13 aa, Mycobacterium tuberculosis
IGTLGFTIPGFTI

SEQ ID NO: 178467 - protein, 13 aa, Mycobacterium tuberculosis
GTLGFTIPGFTIP

SEQ ID NO: 178468 - protein, 13 aa, Mycobacterium tuberculosis
TLGFTIPGFTIPA

SEQ ID NO: 178469 - protein, 13 aa, Mycobacterium tuberculosis
LGFTIPGFTIPAA

SEQ ID NO: 178470 - protein, 13 aa, Mycobacterium tuberculosis
GFTIPGFTIPAAP

SEQ ID NO: 178471 - protein, 13 aa, Mycobacterium tuberculosis
FTIPGFTIPAAPL

SEQ ID NO: 178472 - protein, 13 aa, Mycobacterium tuberculosis
TIPGFTIPAAPLP

SEQ ID NO: 178473 - protein, 13 aa, Mycobacterium tuberculosis
IPGFTIPAAPLPL

SEQ ID NO: 178474 - protein, 13 aa, Mycobacterium tuberculosis
PGFTIPAAPLPLT

SEQ ID NO: 178475 - protein, 13 aa, Mycobacterium tuberculosis
GFTIPAAPLPLTI

SEQ ID NO: 178476 - protein, 13 aa, Mycobacterium tuberculosis
FTIPAAPLPLTID

SEQ ID NO: 178477 - protein, 13 aa, Mycobacterium tuberculosis
TIPAAPLPLTIDI

SEQ ID NO: 178478 - protein, 13 aa, Mycobacterium tuberculosis
IPAAPLPLTIDID

SEQ ID NO: 178479 - protein, 13 aa, Mycobacterium tuberculosis
PAAPLPLTIDIDG

SEQ ID NO: 178480 - protein, 13 aa, Mycobacterium tuberculosis
AAPLPLTIDIDGQ

SEQ ID NO: 178481 - protein, 13 aa, Mycobacterium tuberculosis
APLPLTIDIDGQI

SEQ ID NO: 178482 - protein, 13 aa, Mycobacterium tuberculosis
PLPLTIDIDGQID

SEQ ID NO: 178483 - protein, 13 aa, Mycobacterium tuberculosis
LPLTIDIDGQIDG

SEQ ID NO: 178484 - protein, 13 aa, Mycobacterium tuberculosis
PLTIDIDGQIDGF

SEQ ID NO: 178485 - protein, 13 aa, Mycobacterium tuberculosis
LTIDIDGQIDGFS

SEQ ID NO: 178486 - protein, 13 aa, Mycobacterium tuberculosis
TIDIDGQIDGFST

SEQ ID NO: 178487 - protein, 13 aa, Mycobacterium tuberculosis
IDIDGQIDGFSTP

SEQ ID NO: 178488 - protein, 13 aa, Mycobacterium tuberculosis
DIDGQIDGFSTPP

SEQ ID NO: 178489 - protein, 13 aa, Mycobacterium tuberculosis
IDGQIDGFSTPPI

SEQ ID NO: 178490 - protein, 13 aa, Mycobacterium tuberculosis
DGQIDGFSTPPIT

SEQ ID NO: 178491 - protein, 13 aa, Mycobacterium tuberculosis
GQIDGFSTPPITI

SEQ ID NO: 178492 - protein, 13 aa, Mycobacterium tuberculosis
QIDGFSTPPITID

SEQ ID NO: 178493 - protein, 13 aa, Mycobacterium tuberculosis
IDGFSTPPITIDR

SEQ ID NO: 178494 - protein, 13 aa, Mycobacterium tuberculosis
DGFSTPPITIDRI

SEQ ID NO: 178495 - protein, 13 aa, Mycobacterium tuberculosis
GFSTPPITIDRIP

SEQ ID NO: 178496 - protein, 13 aa, Mycobacterium tuberculosis
FSTPPITIDRIPL

SEQ ID NO: 178497 - protein, 13 aa, Mycobacterium tuberculosis
STPPITIDRIPLN

SEQ ID NO: 178498 - protein, 13 aa, Mycobacterium tuberculosis
TPPITIDRIPLNL

SEQ ID NO: 178499 - protein, 13 aa, Mycobacterium tuberculosis
PPITIDRIPLNLG

SEQ ID NO: 178500 - protein, 13 aa, Mycobacterium tuberculosis
PITIDRIPLNLGA

SEQ ID NO: 178501 - protein, 13 aa, Mycobacterium tuberculosis
ITIDRIPLNLGAS

SEQ ID NO: 178502 - protein, 13 aa, Mycobacterium tuberculosis
TIDRIPLNLGASV

SEQ ID NO: 178503 - protein, 13 aa, Mycobacterium tuberculosis
IDRIPLNLGASVT

SEQ ID NO: 178504 - protein, 13 aa, Mycobacterium tuberculosis
DRIPLNLGASVTV

SEQ ID NO: 178505 - protein, 13 aa, Mycobacterium tuberculosis
RIPLNLGASVTVG

SEQ ID NO: 178506 - protein, 13 aa, Mycobacterium tuberculosis
IPLNLGASVTVGP

SEQ ID NO: 178507 - protein, 13 aa, Mycobacterium tuberculosis
PLNLGASVTVGPI

SEQ ID NO: 178508 - protein, 13 aa, Mycobacterium tuberculosis
LNLGASVTVGPIL

SEQ ID NO: 178509 - protein, 13 aa, Mycobacterium tuberculosis
NLGASVTVGPILI

SEQ ID NO: 178510 - protein, 13 aa, Mycobacterium tuberculosis
LGASVTVGPILIN

SEQ ID NO: 178511 - protein, 13 aa, Mycobacterium tuberculosis
GASVTVGPILING

SEQ ID NO: 178512 - protein, 13 aa, Mycobacterium tuberculosis
ASVTVGPILINGV

SEQ ID NO: 178513 - protein, 13 aa, Mycobacterium tuberculosis
SVTVGPILINGVN

SEQ ID NO: 178514 - protein, 13 aa, Mycobacterium tuberculosis
VTVGPILINGVNI

SEQ ID NO: 178515 - protein, 13 aa, Mycobacterium tuberculosis
TVGPILINGVNIP

SEQ ID NO: 178516 - protein, 13 aa, Mycobacterium tuberculosis
VGPILINGVNIPA

SEQ ID NO: 178517 - protein, 13 aa, Mycobacterium tuberculosis
GPILINGVNIPAT

SEQ ID NO: 178518 - protein, 13 aa, Mycobacterium tuberculosis
PILINGVNIPATP

SEQ ID NO: 178519 - protein, 13 aa, Mycobacterium tuberculosis
ILINGVNIPATPG

SEQ ID NO: 178520 - protein, 13 aa, Mycobacterium tuberculosis
LINGVNIPATPGF

SEQ ID NO: 178521 - protein, 13 aa, Mycobacterium tuberculosis
INGVNIPATPGFG

SEQ ID NO: 178522 - protein, 13 aa, Mycobacterium tuberculosis
NGVNIPATPGFGN

SEQ ID NO: 178523 - protein, 13 aa, Mycobacterium tuberculosis
GVNIPATPGFGNT

SEQ ID NO: 178524 - protein, 13 aa, Mycobacterium tuberculosis
VNIPATPGFGNTT

SEQ ID NO: 178525 - protein, 13 aa, Mycobacterium tuberculosis
NIPATPGFGNTTT

SEQ ID NO: 178526 - protein, 13 aa, Mycobacterium tuberculosis
IPATPGFGNTTTA

SEQ ID NO: 178527 - protein, 13 aa, Mycobacterium tuberculosis
PATPGFGNTTTAP

SEQ ID NO: 178528 - protein, 13 aa, Mycobacterium tuberculosis
ATPGFGNTTTAPS

SEQ ID NO: 178529 - protein, 13 aa, Mycobacterium tuberculosis
TPGFGNTTTAPSS

SEQ ID NO: 178530 - protein, 13 aa, Mycobacterium tuberculosis
PGFGNTTTAPSSG

SEQ ID NO: 178531 - protein, 13 aa, Mycobacterium tuberculosis
GFGNTTTAPSSGF

SEQ ID NO: 178532 - protein, 13 aa, Mycobacterium tuberculosis
FGNTTTAPSSGFF

SEQ ID NO: 178533 - protein, 13 aa, Mycobacterium tuberculosis
GNTTTAPSSGFFN

SEQ ID NO: 178534 - protein, 13 aa, Mycobacterium tuberculosis
NTTTAPSSGFFNS

SEQ ID NO: 178535 - protein, 13 aa, Mycobacterium tuberculosis
TTTAPSSGFFNSG

SEQ ID NO: 178536 - protein, 13 aa, Mycobacterium tuberculosis
TTAPSSGFFNSGD

SEQ ID NO: 178537 - protein, 13 aa, Mycobacterium tuberculosis
TAPSSGFFNSGDG

SEQ ID NO: 178538 - protein, 13 aa, Mycobacterium tuberculosis
APSSGFFNSGDGG

SEQ ID NO: 178539 - protein, 13 aa, Mycobacterium tuberculosis
PSSGFFNSGDGGV

SEQ ID NO: 178540 - protein, 13 aa, Mycobacterium tuberculosis
SSGFFNSGDGGVS

SEQ ID NO: 178541 - protein, 13 aa, Mycobacterium tuberculosis
SGFFNSGDGGVSG

SEQ ID NO: 178542 - protein, 13 aa, Mycobacterium tuberculosis
GFFNSGDGGVSGF

SEQ ID NO: 178543 - protein, 13 aa, Mycobacterium tuberculosis
FFNSGDGGVSGFG

SEQ ID NO: 178544 - protein, 13 aa, Mycobacterium tuberculosis
FNSGDGGVSGFGN

SEQ ID NO: 178545 - protein, 13 aa, Mycobacterium tuberculosis
NSGDGGVSGFGNF

SEQ ID NO: 178546 - protein, 13 aa, Mycobacterium tuberculosis
SGDGGVSGFGNFG

SEQ ID NO: 178547 - protein, 13 aa, Mycobacterium tuberculosis
GDGGVSGFGNFGA

SEQ ID NO: 178548 - protein, 13 aa, Mycobacterium tuberculosis
DGGVSGFGNFGAG

SEQ ID NO: 178549 - protein, 13 aa, Mycobacterium tuberculosis
GGVSGFGNFGAGS

SEQ ID NO: 178550 - protein, 13 aa, Mycobacterium tuberculosis
GVSGFGNFGAGSS

SEQ ID NO: 178551 - protein, 13 aa, Mycobacterium tuberculosis
VSGFGNFGAGSSG

SEQ ID NO: 178552 - protein, 13 aa, Mycobacterium tuberculosis
SGFGNFGAGSSGW

SEQ ID NO: 178553 - protein, 13 aa, Mycobacterium tuberculosis
GFGNFGAGSSGWW

SEQ ID NO: 178554 - protein, 13 aa, Mycobacterium tuberculosis
FGNFGAGSSGWWN

SEQ ID NO: 178555 - protein, 13 aa, Mycobacterium tuberculosis
GNFGAGSSGWWNQ

SEQ ID NO: 178556 - protein, 13 aa, Mycobacterium tuberculosis
NFGAGSSGWWNQA

SEQ ID NO: 178557 - protein, 13 aa, Mycobacterium tuberculosis
FGAGSSGWWNQAQ

SEQ ID NO: 178558 - protein, 13 aa, Mycobacterium tuberculosis
GAGSSGWWNQAQT

SEQ ID NO: 178559 - protein, 13 aa, Mycobacterium tuberculosis
AGSSGWWNQAQTE

SEQ ID NO: 178560 - protein, 13 aa, Mycobacterium tuberculosis
GSSGWWNQAQTEV

SEQ ID NO: 178561 - protein, 13 aa, Mycobacterium tuberculosis
SSGWWNQAQTEVA

SEQ ID NO: 178562 - protein, 13 aa, Mycobacterium tuberculosis
SGWWNQAQTEVAG

SEQ ID NO: 178563 - protein, 13 aa, Mycobacterium tuberculosis
GWWNQAQTEVAGA

SEQ ID NO: 178564 - protein, 13 aa, Mycobacterium tuberculosis
WWNQAQTEVAGAG

SEQ ID NO: 178565 - protein, 13 aa, Mycobacterium tuberculosis
WNQAQTEVAGAGS

SEQ ID NO: 178566 - protein, 13 aa, Mycobacterium tuberculosis
NQAQTEVAGAGSG

SEQ ID NO: 178567 - protein, 13 aa, Mycobacterium tuberculosis
QAQTEVAGAGSGF

SEQ ID NO: 178568 - protein, 13 aa, Mycobacterium tuberculosis
AQTEVAGAGSGFA

SEQ ID NO: 178569 - protein, 13 aa, Mycobacterium tuberculosis
QTEVAGAGSGFAN

SEQ ID NO: 178570 - protein, 13 aa, Mycobacterium tuberculosis
TEVAGAGSGFANF

SEQ ID NO: 178571 - protein, 13 aa, Mycobacterium tuberculosis
EVAGAGSGFANFG

SEQ ID NO: 178572 - protein, 13 aa, Mycobacterium tuberculosis
VAGAGSGFANFGS

SEQ ID NO: 178573 - protein, 13 aa, Mycobacterium tuberculosis
AGAGSGFANFGSL

SEQ ID NO: 178574 - protein, 13 aa, Mycobacterium tuberculosis
GAGSGFANFGSLG

SEQ ID NO: 178575 - protein, 13 aa, Mycobacterium tuberculosis
AGSGFANFGSLGS

SEQ ID NO: 178576 - protein, 13 aa, Mycobacterium tuberculosis
GSGFANFGSLGSG

SEQ ID NO: 178577 - protein, 13 aa, Mycobacterium tuberculosis
SGFANFGSLGSGV

SEQ ID NO: 178578 - protein, 13 aa, Mycobacterium tuberculosis
GFANFGSLGSGVL

SEQ ID NO: 178579 - protein, 13 aa, Mycobacterium tuberculosis
FANFGSLGSGVLN

SEQ ID NO: 178580 - protein, 13 aa, Mycobacterium tuberculosis
ANFGSLGSGVLNF

SEQ ID NO: 178581 - protein, 13 aa, Mycobacterium tuberculosis
NFGSLGSGVLNFG

SEQ ID NO: 178582 - protein, 13 aa, Mycobacterium tuberculosis
FGSLGSGVLNFGS

SEQ ID NO: 178583 - protein, 13 aa, Mycobacterium tuberculosis
GSLGSGVLNFGSG

SEQ ID NO: 178584 - protein, 13 aa, Mycobacterium tuberculosis
SLGSGVLNFGSGV

SEQ ID NO: 178585 - protein, 13 aa, Mycobacterium tuberculosis
LGSGVLNFGSGVS

SEQ ID NO: 178586 - protein, 13 aa, Mycobacterium tuberculosis
GSGVLNFGSGVSG

SEQ ID NO: 178587 - protein, 13 aa, Mycobacterium tuberculosis
SGVLNFGSGVSGL

SEQ ID NO: 178588 - protein, 13 aa, Mycobacterium tuberculosis
GVLNFGSGVSGLY

SEQ ID NO: 178589 - protein, 13 aa, Mycobacterium tuberculosis
VLNFGSGVSGLYN

SEQ ID NO: 178590 - protein, 13 aa, Mycobacterium tuberculosis
LNFGSGVSGLYNT

SEQ ID NO: 178591 - protein, 13 aa, Mycobacterium tuberculosis
NFGSGVSGLYNTG

SEQ ID NO: 178592 - protein, 13 aa, Mycobacterium tuberculosis
FGSGVSGLYNTGG

SEQ ID NO: 178593 - protein, 13 aa, Mycobacterium tuberculosis
GSGVSGLYNTGGL

SEQ ID NO: 178594 - protein, 13 aa, Mycobacterium tuberculosis
SGVSGLYNTGGLP

SEQ ID NO: 178595 - protein, 13 aa, Mycobacterium tuberculosis
GVSGLYNTGGLPP

SEQ ID NO: 178596 - protein, 13 aa, Mycobacterium tuberculosis
VSGLYNTGGLPPG

SEQ ID NO: 178597 - protein, 13 aa, Mycobacterium tuberculosis
SGLYNTGGLPPGT

SEQ ID NO: 178598 - protein, 13 aa, Mycobacterium tuberculosis
GLYNTGGLPPGTP

SEQ ID NO: 178599 - protein, 13 aa, Mycobacterium tuberculosis
LYNTGGLPPGTPA

SEQ ID NO: 178600 - protein, 13 aa, Mycobacterium tuberculosis
YNTGGLPPGTPAV

SEQ ID NO: 178601 - protein, 13 aa, Mycobacterium tuberculosis
NTGGLPPGTPAVV

SEQ ID NO: 178602 - protein, 13 aa, Mycobacterium tuberculosis
TGGLPPGTPAVVS

SEQ ID NO: 178603 - protein, 13 aa, Mycobacterium tuberculosis
GGLPPGTPAVVSG

SEQ ID NO: 178604 - protein, 13 aa, Mycobacterium tuberculosis
GLPPGTPAVVSGI

SEQ ID NO: 178605 - protein, 13 aa, Mycobacterium tuberculosis
LPPGTPAVVSGIG

SEQ ID NO: 178606 - protein, 13 aa, Mycobacterium tuberculosis
PPGTPAVVSGIGN

SEQ ID NO: 178607 - protein, 13 aa, Mycobacterium tuberculosis
PGTPAVVSGIGNV

SEQ ID NO: 178608 - protein, 13 aa, Mycobacterium tuberculosis
GTPAVVSGIGNVG

SEQ ID NO: 178609 - protein, 13 aa, Mycobacterium tuberculosis
TPAVVSGIGNVGE

SEQ ID NO: 178610 - protein, 13 aa, Mycobacterium tuberculosis
PAVVSGIGNVGEQ

SEQ ID NO: 178611 - protein, 13 aa, Mycobacterium tuberculosis
AVVSGIGNVGEQL

SEQ ID NO: 178612 - protein, 13 aa, Mycobacterium tuberculosis
VVSGIGNVGEQLS

SEQ ID NO: 178613 - protein, 13 aa, Mycobacterium tuberculosis
VSGIGNVGEQLSG

SEQ ID NO: 178614 - protein, 13 aa, Mycobacterium tuberculosis
SGIGNVGEQLSGL

SEQ ID NO: 178615 - protein, 13 aa, Mycobacterium tuberculosis
GIGNVGEQLSGLS

SEQ ID NO: 178616 - protein, 13 aa, Mycobacterium tuberculosis
IGNVGEQLSGLSS

SEQ ID NO: 178617 - protein, 13 aa, Mycobacterium tuberculosis
GNVGEQLSGLSSA

SEQ ID NO: 178618 - protein, 13 aa, Mycobacterium tuberculosis
NVGEQLSGLSSAG

SEQ ID NO: 178619 - protein, 13 aa, Mycobacterium tuberculosis
VGEQLSGLSSAGT

SEQ ID NO: 178620 - protein, 13 aa, Mycobacterium tuberculosis
GEQLSGLSSAGTA

SEQ ID NO: 178621 - protein, 13 aa, Mycobacterium tuberculosis
EQLSGLSSAGTAL

SEQ ID NO: 178622 - protein, 13 aa, Mycobacterium tuberculosis
QLSGLSSAGTALN

SEQ ID NO: 178623 - protein, 13 aa, Mycobacterium tuberculosis
LSGLSSAGTALNQ

SEQ ID NO: 178624 - protein, 13 aa, Mycobacterium tuberculosis
SGLSSAGTALNQS

SEQ ID NO: 178625 - protein, 13 aa, Mycobacterium tuberculosis
GLSSAGTALNQSL

SEQ ID NO: 178626 - protein, 13 aa, Mycobacterium tuberculosis
LSSAGTALNQSLI

SEQ ID NO: 178627 - protein, 13 aa, Mycobacterium tuberculosis
SSAGTALNQSLII

SEQ ID NO: 178628 - protein, 13 aa, Mycobacterium tuberculosis
SAGTALNQSLIIN

SEQ ID NO: 178629 - protein, 13 aa, Mycobacterium tuberculosis
AGTALNQSLIINL

SEQ ID NO: 178630 - protein, 13 aa, Mycobacterium tuberculosis
GTALNQSLIINLG

SEQ ID NO: 178631 - protein, 13 aa, Mycobacterium tuberculosis
TALNQSLIINLGL

SEQ ID NO: 178632 - protein, 13 aa, Mycobacterium tuberculosis
ALNQSLIINLGLA

SEQ ID NO: 178633 - protein, 13 aa, Mycobacterium tuberculosis
LNQSLIINLGLAD

SEQ ID NO: 178634 - protein, 13 aa, Mycobacterium tuberculosis
NQSLIINLGLADV

SEQ ID NO: 178635 - protein, 13 aa, Mycobacterium tuberculosis
QSLIINLGLADVG

SEQ ID NO: 178636 - protein, 13 aa, Mycobacterium tuberculosis
SLIINLGLADVGS

SEQ ID NO: 178637 - protein, 13 aa, Mycobacterium tuberculosis
LIINLGLADVGSV

SEQ ID NO: 178638 - protein, 13 aa, Mycobacterium tuberculosis
IINLGLADVGSVN

SEQ ID NO: 178639 - protein, 13 aa, Mycobacterium tuberculosis
INLGLADVGSVNV

SEQ ID NO: 178640 - protein, 13 aa, Mycobacterium tuberculosis
NLGLADVGSVNVG

SEQ ID NO: 178641 - protein, 13 aa, Mycobacterium tuberculosis
LGLADVGSVNVGF

SEQ ID NO: 178642 - protein, 13 aa, Mycobacterium tuberculosis
GLADVGSVNVGFG

SEQ ID NO: 178643 - protein, 13 aa, Mycobacterium tuberculosis
LADVGSVNVGFGN

SEQ ID NO: 178644 - protein, 13 aa, Mycobacterium tuberculosis
ADVGSVNVGFGNV

SEQ ID NO: 178645 - protein, 13 aa, Mycobacterium tuberculosis
DVGSVNVGFGNVG

SEQ ID NO: 178646 - protein, 13 aa, Mycobacterium tuberculosis
VGSVNVGFGNVGD

SEQ ID NO: 178647 - protein, 13 aa, Mycobacterium tuberculosis
GSVNVGFGNVGDF

SEQ ID NO: 178648 - protein, 13 aa, Mycobacterium tuberculosis
SVNVGFGNVGDFN

SEQ ID NO: 178649 - protein, 13 aa, Mycobacterium tuberculosis
VNVGFGNVGDFNL

SEQ ID NO: 178650 - protein, 13 aa, Mycobacterium tuberculosis
NVGFGNVGDFNLG

SEQ ID NO: 178651 - protein, 13 aa, Mycobacterium tuberculosis
VGFGNVGDFNLGA

SEQ ID NO: 178652 - protein, 13 aa, Mycobacterium tuberculosis
GFGNVGDFNLGAA

SEQ ID NO: 178653 - protein, 13 aa, Mycobacterium tuberculosis
FGNVGDFNLGAAN

SEQ ID NO: 178654 - protein, 13 aa, Mycobacterium tuberculosis
GNVGDFNLGAANI

SEQ ID NO: 178655 - protein, 13 aa, Mycobacterium tuberculosis
NVGDFNLGAANIG

SEQ ID NO: 178656 - protein, 13 aa, Mycobacterium tuberculosis
VGDFNLGAANIGD

SEQ ID NO: 178657 - protein, 13 aa, Mycobacterium tuberculosis
GDFNLGAANIGDL

SEQ ID NO: 178658 - protein, 13 aa, Mycobacterium tuberculosis
DFNLGAANIGDLN

SEQ ID NO: 178659 - protein, 13 aa, Mycobacterium tuberculosis
FNLGAANIGDLNV

SEQ ID NO: 178660 - protein, 13 aa, Mycobacterium tuberculosis
NLGAANIGDLNVG

SEQ ID NO: 178661 - protein, 13 aa, Mycobacterium tuberculosis
LGAANIGDLNVGL

SEQ ID NO: 178662 - protein, 13 aa, Mycobacterium tuberculosis
GAANIGDLNVGLG

SEQ ID NO: 178663 - protein, 13 aa, Mycobacterium tuberculosis
AANIGDLNVGLGN

SEQ ID NO: 178664 - protein, 13 aa, Mycobacterium tuberculosis
ANIGDLNVGLGNV

SEQ ID NO: 178665 - protein, 13 aa, Mycobacterium tuberculosis
NIGDLNVGLGNVG

SEQ ID NO: 178666 - protein, 13 aa, Mycobacterium tuberculosis
IGDLNVGLGNVGG

SEQ ID NO: 178667 - protein, 13 aa, Mycobacterium tuberculosis
GDLNVGLGNVGGG

SEQ ID NO: 178668 - protein, 13 aa, Mycobacterium tuberculosis
DLNVGLGNVGGGN

SEQ ID NO: 178669 - protein, 13 aa, Mycobacterium tuberculosis
LNVGLGNVGGGNV

SEQ ID NO: 178670 - protein, 13 aa, Mycobacterium tuberculosis
NVGLGNVGGGNVG

SEQ ID NO: 178671 - protein, 13 aa, Mycobacterium tuberculosis
VGLGNVGGGNVGF

SEQ ID NO: 178672 - protein, 13 aa, Mycobacterium tuberculosis
GLGNVGGGNVGFG

SEQ ID NO: 178673 - protein, 13 aa, Mycobacterium tuberculosis
LGNVGGGNVGFGN

SEQ ID NO: 178674 - protein, 13 aa, Mycobacterium tuberculosis
GNVGGGNVGFGNI

SEQ ID NO: 178675 - protein, 13 aa, Mycobacterium tuberculosis
NVGGGNVGFGNIG

SEQ ID NO: 178676 - protein, 13 aa, Mycobacterium tuberculosis
VGGGNVGFGNIGD

SEQ ID NO: 178677 - protein, 13 aa, Mycobacterium tuberculosis
GGGNVGFGNIGDA

SEQ ID NO: 178678 - protein, 13 aa, Mycobacterium tuberculosis
GGNVGFGNIGDAN

SEQ ID NO: 178679 - protein, 13 aa, Mycobacterium tuberculosis
GNVGFGNIGDANF

SEQ ID NO: 178680 - protein, 13 aa, Mycobacterium tuberculosis
NVGFGNIGDANFG

SEQ ID NO: 178681 - protein, 13 aa, Mycobacterium tuberculosis
VGFGNIGDANFGL

SEQ ID NO: 178682 - protein, 13 aa, Mycobacterium tuberculosis
GFGNIGDANFGLG

SEQ ID NO: 178683 - protein, 13 aa, Mycobacterium tuberculosis
FGNIGDANFGLGN

SEQ ID NO: 178684 - protein, 13 aa, Mycobacterium tuberculosis
GNIGDANFGLGNA

SEQ ID NO: 178685 - protein, 13 aa, Mycobacterium tuberculosis
NIGDANFGLGNAG

SEQ ID NO: 178686 - protein, 13 aa, Mycobacterium tuberculosis
IGDANFGLGNAGL

SEQ ID NO: 178687 - protein, 13 aa, Mycobacterium tuberculosis
GDANFGLGNAGLA

SEQ ID NO: 178688 - protein, 13 aa, Mycobacterium tuberculosis
DANFGLGNAGLAA

SEQ ID NO: 178689 - protein, 13 aa, Mycobacterium tuberculosis
ANFGLGNAGLAAG

SEQ ID NO: 178690 - protein, 13 aa, Mycobacterium tuberculosis
NFGLGNAGLAAGL

SEQ ID NO: 178691 - protein, 13 aa, Mycobacterium tuberculosis
FGLGNAGLAAGLA

SEQ ID NO: 178692 - protein, 13 aa, Mycobacterium tuberculosis
GLGNAGLAAGLAG

SEQ ID NO: 178693 - protein, 13 aa, Mycobacterium tuberculosis
LGNAGLAAGLAGV

SEQ ID NO: 178694 - protein, 13 aa, Mycobacterium tuberculosis
GNAGLAAGLAGVG

SEQ ID NO: 178695 - protein, 13 aa, Mycobacterium tuberculosis
NAGLAAGLAGVGN

SEQ ID NO: 178696 - protein, 13 aa, Mycobacterium tuberculosis
AGLAAGLAGVGNI

SEQ ID NO: 178697 - protein, 13 aa, Mycobacterium tuberculosis
GLAAGLAGVGNIG

SEQ ID NO: 178698 - protein, 13 aa, Mycobacterium tuberculosis
LAAGLAGVGNIGL

SEQ ID NO: 178699 - protein, 13 aa, Mycobacterium tuberculosis
AAGLAGVGNIGLG

SEQ ID NO: 178700 - protein, 13 aa, Mycobacterium tuberculosis
AGLAGVGNIGLGN

SEQ ID NO: 178701 - protein, 13 aa, Mycobacterium tuberculosis
GLAGVGNIGLGNA

SEQ ID NO: 178702 - protein, 13 aa, Mycobacterium tuberculosis
LAGVGNIGLGNAG

SEQ ID NO: 178703 - protein, 13 aa, Mycobacterium tuberculosis
AGVGNIGLGNAGS

SEQ ID NO: 178704 - protein, 13 aa, Mycobacterium tuberculosis
GVGNIGLGNAGSG

SEQ ID NO: 178705 - protein, 13 aa, Mycobacterium tuberculosis
VGNIGLGNAGSGN

SEQ ID NO: 178706 - protein, 13 aa, Mycobacterium tuberculosis
GNIGLGNAGSGNV

SEQ ID NO: 178707 - protein, 13 aa, Mycobacterium tuberculosis
NIGLGNAGSGNVG

SEQ ID NO: 178708 - protein, 13 aa, Mycobacterium tuberculosis
IGLGNAGSGNVGF

SEQ ID NO: 178709 - protein, 13 aa, Mycobacterium tuberculosis
GLGNAGSGNVGFG

SEQ ID NO: 178710 - protein, 13 aa, Mycobacterium tuberculosis
LGNAGSGNVGFGN

SEQ ID NO: 178711 - protein, 13 aa, Mycobacterium tuberculosis
GNAGSGNVGFGNM

SEQ ID NO: 178712 - protein, 13 aa, Mycobacterium tuberculosis
NAGSGNVGFGNMG

SEQ ID NO: 178713 - protein, 13 aa, Mycobacterium tuberculosis
AGSGNVGFGNMGV

SEQ ID NO: 178714 - protein, 13 aa, Mycobacterium tuberculosis
GSGNVGFGNMGVG

SEQ ID NO: 178715 - protein, 13 aa, Mycobacterium tuberculosis
SGNVGFGNMGVGN

SEQ ID NO: 178716 - protein, 13 aa, Mycobacterium tuberculosis
GNVGFGNMGVGNI

SEQ ID NO: 178717 - protein, 13 aa, Mycobacterium tuberculosis
NVGFGNMGVGNIG

SEQ ID NO: 178718 - protein, 13 aa, Mycobacterium tuberculosis
VGFGNMGVGNIGF

SEQ ID NO: 178719 - protein, 13 aa, Mycobacterium tuberculosis
GFGNMGVGNIGFG

SEQ ID NO: 178720 - protein, 13 aa, Mycobacterium tuberculosis
FGNMGVGNIGFGN

SEQ ID NO: 178721 - protein, 13 aa, Mycobacterium tuberculosis
GNMGVGNIGFGNT

SEQ ID NO: 178722 - protein, 13 aa, Mycobacterium tuberculosis
NMGVGNIGFGNTG

SEQ ID NO: 178723 - protein, 13 aa, Mycobacterium tuberculosis
MGVGNIGFGNTGT

SEQ ID NO: 178724 - protein, 13 aa, Mycobacterium tuberculosis
GVGNIGFGNTGTN

SEQ ID NO: 178725 - protein, 13 aa, Mycobacterium tuberculosis
VGNIGFGNTGTNN

SEQ ID NO: 178726 - protein, 13 aa, Mycobacterium tuberculosis
GNIGFGNTGTNNL

SEQ ID NO: 178727 - protein, 13 aa, Mycobacterium tuberculosis
NIGFGNTGTNNLG

SEQ ID NO: 178728 - protein, 13 aa, Mycobacterium tuberculosis
IGFGNTGTNNLGI

SEQ ID NO: 178729 - protein, 13 aa, Mycobacterium tuberculosis
GFGNTGTNNLGIG

SEQ ID NO: 178730 - protein, 13 aa, Mycobacterium tuberculosis
FGNTGTNNLGIGL

SEQ ID NO: 178731 - protein, 13 aa, Mycobacterium tuberculosis
GNTGTNNLGIGLT

SEQ ID NO: 178732 - protein, 13 aa, Mycobacterium tuberculosis
NTGTNNLGIGLTG

SEQ ID NO: 178733 - protein, 13 aa, Mycobacterium tuberculosis
TGTNNLGIGLTGD

SEQ ID NO: 178734 - protein, 13 aa, Mycobacterium tuberculosis
GTNNLGIGLTGDN

SEQ ID NO: 178735 - protein, 13 aa, Mycobacterium tuberculosis
TNNLGIGLTGDNQ

SEQ ID NO: 178736 - protein, 13 aa, Mycobacterium tuberculosis
NNLGIGLTGDNQT

SEQ ID NO: 178737 - protein, 13 aa, Mycobacterium tuberculosis
NLGIGLTGDNQTG

SEQ ID NO: 178738 - protein, 13 aa, Mycobacterium tuberculosis
LGIGLTGDNQTGI

SEQ ID NO: 178739 - protein, 13 aa, Mycobacterium tuberculosis
GIGLTGDNQTGIG

SEQ ID NO: 178740 - protein, 13 aa, Mycobacterium tuberculosis
IGLTGDNQTGIGG

SEQ ID NO: 178741 - protein, 13 aa, Mycobacterium tuberculosis
GLTGDNQTGIGGL

SEQ ID NO: 178742 - protein, 13 aa, Mycobacterium tuberculosis
LTGDNQTGIGGLN

SEQ ID NO: 178743 - protein, 13 aa, Mycobacterium tuberculosis
TGDNQTGIGGLNS

SEQ ID NO: 178744 - protein, 13 aa, Mycobacterium tuberculosis
GDNQTGIGGLNSG

SEQ ID NO: 178745 - protein, 13 aa, Mycobacterium tuberculosis
DNQTGIGGLNSGA

SEQ ID NO: 178746 - protein, 13 aa, Mycobacterium tuberculosis
NQTGIGGLNSGAG

SEQ ID NO: 178747 - protein, 13 aa, Mycobacterium tuberculosis
QTGIGGLNSGAGN

SEQ ID NO: 178748 - protein, 13 aa, Mycobacterium tuberculosis
TGIGGLNSGAGNI

SEQ ID NO: 178749 - protein, 13 aa, Mycobacterium tuberculosis
GIGGLNSGAGNIG

SEQ ID NO: 178750 - protein, 13 aa, Mycobacterium tuberculosis
IGGLNSGAGNIGL

SEQ ID NO: 178751 - protein, 13 aa, Mycobacterium tuberculosis
GGLNSGAGNIGLF

SEQ ID NO: 178752 - protein, 13 aa, Mycobacterium tuberculosis
GLNSGAGNIGLFN

SEQ ID NO: 178753 - protein, 13 aa, Mycobacterium tuberculosis
LNSGAGNIGLFNS

SEQ ID NO: 178754 - protein, 13 aa, Mycobacterium tuberculosis
NSGAGNIGLFNSG

SEQ ID NO: 178755 - protein, 13 aa, Mycobacterium tuberculosis
SGAGNIGLFNSGT

SEQ ID NO: 178756 - protein, 13 aa, Mycobacterium tuberculosis
GAGNIGLFNSGTG

SEQ ID NO: 178757 - protein, 13 aa, Mycobacterium tuberculosis
AGNIGLFNSGTGN

SEQ ID NO: 178758 - protein, 13 aa, Mycobacterium tuberculosis
GNIGLFNSGTGNV

SEQ ID NO: 178759 - protein, 13 aa, Mycobacterium tuberculosis
NIGLFNSGTGNVG

SEQ ID NO: 178760 - protein, 13 aa, Mycobacterium tuberculosis
IGLFNSGTGNVGL

SEQ ID NO: 178761 - protein, 13 aa, Mycobacterium tuberculosis
GLFNSGTGNVGLF

SEQ ID NO: 178762 - protein, 13 aa, Mycobacterium tuberculosis
LFNSGTGNVGLFN

SEQ ID NO: 178763 - protein, 13 aa, Mycobacterium tuberculosis
FNSGTGNVGLFNS

SEQ ID NO: 178764 - protein, 13 aa, Mycobacterium tuberculosis
NSGTGNVGLFNSG

SEQ ID NO: 178765 - protein, 13 aa, Mycobacterium tuberculosis
SGTGNVGLFNSGT

SEQ ID NO: 178766 - protein, 13 aa, Mycobacterium tuberculosis
GTGNVGLFNSGTG

SEQ ID NO: 178767 - protein, 13 aa, Mycobacterium tuberculosis
TGNVGLFNSGTGN

SEQ ID NO: 178768 - protein, 13 aa, Mycobacterium tuberculosis
GNVGLFNSGTGNF

SEQ ID NO: 178769 - protein, 13 aa, Mycobacterium tuberculosis
NVGLFNSGTGNFG

SEQ ID NO: 178770 - protein, 13 aa, Mycobacterium tuberculosis
VGLFNSGTGNFGL

SEQ ID NO: 178771 - protein, 13 aa, Mycobacterium tuberculosis
GLFNSGTGNFGLF

SEQ ID NO: 178772 - protein, 13 aa, Mycobacterium tuberculosis
LFNSGTGNFGLFN

SEQ ID NO: 178773 - protein, 13 aa, Mycobacterium tuberculosis
FNSGTGNFGLFNS

SEQ ID NO: 178774 - protein, 13 aa, Mycobacterium tuberculosis
NSGTGNFGLFNSG

SEQ ID NO: 178775 - protein, 13 aa, Mycobacterium tuberculosis
SGTGNFGLFNSGS

SEQ ID NO: 178776 - protein, 13 aa, Mycobacterium tuberculosis
GTGNFGLFNSGSF

SEQ ID NO: 178777 - protein, 13 aa, Mycobacterium tuberculosis
TGNFGLFNSGSFN

SEQ ID NO: 178778 - protein, 13 aa, Mycobacterium tuberculosis
GNFGLFNSGSFNT

SEQ ID NO: 178779 - protein, 13 aa, Mycobacterium tuberculosis
NFGLFNSGSFNTG

SEQ ID NO: 178780 - protein, 13 aa, Mycobacterium tuberculosis
FGLFNSGSFNTGI

SEQ ID NO: 178781 - protein, 13 aa, Mycobacterium tuberculosis
GLFNSGSFNTGIG

SEQ ID NO: 178782 - protein, 13 aa, Mycobacterium tuberculosis
LFNSGSFNTGIGN

SEQ ID NO: 178783 - protein, 13 aa, Mycobacterium tuberculosis
FNSGSFNTGIGNG

SEQ ID NO: 178784 - protein, 13 aa, Mycobacterium tuberculosis
NSGSFNTGIGNGG

SEQ ID NO: 178785 - protein, 13 aa, Mycobacterium tuberculosis
SGSFNTGIGNGGT

SEQ ID NO: 178786 - protein, 13 aa, Mycobacterium tuberculosis
GSFNTGIGNGGTG

SEQ ID NO: 178787 - protein, 13 aa, Mycobacterium tuberculosis
SFNTGIGNGGTGS

SEQ ID NO: 178788 - protein, 13 aa, Mycobacterium tuberculosis
FNTGIGNGGTGST

SEQ ID NO: 178789 - protein, 13 aa, Mycobacterium tuberculosis
NTGIGNGGTGSTG

SEQ ID NO: 178790 - protein, 13 aa, Mycobacterium tuberculosis
TGIGNGGTGSTGL

SEQ ID NO: 178791 - protein, 13 aa, Mycobacterium tuberculosis
GIGNGGTGSTGLF

SEQ ID NO: 178792 - protein, 13 aa, Mycobacterium tuberculosis
IGNGGTGSTGLFN

SEQ ID NO: 178793 - protein, 13 aa, Mycobacterium tuberculosis
GNGGTGSTGLFNA

SEQ ID NO: 178794 - protein, 13 aa, Mycobacterium tuberculosis
NGGTGSTGLFNAG

SEQ ID NO: 178795 - protein, 13 aa, Mycobacterium tuberculosis
GGTGSTGLFNAGN

SEQ ID NO: 178796 - protein, 13 aa, Mycobacterium tuberculosis
GTGSTGLFNAGNF

SEQ ID NO: 178797 - protein, 13 aa, Mycobacterium tuberculosis
TGSTGLFNAGNFN

SEQ ID NO: 178798 - protein, 13 aa, Mycobacterium tuberculosis
GSTGLFNAGNFNT

SEQ ID NO: 178799 - protein, 13 aa, Mycobacterium tuberculosis
STGLFNAGNFNTG

SEQ ID NO: 178800 - protein, 13 aa, Mycobacterium tuberculosis
TGLFNAGNFNTGV

SEQ ID NO: 178801 - protein, 13 aa, Mycobacterium tuberculosis
GLFNAGNFNTGVA

SEQ ID NO: 178802 - protein, 13 aa, Mycobacterium tuberculosis
LFNAGNFNTGVAN

SEQ ID NO: 178803 - protein, 13 aa, Mycobacterium tuberculosis
FNAGNFNTGVANP

SEQ ID NO: 178804 - protein, 13 aa, Mycobacterium tuberculosis
NAGNFNTGVANPG

SEQ ID NO: 178805 - protein, 13 aa, Mycobacterium tuberculosis
AGNFNTGVANPGS

SEQ ID NO: 178806 - protein, 13 aa, Mycobacterium tuberculosis
GNFNTGVANPGSY

SEQ ID NO: 178807 - protein, 13 aa, Mycobacterium tuberculosis
NFNTGVANPGSYN

SEQ ID NO: 178808 - protein, 13 aa, Mycobacterium tuberculosis
FNTGVANPGSYNT

SEQ ID NO: 178809 - protein, 13 aa, Mycobacterium tuberculosis
NTGVANPGSYNTG

SEQ ID NO: 178810 - protein, 13 aa, Mycobacterium tuberculosis
TGVANPGSYNTGS

SEQ ID NO: 178811 - protein, 13 aa, Mycobacterium tuberculosis
GVANPGSYNTGSF

SEQ ID NO: 178812 - protein, 13 aa, Mycobacterium tuberculosis
VANPGSYNTGSFN

SEQ ID NO: 178813 - protein, 13 aa, Mycobacterium tuberculosis
ANPGSYNTGSFNV

SEQ ID NO: 178814 - protein, 13 aa, Mycobacterium tuberculosis
NPGSYNTGSFNVG

SEQ ID NO: 178815 - protein, 13 aa, Mycobacterium tuberculosis
PGSYNTGSFNVGD

SEQ ID NO: 178816 - protein, 13 aa, Mycobacterium tuberculosis
GSYNTGSFNVGDT

SEQ ID NO: 178817 - protein, 13 aa, Mycobacterium tuberculosis
SYNTGSFNVGDTN

SEQ ID NO: 178818 - protein, 13 aa, Mycobacterium tuberculosis
YNTGSFNVGDTNT

SEQ ID NO: 178819 - protein, 13 aa, Mycobacterium tuberculosis
NTGSFNVGDTNTG

SEQ ID NO: 178820 - protein, 13 aa, Mycobacterium tuberculosis
TGSFNVGDTNTGG

SEQ ID NO: 178821 - protein, 13 aa, Mycobacterium tuberculosis
GSFNVGDTNTGGF

SEQ ID NO: 178822 - protein, 13 aa, Mycobacterium tuberculosis
SFNVGDTNTGGFN

SEQ ID NO: 178823 - protein, 13 aa, Mycobacterium tuberculosis
FNVGDTNTGGFNP

SEQ ID NO: 178824 - protein, 13 aa, Mycobacterium tuberculosis
NVGDTNTGGFNPG

SEQ ID NO: 178825 - protein, 13 aa, Mycobacterium tuberculosis
VGDTNTGGFNPGS

SEQ ID NO: 178826 - protein, 13 aa, Mycobacterium tuberculosis
GDTNTGGFNPGSI

SEQ ID NO: 178827 - protein, 13 aa, Mycobacterium tuberculosis
DTNTGGFNPGSIN

SEQ ID NO: 178828 - protein, 13 aa, Mycobacterium tuberculosis
TNTGGFNPGSINT

SEQ ID NO: 178829 - protein, 13 aa, Mycobacterium tuberculosis
NTGGFNPGSINTG

SEQ ID NO: 178830 - protein, 13 aa, Mycobacterium tuberculosis
TGGFNPGSINTGW

SEQ ID NO: 178831 - protein, 13 aa, Mycobacterium tuberculosis
GGFNPGSINTGWF

SEQ ID NO: 178832 - protein, 13 aa, Mycobacterium tuberculosis
GFNPGSINTGWFN

SEQ ID NO: 178833 - protein, 13 aa, Mycobacterium tuberculosis
FNPGSINTGWFNT

SEQ ID NO: 178834 - protein, 13 aa, Mycobacterium tuberculosis
NPGSINTGWFNTG

SEQ ID NO: 178835 - protein, 13 aa, Mycobacterium tuberculosis
PGSINTGWFNTGN

SEQ ID NO: 178836 - protein, 13 aa, Mycobacterium tuberculosis
GSINTGWFNTGNA

SEQ ID NO: 178837 - protein, 13 aa, Mycobacterium tuberculosis
SINTGWFNTGNAN

SEQ ID NO: 178838 - protein, 13 aa, Mycobacterium tuberculosis
INTGWFNTGNANT

SEQ ID NO: 178839 - protein, 13 aa, Mycobacterium tuberculosis
NTGWFNTGNANTG

SEQ ID NO: 178840 - protein, 13 aa, Mycobacterium tuberculosis
TGWFNTGNANTGV

SEQ ID NO: 178841 - protein, 13 aa, Mycobacterium tuberculosis
GWFNTGNANTGVA

SEQ ID NO: 178842 - protein, 13 aa, Mycobacterium tuberculosis
WFNTGNANTGVAN

SEQ ID NO: 178843 - protein, 13 aa, Mycobacterium tuberculosis
FNTGNANTGVANS

SEQ ID NO: 178844 - protein, 13 aa, Mycobacterium tuberculosis
NTGNANTGVANSG

SEQ ID NO: 178845 - protein, 13 aa, Mycobacterium tuberculosis
TGNANTGVANSGN

SEQ ID NO: 178846 - protein, 13 aa, Mycobacterium tuberculosis
GNANTGVANSGNV

SEQ ID NO: 178847 - protein, 13 aa, Mycobacterium tuberculosis
NANTGVANSGNVD

SEQ ID NO: 178848 - protein, 13 aa, Mycobacterium tuberculosis
ANTGVANSGNVDT

SEQ ID NO: 178849 - protein, 13 aa, Mycobacterium tuberculosis
NTGVANSGNVDTG

SEQ ID NO: 178850 - protein, 13 aa, Mycobacterium tuberculosis
TGVANSGNVDTGA

SEQ ID NO: 178851 - protein, 13 aa, Mycobacterium tuberculosis
GVANSGNVDTGAL

SEQ ID NO: 178852 - protein, 13 aa, Mycobacterium tuberculosis
VANSGNVDTGALM

SEQ ID NO: 178853 - protein, 13 aa, Mycobacterium tuberculosis
ANSGNVDTGALMS

SEQ ID NO: 178854 - protein, 13 aa, Mycobacterium tuberculosis
NSGNVDTGALMSG

SEQ ID NO: 178855 - protein, 13 aa, Mycobacterium tuberculosis
SGNVDTGALMSGN

SEQ ID NO: 178856 - protein, 13 aa, Mycobacterium tuberculosis
GNVDTGALMSGNF

SEQ ID NO: 178857 - protein, 13 aa, Mycobacterium tuberculosis
NVDTGALMSGNFS

SEQ ID NO: 178858 - protein, 13 aa, Mycobacterium tuberculosis
VDTGALMSGNFSN

SEQ ID NO: 178859 - protein, 13 aa, Mycobacterium tuberculosis
DTGALMSGNFSNG

SEQ ID NO: 178860 - protein, 13 aa, Mycobacterium tuberculosis
TGALMSGNFSNGI

SEQ ID NO: 178861 - protein, 13 aa, Mycobacterium tuberculosis
GALMSGNFSNGIL

SEQ ID NO: 178862 - protein, 13 aa, Mycobacterium tuberculosis
ALMSGNFSNGILW

SEQ ID NO: 178863 - protein, 13 aa, Mycobacterium tuberculosis
LMSGNFSNGILWR

SEQ ID NO: 178864 - protein, 13 aa, Mycobacterium tuberculosis
MSGNFSNGILWRG

SEQ ID NO: 178865 - protein, 13 aa, Mycobacterium tuberculosis
SGNFSNGILWRGN

SEQ ID NO: 178866 - protein, 13 aa, Mycobacterium tuberculosis
GNFSNGILWRGNF

SEQ ID NO: 178867 - protein, 13 aa, Mycobacterium tuberculosis
NFSNGILWRGNFE

SEQ ID NO: 178868 - protein, 13 aa, Mycobacterium tuberculosis
FSNGILWRGNFEG

SEQ ID NO: 178869 - protein, 13 aa, Mycobacterium tuberculosis
SNGILWRGNFEGL

SEQ ID NO: 178870 - protein, 13 aa, Mycobacterium tuberculosis
NGILWRGNFEGLF

SEQ ID NO: 178871 - protein, 13 aa, Mycobacterium tuberculosis
GILWRGNFEGLFG

SEQ ID NO: 178872 - protein, 13 aa, Mycobacterium tuberculosis
ILWRGNFEGLFGL

SEQ ID NO: 178873 - protein, 13 aa, Mycobacterium tuberculosis
LWRGNFEGLFGLN

SEQ ID NO: 178874 - protein, 13 aa, Mycobacterium tuberculosis
WRGNFEGLFGLNV

SEQ ID NO: 178875 - protein, 13 aa, Mycobacterium tuberculosis
RGNFEGLFGLNVG

SEQ ID NO: 178876 - protein, 13 aa, Mycobacterium tuberculosis
GNFEGLFGLNVGI

SEQ ID NO: 178877 - protein, 13 aa, Mycobacterium tuberculosis
NFEGLFGLNVGIT

SEQ ID NO: 178878 - protein, 13 aa, Mycobacterium tuberculosis
FEGLFGLNVGITI

SEQ ID NO: 178879 - protein, 13 aa, Mycobacterium tuberculosis
EGLFGLNVGITIP

SEQ ID NO: 178880 - protein, 13 aa, Mycobacterium tuberculosis
GLFGLNVGITIPE

SEQ ID NO: 178881 - protein, 13 aa, Mycobacterium tuberculosis
LFGLNVGITIPEF

SEQ ID NO: 178882 - protein, 13 aa, Mycobacterium tuberculosis
FGLNVGITIPEFP

SEQ ID NO: 178883 - protein, 13 aa, Mycobacterium tuberculosis
GLNVGITIPEFPI

SEQ ID NO: 178884 - protein, 13 aa, Mycobacterium tuberculosis
LNVGITIPEFPIH

SEQ ID NO: 178885 - protein, 13 aa, Mycobacterium tuberculosis
NVGITIPEFPIHW

SEQ ID NO: 178886 - protein, 13 aa, Mycobacterium tuberculosis
VGITIPEFPIHWT

SEQ ID NO: 178887 - protein, 13 aa, Mycobacterium tuberculosis
GITIPEFPIHWTS

SEQ ID NO: 178888 - protein, 13 aa, Mycobacterium tuberculosis
ITIPEFPIHWTST

SEQ ID NO: 178889 - protein, 13 aa, Mycobacterium tuberculosis
TIPEFPIHWTSTG

SEQ ID NO: 178890 - protein, 13 aa, Mycobacterium tuberculosis
IPEFPIHWTSTGG

SEQ ID NO: 178891 - protein, 13 aa, Mycobacterium tuberculosis
PEFPIHWTSTGGI

SEQ ID NO: 178892 - protein, 13 aa, Mycobacterium tuberculosis
EFPIHWTSTGGIG

SEQ ID NO: 178893 - protein, 13 aa, Mycobacterium tuberculosis
FPIHWTSTGGIGP

SEQ ID NO: 178894 - protein, 13 aa, Mycobacterium tuberculosis
PIHWTSTGGIGPI

SEQ ID NO: 178895 - protein, 13 aa, Mycobacterium tuberculosis
IHWTSTGGIGPII

SEQ ID NO: 178896 - protein, 13 aa, Mycobacterium tuberculosis
HWTSTGGIGPIII

SEQ ID NO: 178897 - protein, 13 aa, Mycobacterium tuberculosis
WTSTGGIGPIIIP

SEQ ID NO: 178898 - protein, 13 aa, Mycobacterium tuberculosis
TSTGGIGPIIIPD

SEQ ID NO: 178899 - protein, 13 aa, Mycobacterium tuberculosis
STGGIGPIIIPDT

SEQ ID NO: 178900 - protein, 13 aa, Mycobacterium tuberculosis
TGGIGPIIIPDTT

SEQ ID NO: 178901 - protein, 13 aa, Mycobacterium tuberculosis
GGIGPIIIPDTTI

SEQ ID NO: 178902 - protein, 13 aa, Mycobacterium tuberculosis
GIGPIIIPDTTIL

SEQ ID NO: 178903 - protein, 13 aa, Mycobacterium tuberculosis
IGPIIIPDTTILP

SEQ ID NO: 178904 - protein, 13 aa, Mycobacterium tuberculosis
GPIIIPDTTILPP

SEQ ID NO: 178905 - protein, 13 aa, Mycobacterium tuberculosis
PIIIPDTTILPPI

SEQ ID NO: 178906 - protein, 13 aa, Mycobacterium tuberculosis
IIIPDTTILPPIH

SEQ ID NO: 178907 - protein, 13 aa, Mycobacterium tuberculosis
IIPDTTILPPIHL

SEQ ID NO: 178908 - protein, 13 aa, Mycobacterium tuberculosis
IPDTTILPPIHLG

SEQ ID NO: 178909 - protein, 13 aa, Mycobacterium tuberculosis
PDTTILPPIHLGL

SEQ ID NO: 178910 - protein, 13 aa, Mycobacterium tuberculosis
DTTILPPIHLGLT

SEQ ID NO: 178911 - protein, 13 aa, Mycobacterium tuberculosis
TTILPPIHLGLTG

SEQ ID NO: 178912 - protein, 13 aa, Mycobacterium tuberculosis
TILPPIHLGLTGQ

SEQ ID NO: 178913 - protein, 13 aa, Mycobacterium tuberculosis
ILPPIHLGLTGQA

SEQ ID NO: 178914 - protein, 13 aa, Mycobacterium tuberculosis
LPPIHLGLTGQAN

SEQ ID NO: 178915 - protein, 13 aa, Mycobacterium tuberculosis
PPIHLGLTGQANY

SEQ ID NO: 178916 - protein, 13 aa, Mycobacterium tuberculosis
PIHLGLTGQANYG

SEQ ID NO: 178917 - protein, 13 aa, Mycobacterium tuberculosis
IHLGLTGQANYGF

SEQ ID NO: 178918 - protein, 13 aa, Mycobacterium tuberculosis
HLGLTGQANYGFA

SEQ ID NO: 178919 - protein, 13 aa, Mycobacterium tuberculosis
LGLTGQANYGFAV

SEQ ID NO: 178920 - protein, 13 aa, Mycobacterium tuberculosis
GLTGQANYGFAVP

SEQ ID NO: 178921 - protein, 13 aa, Mycobacterium tuberculosis
LTGQANYGFAVPD

SEQ ID NO: 178922 - protein, 13 aa, Mycobacterium tuberculosis
TGQANYGFAVPDI

SEQ ID NO: 178923 - protein, 13 aa, Mycobacterium tuberculosis
GQANYGFAVPDIP

SEQ ID NO: 178924 - protein, 13 aa, Mycobacterium tuberculosis
QANYGFAVPDIPI

SEQ ID NO: 178925 - protein, 13 aa, Mycobacterium tuberculosis
ANYGFAVPDIPIP

SEQ ID NO: 178926 - protein, 13 aa, Mycobacterium tuberculosis
NYGFAVPDIPIPA

SEQ ID NO: 178927 - protein, 13 aa, Mycobacterium tuberculosis
YGFAVPDIPIPAI

SEQ ID NO: 178928 - protein, 13 aa, Mycobacterium tuberculosis
GFAVPDIPIPAIH

SEQ ID NO: 178929 - protein, 13 aa, Mycobacterium tuberculosis
FAVPDIPIPAIHI

SEQ ID NO: 178930 - protein, 13 aa, Mycobacterium tuberculosis
AVPDIPIPAIHID

SEQ ID NO: 178931 - protein, 13 aa, Mycobacterium tuberculosis
VPDIPIPAIHIDF

SEQ ID NO: 178932 - protein, 13 aa, Mycobacterium tuberculosis
PDIPIPAIHIDFD

SEQ ID NO: 178933 - protein, 13 aa, Mycobacterium tuberculosis
DIPIPAIHIDFDG

SEQ ID NO: 178934 - protein, 13 aa, Mycobacterium tuberculosis
IPIPAIHIDFDGA

SEQ ID NO: 178935 - protein, 13 aa, Mycobacterium tuberculosis
PIPAIHIDFDGAA

SEQ ID NO: 178936 - protein, 13 aa, Mycobacterium tuberculosis
IPAIHIDFDGAAD

SEQ ID NO: 178937 - protein, 13 aa, Mycobacterium tuberculosis
PAIHIDFDGAADA

SEQ ID NO: 178938 - protein, 13 aa, Mycobacterium tuberculosis
AIHIDFDGAADAG

SEQ ID NO: 178939 - protein, 13 aa, Mycobacterium tuberculosis
IHIDFDGAADAGF

SEQ ID NO: 178940 - protein, 13 aa, Mycobacterium tuberculosis
HIDFDGAADAGFT

SEQ ID NO: 178941 - protein, 13 aa, Mycobacterium tuberculosis
IDFDGAADAGFTA

SEQ ID NO: 178942 - protein, 13 aa, Mycobacterium tuberculosis
DFDGAADAGFTAP

SEQ ID NO: 178943 - protein, 13 aa, Mycobacterium tuberculosis
FDGAADAGFTAPA

SEQ ID NO: 178944 - protein, 13 aa, Mycobacterium tuberculosis
DGAADAGFTAPAT

SEQ ID NO: 178945 - protein, 13 aa, Mycobacterium tuberculosis
GAADAGFTAPATT

SEQ ID NO: 178946 - protein, 13 aa, Mycobacterium tuberculosis
AADAGFTAPATTL

SEQ ID NO: 178947 - protein, 13 aa, Mycobacterium tuberculosis
ADAGFTAPATTLL

SEQ ID NO: 178948 - protein, 13 aa, Mycobacterium tuberculosis
DAGFTAPATTLLS

SEQ ID NO: 178949 - protein, 13 aa, Mycobacterium tuberculosis
AGFTAPATTLLSA

SEQ ID NO: 178950 - protein, 13 aa, Mycobacterium tuberculosis
GFTAPATTLLSAL

SEQ ID NO: 178951 - protein, 13 aa, Mycobacterium tuberculosis
FTAPATTLLSALG

SEQ ID NO: 178952 - protein, 13 aa, Mycobacterium tuberculosis
TAPATTLLSALGI

SEQ ID NO: 178953 - protein, 13 aa, Mycobacterium tuberculosis
APATTLLSALGIT

SEQ ID NO: 178954 - protein, 13 aa, Mycobacterium tuberculosis
PATTLLSALGITG

SEQ ID NO: 178955 - protein, 13 aa, Mycobacterium tuberculosis
ATTLLSALGITGQ

SEQ ID NO: 178956 - protein, 13 aa, Mycobacterium tuberculosis
TTLLSALGITGQF

SEQ ID NO: 178957 - protein, 13 aa, Mycobacterium tuberculosis
TLLSALGITGQFR

SEQ ID NO: 178958 - protein, 13 aa, Mycobacterium tuberculosis
LLSALGITGQFRF

SEQ ID NO: 178959 - protein, 13 aa, Mycobacterium tuberculosis
LSALGITGQFRFG

SEQ ID NO: 178960 - protein, 13 aa, Mycobacterium tuberculosis
SALGITGQFRFGP

SEQ ID NO: 178961 - protein, 13 aa, Mycobacterium tuberculosis
ALGITGQFRFGPI

SEQ ID NO: 178962 - protein, 13 aa, Mycobacterium tuberculosis
LGITGQFRFGPIT

SEQ ID NO: 178963 - protein, 13 aa, Mycobacterium tuberculosis
GITGQFRFGPITV

SEQ ID NO: 178964 - protein, 13 aa, Mycobacterium tuberculosis
ITGQFRFGPITVS

SEQ ID NO: 178965 - protein, 13 aa, Mycobacterium tuberculosis
TGQFRFGPITVSN

SEQ ID NO: 178966 - protein, 13 aa, Mycobacterium tuberculosis
GQFRFGPITVSNV

SEQ ID NO: 178967 - protein, 13 aa, Mycobacterium tuberculosis
QFRFGPITVSNVQ

SEQ ID NO: 178968 - protein, 13 aa, Mycobacterium tuberculosis
FRFGPITVSNVQL

SEQ ID NO: 178969 - protein, 13 aa, Mycobacterium tuberculosis
RFGPITVSNVQLN

SEQ ID NO: 178970 - protein, 13 aa, Mycobacterium tuberculosis
FGPITVSNVQLNP

SEQ ID NO: 178971 - protein, 13 aa, Mycobacterium tuberculosis
GPITVSNVQLNPF

SEQ ID NO: 178972 - protein, 13 aa, Mycobacterium tuberculosis
PITVSNVQLNPFN

SEQ ID NO: 178973 - protein, 13 aa, Mycobacterium tuberculosis
ITVSNVQLNPFNV

SEQ ID NO: 178974 - protein, 13 aa, Mycobacterium tuberculosis
TVSNVQLNPFNVN

SEQ ID NO: 178975 - protein, 13 aa, Mycobacterium tuberculosis
VSNVQLNPFNVNL

SEQ ID NO: 178976 - protein, 13 aa, Mycobacterium tuberculosis
SNVQLNPFNVNLK

SEQ ID NO: 178977 - protein, 13 aa, Mycobacterium tuberculosis
NVQLNPFNVNLKL

SEQ ID NO: 178978 - protein, 13 aa, Mycobacterium tuberculosis
VQLNPFNVNLKLQ

SEQ ID NO: 178979 - protein, 13 aa, Mycobacterium tuberculosis
QLNPFNVNLKLQF

SEQ ID NO: 178980 - protein, 13 aa, Mycobacterium tuberculosis
LNPFNVNLKLQFL

SEQ ID NO: 178981 - protein, 13 aa, Mycobacterium tuberculosis
NPFNVNLKLQFLH

SEQ ID NO: 178982 - protein, 13 aa, Mycobacterium tuberculosis
PFNVNLKLQFLHD

SEQ ID NO: 178983 - protein, 13 aa, Mycobacterium tuberculosis
FNVNLKLQFLHDA

SEQ ID NO: 178984 - protein, 13 aa, Mycobacterium tuberculosis
NVNLKLQFLHDAF

SEQ ID NO: 178985 - protein, 13 aa, Mycobacterium tuberculosis
VNLKLQFLHDAFP

SEQ ID NO: 178986 - protein, 13 aa, Mycobacterium tuberculosis
NLKLQFLHDAFPN

SEQ ID NO: 178987 - protein, 13 aa, Mycobacterium tuberculosis
LKLQFLHDAFPNE

SEQ ID NO: 178988 - protein, 13 aa, Mycobacterium tuberculosis
KLQFLHDAFPNEF

SEQ ID NO: 178989 - protein, 13 aa, Mycobacterium tuberculosis
LQFLHDAFPNEFP

SEQ ID NO: 178990 - protein, 13 aa, Mycobacterium tuberculosis
QFLHDAFPNEFPD

SEQ ID NO: 178991 - protein, 13 aa, Mycobacterium tuberculosis
FLHDAFPNEFPDP

SEQ ID NO: 178992 - protein, 13 aa, Mycobacterium tuberculosis
LHDAFPNEFPDPT

SEQ ID NO: 178993 - protein, 13 aa, Mycobacterium tuberculosis
HDAFPNEFPDPTI

SEQ ID NO: 178994 - protein, 13 aa, Mycobacterium tuberculosis
DAFPNEFPDPTIS

SEQ ID NO: 178995 - protein, 13 aa, Mycobacterium tuberculosis
AFPNEFPDPTISV

SEQ ID NO: 178996 - protein, 13 aa, Mycobacterium tuberculosis
FPNEFPDPTISVQ

SEQ ID NO: 178997 - protein, 13 aa, Mycobacterium tuberculosis
PNEFPDPTISVQI

SEQ ID NO: 178998 - protein, 13 aa, Mycobacterium tuberculosis
NEFPDPTISVQIQ

SEQ ID NO: 178999 - protein, 13 aa, Mycobacterium tuberculosis
EFPDPTISVQIQV

SEQ ID NO: 179000 - protein, 13 aa, Mycobacterium tuberculosis
FPDPTISVQIQVA

SEQ ID NO: 179001 - protein, 13 aa, Mycobacterium tuberculosis
PDPTISVQIQVAI

SEQ ID NO: 179002 - protein, 13 aa, Mycobacterium tuberculosis
DPTISVQIQVAIP

SEQ ID NO: 179003 - protein, 13 aa, Mycobacterium tuberculosis
PTISVQIQVAIPL

SEQ ID NO: 179004 - protein, 13 aa, Mycobacterium tuberculosis
TISVQIQVAIPLT

SEQ ID NO: 179005 - protein, 13 aa, Mycobacterium tuberculosis
ISVQIQVAIPLTS

SEQ ID NO: 179006 - protein, 13 aa, Mycobacterium tuberculosis
SVQIQVAIPLTSA

SEQ ID NO: 179007 - protein, 13 aa, Mycobacterium tuberculosis
VQIQVAIPLTSAT

SEQ ID NO: 179008 - protein, 13 aa, Mycobacterium tuberculosis
QIQVAIPLTSATL

SEQ ID NO: 179009 - protein, 13 aa, Mycobacterium tuberculosis
IQVAIPLTSATLG

SEQ ID NO: 179010 - protein, 13 aa, Mycobacterium tuberculosis
QVAIPLTSATLGG

SEQ ID NO: 179011 - protein, 13 aa, Mycobacterium tuberculosis
VAIPLTSATLGGL

SEQ ID NO: 179012 - protein, 13 aa, Mycobacterium tuberculosis
AIPLTSATLGGLA

SEQ ID NO: 179013 - protein, 13 aa, Mycobacterium tuberculosis
IPLTSATLGGLAL

SEQ ID NO: 179014 - protein, 13 aa, Mycobacterium tuberculosis
PLTSATLGGLALP

SEQ ID NO: 179015 - protein, 13 aa, Mycobacterium tuberculosis
LTSATLGGLALPL

SEQ ID NO: 179016 - protein, 13 aa, Mycobacterium tuberculosis
TSATLGGLALPLQ

SEQ ID NO: 179017 - protein, 13 aa, Mycobacterium tuberculosis
SATLGGLALPLQQ

SEQ ID NO: 179018 - protein, 13 aa, Mycobacterium tuberculosis
ATLGGLALPLQQT

SEQ ID NO: 179019 - protein, 13 aa, Mycobacterium tuberculosis
TLGGLALPLQQTI

SEQ ID NO: 179020 - protein, 13 aa, Mycobacterium tuberculosis
LGGLALPLQQTID

SEQ ID NO: 179021 - protein, 13 aa, Mycobacterium tuberculosis
GGLALPLQQTIDA

SEQ ID NO: 179022 - protein, 13 aa, Mycobacterium tuberculosis
GLALPLQQTIDAI

SEQ ID NO: 179023 - protein, 13 aa, Mycobacterium tuberculosis
LALPLQQTIDAIE

SEQ ID NO: 179024 - protein, 13 aa, Mycobacterium tuberculosis
ALPLQQTIDAIEL

SEQ ID NO: 179025 - protein, 13 aa, Mycobacterium tuberculosis
LPLQQTIDAIELP

SEQ ID NO: 179026 - protein, 13 aa, Mycobacterium tuberculosis
PLQQTIDAIELPA

SEQ ID NO: 179027 - protein, 13 aa, Mycobacterium tuberculosis
LQQTIDAIELPAI

SEQ ID NO: 179028 - protein, 13 aa, Mycobacterium tuberculosis
QQTIDAIELPAIS

SEQ ID NO: 179029 - protein, 13 aa, Mycobacterium tuberculosis
QTIDAIELPAISF

SEQ ID NO: 179030 - protein, 13 aa, Mycobacterium tuberculosis
TIDAIELPAISFS

SEQ ID NO: 179031 - protein, 13 aa, Mycobacterium tuberculosis
IDAIELPAISFSQ

SEQ ID NO: 179032 - protein, 13 aa, Mycobacterium tuberculosis
DAIELPAISFSQS

SEQ ID NO: 179033 - protein, 13 aa, Mycobacterium tuberculosis
AIELPAISFSQSI

SEQ ID NO: 179034 - protein, 13 aa, Mycobacterium tuberculosis
IELPAISFSQSIP

SEQ ID NO: 179035 - protein, 13 aa, Mycobacterium tuberculosis
ELPAISFSQSIPI

SEQ ID NO: 179036 - protein, 13 aa, Mycobacterium tuberculosis
LPAISFSQSIPID

SEQ ID NO: 179037 - protein, 13 aa, Mycobacterium tuberculosis
PAISFSQSIPIDI

SEQ ID NO: 179038 - protein, 13 aa, Mycobacterium tuberculosis
AISFSQSIPIDIP

SEQ ID NO: 179039 - protein, 13 aa, Mycobacterium tuberculosis
ISFSQSIPIDIPP

SEQ ID NO: 179040 - protein, 13 aa, Mycobacterium tuberculosis
SFSQSIPIDIPPI

SEQ ID NO: 179041 - protein, 13 aa, Mycobacterium tuberculosis
FSQSIPIDIPPID

SEQ ID NO: 179042 - protein, 13 aa, Mycobacterium tuberculosis
SQSIPIDIPPIDI

SEQ ID NO: 179043 - protein, 13 aa, Mycobacterium tuberculosis
QSIPIDIPPIDIP

SEQ ID NO: 179044 - protein, 13 aa, Mycobacterium tuberculosis
SIPIDIPPIDIPA

SEQ ID NO: 179045 - protein, 13 aa, Mycobacterium tuberculosis
IPIDIPPIDIPAS

SEQ ID NO: 179046 - protein, 13 aa, Mycobacterium tuberculosis
PIDIPPIDIPAST

SEQ ID NO: 179047 - protein, 13 aa, Mycobacterium tuberculosis
IDIPPIDIPASTI

SEQ ID NO: 179048 - protein, 13 aa, Mycobacterium tuberculosis
DIPPIDIPASTIN

SEQ ID NO: 179049 - protein, 13 aa, Mycobacterium tuberculosis
IPPIDIPASTING

SEQ ID NO: 179050 - protein, 13 aa, Mycobacterium tuberculosis
PPIDIPASTINGI

SEQ ID NO: 179051 - protein, 13 aa, Mycobacterium tuberculosis
PIDIPASTINGIS

SEQ ID NO: 179052 - protein, 13 aa, Mycobacterium tuberculosis
IDIPASTINGISM

SEQ ID NO: 179053 - protein, 13 aa, Mycobacterium tuberculosis
DIPASTINGISMS

SEQ ID NO: 179054 - protein, 13 aa, Mycobacterium tuberculosis
IPASTINGISMSE

SEQ ID NO: 179055 - protein, 13 aa, Mycobacterium tuberculosis
PASTINGISMSEV

SEQ ID NO: 179056 - protein, 13 aa, Mycobacterium tuberculosis
ASTINGISMSEVV

SEQ ID NO: 179057 - protein, 13 aa, Mycobacterium tuberculosis
STINGISMSEVVP

SEQ ID NO: 179058 - protein, 13 aa, Mycobacterium tuberculosis
TINGISMSEVVPI

SEQ ID NO: 179059 - protein, 13 aa, Mycobacterium tuberculosis
INGISMSEVVPID

SEQ ID NO: 179060 - protein, 13 aa, Mycobacterium tuberculosis
NGISMSEVVPIDV

SEQ ID NO: 179061 - protein, 13 aa, Mycobacterium tuberculosis
GISMSEVVPIDVS

SEQ ID NO: 179062 - protein, 13 aa, Mycobacterium tuberculosis
ISMSEVVPIDVSV

SEQ ID NO: 179063 - protein, 13 aa, Mycobacterium tuberculosis
SMSEVVPIDVSVD

SEQ ID NO: 179064 - protein, 13 aa, Mycobacterium tuberculosis
MSEVVPIDVSVDI

SEQ ID NO: 179065 - protein, 13 aa, Mycobacterium tuberculosis
SEVVPIDVSVDIP

SEQ ID NO: 179066 - protein, 13 aa, Mycobacterium tuberculosis
EVVPIDVSVDIPA

SEQ ID NO: 179067 - protein, 13 aa, Mycobacterium tuberculosis
VVPIDVSVDIPAV

SEQ ID NO: 179068 - protein, 13 aa, Mycobacterium tuberculosis
VPIDVSVDIPAVT

SEQ ID NO: 179069 - protein, 13 aa, Mycobacterium tuberculosis
PIDVSVDIPAVTI

SEQ ID NO: 179070 - protein, 13 aa, Mycobacterium tuberculosis
IDVSVDIPAVTIT

SEQ ID NO: 179071 - protein, 13 aa, Mycobacterium tuberculosis
DVSVDIPAVTITG

SEQ ID NO: 179072 - protein, 13 aa, Mycobacterium tuberculosis
VSVDIPAVTITGT

SEQ ID NO: 179073 - protein, 13 aa, Mycobacterium tuberculosis
SVDIPAVTITGTR

SEQ ID NO: 179074 - protein, 13 aa, Mycobacterium tuberculosis
VDIPAVTITGTRI

SEQ ID NO: 179075 - protein, 13 aa, Mycobacterium tuberculosis
DIPAVTITGTRID

SEQ ID NO: 179076 - protein, 13 aa, Mycobacterium tuberculosis
IPAVTITGTRIDP

SEQ ID NO: 179077 - protein, 13 aa, Mycobacterium tuberculosis
PAVTITGTRIDPI

SEQ ID NO: 179078 - protein, 13 aa, Mycobacterium tuberculosis
AVTITGTRIDPIP

SEQ ID NO: 179079 - protein, 13 aa, Mycobacterium tuberculosis
VTITGTRIDPIPL

SEQ ID NO: 179080 - protein, 13 aa, Mycobacterium tuberculosis
TITGTRIDPIPLN

SEQ ID NO: 179081 - protein, 13 aa, Mycobacterium tuberculosis
ITGTRIDPIPLNF

SEQ ID NO: 179082 - protein, 13 aa, Mycobacterium tuberculosis
TGTRIDPIPLNFD

SEQ ID NO: 179083 - protein, 13 aa, Mycobacterium tuberculosis
GTRIDPIPLNFDV

SEQ ID NO: 179084 - protein, 13 aa, Mycobacterium tuberculosis
TRIDPIPLNFDVL

SEQ ID NO: 179085 - protein, 13 aa, Mycobacterium tuberculosis
RIDPIPLNFDVLS

SEQ ID NO: 179086 - protein, 13 aa, Mycobacterium tuberculosis
IDPIPLNFDVLSS

SEQ ID NO: 179087 - protein, 13 aa, Mycobacterium tuberculosis
DPIPLNFDVLSSA

SEQ ID NO: 179088 - protein, 13 aa, Mycobacterium tuberculosis
PIPLNFDVLSSAG

SEQ ID NO: 179089 - protein, 13 aa, Mycobacterium tuberculosis
IPLNFDVLSSAGP

SEQ ID NO: 179090 - protein, 13 aa, Mycobacterium tuberculosis
PLNFDVLSSAGPI

SEQ ID NO: 179091 - protein, 13 aa, Mycobacterium tuberculosis
LNFDVLSSAGPIN

SEQ ID NO: 179092 - protein, 13 aa, Mycobacterium tuberculosis
NFDVLSSAGPINI

SEQ ID NO: 179093 - protein, 13 aa, Mycobacterium tuberculosis
FDVLSSAGPINIS

SEQ ID NO: 179094 - protein, 13 aa, Mycobacterium tuberculosis
DVLSSAGPINISI

SEQ ID NO: 179095 - protein, 13 aa, Mycobacterium tuberculosis
VLSSAGPINISII

SEQ ID NO: 179096 - protein, 13 aa, Mycobacterium tuberculosis
LSSAGPINISIID

SEQ ID NO: 179097 - protein, 13 aa, Mycobacterium tuberculosis
SSAGPINISIIDI

SEQ ID NO: 179098 - protein, 13 aa, Mycobacterium tuberculosis
SAGPINISIIDIP

SEQ ID NO: 179099 - protein, 13 aa, Mycobacterium tuberculosis
AGPINISIIDIPA

SEQ ID NO: 179100 - protein, 13 aa, Mycobacterium tuberculosis
GPINISIIDIPAL

SEQ ID NO: 179101 - protein, 13 aa, Mycobacterium tuberculosis
PINISIIDIPALP

SEQ ID NO: 179102 - protein, 13 aa, Mycobacterium tuberculosis
INISIIDIPALPG

SEQ ID NO: 179103 - protein, 13 aa, Mycobacterium tuberculosis
NISIIDIPALPGF

SEQ ID NO: 179104 - protein, 13 aa, Mycobacterium tuberculosis
ISIIDIPALPGFG

SEQ ID NO: 179105 - protein, 13 aa, Mycobacterium tuberculosis
SIIDIPALPGFGN

SEQ ID NO: 179106 - protein, 13 aa, Mycobacterium tuberculosis
IIDIPALPGFGNS

SEQ ID NO: 179107 - protein, 13 aa, Mycobacterium tuberculosis
IDIPALPGFGNST

SEQ ID NO: 179108 - protein, 13 aa, Mycobacterium tuberculosis
DIPALPGFGNSTE

SEQ ID NO: 179109 - protein, 13 aa, Mycobacterium tuberculosis
IPALPGFGNSTEL

SEQ ID NO: 179110 - protein, 13 aa, Mycobacterium tuberculosis
PALPGFGNSTELP

SEQ ID NO: 179111 - protein, 13 aa, Mycobacterium tuberculosis
ALPGFGNSTELPS

SEQ ID NO: 179112 - protein, 13 aa, Mycobacterium tuberculosis
LPGFGNSTELPSS

SEQ ID NO: 179113 - protein, 13 aa, Mycobacterium tuberculosis
PGFGNSTELPSSG

SEQ ID NO: 179114 - protein, 13 aa, Mycobacterium tuberculosis
GFGNSTELPSSGF

SEQ ID NO: 179115 - protein, 13 aa, Mycobacterium tuberculosis
FGNSTELPSSGFF

SEQ ID NO: 179116 - protein, 13 aa, Mycobacterium tuberculosis
GNSTELPSSGFFN

SEQ ID NO: 179117 - protein, 13 aa, Mycobacterium tuberculosis
NSTELPSSGFFNT

SEQ ID NO: 179118 - protein, 13 aa, Mycobacterium tuberculosis
STELPSSGFFNTG

SEQ ID NO: 179119 - protein, 13 aa, Mycobacterium tuberculosis
TELPSSGFFNTGG

SEQ ID NO: 179120 - protein, 13 aa, Mycobacterium tuberculosis
ELPSSGFFNTGGG

SEQ ID NO: 179121 - protein, 13 aa, Mycobacterium tuberculosis
LPSSGFFNTGGGG

SEQ ID NO: 179122 - protein, 13 aa, Mycobacterium tuberculosis
PSSGFFNTGGGGG

SEQ ID NO: 179123 - protein, 13 aa, Mycobacterium tuberculosis
SSGFFNTGGGGGS

SEQ ID NO: 179124 - protein, 13 aa, Mycobacterium tuberculosis
SGFFNTGGGGGSG

SEQ ID NO: 179125 - protein, 13 aa, Mycobacterium tuberculosis
GFFNTGGGGGSGI

SEQ ID NO: 179126 - protein, 13 aa, Mycobacterium tuberculosis
FFNTGGGGGSGIA

SEQ ID NO: 179127 - protein, 13 aa, Mycobacterium tuberculosis
FNTGGGGGSGIAN

SEQ ID NO: 179128 - protein, 13 aa, Mycobacterium tuberculosis
NTGGGGGSGIANF

SEQ ID NO: 179129 - protein, 13 aa, Mycobacterium tuberculosis
TGGGGGSGIANFG

SEQ ID NO: 179130 - protein, 13 aa, Mycobacterium tuberculosis
GGGGGSGIANFGA

SEQ ID NO: 179131 - protein, 13 aa, Mycobacterium tuberculosis
GGGGSGIANFGAG

SEQ ID NO: 179132 - protein, 13 aa, Mycobacterium tuberculosis
GGGSGIANFGAGV

SEQ ID NO: 179133 - protein, 13 aa, Mycobacterium tuberculosis
GGSGIANFGAGVS

SEQ ID NO: 179134 - protein, 13 aa, Mycobacterium tuberculosis
GSGIANFGAGVSG

SEQ ID NO: 179135 - protein, 13 aa, Mycobacterium tuberculosis
SGIANFGAGVSGL

SEQ ID NO: 179136 - protein, 13 aa, Mycobacterium tuberculosis
GIANFGAGVSGLL

SEQ ID NO: 179137 - protein, 13 aa, Mycobacterium tuberculosis
IANFGAGVSGLLN

SEQ ID NO: 179138 - protein, 13 aa, Mycobacterium tuberculosis
ANFGAGVSGLLNQ

SEQ ID NO: 179139 - protein, 13 aa, Mycobacterium tuberculosis
NFGAGVSGLLNQA

SEQ ID NO: 179140 - protein, 13 aa, Mycobacterium tuberculosis
FGAGVSGLLNQAS

SEQ ID NO: 179141 - protein, 13 aa, Mycobacterium tuberculosis
GAGVSGLLNQASS

SEQ ID NO: 179142 - protein, 13 aa, Mycobacterium tuberculosis
AGVSGLLNQASSP

SEQ ID NO: 179143 - protein, 13 aa, Mycobacterium tuberculosis
GVSGLLNQASSPM

SEQ ID NO: 179144 - protein, 13 aa, Mycobacterium tuberculosis
VSGLLNQASSPMV

SEQ ID NO: 179145 - protein, 13 aa, Mycobacterium tuberculosis
SGLLNQASSPMVG

SEQ ID NO: 179146 - protein, 13 aa, Mycobacterium tuberculosis
GLLNQASSPMVGT

SEQ ID NO: 179147 - protein, 13 aa, Mycobacterium tuberculosis
LLNQASSPMVGTL

SEQ ID NO: 179148 - protein, 13 aa, Mycobacterium tuberculosis
LNQASSPMVGTLS

SEQ ID NO: 179149 - protein, 13 aa, Mycobacterium tuberculosis
NQASSPMVGTLSG

SEQ ID NO: 179150 - protein, 13 aa, Mycobacterium tuberculosis
QASSPMVGTLSGL

SEQ ID NO: 179151 - protein, 13 aa, Mycobacterium tuberculosis
ASSPMVGTLSGLG

SEQ ID NO: 179152 - protein, 13 aa, Mycobacterium tuberculosis
SSPMVGTLSGLGN

SEQ ID NO: 179153 - protein, 13 aa, Mycobacterium tuberculosis
SPMVGTLSGLGNA

SEQ ID NO: 179154 - protein, 13 aa, Mycobacterium tuberculosis
PMVGTLSGLGNAG

SEQ ID NO: 179155 - protein, 13 aa, Mycobacterium tuberculosis
MVGTLSGLGNAGS

SEQ ID NO: 179156 - protein, 13 aa, Mycobacterium tuberculosis
VGTLSGLGNAGSL

SEQ ID NO: 179157 - protein, 13 aa, Mycobacterium tuberculosis
GTLSGLGNAGSLA

SEQ ID NO: 179158 - protein, 13 aa, Mycobacterium tuberculosis
TLSGLGNAGSLAS

SEQ ID NO: 179159 - protein, 13 aa, Mycobacterium tuberculosis
LSGLGNAGSLASG

SEQ ID NO: 179160 - protein, 13 aa, Mycobacterium tuberculosis
SGLGNAGSLASGV

SEQ ID NO: 179161 - protein, 13 aa, Mycobacterium tuberculosis
GLGNAGSLASGVL

SEQ ID NO: 179162 - protein, 13 aa, Mycobacterium tuberculosis
LGNAGSLASGVLN

SEQ ID NO: 179163 - protein, 13 aa, Mycobacterium tuberculosis
GNAGSLASGVLNS

SEQ ID NO: 179164 - protein, 13 aa, Mycobacterium tuberculosis
NAGSLASGVLNSG

SEQ ID NO: 179165 - protein, 13 aa, Mycobacterium tuberculosis
AGSLASGVLNSGV

SEQ ID NO: 179166 - protein, 13 aa, Mycobacterium tuberculosis
GSLASGVLNSGVD

SEQ ID NO: 179167 - protein, 13 aa, Mycobacterium tuberculosis
SLASGVLNSGVDI

SEQ ID NO: 179168 - protein, 13 aa, Mycobacterium tuberculosis
LASGVLNSGVDIS

SEQ ID NO: 179169 - protein, 13 aa, Mycobacterium tuberculosis
ASGVLNSGVDISG

SEQ ID NO: 179170 - protein, 13 aa, Mycobacterium tuberculosis
SGVLNSGVDISGM

SEQ ID NO: 179171 - protein, 13 aa, Mycobacterium tuberculosis
GVLNSGVDISGMF

SEQ ID NO: 179172 - protein, 13 aa, Mycobacterium tuberculosis
VLNSGVDISGMFN

SEQ ID NO: 179173 - protein, 13 aa, Mycobacterium tuberculosis
LNSGVDISGMFNV

SEQ ID NO: 179174 - protein, 13 aa, Mycobacterium tuberculosis
NSGVDISGMFNVS

SEQ ID NO: 179175 - protein, 13 aa, Mycobacterium tuberculosis
SGVDISGMFNVST

SEQ ID NO: 179176 - protein, 13 aa, Mycobacterium tuberculosis
GVDISGMFNVSTL

SEQ ID NO: 179177 - protein, 13 aa, Mycobacterium tuberculosis
VDISGMFNVSTLG

SEQ ID NO: 179178 - protein, 13 aa, Mycobacterium tuberculosis
DISGMFNVSTLGS

SEQ ID NO: 179179 - protein, 13 aa, Mycobacterium tuberculosis
ISGMFNVSTLGSA

SEQ ID NO: 179180 - protein, 13 aa, Mycobacterium tuberculosis
SGMFNVSTLGSAP

SEQ ID NO: 179181 - protein, 13 aa, Mycobacterium tuberculosis
GMFNVSTLGSAPA

SEQ ID NO: 179182 - protein, 13 aa, Mycobacterium tuberculosis
MFNVSTLGSAPAV

SEQ ID NO: 179183 - protein, 13 aa, Mycobacterium tuberculosis
FNVSTLGSAPAVI

SEQ ID NO: 179184 - protein, 13 aa, Mycobacterium tuberculosis
NVSTLGSAPAVIS

SEQ ID NO: 179185 - protein, 13 aa, Mycobacterium tuberculosis
VSTLGSAPAVISG

SEQ ID NO: 179186 - protein, 13 aa, Mycobacterium tuberculosis
STLGSAPAVISGF

SEQ ID NO: 179187 - protein, 13 aa, Mycobacterium tuberculosis
TLGSAPAVISGFG

SEQ ID NO: 179188 - protein, 13 aa, Mycobacterium tuberculosis
LGSAPAVISGFGN

SEQ ID NO: 179189 - protein, 13 aa, Mycobacterium tuberculosis
GSAPAVISGFGNL

SEQ ID NO: 179190 - protein, 13 aa, Mycobacterium tuberculosis
SAPAVISGFGNLG

SEQ ID NO: 179191 - protein, 13 aa, Mycobacterium tuberculosis
APAVISGFGNLGN

SEQ ID NO: 179192 - protein, 13 aa, Mycobacterium tuberculosis
PAVISGFGNLGNH

SEQ ID NO: 179193 - protein, 13 aa, Mycobacterium tuberculosis
AVISGFGNLGNHV

SEQ ID NO: 179194 - protein, 13 aa, Mycobacterium tuberculosis
VISGFGNLGNHVS

SEQ ID NO: 179195 - protein, 13 aa, Mycobacterium tuberculosis
ISGFGNLGNHVSG

SEQ ID NO: 179196 - protein, 13 aa, Mycobacterium tuberculosis
SGFGNLGNHVSGV

SEQ ID NO: 179197 - protein, 13 aa, Mycobacterium tuberculosis
GFGNLGNHVSGVS

SEQ ID NO: 179198 - protein, 13 aa, Mycobacterium tuberculosis
FGNLGNHVSGVSI

SEQ ID NO: 179199 - protein, 13 aa, Mycobacterium tuberculosis
GNLGNHVSGVSID

SEQ ID NO: 179200 - protein, 13 aa, Mycobacterium tuberculosis
NLGNHVSGVSIDG

SEQ ID NO: 179201 - protein, 13 aa, Mycobacterium tuberculosis
LGNHVSGVSIDGL

SEQ ID NO: 179202 - protein, 13 aa, Mycobacterium tuberculosis
GNHVSGVSIDGLL

SEQ ID NO: 179203 - protein, 13 aa, Mycobacterium tuberculosis
NHVSGVSIDGLLA

SEQ ID NO: 179204 - protein, 13 aa, Mycobacterium tuberculosis
HVSGVSIDGLLAM

SEQ ID NO: 179205 - protein, 13 aa, Mycobacterium tuberculosis
VSGVSIDGLLAML

SEQ ID NO: 179206 - protein, 13 aa, Mycobacterium tuberculosis
SGVSIDGLLAMLT

SEQ ID NO: 179207 - protein, 13 aa, Mycobacterium tuberculosis
GVSIDGLLAMLTS

SEQ ID NO: 179208 - protein, 13 aa, Mycobacterium tuberculosis
VSIDGLLAMLTSG

SEQ ID NO: 179209 - protein, 13 aa, Mycobacterium tuberculosis
SIDGLLAMLTSGG

SEQ ID NO: 179210 - protein, 13 aa, Mycobacterium tuberculosis
IDGLLAMLTSGGS

SEQ ID NO: 179211 - protein, 13 aa, Mycobacterium tuberculosis
DGLLAMLTSGGSG

SEQ ID NO: 179212 - protein, 13 aa, Mycobacterium tuberculosis
GLLAMLTSGGSGG

SEQ ID NO: 179213 - protein, 13 aa, Mycobacterium tuberculosis
LLAMLTSGGSGGS

SEQ ID NO: 179214 - protein, 13 aa, Mycobacterium tuberculosis
LAMLTSGGSGGSG

SEQ ID NO: 179215 - protein, 13 aa, Mycobacterium tuberculosis
AMLTSGGSGGSGQ

SEQ ID NO: 179216 - protein, 13 aa, Mycobacterium tuberculosis
MLTSGGSGGSGQP

SEQ ID NO: 179217 - protein, 13 aa, Mycobacterium tuberculosis
LTSGGSGGSGQPS

SEQ ID NO: 179218 - protein, 13 aa, Mycobacterium tuberculosis
TSGGSGGSGQPSI

SEQ ID NO: 179219 - protein, 13 aa, Mycobacterium tuberculosis
SGGSGGSGQPSII

SEQ ID NO: 179220 - protein, 13 aa, Mycobacterium tuberculosis
GGSGGSGQPSIID

SEQ ID NO: 179221 - protein, 13 aa, Mycobacterium tuberculosis
GSGGSGQPSIIDA

SEQ ID NO: 179222 - protein, 13 aa, Mycobacterium tuberculosis
SGGSGQPSIIDAA

SEQ ID NO: 179223 - protein, 13 aa, Mycobacterium tuberculosis
GGSGQPSIIDAAI

SEQ ID NO: 179224 - protein, 13 aa, Mycobacterium tuberculosis
GSGQPSIIDAAIA

SEQ ID NO: 179225 - protein, 13 aa, Mycobacterium tuberculosis
SGQPSIIDAAIAE

SEQ ID NO: 179226 - protein, 13 aa, Mycobacterium tuberculosis
GQPSIIDAAIAEL

SEQ ID NO: 179227 - protein, 13 aa, Mycobacterium tuberculosis
QPSIIDAAIAELR

SEQ ID NO: 179228 - protein, 13 aa, Mycobacterium tuberculosis
PSIIDAAIAELRH

SEQ ID NO: 179229 - protein, 13 aa, Mycobacterium tuberculosis
SIIDAAIAELRHL

SEQ ID NO: 179230 - protein, 13 aa, Mycobacterium tuberculosis
IIDAAIAELRHLN

SEQ ID NO: 179231 - protein, 13 aa, Mycobacterium tuberculosis
IDAAIAELRHLNP

SEQ ID NO: 179232 - protein, 13 aa, Mycobacterium tuberculosis
DAAIAELRHLNPL

SEQ ID NO: 179233 - protein, 13 aa, Mycobacterium tuberculosis
AAIAELRHLNPLN

SEQ ID NO: 179234 - protein, 13 aa, Mycobacterium tuberculosis
AIAELRHLNPLNI

SEQ ID NO: 179235 - protein, 13 aa, Mycobacterium tuberculosis
IAELRHLNPLNIV

SEQ ID NO: 179236 - protein, 13 aa, Mycobacterium tuberculosis
AELRHLNPLNIVN

SEQ ID NO: 179237 - protein, 13 aa, Mycobacterium tuberculosis
ELRHLNPLNIVNL

SEQ ID NO: 179238 - protein, 13 aa, Mycobacterium tuberculosis
LRHLNPLNIVNLG

SEQ ID NO: 179239 - protein, 13 aa, Mycobacterium tuberculosis
RHLNPLNIVNLGN

SEQ ID NO: 179240 - protein, 13 aa, Mycobacterium tuberculosis
HLNPLNIVNLGNV

SEQ ID NO: 179241 - protein, 13 aa, Mycobacterium tuberculosis
LNPLNIVNLGNVG

SEQ ID NO: 179242 - protein, 13 aa, Mycobacterium tuberculosis
NPLNIVNLGNVGS

SEQ ID NO: 179243 - protein, 13 aa, Mycobacterium tuberculosis
PLNIVNLGNVGSY

SEQ ID NO: 179244 - protein, 13 aa, Mycobacterium tuberculosis
LNIVNLGNVGSYN

SEQ ID NO: 179245 - protein, 13 aa, Mycobacterium tuberculosis
NIVNLGNVGSYNL

SEQ ID NO: 179246 - protein, 13 aa, Mycobacterium tuberculosis
IVNLGNVGSYNLG

SEQ ID NO: 179247 - protein, 13 aa, Mycobacterium tuberculosis
VNLGNVGSYNLGF

SEQ ID NO: 179248 - protein, 13 aa, Mycobacterium tuberculosis
NLGNVGSYNLGFA

SEQ ID NO: 179249 - protein, 13 aa, Mycobacterium tuberculosis
LGNVGSYNLGFAN

SEQ ID NO: 179250 - protein, 13 aa, Mycobacterium tuberculosis
GNVGSYNLGFANV

SEQ ID NO: 179251 - protein, 13 aa, Mycobacterium tuberculosis
NVGSYNLGFANVG

SEQ ID NO: 179252 - protein, 13 aa, Mycobacterium tuberculosis
VGSYNLGFANVGD

SEQ ID NO: 179253 - protein, 13 aa, Mycobacterium tuberculosis
GSYNLGFANVGDV

SEQ ID NO: 179254 - protein, 13 aa, Mycobacterium tuberculosis
SYNLGFANVGDVN

SEQ ID NO: 179255 - protein, 13 aa, Mycobacterium tuberculosis
YNLGFANVGDVNL

SEQ ID NO: 179256 - protein, 13 aa, Mycobacterium tuberculosis
NLGFANVGDVNLG

SEQ ID NO: 179257 - protein, 13 aa, Mycobacterium tuberculosis
LGFANVGDVNLGA

SEQ ID NO: 179258 - protein, 13 aa, Mycobacterium tuberculosis
GFANVGDVNLGAG

SEQ ID NO: 179259 - protein, 13 aa, Mycobacterium tuberculosis
FANVGDVNLGAGN

SEQ ID NO: 179260 - protein, 13 aa, Mycobacterium tuberculosis
ANVGDVNLGAGNL

SEQ ID NO: 179261 - protein, 13 aa, Mycobacterium tuberculosis
NVGDVNLGAGNLG

SEQ ID NO: 179262 - protein, 13 aa, Mycobacterium tuberculosis
VGDVNLGAGNLGN

SEQ ID NO: 179263 - protein, 13 aa, Mycobacterium tuberculosis
GDVNLGAGNLGNL

SEQ ID NO: 179264 - protein, 13 aa, Mycobacterium tuberculosis
DVNLGAGNLGNLN

SEQ ID NO: 179265 - protein, 13 aa, Mycobacterium tuberculosis
VNLGAGNLGNLNL

SEQ ID NO: 179266 - protein, 13 aa, Mycobacterium tuberculosis
NLGAGNLGNLNLG

SEQ ID NO: 179267 - protein, 13 aa, Mycobacterium tuberculosis
LGAGNLGNLNLGG

SEQ ID NO: 179268 - protein, 13 aa, Mycobacterium tuberculosis
GAGNLGNLNLGGG

SEQ ID NO: 179269 - protein, 13 aa, Mycobacterium tuberculosis
AGNLGNLNLGGGN

SEQ ID NO: 179270 - protein, 13 aa, Mycobacterium tuberculosis
GNLGNLNLGGGNL

SEQ ID NO: 179271 - protein, 13 aa, Mycobacterium tuberculosis
NLGNLNLGGGNLG

SEQ ID NO: 179272 - protein, 13 aa, Mycobacterium tuberculosis
LGNLNLGGGNLGG

SEQ ID NO: 179273 - protein, 13 aa, Mycobacterium tuberculosis
GNLNLGGGNLGGQ

SEQ ID NO: 179274 - protein, 13 aa, Mycobacterium tuberculosis
NLNLGGGNLGGQN

SEQ ID NO: 179275 - protein, 13 aa, Mycobacterium tuberculosis
LNLGGGNLGGQNL

SEQ ID NO: 179276 - protein, 13 aa, Mycobacterium tuberculosis
NLGGGNLGGQNLG

SEQ ID NO: 179277 - protein, 13 aa, Mycobacterium tuberculosis
LGGGNLGGQNLGL

SEQ ID NO: 179278 - protein, 13 aa, Mycobacterium tuberculosis
GGGNLGGQNLGLG

SEQ ID NO: 179279 - protein, 13 aa, Mycobacterium tuberculosis
GGNLGGQNLGLGN

SEQ ID NO: 179280 - protein, 13 aa, Mycobacterium tuberculosis
GNLGGQNLGLGNL

SEQ ID NO: 179281 - protein, 13 aa, Mycobacterium tuberculosis
NLGGQNLGLGNLG

SEQ ID NO: 179282 - protein, 13 aa, Mycobacterium tuberculosis
LGGQNLGLGNLGD

SEQ ID NO: 179283 - protein, 13 aa, Mycobacterium tuberculosis
GGQNLGLGNLGDG

SEQ ID NO: 179284 - protein, 13 aa, Mycobacterium tuberculosis
GQNLGLGNLGDGN

SEQ ID NO: 179285 - protein, 13 aa, Mycobacterium tuberculosis
QNLGLGNLGDGNV

SEQ ID NO: 179286 - protein, 13 aa, Mycobacterium tuberculosis
NLGLGNLGDGNVG

SEQ ID NO: 179287 - protein, 13 aa, Mycobacterium tuberculosis
LGLGNLGDGNVGF

SEQ ID NO: 179288 - protein, 13 aa, Mycobacterium tuberculosis
GLGNLGDGNVGFG

SEQ ID NO: 179289 - protein, 13 aa, Mycobacterium tuberculosis
LGNLGDGNVGFGN

SEQ ID NO: 179290 - protein, 13 aa, Mycobacterium tuberculosis
GNLGDGNVGFGNL

SEQ ID NO: 179291 - protein, 13 aa, Mycobacterium tuberculosis
NLGDGNVGFGNLG

SEQ ID NO: 179292 - protein, 13 aa, Mycobacterium tuberculosis
LGDGNVGFGNLGH

SEQ ID NO: 179293 - protein, 13 aa, Mycobacterium tuberculosis
GDGNVGFGNLGHG

SEQ ID NO: 179294 - protein, 13 aa, Mycobacterium tuberculosis
DGNVGFGNLGHGN

SEQ ID NO: 179295 - protein, 13 aa, Mycobacterium tuberculosis
GNVGFGNLGHGNV

SEQ ID NO: 179296 - protein, 13 aa, Mycobacterium tuberculosis
NVGFGNLGHGNVG

SEQ ID NO: 179297 - protein, 13 aa, Mycobacterium tuberculosis
VGFGNLGHGNVGF

SEQ ID NO: 179298 - protein, 13 aa, Mycobacterium tuberculosis
GFGNLGHGNVGFG

SEQ ID NO: 179299 - protein, 13 aa, Mycobacterium tuberculosis
FGNLGHGNVGFGN

SEQ ID NO: 179300 - protein, 13 aa, Mycobacterium tuberculosis
GNLGHGNVGFGNS

SEQ ID NO: 179301 - protein, 13 aa, Mycobacterium tuberculosis
NLGHGNVGFGNSG

SEQ ID NO: 179302 - protein, 13 aa, Mycobacterium tuberculosis
LGHGNVGFGNSGL

SEQ ID NO: 179303 - protein, 13 aa, Mycobacterium tuberculosis
GHGNVGFGNSGLG

SEQ ID NO: 179304 - protein, 13 aa, Mycobacterium tuberculosis
HGNVGFGNSGLGA

SEQ ID NO: 179305 - protein, 13 aa, Mycobacterium tuberculosis
GNVGFGNSGLGAL

SEQ ID NO: 179306 - protein, 13 aa, Mycobacterium tuberculosis
NVGFGNSGLGALP

SEQ ID NO: 179307 - protein, 13 aa, Mycobacterium tuberculosis
VGFGNSGLGALPG

SEQ ID NO: 179308 - protein, 13 aa, Mycobacterium tuberculosis
GFGNSGLGALPGI

SEQ ID NO: 179309 - protein, 13 aa, Mycobacterium tuberculosis
FGNSGLGALPGIG

SEQ ID NO: 179310 - protein, 13 aa, Mycobacterium tuberculosis
GNSGLGALPGIGN

SEQ ID NO: 179311 - protein, 13 aa, Mycobacterium tuberculosis
NSGLGALPGIGNI

SEQ ID NO: 179312 - protein, 13 aa, Mycobacterium tuberculosis
SGLGALPGIGNIG

SEQ ID NO: 179313 - protein, 13 aa, Mycobacterium tuberculosis
GLGALPGIGNIGL

SEQ ID NO: 179314 - protein, 13 aa, Mycobacterium tuberculosis
LGALPGIGNIGLG

SEQ ID NO: 179315 - protein, 13 aa, Mycobacterium tuberculosis
GALPGIGNIGLGN

SEQ ID NO: 179316 - protein, 13 aa, Mycobacterium tuberculosis
ALPGIGNIGLGNA

SEQ ID NO: 179317 - protein, 13 aa, Mycobacterium tuberculosis
LPGIGNIGLGNAG

SEQ ID NO: 179318 - protein, 13 aa, Mycobacterium tuberculosis
PGIGNIGLGNAGS

SEQ ID NO: 179319 - protein, 13 aa, Mycobacterium tuberculosis
GIGNIGLGNAGSN

SEQ ID NO: 179320 - protein, 13 aa, Mycobacterium tuberculosis
IGNIGLGNAGSNN

SEQ ID NO: 179321 - protein, 13 aa, Mycobacterium tuberculosis
GNIGLGNAGSNNV

SEQ ID NO: 179322 - protein, 13 aa, Mycobacterium tuberculosis
NIGLGNAGSNNVG

SEQ ID NO: 179323 - protein, 13 aa, Mycobacterium tuberculosis
IGLGNAGSNNVGF

SEQ ID NO: 179324 - protein, 13 aa, Mycobacterium tuberculosis
GLGNAGSNNVGFG

SEQ ID NO: 179325 - protein, 13 aa, Mycobacterium tuberculosis
LGNAGSNNVGFGN

SEQ ID NO: 179326 - protein, 13 aa, Mycobacterium tuberculosis
GNAGSNNVGFGNM

SEQ ID NO: 179327 - protein, 13 aa, Mycobacterium tuberculosis
NAGSNNVGFGNMG

SEQ ID NO: 179328 - protein, 13 aa, Mycobacterium tuberculosis
AGSNNVGFGNMGL

SEQ ID NO: 179329 - protein, 13 aa, Mycobacterium tuberculosis
GSNNVGFGNMGLG

SEQ ID NO: 179330 - protein, 13 aa, Mycobacterium tuberculosis
SNNVGFGNMGLGN

SEQ ID NO: 179331 - protein, 13 aa, Mycobacterium tuberculosis
NNVGFGNMGLGNI

SEQ ID NO: 179332 - protein, 13 aa, Mycobacterium tuberculosis
NVGFGNMGLGNIG

SEQ ID NO: 179333 - protein, 13 aa, Mycobacterium tuberculosis
VGFGNMGLGNIGF

SEQ ID NO: 179334 - protein, 13 aa, Mycobacterium tuberculosis
GFGNMGLGNIGFG

SEQ ID NO: 179335 - protein, 13 aa, Mycobacterium tuberculosis
FGNMGLGNIGFGN

SEQ ID NO: 179336 - protein, 13 aa, Mycobacterium tuberculosis
GNMGLGNIGFGNT

SEQ ID NO: 179337 - protein, 13 aa, Mycobacterium tuberculosis
NMGLGNIGFGNTG

SEQ ID NO: 179338 - protein, 13 aa, Mycobacterium tuberculosis
MGLGNIGFGNTGT

SEQ ID NO: 179339 - protein, 13 aa, Mycobacterium tuberculosis
GLGNIGFGNTGTN

SEQ ID NO: 179340 - protein, 13 aa, Mycobacterium tuberculosis
LGNIGFGNTGTNN

SEQ ID NO: 179341 - protein, 13 aa, Mycobacterium tuberculosis
GNIGFGNTGTNNL

SEQ ID NO: 179342 - protein, 13 aa, Mycobacterium tuberculosis
NIGFGNTGTNNLG

SEQ ID NO: 179343 - protein, 13 aa, Mycobacterium tuberculosis
IGFGNTGTNNLGI

SEQ ID NO: 179344 - protein, 13 aa, Mycobacterium tuberculosis
GFGNTGTNNLGIG

SEQ ID NO: 179345 - protein, 13 aa, Mycobacterium tuberculosis
FGNTGTNNLGIGL

SEQ ID NO: 179346 - protein, 13 aa, Mycobacterium tuberculosis
GNTGTNNLGIGLT

SEQ ID NO: 179347 - protein, 13 aa, Mycobacterium tuberculosis
NTGTNNLGIGLTG

SEQ ID NO: 179348 - protein, 13 aa, Mycobacterium tuberculosis
TGTNNLGIGLTGD

SEQ ID NO: 179349 - protein, 13 aa, Mycobacterium tuberculosis
GTNNLGIGLTGDN

SEQ ID NO: 179350 - protein, 13 aa, Mycobacterium tuberculosis
TNNLGIGLTGDNQ

SEQ ID NO: 179351 - protein, 13 aa, Mycobacterium tuberculosis
NNLGIGLTGDNQT

SEQ ID NO: 179352 - protein, 13 aa, Mycobacterium tuberculosis
NLGIGLTGDNQTG

SEQ ID NO: 179353 - protein, 13 aa, Mycobacterium tuberculosis
LGIGLTGDNQTGF

SEQ ID NO: 179354 - protein, 13 aa, Mycobacterium tuberculosis
GIGLTGDNQTGFG

SEQ ID NO: 179355 - protein, 13 aa, Mycobacterium tuberculosis
IGLTGDNQTGFGG

SEQ ID NO: 179356 - protein, 13 aa, Mycobacterium tuberculosis
GLTGDNQTGFGGL

SEQ ID NO: 179357 - protein, 13 aa, Mycobacterium tuberculosis
LTGDNQTGFGGLN

SEQ ID NO: 179358 - protein, 13 aa, Mycobacterium tuberculosis
TGDNQTGFGGLNS

SEQ ID NO: 179359 - protein, 13 aa, Mycobacterium tuberculosis
GDNQTGFGGLNSG

SEQ ID NO: 179360 - protein, 13 aa, Mycobacterium tuberculosis
DNQTGFGGLNSGA

SEQ ID NO: 179361 - protein, 13 aa, Mycobacterium tuberculosis
NQTGFGGLNSGAG

SEQ ID NO: 179362 - protein, 13 aa, Mycobacterium tuberculosis
QTGFGGLNSGAGN

SEQ ID NO: 179363 - protein, 13 aa, Mycobacterium tuberculosis
TGFGGLNSGAGNL

SEQ ID NO: 179364 - protein, 13 aa, Mycobacterium tuberculosis
GFGGLNSGAGNLG

SEQ ID NO: 179365 - protein, 13 aa, Mycobacterium tuberculosis
FGGLNSGAGNLGL

SEQ ID NO: 179366 - protein, 13 aa, Mycobacterium tuberculosis
GGLNSGAGNLGLF

SEQ ID NO: 179367 - protein, 13 aa, Mycobacterium tuberculosis
GLNSGAGNLGLFN

SEQ ID NO: 179368 - protein, 13 aa, Mycobacterium tuberculosis
LNSGAGNLGLFNS

SEQ ID NO: 179369 - protein, 13 aa, Mycobacterium tuberculosis
NSGAGNLGLFNSG

SEQ ID NO: 179370 - protein, 13 aa, Mycobacterium tuberculosis
SGAGNLGLFNSGT

SEQ ID NO: 179371 - protein, 13 aa, Mycobacterium tuberculosis
GAGNLGLFNSGTG

SEQ ID NO: 179372 - protein, 13 aa, Mycobacterium tuberculosis
AGNLGLFNSGTGN

SEQ ID NO: 179373 - protein, 13 aa, Mycobacterium tuberculosis
GNLGLFNSGTGNI

SEQ ID NO: 179374 - protein, 13 aa, Mycobacterium tuberculosis
NLGLFNSGTGNIG

SEQ ID NO: 179375 - protein, 13 aa, Mycobacterium tuberculosis
LGLFNSGTGNIGF

SEQ ID NO: 179376 - protein, 13 aa, Mycobacterium tuberculosis
GLFNSGTGNIGFF

SEQ ID NO: 179377 - protein, 13 aa, Mycobacterium tuberculosis
LFNSGTGNIGFFN

SEQ ID NO: 179378 - protein, 13 aa, Mycobacterium tuberculosis
FNSGTGNIGFFNT

SEQ ID NO: 179379 - protein, 13 aa, Mycobacterium tuberculosis
NSGTGNIGFFNTG

SEQ ID NO: 179380 - protein, 13 aa, Mycobacterium tuberculosis
SGTGNIGFFNTGT

SEQ ID NO: 179381 - protein, 13 aa, Mycobacterium tuberculosis
GTGNIGFFNTGTG

SEQ ID NO: 179382 - protein, 13 aa, Mycobacterium tuberculosis
TGNIGFFNTGTGN

SEQ ID NO: 179383 - protein, 13 aa, Mycobacterium tuberculosis
GNIGFFNTGTGNW

SEQ ID NO: 179384 - protein, 13 aa, Mycobacterium tuberculosis
NIGFFNTGTGNWG

SEQ ID NO: 179385 - protein, 13 aa, Mycobacterium tuberculosis
IGFFNTGTGNWGL

SEQ ID NO: 179386 - protein, 13 aa, Mycobacterium tuberculosis
GFFNTGTGNWGLF

SEQ ID NO: 179387 - protein, 13 aa, Mycobacterium tuberculosis
FFNTGTGNWGLFN

SEQ ID NO: 179388 - protein, 13 aa, Mycobacterium tuberculosis
FNTGTGNWGLFNS

SEQ ID NO: 179389 - protein, 13 aa, Mycobacterium tuberculosis
NTGTGNWGLFNSG

SEQ ID NO: 179390 - protein, 13 aa, Mycobacterium tuberculosis
TGTGNWGLFNSGS

SEQ ID NO: 179391 - protein, 13 aa, Mycobacterium tuberculosis
GTGNWGLFNSGSY

SEQ ID NO: 179392 - protein, 13 aa, Mycobacterium tuberculosis
TGNWGLFNSGSYN

SEQ ID NO: 179393 - protein, 13 aa, Mycobacterium tuberculosis
GNWGLFNSGSYNT

SEQ ID NO: 179394 - protein, 13 aa, Mycobacterium tuberculosis
NWGLFNSGSYNTG

SEQ ID NO: 179395 - protein, 13 aa, Mycobacterium tuberculosis
WGLFNSGSYNTGI

SEQ ID NO: 179396 - protein, 13 aa, Mycobacterium tuberculosis
GLFNSGSYNTGIG

SEQ ID NO: 179397 - protein, 13 aa, Mycobacterium tuberculosis
LFNSGSYNTGIGN

SEQ ID NO: 179398 - protein, 13 aa, Mycobacterium tuberculosis
FNSGSYNTGIGNS

SEQ ID NO: 179399 - protein, 13 aa, Mycobacterium tuberculosis
NSGSYNTGIGNSG

SEQ ID NO: 179400 - protein, 13 aa, Mycobacterium tuberculosis
SGSYNTGIGNSGT

SEQ ID NO: 179401 - protein, 13 aa, Mycobacterium tuberculosis
GSYNTGIGNSGTG

SEQ ID NO: 179402 - protein, 13 aa, Mycobacterium tuberculosis
SYNTGIGNSGTGS

SEQ ID NO: 179403 - protein, 13 aa, Mycobacterium tuberculosis
YNTGIGNSGTGST

SEQ ID NO: 179404 - protein, 13 aa, Mycobacterium tuberculosis
NTGIGNSGTGSTG

SEQ ID NO: 179405 - protein, 13 aa, Mycobacterium tuberculosis
TGIGNSGTGSTGL

SEQ ID NO: 179406 - protein, 13 aa, Mycobacterium tuberculosis
GIGNSGTGSTGLF

SEQ ID NO: 179407 - protein, 13 aa, Mycobacterium tuberculosis
IGNSGTGSTGLFN

SEQ ID NO: 179408 - protein, 13 aa, Mycobacterium tuberculosis
GNSGTGSTGLFNA

SEQ ID NO: 179409 - protein, 13 aa, Mycobacterium tuberculosis
NSGTGSTGLFNAG

SEQ ID NO: 179410 - protein, 13 aa, Mycobacterium tuberculosis
SGTGSTGLFNAGS

SEQ ID NO: 179411 - protein, 13 aa, Mycobacterium tuberculosis
GTGSTGLFNAGSF

SEQ ID NO: 179412 - protein, 13 aa, Mycobacterium tuberculosis
TGSTGLFNAGSFN

SEQ ID NO: 179413 - protein, 13 aa, Mycobacterium tuberculosis
GSTGLFNAGSFNT

SEQ ID NO: 179414 - protein, 13 aa, Mycobacterium tuberculosis
STGLFNAGSFNTG

SEQ ID NO: 179415 - protein, 13 aa, Mycobacterium tuberculosis
TGLFNAGSFNTGL

SEQ ID NO: 179416 - protein, 13 aa, Mycobacterium tuberculosis
GLFNAGSFNTGLA

SEQ ID NO: 179417 - protein, 13 aa, Mycobacterium tuberculosis
LFNAGSFNTGLAN

SEQ ID NO: 179418 - protein, 13 aa, Mycobacterium tuberculosis
FNAGSFNTGLANA

SEQ ID NO: 179419 - protein, 13 aa, Mycobacterium tuberculosis
NAGSFNTGLANAG

SEQ ID NO: 179420 - protein, 13 aa, Mycobacterium tuberculosis
AGSFNTGLANAGS

SEQ ID NO: 179421 - protein, 13 aa, Mycobacterium tuberculosis
GSFNTGLANAGSY

SEQ ID NO: 179422 - protein, 13 aa, Mycobacterium tuberculosis
SFNTGLANAGSYN

SEQ ID NO: 179423 - protein, 13 aa, Mycobacterium tuberculosis
FNTGLANAGSYNT

SEQ ID NO: 179424 - protein, 13 aa, Mycobacterium tuberculosis
NTGLANAGSYNTG

SEQ ID NO: 179425 - protein, 13 aa, Mycobacterium tuberculosis
TGLANAGSYNTGS

SEQ ID NO: 179426 - protein, 13 aa, Mycobacterium tuberculosis
GLANAGSYNTGSL

SEQ ID NO: 179427 - protein, 13 aa, Mycobacterium tuberculosis
LANAGSYNTGSLN

SEQ ID NO: 179428 - protein, 13 aa, Mycobacterium tuberculosis
ANAGSYNTGSLNA

SEQ ID NO: 179429 - protein, 13 aa, Mycobacterium tuberculosis
NAGSYNTGSLNAG

SEQ ID NO: 179430 - protein, 13 aa, Mycobacterium tuberculosis
AGSYNTGSLNAGN

SEQ ID NO: 179431 - protein, 13 aa, Mycobacterium tuberculosis
GSYNTGSLNAGNT

SEQ ID NO: 179432 - protein, 13 aa, Mycobacterium tuberculosis
SYNTGSLNAGNTN

SEQ ID NO: 179433 - protein, 13 aa, Mycobacterium tuberculosis
YNTGSLNAGNTNT

SEQ ID NO: 179434 - protein, 13 aa, Mycobacterium tuberculosis
NTGSLNAGNTNTG

SEQ ID NO: 179435 - protein, 13 aa, Mycobacterium tuberculosis
TGSLNAGNTNTGG

SEQ ID NO: 179436 - protein, 13 aa, Mycobacterium tuberculosis
GSLNAGNTNTGGF

SEQ ID NO: 179437 - protein, 13 aa, Mycobacterium tuberculosis
SLNAGNTNTGGFN

SEQ ID NO: 179438 - protein, 13 aa, Mycobacterium tuberculosis
LNAGNTNTGGFNP

SEQ ID NO: 179439 - protein, 13 aa, Mycobacterium tuberculosis
NAGNTNTGGFNPG

SEQ ID NO: 179440 - protein, 13 aa, Mycobacterium tuberculosis
AGNTNTGGFNPGN

SEQ ID NO: 179441 - protein, 13 aa, Mycobacterium tuberculosis
GNTNTGGFNPGNV

SEQ ID NO: 179442 - protein, 13 aa, Mycobacterium tuberculosis
NTNTGGFNPGNVN

SEQ ID NO: 179443 - protein, 13 aa, Mycobacterium tuberculosis
TNTGGFNPGNVNT

SEQ ID NO: 179444 - protein, 13 aa, Mycobacterium tuberculosis
NTGGFNPGNVNTG

SEQ ID NO: 179445 - protein, 13 aa, Mycobacterium tuberculosis
TGGFNPGNVNTGW

SEQ ID NO: 179446 - protein, 13 aa, Mycobacterium tuberculosis
GGFNPGNVNTGWF

SEQ ID NO: 179447 - protein, 13 aa, Mycobacterium tuberculosis
GFNPGNVNTGWFN

SEQ ID NO: 179448 - protein, 13 aa, Mycobacterium tuberculosis
FNPGNVNTGWFNA

SEQ ID NO: 179449 - protein, 13 aa, Mycobacterium tuberculosis
NPGNVNTGWFNAG

SEQ ID NO: 179450 - protein, 13 aa, Mycobacterium tuberculosis
PGNVNTGWFNAGH

SEQ ID NO: 179451 - protein, 13 aa, Mycobacterium tuberculosis
GNVNTGWFNAGHT

SEQ ID NO: 179452 - protein, 13 aa, Mycobacterium tuberculosis
NVNTGWFNAGHTN

SEQ ID NO: 179453 - protein, 13 aa, Mycobacterium tuberculosis
VNTGWFNAGHTNT

SEQ ID NO: 179454 - protein, 13 aa, Mycobacterium tuberculosis
NTGWFNAGHTNTG

SEQ ID NO: 179455 - protein, 13 aa, Mycobacterium tuberculosis
TGWFNAGHTNTGG

SEQ ID NO: 179456 - protein, 13 aa, Mycobacterium tuberculosis
GWFNAGHTNTGGF

SEQ ID NO: 179457 - protein, 13 aa, Mycobacterium tuberculosis
WFNAGHTNTGGFN

SEQ ID NO: 179458 - protein, 13 aa, Mycobacterium tuberculosis
FNAGHTNTGGFNT

SEQ ID NO: 179459 - protein, 13 aa, Mycobacterium tuberculosis
NAGHTNTGGFNTG

SEQ ID NO: 179460 - protein, 13 aa, Mycobacterium tuberculosis
AGHTNTGGFNTGN

SEQ ID NO: 179461 - protein, 13 aa, Mycobacterium tuberculosis
GHTNTGGFNTGNV

SEQ ID NO: 179462 - protein, 13 aa, Mycobacterium tuberculosis
HTNTGGFNTGNVN

SEQ ID NO: 179463 - protein, 13 aa, Mycobacterium tuberculosis
TNTGGFNTGNVNT

SEQ ID NO: 179464 - protein, 13 aa, Mycobacterium tuberculosis
NTGGFNTGNVNTG

SEQ ID NO: 179465 - protein, 13 aa, Mycobacterium tuberculosis
TGGFNTGNVNTGA

SEQ ID NO: 179466 - protein, 13 aa, Mycobacterium tuberculosis
GGFNTGNVNTGAF

SEQ ID NO: 179467 - protein, 13 aa, Mycobacterium tuberculosis
GFNTGNVNTGAFN

SEQ ID NO: 179468 - protein, 13 aa, Mycobacterium tuberculosis
FNTGNVNTGAFNS

SEQ ID NO: 179469 - protein, 13 aa, Mycobacterium tuberculosis
NTGNVNTGAFNSG

SEQ ID NO: 179470 - protein, 13 aa, Mycobacterium tuberculosis
TGNVNTGAFNSGS

SEQ ID NO: 179471 - protein, 13 aa, Mycobacterium tuberculosis
GNVNTGAFNSGSF

SEQ ID NO: 179472 - protein, 13 aa, Mycobacterium tuberculosis
NVNTGAFNSGSFN

SEQ ID NO: 179473 - protein, 13 aa, Mycobacterium tuberculosis
VNTGAFNSGSFNN

SEQ ID NO: 179474 - protein, 13 aa, Mycobacterium tuberculosis
NTGAFNSGSFNNG

SEQ ID NO: 179475 - protein, 13 aa, Mycobacterium tuberculosis
TGAFNSGSFNNGA

SEQ ID NO: 179476 - protein, 13 aa, Mycobacterium tuberculosis
GAFNSGSFNNGAL

SEQ ID NO: 179477 - protein, 13 aa, Mycobacterium tuberculosis
AFNSGSFNNGALW

SEQ ID NO: 179478 - protein, 13 aa, Mycobacterium tuberculosis
FNSGSFNNGALWT

SEQ ID NO: 179479 - protein, 13 aa, Mycobacterium tuberculosis
NSGSFNNGALWTG

SEQ ID NO: 179480 - protein, 13 aa, Mycobacterium tuberculosis
SGSFNNGALWTGD

SEQ ID NO: 179481 - protein, 13 aa, Mycobacterium tuberculosis
GSFNNGALWTGDH

SEQ ID NO: 179482 - protein, 13 aa, Mycobacterium tuberculosis
SFNNGALWTGDHH

SEQ ID NO: 179483 - protein, 13 aa, Mycobacterium tuberculosis
FNNGALWTGDHHG

SEQ ID NO: 179484 - protein, 13 aa, Mycobacterium tuberculosis
NNGALWTGDHHGL

SEQ ID NO: 179485 - protein, 13 aa, Mycobacterium tuberculosis
NGALWTGDHHGLV

SEQ ID NO: 179486 - protein, 13 aa, Mycobacterium tuberculosis
GALWTGDHHGLVG

SEQ ID NO: 179487 - protein, 13 aa, Mycobacterium tuberculosis
ALWTGDHHGLVGF

SEQ ID NO: 179488 - protein, 13 aa, Mycobacterium tuberculosis
LWTGDHHGLVGFS

SEQ ID NO: 179489 - protein, 13 aa, Mycobacterium tuberculosis
WTGDHHGLVGFSY

SEQ ID NO: 179490 - protein, 13 aa, Mycobacterium tuberculosis
TGDHHGLVGFSYS

SEQ ID NO: 179491 - protein, 13 aa, Mycobacterium tuberculosis
GDHHGLVGFSYSI

SEQ ID NO: 179492 - protein, 13 aa, Mycobacterium tuberculosis
DHHGLVGFSYSIE

SEQ ID NO: 179493 - protein, 13 aa, Mycobacterium tuberculosis
HHGLVGFSYSIEI

SEQ ID NO: 179494 - protein, 13 aa, Mycobacterium tuberculosis
HGLVGFSYSIEIT

SEQ ID NO: 179495 - protein, 13 aa, Mycobacterium tuberculosis
GLVGFSYSIEITG

SEQ ID NO: 179496 - protein, 13 aa, Mycobacterium tuberculosis
LVGFSYSIEITGS

SEQ ID NO: 179497 - protein, 13 aa, Mycobacterium tuberculosis
VGFSYSIEITGST

SEQ ID NO: 179498 - protein, 13 aa, Mycobacterium tuberculosis
GFSYSIEITGSTL

SEQ ID NO: 179499 - protein, 13 aa, Mycobacterium tuberculosis
FSYSIEITGSTLV

SEQ ID NO: 179500 - protein, 13 aa, Mycobacterium tuberculosis
SYSIEITGSTLVD

SEQ ID NO: 179501 - protein, 13 aa, Mycobacterium tuberculosis
YSIEITGSTLVDI

SEQ ID NO: 179502 - protein, 13 aa, Mycobacterium tuberculosis
SIEITGSTLVDIN

SEQ ID NO: 179503 - protein, 13 aa, Mycobacterium tuberculosis
IEITGSTLVDINE

SEQ ID NO: 179504 - protein, 13 aa, Mycobacterium tuberculosis
EITGSTLVDINET

SEQ ID NO: 179505 - protein, 13 aa, Mycobacterium tuberculosis
ITGSTLVDINETL

SEQ ID NO: 179506 - protein, 13 aa, Mycobacterium tuberculosis
TGSTLVDINETLN

SEQ ID NO: 179507 - protein, 13 aa, Mycobacterium tuberculosis
GSTLVDINETLNL

SEQ ID NO: 179508 - protein, 13 aa, Mycobacterium tuberculosis
STLVDINETLNLG

SEQ ID NO: 179509 - protein, 13 aa, Mycobacterium tuberculosis
TLVDINETLNLGP

SEQ ID NO: 179510 - protein, 13 aa, Mycobacterium tuberculosis
LVDINETLNLGPV

SEQ ID NO: 179511 - protein, 13 aa, Mycobacterium tuberculosis
VDINETLNLGPVH

SEQ ID NO: 179512 - protein, 13 aa, Mycobacterium tuberculosis
DINETLNLGPVHI

SEQ ID NO: 179513 - protein, 13 aa, Mycobacterium tuberculosis
INETLNLGPVHID

SEQ ID NO: 179514 - protein, 13 aa, Mycobacterium tuberculosis
NETLNLGPVHIDQ

SEQ ID NO: 179515 - protein, 13 aa, Mycobacterium tuberculosis
ETLNLGPVHIDQI

SEQ ID NO: 179516 - protein, 13 aa, Mycobacterium tuberculosis
TLNLGPVHIDQID

SEQ ID NO: 179517 - protein, 13 aa, Mycobacterium tuberculosis
LNLGPVHIDQIDI

SEQ ID NO: 179518 - protein, 13 aa, Mycobacterium tuberculosis
NLGPVHIDQIDIP

SEQ ID NO: 179519 - protein, 13 aa, Mycobacterium tuberculosis
LGPVHIDQIDIPG

SEQ ID NO: 179520 - protein, 13 aa, Mycobacterium tuberculosis
GPVHIDQIDIPGM

SEQ ID NO: 179521 - protein, 13 aa, Mycobacterium tuberculosis
PVHIDQIDIPGMS

SEQ ID NO: 179522 - protein, 13 aa, Mycobacterium tuberculosis
VHIDQIDIPGMSL

SEQ ID NO: 179523 - protein, 13 aa, Mycobacterium tuberculosis
HIDQIDIPGMSLF

SEQ ID NO: 179524 - protein, 13 aa, Mycobacterium tuberculosis
IDQIDIPGMSLFD

SEQ ID NO: 179525 - protein, 13 aa, Mycobacterium tuberculosis
DQIDIPGMSLFDI

SEQ ID NO: 179526 - protein, 13 aa, Mycobacterium tuberculosis
QIDIPGMSLFDIH

SEQ ID NO: 179527 - protein, 13 aa, Mycobacterium tuberculosis
IDIPGMSLFDIHE

SEQ ID NO: 179528 - protein, 13 aa, Mycobacterium tuberculosis
DIPGMSLFDIHEL

SEQ ID NO: 179529 - protein, 13 aa, Mycobacterium tuberculosis
IPGMSLFDIHELV

SEQ ID NO: 179530 - protein, 13 aa, Mycobacterium tuberculosis
PGMSLFDIHELVN

SEQ ID NO: 179531 - protein, 13 aa, Mycobacterium tuberculosis
GMSLFDIHELVNI

SEQ ID NO: 179532 - protein, 13 aa, Mycobacterium tuberculosis
MSLFDIHELVNIG

SEQ ID NO: 179533 - protein, 13 aa, Mycobacterium tuberculosis
SLFDIHELVNIGP

SEQ ID NO: 179534 - protein, 13 aa, Mycobacterium tuberculosis
LFDIHELVNIGPF

SEQ ID NO: 179535 - protein, 13 aa, Mycobacterium tuberculosis
FDIHELVNIGPFR

SEQ ID NO: 179536 - protein, 13 aa, Mycobacterium tuberculosis
DIHELVNIGPFRI

SEQ ID NO: 179537 - protein, 13 aa, Mycobacterium tuberculosis
IHELVNIGPFRIE

SEQ ID NO: 179538 - protein, 13 aa, Mycobacterium tuberculosis
HELVNIGPFRIEP

SEQ ID NO: 179539 - protein, 13 aa, Mycobacterium tuberculosis
ELVNIGPFRIEPI

SEQ ID NO: 179540 - protein, 13 aa, Mycobacterium tuberculosis
LVNIGPFRIEPID

SEQ ID NO: 179541 - protein, 13 aa, Mycobacterium tuberculosis
VNIGPFRIEPIDV

SEQ ID NO: 179542 - protein, 13 aa, Mycobacterium tuberculosis
NIGPFRIEPIDVP

SEQ ID NO: 179543 - protein, 13 aa, Mycobacterium tuberculosis
IGPFRIEPIDVPA

SEQ ID NO: 179544 - protein, 13 aa, Mycobacterium tuberculosis
GPFRIEPIDVPAV

SEQ ID NO: 179545 - protein, 13 aa, Mycobacterium tuberculosis
PFRIEPIDVPAVV

SEQ ID NO: 179546 - protein, 13 aa, Mycobacterium tuberculosis
FRIEPIDVPAVVL

SEQ ID NO: 179547 - protein, 13 aa, Mycobacterium tuberculosis
RIEPIDVPAVVLD

SEQ ID NO: 179548 - protein, 13 aa, Mycobacterium tuberculosis
IEPIDVPAVVLDI

SEQ ID NO: 179549 - protein, 13 aa, Mycobacterium tuberculosis
EPIDVPAVVLDIH

SEQ ID NO: 179550 - protein, 13 aa, Mycobacterium tuberculosis
PIDVPAVVLDIHE

SEQ ID NO: 179551 - protein, 13 aa, Mycobacterium tuberculosis
IDVPAVVLDIHET

SEQ ID NO: 179552 - protein, 13 aa, Mycobacterium tuberculosis
DVPAVVLDIHETM

SEQ ID NO: 179553 - protein, 13 aa, Mycobacterium tuberculosis
VPAVVLDIHETMV

SEQ ID NO: 179554 - protein, 13 aa, Mycobacterium tuberculosis
PAVVLDIHETMVI

SEQ ID NO: 179555 - protein, 13 aa, Mycobacterium tuberculosis
AVVLDIHETMVIP

SEQ ID NO: 179556 - protein, 13 aa, Mycobacterium tuberculosis
VVLDIHETMVIPP

SEQ ID NO: 179557 - protein, 13 aa, Mycobacterium tuberculosis
VLDIHETMVIPPI

SEQ ID NO: 179558 - protein, 13 aa, Mycobacterium tuberculosis
LDIHETMVIPPIV

SEQ ID NO: 179559 - protein, 13 aa, Mycobacterium tuberculosis
DIHETMVIPPIVF

SEQ ID NO: 179560 - protein, 13 aa, Mycobacterium tuberculosis
IHETMVIPPIVFL

SEQ ID NO: 179561 - protein, 13 aa, Mycobacterium tuberculosis
HETMVIPPIVFLP

SEQ ID NO: 179562 - protein, 13 aa, Mycobacterium tuberculosis
ETMVIPPIVFLPS

SEQ ID NO: 179563 - protein, 13 aa, Mycobacterium tuberculosis
TMVIPPIVFLPSM

SEQ ID NO: 179564 - protein, 13 aa, Mycobacterium tuberculosis
MVIPPIVFLPSMT

SEQ ID NO: 179565 - protein, 13 aa, Mycobacterium tuberculosis
VIPPIVFLPSMTI

SEQ ID NO: 179566 - protein, 13 aa, Mycobacterium tuberculosis
IPPIVFLPSMTIG

SEQ ID NO: 179567 - protein, 13 aa, Mycobacterium tuberculosis
PPIVFLPSMTIGG

SEQ ID NO: 179568 - protein, 13 aa, Mycobacterium tuberculosis
PIVFLPSMTIGGQ

SEQ ID NO: 179569 - protein, 13 aa, Mycobacterium tuberculosis
IVFLPSMTIGGQT

SEQ ID NO: 179570 - protein, 13 aa, Mycobacterium tuberculosis
VFLPSMTIGGQTY

SEQ ID NO: 179571 - protein, 13 aa, Mycobacterium tuberculosis
FLPSMTIGGQTYT

SEQ ID NO: 179572 - protein, 13 aa, Mycobacterium tuberculosis
LPSMTIGGQTYTI

SEQ ID NO: 179573 - protein, 13 aa, Mycobacterium tuberculosis
PSMTIGGQTYTIP

SEQ ID NO: 179574 - protein, 13 aa, Mycobacterium tuberculosis
SMTIGGQTYTIPL

SEQ ID NO: 179575 - protein, 13 aa, Mycobacterium tuberculosis
MTIGGQTYTIPLD

SEQ ID NO: 179576 - protein, 13 aa, Mycobacterium tuberculosis
TIGGQTYTIPLDT

SEQ ID NO: 179577 - protein, 13 aa, Mycobacterium tuberculosis
IGGQTYTIPLDTP

SEQ ID NO: 179578 - protein, 13 aa, Mycobacterium tuberculosis
GGQTYTIPLDTPP

SEQ ID NO: 179579 - protein, 13 aa, Mycobacterium tuberculosis
GQTYTIPLDTPPA

SEQ ID NO: 179580 - protein, 13 aa, Mycobacterium tuberculosis
QTYTIPLDTPPAP

SEQ ID NO: 179581 - protein, 13 aa, Mycobacterium tuberculosis
TYTIPLDTPPAPA

SEQ ID NO: 179582 - protein, 13 aa, Mycobacterium tuberculosis
YTIPLDTPPAPAP

SEQ ID NO: 179583 - protein, 13 aa, Mycobacterium tuberculosis
TIPLDTPPAPAPP

SEQ ID NO: 179584 - protein, 13 aa, Mycobacterium tuberculosis
IPLDTPPAPAPPP

SEQ ID NO: 179585 - protein, 13 aa, Mycobacterium tuberculosis
PLDTPPAPAPPPF

SEQ ID NO: 179586 - protein, 13 aa, Mycobacterium tuberculosis
LDTPPAPAPPPFR

SEQ ID NO: 179587 - protein, 13 aa, Mycobacterium tuberculosis
DTPPAPAPPPFRL

SEQ ID NO: 179588 - protein, 13 aa, Mycobacterium tuberculosis
TPPAPAPPPFRLP

SEQ ID NO: 179589 - protein, 13 aa, Mycobacterium tuberculosis
PPAPAPPPFRLPL

SEQ ID NO: 179590 - protein, 13 aa, Mycobacterium tuberculosis
PAPAPPPFRLPLL

SEQ ID NO: 179591 - protein, 13 aa, Mycobacterium tuberculosis
APAPPPFRLPLLF

SEQ ID NO: 179592 - protein, 13 aa, Mycobacterium tuberculosis
PAPPPFRLPLLFV

SEQ ID NO: 179593 - protein, 13 aa, Mycobacterium tuberculosis
APPPFRLPLLFVN

SEQ ID NO: 179594 - protein, 13 aa, Mycobacterium tuberculosis
PPPFRLPLLFVNA

SEQ ID NO: 179595 - protein, 13 aa, Mycobacterium tuberculosis
PPFRLPLLFVNAL

SEQ ID NO: 179596 - protein, 13 aa, Mycobacterium tuberculosis
PFRLPLLFVNALG

SEQ ID NO: 179597 - protein, 13 aa, Mycobacterium tuberculosis
FRLPLLFVNALGD

SEQ ID NO: 179598 - protein, 13 aa, Mycobacterium tuberculosis
RLPLLFVNALGDN

SEQ ID NO: 179599 - protein, 13 aa, Mycobacterium tuberculosis
LPLLFVNALGDNW

SEQ ID NO: 179600 - protein, 13 aa, Mycobacterium tuberculosis
PLLFVNALGDNWI

SEQ ID NO: 179601 - protein, 13 aa, Mycobacterium tuberculosis
LLFVNALGDNWIV

SEQ ID NO: 179602 - protein, 13 aa, Mycobacterium tuberculosis
LFVNALGDNWIVG

SEQ ID NO: 179603 - protein, 13 aa, Mycobacterium tuberculosis
FVNALGDNWIVGA

SEQ ID NO: 179604 - protein, 13 aa, Mycobacterium tuberculosis
VNALGDNWIVGAS

SEQ ID NO: 179605 - protein, 13 aa, Mycobacterium tuberculosis
NALGDNWIVGASN

SEQ ID NO: 179606 - protein, 13 aa, Mycobacterium tuberculosis
ALGDNWIVGASNS

SEQ ID NO: 179607 - protein, 13 aa, Mycobacterium tuberculosis
LGDNWIVGASNST

SEQ ID NO: 179608 - protein, 13 aa, Mycobacterium tuberculosis
GDNWIVGASNSTG

SEQ ID NO: 179609 - protein, 13 aa, Mycobacterium tuberculosis
DNWIVGASNSTGM

SEQ ID NO: 179610 - protein, 13 aa, Mycobacterium tuberculosis
NWIVGASNSTGMS

SEQ ID NO: 179611 - protein, 13 aa, Mycobacterium tuberculosis
WIVGASNSTGMSG

SEQ ID NO: 179612 - protein, 13 aa, Mycobacterium tuberculosis
IVGASNSTGMSGG

SEQ ID NO: 179613 - protein, 13 aa, Mycobacterium tuberculosis
VGASNSTGMSGGF

SEQ ID NO: 179614 - protein, 13 aa, Mycobacterium tuberculosis
GASNSTGMSGGFV

SEQ ID NO: 179615 - protein, 13 aa, Mycobacterium tuberculosis
ASNSTGMSGGFVT

SEQ ID NO: 179616 - protein, 13 aa, Mycobacterium tuberculosis
SNSTGMSGGFVTA

SEQ ID NO: 179617 - protein, 13 aa, Mycobacterium tuberculosis
NSTGMSGGFVTAP

SEQ ID NO: 179618 - protein, 13 aa, Mycobacterium tuberculosis
STGMSGGFVTAPT

SEQ ID NO: 179619 - protein, 13 aa, Mycobacterium tuberculosis
TGMSGGFVTAPTQ

SEQ ID NO: 179620 - protein, 13 aa, Mycobacterium tuberculosis
GMSGGFVTAPTQG

SEQ ID NO: 179621 - protein, 13 aa, Mycobacterium tuberculosis
MSGGFVTAPTQGI

SEQ ID NO: 179622 - protein, 13 aa, Mycobacterium tuberculosis
SGGFVTAPTQGIL

SEQ ID NO: 179623 - protein, 13 aa, Mycobacterium tuberculosis
GGFVTAPTQGILI

SEQ ID NO: 179624 - protein, 13 aa, Mycobacterium tuberculosis
GFVTAPTQGILIH

SEQ ID NO: 179625 - protein, 13 aa, Mycobacterium tuberculosis
FVTAPTQGILIHT

SEQ ID NO: 179626 - protein, 13 aa, Mycobacterium tuberculosis
VTAPTQGILIHTG

SEQ ID NO: 179627 - protein, 13 aa, Mycobacterium tuberculosis
TAPTQGILIHTGP

SEQ ID NO: 179628 - protein, 13 aa, Mycobacterium tuberculosis
APTQGILIHTGPS

SEQ ID NO: 179629 - protein, 13 aa, Mycobacterium tuberculosis
PTQGILIHTGPSS

SEQ ID NO: 179630 - protein, 13 aa, Mycobacterium tuberculosis
TQGILIHTGPSSA

SEQ ID NO: 179631 - protein, 13 aa, Mycobacterium tuberculosis
QGILIHTGPSSAT

SEQ ID NO: 179632 - protein, 13 aa, Mycobacterium tuberculosis
GILIHTGPSSATT

SEQ ID NO: 179633 - protein, 13 aa, Mycobacterium tuberculosis
ILIHTGPSSATTG

SEQ ID NO: 179634 - protein, 13 aa, Mycobacterium tuberculosis
LIHTGPSSATTGS

SEQ ID NO: 179635 - protein, 13 aa, Mycobacterium tuberculosis
IHTGPSSATTGSL

SEQ ID NO: 179636 - protein, 13 aa, Mycobacterium tuberculosis
HTGPSSATTGSLA

SEQ ID NO: 179637 - protein, 13 aa, Mycobacterium tuberculosis
TGPSSATTGSLAL

SEQ ID NO: 179638 - protein, 13 aa, Mycobacterium tuberculosis
GPSSATTGSLALT

SEQ ID NO: 179639 - protein, 13 aa, Mycobacterium tuberculosis
PSSATTGSLALTL

SEQ ID NO: 179640 - protein, 13 aa, Mycobacterium tuberculosis
SSATTGSLALTLP

SEQ ID NO: 179641 - protein, 13 aa, Mycobacterium tuberculosis
SATTGSLALTLPT

SEQ ID NO: 179642 - protein, 13 aa, Mycobacterium tuberculosis
ATTGSLALTLPTV

SEQ ID NO: 179643 - protein, 13 aa, Mycobacterium tuberculosis
TTGSLALTLPTVT

SEQ ID NO: 179644 - protein, 13 aa, Mycobacterium tuberculosis
TGSLALTLPTVTI

SEQ ID NO: 179645 - protein, 13 aa, Mycobacterium tuberculosis
GSLALTLPTVTIP

SEQ ID NO: 179646 - protein, 13 aa, Mycobacterium tuberculosis
SLALTLPTVTIPT

SEQ ID NO: 179647 - protein, 13 aa, Mycobacterium tuberculosis
LALTLPTVTIPTI

SEQ ID NO: 179648 - protein, 13 aa, Mycobacterium tuberculosis
ALTLPTVTIPTIT

SEQ ID NO: 179649 - protein, 13 aa, Mycobacterium tuberculosis
LTLPTVTIPTITT

SEQ ID NO: 179650 - protein, 13 aa, Mycobacterium tuberculosis
TLPTVTIPTITTS

SEQ ID NO: 179651 - protein, 13 aa, Mycobacterium tuberculosis
LPTVTIPTITTSP

SEQ ID NO: 179652 - protein, 13 aa, Mycobacterium tuberculosis
PTVTIPTITTSPI

SEQ ID NO: 179653 - protein, 13 aa, Mycobacterium tuberculosis
TVTIPTITTSPIP

SEQ ID NO: 179654 - protein, 13 aa, Mycobacterium tuberculosis
VTIPTITTSPIPL

SEQ ID NO: 179655 - protein, 13 aa, Mycobacterium tuberculosis
TIPTITTSPIPLK

SEQ ID NO: 179656 - protein, 13 aa, Mycobacterium tuberculosis
IPTITTSPIPLKI

SEQ ID NO: 179657 - protein, 13 aa, Mycobacterium tuberculosis
PTITTSPIPLKID

SEQ ID NO: 179658 - protein, 13 aa, Mycobacterium tuberculosis
TITTSPIPLKIDV

SEQ ID NO: 179659 - protein, 13 aa, Mycobacterium tuberculosis
ITTSPIPLKIDVS

SEQ ID NO: 179660 - protein, 13 aa, Mycobacterium tuberculosis
TTSPIPLKIDVSG

SEQ ID NO: 179661 - protein, 13 aa, Mycobacterium tuberculosis
TSPIPLKIDVSGG

SEQ ID NO: 179662 - protein, 13 aa, Mycobacterium tuberculosis
SPIPLKIDVSGGL

SEQ ID NO: 179663 - protein, 13 aa, Mycobacterium tuberculosis
PIPLKIDVSGGLP

SEQ ID NO: 179664 - protein, 13 aa, Mycobacterium tuberculosis
IPLKIDVSGGLPA

SEQ ID NO: 179665 - protein, 13 aa, Mycobacterium tuberculosis
PLKIDVSGGLPAF

SEQ ID NO: 179666 - protein, 13 aa, Mycobacterium tuberculosis
LKIDVSGGLPAFT

SEQ ID NO: 179667 - protein, 13 aa, Mycobacterium tuberculosis
KIDVSGGLPAFTL

SEQ ID NO: 179668 - protein, 13 aa, Mycobacterium tuberculosis
IDVSGGLPAFTLF

SEQ ID NO: 179669 - protein, 13 aa, Mycobacterium tuberculosis
DVSGGLPAFTLFP

SEQ ID NO: 179670 - protein, 13 aa, Mycobacterium tuberculosis
VSGGLPAFTLFPG

SEQ ID NO: 179671 - protein, 13 aa, Mycobacterium tuberculosis
SGGLPAFTLFPGG

SEQ ID NO: 179672 - protein, 13 aa, Mycobacterium tuberculosis
GGLPAFTLFPGGL

SEQ ID NO: 179673 - protein, 13 aa, Mycobacterium tuberculosis
GLPAFTLFPGGLN

SEQ ID NO: 179674 - protein, 13 aa, Mycobacterium tuberculosis
LPAFTLFPGGLNI

SEQ ID NO: 179675 - protein, 13 aa, Mycobacterium tuberculosis
PAFTLFPGGLNIP

SEQ ID NO: 179676 - protein, 13 aa, Mycobacterium tuberculosis
AFTLFPGGLNIPQ

SEQ ID NO: 179677 - protein, 13 aa, Mycobacterium tuberculosis
FTLFPGGLNIPQN

SEQ ID NO: 179678 - protein, 13 aa, Mycobacterium tuberculosis
TLFPGGLNIPQNA

SEQ ID NO: 179679 - protein, 13 aa, Mycobacterium tuberculosis
LFPGGLNIPQNAI

SEQ ID NO: 179680 - protein, 13 aa, Mycobacterium tuberculosis
FPGGLNIPQNAIP

SEQ ID NO: 179681 - protein, 13 aa, Mycobacterium tuberculosis
PGGLNIPQNAIPL

SEQ ID NO: 179682 - protein, 13 aa, Mycobacterium tuberculosis
GGLNIPQNAIPLT

SEQ ID NO: 179683 - protein, 13 aa, Mycobacterium tuberculosis
GLNIPQNAIPLTI

SEQ ID NO: 179684 - protein, 13 aa, Mycobacterium tuberculosis
LNIPQNAIPLTID

SEQ ID NO: 179685 - protein, 13 aa, Mycobacterium tuberculosis
NIPQNAIPLTIDA

SEQ ID NO: 179686 - protein, 13 aa, Mycobacterium tuberculosis
IPQNAIPLTIDAS

SEQ ID NO: 179687 - protein, 13 aa, Mycobacterium tuberculosis
PQNAIPLTIDASG

SEQ ID NO: 179688 - protein, 13 aa, Mycobacterium tuberculosis
QNAIPLTIDASGV

SEQ ID NO: 179689 - protein, 13 aa, Mycobacterium tuberculosis
NAIPLTIDASGVL

SEQ ID NO: 179690 - protein, 13 aa, Mycobacterium tuberculosis
AIPLTIDASGVLD

SEQ ID NO: 179691 - protein, 13 aa, Mycobacterium tuberculosis
IPLTIDASGVLDP

SEQ ID NO: 179692 - protein, 13 aa, Mycobacterium tuberculosis
PLTIDASGVLDPI

SEQ ID NO: 179693 - protein, 13 aa, Mycobacterium tuberculosis
LTIDASGVLDPIT

SEQ ID NO: 179694 - protein, 13 aa, Mycobacterium tuberculosis
TIDASGVLDPITI

SEQ ID NO: 179695 - protein, 13 aa, Mycobacterium tuberculosis
IDASGVLDPITIF

SEQ ID NO: 179696 - protein, 13 aa, Mycobacterium tuberculosis
DASGVLDPITIFP

SEQ ID NO: 179697 - protein, 13 aa, Mycobacterium tuberculosis
ASGVLDPITIFPG

SEQ ID NO: 179698 - protein, 13 aa, Mycobacterium tuberculosis
SGVLDPITIFPGG

SEQ ID NO: 179699 - protein, 13 aa, Mycobacterium tuberculosis
GVLDPITIFPGGF

SEQ ID NO: 179700 - protein, 13 aa, Mycobacterium tuberculosis
VLDPITIFPGGFT

SEQ ID NO: 179701 - protein, 13 aa, Mycobacterium tuberculosis
LDPITIFPGGFTI

SEQ ID NO: 179702 - protein, 13 aa, Mycobacterium tuberculosis
DPITIFPGGFTID

SEQ ID NO: 179703 - protein, 13 aa, Mycobacterium tuberculosis
PITIFPGGFTIDP

SEQ ID NO: 179704 - protein, 13 aa, Mycobacterium tuberculosis
ITIFPGGFTIDPL

SEQ ID NO: 179705 - protein, 13 aa, Mycobacterium tuberculosis
TIFPGGFTIDPLP

SEQ ID NO: 179706 - protein, 13 aa, Mycobacterium tuberculosis
IFPGGFTIDPLPL

SEQ ID NO: 179707 - protein, 13 aa, Mycobacterium tuberculosis
FPGGFTIDPLPLS

SEQ ID NO: 179708 - protein, 13 aa, Mycobacterium tuberculosis
PGGFTIDPLPLSL

SEQ ID NO: 179709 - protein, 13 aa, Mycobacterium tuberculosis
GGFTIDPLPLSLA

SEQ ID NO: 179710 - protein, 13 aa, Mycobacterium tuberculosis
GFTIDPLPLSLAL

SEQ ID NO: 179711 - protein, 13 aa, Mycobacterium tuberculosis
FTIDPLPLSLALN

SEQ ID NO: 179712 - protein, 13 aa, Mycobacterium tuberculosis
TIDPLPLSLALNI

SEQ ID NO: 179713 - protein, 13 aa, Mycobacterium tuberculosis
IDPLPLSLALNIS

SEQ ID NO: 179714 - protein, 13 aa, Mycobacterium tuberculosis
DPLPLSLALNISV

SEQ ID NO: 179715 - protein, 13 aa, Mycobacterium tuberculosis
PLPLSLALNISVP

SEQ ID NO: 179716 - protein, 13 aa, Mycobacterium tuberculosis
LPLSLALNISVPD

SEQ ID NO: 179717 - protein, 13 aa, Mycobacterium tuberculosis
PLSLALNISVPDS

SEQ ID NO: 179718 - protein, 13 aa, Mycobacterium tuberculosis
LSLALNISVPDSS

SEQ ID NO: 179719 - protein, 13 aa, Mycobacterium tuberculosis
SLALNISVPDSSV

SEQ ID NO: 179720 - protein, 13 aa, Mycobacterium tuberculosis
LALNISVPDSSVP

SEQ ID NO: 179721 - protein, 13 aa, Mycobacterium tuberculosis
ALNISVPDSSVPI

SEQ ID NO: 179722 - protein, 13 aa, Mycobacterium tuberculosis
LNISVPDSSVPII

SEQ ID NO: 179723 - protein, 13 aa, Mycobacterium tuberculosis
NISVPDSSVPIII

SEQ ID NO: 179724 - protein, 13 aa, Mycobacterium tuberculosis
ISVPDSSVPIIIV

SEQ ID NO: 179725 - protein, 13 aa, Mycobacterium tuberculosis
SVPDSSVPIIIVP

SEQ ID NO: 179726 - protein, 13 aa, Mycobacterium tuberculosis
VPDSSVPIIIVPP

SEQ ID NO: 179727 - protein, 13 aa, Mycobacterium tuberculosis
PDSSVPIIIVPPT

SEQ ID NO: 179728 - protein, 13 aa, Mycobacterium tuberculosis
DSSVPIIIVPPTP

SEQ ID NO: 179729 - protein, 13 aa, Mycobacterium tuberculosis
SSVPIIIVPPTPG

SEQ ID NO: 179730 - protein, 13 aa, Mycobacterium tuberculosis
SVPIIIVPPTPGF

SEQ ID NO: 179731 - protein, 13 aa, Mycobacterium tuberculosis
VPIIIVPPTPGFG

SEQ ID NO: 179732 - protein, 13 aa, Mycobacterium tuberculosis
PIIIVPPTPGFGN

SEQ ID NO: 179733 - protein, 13 aa, Mycobacterium tuberculosis
IIIVPPTPGFGNA

SEQ ID NO: 179734 - protein, 13 aa, Mycobacterium tuberculosis
IIVPPTPGFGNAT

SEQ ID NO: 179735 - protein, 13 aa, Mycobacterium tuberculosis
IVPPTPGFGNATA

SEQ ID NO: 179736 - protein, 13 aa, Mycobacterium tuberculosis
VPPTPGFGNATAT

SEQ ID NO: 179737 - protein, 13 aa, Mycobacterium tuberculosis
PPTPGFGNATATP

SEQ ID NO: 179738 - protein, 13 aa, Mycobacterium tuberculosis
PTPGFGNATATPS

SEQ ID NO: 179739 - protein, 13 aa, Mycobacterium tuberculosis
TPGFGNATATPSS

SEQ ID NO: 179740 - protein, 13 aa, Mycobacterium tuberculosis
PGFGNATATPSSG

SEQ ID NO: 179741 - protein, 13 aa, Mycobacterium tuberculosis
GFGNATATPSSGF

SEQ ID NO: 179742 - protein, 13 aa, Mycobacterium tuberculosis
FGNATATPSSGFF

SEQ ID NO: 179743 - protein, 13 aa, Mycobacterium tuberculosis
GNATATPSSGFFN

SEQ ID NO: 179744 - protein, 13 aa, Mycobacterium tuberculosis
NATATPSSGFFNS

SEQ ID NO: 179745 - protein, 13 aa, Mycobacterium tuberculosis
ATATPSSGFFNSG

SEQ ID NO: 179746 - protein, 13 aa, Mycobacterium tuberculosis
TATPSSGFFNSGA

SEQ ID NO: 179747 - protein, 13 aa, Mycobacterium tuberculosis
ATPSSGFFNSGAG

SEQ ID NO: 179748 - protein, 13 aa, Mycobacterium tuberculosis
TPSSGFFNSGAGG

SEQ ID NO: 179749 - protein, 13 aa, Mycobacterium tuberculosis
PSSGFFNSGAGGV

SEQ ID NO: 179750 - protein, 13 aa, Mycobacterium tuberculosis
SSGFFNSGAGGVS

SEQ ID NO: 179751 - protein, 13 aa, Mycobacterium tuberculosis
SGFFNSGAGGVSG

SEQ ID NO: 179752 - protein, 13 aa, Mycobacterium tuberculosis
GFFNSGAGGVSGF

SEQ ID NO: 179753 - protein, 13 aa, Mycobacterium tuberculosis
FFNSGAGGVSGFG

SEQ ID NO: 179754 - protein, 13 aa, Mycobacterium tuberculosis
FNSGAGGVSGFGN

SEQ ID NO: 179755 - protein, 13 aa, Mycobacterium tuberculosis
NSGAGGVSGFGNF

SEQ ID NO: 179756 - protein, 13 aa, Mycobacterium tuberculosis
SGAGGVSGFGNFG

SEQ ID NO: 179757 - protein, 13 aa, Mycobacterium tuberculosis
GAGGVSGFGNFGA

SEQ ID NO: 179758 - protein, 13 aa, Mycobacterium tuberculosis
AGGVSGFGNFGAG

SEQ ID NO: 179759 - protein, 13 aa, Mycobacterium tuberculosis
GGVSGFGNFGAGS

SEQ ID NO: 179760 - protein, 13 aa, Mycobacterium tuberculosis
GVSGFGNFGAGSS

SEQ ID NO: 179761 - protein, 13 aa, Mycobacterium tuberculosis
VSGFGNFGAGSSG

SEQ ID NO: 179762 - protein, 13 aa, Mycobacterium tuberculosis
SGFGNFGAGSSGW

SEQ ID NO: 179763 - protein, 13 aa, Mycobacterium tuberculosis
GFGNFGAGSSGWW

SEQ ID NO: 179764 - protein, 13 aa, Mycobacterium tuberculosis
FGNFGAGSSGWWN

SEQ ID NO: 179765 - protein, 13 aa, Mycobacterium tuberculosis
GNFGAGSSGWWNQ

SEQ ID NO: 179766 - protein, 13 aa, Mycobacterium tuberculosis
NFGAGSSGWWNQA

SEQ ID NO: 179767 - protein, 13 aa, Mycobacterium tuberculosis
FGAGSSGWWNQAH

SEQ ID NO: 179768 - protein, 13 aa, Mycobacterium tuberculosis
GAGSSGWWNQAHA

SEQ ID NO: 179769 - protein, 13 aa, Mycobacterium tuberculosis
AGSSGWWNQAHAA

SEQ ID NO: 179770 - protein, 13 aa, Mycobacterium tuberculosis
GSSGWWNQAHAAL

SEQ ID NO: 179771 - protein, 13 aa, Mycobacterium tuberculosis
SSGWWNQAHAALA

SEQ ID NO: 179772 - protein, 13 aa, Mycobacterium tuberculosis
SGWWNQAHAALAG

SEQ ID NO: 179773 - protein, 13 aa, Mycobacterium tuberculosis
GWWNQAHAALAGA

SEQ ID NO: 179774 - protein, 13 aa, Mycobacterium tuberculosis
WWNQAHAALAGAG

SEQ ID NO: 179775 - protein, 13 aa, Mycobacterium tuberculosis
WNQAHAALAGAGS

SEQ ID NO: 179776 - protein, 13 aa, Mycobacterium tuberculosis
NQAHAALAGAGSG

SEQ ID NO: 179777 - protein, 13 aa, Mycobacterium tuberculosis
QAHAALAGAGSGV

SEQ ID NO: 179778 - protein, 13 aa, Mycobacterium tuberculosis
AHAALAGAGSGVL

SEQ ID NO: 179779 - protein, 13 aa, Mycobacterium tuberculosis
HAALAGAGSGVLN

SEQ ID NO: 179780 - protein, 13 aa, Mycobacterium tuberculosis
AALAGAGSGVLNV

SEQ ID NO: 179781 - protein, 13 aa, Mycobacterium tuberculosis
ALAGAGSGVLNVG

SEQ ID NO: 179782 - protein, 13 aa, Mycobacterium tuberculosis
LAGAGSGVLNVGT

SEQ ID NO: 179783 - protein, 13 aa, Mycobacterium tuberculosis
AGAGSGVLNVGTL

SEQ ID NO: 179784 - protein, 13 aa, Mycobacterium tuberculosis
GAGSGVLNVGTLN

SEQ ID NO: 179785 - protein, 13 aa, Mycobacterium tuberculosis
AGSGVLNVGTLNS

SEQ ID NO: 179786 - protein, 13 aa, Mycobacterium tuberculosis
GSGVLNVGTLNSG

SEQ ID NO: 179787 - protein, 13 aa, Mycobacterium tuberculosis
SGVLNVGTLNSGV

SEQ ID NO: 179788 - protein, 13 aa, Mycobacterium tuberculosis
GVLNVGTLNSGVL

SEQ ID NO: 179789 - protein, 13 aa, Mycobacterium tuberculosis
VLNVGTLNSGVLN

SEQ ID NO: 179790 - protein, 13 aa, Mycobacterium tuberculosis
LNVGTLNSGVLNV

SEQ ID NO: 179791 - protein, 13 aa, Mycobacterium tuberculosis
NVGTLNSGVLNVG

SEQ ID NO: 179792 - protein, 13 aa, Mycobacterium tuberculosis
VGTLNSGVLNVGS

SEQ ID NO: 179793 - protein, 13 aa, Mycobacterium tuberculosis
GTLNSGVLNVGSG

SEQ ID NO: 179794 - protein, 13 aa, Mycobacterium tuberculosis
TLNSGVLNVGSGI

SEQ ID NO: 179795 - protein, 13 aa, Mycobacterium tuberculosis
LNSGVLNVGSGIS

SEQ ID NO: 179796 - protein, 13 aa, Mycobacterium tuberculosis
NSGVLNVGSGISG

SEQ ID NO: 179797 - protein, 13 aa, Mycobacterium tuberculosis
SGVLNVGSGISGL

SEQ ID NO: 179798 - protein, 13 aa, Mycobacterium tuberculosis
GVLNVGSGISGLY

SEQ ID NO: 179799 - protein, 13 aa, Mycobacterium tuberculosis
VLNVGSGISGLYN

SEQ ID NO: 179800 - protein, 13 aa, Mycobacterium tuberculosis
LNVGSGISGLYNT

SEQ ID NO: 179801 - protein, 13 aa, Mycobacterium tuberculosis
NVGSGISGLYNTA

SEQ ID NO: 179802 - protein, 13 aa, Mycobacterium tuberculosis
VGSGISGLYNTAI

SEQ ID NO: 179803 - protein, 13 aa, Mycobacterium tuberculosis
GSGISGLYNTAIV

SEQ ID NO: 179804 - protein, 13 aa, Mycobacterium tuberculosis
SGISGLYNTAIVG

SEQ ID NO: 179805 - protein, 13 aa, Mycobacterium tuberculosis
GISGLYNTAIVGL

SEQ ID NO: 179806 - protein, 13 aa, Mycobacterium tuberculosis
ISGLYNTAIVGLG

SEQ ID NO: 179807 - protein, 13 aa, Mycobacterium tuberculosis
SGLYNTAIVGLGT

SEQ ID NO: 179808 - protein, 13 aa, Mycobacterium tuberculosis
GLYNTAIVGLGTP

SEQ ID NO: 179809 - protein, 13 aa, Mycobacterium tuberculosis
LYNTAIVGLGTPA

SEQ ID NO: 179810 - protein, 13 aa, Mycobacterium tuberculosis
YNTAIVGLGTPAL

SEQ ID NO: 179811 - protein, 13 aa, Mycobacterium tuberculosis
NTAIVGLGTPALV

SEQ ID NO: 179812 - protein, 13 aa, Mycobacterium tuberculosis
TAIVGLGTPALVS

SEQ ID NO: 179813 - protein, 13 aa, Mycobacterium tuberculosis
AIVGLGTPALVSG

SEQ ID NO: 179814 - protein, 13 aa, Mycobacterium tuberculosis
IVGLGTPALVSGA

SEQ ID NO: 179815 - protein, 13 aa, Mycobacterium tuberculosis
VGLGTPALVSGAG

SEQ ID NO: 179816 - protein, 13 aa, Mycobacterium tuberculosis
GLGTPALVSGAGN

SEQ ID NO: 179817 - protein, 13 aa, Mycobacterium tuberculosis
LGTPALVSGAGNV

SEQ ID NO: 179818 - protein, 13 aa, Mycobacterium tuberculosis
GTPALVSGAGNVG

SEQ ID NO: 179819 - protein, 13 aa, Mycobacterium tuberculosis
TPALVSGAGNVGQ

SEQ ID NO: 179820 - protein, 13 aa, Mycobacterium tuberculosis
PALVSGAGNVGQQ

SEQ ID NO: 179821 - protein, 13 aa, Mycobacterium tuberculosis
ALVSGAGNVGQQL

SEQ ID NO: 179822 - protein, 13 aa, Mycobacterium tuberculosis
LVSGAGNVGQQLS

SEQ ID NO: 179823 - protein, 13 aa, Mycobacterium tuberculosis
VSGAGNVGQQLSG

SEQ ID NO: 179824 - protein, 13 aa, Mycobacterium tuberculosis
SGAGNVGQQLSGV

SEQ ID NO: 179825 - protein, 13 aa, Mycobacterium tuberculosis
GAGNVGQQLSGVL

SEQ ID NO: 179826 - protein, 13 aa, Mycobacterium tuberculosis
AGNVGQQLSGVLA

SEQ ID NO: 179827 - protein, 13 aa, Mycobacterium tuberculosis
GNVGQQLSGVLAA

SEQ ID NO: 179828 - protein, 13 aa, Mycobacterium tuberculosis
NVGQQLSGVLAAG

SEQ ID NO: 179829 - protein, 13 aa, Mycobacterium tuberculosis
VGQQLSGVLAAGT

SEQ ID NO: 179830 - protein, 13 aa, Mycobacterium tuberculosis
GQQLSGVLAAGTA

SEQ ID NO: 179831 - protein, 13 aa, Mycobacterium tuberculosis
QQLSGVLAAGTAL

SEQ ID NO: 179832 - protein, 13 aa, Mycobacterium tuberculosis
QLSGVLAAGTALT

SEQ ID NO: 179833 - protein, 13 aa, Mycobacterium tuberculosis
LSGVLAAGTALTQ

SEQ ID NO: 179834 - protein, 13 aa, Mycobacterium tuberculosis
SGVLAAGTALTQS

SEQ ID NO: 179835 - protein, 13 aa, Mycobacterium tuberculosis
GVLAAGTALTQSP

SEQ ID NO: 179836 - protein, 13 aa, Mycobacterium tuberculosis
VLAAGTALTQSPI

SEQ ID NO: 179837 - protein, 13 aa, Mycobacterium tuberculosis
LAAGTALTQSPII

SEQ ID NO: 179838 - protein, 13 aa, Mycobacterium tuberculosis
AAGTALTQSPIIN

SEQ ID NO: 179839 - protein, 13 aa, Mycobacterium tuberculosis
AGTALTQSPIINL

SEQ ID NO: 179840 - protein, 13 aa, Mycobacterium tuberculosis
GTALTQSPIINLG

SEQ ID NO: 179841 - protein, 13 aa, Mycobacterium tuberculosis
TALTQSPIINLGL

SEQ ID NO: 179842 - protein, 13 aa, Mycobacterium tuberculosis
ALTQSPIINLGLA

SEQ ID NO: 179843 - protein, 13 aa, Mycobacterium tuberculosis
LTQSPIINLGLAD

SEQ ID NO: 179844 - protein, 13 aa, Mycobacterium tuberculosis
TQSPIINLGLADV

SEQ ID NO: 179845 - protein, 13 aa, Mycobacterium tuberculosis
QSPIINLGLADVG

SEQ ID NO: 179846 - protein, 13 aa, Mycobacterium tuberculosis
SPIINLGLADVGN

SEQ ID NO: 179847 - protein, 13 aa, Mycobacterium tuberculosis
PIINLGLADVGNY

SEQ ID NO: 179848 - protein, 13 aa, Mycobacterium tuberculosis
IINLGLADVGNYN

SEQ ID NO: 179849 - protein, 13 aa, Mycobacterium tuberculosis
INLGLADVGNYNL

SEQ ID NO: 179850 - protein, 13 aa, Mycobacterium tuberculosis
NLGLADVGNYNLG

SEQ ID NO: 179851 - protein, 13 aa, Mycobacterium tuberculosis
LGLADVGNYNLGL

SEQ ID NO: 179852 - protein, 13 aa, Mycobacterium tuberculosis
GLADVGNYNLGLG

SEQ ID NO: 179853 - protein, 13 aa, Mycobacterium tuberculosis
LADVGNYNLGLGN

SEQ ID NO: 179854 - protein, 13 aa, Mycobacterium tuberculosis
ADVGNYNLGLGNV

SEQ ID NO: 179855 - protein, 13 aa, Mycobacterium tuberculosis
DVGNYNLGLGNVG

SEQ ID NO: 179856 - protein, 13 aa, Mycobacterium tuberculosis
VGNYNLGLGNVGD

SEQ ID NO: 179857 - protein, 13 aa, Mycobacterium tuberculosis
GNYNLGLGNVGDF

SEQ ID NO: 179858 - protein, 13 aa, Mycobacterium tuberculosis
NYNLGLGNVGDFN

SEQ ID NO: 179859 - protein, 13 aa, Mycobacterium tuberculosis
YNLGLGNVGDFNL

SEQ ID NO: 179860 - protein, 13 aa, Mycobacterium tuberculosis
NLGLGNVGDFNLG

SEQ ID NO: 179861 - protein, 13 aa, Mycobacterium tuberculosis
LGLGNVGDFNLGA

SEQ ID NO: 179862 - protein, 13 aa, Mycobacterium tuberculosis
GLGNVGDFNLGAA

SEQ ID NO: 179863 - protein, 13 aa, Mycobacterium tuberculosis
LGNVGDFNLGAAN

SEQ ID NO: 179864 - protein, 13 aa, Mycobacterium tuberculosis
GNVGDFNLGAANL

SEQ ID NO: 179865 - protein, 13 aa, Mycobacterium tuberculosis
NVGDFNLGAANLG

SEQ ID NO: 179866 - protein, 13 aa, Mycobacterium tuberculosis
VGDFNLGAANLGD

SEQ ID NO: 179867 - protein, 13 aa, Mycobacterium tuberculosis
GDFNLGAANLGDL

SEQ ID NO: 179868 - protein, 13 aa, Mycobacterium tuberculosis
DFNLGAANLGDLN

SEQ ID NO: 179869 - protein, 13 aa, Mycobacterium tuberculosis
FNLGAANLGDLNL

SEQ ID NO: 179870 - protein, 13 aa, Mycobacterium tuberculosis
NLGAANLGDLNLG

SEQ ID NO: 179871 - protein, 13 aa, Mycobacterium tuberculosis
LGAANLGDLNLGL

SEQ ID NO: 179872 - protein, 13 aa, Mycobacterium tuberculosis
GAANLGDLNLGLG

SEQ ID NO: 179873 - protein, 13 aa, Mycobacterium tuberculosis
AANLGDLNLGLGN

SEQ ID NO: 179874 - protein, 13 aa, Mycobacterium tuberculosis
ANLGDLNLGLGNI

SEQ ID NO: 179875 - protein, 13 aa, Mycobacterium tuberculosis
NLGDLNLGLGNIG

SEQ ID NO: 179876 - protein, 13 aa, Mycobacterium tuberculosis
LGDLNLGLGNIGN

SEQ ID NO: 179877 - protein, 13 aa, Mycobacterium tuberculosis
GDLNLGLGNIGNA

SEQ ID NO: 179878 - protein, 13 aa, Mycobacterium tuberculosis
DLNLGLGNIGNAN

SEQ ID NO: 179879 - protein, 13 aa, Mycobacterium tuberculosis
LNLGLGNIGNANV

SEQ ID NO: 179880 - protein, 13 aa, Mycobacterium tuberculosis
NLGLGNIGNANVG

SEQ ID NO: 179881 - protein, 13 aa, Mycobacterium tuberculosis
LGLGNIGNANVGF

SEQ ID NO: 179882 - protein, 13 aa, Mycobacterium tuberculosis
GLGNIGNANVGFG

SEQ ID NO: 179883 - protein, 13 aa, Mycobacterium tuberculosis
LGNIGNANVGFGN

SEQ ID NO: 179884 - protein, 13 aa, Mycobacterium tuberculosis
GNIGNANVGFGNI

SEQ ID NO: 179885 - protein, 13 aa, Mycobacterium tuberculosis
NIGNANVGFGNIG

SEQ ID NO: 179886 - protein, 13 aa, Mycobacterium tuberculosis
IGNANVGFGNIGH

SEQ ID NO: 179887 - protein, 13 aa, Mycobacterium tuberculosis
GNANVGFGNIGHG

SEQ ID NO: 179888 - protein, 13 aa, Mycobacterium tuberculosis
NANVGFGNIGHGN

SEQ ID NO: 179889 - protein, 13 aa, Mycobacterium tuberculosis
ANVGFGNIGHGNV

SEQ ID NO: 179890 - protein, 13 aa, Mycobacterium tuberculosis
NVGFGNIGHGNVG

SEQ ID NO: 179891 - protein, 13 aa, Mycobacterium tuberculosis
VGFGNIGHGNVGF

SEQ ID NO: 179892 - protein, 13 aa, Mycobacterium tuberculosis
GFGNIGHGNVGFG

SEQ ID NO: 179893 - protein, 13 aa, Mycobacterium tuberculosis
FGNIGHGNVGFGN

SEQ ID NO: 179894 - protein, 13 aa, Mycobacterium tuberculosis
GNIGHGNVGFGNS

SEQ ID NO: 179895 - protein, 13 aa, Mycobacterium tuberculosis
NIGHGNVGFGNSG

SEQ ID NO: 179896 - protein, 13 aa, Mycobacterium tuberculosis
IGHGNVGFGNSGL

SEQ ID NO: 179897 - protein, 13 aa, Mycobacterium tuberculosis
GHGNVGFGNSGLG

SEQ ID NO: 179898 - protein, 13 aa, Mycobacterium tuberculosis
HGNVGFGNSGLGA

SEQ ID NO: 179899 - protein, 13 aa, Mycobacterium tuberculosis
GNVGFGNSGLGAA

SEQ ID NO: 179900 - protein, 13 aa, Mycobacterium tuberculosis
NVGFGNSGLGAAL

SEQ ID NO: 179901 - protein, 13 aa, Mycobacterium tuberculosis
VGFGNSGLGAALG

SEQ ID NO: 179902 - protein, 13 aa, Mycobacterium tuberculosis
GFGNSGLGAALGI

SEQ ID NO: 179903 - protein, 13 aa, Mycobacterium tuberculosis
FGNSGLGAALGIG

SEQ ID NO: 179904 - protein, 13 aa, Mycobacterium tuberculosis
GNSGLGAALGIGN

SEQ ID NO: 179905 - protein, 13 aa, Mycobacterium tuberculosis
NSGLGAALGIGNI

SEQ ID NO: 179906 - protein, 13 aa, Mycobacterium tuberculosis
SGLGAALGIGNIG

SEQ ID NO: 179907 - protein, 13 aa, Mycobacterium tuberculosis
GLGAALGIGNIGL

SEQ ID NO: 179908 - protein, 13 aa, Mycobacterium tuberculosis
LGAALGIGNIGLG

SEQ ID NO: 179909 - protein, 13 aa, Mycobacterium tuberculosis
GAALGIGNIGLGN

SEQ ID NO: 179910 - protein, 13 aa, Mycobacterium tuberculosis
AALGIGNIGLGNA

SEQ ID NO: 179911 - protein, 13 aa, Mycobacterium tuberculosis
ALGIGNIGLGNAG

SEQ ID NO: 179912 - protein, 13 aa, Mycobacterium tuberculosis
LGIGNIGLGNAGS

SEQ ID NO: 179913 - protein, 13 aa, Mycobacterium tuberculosis
GIGNIGLGNAGST

SEQ ID NO: 179914 - protein, 13 aa, Mycobacterium tuberculosis
IGNIGLGNAGSTN

SEQ ID NO: 179915 - protein, 13 aa, Mycobacterium tuberculosis
GNIGLGNAGSTNV

SEQ ID NO: 179916 - protein, 13 aa, Mycobacterium tuberculosis
NIGLGNAGSTNVG

SEQ ID NO: 179917 - protein, 13 aa, Mycobacterium tuberculosis
IGLGNAGSTNVGL

SEQ ID NO: 179918 - protein, 13 aa, Mycobacterium tuberculosis
GLGNAGSTNVGLA

SEQ ID NO: 179919 - protein, 13 aa, Mycobacterium tuberculosis
LGNAGSTNVGLAN

SEQ ID NO: 179920 - protein, 13 aa, Mycobacterium tuberculosis
GNAGSTNVGLANM

SEQ ID NO: 179921 - protein, 13 aa, Mycobacterium tuberculosis
NAGSTNVGLANMG

SEQ ID NO: 179922 - protein, 13 aa, Mycobacterium tuberculosis
AGSTNVGLANMGV

SEQ ID NO: 179923 - protein, 13 aa, Mycobacterium tuberculosis
GSTNVGLANMGVG

SEQ ID NO: 179924 - protein, 13 aa, Mycobacterium tuberculosis
STNVGLANMGVGN

SEQ ID NO: 179925 - protein, 13 aa, Mycobacterium tuberculosis
TNVGLANMGVGNI

SEQ ID NO: 179926 - protein, 13 aa, Mycobacterium tuberculosis
NVGLANMGVGNIG

SEQ ID NO: 179927 - protein, 13 aa, Mycobacterium tuberculosis
VGLANMGVGNIGF

SEQ ID NO: 179928 - protein, 13 aa, Mycobacterium tuberculosis
GLANMGVGNIGFA

SEQ ID NO: 179929 - protein, 13 aa, Mycobacterium tuberculosis
LANMGVGNIGFAN

SEQ ID NO: 179930 - protein, 13 aa, Mycobacterium tuberculosis
ANMGVGNIGFANT

SEQ ID NO: 179931 - protein, 13 aa, Mycobacterium tuberculosis
NMGVGNIGFANTG

SEQ ID NO: 179932 - protein, 13 aa, Mycobacterium tuberculosis
MGVGNIGFANTGT

SEQ ID NO: 179933 - protein, 13 aa, Mycobacterium tuberculosis
GVGNIGFANTGTN

SEQ ID NO: 179934 - protein, 13 aa, Mycobacterium tuberculosis
VGNIGFANTGTNN

SEQ ID NO: 179935 - protein, 13 aa, Mycobacterium tuberculosis
GNIGFANTGTNNL

SEQ ID NO: 179936 - protein, 13 aa, Mycobacterium tuberculosis
NIGFANTGTNNLG

SEQ ID NO: 179937 - protein, 13 aa, Mycobacterium tuberculosis
IGFANTGTNNLGI

SEQ ID NO: 179938 - protein, 13 aa, Mycobacterium tuberculosis
GFANTGTNNLGIG

SEQ ID NO: 179939 - protein, 13 aa, Mycobacterium tuberculosis
FANTGTNNLGIGL

SEQ ID NO: 179940 - protein, 13 aa, Mycobacterium tuberculosis
ANTGTNNLGIGLT

SEQ ID NO: 179941 - protein, 13 aa, Mycobacterium tuberculosis
NTGTNNLGIGLTG

SEQ ID NO: 179942 - protein, 13 aa, Mycobacterium tuberculosis
TGTNNLGIGLTGD

SEQ ID NO: 179943 - protein, 13 aa, Mycobacterium tuberculosis
GTNNLGIGLTGDN

SEQ ID NO: 179944 - protein, 13 aa, Mycobacterium tuberculosis
TNNLGIGLTGDNQ

SEQ ID NO: 179945 - protein, 13 aa, Mycobacterium tuberculosis
NNLGIGLTGDNQT

SEQ ID NO: 179946 - protein, 13 aa, Mycobacterium tuberculosis
NLGIGLTGDNQTG

SEQ ID NO: 179947 - protein, 13 aa, Mycobacterium tuberculosis
LGIGLTGDNQTGI

SEQ ID NO: 179948 - protein, 13 aa, Mycobacterium tuberculosis
GIGLTGDNQTGIG

SEQ ID NO: 179949 - protein, 13 aa, Mycobacterium tuberculosis
IGLTGDNQTGIGG

SEQ ID NO: 179950 - protein, 13 aa, Mycobacterium tuberculosis
GLTGDNQTGIGGL

SEQ ID NO: 179951 - protein, 13 aa, Mycobacterium tuberculosis
LTGDNQTGIGGLN

SEQ ID NO: 179952 - protein, 13 aa, Mycobacterium tuberculosis
TGDNQTGIGGLNS

SEQ ID NO: 179953 - protein, 13 aa, Mycobacterium tuberculosis
GDNQTGIGGLNSG

SEQ ID NO: 179954 - protein, 13 aa, Mycobacterium tuberculosis
DNQTGIGGLNSGA

SEQ ID NO: 179955 - protein, 13 aa, Mycobacterium tuberculosis
NQTGIGGLNSGAG

SEQ ID NO: 179956 - protein, 13 aa, Mycobacterium tuberculosis
QTGIGGLNSGAGN

SEQ ID NO: 179957 - protein, 13 aa, Mycobacterium tuberculosis
TGIGGLNSGAGNI

SEQ ID NO: 179958 - protein, 13 aa, Mycobacterium tuberculosis
GIGGLNSGAGNIG

SEQ ID NO: 179959 - protein, 13 aa, Mycobacterium tuberculosis
IGGLNSGAGNIGL

SEQ ID NO: 179960 - protein, 13 aa, Mycobacterium tuberculosis
GGLNSGAGNIGLF

SEQ ID NO: 179961 - protein, 13 aa, Mycobacterium tuberculosis
GLNSGAGNIGLFN

SEQ ID NO: 179962 - protein, 13 aa, Mycobacterium tuberculosis
LNSGAGNIGLFNS

SEQ ID NO: 179963 - protein, 13 aa, Mycobacterium tuberculosis
NSGAGNIGLFNSG

SEQ ID NO: 179964 - protein, 13 aa, Mycobacterium tuberculosis
SGAGNIGLFNSGT

SEQ ID NO: 179965 - protein, 13 aa, Mycobacterium tuberculosis
GAGNIGLFNSGTG

SEQ ID NO: 179966 - protein, 13 aa, Mycobacterium tuberculosis
AGNIGLFNSGTGN

SEQ ID NO: 179967 - protein, 13 aa, Mycobacterium tuberculosis
GNIGLFNSGTGNI

SEQ ID NO: 179968 - protein, 13 aa, Mycobacterium tuberculosis
NIGLFNSGTGNIG

SEQ ID NO: 179969 - protein, 13 aa, Mycobacterium tuberculosis
IGLFNSGTGNIGF

SEQ ID NO: 179970 - protein, 13 aa, Mycobacterium tuberculosis
GLFNSGTGNIGFF

SEQ ID NO: 179971 - protein, 13 aa, Mycobacterium tuberculosis
LFNSGTGNIGFFN

SEQ ID NO: 179972 - protein, 13 aa, Mycobacterium tuberculosis
FNSGTGNIGFFNS

SEQ ID NO: 179973 - protein, 13 aa, Mycobacterium tuberculosis
NSGTGNIGFFNSG

SEQ ID NO: 179974 - protein, 13 aa, Mycobacterium tuberculosis
SGTGNIGFFNSGT

SEQ ID NO: 179975 - protein, 13 aa, Mycobacterium tuberculosis
GTGNIGFFNSGTG

SEQ ID NO: 179976 - protein, 13 aa, Mycobacterium tuberculosis
TGNIGFFNSGTGN

SEQ ID NO: 179977 - protein, 13 aa, Mycobacterium tuberculosis
GNIGFFNSGTGNW

SEQ ID NO: 179978 - protein, 13 aa, Mycobacterium tuberculosis
NIGFFNSGTGNWG

SEQ ID NO: 179979 - protein, 13 aa, Mycobacterium tuberculosis
IGFFNSGTGNWGL

SEQ ID NO: 179980 - protein, 13 aa, Mycobacterium tuberculosis
GFFNSGTGNWGLF

SEQ ID NO: 179981 - protein, 13 aa, Mycobacterium tuberculosis
FFNSGTGNWGLFN

SEQ ID NO: 179982 - protein, 13 aa, Mycobacterium tuberculosis
FNSGTGNWGLFNS

SEQ ID NO: 179983 - protein, 13 aa, Mycobacterium tuberculosis
NSGTGNWGLFNSG

SEQ ID NO: 179984 - protein, 13 aa, Mycobacterium tuberculosis
SGTGNWGLFNSGS

SEQ ID NO: 179985 - protein, 13 aa, Mycobacterium tuberculosis
GTGNWGLFNSGSF

SEQ ID NO: 179986 - protein, 13 aa, Mycobacterium tuberculosis
TGNWGLFNSGSFN

SEQ ID NO: 179987 - protein, 13 aa, Mycobacterium tuberculosis
GNWGLFNSGSFNT

SEQ ID NO: 179988 - protein, 13 aa, Mycobacterium tuberculosis
NWGLFNSGSFNTG

SEQ ID NO: 179989 - protein, 13 aa, Mycobacterium tuberculosis
WGLFNSGSFNTGI

SEQ ID NO: 179990 - protein, 13 aa, Mycobacterium tuberculosis
GLFNSGSFNTGIG

SEQ ID NO: 179991 - protein, 13 aa, Mycobacterium tuberculosis
LFNSGSFNTGIGN

SEQ ID NO: 179992 - protein, 13 aa, Mycobacterium tuberculosis
FNSGSFNTGIGNS

SEQ ID NO: 179993 - protein, 13 aa, Mycobacterium tuberculosis
NSGSFNTGIGNSG

SEQ ID NO: 179994 - protein, 13 aa, Mycobacterium tuberculosis
SGSFNTGIGNSGT

SEQ ID NO: 179995 - protein, 13 aa, Mycobacterium tuberculosis
GSFNTGIGNSGTG

SEQ ID NO: 179996 - protein, 13 aa, Mycobacterium tuberculosis
SFNTGIGNSGTGS

SEQ ID NO: 179997 - protein, 13 aa, Mycobacterium tuberculosis
FNTGIGNSGTGST

SEQ ID NO: 179998 - protein, 13 aa, Mycobacterium tuberculosis
NTGIGNSGTGSTG

SEQ ID NO: 179999 - protein, 13 aa, Mycobacterium tuberculosis
TGIGNSGTGSTGL

SEQ ID NO: 180000 - protein, 13 aa, Mycobacterium tuberculosis
GIGNSGTGSTGLF

SEQ ID NO: 180001 - protein, 13 aa, Mycobacterium tuberculosis
IGNSGTGSTGLFN

SEQ ID NO: 180002 - protein, 13 aa, Mycobacterium tuberculosis
GNSGTGSTGLFNA

SEQ ID NO: 180003 - protein, 13 aa, Mycobacterium tuberculosis
NSGTGSTGLFNAG

SEQ ID NO: 180004 - protein, 13 aa, Mycobacterium tuberculosis
SGTGSTGLFNAGG

SEQ ID NO: 180005 - protein, 13 aa, Mycobacterium tuberculosis
GTGSTGLFNAGGF

SEQ ID NO: 180006 - protein, 13 aa, Mycobacterium tuberculosis
TGSTGLFNAGGFT

SEQ ID NO: 180007 - protein, 13 aa, Mycobacterium tuberculosis
GSTGLFNAGGFTT

SEQ ID NO: 180008 - protein, 13 aa, Mycobacterium tuberculosis
STGLFNAGGFTTG

SEQ ID NO: 180009 - protein, 13 aa, Mycobacterium tuberculosis
TGLFNAGGFTTGL

SEQ ID NO: 180010 - protein, 13 aa, Mycobacterium tuberculosis
GLFNAGGFTTGLA

SEQ ID NO: 180011 - protein, 13 aa, Mycobacterium tuberculosis
LFNAGGFTTGLAN

SEQ ID NO: 180012 - protein, 13 aa, Mycobacterium tuberculosis
FNAGGFTTGLANA

SEQ ID NO: 180013 - protein, 13 aa, Mycobacterium tuberculosis
NAGGFTTGLANAG

SEQ ID NO: 180014 - protein, 13 aa, Mycobacterium tuberculosis
AGGFTTGLANAGS

SEQ ID NO: 180015 - protein, 13 aa, Mycobacterium tuberculosis
GGFTTGLANAGSY

SEQ ID NO: 180016 - protein, 13 aa, Mycobacterium tuberculosis
GFTTGLANAGSYN

SEQ ID NO: 180017 - protein, 13 aa, Mycobacterium tuberculosis
FTTGLANAGSYNT

SEQ ID NO: 180018 - protein, 13 aa, Mycobacterium tuberculosis
TTGLANAGSYNTG

SEQ ID NO: 180019 - protein, 13 aa, Mycobacterium tuberculosis
TGLANAGSYNTGS

SEQ ID NO: 180020 - protein, 13 aa, Mycobacterium tuberculosis
GLANAGSYNTGSF

SEQ ID NO: 180021 - protein, 13 aa, Mycobacterium tuberculosis
LANAGSYNTGSFN

SEQ ID NO: 180022 - protein, 13 aa, Mycobacterium tuberculosis
ANAGSYNTGSFNV

SEQ ID NO: 180023 - protein, 13 aa, Mycobacterium tuberculosis
NAGSYNTGSFNVG

SEQ ID NO: 180024 - protein, 13 aa, Mycobacterium tuberculosis
AGSYNTGSFNVGD

SEQ ID NO: 180025 - protein, 13 aa, Mycobacterium tuberculosis
GSYNTGSFNVGDT

SEQ ID NO: 180026 - protein, 13 aa, Mycobacterium tuberculosis
SYNTGSFNVGDTN

SEQ ID NO: 180027 - protein, 13 aa, Mycobacterium tuberculosis
YNTGSFNVGDTNT

SEQ ID NO: 180028 - protein, 13 aa, Mycobacterium tuberculosis
NTGSFNVGDTNTG

SEQ ID NO: 180029 - protein, 13 aa, Mycobacterium tuberculosis
TGSFNVGDTNTGG

SEQ ID NO: 180030 - protein, 13 aa, Mycobacterium tuberculosis
GSFNVGDTNTGGF

SEQ ID NO: 180031 - protein, 13 aa, Mycobacterium tuberculosis
SFNVGDTNTGGFN

SEQ ID NO: 180032 - protein, 13 aa, Mycobacterium tuberculosis
FNVGDTNTGGFNP

SEQ ID NO: 180033 - protein, 13 aa, Mycobacterium tuberculosis
NVGDTNTGGFNPG

SEQ ID NO: 180034 - protein, 13 aa, Mycobacterium tuberculosis
VGDTNTGGFNPGS

SEQ ID NO: 180035 - protein, 13 aa, Mycobacterium tuberculosis
GDTNTGGFNPGSI

SEQ ID NO: 180036 - protein, 13 aa, Mycobacterium tuberculosis
DTNTGGFNPGSIN

SEQ ID NO: 180037 - protein, 13 aa, Mycobacterium tuberculosis
TNTGGFNPGSINT

SEQ ID NO: 180038 - protein, 13 aa, Mycobacterium tuberculosis
NTGGFNPGSINTG

SEQ ID NO: 180039 - protein, 13 aa, Mycobacterium tuberculosis
TGGFNPGSINTGW

SEQ ID NO: 180040 - protein, 13 aa, Mycobacterium tuberculosis
GGFNPGSINTGWF

SEQ ID NO: 180041 - protein, 13 aa, Mycobacterium tuberculosis
GFNPGSINTGWFN

SEQ ID NO: 180042 - protein, 13 aa, Mycobacterium tuberculosis
FNPGSINTGWFNT

SEQ ID NO: 180043 - protein, 13 aa, Mycobacterium tuberculosis
NPGSINTGWFNTG

SEQ ID NO: 180044 - protein, 13 aa, Mycobacterium tuberculosis
PGSINTGWFNTGN

SEQ ID NO: 180045 - protein, 13 aa, Mycobacterium tuberculosis
GSINTGWFNTGNA

SEQ ID NO: 180046 - protein, 13 aa, Mycobacterium tuberculosis
SINTGWFNTGNAN

SEQ ID NO: 180047 - protein, 13 aa, Mycobacterium tuberculosis
INTGWFNTGNANT

SEQ ID NO: 180048 - protein, 13 aa, Mycobacterium tuberculosis
NTGWFNTGNANTG

SEQ ID NO: 180049 - protein, 13 aa, Mycobacterium tuberculosis
TGWFNTGNANTGI

SEQ ID NO: 180050 - protein, 13 aa, Mycobacterium tuberculosis
GWFNTGNANTGIA

SEQ ID NO: 180051 - protein, 13 aa, Mycobacterium tuberculosis
WFNTGNANTGIAN

SEQ ID NO: 180052 - protein, 13 aa, Mycobacterium tuberculosis
FNTGNANTGIANS

SEQ ID NO: 180053 - protein, 13 aa, Mycobacterium tuberculosis
NTGNANTGIANSG

SEQ ID NO: 180054 - protein, 13 aa, Mycobacterium tuberculosis
TGNANTGIANSGN

SEQ ID NO: 180055 - protein, 13 aa, Mycobacterium tuberculosis
GNANTGIANSGNV

SEQ ID NO: 180056 - protein, 13 aa, Mycobacterium tuberculosis
NANTGIANSGNVD

SEQ ID NO: 180057 - protein, 13 aa, Mycobacterium tuberculosis
ANTGIANSGNVDT

SEQ ID NO: 180058 - protein, 13 aa, Mycobacterium tuberculosis
NTGIANSGNVDTG

SEQ ID NO: 180059 - protein, 13 aa, Mycobacterium tuberculosis
TGIANSGNVDTGA

SEQ ID NO: 180060 - protein, 13 aa, Mycobacterium tuberculosis
GIANSGNVDTGAL

SEQ ID NO: 180061 - protein, 13 aa, Mycobacterium tuberculosis
IANSGNVDTGALM

SEQ ID NO: 180062 - protein, 13 aa, Mycobacterium tuberculosis
ANSGNVDTGALMS

SEQ ID NO: 180063 - protein, 13 aa, Mycobacterium tuberculosis
NSGNVDTGALMSG

SEQ ID NO: 180064 - protein, 13 aa, Mycobacterium tuberculosis
SGNVDTGALMSGN

SEQ ID NO: 180065 - protein, 13 aa, Mycobacterium tuberculosis
GNVDTGALMSGNF

SEQ ID NO: 180066 - protein, 13 aa, Mycobacterium tuberculosis
NVDTGALMSGNFS

SEQ ID NO: 180067 - protein, 13 aa, Mycobacterium tuberculosis
VDTGALMSGNFSN

SEQ ID NO: 180068 - protein, 13 aa, Mycobacterium tuberculosis
DTGALMSGNFSNG

SEQ ID NO: 180069 - protein, 13 aa, Mycobacterium tuberculosis
TGALMSGNFSNGI

SEQ ID NO: 180070 - protein, 13 aa, Mycobacterium tuberculosis
GALMSGNFSNGIL

SEQ ID NO: 180071 - protein, 13 aa, Mycobacterium tuberculosis
ALMSGNFSNGILW

SEQ ID NO: 180072 - protein, 13 aa, Mycobacterium tuberculosis
LMSGNFSNGILWR

SEQ ID NO: 180073 - protein, 13 aa, Mycobacterium tuberculosis
MSGNFSNGILWRG

SEQ ID NO: 180074 - protein, 13 aa, Mycobacterium tuberculosis
SGNFSNGILWRGN

SEQ ID NO: 180075 - protein, 13 aa, Mycobacterium tuberculosis
GNFSNGILWRGNY

SEQ ID NO: 180076 - protein, 13 aa, Mycobacterium tuberculosis
NFSNGILWRGNYE

SEQ ID NO: 180077 - protein, 13 aa, Mycobacterium tuberculosis
FSNGILWRGNYEG

SEQ ID NO: 180078 - protein, 13 aa, Mycobacterium tuberculosis
SNGILWRGNYEGL

SEQ ID NO: 180079 - protein, 13 aa, Mycobacterium tuberculosis
NGILWRGNYEGLF

SEQ ID NO: 180080 - protein, 13 aa, Mycobacterium tuberculosis
GILWRGNYEGLFS

SEQ ID NO: 180081 - protein, 13 aa, Mycobacterium tuberculosis
ILWRGNYEGLFSY

SEQ ID NO: 180082 - protein, 13 aa, Mycobacterium tuberculosis
LWRGNYEGLFSYS

SEQ ID NO: 180083 - protein, 13 aa, Mycobacterium tuberculosis
WRGNYEGLFSYSY

SEQ ID NO: 180084 - protein, 13 aa, Mycobacterium tuberculosis
RGNYEGLFSYSYS

SEQ ID NO: 180085 - protein, 13 aa, Mycobacterium tuberculosis
GNYEGLFSYSYSL

SEQ ID NO: 180086 - protein, 13 aa, Mycobacterium tuberculosis
NYEGLFSYSYSLD

SEQ ID NO: 180087 - protein, 13 aa, Mycobacterium tuberculosis
YEGLFSYSYSLDV

SEQ ID NO: 180088 - protein, 13 aa, Mycobacterium tuberculosis
EGLFSYSYSLDVP

SEQ ID NO: 180089 - protein, 13 aa, Mycobacterium tuberculosis
GLFSYSYSLDVPR

SEQ ID NO: 180090 - protein, 13 aa, Mycobacterium tuberculosis
LFSYSYSLDVPRI

SEQ ID NO: 180091 - protein, 13 aa, Mycobacterium tuberculosis
FSYSYSLDVPRIT

SEQ ID NO: 180092 - protein, 13 aa, Mycobacterium tuberculosis
SYSYSLDVPRITI

SEQ ID NO: 180093 - protein, 13 aa, Mycobacterium tuberculosis
YSYSLDVPRITIL

SEQ ID NO: 180094 - protein, 13 aa, Mycobacterium tuberculosis
SYSLDVPRITILD

SEQ ID NO: 180095 - protein, 13 aa, Mycobacterium tuberculosis
YSLDVPRITILDA

SEQ ID NO: 180096 - protein, 13 aa, Mycobacterium tuberculosis
SLDVPRITILDAH

SEQ ID NO: 180097 - protein, 13 aa, Mycobacterium tuberculosis
LDVPRITILDAHF

SEQ ID NO: 180098 - protein, 13 aa, Mycobacterium tuberculosis
DVPRITILDAHFT

SEQ ID NO: 180099 - protein, 13 aa, Mycobacterium tuberculosis
VPRITILDAHFTG

SEQ ID NO: 180100 - protein, 13 aa, Mycobacterium tuberculosis
PRITILDAHFTGA

SEQ ID NO: 180101 - protein, 13 aa, Mycobacterium tuberculosis
RITILDAHFTGAF

SEQ ID NO: 180102 - protein, 13 aa, Mycobacterium tuberculosis
ITILDAHFTGAFG

SEQ ID NO: 180103 - protein, 13 aa, Mycobacterium tuberculosis
TILDAHFTGAFGP

SEQ ID NO: 180104 - protein, 13 aa, Mycobacterium tuberculosis
ILDAHFTGAFGPV

SEQ ID NO: 180105 - protein, 13 aa, Mycobacterium tuberculosis
LDAHFTGAFGPVV

SEQ ID NO: 180106 - protein, 13 aa, Mycobacterium tuberculosis
DAHFTGAFGPVVV

SEQ ID NO: 180107 - protein, 13 aa, Mycobacterium tuberculosis
AHFTGAFGPVVVP

SEQ ID NO: 180108 - protein, 13 aa, Mycobacterium tuberculosis
HFTGAFGPVVVPP

SEQ ID NO: 180109 - protein, 13 aa, Mycobacterium tuberculosis
FTGAFGPVVVPPI

SEQ ID NO: 180110 - protein, 13 aa, Mycobacterium tuberculosis
TGAFGPVVVPPIP

SEQ ID NO: 180111 - protein, 13 aa, Mycobacterium tuberculosis
GAFGPVVVPPIPV

SEQ ID NO: 180112 - protein, 13 aa, Mycobacterium tuberculosis
AFGPVVVPPIPVL

SEQ ID NO: 180113 - protein, 13 aa, Mycobacterium tuberculosis
FGPVVVPPIPVLA

SEQ ID NO: 180114 - protein, 13 aa, Mycobacterium tuberculosis
GPVVVPPIPVLAI

SEQ ID NO: 180115 - protein, 13 aa, Mycobacterium tuberculosis
PVVVPPIPVLAIN

SEQ ID NO: 180116 - protein, 13 aa, Mycobacterium tuberculosis
VVVPPIPVLAINA

SEQ ID NO: 180117 - protein, 13 aa, Mycobacterium tuberculosis
VVPPIPVLAINAH

SEQ ID NO: 180118 - protein, 13 aa, Mycobacterium tuberculosis
VPPIPVLAINAHL

SEQ ID NO: 180119 - protein, 13 aa, Mycobacterium tuberculosis
PPIPVLAINAHLT

SEQ ID NO: 180120 - protein, 13 aa, Mycobacterium tuberculosis
PIPVLAINAHLTG

SEQ ID NO: 180121 - protein, 13 aa, Mycobacterium tuberculosis
IPVLAINAHLTGN

SEQ ID NO: 180122 - protein, 13 aa, Mycobacterium tuberculosis
PVLAINAHLTGNA

SEQ ID NO: 180123 - protein, 13 aa, Mycobacterium tuberculosis
VLAINAHLTGNAA

SEQ ID NO: 180124 - protein, 13 aa, Mycobacterium tuberculosis
LAINAHLTGNAAM

SEQ ID NO: 180125 - protein, 13 aa, Mycobacterium tuberculosis
AINAHLTGNAAMG

SEQ ID NO: 180126 - protein, 13 aa, Mycobacterium tuberculosis
INAHLTGNAAMGA

SEQ ID NO: 180127 - protein, 13 aa, Mycobacterium tuberculosis
NAHLTGNAAMGAF

SEQ ID NO: 180128 - protein, 13 aa, Mycobacterium tuberculosis
AHLTGNAAMGAFT

SEQ ID NO: 180129 - protein, 13 aa, Mycobacterium tuberculosis
HLTGNAAMGAFTI

SEQ ID NO: 180130 - protein, 13 aa, Mycobacterium tuberculosis
LTGNAAMGAFTIP

SEQ ID NO: 180131 - protein, 13 aa, Mycobacterium tuberculosis
TGNAAMGAFTIPQ

SEQ ID NO: 180132 - protein, 13 aa, Mycobacterium tuberculosis
GNAAMGAFTIPQI

SEQ ID NO: 180133 - protein, 13 aa, Mycobacterium tuberculosis
NAAMGAFTIPQID

SEQ ID NO: 180134 - protein, 13 aa, Mycobacterium tuberculosis
AAMGAFTIPQIDI

SEQ ID NO: 180135 - protein, 13 aa, Mycobacterium tuberculosis
AMGAFTIPQIDIP

SEQ ID NO: 180136 - protein, 13 aa, Mycobacterium tuberculosis
MGAFTIPQIDIPA

SEQ ID NO: 180137 - protein, 13 aa, Mycobacterium tuberculosis
GAFTIPQIDIPAL

SEQ ID NO: 180138 - protein, 13 aa, Mycobacterium tuberculosis
AFTIPQIDIPALN

SEQ ID NO: 180139 - protein, 13 aa, Mycobacterium tuberculosis
FTIPQIDIPALNP

SEQ ID NO: 180140 - protein, 13 aa, Mycobacterium tuberculosis
TIPQIDIPALNPN

SEQ ID NO: 180141 - protein, 13 aa, Mycobacterium tuberculosis
IPQIDIPALNPNV

SEQ ID NO: 180142 - protein, 13 aa, Mycobacterium tuberculosis
PQIDIPALNPNVT

SEQ ID NO: 180143 - protein, 13 aa, Mycobacterium tuberculosis
QIDIPALNPNVTG

SEQ ID NO: 180144 - protein, 13 aa, Mycobacterium tuberculosis
IDIPALNPNVTGS

SEQ ID NO: 180145 - protein, 13 aa, Mycobacterium tuberculosis
DIPALNPNVTGSV

SEQ ID NO: 180146 - protein, 13 aa, Mycobacterium tuberculosis
IPALNPNVTGSVG

SEQ ID NO: 180147 - protein, 13 aa, Mycobacterium tuberculosis
PALNPNVTGSVGF

SEQ ID NO: 180148 - protein, 13 aa, Mycobacterium tuberculosis
ALNPNVTGSVGFG

SEQ ID NO: 180149 - protein, 13 aa, Mycobacterium tuberculosis
LNPNVTGSVGFGP

SEQ ID NO: 180150 - protein, 13 aa, Mycobacterium tuberculosis
NPNVTGSVGFGPI

SEQ ID NO: 180151 - protein, 13 aa, Mycobacterium tuberculosis
PNVTGSVGFGPIA

SEQ ID NO: 180152 - protein, 13 aa, Mycobacterium tuberculosis
NVTGSVGFGPIAV

SEQ ID NO: 180153 - protein, 13 aa, Mycobacterium tuberculosis
VTGSVGFGPIAVP

SEQ ID NO: 180154 - protein, 13 aa, Mycobacterium tuberculosis
TGSVGFGPIAVPS

SEQ ID NO: 180155 - protein, 13 aa, Mycobacterium tuberculosis
GSVGFGPIAVPSV

SEQ ID NO: 180156 - protein, 13 aa, Mycobacterium tuberculosis
SVGFGPIAVPSVT

SEQ ID NO: 180157 - protein, 13 aa, Mycobacterium tuberculosis
VGFGPIAVPSVTI

SEQ ID NO: 180158 - protein, 13 aa, Mycobacterium tuberculosis
GFGPIAVPSVTIP

SEQ ID NO: 180159 - protein, 13 aa, Mycobacterium tuberculosis
FGPIAVPSVTIPA

SEQ ID NO: 180160 - protein, 13 aa, Mycobacterium tuberculosis
GPIAVPSVTIPAL

SEQ ID NO: 180161 - protein, 13 aa, Mycobacterium tuberculosis
PIAVPSVTIPALT

SEQ ID NO: 180162 - protein, 13 aa, Mycobacterium tuberculosis
IAVPSVTIPALTA

SEQ ID NO: 180163 - protein, 13 aa, Mycobacterium tuberculosis
AVPSVTIPALTAA

SEQ ID NO: 180164 - protein, 13 aa, Mycobacterium tuberculosis
VPSVTIPALTAAR

SEQ ID NO: 180165 - protein, 13 aa, Mycobacterium tuberculosis
PSVTIPALTAARA

SEQ ID NO: 180166 - protein, 13 aa, Mycobacterium tuberculosis
SVTIPALTAARAV

SEQ ID NO: 180167 - protein, 13 aa, Mycobacterium tuberculosis
VTIPALTAARAVL

SEQ ID NO: 180168 - protein, 13 aa, Mycobacterium tuberculosis
TIPALTAARAVLD

SEQ ID NO: 180169 - protein, 13 aa, Mycobacterium tuberculosis
IPALTAARAVLDM

SEQ ID NO: 180170 - protein, 13 aa, Mycobacterium tuberculosis
PALTAARAVLDMA

SEQ ID NO: 180171 - protein, 13 aa, Mycobacterium tuberculosis
ALTAARAVLDMAA

SEQ ID NO: 180172 - protein, 13 aa, Mycobacterium tuberculosis
LTAARAVLDMAAS

SEQ ID NO: 180173 - protein, 13 aa, Mycobacterium tuberculosis
TAARAVLDMAASV

SEQ ID NO: 180174 - protein, 13 aa, Mycobacterium tuberculosis
AARAVLDMAASVG

SEQ ID NO: 180175 - protein, 13 aa, Mycobacterium tuberculosis
ARAVLDMAASVGA

SEQ ID NO: 180176 - protein, 13 aa, Mycobacterium tuberculosis
RAVLDMAASVGAT

SEQ ID NO: 180177 - protein, 13 aa, Mycobacterium tuberculosis
AVLDMAASVGATS

SEQ ID NO: 180178 - protein, 13 aa, Mycobacterium tuberculosis
VLDMAASVGATSE

SEQ ID NO: 180179 - protein, 13 aa, Mycobacterium tuberculosis
LDMAASVGATSEI

SEQ ID NO: 180180 - protein, 13 aa, Mycobacterium tuberculosis
DMAASVGATSEIE

SEQ ID NO: 180181 - protein, 13 aa, Mycobacterium tuberculosis
MAASVGATSEIEP

SEQ ID NO: 180182 - protein, 13 aa, Mycobacterium tuberculosis
AASVGATSEIEPF

SEQ ID NO: 180183 - protein, 13 aa, Mycobacterium tuberculosis
ASVGATSEIEPFI

SEQ ID NO: 180184 - protein, 13 aa, Mycobacterium tuberculosis
SVGATSEIEPFIV

SEQ ID NO: 180185 - protein, 13 aa, Mycobacterium tuberculosis
VGATSEIEPFIVW

SEQ ID NO: 180186 - protein, 13 aa, Mycobacterium tuberculosis
GATSEIEPFIVWT

SEQ ID NO: 180187 - protein, 13 aa, Mycobacterium tuberculosis
ATSEIEPFIVWTS

SEQ ID NO: 180188 - protein, 13 aa, Mycobacterium tuberculosis
TSEIEPFIVWTSS

SEQ ID NO: 180189 - protein, 13 aa, Mycobacterium tuberculosis
SEIEPFIVWTSSG

SEQ ID NO: 180190 - protein, 13 aa, Mycobacterium tuberculosis
EIEPFIVWTSSGA

SEQ ID NO: 180191 - protein, 13 aa, Mycobacterium tuberculosis
IEPFIVWTSSGAI

SEQ ID NO: 180192 - protein, 13 aa, Mycobacterium tuberculosis
EPFIVWTSSGAIG

SEQ ID NO: 180193 - protein, 13 aa, Mycobacterium tuberculosis
PFIVWTSSGAIGP

SEQ ID NO: 180194 - protein, 13 aa, Mycobacterium tuberculosis
FIVWTSSGAIGPT

SEQ ID NO: 180195 - protein, 13 aa, Mycobacterium tuberculosis
IVWTSSGAIGPTW

SEQ ID NO: 180196 - protein, 13 aa, Mycobacterium tuberculosis
VWTSSGAIGPTWY

SEQ ID NO: 180197 - protein, 13 aa, Mycobacterium tuberculosis
WTSSGAIGPTWYS

SEQ ID NO: 180198 - protein, 13 aa, Mycobacterium tuberculosis
TSSGAIGPTWYSV

SEQ ID NO: 180199 - protein, 13 aa, Mycobacterium tuberculosis
SSGAIGPTWYSVG

SEQ ID NO: 180200 - protein, 13 aa, Mycobacterium tuberculosis
SGAIGPTWYSVGR

SEQ ID NO: 180201 - protein, 13 aa, Mycobacterium tuberculosis
GAIGPTWYSVGRI

SEQ ID NO: 180202 - protein, 13 aa, Mycobacterium tuberculosis
AIGPTWYSVGRIY

SEQ ID NO: 180203 - protein, 13 aa, Mycobacterium tuberculosis
IGPTWYSVGRIYN

SEQ ID NO: 180204 - protein, 13 aa, Mycobacterium tuberculosis
GPTWYSVGRIYNA

SEQ ID NO: 180205 - protein, 13 aa, Mycobacterium tuberculosis
PTWYSVGRIYNAG

SEQ ID NO: 180206 - protein, 13 aa, Mycobacterium tuberculosis
TWYSVGRIYNAGD

SEQ ID NO: 180207 - protein, 13 aa, Mycobacterium tuberculosis
WYSVGRIYNAGDL

SEQ ID NO: 180208 - protein, 13 aa, Mycobacterium tuberculosis
YSVGRIYNAGDLF

SEQ ID NO: 180209 - protein, 13 aa, Mycobacterium tuberculosis
SVGRIYNAGDLFV

SEQ ID NO: 180210 - protein, 13 aa, Mycobacterium tuberculosis
VGRIYNAGDLFVG

SEQ ID NO: 180211 - protein, 13 aa, Mycobacterium tuberculosis
GRIYNAGDLFVGG

SEQ ID NO: 180212 - protein, 13 aa, Mycobacterium tuberculosis
RIYNAGDLFVGGN

SEQ ID NO: 180213 - protein, 13 aa, Mycobacterium tuberculosis
IYNAGDLFVGGNI

SEQ ID NO: 180214 - protein, 13 aa, Mycobacterium tuberculosis
YNAGDLFVGGNII

SEQ ID NO: 180215 - protein, 13 aa, Mycobacterium tuberculosis
NAGDLFVGGNIIS

SEQ ID NO: 180216 - protein, 13 aa, Mycobacterium tuberculosis
AGDLFVGGNIISG

SEQ ID NO: 180217 - protein, 13 aa, Mycobacterium tuberculosis
GDLFVGGNIISGI

SEQ ID NO: 180218 - protein, 13 aa, Mycobacterium tuberculosis
DLFVGGNIISGIP

SEQ ID NO: 180219 - protein, 13 aa, Mycobacterium tuberculosis
LFVGGNIISGIPT

SEQ ID NO: 180220 - protein, 13 aa, Mycobacterium tuberculosis
FVGGNIISGIPTL

SEQ ID NO: 180221 - protein, 13 aa, Mycobacterium tuberculosis
VGGNIISGIPTLS

SEQ ID NO: 180222 - protein, 13 aa, Mycobacterium tuberculosis
GGNIISGIPTLST

SEQ ID NO: 180223 - protein, 13 aa, Mycobacterium tuberculosis
GNIISGIPTLSTT

SEQ ID NO: 180224 - protein, 13 aa, Mycobacterium tuberculosis
NIISGIPTLSTTG

SEQ ID NO: 180225 - protein, 13 aa, Mycobacterium tuberculosis
IISGIPTLSTTGP

SEQ ID NO: 180226 - protein, 13 aa, Mycobacterium tuberculosis
ISGIPTLSTTGPV

SEQ ID NO: 180227 - protein, 13 aa, Mycobacterium tuberculosis
SGIPTLSTTGPVH

SEQ ID NO: 180228 - protein, 13 aa, Mycobacterium tuberculosis
GIPTLSTTGPVHA

SEQ ID NO: 180229 - protein, 13 aa, Mycobacterium tuberculosis
IPTLSTTGPVHAV

SEQ ID NO: 180230 - protein, 13 aa, Mycobacterium tuberculosis
PTLSTTGPVHAVF

SEQ ID NO: 180231 - protein, 13 aa, Mycobacterium tuberculosis
TLSTTGPVHAVFN

SEQ ID NO: 180232 - protein, 13 aa, Mycobacterium tuberculosis
LSTTGPVHAVFNA

SEQ ID NO: 180233 - protein, 13 aa, Mycobacterium tuberculosis
STTGPVHAVFNAA

SEQ ID NO: 180234 - protein, 13 aa, Mycobacterium tuberculosis
TTGPVHAVFNAAS

SEQ ID NO: 180235 - protein, 13 aa, Mycobacterium tuberculosis
TGPVHAVFNAASQ

SEQ ID NO: 180236 - protein, 13 aa, Mycobacterium tuberculosis
GPVHAVFNAASQA

SEQ ID NO: 180237 - protein, 13 aa, Mycobacterium tuberculosis
PVHAVFNAASQAF

SEQ ID NO: 180238 - protein, 13 aa, Mycobacterium tuberculosis
VHAVFNAASQAFN

SEQ ID NO: 180239 - protein, 13 aa, Mycobacterium tuberculosis
HAVFNAASQAFNT

SEQ ID NO: 180240 - protein, 13 aa, Mycobacterium tuberculosis
AVFNAASQAFNTP

SEQ ID NO: 180241 - protein, 13 aa, Mycobacterium tuberculosis
VFNAASQAFNTPA

SEQ ID NO: 180242 - protein, 13 aa, Mycobacterium tuberculosis
FNAASQAFNTPAL

SEQ ID NO: 180243 - protein, 13 aa, Mycobacterium tuberculosis
NAASQAFNTPALN

SEQ ID NO: 180244 - protein, 13 aa, Mycobacterium tuberculosis
AASQAFNTPALNI

SEQ ID NO: 180245 - protein, 13 aa, Mycobacterium tuberculosis
ASQAFNTPALNIH

SEQ ID NO: 180246 - protein, 13 aa, Mycobacterium tuberculosis
SQAFNTPALNIHQ

SEQ ID NO: 180247 - protein, 13 aa, Mycobacterium tuberculosis
QAFNTPALNIHQI

SEQ ID NO: 180248 - protein, 13 aa, Mycobacterium tuberculosis
AFNTPALNIHQIP

SEQ ID NO: 180249 - protein, 13 aa, Mycobacterium tuberculosis
FNTPALNIHQIPL

SEQ ID NO: 180250 - protein, 13 aa, Mycobacterium tuberculosis
NTPALNIHQIPLG

SEQ ID NO: 180251 - protein, 13 aa, Mycobacterium tuberculosis
TPALNIHQIPLGF

SEQ ID NO: 180252 - protein, 13 aa, Mycobacterium tuberculosis
PALNIHQIPLGFQ

SEQ ID NO: 180253 - protein, 13 aa, Mycobacterium tuberculosis
ALNIHQIPLGFQV

SEQ ID NO: 180254 - protein, 13 aa, Mycobacterium tuberculosis
LNIHQIPLGFQVP

SEQ ID NO: 180255 - protein, 13 aa, Mycobacterium tuberculosis
NIHQIPLGFQVPG

SEQ ID NO: 180256 - protein, 13 aa, Mycobacterium tuberculosis
IHQIPLGFQVPGS

SEQ ID NO: 180257 - protein, 13 aa, Mycobacterium tuberculosis
HQIPLGFQVPGSI

SEQ ID NO: 180258 - protein, 13 aa, Mycobacterium tuberculosis
QIPLGFQVPGSID

SEQ ID NO: 180259 - protein, 13 aa, Mycobacterium tuberculosis
IPLGFQVPGSIDA

SEQ ID NO: 180260 - protein, 13 aa, Mycobacterium tuberculosis
PLGFQVPGSIDAI

SEQ ID NO: 180261 - protein, 13 aa, Mycobacterium tuberculosis
LGFQVPGSIDAIT

SEQ ID NO: 180262 - protein, 13 aa, Mycobacterium tuberculosis
GFQVPGSIDAITL

SEQ ID NO: 180263 - protein, 13 aa, Mycobacterium tuberculosis
FQVPGSIDAITLF

SEQ ID NO: 180264 - protein, 13 aa, Mycobacterium tuberculosis
QVPGSIDAITLFP

SEQ ID NO: 180265 - protein, 13 aa, Mycobacterium tuberculosis
VPGSIDAITLFPG

SEQ ID NO: 180266 - protein, 13 aa, Mycobacterium tuberculosis
PGSIDAITLFPGG

SEQ ID NO: 180267 - protein, 13 aa, Mycobacterium tuberculosis
GSIDAITLFPGGL

SEQ ID NO: 180268 - protein, 13 aa, Mycobacterium tuberculosis
SIDAITLFPGGLT

SEQ ID NO: 180269 - protein, 13 aa, Mycobacterium tuberculosis
IDAITLFPGGLTF

SEQ ID NO: 180270 - protein, 13 aa, Mycobacterium tuberculosis
DAITLFPGGLTFP

SEQ ID NO: 180271 - protein, 13 aa, Mycobacterium tuberculosis
AITLFPGGLTFPA

SEQ ID NO: 180272 - protein, 13 aa, Mycobacterium tuberculosis
ITLFPGGLTFPAN

SEQ ID NO: 180273 - protein, 13 aa, Mycobacterium tuberculosis
TLFPGGLTFPANS

SEQ ID NO: 180274 - protein, 13 aa, Mycobacterium tuberculosis
LFPGGLTFPANSL

SEQ ID NO: 180275 - protein, 13 aa, Mycobacterium tuberculosis
FPGGLTFPANSLL

SEQ ID NO: 180276 - protein, 13 aa, Mycobacterium tuberculosis
PGGLTFPANSLLN

SEQ ID NO: 180277 - protein, 13 aa, Mycobacterium tuberculosis
GGLTFPANSLLNL

SEQ ID NO: 180278 - protein, 13 aa, Mycobacterium tuberculosis
GLTFPANSLLNLD

SEQ ID NO: 180279 - protein, 13 aa, Mycobacterium tuberculosis
LTFPANSLLNLDV

SEQ ID NO: 180280 - protein, 13 aa, Mycobacterium tuberculosis
TFPANSLLNLDVF

SEQ ID NO: 180281 - protein, 13 aa, Mycobacterium tuberculosis
FPANSLLNLDVFV

SEQ ID NO: 180282 - protein, 13 aa, Mycobacterium tuberculosis
PANSLLNLDVFVG

SEQ ID NO: 180283 - protein, 13 aa, Mycobacterium tuberculosis
ANSLLNLDVFVGT

SEQ ID NO: 180284 - protein, 13 aa, Mycobacterium tuberculosis
NSLLNLDVFVGTP

SEQ ID NO: 180285 - protein, 13 aa, Mycobacterium tuberculosis
SLLNLDVFVGTPG

SEQ ID NO: 180286 - protein, 13 aa, Mycobacterium tuberculosis
LLNLDVFVGTPGA

SEQ ID NO: 180287 - protein, 13 aa, Mycobacterium tuberculosis
LNLDVFVGTPGAT

SEQ ID NO: 180288 - protein, 13 aa, Mycobacterium tuberculosis
NLDVFVGTPGATI

SEQ ID NO: 180289 - protein, 13 aa, Mycobacterium tuberculosis
LDVFVGTPGATIP

SEQ ID NO: 180290 - protein, 13 aa, Mycobacterium tuberculosis
DVFVGTPGATIPA

SEQ ID NO: 180291 - protein, 13 aa, Mycobacterium tuberculosis
VFVGTPGATIPAI

SEQ ID NO: 180292 - protein, 13 aa, Mycobacterium tuberculosis
FVGTPGATIPAIT

SEQ ID NO: 180293 - protein, 13 aa, Mycobacterium tuberculosis
VGTPGATIPAITF

SEQ ID NO: 180294 - protein, 13 aa, Mycobacterium tuberculosis
GTPGATIPAITFP

SEQ ID NO: 180295 - protein, 13 aa, Mycobacterium tuberculosis
TPGATIPAITFPE

SEQ ID NO: 180296 - protein, 13 aa, Mycobacterium tuberculosis
PGATIPAITFPEI

SEQ ID NO: 180297 - protein, 13 aa, Mycobacterium tuberculosis
GATIPAITFPEIP

SEQ ID NO: 180298 - protein, 13 aa, Mycobacterium tuberculosis
ATIPAITFPEIPA

SEQ ID NO: 180299 - protein, 13 aa, Mycobacterium tuberculosis
TIPAITFPEIPAN

SEQ ID NO: 180300 - protein, 13 aa, Mycobacterium tuberculosis
IPAITFPEIPANA

SEQ ID NO: 180301 - protein, 13 aa, Mycobacterium tuberculosis
PAITFPEIPANAD

SEQ ID NO: 180302 - protein, 13 aa, Mycobacterium tuberculosis
AITFPEIPANADG

SEQ ID NO: 180303 - protein, 13 aa, Mycobacterium tuberculosis
ITFPEIPANADGE

SEQ ID NO: 180304 - protein, 13 aa, Mycobacterium tuberculosis
TFPEIPANADGEL

SEQ ID NO: 180305 - protein, 13 aa, Mycobacterium tuberculosis
FPEIPANADGELY

SEQ ID NO: 180306 - protein, 13 aa, Mycobacterium tuberculosis
PEIPANADGELYV

SEQ ID NO: 180307 - protein, 13 aa, Mycobacterium tuberculosis
EIPANADGELYVI

SEQ ID NO: 180308 - protein, 13 aa, Mycobacterium tuberculosis
IPANADGELYVIA

SEQ ID NO: 180309 - protein, 13 aa, Mycobacterium tuberculosis
PANADGELYVIAG

SEQ ID NO: 180310 - protein, 13 aa, Mycobacterium tuberculosis
ANADGELYVIAGD

SEQ ID NO: 180311 - protein, 13 aa, Mycobacterium tuberculosis
NADGELYVIAGDI

SEQ ID NO: 180312 - protein, 13 aa, Mycobacterium tuberculosis
ADGELYVIAGDIP

SEQ ID NO: 180313 - protein, 13 aa, Mycobacterium tuberculosis
DGELYVIAGDIPL

SEQ ID NO: 180314 - protein, 13 aa, Mycobacterium tuberculosis
GELYVIAGDIPLI

SEQ ID NO: 180315 - protein, 13 aa, Mycobacterium tuberculosis
ELYVIAGDIPLIN

SEQ ID NO: 180316 - protein, 13 aa, Mycobacterium tuberculosis
LYVIAGDIPLINI

SEQ ID NO: 180317 - protein, 13 aa, Mycobacterium tuberculosis
YVIAGDIPLINIP

SEQ ID NO: 180318 - protein, 13 aa, Mycobacterium tuberculosis
VIAGDIPLINIPP

SEQ ID NO: 180319 - protein, 13 aa, Mycobacterium tuberculosis
IAGDIPLINIPPT

SEQ ID NO: 180320 - protein, 13 aa, Mycobacterium tuberculosis
AGDIPLINIPPTP

SEQ ID NO: 180321 - protein, 13 aa, Mycobacterium tuberculosis
GDIPLINIPPTPG

SEQ ID NO: 180322 - protein, 13 aa, Mycobacterium tuberculosis
DIPLINIPPTPGI

SEQ ID NO: 180323 - protein, 13 aa, Mycobacterium tuberculosis
IPLINIPPTPGIG

SEQ ID NO: 180324 - protein, 13 aa, Mycobacterium tuberculosis
PLINIPPTPGIGN

SEQ ID NO: 180325 - protein, 13 aa, Mycobacterium tuberculosis
LINIPPTPGIGNT

SEQ ID NO: 180326 - protein, 13 aa, Mycobacterium tuberculosis
INIPPTPGIGNTT

SEQ ID NO: 180327 - protein, 13 aa, Mycobacterium tuberculosis
NIPPTPGIGNTTT

SEQ ID NO: 180328 - protein, 13 aa, Mycobacterium tuberculosis
IPPTPGIGNTTTV

SEQ ID NO: 180329 - protein, 13 aa, Mycobacterium tuberculosis
PPTPGIGNTTTVP

SEQ ID NO: 180330 - protein, 13 aa, Mycobacterium tuberculosis
PTPGIGNTTTVPS

SEQ ID NO: 180331 - protein, 13 aa, Mycobacterium tuberculosis
TPGIGNTTTVPSS

SEQ ID NO: 180332 - protein, 13 aa, Mycobacterium tuberculosis
PGIGNTTTVPSSG

SEQ ID NO: 180333 - protein, 13 aa, Mycobacterium tuberculosis
GIGNTTTVPSSGF

SEQ ID NO: 180334 - protein, 13 aa, Mycobacterium tuberculosis
IGNTTTVPSSGFF

SEQ ID NO: 180335 - protein, 13 aa, Mycobacterium tuberculosis
GNTTTVPSSGFFN

SEQ ID NO: 180336 - protein, 13 aa, Mycobacterium tuberculosis
NTTTVPSSGFFNT

SEQ ID NO: 180337 - protein, 13 aa, Mycobacterium tuberculosis
TTTVPSSGFFNTG

SEQ ID NO: 180338 - protein, 13 aa, Mycobacterium tuberculosis
TTVPSSGFFNTGA

SEQ ID NO: 180339 - protein, 13 aa, Mycobacterium tuberculosis
TVPSSGFFNTGAG

SEQ ID NO: 180340 - protein, 13 aa, Mycobacterium tuberculosis
VPSSGFFNTGAGG

SEQ ID NO: 180341 - protein, 13 aa, Mycobacterium tuberculosis
PSSGFFNTGAGGG

SEQ ID NO: 180342 - protein, 13 aa, Mycobacterium tuberculosis
SSGFFNTGAGGGS

SEQ ID NO: 180343 - protein, 13 aa, Mycobacterium tuberculosis
SGFFNTGAGGGSG

SEQ ID NO: 180344 - protein, 13 aa, Mycobacterium tuberculosis
GFFNTGAGGGSGF

SEQ ID NO: 180345 - protein, 13 aa, Mycobacterium tuberculosis
FFNTGAGGGSGFG

SEQ ID NO: 180346 - protein, 13 aa, Mycobacterium tuberculosis
FNTGAGGGSGFGN

SEQ ID NO: 180347 - protein, 13 aa, Mycobacterium tuberculosis
NTGAGGGSGFGNF

SEQ ID NO: 180348 - protein, 13 aa, Mycobacterium tuberculosis
TGAGGGSGFGNFG

SEQ ID NO: 180349 - protein, 13 aa, Mycobacterium tuberculosis
GAGGGSGFGNFGA

SEQ ID NO: 180350 - protein, 13 aa, Mycobacterium tuberculosis
AGGGSGFGNFGAN

SEQ ID NO: 180351 - protein, 13 aa, Mycobacterium tuberculosis
GGGSGFGNFGANM

SEQ ID NO: 180352 - protein, 13 aa, Mycobacterium tuberculosis
GGSGFGNFGANMS

SEQ ID NO: 180353 - protein, 13 aa, Mycobacterium tuberculosis
GSGFGNFGANMSG

SEQ ID NO: 180354 - protein, 13 aa, Mycobacterium tuberculosis
SGFGNFGANMSGW

SEQ ID NO: 180355 - protein, 13 aa, Mycobacterium tuberculosis
GFGNFGANMSGWW

SEQ ID NO: 180356 - protein, 13 aa, Mycobacterium tuberculosis
FGNFGANMSGWWN

SEQ ID NO: 180357 - protein, 13 aa, Mycobacterium tuberculosis
GNFGANMSGWWNQ

SEQ ID NO: 180358 - protein, 13 aa, Mycobacterium tuberculosis
NFGANMSGWWNQA

SEQ ID NO: 180359 - protein, 13 aa, Mycobacterium tuberculosis
FGANMSGWWNQAH

SEQ ID NO: 180360 - protein, 13 aa, Mycobacterium tuberculosis
GANMSGWWNQAHT

SEQ ID NO: 180361 - protein, 13 aa, Mycobacterium tuberculosis
ANMSGWWNQAHTA

SEQ ID NO: 180362 - protein, 13 aa, Mycobacterium tuberculosis
NMSGWWNQAHTAL

SEQ ID NO: 180363 - protein, 13 aa, Mycobacterium tuberculosis
MSGWWNQAHTALA

SEQ ID NO: 180364 - protein, 13 aa, Mycobacterium tuberculosis
SGWWNQAHTALAG

SEQ ID NO: 180365 - protein, 13 aa, Mycobacterium tuberculosis
GWWNQAHTALAGA

SEQ ID NO: 180366 - protein, 13 aa, Mycobacterium tuberculosis
WWNQAHTALAGAG

SEQ ID NO: 180367 - protein, 13 aa, Mycobacterium tuberculosis
WNQAHTALAGAGS

SEQ ID NO: 180368 - protein, 13 aa, Mycobacterium tuberculosis
NQAHTALAGAGSG

SEQ ID NO: 180369 - protein, 13 aa, Mycobacterium tuberculosis
QAHTALAGAGSGI

SEQ ID NO: 180370 - protein, 13 aa, Mycobacterium tuberculosis
AHTALAGAGSGIA

SEQ ID NO: 180371 - protein, 13 aa, Mycobacterium tuberculosis
HTALAGAGSGIAN

SEQ ID NO: 180372 - protein, 13 aa, Mycobacterium tuberculosis
TALAGAGSGIANV

SEQ ID NO: 180373 - protein, 13 aa, Mycobacterium tuberculosis
ALAGAGSGIANVG

SEQ ID NO: 180374 - protein, 13 aa, Mycobacterium tuberculosis
LAGAGSGIANVGT

SEQ ID NO: 180375 - protein, 13 aa, Mycobacterium tuberculosis
AGAGSGIANVGTL

SEQ ID NO: 180376 - protein, 13 aa, Mycobacterium tuberculosis
GAGSGIANVGTLH

SEQ ID NO: 180377 - protein, 13 aa, Mycobacterium tuberculosis
AGSGIANVGTLHS

SEQ ID NO: 180378 - protein, 13 aa, Mycobacterium tuberculosis
GSGIANVGTLHSG

SEQ ID NO: 180379 - protein, 13 aa, Mycobacterium tuberculosis
SGIANVGTLHSGV

SEQ ID NO: 180380 - protein, 13 aa, Mycobacterium tuberculosis
GIANVGTLHSGVL

SEQ ID NO: 180381 - protein, 13 aa, Mycobacterium tuberculosis
IANVGTLHSGVLN

SEQ ID NO: 180382 - protein, 13 aa, Mycobacterium tuberculosis
ANVGTLHSGVLNL

SEQ ID NO: 180383 - protein, 13 aa, Mycobacterium tuberculosis
NVGTLHSGVLNLG

SEQ ID NO: 180384 - protein, 13 aa, Mycobacterium tuberculosis
VGTLHSGVLNLGS

SEQ ID NO: 180385 - protein, 13 aa, Mycobacterium tuberculosis
GTLHSGVLNLGSG

SEQ ID NO: 180386 - protein, 13 aa, Mycobacterium tuberculosis
TLHSGVLNLGSGL

SEQ ID NO: 180387 - protein, 13 aa, Mycobacterium tuberculosis
LHSGVLNLGSGLS

SEQ ID NO: 180388 - protein, 13 aa, Mycobacterium tuberculosis
HSGVLNLGSGLSG

SEQ ID NO: 180389 - protein, 13 aa, Mycobacterium tuberculosis
SGVLNLGSGLSGI

SEQ ID NO: 180390 - protein, 13 aa, Mycobacterium tuberculosis
GVLNLGSGLSGIY

SEQ ID NO: 180391 - protein, 13 aa, Mycobacterium tuberculosis
VLNLGSGLSGIYN

SEQ ID NO: 180392 - protein, 13 aa, Mycobacterium tuberculosis
LNLGSGLSGIYNT

SEQ ID NO: 180393 - protein, 13 aa, Mycobacterium tuberculosis
NLGSGLSGIYNTS

SEQ ID NO: 180394 - protein, 13 aa, Mycobacterium tuberculosis
LGSGLSGIYNTST

SEQ ID NO: 180395 - protein, 13 aa, Mycobacterium tuberculosis
GSGLSGIYNTSTL

SEQ ID NO: 180396 - protein, 13 aa, Mycobacterium tuberculosis
SGLSGIYNTSTLP

SEQ ID NO: 180397 - protein, 13 aa, Mycobacterium tuberculosis
GLSGIYNTSTLPL

SEQ ID NO: 180398 - protein, 13 aa, Mycobacterium tuberculosis
LSGIYNTSTLPLG

SEQ ID NO: 180399 - protein, 13 aa, Mycobacterium tuberculosis
SGIYNTSTLPLGT

SEQ ID NO: 180400 - protein, 13 aa, Mycobacterium tuberculosis
GIYNTSTLPLGTP

SEQ ID NO: 180401 - protein, 13 aa, Mycobacterium tuberculosis
IYNTSTLPLGTPA

SEQ ID NO: 180402 - protein, 13 aa, Mycobacterium tuberculosis
YNTSTLPLGTPAL

SEQ ID NO: 180403 - protein, 13 aa, Mycobacterium tuberculosis
NTSTLPLGTPALV

SEQ ID NO: 180404 - protein, 13 aa, Mycobacterium tuberculosis
TSTLPLGTPALVS

SEQ ID NO: 180405 - protein, 13 aa, Mycobacterium tuberculosis
STLPLGTPALVSG

SEQ ID NO: 180406 - protein, 13 aa, Mycobacterium tuberculosis
TLPLGTPALVSGL

SEQ ID NO: 180407 - protein, 13 aa, Mycobacterium tuberculosis
LPLGTPALVSGLG

SEQ ID NO: 180408 - protein, 13 aa, Mycobacterium tuberculosis
PLGTPALVSGLGN

SEQ ID NO: 180409 - protein, 13 aa, Mycobacterium tuberculosis
LGTPALVSGLGNV

SEQ ID NO: 180410 - protein, 13 aa, Mycobacterium tuberculosis
GTPALVSGLGNVG

SEQ ID NO: 180411 - protein, 13 aa, Mycobacterium tuberculosis
TPALVSGLGNVGD

SEQ ID NO: 180412 - protein, 13 aa, Mycobacterium tuberculosis
PALVSGLGNVGDH

SEQ ID NO: 180413 - protein, 13 aa, Mycobacterium tuberculosis
ALVSGLGNVGDHL

SEQ ID NO: 180414 - protein, 13 aa, Mycobacterium tuberculosis
LVSGLGNVGDHLS

SEQ ID NO: 180415 - protein, 13 aa, Mycobacterium tuberculosis
VSGLGNVGDHLSG

SEQ ID NO: 180416 - protein, 13 aa, Mycobacterium tuberculosis
SGLGNVGDHLSGL

SEQ ID NO: 180417 - protein, 13 aa, Mycobacterium tuberculosis
GLGNVGDHLSGLL

SEQ ID NO: 180418 - protein, 13 aa, Mycobacterium tuberculosis
LGNVGDHLSGLLA

SEQ ID NO: 180419 - protein, 13 aa, Mycobacterium tuberculosis
GNVGDHLSGLLAS

SEQ ID NO: 180420 - protein, 13 aa, Mycobacterium tuberculosis
NVGDHLSGLLASN

SEQ ID NO: 180421 - protein, 13 aa, Mycobacterium tuberculosis
VGDHLSGLLASNV

SEQ ID NO: 180422 - protein, 13 aa, Mycobacterium tuberculosis
GDHLSGLLASNVG

SEQ ID NO: 180423 - protein, 13 aa, Mycobacterium tuberculosis
DHLSGLLASNVGQ

SEQ ID NO: 180424 - protein, 13 aa, Mycobacterium tuberculosis
HLSGLLASNVGQN

SEQ ID NO: 180425 - protein, 13 aa, Mycobacterium tuberculosis
LSGLLASNVGQNP

SEQ ID NO: 180426 - protein, 13 aa, Mycobacterium tuberculosis
SGLLASNVGQNPI

SEQ ID NO: 180427 - protein, 13 aa, Mycobacterium tuberculosis
GLLASNVGQNPIT

SEQ ID NO: 180428 - protein, 13 aa, Mycobacterium tuberculosis
LLASNVGQNPITI

SEQ ID NO: 180429 - protein, 13 aa, Mycobacterium tuberculosis
LASNVGQNPITIV

SEQ ID NO: 180430 - protein, 13 aa, Mycobacterium tuberculosis
ASNVGQNPITIVN

SEQ ID NO: 180431 - protein, 13 aa, Mycobacterium tuberculosis
SNVGQNPITIVNI

SEQ ID NO: 180432 - protein, 13 aa, Mycobacterium tuberculosis
NVGQNPITIVNIG

SEQ ID NO: 180433 - protein, 13 aa, Mycobacterium tuberculosis
VGQNPITIVNIGL

SEQ ID NO: 180434 - protein, 13 aa, Mycobacterium tuberculosis
GQNPITIVNIGLA

SEQ ID NO: 180435 - protein, 13 aa, Mycobacterium tuberculosis
QNPITIVNIGLAN

SEQ ID NO: 180436 - protein, 13 aa, Mycobacterium tuberculosis
NPITIVNIGLANV

SEQ ID NO: 180437 - protein, 13 aa, Mycobacterium tuberculosis
PITIVNIGLANVG

SEQ ID NO: 180438 - protein, 13 aa, Mycobacterium tuberculosis
ITIVNIGLANVGN

SEQ ID NO: 180439 - protein, 13 aa, Mycobacterium tuberculosis
TIVNIGLANVGNG

SEQ ID NO: 180440 - protein, 13 aa, Mycobacterium tuberculosis
IVNIGLANVGNGN

SEQ ID NO: 180441 - protein, 13 aa, Mycobacterium tuberculosis
VNIGLANVGNGNV

SEQ ID NO: 180442 - protein, 13 aa, Mycobacterium tuberculosis
NIGLANVGNGNVG

SEQ ID NO: 180443 - protein, 13 aa, Mycobacterium tuberculosis
IGLANVGNGNVGL

SEQ ID NO: 180444 - protein, 13 aa, Mycobacterium tuberculosis
GLANVGNGNVGLG

SEQ ID NO: 180445 - protein, 13 aa, Mycobacterium tuberculosis
LANVGNGNVGLGN

SEQ ID NO: 180446 - protein, 13 aa, Mycobacterium tuberculosis
ANVGNGNVGLGNI

SEQ ID NO: 180447 - protein, 13 aa, Mycobacterium tuberculosis
NVGNGNVGLGNIG

SEQ ID NO: 180448 - protein, 13 aa, Mycobacterium tuberculosis
VGNGNVGLGNIGN

SEQ ID NO: 180449 - protein, 13 aa, Mycobacterium tuberculosis
GNGNVGLGNIGNL

SEQ ID NO: 180450 - protein, 13 aa, Mycobacterium tuberculosis
NGNVGLGNIGNLN

SEQ ID NO: 180451 - protein, 13 aa, Mycobacterium tuberculosis
GNVGLGNIGNLNL

SEQ ID NO: 180452 - protein, 13 aa, Mycobacterium tuberculosis
NVGLGNIGNLNLG

SEQ ID NO: 180453 - protein, 13 aa, Mycobacterium tuberculosis
VGLGNIGNLNLGA

SEQ ID NO: 180454 - protein, 13 aa, Mycobacterium tuberculosis
GLGNIGNLNLGAA

SEQ ID NO: 180455 - protein, 13 aa, Mycobacterium tuberculosis
LGNIGNLNLGAAN

SEQ ID NO: 180456 - protein, 13 aa, Mycobacterium tuberculosis
GNIGNLNLGAANI

SEQ ID NO: 180457 - protein, 13 aa, Mycobacterium tuberculosis
NIGNLNLGAANIG

SEQ ID NO: 180458 - protein, 13 aa, Mycobacterium tuberculosis
IGNLNLGAANIGD

SEQ ID NO: 180459 - protein, 13 aa, Mycobacterium tuberculosis
GNLNLGAANIGDV

SEQ ID NO: 180460 - protein, 13 aa, Mycobacterium tuberculosis
NLNLGAANIGDVN

SEQ ID NO: 180461 - protein, 13 aa, Mycobacterium tuberculosis
LNLGAANIGDVNL

SEQ ID NO: 180462 - protein, 13 aa, Mycobacterium tuberculosis
NLGAANIGDVNLG

SEQ ID NO: 180463 - protein, 13 aa, Mycobacterium tuberculosis
LGAANIGDVNLGF

SEQ ID NO: 180464 - protein, 13 aa, Mycobacterium tuberculosis
GAANIGDVNLGFG

SEQ ID NO: 180465 - protein, 13 aa, Mycobacterium tuberculosis
AANIGDVNLGFGN

SEQ ID NO: 180466 - protein, 13 aa, Mycobacterium tuberculosis
ANIGDVNLGFGNI

SEQ ID NO: 180467 - protein, 13 aa, Mycobacterium tuberculosis
NIGDVNLGFGNIG

SEQ ID NO: 180468 - protein, 13 aa, Mycobacterium tuberculosis
IGDVNLGFGNIGD

SEQ ID NO: 180469 - protein, 13 aa, Mycobacterium tuberculosis
GDVNLGFGNIGDV

SEQ ID NO: 180470 - protein, 13 aa, Mycobacterium tuberculosis
DVNLGFGNIGDVN

SEQ ID NO: 180471 - protein, 13 aa, Mycobacterium tuberculosis
VNLGFGNIGDVNL

SEQ ID NO: 180472 - protein, 13 aa, Mycobacterium tuberculosis
NLGFGNIGDVNLG

SEQ ID NO: 180473 - protein, 13 aa, Mycobacterium tuberculosis
LGFGNIGDVNLGF

SEQ ID NO: 180474 - protein, 13 aa, Mycobacterium tuberculosis
GFGNIGDVNLGFG

SEQ ID NO: 180475 - protein, 13 aa, Mycobacterium tuberculosis
FGNIGDVNLGFGN

SEQ ID NO: 180476 - protein, 13 aa, Mycobacterium tuberculosis
GNIGDVNLGFGNI

SEQ ID NO: 180477 - protein, 13 aa, Mycobacterium tuberculosis
NIGDVNLGFGNIG

SEQ ID NO: 180478 - protein, 13 aa, Mycobacterium tuberculosis
IGDVNLGFGNIGG

SEQ ID NO: 180479 - protein, 13 aa, Mycobacterium tuberculosis
GDVNLGFGNIGGG

SEQ ID NO: 180480 - protein, 13 aa, Mycobacterium tuberculosis
DVNLGFGNIGGGN

SEQ ID NO: 180481 - protein, 13 aa, Mycobacterium tuberculosis
VNLGFGNIGGGNV

SEQ ID NO: 180482 - protein, 13 aa, Mycobacterium tuberculosis
NLGFGNIGGGNVG

SEQ ID NO: 180483 - protein, 13 aa, Mycobacterium tuberculosis
LGFGNIGGGNVGF

SEQ ID NO: 180484 - protein, 13 aa, Mycobacterium tuberculosis
GFGNIGGGNVGFG

SEQ ID NO: 180485 - protein, 13 aa, Mycobacterium tuberculosis
FGNIGGGNVGFGN

SEQ ID NO: 180486 - protein, 13 aa, Mycobacterium tuberculosis
GNIGGGNVGFGNI

SEQ ID NO: 180487 - protein, 13 aa, Mycobacterium tuberculosis
NIGGGNVGFGNIG

SEQ ID NO: 180488 - protein, 13 aa, Mycobacterium tuberculosis
IGGGNVGFGNIGD

SEQ ID NO: 180489 - protein, 13 aa, Mycobacterium tuberculosis
GGGNVGFGNIGDA

SEQ ID NO: 180490 - protein, 13 aa, Mycobacterium tuberculosis
GGNVGFGNIGDAN

SEQ ID NO: 180491 - protein, 13 aa, Mycobacterium tuberculosis
GNVGFGNIGDANF

SEQ ID NO: 180492 - protein, 13 aa, Mycobacterium tuberculosis
NVGFGNIGDANFG

SEQ ID NO: 180493 - protein, 13 aa, Mycobacterium tuberculosis
VGFGNIGDANFGF

SEQ ID NO: 180494 - protein, 13 aa, Mycobacterium tuberculosis
GFGNIGDANFGFG

SEQ ID NO: 180495 - protein, 13 aa, Mycobacterium tuberculosis
FGNIGDANFGFGN

SEQ ID NO: 180496 - protein, 13 aa, Mycobacterium tuberculosis
GNIGDANFGFGNS

SEQ ID NO: 180497 - protein, 13 aa, Mycobacterium tuberculosis
NIGDANFGFGNSG

SEQ ID NO: 180498 - protein, 13 aa, Mycobacterium tuberculosis
IGDANFGFGNSGL

SEQ ID NO: 180499 - protein, 13 aa, Mycobacterium tuberculosis
GDANFGFGNSGLA

SEQ ID NO: 180500 - protein, 13 aa, Mycobacterium tuberculosis
DANFGFGNSGLAA

SEQ ID NO: 180501 - protein, 13 aa, Mycobacterium tuberculosis
ANFGFGNSGLAAG

SEQ ID NO: 180502 - protein, 13 aa, Mycobacterium tuberculosis
NFGFGNSGLAAGL

SEQ ID NO: 180503 - protein, 13 aa, Mycobacterium tuberculosis
FGFGNSGLAAGLA

SEQ ID NO: 180504 - protein, 13 aa, Mycobacterium tuberculosis
GFGNSGLAAGLAG

SEQ ID NO: 180505 - protein, 13 aa, Mycobacterium tuberculosis
FGNSGLAAGLAGM

SEQ ID NO: 180506 - protein, 13 aa, Mycobacterium tuberculosis
GNSGLAAGLAGMG

SEQ ID NO: 180507 - protein, 13 aa, Mycobacterium tuberculosis
NSGLAAGLAGMGN

SEQ ID NO: 180508 - protein, 13 aa, Mycobacterium tuberculosis
SGLAAGLAGMGNI

SEQ ID NO: 180509 - protein, 13 aa, Mycobacterium tuberculosis
GLAAGLAGMGNIG

SEQ ID NO: 180510 - protein, 13 aa, Mycobacterium tuberculosis
LAAGLAGMGNIGL

SEQ ID NO: 180511 - protein, 13 aa, Mycobacterium tuberculosis
AAGLAGMGNIGLG

SEQ ID NO: 180512 - protein, 13 aa, Mycobacterium tuberculosis
AGLAGMGNIGLGN

SEQ ID NO: 180513 - protein, 13 aa, Mycobacterium tuberculosis
GLAGMGNIGLGNA

SEQ ID NO: 180514 - protein, 13 aa, Mycobacterium tuberculosis
LAGMGNIGLGNAG

SEQ ID NO: 180515 - protein, 13 aa, Mycobacterium tuberculosis
AGMGNIGLGNAGS

SEQ ID NO: 180516 - protein, 13 aa, Mycobacterium tuberculosis
GMGNIGLGNAGSG

SEQ ID NO: 180517 - protein, 13 aa, Mycobacterium tuberculosis
MGNIGLGNAGSGN

SEQ ID NO: 180518 - protein, 13 aa, Mycobacterium tuberculosis
GNIGLGNAGSGNV

SEQ ID NO: 180519 - protein, 13 aa, Mycobacterium tuberculosis
NIGLGNAGSGNVG

SEQ ID NO: 180520 - protein, 13 aa, Mycobacterium tuberculosis
IGLGNAGSGNVGW

SEQ ID NO: 180521 - protein, 13 aa, Mycobacterium tuberculosis
GLGNAGSGNVGWA

SEQ ID NO: 180522 - protein, 13 aa, Mycobacterium tuberculosis
LGNAGSGNVGWAN

SEQ ID NO: 180523 - protein, 13 aa, Mycobacterium tuberculosis
GNAGSGNVGWANM

SEQ ID NO: 180524 - protein, 13 aa, Mycobacterium tuberculosis
NAGSGNVGWANMG

SEQ ID NO: 180525 - protein, 13 aa, Mycobacterium tuberculosis
AGSGNVGWANMGL

SEQ ID NO: 180526 - protein, 13 aa, Mycobacterium tuberculosis
GSGNVGWANMGLG

SEQ ID NO: 180527 - protein, 13 aa, Mycobacterium tuberculosis
SGNVGWANMGLGN

SEQ ID NO: 180528 - protein, 13 aa, Mycobacterium tuberculosis
GNVGWANMGLGNI

SEQ ID NO: 180529 - protein, 13 aa, Mycobacterium tuberculosis
NVGWANMGLGNIG

SEQ ID NO: 180530 - protein, 13 aa, Mycobacterium tuberculosis
VGWANMGLGNIGF

SEQ ID NO: 180531 - protein, 13 aa, Mycobacterium tuberculosis
GWANMGLGNIGFG

SEQ ID NO: 180532 - protein, 13 aa, Mycobacterium tuberculosis
WANMGLGNIGFGN

SEQ ID NO: 180533 - protein, 13 aa, Mycobacterium tuberculosis
ANMGLGNIGFGNT

SEQ ID NO: 180534 - protein, 13 aa, Mycobacterium tuberculosis
NMGLGNIGFGNTG

SEQ ID NO: 180535 - protein, 13 aa, Mycobacterium tuberculosis
MGLGNIGFGNTGT

SEQ ID NO: 180536 - protein, 13 aa, Mycobacterium tuberculosis
GLGNIGFGNTGTN

SEQ ID NO: 180537 - protein, 13 aa, Mycobacterium tuberculosis
LGNIGFGNTGTNN

SEQ ID NO: 180538 - protein, 13 aa, Mycobacterium tuberculosis
GNIGFGNTGTNNL

SEQ ID NO: 180539 - protein, 13 aa, Mycobacterium tuberculosis
NIGFGNTGTNNLG

SEQ ID NO: 180540 - protein, 13 aa, Mycobacterium tuberculosis
IGFGNTGTNNLGI

SEQ ID NO: 180541 - protein, 13 aa, Mycobacterium tuberculosis
GFGNTGTNNLGIG

SEQ ID NO: 180542 - protein, 13 aa, Mycobacterium tuberculosis
FGNTGTNNLGIGL

SEQ ID NO: 180543 - protein, 13 aa, Mycobacterium tuberculosis
GNTGTNNLGIGLT

SEQ ID NO: 180544 - protein, 13 aa, Mycobacterium tuberculosis
NTGTNNLGIGLTG

SEQ ID NO: 180545 - protein, 13 aa, Mycobacterium tuberculosis
TGTNNLGIGLTGD

SEQ ID NO: 180546 - protein, 13 aa, Mycobacterium tuberculosis
GTNNLGIGLTGDN

SEQ ID NO: 180547 - protein, 13 aa, Mycobacterium tuberculosis
TNNLGIGLTGDNQ

SEQ ID NO: 180548 - protein, 13 aa, Mycobacterium tuberculosis
NNLGIGLTGDNQS

SEQ ID NO: 180549 - protein, 13 aa, Mycobacterium tuberculosis
NLGIGLTGDNQSG

SEQ ID NO: 180550 - protein, 13 aa, Mycobacterium tuberculosis
LGIGLTGDNQSGI

SEQ ID NO: 180551 - protein, 13 aa, Mycobacterium tuberculosis
GIGLTGDNQSGIG

SEQ ID NO: 180552 - protein, 13 aa, Mycobacterium tuberculosis
IGLTGDNQSGIGG

SEQ ID NO: 180553 - protein, 13 aa, Mycobacterium tuberculosis
GLTGDNQSGIGGL

SEQ ID NO: 180554 - protein, 13 aa, Mycobacterium tuberculosis
LTGDNQSGIGGLN

SEQ ID NO: 180555 - protein, 13 aa, Mycobacterium tuberculosis
TGDNQSGIGGLNS

SEQ ID NO: 180556 - protein, 13 aa, Mycobacterium tuberculosis
GDNQSGIGGLNSG

SEQ ID NO: 180557 - protein, 13 aa, Mycobacterium tuberculosis
DNQSGIGGLNSGT

SEQ ID NO: 180558 - protein, 13 aa, Mycobacterium tuberculosis
NQSGIGGLNSGTG

SEQ ID NO: 180559 - protein, 13 aa, Mycobacterium tuberculosis
QSGIGGLNSGTGN

SEQ ID NO: 180560 - protein, 13 aa, Mycobacterium tuberculosis
SGIGGLNSGTGNI

SEQ ID NO: 180561 - protein, 13 aa, Mycobacterium tuberculosis
GIGGLNSGTGNIG

SEQ ID NO: 180562 - protein, 13 aa, Mycobacterium tuberculosis
IGGLNSGTGNIGL

SEQ ID NO: 180563 - protein, 13 aa, Mycobacterium tuberculosis
GGLNSGTGNIGLF

SEQ ID NO: 180564 - protein, 13 aa, Mycobacterium tuberculosis
GLNSGTGNIGLFN

SEQ ID NO: 180565 - protein, 13 aa, Mycobacterium tuberculosis
LNSGTGNIGLFNS

SEQ ID NO: 180566 - protein, 13 aa, Mycobacterium tuberculosis
NSGTGNIGLFNSG

SEQ ID NO: 180567 - protein, 13 aa, Mycobacterium tuberculosis
SGTGNIGLFNSGT

SEQ ID NO: 180568 - protein, 13 aa, Mycobacterium tuberculosis
GTGNIGLFNSGTG

SEQ ID NO: 180569 - protein, 13 aa, Mycobacterium tuberculosis
TGNIGLFNSGTGN

SEQ ID NO: 180570 - protein, 13 aa, Mycobacterium tuberculosis
GNIGLFNSGTGNI

SEQ ID NO: 180571 - protein, 13 aa, Mycobacterium tuberculosis
NIGLFNSGTGNIG

SEQ ID NO: 180572 - protein, 13 aa, Mycobacterium tuberculosis
IGLFNSGTGNIGF

SEQ ID NO: 180573 - protein, 13 aa, Mycobacterium tuberculosis
GLFNSGTGNIGFF

SEQ ID NO: 180574 - protein, 13 aa, Mycobacterium tuberculosis
LFNSGTGNIGFFN

SEQ ID NO: 180575 - protein, 13 aa, Mycobacterium tuberculosis
FNSGTGNIGFFNS

SEQ ID NO: 180576 - protein, 13 aa, Mycobacterium tuberculosis
NSGTGNIGFFNSG

SEQ ID NO: 180577 - protein, 13 aa, Mycobacterium tuberculosis
SGTGNIGFFNSGT

SEQ ID NO: 180578 - protein, 13 aa, Mycobacterium tuberculosis
GTGNIGFFNSGTA

SEQ ID NO: 180579 - protein, 13 aa, Mycobacterium tuberculosis
TGNIGFFNSGTAN

SEQ ID NO: 180580 - protein, 13 aa, Mycobacterium tuberculosis
GNIGFFNSGTANF

SEQ ID NO: 180581 - protein, 13 aa, Mycobacterium tuberculosis
NIGFFNSGTANFG

SEQ ID NO: 180582 - protein, 13 aa, Mycobacterium tuberculosis
IGFFNSGTANFGL

SEQ ID NO: 180583 - protein, 13 aa, Mycobacterium tuberculosis
GFFNSGTANFGLF

SEQ ID NO: 180584 - protein, 13 aa, Mycobacterium tuberculosis
FFNSGTANFGLFN

SEQ ID NO: 180585 - protein, 13 aa, Mycobacterium tuberculosis
FNSGTANFGLFNS

SEQ ID NO: 180586 - protein, 13 aa, Mycobacterium tuberculosis
NSGTANFGLFNSG

SEQ ID NO: 180587 - protein, 13 aa, Mycobacterium tuberculosis
SGTANFGLFNSGS

SEQ ID NO: 180588 - protein, 13 aa, Mycobacterium tuberculosis
GTANFGLFNSGSY

SEQ ID NO: 180589 - protein, 13 aa, Mycobacterium tuberculosis
TANFGLFNSGSYN

SEQ ID NO: 180590 - protein, 13 aa, Mycobacterium tuberculosis
ANFGLFNSGSYNT

SEQ ID NO: 180591 - protein, 13 aa, Mycobacterium tuberculosis
NFGLFNSGSYNTG

SEQ ID NO: 180592 - protein, 13 aa, Mycobacterium tuberculosis
FGLFNSGSYNTGI

SEQ ID NO: 180593 - protein, 13 aa, Mycobacterium tuberculosis
GLFNSGSYNTGIG

SEQ ID NO: 180594 - protein, 13 aa, Mycobacterium tuberculosis
LFNSGSYNTGIGN

SEQ ID NO: 180595 - protein, 13 aa, Mycobacterium tuberculosis
FNSGSYNTGIGNS

SEQ ID NO: 180596 - protein, 13 aa, Mycobacterium tuberculosis
NSGSYNTGIGNSG

SEQ ID NO: 180597 - protein, 13 aa, Mycobacterium tuberculosis
SGSYNTGIGNSGV

SEQ ID NO: 180598 - protein, 13 aa, Mycobacterium tuberculosis
GSYNTGIGNSGVA

SEQ ID NO: 180599 - protein, 13 aa, Mycobacterium tuberculosis
SYNTGIGNSGVAS

SEQ ID NO: 180600 - protein, 13 aa, Mycobacterium tuberculosis
YNTGIGNSGVAST

SEQ ID NO: 180601 - protein, 13 aa, Mycobacterium tuberculosis
NTGIGNSGVASTG

SEQ ID NO: 180602 - protein, 13 aa, Mycobacterium tuberculosis
TGIGNSGVASTGL

SEQ ID NO: 180603 - protein, 13 aa, Mycobacterium tuberculosis
GIGNSGVASTGLV

SEQ ID NO: 180604 - protein, 13 aa, Mycobacterium tuberculosis
IGNSGVASTGLVN

SEQ ID NO: 180605 - protein, 13 aa, Mycobacterium tuberculosis
GNSGVASTGLVNA

SEQ ID NO: 180606 - protein, 13 aa, Mycobacterium tuberculosis
NSGVASTGLVNAG

SEQ ID NO: 180607 - protein, 13 aa, Mycobacterium tuberculosis
SGVASTGLVNAGG

SEQ ID NO: 180608 - protein, 13 aa, Mycobacterium tuberculosis
GVASTGLVNAGGF

SEQ ID NO: 180609 - protein, 13 aa, Mycobacterium tuberculosis
VASTGLVNAGGFN

SEQ ID NO: 180610 - protein, 13 aa, Mycobacterium tuberculosis
ASTGLVNAGGFNT

SEQ ID NO: 180611 - protein, 13 aa, Mycobacterium tuberculosis
STGLVNAGGFNTG

SEQ ID NO: 180612 - protein, 13 aa, Mycobacterium tuberculosis
TGLVNAGGFNTGV

SEQ ID NO: 180613 - protein, 13 aa, Mycobacterium tuberculosis
GLVNAGGFNTGVA

SEQ ID NO: 180614 - protein, 13 aa, Mycobacterium tuberculosis
LVNAGGFNTGVAN

SEQ ID NO: 180615 - protein, 13 aa, Mycobacterium tuberculosis
VNAGGFNTGVANA

SEQ ID NO: 180616 - protein, 13 aa, Mycobacterium tuberculosis
NAGGFNTGVANAG

SEQ ID NO: 180617 - protein, 13 aa, Mycobacterium tuberculosis
AGGFNTGVANAGS

SEQ ID NO: 180618 - protein, 13 aa, Mycobacterium tuberculosis
GGFNTGVANAGSY

SEQ ID NO: 180619 - protein, 13 aa, Mycobacterium tuberculosis
GFNTGVANAGSYN

SEQ ID NO: 180620 - protein, 13 aa, Mycobacterium tuberculosis
FNTGVANAGSYNT

SEQ ID NO: 180621 - protein, 13 aa, Mycobacterium tuberculosis
NTGVANAGSYNTG

SEQ ID NO: 180622 - protein, 13 aa, Mycobacterium tuberculosis
TGVANAGSYNTGS

SEQ ID NO: 180623 - protein, 13 aa, Mycobacterium tuberculosis
GVANAGSYNTGSF

SEQ ID NO: 180624 - protein, 13 aa, Mycobacterium tuberculosis
VANAGSYNTGSFN

SEQ ID NO: 180625 - protein, 13 aa, Mycobacterium tuberculosis
ANAGSYNTGSFNA

SEQ ID NO: 180626 - protein, 13 aa, Mycobacterium tuberculosis
NAGSYNTGSFNAG

SEQ ID NO: 180627 - protein, 13 aa, Mycobacterium tuberculosis
AGSYNTGSFNAGD

SEQ ID NO: 180628 - protein, 13 aa, Mycobacterium tuberculosis
GSYNTGSFNAGDT

SEQ ID NO: 180629 - protein, 13 aa, Mycobacterium tuberculosis
SYNTGSFNAGDTN

SEQ ID NO: 180630 - protein, 13 aa, Mycobacterium tuberculosis
YNTGSFNAGDTNT

SEQ ID NO: 180631 - protein, 13 aa, Mycobacterium tuberculosis
NTGSFNAGDTNTG

SEQ ID NO: 180632 - protein, 13 aa, Mycobacterium tuberculosis
TGSFNAGDTNTGG

SEQ ID NO: 180633 - protein, 13 aa, Mycobacterium tuberculosis
GSFNAGDTNTGGF

SEQ ID NO: 180634 - protein, 13 aa, Mycobacterium tuberculosis
SFNAGDTNTGGFN

SEQ ID NO: 180635 - protein, 13 aa, Mycobacterium tuberculosis
FNAGDTNTGGFNP

SEQ ID NO: 180636 - protein, 13 aa, Mycobacterium tuberculosis
NAGDTNTGGFNPG

SEQ ID NO: 180637 - protein, 13 aa, Mycobacterium tuberculosis
AGDTNTGGFNPGS

SEQ ID NO: 180638 - protein, 13 aa, Mycobacterium tuberculosis
GDTNTGGFNPGST

SEQ ID NO: 180639 - protein, 13 aa, Mycobacterium tuberculosis
DTNTGGFNPGSTN

SEQ ID NO: 180640 - protein, 13 aa, Mycobacterium tuberculosis
TNTGGFNPGSTNT

SEQ ID NO: 180641 - protein, 13 aa, Mycobacterium tuberculosis
NTGGFNPGSTNTG

SEQ ID NO: 180642 - protein, 13 aa, Mycobacterium tuberculosis
TGGFNPGSTNTGW

SEQ ID NO: 180643 - protein, 13 aa, Mycobacterium tuberculosis
GGFNPGSTNTGWF

SEQ ID NO: 180644 - protein, 13 aa, Mycobacterium tuberculosis
GFNPGSTNTGWFN

SEQ ID NO: 180645 - protein, 13 aa, Mycobacterium tuberculosis
FNPGSTNTGWFNT

SEQ ID NO: 180646 - protein, 13 aa, Mycobacterium tuberculosis
NPGSTNTGWFNTG

SEQ ID NO: 180647 - protein, 13 aa, Mycobacterium tuberculosis
PGSTNTGWFNTGN

SEQ ID NO: 180648 - protein, 13 aa, Mycobacterium tuberculosis
GSTNTGWFNTGNA

SEQ ID NO: 180649 - protein, 13 aa, Mycobacterium tuberculosis
STNTGWFNTGNAN

SEQ ID NO: 180650 - protein, 13 aa, Mycobacterium tuberculosis
TNTGWFNTGNANT

SEQ ID NO: 180651 - protein, 13 aa, Mycobacterium tuberculosis
NTGWFNTGNANTG

SEQ ID NO: 180652 - protein, 13 aa, Mycobacterium tuberculosis
TGWFNTGNANTGV

SEQ ID NO: 180653 - protein, 13 aa, Mycobacterium tuberculosis
GWFNTGNANTGVA

SEQ ID NO: 180654 - protein, 13 aa, Mycobacterium tuberculosis
WFNTGNANTGVAN

SEQ ID NO: 180655 - protein, 13 aa, Mycobacterium tuberculosis
FNTGNANTGVANA

SEQ ID NO: 180656 - protein, 13 aa, Mycobacterium tuberculosis
NTGNANTGVANAG

SEQ ID NO: 180657 - protein, 13 aa, Mycobacterium tuberculosis
TGNANTGVANAGN

SEQ ID NO: 180658 - protein, 13 aa, Mycobacterium tuberculosis
GNANTGVANAGNV

SEQ ID NO: 180659 - protein, 13 aa, Mycobacterium tuberculosis
NANTGVANAGNVN

SEQ ID NO: 180660 - protein, 13 aa, Mycobacterium tuberculosis
ANTGVANAGNVNT

SEQ ID NO: 180661 - protein, 13 aa, Mycobacterium tuberculosis
NTGVANAGNVNTG

SEQ ID NO: 180662 - protein, 13 aa, Mycobacterium tuberculosis
TGVANAGNVNTGA

SEQ ID NO: 180663 - protein, 13 aa, Mycobacterium tuberculosis
GVANAGNVNTGAL

SEQ ID NO: 180664 - protein, 13 aa, Mycobacterium tuberculosis
VANAGNVNTGALI

SEQ ID NO: 180665 - protein, 13 aa, Mycobacterium tuberculosis
ANAGNVNTGALIT

SEQ ID NO: 180666 - protein, 13 aa, Mycobacterium tuberculosis
NAGNVNTGALITG

SEQ ID NO: 180667 - protein, 13 aa, Mycobacterium tuberculosis
AGNVNTGALITGN

SEQ ID NO: 180668 - protein, 13 aa, Mycobacterium tuberculosis
GNVNTGALITGNF

SEQ ID NO: 180669 - protein, 13 aa, Mycobacterium tuberculosis
NVNTGALITGNFS

SEQ ID NO: 180670 - protein, 13 aa, Mycobacterium tuberculosis
VNTGALITGNFSN

SEQ ID NO: 180671 - protein, 13 aa, Mycobacterium tuberculosis
NTGALITGNFSNG

SEQ ID NO: 180672 - protein, 13 aa, Mycobacterium tuberculosis
TGALITGNFSNGI

SEQ ID NO: 180673 - protein, 13 aa, Mycobacterium tuberculosis
GALITGNFSNGIL

SEQ ID NO: 180674 - protein, 13 aa, Mycobacterium tuberculosis
ALITGNFSNGILW

SEQ ID NO: 180675 - protein, 13 aa, Mycobacterium tuberculosis
LITGNFSNGILWR

SEQ ID NO: 180676 - protein, 13 aa, Mycobacterium tuberculosis
ITGNFSNGILWRG

SEQ ID NO: 180677 - protein, 13 aa, Mycobacterium tuberculosis
TGNFSNGILWRGN

SEQ ID NO: 180678 - protein, 13 aa, Mycobacterium tuberculosis
GNFSNGILWRGNY

SEQ ID NO: 180679 - protein, 13 aa, Mycobacterium tuberculosis
NFSNGILWRGNYE

SEQ ID NO: 180680 - protein, 13 aa, Mycobacterium tuberculosis
FSNGILWRGNYEG

SEQ ID NO: 180681 - protein, 13 aa, Mycobacterium tuberculosis
SNGILWRGNYEGL

SEQ ID NO: 180682 - protein, 13 aa, Mycobacterium tuberculosis
NGILWRGNYEGLA

SEQ ID NO: 180683 - protein, 13 aa, Mycobacterium tuberculosis
GILWRGNYEGLAG

SEQ ID NO: 180684 - protein, 13 aa, Mycobacterium tuberculosis
ILWRGNYEGLAGF

SEQ ID NO: 180685 - protein, 13 aa, Mycobacterium tuberculosis
LWRGNYEGLAGFS

SEQ ID NO: 180686 - protein, 13 aa, Mycobacterium tuberculosis
WRGNYEGLAGFSF

SEQ ID NO: 180687 - protein, 13 aa, Mycobacterium tuberculosis
RGNYEGLAGFSFG

SEQ ID NO: 180688 - protein, 13 aa, Mycobacterium tuberculosis
GNYEGLAGFSFGY

SEQ ID NO: 180689 - protein, 13 aa, Mycobacterium tuberculosis
NYEGLAGFSFGYP

SEQ ID NO: 180690 - protein, 13 aa, Mycobacterium tuberculosis
YEGLAGFSFGYPI

SEQ ID NO: 180691 - protein, 13 aa, Mycobacterium tuberculosis
EGLAGFSFGYPIP

SEQ ID NO: 180692 - protein, 13 aa, Mycobacterium tuberculosis
GLAGFSFGYPIPL

SEQ ID NO: 180693 - protein, 13 aa, Mycobacterium tuberculosis
LAGFSFGYPIPLF

SEQ ID NO: 180694 - protein, 13 aa, Mycobacterium tuberculosis
AGFSFGYPIPLFP

SEQ ID NO: 180695 - protein, 13 aa, Mycobacterium tuberculosis
GFSFGYPIPLFPA

SEQ ID NO: 180696 - protein, 13 aa, Mycobacterium tuberculosis
FSFGYPIPLFPAV

SEQ ID NO: 180697 - protein, 13 aa, Mycobacterium tuberculosis
SFGYPIPLFPAVG

SEQ ID NO: 180698 - protein, 13 aa, Mycobacterium tuberculosis
FGYPIPLFPAVGA

SEQ ID NO: 180699 - protein, 13 aa, Mycobacterium tuberculosis
GYPIPLFPAVGAD

SEQ ID NO: 180700 - protein, 13 aa, Mycobacterium tuberculosis
YPIPLFPAVGADV

SEQ ID NO: 180701 - protein, 13 aa, Mycobacterium tuberculosis
PIPLFPAVGADVT

SEQ ID NO: 180702 - protein, 13 aa, Mycobacterium tuberculosis
IPLFPAVGADVTG

SEQ ID NO: 180703 - protein, 13 aa, Mycobacterium tuberculosis
PLFPAVGADVTGD

SEQ ID NO: 180704 - protein, 13 aa, Mycobacterium tuberculosis
LFPAVGADVTGDI

SEQ ID NO: 180705 - protein, 13 aa, Mycobacterium tuberculosis
FPAVGADVTGDIG

SEQ ID NO: 180706 - protein, 13 aa, Mycobacterium tuberculosis
PAVGADVTGDIGP

SEQ ID NO: 180707 - protein, 13 aa, Mycobacterium tuberculosis
AVGADVTGDIGPA

SEQ ID NO: 180708 - protein, 13 aa, Mycobacterium tuberculosis
VGADVTGDIGPAT

SEQ ID NO: 180709 - protein, 13 aa, Mycobacterium tuberculosis
GADVTGDIGPATI

SEQ ID NO: 180710 - protein, 13 aa, Mycobacterium tuberculosis
ADVTGDIGPATII

SEQ ID NO: 180711 - protein, 13 aa, Mycobacterium tuberculosis
DVTGDIGPATIIP

SEQ ID NO: 180712 - protein, 13 aa, Mycobacterium tuberculosis
VTGDIGPATIIPP

SEQ ID NO: 180713 - protein, 13 aa, Mycobacterium tuberculosis
TGDIGPATIIPPI

SEQ ID NO: 180714 - protein, 13 aa, Mycobacterium tuberculosis
GDIGPATIIPPIH

SEQ ID NO: 180715 - protein, 13 aa, Mycobacterium tuberculosis
DIGPATIIPPIHI

SEQ ID NO: 180716 - protein, 13 aa, Mycobacterium tuberculosis
IGPATIIPPIHIP

SEQ ID NO: 180717 - protein, 13 aa, Mycobacterium tuberculosis
GPATIIPPIHIPS

SEQ ID NO: 180718 - protein, 13 aa, Mycobacterium tuberculosis
PATIIPPIHIPSI

SEQ ID NO: 180719 - protein, 13 aa, Mycobacterium tuberculosis
ATIIPPIHIPSIP

SEQ ID NO: 180720 - protein, 13 aa, Mycobacterium tuberculosis
TIIPPIHIPSIPL

SEQ ID NO: 180721 - protein, 13 aa, Mycobacterium tuberculosis
IIPPIHIPSIPLG

SEQ ID NO: 180722 - protein, 13 aa, Mycobacterium tuberculosis
IPPIHIPSIPLGF

SEQ ID NO: 180723 - protein, 13 aa, Mycobacterium tuberculosis
PPIHIPSIPLGFA

SEQ ID NO: 180724 - protein, 13 aa, Mycobacterium tuberculosis
PIHIPSIPLGFAA

SEQ ID NO: 180725 - protein, 13 aa, Mycobacterium tuberculosis
IHIPSIPLGFAAI

SEQ ID NO: 180726 - protein, 13 aa, Mycobacterium tuberculosis
HIPSIPLGFAAIG

SEQ ID NO: 180727 - protein, 13 aa, Mycobacterium tuberculosis
IPSIPLGFAAIGH

SEQ ID NO: 180728 - protein, 13 aa, Mycobacterium tuberculosis
PSIPLGFAAIGHI

SEQ ID NO: 180729 - protein, 13 aa, Mycobacterium tuberculosis
SIPLGFAAIGHIG

SEQ ID NO: 180730 - protein, 13 aa, Mycobacterium tuberculosis
IPLGFAAIGHIGP

SEQ ID NO: 180731 - protein, 13 aa, Mycobacterium tuberculosis
PLGFAAIGHIGPI

SEQ ID NO: 180732 - protein, 13 aa, Mycobacterium tuberculosis
LGFAAIGHIGPIS

SEQ ID NO: 180733 - protein, 13 aa, Mycobacterium tuberculosis
GFAAIGHIGPISI

SEQ ID NO: 180734 - protein, 13 aa, Mycobacterium tuberculosis
FAAIGHIGPISIP

SEQ ID NO: 180735 - protein, 13 aa, Mycobacterium tuberculosis
AAIGHIGPISIPN

SEQ ID NO: 180736 - protein, 13 aa, Mycobacterium tuberculosis
AIGHIGPISIPNI

SEQ ID NO: 180737 - protein, 13 aa, Mycobacterium tuberculosis
IGHIGPISIPNIA

SEQ ID NO: 180738 - protein, 13 aa, Mycobacterium tuberculosis
GHIGPISIPNIAI

SEQ ID NO: 180739 - protein, 13 aa, Mycobacterium tuberculosis
HIGPISIPNIAIP

SEQ ID NO: 180740 - protein, 13 aa, Mycobacterium tuberculosis
IGPISIPNIAIPS

SEQ ID NO: 180741 - protein, 13 aa, Mycobacterium tuberculosis
GPISIPNIAIPSI

SEQ ID NO: 180742 - protein, 13 aa, Mycobacterium tuberculosis
PISIPNIAIPSIH

SEQ ID NO: 180743 - protein, 13 aa, Mycobacterium tuberculosis
ISIPNIAIPSIHL

SEQ ID NO: 180744 - protein, 13 aa, Mycobacterium tuberculosis
SIPNIAIPSIHLG

SEQ ID NO: 180745 - protein, 13 aa, Mycobacterium tuberculosis
IPNIAIPSIHLGI

SEQ ID NO: 180746 - protein, 13 aa, Mycobacterium tuberculosis
PNIAIPSIHLGID

SEQ ID NO: 180747 - protein, 13 aa, Mycobacterium tuberculosis
NIAIPSIHLGIDP

SEQ ID NO: 180748 - protein, 13 aa, Mycobacterium tuberculosis
IAIPSIHLGIDPT

SEQ ID NO: 180749 - protein, 13 aa, Mycobacterium tuberculosis
AIPSIHLGIDPTF

SEQ ID NO: 180750 - protein, 13 aa, Mycobacterium tuberculosis
IPSIHLGIDPTFD

SEQ ID NO: 180751 - protein, 13 aa, Mycobacterium tuberculosis
PSIHLGIDPTFDV

SEQ ID NO: 180752 - protein, 13 aa, Mycobacterium tuberculosis
SIHLGIDPTFDVG

SEQ ID NO: 180753 - protein, 13 aa, Mycobacterium tuberculosis
IHLGIDPTFDVGP

SEQ ID NO: 180754 - protein, 13 aa, Mycobacterium tuberculosis
HLGIDPTFDVGPI

SEQ ID NO: 180755 - protein, 13 aa, Mycobacterium tuberculosis
LGIDPTFDVGPIT

SEQ ID NO: 180756 - protein, 13 aa, Mycobacterium tuberculosis
GIDPTFDVGPITV

SEQ ID NO: 180757 - protein, 13 aa, Mycobacterium tuberculosis
IDPTFDVGPITVD

SEQ ID NO: 180758 - protein, 13 aa, Mycobacterium tuberculosis
DPTFDVGPITVDP

SEQ ID NO: 180759 - protein, 13 aa, Mycobacterium tuberculosis
PTFDVGPITVDPI

SEQ ID NO: 180760 - protein, 13 aa, Mycobacterium tuberculosis
TFDVGPITVDPIT

SEQ ID NO: 180761 - protein, 13 aa, Mycobacterium tuberculosis
FDVGPITVDPITL

SEQ ID NO: 180762 - protein, 13 aa, Mycobacterium tuberculosis
DVGPITVDPITLT

SEQ ID NO: 180763 - protein, 13 aa, Mycobacterium tuberculosis
VGPITVDPITLTI

SEQ ID NO: 180764 - protein, 13 aa, Mycobacterium tuberculosis
GPITVDPITLTIP

SEQ ID NO: 180765 - protein, 13 aa, Mycobacterium tuberculosis
PITVDPITLTIPG

SEQ ID NO: 180766 - protein, 13 aa, Mycobacterium tuberculosis
ITVDPITLTIPGL

SEQ ID NO: 180767 - protein, 13 aa, Mycobacterium tuberculosis
TVDPITLTIPGLS

SEQ ID NO: 180768 - protein, 13 aa, Mycobacterium tuberculosis
VDPITLTIPGLSL

SEQ ID NO: 180769 - protein, 13 aa, Mycobacterium tuberculosis
DPITLTIPGLSLD

SEQ ID NO: 180770 - protein, 13 aa, Mycobacterium tuberculosis
PITLTIPGLSLDA

SEQ ID NO: 180771 - protein, 13 aa, Mycobacterium tuberculosis
ITLTIPGLSLDAA

SEQ ID NO: 180772 - protein, 13 aa, Mycobacterium tuberculosis
TLTIPGLSLDAAV

SEQ ID NO: 180773 - protein, 13 aa, Mycobacterium tuberculosis
LTIPGLSLDAAVS

SEQ ID NO: 180774 - protein, 13 aa, Mycobacterium tuberculosis
TIPGLSLDAAVSE

SEQ ID NO: 180775 - protein, 13 aa, Mycobacterium tuberculosis
IPGLSLDAAVSEI

SEQ ID NO: 180776 - protein, 13 aa, Mycobacterium tuberculosis
PGLSLDAAVSEIR

SEQ ID NO: 180777 - protein, 13 aa, Mycobacterium tuberculosis
GLSLDAAVSEIRM

SEQ ID NO: 180778 - protein, 13 aa, Mycobacterium tuberculosis
LSLDAAVSEIRMT

SEQ ID NO: 180779 - protein, 13 aa, Mycobacterium tuberculosis
SLDAAVSEIRMTS

SEQ ID NO: 180780 - protein, 13 aa, Mycobacterium tuberculosis
LDAAVSEIRMTSG

SEQ ID NO: 180781 - protein, 13 aa, Mycobacterium tuberculosis
DAAVSEIRMTSGS

SEQ ID NO: 180782 - protein, 13 aa, Mycobacterium tuberculosis
AAVSEIRMTSGSS

SEQ ID NO: 180783 - protein, 13 aa, Mycobacterium tuberculosis
AVSEIRMTSGSSS

SEQ ID NO: 180784 - protein, 13 aa, Mycobacterium tuberculosis
VSEIRMTSGSSSG

SEQ ID NO: 180785 - protein, 13 aa, Mycobacterium tuberculosis
SEIRMTSGSSSGF

SEQ ID NO: 180786 - protein, 13 aa, Mycobacterium tuberculosis
EIRMTSGSSSGFK

SEQ ID NO: 180787 - protein, 13 aa, Mycobacterium tuberculosis
IRMTSGSSSGFKV

SEQ ID NO: 180788 - protein, 13 aa, Mycobacterium tuberculosis
RMTSGSSSGFKVR

SEQ ID NO: 180789 - protein, 13 aa, Mycobacterium tuberculosis
MTSGSSSGFKVRP

SEQ ID NO: 180790 - protein, 13 aa, Mycobacterium tuberculosis
TSGSSSGFKVRPS

SEQ ID NO: 180791 - protein, 13 aa, Mycobacterium tuberculosis
SGSSSGFKVRPSF

SEQ ID NO: 180792 - protein, 13 aa, Mycobacterium tuberculosis
GSSSGFKVRPSFS

SEQ ID NO: 180793 - protein, 13 aa, Mycobacterium tuberculosis
SSSGFKVRPSFSF

SEQ ID NO: 180794 - protein, 13 aa, Mycobacterium tuberculosis
SSGFKVRPSFSFF

SEQ ID NO: 180795 - protein, 13 aa, Mycobacterium tuberculosis
SGFKVRPSFSFFA

SEQ ID NO: 180796 - protein, 13 aa, Mycobacterium tuberculosis
GFKVRPSFSFFAV

SEQ ID NO: 180797 - protein, 13 aa, Mycobacterium tuberculosis
FKVRPSFSFFAVG

SEQ ID NO: 180798 - protein, 13 aa, Mycobacterium tuberculosis
KVRPSFSFFAVGP

SEQ ID NO: 180799 - protein, 13 aa, Mycobacterium tuberculosis
VRPSFSFFAVGPD

SEQ ID NO: 180800 - protein, 13 aa, Mycobacterium tuberculosis
RPSFSFFAVGPDG

SEQ ID NO: 180801 - protein, 13 aa, Mycobacterium tuberculosis
PSFSFFAVGPDGM

SEQ ID NO: 180802 - protein, 13 aa, Mycobacterium tuberculosis
SFSFFAVGPDGMP

SEQ ID NO: 180803 - protein, 13 aa, Mycobacterium tuberculosis
FSFFAVGPDGMPG

SEQ ID NO: 180804 - protein, 13 aa, Mycobacterium tuberculosis
SFFAVGPDGMPGG

SEQ ID NO: 180805 - protein, 13 aa, Mycobacterium tuberculosis
FFAVGPDGMPGGE

SEQ ID NO: 180806 - protein, 13 aa, Mycobacterium tuberculosis
FAVGPDGMPGGEV

SEQ ID NO: 180807 - protein, 13 aa, Mycobacterium tuberculosis
AVGPDGMPGGEVS

SEQ ID NO: 180808 - protein, 13 aa, Mycobacterium tuberculosis
VGPDGMPGGEVSI

SEQ ID NO: 180809 - protein, 13 aa, Mycobacterium tuberculosis
GPDGMPGGEVSIL

SEQ ID NO: 180810 - protein, 13 aa, Mycobacterium tuberculosis
PDGMPGGEVSILQ

SEQ ID NO: 180811 - protein, 13 aa, Mycobacterium tuberculosis
DGMPGGEVSILQP

SEQ ID NO: 180812 - protein, 13 aa, Mycobacterium tuberculosis
GMPGGEVSILQPF

SEQ ID NO: 180813 - protein, 13 aa, Mycobacterium tuberculosis
MPGGEVSILQPFT

SEQ ID NO: 180814 - protein, 13 aa, Mycobacterium tuberculosis
PGGEVSILQPFTV

SEQ ID NO: 180815 - protein, 13 aa, Mycobacterium tuberculosis
GGEVSILQPFTVA

SEQ ID NO: 180816 - protein, 13 aa, Mycobacterium tuberculosis
GEVSILQPFTVAP

SEQ ID NO: 180817 - protein, 13 aa, Mycobacterium tuberculosis
EVSILQPFTVAPI

SEQ ID NO: 180818 - protein, 13 aa, Mycobacterium tuberculosis
VSILQPFTVAPIN

SEQ ID NO: 180819 - protein, 13 aa, Mycobacterium tuberculosis
SILQPFTVAPINL

SEQ ID NO: 180820 - protein, 13 aa, Mycobacterium tuberculosis
ILQPFTVAPINLN

SEQ ID NO: 180821 - protein, 13 aa, Mycobacterium tuberculosis
LQPFTVAPINLNP

SEQ ID NO: 180822 - protein, 13 aa, Mycobacterium tuberculosis
QPFTVAPINLNPT

SEQ ID NO: 180823 - protein, 13 aa, Mycobacterium tuberculosis
PFTVAPINLNPTT

SEQ ID NO: 180824 - protein, 13 aa, Mycobacterium tuberculosis
FTVAPINLNPTTL

SEQ ID NO: 180825 - protein, 13 aa, Mycobacterium tuberculosis
TVAPINLNPTTLH

SEQ ID NO: 180826 - protein, 13 aa, Mycobacterium tuberculosis
VAPINLNPTTLHF

SEQ ID NO: 180827 - protein, 13 aa, Mycobacterium tuberculosis
APINLNPTTLHFP

SEQ ID NO: 180828 - protein, 13 aa, Mycobacterium tuberculosis
PINLNPTTLHFPG

SEQ ID NO: 180829 - protein, 13 aa, Mycobacterium tuberculosis
INLNPTTLHFPGF

SEQ ID NO: 180830 - protein, 13 aa, Mycobacterium tuberculosis
NLNPTTLHFPGFT

SEQ ID NO: 180831 - protein, 13 aa, Mycobacterium tuberculosis
LNPTTLHFPGFTI

SEQ ID NO: 180832 - protein, 13 aa, Mycobacterium tuberculosis
NPTTLHFPGFTIP

SEQ ID NO: 180833 - protein, 13 aa, Mycobacterium tuberculosis
PTTLHFPGFTIPT

SEQ ID NO: 180834 - protein, 13 aa, Mycobacterium tuberculosis
TTLHFPGFTIPTG

SEQ ID NO: 180835 - protein, 13 aa, Mycobacterium tuberculosis
TLHFPGFTIPTGP

SEQ ID NO: 180836 - protein, 13 aa, Mycobacterium tuberculosis
LHFPGFTIPTGPI

SEQ ID NO: 180837 - protein, 13 aa, Mycobacterium tuberculosis
HFPGFTIPTGPIH

SEQ ID NO: 180838 - protein, 13 aa, Mycobacterium tuberculosis
FPGFTIPTGPIHI

SEQ ID NO: 180839 - protein, 13 aa, Mycobacterium tuberculosis
PGFTIPTGPIHIG

SEQ ID NO: 180840 - protein, 13 aa, Mycobacterium tuberculosis
GFTIPTGPIHIGL

SEQ ID NO: 180841 - protein, 13 aa, Mycobacterium tuberculosis
FTIPTGPIHIGLP

SEQ ID NO: 180842 - protein, 13 aa, Mycobacterium tuberculosis
TIPTGPIHIGLPL

SEQ ID NO: 180843 - protein, 13 aa, Mycobacterium tuberculosis
IPTGPIHIGLPLS

SEQ ID NO: 180844 - protein, 13 aa, Mycobacterium tuberculosis
PTGPIHIGLPLSL

SEQ ID NO: 180845 - protein, 13 aa, Mycobacterium tuberculosis
TGPIHIGLPLSLT

SEQ ID NO: 180846 - protein, 13 aa, Mycobacterium tuberculosis
GPIHIGLPLSLTI

SEQ ID NO: 180847 - protein, 13 aa, Mycobacterium tuberculosis
PIHIGLPLSLTIP

SEQ ID NO: 180848 - protein, 13 aa, Mycobacterium tuberculosis
IHIGLPLSLTIPG

SEQ ID NO: 180849 - protein, 13 aa, Mycobacterium tuberculosis
HIGLPLSLTIPGF

SEQ ID NO: 180850 - protein, 13 aa, Mycobacterium tuberculosis
IGLPLSLTIPGFT

SEQ ID NO: 180851 - protein, 13 aa, Mycobacterium tuberculosis
GLPLSLTIPGFTI

SEQ ID NO: 180852 - protein, 13 aa, Mycobacterium tuberculosis
LPLSLTIPGFTIP

SEQ ID NO: 180853 - protein, 13 aa, Mycobacterium tuberculosis
PLSLTIPGFTIPG

SEQ ID NO: 180854 - protein, 13 aa, Mycobacterium tuberculosis
LSLTIPGFTIPGG

SEQ ID NO: 180855 - protein, 13 aa, Mycobacterium tuberculosis
SLTIPGFTIPGGT

SEQ ID NO: 180856 - protein, 13 aa, Mycobacterium tuberculosis
LTIPGFTIPGGTL

SEQ ID NO: 180857 - protein, 13 aa, Mycobacterium tuberculosis
TIPGFTIPGGTLI

SEQ ID NO: 180858 - protein, 13 aa, Mycobacterium tuberculosis
IPGFTIPGGTLIP

SEQ ID NO: 180859 - protein, 13 aa, Mycobacterium tuberculosis
PGFTIPGGTLIPQ

SEQ ID NO: 180860 - protein, 13 aa, Mycobacterium tuberculosis
GFTIPGGTLIPQL

SEQ ID NO: 180861 - protein, 13 aa, Mycobacterium tuberculosis
FTIPGGTLIPQLP

SEQ ID NO: 180862 - protein, 13 aa, Mycobacterium tuberculosis
TIPGGTLIPQLPL

SEQ ID NO: 180863 - protein, 13 aa, Mycobacterium tuberculosis
IPGGTLIPQLPLG

SEQ ID NO: 180864 - protein, 13 aa, Mycobacterium tuberculosis
PGGTLIPQLPLGL

SEQ ID NO: 180865 - protein, 13 aa, Mycobacterium tuberculosis
GGTLIPQLPLGLG

SEQ ID NO: 180866 - protein, 13 aa, Mycobacterium tuberculosis
GTLIPQLPLGLGL

SEQ ID NO: 180867 - protein, 13 aa, Mycobacterium tuberculosis
TLIPQLPLGLGLS

SEQ ID NO: 180868 - protein, 13 aa, Mycobacterium tuberculosis
LIPQLPLGLGLSG

SEQ ID NO: 180869 - protein, 13 aa, Mycobacterium tuberculosis
IPQLPLGLGLSGG

SEQ ID NO: 180870 - protein, 13 aa, Mycobacterium tuberculosis
PQLPLGLGLSGGT

SEQ ID NO: 180871 - protein, 13 aa, Mycobacterium tuberculosis
QLPLGLGLSGGTP

SEQ ID NO: 180872 - protein, 13 aa, Mycobacterium tuberculosis
LPLGLGLSGGTPP

SEQ ID NO: 180873 - protein, 13 aa, Mycobacterium tuberculosis
PLGLGLSGGTPPF

SEQ ID NO: 180874 - protein, 13 aa, Mycobacterium tuberculosis
LGLGLSGGTPPFD

SEQ ID NO: 180875 - protein, 13 aa, Mycobacterium tuberculosis
GLGLSGGTPPFDL

SEQ ID NO: 180876 - protein, 13 aa, Mycobacterium tuberculosis
LGLSGGTPPFDLP

SEQ ID NO: 180877 - protein, 13 aa, Mycobacterium tuberculosis
GLSGGTPPFDLPT

SEQ ID NO: 180878 - protein, 13 aa, Mycobacterium tuberculosis
LSGGTPPFDLPTV

SEQ ID NO: 180879 - protein, 13 aa, Mycobacterium tuberculosis
SGGTPPFDLPTVV

SEQ ID NO: 180880 - protein, 13 aa, Mycobacterium tuberculosis
GGTPPFDLPTVVI

SEQ ID NO: 180881 - protein, 13 aa, Mycobacterium tuberculosis
GTPPFDLPTVVID

SEQ ID NO: 180882 - protein, 13 aa, Mycobacterium tuberculosis
TPPFDLPTVVIDR

SEQ ID NO: 180883 - protein, 13 aa, Mycobacterium tuberculosis
PPFDLPTVVIDRI

SEQ ID NO: 180884 - protein, 13 aa, Mycobacterium tuberculosis
PFDLPTVVIDRIP

SEQ ID NO: 180885 - protein, 13 aa, Mycobacterium tuberculosis
FDLPTVVIDRIPV

SEQ ID NO: 180886 - protein, 13 aa, Mycobacterium tuberculosis
DLPTVVIDRIPVE

SEQ ID NO: 180887 - protein, 13 aa, Mycobacterium tuberculosis
LPTVVIDRIPVEL

SEQ ID NO: 180888 - protein, 13 aa, Mycobacterium tuberculosis
PTVVIDRIPVELH

SEQ ID NO: 180889 - protein, 13 aa, Mycobacterium tuberculosis
TVVIDRIPVELHA

SEQ ID NO: 180890 - protein, 13 aa, Mycobacterium tuberculosis
VVIDRIPVELHAS

SEQ ID NO: 180891 - protein, 13 aa, Mycobacterium tuberculosis
VIDRIPVELHAST

SEQ ID NO: 180892 - protein, 13 aa, Mycobacterium tuberculosis
IDRIPVELHASTT

SEQ ID NO: 180893 - protein, 13 aa, Mycobacterium tuberculosis
DRIPVELHASTTI

SEQ ID NO: 180894 - protein, 13 aa, Mycobacterium tuberculosis
RIPVELHASTTIG

SEQ ID NO: 180895 - protein, 13 aa, Mycobacterium tuberculosis
IPVELHASTTIGP

SEQ ID NO: 180896 - protein, 13 aa, Mycobacterium tuberculosis
PVELHASTTIGPV

SEQ ID NO: 180897 - protein, 13 aa, Mycobacterium tuberculosis
VELHASTTIGPVS

SEQ ID NO: 180898 - protein, 13 aa, Mycobacterium tuberculosis
ELHASTTIGPVSL

SEQ ID NO: 180899 - protein, 13 aa, Mycobacterium tuberculosis
LHASTTIGPVSLP

SEQ ID NO: 180900 - protein, 13 aa, Mycobacterium tuberculosis
HASTTIGPVSLPI

SEQ ID NO: 180901 - protein, 13 aa, Mycobacterium tuberculosis
ASTTIGPVSLPIF

SEQ ID NO: 180902 - protein, 13 aa, Mycobacterium tuberculosis
STTIGPVSLPIFG

SEQ ID NO: 180903 - protein, 13 aa, Mycobacterium tuberculosis
TTIGPVSLPIFGF

SEQ ID NO: 180904 - protein, 13 aa, Mycobacterium tuberculosis
TIGPVSLPIFGFG

SEQ ID NO: 180905 - protein, 13 aa, Mycobacterium tuberculosis
IGPVSLPIFGFGG

SEQ ID NO: 180906 - protein, 13 aa, Mycobacterium tuberculosis
GPVSLPIFGFGGA

SEQ ID NO: 180907 - protein, 13 aa, Mycobacterium tuberculosis
PVSLPIFGFGGAP

SEQ ID NO: 180908 - protein, 13 aa, Mycobacterium tuberculosis
VSLPIFGFGGAPG

SEQ ID NO: 180909 - protein, 13 aa, Mycobacterium tuberculosis
SLPIFGFGGAPGF

SEQ ID NO: 180910 - protein, 13 aa, Mycobacterium tuberculosis
LPIFGFGGAPGFG

SEQ ID NO: 180911 - protein, 13 aa, Mycobacterium tuberculosis
PIFGFGGAPGFGN

SEQ ID NO: 180912 - protein, 13 aa, Mycobacterium tuberculosis
IFGFGGAPGFGND

SEQ ID NO: 180913 - protein, 13 aa, Mycobacterium tuberculosis
FGFGGAPGFGNDT

SEQ ID NO: 180914 - protein, 13 aa, Mycobacterium tuberculosis
GFGGAPGFGNDTT

SEQ ID NO: 180915 - protein, 13 aa, Mycobacterium tuberculosis
FGGAPGFGNDTTA

SEQ ID NO: 180916 - protein, 13 aa, Mycobacterium tuberculosis
GGAPGFGNDTTAP

SEQ ID NO: 180917 - protein, 13 aa, Mycobacterium tuberculosis
GAPGFGNDTTAPS

SEQ ID NO: 180918 - protein, 13 aa, Mycobacterium tuberculosis
APGFGNDTTAPSS

SEQ ID NO: 180919 - protein, 13 aa, Mycobacterium tuberculosis
PGFGNDTTAPSSG

SEQ ID NO: 180920 - protein, 13 aa, Mycobacterium tuberculosis
GFGNDTTAPSSGF

SEQ ID NO: 180921 - protein, 13 aa, Mycobacterium tuberculosis
FGNDTTAPSSGFF

SEQ ID NO: 180922 - protein, 13 aa, Mycobacterium tuberculosis
GNDTTAPSSGFFN

SEQ ID NO: 180923 - protein, 13 aa, Mycobacterium tuberculosis
NDTTAPSSGFFNT

SEQ ID NO: 180924 - protein, 13 aa, Mycobacterium tuberculosis
DTTAPSSGFFNTG

SEQ ID NO: 180925 - protein, 13 aa, Mycobacterium tuberculosis
TTAPSSGFFNTGG

SEQ ID NO: 180926 - protein, 13 aa, Mycobacterium tuberculosis
TAPSSGFFNTGGG

SEQ ID NO: 180927 - protein, 13 aa, Mycobacterium tuberculosis
APSSGFFNTGGGG

SEQ ID NO: 180928 - protein, 13 aa, Mycobacterium tuberculosis
PSSGFFNTGGGGG

SEQ ID NO: 180929 - protein, 13 aa, Mycobacterium tuberculosis
SSGFFNTGGGGGS

SEQ ID NO: 180930 - protein, 13 aa, Mycobacterium tuberculosis
SGFFNTGGGGGSG

SEQ ID NO: 180931 - protein, 13 aa, Mycobacterium tuberculosis
GFFNTGGGGGSGF

SEQ ID NO: 180932 - protein, 13 aa, Mycobacterium tuberculosis
FFNTGGGGGSGFS

SEQ ID NO: 180933 - protein, 13 aa, Mycobacterium tuberculosis
FNTGGGGGSGFSN

SEQ ID NO: 180934 - protein, 13 aa, Mycobacterium tuberculosis
NTGGGGGSGFSNS

SEQ ID NO: 180935 - protein, 13 aa, Mycobacterium tuberculosis
TGGGGGSGFSNSG

SEQ ID NO: 180936 - protein, 13 aa, Mycobacterium tuberculosis
GGGGGSGFSNSGS

SEQ ID NO: 180937 - protein, 13 aa, Mycobacterium tuberculosis
GGGGSGFSNSGSG

SEQ ID NO: 180938 - protein, 13 aa, Mycobacterium tuberculosis
GGGSGFSNSGSGM

SEQ ID NO: 180939 - protein, 13 aa, Mycobacterium tuberculosis
GGSGFSNSGSGMS

SEQ ID NO: 180940 - protein, 13 aa, Mycobacterium tuberculosis
GSGFSNSGSGMSG

SEQ ID NO: 180941 - protein, 13 aa, Mycobacterium tuberculosis
SGFSNSGSGMSGV

SEQ ID NO: 180942 - protein, 13 aa, Mycobacterium tuberculosis
GFSNSGSGMSGVL

SEQ ID NO: 180943 - protein, 13 aa, Mycobacterium tuberculosis
FSNSGSGMSGVLN

SEQ ID NO: 180944 - protein, 13 aa, Mycobacterium tuberculosis
SNSGSGMSGVLNA

SEQ ID NO: 180945 - protein, 13 aa, Mycobacterium tuberculosis
NSGSGMSGVLNAI

SEQ ID NO: 180946 - protein, 13 aa, Mycobacterium tuberculosis
SGSGMSGVLNAIS

SEQ ID NO: 180947 - protein, 13 aa, Mycobacterium tuberculosis
GSGMSGVLNAISD

SEQ ID NO: 180948 - protein, 13 aa, Mycobacterium tuberculosis
SGMSGVLNAISDP

SEQ ID NO: 180949 - protein, 13 aa, Mycobacterium tuberculosis
GMSGVLNAISDPL

SEQ ID NO: 180950 - protein, 13 aa, Mycobacterium tuberculosis
MSGVLNAISDPLL

SEQ ID NO: 180951 - protein, 13 aa, Mycobacterium tuberculosis
SGVLNAISDPLLG

SEQ ID NO: 180952 - protein, 13 aa, Mycobacterium tuberculosis
GVLNAISDPLLGS

SEQ ID NO: 180953 - protein, 13 aa, Mycobacterium tuberculosis
VLNAISDPLLGSA

SEQ ID NO: 180954 - protein, 13 aa, Mycobacterium tuberculosis
LNAISDPLLGSAS

SEQ ID NO: 180955 - protein, 13 aa, Mycobacterium tuberculosis
NAISDPLLGSASG

SEQ ID NO: 180956 - protein, 13 aa, Mycobacterium tuberculosis
AISDPLLGSASGF

SEQ ID NO: 180957 - protein, 13 aa, Mycobacterium tuberculosis
ISDPLLGSASGFA

SEQ ID NO: 180958 - protein, 13 aa, Mycobacterium tuberculosis
SDPLLGSASGFAN

SEQ ID NO: 180959 - protein, 13 aa, Mycobacterium tuberculosis
DPLLGSASGFANF

SEQ ID NO: 180960 - protein, 13 aa, Mycobacterium tuberculosis
PLLGSASGFANFG

SEQ ID NO: 180961 - protein, 13 aa, Mycobacterium tuberculosis
LLGSASGFANFGT

SEQ ID NO: 180962 - protein, 13 aa, Mycobacterium tuberculosis
LGSASGFANFGTQ

SEQ ID NO: 180963 - protein, 13 aa, Mycobacterium tuberculosis
GSASGFANFGTQL

SEQ ID NO: 180964 - protein, 13 aa, Mycobacterium tuberculosis
SASGFANFGTQLS

SEQ ID NO: 180965 - protein, 13 aa, Mycobacterium tuberculosis
ASGFANFGTQLSG

SEQ ID NO: 180966 - protein, 13 aa, Mycobacterium tuberculosis
SGFANFGTQLSGI

SEQ ID NO: 180967 - protein, 13 aa, Mycobacterium tuberculosis
GFANFGTQLSGIL

SEQ ID NO: 180968 - protein, 13 aa, Mycobacterium tuberculosis
FANFGTQLSGILN

SEQ ID NO: 180969 - protein, 13 aa, Mycobacterium tuberculosis
ANFGTQLSGILNR

SEQ ID NO: 180970 - protein, 13 aa, Mycobacterium tuberculosis
NFGTQLSGILNRG

SEQ ID NO: 180971 - protein, 13 aa, Mycobacterium tuberculosis
FGTQLSGILNRGA

SEQ ID NO: 180972 - protein, 13 aa, Mycobacterium tuberculosis
GTQLSGILNRGAG

SEQ ID NO: 180973 - protein, 13 aa, Mycobacterium tuberculosis
TQLSGILNRGAGI

SEQ ID NO: 180974 - protein, 13 aa, Mycobacterium tuberculosis
QLSGILNRGAGIS

SEQ ID NO: 180975 - protein, 13 aa, Mycobacterium tuberculosis
LSGILNRGAGISG

SEQ ID NO: 180976 - protein, 13 aa, Mycobacterium tuberculosis
SGILNRGAGISGV

SEQ ID NO: 180977 - protein, 13 aa, Mycobacterium tuberculosis
GILNRGAGISGVY

SEQ ID NO: 180978 - protein, 13 aa, Mycobacterium tuberculosis
ILNRGAGISGVYN

SEQ ID NO: 180979 - protein, 13 aa, Mycobacterium tuberculosis
LNRGAGISGVYNT

SEQ ID NO: 180980 - protein, 13 aa, Mycobacterium tuberculosis
NRGAGISGVYNTG

SEQ ID NO: 180981 - protein, 13 aa, Mycobacterium tuberculosis
RGAGISGVYNTGT

SEQ ID NO: 180982 - protein, 13 aa, Mycobacterium tuberculosis
GAGISGVYNTGTL

SEQ ID NO: 180983 - protein, 13 aa, Mycobacterium tuberculosis
AGISGVYNTGTLG

SEQ ID NO: 180984 - protein, 13 aa, Mycobacterium tuberculosis
GISGVYNTGTLGL

SEQ ID NO: 180985 - protein, 13 aa, Mycobacterium tuberculosis
ISGVYNTGTLGLV

SEQ ID NO: 180986 - protein, 13 aa, Mycobacterium tuberculosis
SGVYNTGTLGLVT

SEQ ID NO: 180987 - protein, 13 aa, Mycobacterium tuberculosis
GVYNTGTLGLVTS

SEQ ID NO: 180988 - protein, 13 aa, Mycobacterium tuberculosis
VYNTGTLGLVTSA

SEQ ID NO: 180989 - protein, 13 aa, Mycobacterium tuberculosis
YNTGTLGLVTSAF

SEQ ID NO: 180990 - protein, 13 aa, Mycobacterium tuberculosis
NTGTLGLVTSAFV

SEQ ID NO: 180991 - protein, 13 aa, Mycobacterium tuberculosis
TGTLGLVTSAFVS

SEQ ID NO: 180992 - protein, 13 aa, Mycobacterium tuberculosis
GTLGLVTSAFVSG

SEQ ID NO: 180993 - protein, 13 aa, Mycobacterium tuberculosis
TLGLVTSAFVSGF

SEQ ID NO: 180994 - protein, 13 aa, Mycobacterium tuberculosis
LGLVTSAFVSGFM

SEQ ID NO: 180995 - protein, 13 aa, Mycobacterium tuberculosis
GLVTSAFVSGFMN

SEQ ID NO: 180996 - protein, 13 aa, Mycobacterium tuberculosis
LVTSAFVSGFMNV

SEQ ID NO: 180997 - protein, 13 aa, Mycobacterium tuberculosis
VTSAFVSGFMNVG

SEQ ID NO: 180998 - protein, 13 aa, Mycobacterium tuberculosis
TSAFVSGFMNVGQ

SEQ ID NO: 180999 - protein, 13 aa, Mycobacterium tuberculosis
SAFVSGFMNVGQQ

SEQ ID NO: 181000 - protein, 13 aa, Mycobacterium tuberculosis
AFVSGFMNVGQQL

SEQ ID NO: 181001 - protein, 13 aa, Mycobacterium tuberculosis
FVSGFMNVGQQLS

SEQ ID NO: 181002 - protein, 13 aa, Mycobacterium tuberculosis
VSGFMNVGQQLSG

SEQ ID NO: 181003 - protein, 13 aa, Mycobacterium tuberculosis
SGFMNVGQQLSGL

SEQ ID NO: 181004 - protein, 13 aa, Mycobacterium tuberculosis
GFMNVGQQLSGLL

SEQ ID NO: 181005 - protein, 13 aa, Mycobacterium tuberculosis
FMNVGQQLSGLLF

SEQ ID NO: 181006 - protein, 13 aa, Mycobacterium tuberculosis
MNVGQQLSGLLFA

SEQ ID NO: 181007 - protein, 13 aa, Mycobacterium tuberculosis
NVGQQLSGLLFAG

SEQ ID NO: 181008 - protein, 13 aa, Mycobacterium tuberculosis
VGQQLSGLLFAGT

SEQ ID NO: 181009 - protein, 13 aa, Mycobacterium tuberculosis
GQQLSGLLFAGTG

SEQ ID NO: 181010 - protein, 13 aa, Mycobacterium tuberculosis
QQLSGLLFAGTGP

SEQ ID NO: 181011 - protein, 14 aa, Mycobacterium tuberculosis
MNFPVLPPEINSVL

SEQ ID NO: 181012 - protein, 14 aa, Mycobacterium tuberculosis
NFPVLPPEINSVLM

SEQ ID NO: 181013 - protein, 14 aa, Mycobacterium tuberculosis
FPVLPPEINSVLMY

SEQ ID NO: 181014 - protein, 14 aa, Mycobacterium tuberculosis
PVLPPEINSVLMYS

SEQ ID NO: 181015 - protein, 14 aa, Mycobacterium tuberculosis
VLPPEINSVLMYSG

SEQ ID NO: 181016 - protein, 14 aa, Mycobacterium tuberculosis
LPPEINSVLMYSGA

SEQ ID NO: 181017 - protein, 14 aa, Mycobacterium tuberculosis
PPEINSVLMYSGAG

SEQ ID NO: 181018 - protein, 14 aa, Mycobacterium tuberculosis
PEINSVLMYSGAGS

SEQ ID NO: 181019 - protein, 14 aa, Mycobacterium tuberculosis
EINSVLMYSGAGSS

SEQ ID NO: 181020 - protein, 14 aa, Mycobacterium tuberculosis
INSVLMYSGAGSSP

SEQ ID NO: 181021 - protein, 14 aa, Mycobacterium tuberculosis
NSVLMYSGAGSSPL

SEQ ID NO: 181022 - protein, 14 aa, Mycobacterium tuberculosis
SVLMYSGAGSSPLL

SEQ ID NO: 181023 - protein, 14 aa, Mycobacterium tuberculosis
VLMYSGAGSSPLLA

SEQ ID NO: 181024 - protein, 14 aa, Mycobacterium tuberculosis
LMYSGAGSSPLLAA

SEQ ID NO: 181025 - protein, 14 aa, Mycobacterium tuberculosis
MYSGAGSSPLLAAA

SEQ ID NO: 181026 - protein, 14 aa, Mycobacterium tuberculosis
YSGAGSSPLLAAAA

SEQ ID NO: 181027 - protein, 14 aa, Mycobacterium tuberculosis
SGAGSSPLLAAAAA

SEQ ID NO: 181028 - protein, 14 aa, Mycobacterium tuberculosis
GAGSSPLLAAAAAW

SEQ ID NO: 181029 - protein, 14 aa, Mycobacterium tuberculosis
AGSSPLLAAAAAWD

SEQ ID NO: 181030 - protein, 14 aa, Mycobacterium tuberculosis
GSSPLLAAAAAWDG

SEQ ID NO: 181031 - protein, 14 aa, Mycobacterium tuberculosis
SSPLLAAAAAWDGL

SEQ ID NO: 181032 - protein, 14 aa, Mycobacterium tuberculosis
SPLLAAAAAWDGLA

SEQ ID NO: 181033 - protein, 14 aa, Mycobacterium tuberculosis
PLLAAAAAWDGLAE

SEQ ID NO: 181034 - protein, 14 aa, Mycobacterium tuberculosis
LLAAAAAWDGLAEE

SEQ ID NO: 181035 - protein, 14 aa, Mycobacterium tuberculosis
LAAAAAWDGLAEEL

SEQ ID NO: 181036 - protein, 14 aa, Mycobacterium tuberculosis
AAAAAWDGLAEELG

SEQ ID NO: 181037 - protein, 14 aa, Mycobacterium tuberculosis
AAAAWDGLAEELGS

SEQ ID NO: 181038 - protein, 14 aa, Mycobacterium tuberculosis
AAAWDGLAEELGSA

SEQ ID NO: 181039 - protein, 14 aa, Mycobacterium tuberculosis
AAWDGLAEELGSAA

SEQ ID NO: 181040 - protein, 14 aa, Mycobacterium tuberculosis
AWDGLAEELGSAAV

SEQ ID NO: 181041 - protein, 14 aa, Mycobacterium tuberculosis
WDGLAEELGSAAVS

SEQ ID NO: 181042 - protein, 14 aa, Mycobacterium tuberculosis
DGLAEELGSAAVSF

SEQ ID NO: 181043 - protein, 14 aa, Mycobacterium tuberculosis
GLAEELGSAAVSFG

SEQ ID NO: 181044 - protein, 14 aa, Mycobacterium tuberculosis
LAEELGSAAVSFGQ

SEQ ID NO: 181045 - protein, 14 aa, Mycobacterium tuberculosis
AEELGSAAVSFGQV

SEQ ID NO: 181046 - protein, 14 aa, Mycobacterium tuberculosis
EELGSAAVSFGQVT

SEQ ID NO: 181047 - protein, 14 aa, Mycobacterium tuberculosis
ELGSAAVSFGQVTS

SEQ ID NO: 181048 - protein, 14 aa, Mycobacterium tuberculosis
LGSAAVSFGQVTSG

SEQ ID NO: 181049 - protein, 14 aa, Mycobacterium tuberculosis
GSAAVSFGQVTSGL

SEQ ID NO: 181050 - protein, 14 aa, Mycobacterium tuberculosis
SAAVSFGQVTSGLT

SEQ ID NO: 181051 - protein, 14 aa, Mycobacterium tuberculosis
AAVSFGQVTSGLTA

SEQ ID NO: 181052 - protein, 14 aa, Mycobacterium tuberculosis
AVSFGQVTSGLTAG

SEQ ID NO: 181053 - protein, 14 aa, Mycobacterium tuberculosis
VSFGQVTSGLTAGV

SEQ ID NO: 181054 - protein, 14 aa, Mycobacterium tuberculosis
SFGQVTSGLTAGVW

SEQ ID NO: 181055 - protein, 14 aa, Mycobacterium tuberculosis
FGQVTSGLTAGVWQ

SEQ ID NO: 181056 - protein, 14 aa, Mycobacterium tuberculosis
GQVTSGLTAGVWQG

SEQ ID NO: 181057 - protein, 14 aa, Mycobacterium tuberculosis
QVTSGLTAGVWQGA

SEQ ID NO: 181058 - protein, 14 aa, Mycobacterium tuberculosis
VTSGLTAGVWQGAA

SEQ ID NO: 181059 - protein, 14 aa, Mycobacterium tuberculosis
TSGLTAGVWQGAAA

SEQ ID NO: 181060 - protein, 14 aa, Mycobacterium tuberculosis
SGLTAGVWQGAAAA

SEQ ID NO: 181061 - protein, 14 aa, Mycobacterium tuberculosis
GLTAGVWQGAAAAA

SEQ ID NO: 181062 - protein, 14 aa, Mycobacterium tuberculosis
LTAGVWQGAAAAAM

SEQ ID NO: 181063 - protein, 14 aa, Mycobacterium tuberculosis
TAGVWQGAAAAAMA

SEQ ID NO: 181064 - protein, 14 aa, Mycobacterium tuberculosis
AGVWQGAAAAAMAA

SEQ ID NO: 181065 - protein, 14 aa, Mycobacterium tuberculosis
GVWQGAAAAAMAAA

SEQ ID NO: 181066 - protein, 14 aa, Mycobacterium tuberculosis
VWQGAAAAAMAAAA

SEQ ID NO: 181067 - protein, 14 aa, Mycobacterium tuberculosis
WQGAAAAAMAAAAA

SEQ ID NO: 181068 - protein, 14 aa, Mycobacterium tuberculosis
QGAAAAAMAAAAAP

SEQ ID NO: 181069 - protein, 14 aa, Mycobacterium tuberculosis
GAAAAAMAAAAAPY

SEQ ID NO: 181070 - protein, 14 aa, Mycobacterium tuberculosis
AAAAAMAAAAAPYA

SEQ ID NO: 181071 - protein, 14 aa, Mycobacterium tuberculosis
AAAAMAAAAAPYAG

SEQ ID NO: 181072 - protein, 14 aa, Mycobacterium tuberculosis
AAAMAAAAAPYAGW

SEQ ID NO: 181073 - protein, 14 aa, Mycobacterium tuberculosis
AAMAAAAAPYAGWL

SEQ ID NO: 181074 - protein, 14 aa, Mycobacterium tuberculosis
AMAAAAAPYAGWLG

SEQ ID NO: 181075 - protein, 14 aa, Mycobacterium tuberculosis
MAAAAAPYAGWLGS

SEQ ID NO: 181076 - protein, 14 aa, Mycobacterium tuberculosis
AAAAAPYAGWLGSV

SEQ ID NO: 181077 - protein, 14 aa, Mycobacterium tuberculosis
AAAAPYAGWLGSVA

SEQ ID NO: 181078 - protein, 14 aa, Mycobacterium tuberculosis
AAAPYAGWLGSVAA

SEQ ID NO: 181079 - protein, 14 aa, Mycobacterium tuberculosis
AAPYAGWLGSVAAQ

SEQ ID NO: 181080 - protein, 14 aa, Mycobacterium tuberculosis
APYAGWLGSVAAQA

SEQ ID NO: 181081 - protein, 14 aa, Mycobacterium tuberculosis
PYAGWLGSVAAQAV

SEQ ID NO: 181082 - protein, 14 aa, Mycobacterium tuberculosis
YAGWLGSVAAQAVA

SEQ ID NO: 181083 - protein, 14 aa, Mycobacterium tuberculosis
AGWLGSVAAQAVAV

SEQ ID NO: 181084 - protein, 14 aa, Mycobacterium tuberculosis
GWLGSVAAQAVAVA

SEQ ID NO: 181085 - protein, 14 aa, Mycobacterium tuberculosis
WLGSVAAQAVAVAG

SEQ ID NO: 181086 - protein, 14 aa, Mycobacterium tuberculosis
LGSVAAQAVAVAGQ

SEQ ID NO: 181087 - protein, 14 aa, Mycobacterium tuberculosis
GSVAAQAVAVAGQA

SEQ ID NO: 181088 - protein, 14 aa, Mycobacterium tuberculosis
SVAAQAVAVAGQAR

SEQ ID NO: 181089 - protein, 14 aa, Mycobacterium tuberculosis
VAAQAVAVAGQARA

SEQ ID NO: 181090 - protein, 14 aa, Mycobacterium tuberculosis
AAQAVAVAGQARAA

SEQ ID NO: 181091 - protein, 14 aa, Mycobacterium tuberculosis
AQAVAVAGQARAAV

SEQ ID NO: 181092 - protein, 14 aa, Mycobacterium tuberculosis
QAVAVAGQARAAVA

SEQ ID NO: 181093 - protein, 14 aa, Mycobacterium tuberculosis
AVAVAGQARAAVAA

SEQ ID NO: 181094 - protein, 14 aa, Mycobacterium tuberculosis
VAVAGQARAAVAAF

SEQ ID NO: 181095 - protein, 14 aa, Mycobacterium tuberculosis
AVAGQARAAVAAFE

SEQ ID NO: 181096 - protein, 14 aa, Mycobacterium tuberculosis
VAGQARAAVAAFEA

SEQ ID NO: 181097 - protein, 14 aa, Mycobacterium tuberculosis
AGQARAAVAAFEAA

SEQ ID NO: 181098 - protein, 14 aa, Mycobacterium tuberculosis
GQARAAVAAFEAAL

SEQ ID NO: 181099 - protein, 14 aa, Mycobacterium tuberculosis
QARAAVAAFEAALA

SEQ ID NO: 181100 - protein, 14 aa, Mycobacterium tuberculosis
ARAAVAAFEAALAA

SEQ ID NO: 181101 - protein, 14 aa, Mycobacterium tuberculosis
RAAVAAFEAALAAT

SEQ ID NO: 181102 - protein, 14 aa, Mycobacterium tuberculosis
AAVAAFEAALAATV

SEQ ID NO: 181103 - protein, 14 aa, Mycobacterium tuberculosis
AVAAFEAALAATVD

SEQ ID NO: 181104 - protein, 14 aa, Mycobacterium tuberculosis
VAAFEAALAATVDP

SEQ ID NO: 181105 - protein, 14 aa, Mycobacterium tuberculosis
AAFEAALAATVDPA

SEQ ID NO: 181106 - protein, 14 aa, Mycobacterium tuberculosis
AFEAALAATVDPAA

SEQ ID NO: 181107 - protein, 14 aa, Mycobacterium tuberculosis
FEAALAATVDPAAV

SEQ ID NO: 181108 - protein, 14 aa, Mycobacterium tuberculosis
EAALAATVDPAAVA

SEQ ID NO: 181109 - protein, 14 aa, Mycobacterium tuberculosis
AALAATVDPAAVAV

SEQ ID NO: 181110 - protein, 14 aa, Mycobacterium tuberculosis
ALAATVDPAAVAVN

SEQ ID NO: 181111 - protein, 14 aa, Mycobacterium tuberculosis
LAATVDPAAVAVNR

SEQ ID NO: 181112 - protein, 14 aa, Mycobacterium tuberculosis
AATVDPAAVAVNRM

SEQ ID NO: 181113 - protein, 14 aa, Mycobacterium tuberculosis
ATVDPAAVAVNRMA

SEQ ID NO: 181114 - protein, 14 aa, Mycobacterium tuberculosis
TVDPAAVAVNRMAM

SEQ ID NO: 181115 - protein, 14 aa, Mycobacterium tuberculosis
VDPAAVAVNRMAMR

SEQ ID NO: 181116 - protein, 14 aa, Mycobacterium tuberculosis
DPAAVAVNRMAMRA

SEQ ID NO: 181117 - protein, 14 aa, Mycobacterium tuberculosis
PAAVAVNRMAMRAL

SEQ ID NO: 181118 - protein, 14 aa, Mycobacterium tuberculosis
AAVAVNRMAMRALA

SEQ ID NO: 181119 - protein, 14 aa, Mycobacterium tuberculosis
AVAVNRMAMRALAM

SEQ ID NO: 181120 - protein, 14 aa, Mycobacterium tuberculosis
VAVNRMAMRALAMS

SEQ ID NO: 181121 - protein, 14 aa, Mycobacterium tuberculosis
AVNRMAMRALAMSN

SEQ ID NO: 181122 - protein, 14 aa, Mycobacterium tuberculosis
VNRMAMRALAMSNL

SEQ ID NO: 181123 - protein, 14 aa, Mycobacterium tuberculosis
NRMAMRALAMSNLL

SEQ ID NO: 181124 - protein, 14 aa, Mycobacterium tuberculosis
RMAMRALAMSNLLG

SEQ ID NO: 181125 - protein, 14 aa, Mycobacterium tuberculosis
MAMRALAMSNLLGQ

SEQ ID NO: 181126 - protein, 14 aa, Mycobacterium tuberculosis
AMRALAMSNLLGQN

SEQ ID NO: 181127 - protein, 14 aa, Mycobacterium tuberculosis
MRALAMSNLLGQNA

SEQ ID NO: 181128 - protein, 14 aa, Mycobacterium tuberculosis
RALAMSNLLGQNAA

SEQ ID NO: 181129 - protein, 14 aa, Mycobacterium tuberculosis
ALAMSNLLGQNAAA

SEQ ID NO: 181130 - protein, 14 aa, Mycobacterium tuberculosis
LAMSNLLGQNAAAI

SEQ ID NO: 181131 - protein, 14 aa, Mycobacterium tuberculosis
AMSNLLGQNAAAIA

SEQ ID NO: 181132 - protein, 14 aa, Mycobacterium tuberculosis
MSNLLGQNAAAIAA

SEQ ID NO: 181133 - protein, 14 aa, Mycobacterium tuberculosis
SNLLGQNAAAIAAV

SEQ ID NO: 181134 - protein, 14 aa, Mycobacterium tuberculosis
NLLGQNAAAIAAVE

SEQ ID NO: 181135 - protein, 14 aa, Mycobacterium tuberculosis
LLGQNAAAIAAVEA

SEQ ID NO: 181136 - protein, 14 aa, Mycobacterium tuberculosis
LGQNAAAIAAVEAE

SEQ ID NO: 181137 - protein, 14 aa, Mycobacterium tuberculosis
GQNAAAIAAVEAEY

SEQ ID NO: 181138 - protein, 14 aa, Mycobacterium tuberculosis
QNAAAIAAVEAEYE

SEQ ID NO: 181139 - protein, 14 aa, Mycobacterium tuberculosis
NAAAIAAVEAEYEL

SEQ ID NO: 181140 - protein, 14 aa, Mycobacterium tuberculosis
AAAIAAVEAEYELM

SEQ ID NO: 181141 - protein, 14 aa, Mycobacterium tuberculosis
AAIAAVEAEYELMW

SEQ ID NO: 181142 - protein, 14 aa, Mycobacterium tuberculosis
AIAAVEAEYELMWA

SEQ ID NO: 181143 - protein, 14 aa, Mycobacterium tuberculosis
IAAVEAEYELMWAA

SEQ ID NO: 181144 - protein, 14 aa, Mycobacterium tuberculosis
AAVEAEYELMWAAD

SEQ ID NO: 181145 - protein, 14 aa, Mycobacterium tuberculosis
AVEAEYELMWAADV

SEQ ID NO: 181146 - protein, 14 aa, Mycobacterium tuberculosis
VEAEYELMWAADVA

SEQ ID NO: 181147 - protein, 14 aa, Mycobacterium tuberculosis
EAEYELMWAADVAA

SEQ ID NO: 181148 - protein, 14 aa, Mycobacterium tuberculosis
AEYELMWAADVAAM

SEQ ID NO: 181149 - protein, 14 aa, Mycobacterium tuberculosis
EYELMWAADVAAMA

SEQ ID NO: 181150 - protein, 14 aa, Mycobacterium tuberculosis
YELMWAADVAAMAG

SEQ ID NO: 181151 - protein, 14 aa, Mycobacterium tuberculosis
ELMWAADVAAMAGY

SEQ ID NO: 181152 - protein, 14 aa, Mycobacterium tuberculosis
LMWAADVAAMAGYH

SEQ ID NO: 181153 - protein, 14 aa, Mycobacterium tuberculosis
MWAADVAAMAGYHS

SEQ ID NO: 181154 - protein, 14 aa, Mycobacterium tuberculosis
WAADVAAMAGYHSG

SEQ ID NO: 181155 - protein, 14 aa, Mycobacterium tuberculosis
AADVAAMAGYHSGA

SEQ ID NO: 181156 - protein, 14 aa, Mycobacterium tuberculosis
ADVAAMAGYHSGAS

SEQ ID NO: 181157 - protein, 14 aa, Mycobacterium tuberculosis
DVAAMAGYHSGASA

SEQ ID NO: 181158 - protein, 14 aa, Mycobacterium tuberculosis
VAAMAGYHSGASAA

SEQ ID NO: 181159 - protein, 14 aa, Mycobacterium tuberculosis
AAMAGYHSGASAAA

SEQ ID NO: 181160 - protein, 14 aa, Mycobacterium tuberculosis
AMAGYHSGASAAAA

SEQ ID NO: 181161 - protein, 14 aa, Mycobacterium tuberculosis
MAGYHSGASAAAAA

SEQ ID NO: 181162 - protein, 14 aa, Mycobacterium tuberculosis
AGYHSGASAAAAAL

SEQ ID NO: 181163 - protein, 14 aa, Mycobacterium tuberculosis
GYHSGASAAAAALP

SEQ ID NO: 181164 - protein, 14 aa, Mycobacterium tuberculosis
YHSGASAAAAALPA

SEQ ID NO: 181165 - protein, 14 aa, Mycobacterium tuberculosis
HSGASAAAAALPAF

SEQ ID NO: 181166 - protein, 14 aa, Mycobacterium tuberculosis
SGASAAAAALPAFS

SEQ ID NO: 181167 - protein, 14 aa, Mycobacterium tuberculosis
GASAAAAALPAFSP

SEQ ID NO: 181168 - protein, 14 aa, Mycobacterium tuberculosis
ASAAAAALPAFSPP

SEQ ID NO: 181169 - protein, 14 aa, Mycobacterium tuberculosis
SAAAAALPAFSPPA

SEQ ID NO: 181170 - protein, 14 aa, Mycobacterium tuberculosis
AAAAALPAFSPPAQ

SEQ ID NO: 181171 - protein, 14 aa, Mycobacterium tuberculosis
AAAALPAFSPPAQA

SEQ ID NO: 181172 - protein, 14 aa, Mycobacterium tuberculosis
AAALPAFSPPAQAL

SEQ ID NO: 181173 - protein, 14 aa, Mycobacterium tuberculosis
AALPAFSPPAQALG

SEQ ID NO: 181174 - protein, 14 aa, Mycobacterium tuberculosis
ALPAFSPPAQALGG

SEQ ID NO: 181175 - protein, 14 aa, Mycobacterium tuberculosis
LPAFSPPAQALGGG

SEQ ID NO: 181176 - protein, 14 aa, Mycobacterium tuberculosis
PAFSPPAQALGGGV

SEQ ID NO: 181177 - protein, 14 aa, Mycobacterium tuberculosis
AFSPPAQALGGGVG

SEQ ID NO: 181178 - protein, 14 aa, Mycobacterium tuberculosis
FSPPAQALGGGVGA

SEQ ID NO: 181179 - protein, 14 aa, Mycobacterium tuberculosis
SPPAQALGGGVGAF

SEQ ID NO: 181180 - protein, 14 aa, Mycobacterium tuberculosis
PPAQALGGGVGAFL

SEQ ID NO: 181181 - protein, 14 aa, Mycobacterium tuberculosis
PAQALGGGVGAFLN

SEQ ID NO: 181182 - protein, 14 aa, Mycobacterium tuberculosis
AQALGGGVGAFLNA

SEQ ID NO: 181183 - protein, 14 aa, Mycobacterium tuberculosis
QALGGGVGAFLNAL

SEQ ID NO: 181184 - protein, 14 aa, Mycobacterium tuberculosis
ALGGGVGAFLNALF

SEQ ID NO: 181185 - protein, 14 aa, Mycobacterium tuberculosis
LGGGVGAFLNALFA

SEQ ID NO: 181186 - protein, 14 aa, Mycobacterium tuberculosis
GGGVGAFLNALFAG

SEQ ID NO: 181187 - protein, 14 aa, Mycobacterium tuberculosis
GGVGAFLNALFAGP

SEQ ID NO: 181188 - protein, 14 aa, Mycobacterium tuberculosis
GVGAFLNALFAGPA

SEQ ID NO: 181189 - protein, 14 aa, Mycobacterium tuberculosis
VGAFLNALFAGPAK

SEQ ID NO: 181190 - protein, 14 aa, Mycobacterium tuberculosis
GAFLNALFAGPAKM

SEQ ID NO: 181191 - protein, 14 aa, Mycobacterium tuberculosis
AFLNALFAGPAKML

SEQ ID NO: 181192 - protein, 14 aa, Mycobacterium tuberculosis
FLNALFAGPAKMLR

SEQ ID NO: 181193 - protein, 14 aa, Mycobacterium tuberculosis
LNALFAGPAKMLRL

SEQ ID NO: 181194 - protein, 14 aa, Mycobacterium tuberculosis
NALFAGPAKMLRLN

SEQ ID NO: 181195 - protein, 14 aa, Mycobacterium tuberculosis
ALFAGPAKMLRLNA

SEQ ID NO: 181196 - protein, 14 aa, Mycobacterium tuberculosis
LFAGPAKMLRLNAG

SEQ ID NO: 181197 - protein, 14 aa, Mycobacterium tuberculosis
FAGPAKMLRLNAGL

SEQ ID NO: 181198 - protein, 14 aa, Mycobacterium tuberculosis
AGPAKMLRLNAGLG

SEQ ID NO: 181199 - protein, 14 aa, Mycobacterium tuberculosis
GPAKMLRLNAGLGN

SEQ ID NO: 181200 - protein, 14 aa, Mycobacterium tuberculosis
PAKMLRLNAGLGNV

SEQ ID NO: 181201 - protein, 14 aa, Mycobacterium tuberculosis
AKMLRLNAGLGNVG

SEQ ID NO: 181202 - protein, 14 aa, Mycobacterium tuberculosis
KMLRLNAGLGNVGN

SEQ ID NO: 181203 - protein, 14 aa, Mycobacterium tuberculosis
MLRLNAGLGNVGNY

SEQ ID NO: 181204 - protein, 14 aa, Mycobacterium tuberculosis
LRLNAGLGNVGNYN

SEQ ID NO: 181205 - protein, 14 aa, Mycobacterium tuberculosis
RLNAGLGNVGNYNV

SEQ ID NO: 181206 - protein, 14 aa, Mycobacterium tuberculosis
LNAGLGNVGNYNVG

SEQ ID NO: 181207 - protein, 14 aa, Mycobacterium tuberculosis
NAGLGNVGNYNVGL

SEQ ID NO: 181208 - protein, 14 aa, Mycobacterium tuberculosis
AGLGNVGNYNVGLG

SEQ ID NO: 181209 - protein, 14 aa, Mycobacterium tuberculosis
GLGNVGNYNVGLGN

SEQ ID NO: 181210 - protein, 14 aa, Mycobacterium tuberculosis
LGNVGNYNVGLGNV

SEQ ID NO: 181211 - protein, 14 aa, Mycobacterium tuberculosis
GNVGNYNVGLGNVG

SEQ ID NO: 181212 - protein, 14 aa, Mycobacterium tuberculosis
NVGNYNVGLGNVGI

SEQ ID NO: 181213 - protein, 14 aa, Mycobacterium tuberculosis
VGNYNVGLGNVGIF

SEQ ID NO: 181214 - protein, 14 aa, Mycobacterium tuberculosis
GNYNVGLGNVGIFN

SEQ ID NO: 181215 - protein, 14 aa, Mycobacterium tuberculosis
NYNVGLGNVGIFNL

SEQ ID NO: 181216 - protein, 14 aa, Mycobacterium tuberculosis
YNVGLGNVGIFNLG

SEQ ID NO: 181217 - protein, 14 aa, Mycobacterium tuberculosis
NVGLGNVGIFNLGA

SEQ ID NO: 181218 - protein, 14 aa, Mycobacterium tuberculosis
VGLGNVGIFNLGAA

SEQ ID NO: 181219 - protein, 14 aa, Mycobacterium tuberculosis
GLGNVGIFNLGAAN

SEQ ID NO: 181220 - protein, 14 aa, Mycobacterium tuberculosis
LGNVGIFNLGAANV

SEQ ID NO: 181221 - protein, 14 aa, Mycobacterium tuberculosis
GNVGIFNLGAANVG

SEQ ID NO: 181222 - protein, 14 aa, Mycobacterium tuberculosis
NVGIFNLGAANVGA

SEQ ID NO: 181223 - protein, 14 aa, Mycobacterium tuberculosis
VGIFNLGAANVGAQ

SEQ ID NO: 181224 - protein, 14 aa, Mycobacterium tuberculosis
GIFNLGAANVGAQN

SEQ ID NO: 181225 - protein, 14 aa, Mycobacterium tuberculosis
IFNLGAANVGAQNL

SEQ ID NO: 181226 - protein, 14 aa, Mycobacterium tuberculosis
FNLGAANVGAQNLG

SEQ ID NO: 181227 - protein, 14 aa, Mycobacterium tuberculosis
NLGAANVGAQNLGA

SEQ ID NO: 181228 - protein, 14 aa, Mycobacterium tuberculosis
LGAANVGAQNLGAA

SEQ ID NO: 181229 - protein, 14 aa, Mycobacterium tuberculosis
GAANVGAQNLGAAN

SEQ ID NO: 181230 - protein, 14 aa, Mycobacterium tuberculosis
AANVGAQNLGAANA

SEQ ID NO: 181231 - protein, 14 aa, Mycobacterium tuberculosis
ANVGAQNLGAANAG

SEQ ID NO: 181232 - protein, 14 aa, Mycobacterium tuberculosis
NVGAQNLGAANAGS

SEQ ID NO: 181233 - protein, 14 aa, Mycobacterium tuberculosis
VGAQNLGAANAGSG

SEQ ID NO: 181234 - protein, 14 aa, Mycobacterium tuberculosis
GAQNLGAANAGSGN

SEQ ID NO: 181235 - protein, 14 aa, Mycobacterium tuberculosis
AQNLGAANAGSGNF

SEQ ID NO: 181236 - protein, 14 aa, Mycobacterium tuberculosis
QNLGAANAGSGNFG

SEQ ID NO: 181237 - protein, 14 aa, Mycobacterium tuberculosis
NLGAANAGSGNFGF

SEQ ID NO: 181238 - protein, 14 aa, Mycobacterium tuberculosis
LGAANAGSGNFGFG

SEQ ID NO: 181239 - protein, 14 aa, Mycobacterium tuberculosis
GAANAGSGNFGFGN

SEQ ID NO: 181240 - protein, 14 aa, Mycobacterium tuberculosis
AANAGSGNFGFGNI

SEQ ID NO: 181241 - protein, 14 aa, Mycobacterium tuberculosis
ANAGSGNFGFGNIG

SEQ ID NO: 181242 - protein, 14 aa, Mycobacterium tuberculosis
NAGSGNFGFGNIGN

SEQ ID NO: 181243 - protein, 14 aa, Mycobacterium tuberculosis
AGSGNFGFGNIGNA

SEQ ID NO: 181244 - protein, 14 aa, Mycobacterium tuberculosis
GSGNFGFGNIGNAN

SEQ ID NO: 181245 - protein, 14 aa, Mycobacterium tuberculosis
SGNFGFGNIGNANF

SEQ ID NO: 181246 - protein, 14 aa, Mycobacterium tuberculosis
GNFGFGNIGNANFG

SEQ ID NO: 181247 - protein, 14 aa, Mycobacterium tuberculosis
NFGFGNIGNANFGF

SEQ ID NO: 181248 - protein, 14 aa, Mycobacterium tuberculosis
FGFGNIGNANFGFG

SEQ ID NO: 181249 - protein, 14 aa, Mycobacterium tuberculosis
GFGNIGNANFGFGN

SEQ ID NO: 181250 - protein, 14 aa, Mycobacterium tuberculosis
FGNIGNANFGFGNS

SEQ ID NO: 181251 - protein, 14 aa, Mycobacterium tuberculosis
GNIGNANFGFGNSG

SEQ ID NO: 181252 - protein, 14 aa, Mycobacterium tuberculosis
NIGNANFGFGNSGL

SEQ ID NO: 181253 - protein, 14 aa, Mycobacterium tuberculosis
IGNANFGFGNSGLG

SEQ ID NO: 181254 - protein, 14 aa, Mycobacterium tuberculosis
GNANFGFGNSGLGL

SEQ ID NO: 181255 - protein, 14 aa, Mycobacterium tuberculosis
NANFGFGNSGLGLP

SEQ ID NO: 181256 - protein, 14 aa, Mycobacterium tuberculosis
ANFGFGNSGLGLPP

SEQ ID NO: 181257 - protein, 14 aa, Mycobacterium tuberculosis
NFGFGNSGLGLPPG

SEQ ID NO: 181258 - protein, 14 aa, Mycobacterium tuberculosis
FGFGNSGLGLPPGM

SEQ ID NO: 181259 - protein, 14 aa, Mycobacterium tuberculosis
GFGNSGLGLPPGMG

SEQ ID NO: 181260 - protein, 14 aa, Mycobacterium tuberculosis
FGNSGLGLPPGMGN

SEQ ID NO: 181261 - protein, 14 aa, Mycobacterium tuberculosis
GNSGLGLPPGMGNI

SEQ ID NO: 181262 - protein, 14 aa, Mycobacterium tuberculosis
NSGLGLPPGMGNIG

SEQ ID NO: 181263 - protein, 14 aa, Mycobacterium tuberculosis
SGLGLPPGMGNIGL

SEQ ID NO: 181264 - protein, 14 aa, Mycobacterium tuberculosis
GLGLPPGMGNIGLG

SEQ ID NO: 181265 - protein, 14 aa, Mycobacterium tuberculosis
LGLPPGMGNIGLGN

SEQ ID NO: 181266 - protein, 14 aa, Mycobacterium tuberculosis
GLPPGMGNIGLGNA

SEQ ID NO: 181267 - protein, 14 aa, Mycobacterium tuberculosis
LPPGMGNIGLGNAG

SEQ ID NO: 181268 - protein, 14 aa, Mycobacterium tuberculosis
PPGMGNIGLGNAGS

SEQ ID NO: 181269 - protein, 14 aa, Mycobacterium tuberculosis
PGMGNIGLGNAGSS

SEQ ID NO: 181270 - protein, 14 aa, Mycobacterium tuberculosis
GMGNIGLGNAGSSN

SEQ ID NO: 181271 - protein, 14 aa, Mycobacterium tuberculosis
MGNIGLGNAGSSNY

SEQ ID NO: 181272 - protein, 14 aa, Mycobacterium tuberculosis
GNIGLGNAGSSNYG

SEQ ID NO: 181273 - protein, 14 aa, Mycobacterium tuberculosis
NIGLGNAGSSNYGL

SEQ ID NO: 181274 - protein, 14 aa, Mycobacterium tuberculosis
IGLGNAGSSNYGLA

SEQ ID NO: 181275 - protein, 14 aa, Mycobacterium tuberculosis
GLGNAGSSNYGLAN

SEQ ID NO: 181276 - protein, 14 aa, Mycobacterium tuberculosis
LGNAGSSNYGLANL

SEQ ID NO: 181277 - protein, 14 aa, Mycobacterium tuberculosis
GNAGSSNYGLANLG

SEQ ID NO: 181278 - protein, 14 aa, Mycobacterium tuberculosis
NAGSSNYGLANLGV

SEQ ID NO: 181279 - protein, 14 aa, Mycobacterium tuberculosis
AGSSNYGLANLGVG

SEQ ID NO: 181280 - protein, 14 aa, Mycobacterium tuberculosis
GSSNYGLANLGVGN

SEQ ID NO: 181281 - protein, 14 aa, Mycobacterium tuberculosis
SSNYGLANLGVGNI

SEQ ID NO: 181282 - protein, 14 aa, Mycobacterium tuberculosis
SNYGLANLGVGNIG

SEQ ID NO: 181283 - protein, 14 aa, Mycobacterium tuberculosis
NYGLANLGVGNIGF

SEQ ID NO: 181284 - protein, 14 aa, Mycobacterium tuberculosis
YGLANLGVGNIGFA

SEQ ID NO: 181285 - protein, 14 aa, Mycobacterium tuberculosis
GLANLGVGNIGFAN

SEQ ID NO: 181286 - protein, 14 aa, Mycobacterium tuberculosis
LANLGVGNIGFANT

SEQ ID NO: 181287 - protein, 14 aa, Mycobacterium tuberculosis
ANLGVGNIGFANTG

SEQ ID NO: 181288 - protein, 14 aa, Mycobacterium tuberculosis
NLGVGNIGFANTGS

SEQ ID NO: 181289 - protein, 14 aa, Mycobacterium tuberculosis
LGVGNIGFANTGSN

SEQ ID NO: 181290 - protein, 14 aa, Mycobacterium tuberculosis
GVGNIGFANTGSNN

SEQ ID NO: 181291 - protein, 14 aa, Mycobacterium tuberculosis
VGNIGFANTGSNNI

SEQ ID NO: 181292 - protein, 14 aa, Mycobacterium tuberculosis
GNIGFANTGSNNIG

SEQ ID NO: 181293 - protein, 14 aa, Mycobacterium tuberculosis
NIGFANTGSNNIGI

SEQ ID NO: 181294 - protein, 14 aa, Mycobacterium tuberculosis
IGFANTGSNNIGIG

SEQ ID NO: 181295 - protein, 14 aa, Mycobacterium tuberculosis
GFANTGSNNIGIGL

SEQ ID NO: 181296 - protein, 14 aa, Mycobacterium tuberculosis
FANTGSNNIGIGLT

SEQ ID NO: 181297 - protein, 14 aa, Mycobacterium tuberculosis
ANTGSNNIGIGLTG

SEQ ID NO: 181298 - protein, 14 aa, Mycobacterium tuberculosis
NTGSNNIGIGLTGD

SEQ ID NO: 181299 - protein, 14 aa, Mycobacterium tuberculosis
TGSNNIGIGLTGDN

SEQ ID NO: 181300 - protein, 14 aa, Mycobacterium tuberculosis
GSNNIGIGLTGDNL

SEQ ID NO: 181301 - protein, 14 aa, Mycobacterium tuberculosis
SNNIGIGLTGDNLT

SEQ ID NO: 181302 - protein, 14 aa, Mycobacterium tuberculosis
NNIGIGLTGDNLTG

SEQ ID NO: 181303 - protein, 14 aa, Mycobacterium tuberculosis
NIGIGLTGDNLTGI

SEQ ID NO: 181304 - protein, 14 aa, Mycobacterium tuberculosis
IGIGLTGDNLTGIG

SEQ ID NO: 181305 - protein, 14 aa, Mycobacterium tuberculosis
GIGLTGDNLTGIGG

SEQ ID NO: 181306 - protein, 14 aa, Mycobacterium tuberculosis
IGLTGDNLTGIGGL

SEQ ID NO: 181307 - protein, 14 aa, Mycobacterium tuberculosis
GLTGDNLTGIGGLN

SEQ ID NO: 181308 - protein, 14 aa, Mycobacterium tuberculosis
LTGDNLTGIGGLNS

SEQ ID NO: 181309 - protein, 14 aa, Mycobacterium tuberculosis
TGDNLTGIGGLNSG

SEQ ID NO: 181310 - protein, 14 aa, Mycobacterium tuberculosis
GDNLTGIGGLNSGT

SEQ ID NO: 181311 - protein, 14 aa, Mycobacterium tuberculosis
DNLTGIGGLNSGTG

SEQ ID NO: 181312 - protein, 14 aa, Mycobacterium tuberculosis
NLTGIGGLNSGTGN

SEQ ID NO: 181313 - protein, 14 aa, Mycobacterium tuberculosis
LTGIGGLNSGTGNL

SEQ ID NO: 181314 - protein, 14 aa, Mycobacterium tuberculosis
TGIGGLNSGTGNLG

SEQ ID NO: 181315 - protein, 14 aa, Mycobacterium tuberculosis
GIGGLNSGTGNLGL

SEQ ID NO: 181316 - protein, 14 aa, Mycobacterium tuberculosis
IGGLNSGTGNLGLF

SEQ ID NO: 181317 - protein, 14 aa, Mycobacterium tuberculosis
GGLNSGTGNLGLFN

SEQ ID NO: 181318 - protein, 14 aa, Mycobacterium tuberculosis
GLNSGTGNLGLFNS

SEQ ID NO: 181319 - protein, 14 aa, Mycobacterium tuberculosis
LNSGTGNLGLFNSG

SEQ ID NO: 181320 - protein, 14 aa, Mycobacterium tuberculosis
NSGTGNLGLFNSGT

SEQ ID NO: 181321 - protein, 14 aa, Mycobacterium tuberculosis
SGTGNLGLFNSGTG

SEQ ID NO: 181322 - protein, 14 aa, Mycobacterium tuberculosis
GTGNLGLFNSGTGN

SEQ ID NO: 181323 - protein, 14 aa, Mycobacterium tuberculosis
TGNLGLFNSGTGNI

SEQ ID NO: 181324 - protein, 14 aa, Mycobacterium tuberculosis
GNLGLFNSGTGNIG

SEQ ID NO: 181325 - protein, 14 aa, Mycobacterium tuberculosis
NLGLFNSGTGNIGF

SEQ ID NO: 181326 - protein, 14 aa, Mycobacterium tuberculosis
LGLFNSGTGNIGFF

SEQ ID NO: 181327 - protein, 14 aa, Mycobacterium tuberculosis
GLFNSGTGNIGFFN

SEQ ID NO: 181328 - protein, 14 aa, Mycobacterium tuberculosis
LFNSGTGNIGFFNS

SEQ ID NO: 181329 - protein, 14 aa, Mycobacterium tuberculosis
FNSGTGNIGFFNSG

SEQ ID NO: 181330 - protein, 14 aa, Mycobacterium tuberculosis
NSGTGNIGFFNSGT

SEQ ID NO: 181331 - protein, 14 aa, Mycobacterium tuberculosis
SGTGNIGFFNSGTG

SEQ ID NO: 181332 - protein, 14 aa, Mycobacterium tuberculosis
GTGNIGFFNSGTGN

SEQ ID NO: 181333 - protein, 14 aa, Mycobacterium tuberculosis
TGNIGFFNSGTGNF

SEQ ID NO: 181334 - protein, 14 aa, Mycobacterium tuberculosis
GNIGFFNSGTGNFG

SEQ ID NO: 181335 - protein, 14 aa, Mycobacterium tuberculosis
NIGFFNSGTGNFGV

SEQ ID NO: 181336 - protein, 14 aa, Mycobacterium tuberculosis
IGFFNSGTGNFGVF

SEQ ID NO: 181337 - protein, 14 aa, Mycobacterium tuberculosis
GFFNSGTGNFGVFN

SEQ ID NO: 181338 - protein, 14 aa, Mycobacterium tuberculosis
FFNSGTGNFGVFNS

SEQ ID NO: 181339 - protein, 14 aa, Mycobacterium tuberculosis
FNSGTGNFGVFNSG

SEQ ID NO: 181340 - protein, 14 aa, Mycobacterium tuberculosis
NSGTGNFGVFNSGS

SEQ ID NO: 181341 - protein, 14 aa, Mycobacterium tuberculosis
SGTGNFGVFNSGSY

SEQ ID NO: 181342 - protein, 14 aa, Mycobacterium tuberculosis
GTGNFGVFNSGSYN

SEQ ID NO: 181343 - protein, 14 aa, Mycobacterium tuberculosis
TGNFGVFNSGSYNT

SEQ ID NO: 181344 - protein, 14 aa, Mycobacterium tuberculosis
GNFGVFNSGSYNTG

SEQ ID NO: 181345 - protein, 14 aa, Mycobacterium tuberculosis
NFGVFNSGSYNTGV

SEQ ID NO: 181346 - protein, 14 aa, Mycobacterium tuberculosis
FGVFNSGSYNTGVG

SEQ ID NO: 181347 - protein, 14 aa, Mycobacterium tuberculosis
GVFNSGSYNTGVGN

SEQ ID NO: 181348 - protein, 14 aa, Mycobacterium tuberculosis
VFNSGSYNTGVGNA

SEQ ID NO: 181349 - protein, 14 aa, Mycobacterium tuberculosis
FNSGSYNTGVGNAG

SEQ ID NO: 181350 - protein, 14 aa, Mycobacterium tuberculosis
NSGSYNTGVGNAGT

SEQ ID NO: 181351 - protein, 14 aa, Mycobacterium tuberculosis
SGSYNTGVGNAGTA

SEQ ID NO: 181352 - protein, 14 aa, Mycobacterium tuberculosis
GSYNTGVGNAGTAS

SEQ ID NO: 181353 - protein, 14 aa, Mycobacterium tuberculosis
SYNTGVGNAGTAST

SEQ ID NO: 181354 - protein, 14 aa, Mycobacterium tuberculosis
YNTGVGNAGTASTG

SEQ ID NO: 181355 - protein, 14 aa, Mycobacterium tuberculosis
NTGVGNAGTASTGL

SEQ ID NO: 181356 - protein, 14 aa, Mycobacterium tuberculosis
TGVGNAGTASTGLF

SEQ ID NO: 181357 - protein, 14 aa, Mycobacterium tuberculosis
GVGNAGTASTGLFN

SEQ ID NO: 181358 - protein, 14 aa, Mycobacterium tuberculosis
VGNAGTASTGLFNV

SEQ ID NO: 181359 - protein, 14 aa, Mycobacterium tuberculosis
GNAGTASTGLFNVG

SEQ ID NO: 181360 - protein, 14 aa, Mycobacterium tuberculosis
NAGTASTGLFNVGG

SEQ ID NO: 181361 - protein, 14 aa, Mycobacterium tuberculosis
AGTASTGLFNVGGF

SEQ ID NO: 181362 - protein, 14 aa, Mycobacterium tuberculosis
GTASTGLFNVGGFN

SEQ ID NO: 181363 - protein, 14 aa, Mycobacterium tuberculosis
TASTGLFNVGGFNT

SEQ ID NO: 181364 - protein, 14 aa, Mycobacterium tuberculosis
ASTGLFNVGGFNTG

SEQ ID NO: 181365 - protein, 14 aa, Mycobacterium tuberculosis
STGLFNVGGFNTGV

SEQ ID NO: 181366 - protein, 14 aa, Mycobacterium tuberculosis
TGLFNVGGFNTGVA

SEQ ID NO: 181367 - protein, 14 aa, Mycobacterium tuberculosis
GLFNVGGFNTGVAN

SEQ ID NO: 181368 - protein, 14 aa, Mycobacterium tuberculosis
LFNVGGFNTGVANV

SEQ ID NO: 181369 - protein, 14 aa, Mycobacterium tuberculosis
FNVGGFNTGVANVG

SEQ ID NO: 181370 - protein, 14 aa, Mycobacterium tuberculosis
NVGGFNTGVANVGS

SEQ ID NO: 181371 - protein, 14 aa, Mycobacterium tuberculosis
VGGFNTGVANVGSY

SEQ ID NO: 181372 - protein, 14 aa, Mycobacterium tuberculosis
GGFNTGVANVGSYN

SEQ ID NO: 181373 - protein, 14 aa, Mycobacterium tuberculosis
GFNTGVANVGSYNT

SEQ ID NO: 181374 - protein, 14 aa, Mycobacterium tuberculosis
FNTGVANVGSYNTG

SEQ ID NO: 181375 - protein, 14 aa, Mycobacterium tuberculosis
NTGVANVGSYNTGS

SEQ ID NO: 181376 - protein, 14 aa, Mycobacterium tuberculosis
TGVANVGSYNTGSF

SEQ ID NO: 181377 - protein, 14 aa, Mycobacterium tuberculosis
GVANVGSYNTGSFN

SEQ ID NO: 181378 - protein, 14 aa, Mycobacterium tuberculosis
VANVGSYNTGSFNA

SEQ ID NO: 181379 - protein, 14 aa, Mycobacterium tuberculosis
ANVGSYNTGSFNAG

SEQ ID NO: 181380 - protein, 14 aa, Mycobacterium tuberculosis
NVGSYNTGSFNAGN

SEQ ID NO: 181381 - protein, 14 aa, Mycobacterium tuberculosis
VGSYNTGSFNAGNT

SEQ ID NO: 181382 - protein, 14 aa, Mycobacterium tuberculosis
GSYNTGSFNAGNTN

SEQ ID NO: 181383 - protein, 14 aa, Mycobacterium tuberculosis
SYNTGSFNAGNTNT

SEQ ID NO: 181384 - protein, 14 aa, Mycobacterium tuberculosis
YNTGSFNAGNTNTG

SEQ ID NO: 181385 - protein, 14 aa, Mycobacterium tuberculosis
NTGSFNAGNTNTGG

SEQ ID NO: 181386 - protein, 14 aa, Mycobacterium tuberculosis
TGSFNAGNTNTGGF

SEQ ID NO: 181387 - protein, 14 aa, Mycobacterium tuberculosis
GSFNAGNTNTGGFN

SEQ ID NO: 181388 - protein, 14 aa, Mycobacterium tuberculosis
SFNAGNTNTGGFNP

SEQ ID NO: 181389 - protein, 14 aa, Mycobacterium tuberculosis
FNAGNTNTGGFNPG

SEQ ID NO: 181390 - protein, 14 aa, Mycobacterium tuberculosis
NAGNTNTGGFNPGN

SEQ ID NO: 181391 - protein, 14 aa, Mycobacterium tuberculosis
AGNTNTGGFNPGNV

SEQ ID NO: 181392 - protein, 14 aa, Mycobacterium tuberculosis
GNTNTGGFNPGNVN

SEQ ID NO: 181393 - protein, 14 aa, Mycobacterium tuberculosis
NTNTGGFNPGNVNT

SEQ ID NO: 181394 - protein, 14 aa, Mycobacterium tuberculosis
TNTGGFNPGNVNTG

SEQ ID NO: 181395 - protein, 14 aa, Mycobacterium tuberculosis
NTGGFNPGNVNTGW

SEQ ID NO: 181396 - protein, 14 aa, Mycobacterium tuberculosis
TGGFNPGNVNTGWL

SEQ ID NO: 181397 - protein, 14 aa, Mycobacterium tuberculosis
GGFNPGNVNTGWLN

SEQ ID NO: 181398 - protein, 14 aa, Mycobacterium tuberculosis
GFNPGNVNTGWLNT

SEQ ID NO: 181399 - protein, 14 aa, Mycobacterium tuberculosis
FNPGNVNTGWLNTG

SEQ ID NO: 181400 - protein, 14 aa, Mycobacterium tuberculosis
NPGNVNTGWLNTGN

SEQ ID NO: 181401 - protein, 14 aa, Mycobacterium tuberculosis
PGNVNTGWLNTGNT

SEQ ID NO: 181402 - protein, 14 aa, Mycobacterium tuberculosis
GNVNTGWLNTGNTN

SEQ ID NO: 181403 - protein, 14 aa, Mycobacterium tuberculosis
NVNTGWLNTGNTNT

SEQ ID NO: 181404 - protein, 14 aa, Mycobacterium tuberculosis
VNTGWLNTGNTNTG

SEQ ID NO: 181405 - protein, 14 aa, Mycobacterium tuberculosis
NTGWLNTGNTNTGI

SEQ ID NO: 181406 - protein, 14 aa, Mycobacterium tuberculosis
TGWLNTGNTNTGIA

SEQ ID NO: 181407 - protein, 14 aa, Mycobacterium tuberculosis
GWLNTGNTNTGIAN

SEQ ID NO: 181408 - protein, 14 aa, Mycobacterium tuberculosis
WLNTGNTNTGIANS

SEQ ID NO: 181409 - protein, 14 aa, Mycobacterium tuberculosis
LNTGNTNTGIANSG

SEQ ID NO: 181410 - protein, 14 aa, Mycobacterium tuberculosis
NTGNTNTGIANSGN

SEQ ID NO: 181411 - protein, 14 aa, Mycobacterium tuberculosis
TGNTNTGIANSGNV

SEQ ID NO: 181412 - protein, 14 aa, Mycobacterium tuberculosis
GNTNTGIANSGNVN

SEQ ID NO: 181413 - protein, 14 aa, Mycobacterium tuberculosis
NTNTGIANSGNVNT

SEQ ID NO: 181414 - protein, 14 aa, Mycobacterium tuberculosis
TNTGIANSGNVNTG

SEQ ID NO: 181415 - protein, 14 aa, Mycobacterium tuberculosis
NTGIANSGNVNTGA

SEQ ID NO: 181416 - protein, 14 aa, Mycobacterium tuberculosis
TGIANSGNVNTGAF

SEQ ID NO: 181417 - protein, 14 aa, Mycobacterium tuberculosis
GIANSGNVNTGAFI

SEQ ID NO: 181418 - protein, 14 aa, Mycobacterium tuberculosis
IANSGNVNTGAFIS

SEQ ID NO: 181419 - protein, 14 aa, Mycobacterium tuberculosis
ANSGNVNTGAFISG

SEQ ID NO: 181420 - protein, 14 aa, Mycobacterium tuberculosis
NSGNVNTGAFISGN

SEQ ID NO: 181421 - protein, 14 aa, Mycobacterium tuberculosis
SGNVNTGAFISGNF

SEQ ID NO: 181422 - protein, 14 aa, Mycobacterium tuberculosis
GNVNTGAFISGNFS

SEQ ID NO: 181423 - protein, 14 aa, Mycobacterium tuberculosis
NVNTGAFISGNFSN

SEQ ID NO: 181424 - protein, 14 aa, Mycobacterium tuberculosis
VNTGAFISGNFSNG

SEQ ID NO: 181425 - protein, 14 aa, Mycobacterium tuberculosis
NTGAFISGNFSNGV

SEQ ID NO: 181426 - protein, 14 aa, Mycobacterium tuberculosis
TGAFISGNFSNGVL

SEQ ID NO: 181427 - protein, 14 aa, Mycobacterium tuberculosis
GAFISGNFSNGVLW

SEQ ID NO: 181428 - protein, 14 aa, Mycobacterium tuberculosis
AFISGNFSNGVLWR

SEQ ID NO: 181429 - protein, 14 aa, Mycobacterium tuberculosis
FISGNFSNGVLWRG

SEQ ID NO: 181430 - protein, 14 aa, Mycobacterium tuberculosis
ISGNFSNGVLWRGD

SEQ ID NO: 181431 - protein, 14 aa, Mycobacterium tuberculosis
SGNFSNGVLWRGDY

SEQ ID NO: 181432 - protein, 14 aa, Mycobacterium tuberculosis
GNFSNGVLWRGDYE

SEQ ID NO: 181433 - protein, 14 aa, Mycobacterium tuberculosis
NFSNGVLWRGDYEG

SEQ ID NO: 181434 - protein, 14 aa, Mycobacterium tuberculosis
FSNGVLWRGDYEGL

SEQ ID NO: 181435 - protein, 14 aa, Mycobacterium tuberculosis
SNGVLWRGDYEGLW

SEQ ID NO: 181436 - protein, 14 aa, Mycobacterium tuberculosis
NGVLWRGDYEGLWG

SEQ ID NO: 181437 - protein, 14 aa, Mycobacterium tuberculosis
GVLWRGDYEGLWGL

SEQ ID NO: 181438 - protein, 14 aa, Mycobacterium tuberculosis
VLWRGDYEGLWGLS

SEQ ID NO: 181439 - protein, 14 aa, Mycobacterium tuberculosis
LWRGDYEGLWGLSG

SEQ ID NO: 181440 - protein, 14 aa, Mycobacterium tuberculosis
WRGDYEGLWGLSGG

SEQ ID NO: 181441 - protein, 14 aa, Mycobacterium tuberculosis
RGDYEGLWGLSGGS

SEQ ID NO: 181442 - protein, 14 aa, Mycobacterium tuberculosis
GDYEGLWGLSGGST

SEQ ID NO: 181443 - protein, 14 aa, Mycobacterium tuberculosis
DYEGLWGLSGGSTI

SEQ ID NO: 181444 - protein, 14 aa, Mycobacterium tuberculosis
YEGLWGLSGGSTIP

SEQ ID NO: 181445 - protein, 14 aa, Mycobacterium tuberculosis
EGLWGLSGGSTIPA

SEQ ID NO: 181446 - protein, 14 aa, Mycobacterium tuberculosis
GLWGLSGGSTIPAI

SEQ ID NO: 181447 - protein, 14 aa, Mycobacterium tuberculosis
LWGLSGGSTIPAIP

SEQ ID NO: 181448 - protein, 14 aa, Mycobacterium tuberculosis
WGLSGGSTIPAIPI

SEQ ID NO: 181449 - protein, 14 aa, Mycobacterium tuberculosis
GLSGGSTIPAIPIG

SEQ ID NO: 181450 - protein, 14 aa, Mycobacterium tuberculosis
LSGGSTIPAIPIGL

SEQ ID NO: 181451 - protein, 14 aa, Mycobacterium tuberculosis
SGGSTIPAIPIGLE

SEQ ID NO: 181452 - protein, 14 aa, Mycobacterium tuberculosis
GGSTIPAIPIGLEL

SEQ ID NO: 181453 - protein, 14 aa, Mycobacterium tuberculosis
GSTIPAIPIGLELN

SEQ ID NO: 181454 - protein, 14 aa, Mycobacterium tuberculosis
STIPAIPIGLELNG

SEQ ID NO: 181455 - protein, 14 aa, Mycobacterium tuberculosis
TIPAIPIGLELNGG

SEQ ID NO: 181456 - protein, 14 aa, Mycobacterium tuberculosis
IPAIPIGLELNGGV

SEQ ID NO: 181457 - protein, 14 aa, Mycobacterium tuberculosis
PAIPIGLELNGGVG

SEQ ID NO: 181458 - protein, 14 aa, Mycobacterium tuberculosis
AIPIGLELNGGVGP

SEQ ID NO: 181459 - protein, 14 aa, Mycobacterium tuberculosis
IPIGLELNGGVGPI

SEQ ID NO: 181460 - protein, 14 aa, Mycobacterium tuberculosis
PIGLELNGGVGPIT

SEQ ID NO: 181461 - protein, 14 aa, Mycobacterium tuberculosis
IGLELNGGVGPITV

SEQ ID NO: 181462 - protein, 14 aa, Mycobacterium tuberculosis
GLELNGGVGPITVL

SEQ ID NO: 181463 - protein, 14 aa, Mycobacterium tuberculosis
LELNGGVGPITVLP

SEQ ID NO: 181464 - protein, 14 aa, Mycobacterium tuberculosis
ELNGGVGPITVLPI

SEQ ID NO: 181465 - protein, 14 aa, Mycobacterium tuberculosis
LNGGVGPITVLPIQ

SEQ ID NO: 181466 - protein, 14 aa, Mycobacterium tuberculosis
NGGVGPITVLPIQI

SEQ ID NO: 181467 - protein, 14 aa, Mycobacterium tuberculosis
GGVGPITVLPIQIL

SEQ ID NO: 181468 - protein, 14 aa, Mycobacterium tuberculosis
GVGPITVLPIQILP

SEQ ID NO: 181469 - protein, 14 aa, Mycobacterium tuberculosis
VGPITVLPIQILPT

SEQ ID NO: 181470 - protein, 14 aa, Mycobacterium tuberculosis
GPITVLPIQILPTI

SEQ ID NO: 181471 - protein, 14 aa, Mycobacterium tuberculosis
PITVLPIQILPTIP

SEQ ID NO: 181472 - protein, 14 aa, Mycobacterium tuberculosis
ITVLPIQILPTIPL

SEQ ID NO: 181473 - protein, 14 aa, Mycobacterium tuberculosis
TVLPIQILPTIPLN

SEQ ID NO: 181474 - protein, 14 aa, Mycobacterium tuberculosis
VLPIQILPTIPLNI

SEQ ID NO: 181475 - protein, 14 aa, Mycobacterium tuberculosis
LPIQILPTIPLNIH

SEQ ID NO: 181476 - protein, 14 aa, Mycobacterium tuberculosis
PIQILPTIPLNIHQ

SEQ ID NO: 181477 - protein, 14 aa, Mycobacterium tuberculosis
IQILPTIPLNIHQT

SEQ ID NO: 181478 - protein, 14 aa, Mycobacterium tuberculosis
QILPTIPLNIHQTF

SEQ ID NO: 181479 - protein, 14 aa, Mycobacterium tuberculosis
ILPTIPLNIHQTFS

SEQ ID NO: 181480 - protein, 14 aa, Mycobacterium tuberculosis
LPTIPLNIHQTFSL

SEQ ID NO: 181481 - protein, 14 aa, Mycobacterium tuberculosis
PTIPLNIHQTFSLG

SEQ ID NO: 181482 - protein, 14 aa, Mycobacterium tuberculosis
TIPLNIHQTFSLGP

SEQ ID NO: 181483 - protein, 14 aa, Mycobacterium tuberculosis
IPLNIHQTFSLGPL

SEQ ID NO: 181484 - protein, 14 aa, Mycobacterium tuberculosis
PLNIHQTFSLGPLV

SEQ ID NO: 181485 - protein, 14 aa, Mycobacterium tuberculosis
LNIHQTFSLGPLVV

SEQ ID NO: 181486 - protein, 14 aa, Mycobacterium tuberculosis
NIHQTFSLGPLVVP

SEQ ID NO: 181487 - protein, 14 aa, Mycobacterium tuberculosis
IHQTFSLGPLVVPD

SEQ ID NO: 181488 - protein, 14 aa, Mycobacterium tuberculosis
HQTFSLGPLVVPDI

SEQ ID NO: 181489 - protein, 14 aa, Mycobacterium tuberculosis
QTFSLGPLVVPDIV

SEQ ID NO: 181490 - protein, 14 aa, Mycobacterium tuberculosis
TFSLGPLVVPDIVI

SEQ ID NO: 181491 - protein, 14 aa, Mycobacterium tuberculosis
FSLGPLVVPDIVIP

SEQ ID NO: 181492 - protein, 14 aa, Mycobacterium tuberculosis
SLGPLVVPDIVIPA

SEQ ID NO: 181493 - protein, 14 aa, Mycobacterium tuberculosis
LGPLVVPDIVIPAF

SEQ ID NO: 181494 - protein, 14 aa, Mycobacterium tuberculosis
GPLVVPDIVIPAFG

SEQ ID NO: 181495 - protein, 14 aa, Mycobacterium tuberculosis
PLVVPDIVIPAFGG

SEQ ID NO: 181496 - protein, 14 aa, Mycobacterium tuberculosis
LVVPDIVIPAFGGG

SEQ ID NO: 181497 - protein, 14 aa, Mycobacterium tuberculosis
VVPDIVIPAFGGGT

SEQ ID NO: 181498 - protein, 14 aa, Mycobacterium tuberculosis
VPDIVIPAFGGGTA

SEQ ID NO: 181499 - protein, 14 aa, Mycobacterium tuberculosis
PDIVIPAFGGGTAI

SEQ ID NO: 181500 - protein, 14 aa, Mycobacterium tuberculosis
DIVIPAFGGGTAIP

SEQ ID NO: 181501 - protein, 14 aa, Mycobacterium tuberculosis
IVIPAFGGGTAIPI

SEQ ID NO: 181502 - protein, 14 aa, Mycobacterium tuberculosis
VIPAFGGGTAIPIS

SEQ ID NO: 181503 - protein, 14 aa, Mycobacterium tuberculosis
IPAFGGGTAIPISV

SEQ ID NO: 181504 - protein, 14 aa, Mycobacterium tuberculosis
PAFGGGTAIPISVG

SEQ ID NO: 181505 - protein, 14 aa, Mycobacterium tuberculosis
AFGGGTAIPISVGP

SEQ ID NO: 181506 - protein, 14 aa, Mycobacterium tuberculosis
FGGGTAIPISVGPI

SEQ ID NO: 181507 - protein, 14 aa, Mycobacterium tuberculosis
GGGTAIPISVGPIT

SEQ ID NO: 181508 - protein, 14 aa, Mycobacterium tuberculosis
GGTAIPISVGPITI

SEQ ID NO: 181509 - protein, 14 aa, Mycobacterium tuberculosis
GTAIPISVGPITIS

SEQ ID NO: 181510 - protein, 14 aa, Mycobacterium tuberculosis
TAIPISVGPITISP

SEQ ID NO: 181511 - protein, 14 aa, Mycobacterium tuberculosis
AIPISVGPITISPI

SEQ ID NO: 181512 - protein, 14 aa, Mycobacterium tuberculosis
IPISVGPITISPIT

SEQ ID NO: 181513 - protein, 14 aa, Mycobacterium tuberculosis
PISVGPITISPITL

SEQ ID NO: 181514 - protein, 14 aa, Mycobacterium tuberculosis
ISVGPITISPITLF

SEQ ID NO: 181515 - protein, 14 aa, Mycobacterium tuberculosis
SVGPITISPITLFP

SEQ ID NO: 181516 - protein, 14 aa, Mycobacterium tuberculosis
VGPITISPITLFPA

SEQ ID NO: 181517 - protein, 14 aa, Mycobacterium tuberculosis
GPITISPITLFPAQ

SEQ ID NO: 181518 - protein, 14 aa, Mycobacterium tuberculosis
PITISPITLFPAQN

SEQ ID NO: 181519 - protein, 14 aa, Mycobacterium tuberculosis
ITISPITLFPAQNF

SEQ ID NO: 181520 - protein, 14 aa, Mycobacterium tuberculosis
TISPITLFPAQNFN

SEQ ID NO: 181521 - protein, 14 aa, Mycobacterium tuberculosis
ISPITLFPAQNFNT

SEQ ID NO: 181522 - protein, 14 aa, Mycobacterium tuberculosis
SPITLFPAQNFNTT

SEQ ID NO: 181523 - protein, 14 aa, Mycobacterium tuberculosis
PITLFPAQNFNTTF

SEQ ID NO: 181524 - protein, 14 aa, Mycobacterium tuberculosis
ITLFPAQNFNTTFP

SEQ ID NO: 181525 - protein, 14 aa, Mycobacterium tuberculosis
TLFPAQNFNTTFPV

SEQ ID NO: 181526 - protein, 14 aa, Mycobacterium tuberculosis
LFPAQNFNTTFPVG

SEQ ID NO: 181527 - protein, 14 aa, Mycobacterium tuberculosis
FPAQNFNTTFPVGP

SEQ ID NO: 181528 - protein, 14 aa, Mycobacterium tuberculosis
PAQNFNTTFPVGPF

SEQ ID NO: 181529 - protein, 14 aa, Mycobacterium tuberculosis
AQNFNTTFPVGPFF

SEQ ID NO: 181530 - protein, 14 aa, Mycobacterium tuberculosis
QNFNTTFPVGPFFG

SEQ ID NO: 181531 - protein, 14 aa, Mycobacterium tuberculosis
NFNTTFPVGPFFGL

SEQ ID NO: 181532 - protein, 14 aa, Mycobacterium tuberculosis
FNTTFPVGPFFGLG

SEQ ID NO: 181533 - protein, 14 aa, Mycobacterium tuberculosis
NTTFPVGPFFGLGV

SEQ ID NO: 181534 - protein, 14 aa, Mycobacterium tuberculosis
TTFPVGPFFGLGVV

SEQ ID NO: 181535 - protein, 14 aa, Mycobacterium tuberculosis
TFPVGPFFGLGVVN

SEQ ID NO: 181536 - protein, 14 aa, Mycobacterium tuberculosis
FPVGPFFGLGVVNI

SEQ ID NO: 181537 - protein, 14 aa, Mycobacterium tuberculosis
PVGPFFGLGVVNIS

SEQ ID NO: 181538 - protein, 14 aa, Mycobacterium tuberculosis
VGPFFGLGVVNISG

SEQ ID NO: 181539 - protein, 14 aa, Mycobacterium tuberculosis
GPFFGLGVVNISGI

SEQ ID NO: 181540 - protein, 14 aa, Mycobacterium tuberculosis
PFFGLGVVNISGIE

SEQ ID NO: 181541 - protein, 14 aa, Mycobacterium tuberculosis
FFGLGVVNISGIEI

SEQ ID NO: 181542 - protein, 14 aa, Mycobacterium tuberculosis
FGLGVVNISGIEIK

SEQ ID NO: 181543 - protein, 14 aa, Mycobacterium tuberculosis
GLGVVNISGIEIKD

SEQ ID NO: 181544 - protein, 14 aa, Mycobacterium tuberculosis
LGVVNISGIEIKDL

SEQ ID NO: 181545 - protein, 14 aa, Mycobacterium tuberculosis
GVVNISGIEIKDLA

SEQ ID NO: 181546 - protein, 14 aa, Mycobacterium tuberculosis
VVNISGIEIKDLAG

SEQ ID NO: 181547 - protein, 14 aa, Mycobacterium tuberculosis
VNISGIEIKDLAGN

SEQ ID NO: 181548 - protein, 14 aa, Mycobacterium tuberculosis
NISGIEIKDLAGNV

SEQ ID NO: 181549 - protein, 14 aa, Mycobacterium tuberculosis
ISGIEIKDLAGNVT

SEQ ID NO: 181550 - protein, 14 aa, Mycobacterium tuberculosis
SGIEIKDLAGNVTL

SEQ ID NO: 181551 - protein, 14 aa, Mycobacterium tuberculosis
GIEIKDLAGNVTLQ

SEQ ID NO: 181552 - protein, 14 aa, Mycobacterium tuberculosis
IEIKDLAGNVTLQL

SEQ ID NO: 181553 - protein, 14 aa, Mycobacterium tuberculosis
EIKDLAGNVTLQLG

SEQ ID NO: 181554 - protein, 14 aa, Mycobacterium tuberculosis
IKDLAGNVTLQLGN

SEQ ID NO: 181555 - protein, 14 aa, Mycobacterium tuberculosis
KDLAGNVTLQLGNL

SEQ ID NO: 181556 - protein, 14 aa, Mycobacterium tuberculosis
DLAGNVTLQLGNLN

SEQ ID NO: 181557 - protein, 14 aa, Mycobacterium tuberculosis
LAGNVTLQLGNLNI

SEQ ID NO: 181558 - protein, 14 aa, Mycobacterium tuberculosis
AGNVTLQLGNLNID

SEQ ID NO: 181559 - protein, 14 aa, Mycobacterium tuberculosis
GNVTLQLGNLNIDT

SEQ ID NO: 181560 - protein, 14 aa, Mycobacterium tuberculosis
NVTLQLGNLNIDTR

SEQ ID NO: 181561 - protein, 14 aa, Mycobacterium tuberculosis
VTLQLGNLNIDTRI

SEQ ID NO: 181562 - protein, 14 aa, Mycobacterium tuberculosis
TLQLGNLNIDTRIN

SEQ ID NO: 181563 - protein, 14 aa, Mycobacterium tuberculosis
LQLGNLNIDTRINQ

SEQ ID NO: 181564 - protein, 14 aa, Mycobacterium tuberculosis
QLGNLNIDTRINQS

SEQ ID NO: 181565 - protein, 14 aa, Mycobacterium tuberculosis
LGNLNIDTRINQSF

SEQ ID NO: 181566 - protein, 14 aa, Mycobacterium tuberculosis
GNLNIDTRINQSFP

SEQ ID NO: 181567 - protein, 14 aa, Mycobacterium tuberculosis
NLNIDTRINQSFPV

SEQ ID NO: 181568 - protein, 14 aa, Mycobacterium tuberculosis
LNIDTRINQSFPVT

SEQ ID NO: 181569 - protein, 14 aa, Mycobacterium tuberculosis
NIDTRINQSFPVTV

SEQ ID NO: 181570 - protein, 14 aa, Mycobacterium tuberculosis
IDTRINQSFPVTVN

SEQ ID NO: 181571 - protein, 14 aa, Mycobacterium tuberculosis
DTRINQSFPVTVNW

SEQ ID NO: 181572 - protein, 14 aa, Mycobacterium tuberculosis
TRINQSFPVTVNWS

SEQ ID NO: 181573 - protein, 14 aa, Mycobacterium tuberculosis
RINQSFPVTVNWST

SEQ ID NO: 181574 - protein, 14 aa, Mycobacterium tuberculosis
INQSFPVTVNWSTP

SEQ ID NO: 181575 - protein, 14 aa, Mycobacterium tuberculosis
NQSFPVTVNWSTPA

SEQ ID NO: 181576 - protein, 14 aa, Mycobacterium tuberculosis
QSFPVTVNWSTPAV

SEQ ID NO: 181577 - protein, 14 aa, Mycobacterium tuberculosis
SFPVTVNWSTPAVT

SEQ ID NO: 181578 - protein, 14 aa, Mycobacterium tuberculosis
FPVTVNWSTPAVTI

SEQ ID NO: 181579 - protein, 14 aa, Mycobacterium tuberculosis
PVTVNWSTPAVTIF

SEQ ID NO: 181580 - protein, 14 aa, Mycobacterium tuberculosis
VTVNWSTPAVTIFP

SEQ ID NO: 181581 - protein, 14 aa, Mycobacterium tuberculosis
TVNWSTPAVTIFPN

SEQ ID NO: 181582 - protein, 14 aa, Mycobacterium tuberculosis
VNWSTPAVTIFPNG

SEQ ID NO: 181583 - protein, 14 aa, Mycobacterium tuberculosis
NWSTPAVTIFPNGI

SEQ ID NO: 181584 - protein, 14 aa, Mycobacterium tuberculosis
WSTPAVTIFPNGIS

SEQ ID NO: 181585 - protein, 14 aa, Mycobacterium tuberculosis
STPAVTIFPNGISI

SEQ ID NO: 181586 - protein, 14 aa, Mycobacterium tuberculosis
TPAVTIFPNGISIP

SEQ ID NO: 181587 - protein, 14 aa, Mycobacterium tuberculosis
PAVTIFPNGISIPN

SEQ ID NO: 181588 - protein, 14 aa, Mycobacterium tuberculosis
AVTIFPNGISIPNN

SEQ ID NO: 181589 - protein, 14 aa, Mycobacterium tuberculosis
VTIFPNGISIPNNP

SEQ ID NO: 181590 - protein, 14 aa, Mycobacterium tuberculosis
TIFPNGISIPNNPL

SEQ ID NO: 181591 - protein, 14 aa, Mycobacterium tuberculosis
IFPNGISIPNNPLA

SEQ ID NO: 181592 - protein, 14 aa, Mycobacterium tuberculosis
FPNGISIPNNPLAL

SEQ ID NO: 181593 - protein, 14 aa, Mycobacterium tuberculosis
PNGISIPNNPLALL

SEQ ID NO: 181594 - protein, 14 aa, Mycobacterium tuberculosis
NGISIPNNPLALLA

SEQ ID NO: 181595 - protein, 14 aa, Mycobacterium tuberculosis
GISIPNNPLALLAS

SEQ ID NO: 181596 - protein, 14 aa, Mycobacterium tuberculosis
ISIPNNPLALLASA

SEQ ID NO: 181597 - protein, 14 aa, Mycobacterium tuberculosis
SIPNNPLALLASAS

SEQ ID NO: 181598 - protein, 14 aa, Mycobacterium tuberculosis
IPNNPLALLASASI

SEQ ID NO: 181599 - protein, 14 aa, Mycobacterium tuberculosis
PNNPLALLASASIG

SEQ ID NO: 181600 - protein, 14 aa, Mycobacterium tuberculosis
NNPLALLASASIGT

SEQ ID NO: 181601 - protein, 14 aa, Mycobacterium tuberculosis
NPLALLASASIGTL

SEQ ID NO: 181602 - protein, 14 aa, Mycobacterium tuberculosis
PLALLASASIGTLG

SEQ ID NO: 181603 - protein, 14 aa, Mycobacterium tuberculosis
LALLASASIGTLGF

SEQ ID NO: 181604 - protein, 14 aa, Mycobacterium tuberculosis
ALLASASIGTLGFT

SEQ ID NO: 181605 - protein, 14 aa, Mycobacterium tuberculosis
LLASASIGTLGFTI

SEQ ID NO: 181606 - protein, 14 aa, Mycobacterium tuberculosis
LASASIGTLGFTIP

SEQ ID NO: 181607 - protein, 14 aa, Mycobacterium tuberculosis
ASASIGTLGFTIPG

SEQ ID NO: 181608 - protein, 14 aa, Mycobacterium tuberculosis
SASIGTLGFTIPGF

SEQ ID NO: 181609 - protein, 14 aa, Mycobacterium tuberculosis
ASIGTLGFTIPGFT

SEQ ID NO: 181610 - protein, 14 aa, Mycobacterium tuberculosis
SIGTLGFTIPGFTI

SEQ ID NO: 181611 - protein, 14 aa, Mycobacterium tuberculosis
IGTLGFTIPGFTIP

SEQ ID NO: 181612 - protein, 14 aa, Mycobacterium tuberculosis
GTLGFTIPGFTIPA

SEQ ID NO: 181613 - protein, 14 aa, Mycobacterium tuberculosis
TLGFTIPGFTIPAA

SEQ ID NO: 181614 - protein, 14 aa, Mycobacterium tuberculosis
LGFTIPGFTIPAAP

SEQ ID NO: 181615 - protein, 14 aa, Mycobacterium tuberculosis
GFTIPGFTIPAAPL

SEQ ID NO: 181616 - protein, 14 aa, Mycobacterium tuberculosis
FTIPGFTIPAAPLP

SEQ ID NO: 181617 - protein, 14 aa, Mycobacterium tuberculosis
TIPGFTIPAAPLPL

SEQ ID NO: 181618 - protein, 14 aa, Mycobacterium tuberculosis
IPGFTIPAAPLPLT

SEQ ID NO: 181619 - protein, 14 aa, Mycobacterium tuberculosis
PGFTIPAAPLPLTI

SEQ ID NO: 181620 - protein, 14 aa, Mycobacterium tuberculosis
GFTIPAAPLPLTID

SEQ ID NO: 181621 - protein, 14 aa, Mycobacterium tuberculosis
FTIPAAPLPLTIDI

SEQ ID NO: 181622 - protein, 14 aa, Mycobacterium tuberculosis
TIPAAPLPLTIDID

SEQ ID NO: 181623 - protein, 14 aa, Mycobacterium tuberculosis
IPAAPLPLTIDIDG

SEQ ID NO: 181624 - protein, 14 aa, Mycobacterium tuberculosis
PAAPLPLTIDIDGQ

SEQ ID NO: 181625 - protein, 14 aa, Mycobacterium tuberculosis
AAPLPLTIDIDGQI

SEQ ID NO: 181626 - protein, 14 aa, Mycobacterium tuberculosis
APLPLTIDIDGQID

SEQ ID NO: 181627 - protein, 14 aa, Mycobacterium tuberculosis
PLPLTIDIDGQIDG

SEQ ID NO: 181628 - protein, 14 aa, Mycobacterium tuberculosis
LPLTIDIDGQIDGF

SEQ ID NO: 181629 - protein, 14 aa, Mycobacterium tuberculosis
PLTIDIDGQIDGFS

SEQ ID NO: 181630 - protein, 14 aa, Mycobacterium tuberculosis
LTIDIDGQIDGFST

SEQ ID NO: 181631 - protein, 14 aa, Mycobacterium tuberculosis
TIDIDGQIDGFSTP

SEQ ID NO: 181632 - protein, 14 aa, Mycobacterium tuberculosis
IDIDGQIDGFSTPP

SEQ ID NO: 181633 - protein, 14 aa, Mycobacterium tuberculosis
DIDGQIDGFSTPPI

SEQ ID NO: 181634 - protein, 14 aa, Mycobacterium tuberculosis
IDGQIDGFSTPPIT

SEQ ID NO: 181635 - protein, 14 aa, Mycobacterium tuberculosis
DGQIDGFSTPPITI

SEQ ID NO: 181636 - protein, 14 aa, Mycobacterium tuberculosis
GQIDGFSTPPITID

SEQ ID NO: 181637 - protein, 14 aa, Mycobacterium tuberculosis
QIDGFSTPPITIDR

SEQ ID NO: 181638 - protein, 14 aa, Mycobacterium tuberculosis
IDGFSTPPITIDRI

SEQ ID NO: 181639 - protein, 14 aa, Mycobacterium tuberculosis
DGFSTPPITIDRIP

SEQ ID NO: 181640 - protein, 14 aa, Mycobacterium tuberculosis
GFSTPPITIDRIPL

SEQ ID NO: 181641 - protein, 14 aa, Mycobacterium tuberculosis
FSTPPITIDRIPLN

SEQ ID NO: 181642 - protein, 14 aa, Mycobacterium tuberculosis
STPPITIDRIPLNL

SEQ ID NO: 181643 - protein, 14 aa, Mycobacterium tuberculosis
TPPITIDRIPLNLG

SEQ ID NO: 181644 - protein, 14 aa, Mycobacterium tuberculosis
PPITIDRIPLNLGA

SEQ ID NO: 181645 - protein, 14 aa, Mycobacterium tuberculosis
PITIDRIPLNLGAS

SEQ ID NO: 181646 - protein, 14 aa, Mycobacterium tuberculosis
ITIDRIPLNLGASV

SEQ ID NO: 181647 - protein, 14 aa, Mycobacterium tuberculosis
TIDRIPLNLGASVT

SEQ ID NO: 181648 - protein, 14 aa, Mycobacterium tuberculosis
IDRIPLNLGASVTV

SEQ ID NO: 181649 - protein, 14 aa, Mycobacterium tuberculosis
DRIPLNLGASVTVG

SEQ ID NO: 181650 - protein, 14 aa, Mycobacterium tuberculosis
RIPLNLGASVTVGP

SEQ ID NO: 181651 - protein, 14 aa, Mycobacterium tuberculosis
IPLNLGASVTVGPI

SEQ ID NO: 181652 - protein, 14 aa, Mycobacterium tuberculosis
PLNLGASVTVGPIL

SEQ ID NO: 181653 - protein, 14 aa, Mycobacterium tuberculosis
LNLGASVTVGPILI

SEQ ID NO: 181654 - protein, 14 aa, Mycobacterium tuberculosis
NLGASVTVGPILIN

SEQ ID NO: 181655 - protein, 14 aa, Mycobacterium tuberculosis
LGASVTVGPILING

SEQ ID NO: 181656 - protein, 14 aa, Mycobacterium tuberculosis
GASVTVGPILINGV

SEQ ID NO: 181657 - protein, 14 aa, Mycobacterium tuberculosis
ASVTVGPILINGVN

SEQ ID NO: 181658 - protein, 14 aa, Mycobacterium tuberculosis
SVTVGPILINGVNI

SEQ ID NO: 181659 - protein, 14 aa, Mycobacterium tuberculosis
VTVGPILINGVNIP

SEQ ID NO: 181660 - protein, 14 aa, Mycobacterium tuberculosis
TVGPILINGVNIPA

SEQ ID NO: 181661 - protein, 14 aa, Mycobacterium tuberculosis
VGPILINGVNIPAT

SEQ ID NO: 181662 - protein, 14 aa, Mycobacterium tuberculosis
GPILINGVNIPATP

SEQ ID NO: 181663 - protein, 14 aa, Mycobacterium tuberculosis
PILINGVNIPATPG

SEQ ID NO: 181664 - protein, 14 aa, Mycobacterium tuberculosis
ILINGVNIPATPGF

SEQ ID NO: 181665 - protein, 14 aa, Mycobacterium tuberculosis
LINGVNIPATPGFG

SEQ ID NO: 181666 - protein, 14 aa, Mycobacterium tuberculosis
INGVNIPATPGFGN

SEQ ID NO: 181667 - protein, 14 aa, Mycobacterium tuberculosis
NGVNIPATPGFGNT

SEQ ID NO: 181668 - protein, 14 aa, Mycobacterium tuberculosis
GVNIPATPGFGNTT

SEQ ID NO: 181669 - protein, 14 aa, Mycobacterium tuberculosis
VNIPATPGFGNTTT

SEQ ID NO: 181670 - protein, 14 aa, Mycobacterium tuberculosis
NIPATPGFGNTTTA

SEQ ID NO: 181671 - protein, 14 aa, Mycobacterium tuberculosis
IPATPGFGNTTTAP

SEQ ID NO: 181672 - protein, 14 aa, Mycobacterium tuberculosis
PATPGFGNTTTAPS

SEQ ID NO: 181673 - protein, 14 aa, Mycobacterium tuberculosis
ATPGFGNTTTAPSS

SEQ ID NO: 181674 - protein, 14 aa, Mycobacterium tuberculosis
TPGFGNTTTAPSSG

SEQ ID NO: 181675 - protein, 14 aa, Mycobacterium tuberculosis
PGFGNTTTAPSSGF

SEQ ID NO: 181676 - protein, 14 aa, Mycobacterium tuberculosis
GFGNTTTAPSSGFF

SEQ ID NO: 181677 - protein, 14 aa, Mycobacterium tuberculosis
FGNTTTAPSSGFFN

SEQ ID NO: 181678 - protein, 14 aa, Mycobacterium tuberculosis
GNTTTAPSSGFFNS

SEQ ID NO: 181679 - protein, 14 aa, Mycobacterium tuberculosis
NTTTAPSSGFFNSG

SEQ ID NO: 181680 - protein, 14 aa, Mycobacterium tuberculosis
TTTAPSSGFFNSGD

SEQ ID NO: 181681 - protein, 14 aa, Mycobacterium tuberculosis
TTAPSSGFFNSGDG

SEQ ID NO: 181682 - protein, 14 aa, Mycobacterium tuberculosis
TAPSSGFFNSGDGG

SEQ ID NO: 181683 - protein, 14 aa, Mycobacterium tuberculosis
APSSGFFNSGDGGV

SEQ ID NO: 181684 - protein, 14 aa, Mycobacterium tuberculosis
PSSGFFNSGDGGVS

SEQ ID NO: 181685 - protein, 14 aa, Mycobacterium tuberculosis
SSGFFNSGDGGVSG

SEQ ID NO: 181686 - protein, 14 aa, Mycobacterium tuberculosis
SGFFNSGDGGVSGF

SEQ ID NO: 181687 - protein, 14 aa, Mycobacterium tuberculosis
GFFNSGDGGVSGFG

SEQ ID NO: 181688 - protein, 14 aa, Mycobacterium tuberculosis
FFNSGDGGVSGFGN

SEQ ID NO: 181689 - protein, 14 aa, Mycobacterium tuberculosis
FNSGDGGVSGFGNF

SEQ ID NO: 181690 - protein, 14 aa, Mycobacterium tuberculosis
NSGDGGVSGFGNFG

SEQ ID NO: 181691 - protein, 14 aa, Mycobacterium tuberculosis
SGDGGVSGFGNFGA

SEQ ID NO: 181692 - protein, 14 aa, Mycobacterium tuberculosis
GDGGVSGFGNFGAG

SEQ ID NO: 181693 - protein, 14 aa, Mycobacterium tuberculosis
DGGVSGFGNFGAGS

SEQ ID NO: 181694 - protein, 14 aa, Mycobacterium tuberculosis
GGVSGFGNFGAGSS

SEQ ID NO: 181695 - protein, 14 aa, Mycobacterium tuberculosis
GVSGFGNFGAGSSG

SEQ ID NO: 181696 - protein, 14 aa, Mycobacterium tuberculosis
VSGFGNFGAGSSGW

SEQ ID NO: 181697 - protein, 14 aa, Mycobacterium tuberculosis
SGFGNFGAGSSGWW

SEQ ID NO: 181698 - protein, 14 aa, Mycobacterium tuberculosis
GFGNFGAGSSGWWN

SEQ ID NO: 181699 - protein, 14 aa, Mycobacterium tuberculosis
FGNFGAGSSGWWNQ

SEQ ID NO: 181700 - protein, 14 aa, Mycobacterium tuberculosis
GNFGAGSSGWWNQA

SEQ ID NO: 181701 - protein, 14 aa, Mycobacterium tuberculosis
NFGAGSSGWWNQAQ

SEQ ID NO: 181702 - protein, 14 aa, Mycobacterium tuberculosis
FGAGSSGWWNQAQT

SEQ ID NO: 181703 - protein, 14 aa, Mycobacterium tuberculosis
GAGSSGWWNQAQTE

SEQ ID NO: 181704 - protein, 14 aa, Mycobacterium tuberculosis
AGSSGWWNQAQTEV

SEQ ID NO: 181705 - protein, 14 aa, Mycobacterium tuberculosis
GSSGWWNQAQTEVA

SEQ ID NO: 181706 - protein, 14 aa, Mycobacterium tuberculosis
SSGWWNQAQTEVAG

SEQ ID NO: 181707 - protein, 14 aa, Mycobacterium tuberculosis
SGWWNQAQTEVAGA

SEQ ID NO: 181708 - protein, 14 aa, Mycobacterium tuberculosis
GWWNQAQTEVAGAG

SEQ ID NO: 181709 - protein, 14 aa, Mycobacterium tuberculosis
WWNQAQTEVAGAGS

SEQ ID NO: 181710 - protein, 14 aa, Mycobacterium tuberculosis
WNQAQTEVAGAGSG

SEQ ID NO: 181711 - protein, 14 aa, Mycobacterium tuberculosis
NQAQTEVAGAGSGF

SEQ ID NO: 181712 - protein, 14 aa, Mycobacterium tuberculosis
QAQTEVAGAGSGFA

SEQ ID NO: 181713 - protein, 14 aa, Mycobacterium tuberculosis
AQTEVAGAGSGFAN

SEQ ID NO: 181714 - protein, 14 aa, Mycobacterium tuberculosis
QTEVAGAGSGFANF

SEQ ID NO: 181715 - protein, 14 aa, Mycobacterium tuberculosis
TEVAGAGSGFANFG

SEQ ID NO: 181716 - protein, 14 aa, Mycobacterium tuberculosis
EVAGAGSGFANFGS

SEQ ID NO: 181717 - protein, 14 aa, Mycobacterium tuberculosis
VAGAGSGFANFGSL

SEQ ID NO: 181718 - protein, 14 aa, Mycobacterium tuberculosis
AGAGSGFANFGSLG

SEQ ID NO: 181719 - protein, 14 aa, Mycobacterium tuberculosis
GAGSGFANFGSLGS

SEQ ID NO: 181720 - protein, 14 aa, Mycobacterium tuberculosis
AGSGFANFGSLGSG

SEQ ID NO: 181721 - protein, 14 aa, Mycobacterium tuberculosis
GSGFANFGSLGSGV

SEQ ID NO: 181722 - protein, 14 aa, Mycobacterium tuberculosis
SGFANFGSLGSGVL

SEQ ID NO: 181723 - protein, 14 aa, Mycobacterium tuberculosis
GFANFGSLGSGVLN

SEQ ID NO: 181724 - protein, 14 aa, Mycobacterium tuberculosis
FANFGSLGSGVLNF

SEQ ID NO: 181725 - protein, 14 aa, Mycobacterium tuberculosis
ANFGSLGSGVLNFG

SEQ ID NO: 181726 - protein, 14 aa, Mycobacterium tuberculosis
NFGSLGSGVLNFGS

SEQ ID NO: 181727 - protein, 14 aa, Mycobacterium tuberculosis
FGSLGSGVLNFGSG

SEQ ID NO: 181728 - protein, 14 aa, Mycobacterium tuberculosis
GSLGSGVLNFGSGV

SEQ ID NO: 181729 - protein, 14 aa, Mycobacterium tuberculosis
SLGSGVLNFGSGVS

SEQ ID NO: 181730 - protein, 14 aa, Mycobacterium tuberculosis
LGSGVLNFGSGVSG

SEQ ID NO: 181731 - protein, 14 aa, Mycobacterium tuberculosis
GSGVLNFGSGVSGL

SEQ ID NO: 181732 - protein, 14 aa, Mycobacterium tuberculosis
SGVLNFGSGVSGLY

SEQ ID NO: 181733 - protein, 14 aa, Mycobacterium tuberculosis
GVLNFGSGVSGLYN

SEQ ID NO: 181734 - protein, 14 aa, Mycobacterium tuberculosis
VLNFGSGVSGLYNT

SEQ ID NO: 181735 - protein, 14 aa, Mycobacterium tuberculosis
LNFGSGVSGLYNTG

SEQ ID NO: 181736 - protein, 14 aa, Mycobacterium tuberculosis
NFGSGVSGLYNTGG

SEQ ID NO: 181737 - protein, 14 aa, Mycobacterium tuberculosis
FGSGVSGLYNTGGL

SEQ ID NO: 181738 - protein, 14 aa, Mycobacterium tuberculosis
GSGVSGLYNTGGLP

SEQ ID NO: 181739 - protein, 14 aa, Mycobacterium tuberculosis
SGVSGLYNTGGLPP

SEQ ID NO: 181740 - protein, 14 aa, Mycobacterium tuberculosis
GVSGLYNTGGLPPG

SEQ ID NO: 181741 - protein, 14 aa, Mycobacterium tuberculosis
VSGLYNTGGLPPGT

SEQ ID NO: 181742 - protein, 14 aa, Mycobacterium tuberculosis
SGLYNTGGLPPGTP

SEQ ID NO: 181743 - protein, 14 aa, Mycobacterium tuberculosis
GLYNTGGLPPGTPA

SEQ ID NO: 181744 - protein, 14 aa, Mycobacterium tuberculosis
LYNTGGLPPGTPAV

SEQ ID NO: 181745 - protein, 14 aa, Mycobacterium tuberculosis
YNTGGLPPGTPAVV

SEQ ID NO: 181746 - protein, 14 aa, Mycobacterium tuberculosis
NTGGLPPGTPAVVS

SEQ ID NO: 181747 - protein, 14 aa, Mycobacterium tuberculosis
TGGLPPGTPAVVSG

SEQ ID NO: 181748 - protein, 14 aa, Mycobacterium tuberculosis
GGLPPGTPAVVSGI

SEQ ID NO: 181749 - protein, 14 aa, Mycobacterium tuberculosis
GLPPGTPAVVSGIG

SEQ ID NO: 181750 - protein, 14 aa, Mycobacterium tuberculosis
LPPGTPAVVSGIGN

SEQ ID NO: 181751 - protein, 14 aa, Mycobacterium tuberculosis
PPGTPAVVSGIGNV

SEQ ID NO: 181752 - protein, 14 aa, Mycobacterium tuberculosis
PGTPAVVSGIGNVG

SEQ ID NO: 181753 - protein, 14 aa, Mycobacterium tuberculosis
GTPAVVSGIGNVGE

SEQ ID NO: 181754 - protein, 14 aa, Mycobacterium tuberculosis
TPAVVSGIGNVGEQ

SEQ ID NO: 181755 - protein, 14 aa, Mycobacterium tuberculosis
PAVVSGIGNVGEQL

SEQ ID NO: 181756 - protein, 14 aa, Mycobacterium tuberculosis
AVVSGIGNVGEQLS

SEQ ID NO: 181757 - protein, 14 aa, Mycobacterium tuberculosis
VVSGIGNVGEQLSG

SEQ ID NO: 181758 - protein, 14 aa, Mycobacterium tuberculosis
VSGIGNVGEQLSGL

SEQ ID NO: 181759 - protein, 14 aa, Mycobacterium tuberculosis
SGIGNVGEQLSGLS

SEQ ID NO: 181760 - protein, 14 aa, Mycobacterium tuberculosis
GIGNVGEQLSGLSS

SEQ ID NO: 181761 - protein, 14 aa, Mycobacterium tuberculosis
IGNVGEQLSGLSSA

SEQ ID NO: 181762 - protein, 14 aa, Mycobacterium tuberculosis
GNVGEQLSGLSSAG

SEQ ID NO: 181763 - protein, 14 aa, Mycobacterium tuberculosis
NVGEQLSGLSSAGT

SEQ ID NO: 181764 - protein, 14 aa, Mycobacterium tuberculosis
VGEQLSGLSSAGTA

SEQ ID NO: 181765 - protein, 14 aa, Mycobacterium tuberculosis
GEQLSGLSSAGTAL

SEQ ID NO: 181766 - protein, 14 aa, Mycobacterium tuberculosis
EQLSGLSSAGTALN

SEQ ID NO: 181767 - protein, 14 aa, Mycobacterium tuberculosis
QLSGLSSAGTALNQ

SEQ ID NO: 181768 - protein, 14 aa, Mycobacterium tuberculosis
LSGLSSAGTALNQS

SEQ ID NO: 181769 - protein, 14 aa, Mycobacterium tuberculosis
SGLSSAGTALNQSL

SEQ ID NO: 181770 - protein, 14 aa, Mycobacterium tuberculosis
GLSSAGTALNQSLI

SEQ ID NO: 181771 - protein, 14 aa, Mycobacterium tuberculosis
LSSAGTALNQSLII

SEQ ID NO: 181772 - protein, 14 aa, Mycobacterium tuberculosis
SSAGTALNQSLIIN

SEQ ID NO: 181773 - protein, 14 aa, Mycobacterium tuberculosis
SAGTALNQSLIINL

SEQ ID NO: 181774 - protein, 14 aa, Mycobacterium tuberculosis
AGTALNQSLIINLG

SEQ ID NO: 181775 - protein, 14 aa, Mycobacterium tuberculosis
GTALNQSLIINLGL

SEQ ID NO: 181776 - protein, 14 aa, Mycobacterium tuberculosis
TALNQSLIINLGLA

SEQ ID NO: 181777 - protein, 14 aa, Mycobacterium tuberculosis
ALNQSLIINLGLAD

SEQ ID NO: 181778 - protein, 14 aa, Mycobacterium tuberculosis
LNQSLIINLGLADV

SEQ ID NO: 181779 - protein, 14 aa, Mycobacterium tuberculosis
NQSLIINLGLADVG

SEQ ID NO: 181780 - protein, 14 aa, Mycobacterium tuberculosis
QSLIINLGLADVGS

SEQ ID NO: 181781 - protein, 14 aa, Mycobacterium tuberculosis
SLIINLGLADVGSV

SEQ ID NO: 181782 - protein, 14 aa, Mycobacterium tuberculosis
LIINLGLADVGSVN

SEQ ID NO: 181783 - protein, 14 aa, Mycobacterium tuberculosis
IINLGLADVGSVNV

SEQ ID NO: 181784 - protein, 14 aa, Mycobacterium tuberculosis
INLGLADVGSVNVG

SEQ ID NO: 181785 - protein, 14 aa, Mycobacterium tuberculosis
NLGLADVGSVNVGF

SEQ ID NO: 181786 - protein, 14 aa, Mycobacterium tuberculosis
LGLADVGSVNVGFG

SEQ ID NO: 181787 - protein, 14 aa, Mycobacterium tuberculosis
GLADVGSVNVGFGN

SEQ ID NO: 181788 - protein, 14 aa, Mycobacterium tuberculosis
LADVGSVNVGFGNV

SEQ ID NO: 181789 - protein, 14 aa, Mycobacterium tuberculosis
ADVGSVNVGFGNVG

SEQ ID NO: 181790 - protein, 14 aa, Mycobacterium tuberculosis
DVGSVNVGFGNVGD

SEQ ID NO: 181791 - protein, 14 aa, Mycobacterium tuberculosis
VGSVNVGFGNVGDF

SEQ ID NO: 181792 - protein, 14 aa, Mycobacterium tuberculosis
GSVNVGFGNVGDFN

SEQ ID NO: 181793 - protein, 14 aa, Mycobacterium tuberculosis
SVNVGFGNVGDFNL

SEQ ID NO: 181794 - protein, 14 aa, Mycobacterium tuberculosis
VNVGFGNVGDFNLG

SEQ ID NO: 181795 - protein, 14 aa, Mycobacterium tuberculosis
NVGFGNVGDFNLGA

SEQ ID NO: 181796 - protein, 14 aa, Mycobacterium tuberculosis
VGFGNVGDFNLGAA

SEQ ID NO: 181797 - protein, 14 aa, Mycobacterium tuberculosis
GFGNVGDFNLGAAN

SEQ ID NO: 181798 - protein, 14 aa, Mycobacterium tuberculosis
FGNVGDFNLGAANI

SEQ ID NO: 181799 - protein, 14 aa, Mycobacterium tuberculosis
GNVGDFNLGAANIG

SEQ ID NO: 181800 - protein, 14 aa, Mycobacterium tuberculosis
NVGDFNLGAANIGD

SEQ ID NO: 181801 - protein, 14 aa, Mycobacterium tuberculosis
VGDFNLGAANIGDL

SEQ ID NO: 181802 - protein, 14 aa, Mycobacterium tuberculosis
GDFNLGAANIGDLN

SEQ ID NO: 181803 - protein, 14 aa, Mycobacterium tuberculosis
DFNLGAANIGDLNV

SEQ ID NO: 181804 - protein, 14 aa, Mycobacterium tuberculosis
FNLGAANIGDLNVG

SEQ ID NO: 181805 - protein, 14 aa, Mycobacterium tuberculosis
NLGAANIGDLNVGL

SEQ ID NO: 181806 - protein, 14 aa, Mycobacterium tuberculosis
LGAANIGDLNVGLG

SEQ ID NO: 181807 - protein, 14 aa, Mycobacterium tuberculosis
GAANIGDLNVGLGN

SEQ ID NO: 181808 - protein, 14 aa, Mycobacterium tuberculosis
AANIGDLNVGLGNV

SEQ ID NO: 181809 - protein, 14 aa, Mycobacterium tuberculosis
ANIGDLNVGLGNVG

SEQ ID NO: 181810 - protein, 14 aa, Mycobacterium tuberculosis
NIGDLNVGLGNVGG

SEQ ID NO: 181811 - protein, 14 aa, Mycobacterium tuberculosis
IGDLNVGLGNVGGG

SEQ ID NO: 181812 - protein, 14 aa, Mycobacterium tuberculosis
GDLNVGLGNVGGGN

SEQ ID NO: 181813 - protein, 14 aa, Mycobacterium tuberculosis
DLNVGLGNVGGGNV

SEQ ID NO: 181814 - protein, 14 aa, Mycobacterium tuberculosis
LNVGLGNVGGGNVG

SEQ ID NO: 181815 - protein, 14 aa, Mycobacterium tuberculosis
NVGLGNVGGGNVGF

SEQ ID NO: 181816 - protein, 14 aa, Mycobacterium tuberculosis
VGLGNVGGGNVGFG

SEQ ID NO: 181817 - protein, 14 aa, Mycobacterium tuberculosis
GLGNVGGGNVGFGN

SEQ ID NO: 181818 - protein, 14 aa, Mycobacterium tuberculosis
LGNVGGGNVGFGNI

SEQ ID NO: 181819 - protein, 14 aa, Mycobacterium tuberculosis
GNVGGGNVGFGNIG

SEQ ID NO: 181820 - protein, 14 aa, Mycobacterium tuberculosis
NVGGGNVGFGNIGD

SEQ ID NO: 181821 - protein, 14 aa, Mycobacterium tuberculosis
VGGGNVGFGNIGDA

SEQ ID NO: 181822 - protein, 14 aa, Mycobacterium tuberculosis
GGGNVGFGNIGDAN

SEQ ID NO: 181823 - protein, 14 aa, Mycobacterium tuberculosis
GGNVGFGNIGDANF

SEQ ID NO: 181824 - protein, 14 aa, Mycobacterium tuberculosis
GNVGFGNIGDANFG

SEQ ID NO: 181825 - protein, 14 aa, Mycobacterium tuberculosis
NVGFGNIGDANFGL

SEQ ID NO: 181826 - protein, 14 aa, Mycobacterium tuberculosis
VGFGNIGDANFGLG

SEQ ID NO: 181827 - protein, 14 aa, Mycobacterium tuberculosis
GFGNIGDANFGLGN

SEQ ID NO: 181828 - protein, 14 aa, Mycobacterium tuberculosis
FGNIGDANFGLGNA

SEQ ID NO: 181829 - protein, 14 aa, Mycobacterium tuberculosis
GNIGDANFGLGNAG

SEQ ID NO: 181830 - protein, 14 aa, Mycobacterium tuberculosis
NIGDANFGLGNAGL

SEQ ID NO: 181831 - protein, 14 aa, Mycobacterium tuberculosis
IGDANFGLGNAGLA

SEQ ID NO: 181832 - protein, 14 aa, Mycobacterium tuberculosis
GDANFGLGNAGLAA

SEQ ID NO: 181833 - protein, 14 aa, Mycobacterium tuberculosis
DANFGLGNAGLAAG

SEQ ID NO: 181834 - protein, 14 aa, Mycobacterium tuberculosis
ANFGLGNAGLAAGL

SEQ ID NO: 181835 - protein, 14 aa, Mycobacterium tuberculosis
NFGLGNAGLAAGLA

SEQ ID NO: 181836 - protein, 14 aa, Mycobacterium tuberculosis
FGLGNAGLAAGLAG

SEQ ID NO: 181837 - protein, 14 aa, Mycobacterium tuberculosis
GLGNAGLAAGLAGV

SEQ ID NO: 181838 - protein, 14 aa, Mycobacterium tuberculosis
LGNAGLAAGLAGVG

SEQ ID NO: 181839 - protein, 14 aa, Mycobacterium tuberculosis
GNAGLAAGLAGVGN

SEQ ID NO: 181840 - protein, 14 aa, Mycobacterium tuberculosis
NAGLAAGLAGVGNI

SEQ ID NO: 181841 - protein, 14 aa, Mycobacterium tuberculosis
AGLAAGLAGVGNIG

SEQ ID NO: 181842 - protein, 14 aa, Mycobacterium tuberculosis
GLAAGLAGVGNIGL

SEQ ID NO: 181843 - protein, 14 aa, Mycobacterium tuberculosis
LAAGLAGVGNIGLG

SEQ ID NO: 181844 - protein, 14 aa, Mycobacterium tuberculosis
AAGLAGVGNIGLGN

SEQ ID NO: 181845 - protein, 14 aa, Mycobacterium tuberculosis
AGLAGVGNIGLGNA

SEQ ID NO: 181846 - protein, 14 aa, Mycobacterium tuberculosis
GLAGVGNIGLGNAG

SEQ ID NO: 181847 - protein, 14 aa, Mycobacterium tuberculosis
LAGVGNIGLGNAGS

SEQ ID NO: 181848 - protein, 14 aa, Mycobacterium tuberculosis
AGVGNIGLGNAGSG

SEQ ID NO: 181849 - protein, 14 aa, Mycobacterium tuberculosis
GVGNIGLGNAGSGN

SEQ ID NO: 181850 - protein, 14 aa, Mycobacterium tuberculosis
VGNIGLGNAGSGNV

SEQ ID NO: 181851 - protein, 14 aa, Mycobacterium tuberculosis
GNIGLGNAGSGNVG

SEQ ID NO: 181852 - protein, 14 aa, Mycobacterium tuberculosis
NIGLGNAGSGNVGF

SEQ ID NO: 181853 - protein, 14 aa, Mycobacterium tuberculosis
IGLGNAGSGNVGFG

SEQ ID NO: 181854 - protein, 14 aa, Mycobacterium tuberculosis
GLGNAGSGNVGFGN

SEQ ID NO: 181855 - protein, 14 aa, Mycobacterium tuberculosis
LGNAGSGNVGFGNM

SEQ ID NO: 181856 - protein, 14 aa, Mycobacterium tuberculosis
GNAGSGNVGFGNMG

SEQ ID NO: 181857 - protein, 14 aa, Mycobacterium tuberculosis
NAGSGNVGFGNMGV

SEQ ID NO: 181858 - protein, 14 aa, Mycobacterium tuberculosis
AGSGNVGFGNMGVG

SEQ ID NO: 181859 - protein, 14 aa, Mycobacterium tuberculosis
GSGNVGFGNMGVGN

SEQ ID NO: 181860 - protein, 14 aa, Mycobacterium tuberculosis
SGNVGFGNMGVGNI

SEQ ID NO: 181861 - protein, 14 aa, Mycobacterium tuberculosis
GNVGFGNMGVGNIG

SEQ ID NO: 181862 - protein, 14 aa, Mycobacterium tuberculosis
NVGFGNMGVGNIGF

SEQ ID NO: 181863 - protein, 14 aa, Mycobacterium tuberculosis
VGFGNMGVGNIGFG

SEQ ID NO: 181864 - protein, 14 aa, Mycobacterium tuberculosis
GFGNMGVGNIGFGN

SEQ ID NO: 181865 - protein, 14 aa, Mycobacterium tuberculosis
FGNMGVGNIGFGNT

SEQ ID NO: 181866 - protein, 14 aa, Mycobacterium tuberculosis
GNMGVGNIGFGNTG

SEQ ID NO: 181867 - protein, 14 aa, Mycobacterium tuberculosis
NMGVGNIGFGNTGT

SEQ ID NO: 181868 - protein, 14 aa, Mycobacterium tuberculosis
MGVGNIGFGNTGTN

SEQ ID NO: 181869 - protein, 14 aa, Mycobacterium tuberculosis
GVGNIGFGNTGTNN

SEQ ID NO: 181870 - protein, 14 aa, Mycobacterium tuberculosis
VGNIGFGNTGTNNL

SEQ ID NO: 181871 - protein, 14 aa, Mycobacterium tuberculosis
GNIGFGNTGTNNLG

SEQ ID NO: 181872 - protein, 14 aa, Mycobacterium tuberculosis
NIGFGNTGTNNLGI

SEQ ID NO: 181873 - protein, 14 aa, Mycobacterium tuberculosis
IGFGNTGTNNLGIG

SEQ ID NO: 181874 - protein, 14 aa, Mycobacterium tuberculosis
GFGNTGTNNLGIGL

SEQ ID NO: 181875 - protein, 14 aa, Mycobacterium tuberculosis
FGNTGTNNLGIGLT

SEQ ID NO: 181876 - protein, 14 aa, Mycobacterium tuberculosis
GNTGTNNLGIGLTG

SEQ ID NO: 181877 - protein, 14 aa, Mycobacterium tuberculosis
NTGTNNLGIGLTGD

SEQ ID NO: 181878 - protein, 14 aa, Mycobacterium tuberculosis
TGTNNLGIGLTGDN

SEQ ID NO: 181879 - protein, 14 aa, Mycobacterium tuberculosis
GTNNLGIGLTGDNQ

SEQ ID NO: 181880 - protein, 14 aa, Mycobacterium tuberculosis
TNNLGIGLTGDNQT

SEQ ID NO: 181881 - protein, 14 aa, Mycobacterium tuberculosis
NNLGIGLTGDNQTG

SEQ ID NO: 181882 - protein, 14 aa, Mycobacterium tuberculosis
NLGIGLTGDNQTGI

SEQ ID NO: 181883 - protein, 14 aa, Mycobacterium tuberculosis
LGIGLTGDNQTGIG

SEQ ID NO: 181884 - protein, 14 aa, Mycobacterium tuberculosis
GIGLTGDNQTGIGG

SEQ ID NO: 181885 - protein, 14 aa, Mycobacterium tuberculosis
IGLTGDNQTGIGGL

SEQ ID NO: 181886 - protein, 14 aa, Mycobacterium tuberculosis
GLTGDNQTGIGGLN

SEQ ID NO: 181887 - protein, 14 aa, Mycobacterium tuberculosis
LTGDNQTGIGGLNS

SEQ ID NO: 181888 - protein, 14 aa, Mycobacterium tuberculosis
TGDNQTGIGGLNSG

SEQ ID NO: 181889 - protein, 14 aa, Mycobacterium tuberculosis
GDNQTGIGGLNSGA

SEQ ID NO: 181890 - protein, 14 aa, Mycobacterium tuberculosis
DNQTGIGGLNSGAG

SEQ ID NO: 181891 - protein, 14 aa, Mycobacterium tuberculosis
NQTGIGGLNSGAGN

SEQ ID NO: 181892 - protein, 14 aa, Mycobacterium tuberculosis
QTGIGGLNSGAGNI

SEQ ID NO: 181893 - protein, 14 aa, Mycobacterium tuberculosis
TGIGGLNSGAGNIG

SEQ ID NO: 181894 - protein, 14 aa, Mycobacterium tuberculosis
GIGGLNSGAGNIGL

SEQ ID NO: 181895 - protein, 14 aa, Mycobacterium tuberculosis
IGGLNSGAGNIGLF

SEQ ID NO: 181896 - protein, 14 aa, Mycobacterium tuberculosis
GGLNSGAGNIGLFN

SEQ ID NO: 181897 - protein, 14 aa, Mycobacterium tuberculosis
GLNSGAGNIGLFNS

SEQ ID NO: 181898 - protein, 14 aa, Mycobacterium tuberculosis
LNSGAGNIGLFNSG

SEQ ID NO: 181899 - protein, 14 aa, Mycobacterium tuberculosis
NSGAGNIGLFNSGT

SEQ ID NO: 181900 - protein, 14 aa, Mycobacterium tuberculosis
SGAGNIGLFNSGTG

SEQ ID NO: 181901 - protein, 14 aa, Mycobacterium tuberculosis
GAGNIGLFNSGTGN

SEQ ID NO: 181902 - protein, 14 aa, Mycobacterium tuberculosis
AGNIGLFNSGTGNV

SEQ ID NO: 181903 - protein, 14 aa, Mycobacterium tuberculosis
GNIGLFNSGTGNVG

SEQ ID NO: 181904 - protein, 14 aa, Mycobacterium tuberculosis
NIGLFNSGTGNVGL

SEQ ID NO: 181905 - protein, 14 aa, Mycobacterium tuberculosis
IGLFNSGTGNVGLF

SEQ ID NO: 181906 - protein, 14 aa, Mycobacterium tuberculosis
GLFNSGTGNVGLFN

SEQ ID NO: 181907 - protein, 14 aa, Mycobacterium tuberculosis
LFNSGTGNVGLFNS

SEQ ID NO: 181908 - protein, 14 aa, Mycobacterium tuberculosis
FNSGTGNVGLFNSG

SEQ ID NO: 181909 - protein, 14 aa, Mycobacterium tuberculosis
NSGTGNVGLFNSGT

SEQ ID NO: 181910 - protein, 14 aa, Mycobacterium tuberculosis
SGTGNVGLFNSGTG

SEQ ID NO: 181911 - protein, 14 aa, Mycobacterium tuberculosis
GTGNVGLFNSGTGN

SEQ ID NO: 181912 - protein, 14 aa, Mycobacterium tuberculosis
TGNVGLFNSGTGNF

SEQ ID NO: 181913 - protein, 14 aa, Mycobacterium tuberculosis
GNVGLFNSGTGNFG

SEQ ID NO: 181914 - protein, 14 aa, Mycobacterium tuberculosis
NVGLFNSGTGNFGL

SEQ ID NO: 181915 - protein, 14 aa, Mycobacterium tuberculosis
VGLFNSGTGNFGLF

SEQ ID NO: 181916 - protein, 14 aa, Mycobacterium tuberculosis
GLFNSGTGNFGLFN

SEQ ID NO: 181917 - protein, 14 aa, Mycobacterium tuberculosis
LFNSGTGNFGLFNS

SEQ ID NO: 181918 - protein, 14 aa, Mycobacterium tuberculosis
FNSGTGNFGLFNSG

SEQ ID NO: 181919 - protein, 14 aa, Mycobacterium tuberculosis
NSGTGNFGLFNSGS

SEQ ID NO: 181920 - protein, 14 aa, Mycobacterium tuberculosis
SGTGNFGLFNSGSF

SEQ ID NO: 181921 - protein, 14 aa, Mycobacterium tuberculosis
GTGNFGLFNSGSFN

SEQ ID NO: 181922 - protein, 14 aa, Mycobacterium tuberculosis
TGNFGLFNSGSFNT

SEQ ID NO: 181923 - protein, 14 aa, Mycobacterium tuberculosis
GNFGLFNSGSFNTG

SEQ ID NO: 181924 - protein, 14 aa, Mycobacterium tuberculosis
NFGLFNSGSFNTGI

SEQ ID NO: 181925 - protein, 14 aa, Mycobacterium tuberculosis
FGLFNSGSFNTGIG

SEQ ID NO: 181926 - protein, 14 aa, Mycobacterium tuberculosis
GLFNSGSFNTGIGN

SEQ ID NO: 181927 - protein, 14 aa, Mycobacterium tuberculosis
LFNSGSFNTGIGNG

SEQ ID NO: 181928 - protein, 14 aa, Mycobacterium tuberculosis
FNSGSFNTGIGNGG

SEQ ID NO: 181929 - protein, 14 aa, Mycobacterium tuberculosis
NSGSFNTGIGNGGT

SEQ ID NO: 181930 - protein, 14 aa, Mycobacterium tuberculosis
SGSFNTGIGNGGTG

SEQ ID NO: 181931 - protein, 14 aa, Mycobacterium tuberculosis
GSFNTGIGNGGTGS

SEQ ID NO: 181932 - protein, 14 aa, Mycobacterium tuberculosis
SFNTGIGNGGTGST

SEQ ID NO: 181933 - protein, 14 aa, Mycobacterium tuberculosis
FNTGIGNGGTGSTG

SEQ ID NO: 181934 - protein, 14 aa, Mycobacterium tuberculosis
NTGIGNGGTGSTGL

SEQ ID NO: 181935 - protein, 14 aa, Mycobacterium tuberculosis
TGIGNGGTGSTGLF

SEQ ID NO: 181936 - protein, 14 aa, Mycobacterium tuberculosis
GIGNGGTGSTGLFN

SEQ ID NO: 181937 - protein, 14 aa, Mycobacterium tuberculosis
IGNGGTGSTGLFNA

SEQ ID NO: 181938 - protein, 14 aa, Mycobacterium tuberculosis
GNGGTGSTGLFNAG

SEQ ID NO: 181939 - protein, 14 aa, Mycobacterium tuberculosis
NGGTGSTGLFNAGN

SEQ ID NO: 181940 - protein, 14 aa, Mycobacterium tuberculosis
GGTGSTGLFNAGNF

SEQ ID NO: 181941 - protein, 14 aa, Mycobacterium tuberculosis
GTGSTGLFNAGNFN

SEQ ID NO: 181942 - protein, 14 aa, Mycobacterium tuberculosis
TGSTGLFNAGNFNT

SEQ ID NO: 181943 - protein, 14 aa, Mycobacterium tuberculosis
GSTGLFNAGNFNTG

SEQ ID NO: 181944 - protein, 14 aa, Mycobacterium tuberculosis
STGLFNAGNFNTGV

SEQ ID NO: 181945 - protein, 14 aa, Mycobacterium tuberculosis
TGLFNAGNFNTGVA

SEQ ID NO: 181946 - protein, 14 aa, Mycobacterium tuberculosis
GLFNAGNFNTGVAN

SEQ ID NO: 181947 - protein, 14 aa, Mycobacterium tuberculosis
LFNAGNFNTGVANP

SEQ ID NO: 181948 - protein, 14 aa, Mycobacterium tuberculosis
FNAGNFNTGVANPG

SEQ ID NO: 181949 - protein, 14 aa, Mycobacterium tuberculosis
NAGNFNTGVANPGS

SEQ ID NO: 181950 - protein, 14 aa, Mycobacterium tuberculosis
AGNFNTGVANPGSY

SEQ ID NO: 181951 - protein, 14 aa, Mycobacterium tuberculosis
GNFNTGVANPGSYN

SEQ ID NO: 181952 - protein, 14 aa, Mycobacterium tuberculosis
NFNTGVANPGSYNT

SEQ ID NO: 181953 - protein, 14 aa, Mycobacterium tuberculosis
FNTGVANPGSYNTG

SEQ ID NO: 181954 - protein, 14 aa, Mycobacterium tuberculosis
NTGVANPGSYNTGS

SEQ ID NO: 181955 - protein, 14 aa, Mycobacterium tuberculosis
TGVANPGSYNTGSF

SEQ ID NO: 181956 - protein, 14 aa, Mycobacterium tuberculosis
GVANPGSYNTGSFN

SEQ ID NO: 181957 - protein, 14 aa, Mycobacterium tuberculosis
VANPGSYNTGSFNV

SEQ ID NO: 181958 - protein, 14 aa, Mycobacterium tuberculosis
ANPGSYNTGSFNVG

SEQ ID NO: 181959 - protein, 14 aa, Mycobacterium tuberculosis
NPGSYNTGSFNVGD

SEQ ID NO: 181960 - protein, 14 aa, Mycobacterium tuberculosis
PGSYNTGSFNVGDT

SEQ ID NO: 181961 - protein, 14 aa, Mycobacterium tuberculosis
GSYNTGSFNVGDTN

SEQ ID NO: 181962 - protein, 14 aa, Mycobacterium tuberculosis
SYNTGSFNVGDTNT

SEQ ID NO: 181963 - protein, 14 aa, Mycobacterium tuberculosis
YNTGSFNVGDTNTG

SEQ ID NO: 181964 - protein, 14 aa, Mycobacterium tuberculosis
NTGSFNVGDTNTGG

SEQ ID NO: 181965 - protein, 14 aa, Mycobacterium tuberculosis
TGSFNVGDTNTGGF

SEQ ID NO: 181966 - protein, 14 aa, Mycobacterium tuberculosis
GSFNVGDTNTGGFN

SEQ ID NO: 181967 - protein, 14 aa, Mycobacterium tuberculosis
SFNVGDTNTGGFNP

SEQ ID NO: 181968 - protein, 14 aa, Mycobacterium tuberculosis
FNVGDTNTGGFNPG

SEQ ID NO: 181969 - protein, 14 aa, Mycobacterium tuberculosis
NVGDTNTGGFNPGS

SEQ ID NO: 181970 - protein, 14 aa, Mycobacterium tuberculosis
VGDTNTGGFNPGSI

SEQ ID NO: 181971 - protein, 14 aa, Mycobacterium tuberculosis
GDTNTGGFNPGSIN

SEQ ID NO: 181972 - protein, 14 aa, Mycobacterium tuberculosis
DTNTGGFNPGSINT

SEQ ID NO: 181973 - protein, 14 aa, Mycobacterium tuberculosis
TNTGGFNPGSINTG

SEQ ID NO: 181974 - protein, 14 aa, Mycobacterium tuberculosis
NTGGFNPGSINTGW

SEQ ID NO: 181975 - protein, 14 aa, Mycobacterium tuberculosis
TGGFNPGSINTGWF

SEQ ID NO: 181976 - protein, 14 aa, Mycobacterium tuberculosis
GGFNPGSINTGWFN

SEQ ID NO: 181977 - protein, 14 aa, Mycobacterium tuberculosis
GFNPGSINTGWFNT

SEQ ID NO: 181978 - protein, 14 aa, Mycobacterium tuberculosis
FNPGSINTGWFNTG

SEQ ID NO: 181979 - protein, 14 aa, Mycobacterium tuberculosis
NPGSINTGWFNTGN

SEQ ID NO: 181980 - protein, 14 aa, Mycobacterium tuberculosis
PGSINTGWFNTGNA

SEQ ID NO: 181981 - protein, 14 aa, Mycobacterium tuberculosis
GSINTGWFNTGNAN

SEQ ID NO: 181982 - protein, 14 aa, Mycobacterium tuberculosis
SINTGWFNTGNANT

SEQ ID NO: 181983 - protein, 14 aa, Mycobacterium tuberculosis
INTGWFNTGNANTG

SEQ ID NO: 181984 - protein, 14 aa, Mycobacterium tuberculosis
NTGWFNTGNANTGV

SEQ ID NO: 181985 - protein, 14 aa, Mycobacterium tuberculosis
TGWFNTGNANTGVA

SEQ ID NO: 181986 - protein, 14 aa, Mycobacterium tuberculosis
GWFNTGNANTGVAN

SEQ ID NO: 181987 - protein, 14 aa, Mycobacterium tuberculosis
WFNTGNANTGVANS

SEQ ID NO: 181988 - protein, 14 aa, Mycobacterium tuberculosis
FNTGNANTGVANSG

SEQ ID NO: 181989 - protein, 14 aa, Mycobacterium tuberculosis
NTGNANTGVANSGN

SEQ ID NO: 181990 - protein, 14 aa, Mycobacterium tuberculosis
TGNANTGVANSGNV

SEQ ID NO: 181991 - protein, 14 aa, Mycobacterium tuberculosis
GNANTGVANSGNVD

SEQ ID NO: 181992 - protein, 14 aa, Mycobacterium tuberculosis
NANTGVANSGNVDT

SEQ ID NO: 181993 - protein, 14 aa, Mycobacterium tuberculosis
ANTGVANSGNVDTG

SEQ ID NO: 181994 - protein, 14 aa, Mycobacterium tuberculosis
NTGVANSGNVDTGA

SEQ ID NO: 181995 - protein, 14 aa, Mycobacterium tuberculosis
TGVANSGNVDTGAL

SEQ ID NO: 181996 - protein, 14 aa, Mycobacterium tuberculosis
GVANSGNVDTGALM

SEQ ID NO: 181997 - protein, 14 aa, Mycobacterium tuberculosis
VANSGNVDTGALMS

SEQ ID NO: 181998 - protein, 14 aa, Mycobacterium tuberculosis
ANSGNVDTGALMSG

SEQ ID NO: 181999 - protein, 14 aa, Mycobacterium tuberculosis
NSGNVDTGALMSGN

SEQ ID NO: 182000 - protein, 14 aa, Mycobacterium tuberculosis
SGNVDTGALMSGNF

SEQ ID NO: 182001 - protein, 14 aa, Mycobacterium tuberculosis
GNVDTGALMSGNFS

SEQ ID NO: 182002 - protein, 14 aa, Mycobacterium tuberculosis
NVDTGALMSGNFSN

SEQ ID NO: 182003 - protein, 14 aa, Mycobacterium tuberculosis
VDTGALMSGNFSNG

SEQ ID NO: 182004 - protein, 14 aa, Mycobacterium tuberculosis
DTGALMSGNFSNGI

SEQ ID NO: 182005 - protein, 14 aa, Mycobacterium tuberculosis
TGALMSGNFSNGIL

SEQ ID NO: 182006 - protein, 14 aa, Mycobacterium tuberculosis
GALMSGNFSNGILW

SEQ ID NO: 182007 - protein, 14 aa, Mycobacterium tuberculosis
ALMSGNFSNGILWR

SEQ ID NO: 182008 - protein, 14 aa, Mycobacterium tuberculosis
LMSGNFSNGILWRG

SEQ ID NO: 182009 - protein, 14 aa, Mycobacterium tuberculosis
MSGNFSNGILWRGN

SEQ ID NO: 182010 - protein, 14 aa, Mycobacterium tuberculosis
SGNFSNGILWRGNF

SEQ ID NO: 182011 - protein, 14 aa, Mycobacterium tuberculosis
GNFSNGILWRGNFE

SEQ ID NO: 182012 - protein, 14 aa, Mycobacterium tuberculosis
NFSNGILWRGNFEG

SEQ ID NO: 182013 - protein, 14 aa, Mycobacterium tuberculosis
FSNGILWRGNFEGL

SEQ ID NO: 182014 - protein, 14 aa, Mycobacterium tuberculosis
SNGILWRGNFEGLF

SEQ ID NO: 182015 - protein, 14 aa, Mycobacterium tuberculosis
NGILWRGNFEGLFG

SEQ ID NO: 182016 - protein, 14 aa, Mycobacterium tuberculosis
GILWRGNFEGLFGL

SEQ ID NO: 182017 - protein, 14 aa, Mycobacterium tuberculosis
ILWRGNFEGLFGLN

SEQ ID NO: 182018 - protein, 14 aa, Mycobacterium tuberculosis
LWRGNFEGLFGLNV

SEQ ID NO: 182019 - protein, 14 aa, Mycobacterium tuberculosis
WRGNFEGLFGLNVG

SEQ ID NO: 182020 - protein, 14 aa, Mycobacterium tuberculosis
RGNFEGLFGLNVGI

SEQ ID NO: 182021 - protein, 14 aa, Mycobacterium tuberculosis
GNFEGLFGLNVGIT

SEQ ID NO: 182022 - protein, 14 aa, Mycobacterium tuberculosis
NFEGLFGLNVGITI

SEQ ID NO: 182023 - protein, 14 aa, Mycobacterium tuberculosis
FEGLFGLNVGITIP

SEQ ID NO: 182024 - protein, 14 aa, Mycobacterium tuberculosis
EGLFGLNVGITIPE

SEQ ID NO: 182025 - protein, 14 aa, Mycobacterium tuberculosis
GLFGLNVGITIPEF

SEQ ID NO: 182026 - protein, 14 aa, Mycobacterium tuberculosis
LFGLNVGITIPEFP

SEQ ID NO: 182027 - protein, 14 aa, Mycobacterium tuberculosis
FGLNVGITIPEFPI

SEQ ID NO: 182028 - protein, 14 aa, Mycobacterium tuberculosis
GLNVGITIPEFPIH

SEQ ID NO: 182029 - protein, 14 aa, Mycobacterium tuberculosis
LNVGITIPEFPIHW

SEQ ID NO: 182030 - protein, 14 aa, Mycobacterium tuberculosis
NVGITIPEFPIHWT

SEQ ID NO: 182031 - protein, 14 aa, Mycobacterium tuberculosis
VGITIPEFPIHWTS

SEQ ID NO: 182032 - protein, 14 aa, Mycobacterium tuberculosis
GITIPEFPIHWTST

SEQ ID NO: 182033 - protein, 14 aa, Mycobacterium tuberculosis
ITIPEFPIHWTSTG

SEQ ID NO: 182034 - protein, 14 aa, Mycobacterium tuberculosis
TIPEFPIHWTSTGG

SEQ ID NO: 182035 - protein, 14 aa, Mycobacterium tuberculosis
IPEFPIHWTSTGGI

SEQ ID NO: 182036 - protein, 14 aa, Mycobacterium tuberculosis
PEFPIHWTSTGGIG

SEQ ID NO: 182037 - protein, 14 aa, Mycobacterium tuberculosis
EFPIHWTSTGGIGP

SEQ ID NO: 182038 - protein, 14 aa, Mycobacterium tuberculosis
FPIHWTSTGGIGPI

SEQ ID NO: 182039 - protein, 14 aa, Mycobacterium tuberculosis
PIHWTSTGGIGPII

SEQ ID NO: 182040 - protein, 14 aa, Mycobacterium tuberculosis
IHWTSTGGIGPIII

SEQ ID NO: 182041 - protein, 14 aa, Mycobacterium tuberculosis
HWTSTGGIGPIIIP

SEQ ID NO: 182042 - protein, 14 aa, Mycobacterium tuberculosis
WTSTGGIGPIIIPD

SEQ ID NO: 182043 - protein, 14 aa, Mycobacterium tuberculosis
TSTGGIGPIIIPDT

SEQ ID NO: 182044 - protein, 14 aa, Mycobacterium tuberculosis
STGGIGPIIIPDTT

SEQ ID NO: 182045 - protein, 14 aa, Mycobacterium tuberculosis
TGGIGPIIIPDTTI

SEQ ID NO: 182046 - protein, 14 aa, Mycobacterium tuberculosis
GGIGPIIIPDTTIL

SEQ ID NO: 182047 - protein, 14 aa, Mycobacterium tuberculosis
GIGPIIIPDTTILP

SEQ ID NO: 182048 - protein, 14 aa, Mycobacterium tuberculosis
IGPIIIPDTTILPP

SEQ ID NO: 182049 - protein, 14 aa, Mycobacterium tuberculosis
GPIIIPDTTILPPI

SEQ ID NO: 182050 - protein, 14 aa, Mycobacterium tuberculosis
PIIIPDTTILPPIH

SEQ ID NO: 182051 - protein, 14 aa, Mycobacterium tuberculosis
IIIPDTTILPPIHL

SEQ ID NO: 182052 - protein, 14 aa, Mycobacterium tuberculosis
IIPDTTILPPIHLG

SEQ ID NO: 182053 - protein, 14 aa, Mycobacterium tuberculosis
IPDTTILPPIHLGL

SEQ ID NO: 182054 - protein, 14 aa, Mycobacterium tuberculosis
PDTTILPPIHLGLT

SEQ ID NO: 182055 - protein, 14 aa, Mycobacterium tuberculosis
DTTILPPIHLGLTG

SEQ ID NO: 182056 - protein, 14 aa, Mycobacterium tuberculosis
TTILPPIHLGLTGQ

SEQ ID NO: 182057 - protein, 14 aa, Mycobacterium tuberculosis
TILPPIHLGLTGQA

SEQ ID NO: 182058 - protein, 14 aa, Mycobacterium tuberculosis
ILPPIHLGLTGQAN

SEQ ID NO: 182059 - protein, 14 aa, Mycobacterium tuberculosis
LPPIHLGLTGQANY

SEQ ID NO: 182060 - protein, 14 aa, Mycobacterium tuberculosis
PPIHLGLTGQANYG

SEQ ID NO: 182061 - protein, 14 aa, Mycobacterium tuberculosis
PIHLGLTGQANYGF

SEQ ID NO: 182062 - protein, 14 aa, Mycobacterium tuberculosis
IHLGLTGQANYGFA

SEQ ID NO: 182063 - protein, 14 aa, Mycobacterium tuberculosis
HLGLTGQANYGFAV

SEQ ID NO: 182064 - protein, 14 aa, Mycobacterium tuberculosis
LGLTGQANYGFAVP

SEQ ID NO: 182065 - protein, 14 aa, Mycobacterium tuberculosis
GLTGQANYGFAVPD

SEQ ID NO: 182066 - protein, 14 aa, Mycobacterium tuberculosis
LTGQANYGFAVPDI

SEQ ID NO: 182067 - protein, 14 aa, Mycobacterium tuberculosis
TGQANYGFAVPDIP

SEQ ID NO: 182068 - protein, 14 aa, Mycobacterium tuberculosis
GQANYGFAVPDIPI

SEQ ID NO: 182069 - protein, 14 aa, Mycobacterium tuberculosis
QANYGFAVPDIPIP

SEQ ID NO: 182070 - protein, 14 aa, Mycobacterium tuberculosis
ANYGFAVPDIPIPA

SEQ ID NO: 182071 - protein, 14 aa, Mycobacterium tuberculosis
NYGFAVPDIPIPAI

SEQ ID NO: 182072 - protein, 14 aa, Mycobacterium tuberculosis
YGFAVPDIPIPAIH

SEQ ID NO: 182073 - protein, 14 aa, Mycobacterium tuberculosis
GFAVPDIPIPAIHI

SEQ ID NO: 182074 - protein, 14 aa, Mycobacterium tuberculosis
FAVPDIPIPAIHID

SEQ ID NO: 182075 - protein, 14 aa, Mycobacterium tuberculosis
AVPDIPIPAIHIDF

SEQ ID NO: 182076 - protein, 14 aa, Mycobacterium tuberculosis
VPDIPIPAIHIDFD

SEQ ID NO: 182077 - protein, 14 aa, Mycobacterium tuberculosis
PDIPIPAIHIDFDG

SEQ ID NO: 182078 - protein, 14 aa, Mycobacterium tuberculosis
DIPIPAIHIDFDGA

SEQ ID NO: 182079 - protein, 14 aa, Mycobacterium tuberculosis
IPIPAIHIDFDGAA

SEQ ID NO: 182080 - protein, 14 aa, Mycobacterium tuberculosis
PIPAIHIDFDGAAD

SEQ ID NO: 182081 - protein, 14 aa, Mycobacterium tuberculosis
IPAIHIDFDGAADA

SEQ ID NO: 182082 - protein, 14 aa, Mycobacterium tuberculosis
PAIHIDFDGAADAG

SEQ ID NO: 182083 - protein, 14 aa, Mycobacterium tuberculosis
AIHIDFDGAADAGF

SEQ ID NO: 182084 - protein, 14 aa, Mycobacterium tuberculosis
IHIDFDGAADAGFT

SEQ ID NO: 182085 - protein, 14 aa, Mycobacterium tuberculosis
HIDFDGAADAGFTA

SEQ ID NO: 182086 - protein, 14 aa, Mycobacterium tuberculosis
IDFDGAADAGFTAP

SEQ ID NO: 182087 - protein, 14 aa, Mycobacterium tuberculosis
DFDGAADAGFTAPA

SEQ ID NO: 182088 - protein, 14 aa, Mycobacterium tuberculosis
FDGAADAGFTAPAT

SEQ ID NO: 182089 - protein, 14 aa, Mycobacterium tuberculosis
DGAADAGFTAPATT

SEQ ID NO: 182090 - protein, 14 aa, Mycobacterium tuberculosis
GAADAGFTAPATTL

SEQ ID NO: 182091 - protein, 14 aa, Mycobacterium tuberculosis
AADAGFTAPATTLL

SEQ ID NO: 182092 - protein, 14 aa, Mycobacterium tuberculosis
ADAGFTAPATTLLS

SEQ ID NO: 182093 - protein, 14 aa, Mycobacterium tuberculosis
DAGFTAPATTLLSA

SEQ ID NO: 182094 - protein, 14 aa, Mycobacterium tuberculosis
AGFTAPATTLLSAL

SEQ ID NO: 182095 - protein, 14 aa, Mycobacterium tuberculosis
GFTAPATTLLSALG

SEQ ID NO: 182096 - protein, 14 aa, Mycobacterium tuberculosis
FTAPATTLLSALGI

SEQ ID NO: 182097 - protein, 14 aa, Mycobacterium tuberculosis
TAPATTLLSALGIT

SEQ ID NO: 182098 - protein, 14 aa, Mycobacterium tuberculosis
APATTLLSALGITG

SEQ ID NO: 182099 - protein, 14 aa, Mycobacterium tuberculosis
PATTLLSALGITGQ

SEQ ID NO: 182100 - protein, 14 aa, Mycobacterium tuberculosis
ATTLLSALGITGQF

SEQ ID NO: 182101 - protein, 14 aa, Mycobacterium tuberculosis
TTLLSALGITGQFR

SEQ ID NO: 182102 - protein, 14 aa, Mycobacterium tuberculosis
TLLSALGITGQFRF

SEQ ID NO: 182103 - protein, 14 aa, Mycobacterium tuberculosis
LLSALGITGQFRFG

SEQ ID NO: 182104 - protein, 14 aa, Mycobacterium tuberculosis
LSALGITGQFRFGP

SEQ ID NO: 182105 - protein, 14 aa, Mycobacterium tuberculosis
SALGITGQFRFGPI

SEQ ID NO: 182106 - protein, 14 aa, Mycobacterium tuberculosis
ALGITGQFRFGPIT

SEQ ID NO: 182107 - protein, 14 aa, Mycobacterium tuberculosis
LGITGQFRFGPITV

SEQ ID NO: 182108 - protein, 14 aa, Mycobacterium tuberculosis
GITGQFRFGPITVS

SEQ ID NO: 182109 - protein, 14 aa, Mycobacterium tuberculosis
ITGQFRFGPITVSN

SEQ ID NO: 182110 - protein, 14 aa, Mycobacterium tuberculosis
TGQFRFGPITVSNV

SEQ ID NO: 182111 - protein, 14 aa, Mycobacterium tuberculosis
GQFRFGPITVSNVQ

SEQ ID NO: 182112 - protein, 14 aa, Mycobacterium tuberculosis
QFRFGPITVSNVQL

SEQ ID NO: 182113 - protein, 14 aa, Mycobacterium tuberculosis
FRFGPITVSNVQLN

SEQ ID NO: 182114 - protein, 14 aa, Mycobacterium tuberculosis
RFGPITVSNVQLNP

SEQ ID NO: 182115 - protein, 14 aa, Mycobacterium tuberculosis
FGPITVSNVQLNPF

SEQ ID NO: 182116 - protein, 14 aa, Mycobacterium tuberculosis
GPITVSNVQLNPFN

SEQ ID NO: 182117 - protein, 14 aa, Mycobacterium tuberculosis
PITVSNVQLNPFNV

SEQ ID NO: 182118 - protein, 14 aa, Mycobacterium tuberculosis
ITVSNVQLNPFNVN

SEQ ID NO: 182119 - protein, 14 aa, Mycobacterium tuberculosis
TVSNVQLNPFNVNL

SEQ ID NO: 182120 - protein, 14 aa, Mycobacterium tuberculosis
VSNVQLNPFNVNLK

SEQ ID NO: 182121 - protein, 14 aa, Mycobacterium tuberculosis
SNVQLNPFNVNLKL

SEQ ID NO: 182122 - protein, 14 aa, Mycobacterium tuberculosis
NVQLNPFNVNLKLQ

SEQ ID NO: 182123 - protein, 14 aa, Mycobacterium tuberculosis
VQLNPFNVNLKLQF

SEQ ID NO: 182124 - protein, 14 aa, Mycobacterium tuberculosis
QLNPFNVNLKLQFL

SEQ ID NO: 182125 - protein, 14 aa, Mycobacterium tuberculosis
LNPFNVNLKLQFLH

SEQ ID NO: 182126 - protein, 14 aa, Mycobacterium tuberculosis
NPFNVNLKLQFLHD

SEQ ID NO: 182127 - protein, 14 aa, Mycobacterium tuberculosis
PFNVNLKLQFLHDA

SEQ ID NO: 182128 - protein, 14 aa, Mycobacterium tuberculosis
FNVNLKLQFLHDAF

SEQ ID NO: 182129 - protein, 14 aa, Mycobacterium tuberculosis
NVNLKLQFLHDAFP

SEQ ID NO: 182130 - protein, 14 aa, Mycobacterium tuberculosis
VNLKLQFLHDAFPN

SEQ ID NO: 182131 - protein, 14 aa, Mycobacterium tuberculosis
NLKLQFLHDAFPNE

SEQ ID NO: 182132 - protein, 14 aa, Mycobacterium tuberculosis
LKLQFLHDAFPNEF

SEQ ID NO: 182133 - protein, 14 aa, Mycobacterium tuberculosis
KLQFLHDAFPNEFP

SEQ ID NO: 182134 - protein, 14 aa, Mycobacterium tuberculosis
LQFLHDAFPNEFPD

SEQ ID NO: 182135 - protein, 14 aa, Mycobacterium tuberculosis
QFLHDAFPNEFPDP

SEQ ID NO: 182136 - protein, 14 aa, Mycobacterium tuberculosis
FLHDAFPNEFPDPT

SEQ ID NO: 182137 - protein, 14 aa, Mycobacterium tuberculosis
LHDAFPNEFPDPTI

SEQ ID NO: 182138 - protein, 14 aa, Mycobacterium tuberculosis
HDAFPNEFPDPTIS

SEQ ID NO: 182139 - protein, 14 aa, Mycobacterium tuberculosis
DAFPNEFPDPTISV

SEQ ID NO: 182140 - protein, 14 aa, Mycobacterium tuberculosis
AFPNEFPDPTISVQ

SEQ ID NO: 182141 - protein, 14 aa, Mycobacterium tuberculosis
FPNEFPDPTISVQI

SEQ ID NO: 182142 - protein, 14 aa, Mycobacterium tuberculosis
PNEFPDPTISVQIQ

SEQ ID NO: 182143 - protein, 14 aa, Mycobacterium tuberculosis
NEFPDPTISVQIQV

SEQ ID NO: 182144 - protein, 14 aa, Mycobacterium tuberculosis
EFPDPTISVQIQVA

SEQ ID NO: 182145 - protein, 14 aa, Mycobacterium tuberculosis
FPDPTISVQIQVAI

SEQ ID NO: 182146 - protein, 14 aa, Mycobacterium tuberculosis
PDPTISVQIQVAIP

SEQ ID NO: 182147 - protein, 14 aa, Mycobacterium tuberculosis
DPTISVQIQVAIPL

SEQ ID NO: 182148 - protein, 14 aa, Mycobacterium tuberculosis
PTISVQIQVAIPLT

SEQ ID NO: 182149 - protein, 14 aa, Mycobacterium tuberculosis
TISVQIQVAIPLTS

SEQ ID NO: 182150 - protein, 14 aa, Mycobacterium tuberculosis
ISVQIQVAIPLTSA

SEQ ID NO: 182151 - protein, 14 aa, Mycobacterium tuberculosis
SVQIQVAIPLTSAT

SEQ ID NO: 182152 - protein, 14 aa, Mycobacterium tuberculosis
VQIQVAIPLTSATL

SEQ ID NO: 182153 - protein, 14 aa, Mycobacterium tuberculosis
QIQVAIPLTSATLG

SEQ ID NO: 182154 - protein, 14 aa, Mycobacterium tuberculosis
IQVAIPLTSATLGG

SEQ ID NO: 182155 - protein, 14 aa, Mycobacterium tuberculosis
QVAIPLTSATLGGL

SEQ ID NO: 182156 - protein, 14 aa, Mycobacterium tuberculosis
VAIPLTSATLGGLA

SEQ ID NO: 182157 - protein, 14 aa, Mycobacterium tuberculosis
AIPLTSATLGGLAL

SEQ ID NO: 182158 - protein, 14 aa, Mycobacterium tuberculosis
IPLTSATLGGLALP

SEQ ID NO: 182159 - protein, 14 aa, Mycobacterium tuberculosis
PLTSATLGGLALPL

SEQ ID NO: 182160 - protein, 14 aa, Mycobacterium tuberculosis
LTSATLGGLALPLQ

SEQ ID NO: 182161 - protein, 14 aa, Mycobacterium tuberculosis
TSATLGGLALPLQQ

SEQ ID NO: 182162 - protein, 14 aa, Mycobacterium tuberculosis
SATLGGLALPLQQT

SEQ ID NO: 182163 - protein, 14 aa, Mycobacterium tuberculosis
ATLGGLALPLQQTI

SEQ ID NO: 182164 - protein, 14 aa, Mycobacterium tuberculosis
TLGGLALPLQQTID

SEQ ID NO: 182165 - protein, 14 aa, Mycobacterium tuberculosis
LGGLALPLQQTIDA

SEQ ID NO: 182166 - protein, 14 aa, Mycobacterium tuberculosis
GGLALPLQQTIDAI

SEQ ID NO: 182167 - protein, 14 aa, Mycobacterium tuberculosis
GLALPLQQTIDAIE

SEQ ID NO: 182168 - protein, 14 aa, Mycobacterium tuberculosis
LALPLQQTIDAIEL

SEQ ID NO: 182169 - protein, 14 aa, Mycobacterium tuberculosis
ALPLQQTIDAIELP

SEQ ID NO: 182170 - protein, 14 aa, Mycobacterium tuberculosis
LPLQQTIDAIELPA

SEQ ID NO: 182171 - protein, 14 aa, Mycobacterium tuberculosis
PLQQTIDAIELPAI

SEQ ID NO: 182172 - protein, 14 aa, Mycobacterium tuberculosis
LQQTIDAIELPAIS

SEQ ID NO: 182173 - protein, 14 aa, Mycobacterium tuberculosis
QQTIDAIELPAISF

SEQ ID NO: 182174 - protein, 14 aa, Mycobacterium tuberculosis
QTIDAIELPAISFS

SEQ ID NO: 182175 - protein, 14 aa, Mycobacterium tuberculosis
TIDAIELPAISFSQ

SEQ ID NO: 182176 - protein, 14 aa, Mycobacterium tuberculosis
IDAIELPAISFSQS

SEQ ID NO: 182177 - protein, 14 aa, Mycobacterium tuberculosis
DAIELPAISFSQSI

SEQ ID NO: 182178 - protein, 14 aa, Mycobacterium tuberculosis
AIELPAISFSQSIP

SEQ ID NO: 182179 - protein, 14 aa, Mycobacterium tuberculosis
IELPAISFSQSIPI

SEQ ID NO: 182180 - protein, 14 aa, Mycobacterium tuberculosis
ELPAISFSQSIPID

SEQ ID NO: 182181 - protein, 14 aa, Mycobacterium tuberculosis
LPAISFSQSIPIDI

SEQ ID NO: 182182 - protein, 14 aa, Mycobacterium tuberculosis
PAISFSQSIPIDIP

SEQ ID NO: 182183 - protein, 14 aa, Mycobacterium tuberculosis
AISFSQSIPIDIPP

SEQ ID NO: 182184 - protein, 14 aa, Mycobacterium tuberculosis
ISFSQSIPIDIPPI

SEQ ID NO: 182185 - protein, 14 aa, Mycobacterium tuberculosis
SFSQSIPIDIPPID

SEQ ID NO: 182186 - protein, 14 aa, Mycobacterium tuberculosis
FSQSIPIDIPPIDI

SEQ ID NO: 182187 - protein, 14 aa, Mycobacterium tuberculosis
SQSIPIDIPPIDIP

SEQ ID NO: 182188 - protein, 14 aa, Mycobacterium tuberculosis
QSIPIDIPPIDIPA

SEQ ID NO: 182189 - protein, 14 aa, Mycobacterium tuberculosis
SIPIDIPPIDIPAS

SEQ ID NO: 182190 - protein, 14 aa, Mycobacterium tuberculosis
IPIDIPPIDIPAST

SEQ ID NO: 182191 - protein, 14 aa, Mycobacterium tuberculosis
PIDIPPIDIPASTI

SEQ ID NO: 182192 - protein, 14 aa, Mycobacterium tuberculosis
IDIPPIDIPASTIN

SEQ ID NO: 182193 - protein, 14 aa, Mycobacterium tuberculosis
DIPPIDIPASTING

SEQ ID NO: 182194 - protein, 14 aa, Mycobacterium tuberculosis
IPPIDIPASTINGI

SEQ ID NO: 182195 - protein, 14 aa, Mycobacterium tuberculosis
PPIDIPASTINGIS

SEQ ID NO: 182196 - protein, 14 aa, Mycobacterium tuberculosis
PIDIPASTINGISM

SEQ ID NO: 182197 - protein, 14 aa, Mycobacterium tuberculosis
IDIPASTINGISMS

SEQ ID NO: 182198 - protein, 14 aa, Mycobacterium tuberculosis
DIPASTINGISMSE

SEQ ID NO: 182199 - protein, 14 aa, Mycobacterium tuberculosis
IPASTINGISMSEV

SEQ ID NO: 182200 - protein, 14 aa, Mycobacterium tuberculosis
PASTINGISMSEVV

SEQ ID NO: 182201 - protein, 14 aa, Mycobacterium tuberculosis
ASTINGISMSEVVP

SEQ ID NO: 182202 - protein, 14 aa, Mycobacterium tuberculosis
STINGISMSEVVPI

SEQ ID NO: 182203 - protein, 14 aa, Mycobacterium tuberculosis
TINGISMSEVVPID

SEQ ID NO: 182204 - protein, 14 aa, Mycobacterium tuberculosis
INGISMSEVVPIDV

SEQ ID NO: 182205 - protein, 14 aa, Mycobacterium tuberculosis
NGISMSEVVPIDVS

SEQ ID NO: 182206 - protein, 14 aa, Mycobacterium tuberculosis
GISMSEVVPIDVSV

SEQ ID NO: 182207 - protein, 14 aa, Mycobacterium tuberculosis
ISMSEVVPIDVSVD

SEQ ID NO: 182208 - protein, 14 aa, Mycobacterium tuberculosis
SMSEVVPIDVSVDI

SEQ ID NO: 182209 - protein, 14 aa, Mycobacterium tuberculosis
MSEVVPIDVSVDIP

SEQ ID NO: 182210 - protein, 14 aa, Mycobacterium tuberculosis
SEVVPIDVSVDIPA

SEQ ID NO: 182211 - protein, 14 aa, Mycobacterium tuberculosis
EVVPIDVSVDIPAV

SEQ ID NO: 182212 - protein, 14 aa, Mycobacterium tuberculosis
VVPIDVSVDIPAVT

SEQ ID NO: 182213 - protein, 14 aa, Mycobacterium tuberculosis
VPIDVSVDIPAVTI

SEQ ID NO: 182214 - protein, 14 aa, Mycobacterium tuberculosis
PIDVSVDIPAVTIT

SEQ ID NO: 182215 - protein, 14 aa, Mycobacterium tuberculosis
IDVSVDIPAVTITG

SEQ ID NO: 182216 - protein, 14 aa, Mycobacterium tuberculosis
DVSVDIPAVTITGT

SEQ ID NO: 182217 - protein, 14 aa, Mycobacterium tuberculosis
VSVDIPAVTITGTR

SEQ ID NO: 182218 - protein, 14 aa, Mycobacterium tuberculosis
SVDIPAVTITGTRI

SEQ ID NO: 182219 - protein, 14 aa, Mycobacterium tuberculosis
VDIPAVTITGTRID

SEQ ID NO: 182220 - protein, 14 aa, Mycobacterium tuberculosis
DIPAVTITGTRIDP

SEQ ID NO: 182221 - protein, 14 aa, Mycobacterium tuberculosis
IPAVTITGTRIDPI

SEQ ID NO: 182222 - protein, 14 aa, Mycobacterium tuberculosis
PAVTITGTRIDPIP

SEQ ID NO: 182223 - protein, 14 aa, Mycobacterium tuberculosis
AVTITGTRIDPIPL

SEQ ID NO: 182224 - protein, 14 aa, Mycobacterium tuberculosis
VTITGTRIDPIPLN

SEQ ID NO: 182225 - protein, 14 aa, Mycobacterium tuberculosis
TITGTRIDPIPLNF

SEQ ID NO: 182226 - protein, 14 aa, Mycobacterium tuberculosis
ITGTRIDPIPLNFD

SEQ ID NO: 182227 - protein, 14 aa, Mycobacterium tuberculosis
TGTRIDPIPLNFDV

SEQ ID NO: 182228 - protein, 14 aa, Mycobacterium tuberculosis
GTRIDPIPLNFDVL

SEQ ID NO: 182229 - protein, 14 aa, Mycobacterium tuberculosis
TRIDPIPLNFDVLS

SEQ ID NO: 182230 - protein, 14 aa, Mycobacterium tuberculosis
RIDPIPLNFDVLSS

SEQ ID NO: 182231 - protein, 14 aa, Mycobacterium tuberculosis
IDPIPLNFDVLSSA

SEQ ID NO: 182232 - protein, 14 aa, Mycobacterium tuberculosis
DPIPLNFDVLSSAG

SEQ ID NO: 182233 - protein, 14 aa, Mycobacterium tuberculosis
PIPLNFDVLSSAGP

SEQ ID NO: 182234 - protein, 14 aa, Mycobacterium tuberculosis
IPLNFDVLSSAGPI

SEQ ID NO: 182235 - protein, 14 aa, Mycobacterium tuberculosis
PLNFDVLSSAGPIN

SEQ ID NO: 182236 - protein, 14 aa, Mycobacterium tuberculosis
LNFDVLSSAGPINI

SEQ ID NO: 182237 - protein, 14 aa, Mycobacterium tuberculosis
NFDVLSSAGPINIS

SEQ ID NO: 182238 - protein, 14 aa, Mycobacterium tuberculosis
FDVLSSAGPINISI

SEQ ID NO: 182239 - protein, 14 aa, Mycobacterium tuberculosis
DVLSSAGPINISII

SEQ ID NO: 182240 - protein, 14 aa, Mycobacterium tuberculosis
VLSSAGPINISIID

SEQ ID NO: 182241 - protein, 14 aa, Mycobacterium tuberculosis
LSSAGPINISIIDI

SEQ ID NO: 182242 - protein, 14 aa, Mycobacterium tuberculosis
SSAGPINISIIDIP

SEQ ID NO: 182243 - protein, 14 aa, Mycobacterium tuberculosis
SAGPINISIIDIPA

SEQ ID NO: 182244 - protein, 14 aa, Mycobacterium tuberculosis
AGPINISIIDIPAL

SEQ ID NO: 182245 - protein, 14 aa, Mycobacterium tuberculosis
GPINISIIDIPALP

SEQ ID NO: 182246 - protein, 14 aa, Mycobacterium tuberculosis
PINISIIDIPALPG

SEQ ID NO: 182247 - protein, 14 aa, Mycobacterium tuberculosis
INISIIDIPALPGF

SEQ ID NO: 182248 - protein, 14 aa, Mycobacterium tuberculosis
NISIIDIPALPGFG

SEQ ID NO: 182249 - protein, 14 aa, Mycobacterium tuberculosis
ISIIDIPALPGFGN

SEQ ID NO: 182250 - protein, 14 aa, Mycobacterium tuberculosis
SIIDIPALPGFGNS

SEQ ID NO: 182251 - protein, 14 aa, Mycobacterium tuberculosis
IIDIPALPGFGNST

SEQ ID NO: 182252 - protein, 14 aa, Mycobacterium tuberculosis
IDIPALPGFGNSTE

SEQ ID NO: 182253 - protein, 14 aa, Mycobacterium tuberculosis
DIPALPGFGNSTEL

SEQ ID NO: 182254 - protein, 14 aa, Mycobacterium tuberculosis
IPALPGFGNSTELP

SEQ ID NO: 182255 - protein, 14 aa, Mycobacterium tuberculosis
PALPGFGNSTELPS

SEQ ID NO: 182256 - protein, 14 aa, Mycobacterium tuberculosis
ALPGFGNSTELPSS

SEQ ID NO: 182257 - protein, 14 aa, Mycobacterium tuberculosis
LPGFGNSTELPSSG

SEQ ID NO: 182258 - protein, 14 aa, Mycobacterium tuberculosis
PGFGNSTELPSSGF

SEQ ID NO: 182259 - protein, 14 aa, Mycobacterium tuberculosis
GFGNSTELPSSGFF

SEQ ID NO: 182260 - protein, 14 aa, Mycobacterium tuberculosis
FGNSTELPSSGFFN

SEQ ID NO: 182261 - protein, 14 aa, Mycobacterium tuberculosis
GNSTELPSSGFFNT

SEQ ID NO: 182262 - protein, 14 aa, Mycobacterium tuberculosis
NSTELPSSGFFNTG

SEQ ID NO: 182263 - protein, 14 aa, Mycobacterium tuberculosis
STELPSSGFFNTGG

SEQ ID NO: 182264 - protein, 14 aa, Mycobacterium tuberculosis
TELPSSGFFNTGGG

SEQ ID NO: 182265 - protein, 14 aa, Mycobacterium tuberculosis
ELPSSGFFNTGGGG

SEQ ID NO: 182266 - protein, 14 aa, Mycobacterium tuberculosis
LPSSGFFNTGGGGG

SEQ ID NO: 182267 - protein, 14 aa, Mycobacterium tuberculosis
PSSGFFNTGGGGGS

SEQ ID NO: 182268 - protein, 14 aa, Mycobacterium tuberculosis
SSGFFNTGGGGGSG

SEQ ID NO: 182269 - protein, 14 aa, Mycobacterium tuberculosis
SGFFNTGGGGGSGI

SEQ ID NO: 182270 - protein, 14 aa, Mycobacterium tuberculosis
GFFNTGGGGGSGIA

SEQ ID NO: 182271 - protein, 14 aa, Mycobacterium tuberculosis
FFNTGGGGGSGIAN

SEQ ID NO: 182272 - protein, 14 aa, Mycobacterium tuberculosis
FNTGGGGGSGIANF

SEQ ID NO: 182273 - protein, 14 aa, Mycobacterium tuberculosis
NTGGGGGSGIANFG

SEQ ID NO: 182274 - protein, 14 aa, Mycobacterium tuberculosis
TGGGGGSGIANFGA

SEQ ID NO: 182275 - protein, 14 aa, Mycobacterium tuberculosis
GGGGGSGIANFGAG

SEQ ID NO: 182276 - protein, 14 aa, Mycobacterium tuberculosis
GGGGSGIANFGAGV

SEQ ID NO: 182277 - protein, 14 aa, Mycobacterium tuberculosis
GGGSGIANFGAGVS

SEQ ID NO: 182278 - protein, 14 aa, Mycobacterium tuberculosis
GGSGIANFGAGVSG

SEQ ID NO: 182279 - protein, 14 aa, Mycobacterium tuberculosis
GSGIANFGAGVSGL

SEQ ID NO: 182280 - protein, 14 aa, Mycobacterium tuberculosis
SGIANFGAGVSGLL

SEQ ID NO: 182281 - protein, 14 aa, Mycobacterium tuberculosis
GIANFGAGVSGLLN

SEQ ID NO: 182282 - protein, 14 aa, Mycobacterium tuberculosis
IANFGAGVSGLLNQ

SEQ ID NO: 182283 - protein, 14 aa, Mycobacterium tuberculosis
ANFGAGVSGLLNQA

SEQ ID NO: 182284 - protein, 14 aa, Mycobacterium tuberculosis
NFGAGVSGLLNQAS

SEQ ID NO: 182285 - protein, 14 aa, Mycobacterium tuberculosis
FGAGVSGLLNQASS

SEQ ID NO: 182286 - protein, 14 aa, Mycobacterium tuberculosis
GAGVSGLLNQASSP

SEQ ID NO: 182287 - protein, 14 aa, Mycobacterium tuberculosis
AGVSGLLNQASSPM

SEQ ID NO: 182288 - protein, 14 aa, Mycobacterium tuberculosis
GVSGLLNQASSPMV

SEQ ID NO: 182289 - protein, 14 aa, Mycobacterium tuberculosis
VSGLLNQASSPMVG

SEQ ID NO: 182290 - protein, 14 aa, Mycobacterium tuberculosis
SGLLNQASSPMVGT

SEQ ID NO: 182291 - protein, 14 aa, Mycobacterium tuberculosis
GLLNQASSPMVGTL

SEQ ID NO: 182292 - protein, 14 aa, Mycobacterium tuberculosis
LLNQASSPMVGTLS

SEQ ID NO: 182293 - protein, 14 aa, Mycobacterium tuberculosis
LNQASSPMVGTLSG

SEQ ID NO: 182294 - protein, 14 aa, Mycobacterium tuberculosis
NQASSPMVGTLSGL

SEQ ID NO: 182295 - protein, 14 aa, Mycobacterium tuberculosis
QASSPMVGTLSGLG

SEQ ID NO: 182296 - protein, 14 aa, Mycobacterium tuberculosis
ASSPMVGTLSGLGN

SEQ ID NO: 182297 - protein, 14 aa, Mycobacterium tuberculosis
SSPMVGTLSGLGNA

SEQ ID NO: 182298 - protein, 14 aa, Mycobacterium tuberculosis
SPMVGTLSGLGNAG

SEQ ID NO: 182299 - protein, 14 aa, Mycobacterium tuberculosis
PMVGTLSGLGNAGS

SEQ ID NO: 182300 - protein, 14 aa, Mycobacterium tuberculosis
MVGTLSGLGNAGSL

SEQ ID NO: 182301 - protein, 14 aa, Mycobacterium tuberculosis
VGTLSGLGNAGSLA

SEQ ID NO: 182302 - protein, 14 aa, Mycobacterium tuberculosis
GTLSGLGNAGSLAS

SEQ ID NO: 182303 - protein, 14 aa, Mycobacterium tuberculosis
TLSGLGNAGSLASG

SEQ ID NO: 182304 - protein, 14 aa, Mycobacterium tuberculosis
LSGLGNAGSLASGV

SEQ ID NO: 182305 - protein, 14 aa, Mycobacterium tuberculosis
SGLGNAGSLASGVL

SEQ ID NO: 182306 - protein, 14 aa, Mycobacterium tuberculosis
GLGNAGSLASGVLN

SEQ ID NO: 182307 - protein, 14 aa, Mycobacterium tuberculosis
LGNAGSLASGVLNS

SEQ ID NO: 182308 - protein, 14 aa, Mycobacterium tuberculosis
GNAGSLASGVLNSG

SEQ ID NO: 182309 - protein, 14 aa, Mycobacterium tuberculosis
NAGSLASGVLNSGV

SEQ ID NO: 182310 - protein, 14 aa, Mycobacterium tuberculosis
AGSLASGVLNSGVD

SEQ ID NO: 182311 - protein, 14 aa, Mycobacterium tuberculosis
GSLASGVLNSGVDI

SEQ ID NO: 182312 - protein, 14 aa, Mycobacterium tuberculosis
SLASGVLNSGVDIS

SEQ ID NO: 182313 - protein, 14 aa, Mycobacterium tuberculosis
LASGVLNSGVDISG

SEQ ID NO: 182314 - protein, 14 aa, Mycobacterium tuberculosis
ASGVLNSGVDISGM

SEQ ID NO: 182315 - protein, 14 aa, Mycobacterium tuberculosis
SGVLNSGVDISGMF

SEQ ID NO: 182316 - protein, 14 aa, Mycobacterium tuberculosis
GVLNSGVDISGMFN

SEQ ID NO: 182317 - protein, 14 aa, Mycobacterium tuberculosis
VLNSGVDISGMFNV

SEQ ID NO: 182318 - protein, 14 aa, Mycobacterium tuberculosis
LNSGVDISGMFNVS

SEQ ID NO: 182319 - protein, 14 aa, Mycobacterium tuberculosis
NSGVDISGMFNVST

SEQ ID NO: 182320 - protein, 14 aa, Mycobacterium tuberculosis
SGVDISGMFNVSTL

SEQ ID NO: 182321 - protein, 14 aa, Mycobacterium tuberculosis
GVDISGMFNVSTLG

SEQ ID NO: 182322 - protein, 14 aa, Mycobacterium tuberculosis
VDISGMFNVSTLGS

SEQ ID NO: 182323 - protein, 14 aa, Mycobacterium tuberculosis
DISGMFNVSTLGSA

SEQ ID NO: 182324 - protein, 14 aa, Mycobacterium tuberculosis
ISGMFNVSTLGSAP

SEQ ID NO: 182325 - protein, 14 aa, Mycobacterium tuberculosis
SGMFNVSTLGSAPA

SEQ ID NO: 182326 - protein, 14 aa, Mycobacterium tuberculosis
GMFNVSTLGSAPAV

SEQ ID NO: 182327 - protein, 14 aa, Mycobacterium tuberculosis
MFNVSTLGSAPAVI

SEQ ID NO: 182328 - protein, 14 aa, Mycobacterium tuberculosis
FNVSTLGSAPAVIS

SEQ ID NO: 182329 - protein, 14 aa, Mycobacterium tuberculosis
NVSTLGSAPAVISG

SEQ ID NO: 182330 - protein, 14 aa, Mycobacterium tuberculosis
VSTLGSAPAVISGF

SEQ ID NO: 182331 - protein, 14 aa, Mycobacterium tuberculosis
STLGSAPAVISGFG

SEQ ID NO: 182332 - protein, 14 aa, Mycobacterium tuberculosis
TLGSAPAVISGFGN

SEQ ID NO: 182333 - protein, 14 aa, Mycobacterium tuberculosis
LGSAPAVISGFGNL

SEQ ID NO: 182334 - protein, 14 aa, Mycobacterium tuberculosis
GSAPAVISGFGNLG

SEQ ID NO: 182335 - protein, 14 aa, Mycobacterium tuberculosis
SAPAVISGFGNLGN

SEQ ID NO: 182336 - protein, 14 aa, Mycobacterium tuberculosis
APAVISGFGNLGNH

SEQ ID NO: 182337 - protein, 14 aa, Mycobacterium tuberculosis
PAVISGFGNLGNHV

SEQ ID NO: 182338 - protein, 14 aa, Mycobacterium tuberculosis
AVISGFGNLGNHVS

SEQ ID NO: 182339 - protein, 14 aa, Mycobacterium tuberculosis
VISGFGNLGNHVSG

SEQ ID NO: 182340 - protein, 14 aa, Mycobacterium tuberculosis
ISGFGNLGNHVSGV

SEQ ID NO: 182341 - protein, 14 aa, Mycobacterium tuberculosis
SGFGNLGNHVSGVS

SEQ ID NO: 182342 - protein, 14 aa, Mycobacterium tuberculosis
GFGNLGNHVSGVSI

SEQ ID NO: 182343 - protein, 14 aa, Mycobacterium tuberculosis
FGNLGNHVSGVSID

SEQ ID NO: 182344 - protein, 14 aa, Mycobacterium tuberculosis
GNLGNHVSGVSIDG

SEQ ID NO: 182345 - protein, 14 aa, Mycobacterium tuberculosis
NLGNHVSGVSIDGL

SEQ ID NO: 182346 - protein, 14 aa, Mycobacterium tuberculosis
LGNHVSGVSIDGLL

SEQ ID NO: 182347 - protein, 14 aa, Mycobacterium tuberculosis
GNHVSGVSIDGLLA

SEQ ID NO: 182348 - protein, 14 aa, Mycobacterium tuberculosis
NHVSGVSIDGLLAM

SEQ ID NO: 182349 - protein, 14 aa, Mycobacterium tuberculosis
HVSGVSIDGLLAML

SEQ ID NO: 182350 - protein, 14 aa, Mycobacterium tuberculosis
VSGVSIDGLLAMLT

SEQ ID NO: 182351 - protein, 14 aa, Mycobacterium tuberculosis
SGVSIDGLLAMLTS

SEQ ID NO: 182352 - protein, 14 aa, Mycobacterium tuberculosis
GVSIDGLLAMLTSG

SEQ ID NO: 182353 - protein, 14 aa, Mycobacterium tuberculosis
VSIDGLLAMLTSGG

SEQ ID NO: 182354 - protein, 14 aa, Mycobacterium tuberculosis
SIDGLLAMLTSGGS

SEQ ID NO: 182355 - protein, 14 aa, Mycobacterium tuberculosis
IDGLLAMLTSGGSG

SEQ ID NO: 182356 - protein, 14 aa, Mycobacterium tuberculosis
DGLLAMLTSGGSGG

SEQ ID NO: 182357 - protein, 14 aa, Mycobacterium tuberculosis
GLLAMLTSGGSGGS

SEQ ID NO: 182358 - protein, 14 aa, Mycobacterium tuberculosis
LLAMLTSGGSGGSG

SEQ ID NO: 182359 - protein, 14 aa, Mycobacterium tuberculosis
LAMLTSGGSGGSGQ

SEQ ID NO: 182360 - protein, 14 aa, Mycobacterium tuberculosis
AMLTSGGSGGSGQP

SEQ ID NO: 182361 - protein, 14 aa, Mycobacterium tuberculosis
MLTSGGSGGSGQPS

SEQ ID NO: 182362 - protein, 14 aa, Mycobacterium tuberculosis
LTSGGSGGSGQPSI

SEQ ID NO: 182363 - protein, 14 aa, Mycobacterium tuberculosis
TSGGSGGSGQPSII

SEQ ID NO: 182364 - protein, 14 aa, Mycobacterium tuberculosis
SGGSGGSGQPSIID

SEQ ID NO: 182365 - protein, 14 aa, Mycobacterium tuberculosis
GGSGGSGQPSIIDA

SEQ ID NO: 182366 - protein, 14 aa, Mycobacterium tuberculosis
GSGGSGQPSIIDAA

SEQ ID NO: 182367 - protein, 14 aa, Mycobacterium tuberculosis
SGGSGQPSIIDAAI

SEQ ID NO: 182368 - protein, 14 aa, Mycobacterium tuberculosis
GGSGQPSIIDAAIA

SEQ ID NO: 182369 - protein, 14 aa, Mycobacterium tuberculosis
GSGQPSIIDAAIAE

SEQ ID NO: 182370 - protein, 14 aa, Mycobacterium tuberculosis
SGQPSIIDAAIAEL

SEQ ID NO: 182371 - protein, 14 aa, Mycobacterium tuberculosis
GQPSIIDAAIAELR

SEQ ID NO: 182372 - protein, 14 aa, Mycobacterium tuberculosis
QPSIIDAAIAELRH

SEQ ID NO: 182373 - protein, 14 aa, Mycobacterium tuberculosis
PSIIDAAIAELRHL

SEQ ID NO: 182374 - protein, 14 aa, Mycobacterium tuberculosis
SIIDAAIAELRHLN

SEQ ID NO: 182375 - protein, 14 aa, Mycobacterium tuberculosis
IIDAAIAELRHLNP

SEQ ID NO: 182376 - protein, 14 aa, Mycobacterium tuberculosis
IDAAIAELRHLNPL

SEQ ID NO: 182377 - protein, 14 aa, Mycobacterium tuberculosis
DAAIAELRHLNPLN

SEQ ID NO: 182378 - protein, 14 aa, Mycobacterium tuberculosis
AAIAELRHLNPLNI

SEQ ID NO: 182379 - protein, 14 aa, Mycobacterium tuberculosis
AIAELRHLNPLNIV

SEQ ID NO: 182380 - protein, 14 aa, Mycobacterium tuberculosis
IAELRHLNPLNIVN

SEQ ID NO: 182381 - protein, 14 aa, Mycobacterium tuberculosis
AELRHLNPLNIVNL

SEQ ID NO: 182382 - protein, 14 aa, Mycobacterium tuberculosis
ELRHLNPLNIVNLG

SEQ ID NO: 182383 - protein, 14 aa, Mycobacterium tuberculosis
LRHLNPLNIVNLGN

SEQ ID NO: 182384 - protein, 14 aa, Mycobacterium tuberculosis
RHLNPLNIVNLGNV

SEQ ID NO: 182385 - protein, 14 aa, Mycobacterium tuberculosis
HLNPLNIVNLGNVG

SEQ ID NO: 182386 - protein, 14 aa, Mycobacterium tuberculosis
LNPLNIVNLGNVGS

SEQ ID NO: 182387 - protein, 14 aa, Mycobacterium tuberculosis
NPLNIVNLGNVGSY

SEQ ID NO: 182388 - protein, 14 aa, Mycobacterium tuberculosis
PLNIVNLGNVGSYN

SEQ ID NO: 182389 - protein, 14 aa, Mycobacterium tuberculosis
LNIVNLGNVGSYNL

SEQ ID NO: 182390 - protein, 14 aa, Mycobacterium tuberculosis
NIVNLGNVGSYNLG

SEQ ID NO: 182391 - protein, 14 aa, Mycobacterium tuberculosis
IVNLGNVGSYNLGF

SEQ ID NO: 182392 - protein, 14 aa, Mycobacterium tuberculosis
VNLGNVGSYNLGFA

SEQ ID NO: 182393 - protein, 14 aa, Mycobacterium tuberculosis
NLGNVGSYNLGFAN

SEQ ID NO: 182394 - protein, 14 aa, Mycobacterium tuberculosis
LGNVGSYNLGFANV

SEQ ID NO: 182395 - protein, 14 aa, Mycobacterium tuberculosis
GNVGSYNLGFANVG

SEQ ID NO: 182396 - protein, 14 aa, Mycobacterium tuberculosis
NVGSYNLGFANVGD

SEQ ID NO: 182397 - protein, 14 aa, Mycobacterium tuberculosis
VGSYNLGFANVGDV

SEQ ID NO: 182398 - protein, 14 aa, Mycobacterium tuberculosis
GSYNLGFANVGDVN

SEQ ID NO: 182399 - protein, 14 aa, Mycobacterium tuberculosis
SYNLGFANVGDVNL

SEQ ID NO: 182400 - protein, 14 aa, Mycobacterium tuberculosis
YNLGFANVGDVNLG

SEQ ID NO: 182401 - protein, 14 aa, Mycobacterium tuberculosis
NLGFANVGDVNLGA

SEQ ID NO: 182402 - protein, 14 aa, Mycobacterium tuberculosis
LGFANVGDVNLGAG

SEQ ID NO: 182403 - protein, 14 aa, Mycobacterium tuberculosis
GFANVGDVNLGAGN

SEQ ID NO: 182404 - protein, 14 aa, Mycobacterium tuberculosis
FANVGDVNLGAGNL

SEQ ID NO: 182405 - protein, 14 aa, Mycobacterium tuberculosis
ANVGDVNLGAGNLG

SEQ ID NO: 182406 - protein, 14 aa, Mycobacterium tuberculosis
NVGDVNLGAGNLGN

SEQ ID NO: 182407 - protein, 14 aa, Mycobacterium tuberculosis
VGDVNLGAGNLGNL

SEQ ID NO: 182408 - protein, 14 aa, Mycobacterium tuberculosis
GDVNLGAGNLGNLN

SEQ ID NO: 182409 - protein, 14 aa, Mycobacterium tuberculosis
DVNLGAGNLGNLNL

SEQ ID NO: 182410 - protein, 14 aa, Mycobacterium tuberculosis
VNLGAGNLGNLNLG

SEQ ID NO: 182411 - protein, 14 aa, Mycobacterium tuberculosis
NLGAGNLGNLNLGG

SEQ ID NO: 182412 - protein, 14 aa, Mycobacterium tuberculosis
LGAGNLGNLNLGGG

SEQ ID NO: 182413 - protein, 14 aa, Mycobacterium tuberculosis
GAGNLGNLNLGGGN

SEQ ID NO: 182414 - protein, 14 aa, Mycobacterium tuberculosis
AGNLGNLNLGGGNL

SEQ ID NO: 182415 - protein, 14 aa, Mycobacterium tuberculosis
GNLGNLNLGGGNLG

SEQ ID NO: 182416 - protein, 14 aa, Mycobacterium tuberculosis
NLGNLNLGGGNLGG

SEQ ID NO: 182417 - protein, 14 aa, Mycobacterium tuberculosis
LGNLNLGGGNLGGQ

SEQ ID NO: 182418 - protein, 14 aa, Mycobacterium tuberculosis
GNLNLGGGNLGGQN

SEQ ID NO: 182419 - protein, 14 aa, Mycobacterium tuberculosis
NLNLGGGNLGGQNL

SEQ ID NO: 182420 - protein, 14 aa, Mycobacterium tuberculosis
LNLGGGNLGGQNLG

SEQ ID NO: 182421 - protein, 14 aa, Mycobacterium tuberculosis
NLGGGNLGGQNLGL

SEQ ID NO: 182422 - protein, 14 aa, Mycobacterium tuberculosis
LGGGNLGGQNLGLG

SEQ ID NO: 182423 - protein, 14 aa, Mycobacterium tuberculosis
GGGNLGGQNLGLGN

SEQ ID NO: 182424 - protein, 14 aa, Mycobacterium tuberculosis
GGNLGGQNLGLGNL

SEQ ID NO: 182425 - protein, 14 aa, Mycobacterium tuberculosis
GNLGGQNLGLGNLG

SEQ ID NO: 182426 - protein, 14 aa, Mycobacterium tuberculosis
NLGGQNLGLGNLGD

SEQ ID NO: 182427 - protein, 14 aa, Mycobacterium tuberculosis
LGGQNLGLGNLGDG

SEQ ID NO: 182428 - protein, 14 aa, Mycobacterium tuberculosis
GGQNLGLGNLGDGN

SEQ ID NO: 182429 - protein, 14 aa, Mycobacterium tuberculosis
GQNLGLGNLGDGNV

SEQ ID NO: 182430 - protein, 14 aa, Mycobacterium tuberculosis
QNLGLGNLGDGNVG

SEQ ID NO: 182431 - protein, 14 aa, Mycobacterium tuberculosis
NLGLGNLGDGNVGF

SEQ ID NO: 182432 - protein, 14 aa, Mycobacterium tuberculosis
LGLGNLGDGNVGFG

SEQ ID NO: 182433 - protein, 14 aa, Mycobacterium tuberculosis
GLGNLGDGNVGFGN

SEQ ID NO: 182434 - protein, 14 aa, Mycobacterium tuberculosis
LGNLGDGNVGFGNL

SEQ ID NO: 182435 - protein, 14 aa, Mycobacterium tuberculosis
GNLGDGNVGFGNLG

SEQ ID NO: 182436 - protein, 14 aa, Mycobacterium tuberculosis
NLGDGNVGFGNLGH

SEQ ID NO: 182437 - protein, 14 aa, Mycobacterium tuberculosis
LGDGNVGFGNLGHG

SEQ ID NO: 182438 - protein, 14 aa, Mycobacterium tuberculosis
GDGNVGFGNLGHGN

SEQ ID NO: 182439 - protein, 14 aa, Mycobacterium tuberculosis
DGNVGFGNLGHGNV

SEQ ID NO: 182440 - protein, 14 aa, Mycobacterium tuberculosis
GNVGFGNLGHGNVG

SEQ ID NO: 182441 - protein, 14 aa, Mycobacterium tuberculosis
NVGFGNLGHGNVGF

SEQ ID NO: 182442 - protein, 14 aa, Mycobacterium tuberculosis
VGFGNLGHGNVGFG

SEQ ID NO: 182443 - protein, 14 aa, Mycobacterium tuberculosis
GFGNLGHGNVGFGN

SEQ ID NO: 182444 - protein, 14 aa, Mycobacterium tuberculosis
FGNLGHGNVGFGNS

SEQ ID NO: 182445 - protein, 14 aa, Mycobacterium tuberculosis
GNLGHGNVGFGNSG

SEQ ID NO: 182446 - protein, 14 aa, Mycobacterium tuberculosis
NLGHGNVGFGNSGL

SEQ ID NO: 182447 - protein, 14 aa, Mycobacterium tuberculosis
LGHGNVGFGNSGLG

SEQ ID NO: 182448 - protein, 14 aa, Mycobacterium tuberculosis
GHGNVGFGNSGLGA

SEQ ID NO: 182449 - protein, 14 aa, Mycobacterium tuberculosis
HGNVGFGNSGLGAL

SEQ ID NO: 182450 - protein, 14 aa, Mycobacterium tuberculosis
GNVGFGNSGLGALP

SEQ ID NO: 182451 - protein, 14 aa, Mycobacterium tuberculosis
NVGFGNSGLGALPG

SEQ ID NO: 182452 - protein, 14 aa, Mycobacterium tuberculosis
VGFGNSGLGALPGI

SEQ ID NO: 182453 - protein, 14 aa, Mycobacterium tuberculosis
GFGNSGLGALPGIG

SEQ ID NO: 182454 - protein, 14 aa, Mycobacterium tuberculosis
FGNSGLGALPGIGN

SEQ ID NO: 182455 - protein, 14 aa, Mycobacterium tuberculosis
GNSGLGALPGIGNI

SEQ ID NO: 182456 - protein, 14 aa, Mycobacterium tuberculosis
NSGLGALPGIGNIG

SEQ ID NO: 182457 - protein, 14 aa, Mycobacterium tuberculosis
SGLGALPGIGNIGL

SEQ ID NO: 182458 - protein, 14 aa, Mycobacterium tuberculosis
GLGALPGIGNIGLG

SEQ ID NO: 182459 - protein, 14 aa, Mycobacterium tuberculosis
LGALPGIGNIGLGN

SEQ ID NO: 182460 - protein, 14 aa, Mycobacterium tuberculosis
GALPGIGNIGLGNA

SEQ ID NO: 182461 - protein, 14 aa, Mycobacterium tuberculosis
ALPGIGNIGLGNAG

SEQ ID NO: 182462 - protein, 14 aa, Mycobacterium tuberculosis
LPGIGNIGLGNAGS

SEQ ID NO: 182463 - protein, 14 aa, Mycobacterium tuberculosis
PGIGNIGLGNAGSN

SEQ ID NO: 182464 - protein, 14 aa, Mycobacterium tuberculosis
GIGNIGLGNAGSNN

SEQ ID NO: 182465 - protein, 14 aa, Mycobacterium tuberculosis
IGNIGLGNAGSNNV

SEQ ID NO: 182466 - protein, 14 aa, Mycobacterium tuberculosis
GNIGLGNAGSNNVG

SEQ ID NO: 182467 - protein, 14 aa, Mycobacterium tuberculosis
NIGLGNAGSNNVGF

SEQ ID NO: 182468 - protein, 14 aa, Mycobacterium tuberculosis
IGLGNAGSNNVGFG

SEQ ID NO: 182469 - protein, 14 aa, Mycobacterium tuberculosis
GLGNAGSNNVGFGN

SEQ ID NO: 182470 - protein, 14 aa, Mycobacterium tuberculosis
LGNAGSNNVGFGNM

SEQ ID NO: 182471 - protein, 14 aa, Mycobacterium tuberculosis
GNAGSNNVGFGNMG

SEQ ID NO: 182472 - protein, 14 aa, Mycobacterium tuberculosis
NAGSNNVGFGNMGL

SEQ ID NO: 182473 - protein, 14 aa, Mycobacterium tuberculosis
AGSNNVGFGNMGLG

SEQ ID NO: 182474 - protein, 14 aa, Mycobacterium tuberculosis
GSNNVGFGNMGLGN

SEQ ID NO: 182475 - protein, 14 aa, Mycobacterium tuberculosis
SNNVGFGNMGLGNI

SEQ ID NO: 182476 - protein, 14 aa, Mycobacterium tuberculosis
NNVGFGNMGLGNIG

SEQ ID NO: 182477 - protein, 14 aa, Mycobacterium tuberculosis
NVGFGNMGLGNIGF

SEQ ID NO: 182478 - protein, 14 aa, Mycobacterium tuberculosis
VGFGNMGLGNIGFG

SEQ ID NO: 182479 - protein, 14 aa, Mycobacterium tuberculosis
GFGNMGLGNIGFGN

SEQ ID NO: 182480 - protein, 14 aa, Mycobacterium tuberculosis
FGNMGLGNIGFGNT

SEQ ID NO: 182481 - protein, 14 aa, Mycobacterium tuberculosis
GNMGLGNIGFGNTG

SEQ ID NO: 182482 - protein, 14 aa, Mycobacterium tuberculosis
NMGLGNIGFGNTGT

SEQ ID NO: 182483 - protein, 14 aa, Mycobacterium tuberculosis
MGLGNIGFGNTGTN

SEQ ID NO: 182484 - protein, 14 aa, Mycobacterium tuberculosis
GLGNIGFGNTGTNN

SEQ ID NO: 182485 - protein, 14 aa, Mycobacterium tuberculosis
LGNIGFGNTGTNNL

SEQ ID NO: 182486 - protein, 14 aa, Mycobacterium tuberculosis
GNIGFGNTGTNNLG

SEQ ID NO: 182487 - protein, 14 aa, Mycobacterium tuberculosis
NIGFGNTGTNNLGI

SEQ ID NO: 182488 - protein, 14 aa, Mycobacterium tuberculosis
IGFGNTGTNNLGIG

SEQ ID NO: 182489 - protein, 14 aa, Mycobacterium tuberculosis
GFGNTGTNNLGIGL

SEQ ID NO: 182490 - protein, 14 aa, Mycobacterium tuberculosis
FGNTGTNNLGIGLT

SEQ ID NO: 182491 - protein, 14 aa, Mycobacterium tuberculosis
GNTGTNNLGIGLTG

SEQ ID NO: 182492 - protein, 14 aa, Mycobacterium tuberculosis
NTGTNNLGIGLTGD

SEQ ID NO: 182493 - protein, 14 aa, Mycobacterium tuberculosis
TGTNNLGIGLTGDN

SEQ ID NO: 182494 - protein, 14 aa, Mycobacterium tuberculosis
GTNNLGIGLTGDNQ

SEQ ID NO: 182495 - protein, 14 aa, Mycobacterium tuberculosis
TNNLGIGLTGDNQT

SEQ ID NO: 182496 - protein, 14 aa, Mycobacterium tuberculosis
NNLGIGLTGDNQTG

SEQ ID NO: 182497 - protein, 14 aa, Mycobacterium tuberculosis
NLGIGLTGDNQTGF

SEQ ID NO: 182498 - protein, 14 aa, Mycobacterium tuberculosis
LGIGLTGDNQTGFG

SEQ ID NO: 182499 - protein, 14 aa, Mycobacterium tuberculosis
GIGLTGDNQTGFGG

SEQ ID NO: 182500 - protein, 14 aa, Mycobacterium tuberculosis
IGLTGDNQTGFGGL

SEQ ID NO: 182501 - protein, 14 aa, Mycobacterium tuberculosis
GLTGDNQTGFGGLN

SEQ ID NO: 182502 - protein, 14 aa, Mycobacterium tuberculosis
LTGDNQTGFGGLNS

SEQ ID NO: 182503 - protein, 14 aa, Mycobacterium tuberculosis
TGDNQTGFGGLNSG

SEQ ID NO: 182504 - protein, 14 aa, Mycobacterium tuberculosis
GDNQTGFGGLNSGA

SEQ ID NO: 182505 - protein, 14 aa, Mycobacterium tuberculosis
DNQTGFGGLNSGAG

SEQ ID NO: 182506 - protein, 14 aa, Mycobacterium tuberculosis
NQTGFGGLNSGAGN

SEQ ID NO: 182507 - protein, 14 aa, Mycobacterium tuberculosis
QTGFGGLNSGAGNL

SEQ ID NO: 182508 - protein, 14 aa, Mycobacterium tuberculosis
TGFGGLNSGAGNLG

SEQ ID NO: 182509 - protein, 14 aa, Mycobacterium tuberculosis
GFGGLNSGAGNLGL

SEQ ID NO: 182510 - protein, 14 aa, Mycobacterium tuberculosis
FGGLNSGAGNLGLF

SEQ ID NO: 182511 - protein, 14 aa, Mycobacterium tuberculosis
GGLNSGAGNLGLFN

SEQ ID NO: 182512 - protein, 14 aa, Mycobacterium tuberculosis
GLNSGAGNLGLFNS

SEQ ID NO: 182513 - protein, 14 aa, Mycobacterium tuberculosis
LNSGAGNLGLFNSG

SEQ ID NO: 182514 - protein, 14 aa, Mycobacterium tuberculosis
NSGAGNLGLFNSGT

SEQ ID NO: 182515 - protein, 14 aa, Mycobacterium tuberculosis
SGAGNLGLFNSGTG

SEQ ID NO: 182516 - protein, 14 aa, Mycobacterium tuberculosis
GAGNLGLFNSGTGN

SEQ ID NO: 182517 - protein, 14 aa, Mycobacterium tuberculosis
AGNLGLFNSGTGNI

SEQ ID NO: 182518 - protein, 14 aa, Mycobacterium tuberculosis
GNLGLFNSGTGNIG

SEQ ID NO: 182519 - protein, 14 aa, Mycobacterium tuberculosis
NLGLFNSGTGNIGF

SEQ ID NO: 182520 - protein, 14 aa, Mycobacterium tuberculosis
LGLFNSGTGNIGFF

SEQ ID NO: 182521 - protein, 14 aa, Mycobacterium tuberculosis
GLFNSGTGNIGFFN

SEQ ID NO: 182522 - protein, 14 aa, Mycobacterium tuberculosis
LFNSGTGNIGFFNT

SEQ ID NO: 182523 - protein, 14 aa, Mycobacterium tuberculosis
FNSGTGNIGFFNTG

SEQ ID NO: 182524 - protein, 14 aa, Mycobacterium tuberculosis
NSGTGNIGFFNTGT

SEQ ID NO: 182525 - protein, 14 aa, Mycobacterium tuberculosis
SGTGNIGFFNTGTG

SEQ ID NO: 182526 - protein, 14 aa, Mycobacterium tuberculosis
GTGNIGFFNTGTGN

SEQ ID NO: 182527 - protein, 14 aa, Mycobacterium tuberculosis
TGNIGFFNTGTGNW

SEQ ID NO: 182528 - protein, 14 aa, Mycobacterium tuberculosis
GNIGFFNTGTGNWG

SEQ ID NO: 182529 - protein, 14 aa, Mycobacterium tuberculosis
NIGFFNTGTGNWGL

SEQ ID NO: 182530 - protein, 14 aa, Mycobacterium tuberculosis
IGFFNTGTGNWGLF

SEQ ID NO: 182531 - protein, 14 aa, Mycobacterium tuberculosis
GFFNTGTGNWGLFN

SEQ ID NO: 182532 - protein, 14 aa, Mycobacterium tuberculosis
FFNTGTGNWGLFNS

SEQ ID NO: 182533 - protein, 14 aa, Mycobacterium tuberculosis
FNTGTGNWGLFNSG

SEQ ID NO: 182534 - protein, 14 aa, Mycobacterium tuberculosis
NTGTGNWGLFNSGS

SEQ ID NO: 182535 - protein, 14 aa, Mycobacterium tuberculosis
TGTGNWGLFNSGSY

SEQ ID NO: 182536 - protein, 14 aa, Mycobacterium tuberculosis
GTGNWGLFNSGSYN

SEQ ID NO: 182537 - protein, 14 aa, Mycobacterium tuberculosis
TGNWGLFNSGSYNT

SEQ ID NO: 182538 - protein, 14 aa, Mycobacterium tuberculosis
GNWGLFNSGSYNTG

SEQ ID NO: 182539 - protein, 14 aa, Mycobacterium tuberculosis
NWGLFNSGSYNTGI

SEQ ID NO: 182540 - protein, 14 aa, Mycobacterium tuberculosis
WGLFNSGSYNTGIG

SEQ ID NO: 182541 - protein, 14 aa, Mycobacterium tuberculosis
GLFNSGSYNTGIGN

SEQ ID NO: 182542 - protein, 14 aa, Mycobacterium tuberculosis
LFNSGSYNTGIGNS

SEQ ID NO: 182543 - protein, 14 aa, Mycobacterium tuberculosis
FNSGSYNTGIGNSG

SEQ ID NO: 182544 - protein, 14 aa, Mycobacterium tuberculosis
NSGSYNTGIGNSGT

SEQ ID NO: 182545 - protein, 14 aa, Mycobacterium tuberculosis
SGSYNTGIGNSGTG

SEQ ID NO: 182546 - protein, 14 aa, Mycobacterium tuberculosis
GSYNTGIGNSGTGS

SEQ ID NO: 182547 - protein, 14 aa, Mycobacterium tuberculosis
SYNTGIGNSGTGST

SEQ ID NO: 182548 - protein, 14 aa, Mycobacterium tuberculosis
YNTGIGNSGTGSTG

SEQ ID NO: 182549 - protein, 14 aa, Mycobacterium tuberculosis
NTGIGNSGTGSTGL

SEQ ID NO: 182550 - protein, 14 aa, Mycobacterium tuberculosis
TGIGNSGTGSTGLF

SEQ ID NO: 182551 - protein, 14 aa, Mycobacterium tuberculosis
GIGNSGTGSTGLFN

SEQ ID NO: 182552 - protein, 14 aa, Mycobacterium tuberculosis
IGNSGTGSTGLFNA

SEQ ID NO: 182553 - protein, 14 aa, Mycobacterium tuberculosis
GNSGTGSTGLFNAG

SEQ ID NO: 182554 - protein, 14 aa, Mycobacterium tuberculosis
NSGTGSTGLFNAGS

SEQ ID NO: 182555 - protein, 14 aa, Mycobacterium tuberculosis
SGTGSTGLFNAGSF

SEQ ID NO: 182556 - protein, 14 aa, Mycobacterium tuberculosis
GTGSTGLFNAGSFN

SEQ ID NO: 182557 - protein, 14 aa, Mycobacterium tuberculosis
TGSTGLFNAGSFNT

SEQ ID NO: 182558 - protein, 14 aa, Mycobacterium tuberculosis
GSTGLFNAGSFNTG

SEQ ID NO: 182559 - protein, 14 aa, Mycobacterium tuberculosis
STGLFNAGSFNTGL

SEQ ID NO: 182560 - protein, 14 aa, Mycobacterium tuberculosis
TGLFNAGSFNTGLA

SEQ ID NO: 182561 - protein, 14 aa, Mycobacterium tuberculosis
GLFNAGSFNTGLAN

SEQ ID NO: 182562 - protein, 14 aa, Mycobacterium tuberculosis
LFNAGSFNTGLANA

SEQ ID NO: 182563 - protein, 14 aa, Mycobacterium tuberculosis
FNAGSFNTGLANAG

SEQ ID NO: 182564 - protein, 14 aa, Mycobacterium tuberculosis
NAGSFNTGLANAGS

SEQ ID NO: 182565 - protein, 14 aa, Mycobacterium tuberculosis
AGSFNTGLANAGSY

SEQ ID NO: 182566 - protein, 14 aa, Mycobacterium tuberculosis
GSFNTGLANAGSYN

SEQ ID NO: 182567 - protein, 14 aa, Mycobacterium tuberculosis
SFNTGLANAGSYNT

SEQ ID NO: 182568 - protein, 14 aa, Mycobacterium tuberculosis
FNTGLANAGSYNTG

SEQ ID NO: 182569 - protein, 14 aa, Mycobacterium tuberculosis
NTGLANAGSYNTGS

SEQ ID NO: 182570 - protein, 14 aa, Mycobacterium tuberculosis
TGLANAGSYNTGSL

SEQ ID NO: 182571 - protein, 14 aa, Mycobacterium tuberculosis
GLANAGSYNTGSLN

SEQ ID NO: 182572 - protein, 14 aa, Mycobacterium tuberculosis
LANAGSYNTGSLNA

SEQ ID NO: 182573 - protein, 14 aa, Mycobacterium tuberculosis
ANAGSYNTGSLNAG

SEQ ID NO: 182574 - protein, 14 aa, Mycobacterium tuberculosis
NAGSYNTGSLNAGN

SEQ ID NO: 182575 - protein, 14 aa, Mycobacterium tuberculosis
AGSYNTGSLNAGNT

SEQ ID NO: 182576 - protein, 14 aa, Mycobacterium tuberculosis
GSYNTGSLNAGNTN

SEQ ID NO: 182577 - protein, 14 aa, Mycobacterium tuberculosis
SYNTGSLNAGNTNT

SEQ ID NO: 182578 - protein, 14 aa, Mycobacterium tuberculosis
YNTGSLNAGNTNTG

SEQ ID NO: 182579 - protein, 14 aa, Mycobacterium tuberculosis
NTGSLNAGNTNTGG

SEQ ID NO: 182580 - protein, 14 aa, Mycobacterium tuberculosis
TGSLNAGNTNTGGF

SEQ ID NO: 182581 - protein, 14 aa, Mycobacterium tuberculosis
GSLNAGNTNTGGFN

SEQ ID NO: 182582 - protein, 14 aa, Mycobacterium tuberculosis
SLNAGNTNTGGFNP

SEQ ID NO: 182583 - protein, 14 aa, Mycobacterium tuberculosis
LNAGNTNTGGFNPG

SEQ ID NO: 182584 - protein, 14 aa, Mycobacterium tuberculosis
NAGNTNTGGFNPGN

SEQ ID NO: 182585 - protein, 14 aa, Mycobacterium tuberculosis
AGNTNTGGFNPGNV

SEQ ID NO: 182586 - protein, 14 aa, Mycobacterium tuberculosis
GNTNTGGFNPGNVN

SEQ ID NO: 182587 - protein, 14 aa, Mycobacterium tuberculosis
NTNTGGFNPGNVNT

SEQ ID NO: 182588 - protein, 14 aa, Mycobacterium tuberculosis
TNTGGFNPGNVNTG

SEQ ID NO: 182589 - protein, 14 aa, Mycobacterium tuberculosis
NTGGFNPGNVNTGW

SEQ ID NO: 182590 - protein, 14 aa, Mycobacterium tuberculosis
TGGFNPGNVNTGWF

SEQ ID NO: 182591 - protein, 14 aa, Mycobacterium tuberculosis
GGFNPGNVNTGWFN

SEQ ID NO: 182592 - protein, 14 aa, Mycobacterium tuberculosis
GFNPGNVNTGWFNA

SEQ ID NO: 182593 - protein, 14 aa, Mycobacterium tuberculosis
FNPGNVNTGWFNAG

SEQ ID NO: 182594 - protein, 14 aa, Mycobacterium tuberculosis
NPGNVNTGWFNAGH

SEQ ID NO: 182595 - protein, 14 aa, Mycobacterium tuberculosis
PGNVNTGWFNAGHT

SEQ ID NO: 182596 - protein, 14 aa, Mycobacterium tuberculosis
GNVNTGWFNAGHTN

SEQ ID NO: 182597 - protein, 14 aa, Mycobacterium tuberculosis
NVNTGWFNAGHTNT

SEQ ID NO: 182598 - protein, 14 aa, Mycobacterium tuberculosis
VNTGWFNAGHTNTG

SEQ ID NO: 182599 - protein, 14 aa, Mycobacterium tuberculosis
NTGWFNAGHTNTGG

SEQ ID NO: 182600 - protein, 14 aa, Mycobacterium tuberculosis
TGWFNAGHTNTGGF

SEQ ID NO: 182601 - protein, 14 aa, Mycobacterium tuberculosis
GWFNAGHTNTGGFN

SEQ ID NO: 182602 - protein, 14 aa, Mycobacterium tuberculosis
WFNAGHTNTGGFNT

SEQ ID NO: 182603 - protein, 14 aa, Mycobacterium tuberculosis
FNAGHTNTGGFNTG

SEQ ID NO: 182604 - protein, 14 aa, Mycobacterium tuberculosis
NAGHTNTGGFNTGN

SEQ ID NO: 182605 - protein, 14 aa, Mycobacterium tuberculosis
AGHTNTGGFNTGNV

SEQ ID NO: 182606 - protein, 14 aa, Mycobacterium tuberculosis
GHTNTGGFNTGNVN

SEQ ID NO: 182607 - protein, 14 aa, Mycobacterium tuberculosis
HTNTGGFNTGNVNT

SEQ ID NO: 182608 - protein, 14 aa, Mycobacterium tuberculosis
TNTGGFNTGNVNTG

SEQ ID NO: 182609 - protein, 14 aa, Mycobacterium tuberculosis
NTGGFNTGNVNTGA

SEQ ID NO: 182610 - protein, 14 aa, Mycobacterium tuberculosis
TGGFNTGNVNTGAF

SEQ ID NO: 182611 - protein, 14 aa, Mycobacterium tuberculosis
GGFNTGNVNTGAFN

SEQ ID NO: 182612 - protein, 14 aa, Mycobacterium tuberculosis
GFNTGNVNTGAFNS

SEQ ID NO: 182613 - protein, 14 aa, Mycobacterium tuberculosis
FNTGNVNTGAFNSG

SEQ ID NO: 182614 - protein, 14 aa, Mycobacterium tuberculosis
NTGNVNTGAFNSGS

SEQ ID NO: 182615 - protein, 14 aa, Mycobacterium tuberculosis
TGNVNTGAFNSGSF

SEQ ID NO: 182616 - protein, 14 aa, Mycobacterium tuberculosis
GNVNTGAFNSGSFN

SEQ ID NO: 182617 - protein, 14 aa, Mycobacterium tuberculosis
NVNTGAFNSGSFNN

SEQ ID NO: 182618 - protein, 14 aa, Mycobacterium tuberculosis
VNTGAFNSGSFNNG

SEQ ID NO: 182619 - protein, 14 aa, Mycobacterium tuberculosis
NTGAFNSGSFNNGA

SEQ ID NO: 182620 - protein, 14 aa, Mycobacterium tuberculosis
TGAFNSGSFNNGAL

SEQ ID NO: 182621 - protein, 14 aa, Mycobacterium tuberculosis
GAFNSGSFNNGALW

SEQ ID NO: 182622 - protein, 14 aa, Mycobacterium tuberculosis
AFNSGSFNNGALWT

SEQ ID NO: 182623 - protein, 14 aa, Mycobacterium tuberculosis
FNSGSFNNGALWTG

SEQ ID NO: 182624 - protein, 14 aa, Mycobacterium tuberculosis
NSGSFNNGALWTGD

SEQ ID NO: 182625 - protein, 14 aa, Mycobacterium tuberculosis
SGSFNNGALWTGDH

SEQ ID NO: 182626 - protein, 14 aa, Mycobacterium tuberculosis
GSFNNGALWTGDHH

SEQ ID NO: 182627 - protein, 14 aa, Mycobacterium tuberculosis
SFNNGALWTGDHHG

SEQ ID NO: 182628 - protein, 14 aa, Mycobacterium tuberculosis
FNNGALWTGDHHGL

SEQ ID NO: 182629 - protein, 14 aa, Mycobacterium tuberculosis
NNGALWTGDHHGLV

SEQ ID NO: 182630 - protein, 14 aa, Mycobacterium tuberculosis
NGALWTGDHHGLVG

SEQ ID NO: 182631 - protein, 14 aa, Mycobacterium tuberculosis
GALWTGDHHGLVGF

SEQ ID NO: 182632 - protein, 14 aa, Mycobacterium tuberculosis
ALWTGDHHGLVGFS

SEQ ID NO: 182633 - protein, 14 aa, Mycobacterium tuberculosis
LWTGDHHGLVGFSY

SEQ ID NO: 182634 - protein, 14 aa, Mycobacterium tuberculosis
WTGDHHGLVGFSYS

SEQ ID NO: 182635 - protein, 14 aa, Mycobacterium tuberculosis
TGDHHGLVGFSYSI

SEQ ID NO: 182636 - protein, 14 aa, Mycobacterium tuberculosis
GDHHGLVGFSYSIE

SEQ ID NO: 182637 - protein, 14 aa, Mycobacterium tuberculosis
DHHGLVGFSYSIEI

SEQ ID NO: 182638 - protein, 14 aa, Mycobacterium tuberculosis
HHGLVGFSYSIEIT

SEQ ID NO: 182639 - protein, 14 aa, Mycobacterium tuberculosis
HGLVGFSYSIEITG

SEQ ID NO: 182640 - protein, 14 aa, Mycobacterium tuberculosis
GLVGFSYSIEITGS

SEQ ID NO: 182641 - protein, 14 aa, Mycobacterium tuberculosis
LVGFSYSIEITGST

SEQ ID NO: 182642 - protein, 14 aa, Mycobacterium tuberculosis
VGFSYSIEITGSTL

SEQ ID NO: 182643 - protein, 14 aa, Mycobacterium tuberculosis
GFSYSIEITGSTLV

SEQ ID NO: 182644 - protein, 14 aa, Mycobacterium tuberculosis
FSYSIEITGSTLVD

SEQ ID NO: 182645 - protein, 14 aa, Mycobacterium tuberculosis
SYSIEITGSTLVDI

SEQ ID NO: 182646 - protein, 14 aa, Mycobacterium tuberculosis
YSIEITGSTLVDIN

SEQ ID NO: 182647 - protein, 14 aa, Mycobacterium tuberculosis
SIEITGSTLVDINE

SEQ ID NO: 182648 - protein, 14 aa, Mycobacterium tuberculosis
IEITGSTLVDINET

SEQ ID NO: 182649 - protein, 14 aa, Mycobacterium tuberculosis
EITGSTLVDINETL

SEQ ID NO: 182650 - protein, 14 aa, Mycobacterium tuberculosis
ITGSTLVDINETLN

SEQ ID NO: 182651 - protein, 14 aa, Mycobacterium tuberculosis
TGSTLVDINETLNL

SEQ ID NO: 182652 - protein, 14 aa, Mycobacterium tuberculosis
GSTLVDINETLNLG

SEQ ID NO: 182653 - protein, 14 aa, Mycobacterium tuberculosis
STLVDINETLNLGP

SEQ ID NO: 182654 - protein, 14 aa, Mycobacterium tuberculosis
TLVDINETLNLGPV

SEQ ID NO: 182655 - protein, 14 aa, Mycobacterium tuberculosis
LVDINETLNLGPVH

SEQ ID NO: 182656 - protein, 14 aa, Mycobacterium tuberculosis
VDINETLNLGPVHI

SEQ ID NO: 182657 - protein, 14 aa, Mycobacterium tuberculosis
DINETLNLGPVHID

SEQ ID NO: 182658 - protein, 14 aa, Mycobacterium tuberculosis
INETLNLGPVHIDQ

SEQ ID NO: 182659 - protein, 14 aa, Mycobacterium tuberculosis
NETLNLGPVHIDQI

SEQ ID NO: 182660 - protein, 14 aa, Mycobacterium tuberculosis
ETLNLGPVHIDQID

SEQ ID NO: 182661 - protein, 14 aa, Mycobacterium tuberculosis
TLNLGPVHIDQIDI

SEQ ID NO: 182662 - protein, 14 aa, Mycobacterium tuberculosis
LNLGPVHIDQIDIP

SEQ ID NO: 182663 - protein, 14 aa, Mycobacterium tuberculosis
NLGPVHIDQIDIPG

SEQ ID NO: 182664 - protein, 14 aa, Mycobacterium tuberculosis
LGPVHIDQIDIPGM

SEQ ID NO: 182665 - protein, 14 aa, Mycobacterium tuberculosis
GPVHIDQIDIPGMS

SEQ ID NO: 182666 - protein, 14 aa, Mycobacterium tuberculosis
PVHIDQIDIPGMSL

SEQ ID NO: 182667 - protein, 14 aa, Mycobacterium tuberculosis
VHIDQIDIPGMSLF

SEQ ID NO: 182668 - protein, 14 aa, Mycobacterium tuberculosis
HIDQIDIPGMSLFD

SEQ ID NO: 182669 - protein, 14 aa, Mycobacterium tuberculosis
IDQIDIPGMSLFDI

SEQ ID NO: 182670 - protein, 14 aa, Mycobacterium tuberculosis
DQIDIPGMSLFDIH

SEQ ID NO: 182671 - protein, 14 aa, Mycobacterium tuberculosis
QIDIPGMSLFDIHE

SEQ ID NO: 182672 - protein, 14 aa, Mycobacterium tuberculosis
IDIPGMSLFDIHEL

SEQ ID NO: 182673 - protein, 14 aa, Mycobacterium tuberculosis
DIPGMSLFDIHELV

SEQ ID NO: 182674 - protein, 14 aa, Mycobacterium tuberculosis
IPGMSLFDIHELVN

SEQ ID NO: 182675 - protein, 14 aa, Mycobacterium tuberculosis
PGMSLFDIHELVNI

SEQ ID NO: 182676 - protein, 14 aa, Mycobacterium tuberculosis
GMSLFDIHELVNIG

SEQ ID NO: 182677 - protein, 14 aa, Mycobacterium tuberculosis
MSLFDIHELVNIGP

SEQ ID NO: 182678 - protein, 14 aa, Mycobacterium tuberculosis
SLFDIHELVNIGPF

SEQ ID NO: 182679 - protein, 14 aa, Mycobacterium tuberculosis
LFDIHELVNIGPFR

SEQ ID NO: 182680 - protein, 14 aa, Mycobacterium tuberculosis
FDIHELVNIGPFRI

SEQ ID NO: 182681 - protein, 14 aa, Mycobacterium tuberculosis
DIHELVNIGPFRIE

SEQ ID NO: 182682 - protein, 14 aa, Mycobacterium tuberculosis
IHELVNIGPFRIEP

SEQ ID NO: 182683 - protein, 14 aa, Mycobacterium tuberculosis
HELVNIGPFRIEPI

SEQ ID NO: 182684 - protein, 14 aa, Mycobacterium tuberculosis
ELVNIGPFRIEPID

SEQ ID NO: 182685 - protein, 14 aa, Mycobacterium tuberculosis
LVNIGPFRIEPIDV

SEQ ID NO: 182686 - protein, 14 aa, Mycobacterium tuberculosis
VNIGPFRIEPIDVP

SEQ ID NO: 182687 - protein, 14 aa, Mycobacterium tuberculosis
NIGPFRIEPIDVPA

SEQ ID NO: 182688 - protein, 14 aa, Mycobacterium tuberculosis
IGPFRIEPIDVPAV

SEQ ID NO: 182689 - protein, 14 aa, Mycobacterium tuberculosis
GPFRIEPIDVPAVV

SEQ ID NO: 182690 - protein, 14 aa, Mycobacterium tuberculosis
PFRIEPIDVPAVVL

SEQ ID NO: 182691 - protein, 14 aa, Mycobacterium tuberculosis
FRIEPIDVPAVVLD

SEQ ID NO: 182692 - protein, 14 aa, Mycobacterium tuberculosis
RIEPIDVPAVVLDI

SEQ ID NO: 182693 - protein, 14 aa, Mycobacterium tuberculosis
IEPIDVPAVVLDIH

SEQ ID NO: 182694 - protein, 14 aa, Mycobacterium tuberculosis
EPIDVPAVVLDIHE

SEQ ID NO: 182695 - protein, 14 aa, Mycobacterium tuberculosis
PIDVPAVVLDIHET

SEQ ID NO: 182696 - protein, 14 aa, Mycobacterium tuberculosis
IDVPAVVLDIHETM

SEQ ID NO: 182697 - protein, 14 aa, Mycobacterium tuberculosis
DVPAVVLDIHETMV

SEQ ID NO: 182698 - protein, 14 aa, Mycobacterium tuberculosis
VPAVVLDIHETMVI

SEQ ID NO: 182699 - protein, 14 aa, Mycobacterium tuberculosis
PAVVLDIHETMVIP

SEQ ID NO: 182700 - protein, 14 aa, Mycobacterium tuberculosis
AVVLDIHETMVIPP

SEQ ID NO: 182701 - protein, 14 aa, Mycobacterium tuberculosis
VVLDIHETMVIPPI

SEQ ID NO: 182702 - protein, 14 aa, Mycobacterium tuberculosis
VLDIHETMVIPPIV

SEQ ID NO: 182703 - protein, 14 aa, Mycobacterium tuberculosis
LDIHETMVIPPIVF

SEQ ID NO: 182704 - protein, 14 aa, Mycobacterium tuberculosis
DIHETMVIPPIVFL

SEQ ID NO: 182705 - protein, 14 aa, Mycobacterium tuberculosis
IHETMVIPPIVFLP

SEQ ID NO: 182706 - protein, 14 aa, Mycobacterium tuberculosis
HETMVIPPIVFLPS

SEQ ID NO: 182707 - protein, 14 aa, Mycobacterium tuberculosis
ETMVIPPIVFLPSM

SEQ ID NO: 182708 - protein, 14 aa, Mycobacterium tuberculosis
TMVIPPIVFLPSMT

SEQ ID NO: 182709 - protein, 14 aa, Mycobacterium tuberculosis
MVIPPIVFLPSMTI

SEQ ID NO: 182710 - protein, 14 aa, Mycobacterium tuberculosis
VIPPIVFLPSMTIG

SEQ ID NO: 182711 - protein, 14 aa, Mycobacterium tuberculosis
IPPIVFLPSMTIGG

SEQ ID NO: 182712 - protein, 14 aa, Mycobacterium tuberculosis
PPIVFLPSMTIGGQ

SEQ ID NO: 182713 - protein, 14 aa, Mycobacterium tuberculosis
PIVFLPSMTIGGQT

SEQ ID NO: 182714 - protein, 14 aa, Mycobacterium tuberculosis
IVFLPSMTIGGQTY

SEQ ID NO: 182715 - protein, 14 aa, Mycobacterium tuberculosis
VFLPSMTIGGQTYT

SEQ ID NO: 182716 - protein, 14 aa, Mycobacterium tuberculosis
FLPSMTIGGQTYTI

SEQ ID NO: 182717 - protein, 14 aa, Mycobacterium tuberculosis
LPSMTIGGQTYTIP

SEQ ID NO: 182718 - protein, 14 aa, Mycobacterium tuberculosis
PSMTIGGQTYTIPL

SEQ ID NO: 182719 - protein, 14 aa, Mycobacterium tuberculosis
SMTIGGQTYTIPLD

SEQ ID NO: 182720 - protein, 14 aa, Mycobacterium tuberculosis
MTIGGQTYTIPLDT

SEQ ID NO: 182721 - protein, 14 aa, Mycobacterium tuberculosis
TIGGQTYTIPLDTP

SEQ ID NO: 182722 - protein, 14 aa, Mycobacterium tuberculosis
IGGQTYTIPLDTPP

SEQ ID NO: 182723 - protein, 14 aa, Mycobacterium tuberculosis
GGQTYTIPLDTPPA

SEQ ID NO: 182724 - protein, 14 aa, Mycobacterium tuberculosis
GQTYTIPLDTPPAP

SEQ ID NO: 182725 - protein, 14 aa, Mycobacterium tuberculosis
QTYTIPLDTPPAPA

SEQ ID NO: 182726 - protein, 14 aa, Mycobacterium tuberculosis
TYTIPLDTPPAPAP

SEQ ID NO: 182727 - protein, 14 aa, Mycobacterium tuberculosis
YTIPLDTPPAPAPP

SEQ ID NO: 182728 - protein, 14 aa, Mycobacterium tuberculosis
TIPLDTPPAPAPPP

SEQ ID NO: 182729 - protein, 14 aa, Mycobacterium tuberculosis
IPLDTPPAPAPPPF

SEQ ID NO: 182730 - protein, 14 aa, Mycobacterium tuberculosis
PLDTPPAPAPPPFR

SEQ ID NO: 182731 - protein, 14 aa, Mycobacterium tuberculosis
LDTPPAPAPPPFRL

SEQ ID NO: 182732 - protein, 14 aa, Mycobacterium tuberculosis
DTPPAPAPPPFRLP

SEQ ID NO: 182733 - protein, 14 aa, Mycobacterium tuberculosis
TPPAPAPPPFRLPL

SEQ ID NO: 182734 - protein, 14 aa, Mycobacterium tuberculosis
PPAPAPPPFRLPLL

SEQ ID NO: 182735 - protein, 14 aa, Mycobacterium tuberculosis
PAPAPPPFRLPLLF

SEQ ID NO: 182736 - protein, 14 aa, Mycobacterium tuberculosis
APAPPPFRLPLLFV

SEQ ID NO: 182737 - protein, 14 aa, Mycobacterium tuberculosis
PAPPPFRLPLLFVN

SEQ ID NO: 182738 - protein, 14 aa, Mycobacterium tuberculosis
APPPFRLPLLFVNA

SEQ ID NO: 182739 - protein, 14 aa, Mycobacterium tuberculosis
PPPFRLPLLFVNAL

SEQ ID NO: 182740 - protein, 14 aa, Mycobacterium tuberculosis
PPFRLPLLFVNALG

SEQ ID NO: 182741 - protein, 14 aa, Mycobacterium tuberculosis
PFRLPLLFVNALGD

SEQ ID NO: 182742 - protein, 14 aa, Mycobacterium tuberculosis
FRLPLLFVNALGDN

SEQ ID NO: 182743 - protein, 14 aa, Mycobacterium tuberculosis
RLPLLFVNALGDNW

SEQ ID NO: 182744 - protein, 14 aa, Mycobacterium tuberculosis
LPLLFVNALGDNWI

SEQ ID NO: 182745 - protein, 14 aa, Mycobacterium tuberculosis
PLLFVNALGDNWIV

SEQ ID NO: 182746 - protein, 14 aa, Mycobacterium tuberculosis
LLFVNALGDNWIVG

SEQ ID NO: 182747 - protein, 14 aa, Mycobacterium tuberculosis
LFVNALGDNWIVGA

SEQ ID NO: 182748 - protein, 14 aa, Mycobacterium tuberculosis
FVNALGDNWIVGAS

SEQ ID NO: 182749 - protein, 14 aa, Mycobacterium tuberculosis
VNALGDNWIVGASN

SEQ ID NO: 182750 - protein, 14 aa, Mycobacterium tuberculosis
NALGDNWIVGASNS

SEQ ID NO: 182751 - protein, 14 aa, Mycobacterium tuberculosis
ALGDNWIVGASNST

SEQ ID NO: 182752 - protein, 14 aa, Mycobacterium tuberculosis
LGDNWIVGASNSTG

SEQ ID NO: 182753 - protein, 14 aa, Mycobacterium tuberculosis
GDNWIVGASNSTGM

SEQ ID NO: 182754 - protein, 14 aa, Mycobacterium tuberculosis
DNWIVGASNSTGMS

SEQ ID NO: 182755 - protein, 14 aa, Mycobacterium tuberculosis
NWIVGASNSTGMSG

SEQ ID NO: 182756 - protein, 14 aa, Mycobacterium tuberculosis
WIVGASNSTGMSGG

SEQ ID NO: 182757 - protein, 14 aa, Mycobacterium tuberculosis
IVGASNSTGMSGGF

SEQ ID NO: 182758 - protein, 14 aa, Mycobacterium tuberculosis
VGASNSTGMSGGFV

SEQ ID NO: 182759 - protein, 14 aa, Mycobacterium tuberculosis
GASNSTGMSGGFVT

SEQ ID NO: 182760 - protein, 14 aa, Mycobacterium tuberculosis
ASNSTGMSGGFVTA

SEQ ID NO: 182761 - protein, 14 aa, Mycobacterium tuberculosis
SNSTGMSGGFVTAP

SEQ ID NO: 182762 - protein, 14 aa, Mycobacterium tuberculosis
NSTGMSGGFVTAPT

SEQ ID NO: 182763 - protein, 14 aa, Mycobacterium tuberculosis
STGMSGGFVTAPTQ

SEQ ID NO: 182764 - protein, 14 aa, Mycobacterium tuberculosis
TGMSGGFVTAPTQG

SEQ ID NO: 182765 - protein, 14 aa, Mycobacterium tuberculosis
GMSGGFVTAPTQGI

SEQ ID NO: 182766 - protein, 14 aa, Mycobacterium tuberculosis
MSGGFVTAPTQGIL

SEQ ID NO: 182767 - protein, 14 aa, Mycobacterium tuberculosis
SGGFVTAPTQGILI

SEQ ID NO: 182768 - protein, 14 aa, Mycobacterium tuberculosis
GGFVTAPTQGILIH

SEQ ID NO: 182769 - protein, 14 aa, Mycobacterium tuberculosis
GFVTAPTQGILIHT

SEQ ID NO: 182770 - protein, 14 aa, Mycobacterium tuberculosis
FVTAPTQGILIHTG

SEQ ID NO: 182771 - protein, 14 aa, Mycobacterium tuberculosis
VTAPTQGILIHTGP

SEQ ID NO: 182772 - protein, 14 aa, Mycobacterium tuberculosis
TAPTQGILIHTGPS

SEQ ID NO: 182773 - protein, 14 aa, Mycobacterium tuberculosis
APTQGILIHTGPSS

SEQ ID NO: 182774 - protein, 14 aa, Mycobacterium tuberculosis
PTQGILIHTGPSSA

SEQ ID NO: 182775 - protein, 14 aa, Mycobacterium tuberculosis
TQGILIHTGPSSAT

SEQ ID NO: 182776 - protein, 14 aa, Mycobacterium tuberculosis
QGILIHTGPSSATT

SEQ ID NO: 182777 - protein, 14 aa, Mycobacterium tuberculosis
GILIHTGPSSATTG

SEQ ID NO: 182778 - protein, 14 aa, Mycobacterium tuberculosis
ILIHTGPSSATTGS

SEQ ID NO: 182779 - protein, 14 aa, Mycobacterium tuberculosis
LIHTGPSSATTGSL

SEQ ID NO: 182780 - protein, 14 aa, Mycobacterium tuberculosis
IHTGPSSATTGSLA

SEQ ID NO: 182781 - protein, 14 aa, Mycobacterium tuberculosis
HTGPSSATTGSLAL

SEQ ID NO: 182782 - protein, 14 aa, Mycobacterium tuberculosis
TGPSSATTGSLALT

SEQ ID NO: 182783 - protein, 14 aa, Mycobacterium tuberculosis
GPSSATTGSLALTL

SEQ ID NO: 182784 - protein, 14 aa, Mycobacterium tuberculosis
PSSATTGSLALTLP

SEQ ID NO: 182785 - protein, 14 aa, Mycobacterium tuberculosis
SSATTGSLALTLPT

SEQ ID NO: 182786 - protein, 14 aa, Mycobacterium tuberculosis
SATTGSLALTLPTV

SEQ ID NO: 182787 - protein, 14 aa, Mycobacterium tuberculosis
ATTGSLALTLPTVT

SEQ ID NO: 182788 - protein, 14 aa, Mycobacterium tuberculosis
TTGSLALTLPTVTI

SEQ ID NO: 182789 - protein, 14 aa, Mycobacterium tuberculosis
TGSLALTLPTVTIP

SEQ ID NO: 182790 - protein, 14 aa, Mycobacterium tuberculosis
GSLALTLPTVTIPT

SEQ ID NO: 182791 - protein, 14 aa, Mycobacterium tuberculosis
SLALTLPTVTIPTI

SEQ ID NO: 182792 - protein, 14 aa, Mycobacterium tuberculosis
LALTLPTVTIPTIT

SEQ ID NO: 182793 - protein, 14 aa, Mycobacterium tuberculosis
ALTLPTVTIPTITT

SEQ ID NO: 182794 - protein, 14 aa, Mycobacterium tuberculosis
LTLPTVTIPTITTS

SEQ ID NO: 182795 - protein, 14 aa, Mycobacterium tuberculosis
TLPTVTIPTITTSP

SEQ ID NO: 182796 - protein, 14 aa, Mycobacterium tuberculosis
LPTVTIPTITTSPI

SEQ ID NO: 182797 - protein, 14 aa, Mycobacterium tuberculosis
PTVTIPTITTSPIP

SEQ ID NO: 182798 - protein, 14 aa, Mycobacterium tuberculosis
TVTIPTITTSPIPL

SEQ ID NO: 182799 - protein, 14 aa, Mycobacterium tuberculosis
VTIPTITTSPIPLK

SEQ ID NO: 182800 - protein, 14 aa, Mycobacterium tuberculosis
TIPTITTSPIPLKI

SEQ ID NO: 182801 - protein, 14 aa, Mycobacterium tuberculosis
IPTITTSPIPLKID

SEQ ID NO: 182802 - protein, 14 aa, Mycobacterium tuberculosis
PTITTSPIPLKIDV

SEQ ID NO: 182803 - protein, 14 aa, Mycobacterium tuberculosis
TITTSPIPLKIDVS

SEQ ID NO: 182804 - protein, 14 aa, Mycobacterium tuberculosis
ITTSPIPLKIDVSG

SEQ ID NO: 182805 - protein, 14 aa, Mycobacterium tuberculosis
TTSPIPLKIDVSGG

SEQ ID NO: 182806 - protein, 14 aa, Mycobacterium tuberculosis
TSPIPLKIDVSGGL

SEQ ID NO: 182807 - protein, 14 aa, Mycobacterium tuberculosis
SPIPLKIDVSGGLP

SEQ ID NO: 182808 - protein, 14 aa, Mycobacterium tuberculosis
PIPLKIDVSGGLPA

SEQ ID NO: 182809 - protein, 14 aa, Mycobacterium tuberculosis
IPLKIDVSGGLPAF

SEQ ID NO: 182810 - protein, 14 aa, Mycobacterium tuberculosis
PLKIDVSGGLPAFT

SEQ ID NO: 182811 - protein, 14 aa, Mycobacterium tuberculosis
LKIDVSGGLPAFTL

SEQ ID NO: 182812 - protein, 14 aa, Mycobacterium tuberculosis
KIDVSGGLPAFTLF

SEQ ID NO: 182813 - protein, 14 aa, Mycobacterium tuberculosis
IDVSGGLPAFTLFP

SEQ ID NO: 182814 - protein, 14 aa, Mycobacterium tuberculosis
DVSGGLPAFTLFPG

SEQ ID NO: 182815 - protein, 14 aa, Mycobacterium tuberculosis
VSGGLPAFTLFPGG

SEQ ID NO: 182816 - protein, 14 aa, Mycobacterium tuberculosis
SGGLPAFTLFPGGL

SEQ ID NO: 182817 - protein, 14 aa, Mycobacterium tuberculosis
GGLPAFTLFPGGLN

SEQ ID NO: 182818 - protein, 14 aa, Mycobacterium tuberculosis
GLPAFTLFPGGLNI

SEQ ID NO: 182819 - protein, 14 aa, Mycobacterium tuberculosis
LPAFTLFPGGLNIP

SEQ ID NO: 182820 - protein, 14 aa, Mycobacterium tuberculosis
PAFTLFPGGLNIPQ

SEQ ID NO: 182821 - protein, 14 aa, Mycobacterium tuberculosis
AFTLFPGGLNIPQN

SEQ ID NO: 182822 - protein, 14 aa, Mycobacterium tuberculosis
FTLFPGGLNIPQNA

SEQ ID NO: 182823 - protein, 14 aa, Mycobacterium tuberculosis
TLFPGGLNIPQNAI

SEQ ID NO: 182824 - protein, 14 aa, Mycobacterium tuberculosis
LFPGGLNIPQNAIP

SEQ ID NO: 182825 - protein, 14 aa, Mycobacterium tuberculosis
FPGGLNIPQNAIPL

SEQ ID NO: 182826 - protein, 14 aa, Mycobacterium tuberculosis
PGGLNIPQNAIPLT

SEQ ID NO: 182827 - protein, 14 aa, Mycobacterium tuberculosis
GGLNIPQNAIPLTI

SEQ ID NO: 182828 - protein, 14 aa, Mycobacterium tuberculosis
GLNIPQNAIPLTID

SEQ ID NO: 182829 - protein, 14 aa, Mycobacterium tuberculosis
LNIPQNAIPLTIDA

SEQ ID NO: 182830 - protein, 14 aa, Mycobacterium tuberculosis
NIPQNAIPLTIDAS

SEQ ID NO: 182831 - protein, 14 aa, Mycobacterium tuberculosis
IPQNAIPLTIDASG

SEQ ID NO: 182832 - protein, 14 aa, Mycobacterium tuberculosis
PQNAIPLTIDASGV

SEQ ID NO: 182833 - protein, 14 aa, Mycobacterium tuberculosis
QNAIPLTIDASGVL

SEQ ID NO: 182834 - protein, 14 aa, Mycobacterium tuberculosis
NAIPLTIDASGVLD

SEQ ID NO: 182835 - protein, 14 aa, Mycobacterium tuberculosis
AIPLTIDASGVLDP

SEQ ID NO: 182836 - protein, 14 aa, Mycobacterium tuberculosis
IPLTIDASGVLDPI

SEQ ID NO: 182837 - protein, 14 aa, Mycobacterium tuberculosis
PLTIDASGVLDPIT

SEQ ID NO: 182838 - protein, 14 aa, Mycobacterium tuberculosis
LTIDASGVLDPITI

SEQ ID NO: 182839 - protein, 14 aa, Mycobacterium tuberculosis
TIDASGVLDPITIF

SEQ ID NO: 182840 - protein, 14 aa, Mycobacterium tuberculosis
IDASGVLDPITIFP

SEQ ID NO: 182841 - protein, 14 aa, Mycobacterium tuberculosis
DASGVLDPITIFPG

SEQ ID NO: 182842 - protein, 14 aa, Mycobacterium tuberculosis
ASGVLDPITIFPGG

SEQ ID NO: 182843 - protein, 14 aa, Mycobacterium tuberculosis
SGVLDPITIFPGGF

SEQ ID NO: 182844 - protein, 14 aa, Mycobacterium tuberculosis
GVLDPITIFPGGFT

SEQ ID NO: 182845 - protein, 14 aa, Mycobacterium tuberculosis
VLDPITIFPGGFTI

SEQ ID NO: 182846 - protein, 14 aa, Mycobacterium tuberculosis
LDPITIFPGGFTID

SEQ ID NO: 182847 - protein, 14 aa, Mycobacterium tuberculosis
DPITIFPGGFTIDP

SEQ ID NO: 182848 - protein, 14 aa, Mycobacterium tuberculosis
PITIFPGGFTIDPL

SEQ ID NO: 182849 - protein, 14 aa, Mycobacterium tuberculosis
ITIFPGGFTIDPLP

SEQ ID NO: 182850 - protein, 14 aa, Mycobacterium tuberculosis
TIFPGGFTIDPLPL

SEQ ID NO: 182851 - protein, 14 aa, Mycobacterium tuberculosis
IFPGGFTIDPLPLS

SEQ ID NO: 182852 - protein, 14 aa, Mycobacterium tuberculosis
FPGGFTIDPLPLSL

SEQ ID NO: 182853 - protein, 14 aa, Mycobacterium tuberculosis
PGGFTIDPLPLSLA

SEQ ID NO: 182854 - protein, 14 aa, Mycobacterium tuberculosis
GGFTIDPLPLSLAL

SEQ ID NO: 182855 - protein, 14 aa, Mycobacterium tuberculosis
GFTIDPLPLSLALN

SEQ ID NO: 182856 - protein, 14 aa, Mycobacterium tuberculosis
FTIDPLPLSLALNI

SEQ ID NO: 182857 - protein, 14 aa, Mycobacterium tuberculosis
TIDPLPLSLALNIS

SEQ ID NO: 182858 - protein, 14 aa, Mycobacterium tuberculosis
IDPLPLSLALNISV

SEQ ID NO: 182859 - protein, 14 aa, Mycobacterium tuberculosis
DPLPLSLALNISVP

SEQ ID NO: 182860 - protein, 14 aa, Mycobacterium tuberculosis
PLPLSLALNISVPD

SEQ ID NO: 182861 - protein, 14 aa, Mycobacterium tuberculosis
LPLSLALNISVPDS

SEQ ID NO: 182862 - protein, 14 aa, Mycobacterium tuberculosis
PLSLALNISVPDSS

SEQ ID NO: 182863 - protein, 14 aa, Mycobacterium tuberculosis
LSLALNISVPDSSV

SEQ ID NO: 182864 - protein, 14 aa, Mycobacterium tuberculosis
SLALNISVPDSSVP

SEQ ID NO: 182865 - protein, 14 aa, Mycobacterium tuberculosis
LALNISVPDSSVPI

SEQ ID NO: 182866 - protein, 14 aa, Mycobacterium tuberculosis
ALNISVPDSSVPII

SEQ ID NO: 182867 - protein, 14 aa, Mycobacterium tuberculosis
LNISVPDSSVPIII

SEQ ID NO: 182868 - protein, 14 aa, Mycobacterium tuberculosis
NISVPDSSVPIIIV

SEQ ID NO: 182869 - protein, 14 aa, Mycobacterium tuberculosis
ISVPDSSVPIIIVP

SEQ ID NO: 182870 - protein, 14 aa, Mycobacterium tuberculosis
SVPDSSVPIIIVPP

SEQ ID NO: 182871 - protein, 14 aa, Mycobacterium tuberculosis
VPDSSVPIIIVPPT

SEQ ID NO: 182872 - protein, 14 aa, Mycobacterium tuberculosis
PDSSVPIIIVPPTP

SEQ ID NO: 182873 - protein, 14 aa, Mycobacterium tuberculosis
DSSVPIIIVPPTPG

SEQ ID NO: 182874 - protein, 14 aa, Mycobacterium tuberculosis
SSVPIIIVPPTPGF

SEQ ID NO: 182875 - protein, 14 aa, Mycobacterium tuberculosis
SVPIIIVPPTPGFG

SEQ ID NO: 182876 - protein, 14 aa, Mycobacterium tuberculosis
VPIIIVPPTPGFGN

SEQ ID NO: 182877 - protein, 14 aa, Mycobacterium tuberculosis
PIIIVPPTPGFGNA

SEQ ID NO: 182878 - protein, 14 aa, Mycobacterium tuberculosis
IIIVPPTPGFGNAT

SEQ ID NO: 182879 - protein, 14 aa, Mycobacterium tuberculosis
IIVPPTPGFGNATA

SEQ ID NO: 182880 - protein, 14 aa, Mycobacterium tuberculosis
IVPPTPGFGNATAT

SEQ ID NO: 182881 - protein, 14 aa, Mycobacterium tuberculosis
VPPTPGFGNATATP

SEQ ID NO: 182882 - protein, 14 aa, Mycobacterium tuberculosis
PPTPGFGNATATPS

SEQ ID NO: 182883 - protein, 14 aa, Mycobacterium tuberculosis
PTPGFGNATATPSS

SEQ ID NO: 182884 - protein, 14 aa, Mycobacterium tuberculosis
TPGFGNATATPSSG

SEQ ID NO: 182885 - protein, 14 aa, Mycobacterium tuberculosis
PGFGNATATPSSGF

SEQ ID NO: 182886 - protein, 14 aa, Mycobacterium tuberculosis
GFGNATATPSSGFF

SEQ ID NO: 182887 - protein, 14 aa, Mycobacterium tuberculosis
FGNATATPSSGFFN

SEQ ID NO: 182888 - protein, 14 aa, Mycobacterium tuberculosis
GNATATPSSGFFNS

SEQ ID NO: 182889 - protein, 14 aa, Mycobacterium tuberculosis
NATATPSSGFFNSG

SEQ ID NO: 182890 - protein, 14 aa, Mycobacterium tuberculosis
ATATPSSGFFNSGA

SEQ ID NO: 182891 - protein, 14 aa, Mycobacterium tuberculosis
TATPSSGFFNSGAG

SEQ ID NO: 182892 - protein, 14 aa, Mycobacterium tuberculosis
ATPSSGFFNSGAGG

SEQ ID NO: 182893 - protein, 14 aa, Mycobacterium tuberculosis
TPSSGFFNSGAGGV

SEQ ID NO: 182894 - protein, 14 aa, Mycobacterium tuberculosis
PSSGFFNSGAGGVS

SEQ ID NO: 182895 - protein, 14 aa, Mycobacterium tuberculosis
SSGFFNSGAGGVSG

SEQ ID NO: 182896 - protein, 14 aa, Mycobacterium tuberculosis
SGFFNSGAGGVSGF

SEQ ID NO: 182897 - protein, 14 aa, Mycobacterium tuberculosis
GFFNSGAGGVSGFG

SEQ ID NO: 182898 - protein, 14 aa, Mycobacterium tuberculosis
FFNSGAGGVSGFGN

SEQ ID NO: 182899 - protein, 14 aa, Mycobacterium tuberculosis
FNSGAGGVSGFGNF

SEQ ID NO: 182900 - protein, 14 aa, Mycobacterium tuberculosis
NSGAGGVSGFGNFG

SEQ ID NO: 182901 - protein, 14 aa, Mycobacterium tuberculosis
SGAGGVSGFGNFGA

SEQ ID NO: 182902 - protein, 14 aa, Mycobacterium tuberculosis
GAGGVSGFGNFGAG

SEQ ID NO: 182903 - protein, 14 aa, Mycobacterium tuberculosis
AGGVSGFGNFGAGS

SEQ ID NO: 182904 - protein, 14 aa, Mycobacterium tuberculosis
GGVSGFGNFGAGSS

SEQ ID NO: 182905 - protein, 14 aa, Mycobacterium tuberculosis
GVSGFGNFGAGSSG

SEQ ID NO: 182906 - protein, 14 aa, Mycobacterium tuberculosis
VSGFGNFGAGSSGW

SEQ ID NO: 182907 - protein, 14 aa, Mycobacterium tuberculosis
SGFGNFGAGSSGWW

SEQ ID NO: 182908 - protein, 14 aa, Mycobacterium tuberculosis
GFGNFGAGSSGWWN

SEQ ID NO: 182909 - protein, 14 aa, Mycobacterium tuberculosis
FGNFGAGSSGWWNQ

SEQ ID NO: 182910 - protein, 14 aa, Mycobacterium tuberculosis
GNFGAGSSGWWNQA

SEQ ID NO: 182911 - protein, 14 aa, Mycobacterium tuberculosis
NFGAGSSGWWNQAH

SEQ ID NO: 182912 - protein, 14 aa, Mycobacterium tuberculosis
FGAGSSGWWNQAHA

SEQ ID NO: 182913 - protein, 14 aa, Mycobacterium tuberculosis
GAGSSGWWNQAHAA

SEQ ID NO: 182914 - protein, 14 aa, Mycobacterium tuberculosis
AGSSGWWNQAHAAL

SEQ ID NO: 182915 - protein, 14 aa, Mycobacterium tuberculosis
GSSGWWNQAHAALA

SEQ ID NO: 182916 - protein, 14 aa, Mycobacterium tuberculosis
SSGWWNQAHAALAG

SEQ ID NO: 182917 - protein, 14 aa, Mycobacterium tuberculosis
SGWWNQAHAALAGA

SEQ ID NO: 182918 - protein, 14 aa, Mycobacterium tuberculosis
GWWNQAHAALAGAG

SEQ ID NO: 182919 - protein, 14 aa, Mycobacterium tuberculosis
WWNQAHAALAGAGS

SEQ ID NO: 182920 - protein, 14 aa, Mycobacterium tuberculosis
WNQAHAALAGAGSG

SEQ ID NO: 182921 - protein, 14 aa, Mycobacterium tuberculosis
NQAHAALAGAGSGV

SEQ ID NO: 182922 - protein, 14 aa, Mycobacterium tuberculosis
QAHAALAGAGSGVL

SEQ ID NO: 182923 - protein, 14 aa, Mycobacterium tuberculosis
AHAALAGAGSGVLN

SEQ ID NO: 182924 - protein, 14 aa, Mycobacterium tuberculosis
HAALAGAGSGVLNV

SEQ ID NO: 182925 - protein, 14 aa, Mycobacterium tuberculosis
AALAGAGSGVLNVG

SEQ ID NO: 182926 - protein, 14 aa, Mycobacterium tuberculosis
ALAGAGSGVLNVGT

SEQ ID NO: 182927 - protein, 14 aa, Mycobacterium tuberculosis
LAGAGSGVLNVGTL

SEQ ID NO: 182928 - protein, 14 aa, Mycobacterium tuberculosis
AGAGSGVLNVGTLN

SEQ ID NO: 182929 - protein, 14 aa, Mycobacterium tuberculosis
GAGSGVLNVGTLNS

SEQ ID NO: 182930 - protein, 14 aa, Mycobacterium tuberculosis
AGSGVLNVGTLNSG

SEQ ID NO: 182931 - protein, 14 aa, Mycobacterium tuberculosis
GSGVLNVGTLNSGV

SEQ ID NO: 182932 - protein, 14 aa, Mycobacterium tuberculosis
SGVLNVGTLNSGVL

SEQ ID NO: 182933 - protein, 14 aa, Mycobacterium tuberculosis
GVLNVGTLNSGVLN

SEQ ID NO: 182934 - protein, 14 aa, Mycobacterium tuberculosis
VLNVGTLNSGVLNV

SEQ ID NO: 182935 - protein, 14 aa, Mycobacterium tuberculosis
LNVGTLNSGVLNVG

SEQ ID NO: 182936 - protein, 14 aa, Mycobacterium tuberculosis
NVGTLNSGVLNVGS

SEQ ID NO: 182937 - protein, 14 aa, Mycobacterium tuberculosis
VGTLNSGVLNVGSG

SEQ ID NO: 182938 - protein, 14 aa, Mycobacterium tuberculosis
GTLNSGVLNVGSGI

SEQ ID NO: 182939 - protein, 14 aa, Mycobacterium tuberculosis
TLNSGVLNVGSGIS

SEQ ID NO: 182940 - protein, 14 aa, Mycobacterium tuberculosis
LNSGVLNVGSGISG

SEQ ID NO: 182941 - protein, 14 aa, Mycobacterium tuberculosis
NSGVLNVGSGISGL

SEQ ID NO: 182942 - protein, 14 aa, Mycobacterium tuberculosis
SGVLNVGSGISGLY

SEQ ID NO: 182943 - protein, 14 aa, Mycobacterium tuberculosis
GVLNVGSGISGLYN

SEQ ID NO: 182944 - protein, 14 aa, Mycobacterium tuberculosis
VLNVGSGISGLYNT

SEQ ID NO: 182945 - protein, 14 aa, Mycobacterium tuberculosis
LNVGSGISGLYNTA

SEQ ID NO: 182946 - protein, 14 aa, Mycobacterium tuberculosis
NVGSGISGLYNTAI

SEQ ID NO: 182947 - protein, 14 aa, Mycobacterium tuberculosis
VGSGISGLYNTAIV

SEQ ID NO: 182948 - protein, 14 aa, Mycobacterium tuberculosis
GSGISGLYNTAIVG

SEQ ID NO: 182949 - protein, 14 aa, Mycobacterium tuberculosis
SGISGLYNTAIVGL

SEQ ID NO: 182950 - protein, 14 aa, Mycobacterium tuberculosis
GISGLYNTAIVGLG

SEQ ID NO: 182951 - protein, 14 aa, Mycobacterium tuberculosis
ISGLYNTAIVGLGT

SEQ ID NO: 182952 - protein, 14 aa, Mycobacterium tuberculosis
SGLYNTAIVGLGTP

SEQ ID NO: 182953 - protein, 14 aa, Mycobacterium tuberculosis
GLYNTAIVGLGTPA

SEQ ID NO: 182954 - protein, 14 aa, Mycobacterium tuberculosis
LYNTAIVGLGTPAL

SEQ ID NO: 182955 - protein, 14 aa, Mycobacterium tuberculosis
YNTAIVGLGTPALV

SEQ ID NO: 182956 - protein, 14 aa, Mycobacterium tuberculosis
NTAIVGLGTPALVS

SEQ ID NO: 182957 - protein, 14 aa, Mycobacterium tuberculosis
TAIVGLGTPALVSG

SEQ ID NO: 182958 - protein, 14 aa, Mycobacterium tuberculosis
AIVGLGTPALVSGA

SEQ ID NO: 182959 - protein, 14 aa, Mycobacterium tuberculosis
IVGLGTPALVSGAG

SEQ ID NO: 182960 - protein, 14 aa, Mycobacterium tuberculosis
VGLGTPALVSGAGN

SEQ ID NO: 182961 - protein, 14 aa, Mycobacterium tuberculosis
GLGTPALVSGAGNV

SEQ ID NO: 182962 - protein, 14 aa, Mycobacterium tuberculosis
LGTPALVSGAGNVG

SEQ ID NO: 182963 - protein, 14 aa, Mycobacterium tuberculosis
GTPALVSGAGNVGQ

SEQ ID NO: 182964 - protein, 14 aa, Mycobacterium tuberculosis
TPALVSGAGNVGQQ

SEQ ID NO: 182965 - protein, 14 aa, Mycobacterium tuberculosis
PALVSGAGNVGQQL

SEQ ID NO: 182966 - protein, 14 aa, Mycobacterium tuberculosis
ALVSGAGNVGQQLS

SEQ ID NO: 182967 - protein, 14 aa, Mycobacterium tuberculosis
LVSGAGNVGQQLSG

SEQ ID NO: 182968 - protein, 14 aa, Mycobacterium tuberculosis
VSGAGNVGQQLSGV

SEQ ID NO: 182969 - protein, 14 aa, Mycobacterium tuberculosis
SGAGNVGQQLSGVL

SEQ ID NO: 182970 - protein, 14 aa, Mycobacterium tuberculosis
GAGNVGQQLSGVLA

SEQ ID NO: 182971 - protein, 14 aa, Mycobacterium tuberculosis
AGNVGQQLSGVLAA

SEQ ID NO: 182972 - protein, 14 aa, Mycobacterium tuberculosis
GNVGQQLSGVLAAG

SEQ ID NO: 182973 - protein, 14 aa, Mycobacterium tuberculosis
NVGQQLSGVLAAGT

SEQ ID NO: 182974 - protein, 14 aa, Mycobacterium tuberculosis
VGQQLSGVLAAGTA

SEQ ID NO: 182975 - protein, 14 aa, Mycobacterium tuberculosis
GQQLSGVLAAGTAL

SEQ ID NO: 182976 - protein, 14 aa, Mycobacterium tuberculosis
QQLSGVLAAGTALT

SEQ ID NO: 182977 - protein, 14 aa, Mycobacterium tuberculosis
QLSGVLAAGTALTQ

SEQ ID NO: 182978 - protein, 14 aa, Mycobacterium tuberculosis
LSGVLAAGTALTQS

SEQ ID NO: 182979 - protein, 14 aa, Mycobacterium tuberculosis
SGVLAAGTALTQSP

SEQ ID NO: 182980 - protein, 14 aa, Mycobacterium tuberculosis
GVLAAGTALTQSPI

SEQ ID NO: 182981 - protein, 14 aa, Mycobacterium tuberculosis
VLAAGTALTQSPII

SEQ ID NO: 182982 - protein, 14 aa, Mycobacterium tuberculosis
LAAGTALTQSPIIN

SEQ ID NO: 182983 - protein, 14 aa, Mycobacterium tuberculosis
AAGTALTQSPIINL

SEQ ID NO: 182984 - protein, 14 aa, Mycobacterium tuberculosis
AGTALTQSPIINLG

SEQ ID NO: 182985 - protein, 14 aa, Mycobacterium tuberculosis
GTALTQSPIINLGL

SEQ ID NO: 182986 - protein, 14 aa, Mycobacterium tuberculosis
TALTQSPIINLGLA

SEQ ID NO: 182987 - protein, 14 aa, Mycobacterium tuberculosis
ALTQSPIINLGLAD

SEQ ID NO: 182988 - protein, 14 aa, Mycobacterium tuberculosis
LTQSPIINLGLADV

SEQ ID NO: 182989 - protein, 14 aa, Mycobacterium tuberculosis
TQSPIINLGLADVG

SEQ ID NO: 182990 - protein, 14 aa, Mycobacterium tuberculosis
QSPIINLGLADVGN

SEQ ID NO: 182991 - protein, 14 aa, Mycobacterium tuberculosis
SPIINLGLADVGNY

SEQ ID NO: 182992 - protein, 14 aa, Mycobacterium tuberculosis
PIINLGLADVGNYN

SEQ ID NO: 182993 - protein, 14 aa, Mycobacterium tuberculosis
IINLGLADVGNYNL

SEQ ID NO: 182994 - protein, 14 aa, Mycobacterium tuberculosis
INLGLADVGNYNLG

SEQ ID NO: 182995 - protein, 14 aa, Mycobacterium tuberculosis
NLGLADVGNYNLGL

SEQ ID NO: 182996 - protein, 14 aa, Mycobacterium tuberculosis
LGLADVGNYNLGLG

SEQ ID NO: 182997 - protein, 14 aa, Mycobacterium tuberculosis
GLADVGNYNLGLGN

SEQ ID NO: 182998 - protein, 14 aa, Mycobacterium tuberculosis
LADVGNYNLGLGNV

SEQ ID NO: 182999 - protein, 14 aa, Mycobacterium tuberculosis
ADVGNYNLGLGNVG

SEQ ID NO: 183000 - protein, 14 aa, Mycobacterium tuberculosis
DVGNYNLGLGNVGD

SEQ ID NO: 183001 - protein, 14 aa, Mycobacterium tuberculosis
VGNYNLGLGNVGDF

SEQ ID NO: 183002 - protein, 14 aa, Mycobacterium tuberculosis
GNYNLGLGNVGDFN

SEQ ID NO: 183003 - protein, 14 aa, Mycobacterium tuberculosis
NYNLGLGNVGDFNL

SEQ ID NO: 183004 - protein, 14 aa, Mycobacterium tuberculosis
YNLGLGNVGDFNLG

SEQ ID NO: 183005 - protein, 14 aa, Mycobacterium tuberculosis
NLGLGNVGDFNLGA

SEQ ID NO: 183006 - protein, 14 aa, Mycobacterium tuberculosis
LGLGNVGDFNLGAA

SEQ ID NO: 183007 - protein, 14 aa, Mycobacterium tuberculosis
GLGNVGDFNLGAAN

SEQ ID NO: 183008 - protein, 14 aa, Mycobacterium tuberculosis
LGNVGDFNLGAANL

SEQ ID NO: 183009 - protein, 14 aa, Mycobacterium tuberculosis
GNVGDFNLGAANLG

SEQ ID NO: 183010 - protein, 14 aa, Mycobacterium tuberculosis
NVGDFNLGAANLGD

SEQ ID NO: 183011 - protein, 14 aa, Mycobacterium tuberculosis
VGDFNLGAANLGDL

SEQ ID NO: 183012 - protein, 14 aa, Mycobacterium tuberculosis
GDFNLGAANLGDLN

SEQ ID NO: 183013 - protein, 14 aa, Mycobacterium tuberculosis
DFNLGAANLGDLNL

SEQ ID NO: 183014 - protein, 14 aa, Mycobacterium tuberculosis
FNLGAANLGDLNLG

SEQ ID NO: 183015 - protein, 14 aa, Mycobacterium tuberculosis
NLGAANLGDLNLGL

SEQ ID NO: 183016 - protein, 14 aa, Mycobacterium tuberculosis
LGAANLGDLNLGLG

SEQ ID NO: 183017 - protein, 14 aa, Mycobacterium tuberculosis
GAANLGDLNLGLGN

SEQ ID NO: 183018 - protein, 14 aa, Mycobacterium tuberculosis
AANLGDLNLGLGNI

SEQ ID NO: 183019 - protein, 14 aa, Mycobacterium tuberculosis
ANLGDLNLGLGNIG

SEQ ID NO: 183020 - protein, 14 aa, Mycobacterium tuberculosis
NLGDLNLGLGNIGN

SEQ ID NO: 183021 - protein, 14 aa, Mycobacterium tuberculosis
LGDLNLGLGNIGNA

SEQ ID NO: 183022 - protein, 14 aa, Mycobacterium tuberculosis
GDLNLGLGNIGNAN

SEQ ID NO: 183023 - protein, 14 aa, Mycobacterium tuberculosis
DLNLGLGNIGNANV

SEQ ID NO: 183024 - protein, 14 aa, Mycobacterium tuberculosis
LNLGLGNIGNANVG

SEQ ID NO: 183025 - protein, 14 aa, Mycobacterium tuberculosis
NLGLGNIGNANVGF

SEQ ID NO: 183026 - protein, 14 aa, Mycobacterium tuberculosis
LGLGNIGNANVGFG

SEQ ID NO: 183027 - protein, 14 aa, Mycobacterium tuberculosis
GLGNIGNANVGFGN

SEQ ID NO: 183028 - protein, 14 aa, Mycobacterium tuberculosis
LGNIGNANVGFGNI

SEQ ID NO: 183029 - protein, 14 aa, Mycobacterium tuberculosis
GNIGNANVGFGNIG

SEQ ID NO: 183030 - protein, 14 aa, Mycobacterium tuberculosis
NIGNANVGFGNIGH

SEQ ID NO: 183031 - protein, 14 aa, Mycobacterium tuberculosis
IGNANVGFGNIGHG

SEQ ID NO: 183032 - protein, 14 aa, Mycobacterium tuberculosis
GNANVGFGNIGHGN

SEQ ID NO: 183033 - protein, 14 aa, Mycobacterium tuberculosis
NANVGFGNIGHGNV

SEQ ID NO: 183034 - protein, 14 aa, Mycobacterium tuberculosis
ANVGFGNIGHGNVG

SEQ ID NO: 183035 - protein, 14 aa, Mycobacterium tuberculosis
NVGFGNIGHGNVGF

SEQ ID NO: 183036 - protein, 14 aa, Mycobacterium tuberculosis
VGFGNIGHGNVGFG

SEQ ID NO: 183037 - protein, 14 aa, Mycobacterium tuberculosis
GFGNIGHGNVGFGN

SEQ ID NO: 183038 - protein, 14 aa, Mycobacterium tuberculosis
FGNIGHGNVGFGNS

SEQ ID NO: 183039 - protein, 14 aa, Mycobacterium tuberculosis
GNIGHGNVGFGNSG

SEQ ID NO: 183040 - protein, 14 aa, Mycobacterium tuberculosis
NIGHGNVGFGNSGL

SEQ ID NO: 183041 - protein, 14 aa, Mycobacterium tuberculosis
IGHGNVGFGNSGLG

SEQ ID NO: 183042 - protein, 14 aa, Mycobacterium tuberculosis
GHGNVGFGNSGLGA

SEQ ID NO: 183043 - protein, 14 aa, Mycobacterium tuberculosis
HGNVGFGNSGLGAA

SEQ ID NO: 183044 - protein, 14 aa, Mycobacterium tuberculosis
GNVGFGNSGLGAAL

SEQ ID NO: 183045 - protein, 14 aa, Mycobacterium tuberculosis
NVGFGNSGLGAALG

SEQ ID NO: 183046 - protein, 14 aa, Mycobacterium tuberculosis
VGFGNSGLGAALGI

SEQ ID NO: 183047 - protein, 14 aa, Mycobacterium tuberculosis
GFGNSGLGAALGIG

SEQ ID NO: 183048 - protein, 14 aa, Mycobacterium tuberculosis
FGNSGLGAALGIGN

SEQ ID NO: 183049 - protein, 14 aa, Mycobacterium tuberculosis
GNSGLGAALGIGNI

SEQ ID NO: 183050 - protein, 14 aa, Mycobacterium tuberculosis
NSGLGAALGIGNIG

SEQ ID NO: 183051 - protein, 14 aa, Mycobacterium tuberculosis
SGLGAALGIGNIGL

SEQ ID NO: 183052 - protein, 14 aa, Mycobacterium tuberculosis
GLGAALGIGNIGLG

SEQ ID NO: 183053 - protein, 14 aa, Mycobacterium tuberculosis
LGAALGIGNIGLGN

SEQ ID NO: 183054 - protein, 14 aa, Mycobacterium tuberculosis
GAALGIGNIGLGNA

SEQ ID NO: 183055 - protein, 14 aa, Mycobacterium tuberculosis
AALGIGNIGLGNAG

SEQ ID NO: 183056 - protein, 14 aa, Mycobacterium tuberculosis
ALGIGNIGLGNAGS

SEQ ID NO: 183057 - protein, 14 aa, Mycobacterium tuberculosis
LGIGNIGLGNAGST

SEQ ID NO: 183058 - protein, 14 aa, Mycobacterium tuberculosis
GIGNIGLGNAGSTN

SEQ ID NO: 183059 - protein, 14 aa, Mycobacterium tuberculosis
IGNIGLGNAGSTNV

SEQ ID NO: 183060 - protein, 14 aa, Mycobacterium tuberculosis
GNIGLGNAGSTNVG

SEQ ID NO: 183061 - protein, 14 aa, Mycobacterium tuberculosis
NIGLGNAGSTNVGL

SEQ ID NO: 183062 - protein, 14 aa, Mycobacterium tuberculosis
IGLGNAGSTNVGLA

SEQ ID NO: 183063 - protein, 14 aa, Mycobacterium tuberculosis
GLGNAGSTNVGLAN

SEQ ID NO: 183064 - protein, 14 aa, Mycobacterium tuberculosis
LGNAGSTNVGLANM

SEQ ID NO: 183065 - protein, 14 aa, Mycobacterium tuberculosis
GNAGSTNVGLANMG

SEQ ID NO: 183066 - protein, 14 aa, Mycobacterium tuberculosis
NAGSTNVGLANMGV

SEQ ID NO: 183067 - protein, 14 aa, Mycobacterium tuberculosis
AGSTNVGLANMGVG

SEQ ID NO: 183068 - protein, 14 aa, Mycobacterium tuberculosis
GSTNVGLANMGVGN

SEQ ID NO: 183069 - protein, 14 aa, Mycobacterium tuberculosis
STNVGLANMGVGNI

SEQ ID NO: 183070 - protein, 14 aa, Mycobacterium tuberculosis
TNVGLANMGVGNIG

SEQ ID NO: 183071 - protein, 14 aa, Mycobacterium tuberculosis
NVGLANMGVGNIGF

SEQ ID NO: 183072 - protein, 14 aa, Mycobacterium tuberculosis
VGLANMGVGNIGFA

SEQ ID NO: 183073 - protein, 14 aa, Mycobacterium tuberculosis
GLANMGVGNIGFAN

SEQ ID NO: 183074 - protein, 14 aa, Mycobacterium tuberculosis
LANMGVGNIGFANT

SEQ ID NO: 183075 - protein, 14 aa, Mycobacterium tuberculosis
ANMGVGNIGFANTG

SEQ ID NO: 183076 - protein, 14 aa, Mycobacterium tuberculosis
NMGVGNIGFANTGT

SEQ ID NO: 183077 - protein, 14 aa, Mycobacterium tuberculosis
MGVGNIGFANTGTN

SEQ ID NO: 183078 - protein, 14 aa, Mycobacterium tuberculosis
GVGNIGFANTGTNN

SEQ ID NO: 183079 - protein, 14 aa, Mycobacterium tuberculosis
VGNIGFANTGTNNL

SEQ ID NO: 183080 - protein, 14 aa, Mycobacterium tuberculosis
GNIGFANTGTNNLG

SEQ ID NO: 183081 - protein, 14 aa, Mycobacterium tuberculosis
NIGFANTGTNNLGI

SEQ ID NO: 183082 - protein, 14 aa, Mycobacterium tuberculosis
IGFANTGTNNLGIG

SEQ ID NO: 183083 - protein, 14 aa, Mycobacterium tuberculosis
GFANTGTNNLGIGL

SEQ ID NO: 183084 - protein, 14 aa, Mycobacterium tuberculosis
FANTGTNNLGIGLT

SEQ ID NO: 183085 - protein, 14 aa, Mycobacterium tuberculosis
ANTGTNNLGIGLTG

SEQ ID NO: 183086 - protein, 14 aa, Mycobacterium tuberculosis
NTGTNNLGIGLTGD

SEQ ID NO: 183087 - protein, 14 aa, Mycobacterium tuberculosis
TGTNNLGIGLTGDN

SEQ ID NO: 183088 - protein, 14 aa, Mycobacterium tuberculosis
GTNNLGIGLTGDNQ

SEQ ID NO: 183089 - protein, 14 aa, Mycobacterium tuberculosis
TNNLGIGLTGDNQT

SEQ ID NO: 183090 - protein, 14 aa, Mycobacterium tuberculosis
NNLGIGLTGDNQTG

SEQ ID NO: 183091 - protein, 14 aa, Mycobacterium tuberculosis
NLGIGLTGDNQTGI

SEQ ID NO: 183092 - protein, 14 aa, Mycobacterium tuberculosis
LGIGLTGDNQTGIG

SEQ ID NO: 183093 - protein, 14 aa, Mycobacterium tuberculosis
GIGLTGDNQTGIGG

SEQ ID NO: 183094 - protein, 14 aa, Mycobacterium tuberculosis
IGLTGDNQTGIGGL

SEQ ID NO: 183095 - protein, 14 aa, Mycobacterium tuberculosis
GLTGDNQTGIGGLN

SEQ ID NO: 183096 - protein, 14 aa, Mycobacterium tuberculosis
LTGDNQTGIGGLNS

SEQ ID NO: 183097 - protein, 14 aa, Mycobacterium tuberculosis
TGDNQTGIGGLNSG

SEQ ID NO: 183098 - protein, 14 aa, Mycobacterium tuberculosis
GDNQTGIGGLNSGA

SEQ ID NO: 183099 - protein, 14 aa, Mycobacterium tuberculosis
DNQTGIGGLNSGAG

SEQ ID NO: 183100 - protein, 14 aa, Mycobacterium tuberculosis
NQTGIGGLNSGAGN

SEQ ID NO: 183101 - protein, 14 aa, Mycobacterium tuberculosis
QTGIGGLNSGAGNI

SEQ ID NO: 183102 - protein, 14 aa, Mycobacterium tuberculosis
TGIGGLNSGAGNIG

SEQ ID NO: 183103 - protein, 14 aa, Mycobacterium tuberculosis
GIGGLNSGAGNIGL

SEQ ID NO: 183104 - protein, 14 aa, Mycobacterium tuberculosis
IGGLNSGAGNIGLF

SEQ ID NO: 183105 - protein, 14 aa, Mycobacterium tuberculosis
GGLNSGAGNIGLFN

SEQ ID NO: 183106 - protein, 14 aa, Mycobacterium tuberculosis
GLNSGAGNIGLFNS

SEQ ID NO: 183107 - protein, 14 aa, Mycobacterium tuberculosis
LNSGAGNIGLFNSG

SEQ ID NO: 183108 - protein, 14 aa, Mycobacterium tuberculosis
NSGAGNIGLFNSGT

SEQ ID NO: 183109 - protein, 14 aa, Mycobacterium tuberculosis
SGAGNIGLFNSGTG

SEQ ID NO: 183110 - protein, 14 aa, Mycobacterium tuberculosis
GAGNIGLFNSGTGN

SEQ ID NO: 183111 - protein, 14 aa, Mycobacterium tuberculosis
AGNIGLFNSGTGNI

SEQ ID NO: 183112 - protein, 14 aa, Mycobacterium tuberculosis
GNIGLFNSGTGNIG

SEQ ID NO: 183113 - protein, 14 aa, Mycobacterium tuberculosis
NIGLFNSGTGNIGF

SEQ ID NO: 183114 - protein, 14 aa, Mycobacterium tuberculosis
IGLFNSGTGNIGFF

SEQ ID NO: 183115 - protein, 14 aa, Mycobacterium tuberculosis
GLFNSGTGNIGFFN

SEQ ID NO: 183116 - protein, 14 aa, Mycobacterium tuberculosis
LFNSGTGNIGFFNS

SEQ ID NO: 183117 - protein, 14 aa, Mycobacterium tuberculosis
FNSGTGNIGFFNSG

SEQ ID NO: 183118 - protein, 14 aa, Mycobacterium tuberculosis
NSGTGNIGFFNSGT

SEQ ID NO: 183119 - protein, 14 aa, Mycobacterium tuberculosis
SGTGNIGFFNSGTG

SEQ ID NO: 183120 - protein, 14 aa, Mycobacterium tuberculosis
GTGNIGFFNSGTGN

SEQ ID NO: 183121 - protein, 14 aa, Mycobacterium tuberculosis
TGNIGFFNSGTGNW

SEQ ID NO: 183122 - protein, 14 aa, Mycobacterium tuberculosis
GNIGFFNSGTGNWG

SEQ ID NO: 183123 - protein, 14 aa, Mycobacterium tuberculosis
NIGFFNSGTGNWGL

SEQ ID NO: 183124 - protein, 14 aa, Mycobacterium tuberculosis
IGFFNSGTGNWGLF

SEQ ID NO: 183125 - protein, 14 aa, Mycobacterium tuberculosis
GFFNSGTGNWGLFN

SEQ ID NO: 183126 - protein, 14 aa, Mycobacterium tuberculosis
FFNSGTGNWGLFNS

SEQ ID NO: 183127 - protein, 14 aa, Mycobacterium tuberculosis
FNSGTGNWGLFNSG

SEQ ID NO: 183128 - protein, 14 aa, Mycobacterium tuberculosis
NSGTGNWGLFNSGS

SEQ ID NO: 183129 - protein, 14 aa, Mycobacterium tuberculosis
SGTGNWGLFNSGSF

SEQ ID NO: 183130 - protein, 14 aa, Mycobacterium tuberculosis
GTGNWGLFNSGSFN

SEQ ID NO: 183131 - protein, 14 aa, Mycobacterium tuberculosis
TGNWGLFNSGSFNT

SEQ ID NO: 183132 - protein, 14 aa, Mycobacterium tuberculosis
GNWGLFNSGSFNTG

SEQ ID NO: 183133 - protein, 14 aa, Mycobacterium tuberculosis
NWGLFNSGSFNTGI

SEQ ID NO: 183134 - protein, 14 aa, Mycobacterium tuberculosis
WGLFNSGSFNTGIG

SEQ ID NO: 183135 - protein, 14 aa, Mycobacterium tuberculosis
GLFNSGSFNTGIGN

SEQ ID NO: 183136 - protein, 14 aa, Mycobacterium tuberculosis
LFNSGSFNTGIGNS

SEQ ID NO: 183137 - protein, 14 aa, Mycobacterium tuberculosis
FNSGSFNTGIGNSG

SEQ ID NO: 183138 - protein, 14 aa, Mycobacterium tuberculosis
NSGSFNTGIGNSGT

SEQ ID NO: 183139 - protein, 14 aa, Mycobacterium tuberculosis
SGSFNTGIGNSGTG

SEQ ID NO: 183140 - protein, 14 aa, Mycobacterium tuberculosis
GSFNTGIGNSGTGS

SEQ ID NO: 183141 - protein, 14 aa, Mycobacterium tuberculosis
SFNTGIGNSGTGST

SEQ ID NO: 183142 - protein, 14 aa, Mycobacterium tuberculosis
FNTGIGNSGTGSTG

SEQ ID NO: 183143 - protein, 14 aa, Mycobacterium tuberculosis
NTGIGNSGTGSTGL

SEQ ID NO: 183144 - protein, 14 aa, Mycobacterium tuberculosis
TGIGNSGTGSTGLF

SEQ ID NO: 183145 - protein, 14 aa, Mycobacterium tuberculosis
GIGNSGTGSTGLFN

SEQ ID NO: 183146 - protein, 14 aa, Mycobacterium tuberculosis
IGNSGTGSTGLFNA

SEQ ID NO: 183147 - protein, 14 aa, Mycobacterium tuberculosis
GNSGTGSTGLFNAG

SEQ ID NO: 183148 - protein, 14 aa, Mycobacterium tuberculosis
NSGTGSTGLFNAGG

SEQ ID NO: 183149 - protein, 14 aa, Mycobacterium tuberculosis
SGTGSTGLFNAGGF

SEQ ID NO: 183150 - protein, 14 aa, Mycobacterium tuberculosis
GTGSTGLFNAGGFT

SEQ ID NO: 183151 - protein, 14 aa, Mycobacterium tuberculosis
TGSTGLFNAGGFTT

SEQ ID NO: 183152 - protein, 14 aa, Mycobacterium tuberculosis
GSTGLFNAGGFTTG

SEQ ID NO: 183153 - protein, 14 aa, Mycobacterium tuberculosis
STGLFNAGGFTTGL

SEQ ID NO: 183154 - protein, 14 aa, Mycobacterium tuberculosis
TGLFNAGGFTTGLA

SEQ ID NO: 183155 - protein, 14 aa, Mycobacterium tuberculosis
GLFNAGGFTTGLAN

SEQ ID NO: 183156 - protein, 14 aa, Mycobacterium tuberculosis
LFNAGGFTTGLANA

SEQ ID NO: 183157 - protein, 14 aa, Mycobacterium tuberculosis
FNAGGFTTGLANAG

SEQ ID NO: 183158 - protein, 14 aa, Mycobacterium tuberculosis
NAGGFTTGLANAGS

SEQ ID NO: 183159 - protein, 14 aa, Mycobacterium tuberculosis
AGGFTTGLANAGSY

SEQ ID NO: 183160 - protein, 14 aa, Mycobacterium tuberculosis
GGFTTGLANAGSYN

SEQ ID NO: 183161 - protein, 14 aa, Mycobacterium tuberculosis
GFTTGLANAGSYNT

SEQ ID NO: 183162 - protein, 14 aa, Mycobacterium tuberculosis
FTTGLANAGSYNTG

SEQ ID NO: 183163 - protein, 14 aa, Mycobacterium tuberculosis
TTGLANAGSYNTGS

SEQ ID NO: 183164 - protein, 14 aa, Mycobacterium tuberculosis
TGLANAGSYNTGSF

SEQ ID NO: 183165 - protein, 14 aa, Mycobacterium tuberculosis
GLANAGSYNTGSFN

SEQ ID NO: 183166 - protein, 14 aa, Mycobacterium tuberculosis
LANAGSYNTGSFNV

SEQ ID NO: 183167 - protein, 14 aa, Mycobacterium tuberculosis
ANAGSYNTGSFNVG

SEQ ID NO: 183168 - protein, 14 aa, Mycobacterium tuberculosis
NAGSYNTGSFNVGD

SEQ ID NO: 183169 - protein, 14 aa, Mycobacterium tuberculosis
AGSYNTGSFNVGDT

SEQ ID NO: 183170 - protein, 14 aa, Mycobacterium tuberculosis
GSYNTGSFNVGDTN

SEQ ID NO: 183171 - protein, 14 aa, Mycobacterium tuberculosis
SYNTGSFNVGDTNT

SEQ ID NO: 183172 - protein, 14 aa, Mycobacterium tuberculosis
YNTGSFNVGDTNTG

SEQ ID NO: 183173 - protein, 14 aa, Mycobacterium tuberculosis
NTGSFNVGDTNTGG

SEQ ID NO: 183174 - protein, 14 aa, Mycobacterium tuberculosis
TGSFNVGDTNTGGF

SEQ ID NO: 183175 - protein, 14 aa, Mycobacterium tuberculosis
GSFNVGDTNTGGFN

SEQ ID NO: 183176 - protein, 14 aa, Mycobacterium tuberculosis
SFNVGDTNTGGFNP

SEQ ID NO: 183177 - protein, 14 aa, Mycobacterium tuberculosis
FNVGDTNTGGFNPG

SEQ ID NO: 183178 - protein, 14 aa, Mycobacterium tuberculosis
NVGDTNTGGFNPGS

SEQ ID NO: 183179 - protein, 14 aa, Mycobacterium tuberculosis
VGDTNTGGFNPGSI

SEQ ID NO: 183180 - protein, 14 aa, Mycobacterium tuberculosis
GDTNTGGFNPGSIN

SEQ ID NO: 183181 - protein, 14 aa, Mycobacterium tuberculosis
DTNTGGFNPGSINT

SEQ ID NO: 183182 - protein, 14 aa, Mycobacterium tuberculosis
TNTGGFNPGSINTG

SEQ ID NO: 183183 - protein, 14 aa, Mycobacterium tuberculosis
NTGGFNPGSINTGW

SEQ ID NO: 183184 - protein, 14 aa, Mycobacterium tuberculosis
TGGFNPGSINTGWF

SEQ ID NO: 183185 - protein, 14 aa, Mycobacterium tuberculosis
GGFNPGSINTGWFN

SEQ ID NO: 183186 - protein, 14 aa, Mycobacterium tuberculosis
GFNPGSINTGWFNT

SEQ ID NO: 183187 - protein, 14 aa, Mycobacterium tuberculosis
FNPGSINTGWFNTG

SEQ ID NO: 183188 - protein, 14 aa, Mycobacterium tuberculosis
NPGSINTGWFNTGN

SEQ ID NO: 183189 - protein, 14 aa, Mycobacterium tuberculosis
PGSINTGWFNTGNA

SEQ ID NO: 183190 - protein, 14 aa, Mycobacterium tuberculosis
GSINTGWFNTGNAN

SEQ ID NO: 183191 - protein, 14 aa, Mycobacterium tuberculosis
SINTGWFNTGNANT

SEQ ID NO: 183192 - protein, 14 aa, Mycobacterium tuberculosis
INTGWFNTGNANTG

SEQ ID NO: 183193 - protein, 14 aa, Mycobacterium tuberculosis
NTGWFNTGNANTGI

SEQ ID NO: 183194 - protein, 14 aa, Mycobacterium tuberculosis
TGWFNTGNANTGIA

SEQ ID NO: 183195 - protein, 14 aa, Mycobacterium tuberculosis
GWFNTGNANTGIAN

SEQ ID NO: 183196 - protein, 14 aa, Mycobacterium tuberculosis
WFNTGNANTGIANS

SEQ ID NO: 183197 - protein, 14 aa, Mycobacterium tuberculosis
FNTGNANTGIANSG

SEQ ID NO: 183198 - protein, 14 aa, Mycobacterium tuberculosis
NTGNANTGIANSGN

SEQ ID NO: 183199 - protein, 14 aa, Mycobacterium tuberculosis
TGNANTGIANSGNV

SEQ ID NO: 183200 - protein, 14 aa, Mycobacterium tuberculosis
GNANTGIANSGNVD

SEQ ID NO: 183201 - protein, 14 aa, Mycobacterium tuberculosis
NANTGIANSGNVDT

SEQ ID NO: 183202 - protein, 14 aa, Mycobacterium tuberculosis
ANTGIANSGNVDTG

SEQ ID NO: 183203 - protein, 14 aa, Mycobacterium tuberculosis
NTGIANSGNVDTGA

SEQ ID NO: 183204 - protein, 14 aa, Mycobacterium tuberculosis
TGIANSGNVDTGAL

SEQ ID NO: 183205 - protein, 14 aa, Mycobacterium tuberculosis
GIANSGNVDTGALM

SEQ ID NO: 183206 - protein, 14 aa, Mycobacterium tuberculosis
IANSGNVDTGALMS

SEQ ID NO: 183207 - protein, 14 aa, Mycobacterium tuberculosis
ANSGNVDTGALMSG

SEQ ID NO: 183208 - protein, 14 aa, Mycobacterium tuberculosis
NSGNVDTGALMSGN

SEQ ID NO: 183209 - protein, 14 aa, Mycobacterium tuberculosis
SGNVDTGALMSGNF

SEQ ID NO: 183210 - protein, 14 aa, Mycobacterium tuberculosis
GNVDTGALMSGNFS

SEQ ID NO: 183211 - protein, 14 aa, Mycobacterium tuberculosis
NVDTGALMSGNFSN

SEQ ID NO: 183212 - protein, 14 aa, Mycobacterium tuberculosis
VDTGALMSGNFSNG

SEQ ID NO: 183213 - protein, 14 aa, Mycobacterium tuberculosis
DTGALMSGNFSNGI

SEQ ID NO: 183214 - protein, 14 aa, Mycobacterium tuberculosis
TGALMSGNFSNGIL

SEQ ID NO: 183215 - protein, 14 aa, Mycobacterium tuberculosis
GALMSGNFSNGILW

SEQ ID NO: 183216 - protein, 14 aa, Mycobacterium tuberculosis
ALMSGNFSNGILWR

SEQ ID NO: 183217 - protein, 14 aa, Mycobacterium tuberculosis
LMSGNFSNGILWRG

SEQ ID NO: 183218 - protein, 14 aa, Mycobacterium tuberculosis
MSGNFSNGILWRGN

SEQ ID NO: 183219 - protein, 14 aa, Mycobacterium tuberculosis
SGNFSNGILWRGNY

SEQ ID NO: 183220 - protein, 14 aa, Mycobacterium tuberculosis
GNFSNGILWRGNYE

SEQ ID NO: 183221 - protein, 14 aa, Mycobacterium tuberculosis
NFSNGILWRGNYEG

SEQ ID NO: 183222 - protein, 14 aa, Mycobacterium tuberculosis
FSNGILWRGNYEGL

SEQ ID NO: 183223 - protein, 14 aa, Mycobacterium tuberculosis
SNGILWRGNYEGLF

SEQ ID NO: 183224 - protein, 14 aa, Mycobacterium tuberculosis
NGILWRGNYEGLFS

SEQ ID NO: 183225 - protein, 14 aa, Mycobacterium tuberculosis
GILWRGNYEGLFSY

SEQ ID NO: 183226 - protein, 14 aa, Mycobacterium tuberculosis
ILWRGNYEGLFSYS

SEQ ID NO: 183227 - protein, 14 aa, Mycobacterium tuberculosis
LWRGNYEGLFSYSY

SEQ ID NO: 183228 - protein, 14 aa, Mycobacterium tuberculosis
WRGNYEGLFSYSYS

SEQ ID NO: 183229 - protein, 14 aa, Mycobacterium tuberculosis
RGNYEGLFSYSYSL

SEQ ID NO: 183230 - protein, 14 aa, Mycobacterium tuberculosis
GNYEGLFSYSYSLD

SEQ ID NO: 183231 - protein, 14 aa, Mycobacterium tuberculosis
NYEGLFSYSYSLDV

SEQ ID NO: 183232 - protein, 14 aa, Mycobacterium tuberculosis
YEGLFSYSYSLDVP

SEQ ID NO: 183233 - protein, 14 aa, Mycobacterium tuberculosis
EGLFSYSYSLDVPR

SEQ ID NO: 183234 - protein, 14 aa, Mycobacterium tuberculosis
GLFSYSYSLDVPRI

SEQ ID NO: 183235 - protein, 14 aa, Mycobacterium tuberculosis
LFSYSYSLDVPRIT

SEQ ID NO: 183236 - protein, 14 aa, Mycobacterium tuberculosis
FSYSYSLDVPRITI

SEQ ID NO: 183237 - protein, 14 aa, Mycobacterium tuberculosis
SYSYSLDVPRITIL

SEQ ID NO: 183238 - protein, 14 aa, Mycobacterium tuberculosis
YSYSLDVPRITILD

SEQ ID NO: 183239 - protein, 14 aa, Mycobacterium tuberculosis
SYSLDVPRITILDA

SEQ ID NO: 183240 - protein, 14 aa, Mycobacterium tuberculosis
YSLDVPRITILDAH

SEQ ID NO: 183241 - protein, 14 aa, Mycobacterium tuberculosis
SLDVPRITILDAHF

SEQ ID NO: 183242 - protein, 14 aa, Mycobacterium tuberculosis
LDVPRITILDAHFT

SEQ ID NO: 183243 - protein, 14 aa, Mycobacterium tuberculosis
DVPRITILDAHFTG

SEQ ID NO: 183244 - protein, 14 aa, Mycobacterium tuberculosis
VPRITILDAHFTGA

SEQ ID NO: 183245 - protein, 14 aa, Mycobacterium tuberculosis
PRITILDAHFTGAF

SEQ ID NO: 183246 - protein, 14 aa, Mycobacterium tuberculosis
RITILDAHFTGAFG

SEQ ID NO: 183247 - protein, 14 aa, Mycobacterium tuberculosis
ITILDAHFTGAFGP

SEQ ID NO: 183248 - protein, 14 aa, Mycobacterium tuberculosis
TILDAHFTGAFGPV

SEQ ID NO: 183249 - protein, 14 aa, Mycobacterium tuberculosis
ILDAHFTGAFGPVV

SEQ ID NO: 183250 - protein, 14 aa, Mycobacterium tuberculosis
LDAHFTGAFGPVVV

SEQ ID NO: 183251 - protein, 14 aa, Mycobacterium tuberculosis
DAHFTGAFGPVVVP

SEQ ID NO: 183252 - protein, 14 aa, Mycobacterium tuberculosis
AHFTGAFGPVVVPP

SEQ ID NO: 183253 - protein, 14 aa, Mycobacterium tuberculosis
HFTGAFGPVVVPPI

SEQ ID NO: 183254 - protein, 14 aa, Mycobacterium tuberculosis
FTGAFGPVVVPPIP

SEQ ID NO: 183255 - protein, 14 aa, Mycobacterium tuberculosis
TGAFGPVVVPPIPV

SEQ ID NO: 183256 - protein, 14 aa, Mycobacterium tuberculosis
GAFGPVVVPPIPVL

SEQ ID NO: 183257 - protein, 14 aa, Mycobacterium tuberculosis
AFGPVVVPPIPVLA

SEQ ID NO: 183258 - protein, 14 aa, Mycobacterium tuberculosis
FGPVVVPPIPVLAI

SEQ ID NO: 183259 - protein, 14 aa, Mycobacterium tuberculosis
GPVVVPPIPVLAIN

SEQ ID NO: 183260 - protein, 14 aa, Mycobacterium tuberculosis
PVVVPPIPVLAINA

SEQ ID NO: 183261 - protein, 14 aa, Mycobacterium tuberculosis
VVVPPIPVLAINAH

SEQ ID NO: 183262 - protein, 14 aa, Mycobacterium tuberculosis
VVPPIPVLAINAHL

SEQ ID NO: 183263 - protein, 14 aa, Mycobacterium tuberculosis
VPPIPVLAINAHLT

SEQ ID NO: 183264 - protein, 14 aa, Mycobacterium tuberculosis
PPIPVLAINAHLTG

SEQ ID NO: 183265 - protein, 14 aa, Mycobacterium tuberculosis
PIPVLAINAHLTGN

SEQ ID NO: 183266 - protein, 14 aa, Mycobacterium tuberculosis
IPVLAINAHLTGNA

SEQ ID NO: 183267 - protein, 14 aa, Mycobacterium tuberculosis
PVLAINAHLTGNAA

SEQ ID NO: 183268 - protein, 14 aa, Mycobacterium tuberculosis
VLAINAHLTGNAAM

SEQ ID NO: 183269 - protein, 14 aa, Mycobacterium tuberculosis
LAINAHLTGNAAMG

SEQ ID NO: 183270 - protein, 14 aa, Mycobacterium tuberculosis
AINAHLTGNAAMGA

SEQ ID NO: 183271 - protein, 14 aa, Mycobacterium tuberculosis
INAHLTGNAAMGAF

SEQ ID NO: 183272 - protein, 14 aa, Mycobacterium tuberculosis
NAHLTGNAAMGAFT

SEQ ID NO: 183273 - protein, 14 aa, Mycobacterium tuberculosis
AHLTGNAAMGAFTI

SEQ ID NO: 183274 - protein, 14 aa, Mycobacterium tuberculosis
HLTGNAAMGAFTIP

SEQ ID NO: 183275 - protein, 14 aa, Mycobacterium tuberculosis
LTGNAAMGAFTIPQ

SEQ ID NO: 183276 - protein, 14 aa, Mycobacterium tuberculosis
TGNAAMGAFTIPQI

SEQ ID NO: 183277 - protein, 14 aa, Mycobacterium tuberculosis
GNAAMGAFTIPQID

SEQ ID NO: 183278 - protein, 14 aa, Mycobacterium tuberculosis
NAAMGAFTIPQIDI

SEQ ID NO: 183279 - protein, 14 aa, Mycobacterium tuberculosis
AAMGAFTIPQIDIP

SEQ ID NO: 183280 - protein, 14 aa, Mycobacterium tuberculosis
AMGAFTIPQIDIPA

SEQ ID NO: 183281 - protein, 14 aa, Mycobacterium tuberculosis
MGAFTIPQIDIPAL

SEQ ID NO: 183282 - protein, 14 aa, Mycobacterium tuberculosis
GAFTIPQIDIPALN

SEQ ID NO: 183283 - protein, 14 aa, Mycobacterium tuberculosis
AFTIPQIDIPALNP

SEQ ID NO: 183284 - protein, 14 aa, Mycobacterium tuberculosis
FTIPQIDIPALNPN

SEQ ID NO: 183285 - protein, 14 aa, Mycobacterium tuberculosis
TIPQIDIPALNPNV

SEQ ID NO: 183286 - protein, 14 aa, Mycobacterium tuberculosis
IPQIDIPALNPNVT

SEQ ID NO: 183287 - protein, 14 aa, Mycobacterium tuberculosis
PQIDIPALNPNVTG

SEQ ID NO: 183288 - protein, 14 aa, Mycobacterium tuberculosis
QIDIPALNPNVTGS

SEQ ID NO: 183289 - protein, 14 aa, Mycobacterium tuberculosis
IDIPALNPNVTGSV

SEQ ID NO: 183290 - protein, 14 aa, Mycobacterium tuberculosis
DIPALNPNVTGSVG

SEQ ID NO: 183291 - protein, 14 aa, Mycobacterium tuberculosis
IPALNPNVTGSVGF

SEQ ID NO: 183292 - protein, 14 aa, Mycobacterium tuberculosis
PALNPNVTGSVGFG

SEQ ID NO: 183293 - protein, 14 aa, Mycobacterium tuberculosis
ALNPNVTGSVGFGP

SEQ ID NO: 183294 - protein, 14 aa, Mycobacterium tuberculosis
LNPNVTGSVGFGPI

SEQ ID NO: 183295 - protein, 14 aa, Mycobacterium tuberculosis
NPNVTGSVGFGPIA

SEQ ID NO: 183296 - protein, 14 aa, Mycobacterium tuberculosis
PNVTGSVGFGPIAV

SEQ ID NO: 183297 - protein, 14 aa, Mycobacterium tuberculosis
NVTGSVGFGPIAVP

SEQ ID NO: 183298 - protein, 14 aa, Mycobacterium tuberculosis
VTGSVGFGPIAVPS

SEQ ID NO: 183299 - protein, 14 aa, Mycobacterium tuberculosis
TGSVGFGPIAVPSV

SEQ ID NO: 183300 - protein, 14 aa, Mycobacterium tuberculosis
GSVGFGPIAVPSVT

SEQ ID NO: 183301 - protein, 14 aa, Mycobacterium tuberculosis
SVGFGPIAVPSVTI

SEQ ID NO: 183302 - protein, 14 aa, Mycobacterium tuberculosis
VGFGPIAVPSVTIP

SEQ ID NO: 183303 - protein, 14 aa, Mycobacterium tuberculosis
GFGPIAVPSVTIPA

SEQ ID NO: 183304 - protein, 14 aa, Mycobacterium tuberculosis
FGPIAVPSVTIPAL

SEQ ID NO: 183305 - protein, 14 aa, Mycobacterium tuberculosis
GPIAVPSVTIPALT

SEQ ID NO: 183306 - protein, 14 aa, Mycobacterium tuberculosis
PIAVPSVTIPALTA

SEQ ID NO: 183307 - protein, 14 aa, Mycobacterium tuberculosis
IAVPSVTIPALTAA

SEQ ID NO: 183308 - protein, 14 aa, Mycobacterium tuberculosis
AVPSVTIPALTAAR

SEQ ID NO: 183309 - protein, 14 aa, Mycobacterium tuberculosis
VPSVTIPALTAARA

SEQ ID NO: 183310 - protein, 14 aa, Mycobacterium tuberculosis
PSVTIPALTAARAV

SEQ ID NO: 183311 - protein, 14 aa, Mycobacterium tuberculosis
SVTIPALTAARAVL

SEQ ID NO: 183312 - protein, 14 aa, Mycobacterium tuberculosis
VTIPALTAARAVLD

SEQ ID NO: 183313 - protein, 14 aa, Mycobacterium tuberculosis
TIPALTAARAVLDM

SEQ ID NO: 183314 - protein, 14 aa, Mycobacterium tuberculosis
IPALTAARAVLDMA

SEQ ID NO: 183315 - protein, 14 aa, Mycobacterium tuberculosis
PALTAARAVLDMAA

SEQ ID NO: 183316 - protein, 14 aa, Mycobacterium tuberculosis
ALTAARAVLDMAAS

SEQ ID NO: 183317 - protein, 14 aa, Mycobacterium tuberculosis
LTAARAVLDMAASV

SEQ ID NO: 183318 - protein, 14 aa, Mycobacterium tuberculosis
TAARAVLDMAASVG

SEQ ID NO: 183319 - protein, 14 aa, Mycobacterium tuberculosis
AARAVLDMAASVGA

SEQ ID NO: 183320 - protein, 14 aa, Mycobacterium tuberculosis
ARAVLDMAASVGAT

SEQ ID NO: 183321 - protein, 14 aa, Mycobacterium tuberculosis
RAVLDMAASVGATS

SEQ ID NO: 183322 - protein, 14 aa, Mycobacterium tuberculosis
AVLDMAASVGATSE

SEQ ID NO: 183323 - protein, 14 aa, Mycobacterium tuberculosis
VLDMAASVGATSEI

SEQ ID NO: 183324 - protein, 14 aa, Mycobacterium tuberculosis
LDMAASVGATSEIE

SEQ ID NO: 183325 - protein, 14 aa, Mycobacterium tuberculosis
DMAASVGATSEIEP

SEQ ID NO: 183326 - protein, 14 aa, Mycobacterium tuberculosis
MAASVGATSEIEPF

SEQ ID NO: 183327 - protein, 14 aa, Mycobacterium tuberculosis
AASVGATSEIEPFI

SEQ ID NO: 183328 - protein, 14 aa, Mycobacterium tuberculosis
ASVGATSEIEPFIV

SEQ ID NO: 183329 - protein, 14 aa, Mycobacterium tuberculosis
SVGATSEIEPFIVW

SEQ ID NO: 183330 - protein, 14 aa, Mycobacterium tuberculosis
VGATSEIEPFIVWT

SEQ ID NO: 183331 - protein, 14 aa, Mycobacterium tuberculosis
GATSEIEPFIVWTS

SEQ ID NO: 183332 - protein, 14 aa, Mycobacterium tuberculosis
ATSEIEPFIVWTSS

SEQ ID NO: 183333 - protein, 14 aa, Mycobacterium tuberculosis
TSEIEPFIVWTSSG

SEQ ID NO: 183334 - protein, 14 aa, Mycobacterium tuberculosis
SEIEPFIVWTSSGA

SEQ ID NO: 183335 - protein, 14 aa, Mycobacterium tuberculosis
EIEPFIVWTSSGAI

SEQ ID NO: 183336 - protein, 14 aa, Mycobacterium tuberculosis
IEPFIVWTSSGAIG

SEQ ID NO: 183337 - protein, 14 aa, Mycobacterium tuberculosis
EPFIVWTSSGAIGP

SEQ ID NO: 183338 - protein, 14 aa, Mycobacterium tuberculosis
PFIVWTSSGAIGPT

SEQ ID NO: 183339 - protein, 14 aa, Mycobacterium tuberculosis
FIVWTSSGAIGPTW

SEQ ID NO: 183340 - protein, 14 aa, Mycobacterium tuberculosis
IVWTSSGAIGPTWY

SEQ ID NO: 183341 - protein, 14 aa, Mycobacterium tuberculosis
VWTSSGAIGPTWYS

SEQ ID NO: 183342 - protein, 14 aa, Mycobacterium tuberculosis
WTSSGAIGPTWYSV

SEQ ID NO: 183343 - protein, 14 aa, Mycobacterium tuberculosis
TSSGAIGPTWYSVG

SEQ ID NO: 183344 - protein, 14 aa, Mycobacterium tuberculosis
SSGAIGPTWYSVGR

SEQ ID NO: 183345 - protein, 14 aa, Mycobacterium tuberculosis
SGAIGPTWYSVGRI

SEQ ID NO: 183346 - protein, 14 aa, Mycobacterium tuberculosis
GAIGPTWYSVGRIY

SEQ ID NO: 183347 - protein, 14 aa, Mycobacterium tuberculosis
AIGPTWYSVGRIYN

SEQ ID NO: 183348 - protein, 14 aa, Mycobacterium tuberculosis
IGPTWYSVGRIYNA

SEQ ID NO: 183349 - protein, 14 aa, Mycobacterium tuberculosis
GPTWYSVGRIYNAG

SEQ ID NO: 183350 - protein, 14 aa, Mycobacterium tuberculosis
PTWYSVGRIYNAGD

SEQ ID NO: 183351 - protein, 14 aa, Mycobacterium tuberculosis
TWYSVGRIYNAGDL

SEQ ID NO: 183352 - protein, 14 aa, Mycobacterium tuberculosis
WYSVGRIYNAGDLF

SEQ ID NO: 183353 - protein, 14 aa, Mycobacterium tuberculosis
YSVGRIYNAGDLFV

SEQ ID NO: 183354 - protein, 14 aa, Mycobacterium tuberculosis
SVGRIYNAGDLFVG

SEQ ID NO: 183355 - protein, 14 aa, Mycobacterium tuberculosis
VGRIYNAGDLFVGG

SEQ ID NO: 183356 - protein, 14 aa, Mycobacterium tuberculosis
GRIYNAGDLFVGGN

SEQ ID NO: 183357 - protein, 14 aa, Mycobacterium tuberculosis
RIYNAGDLFVGGNI

SEQ ID NO: 183358 - protein, 14 aa, Mycobacterium tuberculosis
IYNAGDLFVGGNII

SEQ ID NO: 183359 - protein, 14 aa, Mycobacterium tuberculosis
YNAGDLFVGGNIIS

SEQ ID NO: 183360 - protein, 14 aa, Mycobacterium tuberculosis
NAGDLFVGGNIISG

SEQ ID NO: 183361 - protein, 14 aa, Mycobacterium tuberculosis
AGDLFVGGNIISGI

SEQ ID NO: 183362 - protein, 14 aa, Mycobacterium tuberculosis
GDLFVGGNIISGIP

SEQ ID NO: 183363 - protein, 14 aa, Mycobacterium tuberculosis
DLFVGGNIISGIPT

SEQ ID NO: 183364 - protein, 14 aa, Mycobacterium tuberculosis
LFVGGNIISGIPTL

SEQ ID NO: 183365 - protein, 14 aa, Mycobacterium tuberculosis
FVGGNIISGIPTLS

SEQ ID NO: 183366 - protein, 14 aa, Mycobacterium tuberculosis
VGGNIISGIPTLST

SEQ ID NO: 183367 - protein, 14 aa, Mycobacterium tuberculosis
GGNIISGIPTLSTT

SEQ ID NO: 183368 - protein, 14 aa, Mycobacterium tuberculosis
GNIISGIPTLSTTG

SEQ ID NO: 183369 - protein, 14 aa, Mycobacterium tuberculosis
NIISGIPTLSTTGP

SEQ ID NO: 183370 - protein, 14 aa, Mycobacterium tuberculosis
IISGIPTLSTTGPV

SEQ ID NO: 183371 - protein, 14 aa, Mycobacterium tuberculosis
ISGIPTLSTTGPVH

SEQ ID NO: 183372 - protein, 14 aa, Mycobacterium tuberculosis
SGIPTLSTTGPVHA

SEQ ID NO: 183373 - protein, 14 aa, Mycobacterium tuberculosis
GIPTLSTTGPVHAV

SEQ ID NO: 183374 - protein, 14 aa, Mycobacterium tuberculosis
IPTLSTTGPVHAVF

SEQ ID NO: 183375 - protein, 14 aa, Mycobacterium tuberculosis
PTLSTTGPVHAVFN

SEQ ID NO: 183376 - protein, 14 aa, Mycobacterium tuberculosis
TLSTTGPVHAVFNA

SEQ ID NO: 183377 - protein, 14 aa, Mycobacterium tuberculosis
LSTTGPVHAVFNAA

SEQ ID NO: 183378 - protein, 14 aa, Mycobacterium tuberculosis
STTGPVHAVFNAAS

SEQ ID NO: 183379 - protein, 14 aa, Mycobacterium tuberculosis
TTGPVHAVFNAASQ

SEQ ID NO: 183380 - protein, 14 aa, Mycobacterium tuberculosis
TGPVHAVFNAASQA

SEQ ID NO: 183381 - protein, 14 aa, Mycobacterium tuberculosis
GPVHAVFNAASQAF

SEQ ID NO: 183382 - protein, 14 aa, Mycobacterium tuberculosis
PVHAVFNAASQAFN

SEQ ID NO: 183383 - protein, 14 aa, Mycobacterium tuberculosis
VHAVFNAASQAFNT

SEQ ID NO: 183384 - protein, 14 aa, Mycobacterium tuberculosis
HAVFNAASQAFNTP

SEQ ID NO: 183385 - protein, 14 aa, Mycobacterium tuberculosis
AVFNAASQAFNTPA

SEQ ID NO: 183386 - protein, 14 aa, Mycobacterium tuberculosis
VFNAASQAFNTPAL

SEQ ID NO: 183387 - protein, 14 aa, Mycobacterium tuberculosis
FNAASQAFNTPALN

SEQ ID NO: 183388 - protein, 14 aa, Mycobacterium tuberculosis
NAASQAFNTPALNI

SEQ ID NO: 183389 - protein, 14 aa, Mycobacterium tuberculosis
AASQAFNTPALNIH

SEQ ID NO: 183390 - protein, 14 aa, Mycobacterium tuberculosis
ASQAFNTPALNIHQ

SEQ ID NO: 183391 - protein, 14 aa, Mycobacterium tuberculosis
SQAFNTPALNIHQI

SEQ ID NO: 183392 - protein, 14 aa, Mycobacterium tuberculosis
QAFNTPALNIHQIP

SEQ ID NO: 183393 - protein, 14 aa, Mycobacterium tuberculosis
AFNTPALNIHQIPL

SEQ ID NO: 183394 - protein, 14 aa, Mycobacterium tuberculosis
FNTPALNIHQIPLG

SEQ ID NO: 183395 - protein, 14 aa, Mycobacterium tuberculosis
NTPALNIHQIPLGF

SEQ ID NO: 183396 - protein, 14 aa, Mycobacterium tuberculosis
TPALNIHQIPLGFQ

SEQ ID NO: 183397 - protein, 14 aa, Mycobacterium tuberculosis
PALNIHQIPLGFQV

SEQ ID NO: 183398 - protein, 14 aa, Mycobacterium tuberculosis
ALNIHQIPLGFQVP

SEQ ID NO: 183399 - protein, 14 aa, Mycobacterium tuberculosis
LNIHQIPLGFQVPG

SEQ ID NO: 183400 - protein, 14 aa, Mycobacterium tuberculosis
NIHQIPLGFQVPGS

SEQ ID NO: 183401 - protein, 14 aa, Mycobacterium tuberculosis
IHQIPLGFQVPGSI

SEQ ID NO: 183402 - protein, 14 aa, Mycobacterium tuberculosis
HQIPLGFQVPGSID

SEQ ID NO: 183403 - protein, 14 aa, Mycobacterium tuberculosis
QIPLGFQVPGSIDA

SEQ ID NO: 183404 - protein, 14 aa, Mycobacterium tuberculosis
IPLGFQVPGSIDAI

SEQ ID NO: 183405 - protein, 14 aa, Mycobacterium tuberculosis
PLGFQVPGSIDAIT

SEQ ID NO: 183406 - protein, 14 aa, Mycobacterium tuberculosis
LGFQVPGSIDAITL

SEQ ID NO: 183407 - protein, 14 aa, Mycobacterium tuberculosis
GFQVPGSIDAITLF

SEQ ID NO: 183408 - protein, 14 aa, Mycobacterium tuberculosis
FQVPGSIDAITLFP

SEQ ID NO: 183409 - protein, 14 aa, Mycobacterium tuberculosis
QVPGSIDAITLFPG

SEQ ID NO: 183410 - protein, 14 aa, Mycobacterium tuberculosis
VPGSIDAITLFPGG

SEQ ID NO: 183411 - protein, 14 aa, Mycobacterium tuberculosis
PGSIDAITLFPGGL

SEQ ID NO: 183412 - protein, 14 aa, Mycobacterium tuberculosis
GSIDAITLFPGGLT

SEQ ID NO: 183413 - protein, 14 aa, Mycobacterium tuberculosis
SIDAITLFPGGLTF

SEQ ID NO: 183414 - protein, 14 aa, Mycobacterium tuberculosis
IDAITLFPGGLTFP

SEQ ID NO: 183415 - protein, 14 aa, Mycobacterium tuberculosis
DAITLFPGGLTFPA

SEQ ID NO: 183416 - protein, 14 aa, Mycobacterium tuberculosis
AITLFPGGLTFPAN

SEQ ID NO: 183417 - protein, 14 aa, Mycobacterium tuberculosis
ITLFPGGLTFPANS

SEQ ID NO: 183418 - protein, 14 aa, Mycobacterium tuberculosis
TLFPGGLTFPANSL

SEQ ID NO: 183419 - protein, 14 aa, Mycobacterium tuberculosis
LFPGGLTFPANSLL

SEQ ID NO: 183420 - protein, 14 aa, Mycobacterium tuberculosis
FPGGLTFPANSLLN

SEQ ID NO: 183421 - protein, 14 aa, Mycobacterium tuberculosis
PGGLTFPANSLLNL

SEQ ID NO: 183422 - protein, 14 aa, Mycobacterium tuberculosis
GGLTFPANSLLNLD

SEQ ID NO: 183423 - protein, 14 aa, Mycobacterium tuberculosis
GLTFPANSLLNLDV

SEQ ID NO: 183424 - protein, 14 aa, Mycobacterium tuberculosis
LTFPANSLLNLDVF

SEQ ID NO: 183425 - protein, 14 aa, Mycobacterium tuberculosis
TFPANSLLNLDVFV

SEQ ID NO: 183426 - protein, 14 aa, Mycobacterium tuberculosis
FPANSLLNLDVFVG

SEQ ID NO: 183427 - protein, 14 aa, Mycobacterium tuberculosis
PANSLLNLDVFVGT

SEQ ID NO: 183428 - protein, 14 aa, Mycobacterium tuberculosis
ANSLLNLDVFVGTP

SEQ ID NO: 183429 - protein, 14 aa, Mycobacterium tuberculosis
NSLLNLDVFVGTPG

SEQ ID NO: 183430 - protein, 14 aa, Mycobacterium tuberculosis
SLLNLDVFVGTPGA

SEQ ID NO: 183431 - protein, 14 aa, Mycobacterium tuberculosis
LLNLDVFVGTPGAT

SEQ ID NO: 183432 - protein, 14 aa, Mycobacterium tuberculosis
LNLDVFVGTPGATI

SEQ ID NO: 183433 - protein, 14 aa, Mycobacterium tuberculosis
NLDVFVGTPGATIP

SEQ ID NO: 183434 - protein, 14 aa, Mycobacterium tuberculosis
LDVFVGTPGATIPA

SEQ ID NO: 183435 - protein, 14 aa, Mycobacterium tuberculosis
DVFVGTPGATIPAI

SEQ ID NO: 183436 - protein, 14 aa, Mycobacterium tuberculosis
VFVGTPGATIPAIT

SEQ ID NO: 183437 - protein, 14 aa, Mycobacterium tuberculosis
FVGTPGATIPAITF

SEQ ID NO: 183438 - protein, 14 aa, Mycobacterium tuberculosis
VGTPGATIPAITFP

SEQ ID NO: 183439 - protein, 14 aa, Mycobacterium tuberculosis
GTPGATIPAITFPE

SEQ ID NO: 183440 - protein, 14 aa, Mycobacterium tuberculosis
TPGATIPAITFPEI

SEQ ID NO: 183441 - protein, 14 aa, Mycobacterium tuberculosis
PGATIPAITFPEIP

SEQ ID NO: 183442 - protein, 14 aa, Mycobacterium tuberculosis
GATIPAITFPEIPA

SEQ ID NO: 183443 - protein, 14 aa, Mycobacterium tuberculosis
ATIPAITFPEIPAN

SEQ ID NO: 183444 - protein, 14 aa, Mycobacterium tuberculosis
TIPAITFPEIPANA

SEQ ID NO: 183445 - protein, 14 aa, Mycobacterium tuberculosis
IPAITFPEIPANAD

SEQ ID NO: 183446 - protein, 14 aa, Mycobacterium tuberculosis
PAITFPEIPANADG

SEQ ID NO: 183447 - protein, 14 aa, Mycobacterium tuberculosis
AITFPEIPANADGE

SEQ ID NO: 183448 - protein, 14 aa, Mycobacterium tuberculosis
ITFPEIPANADGEL

SEQ ID NO: 183449 - protein, 14 aa, Mycobacterium tuberculosis
TFPEIPANADGELY

SEQ ID NO: 183450 - protein, 14 aa, Mycobacterium tuberculosis
FPEIPANADGELYV

SEQ ID NO: 183451 - protein, 14 aa, Mycobacterium tuberculosis
PEIPANADGELYVI

SEQ ID NO: 183452 - protein, 14 aa, Mycobacterium tuberculosis
EIPANADGELYVIA

SEQ ID NO: 183453 - protein, 14 aa, Mycobacterium tuberculosis
IPANADGELYVIAG

SEQ ID NO: 183454 - protein, 14 aa, Mycobacterium tuberculosis
PANADGELYVIAGD

SEQ ID NO: 183455 - protein, 14 aa, Mycobacterium tuberculosis
ANADGELYVIAGDI

SEQ ID NO: 183456 - protein, 14 aa, Mycobacterium tuberculosis
NADGELYVIAGDIP

SEQ ID NO: 183457 - protein, 14 aa, Mycobacterium tuberculosis
ADGELYVIAGDIPL

SEQ ID NO: 183458 - protein, 14 aa, Mycobacterium tuberculosis
DGELYVIAGDIPLI

SEQ ID NO: 183459 - protein, 14 aa, Mycobacterium tuberculosis
GELYVIAGDIPLIN

SEQ ID NO: 183460 - protein, 14 aa, Mycobacterium tuberculosis
ELYVIAGDIPLINI

SEQ ID NO: 183461 - protein, 14 aa, Mycobacterium tuberculosis
LYVIAGDIPLINIP

SEQ ID NO: 183462 - protein, 14 aa, Mycobacterium tuberculosis
YVIAGDIPLINIPP

SEQ ID NO: 183463 - protein, 14 aa, Mycobacterium tuberculosis
VIAGDIPLINIPPT

SEQ ID NO: 183464 - protein, 14 aa, Mycobacterium tuberculosis
IAGDIPLINIPPTP

SEQ ID NO: 183465 - protein, 14 aa, Mycobacterium tuberculosis
AGDIPLINIPPTPG

SEQ ID NO: 183466 - protein, 14 aa, Mycobacterium tuberculosis
GDIPLINIPPTPGI

SEQ ID NO: 183467 - protein, 14 aa, Mycobacterium tuberculosis
DIPLINIPPTPGIG

SEQ ID NO: 183468 - protein, 14 aa, Mycobacterium tuberculosis
IPLINIPPTPGIGN

SEQ ID NO: 183469 - protein, 14 aa, Mycobacterium tuberculosis
PLINIPPTPGIGNT

SEQ ID NO: 183470 - protein, 14 aa, Mycobacterium tuberculosis
LINIPPTPGIGNTT

SEQ ID NO: 183471 - protein, 14 aa, Mycobacterium tuberculosis
INIPPTPGIGNTTT

SEQ ID NO: 183472 - protein, 14 aa, Mycobacterium tuberculosis
NIPPTPGIGNTTTV

SEQ ID NO: 183473 - protein, 14 aa, Mycobacterium tuberculosis
IPPTPGIGNTTTVP

SEQ ID NO: 183474 - protein, 14 aa, Mycobacterium tuberculosis
PPTPGIGNTTTVPS

SEQ ID NO: 183475 - protein, 14 aa, Mycobacterium tuberculosis
PTPGIGNTTTVPSS

SEQ ID NO: 183476 - protein, 14 aa, Mycobacterium tuberculosis
TPGIGNTTTVPSSG

SEQ ID NO: 183477 - protein, 14 aa, Mycobacterium tuberculosis
PGIGNTTTVPSSGF

SEQ ID NO: 183478 - protein, 14 aa, Mycobacterium tuberculosis
GIGNTTTVPSSGFF

SEQ ID NO: 183479 - protein, 14 aa, Mycobacterium tuberculosis
IGNTTTVPSSGFFN

SEQ ID NO: 183480 - protein, 14 aa, Mycobacterium tuberculosis
GNTTTVPSSGFFNT

SEQ ID NO: 183481 - protein, 14 aa, Mycobacterium tuberculosis
NTTTVPSSGFFNTG

SEQ ID NO: 183482 - protein, 14 aa, Mycobacterium tuberculosis
TTTVPSSGFFNTGA

SEQ ID NO: 183483 - protein, 14 aa, Mycobacterium tuberculosis
TTVPSSGFFNTGAG

SEQ ID NO: 183484 - protein, 14 aa, Mycobacterium tuberculosis
TVPSSGFFNTGAGG

SEQ ID NO: 183485 - protein, 14 aa, Mycobacterium tuberculosis
VPSSGFFNTGAGGG

SEQ ID NO: 183486 - protein, 14 aa, Mycobacterium tuberculosis
PSSGFFNTGAGGGS

SEQ ID NO: 183487 - protein, 14 aa, Mycobacterium tuberculosis
SSGFFNTGAGGGSG

SEQ ID NO: 183488 - protein, 14 aa, Mycobacterium tuberculosis
SGFFNTGAGGGSGF

SEQ ID NO: 183489 - protein, 14 aa, Mycobacterium tuberculosis
GFFNTGAGGGSGFG

SEQ ID NO: 183490 - protein, 14 aa, Mycobacterium tuberculosis
FFNTGAGGGSGFGN

SEQ ID NO: 183491 - protein, 14 aa, Mycobacterium tuberculosis
FNTGAGGGSGFGNF

SEQ ID NO: 183492 - protein, 14 aa, Mycobacterium tuberculosis
NTGAGGGSGFGNFG

SEQ ID NO: 183493 - protein, 14 aa, Mycobacterium tuberculosis
TGAGGGSGFGNFGA

SEQ ID NO: 183494 - protein, 14 aa, Mycobacterium tuberculosis
GAGGGSGFGNFGAN

SEQ ID NO: 183495 - protein, 14 aa, Mycobacterium tuberculosis
AGGGSGFGNFGANM

SEQ ID NO: 183496 - protein, 14 aa, Mycobacterium tuberculosis
GGGSGFGNFGANMS

SEQ ID NO: 183497 - protein, 14 aa, Mycobacterium tuberculosis
GGSGFGNFGANMSG

SEQ ID NO: 183498 - protein, 14 aa, Mycobacterium tuberculosis
GSGFGNFGANMSGW

SEQ ID NO: 183499 - protein, 14 aa, Mycobacterium tuberculosis
SGFGNFGANMSGWW

SEQ ID NO: 183500 - protein, 14 aa, Mycobacterium tuberculosis
GFGNFGANMSGWWN

SEQ ID NO: 183501 - protein, 14 aa, Mycobacterium tuberculosis
FGNFGANMSGWWNQ

SEQ ID NO: 183502 - protein, 14 aa, Mycobacterium tuberculosis
GNFGANMSGWWNQA

SEQ ID NO: 183503 - protein, 14 aa, Mycobacterium tuberculosis
NFGANMSGWWNQAH

SEQ ID NO: 183504 - protein, 14 aa, Mycobacterium tuberculosis
FGANMSGWWNQAHT

SEQ ID NO: 183505 - protein, 14 aa, Mycobacterium tuberculosis
GANMSGWWNQAHTA

SEQ ID NO: 183506 - protein, 14 aa, Mycobacterium tuberculosis
ANMSGWWNQAHTAL

SEQ ID NO: 183507 - protein, 14 aa, Mycobacterium tuberculosis
NMSGWWNQAHTALA

SEQ ID NO: 183508 - protein, 14 aa, Mycobacterium tuberculosis
MSGWWNQAHTALAG

SEQ ID NO: 183509 - protein, 14 aa, Mycobacterium tuberculosis
SGWWNQAHTALAGA

SEQ ID NO: 183510 - protein, 14 aa, Mycobacterium tuberculosis
GWWNQAHTALAGAG

SEQ ID NO: 183511 - protein, 14 aa, Mycobacterium tuberculosis
WWNQAHTALAGAGS

SEQ ID NO: 183512 - protein, 14 aa, Mycobacterium tuberculosis
WNQAHTALAGAGSG

SEQ ID NO: 183513 - protein, 14 aa, Mycobacterium tuberculosis
NQAHTALAGAGSGI

SEQ ID NO: 183514 - protein, 14 aa, Mycobacterium tuberculosis
QAHTALAGAGSGIA

SEQ ID NO: 183515 - protein, 14 aa, Mycobacterium tuberculosis
AHTALAGAGSGIAN

SEQ ID NO: 183516 - protein, 14 aa, Mycobacterium tuberculosis
HTALAGAGSGIANV

SEQ ID NO: 183517 - protein, 14 aa, Mycobacterium tuberculosis
TALAGAGSGIANVG

SEQ ID NO: 183518 - protein, 14 aa, Mycobacterium tuberculosis
ALAGAGSGIANVGT

SEQ ID NO: 183519 - protein, 14 aa, Mycobacterium tuberculosis
LAGAGSGIANVGTL

SEQ ID NO: 183520 - protein, 14 aa, Mycobacterium tuberculosis
AGAGSGIANVGTLH

SEQ ID NO: 183521 - protein, 14 aa, Mycobacterium tuberculosis
GAGSGIANVGTLHS

SEQ ID NO: 183522 - protein, 14 aa, Mycobacterium tuberculosis
AGSGIANVGTLHSG

SEQ ID NO: 183523 - protein, 14 aa, Mycobacterium tuberculosis
GSGIANVGTLHSGV

SEQ ID NO: 183524 - protein, 14 aa, Mycobacterium tuberculosis
SGIANVGTLHSGVL

SEQ ID NO: 183525 - protein, 14 aa, Mycobacterium tuberculosis
GIANVGTLHSGVLN

SEQ ID NO: 183526 - protein, 14 aa, Mycobacterium tuberculosis
IANVGTLHSGVLNL

SEQ ID NO: 183527 - protein, 14 aa, Mycobacterium tuberculosis
ANVGTLHSGVLNLG

SEQ ID NO: 183528 - protein, 14 aa, Mycobacterium tuberculosis
NVGTLHSGVLNLGS

SEQ ID NO: 183529 - protein, 14 aa, Mycobacterium tuberculosis
VGTLHSGVLNLGSG

SEQ ID NO: 183530 - protein, 14 aa, Mycobacterium tuberculosis
GTLHSGVLNLGSGL

SEQ ID NO: 183531 - protein, 14 aa, Mycobacterium tuberculosis
TLHSGVLNLGSGLS

SEQ ID NO: 183532 - protein, 14 aa, Mycobacterium tuberculosis
LHSGVLNLGSGLSG

SEQ ID NO: 183533 - protein, 14 aa, Mycobacterium tuberculosis
HSGVLNLGSGLSGI

SEQ ID NO: 183534 - protein, 14 aa, Mycobacterium tuberculosis
SGVLNLGSGLSGIY

SEQ ID NO: 183535 - protein, 14 aa, Mycobacterium tuberculosis
GVLNLGSGLSGIYN

SEQ ID NO: 183536 - protein, 14 aa, Mycobacterium tuberculosis
VLNLGSGLSGIYNT

SEQ ID NO: 183537 - protein, 14 aa, Mycobacterium tuberculosis
LNLGSGLSGIYNTS

SEQ ID NO: 183538 - protein, 14 aa, Mycobacterium tuberculosis
NLGSGLSGIYNTST

SEQ ID NO: 183539 - protein, 14 aa, Mycobacterium tuberculosis
LGSGLSGIYNTSTL

SEQ ID NO: 183540 - protein, 14 aa, Mycobacterium tuberculosis
GSGLSGIYNTSTLP

SEQ ID NO: 183541 - protein, 14 aa, Mycobacterium tuberculosis
SGLSGIYNTSTLPL

SEQ ID NO: 183542 - protein, 14 aa, Mycobacterium tuberculosis
GLSGIYNTSTLPLG

SEQ ID NO: 183543 - protein, 14 aa, Mycobacterium tuberculosis
LSGIYNTSTLPLGT

SEQ ID NO: 183544 - protein, 14 aa, Mycobacterium tuberculosis
SGIYNTSTLPLGTP

SEQ ID NO: 183545 - protein, 14 aa, Mycobacterium tuberculosis
GIYNTSTLPLGTPA

SEQ ID NO: 183546 - protein, 14 aa, Mycobacterium tuberculosis
IYNTSTLPLGTPAL

SEQ ID NO: 183547 - protein, 14 aa, Mycobacterium tuberculosis
YNTSTLPLGTPALV

SEQ ID NO: 183548 - protein, 14 aa, Mycobacterium tuberculosis
NTSTLPLGTPALVS

SEQ ID NO: 183549 - protein, 14 aa, Mycobacterium tuberculosis
TSTLPLGTPALVSG

SEQ ID NO: 183550 - protein, 14 aa, Mycobacterium tuberculosis
STLPLGTPALVSGL

SEQ ID NO: 183551 - protein, 14 aa, Mycobacterium tuberculosis
TLPLGTPALVSGLG

SEQ ID NO: 183552 - protein, 14 aa, Mycobacterium tuberculosis
LPLGTPALVSGLGN

SEQ ID NO: 183553 - protein, 14 aa, Mycobacterium tuberculosis
PLGTPALVSGLGNV

SEQ ID NO: 183554 - protein, 14 aa, Mycobacterium tuberculosis
LGTPALVSGLGNVG

SEQ ID NO: 183555 - protein, 14 aa, Mycobacterium tuberculosis
GTPALVSGLGNVGD

SEQ ID NO: 183556 - protein, 14 aa, Mycobacterium tuberculosis
TPALVSGLGNVGDH

SEQ ID NO: 183557 - protein, 14 aa, Mycobacterium tuberculosis
PALVSGLGNVGDHL

SEQ ID NO: 183558 - protein, 14 aa, Mycobacterium tuberculosis
ALVSGLGNVGDHLS

SEQ ID NO: 183559 - protein, 14 aa, Mycobacterium tuberculosis
LVSGLGNVGDHLSG

SEQ ID NO: 183560 - protein, 14 aa, Mycobacterium tuberculosis
VSGLGNVGDHLSGL

SEQ ID NO: 183561 - protein, 14 aa, Mycobacterium tuberculosis
SGLGNVGDHLSGLL

SEQ ID NO: 183562 - protein, 14 aa, Mycobacterium tuberculosis
GLGNVGDHLSGLLA

SEQ ID NO: 183563 - protein, 14 aa, Mycobacterium tuberculosis
LGNVGDHLSGLLAS

SEQ ID NO: 183564 - protein, 14 aa, Mycobacterium tuberculosis
GNVGDHLSGLLASN

SEQ ID NO: 183565 - protein, 14 aa, Mycobacterium tuberculosis
NVGDHLSGLLASNV

SEQ ID NO: 183566 - protein, 14 aa, Mycobacterium tuberculosis
VGDHLSGLLASNVG

SEQ ID NO: 183567 - protein, 14 aa, Mycobacterium tuberculosis
GDHLSGLLASNVGQ

SEQ ID NO: 183568 - protein, 14 aa, Mycobacterium tuberculosis
DHLSGLLASNVGQN

SEQ ID NO: 183569 - protein, 14 aa, Mycobacterium tuberculosis
HLSGLLASNVGQNP

SEQ ID NO: 183570 - protein, 14 aa, Mycobacterium tuberculosis
LSGLLASNVGQNPI

SEQ ID NO: 183571 - protein, 14 aa, Mycobacterium tuberculosis
SGLLASNVGQNPIT

SEQ ID NO: 183572 - protein, 14 aa, Mycobacterium tuberculosis
GLLASNVGQNPITI

SEQ ID NO: 183573 - protein, 14 aa, Mycobacterium tuberculosis
LLASNVGQNPITIV

SEQ ID NO: 183574 - protein, 14 aa, Mycobacterium tuberculosis
LASNVGQNPITIVN

SEQ ID NO: 183575 - protein, 14 aa, Mycobacterium tuberculosis
ASNVGQNPITIVNI

SEQ ID NO: 183576 - protein, 14 aa, Mycobacterium tuberculosis
SNVGQNPITIVNIG

SEQ ID NO: 183577 - protein, 14 aa, Mycobacterium tuberculosis
NVGQNPITIVNIGL

SEQ ID NO: 183578 - protein, 14 aa, Mycobacterium tuberculosis
VGQNPITIVNIGLA

SEQ ID NO: 183579 - protein, 14 aa, Mycobacterium tuberculosis
GQNPITIVNIGLAN

SEQ ID NO: 183580 - protein, 14 aa, Mycobacterium tuberculosis
QNPITIVNIGLANV

SEQ ID NO: 183581 - protein, 14 aa, Mycobacterium tuberculosis
NPITIVNIGLANVG

SEQ ID NO: 183582 - protein, 14 aa, Mycobacterium tuberculosis
PITIVNIGLANVGN

SEQ ID NO: 183583 - protein, 14 aa, Mycobacterium tuberculosis
ITIVNIGLANVGNG

SEQ ID NO: 183584 - protein, 14 aa, Mycobacterium tuberculosis
TIVNIGLANVGNGN

SEQ ID NO: 183585 - protein, 14 aa, Mycobacterium tuberculosis
IVNIGLANVGNGNV

SEQ ID NO: 183586 - protein, 14 aa, Mycobacterium tuberculosis
VNIGLANVGNGNVG

SEQ ID NO: 183587 - protein, 14 aa, Mycobacterium tuberculosis
NIGLANVGNGNVGL

SEQ ID NO: 183588 - protein, 14 aa, Mycobacterium tuberculosis
IGLANVGNGNVGLG

SEQ ID NO: 183589 - protein, 14 aa, Mycobacterium tuberculosis
GLANVGNGNVGLGN

SEQ ID NO: 183590 - protein, 14 aa, Mycobacterium tuberculosis
LANVGNGNVGLGNI

SEQ ID NO: 183591 - protein, 14 aa, Mycobacterium tuberculosis
ANVGNGNVGLGNIG

SEQ ID NO: 183592 - protein, 14 aa, Mycobacterium tuberculosis
NVGNGNVGLGNIGN

SEQ ID NO: 183593 - protein, 14 aa, Mycobacterium tuberculosis
VGNGNVGLGNIGNL

SEQ ID NO: 183594 - protein, 14 aa, Mycobacterium tuberculosis
GNGNVGLGNIGNLN

SEQ ID NO: 183595 - protein, 14 aa, Mycobacterium tuberculosis
NGNVGLGNIGNLNL

SEQ ID NO: 183596 - protein, 14 aa, Mycobacterium tuberculosis
GNVGLGNIGNLNLG

SEQ ID NO: 183597 - protein, 14 aa, Mycobacterium tuberculosis
NVGLGNIGNLNLGA

SEQ ID NO: 183598 - protein, 14 aa, Mycobacterium tuberculosis
VGLGNIGNLNLGAA

SEQ ID NO: 183599 - protein, 14 aa, Mycobacterium tuberculosis
GLGNIGNLNLGAAN

SEQ ID NO: 183600 - protein, 14 aa, Mycobacterium tuberculosis
LGNIGNLNLGAANI

SEQ ID NO: 183601 - protein, 14 aa, Mycobacterium tuberculosis
GNIGNLNLGAANIG

SEQ ID NO: 183602 - protein, 14 aa, Mycobacterium tuberculosis
NIGNLNLGAANIGD

SEQ ID NO: 183603 - protein, 14 aa, Mycobacterium tuberculosis
IGNLNLGAANIGDV

SEQ ID NO: 183604 - protein, 14 aa, Mycobacterium tuberculosis
GNLNLGAANIGDVN

SEQ ID NO: 183605 - protein, 14 aa, Mycobacterium tuberculosis
NLNLGAANIGDVNL

SEQ ID NO: 183606 - protein, 14 aa, Mycobacterium tuberculosis
LNLGAANIGDVNLG

SEQ ID NO: 183607 - protein, 14 aa, Mycobacterium tuberculosis
NLGAANIGDVNLGF

SEQ ID NO: 183608 - protein, 14 aa, Mycobacterium tuberculosis
LGAANIGDVNLGFG

SEQ ID NO: 183609 - protein, 14 aa, Mycobacterium tuberculosis
GAANIGDVNLGFGN

SEQ ID NO: 183610 - protein, 14 aa, Mycobacterium tuberculosis
AANIGDVNLGFGNI

SEQ ID NO: 183611 - protein, 14 aa, Mycobacterium tuberculosis
ANIGDVNLGFGNIG

SEQ ID NO: 183612 - protein, 14 aa, Mycobacterium tuberculosis
NIGDVNLGFGNIGD

SEQ ID NO: 183613 - protein, 14 aa, Mycobacterium tuberculosis
IGDVNLGFGNIGDV

SEQ ID NO: 183614 - protein, 14 aa, Mycobacterium tuberculosis
GDVNLGFGNIGDVN

SEQ ID NO: 183615 - protein, 14 aa, Mycobacterium tuberculosis
DVNLGFGNIGDVNL

SEQ ID NO: 183616 - protein, 14 aa, Mycobacterium tuberculosis
VNLGFGNIGDVNLG

SEQ ID NO: 183617 - protein, 14 aa, Mycobacterium tuberculosis
NLGFGNIGDVNLGF

SEQ ID NO: 183618 - protein, 14 aa, Mycobacterium tuberculosis
LGFGNIGDVNLGFG

SEQ ID NO: 183619 - protein, 14 aa, Mycobacterium tuberculosis
GFGNIGDVNLGFGN

SEQ ID NO: 183620 - protein, 14 aa, Mycobacterium tuberculosis
FGNIGDVNLGFGNI

SEQ ID NO: 183621 - protein, 14 aa, Mycobacterium tuberculosis
GNIGDVNLGFGNIG

SEQ ID NO: 183622 - protein, 14 aa, Mycobacterium tuberculosis
NIGDVNLGFGNIGG

SEQ ID NO: 183623 - protein, 14 aa, Mycobacterium tuberculosis
IGDVNLGFGNIGGG

SEQ ID NO: 183624 - protein, 14 aa, Mycobacterium tuberculosis
GDVNLGFGNIGGGN

SEQ ID NO: 183625 - protein, 14 aa, Mycobacterium tuberculosis
DVNLGFGNIGGGNV

SEQ ID NO: 183626 - protein, 14 aa, Mycobacterium tuberculosis
VNLGFGNIGGGNVG

SEQ ID NO: 183627 - protein, 14 aa, Mycobacterium tuberculosis
NLGFGNIGGGNVGF

SEQ ID NO: 183628 - protein, 14 aa, Mycobacterium tuberculosis
LGFGNIGGGNVGFG

SEQ ID NO: 183629 - protein, 14 aa, Mycobacterium tuberculosis
GFGNIGGGNVGFGN

SEQ ID NO: 183630 - protein, 14 aa, Mycobacterium tuberculosis
FGNIGGGNVGFGNI

SEQ ID NO: 183631 - protein, 14 aa, Mycobacterium tuberculosis
GNIGGGNVGFGNIG

SEQ ID NO: 183632 - protein, 14 aa, Mycobacterium tuberculosis
NIGGGNVGFGNIGD

SEQ ID NO: 183633 - protein, 14 aa, Mycobacterium tuberculosis
IGGGNVGFGNIGDA

SEQ ID NO: 183634 - protein, 14 aa, Mycobacterium tuberculosis
GGGNVGFGNIGDAN

SEQ ID NO: 183635 - protein, 14 aa, Mycobacterium tuberculosis
GGNVGFGNIGDANF

SEQ ID NO: 183636 - protein, 14 aa, Mycobacterium tuberculosis
GNVGFGNIGDANFG

SEQ ID NO: 183637 - protein, 14 aa, Mycobacterium tuberculosis
NVGFGNIGDANFGF

SEQ ID NO: 183638 - protein, 14 aa, Mycobacterium tuberculosis
VGFGNIGDANFGFG

SEQ ID NO: 183639 - protein, 14 aa, Mycobacterium tuberculosis
GFGNIGDANFGFGN

SEQ ID NO: 183640 - protein, 14 aa, Mycobacterium tuberculosis
FGNIGDANFGFGNS

SEQ ID NO: 183641 - protein, 14 aa, Mycobacterium tuberculosis
GNIGDANFGFGNSG

SEQ ID NO: 183642 - protein, 14 aa, Mycobacterium tuberculosis
NIGDANFGFGNSGL

SEQ ID NO: 183643 - protein, 14 aa, Mycobacterium tuberculosis
IGDANFGFGNSGLA

SEQ ID NO: 183644 - protein, 14 aa, Mycobacterium tuberculosis
GDANFGFGNSGLAA

SEQ ID NO: 183645 - protein, 14 aa, Mycobacterium tuberculosis
DANFGFGNSGLAAG

SEQ ID NO: 183646 - protein, 14 aa, Mycobacterium tuberculosis
ANFGFGNSGLAAGL

SEQ ID NO: 183647 - protein, 14 aa, Mycobacterium tuberculosis
NFGFGNSGLAAGLA

SEQ ID NO: 183648 - protein, 14 aa, Mycobacterium tuberculosis
FGFGNSGLAAGLAG

SEQ ID NO: 183649 - protein, 14 aa, Mycobacterium tuberculosis
GFGNSGLAAGLAGM

SEQ ID NO: 183650 - protein, 14 aa, Mycobacterium tuberculosis
FGNSGLAAGLAGMG

SEQ ID NO: 183651 - protein, 14 aa, Mycobacterium tuberculosis
GNSGLAAGLAGMGN

SEQ ID NO: 183652 - protein, 14 aa, Mycobacterium tuberculosis
NSGLAAGLAGMGNI

SEQ ID NO: 183653 - protein, 14 aa, Mycobacterium tuberculosis
SGLAAGLAGMGNIG

SEQ ID NO: 183654 - protein, 14 aa, Mycobacterium tuberculosis
GLAAGLAGMGNIGL

SEQ ID NO: 183655 - protein, 14 aa, Mycobacterium tuberculosis
LAAGLAGMGNIGLG

SEQ ID NO: 183656 - protein, 14 aa, Mycobacterium tuberculosis
AAGLAGMGNIGLGN

SEQ ID NO: 183657 - protein, 14 aa, Mycobacterium tuberculosis
AGLAGMGNIGLGNA

SEQ ID NO: 183658 - protein, 14 aa, Mycobacterium tuberculosis
GLAGMGNIGLGNAG

SEQ ID NO: 183659 - protein, 14 aa, Mycobacterium tuberculosis
LAGMGNIGLGNAGS

SEQ ID NO: 183660 - protein, 14 aa, Mycobacterium tuberculosis
AGMGNIGLGNAGSG

SEQ ID NO: 183661 - protein, 14 aa, Mycobacterium tuberculosis
GMGNIGLGNAGSGN

SEQ ID NO: 183662 - protein, 14 aa, Mycobacterium tuberculosis
MGNIGLGNAGSGNV

SEQ ID NO: 183663 - protein, 14 aa, Mycobacterium tuberculosis
GNIGLGNAGSGNVG

SEQ ID NO: 183664 - protein, 14 aa, Mycobacterium tuberculosis
NIGLGNAGSGNVGW

SEQ ID NO: 183665 - protein, 14 aa, Mycobacterium tuberculosis
IGLGNAGSGNVGWA

SEQ ID NO: 183666 - protein, 14 aa, Mycobacterium tuberculosis
GLGNAGSGNVGWAN

SEQ ID NO: 183667 - protein, 14 aa, Mycobacterium tuberculosis
LGNAGSGNVGWANM

SEQ ID NO: 183668 - protein, 14 aa, Mycobacterium tuberculosis
GNAGSGNVGWANMG

SEQ ID NO: 183669 - protein, 14 aa, Mycobacterium tuberculosis
NAGSGNVGWANMGL

SEQ ID NO: 183670 - protein, 14 aa, Mycobacterium tuberculosis
AGSGNVGWANMGLG

SEQ ID NO: 183671 - protein, 14 aa, Mycobacterium tuberculosis
GSGNVGWANMGLGN

SEQ ID NO: 183672 - protein, 14 aa, Mycobacterium tuberculosis
SGNVGWANMGLGNI

SEQ ID NO: 183673 - protein, 14 aa, Mycobacterium tuberculosis
GNVGWANMGLGNIG

SEQ ID NO: 183674 - protein, 14 aa, Mycobacterium tuberculosis
NVGWANMGLGNIGF

SEQ ID NO: 183675 - protein, 14 aa, Mycobacterium tuberculosis
VGWANMGLGNIGFG

SEQ ID NO: 183676 - protein, 14 aa, Mycobacterium tuberculosis
GWANMGLGNIGFGN

SEQ ID NO: 183677 - protein, 14 aa, Mycobacterium tuberculosis
WANMGLGNIGFGNT

SEQ ID NO: 183678 - protein, 14 aa, Mycobacterium tuberculosis
ANMGLGNIGFGNTG

SEQ ID NO: 183679 - protein, 14 aa, Mycobacterium tuberculosis
NMGLGNIGFGNTGT

SEQ ID NO: 183680 - protein, 14 aa, Mycobacterium tuberculosis
MGLGNIGFGNTGTN

SEQ ID NO: 183681 - protein, 14 aa, Mycobacterium tuberculosis
GLGNIGFGNTGTNN

SEQ ID NO: 183682 - protein, 14 aa, Mycobacterium tuberculosis
LGNIGFGNTGTNNL

SEQ ID NO: 183683 - protein, 14 aa, Mycobacterium tuberculosis
GNIGFGNTGTNNLG

SEQ ID NO: 183684 - protein, 14 aa, Mycobacterium tuberculosis
NIGFGNTGTNNLGI

SEQ ID NO: 183685 - protein, 14 aa, Mycobacterium tuberculosis
IGFGNTGTNNLGIG

SEQ ID NO: 183686 - protein, 14 aa, Mycobacterium tuberculosis
GFGNTGTNNLGIGL

SEQ ID NO: 183687 - protein, 14 aa, Mycobacterium tuberculosis
FGNTGTNNLGIGLT

SEQ ID NO: 183688 - protein, 14 aa, Mycobacterium tuberculosis
GNTGTNNLGIGLTG

SEQ ID NO: 183689 - protein, 14 aa, Mycobacterium tuberculosis
NTGTNNLGIGLTGD

SEQ ID NO: 183690 - protein, 14 aa, Mycobacterium tuberculosis
TGTNNLGIGLTGDN

SEQ ID NO: 183691 - protein, 14 aa, Mycobacterium tuberculosis
GTNNLGIGLTGDNQ

SEQ ID NO: 183692 - protein, 14 aa, Mycobacterium tuberculosis
TNNLGIGLTGDNQS

SEQ ID NO: 183693 - protein, 14 aa, Mycobacterium tuberculosis
NNLGIGLTGDNQSG

SEQ ID NO: 183694 - protein, 14 aa, Mycobacterium tuberculosis
NLGIGLTGDNQSGI

SEQ ID NO: 183695 - protein, 14 aa, Mycobacterium tuberculosis
LGIGLTGDNQSGIG

SEQ ID NO: 183696 - protein, 14 aa, Mycobacterium tuberculosis
GIGLTGDNQSGIGG

SEQ ID NO: 183697 - protein, 14 aa, Mycobacterium tuberculosis
IGLTGDNQSGIGGL

SEQ ID NO: 183698 - protein, 14 aa, Mycobacterium tuberculosis
GLTGDNQSGIGGLN

SEQ ID NO: 183699 - protein, 14 aa, Mycobacterium tuberculosis
LTGDNQSGIGGLNS

SEQ ID NO: 183700 - protein, 14 aa, Mycobacterium tuberculosis
TGDNQSGIGGLNSG

SEQ ID NO: 183701 - protein, 14 aa, Mycobacterium tuberculosis
GDNQSGIGGLNSGT

SEQ ID NO: 183702 - protein, 14 aa, Mycobacterium tuberculosis
DNQSGIGGLNSGTG

SEQ ID NO: 183703 - protein, 14 aa, Mycobacterium tuberculosis
NQSGIGGLNSGTGN

SEQ ID NO: 183704 - protein, 14 aa, Mycobacterium tuberculosis
QSGIGGLNSGTGNI

SEQ ID NO: 183705 - protein, 14 aa, Mycobacterium tuberculosis
SGIGGLNSGTGNIG

SEQ ID NO: 183706 - protein, 14 aa, Mycobacterium tuberculosis
GIGGLNSGTGNIGL

SEQ ID NO: 183707 - protein, 14 aa, Mycobacterium tuberculosis
IGGLNSGTGNIGLF

SEQ ID NO: 183708 - protein, 14 aa, Mycobacterium tuberculosis
GGLNSGTGNIGLFN

SEQ ID NO: 183709 - protein, 14 aa, Mycobacterium tuberculosis
GLNSGTGNIGLFNS

SEQ ID NO: 183710 - protein, 14 aa, Mycobacterium tuberculosis
LNSGTGNIGLFNSG

SEQ ID NO: 183711 - protein, 14 aa, Mycobacterium tuberculosis
NSGTGNIGLFNSGT

SEQ ID NO: 183712 - protein, 14 aa, Mycobacterium tuberculosis
SGTGNIGLFNSGTG

SEQ ID NO: 183713 - protein, 14 aa, Mycobacterium tuberculosis
GTGNIGLFNSGTGN

SEQ ID NO: 183714 - protein, 14 aa, Mycobacterium tuberculosis
TGNIGLFNSGTGNI

SEQ ID NO: 183715 - protein, 14 aa, Mycobacterium tuberculosis
GNIGLFNSGTGNIG

SEQ ID NO: 183716 - protein, 14 aa, Mycobacterium tuberculosis
NIGLFNSGTGNIGF

SEQ ID NO: 183717 - protein, 14 aa, Mycobacterium tuberculosis
IGLFNSGTGNIGFF

SEQ ID NO: 183718 - protein, 14 aa, Mycobacterium tuberculosis
GLFNSGTGNIGFFN

SEQ ID NO: 183719 - protein, 14 aa, Mycobacterium tuberculosis
LFNSGTGNIGFFNS

SEQ ID NO: 183720 - protein, 14 aa, Mycobacterium tuberculosis
FNSGTGNIGFFNSG

SEQ ID NO: 183721 - protein, 14 aa, Mycobacterium tuberculosis
NSGTGNIGFFNSGT

SEQ ID NO: 183722 - protein, 14 aa, Mycobacterium tuberculosis
SGTGNIGFFNSGTA

SEQ ID NO: 183723 - protein, 14 aa, Mycobacterium tuberculosis
GTGNIGFFNSGTAN

SEQ ID NO: 183724 - protein, 14 aa, Mycobacterium tuberculosis
TGNIGFFNSGTANF

SEQ ID NO: 183725 - protein, 14 aa, Mycobacterium tuberculosis
GNIGFFNSGTANFG

SEQ ID NO: 183726 - protein, 14 aa, Mycobacterium tuberculosis
NIGFFNSGTANFGL

SEQ ID NO: 183727 - protein, 14 aa, Mycobacterium tuberculosis
IGFFNSGTANFGLF

SEQ ID NO: 183728 - protein, 14 aa, Mycobacterium tuberculosis
GFFNSGTANFGLFN

SEQ ID NO: 183729 - protein, 14 aa, Mycobacterium tuberculosis
FFNSGTANFGLFNS

SEQ ID NO: 183730 - protein, 14 aa, Mycobacterium tuberculosis
FNSGTANFGLFNSG

SEQ ID NO: 183731 - protein, 14 aa, Mycobacterium tuberculosis
NSGTANFGLFNSGS

SEQ ID NO: 183732 - protein, 14 aa, Mycobacterium tuberculosis
SGTANFGLFNSGSY

SEQ ID NO: 183733 - protein, 14 aa, Mycobacterium tuberculosis
GTANFGLFNSGSYN

SEQ ID NO: 183734 - protein, 14 aa, Mycobacterium tuberculosis
TANFGLFNSGSYNT

SEQ ID NO: 183735 - protein, 14 aa, Mycobacterium tuberculosis
ANFGLFNSGSYNTG

SEQ ID NO: 183736 - protein, 14 aa, Mycobacterium tuberculosis
NFGLFNSGSYNTGI

SEQ ID NO: 183737 - protein, 14 aa, Mycobacterium tuberculosis
FGLFNSGSYNTGIG

SEQ ID NO: 183738 - protein, 14 aa, Mycobacterium tuberculosis
GLFNSGSYNTGIGN

SEQ ID NO: 183739 - protein, 14 aa, Mycobacterium tuberculosis
LFNSGSYNTGIGNS

SEQ ID NO: 183740 - protein, 14 aa, Mycobacterium tuberculosis
FNSGSYNTGIGNSG

SEQ ID NO: 183741 - protein, 14 aa, Mycobacterium tuberculosis
NSGSYNTGIGNSGV

SEQ ID NO: 183742 - protein, 14 aa, Mycobacterium tuberculosis
SGSYNTGIGNSGVA

SEQ ID NO: 183743 - protein, 14 aa, Mycobacterium tuberculosis
GSYNTGIGNSGVAS

SEQ ID NO: 183744 - protein, 14 aa, Mycobacterium tuberculosis
SYNTGIGNSGVAST

SEQ ID NO: 183745 - protein, 14 aa, Mycobacterium tuberculosis
YNTGIGNSGVASTG

SEQ ID NO: 183746 - protein, 14 aa, Mycobacterium tuberculosis
NTGIGNSGVASTGL

SEQ ID NO: 183747 - protein, 14 aa, Mycobacterium tuberculosis
TGIGNSGVASTGLV

SEQ ID NO: 183748 - protein, 14 aa, Mycobacterium tuberculosis
GIGNSGVASTGLVN

SEQ ID NO: 183749 - protein, 14 aa, Mycobacterium tuberculosis
IGNSGVASTGLVNA

SEQ ID NO: 183750 - protein, 14 aa, Mycobacterium tuberculosis
GNSGVASTGLVNAG

SEQ ID NO: 183751 - protein, 14 aa, Mycobacterium tuberculosis
NSGVASTGLVNAGG

SEQ ID NO: 183752 - protein, 14 aa, Mycobacterium tuberculosis
SGVASTGLVNAGGF

SEQ ID NO: 183753 - protein, 14 aa, Mycobacterium tuberculosis
GVASTGLVNAGGFN

SEQ ID NO: 183754 - protein, 14 aa, Mycobacterium tuberculosis
VASTGLVNAGGFNT

SEQ ID NO: 183755 - protein, 14 aa, Mycobacterium tuberculosis
ASTGLVNAGGFNTG

SEQ ID NO: 183756 - protein, 14 aa, Mycobacterium tuberculosis
STGLVNAGGFNTGV

SEQ ID NO: 183757 - protein, 14 aa, Mycobacterium tuberculosis
TGLVNAGGFNTGVA

SEQ ID NO: 183758 - protein, 14 aa, Mycobacterium tuberculosis
GLVNAGGFNTGVAN

SEQ ID NO: 183759 - protein, 14 aa, Mycobacterium tuberculosis
LVNAGGFNTGVANA

SEQ ID NO: 183760 - protein, 14 aa, Mycobacterium tuberculosis
VNAGGFNTGVANAG

SEQ ID NO: 183761 - protein, 14 aa, Mycobacterium tuberculosis
NAGGFNTGVANAGS

SEQ ID NO: 183762 - protein, 14 aa, Mycobacterium tuberculosis
AGGFNTGVANAGSY

SEQ ID NO: 183763 - protein, 14 aa, Mycobacterium tuberculosis
GGFNTGVANAGSYN

SEQ ID NO: 183764 - protein, 14 aa, Mycobacterium tuberculosis
GFNTGVANAGSYNT

SEQ ID NO: 183765 - protein, 14 aa, Mycobacterium tuberculosis
FNTGVANAGSYNTG

SEQ ID NO: 183766 - protein, 14 aa, Mycobacterium tuberculosis
NTGVANAGSYNTGS

SEQ ID NO: 183767 - protein, 14 aa, Mycobacterium tuberculosis
TGVANAGSYNTGSF

SEQ ID NO: 183768 - protein, 14 aa, Mycobacterium tuberculosis
GVANAGSYNTGSFN

SEQ ID NO: 183769 - protein, 14 aa, Mycobacterium tuberculosis
VANAGSYNTGSFNA

SEQ ID NO: 183770 - protein, 14 aa, Mycobacterium tuberculosis
ANAGSYNTGSFNAG

SEQ ID NO: 183771 - protein, 14 aa, Mycobacterium tuberculosis
NAGSYNTGSFNAGD

SEQ ID NO: 183772 - protein, 14 aa, Mycobacterium tuberculosis
AGSYNTGSFNAGDT

SEQ ID NO: 183773 - protein, 14 aa, Mycobacterium tuberculosis
GSYNTGSFNAGDTN

SEQ ID NO: 183774 - protein, 14 aa, Mycobacterium tuberculosis
SYNTGSFNAGDTNT

SEQ ID NO: 183775 - protein, 14 aa, Mycobacterium tuberculosis
YNTGSFNAGDTNTG

SEQ ID NO: 183776 - protein, 14 aa, Mycobacterium tuberculosis
NTGSFNAGDTNTGG

SEQ ID NO: 183777 - protein, 14 aa, Mycobacterium tuberculosis
TGSFNAGDTNTGGF

SEQ ID NO: 183778 - protein, 14 aa, Mycobacterium tuberculosis
GSFNAGDTNTGGFN

SEQ ID NO: 183779 - protein, 14 aa, Mycobacterium tuberculosis
SFNAGDTNTGGFNP

SEQ ID NO: 183780 - protein, 14 aa, Mycobacterium tuberculosis
FNAGDTNTGGFNPG

SEQ ID NO: 183781 - protein, 14 aa, Mycobacterium tuberculosis
NAGDTNTGGFNPGS

SEQ ID NO: 183782 - protein, 14 aa, Mycobacterium tuberculosis
AGDTNTGGFNPGST

SEQ ID NO: 183783 - protein, 14 aa, Mycobacterium tuberculosis
GDTNTGGFNPGSTN

SEQ ID NO: 183784 - protein, 14 aa, Mycobacterium tuberculosis
DTNTGGFNPGSTNT

SEQ ID NO: 183785 - protein, 14 aa, Mycobacterium tuberculosis
TNTGGFNPGSTNTG

SEQ ID NO: 183786 - protein, 14 aa, Mycobacterium tuberculosis
NTGGFNPGSTNTGW

SEQ ID NO: 183787 - protein, 14 aa, Mycobacterium tuberculosis
TGGFNPGSTNTGWF

SEQ ID NO: 183788 - protein, 14 aa, Mycobacterium tuberculosis
GGFNPGSTNTGWFN

SEQ ID NO: 183789 - protein, 14 aa, Mycobacterium tuberculosis
GFNPGSTNTGWFNT

SEQ ID NO: 183790 - protein, 14 aa, Mycobacterium tuberculosis
FNPGSTNTGWFNTG

SEQ ID NO: 183791 - protein, 14 aa, Mycobacterium tuberculosis
NPGSTNTGWFNTGN

SEQ ID NO: 183792 - protein, 14 aa, Mycobacterium tuberculosis
PGSTNTGWFNTGNA

SEQ ID NO: 183793 - protein, 14 aa, Mycobacterium tuberculosis
GSTNTGWFNTGNAN

SEQ ID NO: 183794 - protein, 14 aa, Mycobacterium tuberculosis
STNTGWFNTGNANT

SEQ ID NO: 183795 - protein, 14 aa, Mycobacterium tuberculosis
TNTGWFNTGNANTG

SEQ ID NO: 183796 - protein, 14 aa, Mycobacterium tuberculosis
NTGWFNTGNANTGV

SEQ ID NO: 183797 - protein, 14 aa, Mycobacterium tuberculosis
TGWFNTGNANTGVA

SEQ ID NO: 183798 - protein, 14 aa, Mycobacterium tuberculosis
GWFNTGNANTGVAN

SEQ ID NO: 183799 - protein, 14 aa, Mycobacterium tuberculosis
WFNTGNANTGVANA

SEQ ID NO: 183800 - protein, 14 aa, Mycobacterium tuberculosis
FNTGNANTGVANAG

SEQ ID NO: 183801 - protein, 14 aa, Mycobacterium tuberculosis
NTGNANTGVANAGN

SEQ ID NO: 183802 - protein, 14 aa, Mycobacterium tuberculosis
TGNANTGVANAGNV

SEQ ID NO: 183803 - protein, 14 aa, Mycobacterium tuberculosis
GNANTGVANAGNVN

SEQ ID NO: 183804 - protein, 14 aa, Mycobacterium tuberculosis
NANTGVANAGNVNT

SEQ ID NO: 183805 - protein, 14 aa, Mycobacterium tuberculosis
ANTGVANAGNVNTG

SEQ ID NO: 183806 - protein, 14 aa, Mycobacterium tuberculosis
NTGVANAGNVNTGA

SEQ ID NO: 183807 - protein, 14 aa, Mycobacterium tuberculosis
TGVANAGNVNTGAL

SEQ ID NO: 183808 - protein, 14 aa, Mycobacterium tuberculosis
GVANAGNVNTGALI

SEQ ID NO: 183809 - protein, 14 aa, Mycobacterium tuberculosis
VANAGNVNTGALIT

SEQ ID NO: 183810 - protein, 14 aa, Mycobacterium tuberculosis
ANAGNVNTGALITG

SEQ ID NO: 183811 - protein, 14 aa, Mycobacterium tuberculosis
NAGNVNTGALITGN

SEQ ID NO: 183812 - protein, 14 aa, Mycobacterium tuberculosis
AGNVNTGALITGNF

SEQ ID NO: 183813 - protein, 14 aa, Mycobacterium tuberculosis
GNVNTGALITGNFS

SEQ ID NO: 183814 - protein, 14 aa, Mycobacterium tuberculosis
NVNTGALITGNFSN

SEQ ID NO: 183815 - protein, 14 aa, Mycobacterium tuberculosis
VNTGALITGNFSNG

SEQ ID NO: 183816 - protein, 14 aa, Mycobacterium tuberculosis
NTGALITGNFSNGI

SEQ ID NO: 183817 - protein, 14 aa, Mycobacterium tuberculosis
TGALITGNFSNGIL

SEQ ID NO: 183818 - protein, 14 aa, Mycobacterium tuberculosis
GALITGNFSNGILW

SEQ ID NO: 183819 - protein, 14 aa, Mycobacterium tuberculosis
ALITGNFSNGILWR

SEQ ID NO: 183820 - protein, 14 aa, Mycobacterium tuberculosis
LITGNFSNGILWRG

SEQ ID NO: 183821 - protein, 14 aa, Mycobacterium tuberculosis
ITGNFSNGILWRGN

SEQ ID NO: 183822 - protein, 14 aa, Mycobacterium tuberculosis
TGNFSNGILWRGNY

SEQ ID NO: 183823 - protein, 14 aa, Mycobacterium tuberculosis
GNFSNGILWRGNYE

SEQ ID NO: 183824 - protein, 14 aa, Mycobacterium tuberculosis
NFSNGILWRGNYEG

SEQ ID NO: 183825 - protein, 14 aa, Mycobacterium tuberculosis
FSNGILWRGNYEGL

SEQ ID NO: 183826 - protein, 14 aa, Mycobacterium tuberculosis
SNGILWRGNYEGLA

SEQ ID NO: 183827 - protein, 14 aa, Mycobacterium tuberculosis
NGILWRGNYEGLAG

SEQ ID NO: 183828 - protein, 14 aa, Mycobacterium tuberculosis
GILWRGNYEGLAGF

SEQ ID NO: 183829 - protein, 14 aa, Mycobacterium tuberculosis
ILWRGNYEGLAGFS

SEQ ID NO: 183830 - protein, 14 aa, Mycobacterium tuberculosis
LWRGNYEGLAGFSF

SEQ ID NO: 183831 - protein, 14 aa, Mycobacterium tuberculosis
WRGNYEGLAGFSFG

SEQ ID NO: 183832 - protein, 14 aa, Mycobacterium tuberculosis
RGNYEGLAGFSFGY

SEQ ID NO: 183833 - protein, 14 aa, Mycobacterium tuberculosis
GNYEGLAGFSFGYP

SEQ ID NO: 183834 - protein, 14 aa, Mycobacterium tuberculosis
NYEGLAGFSFGYPI

SEQ ID NO: 183835 - protein, 14 aa, Mycobacterium tuberculosis
YEGLAGFSFGYPIP

SEQ ID NO: 183836 - protein, 14 aa, Mycobacterium tuberculosis
EGLAGFSFGYPIPL

SEQ ID NO: 183837 - protein, 14 aa, Mycobacterium tuberculosis
GLAGFSFGYPIPLF

SEQ ID NO: 183838 - protein, 14 aa, Mycobacterium tuberculosis
LAGFSFGYPIPLFP

SEQ ID NO: 183839 - protein, 14 aa, Mycobacterium tuberculosis
AGFSFGYPIPLFPA

SEQ ID NO: 183840 - protein, 14 aa, Mycobacterium tuberculosis
GFSFGYPIPLFPAV

SEQ ID NO: 183841 - protein, 14 aa, Mycobacterium tuberculosis
FSFGYPIPLFPAVG

SEQ ID NO: 183842 - protein, 14 aa, Mycobacterium tuberculosis
SFGYPIPLFPAVGA

SEQ ID NO: 183843 - protein, 14 aa, Mycobacterium tuberculosis
FGYPIPLFPAVGAD

SEQ ID NO: 183844 - protein, 14 aa, Mycobacterium tuberculosis
GYPIPLFPAVGADV

SEQ ID NO: 183845 - protein, 14 aa, Mycobacterium tuberculosis
YPIPLFPAVGADVT

SEQ ID NO: 183846 - protein, 14 aa, Mycobacterium tuberculosis
PIPLFPAVGADVTG

SEQ ID NO: 183847 - protein, 14 aa, Mycobacterium tuberculosis
IPLFPAVGADVTGD

SEQ ID NO: 183848 - protein, 14 aa, Mycobacterium tuberculosis
PLFPAVGADVTGDI

SEQ ID NO: 183849 - protein, 14 aa, Mycobacterium tuberculosis
LFPAVGADVTGDIG

SEQ ID NO: 183850 - protein, 14 aa, Mycobacterium tuberculosis
FPAVGADVTGDIGP

SEQ ID NO: 183851 - protein, 14 aa, Mycobacterium tuberculosis
PAVGADVTGDIGPA

SEQ ID NO: 183852 - protein, 14 aa, Mycobacterium tuberculosis
AVGADVTGDIGPAT

SEQ ID NO: 183853 - protein, 14 aa, Mycobacterium tuberculosis
VGADVTGDIGPATI

SEQ ID NO: 183854 - protein, 14 aa, Mycobacterium tuberculosis
GADVTGDIGPATII

SEQ ID NO: 183855 - protein, 14 aa, Mycobacterium tuberculosis
ADVTGDIGPATIIP

SEQ ID NO: 183856 - protein, 14 aa, Mycobacterium tuberculosis
DVTGDIGPATIIPP

SEQ ID NO: 183857 - protein, 14 aa, Mycobacterium tuberculosis
VTGDIGPATIIPPI

SEQ ID NO: 183858 - protein, 14 aa, Mycobacterium tuberculosis
TGDIGPATIIPPIH

SEQ ID NO: 183859 - protein, 14 aa, Mycobacterium tuberculosis
GDIGPATIIPPIHI

SEQ ID NO: 183860 - protein, 14 aa, Mycobacterium tuberculosis
DIGPATIIPPIHIP

SEQ ID NO: 183861 - protein, 14 aa, Mycobacterium tuberculosis
IGPATIIPPIHIPS

SEQ ID NO: 183862 - protein, 14 aa, Mycobacterium tuberculosis
GPATIIPPIHIPSI

SEQ ID NO: 183863 - protein, 14 aa, Mycobacterium tuberculosis
PATIIPPIHIPSIP

SEQ ID NO: 183864 - protein, 14 aa, Mycobacterium tuberculosis
ATIIPPIHIPSIPL

SEQ ID NO: 183865 - protein, 14 aa, Mycobacterium tuberculosis
TIIPPIHIPSIPLG

SEQ ID NO: 183866 - protein, 14 aa, Mycobacterium tuberculosis
IIPPIHIPSIPLGF

SEQ ID NO: 183867 - protein, 14 aa, Mycobacterium tuberculosis
IPPIHIPSIPLGFA

SEQ ID NO: 183868 - protein, 14 aa, Mycobacterium tuberculosis
PPIHIPSIPLGFAA

SEQ ID NO: 183869 - protein, 14 aa, Mycobacterium tuberculosis
PIHIPSIPLGFAAI

SEQ ID NO: 183870 - protein, 14 aa, Mycobacterium tuberculosis
IHIPSIPLGFAAIG

SEQ ID NO: 183871 - protein, 14 aa, Mycobacterium tuberculosis
HIPSIPLGFAAIGH

SEQ ID NO: 183872 - protein, 14 aa, Mycobacterium tuberculosis
IPSIPLGFAAIGHI

SEQ ID NO: 183873 - protein, 14 aa, Mycobacterium tuberculosis
PSIPLGFAAIGHIG

SEQ ID NO: 183874 - protein, 14 aa, Mycobacterium tuberculosis
SIPLGFAAIGHIGP

SEQ ID NO: 183875 - protein, 14 aa, Mycobacterium tuberculosis
IPLGFAAIGHIGPI

SEQ ID NO: 183876 - protein, 14 aa, Mycobacterium tuberculosis
PLGFAAIGHIGPIS

SEQ ID NO: 183877 - protein, 14 aa, Mycobacterium tuberculosis
LGFAAIGHIGPISI

SEQ ID NO: 183878 - protein, 14 aa, Mycobacterium tuberculosis
GFAAIGHIGPISIP

SEQ ID NO: 183879 - protein, 14 aa, Mycobacterium tuberculosis
FAAIGHIGPISIPN

SEQ ID NO: 183880 - protein, 14 aa, Mycobacterium tuberculosis
AAIGHIGPISIPNI

SEQ ID NO: 183881 - protein, 14 aa, Mycobacterium tuberculosis
AIGHIGPISIPNIA

SEQ ID NO: 183882 - protein, 14 aa, Mycobacterium tuberculosis
IGHIGPISIPNIAI

SEQ ID NO: 183883 - protein, 14 aa, Mycobacterium tuberculosis
GHIGPISIPNIAIP

SEQ ID NO: 183884 - protein, 14 aa, Mycobacterium tuberculosis
HIGPISIPNIAIPS

SEQ ID NO: 183885 - protein, 14 aa, Mycobacterium tuberculosis
IGPISIPNIAIPSI

SEQ ID NO: 183886 - protein, 14 aa, Mycobacterium tuberculosis
GPISIPNIAIPSIH

SEQ ID NO: 183887 - protein, 14 aa, Mycobacterium tuberculosis
PISIPNIAIPSIHL

SEQ ID NO: 183888 - protein, 14 aa, Mycobacterium tuberculosis
ISIPNIAIPSIHLG

SEQ ID NO: 183889 - protein, 14 aa, Mycobacterium tuberculosis
SIPNIAIPSIHLGI

SEQ ID NO: 183890 - protein, 14 aa, Mycobacterium tuberculosis
IPNIAIPSIHLGID

SEQ ID NO: 183891 - protein, 14 aa, Mycobacterium tuberculosis
PNIAIPSIHLGIDP

SEQ ID NO: 183892 - protein, 14 aa, Mycobacterium tuberculosis
NIAIPSIHLGIDPT

SEQ ID NO: 183893 - protein, 14 aa, Mycobacterium tuberculosis
IAIPSIHLGIDPTF

SEQ ID NO: 183894 - protein, 14 aa, Mycobacterium tuberculosis
AIPSIHLGIDPTFD

SEQ ID NO: 183895 - protein, 14 aa, Mycobacterium tuberculosis
IPSIHLGIDPTFDV

SEQ ID NO: 183896 - protein, 14 aa, Mycobacterium tuberculosis
PSIHLGIDPTFDVG

SEQ ID NO: 183897 - protein, 14 aa, Mycobacterium tuberculosis
SIHLGIDPTFDVGP

SEQ ID NO: 183898 - protein, 14 aa, Mycobacterium tuberculosis
IHLGIDPTFDVGPI

SEQ ID NO: 183899 - protein, 14 aa, Mycobacterium tuberculosis
HLGIDPTFDVGPIT

SEQ ID NO: 183900 - protein, 14 aa, Mycobacterium tuberculosis
LGIDPTFDVGPITV

SEQ ID NO: 183901 - protein, 14 aa, Mycobacterium tuberculosis
GIDPTFDVGPITVD

SEQ ID NO: 183902 - protein, 14 aa, Mycobacterium tuberculosis
IDPTFDVGPITVDP

SEQ ID NO: 183903 - protein, 14 aa, Mycobacterium tuberculosis
DPTFDVGPITVDPI

SEQ ID NO: 183904 - protein, 14 aa, Mycobacterium tuberculosis
PTFDVGPITVDPIT

SEQ ID NO: 183905 - protein, 14 aa, Mycobacterium tuberculosis
TFDVGPITVDPITL

SEQ ID NO: 183906 - protein, 14 aa, Mycobacterium tuberculosis
FDVGPITVDPITLT

SEQ ID NO: 183907 - protein, 14 aa, Mycobacterium tuberculosis
DVGPITVDPITLTI

SEQ ID NO: 183908 - protein, 14 aa, Mycobacterium tuberculosis
VGPITVDPITLTIP

SEQ ID NO: 183909 - protein, 14 aa, Mycobacterium tuberculosis
GPITVDPITLTIPG

SEQ ID NO: 183910 - protein, 14 aa, Mycobacterium tuberculosis
PITVDPITLTIPGL

SEQ ID NO: 183911 - protein, 14 aa, Mycobacterium tuberculosis
ITVDPITLTIPGLS

SEQ ID NO: 183912 - protein, 14 aa, Mycobacterium tuberculosis
TVDPITLTIPGLSL

SEQ ID NO: 183913 - protein, 14 aa, Mycobacterium tuberculosis
VDPITLTIPGLSLD

SEQ ID NO: 183914 - protein, 14 aa, Mycobacterium tuberculosis
DPITLTIPGLSLDA

SEQ ID NO: 183915 - protein, 14 aa, Mycobacterium tuberculosis
PITLTIPGLSLDAA

SEQ ID NO: 183916 - protein, 14 aa, Mycobacterium tuberculosis
ITLTIPGLSLDAAV

SEQ ID NO: 183917 - protein, 14 aa, Mycobacterium tuberculosis
TLTIPGLSLDAAVS

SEQ ID NO: 183918 - protein, 14 aa, Mycobacterium tuberculosis
LTIPGLSLDAAVSE

SEQ ID NO: 183919 - protein, 14 aa, Mycobacterium tuberculosis
TIPGLSLDAAVSEI

SEQ ID NO: 183920 - protein, 14 aa, Mycobacterium tuberculosis
IPGLSLDAAVSEIR

SEQ ID NO: 183921 - protein, 14 aa, Mycobacterium tuberculosis
PGLSLDAAVSEIRM

SEQ ID NO: 183922 - protein, 14 aa, Mycobacterium tuberculosis
GLSLDAAVSEIRMT

SEQ ID NO: 183923 - protein, 14 aa, Mycobacterium tuberculosis
LSLDAAVSEIRMTS

SEQ ID NO: 183924 - protein, 14 aa, Mycobacterium tuberculosis
SLDAAVSEIRMTSG

SEQ ID NO: 183925 - protein, 14 aa, Mycobacterium tuberculosis
LDAAVSEIRMTSGS

SEQ ID NO: 183926 - protein, 14 aa, Mycobacterium tuberculosis
DAAVSEIRMTSGSS

SEQ ID NO: 183927 - protein, 14 aa, Mycobacterium tuberculosis
AAVSEIRMTSGSSS

SEQ ID NO: 183928 - protein, 14 aa, Mycobacterium tuberculosis
AVSEIRMTSGSSSG

SEQ ID NO: 183929 - protein, 14 aa, Mycobacterium tuberculosis
VSEIRMTSGSSSGF

SEQ ID NO: 183930 - protein, 14 aa, Mycobacterium tuberculosis
SEIRMTSGSSSGFK

SEQ ID NO: 183931 - protein, 14 aa, Mycobacterium tuberculosis
EIRMTSGSSSGFKV

SEQ ID NO: 183932 - protein, 14 aa, Mycobacterium tuberculosis
IRMTSGSSSGFKVR

SEQ ID NO: 183933 - protein, 14 aa, Mycobacterium tuberculosis
RMTSGSSSGFKVRP

SEQ ID NO: 183934 - protein, 14 aa, Mycobacterium tuberculosis
MTSGSSSGFKVRPS

SEQ ID NO: 183935 - protein, 14 aa, Mycobacterium tuberculosis
TSGSSSGFKVRPSF

SEQ ID NO: 183936 - protein, 14 aa, Mycobacterium tuberculosis
SGSSSGFKVRPSFS

SEQ ID NO: 183937 - protein, 14 aa, Mycobacterium tuberculosis
GSSSGFKVRPSFSF

SEQ ID NO: 183938 - protein, 14 aa, Mycobacterium tuberculosis
SSSGFKVRPSFSFF

SEQ ID NO: 183939 - protein, 14 aa, Mycobacterium tuberculosis
SSGFKVRPSFSFFA

SEQ ID NO: 183940 - protein, 14 aa, Mycobacterium tuberculosis
SGFKVRPSFSFFAV

SEQ ID NO: 183941 - protein, 14 aa, Mycobacterium tuberculosis
GFKVRPSFSFFAVG

SEQ ID NO: 183942 - protein, 14 aa, Mycobacterium tuberculosis
FKVRPSFSFFAVGP

SEQ ID NO: 183943 - protein, 14 aa, Mycobacterium tuberculosis
KVRPSFSFFAVGPD

SEQ ID NO: 183944 - protein, 14 aa, Mycobacterium tuberculosis
VRPSFSFFAVGPDG

SEQ ID NO: 183945 - protein, 14 aa, Mycobacterium tuberculosis
RPSFSFFAVGPDGM

SEQ ID NO: 183946 - protein, 14 aa, Mycobacterium tuberculosis
PSFSFFAVGPDGMP

SEQ ID NO: 183947 - protein, 14 aa, Mycobacterium tuberculosis
SFSFFAVGPDGMPG

SEQ ID NO: 183948 - protein, 14 aa, Mycobacterium tuberculosis
FSFFAVGPDGMPGG

SEQ ID NO: 183949 - protein, 14 aa, Mycobacterium tuberculosis
SFFAVGPDGMPGGE

SEQ ID NO: 183950 - protein, 14 aa, Mycobacterium tuberculosis
FFAVGPDGMPGGEV

SEQ ID NO: 183951 - protein, 14 aa, Mycobacterium tuberculosis
FAVGPDGMPGGEVS

SEQ ID NO: 183952 - protein, 14 aa, Mycobacterium tuberculosis
AVGPDGMPGGEVSI

SEQ ID NO: 183953 - protein, 14 aa, Mycobacterium tuberculosis
VGPDGMPGGEVSIL

SEQ ID NO: 183954 - protein, 14 aa, Mycobacterium tuberculosis
GPDGMPGGEVSILQ

SEQ ID NO: 183955 - protein, 14 aa, Mycobacterium tuberculosis
PDGMPGGEVSILQP

SEQ ID NO: 183956 - protein, 14 aa, Mycobacterium tuberculosis
DGMPGGEVSILQPF

SEQ ID NO: 183957 - protein, 14 aa, Mycobacterium tuberculosis
GMPGGEVSILQPFT

SEQ ID NO: 183958 - protein, 14 aa, Mycobacterium tuberculosis
MPGGEVSILQPFTV

SEQ ID NO: 183959 - protein, 14 aa, Mycobacterium tuberculosis
PGGEVSILQPFTVA

SEQ ID NO: 183960 - protein, 14 aa, Mycobacterium tuberculosis
GGEVSILQPFTVAP

SEQ ID NO: 183961 - protein, 14 aa, Mycobacterium tuberculosis
GEVSILQPFTVAPI

SEQ ID NO: 183962 - protein, 14 aa, Mycobacterium tuberculosis
EVSILQPFTVAPIN

SEQ ID NO: 183963 - protein, 14 aa, Mycobacterium tuberculosis
VSILQPFTVAPINL

SEQ ID NO: 183964 - protein, 14 aa, Mycobacterium tuberculosis
SILQPFTVAPINLN

SEQ ID NO: 183965 - protein, 14 aa, Mycobacterium tuberculosis
ILQPFTVAPINLNP

SEQ ID NO: 183966 - protein, 14 aa, Mycobacterium tuberculosis
LQPFTVAPINLNPT

SEQ ID NO: 183967 - protein, 14 aa, Mycobacterium tuberculosis
QPFTVAPINLNPTT

SEQ ID NO: 183968 - protein, 14 aa, Mycobacterium tuberculosis
PFTVAPINLNPTTL

SEQ ID NO: 183969 - protein, 14 aa, Mycobacterium tuberculosis
FTVAPINLNPTTLH

SEQ ID NO: 183970 - protein, 14 aa, Mycobacterium tuberculosis
TVAPINLNPTTLHF

SEQ ID NO: 183971 - protein, 14 aa, Mycobacterium tuberculosis
VAPINLNPTTLHFP

SEQ ID NO: 183972 - protein, 14 aa, Mycobacterium tuberculosis
APINLNPTTLHFPG

SEQ ID NO: 183973 - protein, 14 aa, Mycobacterium tuberculosis
PINLNPTTLHFPGF

SEQ ID NO: 183974 - protein, 14 aa, Mycobacterium tuberculosis
INLNPTTLHFPGFT

SEQ ID NO: 183975 - protein, 14 aa, Mycobacterium tuberculosis
NLNPTTLHFPGFTI

SEQ ID NO: 183976 - protein, 14 aa, Mycobacterium tuberculosis
LNPTTLHFPGFTIP

SEQ ID NO: 183977 - protein, 14 aa, Mycobacterium tuberculosis
NPTTLHFPGFTIPT

SEQ ID NO: 183978 - protein, 14 aa, Mycobacterium tuberculosis
PTTLHFPGFTIPTG

SEQ ID NO: 183979 - protein, 14 aa, Mycobacterium tuberculosis
TTLHFPGFTIPTGP

SEQ ID NO: 183980 - protein, 14 aa, Mycobacterium tuberculosis
TLHFPGFTIPTGPI

SEQ ID NO: 183981 - protein, 14 aa, Mycobacterium tuberculosis
LHFPGFTIPTGPIH

SEQ ID NO: 183982 - protein, 14 aa, Mycobacterium tuberculosis
HFPGFTIPTGPIHI

SEQ ID NO: 183983 - protein, 14 aa, Mycobacterium tuberculosis
FPGFTIPTGPIHIG

SEQ ID NO: 183984 - protein, 14 aa, Mycobacterium tuberculosis
PGFTIPTGPIHIGL

SEQ ID NO: 183985 - protein, 14 aa, Mycobacterium tuberculosis
GFTIPTGPIHIGLP

SEQ ID NO: 183986 - protein, 14 aa, Mycobacterium tuberculosis
FTIPTGPIHIGLPL

SEQ ID NO: 183987 - protein, 14 aa, Mycobacterium tuberculosis
TIPTGPIHIGLPLS

SEQ ID NO: 183988 - protein, 14 aa, Mycobacterium tuberculosis
IPTGPIHIGLPLSL

SEQ ID NO: 183989 - protein, 14 aa, Mycobacterium tuberculosis
PTGPIHIGLPLSLT

SEQ ID NO: 183990 - protein, 14 aa, Mycobacterium tuberculosis
TGPIHIGLPLSLTI

SEQ ID NO: 183991 - protein, 14 aa, Mycobacterium tuberculosis
GPIHIGLPLSLTIP

SEQ ID NO: 183992 - protein, 14 aa, Mycobacterium tuberculosis
PIHIGLPLSLTIPG

SEQ ID NO: 183993 - protein, 14 aa, Mycobacterium tuberculosis
IHIGLPLSLTIPGF

SEQ ID NO: 183994 - protein, 14 aa, Mycobacterium tuberculosis
HIGLPLSLTIPGFT

SEQ ID NO: 183995 - protein, 14 aa, Mycobacterium tuberculosis
IGLPLSLTIPGFTI

SEQ ID NO: 183996 - protein, 14 aa, Mycobacterium tuberculosis
GLPLSLTIPGFTIP

SEQ ID NO: 183997 - protein, 14 aa, Mycobacterium tuberculosis
LPLSLTIPGFTIPG

SEQ ID NO: 183998 - protein, 14 aa, Mycobacterium tuberculosis
PLSLTIPGFTIPGG

SEQ ID NO: 183999 - protein, 14 aa, Mycobacterium tuberculosis
LSLTIPGFTIPGGT

SEQ ID NO: 184000 - protein, 14 aa, Mycobacterium tuberculosis
SLTIPGFTIPGGTL

SEQ ID NO: 184001 - protein, 14 aa, Mycobacterium tuberculosis
LTIPGFTIPGGTLI

SEQ ID NO: 184002 - protein, 14 aa, Mycobacterium tuberculosis
TIPGFTIPGGTLIP

SEQ ID NO: 184003 - protein, 14 aa, Mycobacterium tuberculosis
IPGFTIPGGTLIPQ

SEQ ID NO: 184004 - protein, 14 aa, Mycobacterium tuberculosis
PGFTIPGGTLIPQL

SEQ ID NO: 184005 - protein, 14 aa, Mycobacterium tuberculosis
GFTIPGGTLIPQLP

SEQ ID NO: 184006 - protein, 14 aa, Mycobacterium tuberculosis
FTIPGGTLIPQLPL

SEQ ID NO: 184007 - protein, 14 aa, Mycobacterium tuberculosis
TIPGGTLIPQLPLG

SEQ ID NO: 184008 - protein, 14 aa, Mycobacterium tuberculosis
IPGGTLIPQLPLGL

SEQ ID NO: 184009 - protein, 14 aa, Mycobacterium tuberculosis
PGGTLIPQLPLGLG

SEQ ID NO: 184010 - protein, 14 aa, Mycobacterium tuberculosis
GGTLIPQLPLGLGL

SEQ ID NO: 184011 - protein, 14 aa, Mycobacterium tuberculosis
GTLIPQLPLGLGLS

SEQ ID NO: 184012 - protein, 14 aa, Mycobacterium tuberculosis
TLIPQLPLGLGLSG

SEQ ID NO: 184013 - protein, 14 aa, Mycobacterium tuberculosis
LIPQLPLGLGLSGG

SEQ ID NO: 184014 - protein, 14 aa, Mycobacterium tuberculosis
IPQLPLGLGLSGGT

SEQ ID NO: 184015 - protein, 14 aa, Mycobacterium tuberculosis
PQLPLGLGLSGGTP

SEQ ID NO: 184016 - protein, 14 aa, Mycobacterium tuberculosis
QLPLGLGLSGGTPP

SEQ ID NO: 184017 - protein, 14 aa, Mycobacterium tuberculosis
LPLGLGLSGGTPPF

SEQ ID NO: 184018 - protein, 14 aa, Mycobacterium tuberculosis
PLGLGLSGGTPPFD

SEQ ID NO: 184019 - protein, 14 aa, Mycobacterium tuberculosis
LGLGLSGGTPPFDL

SEQ ID NO: 184020 - protein, 14 aa, Mycobacterium tuberculosis
GLGLSGGTPPFDLP

SEQ ID NO: 184021 - protein, 14 aa, Mycobacterium tuberculosis
LGLSGGTPPFDLPT

SEQ ID NO: 184022 - protein, 14 aa, Mycobacterium tuberculosis
GLSGGTPPFDLPTV

SEQ ID NO: 184023 - protein, 14 aa, Mycobacterium tuberculosis
LSGGTPPFDLPTVV

SEQ ID NO: 184024 - protein, 14 aa, Mycobacterium tuberculosis
SGGTPPFDLPTVVI

SEQ ID NO: 184025 - protein, 14 aa, Mycobacterium tuberculosis
GGTPPFDLPTVVID

SEQ ID NO: 184026 - protein, 14 aa, Mycobacterium tuberculosis
GTPPFDLPTVVIDR

SEQ ID NO: 184027 - protein, 14 aa, Mycobacterium tuberculosis
TPPFDLPTVVIDRI

SEQ ID NO: 184028 - protein, 14 aa, Mycobacterium tuberculosis
PPFDLPTVVIDRIP

SEQ ID NO: 184029 - protein, 14 aa, Mycobacterium tuberculosis
PFDLPTVVIDRIPV

SEQ ID NO: 184030 - protein, 14 aa, Mycobacterium tuberculosis
FDLPTVVIDRIPVE

SEQ ID NO: 184031 - protein, 14 aa, Mycobacterium tuberculosis
DLPTVVIDRIPVEL

SEQ ID NO: 184032 - protein, 14 aa, Mycobacterium tuberculosis
LPTVVIDRIPVELH

SEQ ID NO: 184033 - protein, 14 aa, Mycobacterium tuberculosis
PTVVIDRIPVELHA

SEQ ID NO: 184034 - protein, 14 aa, Mycobacterium tuberculosis
TVVIDRIPVELHAS

SEQ ID NO: 184035 - protein, 14 aa, Mycobacterium tuberculosis
VVIDRIPVELHAST

SEQ ID NO: 184036 - protein, 14 aa, Mycobacterium tuberculosis
VIDRIPVELHASTT

SEQ ID NO: 184037 - protein, 14 aa, Mycobacterium tuberculosis
IDRIPVELHASTTI

SEQ ID NO: 184038 - protein, 14 aa, Mycobacterium tuberculosis
DRIPVELHASTTIG

SEQ ID NO: 184039 - protein, 14 aa, Mycobacterium tuberculosis
RIPVELHASTTIGP

SEQ ID NO: 184040 - protein, 14 aa, Mycobacterium tuberculosis
IPVELHASTTIGPV

SEQ ID NO: 184041 - protein, 14 aa, Mycobacterium tuberculosis
PVELHASTTIGPVS

SEQ ID NO: 184042 - protein, 14 aa, Mycobacterium tuberculosis
VELHASTTIGPVSL

SEQ ID NO: 184043 - protein, 14 aa, Mycobacterium tuberculosis
ELHASTTIGPVSLP

SEQ ID NO: 184044 - protein, 14 aa, Mycobacterium tuberculosis
LHASTTIGPVSLPI

SEQ ID NO: 184045 - protein, 14 aa, Mycobacterium tuberculosis
HASTTIGPVSLPIF

SEQ ID NO: 184046 - protein, 14 aa, Mycobacterium tuberculosis
ASTTIGPVSLPIFG

SEQ ID NO: 184047 - protein, 14 aa, Mycobacterium tuberculosis
STTIGPVSLPIFGF

SEQ ID NO: 184048 - protein, 14 aa, Mycobacterium tuberculosis
TTIGPVSLPIFGFG

SEQ ID NO: 184049 - protein, 14 aa, Mycobacterium tuberculosis
TIGPVSLPIFGFGG

SEQ ID NO: 184050 - protein, 14 aa, Mycobacterium tuberculosis
IGPVSLPIFGFGGA

SEQ ID NO: 184051 - protein, 14 aa, Mycobacterium tuberculosis
GPVSLPIFGFGGAP

SEQ ID NO: 184052 - protein, 14 aa, Mycobacterium tuberculosis
PVSLPIFGFGGAPG

SEQ ID NO: 184053 - protein, 14 aa, Mycobacterium tuberculosis
VSLPIFGFGGAPGF

SEQ ID NO: 184054 - protein, 14 aa, Mycobacterium tuberculosis
SLPIFGFGGAPGFG

SEQ ID NO: 184055 - protein, 14 aa, Mycobacterium tuberculosis
LPIFGFGGAPGFGN

SEQ ID NO: 184056 - protein, 14 aa, Mycobacterium tuberculosis
PIFGFGGAPGFGND

SEQ ID NO: 184057 - protein, 14 aa, Mycobacterium tuberculosis
IFGFGGAPGFGNDT

SEQ ID NO: 184058 - protein, 14 aa, Mycobacterium tuberculosis
FGFGGAPGFGNDTT

SEQ ID NO: 184059 - protein, 14 aa, Mycobacterium tuberculosis
GFGGAPGFGNDTTA

SEQ ID NO: 184060 - protein, 14 aa, Mycobacterium tuberculosis
FGGAPGFGNDTTAP

SEQ ID NO: 184061 - protein, 14 aa, Mycobacterium tuberculosis
GGAPGFGNDTTAPS

SEQ ID NO: 184062 - protein, 14 aa, Mycobacterium tuberculosis
GAPGFGNDTTAPSS

SEQ ID NO: 184063 - protein, 14 aa, Mycobacterium tuberculosis
APGFGNDTTAPSSG

SEQ ID NO: 184064 - protein, 14 aa, Mycobacterium tuberculosis
PGFGNDTTAPSSGF

SEQ ID NO: 184065 - protein, 14 aa, Mycobacterium tuberculosis
GFGNDTTAPSSGFF

SEQ ID NO: 184066 - protein, 14 aa, Mycobacterium tuberculosis
FGNDTTAPSSGFFN

SEQ ID NO: 184067 - protein, 14 aa, Mycobacterium tuberculosis
GNDTTAPSSGFFNT

SEQ ID NO: 184068 - protein, 14 aa, Mycobacterium tuberculosis
NDTTAPSSGFFNTG

SEQ ID NO: 184069 - protein, 14 aa, Mycobacterium tuberculosis
DTTAPSSGFFNTGG

SEQ ID NO: 184070 - protein, 14 aa, Mycobacterium tuberculosis
TTAPSSGFFNTGGG

SEQ ID NO: 184071 - protein, 14 aa, Mycobacterium tuberculosis
TAPSSGFFNTGGGG

SEQ ID NO: 184072 - protein, 14 aa, Mycobacterium tuberculosis
APSSGFFNTGGGGG

SEQ ID NO: 184073 - protein, 14 aa, Mycobacterium tuberculosis
PSSGFFNTGGGGGS

SEQ ID NO: 184074 - protein, 14 aa, Mycobacterium tuberculosis
SSGFFNTGGGGGSG

SEQ ID NO: 184075 - protein, 14 aa, Mycobacterium tuberculosis
SGFFNTGGGGGSGF

SEQ ID NO: 184076 - protein, 14 aa, Mycobacterium tuberculosis
GFFNTGGGGGSGFS

SEQ ID NO: 184077 - protein, 14 aa, Mycobacterium tuberculosis
FFNTGGGGGSGFSN

SEQ ID NO: 184078 - protein, 14 aa, Mycobacterium tuberculosis
FNTGGGGGSGFSNS

SEQ ID NO: 184079 - protein, 14 aa, Mycobacterium tuberculosis
NTGGGGGSGFSNSG

SEQ ID NO: 184080 - protein, 14 aa, Mycobacterium tuberculosis
TGGGGGSGFSNSGS

SEQ ID NO: 184081 - protein, 14 aa, Mycobacterium tuberculosis
GGGGGSGFSNSGSG

SEQ ID NO: 184082 - protein, 14 aa, Mycobacterium tuberculosis
GGGGSGFSNSGSGM

SEQ ID NO: 184083 - protein, 14 aa, Mycobacterium tuberculosis
GGGSGFSNSGSGMS

SEQ ID NO: 184084 - protein, 14 aa, Mycobacterium tuberculosis
GGSGFSNSGSGMSG

SEQ ID NO: 184085 - protein, 14 aa, Mycobacterium tuberculosis
GSGFSNSGSGMSGV

SEQ ID NO: 184086 - protein, 14 aa, Mycobacterium tuberculosis
SGFSNSGSGMSGVL

SEQ ID NO: 184087 - protein, 14 aa, Mycobacterium tuberculosis
GFSNSGSGMSGVLN

SEQ ID NO: 184088 - protein, 14 aa, Mycobacterium tuberculosis
FSNSGSGMSGVLNA

SEQ ID NO: 184089 - protein, 14 aa, Mycobacterium tuberculosis
SNSGSGMSGVLNAI

SEQ ID NO: 184090 - protein, 14 aa, Mycobacterium tuberculosis
NSGSGMSGVLNAIS

SEQ ID NO: 184091 - protein, 14 aa, Mycobacterium tuberculosis
SGSGMSGVLNAISD

SEQ ID NO: 184092 - protein, 14 aa, Mycobacterium tuberculosis
GSGMSGVLNAISDP

SEQ ID NO: 184093 - protein, 14 aa, Mycobacterium tuberculosis
SGMSGVLNAISDPL

SEQ ID NO: 184094 - protein, 14 aa, Mycobacterium tuberculosis
GMSGVLNAISDPLL

SEQ ID NO: 184095 - protein, 14 aa, Mycobacterium tuberculosis
MSGVLNAISDPLLG

SEQ ID NO: 184096 - protein, 14 aa, Mycobacterium tuberculosis
SGVLNAISDPLLGS

SEQ ID NO: 184097 - protein, 14 aa, Mycobacterium tuberculosis
GVLNAISDPLLGSA

SEQ ID NO: 184098 - protein, 14 aa, Mycobacterium tuberculosis
VLNAISDPLLGSAS

SEQ ID NO: 184099 - protein, 14 aa, Mycobacterium tuberculosis
LNAISDPLLGSASG

SEQ ID NO: 184100 - protein, 14 aa, Mycobacterium tuberculosis
NAISDPLLGSASGF

SEQ ID NO: 184101 - protein, 14 aa, Mycobacterium tuberculosis
AISDPLLGSASGFA

SEQ ID NO: 184102 - protein, 14 aa, Mycobacterium tuberculosis
ISDPLLGSASGFAN

SEQ ID NO: 184103 - protein, 14 aa, Mycobacterium tuberculosis
SDPLLGSASGFANF

SEQ ID NO: 184104 - protein, 14 aa, Mycobacterium tuberculosis
DPLLGSASGFANFG

SEQ ID NO: 184105 - protein, 14 aa, Mycobacterium tuberculosis
PLLGSASGFANFGT

SEQ ID NO: 184106 - protein, 14 aa, Mycobacterium tuberculosis
LLGSASGFANFGTQ

SEQ ID NO: 184107 - protein, 14 aa, Mycobacterium tuberculosis
LGSASGFANFGTQL

SEQ ID NO: 184108 - protein, 14 aa, Mycobacterium tuberculosis
GSASGFANFGTQLS

SEQ ID NO: 184109 - protein, 14 aa, Mycobacterium tuberculosis
SASGFANFGTQLSG

SEQ ID NO: 184110 - protein, 14 aa, Mycobacterium tuberculosis
ASGFANFGTQLSGI

SEQ ID NO: 184111 - protein, 14 aa, Mycobacterium tuberculosis
SGFANFGTQLSGIL

SEQ ID NO: 184112 - protein, 14 aa, Mycobacterium tuberculosis
GFANFGTQLSGILN

SEQ ID NO: 184113 - protein, 14 aa, Mycobacterium tuberculosis
FANFGTQLSGILNR

SEQ ID NO: 184114 - protein, 14 aa, Mycobacterium tuberculosis
ANFGTQLSGILNRG

SEQ ID NO: 184115 - protein, 14 aa, Mycobacterium tuberculosis
NFGTQLSGILNRGA

SEQ ID NO: 184116 - protein, 14 aa, Mycobacterium tuberculosis
FGTQLSGILNRGAG

SEQ ID NO: 184117 - protein, 14 aa, Mycobacterium tuberculosis
GTQLSGILNRGAGI

SEQ ID NO: 184118 - protein, 14 aa, Mycobacterium tuberculosis
TQLSGILNRGAGIS

SEQ ID NO: 184119 - protein, 14 aa, Mycobacterium tuberculosis
QLSGILNRGAGISG

SEQ ID NO: 184120 - protein, 14 aa, Mycobacterium tuberculosis
LSGILNRGAGISGV

SEQ ID NO: 184121 - protein, 14 aa, Mycobacterium tuberculosis
SGILNRGAGISGVY

SEQ ID NO: 184122 - protein, 14 aa, Mycobacterium tuberculosis
GILNRGAGISGVYN

SEQ ID NO: 184123 - protein, 14 aa, Mycobacterium tuberculosis
ILNRGAGISGVYNT

SEQ ID NO: 184124 - protein, 14 aa, Mycobacterium tuberculosis
LNRGAGISGVYNTG

SEQ ID NO: 184125 - protein, 14 aa, Mycobacterium tuberculosis
NRGAGISGVYNTGT

SEQ ID NO: 184126 - protein, 14 aa, Mycobacterium tuberculosis
RGAGISGVYNTGTL

SEQ ID NO: 184127 - protein, 14 aa, Mycobacterium tuberculosis
GAGISGVYNTGTLG

SEQ ID NO: 184128 - protein, 14 aa, Mycobacterium tuberculosis
AGISGVYNTGTLGL

SEQ ID NO: 184129 - protein, 14 aa, Mycobacterium tuberculosis
GISGVYNTGTLGLV

SEQ ID NO: 184130 - protein, 14 aa, Mycobacterium tuberculosis
ISGVYNTGTLGLVT

SEQ ID NO: 184131 - protein, 14 aa, Mycobacterium tuberculosis
SGVYNTGTLGLVTS

SEQ ID NO: 184132 - protein, 14 aa, Mycobacterium tuberculosis
GVYNTGTLGLVTSA

SEQ ID NO: 184133 - protein, 14 aa, Mycobacterium tuberculosis
VYNTGTLGLVTSAF

SEQ ID NO: 184134 - protein, 14 aa, Mycobacterium tuberculosis
YNTGTLGLVTSAFV

SEQ ID NO: 184135 - protein, 14 aa, Mycobacterium tuberculosis
NTGTLGLVTSAFVS

SEQ ID NO: 184136 - protein, 14 aa, Mycobacterium tuberculosis
TGTLGLVTSAFVSG

SEQ ID NO: 184137 - protein, 14 aa, Mycobacterium tuberculosis
GTLGLVTSAFVSGF

SEQ ID NO: 184138 - protein, 14 aa, Mycobacterium tuberculosis
TLGLVTSAFVSGFM

SEQ ID NO: 184139 - protein, 14 aa, Mycobacterium tuberculosis
LGLVTSAFVSGFMN

SEQ ID NO: 184140 - protein, 14 aa, Mycobacterium tuberculosis
GLVTSAFVSGFMNV

SEQ ID NO: 184141 - protein, 14 aa, Mycobacterium tuberculosis
LVTSAFVSGFMNVG

SEQ ID NO: 184142 - protein, 14 aa, Mycobacterium tuberculosis
VTSAFVSGFMNVGQ

SEQ ID NO: 184143 - protein, 14 aa, Mycobacterium tuberculosis
TSAFVSGFMNVGQQ

SEQ ID NO: 184144 - protein, 14 aa, Mycobacterium tuberculosis
SAFVSGFMNVGQQL

SEQ ID NO: 184145 - protein, 14 aa, Mycobacterium tuberculosis
AFVSGFMNVGQQLS

SEQ ID NO: 184146 - protein, 14 aa, Mycobacterium tuberculosis
FVSGFMNVGQQLSG

SEQ ID NO: 184147 - protein, 14 aa, Mycobacterium tuberculosis
VSGFMNVGQQLSGL

SEQ ID NO: 184148 - protein, 14 aa, Mycobacterium tuberculosis
SGFMNVGQQLSGLL

SEQ ID NO: 184149 - protein, 14 aa, Mycobacterium tuberculosis
GFMNVGQQLSGLLF

SEQ ID NO: 184150 - protein, 14 aa, Mycobacterium tuberculosis
FMNVGQQLSGLLFA

SEQ ID NO: 184151 - protein, 14 aa, Mycobacterium tuberculosis
MNVGQQLSGLLFAG

SEQ ID NO: 184152 - protein, 14 aa, Mycobacterium tuberculosis
NVGQQLSGLLFAGT

SEQ ID NO: 184153 - protein, 14 aa, Mycobacterium tuberculosis
VGQQLSGLLFAGTG

SEQ ID NO: 184154 - protein, 14 aa, Mycobacterium tuberculosis
GQQLSGLLFAGTGP

SEQ ID NO: 184155 - protein, 15 aa, Mycobacterium tuberculosis
MNFPVLPPEINSVLM

SEQ ID NO: 184156 - protein, 15 aa, Mycobacterium tuberculosis
NFPVLPPEINSVLMY

SEQ ID NO: 184157 - protein, 15 aa, Mycobacterium tuberculosis
FPVLPPEINSVLMYS

SEQ ID NO: 184158 - protein, 15 aa, Mycobacterium tuberculosis
PVLPPEINSVLMYSG

SEQ ID NO: 184159 - protein, 15 aa, Mycobacterium tuberculosis
VLPPEINSVLMYSGA

SEQ ID NO: 184160 - protein, 15 aa, Mycobacterium tuberculosis
LPPEINSVLMYSGAG

SEQ ID NO: 184161 - protein, 15 aa, Mycobacterium tuberculosis
PPEINSVLMYSGAGS

SEQ ID NO: 184162 - protein, 15 aa, Mycobacterium tuberculosis
PEINSVLMYSGAGSS

SEQ ID NO: 184163 - protein, 15 aa, Mycobacterium tuberculosis
EINSVLMYSGAGSSP

SEQ ID NO: 184164 - protein, 15 aa, Mycobacterium tuberculosis
INSVLMYSGAGSSPL

SEQ ID NO: 184165 - protein, 15 aa, Mycobacterium tuberculosis
NSVLMYSGAGSSPLL

SEQ ID NO: 184166 - protein, 15 aa, Mycobacterium tuberculosis
SVLMYSGAGSSPLLA

SEQ ID NO: 184167 - protein, 15 aa, Mycobacterium tuberculosis
VLMYSGAGSSPLLAA

SEQ ID NO: 184168 - protein, 15 aa, Mycobacterium tuberculosis
LMYSGAGSSPLLAAA

SEQ ID NO: 184169 - protein, 15 aa, Mycobacterium tuberculosis
MYSGAGSSPLLAAAA

SEQ ID NO: 184170 - protein, 15 aa, Mycobacterium tuberculosis
YSGAGSSPLLAAAAA

SEQ ID NO: 184171 - protein, 15 aa, Mycobacterium tuberculosis
SGAGSSPLLAAAAAW

SEQ ID NO: 184172 - protein, 15 aa, Mycobacterium tuberculosis
GAGSSPLLAAAAAWD

SEQ ID NO: 184173 - protein, 15 aa, Mycobacterium tuberculosis
AGSSPLLAAAAAWDG

SEQ ID NO: 184174 - protein, 15 aa, Mycobacterium tuberculosis
GSSPLLAAAAAWDGL

SEQ ID NO: 184175 - protein, 15 aa, Mycobacterium tuberculosis
SSPLLAAAAAWDGLA

SEQ ID NO: 184176 - protein, 15 aa, Mycobacterium tuberculosis
SPLLAAAAAWDGLAE

SEQ ID NO: 184177 - protein, 15 aa, Mycobacterium tuberculosis
PLLAAAAAWDGLAEE

SEQ ID NO: 184178 - protein, 15 aa, Mycobacterium tuberculosis
LLAAAAAWDGLAEEL

SEQ ID NO: 184179 - protein, 15 aa, Mycobacterium tuberculosis
LAAAAAWDGLAEELG

SEQ ID NO: 184180 - protein, 15 aa, Mycobacterium tuberculosis
AAAAAWDGLAEELGS

SEQ ID NO: 184181 - protein, 15 aa, Mycobacterium tuberculosis
AAAAWDGLAEELGSA

SEQ ID NO: 184182 - protein, 15 aa, Mycobacterium tuberculosis
AAAWDGLAEELGSAA

SEQ ID NO: 184183 - protein, 15 aa, Mycobacterium tuberculosis
AAWDGLAEELGSAAV

SEQ ID NO: 184184 - protein, 15 aa, Mycobacterium tuberculosis
AWDGLAEELGSAAVS

SEQ ID NO: 184185 - protein, 15 aa, Mycobacterium tuberculosis
WDGLAEELGSAAVSF

SEQ ID NO: 184186 - protein, 15 aa, Mycobacterium tuberculosis
DGLAEELGSAAVSFG

SEQ ID NO: 184187 - protein, 15 aa, Mycobacterium tuberculosis
GLAEELGSAAVSFGQ

SEQ ID NO: 184188 - protein, 15 aa, Mycobacterium tuberculosis
LAEELGSAAVSFGQV

SEQ ID NO: 184189 - protein, 15 aa, Mycobacterium tuberculosis
AEELGSAAVSFGQVT

SEQ ID NO: 184190 - protein, 15 aa, Mycobacterium tuberculosis
EELGSAAVSFGQVTS

SEQ ID NO: 184191 - protein, 15 aa, Mycobacterium tuberculosis
ELGSAAVSFGQVTSG

SEQ ID NO: 184192 - protein, 15 aa, Mycobacterium tuberculosis
LGSAAVSFGQVTSGL

SEQ ID NO: 184193 - protein, 15 aa, Mycobacterium tuberculosis
GSAAVSFGQVTSGLT

SEQ ID NO: 184194 - protein, 15 aa, Mycobacterium tuberculosis
SAAVSFGQVTSGLTA

SEQ ID NO: 184195 - protein, 15 aa, Mycobacterium tuberculosis
AAVSFGQVTSGLTAG

SEQ ID NO: 184196 - protein, 15 aa, Mycobacterium tuberculosis
AVSFGQVTSGLTAGV

SEQ ID NO: 184197 - protein, 15 aa, Mycobacterium tuberculosis
VSFGQVTSGLTAGVW

SEQ ID NO: 184198 - protein, 15 aa, Mycobacterium tuberculosis
SFGQVTSGLTAGVWQ

SEQ ID NO: 184199 - protein, 15 aa, Mycobacterium tuberculosis
FGQVTSGLTAGVWQG

SEQ ID NO: 184200 - protein, 15 aa, Mycobacterium tuberculosis
GQVTSGLTAGVWQGA

SEQ ID NO: 184201 - protein, 15 aa, Mycobacterium tuberculosis
QVTSGLTAGVWQGAA

SEQ ID NO: 184202 - protein, 15 aa, Mycobacterium tuberculosis
VTSGLTAGVWQGAAA

SEQ ID NO: 184203 - protein, 15 aa, Mycobacterium tuberculosis
TSGLTAGVWQGAAAA

SEQ ID NO: 184204 - protein, 15 aa, Mycobacterium tuberculosis
SGLTAGVWQGAAAAA

SEQ ID NO: 184205 - protein, 15 aa, Mycobacterium tuberculosis
GLTAGVWQGAAAAAM

SEQ ID NO: 184206 - protein, 15 aa, Mycobacterium tuberculosis
LTAGVWQGAAAAAMA

SEQ ID NO: 184207 - protein, 15 aa, Mycobacterium tuberculosis
TAGVWQGAAAAAMAA

SEQ ID NO: 184208 - protein, 15 aa, Mycobacterium tuberculosis
AGVWQGAAAAAMAAA

SEQ ID NO: 184209 - protein, 15 aa, Mycobacterium tuberculosis
GVWQGAAAAAMAAAA

SEQ ID NO: 184210 - protein, 15 aa, Mycobacterium tuberculosis
VWQGAAAAAMAAAAA

SEQ ID NO: 184211 - protein, 15 aa, Mycobacterium tuberculosis
WQGAAAAAMAAAAAP

SEQ ID NO: 184212 - protein, 15 aa, Mycobacterium tuberculosis
QGAAAAAMAAAAAPY

SEQ ID NO: 184213 - protein, 15 aa, Mycobacterium tuberculosis
GAAAAAMAAAAAPYA

SEQ ID NO: 184214 - protein, 15 aa, Mycobacterium tuberculosis
AAAAAMAAAAAPYAG

SEQ ID NO: 184215 - protein, 15 aa, Mycobacterium tuberculosis
AAAAMAAAAAPYAGW

SEQ ID NO: 184216 - protein, 15 aa, Mycobacterium tuberculosis
AAAMAAAAAPYAGWL

SEQ ID NO: 184217 - protein, 15 aa, Mycobacterium tuberculosis
AAMAAAAAPYAGWLG

SEQ ID NO: 184218 - protein, 15 aa, Mycobacterium tuberculosis
AMAAAAAPYAGWLGS

SEQ ID NO: 184219 - protein, 15 aa, Mycobacterium tuberculosis
MAAAAAPYAGWLGSV

SEQ ID NO: 184220 - protein, 15 aa, Mycobacterium tuberculosis
AAAAAPYAGWLGSVA

SEQ ID NO: 184221 - protein, 15 aa, Mycobacterium tuberculosis
AAAAPYAGWLGSVAA

SEQ ID NO: 184222 - protein, 15 aa, Mycobacterium tuberculosis
AAAPYAGWLGSVAAQ

SEQ ID NO: 184223 - protein, 15 aa, Mycobacterium tuberculosis
AAPYAGWLGSVAAQA

SEQ ID NO: 184224 - protein, 15 aa, Mycobacterium tuberculosis
APYAGWLGSVAAQAV

SEQ ID NO: 184225 - protein, 15 aa, Mycobacterium tuberculosis
PYAGWLGSVAAQAVA

SEQ ID NO: 184226 - protein, 15 aa, Mycobacterium tuberculosis
YAGWLGSVAAQAVAV

SEQ ID NO: 184227 - protein, 15 aa, Mycobacterium tuberculosis
AGWLGSVAAQAVAVA

SEQ ID NO: 184228 - protein, 15 aa, Mycobacterium tuberculosis
GWLGSVAAQAVAVAG

SEQ ID NO: 184229 - protein, 15 aa, Mycobacterium tuberculosis
WLGSVAAQAVAVAGQ

SEQ ID NO: 184230 - protein, 15 aa, Mycobacterium tuberculosis
LGSVAAQAVAVAGQA

SEQ ID NO: 184231 - protein, 15 aa, Mycobacterium tuberculosis
GSVAAQAVAVAGQAR

SEQ ID NO: 184232 - protein, 15 aa, Mycobacterium tuberculosis
SVAAQAVAVAGQARA

SEQ ID NO: 184233 - protein, 15 aa, Mycobacterium tuberculosis
VAAQAVAVAGQARAA

SEQ ID NO: 184234 - protein, 15 aa, Mycobacterium tuberculosis
AAQAVAVAGQARAAV

SEQ ID NO: 184235 - protein, 15 aa, Mycobacterium tuberculosis
AQAVAVAGQARAAVA

SEQ ID NO: 184236 - protein, 15 aa, Mycobacterium tuberculosis
QAVAVAGQARAAVAA

SEQ ID NO: 184237 - protein, 15 aa, Mycobacterium tuberculosis
AVAVAGQARAAVAAF

SEQ ID NO: 184238 - protein, 15 aa, Mycobacterium tuberculosis
VAVAGQARAAVAAFE

SEQ ID NO: 184239 - protein, 15 aa, Mycobacterium tuberculosis
AVAGQARAAVAAFEA

SEQ ID NO: 184240 - protein, 15 aa, Mycobacterium tuberculosis
VAGQARAAVAAFEAA

SEQ ID NO: 184241 - protein, 15 aa, Mycobacterium tuberculosis
AGQARAAVAAFEAAL

SEQ ID NO: 184242 - protein, 15 aa, Mycobacterium tuberculosis
GQARAAVAAFEAALA

SEQ ID NO: 184243 - protein, 15 aa, Mycobacterium tuberculosis
QARAAVAAFEAALAA

SEQ ID NO: 184244 - protein, 15 aa, Mycobacterium tuberculosis
ARAAVAAFEAALAAT

SEQ ID NO: 184245 - protein, 15 aa, Mycobacterium tuberculosis
RAAVAAFEAALAATV

SEQ ID NO: 184246 - protein, 15 aa, Mycobacterium tuberculosis
AAVAAFEAALAATVD

SEQ ID NO: 184247 - protein, 15 aa, Mycobacterium tuberculosis
AVAAFEAALAATVDP

SEQ ID NO: 184248 - protein, 15 aa, Mycobacterium tuberculosis
VAAFEAALAATVDPA

SEQ ID NO: 184249 - protein, 15 aa, Mycobacterium tuberculosis
AAFEAALAATVDPAA

SEQ ID NO: 184250 - protein, 15 aa, Mycobacterium tuberculosis
AFEAALAATVDPAAV

SEQ ID NO: 184251 - protein, 15 aa, Mycobacterium tuberculosis
FEAALAATVDPAAVA

SEQ ID NO: 184252 - protein, 15 aa, Mycobacterium tuberculosis
EAALAATVDPAAVAV

SEQ ID NO: 184253 - protein, 15 aa, Mycobacterium tuberculosis
AALAATVDPAAVAVN

SEQ ID NO: 184254 - protein, 15 aa, Mycobacterium tuberculosis
ALAATVDPAAVAVNR

SEQ ID NO: 184255 - protein, 15 aa, Mycobacterium tuberculosis
LAATVDPAAVAVNRM

SEQ ID NO: 184256 - protein, 15 aa, Mycobacterium tuberculosis
AATVDPAAVAVNRMA

SEQ ID NO: 184257 - protein, 15 aa, Mycobacterium tuberculosis
ATVDPAAVAVNRMAM

SEQ ID NO: 184258 - protein, 15 aa, Mycobacterium tuberculosis
TVDPAAVAVNRMAMR

SEQ ID NO: 184259 - protein, 15 aa, Mycobacterium tuberculosis
VDPAAVAVNRMAMRA

SEQ ID NO: 184260 - protein, 15 aa, Mycobacterium tuberculosis
DPAAVAVNRMAMRAL

SEQ ID NO: 184261 - protein, 15 aa, Mycobacterium tuberculosis
PAAVAVNRMAMRALA

SEQ ID NO: 184262 - protein, 15 aa, Mycobacterium tuberculosis
AAVAVNRMAMRALAM

SEQ ID NO: 184263 - protein, 15 aa, Mycobacterium tuberculosis
AVAVNRMAMRALAMS

SEQ ID NO: 184264 - protein, 15 aa, Mycobacterium tuberculosis
VAVNRMAMRALAMSN

SEQ ID NO: 184265 - protein, 15 aa, Mycobacterium tuberculosis
AVNRMAMRALAMSNL

SEQ ID NO: 184266 - protein, 15 aa, Mycobacterium tuberculosis
VNRMAMRALAMSNLL

SEQ ID NO: 184267 - protein, 15 aa, Mycobacterium tuberculosis
NRMAMRALAMSNLLG

SEQ ID NO: 184268 - protein, 15 aa, Mycobacterium tuberculosis
RMAMRALAMSNLLGQ

SEQ ID NO: 184269 - protein, 15 aa, Mycobacterium tuberculosis
MAMRALAMSNLLGQN

SEQ ID NO: 184270 - protein, 15 aa, Mycobacterium tuberculosis
AMRALAMSNLLGQNA

SEQ ID NO: 184271 - protein, 15 aa, Mycobacterium tuberculosis
MRALAMSNLLGQNAA

SEQ ID NO: 184272 - protein, 15 aa, Mycobacterium tuberculosis
RALAMSNLLGQNAAA

SEQ ID NO: 184273 - protein, 15 aa, Mycobacterium tuberculosis
ALAMSNLLGQNAAAI

SEQ ID NO: 184274 - protein, 15 aa, Mycobacterium tuberculosis
LAMSNLLGQNAAAIA

SEQ ID NO: 184275 - protein, 15 aa, Mycobacterium tuberculosis
AMSNLLGQNAAAIAA

SEQ ID NO: 184276 - protein, 15 aa, Mycobacterium tuberculosis
MSNLLGQNAAAIAAV

SEQ ID NO: 184277 - protein, 15 aa, Mycobacterium tuberculosis
SNLLGQNAAAIAAVE

SEQ ID NO: 184278 - protein, 15 aa, Mycobacterium tuberculosis
NLLGQNAAAIAAVEA

SEQ ID NO: 184279 - protein, 15 aa, Mycobacterium tuberculosis
LLGQNAAAIAAVEAE

SEQ ID NO: 184280 - protein, 15 aa, Mycobacterium tuberculosis
LGQNAAAIAAVEAEY

SEQ ID NO: 184281 - protein, 15 aa, Mycobacterium tuberculosis
GQNAAAIAAVEAEYE

SEQ ID NO: 184282 - protein, 15 aa, Mycobacterium tuberculosis
QNAAAIAAVEAEYEL

SEQ ID NO: 184283 - protein, 15 aa, Mycobacterium tuberculosis
NAAAIAAVEAEYELM

SEQ ID NO: 184284 - protein, 15 aa, Mycobacterium tuberculosis
AAAIAAVEAEYELMW

SEQ ID NO: 184285 - protein, 15 aa, Mycobacterium tuberculosis
AAIAAVEAEYELMWA

SEQ ID NO: 184286 - protein, 15 aa, Mycobacterium tuberculosis
AIAAVEAEYELMWAA

SEQ ID NO: 184287 - protein, 15 aa, Mycobacterium tuberculosis
IAAVEAEYELMWAAD

SEQ ID NO: 184288 - protein, 15 aa, Mycobacterium tuberculosis
AAVEAEYELMWAADV

SEQ ID NO: 184289 - protein, 15 aa, Mycobacterium tuberculosis
AVEAEYELMWAADVA

SEQ ID NO: 184290 - protein, 15 aa, Mycobacterium tuberculosis
VEAEYELMWAADVAA

SEQ ID NO: 184291 - protein, 15 aa, Mycobacterium tuberculosis
EAEYELMWAADVAAM

SEQ ID NO: 184292 - protein, 15 aa, Mycobacterium tuberculosis
AEYELMWAADVAAMA

SEQ ID NO: 184293 - protein, 15 aa, Mycobacterium tuberculosis
EYELMWAADVAAMAG

SEQ ID NO: 184294 - protein, 15 aa, Mycobacterium tuberculosis
YELMWAADVAAMAGY

SEQ ID NO: 184295 - protein, 15 aa, Mycobacterium tuberculosis
ELMWAADVAAMAGYH

SEQ ID NO: 184296 - protein, 15 aa, Mycobacterium tuberculosis
LMWAADVAAMAGYHS

SEQ ID NO: 184297 - protein, 15 aa, Mycobacterium tuberculosis
MWAADVAAMAGYHSG

SEQ ID NO: 184298 - protein, 15 aa, Mycobacterium tuberculosis
WAADVAAMAGYHSGA

SEQ ID NO: 184299 - protein, 15 aa, Mycobacterium tuberculosis
AADVAAMAGYHSGAS

SEQ ID NO: 184300 - protein, 15 aa, Mycobacterium tuberculosis
ADVAAMAGYHSGASA

SEQ ID NO: 184301 - protein, 15 aa, Mycobacterium tuberculosis
DVAAMAGYHSGASAA

SEQ ID NO: 184302 - protein, 15 aa, Mycobacterium tuberculosis
VAAMAGYHSGASAAA

SEQ ID NO: 184303 - protein, 15 aa, Mycobacterium tuberculosis
AAMAGYHSGASAAAA

SEQ ID NO: 184304 - protein, 15 aa, Mycobacterium tuberculosis
AMAGYHSGASAAAAA

SEQ ID NO: 184305 - protein, 15 aa, Mycobacterium tuberculosis
MAGYHSGASAAAAAL

SEQ ID NO: 184306 - protein, 15 aa, Mycobacterium tuberculosis
AGYHSGASAAAAALP

SEQ ID NO: 184307 - protein, 15 aa, Mycobacterium tuberculosis
GYHSGASAAAAALPA

SEQ ID NO: 184308 - protein, 15 aa, Mycobacterium tuberculosis
YHSGASAAAAALPAF

SEQ ID NO: 184309 - protein, 15 aa, Mycobacterium tuberculosis
HSGASAAAAALPAFS

SEQ ID NO: 184310 - protein, 15 aa, Mycobacterium tuberculosis
SGASAAAAALPAFSP

SEQ ID NO: 184311 - protein, 15 aa, Mycobacterium tuberculosis
GASAAAAALPAFSPP

SEQ ID NO: 184312 - protein, 15 aa, Mycobacterium tuberculosis
ASAAAAALPAFSPPA

SEQ ID NO: 184313 - protein, 15 aa, Mycobacterium tuberculosis
SAAAAALPAFSPPAQ

SEQ ID NO: 184314 - protein, 15 aa, Mycobacterium tuberculosis
AAAAALPAFSPPAQA

SEQ ID NO: 184315 - protein, 15 aa, Mycobacterium tuberculosis
AAAALPAFSPPAQAL

SEQ ID NO: 184316 - protein, 15 aa, Mycobacterium tuberculosis
AAALPAFSPPAQALG

SEQ ID NO: 184317 - protein, 15 aa, Mycobacterium tuberculosis
AALPAFSPPAQALGG

SEQ ID NO: 184318 - protein, 15 aa, Mycobacterium tuberculosis
ALPAFSPPAQALGGG

SEQ ID NO: 184319 - protein, 15 aa, Mycobacterium tuberculosis
LPAFSPPAQALGGGV

SEQ ID NO: 184320 - protein, 15 aa, Mycobacterium tuberculosis
PAFSPPAQALGGGVG

SEQ ID NO: 184321 - protein, 15 aa, Mycobacterium tuberculosis
AFSPPAQALGGGVGA

SEQ ID NO: 184322 - protein, 15 aa, Mycobacterium tuberculosis
FSPPAQALGGGVGAF

SEQ ID NO: 184323 - protein, 15 aa, Mycobacterium tuberculosis
SPPAQALGGGVGAFL

SEQ ID NO: 184324 - protein, 15 aa, Mycobacterium tuberculosis
PPAQALGGGVGAFLN

SEQ ID NO: 184325 - protein, 15 aa, Mycobacterium tuberculosis
PAQALGGGVGAFLNA

SEQ ID NO: 184326 - protein, 15 aa, Mycobacterium tuberculosis
AQALGGGVGAFLNAL

SEQ ID NO: 184327 - protein, 15 aa, Mycobacterium tuberculosis
QALGGGVGAFLNALF

SEQ ID NO: 184328 - protein, 15 aa, Mycobacterium tuberculosis
ALGGGVGAFLNALFA

SEQ ID NO: 184329 - protein, 15 aa, Mycobacterium tuberculosis
LGGGVGAFLNALFAG

SEQ ID NO: 184330 - protein, 15 aa, Mycobacterium tuberculosis
GGGVGAFLNALFAGP

SEQ ID NO: 184331 - protein, 15 aa, Mycobacterium tuberculosis
GGVGAFLNALFAGPA

SEQ ID NO: 184332 - protein, 15 aa, Mycobacterium tuberculosis
GVGAFLNALFAGPAK

SEQ ID NO: 184333 - protein, 15 aa, Mycobacterium tuberculosis
VGAFLNALFAGPAKM

SEQ ID NO: 184334 - protein, 15 aa, Mycobacterium tuberculosis
GAFLNALFAGPAKML

SEQ ID NO: 184335 - protein, 15 aa, Mycobacterium tuberculosis
AFLNALFAGPAKMLR

SEQ ID NO: 184336 - protein, 15 aa, Mycobacterium tuberculosis
FLNALFAGPAKMLRL

SEQ ID NO: 184337 - protein, 15 aa, Mycobacterium tuberculosis
LNALFAGPAKMLRLN

SEQ ID NO: 184338 - protein, 15 aa, Mycobacterium tuberculosis
NALFAGPAKMLRLNA

SEQ ID NO: 184339 - protein, 15 aa, Mycobacterium tuberculosis
ALFAGPAKMLRLNAG

SEQ ID NO: 184340 - protein, 15 aa, Mycobacterium tuberculosis
LFAGPAKMLRLNAGL

SEQ ID NO: 184341 - protein, 15 aa, Mycobacterium tuberculosis
FAGPAKMLRLNAGLG

SEQ ID NO: 184342 - protein, 15 aa, Mycobacterium tuberculosis
AGPAKMLRLNAGLGN

SEQ ID NO: 184343 - protein, 15 aa, Mycobacterium tuberculosis
GPAKMLRLNAGLGNV

SEQ ID NO: 184344 - protein, 15 aa, Mycobacterium tuberculosis
PAKMLRLNAGLGNVG

SEQ ID NO: 184345 - protein, 15 aa, Mycobacterium tuberculosis
AKMLRLNAGLGNVGN

SEQ ID NO: 184346 - protein, 15 aa, Mycobacterium tuberculosis
KMLRLNAGLGNVGNY

SEQ ID NO: 184347 - protein, 15 aa, Mycobacterium tuberculosis
MLRLNAGLGNVGNYN

SEQ ID NO: 184348 - protein, 15 aa, Mycobacterium tuberculosis
LRLNAGLGNVGNYNV

SEQ ID NO: 184349 - protein, 15 aa, Mycobacterium tuberculosis
RLNAGLGNVGNYNVG

SEQ ID NO: 184350 - protein, 15 aa, Mycobacterium tuberculosis
LNAGLGNVGNYNVGL

SEQ ID NO: 184351 - protein, 15 aa, Mycobacterium tuberculosis
NAGLGNVGNYNVGLG

SEQ ID NO: 184352 - protein, 15 aa, Mycobacterium tuberculosis
AGLGNVGNYNVGLGN

SEQ ID NO: 184353 - protein, 15 aa, Mycobacterium tuberculosis
GLGNVGNYNVGLGNV

SEQ ID NO: 184354 - protein, 15 aa, Mycobacterium tuberculosis
LGNVGNYNVGLGNVG

SEQ ID NO: 184355 - protein, 15 aa, Mycobacterium tuberculosis
GNVGNYNVGLGNVGI

SEQ ID NO: 184356 - protein, 15 aa, Mycobacterium tuberculosis
NVGNYNVGLGNVGIF

SEQ ID NO: 184357 - protein, 15 aa, Mycobacterium tuberculosis
VGNYNVGLGNVGIFN

SEQ ID NO: 184358 - protein, 15 aa, Mycobacterium tuberculosis
GNYNVGLGNVGIFNL

SEQ ID NO: 184359 - protein, 15 aa, Mycobacterium tuberculosis
NYNVGLGNVGIFNLG

SEQ ID NO: 184360 - protein, 15 aa, Mycobacterium tuberculosis
YNVGLGNVGIFNLGA

SEQ ID NO: 184361 - protein, 15 aa, Mycobacterium tuberculosis
NVGLGNVGIFNLGAA

SEQ ID NO: 184362 - protein, 15 aa, Mycobacterium tuberculosis
VGLGNVGIFNLGAAN

SEQ ID NO: 184363 - protein, 15 aa, Mycobacterium tuberculosis
GLGNVGIFNLGAANV

SEQ ID NO: 184364 - protein, 15 aa, Mycobacterium tuberculosis
LGNVGIFNLGAANVG

SEQ ID NO: 184365 - protein, 15 aa, Mycobacterium tuberculosis
GNVGIFNLGAANVGA

SEQ ID NO: 184366 - protein, 15 aa, Mycobacterium tuberculosis
NVGIFNLGAANVGAQ

SEQ ID NO: 184367 - protein, 15 aa, Mycobacterium tuberculosis
VGIFNLGAANVGAQN

SEQ ID NO: 184368 - protein, 15 aa, Mycobacterium tuberculosis
GIFNLGAANVGAQNL

SEQ ID NO: 184369 - protein, 15 aa, Mycobacterium tuberculosis
IFNLGAANVGAQNLG

SEQ ID NO: 184370 - protein, 15 aa, Mycobacterium tuberculosis
FNLGAANVGAQNLGA

SEQ ID NO: 184371 - protein, 15 aa, Mycobacterium tuberculosis
NLGAANVGAQNLGAA

SEQ ID NO: 184372 - protein, 15 aa, Mycobacterium tuberculosis
LGAANVGAQNLGAAN

SEQ ID NO: 184373 - protein, 15 aa, Mycobacterium tuberculosis
GAANVGAQNLGAANA

SEQ ID NO: 184374 - protein, 15 aa, Mycobacterium tuberculosis
AANVGAQNLGAANAG

SEQ ID NO: 184375 - protein, 15 aa, Mycobacterium tuberculosis
ANVGAQNLGAANAGS

SEQ ID NO: 184376 - protein, 15 aa, Mycobacterium tuberculosis
NVGAQNLGAANAGSG

SEQ ID NO: 184377 - protein, 15 aa, Mycobacterium tuberculosis
VGAQNLGAANAGSGN

SEQ ID NO: 184378 - protein, 15 aa, Mycobacterium tuberculosis
GAQNLGAANAGSGNF

SEQ ID NO: 184379 - protein, 15 aa, Mycobacterium tuberculosis
AQNLGAANAGSGNFG

SEQ ID NO: 184380 - protein, 15 aa, Mycobacterium tuberculosis
QNLGAANAGSGNFGF

SEQ ID NO: 184381 - protein, 15 aa, Mycobacterium tuberculosis
NLGAANAGSGNFGFG

SEQ ID NO: 184382 - protein, 15 aa, Mycobacterium tuberculosis
LGAANAGSGNFGFGN

SEQ ID NO: 184383 - protein, 15 aa, Mycobacterium tuberculosis
GAANAGSGNFGFGNI

SEQ ID NO: 184384 - protein, 15 aa, Mycobacterium tuberculosis
AANAGSGNFGFGNIG

SEQ ID NO: 184385 - protein, 15 aa, Mycobacterium tuberculosis
ANAGSGNFGFGNIGN

SEQ ID NO: 184386 - protein, 15 aa, Mycobacterium tuberculosis
NAGSGNFGFGNIGNA

SEQ ID NO: 184387 - protein, 15 aa, Mycobacterium tuberculosis
AGSGNFGFGNIGNAN

SEQ ID NO: 184388 - protein, 15 aa, Mycobacterium tuberculosis
GSGNFGFGNIGNANF

SEQ ID NO: 184389 - protein, 15 aa, Mycobacterium tuberculosis
SGNFGFGNIGNANFG

SEQ ID NO: 184390 - protein, 15 aa, Mycobacterium tuberculosis
GNFGFGNIGNANFGF

SEQ ID NO: 184391 - protein, 15 aa, Mycobacterium tuberculosis
NFGFGNIGNANFGFG

SEQ ID NO: 184392 - protein, 15 aa, Mycobacterium tuberculosis
FGFGNIGNANFGFGN

SEQ ID NO: 184393 - protein, 15 aa, Mycobacterium tuberculosis
GFGNIGNANFGFGNS

SEQ ID NO: 184394 - protein, 15 aa, Mycobacterium tuberculosis
FGNIGNANFGFGNSG

SEQ ID NO: 184395 - protein, 15 aa, Mycobacterium tuberculosis
GNIGNANFGFGNSGL

SEQ ID NO: 184396 - protein, 15 aa, Mycobacterium tuberculosis
NIGNANFGFGNSGLG

SEQ ID NO: 184397 - protein, 15 aa, Mycobacterium tuberculosis
IGNANFGFGNSGLGL

SEQ ID NO: 184398 - protein, 15 aa, Mycobacterium tuberculosis
GNANFGFGNSGLGLP

SEQ ID NO: 184399 - protein, 15 aa, Mycobacterium tuberculosis
NANFGFGNSGLGLPP

SEQ ID NO: 184400 - protein, 15 aa, Mycobacterium tuberculosis
ANFGFGNSGLGLPPG

SEQ ID NO: 184401 - protein, 15 aa, Mycobacterium tuberculosis
NFGFGNSGLGLPPGM

SEQ ID NO: 184402 - protein, 15 aa, Mycobacterium tuberculosis
FGFGNSGLGLPPGMG

SEQ ID NO: 184403 - protein, 15 aa, Mycobacterium tuberculosis
GFGNSGLGLPPGMGN

SEQ ID NO: 184404 - protein, 15 aa, Mycobacterium tuberculosis
FGNSGLGLPPGMGNI

SEQ ID NO: 184405 - protein, 15 aa, Mycobacterium tuberculosis
GNSGLGLPPGMGNIG

SEQ ID NO: 184406 - protein, 15 aa, Mycobacterium tuberculosis
NSGLGLPPGMGNIGL

SEQ ID NO: 184407 - protein, 15 aa, Mycobacterium tuberculosis
SGLGLPPGMGNIGLG

SEQ ID NO: 184408 - protein, 15 aa, Mycobacterium tuberculosis
GLGLPPGMGNIGLGN

SEQ ID NO: 184409 - protein, 15 aa, Mycobacterium tuberculosis
LGLPPGMGNIGLGNA

SEQ ID NO: 184410 - protein, 15 aa, Mycobacterium tuberculosis
GLPPGMGNIGLGNAG

SEQ ID NO: 184411 - protein, 15 aa, Mycobacterium tuberculosis
LPPGMGNIGLGNAGS

SEQ ID NO: 184412 - protein, 15 aa, Mycobacterium tuberculosis
PPGMGNIGLGNAGSS

SEQ ID NO: 184413 - protein, 15 aa, Mycobacterium tuberculosis
PGMGNIGLGNAGSSN

SEQ ID NO: 184414 - protein, 15 aa, Mycobacterium tuberculosis
GMGNIGLGNAGSSNY

SEQ ID NO: 184415 - protein, 15 aa, Mycobacterium tuberculosis
MGNIGLGNAGSSNYG

SEQ ID NO: 184416 - protein, 15 aa, Mycobacterium tuberculosis
GNIGLGNAGSSNYGL

SEQ ID NO: 184417 - protein, 15 aa, Mycobacterium tuberculosis
NIGLGNAGSSNYGLA

SEQ ID NO: 184418 - protein, 15 aa, Mycobacterium tuberculosis
IGLGNAGSSNYGLAN

SEQ ID NO: 184419 - protein, 15 aa, Mycobacterium tuberculosis
GLGNAGSSNYGLANL

SEQ ID NO: 184420 - protein, 15 aa, Mycobacterium tuberculosis
LGNAGSSNYGLANLG

SEQ ID NO: 184421 - protein, 15 aa, Mycobacterium tuberculosis
GNAGSSNYGLANLGV

SEQ ID NO: 184422 - protein, 15 aa, Mycobacterium tuberculosis
NAGSSNYGLANLGVG

SEQ ID NO: 184423 - protein, 15 aa, Mycobacterium tuberculosis
AGSSNYGLANLGVGN

SEQ ID NO: 184424 - protein, 15 aa, Mycobacterium tuberculosis
GSSNYGLANLGVGNI

SEQ ID NO: 184425 - protein, 15 aa, Mycobacterium tuberculosis
SSNYGLANLGVGNIG

SEQ ID NO: 184426 - protein, 15 aa, Mycobacterium tuberculosis
SNYGLANLGVGNIGF

SEQ ID NO: 184427 - protein, 15 aa, Mycobacterium tuberculosis
NYGLANLGVGNIGFA

SEQ ID NO: 184428 - protein, 15 aa, Mycobacterium tuberculosis
YGLANLGVGNIGFAN

SEQ ID NO: 184429 - protein, 15 aa, Mycobacterium tuberculosis
GLANLGVGNIGFANT

SEQ ID NO: 184430 - protein, 15 aa, Mycobacterium tuberculosis
LANLGVGNIGFANTG

SEQ ID NO: 184431 - protein, 15 aa, Mycobacterium tuberculosis
ANLGVGNIGFANTGS

SEQ ID NO: 184432 - protein, 15 aa, Mycobacterium tuberculosis
NLGVGNIGFANTGSN

SEQ ID NO: 184433 - protein, 15 aa, Mycobacterium tuberculosis
LGVGNIGFANTGSNN

SEQ ID NO: 184434 - protein, 15 aa, Mycobacterium tuberculosis
GVGNIGFANTGSNNI

SEQ ID NO: 184435 - protein, 15 aa, Mycobacterium tuberculosis
VGNIGFANTGSNNIG

SEQ ID NO: 184436 - protein, 15 aa, Mycobacterium tuberculosis
GNIGFANTGSNNIGI

SEQ ID NO: 184437 - protein, 15 aa, Mycobacterium tuberculosis
NIGFANTGSNNIGIG

SEQ ID NO: 184438 - protein, 15 aa, Mycobacterium tuberculosis
IGFANTGSNNIGIGL

SEQ ID NO: 184439 - protein, 15 aa, Mycobacterium tuberculosis
GFANTGSNNIGIGLT

SEQ ID NO: 184440 - protein, 15 aa, Mycobacterium tuberculosis
FANTGSNNIGIGLTG

SEQ ID NO: 184441 - protein, 15 aa, Mycobacterium tuberculosis
ANTGSNNIGIGLTGD

SEQ ID NO: 184442 - protein, 15 aa, Mycobacterium tuberculosis
NTGSNNIGIGLTGDN

SEQ ID NO: 184443 - protein, 15 aa, Mycobacterium tuberculosis
TGSNNIGIGLTGDNL

SEQ ID NO: 184444 - protein, 15 aa, Mycobacterium tuberculosis
GSNNIGIGLTGDNLT

SEQ ID NO: 184445 - protein, 15 aa, Mycobacterium tuberculosis
SNNIGIGLTGDNLTG

SEQ ID NO: 184446 - protein, 15 aa, Mycobacterium tuberculosis
NNIGIGLTGDNLTGI

SEQ ID NO: 184447 - protein, 15 aa, Mycobacterium tuberculosis
NIGIGLTGDNLTGIG

SEQ ID NO: 184448 - protein, 15 aa, Mycobacterium tuberculosis
IGIGLTGDNLTGIGG

SEQ ID NO: 184449 - protein, 15 aa, Mycobacterium tuberculosis
GIGLTGDNLTGIGGL

SEQ ID NO: 184450 - protein, 15 aa, Mycobacterium tuberculosis
IGLTGDNLTGIGGLN

SEQ ID NO: 184451 - protein, 15 aa, Mycobacterium tuberculosis
GLTGDNLTGIGGLNS

SEQ ID NO: 184452 - protein, 15 aa, Mycobacterium tuberculosis
LTGDNLTGIGGLNSG

SEQ ID NO: 184453 - protein, 15 aa, Mycobacterium tuberculosis
TGDNLTGIGGLNSGT

SEQ ID NO: 184454 - protein, 15 aa, Mycobacterium tuberculosis
GDNLTGIGGLNSGTG

SEQ ID NO: 184455 - protein, 15 aa, Mycobacterium tuberculosis
DNLTGIGGLNSGTGN

SEQ ID NO: 184456 - protein, 15 aa, Mycobacterium tuberculosis
NLTGIGGLNSGTGNL

SEQ ID NO: 184457 - protein, 15 aa, Mycobacterium tuberculosis
LTGIGGLNSGTGNLG

SEQ ID NO: 184458 - protein, 15 aa, Mycobacterium tuberculosis
TGIGGLNSGTGNLGL

SEQ ID NO: 184459 - protein, 15 aa, Mycobacterium tuberculosis
GIGGLNSGTGNLGLF

SEQ ID NO: 184460 - protein, 15 aa, Mycobacterium tuberculosis
IGGLNSGTGNLGLFN

SEQ ID NO: 184461 - protein, 15 aa, Mycobacterium tuberculosis
GGLNSGTGNLGLFNS

SEQ ID NO: 184462 - protein, 15 aa, Mycobacterium tuberculosis
GLNSGTGNLGLFNSG

SEQ ID NO: 184463 - protein, 15 aa, Mycobacterium tuberculosis
LNSGTGNLGLFNSGT

SEQ ID NO: 184464 - protein, 15 aa, Mycobacterium tuberculosis
NSGTGNLGLFNSGTG

SEQ ID NO: 184465 - protein, 15 aa, Mycobacterium tuberculosis
SGTGNLGLFNSGTGN

SEQ ID NO: 184466 - protein, 15 aa, Mycobacterium tuberculosis
GTGNLGLFNSGTGNI

SEQ ID NO: 184467 - protein, 15 aa, Mycobacterium tuberculosis
TGNLGLFNSGTGNIG

SEQ ID NO: 184468 - protein, 15 aa, Mycobacterium tuberculosis
GNLGLFNSGTGNIGF

SEQ ID NO: 184469 - protein, 15 aa, Mycobacterium tuberculosis
NLGLFNSGTGNIGFF

SEQ ID NO: 184470 - protein, 15 aa, Mycobacterium tuberculosis
LGLFNSGTGNIGFFN

SEQ ID NO: 184471 - protein, 15 aa, Mycobacterium tuberculosis
GLFNSGTGNIGFFNS

SEQ ID NO: 184472 - protein, 15 aa, Mycobacterium tuberculosis
LFNSGTGNIGFFNSG

SEQ ID NO: 184473 - protein, 15 aa, Mycobacterium tuberculosis
FNSGTGNIGFFNSGT

SEQ ID NO: 184474 - protein, 15 aa, Mycobacterium tuberculosis
NSGTGNIGFFNSGTG

SEQ ID NO: 184475 - protein, 15 aa, Mycobacterium tuberculosis
SGTGNIGFFNSGTGN

SEQ ID NO: 184476 - protein, 15 aa, Mycobacterium tuberculosis
GTGNIGFFNSGTGNF

SEQ ID NO: 184477 - protein, 15 aa, Mycobacterium tuberculosis
TGNIGFFNSGTGNFG

SEQ ID NO: 184478 - protein, 15 aa, Mycobacterium tuberculosis
GNIGFFNSGTGNFGV

SEQ ID NO: 184479 - protein, 15 aa, Mycobacterium tuberculosis
NIGFFNSGTGNFGVF

SEQ ID NO: 184480 - protein, 15 aa, Mycobacterium tuberculosis
IGFFNSGTGNFGVFN

SEQ ID NO: 184481 - protein, 15 aa, Mycobacterium tuberculosis
GFFNSGTGNFGVFNS

SEQ ID NO: 184482 - protein, 15 aa, Mycobacterium tuberculosis
FFNSGTGNFGVFNSG

SEQ ID NO: 184483 - protein, 15 aa, Mycobacterium tuberculosis
FNSGTGNFGVFNSGS

SEQ ID NO: 184484 - protein, 15 aa, Mycobacterium tuberculosis
NSGTGNFGVFNSGSY

SEQ ID NO: 184485 - protein, 15 aa, Mycobacterium tuberculosis
SGTGNFGVFNSGSYN

SEQ ID NO: 184486 - protein, 15 aa, Mycobacterium tuberculosis
GTGNFGVFNSGSYNT

SEQ ID NO: 184487 - protein, 15 aa, Mycobacterium tuberculosis
TGNFGVFNSGSYNTG

SEQ ID NO: 184488 - protein, 15 aa, Mycobacterium tuberculosis
GNFGVFNSGSYNTGV

SEQ ID NO: 184489 - protein, 15 aa, Mycobacterium tuberculosis
NFGVFNSGSYNTGVG

SEQ ID NO: 184490 - protein, 15 aa, Mycobacterium tuberculosis
FGVFNSGSYNTGVGN

SEQ ID NO: 184491 - protein, 15 aa, Mycobacterium tuberculosis
GVFNSGSYNTGVGNA

SEQ ID NO: 184492 - protein, 15 aa, Mycobacterium tuberculosis
VFNSGSYNTGVGNAG

SEQ ID NO: 184493 - protein, 15 aa, Mycobacterium tuberculosis
FNSGSYNTGVGNAGT

SEQ ID NO: 184494 - protein, 15 aa, Mycobacterium tuberculosis
NSGSYNTGVGNAGTA

SEQ ID NO: 184495 - protein, 15 aa, Mycobacterium tuberculosis
SGSYNTGVGNAGTAS

SEQ ID NO: 184496 - protein, 15 aa, Mycobacterium tuberculosis
GSYNTGVGNAGTAST

SEQ ID NO: 184497 - protein, 15 aa, Mycobacterium tuberculosis
SYNTGVGNAGTASTG

SEQ ID NO: 184498 - protein, 15 aa, Mycobacterium tuberculosis
YNTGVGNAGTASTGL

SEQ ID NO: 184499 - protein, 15 aa, Mycobacterium tuberculosis
NTGVGNAGTASTGLF

SEQ ID NO: 184500 - protein, 15 aa, Mycobacterium tuberculosis
TGVGNAGTASTGLFN

SEQ ID NO: 184501 - protein, 15 aa, Mycobacterium tuberculosis
GVGNAGTASTGLFNV

SEQ ID NO: 184502 - protein, 15 aa, Mycobacterium tuberculosis
VGNAGTASTGLFNVG

SEQ ID NO: 184503 - protein, 15 aa, Mycobacterium tuberculosis
GNAGTASTGLFNVGG

SEQ ID NO: 184504 - protein, 15 aa, Mycobacterium tuberculosis
NAGTASTGLFNVGGF

SEQ ID NO: 184505 - protein, 15 aa, Mycobacterium tuberculosis
AGTASTGLFNVGGFN

SEQ ID NO: 184506 - protein, 15 aa, Mycobacterium tuberculosis
GTASTGLFNVGGFNT

SEQ ID NO: 184507 - protein, 15 aa, Mycobacterium tuberculosis
TASTGLFNVGGFNTG

SEQ ID NO: 184508 - protein, 15 aa, Mycobacterium tuberculosis
ASTGLFNVGGFNTGV

SEQ ID NO: 184509 - protein, 15 aa, Mycobacterium tuberculosis
STGLFNVGGFNTGVA

SEQ ID NO: 184510 - protein, 15 aa, Mycobacterium tuberculosis
TGLFNVGGFNTGVAN

SEQ ID NO: 184511 - protein, 15 aa, Mycobacterium tuberculosis
GLFNVGGFNTGVANV

SEQ ID NO: 184512 - protein, 15 aa, Mycobacterium tuberculosis
LFNVGGFNTGVANVG

SEQ ID NO: 184513 - protein, 15 aa, Mycobacterium tuberculosis
FNVGGFNTGVANVGS

SEQ ID NO: 184514 - protein, 15 aa, Mycobacterium tuberculosis
NVGGFNTGVANVGSY

SEQ ID NO: 184515 - protein, 15 aa, Mycobacterium tuberculosis
VGGFNTGVANVGSYN

SEQ ID NO: 184516 - protein, 15 aa, Mycobacterium tuberculosis
GGFNTGVANVGSYNT

SEQ ID NO: 184517 - protein, 15 aa, Mycobacterium tuberculosis
GFNTGVANVGSYNTG

SEQ ID NO: 184518 - protein, 15 aa, Mycobacterium tuberculosis
FNTGVANVGSYNTGS

SEQ ID NO: 184519 - protein, 15 aa, Mycobacterium tuberculosis
NTGVANVGSYNTGSF

SEQ ID NO: 184520 - protein, 15 aa, Mycobacterium tuberculosis
TGVANVGSYNTGSFN

SEQ ID NO: 184521 - protein, 15 aa, Mycobacterium tuberculosis
GVANVGSYNTGSFNA

SEQ ID NO: 184522 - protein, 15 aa, Mycobacterium tuberculosis
VANVGSYNTGSFNAG

SEQ ID NO: 184523 - protein, 15 aa, Mycobacterium tuberculosis
ANVGSYNTGSFNAGN

SEQ ID NO: 184524 - protein, 15 aa, Mycobacterium tuberculosis
NVGSYNTGSFNAGNT

SEQ ID NO: 184525 - protein, 15 aa, Mycobacterium tuberculosis
VGSYNTGSFNAGNTN

SEQ ID NO: 184526 - protein, 15 aa, Mycobacterium tuberculosis
GSYNTGSFNAGNTNT

SEQ ID NO: 184527 - protein, 15 aa, Mycobacterium tuberculosis
SYNTGSFNAGNTNTG

SEQ ID NO: 184528 - protein, 15 aa, Mycobacterium tuberculosis
YNTGSFNAGNTNTGG

SEQ ID NO: 184529 - protein, 15 aa, Mycobacterium tuberculosis
NTGSFNAGNTNTGGF

SEQ ID NO: 184530 - protein, 15 aa, Mycobacterium tuberculosis
TGSFNAGNTNTGGFN

SEQ ID NO: 184531 - protein, 15 aa, Mycobacterium tuberculosis
GSFNAGNTNTGGFNP

SEQ ID NO: 184532 - protein, 15 aa, Mycobacterium tuberculosis
SFNAGNTNTGGFNPG

SEQ ID NO: 184533 - protein, 15 aa, Mycobacterium tuberculosis
FNAGNTNTGGFNPGN

SEQ ID NO: 184534 - protein, 15 aa, Mycobacterium tuberculosis
NAGNTNTGGFNPGNV

SEQ ID NO: 184535 - protein, 15 aa, Mycobacterium tuberculosis
AGNTNTGGFNPGNVN

SEQ ID NO: 184536 - protein, 15 aa, Mycobacterium tuberculosis
GNTNTGGFNPGNVNT

SEQ ID NO: 184537 - protein, 15 aa, Mycobacterium tuberculosis
NTNTGGFNPGNVNTG

SEQ ID NO: 184538 - protein, 15 aa, Mycobacterium tuberculosis
TNTGGFNPGNVNTGW

SEQ ID NO: 184539 - protein, 15 aa, Mycobacterium tuberculosis
NTGGFNPGNVNTGWL

SEQ ID NO: 184540 - protein, 15 aa, Mycobacterium tuberculosis
TGGFNPGNVNTGWLN

SEQ ID NO: 184541 - protein, 15 aa, Mycobacterium tuberculosis
GGFNPGNVNTGWLNT

SEQ ID NO: 184542 - protein, 15 aa, Mycobacterium tuberculosis
GFNPGNVNTGWLNTG

SEQ ID NO: 184543 - protein, 15 aa, Mycobacterium tuberculosis
FNPGNVNTGWLNTGN

SEQ ID NO: 184544 - protein, 15 aa, Mycobacterium tuberculosis
NPGNVNTGWLNTGNT

SEQ ID NO: 184545 - protein, 15 aa, Mycobacterium tuberculosis
PGNVNTGWLNTGNTN

SEQ ID NO: 184546 - protein, 15 aa, Mycobacterium tuberculosis
GNVNTGWLNTGNTNT

SEQ ID NO: 184547 - protein, 15 aa, Mycobacterium tuberculosis
NVNTGWLNTGNTNTG

SEQ ID NO: 184548 - protein, 15 aa, Mycobacterium tuberculosis
VNTGWLNTGNTNTGI

SEQ ID NO: 184549 - protein, 15 aa, Mycobacterium tuberculosis
NTGWLNTGNTNTGIA

SEQ ID NO: 184550 - protein, 15 aa, Mycobacterium tuberculosis
TGWLNTGNTNTGIAN

SEQ ID NO: 184551 - protein, 15 aa, Mycobacterium tuberculosis
GWLNTGNTNTGIANS

SEQ ID NO: 184552 - protein, 15 aa, Mycobacterium tuberculosis
WLNTGNTNTGIANSG

SEQ ID NO: 184553 - protein, 15 aa, Mycobacterium tuberculosis
LNTGNTNTGIANSGN

SEQ ID NO: 184554 - protein, 15 aa, Mycobacterium tuberculosis
NTGNTNTGIANSGNV

SEQ ID NO: 184555 - protein, 15 aa, Mycobacterium tuberculosis
TGNTNTGIANSGNVN

SEQ ID NO: 184556 - protein, 15 aa, Mycobacterium tuberculosis
GNTNTGIANSGNVNT

SEQ ID NO: 184557 - protein, 15 aa, Mycobacterium tuberculosis
NTNTGIANSGNVNTG

SEQ ID NO: 184558 - protein, 15 aa, Mycobacterium tuberculosis
TNTGIANSGNVNTGA

SEQ ID NO: 184559 - protein, 15 aa, Mycobacterium tuberculosis
NTGIANSGNVNTGAF

SEQ ID NO: 184560 - protein, 15 aa, Mycobacterium tuberculosis
TGIANSGNVNTGAFI

SEQ ID NO: 184561 - protein, 15 aa, Mycobacterium tuberculosis
GIANSGNVNTGAFIS

SEQ ID NO: 184562 - protein, 15 aa, Mycobacterium tuberculosis
IANSGNVNTGAFISG

SEQ ID NO: 184563 - protein, 15 aa, Mycobacterium tuberculosis
ANSGNVNTGAFISGN

SEQ ID NO: 184564 - protein, 15 aa, Mycobacterium tuberculosis
NSGNVNTGAFISGNF

SEQ ID NO: 184565 - protein, 15 aa, Mycobacterium tuberculosis
SGNVNTGAFISGNFS

SEQ ID NO: 184566 - protein, 15 aa, Mycobacterium tuberculosis
GNVNTGAFISGNFSN

SEQ ID NO: 184567 - protein, 15 aa, Mycobacterium tuberculosis
NVNTGAFISGNFSNG

SEQ ID NO: 184568 - protein, 15 aa, Mycobacterium tuberculosis
VNTGAFISGNFSNGV

SEQ ID NO: 184569 - protein, 15 aa, Mycobacterium tuberculosis
NTGAFISGNFSNGVL

SEQ ID NO: 184570 - protein, 15 aa, Mycobacterium tuberculosis
TGAFISGNFSNGVLW

SEQ ID NO: 184571 - protein, 15 aa, Mycobacterium tuberculosis
GAFISGNFSNGVLWR

SEQ ID NO: 184572 - protein, 15 aa, Mycobacterium tuberculosis
AFISGNFSNGVLWRG

SEQ ID NO: 184573 - protein, 15 aa, Mycobacterium tuberculosis
FISGNFSNGVLWRGD

SEQ ID NO: 184574 - protein, 15 aa, Mycobacterium tuberculosis
ISGNFSNGVLWRGDY

SEQ ID NO: 184575 - protein, 15 aa, Mycobacterium tuberculosis
SGNFSNGVLWRGDYE

SEQ ID NO: 184576 - protein, 15 aa, Mycobacterium tuberculosis
GNFSNGVLWRGDYEG

SEQ ID NO: 184577 - protein, 15 aa, Mycobacterium tuberculosis
NFSNGVLWRGDYEGL

SEQ ID NO: 184578 - protein, 15 aa, Mycobacterium tuberculosis
FSNGVLWRGDYEGLW

SEQ ID NO: 184579 - protein, 15 aa, Mycobacterium tuberculosis
SNGVLWRGDYEGLWG

SEQ ID NO: 184580 - protein, 15 aa, Mycobacterium tuberculosis
NGVLWRGDYEGLWGL

SEQ ID NO: 184581 - protein, 15 aa, Mycobacterium tuberculosis
GVLWRGDYEGLWGLS

SEQ ID NO: 184582 - protein, 15 aa, Mycobacterium tuberculosis
VLWRGDYEGLWGLSG

SEQ ID NO: 184583 - protein, 15 aa, Mycobacterium tuberculosis
LWRGDYEGLWGLSGG

SEQ ID NO: 184584 - protein, 15 aa, Mycobacterium tuberculosis
WRGDYEGLWGLSGGS

SEQ ID NO: 184585 - protein, 15 aa, Mycobacterium tuberculosis
RGDYEGLWGLSGGST

SEQ ID NO: 184586 - protein, 15 aa, Mycobacterium tuberculosis
GDYEGLWGLSGGSTI

SEQ ID NO: 184587 - protein, 15 aa, Mycobacterium tuberculosis
DYEGLWGLSGGSTIP

SEQ ID NO: 184588 - protein, 15 aa, Mycobacterium tuberculosis
YEGLWGLSGGSTIPA

SEQ ID NO: 184589 - protein, 15 aa, Mycobacterium tuberculosis
EGLWGLSGGSTIPAI

SEQ ID NO: 184590 - protein, 15 aa, Mycobacterium tuberculosis
GLWGLSGGSTIPAIP

SEQ ID NO: 184591 - protein, 15 aa, Mycobacterium tuberculosis
LWGLSGGSTIPAIPI

SEQ ID NO: 184592 - protein, 15 aa, Mycobacterium tuberculosis
WGLSGGSTIPAIPIG

SEQ ID NO: 184593 - protein, 15 aa, Mycobacterium tuberculosis
GLSGGSTIPAIPIGL

SEQ ID NO: 184594 - protein, 15 aa, Mycobacterium tuberculosis
LSGGSTIPAIPIGLE

SEQ ID NO: 184595 - protein, 15 aa, Mycobacterium tuberculosis
SGGSTIPAIPIGLEL

SEQ ID NO: 184596 - protein, 15 aa, Mycobacterium tuberculosis
GGSTIPAIPIGLELN

SEQ ID NO: 184597 - protein, 15 aa, Mycobacterium tuberculosis
GSTIPAIPIGLELNG

SEQ ID NO: 184598 - protein, 15 aa, Mycobacterium tuberculosis
STIPAIPIGLELNGG

SEQ ID NO: 184599 - protein, 15 aa, Mycobacterium tuberculosis
TIPAIPIGLELNGGV

SEQ ID NO: 184600 - protein, 15 aa, Mycobacterium tuberculosis
IPAIPIGLELNGGVG

SEQ ID NO: 184601 - protein, 15 aa, Mycobacterium tuberculosis
PAIPIGLELNGGVGP

SEQ ID NO: 184602 - protein, 15 aa, Mycobacterium tuberculosis
AIPIGLELNGGVGPI

SEQ ID NO: 184603 - protein, 15 aa, Mycobacterium tuberculosis
IPIGLELNGGVGPIT

SEQ ID NO: 184604 - protein, 15 aa, Mycobacterium tuberculosis
PIGLELNGGVGPITV

SEQ ID NO: 184605 - protein, 15 aa, Mycobacterium tuberculosis
IGLELNGGVGPITVL

SEQ ID NO: 184606 - protein, 15 aa, Mycobacterium tuberculosis
GLELNGGVGPITVLP

SEQ ID NO: 184607 - protein, 15 aa, Mycobacterium tuberculosis
LELNGGVGPITVLPI

SEQ ID NO: 184608 - protein, 15 aa, Mycobacterium tuberculosis
ELNGGVGPITVLPIQ

SEQ ID NO: 184609 - protein, 15 aa, Mycobacterium tuberculosis
LNGGVGPITVLPIQI

SEQ ID NO: 184610 - protein, 15 aa, Mycobacterium tuberculosis
NGGVGPITVLPIQIL

SEQ ID NO: 184611 - protein, 15 aa, Mycobacterium tuberculosis
GGVGPITVLPIQILP

SEQ ID NO: 184612 - protein, 15 aa, Mycobacterium tuberculosis
GVGPITVLPIQILPT

SEQ ID NO: 184613 - protein, 15 aa, Mycobacterium tuberculosis
VGPITVLPIQILPTI

SEQ ID NO: 184614 - protein, 15 aa, Mycobacterium tuberculosis
GPITVLPIQILPTIP

SEQ ID NO: 184615 - protein, 15 aa, Mycobacterium tuberculosis
PITVLPIQILPTIPL

SEQ ID NO: 184616 - protein, 15 aa, Mycobacterium tuberculosis
ITVLPIQILPTIPLN

SEQ ID NO: 184617 - protein, 15 aa, Mycobacterium tuberculosis
TVLPIQILPTIPLNI

SEQ ID NO: 184618 - protein, 15 aa, Mycobacterium tuberculosis
VLPIQILPTIPLNIH

SEQ ID NO: 184619 - protein, 15 aa, Mycobacterium tuberculosis
LPIQILPTIPLNIHQ

SEQ ID NO: 184620 - protein, 15 aa, Mycobacterium tuberculosis
PIQILPTIPLNIHQT

SEQ ID NO: 184621 - protein, 15 aa, Mycobacterium tuberculosis
IQILPTIPLNIHQTF

SEQ ID NO: 184622 - protein, 15 aa, Mycobacterium tuberculosis
QILPTIPLNIHQTFS

SEQ ID NO: 184623 - protein, 15 aa, Mycobacterium tuberculosis
ILPTIPLNIHQTFSL

SEQ ID NO: 184624 - protein, 15 aa, Mycobacterium tuberculosis
LPTIPLNIHQTFSLG

SEQ ID NO: 184625 - protein, 15 aa, Mycobacterium tuberculosis
PTIPLNIHQTFSLGP

SEQ ID NO: 184626 - protein, 15 aa, Mycobacterium tuberculosis
TIPLNIHQTFSLGPL

SEQ ID NO: 184627 - protein, 15 aa, Mycobacterium tuberculosis
IPLNIHQTFSLGPLV

SEQ ID NO: 184628 - protein, 15 aa, Mycobacterium tuberculosis
PLNIHQTFSLGPLVV

SEQ ID NO: 184629 - protein, 15 aa, Mycobacterium tuberculosis
LNIHQTFSLGPLVVP

SEQ ID NO: 184630 - protein, 15 aa, Mycobacterium tuberculosis
NIHQTFSLGPLVVPD

SEQ ID NO: 184631 - protein, 15 aa, Mycobacterium tuberculosis
IHQTFSLGPLVVPDI

SEQ ID NO: 184632 - protein, 15 aa, Mycobacterium tuberculosis
HQTFSLGPLVVPDIV

SEQ ID NO: 184633 - protein, 15 aa, Mycobacterium tuberculosis
QTFSLGPLVVPDIVI

SEQ ID NO: 184634 - protein, 15 aa, Mycobacterium tuberculosis
TFSLGPLVVPDIVIP

SEQ ID NO: 184635 - protein, 15 aa, Mycobacterium tuberculosis
FSLGPLVVPDIVIPA

SEQ ID NO: 184636 - protein, 15 aa, Mycobacterium tuberculosis
SLGPLVVPDIVIPAF

SEQ ID NO: 184637 - protein, 15 aa, Mycobacterium tuberculosis
LGPLVVPDIVIPAFG

SEQ ID NO: 184638 - protein, 15 aa, Mycobacterium tuberculosis
GPLVVPDIVIPAFGG

SEQ ID NO: 184639 - protein, 15 aa, Mycobacterium tuberculosis
PLVVPDIVIPAFGGG

SEQ ID NO: 184640 - protein, 15 aa, Mycobacterium tuberculosis
LVVPDIVIPAFGGGT

SEQ ID NO: 184641 - protein, 15 aa, Mycobacterium tuberculosis
VVPDIVIPAFGGGTA

SEQ ID NO: 184642 - protein, 15 aa, Mycobacterium tuberculosis
VPDIVIPAFGGGTAI

SEQ ID NO: 184643 - protein, 15 aa, Mycobacterium tuberculosis
PDIVIPAFGGGTAIP

SEQ ID NO: 184644 - protein, 15 aa, Mycobacterium tuberculosis
DIVIPAFGGGTAIPI

SEQ ID NO: 184645 - protein, 15 aa, Mycobacterium tuberculosis
IVIPAFGGGTAIPIS

SEQ ID NO: 184646 - protein, 15 aa, Mycobacterium tuberculosis
VIPAFGGGTAIPISV

SEQ ID NO: 184647 - protein, 15 aa, Mycobacterium tuberculosis
IPAFGGGTAIPISVG

SEQ ID NO: 184648 - protein, 15 aa, Mycobacterium tuberculosis
PAFGGGTAIPISVGP

SEQ ID NO: 184649 - protein, 15 aa, Mycobacterium tuberculosis
AFGGGTAIPISVGPI

SEQ ID NO: 184650 - protein, 15 aa, Mycobacterium tuberculosis
FGGGTAIPISVGPIT

SEQ ID NO: 184651 - protein, 15 aa, Mycobacterium tuberculosis
GGGTAIPISVGPITI

SEQ ID NO: 184652 - protein, 15 aa, Mycobacterium tuberculosis
GGTAIPISVGPITIS

SEQ ID NO: 184653 - protein, 15 aa, Mycobacterium tuberculosis
GTAIPISVGPITISP

SEQ ID NO: 184654 - protein, 15 aa, Mycobacterium tuberculosis
TAIPISVGPITISPI

SEQ ID NO: 184655 - protein, 15 aa, Mycobacterium tuberculosis
AIPISVGPITISPIT

SEQ ID NO: 184656 - protein, 15 aa, Mycobacterium tuberculosis
IPISVGPITISPITL

SEQ ID NO: 184657 - protein, 15 aa, Mycobacterium tuberculosis
PISVGPITISPITLF

SEQ ID NO: 184658 - protein, 15 aa, Mycobacterium tuberculosis
ISVGPITISPITLFP

SEQ ID NO: 184659 - protein, 15 aa, Mycobacterium tuberculosis
SVGPITISPITLFPA

SEQ ID NO: 184660 - protein, 15 aa, Mycobacterium tuberculosis
VGPITISPITLFPAQ

SEQ ID NO: 184661 - protein, 15 aa, Mycobacterium tuberculosis
GPITISPITLFPAQN

SEQ ID NO: 184662 - protein, 15 aa, Mycobacterium tuberculosis
PITISPITLFPAQNF

SEQ ID NO: 184663 - protein, 15 aa, Mycobacterium tuberculosis
ITISPITLFPAQNFN

SEQ ID NO: 184664 - protein, 15 aa, Mycobacterium tuberculosis
TISPITLFPAQNFNT

SEQ ID NO: 184665 - protein, 15 aa, Mycobacterium tuberculosis
ISPITLFPAQNFNTT

SEQ ID NO: 184666 - protein, 15 aa, Mycobacterium tuberculosis
SPITLFPAQNFNTTF

SEQ ID NO: 184667 - protein, 15 aa, Mycobacterium tuberculosis
PITLFPAQNFNTTFP

SEQ ID NO: 184668 - protein, 15 aa, Mycobacterium tuberculosis
ITLFPAQNFNTTFPV

SEQ ID NO: 184669 - protein, 15 aa, Mycobacterium tuberculosis
TLFPAQNFNTTFPVG

SEQ ID NO: 184670 - protein, 15 aa, Mycobacterium tuberculosis
LFPAQNFNTTFPVGP

SEQ ID NO: 184671 - protein, 15 aa, Mycobacterium tuberculosis
FPAQNFNTTFPVGPF

SEQ ID NO: 184672 - protein, 15 aa, Mycobacterium tuberculosis
PAQNFNTTFPVGPFF

SEQ ID NO: 184673 - protein, 15 aa, Mycobacterium tuberculosis
AQNFNTTFPVGPFFG

SEQ ID NO: 184674 - protein, 15 aa, Mycobacterium tuberculosis
QNFNTTFPVGPFFGL

SEQ ID NO: 184675 - protein, 15 aa, Mycobacterium tuberculosis
NFNTTFPVGPFFGLG

SEQ ID NO: 184676 - protein, 15 aa, Mycobacterium tuberculosis
FNTTFPVGPFFGLGV

SEQ ID NO: 184677 - protein, 15 aa, Mycobacterium tuberculosis
NTTFPVGPFFGLGVV

SEQ ID NO: 184678 - protein, 15 aa, Mycobacterium tuberculosis
TTFPVGPFFGLGVVN

SEQ ID NO: 184679 - protein, 15 aa, Mycobacterium tuberculosis
TFPVGPFFGLGVVNI

SEQ ID NO: 184680 - protein, 15 aa, Mycobacterium tuberculosis
FPVGPFFGLGVVNIS

SEQ ID NO: 184681 - protein, 15 aa, Mycobacterium tuberculosis
PVGPFFGLGVVNISG

SEQ ID NO: 184682 - protein, 15 aa, Mycobacterium tuberculosis
VGPFFGLGVVNISGI

SEQ ID NO: 184683 - protein, 15 aa, Mycobacterium tuberculosis
GPFFGLGVVNISGIE

SEQ ID NO: 184684 - protein, 15 aa, Mycobacterium tuberculosis
PFFGLGVVNISGIEI

SEQ ID NO: 184685 - protein, 15 aa, Mycobacterium tuberculosis
FFGLGVVNISGIEIK

SEQ ID NO: 184686 - protein, 15 aa, Mycobacterium tuberculosis
FGLGVVNISGIEIKD

SEQ ID NO: 184687 - protein, 15 aa, Mycobacterium tuberculosis
GLGVVNISGIEIKDL

SEQ ID NO: 184688 - protein, 15 aa, Mycobacterium tuberculosis
LGVVNISGIEIKDLA

SEQ ID NO: 184689 - protein, 15 aa, Mycobacterium tuberculosis
GVVNISGIEIKDLAG

SEQ ID NO: 184690 - protein, 15 aa, Mycobacterium tuberculosis
VVNISGIEIKDLAGN

SEQ ID NO: 184691 - protein, 15 aa, Mycobacterium tuberculosis
VNISGIEIKDLAGNV

SEQ ID NO: 184692 - protein, 15 aa, Mycobacterium tuberculosis
NISGIEIKDLAGNVT

SEQ ID NO: 184693 - protein, 15 aa, Mycobacterium tuberculosis
ISGIEIKDLAGNVTL

SEQ ID NO: 184694 - protein, 15 aa, Mycobacterium tuberculosis
SGIEIKDLAGNVTLQ

SEQ ID NO: 184695 - protein, 15 aa, Mycobacterium tuberculosis
GIEIKDLAGNVTLQL

SEQ ID NO: 184696 - protein, 15 aa, Mycobacterium tuberculosis
IEIKDLAGNVTLQLG

SEQ ID NO: 184697 - protein, 15 aa, Mycobacterium tuberculosis
EIKDLAGNVTLQLGN

SEQ ID NO: 184698 - protein, 15 aa, Mycobacterium tuberculosis
IKDLAGNVTLQLGNL

SEQ ID NO: 184699 - protein, 15 aa, Mycobacterium tuberculosis
KDLAGNVTLQLGNLN

SEQ ID NO: 184700 - protein, 15 aa, Mycobacterium tuberculosis
DLAGNVTLQLGNLNI

SEQ ID NO: 184701 - protein, 15 aa, Mycobacterium tuberculosis
LAGNVTLQLGNLNID

SEQ ID NO: 184702 - protein, 15 aa, Mycobacterium tuberculosis
AGNVTLQLGNLNIDT

SEQ ID NO: 184703 - protein, 15 aa, Mycobacterium tuberculosis
GNVTLQLGNLNIDTR

SEQ ID NO: 184704 - protein, 15 aa, Mycobacterium tuberculosis
NVTLQLGNLNIDTRI

SEQ ID NO: 184705 - protein, 15 aa, Mycobacterium tuberculosis
VTLQLGNLNIDTRIN

SEQ ID NO: 184706 - protein, 15 aa, Mycobacterium tuberculosis
TLQLGNLNIDTRINQ

SEQ ID NO: 184707 - protein, 15 aa, Mycobacterium tuberculosis
LQLGNLNIDTRINQS

SEQ ID NO: 184708 - protein, 15 aa, Mycobacterium tuberculosis
QLGNLNIDTRINQSF

SEQ ID NO: 184709 - protein, 15 aa, Mycobacterium tuberculosis
LGNLNIDTRINQSFP

SEQ ID NO: 184710 - protein, 15 aa, Mycobacterium tuberculosis
GNLNIDTRINQSFPV

SEQ ID NO: 184711 - protein, 15 aa, Mycobacterium tuberculosis
NLNIDTRINQSFPVT

SEQ ID NO: 184712 - protein, 15 aa, Mycobacterium tuberculosis
LNIDTRINQSFPVTV

SEQ ID NO: 184713 - protein, 15 aa, Mycobacterium tuberculosis
NIDTRINQSFPVTVN

SEQ ID NO: 184714 - protein, 15 aa, Mycobacterium tuberculosis
IDTRINQSFPVTVNW

SEQ ID NO: 184715 - protein, 15 aa, Mycobacterium tuberculosis
DTRINQSFPVTVNWS

SEQ ID NO: 184716 - protein, 15 aa, Mycobacterium tuberculosis
TRINQSFPVTVNWST

SEQ ID NO: 184717 - protein, 15 aa, Mycobacterium tuberculosis
RINQSFPVTVNWSTP

SEQ ID NO: 184718 - protein, 15 aa, Mycobacterium tuberculosis
INQSFPVTVNWSTPA

SEQ ID NO: 184719 - protein, 15 aa, Mycobacterium tuberculosis
NQSFPVTVNWSTPAV

SEQ ID NO: 184720 - protein, 15 aa, Mycobacterium tuberculosis
QSFPVTVNWSTPAVT

SEQ ID NO: 184721 - protein, 15 aa, Mycobacterium tuberculosis
SFPVTVNWSTPAVTI

SEQ ID NO: 184722 - protein, 15 aa, Mycobacterium tuberculosis
FPVTVNWSTPAVTIF

SEQ ID NO: 184723 - protein, 15 aa, Mycobacterium tuberculosis
PVTVNWSTPAVTIFP

SEQ ID NO: 184724 - protein, 15 aa, Mycobacterium tuberculosis
VTVNWSTPAVTIFPN

SEQ ID NO: 184725 - protein, 15 aa, Mycobacterium tuberculosis
TVNWSTPAVTIFPNG

SEQ ID NO: 184726 - protein, 15 aa, Mycobacterium tuberculosis
VNWSTPAVTIFPNGI

SEQ ID NO: 184727 - protein, 15 aa, Mycobacterium tuberculosis
NWSTPAVTIFPNGIS

SEQ ID NO: 184728 - protein, 15 aa, Mycobacterium tuberculosis
WSTPAVTIFPNGISI

SEQ ID NO: 184729 - protein, 15 aa, Mycobacterium tuberculosis
STPAVTIFPNGISIP

SEQ ID NO: 184730 - protein, 15 aa, Mycobacterium tuberculosis
TPAVTIFPNGISIPN

SEQ ID NO: 184731 - protein, 15 aa, Mycobacterium tuberculosis
PAVTIFPNGISIPNN

SEQ ID NO: 184732 - protein, 15 aa, Mycobacterium tuberculosis
AVTIFPNGISIPNNP

SEQ ID NO: 184733 - protein, 15 aa, Mycobacterium tuberculosis
VTIFPNGISIPNNPL

SEQ ID NO: 184734 - protein, 15 aa, Mycobacterium tuberculosis
TIFPNGISIPNNPLA

SEQ ID NO: 184735 - protein, 15 aa, Mycobacterium tuberculosis
IFPNGISIPNNPLAL

SEQ ID NO: 184736 - protein, 15 aa, Mycobacterium tuberculosis
FPNGISIPNNPLALL

SEQ ID NO: 184737 - protein, 15 aa, Mycobacterium tuberculosis
PNGISIPNNPLALLA

SEQ ID NO: 184738 - protein, 15 aa, Mycobacterium tuberculosis
NGISIPNNPLALLAS

SEQ ID NO: 184739 - protein, 15 aa, Mycobacterium tuberculosis
GISIPNNPLALLASA

SEQ ID NO: 184740 - protein, 15 aa, Mycobacterium tuberculosis
ISIPNNPLALLASAS

SEQ ID NO: 184741 - protein, 15 aa, Mycobacterium tuberculosis
SIPNNPLALLASASI

SEQ ID NO: 184742 - protein, 15 aa, Mycobacterium tuberculosis
IPNNPLALLASASIG

SEQ ID NO: 184743 - protein, 15 aa, Mycobacterium tuberculosis
PNNPLALLASASIGT

SEQ ID NO: 184744 - protein, 15 aa, Mycobacterium tuberculosis
NNPLALLASASIGTL

SEQ ID NO: 184745 - protein, 15 aa, Mycobacterium tuberculosis
NPLALLASASIGTLG

SEQ ID NO: 184746 - protein, 15 aa, Mycobacterium tuberculosis
PLALLASASIGTLGF

SEQ ID NO: 184747 - protein, 15 aa, Mycobacterium tuberculosis
LALLASASIGTLGFT

SEQ ID NO: 184748 - protein, 15 aa, Mycobacterium tuberculosis
ALLASASIGTLGFTI

SEQ ID NO: 184749 - protein, 15 aa, Mycobacterium tuberculosis
LLASASIGTLGFTIP

SEQ ID NO: 184750 - protein, 15 aa, Mycobacterium tuberculosis
LASASIGTLGFTIPG

SEQ ID NO: 184751 - protein, 15 aa, Mycobacterium tuberculosis
ASASIGTLGFTIPGF

SEQ ID NO: 184752 - protein, 15 aa, Mycobacterium tuberculosis
SASIGTLGFTIPGFT

SEQ ID NO: 184753 - protein, 15 aa, Mycobacterium tuberculosis
ASIGTLGFTIPGFTI

SEQ ID NO: 184754 - protein, 15 aa, Mycobacterium tuberculosis
SIGTLGFTIPGFTIP

SEQ ID NO: 184755 - protein, 15 aa, Mycobacterium tuberculosis
IGTLGFTIPGFTIPA

SEQ ID NO: 184756 - protein, 15 aa, Mycobacterium tuberculosis
GTLGFTIPGFTIPAA

SEQ ID NO: 184757 - protein, 15 aa, Mycobacterium tuberculosis
TLGFTIPGFTIPAAP

SEQ ID NO: 184758 - protein, 15 aa, Mycobacterium tuberculosis
LGFTIPGFTIPAAPL

SEQ ID NO: 184759 - protein, 15 aa, Mycobacterium tuberculosis
GFTIPGFTIPAAPLP

SEQ ID NO: 184760 - protein, 15 aa, Mycobacterium tuberculosis
FTIPGFTIPAAPLPL

SEQ ID NO: 184761 - protein, 15 aa, Mycobacterium tuberculosis
TIPGFTIPAAPLPLT

SEQ ID NO: 184762 - protein, 15 aa, Mycobacterium tuberculosis
IPGFTIPAAPLPLTI

SEQ ID NO: 184763 - protein, 15 aa, Mycobacterium tuberculosis
PGFTIPAAPLPLTID

SEQ ID NO: 184764 - protein, 15 aa, Mycobacterium tuberculosis
GFTIPAAPLPLTIDI

SEQ ID NO: 184765 - protein, 15 aa, Mycobacterium tuberculosis
FTIPAAPLPLTIDID

SEQ ID NO: 184766 - protein, 15 aa, Mycobacterium tuberculosis
TIPAAPLPLTIDIDG

SEQ ID NO: 184767 - protein, 15 aa, Mycobacterium tuberculosis
IPAAPLPLTIDIDGQ

SEQ ID NO: 184768 - protein, 15 aa, Mycobacterium tuberculosis
PAAPLPLTIDIDGQI

SEQ ID NO: 184769 - protein, 15 aa, Mycobacterium tuberculosis
AAPLPLTIDIDGQID

SEQ ID NO: 184770 - protein, 15 aa, Mycobacterium tuberculosis
APLPLTIDIDGQIDG

SEQ ID NO: 184771 - protein, 15 aa, Mycobacterium tuberculosis
PLPLTIDIDGQIDGF

SEQ ID NO: 184772 - protein, 15 aa, Mycobacterium tuberculosis
LPLTIDIDGQIDGFS

SEQ ID NO: 184773 - protein, 15 aa, Mycobacterium tuberculosis
PLTIDIDGQIDGFST

SEQ ID NO: 184774 - protein, 15 aa, Mycobacterium tuberculosis
LTIDIDGQIDGFSTP

SEQ ID NO: 184775 - protein, 15 aa, Mycobacterium tuberculosis
TIDIDGQIDGFSTPP

SEQ ID NO: 184776 - protein, 15 aa, Mycobacterium tuberculosis
IDIDGQIDGFSTPPI

SEQ ID NO: 184777 - protein, 15 aa, Mycobacterium tuberculosis
DIDGQIDGFSTPPIT

SEQ ID NO: 184778 - protein, 15 aa, Mycobacterium tuberculosis
IDGQIDGFSTPPITI

SEQ ID NO: 184779 - protein, 15 aa, Mycobacterium tuberculosis
DGQIDGFSTPPITID

SEQ ID NO: 184780 - protein, 15 aa, Mycobacterium tuberculosis
GQIDGFSTPPITIDR

SEQ ID NO: 184781 - protein, 15 aa, Mycobacterium tuberculosis
QIDGFSTPPITIDRI

SEQ ID NO: 184782 - protein, 15 aa, Mycobacterium tuberculosis
IDGFSTPPITIDRIP

SEQ ID NO: 184783 - protein, 15 aa, Mycobacterium tuberculosis
DGFSTPPITIDRIPL

SEQ ID NO: 184784 - protein, 15 aa, Mycobacterium tuberculosis
GFSTPPITIDRIPLN

SEQ ID NO: 184785 - protein, 15 aa, Mycobacterium tuberculosis
FSTPPITIDRIPLNL

SEQ ID NO: 184786 - protein, 15 aa, Mycobacterium tuberculosis
STPPITIDRIPLNLG

SEQ ID NO: 184787 - protein, 15 aa, Mycobacterium tuberculosis
TPPITIDRIPLNLGA

SEQ ID NO: 184788 - protein, 15 aa, Mycobacterium tuberculosis
PPITIDRIPLNLGAS

SEQ ID NO: 184789 - protein, 15 aa, Mycobacterium tuberculosis
PITIDRIPLNLGASV

SEQ ID NO: 184790 - protein, 15 aa, Mycobacterium tuberculosis
ITIDRIPLNLGASVT

SEQ ID NO: 184791 - protein, 15 aa, Mycobacterium tuberculosis
TIDRIPLNLGASVTV

SEQ ID NO: 184792 - protein, 15 aa, Mycobacterium tuberculosis
IDRIPLNLGASVTVG

SEQ ID NO: 184793 - protein, 15 aa, Mycobacterium tuberculosis
DRIPLNLGASVTVGP

SEQ ID NO: 184794 - protein, 15 aa, Mycobacterium tuberculosis
RIPLNLGASVTVGPI

SEQ ID NO: 184795 - protein, 15 aa, Mycobacterium tuberculosis
IPLNLGASVTVGPIL

SEQ ID NO: 184796 - protein, 15 aa, Mycobacterium tuberculosis
PLNLGASVTVGPILI

SEQ ID NO: 184797 - protein, 15 aa, Mycobacterium tuberculosis
LNLGASVTVGPILIN

SEQ ID NO: 184798 - protein, 15 aa, Mycobacterium tuberculosis
NLGASVTVGPILING

SEQ ID NO: 184799 - protein, 15 aa, Mycobacterium tuberculosis
LGASVTVGPILINGV

SEQ ID NO: 184800 - protein, 15 aa, Mycobacterium tuberculosis
GASVTVGPILINGVN

SEQ ID NO: 184801 - protein, 15 aa, Mycobacterium tuberculosis
ASVTVGPILINGVNI

SEQ ID NO: 184802 - protein, 15 aa, Mycobacterium tuberculosis
SVTVGPILINGVNIP

SEQ ID NO: 184803 - protein, 15 aa, Mycobacterium tuberculosis
VTVGPILINGVNIPA

SEQ ID NO: 184804 - protein, 15 aa, Mycobacterium tuberculosis
TVGPILINGVNIPAT

SEQ ID NO: 184805 - protein, 15 aa, Mycobacterium tuberculosis
VGPILINGVNIPATP

SEQ ID NO: 184806 - protein, 15 aa, Mycobacterium tuberculosis
GPILINGVNIPATPG

SEQ ID NO: 184807 - protein, 15 aa, Mycobacterium tuberculosis
PILINGVNIPATPGF

SEQ ID NO: 184808 - protein, 15 aa, Mycobacterium tuberculosis
ILINGVNIPATPGFG

SEQ ID NO: 184809 - protein, 15 aa, Mycobacterium tuberculosis
LINGVNIPATPGFGN

SEQ ID NO: 184810 - protein, 15 aa, Mycobacterium tuberculosis
INGVNIPATPGFGNT

SEQ ID NO: 184811 - protein, 15 aa, Mycobacterium tuberculosis
NGVNIPATPGFGNTT

SEQ ID NO: 184812 - protein, 15 aa, Mycobacterium tuberculosis
GVNIPATPGFGNTTT

SEQ ID NO: 184813 - protein, 15 aa, Mycobacterium tuberculosis
VNIPATPGFGNTTTA

SEQ ID NO: 184814 - protein, 15 aa, Mycobacterium tuberculosis
NIPATPGFGNTTTAP

SEQ ID NO: 184815 - protein, 15 aa, Mycobacterium tuberculosis
IPATPGFGNTTTAPS

SEQ ID NO: 184816 - protein, 15 aa, Mycobacterium tuberculosis
PATPGFGNTTTAPSS

SEQ ID NO: 184817 - protein, 15 aa, Mycobacterium tuberculosis
ATPGFGNTTTAPSSG

SEQ ID NO: 184818 - protein, 15 aa, Mycobacterium tuberculosis
TPGFGNTTTAPSSGF

SEQ ID NO: 184819 - protein, 15 aa, Mycobacterium tuberculosis
PGFGNTTTAPSSGFF

SEQ ID NO: 184820 - protein, 15 aa, Mycobacterium tuberculosis
GFGNTTTAPSSGFFN

SEQ ID NO: 184821 - protein, 15 aa, Mycobacterium tuberculosis
FGNTTTAPSSGFFNS

SEQ ID NO: 184822 - protein, 15 aa, Mycobacterium tuberculosis
GNTTTAPSSGFFNSG

SEQ ID NO: 184823 - protein, 15 aa, Mycobacterium tuberculosis
NTTTAPSSGFFNSGD

SEQ ID NO: 184824 - protein, 15 aa, Mycobacterium tuberculosis
TTTAPSSGFFNSGDG

SEQ ID NO: 184825 - protein, 15 aa, Mycobacterium tuberculosis
TTAPSSGFFNSGDGG

SEQ ID NO: 184826 - protein, 15 aa, Mycobacterium tuberculosis
TAPSSGFFNSGDGGV

SEQ ID NO: 184827 - protein, 15 aa, Mycobacterium tuberculosis
APSSGFFNSGDGGVS

SEQ ID NO: 184828 - protein, 15 aa, Mycobacterium tuberculosis
PSSGFFNSGDGGVSG

SEQ ID NO: 184829 - protein, 15 aa, Mycobacterium tuberculosis
SSGFFNSGDGGVSGF

SEQ ID NO: 184830 - protein, 15 aa, Mycobacterium tuberculosis
SGFFNSGDGGVSGFG

SEQ ID NO: 184831 - protein, 15 aa, Mycobacterium tuberculosis
GFFNSGDGGVSGFGN

SEQ ID NO: 184832 - protein, 15 aa, Mycobacterium tuberculosis
FFNSGDGGVSGFGNF

SEQ ID NO: 184833 - protein, 15 aa, Mycobacterium tuberculosis
FNSGDGGVSGFGNFG

SEQ ID NO: 184834 - protein, 15 aa, Mycobacterium tuberculosis
NSGDGGVSGFGNFGA

SEQ ID NO: 184835 - protein, 15 aa, Mycobacterium tuberculosis
SGDGGVSGFGNFGAG

SEQ ID NO: 184836 - protein, 15 aa, Mycobacterium tuberculosis
GDGGVSGFGNFGAGS

SEQ ID NO: 184837 - protein, 15 aa, Mycobacterium tuberculosis
DGGVSGFGNFGAGSS

SEQ ID NO: 184838 - protein, 15 aa, Mycobacterium tuberculosis
GGVSGFGNFGAGSSG

SEQ ID NO: 184839 - protein, 15 aa, Mycobacterium tuberculosis
GVSGFGNFGAGSSGW

SEQ ID NO: 184840 - protein, 15 aa, Mycobacterium tuberculosis
VSGFGNFGAGSSGWW

SEQ ID NO: 184841 - protein, 15 aa, Mycobacterium tuberculosis
SGFGNFGAGSSGWWN

SEQ ID NO: 184842 - protein, 15 aa, Mycobacterium tuberculosis
GFGNFGAGSSGWWNQ

SEQ ID NO: 184843 - protein, 15 aa, Mycobacterium tuberculosis
FGNFGAGSSGWWNQA

SEQ ID NO: 184844 - protein, 15 aa, Mycobacterium tuberculosis
GNFGAGSSGWWNQAQ

SEQ ID NO: 184845 - protein, 15 aa, Mycobacterium tuberculosis
NFGAGSSGWWNQAQT

SEQ ID NO: 184846 - protein, 15 aa, Mycobacterium tuberculosis
FGAGSSGWWNQAQTE

SEQ ID NO: 184847 - protein, 15 aa, Mycobacterium tuberculosis
GAGSSGWWNQAQTEV

SEQ ID NO: 184848 - protein, 15 aa, Mycobacterium tuberculosis
AGSSGWWNQAQTEVA

SEQ ID NO: 184849 - protein, 15 aa, Mycobacterium tuberculosis
GSSGWWNQAQTEVAG

SEQ ID NO: 184850 - protein, 15 aa, Mycobacterium tuberculosis
SSGWWNQAQTEVAGA

SEQ ID NO: 184851 - protein, 15 aa, Mycobacterium tuberculosis
SGWWNQAQTEVAGAG

SEQ ID NO: 184852 - protein, 15 aa, Mycobacterium tuberculosis
GWWNQAQTEVAGAGS

SEQ ID NO: 184853 - protein, 15 aa, Mycobacterium tuberculosis
WWNQAQTEVAGAGSG

SEQ ID NO: 184854 - protein, 15 aa, Mycobacterium tuberculosis
WNQAQTEVAGAGSGF

SEQ ID NO: 184855 - protein, 15 aa, Mycobacterium tuberculosis
NQAQTEVAGAGSGFA

SEQ ID NO: 184856 - protein, 15 aa, Mycobacterium tuberculosis
QAQTEVAGAGSGFAN

SEQ ID NO: 184857 - protein, 15 aa, Mycobacterium tuberculosis
AQTEVAGAGSGFANF

SEQ ID NO: 184858 - protein, 15 aa, Mycobacterium tuberculosis
QTEVAGAGSGFANFG

SEQ ID NO: 184859 - protein, 15 aa, Mycobacterium tuberculosis
TEVAGAGSGFANFGS

SEQ ID NO: 184860 - protein, 15 aa, Mycobacterium tuberculosis
EVAGAGSGFANFGSL

SEQ ID NO: 184861 - protein, 15 aa, Mycobacterium tuberculosis
VAGAGSGFANFGSLG

SEQ ID NO: 184862 - protein, 15 aa, Mycobacterium tuberculosis
AGAGSGFANFGSLGS

SEQ ID NO: 184863 - protein, 15 aa, Mycobacterium tuberculosis
GAGSGFANFGSLGSG

SEQ ID NO: 184864 - protein, 15 aa, Mycobacterium tuberculosis
AGSGFANFGSLGSGV

SEQ ID NO: 184865 - protein, 15 aa, Mycobacterium tuberculosis
GSGFANFGSLGSGVL

SEQ ID NO: 184866 - protein, 15 aa, Mycobacterium tuberculosis
SGFANFGSLGSGVLN

SEQ ID NO: 184867 - protein, 15 aa, Mycobacterium tuberculosis
GFANFGSLGSGVLNF

SEQ ID NO: 184868 - protein, 15 aa, Mycobacterium tuberculosis
FANFGSLGSGVLNFG

SEQ ID NO: 184869 - protein, 15 aa, Mycobacterium tuberculosis
ANFGSLGSGVLNFGS

SEQ ID NO: 184870 - protein, 15 aa, Mycobacterium tuberculosis
NFGSLGSGVLNFGSG

SEQ ID NO: 184871 - protein, 15 aa, Mycobacterium tuberculosis
FGSLGSGVLNFGSGV

SEQ ID NO: 184872 - protein, 15 aa, Mycobacterium tuberculosis
GSLGSGVLNFGSGVS

SEQ ID NO: 184873 - protein, 15 aa, Mycobacterium tuberculosis
SLGSGVLNFGSGVSG

SEQ ID NO: 184874 - protein, 15 aa, Mycobacterium tuberculosis
LGSGVLNFGSGVSGL

SEQ ID NO: 184875 - protein, 15 aa, Mycobacterium tuberculosis
GSGVLNFGSGVSGLY

SEQ ID NO: 184876 - protein, 15 aa, Mycobacterium tuberculosis
SGVLNFGSGVSGLYN

SEQ ID NO: 184877 - protein, 15 aa, Mycobacterium tuberculosis
GVLNFGSGVSGLYNT

SEQ ID NO: 184878 - protein, 15 aa, Mycobacterium tuberculosis
VLNFGSGVSGLYNTG

SEQ ID NO: 184879 - protein, 15 aa, Mycobacterium tuberculosis
LNFGSGVSGLYNTGG

SEQ ID NO: 184880 - protein, 15 aa, Mycobacterium tuberculosis
NFGSGVSGLYNTGGL

SEQ ID NO: 184881 - protein, 15 aa, Mycobacterium tuberculosis
FGSGVSGLYNTGGLP

SEQ ID NO: 184882 - protein, 15 aa, Mycobacterium tuberculosis
GSGVSGLYNTGGLPP

SEQ ID NO: 184883 - protein, 15 aa, Mycobacterium tuberculosis
SGVSGLYNTGGLPPG

SEQ ID NO: 184884 - protein, 15 aa, Mycobacterium tuberculosis
GVSGLYNTGGLPPGT

SEQ ID NO: 184885 - protein, 15 aa, Mycobacterium tuberculosis
VSGLYNTGGLPPGTP

SEQ ID NO: 184886 - protein, 15 aa, Mycobacterium tuberculosis
SGLYNTGGLPPGTPA

SEQ ID NO: 184887 - protein, 15 aa, Mycobacterium tuberculosis
GLYNTGGLPPGTPAV

SEQ ID NO: 184888 - protein, 15 aa, Mycobacterium tuberculosis
LYNTGGLPPGTPAVV

SEQ ID NO: 184889 - protein, 15 aa, Mycobacterium tuberculosis
YNTGGLPPGTPAVVS

SEQ ID NO: 184890 - protein, 15 aa, Mycobacterium tuberculosis
NTGGLPPGTPAVVSG

SEQ ID NO: 184891 - protein, 15 aa, Mycobacterium tuberculosis
TGGLPPGTPAVVSGI

SEQ ID NO: 184892 - protein, 15 aa, Mycobacterium tuberculosis
GGLPPGTPAVVSGIG

SEQ ID NO: 184893 - protein, 15 aa, Mycobacterium tuberculosis
GLPPGTPAVVSGIGN

SEQ ID NO: 184894 - protein, 15 aa, Mycobacterium tuberculosis
LPPGTPAVVSGIGNV

SEQ ID NO: 184895 - protein, 15 aa, Mycobacterium tuberculosis
PPGTPAVVSGIGNVG

SEQ ID NO: 184896 - protein, 15 aa, Mycobacterium tuberculosis
PGTPAVVSGIGNVGE

SEQ ID NO: 184897 - protein, 15 aa, Mycobacterium tuberculosis
GTPAVVSGIGNVGEQ

SEQ ID NO: 184898 - protein, 15 aa, Mycobacterium tuberculosis
TPAVVSGIGNVGEQL

SEQ ID NO: 184899 - protein, 15 aa, Mycobacterium tuberculosis
PAVVSGIGNVGEQLS

SEQ ID NO: 184900 - protein, 15 aa, Mycobacterium tuberculosis
AVVSGIGNVGEQLSG

SEQ ID NO: 184901 - protein, 15 aa, Mycobacterium tuberculosis
VVSGIGNVGEQLSGL

SEQ ID NO: 184902 - protein, 15 aa, Mycobacterium tuberculosis
VSGIGNVGEQLSGLS

SEQ ID NO: 184903 - protein, 15 aa, Mycobacterium tuberculosis
SGIGNVGEQLSGLSS

SEQ ID NO: 184904 - protein, 15 aa, Mycobacterium tuberculosis
GIGNVGEQLSGLSSA

SEQ ID NO: 184905 - protein, 15 aa, Mycobacterium tuberculosis
IGNVGEQLSGLSSAG

SEQ ID NO: 184906 - protein, 15 aa, Mycobacterium tuberculosis
GNVGEQLSGLSSAGT

SEQ ID NO: 184907 - protein, 15 aa, Mycobacterium tuberculosis
NVGEQLSGLSSAGTA

SEQ ID NO: 184908 - protein, 15 aa, Mycobacterium tuberculosis
VGEQLSGLSSAGTAL

SEQ ID NO: 184909 - protein, 15 aa, Mycobacterium tuberculosis
GEQLSGLSSAGTALN

SEQ ID NO: 184910 - protein, 15 aa, Mycobacterium tuberculosis
EQLSGLSSAGTALNQ

SEQ ID NO: 184911 - protein, 15 aa, Mycobacterium tuberculosis
QLSGLSSAGTALNQS

SEQ ID NO: 184912 - protein, 15 aa, Mycobacterium tuberculosis
LSGLSSAGTALNQSL

SEQ ID NO: 184913 - protein, 15 aa, Mycobacterium tuberculosis
SGLSSAGTALNQSLI

SEQ ID NO: 184914 - protein, 15 aa, Mycobacterium tuberculosis
GLSSAGTALNQSLII

SEQ ID NO: 184915 - protein, 15 aa, Mycobacterium tuberculosis
LSSAGTALNQSLIIN

SEQ ID NO: 184916 - protein, 15 aa, Mycobacterium tuberculosis
SSAGTALNQSLIINL

SEQ ID NO: 184917 - protein, 15 aa, Mycobacterium tuberculosis
SAGTALNQSLIINLG

SEQ ID NO: 184918 - protein, 15 aa, Mycobacterium tuberculosis
AGTALNQSLIINLGL

SEQ ID NO: 184919 - protein, 15 aa, Mycobacterium tuberculosis
GTALNQSLIINLGLA

SEQ ID NO: 184920 - protein, 15 aa, Mycobacterium tuberculosis
TALNQSLIINLGLAD

SEQ ID NO: 184921 - protein, 15 aa, Mycobacterium tuberculosis
ALNQSLIINLGLADV

SEQ ID NO: 184922 - protein, 15 aa, Mycobacterium tuberculosis
LNQSLIINLGLADVG

SEQ ID NO: 184923 - protein, 15 aa, Mycobacterium tuberculosis
NQSLIINLGLADVGS

SEQ ID NO: 184924 - protein, 15 aa, Mycobacterium tuberculosis
QSLIINLGLADVGSV

SEQ ID NO: 184925 - protein, 15 aa, Mycobacterium tuberculosis
SLIINLGLADVGSVN

SEQ ID NO: 184926 - protein, 15 aa, Mycobacterium tuberculosis
LIINLGLADVGSVNV

SEQ ID NO: 184927 - protein, 15 aa, Mycobacterium tuberculosis
IINLGLADVGSVNVG

SEQ ID NO: 184928 - protein, 15 aa, Mycobacterium tuberculosis
INLGLADVGSVNVGF

SEQ ID NO: 184929 - protein, 15 aa, Mycobacterium tuberculosis
NLGLADVGSVNVGFG

SEQ ID NO: 184930 - protein, 15 aa, Mycobacterium tuberculosis
LGLADVGSVNVGFGN

SEQ ID NO: 184931 - protein, 15 aa, Mycobacterium tuberculosis
GLADVGSVNVGFGNV

SEQ ID NO: 184932 - protein, 15 aa, Mycobacterium tuberculosis
LADVGSVNVGFGNVG

SEQ ID NO: 184933 - protein, 15 aa, Mycobacterium tuberculosis
ADVGSVNVGFGNVGD

SEQ ID NO: 184934 - protein, 15 aa, Mycobacterium tuberculosis
DVGSVNVGFGNVGDF

SEQ ID NO: 184935 - protein, 15 aa, Mycobacterium tuberculosis
VGSVNVGFGNVGDFN

SEQ ID NO: 184936 - protein, 15 aa, Mycobacterium tuberculosis
GSVNVGFGNVGDFNL

SEQ ID NO: 184937 - protein, 15 aa, Mycobacterium tuberculosis
SVNVGFGNVGDFNLG

SEQ ID NO: 184938 - protein, 15 aa, Mycobacterium tuberculosis
VNVGFGNVGDFNLGA

SEQ ID NO: 184939 - protein, 15 aa, Mycobacterium tuberculosis
NVGFGNVGDFNLGAA

SEQ ID NO: 184940 - protein, 15 aa, Mycobacterium tuberculosis
VGFGNVGDFNLGAAN

SEQ ID NO: 184941 - protein, 15 aa, Mycobacterium tuberculosis
GFGNVGDFNLGAANI

SEQ ID NO: 184942 - protein, 15 aa, Mycobacterium tuberculosis
FGNVGDFNLGAANIG

SEQ ID NO: 184943 - protein, 15 aa, Mycobacterium tuberculosis
GNVGDFNLGAANIGD

SEQ ID NO: 184944 - protein, 15 aa, Mycobacterium tuberculosis
NVGDFNLGAANIGDL

SEQ ID NO: 184945 - protein, 15 aa, Mycobacterium tuberculosis
VGDFNLGAANIGDLN

SEQ ID NO: 184946 - protein, 15 aa, Mycobacterium tuberculosis
GDFNLGAANIGDLNV

SEQ ID NO: 184947 - protein, 15 aa, Mycobacterium tuberculosis
DFNLGAANIGDLNVG

SEQ ID NO: 184948 - protein, 15 aa, Mycobacterium tuberculosis
FNLGAANIGDLNVGL

SEQ ID NO: 184949 - protein, 15 aa, Mycobacterium tuberculosis
NLGAANIGDLNVGLG

SEQ ID NO: 184950 - protein, 15 aa, Mycobacterium tuberculosis
LGAANIGDLNVGLGN

SEQ ID NO: 184951 - protein, 15 aa, Mycobacterium tuberculosis
GAANIGDLNVGLGNV

SEQ ID NO: 184952 - protein, 15 aa, Mycobacterium tuberculosis
AANIGDLNVGLGNVG

SEQ ID NO: 184953 - protein, 15 aa, Mycobacterium tuberculosis
ANIGDLNVGLGNVGG

SEQ ID NO: 184954 - protein, 15 aa, Mycobacterium tuberculosis
NIGDLNVGLGNVGGG

SEQ ID NO: 184955 - protein, 15 aa, Mycobacterium tuberculosis
IGDLNVGLGNVGGGN

SEQ ID NO: 184956 - protein, 15 aa, Mycobacterium tuberculosis
GDLNVGLGNVGGGNV

SEQ ID NO: 184957 - protein, 15 aa, Mycobacterium tuberculosis
DLNVGLGNVGGGNVG

SEQ ID NO: 184958 - protein, 15 aa, Mycobacterium tuberculosis
LNVGLGNVGGGNVGF

SEQ ID NO: 184959 - protein, 15 aa, Mycobacterium tuberculosis
NVGLGNVGGGNVGFG

SEQ ID NO: 184960 - protein, 15 aa, Mycobacterium tuberculosis
VGLGNVGGGNVGFGN

SEQ ID NO: 184961 - protein, 15 aa, Mycobacterium tuberculosis
GLGNVGGGNVGFGNI

SEQ ID NO: 184962 - protein, 15 aa, Mycobacterium tuberculosis
LGNVGGGNVGFGNIG

SEQ ID NO: 184963 - protein, 15 aa, Mycobacterium tuberculosis
GNVGGGNVGFGNIGD

SEQ ID NO: 184964 - protein, 15 aa, Mycobacterium tuberculosis
NVGGGNVGFGNIGDA

SEQ ID NO: 184965 - protein, 15 aa, Mycobacterium tuberculosis
VGGGNVGFGNIGDAN

SEQ ID NO: 184966 - protein, 15 aa, Mycobacterium tuberculosis
GGGNVGFGNIGDANF

SEQ ID NO: 184967 - protein, 15 aa, Mycobacterium tuberculosis
GGNVGFGNIGDANFG

SEQ ID NO: 184968 - protein, 15 aa, Mycobacterium tuberculosis
GNVGFGNIGDANFGL

SEQ ID NO: 184969 - protein, 15 aa, Mycobacterium tuberculosis
NVGFGNIGDANFGLG

SEQ ID NO: 184970 - protein, 15 aa, Mycobacterium tuberculosis
VGFGNIGDANFGLGN

SEQ ID NO: 184971 - protein, 15 aa, Mycobacterium tuberculosis
GFGNIGDANFGLGNA

SEQ ID NO: 184972 - protein, 15 aa, Mycobacterium tuberculosis
FGNIGDANFGLGNAG

SEQ ID NO: 184973 - protein, 15 aa, Mycobacterium tuberculosis
GNIGDANFGLGNAGL

SEQ ID NO: 184974 - protein, 15 aa, Mycobacterium tuberculosis
NIGDANFGLGNAGLA

SEQ ID NO: 184975 - protein, 15 aa, Mycobacterium tuberculosis
IGDANFGLGNAGLAA

SEQ ID NO: 184976 - protein, 15 aa, Mycobacterium tuberculosis
GDANFGLGNAGLAAG

SEQ ID NO: 184977 - protein, 15 aa, Mycobacterium tuberculosis
DANFGLGNAGLAAGL

SEQ ID NO: 184978 - protein, 15 aa, Mycobacterium tuberculosis
ANFGLGNAGLAAGLA

SEQ ID NO: 184979 - protein, 15 aa, Mycobacterium tuberculosis
NFGLGNAGLAAGLAG

SEQ ID NO: 184980 - protein, 15 aa, Mycobacterium tuberculosis
FGLGNAGLAAGLAGV

SEQ ID NO: 184981 - protein, 15 aa, Mycobacterium tuberculosis
GLGNAGLAAGLAGVG

SEQ ID NO: 184982 - protein, 15 aa, Mycobacterium tuberculosis
LGNAGLAAGLAGVGN

SEQ ID NO: 184983 - protein, 15 aa, Mycobacterium tuberculosis
GNAGLAAGLAGVGNI

SEQ ID NO: 184984 - protein, 15 aa, Mycobacterium tuberculosis
NAGLAAGLAGVGNIG

SEQ ID NO: 184985 - protein, 15 aa, Mycobacterium tuberculosis
AGLAAGLAGVGNIGL

SEQ ID NO: 184986 - protein, 15 aa, Mycobacterium tuberculosis
GLAAGLAGVGNIGLG

SEQ ID NO: 184987 - protein, 15 aa, Mycobacterium tuberculosis
LAAGLAGVGNIGLGN

SEQ ID NO: 184988 - protein, 15 aa, Mycobacterium tuberculosis
AAGLAGVGNIGLGNA

SEQ ID NO: 184989 - protein, 15 aa, Mycobacterium tuberculosis
AGLAGVGNIGLGNAG

SEQ ID NO: 184990 - protein, 15 aa, Mycobacterium tuberculosis
GLAGVGNIGLGNAGS

SEQ ID NO: 184991 - protein, 15 aa, Mycobacterium tuberculosis
LAGVGNIGLGNAGSG

SEQ ID NO: 184992 - protein, 15 aa, Mycobacterium tuberculosis
AGVGNIGLGNAGSGN

SEQ ID NO: 184993 - protein, 15 aa, Mycobacterium tuberculosis
GVGNIGLGNAGSGNV

SEQ ID NO: 184994 - protein, 15 aa, Mycobacterium tuberculosis
VGNIGLGNAGSGNVG

SEQ ID NO: 184995 - protein, 15 aa, Mycobacterium tuberculosis
GNIGLGNAGSGNVGF

SEQ ID NO: 184996 - protein, 15 aa, Mycobacterium tuberculosis
NIGLGNAGSGNVGFG

SEQ ID NO: 184997 - protein, 15 aa, Mycobacterium tuberculosis
IGLGNAGSGNVGFGN

SEQ ID NO: 184998 - protein, 15 aa, Mycobacterium tuberculosis
GLGNAGSGNVGFGNM

SEQ ID NO: 184999 - protein, 15 aa, Mycobacterium tuberculosis
LGNAGSGNVGFGNMG

SEQ ID NO: 185000 - protein, 15 aa, Mycobacterium tuberculosis
GNAGSGNVGFGNMGV

SEQ ID NO: 185001 - protein, 15 aa, Mycobacterium tuberculosis
NAGSGNVGFGNMGVG

SEQ ID NO: 185002 - protein, 15 aa, Mycobacterium tuberculosis
AGSGNVGFGNMGVGN

SEQ ID NO: 185003 - protein, 15 aa, Mycobacterium tuberculosis
GSGNVGFGNMGVGNI

SEQ ID NO: 185004 - protein, 15 aa, Mycobacterium tuberculosis
SGNVGFGNMGVGNIG

SEQ ID NO: 185005 - protein, 15 aa, Mycobacterium tuberculosis
GNVGFGNMGVGNIGF

SEQ ID NO: 185006 - protein, 15 aa, Mycobacterium tuberculosis
NVGFGNMGVGNIGFG

SEQ ID NO: 185007 - protein, 15 aa, Mycobacterium tuberculosis
VGFGNMGVGNIGFGN

SEQ ID NO: 185008 - protein, 15 aa, Mycobacterium tuberculosis
GFGNMGVGNIGFGNT

SEQ ID NO: 185009 - protein, 15 aa, Mycobacterium tuberculosis
FGNMGVGNIGFGNTG

SEQ ID NO: 185010 - protein, 15 aa, Mycobacterium tuberculosis
GNMGVGNIGFGNTGT

SEQ ID NO: 185011 - protein, 15 aa, Mycobacterium tuberculosis
NMGVGNIGFGNTGTN

SEQ ID NO: 185012 - protein, 15 aa, Mycobacterium tuberculosis
MGVGNIGFGNTGTNN

SEQ ID NO: 185013 - protein, 15 aa, Mycobacterium tuberculosis
GVGNIGFGNTGTNNL

SEQ ID NO: 185014 - protein, 15 aa, Mycobacterium tuberculosis
VGNIGFGNTGTNNLG

SEQ ID NO: 185015 - protein, 15 aa, Mycobacterium tuberculosis
GNIGFGNTGTNNLGI

SEQ ID NO: 185016 - protein, 15 aa, Mycobacterium tuberculosis
NIGFGNTGTNNLGIG

SEQ ID NO: 185017 - protein, 15 aa, Mycobacterium tuberculosis
IGFGNTGTNNLGIGL

SEQ ID NO: 185018 - protein, 15 aa, Mycobacterium tuberculosis
GFGNTGTNNLGIGLT

SEQ ID NO: 185019 - protein, 15 aa, Mycobacterium tuberculosis
FGNTGTNNLGIGLTG

SEQ ID NO: 185020 - protein, 15 aa, Mycobacterium tuberculosis
GNTGTNNLGIGLTGD

SEQ ID NO: 185021 - protein, 15 aa, Mycobacterium tuberculosis
NTGTNNLGIGLTGDN

SEQ ID NO: 185022 - protein, 15 aa, Mycobacterium tuberculosis
TGTNNLGIGLTGDNQ

SEQ ID NO: 185023 - protein, 15 aa, Mycobacterium tuberculosis
GTNNLGIGLTGDNQT

SEQ ID NO: 185024 - protein, 15 aa, Mycobacterium tuberculosis
TNNLGIGLTGDNQTG

SEQ ID NO: 185025 - protein, 15 aa, Mycobacterium tuberculosis
NNLGIGLTGDNQTGI

SEQ ID NO: 185026 - protein, 15 aa, Mycobacterium tuberculosis
NLGIGLTGDNQTGIG

SEQ ID NO: 185027 - protein, 15 aa, Mycobacterium tuberculosis
LGIGLTGDNQTGIGG

SEQ ID NO: 185028 - protein, 15 aa, Mycobacterium tuberculosis
GIGLTGDNQTGIGGL

SEQ ID NO: 185029 - protein, 15 aa, Mycobacterium tuberculosis
IGLTGDNQTGIGGLN

SEQ ID NO: 185030 - protein, 15 aa, Mycobacterium tuberculosis
GLTGDNQTGIGGLNS

SEQ ID NO: 185031 - protein, 15 aa, Mycobacterium tuberculosis
LTGDNQTGIGGLNSG

SEQ ID NO: 185032 - protein, 15 aa, Mycobacterium tuberculosis
TGDNQTGIGGLNSGA

SEQ ID NO: 185033 - protein, 15 aa, Mycobacterium tuberculosis
GDNQTGIGGLNSGAG

SEQ ID NO: 185034 - protein, 15 aa, Mycobacterium tuberculosis
DNQTGIGGLNSGAGN

SEQ ID NO: 185035 - protein, 15 aa, Mycobacterium tuberculosis
NQTGIGGLNSGAGNI

SEQ ID NO: 185036 - protein, 15 aa, Mycobacterium tuberculosis
QTGIGGLNSGAGNIG

SEQ ID NO: 185037 - protein, 15 aa, Mycobacterium tuberculosis
TGIGGLNSGAGNIGL

SEQ ID NO: 185038 - protein, 15 aa, Mycobacterium tuberculosis
GIGGLNSGAGNIGLF

SEQ ID NO: 185039 - protein, 15 aa, Mycobacterium tuberculosis
IGGLNSGAGNIGLFN

SEQ ID NO: 185040 - protein, 15 aa, Mycobacterium tuberculosis
GGLNSGAGNIGLFNS

SEQ ID NO: 185041 - protein, 15 aa, Mycobacterium tuberculosis
GLNSGAGNIGLFNSG

SEQ ID NO: 185042 - protein, 15 aa, Mycobacterium tuberculosis
LNSGAGNIGLFNSGT

SEQ ID NO: 185043 - protein, 15 aa, Mycobacterium tuberculosis
NSGAGNIGLFNSGTG

SEQ ID NO: 185044 - protein, 15 aa, Mycobacterium tuberculosis
SGAGNIGLFNSGTGN

SEQ ID NO: 185045 - protein, 15 aa, Mycobacterium tuberculosis
GAGNIGLFNSGTGNV

SEQ ID NO: 185046 - protein, 15 aa, Mycobacterium tuberculosis
AGNIGLFNSGTGNVG

SEQ ID NO: 185047 - protein, 15 aa, Mycobacterium tuberculosis
GNIGLFNSGTGNVGL

SEQ ID NO: 185048 - protein, 15 aa, Mycobacterium tuberculosis
NIGLFNSGTGNVGLF

SEQ ID NO: 185049 - protein, 15 aa, Mycobacterium tuberculosis
IGLFNSGTGNVGLFN

SEQ ID NO: 185050 - protein, 15 aa, Mycobacterium tuberculosis
GLFNSGTGNVGLFNS

SEQ ID NO: 185051 - protein, 15 aa, Mycobacterium tuberculosis
LFNSGTGNVGLFNSG

SEQ ID NO: 185052 - protein, 15 aa, Mycobacterium tuberculosis
FNSGTGNVGLFNSGT

SEQ ID NO: 185053 - protein, 15 aa, Mycobacterium tuberculosis
NSGTGNVGLFNSGTG

SEQ ID NO: 185054 - protein, 15 aa, Mycobacterium tuberculosis
SGTGNVGLFNSGTGN

SEQ ID NO: 185055 - protein, 15 aa, Mycobacterium tuberculosis
GTGNVGLFNSGTGNF

SEQ ID NO: 185056 - protein, 15 aa, Mycobacterium tuberculosis
TGNVGLFNSGTGNFG

SEQ ID NO: 185057 - protein, 15 aa, Mycobacterium tuberculosis
GNVGLFNSGTGNFGL

SEQ ID NO: 185058 - protein, 15 aa, Mycobacterium tuberculosis
NVGLFNSGTGNFGLF

SEQ ID NO: 185059 - protein, 15 aa, Mycobacterium tuberculosis
VGLFNSGTGNFGLFN

SEQ ID NO: 185060 - protein, 15 aa, Mycobacterium tuberculosis
GLFNSGTGNFGLFNS

SEQ ID NO: 185061 - protein, 15 aa, Mycobacterium tuberculosis
LFNSGTGNFGLFNSG

SEQ ID NO: 185062 - protein, 15 aa, Mycobacterium tuberculosis
FNSGTGNFGLFNSGS

SEQ ID NO: 185063 - protein, 15 aa, Mycobacterium tuberculosis
NSGTGNFGLFNSGSF

SEQ ID NO: 185064 - protein, 15 aa, Mycobacterium tuberculosis
SGTGNFGLFNSGSFN

SEQ ID NO: 185065 - protein, 15 aa, Mycobacterium tuberculosis
GTGNFGLFNSGSFNT

SEQ ID NO: 185066 - protein, 15 aa, Mycobacterium tuberculosis
TGNFGLFNSGSFNTG

SEQ ID NO: 185067 - protein, 15 aa, Mycobacterium tuberculosis
GNFGLFNSGSFNTGI

SEQ ID NO: 185068 - protein, 15 aa, Mycobacterium tuberculosis
NFGLFNSGSFNTGIG

SEQ ID NO: 185069 - protein, 15 aa, Mycobacterium tuberculosis
FGLFNSGSFNTGIGN

SEQ ID NO: 185070 - protein, 15 aa, Mycobacterium tuberculosis
GLFNSGSFNTGIGNG

SEQ ID NO: 185071 - protein, 15 aa, Mycobacterium tuberculosis
LFNSGSFNTGIGNGG

SEQ ID NO: 185072 - protein, 15 aa, Mycobacterium tuberculosis
FNSGSFNTGIGNGGT

SEQ ID NO: 185073 - protein, 15 aa, Mycobacterium tuberculosis
NSGSFNTGIGNGGTG

SEQ ID NO: 185074 - protein, 15 aa, Mycobacterium tuberculosis
SGSFNTGIGNGGTGS

SEQ ID NO: 185075 - protein, 15 aa, Mycobacterium tuberculosis
GSFNTGIGNGGTGST

SEQ ID NO: 185076 - protein, 15 aa, Mycobacterium tuberculosis
SFNTGIGNGGTGSTG

SEQ ID NO: 185077 - protein, 15 aa, Mycobacterium tuberculosis
FNTGIGNGGTGSTGL

SEQ ID NO: 185078 - protein, 15 aa, Mycobacterium tuberculosis
NTGIGNGGTGSTGLF

SEQ ID NO: 185079 - protein, 15 aa, Mycobacterium tuberculosis
TGIGNGGTGSTGLFN

SEQ ID NO: 185080 - protein, 15 aa, Mycobacterium tuberculosis
GIGNGGTGSTGLFNA

SEQ ID NO: 185081 - protein, 15 aa, Mycobacterium tuberculosis
IGNGGTGSTGLFNAG

SEQ ID NO: 185082 - protein, 15 aa, Mycobacterium tuberculosis
GNGGTGSTGLFNAGN

SEQ ID NO: 185083 - protein, 15 aa, Mycobacterium tuberculosis
NGGTGSTGLFNAGNF

SEQ ID NO: 185084 - protein, 15 aa, Mycobacterium tuberculosis
GGTGSTGLFNAGNFN

SEQ ID NO: 185085 - protein, 15 aa, Mycobacterium tuberculosis
GTGSTGLFNAGNFNT

SEQ ID NO: 185086 - protein, 15 aa, Mycobacterium tuberculosis
TGSTGLFNAGNFNTG

SEQ ID NO: 185087 - protein, 15 aa, Mycobacterium tuberculosis
GSTGLFNAGNFNTGV

SEQ ID NO: 185088 - protein, 15 aa, Mycobacterium tuberculosis
STGLFNAGNFNTGVA

SEQ ID NO: 185089 - protein, 15 aa, Mycobacterium tuberculosis
TGLFNAGNFNTGVAN

SEQ ID NO: 185090 - protein, 15 aa, Mycobacterium tuberculosis
GLFNAGNFNTGVANP

SEQ ID NO: 185091 - protein, 15 aa, Mycobacterium tuberculosis
LFNAGNFNTGVANPG

SEQ ID NO: 185092 - protein, 15 aa, Mycobacterium tuberculosis
FNAGNFNTGVANPGS

SEQ ID NO: 185093 - protein, 15 aa, Mycobacterium tuberculosis
NAGNFNTGVANPGSY

SEQ ID NO: 185094 - protein, 15 aa, Mycobacterium tuberculosis
AGNFNTGVANPGSYN

SEQ ID NO: 185095 - protein, 15 aa, Mycobacterium tuberculosis
GNFNTGVANPGSYNT

SEQ ID NO: 185096 - protein, 15 aa, Mycobacterium tuberculosis
NFNTGVANPGSYNTG

SEQ ID NO: 185097 - protein, 15 aa, Mycobacterium tuberculosis
FNTGVANPGSYNTGS

SEQ ID NO: 185098 - protein, 15 aa, Mycobacterium tuberculosis
NTGVANPGSYNTGSF

SEQ ID NO: 185099 - protein, 15 aa, Mycobacterium tuberculosis
TGVANPGSYNTGSFN

SEQ ID NO: 185100 - protein, 15 aa, Mycobacterium tuberculosis
GVANPGSYNTGSFNV

SEQ ID NO: 185101 - protein, 15 aa, Mycobacterium tuberculosis
VANPGSYNTGSFNVG

SEQ ID NO: 185102 - protein, 15 aa, Mycobacterium tuberculosis
ANPGSYNTGSFNVGD

SEQ ID NO: 185103 - protein, 15 aa, Mycobacterium tuberculosis
NPGSYNTGSFNVGDT

SEQ ID NO: 185104 - protein, 15 aa, Mycobacterium tuberculosis
PGSYNTGSFNVGDTN

SEQ ID NO: 185105 - protein, 15 aa, Mycobacterium tuberculosis
GSYNTGSFNVGDTNT

SEQ ID NO: 185106 - protein, 15 aa, Mycobacterium tuberculosis
SYNTGSFNVGDTNTG

SEQ ID NO: 185107 - protein, 15 aa, Mycobacterium tuberculosis
YNTGSFNVGDTNTGG

SEQ ID NO: 185108 - protein, 15 aa, Mycobacterium tuberculosis
NTGSFNVGDTNTGGF

SEQ ID NO: 185109 - protein, 15 aa, Mycobacterium tuberculosis
TGSFNVGDTNTGGFN

SEQ ID NO: 185110 - protein, 15 aa, Mycobacterium tuberculosis
GSFNVGDTNTGGFNP

SEQ ID NO: 185111 - protein, 15 aa, Mycobacterium tuberculosis
SFNVGDTNTGGFNPG

SEQ ID NO: 185112 - protein, 15 aa, Mycobacterium tuberculosis
FNVGDTNTGGFNPGS

SEQ ID NO: 185113 - protein, 15 aa, Mycobacterium tuberculosis
NVGDTNTGGFNPGSI

SEQ ID NO: 185114 - protein, 15 aa, Mycobacterium tuberculosis
VGDTNTGGFNPGSIN

SEQ ID NO: 185115 - protein, 15 aa, Mycobacterium tuberculosis
GDTNTGGFNPGSINT

SEQ ID NO: 185116 - protein, 15 aa, Mycobacterium tuberculosis
DTNTGGFNPGSINTG

SEQ ID NO: 185117 - protein, 15 aa, Mycobacterium tuberculosis
TNTGGFNPGSINTGW

SEQ ID NO: 185118 - protein, 15 aa, Mycobacterium tuberculosis
NTGGFNPGSINTGWF

SEQ ID NO: 185119 - protein, 15 aa, Mycobacterium tuberculosis
TGGFNPGSINTGWFN

SEQ ID NO: 185120 - protein, 15 aa, Mycobacterium tuberculosis
GGFNPGSINTGWFNT

SEQ ID NO: 185121 - protein, 15 aa, Mycobacterium tuberculosis
GFNPGSINTGWFNTG

SEQ ID NO: 185122 - protein, 15 aa, Mycobacterium tuberculosis
FNPGSINTGWFNTGN

SEQ ID NO: 185123 - protein, 15 aa, Mycobacterium tuberculosis
NPGSINTGWFNTGNA

SEQ ID NO: 185124 - protein, 15 aa, Mycobacterium tuberculosis
PGSINTGWFNTGNAN

SEQ ID NO: 185125 - protein, 15 aa, Mycobacterium tuberculosis
GSINTGWFNTGNANT

SEQ ID NO: 185126 - protein, 15 aa, Mycobacterium tuberculosis
SINTGWFNTGNANTG

SEQ ID NO: 185127 - protein, 15 aa, Mycobacterium tuberculosis
INTGWFNTGNANTGV

SEQ ID NO: 185128 - protein, 15 aa, Mycobacterium tuberculosis
NTGWFNTGNANTGVA

SEQ ID NO: 185129 - protein, 15 aa, Mycobacterium tuberculosis
TGWFNTGNANTGVAN

SEQ ID NO: 185130 - protein, 15 aa, Mycobacterium tuberculosis
GWFNTGNANTGVANS

SEQ ID NO: 185131 - protein, 15 aa, Mycobacterium tuberculosis
WFNTGNANTGVANSG

SEQ ID NO: 185132 - protein, 15 aa, Mycobacterium tuberculosis
FNTGNANTGVANSGN

SEQ ID NO: 185133 - protein, 15 aa, Mycobacterium tuberculosis
NTGNANTGVANSGNV

SEQ ID NO: 185134 - protein, 15 aa, Mycobacterium tuberculosis
TGNANTGVANSGNVD

SEQ ID NO: 185135 - protein, 15 aa, Mycobacterium tuberculosis
GNANTGVANSGNVDT

SEQ ID NO: 185136 - protein, 15 aa, Mycobacterium tuberculosis
NANTGVANSGNVDTG

SEQ ID NO: 185137 - protein, 15 aa, Mycobacterium tuberculosis
ANTGVANSGNVDTGA

SEQ ID NO: 185138 - protein, 15 aa, Mycobacterium tuberculosis
NTGVANSGNVDTGAL

SEQ ID NO: 185139 - protein, 15 aa, Mycobacterium tuberculosis
TGVANSGNVDTGALM

SEQ ID NO: 185140 - protein, 15 aa, Mycobacterium tuberculosis
GVANSGNVDTGALMS

SEQ ID NO: 185141 - protein, 15 aa, Mycobacterium tuberculosis
VANSGNVDTGALMSG

SEQ ID NO: 185142 - protein, 15 aa, Mycobacterium tuberculosis
ANSGNVDTGALMSGN

SEQ ID NO: 185143 - protein, 15 aa, Mycobacterium tuberculosis
NSGNVDTGALMSGNF

SEQ ID NO: 185144 - protein, 15 aa, Mycobacterium tuberculosis
SGNVDTGALMSGNFS

SEQ ID NO: 185145 - protein, 15 aa, Mycobacterium tuberculosis
GNVDTGALMSGNFSN

SEQ ID NO: 185146 - protein, 15 aa, Mycobacterium tuberculosis
NVDTGALMSGNFSNG

SEQ ID NO: 185147 - protein, 15 aa, Mycobacterium tuberculosis
VDTGALMSGNFSNGI

SEQ ID NO: 185148 - protein, 15 aa, Mycobacterium tuberculosis
DTGALMSGNFSNGIL

SEQ ID NO: 185149 - protein, 15 aa, Mycobacterium tuberculosis
TGALMSGNFSNGILW

SEQ ID NO: 185150 - protein, 15 aa, Mycobacterium tuberculosis
GALMSGNFSNGILWR

SEQ ID NO: 185151 - protein, 15 aa, Mycobacterium tuberculosis
ALMSGNFSNGILWRG

SEQ ID NO: 185152 - protein, 15 aa, Mycobacterium tuberculosis
LMSGNFSNGILWRGN

SEQ ID NO: 185153 - protein, 15 aa, Mycobacterium tuberculosis
MSGNFSNGILWRGNF

SEQ ID NO: 185154 - protein, 15 aa, Mycobacterium tuberculosis
SGNFSNGILWRGNFE

SEQ ID NO: 185155 - protein, 15 aa, Mycobacterium tuberculosis
GNFSNGILWRGNFEG

SEQ ID NO: 185156 - protein, 15 aa, Mycobacterium tuberculosis
NFSNGILWRGNFEGL

SEQ ID NO: 185157 - protein, 15 aa, Mycobacterium tuberculosis
FSNGILWRGNFEGLF

SEQ ID NO: 185158 - protein, 15 aa, Mycobacterium tuberculosis
SNGILWRGNFEGLFG

SEQ ID NO: 185159 - protein, 15 aa, Mycobacterium tuberculosis
NGILWRGNFEGLFGL

SEQ ID NO: 185160 - protein, 15 aa, Mycobacterium tuberculosis
GILWRGNFEGLFGLN

SEQ ID NO: 185161 - protein, 15 aa, Mycobacterium tuberculosis
ILWRGNFEGLFGLNV

SEQ ID NO: 185162 - protein, 15 aa, Mycobacterium tuberculosis
LWRGNFEGLFGLNVG

SEQ ID NO: 185163 - protein, 15 aa, Mycobacterium tuberculosis
WRGNFEGLFGLNVGI

SEQ ID NO: 185164 - protein, 15 aa, Mycobacterium tuberculosis
RGNFEGLFGLNVGIT

SEQ ID NO: 185165 - protein, 15 aa, Mycobacterium tuberculosis
GNFEGLFGLNVGITI

SEQ ID NO: 185166 - protein, 15 aa, Mycobacterium tuberculosis
NFEGLFGLNVGITIP

SEQ ID NO: 185167 - protein, 15 aa, Mycobacterium tuberculosis
FEGLFGLNVGITIPE

SEQ ID NO: 185168 - protein, 15 aa, Mycobacterium tuberculosis
EGLFGLNVGITIPEF

SEQ ID NO: 185169 - protein, 15 aa, Mycobacterium tuberculosis
GLFGLNVGITIPEFP

SEQ ID NO: 185170 - protein, 15 aa, Mycobacterium tuberculosis
LFGLNVGITIPEFPI

SEQ ID NO: 185171 - protein, 15 aa, Mycobacterium tuberculosis
FGLNVGITIPEFPIH

SEQ ID NO: 185172 - protein, 15 aa, Mycobacterium tuberculosis
GLNVGITIPEFPIHW

SEQ ID NO: 185173 - protein, 15 aa, Mycobacterium tuberculosis
LNVGITIPEFPIHWT

SEQ ID NO: 185174 - protein, 15 aa, Mycobacterium tuberculosis
NVGITIPEFPIHWTS

SEQ ID NO: 185175 - protein, 15 aa, Mycobacterium tuberculosis
VGITIPEFPIHWTST

SEQ ID NO: 185176 - protein, 15 aa, Mycobacterium tuberculosis
GITIPEFPIHWTSTG

SEQ ID NO: 185177 - protein, 15 aa, Mycobacterium tuberculosis
ITIPEFPIHWTSTGG

SEQ ID NO: 185178 - protein, 15 aa, Mycobacterium tuberculosis
TIPEFPIHWTSTGGI

SEQ ID NO: 185179 - protein, 15 aa, Mycobacterium tuberculosis
IPEFPIHWTSTGGIG

SEQ ID NO: 185180 - protein, 15 aa, Mycobacterium tuberculosis
PEFPIHWTSTGGIGP

SEQ ID NO: 185181 - protein, 15 aa, Mycobacterium tuberculosis
EFPIHWTSTGGIGPI

SEQ ID NO: 185182 - protein, 15 aa, Mycobacterium tuberculosis
FPIHWTSTGGIGPII

SEQ ID NO: 185183 - protein, 15 aa, Mycobacterium tuberculosis
PIHWTSTGGIGPIII

SEQ ID NO: 185184 - protein, 15 aa, Mycobacterium tuberculosis
IHWTSTGGIGPIIIP

SEQ ID NO: 185185 - protein, 15 aa, Mycobacterium tuberculosis
HWTSTGGIGPIIIPD

SEQ ID NO: 185186 - protein, 15 aa, Mycobacterium tuberculosis
WTSTGGIGPIIIPDT

SEQ ID NO: 185187 - protein, 15 aa, Mycobacterium tuberculosis
TSTGGIGPIIIPDTT

SEQ ID NO: 185188 - protein, 15 aa, Mycobacterium tuberculosis
STGGIGPIIIPDTTI

SEQ ID NO: 185189 - protein, 15 aa, Mycobacterium tuberculosis
TGGIGPIIIPDTTIL

SEQ ID NO: 185190 - protein, 15 aa, Mycobacterium tuberculosis
GGIGPIIIPDTTILP

SEQ ID NO: 185191 - protein, 15 aa, Mycobacterium tuberculosis
GIGPIIIPDTTILPP

SEQ ID NO: 185192 - protein, 15 aa, Mycobacterium tuberculosis
IGPIIIPDTTILPPI

SEQ ID NO: 185193 - protein, 15 aa, Mycobacterium tuberculosis
GPIIIPDTTILPPIH

SEQ ID NO: 185194 - protein, 15 aa, Mycobacterium tuberculosis
PIIIPDTTILPPIHL

SEQ ID NO: 185195 - protein, 15 aa, Mycobacterium tuberculosis
IIIPDTTILPPIHLG

SEQ ID NO: 185196 - protein, 15 aa, Mycobacterium tuberculosis
IIPDTTILPPIHLGL

SEQ ID NO: 185197 - protein, 15 aa, Mycobacterium tuberculosis
IPDTTILPPIHLGLT

SEQ ID NO: 185198 - protein, 15 aa, Mycobacterium tuberculosis
PDTTILPPIHLGLTG

SEQ ID NO: 185199 - protein, 15 aa, Mycobacterium tuberculosis
DTTILPPIHLGLTGQ

SEQ ID NO: 185200 - protein, 15 aa, Mycobacterium tuberculosis
TTILPPIHLGLTGQA

SEQ ID NO: 185201 - protein, 15 aa, Mycobacterium tuberculosis
TILPPIHLGLTGQAN

SEQ ID NO: 185202 - protein, 15 aa, Mycobacterium tuberculosis
ILPPIHLGLTGQANY

SEQ ID NO: 185203 - protein, 15 aa, Mycobacterium tuberculosis
LPPIHLGLTGQANYG

SEQ ID NO: 185204 - protein, 15 aa, Mycobacterium tuberculosis
PPIHLGLTGQANYGF

SEQ ID NO: 185205 - protein, 15 aa, Mycobacterium tuberculosis
PIHLGLTGQANYGFA

SEQ ID NO: 185206 - protein, 15 aa, Mycobacterium tuberculosis
IHLGLTGQANYGFAV

SEQ ID NO: 185207 - protein, 15 aa, Mycobacterium tuberculosis
HLGLTGQANYGFAVP

SEQ ID NO: 185208 - protein, 15 aa, Mycobacterium tuberculosis
LGLTGQANYGFAVPD

SEQ ID NO: 185209 - protein, 15 aa, Mycobacterium tuberculosis
GLTGQANYGFAVPDI

SEQ ID NO: 185210 - protein, 15 aa, Mycobacterium tuberculosis
LTGQANYGFAVPDIP

SEQ ID NO: 185211 - protein, 15 aa, Mycobacterium tuberculosis
TGQANYGFAVPDIPI

SEQ ID NO: 185212 - protein, 15 aa, Mycobacterium tuberculosis
GQANYGFAVPDIPIP

SEQ ID NO: 185213 - protein, 15 aa, Mycobacterium tuberculosis
QANYGFAVPDIPIPA

SEQ ID NO: 185214 - protein, 15 aa, Mycobacterium tuberculosis
ANYGFAVPDIPIPAI

SEQ ID NO: 185215 - protein, 15 aa, Mycobacterium tuberculosis
NYGFAVPDIPIPAIH

SEQ ID NO: 185216 - protein, 15 aa, Mycobacterium tuberculosis
YGFAVPDIPIPAIHI

SEQ ID NO: 185217 - protein, 15 aa, Mycobacterium tuberculosis
GFAVPDIPIPAIHID

SEQ ID NO: 185218 - protein, 15 aa, Mycobacterium tuberculosis
FAVPDIPIPAIHIDF

SEQ ID NO: 185219 - protein, 15 aa, Mycobacterium tuberculosis
AVPDIPIPAIHIDFD

SEQ ID NO: 185220 - protein, 15 aa, Mycobacterium tuberculosis
VPDIPIPAIHIDFDG

SEQ ID NO: 185221 - protein, 15 aa, Mycobacterium tuberculosis
PDIPIPAIHIDFDGA

SEQ ID NO: 185222 - protein, 15 aa, Mycobacterium tuberculosis
DIPIPAIHIDFDGAA

SEQ ID NO: 185223 - protein, 15 aa, Mycobacterium tuberculosis
IPIPAIHIDFDGAAD

SEQ ID NO: 185224 - protein, 15 aa, Mycobacterium tuberculosis
PIPAIHIDFDGAADA

SEQ ID NO: 185225 - protein, 15 aa, Mycobacterium tuberculosis
IPAIHIDFDGAADAG

SEQ ID NO: 185226 - protein, 15 aa, Mycobacterium tuberculosis
PAIHIDFDGAADAGF

SEQ ID NO: 185227 - protein, 15 aa, Mycobacterium tuberculosis
AIHIDFDGAADAGFT

SEQ ID NO: 185228 - protein, 15 aa, Mycobacterium tuberculosis
IHIDFDGAADAGFTA

SEQ ID NO: 185229 - protein, 15 aa, Mycobacterium tuberculosis
HIDFDGAADAGFTAP

SEQ ID NO: 185230 - protein, 15 aa, Mycobacterium tuberculosis
IDFDGAADAGFTAPA

SEQ ID NO: 185231 - protein, 15 aa, Mycobacterium tuberculosis
DFDGAADAGFTAPAT

SEQ ID NO: 185232 - protein, 15 aa, Mycobacterium tuberculosis
FDGAADAGFTAPATT

SEQ ID NO: 185233 - protein, 15 aa, Mycobacterium tuberculosis
DGAADAGFTAPATTL

SEQ ID NO: 185234 - protein, 15 aa, Mycobacterium tuberculosis
GAADAGFTAPATTLL

SEQ ID NO: 185235 - protein, 15 aa, Mycobacterium tuberculosis
AADAGFTAPATTLLS

SEQ ID NO: 185236 - protein, 15 aa, Mycobacterium tuberculosis
ADAGFTAPATTLLSA

SEQ ID NO: 185237 - protein, 15 aa, Mycobacterium tuberculosis
DAGFTAPATTLLSAL

SEQ ID NO: 185238 - protein, 15 aa, Mycobacterium tuberculosis
AGFTAPATTLLSALG

SEQ ID NO: 185239 - protein, 15 aa, Mycobacterium tuberculosis
GFTAPATTLLSALGI

SEQ ID NO: 185240 - protein, 15 aa, Mycobacterium tuberculosis
FTAPATTLLSALGIT

SEQ ID NO: 185241 - protein, 15 aa, Mycobacterium tuberculosis
TAPATTLLSALGITG

SEQ ID NO: 185242 - protein, 15 aa, Mycobacterium tuberculosis
APATTLLSALGITGQ

SEQ ID NO: 185243 - protein, 15 aa, Mycobacterium tuberculosis
PATTLLSALGITGQF

SEQ ID NO: 185244 - protein, 15 aa, Mycobacterium tuberculosis
ATTLLSALGITGQFR

SEQ ID NO: 185245 - protein, 15 aa, Mycobacterium tuberculosis
TTLLSALGITGQFRF

SEQ ID NO: 185246 - protein, 15 aa, Mycobacterium tuberculosis
TLLSALGITGQFRFG

SEQ ID NO: 185247 - protein, 15 aa, Mycobacterium tuberculosis
LLSALGITGQFRFGP

SEQ ID NO: 185248 - protein, 15 aa, Mycobacterium tuberculosis
LSALGITGQFRFGPI

SEQ ID NO: 185249 - protein, 15 aa, Mycobacterium tuberculosis
SALGITGQFRFGPIT

SEQ ID NO: 185250 - protein, 15 aa, Mycobacterium tuberculosis
ALGITGQFRFGPITV

SEQ ID NO: 185251 - protein, 15 aa, Mycobacterium tuberculosis
LGITGQFRFGPITVS

SEQ ID NO: 185252 - protein, 15 aa, Mycobacterium tuberculosis
GITGQFRFGPITVSN

SEQ ID NO: 185253 - protein, 15 aa, Mycobacterium tuberculosis
ITGQFRFGPITVSNV

SEQ ID NO: 185254 - protein, 15 aa, Mycobacterium tuberculosis
TGQFRFGPITVSNVQ

SEQ ID NO: 185255 - protein, 15 aa, Mycobacterium tuberculosis
GQFRFGPITVSNVQL

SEQ ID NO: 185256 - protein, 15 aa, Mycobacterium tuberculosis
QFRFGPITVSNVQLN

SEQ ID NO: 185257 - protein, 15 aa, Mycobacterium tuberculosis
FRFGPITVSNVQLNP

SEQ ID NO: 185258 - protein, 15 aa, Mycobacterium tuberculosis
RFGPITVSNVQLNPF

SEQ ID NO: 185259 - protein, 15 aa, Mycobacterium tuberculosis
FGPITVSNVQLNPFN

SEQ ID NO: 185260 - protein, 15 aa, Mycobacterium tuberculosis
GPITVSNVQLNPFNV

SEQ ID NO: 185261 - protein, 15 aa, Mycobacterium tuberculosis
PITVSNVQLNPFNVN

SEQ ID NO: 185262 - protein, 15 aa, Mycobacterium tuberculosis
ITVSNVQLNPFNVNL

SEQ ID NO: 185263 - protein, 15 aa, Mycobacterium tuberculosis
TVSNVQLNPFNVNLK

SEQ ID NO: 185264 - protein, 15 aa, Mycobacterium tuberculosis
VSNVQLNPFNVNLKL

SEQ ID NO: 185265 - protein, 15 aa, Mycobacterium tuberculosis
SNVQLNPFNVNLKLQ

SEQ ID NO: 185266 - protein, 15 aa, Mycobacterium tuberculosis
NVQLNPFNVNLKLQF

SEQ ID NO: 185267 - protein, 15 aa, Mycobacterium tuberculosis
VQLNPFNVNLKLQFL

SEQ ID NO: 185268 - protein, 15 aa, Mycobacterium tuberculosis
QLNPFNVNLKLQFLH

SEQ ID NO: 185269 - protein, 15 aa, Mycobacterium tuberculosis
LNPFNVNLKLQFLHD

SEQ ID NO: 185270 - protein, 15 aa, Mycobacterium tuberculosis
NPFNVNLKLQFLHDA

SEQ ID NO: 185271 - protein, 15 aa, Mycobacterium tuberculosis
PFNVNLKLQFLHDAF

SEQ ID NO: 185272 - protein, 15 aa, Mycobacterium tuberculosis
FNVNLKLQFLHDAFP

SEQ ID NO: 185273 - protein, 15 aa, Mycobacterium tuberculosis
NVNLKLQFLHDAFPN

SEQ ID NO: 185274 - protein, 15 aa, Mycobacterium tuberculosis
VNLKLQFLHDAFPNE

SEQ ID NO: 185275 - protein, 15 aa, Mycobacterium tuberculosis
NLKLQFLHDAFPNEF

SEQ ID NO: 185276 - protein, 15 aa, Mycobacterium tuberculosis
LKLQFLHDAFPNEFP

SEQ ID NO: 185277 - protein, 15 aa, Mycobacterium tuberculosis
KLQFLHDAFPNEFPD

SEQ ID NO: 185278 - protein, 15 aa, Mycobacterium tuberculosis
LQFLHDAFPNEFPDP

SEQ ID NO: 185279 - protein, 15 aa, Mycobacterium tuberculosis
QFLHDAFPNEFPDPT

SEQ ID NO: 185280 - protein, 15 aa, Mycobacterium tuberculosis
FLHDAFPNEFPDPTI

SEQ ID NO: 185281 - protein, 15 aa, Mycobacterium tuberculosis
LHDAFPNEFPDPTIS

SEQ ID NO: 185282 - protein, 15 aa, Mycobacterium tuberculosis
HDAFPNEFPDPTISV

SEQ ID NO: 185283 - protein, 15 aa, Mycobacterium tuberculosis
DAFPNEFPDPTISVQ

SEQ ID NO: 185284 - protein, 15 aa, Mycobacterium tuberculosis
AFPNEFPDPTISVQI

SEQ ID NO: 185285 - protein, 15 aa, Mycobacterium tuberculosis
FPNEFPDPTISVQIQ

SEQ ID NO: 185286 - protein, 15 aa, Mycobacterium tuberculosis
PNEFPDPTISVQIQV

SEQ ID NO: 185287 - protein, 15 aa, Mycobacterium tuberculosis
NEFPDPTISVQIQVA

SEQ ID NO: 185288 - protein, 15 aa, Mycobacterium tuberculosis
EFPDPTISVQIQVAI

SEQ ID NO: 185289 - protein, 15 aa, Mycobacterium tuberculosis
FPDPTISVQIQVAIP

SEQ ID NO: 185290 - protein, 15 aa, Mycobacterium tuberculosis
PDPTISVQIQVAIPL

SEQ ID NO: 185291 - protein, 15 aa, Mycobacterium tuberculosis
DPTISVQIQVAIPLT

SEQ ID NO: 185292 - protein, 15 aa, Mycobacterium tuberculosis
PTISVQIQVAIPLTS

SEQ ID NO: 185293 - protein, 15 aa, Mycobacterium tuberculosis
TISVQIQVAIPLTSA

SEQ ID NO: 185294 - protein, 15 aa, Mycobacterium tuberculosis
ISVQIQVAIPLTSAT

SEQ ID NO: 185295 - protein, 15 aa, Mycobacterium tuberculosis
SVQIQVAIPLTSATL

SEQ ID NO: 185296 - protein, 15 aa, Mycobacterium tuberculosis
VQIQVAIPLTSATLG

SEQ ID NO: 185297 - protein, 15 aa, Mycobacterium tuberculosis
QIQVAIPLTSATLGG

SEQ ID NO: 185298 - protein, 15 aa, Mycobacterium tuberculosis
IQVAIPLTSATLGGL

SEQ ID NO: 185299 - protein, 15 aa, Mycobacterium tuberculosis
QVAIPLTSATLGGLA

SEQ ID NO: 185300 - protein, 15 aa, Mycobacterium tuberculosis
VAIPLTSATLGGLAL

SEQ ID NO: 185301 - protein, 15 aa, Mycobacterium tuberculosis
AIPLTSATLGGLALP

SEQ ID NO: 185302 - protein, 15 aa, Mycobacterium tuberculosis
IPLTSATLGGLALPL

SEQ ID NO: 185303 - protein, 15 aa, Mycobacterium tuberculosis
PLTSATLGGLALPLQ

SEQ ID NO: 185304 - protein, 15 aa, Mycobacterium tuberculosis
LTSATLGGLALPLQQ

SEQ ID NO: 185305 - protein, 15 aa, Mycobacterium tuberculosis
TSATLGGLALPLQQT

SEQ ID NO: 185306 - protein, 15 aa, Mycobacterium tuberculosis
SATLGGLALPLQQTI

SEQ ID NO: 185307 - protein, 15 aa, Mycobacterium tuberculosis
ATLGGLALPLQQTID

SEQ ID NO: 185308 - protein, 15 aa, Mycobacterium tuberculosis
TLGGLALPLQQTIDA

SEQ ID NO: 185309 - protein, 15 aa, Mycobacterium tuberculosis
LGGLALPLQQTIDAI

SEQ ID NO: 185310 - protein, 15 aa, Mycobacterium tuberculosis
GGLALPLQQTIDAIE

SEQ ID NO: 185311 - protein, 15 aa, Mycobacterium tuberculosis
GLALPLQQTIDAIEL

SEQ ID NO: 185312 - protein, 15 aa, Mycobacterium tuberculosis
LALPLQQTIDAIELP

SEQ ID NO: 185313 - protein, 15 aa, Mycobacterium tuberculosis
ALPLQQTIDAIELPA

SEQ ID NO: 185314 - protein, 15 aa, Mycobacterium tuberculosis
LPLQQTIDAIELPAI

SEQ ID NO: 185315 - protein, 15 aa, Mycobacterium tuberculosis
PLQQTIDAIELPAIS

SEQ ID NO: 185316 - protein, 15 aa, Mycobacterium tuberculosis
LQQTIDAIELPAISF

SEQ ID NO: 185317 - protein, 15 aa, Mycobacterium tuberculosis
QQTIDAIELPAISFS

SEQ ID NO: 185318 - protein, 15 aa, Mycobacterium tuberculosis
QTIDAIELPAISFSQ

SEQ ID NO: 185319 - protein, 15 aa, Mycobacterium tuberculosis
TIDAIELPAISFSQS

SEQ ID NO: 185320 - protein, 15 aa, Mycobacterium tuberculosis
IDAIELPAISFSQSI

SEQ ID NO: 185321 - protein, 15 aa, Mycobacterium tuberculosis
DAIELPAISFSQSIP

SEQ ID NO: 185322 - protein, 15 aa, Mycobacterium tuberculosis
AIELPAISFSQSIPI

SEQ ID NO: 185323 - protein, 15 aa, Mycobacterium tuberculosis
IELPAISFSQSIPID

SEQ ID NO: 185324 - protein, 15 aa, Mycobacterium tuberculosis
ELPAISFSQSIPIDI

SEQ ID NO: 185325 - protein, 15 aa, Mycobacterium tuberculosis
LPAISFSQSIPIDIP

SEQ ID NO: 185326 - protein, 15 aa, Mycobacterium tuberculosis
PAISFSQSIPIDIPP

SEQ ID NO: 185327 - protein, 15 aa, Mycobacterium tuberculosis
AISFSQSIPIDIPPI

SEQ ID NO: 185328 - protein, 15 aa, Mycobacterium tuberculosis
ISFSQSIPIDIPPID

SEQ ID NO: 185329 - protein, 15 aa, Mycobacterium tuberculosis
SFSQSIPIDIPPIDI

SEQ ID NO: 185330 - protein, 15 aa, Mycobacterium tuberculosis
FSQSIPIDIPPIDIP

SEQ ID NO: 185331 - protein, 15 aa, Mycobacterium tuberculosis
SQSIPIDIPPIDIPA

SEQ ID NO: 185332 - protein, 15 aa, Mycobacterium tuberculosis
QSIPIDIPPIDIPAS

SEQ ID NO: 185333 - protein, 15 aa, Mycobacterium tuberculosis
SIPIDIPPIDIPAST

SEQ ID NO: 185334 - protein, 15 aa, Mycobacterium tuberculosis
IPIDIPPIDIPASTI

SEQ ID NO: 185335 - protein, 15 aa, Mycobacterium tuberculosis
PIDIPPIDIPASTIN

SEQ ID NO: 185336 - protein, 15 aa, Mycobacterium tuberculosis
IDIPPIDIPASTING

SEQ ID NO: 185337 - protein, 15 aa, Mycobacterium tuberculosis
DIPPIDIPASTINGI

SEQ ID NO: 185338 - protein, 15 aa, Mycobacterium tuberculosis
IPPIDIPASTINGIS

SEQ ID NO: 185339 - protein, 15 aa, Mycobacterium tuberculosis
PPIDIPASTINGISM

SEQ ID NO: 185340 - protein, 15 aa, Mycobacterium tuberculosis
PIDIPASTINGISMS

SEQ ID NO: 185341 - protein, 15 aa, Mycobacterium tuberculosis
IDIPASTINGISMSE

SEQ ID NO: 185342 - protein, 15 aa, Mycobacterium tuberculosis
DIPASTINGISMSEV

SEQ ID NO: 185343 - protein, 15 aa, Mycobacterium tuberculosis
IPASTINGISMSEVV

SEQ ID NO: 185344 - protein, 15 aa, Mycobacterium tuberculosis
PASTINGISMSEVVP

SEQ ID NO: 185345 - protein, 15 aa, Mycobacterium tuberculosis
ASTINGISMSEVVPI

SEQ ID NO: 185346 - protein, 15 aa, Mycobacterium tuberculosis
STINGISMSEVVPID

SEQ ID NO: 185347 - protein, 15 aa, Mycobacterium tuberculosis
TINGISMSEVVPIDV

SEQ ID NO: 185348 - protein, 15 aa, Mycobacterium tuberculosis
INGISMSEVVPIDVS

SEQ ID NO: 185349 - protein, 15 aa, Mycobacterium tuberculosis
NGISMSEVVPIDVSV

SEQ ID NO: 185350 - protein, 15 aa, Mycobacterium tuberculosis
GISMSEVVPIDVSVD

SEQ ID NO: 185351 - protein, 15 aa, Mycobacterium tuberculosis
ISMSEVVPIDVSVDI

SEQ ID NO: 185352 - protein, 15 aa, Mycobacterium tuberculosis
SMSEVVPIDVSVDIP

SEQ ID NO: 185353 - protein, 15 aa, Mycobacterium tuberculosis
MSEVVPIDVSVDIPA

SEQ ID NO: 185354 - protein, 15 aa, Mycobacterium tuberculosis
SEVVPIDVSVDIPAV

SEQ ID NO: 185355 - protein, 15 aa, Mycobacterium tuberculosis
EVVPIDVSVDIPAVT

SEQ ID NO: 185356 - protein, 15 aa, Mycobacterium tuberculosis
VVPIDVSVDIPAVTI

SEQ ID NO: 185357 - protein, 15 aa, Mycobacterium tuberculosis
VPIDVSVDIPAVTIT

SEQ ID NO: 185358 - protein, 15 aa, Mycobacterium tuberculosis
PIDVSVDIPAVTITG

SEQ ID NO: 185359 - protein, 15 aa, Mycobacterium tuberculosis
IDVSVDIPAVTITGT

SEQ ID NO: 185360 - protein, 15 aa, Mycobacterium tuberculosis
DVSVDIPAVTITGTR

SEQ ID NO: 185361 - protein, 15 aa, Mycobacterium tuberculosis
VSVDIPAVTITGTRI

SEQ ID NO: 185362 - protein, 15 aa, Mycobacterium tuberculosis
SVDIPAVTITGTRID

SEQ ID NO: 185363 - protein, 15 aa, Mycobacterium tuberculosis
VDIPAVTITGTRIDP

SEQ ID NO: 185364 - protein, 15 aa, Mycobacterium tuberculosis
DIPAVTITGTRIDPI

SEQ ID NO: 185365 - protein, 15 aa, Mycobacterium tuberculosis
IPAVTITGTRIDPIP

SEQ ID NO: 185366 - protein, 15 aa, Mycobacterium tuberculosis
PAVTITGTRIDPIPL

SEQ ID NO: 185367 - protein, 15 aa, Mycobacterium tuberculosis
AVTITGTRIDPIPLN

SEQ ID NO: 185368 - protein, 15 aa, Mycobacterium tuberculosis
VTITGTRIDPIPLNF

SEQ ID NO: 185369 - protein, 15 aa, Mycobacterium tuberculosis
TITGTRIDPIPLNFD

SEQ ID NO: 185370 - protein, 15 aa, Mycobacterium tuberculosis
ITGTRIDPIPLNFDV

SEQ ID NO: 185371 - protein, 15 aa, Mycobacterium tuberculosis
TGTRIDPIPLNFDVL

SEQ ID NO: 185372 - protein, 15 aa, Mycobacterium tuberculosis
GTRIDPIPLNFDVLS

SEQ ID NO: 185373 - protein, 15 aa, Mycobacterium tuberculosis
TRIDPIPLNFDVLSS

SEQ ID NO: 185374 - protein, 15 aa, Mycobacterium tuberculosis
RIDPIPLNFDVLSSA

SEQ ID NO: 185375 - protein, 15 aa, Mycobacterium tuberculosis
IDPIPLNFDVLSSAG

SEQ ID NO: 185376 - protein, 15 aa, Mycobacterium tuberculosis
DPIPLNFDVLSSAGP

SEQ ID NO: 185377 - protein, 15 aa, Mycobacterium tuberculosis
PIPLNFDVLSSAGPI

SEQ ID NO: 185378 - protein, 15 aa, Mycobacterium tuberculosis
IPLNFDVLSSAGPIN

SEQ ID NO: 185379 - protein, 15 aa, Mycobacterium tuberculosis
PLNFDVLSSAGPINI

SEQ ID NO: 185380 - protein, 15 aa, Mycobacterium tuberculosis
LNFDVLSSAGPINIS

SEQ ID NO: 185381 - protein, 15 aa, Mycobacterium tuberculosis
NFDVLSSAGPINISI

SEQ ID NO: 185382 - protein, 15 aa, Mycobacterium tuberculosis
FDVLSSAGPINISII

SEQ ID NO: 185383 - protein, 15 aa, Mycobacterium tuberculosis
DVLSSAGPINISIID

SEQ ID NO: 185384 - protein, 15 aa, Mycobacterium tuberculosis
VLSSAGPINISIIDI

SEQ ID NO: 185385 - protein, 15 aa, Mycobacterium tuberculosis
LSSAGPINISIIDIP

SEQ ID NO: 185386 - protein, 15 aa, Mycobacterium tuberculosis
SSAGPINISIIDIPA

SEQ ID NO: 185387 - protein, 15 aa, Mycobacterium tuberculosis
SAGPINISIIDIPAL

SEQ ID NO: 185388 - protein, 15 aa, Mycobacterium tuberculosis
AGPINISIIDIPALP

SEQ ID NO: 185389 - protein, 15 aa, Mycobacterium tuberculosis
GPINISIIDIPALPG

SEQ ID NO: 185390 - protein, 15 aa, Mycobacterium tuberculosis
PINISIIDIPALPGF

SEQ ID NO: 185391 - protein, 15 aa, Mycobacterium tuberculosis
INISIIDIPALPGFG

SEQ ID NO: 185392 - protein, 15 aa, Mycobacterium tuberculosis
NISIIDIPALPGFGN

SEQ ID NO: 185393 - protein, 15 aa, Mycobacterium tuberculosis
ISIIDIPALPGFGNS

SEQ ID NO: 185394 - protein, 15 aa, Mycobacterium tuberculosis
SIIDIPALPGFGNST

SEQ ID NO: 185395 - protein, 15 aa, Mycobacterium tuberculosis
IIDIPALPGFGNSTE

SEQ ID NO: 185396 - protein, 15 aa, Mycobacterium tuberculosis
IDIPALPGFGNSTEL

SEQ ID NO: 185397 - protein, 15 aa, Mycobacterium tuberculosis
DIPALPGFGNSTELP

SEQ ID NO: 185398 - protein, 15 aa, Mycobacterium tuberculosis
IPALPGFGNSTELPS

SEQ ID NO: 185399 - protein, 15 aa, Mycobacterium tuberculosis
PALPGFGNSTELPSS

SEQ ID NO: 185400 - protein, 15 aa, Mycobacterium tuberculosis
ALPGFGNSTELPSSG

SEQ ID NO: 185401 - protein, 15 aa, Mycobacterium tuberculosis
LPGFGNSTELPSSGF

SEQ ID NO: 185402 - protein, 15 aa, Mycobacterium tuberculosis
PGFGNSTELPSSGFF

SEQ ID NO: 185403 - protein, 15 aa, Mycobacterium tuberculosis
GFGNSTELPSSGFFN

SEQ ID NO: 185404 - protein, 15 aa, Mycobacterium tuberculosis
FGNSTELPSSGFFNT

SEQ ID NO: 185405 - protein, 15 aa, Mycobacterium tuberculosis
GNSTELPSSGFFNTG

SEQ ID NO: 185406 - protein, 15 aa, Mycobacterium tuberculosis
NSTELPSSGFFNTGG

SEQ ID NO: 185407 - protein, 15 aa, Mycobacterium tuberculosis
STELPSSGFFNTGGG

SEQ ID NO: 185408 - protein, 15 aa, Mycobacterium tuberculosis
TELPSSGFFNTGGGG

SEQ ID NO: 185409 - protein, 15 aa, Mycobacterium tuberculosis
ELPSSGFFNTGGGGG

SEQ ID NO: 185410 - protein, 15 aa, Mycobacterium tuberculosis
LPSSGFFNTGGGGGS

SEQ ID NO: 185411 - protein, 15 aa, Mycobacterium tuberculosis
PSSGFFNTGGGGGSG

SEQ ID NO: 185412 - protein, 15 aa, Mycobacterium tuberculosis
SSGFFNTGGGGGSGI

SEQ ID NO: 185413 - protein, 15 aa, Mycobacterium tuberculosis
SGFFNTGGGGGSGIA

SEQ ID NO: 185414 - protein, 15 aa, Mycobacterium tuberculosis
GFFNTGGGGGSGIAN

SEQ ID NO: 185415 - protein, 15 aa, Mycobacterium tuberculosis
FFNTGGGGGSGIANF

SEQ ID NO: 185416 - protein, 15 aa, Mycobacterium tuberculosis
FNTGGGGGSGIANFG

SEQ ID NO: 185417 - protein, 15 aa, Mycobacterium tuberculosis
NTGGGGGSGIANFGA

SEQ ID NO: 185418 - protein, 15 aa, Mycobacterium tuberculosis
TGGGGGSGIANFGAG

SEQ ID NO: 185419 - protein, 15 aa, Mycobacterium tuberculosis
GGGGGSGIANFGAGV

SEQ ID NO: 185420 - protein, 15 aa, Mycobacterium tuberculosis
GGGGSGIANFGAGVS

SEQ ID NO: 185421 - protein, 15 aa, Mycobacterium tuberculosis
GGGSGIANFGAGVSG

SEQ ID NO: 185422 - protein, 15 aa, Mycobacterium tuberculosis
GGSGIANFGAGVSGL

SEQ ID NO: 185423 - protein, 15 aa, Mycobacterium tuberculosis
GSGIANFGAGVSGLL

SEQ ID NO: 185424 - protein, 15 aa, Mycobacterium tuberculosis
SGIANFGAGVSGLLN

SEQ ID NO: 185425 - protein, 15 aa, Mycobacterium tuberculosis
GIANFGAGVSGLLNQ

SEQ ID NO: 185426 - protein, 15 aa, Mycobacterium tuberculosis
IANFGAGVSGLLNQA

SEQ ID NO: 185427 - protein, 15 aa, Mycobacterium tuberculosis
ANFGAGVSGLLNQAS

SEQ ID NO: 185428 - protein, 15 aa, Mycobacterium tuberculosis
NFGAGVSGLLNQASS

SEQ ID NO: 185429 - protein, 15 aa, Mycobacterium tuberculosis
FGAGVSGLLNQASSP

SEQ ID NO: 185430 - protein, 15 aa, Mycobacterium tuberculosis
GAGVSGLLNQASSPM

SEQ ID NO: 185431 - protein, 15 aa, Mycobacterium tuberculosis
AGVSGLLNQASSPMV

SEQ ID NO: 185432 - protein, 15 aa, Mycobacterium tuberculosis
GVSGLLNQASSPMVG

SEQ ID NO: 185433 - protein, 15 aa, Mycobacterium tuberculosis
VSGLLNQASSPMVGT

SEQ ID NO: 185434 - protein, 15 aa, Mycobacterium tuberculosis
SGLLNQASSPMVGTL

SEQ ID NO: 185435 - protein, 15 aa, Mycobacterium tuberculosis
GLLNQASSPMVGTLS

SEQ ID NO: 185436 - protein, 15 aa, Mycobacterium tuberculosis
LLNQASSPMVGTLSG

SEQ ID NO: 185437 - protein, 15 aa, Mycobacterium tuberculosis
LNQASSPMVGTLSGL

SEQ ID NO: 185438 - protein, 15 aa, Mycobacterium tuberculosis
NQASSPMVGTLSGLG

SEQ ID NO: 185439 - protein, 15 aa, Mycobacterium tuberculosis
QASSPMVGTLSGLGN

SEQ ID NO: 185440 - protein, 15 aa, Mycobacterium tuberculosis
ASSPMVGTLSGLGNA

SEQ ID NO: 185441 - protein, 15 aa, Mycobacterium tuberculosis
SSPMVGTLSGLGNAG

SEQ ID NO: 185442 - protein, 15 aa, Mycobacterium tuberculosis
SPMVGTLSGLGNAGS

SEQ ID NO: 185443 - protein, 15 aa, Mycobacterium tuberculosis
PMVGTLSGLGNAGSL

SEQ ID NO: 185444 - protein, 15 aa, Mycobacterium tuberculosis
MVGTLSGLGNAGSLA

SEQ ID NO: 185445 - protein, 15 aa, Mycobacterium tuberculosis
VGTLSGLGNAGSLAS

SEQ ID NO: 185446 - protein, 15 aa, Mycobacterium tuberculosis
GTLSGLGNAGSLASG

SEQ ID NO: 185447 - protein, 15 aa, Mycobacterium tuberculosis
TLSGLGNAGSLASGV

SEQ ID NO: 185448 - protein, 15 aa, Mycobacterium tuberculosis
LSGLGNAGSLASGVL

SEQ ID NO: 185449 - protein, 15 aa, Mycobacterium tuberculosis
SGLGNAGSLASGVLN

SEQ ID NO: 185450 - protein, 15 aa, Mycobacterium tuberculosis
GLGNAGSLASGVLNS

SEQ ID NO: 185451 - protein, 15 aa, Mycobacterium tuberculosis
LGNAGSLASGVLNSG

SEQ ID NO: 185452 - protein, 15 aa, Mycobacterium tuberculosis
GNAGSLASGVLNSGV

SEQ ID NO: 185453 - protein, 15 aa, Mycobacterium tuberculosis
NAGSLASGVLNSGVD

SEQ ID NO: 185454 - protein, 15 aa, Mycobacterium tuberculosis
AGSLASGVLNSGVDI

SEQ ID NO: 185455 - protein, 15 aa, Mycobacterium tuberculosis
GSLASGVLNSGVDIS

SEQ ID NO: 185456 - protein, 15 aa, Mycobacterium tuberculosis
SLASGVLNSGVDISG

SEQ ID NO: 185457 - protein, 15 aa, Mycobacterium tuberculosis
LASGVLNSGVDISGM

SEQ ID NO: 185458 - protein, 15 aa, Mycobacterium tuberculosis
ASGVLNSGVDISGMF

SEQ ID NO: 185459 - protein, 15 aa, Mycobacterium tuberculosis
SGVLNSGVDISGMFN

SEQ ID NO: 185460 - protein, 15 aa, Mycobacterium tuberculosis
GVLNSGVDISGMFNV

SEQ ID NO: 185461 - protein, 15 aa, Mycobacterium tuberculosis
VLNSGVDISGMFNVS

SEQ ID NO: 185462 - protein, 15 aa, Mycobacterium tuberculosis
LNSGVDISGMFNVST

SEQ ID NO: 185463 - protein, 15 aa, Mycobacterium tuberculosis
NSGVDISGMFNVSTL

SEQ ID NO: 185464 - protein, 15 aa, Mycobacterium tuberculosis
SGVDISGMFNVSTLG

SEQ ID NO: 185465 - protein, 15 aa, Mycobacterium tuberculosis
GVDISGMFNVSTLGS

SEQ ID NO: 185466 - protein, 15 aa, Mycobacterium tuberculosis
VDISGMFNVSTLGSA

SEQ ID NO: 185467 - protein, 15 aa, Mycobacterium tuberculosis
DISGMFNVSTLGSAP

SEQ ID NO: 185468 - protein, 15 aa, Mycobacterium tuberculosis
ISGMFNVSTLGSAPA

SEQ ID NO: 185469 - protein, 15 aa, Mycobacterium tuberculosis
SGMFNVSTLGSAPAV

SEQ ID NO: 185470 - protein, 15 aa, Mycobacterium tuberculosis
GMFNVSTLGSAPAVI

SEQ ID NO: 185471 - protein, 15 aa, Mycobacterium tuberculosis
MFNVSTLGSAPAVIS

SEQ ID NO: 185472 - protein, 15 aa, Mycobacterium tuberculosis
FNVSTLGSAPAVISG

SEQ ID NO: 185473 - protein, 15 aa, Mycobacterium tuberculosis
NVSTLGSAPAVISGF

SEQ ID NO: 185474 - protein, 15 aa, Mycobacterium tuberculosis
VSTLGSAPAVISGFG

SEQ ID NO: 185475 - protein, 15 aa, Mycobacterium tuberculosis
STLGSAPAVISGFGN

SEQ ID NO: 185476 - protein, 15 aa, Mycobacterium tuberculosis
TLGSAPAVISGFGNL

SEQ ID NO: 185477 - protein, 15 aa, Mycobacterium tuberculosis
LGSAPAVISGFGNLG

SEQ ID NO: 185478 - protein, 15 aa, Mycobacterium tuberculosis
GSAPAVISGFGNLGN

SEQ ID NO: 185479 - protein, 15 aa, Mycobacterium tuberculosis
SAPAVISGFGNLGNH

SEQ ID NO: 185480 - protein, 15 aa, Mycobacterium tuberculosis
APAVISGFGNLGNHV

SEQ ID NO: 185481 - protein, 15 aa, Mycobacterium tuberculosis
PAVISGFGNLGNHVS

SEQ ID NO: 185482 - protein, 15 aa, Mycobacterium tuberculosis
AVISGFGNLGNHVSG

SEQ ID NO: 185483 - protein, 15 aa, Mycobacterium tuberculosis
VISGFGNLGNHVSGV

SEQ ID NO: 185484 - protein, 15 aa, Mycobacterium tuberculosis
ISGFGNLGNHVSGVS

SEQ ID NO: 185485 - protein, 15 aa, Mycobacterium tuberculosis
SGFGNLGNHVSGVSI

SEQ ID NO: 185486 - protein, 15 aa, Mycobacterium tuberculosis
GFGNLGNHVSGVSID

SEQ ID NO: 185487 - protein, 15 aa, Mycobacterium tuberculosis
FGNLGNHVSGVSIDG

SEQ ID NO: 185488 - protein, 15 aa, Mycobacterium tuberculosis
GNLGNHVSGVSIDGL

SEQ ID NO: 185489 - protein, 15 aa, Mycobacterium tuberculosis
NLGNHVSGVSIDGLL

SEQ ID NO: 185490 - protein, 15 aa, Mycobacterium tuberculosis
LGNHVSGVSIDGLLA

SEQ ID NO: 185491 - protein, 15 aa, Mycobacterium tuberculosis
GNHVSGVSIDGLLAM

SEQ ID NO: 185492 - protein, 15 aa, Mycobacterium tuberculosis
NHVSGVSIDGLLAML

SEQ ID NO: 185493 - protein, 15 aa, Mycobacterium tuberculosis
HVSGVSIDGLLAMLT

SEQ ID NO: 185494 - protein, 15 aa, Mycobacterium tuberculosis
VSGVSIDGLLAMLTS

SEQ ID NO: 185495 - protein, 15 aa, Mycobacterium tuberculosis
SGVSIDGLLAMLTSG

SEQ ID NO: 185496 - protein, 15 aa, Mycobacterium tuberculosis
GVSIDGLLAMLTSGG

SEQ ID NO: 185497 - protein, 15 aa, Mycobacterium tuberculosis
VSIDGLLAMLTSGGS

SEQ ID NO: 185498 - protein, 15 aa, Mycobacterium tuberculosis
SIDGLLAMLTSGGSG

SEQ ID NO: 185499 - protein, 15 aa, Mycobacterium tuberculosis
IDGLLAMLTSGGSGG

SEQ ID NO: 185500 - protein, 15 aa, Mycobacterium tuberculosis
DGLLAMLTSGGSGGS

SEQ ID NO: 185501 - protein, 15 aa, Mycobacterium tuberculosis
GLLAMLTSGGSGGSG

SEQ ID NO: 185502 - protein, 15 aa, Mycobacterium tuberculosis
LLAMLTSGGSGGSGQ

SEQ ID NO: 185503 - protein, 15 aa, Mycobacterium tuberculosis
LAMLTSGGSGGSGQP

SEQ ID NO: 185504 - protein, 15 aa, Mycobacterium tuberculosis
AMLTSGGSGGSGQPS

SEQ ID NO: 185505 - protein, 15 aa, Mycobacterium tuberculosis
MLTSGGSGGSGQPSI

SEQ ID NO: 185506 - protein, 15 aa, Mycobacterium tuberculosis
LTSGGSGGSGQPSII

SEQ ID NO: 185507 - protein, 15 aa, Mycobacterium tuberculosis
TSGGSGGSGQPSIID

SEQ ID NO: 185508 - protein, 15 aa, Mycobacterium tuberculosis
SGGSGGSGQPSIIDA

SEQ ID NO: 185509 - protein, 15 aa, Mycobacterium tuberculosis
GGSGGSGQPSIIDAA

SEQ ID NO: 185510 - protein, 15 aa, Mycobacterium tuberculosis
GSGGSGQPSIIDAAI

SEQ ID NO: 185511 - protein, 15 aa, Mycobacterium tuberculosis
SGGSGQPSIIDAAIA

SEQ ID NO: 185512 - protein, 15 aa, Mycobacterium tuberculosis
GGSGQPSIIDAAIAE

SEQ ID NO: 185513 - protein, 15 aa, Mycobacterium tuberculosis
GSGQPSIIDAAIAEL

SEQ ID NO: 185514 - protein, 15 aa, Mycobacterium tuberculosis
SGQPSIIDAAIAELR

SEQ ID NO: 185515 - protein, 15 aa, Mycobacterium tuberculosis
GQPSIIDAAIAELRH

SEQ ID NO: 185516 - protein, 15 aa, Mycobacterium tuberculosis
QPSIIDAAIAELRHL

SEQ ID NO: 185517 - protein, 15 aa, Mycobacterium tuberculosis
PSIIDAAIAELRHLN

SEQ ID NO: 185518 - protein, 15 aa, Mycobacterium tuberculosis
SIIDAAIAELRHLNP

SEQ ID NO: 185519 - protein, 15 aa, Mycobacterium tuberculosis
IIDAAIAELRHLNPL

SEQ ID NO: 185520 - protein, 15 aa, Mycobacterium tuberculosis
IDAAIAELRHLNPLN

SEQ ID NO: 185521 - protein, 15 aa, Mycobacterium tuberculosis
DAAIAELRHLNPLNI

SEQ ID NO: 185522 - protein, 15 aa, Mycobacterium tuberculosis
AAIAELRHLNPLNIV

SEQ ID NO: 185523 - protein, 15 aa, Mycobacterium tuberculosis
AIAELRHLNPLNIVN

SEQ ID NO: 185524 - protein, 15 aa, Mycobacterium tuberculosis
IAELRHLNPLNIVNL

SEQ ID NO: 185525 - protein, 15 aa, Mycobacterium tuberculosis
AELRHLNPLNIVNLG

SEQ ID NO: 185526 - protein, 15 aa, Mycobacterium tuberculosis
ELRHLNPLNIVNLGN

SEQ ID NO: 185527 - protein, 15 aa, Mycobacterium tuberculosis
LRHLNPLNIVNLGNV

SEQ ID NO: 185528 - protein, 15 aa, Mycobacterium tuberculosis
RHLNPLNIVNLGNVG

SEQ ID NO: 185529 - protein, 15 aa, Mycobacterium tuberculosis
HLNPLNIVNLGNVGS

SEQ ID NO: 185530 - protein, 15 aa, Mycobacterium tuberculosis
LNPLNIVNLGNVGSY

SEQ ID NO: 185531 - protein, 15 aa, Mycobacterium tuberculosis
NPLNIVNLGNVGSYN

SEQ ID NO: 185532 - protein, 15 aa, Mycobacterium tuberculosis
PLNIVNLGNVGSYNL

SEQ ID NO: 185533 - protein, 15 aa, Mycobacterium tuberculosis
LNIVNLGNVGSYNLG

SEQ ID NO: 185534 - protein, 15 aa, Mycobacterium tuberculosis
NIVNLGNVGSYNLGF

SEQ ID NO: 185535 - protein, 15 aa, Mycobacterium tuberculosis
IVNLGNVGSYNLGFA

SEQ ID NO: 185536 - protein, 15 aa, Mycobacterium tuberculosis
VNLGNVGSYNLGFAN

SEQ ID NO: 185537 - protein, 15 aa, Mycobacterium tuberculosis
NLGNVGSYNLGFANV

SEQ ID NO: 185538 - protein, 15 aa, Mycobacterium tuberculosis
LGNVGSYNLGFANVG

SEQ ID NO: 185539 - protein, 15 aa, Mycobacterium tuberculosis
GNVGSYNLGFANVGD

SEQ ID NO: 185540 - protein, 15 aa, Mycobacterium tuberculosis
NVGSYNLGFANVGDV

SEQ ID NO: 185541 - protein, 15 aa, Mycobacterium tuberculosis
VGSYNLGFANVGDVN

SEQ ID NO: 185542 - protein, 15 aa, Mycobacterium tuberculosis
GSYNLGFANVGDVNL

SEQ ID NO: 185543 - protein, 15 aa, Mycobacterium tuberculosis
SYNLGFANVGDVNLG

SEQ ID NO: 185544 - protein, 15 aa, Mycobacterium tuberculosis
YNLGFANVGDVNLGA

SEQ ID NO: 185545 - protein, 15 aa, Mycobacterium tuberculosis
NLGFANVGDVNLGAG

SEQ ID NO: 185546 - protein, 15 aa, Mycobacterium tuberculosis
LGFANVGDVNLGAGN

SEQ ID NO: 185547 - protein, 15 aa, Mycobacterium tuberculosis
GFANVGDVNLGAGNL

SEQ ID NO: 185548 - protein, 15 aa, Mycobacterium tuberculosis
FANVGDVNLGAGNLG

SEQ ID NO: 185549 - protein, 15 aa, Mycobacterium tuberculosis
ANVGDVNLGAGNLGN

SEQ ID NO: 185550 - protein, 15 aa, Mycobacterium tuberculosis
NVGDVNLGAGNLGNL

SEQ ID NO: 185551 - protein, 15 aa, Mycobacterium tuberculosis
VGDVNLGAGNLGNLN

SEQ ID NO: 185552 - protein, 15 aa, Mycobacterium tuberculosis
GDVNLGAGNLGNLNL

SEQ ID NO: 185553 - protein, 15 aa, Mycobacterium tuberculosis
DVNLGAGNLGNLNLG

SEQ ID NO: 185554 - protein, 15 aa, Mycobacterium tuberculosis
VNLGAGNLGNLNLGG

SEQ ID NO: 185555 - protein, 15 aa, Mycobacterium tuberculosis
NLGAGNLGNLNLGGG

SEQ ID NO: 185556 - protein, 15 aa, Mycobacterium tuberculosis
LGAGNLGNLNLGGGN

SEQ ID NO: 185557 - protein, 15 aa, Mycobacterium tuberculosis
GAGNLGNLNLGGGNL

SEQ ID NO: 185558 - protein, 15 aa, Mycobacterium tuberculosis
AGNLGNLNLGGGNLG

SEQ ID NO: 185559 - protein, 15 aa, Mycobacterium tuberculosis
GNLGNLNLGGGNLGG

SEQ ID NO: 185560 - protein, 15 aa, Mycobacterium tuberculosis
NLGNLNLGGGNLGGQ

SEQ ID NO: 185561 - protein, 15 aa, Mycobacterium tuberculosis
LGNLNLGGGNLGGQN

SEQ ID NO: 185562 - protein, 15 aa, Mycobacterium tuberculosis
GNLNLGGGNLGGQNL

SEQ ID NO: 185563 - protein, 15 aa, Mycobacterium tuberculosis
NLNLGGGNLGGQNLG

SEQ ID NO: 185564 - protein, 15 aa, Mycobacterium tuberculosis
LNLGGGNLGGQNLGL

SEQ ID NO: 185565 - protein, 15 aa, Mycobacterium tuberculosis
NLGGGNLGGQNLGLG

SEQ ID NO: 185566 - protein, 15 aa, Mycobacterium tuberculosis
LGGGNLGGQNLGLGN

SEQ ID NO: 185567 - protein, 15 aa, Mycobacterium tuberculosis
GGGNLGGQNLGLGNL

SEQ ID NO: 185568 - protein, 15 aa, Mycobacterium tuberculosis
GGNLGGQNLGLGNLG

SEQ ID NO: 185569 - protein, 15 aa, Mycobacterium tuberculosis
GNLGGQNLGLGNLGD

SEQ ID NO: 185570 - protein, 15 aa, Mycobacterium tuberculosis
NLGGQNLGLGNLGDG

SEQ ID NO: 185571 - protein, 15 aa, Mycobacterium tuberculosis
LGGQNLGLGNLGDGN

SEQ ID NO: 185572 - protein, 15 aa, Mycobacterium tuberculosis
GGQNLGLGNLGDGNV

SEQ ID NO: 185573 - protein, 15 aa, Mycobacterium tuberculosis
GQNLGLGNLGDGNVG

SEQ ID NO: 185574 - protein, 15 aa, Mycobacterium tuberculosis
QNLGLGNLGDGNVGF

SEQ ID NO: 185575 - protein, 15 aa, Mycobacterium tuberculosis
NLGLGNLGDGNVGFG

SEQ ID NO: 185576 - protein, 15 aa, Mycobacterium tuberculosis
LGLGNLGDGNVGFGN

SEQ ID NO: 185577 - protein, 15 aa, Mycobacterium tuberculosis
GLGNLGDGNVGFGNL

SEQ ID NO: 185578 - protein, 15 aa, Mycobacterium tuberculosis
LGNLGDGNVGFGNLG

SEQ ID NO: 185579 - protein, 15 aa, Mycobacterium tuberculosis
GNLGDGNVGFGNLGH

SEQ ID NO: 185580 - protein, 15 aa, Mycobacterium tuberculosis
NLGDGNVGFGNLGHG

SEQ ID NO: 185581 - protein, 15 aa, Mycobacterium tuberculosis
LGDGNVGFGNLGHGN

SEQ ID NO: 185582 - protein, 15 aa, Mycobacterium tuberculosis
GDGNVGFGNLGHGNV

SEQ ID NO: 185583 - protein, 15 aa, Mycobacterium tuberculosis
DGNVGFGNLGHGNVG

SEQ ID NO: 185584 - protein, 15 aa, Mycobacterium tuberculosis
GNVGFGNLGHGNVGF

SEQ ID NO: 185585 - protein, 15 aa, Mycobacterium tuberculosis
NVGFGNLGHGNVGFG

SEQ ID NO: 185586 - protein, 15 aa, Mycobacterium tuberculosis
VGFGNLGHGNVGFGN

SEQ ID NO: 185587 - protein, 15 aa, Mycobacterium tuberculosis
GFGNLGHGNVGFGNS

SEQ ID NO: 185588 - protein, 15 aa, Mycobacterium tuberculosis
FGNLGHGNVGFGNSG

SEQ ID NO: 185589 - protein, 15 aa, Mycobacterium tuberculosis
GNLGHGNVGFGNSGL

SEQ ID NO: 185590 - protein, 15 aa, Mycobacterium tuberculosis
NLGHGNVGFGNSGLG

SEQ ID NO: 185591 - protein, 15 aa, Mycobacterium tuberculosis
LGHGNVGFGNSGLGA

SEQ ID NO: 185592 - protein, 15 aa, Mycobacterium tuberculosis
GHGNVGFGNSGLGAL

SEQ ID NO: 185593 - protein, 15 aa, Mycobacterium tuberculosis
HGNVGFGNSGLGALP

SEQ ID NO: 185594 - protein, 15 aa, Mycobacterium tuberculosis
GNVGFGNSGLGALPG

SEQ ID NO: 185595 - protein, 15 aa, Mycobacterium tuberculosis
NVGFGNSGLGALPGI

SEQ ID NO: 185596 - protein, 15 aa, Mycobacterium tuberculosis
VGFGNSGLGALPGIG

SEQ ID NO: 185597 - protein, 15 aa, Mycobacterium tuberculosis
GFGNSGLGALPGIGN

SEQ ID NO: 185598 - protein, 15 aa, Mycobacterium tuberculosis
FGNSGLGALPGIGNI

SEQ ID NO: 185599 - protein, 15 aa, Mycobacterium tuberculosis
GNSGLGALPGIGNIG

SEQ ID NO: 185600 - protein, 15 aa, Mycobacterium tuberculosis
NSGLGALPGIGNIGL

SEQ ID NO: 185601 - protein, 15 aa, Mycobacterium tuberculosis
SGLGALPGIGNIGLG

SEQ ID NO: 185602 - protein, 15 aa, Mycobacterium tuberculosis
GLGALPGIGNIGLGN

SEQ ID NO: 185603 - protein, 15 aa, Mycobacterium tuberculosis
LGALPGIGNIGLGNA

SEQ ID NO: 185604 - protein, 15 aa, Mycobacterium tuberculosis
GALPGIGNIGLGNAG

SEQ ID NO: 185605 - protein, 15 aa, Mycobacterium tuberculosis
ALPGIGNIGLGNAGS

SEQ ID NO: 185606 - protein, 15 aa, Mycobacterium tuberculosis
LPGIGNIGLGNAGSN

SEQ ID NO: 185607 - protein, 15 aa, Mycobacterium tuberculosis
PGIGNIGLGNAGSNN

SEQ ID NO: 185608 - protein, 15 aa, Mycobacterium tuberculosis
GIGNIGLGNAGSNNV

SEQ ID NO: 185609 - protein, 15 aa, Mycobacterium tuberculosis
IGNIGLGNAGSNNVG

SEQ ID NO: 185610 - protein, 15 aa, Mycobacterium tuberculosis
GNIGLGNAGSNNVGF

SEQ ID NO: 185611 - protein, 15 aa, Mycobacterium tuberculosis
NIGLGNAGSNNVGFG

SEQ ID NO: 185612 - protein, 15 aa, Mycobacterium tuberculosis
IGLGNAGSNNVGFGN

SEQ ID NO: 185613 - protein, 15 aa, Mycobacterium tuberculosis
GLGNAGSNNVGFGNM

SEQ ID NO: 185614 - protein, 15 aa, Mycobacterium tuberculosis
LGNAGSNNVGFGNMG

SEQ ID NO: 185615 - protein, 15 aa, Mycobacterium tuberculosis
GNAGSNNVGFGNMGL

SEQ ID NO: 185616 - protein, 15 aa, Mycobacterium tuberculosis
NAGSNNVGFGNMGLG

SEQ ID NO: 185617 - protein, 15 aa, Mycobacterium tuberculosis
AGSNNVGFGNMGLGN

SEQ ID NO: 185618 - protein, 15 aa, Mycobacterium tuberculosis
GSNNVGFGNMGLGNI

SEQ ID NO: 185619 - protein, 15 aa, Mycobacterium tuberculosis
SNNVGFGNMGLGNIG

SEQ ID NO: 185620 - protein, 15 aa, Mycobacterium tuberculosis
NNVGFGNMGLGNIGF

SEQ ID NO: 185621 - protein, 15 aa, Mycobacterium tuberculosis
NVGFGNMGLGNIGFG

SEQ ID NO: 185622 - protein, 15 aa, Mycobacterium tuberculosis
VGFGNMGLGNIGFGN

SEQ ID NO: 185623 - protein, 15 aa, Mycobacterium tuberculosis
GFGNMGLGNIGFGNT

SEQ ID NO: 185624 - protein, 15 aa, Mycobacterium tuberculosis
FGNMGLGNIGFGNTG

SEQ ID NO: 185625 - protein, 15 aa, Mycobacterium tuberculosis
GNMGLGNIGFGNTGT

SEQ ID NO: 185626 - protein, 15 aa, Mycobacterium tuberculosis
NMGLGNIGFGNTGTN

SEQ ID NO: 185627 - protein, 15 aa, Mycobacterium tuberculosis
MGLGNIGFGNTGTNN

SEQ ID NO: 185628 - protein, 15 aa, Mycobacterium tuberculosis
GLGNIGFGNTGTNNL

SEQ ID NO: 185629 - protein, 15 aa, Mycobacterium tuberculosis
LGNIGFGNTGTNNLG

SEQ ID NO: 185630 - protein, 15 aa, Mycobacterium tuberculosis
GNIGFGNTGTNNLGI

SEQ ID NO: 185631 - protein, 15 aa, Mycobacterium tuberculosis
NIGFGNTGTNNLGIG

SEQ ID NO: 185632 - protein, 15 aa, Mycobacterium tuberculosis
IGFGNTGTNNLGIGL

SEQ ID NO: 185633 - protein, 15 aa, Mycobacterium tuberculosis
GFGNTGTNNLGIGLT

SEQ ID NO: 185634 - protein, 15 aa, Mycobacterium tuberculosis
FGNTGTNNLGIGLTG

SEQ ID NO: 185635 - protein, 15 aa, Mycobacterium tuberculosis
GNTGTNNLGIGLTGD

SEQ ID NO: 185636 - protein, 15 aa, Mycobacterium tuberculosis
NTGTNNLGIGLTGDN

SEQ ID NO: 185637 - protein, 15 aa, Mycobacterium tuberculosis
TGTNNLGIGLTGDNQ

SEQ ID NO: 185638 - protein, 15 aa, Mycobacterium tuberculosis
GTNNLGIGLTGDNQT

SEQ ID NO: 185639 - protein, 15 aa, Mycobacterium tuberculosis
TNNLGIGLTGDNQTG

SEQ ID NO: 185640 - protein, 15 aa, Mycobacterium tuberculosis
NNLGIGLTGDNQTGF

SEQ ID NO: 185641 - protein, 15 aa, Mycobacterium tuberculosis
NLGIGLTGDNQTGFG

SEQ ID NO: 185642 - protein, 15 aa, Mycobacterium tuberculosis
LGIGLTGDNQTGFGG

SEQ ID NO: 185643 - protein, 15 aa, Mycobacterium tuberculosis
GIGLTGDNQTGFGGL

SEQ ID NO: 185644 - protein, 15 aa, Mycobacterium tuberculosis
IGLTGDNQTGFGGLN

SEQ ID NO: 185645 - protein, 15 aa, Mycobacterium tuberculosis
GLTGDNQTGFGGLNS

SEQ ID NO: 185646 - protein, 15 aa, Mycobacterium tuberculosis
LTGDNQTGFGGLNSG

SEQ ID NO: 185647 - protein, 15 aa, Mycobacterium tuberculosis
TGDNQTGFGGLNSGA

SEQ ID NO: 185648 - protein, 15 aa, Mycobacterium tuberculosis
GDNQTGFGGLNSGAG

SEQ ID NO: 185649 - protein, 15 aa, Mycobacterium tuberculosis
DNQTGFGGLNSGAGN

SEQ ID NO: 185650 - protein, 15 aa, Mycobacterium tuberculosis
NQTGFGGLNSGAGNL

SEQ ID NO: 185651 - protein, 15 aa, Mycobacterium tuberculosis
QTGFGGLNSGAGNLG

SEQ ID NO: 185652 - protein, 15 aa, Mycobacterium tuberculosis
TGFGGLNSGAGNLGL

SEQ ID NO: 185653 - protein, 15 aa, Mycobacterium tuberculosis
GFGGLNSGAGNLGLF

SEQ ID NO: 185654 - protein, 15 aa, Mycobacterium tuberculosis
FGGLNSGAGNLGLFN

SEQ ID NO: 185655 - protein, 15 aa, Mycobacterium tuberculosis
GGLNSGAGNLGLFNS

SEQ ID NO: 185656 - protein, 15 aa, Mycobacterium tuberculosis
GLNSGAGNLGLFNSG

SEQ ID NO: 185657 - protein, 15 aa, Mycobacterium tuberculosis
LNSGAGNLGLFNSGT

SEQ ID NO: 185658 - protein, 15 aa, Mycobacterium tuberculosis
NSGAGNLGLFNSGTG

SEQ ID NO: 185659 - protein, 15 aa, Mycobacterium tuberculosis
SGAGNLGLFNSGTGN

SEQ ID NO: 185660 - protein, 15 aa, Mycobacterium tuberculosis
GAGNLGLFNSGTGNI

SEQ ID NO: 185661 - protein, 15 aa, Mycobacterium tuberculosis
AGNLGLFNSGTGNIG

SEQ ID NO: 185662 - protein, 15 aa, Mycobacterium tuberculosis
GNLGLFNSGTGNIGF

SEQ ID NO: 185663 - protein, 15 aa, Mycobacterium tuberculosis
NLGLFNSGTGNIGFF

SEQ ID NO: 185664 - protein, 15 aa, Mycobacterium tuberculosis
LGLFNSGTGNIGFFN

SEQ ID NO: 185665 - protein, 15 aa, Mycobacterium tuberculosis
GLFNSGTGNIGFFNT

SEQ ID NO: 185666 - protein, 15 aa, Mycobacterium tuberculosis
LFNSGTGNIGFFNTG

SEQ ID NO: 185667 - protein, 15 aa, Mycobacterium tuberculosis
FNSGTGNIGFFNTGT

SEQ ID NO: 185668 - protein, 15 aa, Mycobacterium tuberculosis
NSGTGNIGFFNTGTG

SEQ ID NO: 185669 - protein, 15 aa, Mycobacterium tuberculosis
SGTGNIGFFNTGTGN

SEQ ID NO: 185670 - protein, 15 aa, Mycobacterium tuberculosis
GTGNIGFFNTGTGNW

SEQ ID NO: 185671 - protein, 15 aa, Mycobacterium tuberculosis
TGNIGFFNTGTGNWG

SEQ ID NO: 185672 - protein, 15 aa, Mycobacterium tuberculosis
GNIGFFNTGTGNWGL

SEQ ID NO: 185673 - protein, 15 aa, Mycobacterium tuberculosis
NIGFFNTGTGNWGLF

SEQ ID NO: 185674 - protein, 15 aa, Mycobacterium tuberculosis
IGFFNTGTGNWGLFN

SEQ ID NO: 185675 - protein, 15 aa, Mycobacterium tuberculosis
GFFNTGTGNWGLFNS

SEQ ID NO: 185676 - protein, 15 aa, Mycobacterium tuberculosis
FFNTGTGNWGLFNSG

SEQ ID NO: 185677 - protein, 15 aa, Mycobacterium tuberculosis
FNTGTGNWGLFNSGS

SEQ ID NO: 185678 - protein, 15 aa, Mycobacterium tuberculosis
NTGTGNWGLFNSGSY

SEQ ID NO: 185679 - protein, 15 aa, Mycobacterium tuberculosis
TGTGNWGLFNSGSYN

SEQ ID NO: 185680 - protein, 15 aa, Mycobacterium tuberculosis
GTGNWGLFNSGSYNT

SEQ ID NO: 185681 - protein, 15 aa, Mycobacterium tuberculosis
TGNWGLFNSGSYNTG

SEQ ID NO: 185682 - protein, 15 aa, Mycobacterium tuberculosis
GNWGLFNSGSYNTGI

SEQ ID NO: 185683 - protein, 15 aa, Mycobacterium tuberculosis
NWGLFNSGSYNTGIG

SEQ ID NO: 185684 - protein, 15 aa, Mycobacterium tuberculosis
WGLFNSGSYNTGIGN

SEQ ID NO: 185685 - protein, 15 aa, Mycobacterium tuberculosis
GLFNSGSYNTGIGNS

SEQ ID NO: 185686 - protein, 15 aa, Mycobacterium tuberculosis
LFNSGSYNTGIGNSG

SEQ ID NO: 185687 - protein, 15 aa, Mycobacterium tuberculosis
FNSGSYNTGIGNSGT

SEQ ID NO: 185688 - protein, 15 aa, Mycobacterium tuberculosis
NSGSYNTGIGNSGTG

SEQ ID NO: 185689 - protein, 15 aa, Mycobacterium tuberculosis
SGSYNTGIGNSGTGS

SEQ ID NO: 185690 - protein, 15 aa, Mycobacterium tuberculosis
GSYNTGIGNSGTGST

SEQ ID NO: 185691 - protein, 15 aa, Mycobacterium tuberculosis
SYNTGIGNSGTGSTG

SEQ ID NO: 185692 - protein, 15 aa, Mycobacterium tuberculosis
YNTGIGNSGTGSTGL

SEQ ID NO: 185693 - protein, 15 aa, Mycobacterium tuberculosis
NTGIGNSGTGSTGLF

SEQ ID NO: 185694 - protein, 15 aa, Mycobacterium tuberculosis
TGIGNSGTGSTGLFN

SEQ ID NO: 185695 - protein, 15 aa, Mycobacterium tuberculosis
GIGNSGTGSTGLFNA

SEQ ID NO: 185696 - protein, 15 aa, Mycobacterium tuberculosis
IGNSGTGSTGLFNAG

SEQ ID NO: 185697 - protein, 15 aa, Mycobacterium tuberculosis
GNSGTGSTGLFNAGS

SEQ ID NO: 185698 - protein, 15 aa, Mycobacterium tuberculosis
NSGTGSTGLFNAGSF

SEQ ID NO: 185699 - protein, 15 aa, Mycobacterium tuberculosis
SGTGSTGLFNAGSFN

SEQ ID NO: 185700 - protein, 15 aa, Mycobacterium tuberculosis
GTGSTGLFNAGSFNT

SEQ ID NO: 185701 - protein, 15 aa, Mycobacterium tuberculosis
TGSTGLFNAGSFNTG

SEQ ID NO: 185702 - protein, 15 aa, Mycobacterium tuberculosis
GSTGLFNAGSFNTGL

SEQ ID NO: 185703 - protein, 15 aa, Mycobacterium tuberculosis
STGLFNAGSFNTGLA

SEQ ID NO: 185704 - protein, 15 aa, Mycobacterium tuberculosis
TGLFNAGSFNTGLAN

SEQ ID NO: 185705 - protein, 15 aa, Mycobacterium tuberculosis
GLFNAGSFNTGLANA

SEQ ID NO: 185706 - protein, 15 aa, Mycobacterium tuberculosis
LFNAGSFNTGLANAG

SEQ ID NO: 185707 - protein, 15 aa, Mycobacterium tuberculosis
FNAGSFNTGLANAGS

SEQ ID NO: 185708 - protein, 15 aa, Mycobacterium tuberculosis
NAGSFNTGLANAGSY

SEQ ID NO: 185709 - protein, 15 aa, Mycobacterium tuberculosis
AGSFNTGLANAGSYN

SEQ ID NO: 185710 - protein, 15 aa, Mycobacterium tuberculosis
GSFNTGLANAGSYNT

SEQ ID NO: 185711 - protein, 15 aa, Mycobacterium tuberculosis
SFNTGLANAGSYNTG

SEQ ID NO: 185712 - protein, 15 aa, Mycobacterium tuberculosis
FNTGLANAGSYNTGS

SEQ ID NO: 185713 - protein, 15 aa, Mycobacterium tuberculosis
NTGLANAGSYNTGSL

SEQ ID NO: 185714 - protein, 15 aa, Mycobacterium tuberculosis
TGLANAGSYNTGSLN

SEQ ID NO: 185715 - protein, 15 aa, Mycobacterium tuberculosis
GLANAGSYNTGSLNA

SEQ ID NO: 185716 - protein, 15 aa, Mycobacterium tuberculosis
LANAGSYNTGSLNAG

SEQ ID NO: 185717 - protein, 15 aa, Mycobacterium tuberculosis
ANAGSYNTGSLNAGN

SEQ ID NO: 185718 - protein, 15 aa, Mycobacterium tuberculosis
NAGSYNTGSLNAGNT

SEQ ID NO: 185719 - protein, 15 aa, Mycobacterium tuberculosis
AGSYNTGSLNAGNTN

SEQ ID NO: 185720 - protein, 15 aa, Mycobacterium tuberculosis
GSYNTGSLNAGNTNT

SEQ ID NO: 185721 - protein, 15 aa, Mycobacterium tuberculosis
SYNTGSLNAGNTNTG

SEQ ID NO: 185722 - protein, 15 aa, Mycobacterium tuberculosis
YNTGSLNAGNTNTGG

SEQ ID NO: 185723 - protein, 15 aa, Mycobacterium tuberculosis
NTGSLNAGNTNTGGF

SEQ ID NO: 185724 - protein, 15 aa, Mycobacterium tuberculosis
TGSLNAGNTNTGGFN

SEQ ID NO: 185725 - protein, 15 aa, Mycobacterium tuberculosis
GSLNAGNTNTGGFNP

SEQ ID NO: 185726 - protein, 15 aa, Mycobacterium tuberculosis
SLNAGNTNTGGFNPG

SEQ ID NO: 185727 - protein, 15 aa, Mycobacterium tuberculosis
LNAGNTNTGGFNPGN

SEQ ID NO: 185728 - protein, 15 aa, Mycobacterium tuberculosis
NAGNTNTGGFNPGNV

SEQ ID NO: 185729 - protein, 15 aa, Mycobacterium tuberculosis
AGNTNTGGFNPGNVN

SEQ ID NO: 185730 - protein, 15 aa, Mycobacterium tuberculosis
GNTNTGGFNPGNVNT

SEQ ID NO: 185731 - protein, 15 aa, Mycobacterium tuberculosis
NTNTGGFNPGNVNTG

SEQ ID NO: 185732 - protein, 15 aa, Mycobacterium tuberculosis
TNTGGFNPGNVNTGW

SEQ ID NO: 185733 - protein, 15 aa, Mycobacterium tuberculosis
NTGGFNPGNVNTGWF

SEQ ID NO: 185734 - protein, 15 aa, Mycobacterium tuberculosis
TGGFNPGNVNTGWFN

SEQ ID NO: 185735 - protein, 15 aa, Mycobacterium tuberculosis
GGFNPGNVNTGWFNA

SEQ ID NO: 185736 - protein, 15 aa, Mycobacterium tuberculosis
GFNPGNVNTGWFNAG

SEQ ID NO: 185737 - protein, 15 aa, Mycobacterium tuberculosis
FNPGNVNTGWFNAGH

SEQ ID NO: 185738 - protein, 15 aa, Mycobacterium tuberculosis
NPGNVNTGWFNAGHT

SEQ ID NO: 185739 - protein, 15 aa, Mycobacterium tuberculosis
PGNVNTGWFNAGHTN

SEQ ID NO: 185740 - protein, 15 aa, Mycobacterium tuberculosis
GNVNTGWFNAGHTNT

SEQ ID NO: 185741 - protein, 15 aa, Mycobacterium tuberculosis
NVNTGWFNAGHTNTG

SEQ ID NO: 185742 - protein, 15 aa, Mycobacterium tuberculosis
VNTGWFNAGHTNTGG

SEQ ID NO: 185743 - protein, 15 aa, Mycobacterium tuberculosis
NTGWFNAGHTNTGGF

SEQ ID NO: 185744 - protein, 15 aa, Mycobacterium tuberculosis
TGWFNAGHTNTGGFN

SEQ ID NO: 185745 - protein, 15 aa, Mycobacterium tuberculosis
GWFNAGHTNTGGFNT

SEQ ID NO: 185746 - protein, 15 aa, Mycobacterium tuberculosis
WFNAGHTNTGGFNTG

SEQ ID NO: 185747 - protein, 15 aa, Mycobacterium tuberculosis
FNAGHTNTGGFNTGN

SEQ ID NO: 185748 - protein, 15 aa, Mycobacterium tuberculosis
NAGHTNTGGFNTGNV

SEQ ID NO: 185749 - protein, 15 aa, Mycobacterium tuberculosis
AGHTNTGGFNTGNVN

SEQ ID NO: 185750 - protein, 15 aa, Mycobacterium tuberculosis
GHTNTGGFNTGNVNT

SEQ ID NO: 185751 - protein, 15 aa, Mycobacterium tuberculosis
HTNTGGFNTGNVNTG

SEQ ID NO: 185752 - protein, 15 aa, Mycobacterium tuberculosis
TNTGGFNTGNVNTGA

SEQ ID NO: 185753 - protein, 15 aa, Mycobacterium tuberculosis
NTGGFNTGNVNTGAF

SEQ ID NO: 185754 - protein, 15 aa, Mycobacterium tuberculosis
TGGFNTGNVNTGAFN

SEQ ID NO: 185755 - protein, 15 aa, Mycobacterium tuberculosis
GGFNTGNVNTGAFNS

SEQ ID NO: 185756 - protein, 15 aa, Mycobacterium tuberculosis
GFNTGNVNTGAFNSG

SEQ ID NO: 185757 - protein, 15 aa, Mycobacterium tuberculosis
FNTGNVNTGAFNSGS

SEQ ID NO: 185758 - protein, 15 aa, Mycobacterium tuberculosis
NTGNVNTGAFNSGSF

SEQ ID NO: 185759 - protein, 15 aa, Mycobacterium tuberculosis
TGNVNTGAFNSGSFN

SEQ ID NO: 185760 - protein, 15 aa, Mycobacterium tuberculosis
GNVNTGAFNSGSFNN

SEQ ID NO: 185761 - protein, 15 aa, Mycobacterium tuberculosis
NVNTGAFNSGSFNNG

SEQ ID NO: 185762 - protein, 15 aa, Mycobacterium tuberculosis
VNTGAFNSGSFNNGA

SEQ ID NO: 185763 - protein, 15 aa, Mycobacterium tuberculosis
NTGAFNSGSFNNGAL

SEQ ID NO: 185764 - protein, 15 aa, Mycobacterium tuberculosis
TGAFNSGSFNNGALW

SEQ ID NO: 185765 - protein, 15 aa, Mycobacterium tuberculosis
GAFNSGSFNNGALWT

SEQ ID NO: 185766 - protein, 15 aa, Mycobacterium tuberculosis
AFNSGSFNNGALWTG

SEQ ID NO: 185767 - protein, 15 aa, Mycobacterium tuberculosis
FNSGSFNNGALWTGD

SEQ ID NO: 185768 - protein, 15 aa, Mycobacterium tuberculosis
NSGSFNNGALWTGDH

SEQ ID NO: 185769 - protein, 15 aa, Mycobacterium tuberculosis
SGSFNNGALWTGDHH

SEQ ID NO: 185770 - protein, 15 aa, Mycobacterium tuberculosis
GSFNNGALWTGDHHG

SEQ ID NO: 185771 - protein, 15 aa, Mycobacterium tuberculosis
SFNNGALWTGDHHGL

SEQ ID NO: 185772 - protein, 15 aa, Mycobacterium tuberculosis
FNNGALWTGDHHGLV

SEQ ID NO: 185773 - protein, 15 aa, Mycobacterium tuberculosis
NNGALWTGDHHGLVG

SEQ ID NO: 185774 - protein, 15 aa, Mycobacterium tuberculosis
NGALWTGDHHGLVGF

SEQ ID NO: 185775 - protein, 15 aa, Mycobacterium tuberculosis
GALWTGDHHGLVGFS

SEQ ID NO: 185776 - protein, 15 aa, Mycobacterium tuberculosis
ALWTGDHHGLVGFSY

SEQ ID NO: 185777 - protein, 15 aa, Mycobacterium tuberculosis
LWTGDHHGLVGFSYS

SEQ ID NO: 185778 - protein, 15 aa, Mycobacterium tuberculosis
WTGDHHGLVGFSYSI

SEQ ID NO: 185779 - protein, 15 aa, Mycobacterium tuberculosis
TGDHHGLVGFSYSIE

SEQ ID NO: 185780 - protein, 15 aa, Mycobacterium tuberculosis
GDHHGLVGFSYSIEI

SEQ ID NO: 185781 - protein, 15 aa, Mycobacterium tuberculosis
DHHGLVGFSYSIEIT

SEQ ID NO: 185782 - protein, 15 aa, Mycobacterium tuberculosis
HHGLVGFSYSIEITG

SEQ ID NO: 185783 - protein, 15 aa, Mycobacterium tuberculosis
HGLVGFSYSIEITGS

SEQ ID NO: 185784 - protein, 15 aa, Mycobacterium tuberculosis
GLVGFSYSIEITGST

SEQ ID NO: 185785 - protein, 15 aa, Mycobacterium tuberculosis
LVGFSYSIEITGSTL

SEQ ID NO: 185786 - protein, 15 aa, Mycobacterium tuberculosis
VGFSYSIEITGSTLV

SEQ ID NO: 185787 - protein, 15 aa, Mycobacterium tuberculosis
GFSYSIEITGSTLVD

SEQ ID NO: 185788 - protein, 15 aa, Mycobacterium tuberculosis
FSYSIEITGSTLVDI

SEQ ID NO: 185789 - protein, 15 aa, Mycobacterium tuberculosis
SYSIEITGSTLVDIN

SEQ ID NO: 185790 - protein, 15 aa, Mycobacterium tuberculosis
YSIEITGSTLVDINE

SEQ ID NO: 185791 - protein, 15 aa, Mycobacterium tuberculosis
SIEITGSTLVDINET

SEQ ID NO: 185792 - protein, 15 aa, Mycobacterium tuberculosis
IEITGSTLVDINETL

SEQ ID NO: 185793 - protein, 15 aa, Mycobacterium tuberculosis
EITGSTLVDINETLN

SEQ ID NO: 185794 - protein, 15 aa, Mycobacterium tuberculosis
ITGSTLVDINETLNL

SEQ ID NO: 185795 - protein, 15 aa, Mycobacterium tuberculosis
TGSTLVDINETLNLG

SEQ ID NO: 185796 - protein, 15 aa, Mycobacterium tuberculosis
GSTLVDINETLNLGP

SEQ ID NO: 185797 - protein, 15 aa, Mycobacterium tuberculosis
STLVDINETLNLGPV

SEQ ID NO: 185798 - protein, 15 aa, Mycobacterium tuberculosis
TLVDINETLNLGPVH

SEQ ID NO: 185799 - protein, 15 aa, Mycobacterium tuberculosis
LVDINETLNLGPVHI

SEQ ID NO: 185800 - protein, 15 aa, Mycobacterium tuberculosis
VDINETLNLGPVHID

SEQ ID NO: 185801 - protein, 15 aa, Mycobacterium tuberculosis
DINETLNLGPVHIDQ

SEQ ID NO: 185802 - protein, 15 aa, Mycobacterium tuberculosis
INETLNLGPVHIDQI

SEQ ID NO: 185803 - protein, 15 aa, Mycobacterium tuberculosis
NETLNLGPVHIDQID

SEQ ID NO: 185804 - protein, 15 aa, Mycobacterium tuberculosis
ETLNLGPVHIDQIDI

SEQ ID NO: 185805 - protein, 15 aa, Mycobacterium tuberculosis
TLNLGPVHIDQIDIP

SEQ ID NO: 185806 - protein, 15 aa, Mycobacterium tuberculosis
LNLGPVHIDQIDIPG

SEQ ID NO: 185807 - protein, 15 aa, Mycobacterium tuberculosis
NLGPVHIDQIDIPGM

SEQ ID NO: 185808 - protein, 15 aa, Mycobacterium tuberculosis
LGPVHIDQIDIPGMS

SEQ ID NO: 185809 - protein, 15 aa, Mycobacterium tuberculosis
GPVHIDQIDIPGMSL

SEQ ID NO: 185810 - protein, 15 aa, Mycobacterium tuberculosis
PVHIDQIDIPGMSLF

SEQ ID NO: 185811 - protein, 15 aa, Mycobacterium tuberculosis
VHIDQIDIPGMSLFD

SEQ ID NO: 185812 - protein, 15 aa, Mycobacterium tuberculosis
HIDQIDIPGMSLFDI

SEQ ID NO: 185813 - protein, 15 aa, Mycobacterium tuberculosis
IDQIDIPGMSLFDIH

SEQ ID NO: 185814 - protein, 15 aa, Mycobacterium tuberculosis
DQIDIPGMSLFDIHE

SEQ ID NO: 185815 - protein, 15 aa, Mycobacterium tuberculosis
QIDIPGMSLFDIHEL

SEQ ID NO: 185816 - protein, 15 aa, Mycobacterium tuberculosis
IDIPGMSLFDIHELV

SEQ ID NO: 185817 - protein, 15 aa, Mycobacterium tuberculosis
DIPGMSLFDIHELVN

SEQ ID NO: 185818 - protein, 15 aa, Mycobacterium tuberculosis
IPGMSLFDIHELVNI

SEQ ID NO: 185819 - protein, 15 aa, Mycobacterium tuberculosis
PGMSLFDIHELVNIG

SEQ ID NO: 185820 - protein, 15 aa, Mycobacterium tuberculosis
GMSLFDIHELVNIGP

SEQ ID NO: 185821 - protein, 15 aa, Mycobacterium tuberculosis
MSLFDIHELVNIGPF

SEQ ID NO: 185822 - protein, 15 aa, Mycobacterium tuberculosis
SLFDIHELVNIGPFR

SEQ ID NO: 185823 - protein, 15 aa, Mycobacterium tuberculosis
LFDIHELVNIGPFRI

SEQ ID NO: 185824 - protein, 15 aa, Mycobacterium tuberculosis
FDIHELVNIGPFRIE

SEQ ID NO: 185825 - protein, 15 aa, Mycobacterium tuberculosis
DIHELVNIGPFRIEP

SEQ ID NO: 185826 - protein, 15 aa, Mycobacterium tuberculosis
IHELVNIGPFRIEPI

SEQ ID NO: 185827 - protein, 15 aa, Mycobacterium tuberculosis
HELVNIGPFRIEPID

SEQ ID NO: 185828 - protein, 15 aa, Mycobacterium tuberculosis
ELVNIGPFRIEPIDV

SEQ ID NO: 185829 - protein, 15 aa, Mycobacterium tuberculosis
LVNIGPFRIEPIDVP

SEQ ID NO: 185830 - protein, 15 aa, Mycobacterium tuberculosis
VNIGPFRIEPIDVPA

SEQ ID NO: 185831 - protein, 15 aa, Mycobacterium tuberculosis
NIGPFRIEPIDVPAV

SEQ ID NO: 185832 - protein, 15 aa, Mycobacterium tuberculosis
IGPFRIEPIDVPAVV

SEQ ID NO: 185833 - protein, 15 aa, Mycobacterium tuberculosis
GPFRIEPIDVPAVVL

SEQ ID NO: 185834 - protein, 15 aa, Mycobacterium tuberculosis
PFRIEPIDVPAVVLD

SEQ ID NO: 185835 - protein, 15 aa, Mycobacterium tuberculosis
FRIEPIDVPAVVLDI

SEQ ID NO: 185836 - protein, 15 aa, Mycobacterium tuberculosis
RIEPIDVPAVVLDIH

SEQ ID NO: 185837 - protein, 15 aa, Mycobacterium tuberculosis
IEPIDVPAVVLDIHE

SEQ ID NO: 185838 - protein, 15 aa, Mycobacterium tuberculosis
EPIDVPAVVLDIHET

SEQ ID NO: 185839 - protein, 15 aa, Mycobacterium tuberculosis
PIDVPAVVLDIHETM

SEQ ID NO: 185840 - protein, 15 aa, Mycobacterium tuberculosis
IDVPAVVLDIHETMV

SEQ ID NO: 185841 - protein, 15 aa, Mycobacterium tuberculosis
DVPAVVLDIHETMVI

SEQ ID NO: 185842 - protein, 15 aa, Mycobacterium tuberculosis
VPAVVLDIHETMVIP

SEQ ID NO: 185843 - protein, 15 aa, Mycobacterium tuberculosis
PAVVLDIHETMVIPP

SEQ ID NO: 185844 - protein, 15 aa, Mycobacterium tuberculosis
AVVLDIHETMVIPPI

SEQ ID NO: 185845 - protein, 15 aa, Mycobacterium tuberculosis
VVLDIHETMVIPPIV

SEQ ID NO: 185846 - protein, 15 aa, Mycobacterium tuberculosis
VLDIHETMVIPPIVF

SEQ ID NO: 185847 - protein, 15 aa, Mycobacterium tuberculosis
LDIHETMVIPPIVFL

SEQ ID NO: 185848 - protein, 15 aa, Mycobacterium tuberculosis
DIHETMVIPPIVFLP

SEQ ID NO: 185849 - protein, 15 aa, Mycobacterium tuberculosis
IHETMVIPPIVFLPS

SEQ ID NO: 185850 - protein, 15 aa, Mycobacterium tuberculosis
HETMVIPPIVFLPSM

SEQ ID NO: 185851 - protein, 15 aa, Mycobacterium tuberculosis
ETMVIPPIVFLPSMT

SEQ ID NO: 185852 - protein, 15 aa, Mycobacterium tuberculosis
TMVIPPIVFLPSMTI

SEQ ID NO: 185853 - protein, 15 aa, Mycobacterium tuberculosis
MVIPPIVFLPSMTIG

SEQ ID NO: 185854 - protein, 15 aa, Mycobacterium tuberculosis
VIPPIVFLPSMTIGG

SEQ ID NO: 185855 - protein, 15 aa, Mycobacterium tuberculosis
IPPIVFLPSMTIGGQ

SEQ ID NO: 185856 - protein, 15 aa, Mycobacterium tuberculosis
PPIVFLPSMTIGGQT

SEQ ID NO: 185857 - protein, 15 aa, Mycobacterium tuberculosis
PIVFLPSMTIGGQTY

SEQ ID NO: 185858 - protein, 15 aa, Mycobacterium tuberculosis
IVFLPSMTIGGQTYT

SEQ ID NO: 185859 - protein, 15 aa, Mycobacterium tuberculosis
VFLPSMTIGGQTYTI

SEQ ID NO: 185860 - protein, 15 aa, Mycobacterium tuberculosis
FLPSMTIGGQTYTIP

SEQ ID NO: 185861 - protein, 15 aa, Mycobacterium tuberculosis
LPSMTIGGQTYTIPL

SEQ ID NO: 185862 - protein, 15 aa, Mycobacterium tuberculosis
PSMTIGGQTYTIPLD

SEQ ID NO: 185863 - protein, 15 aa, Mycobacterium tuberculosis
SMTIGGQTYTIPLDT

SEQ ID NO: 185864 - protein, 15 aa, Mycobacterium tuberculosis
MTIGGQTYTIPLDTP

SEQ ID NO: 185865 - protein, 15 aa, Mycobacterium tuberculosis
TIGGQTYTIPLDTPP

SEQ ID NO: 185866 - protein, 15 aa, Mycobacterium tuberculosis
IGGQTYTIPLDTPPA

SEQ ID NO: 185867 - protein, 15 aa, Mycobacterium tuberculosis
GGQTYTIPLDTPPAP

SEQ ID NO: 185868 - protein, 15 aa, Mycobacterium tuberculosis
GQTYTIPLDTPPAPA

SEQ ID NO: 185869 - protein, 15 aa, Mycobacterium tuberculosis
QTYTIPLDTPPAPAP

SEQ ID NO: 185870 - protein, 15 aa, Mycobacterium tuberculosis
TYTIPLDTPPAPAPP

SEQ ID NO: 185871 - protein, 15 aa, Mycobacterium tuberculosis
YTIPLDTPPAPAPPP

SEQ ID NO: 185872 - protein, 15 aa, Mycobacterium tuberculosis
TIPLDTPPAPAPPPF

SEQ ID NO: 185873 - protein, 15 aa, Mycobacterium tuberculosis
IPLDTPPAPAPPPFR

SEQ ID NO: 185874 - protein, 15 aa, Mycobacterium tuberculosis
PLDTPPAPAPPPFRL

SEQ ID NO: 185875 - protein, 15 aa, Mycobacterium tuberculosis
LDTPPAPAPPPFRLP

SEQ ID NO: 185876 - protein, 15 aa, Mycobacterium tuberculosis
DTPPAPAPPPFRLPL

SEQ ID NO: 185877 - protein, 15 aa, Mycobacterium tuberculosis
TPPAPAPPPFRLPLL

SEQ ID NO: 185878 - protein, 15 aa, Mycobacterium tuberculosis
PPAPAPPPFRLPLLF

SEQ ID NO: 185879 - protein, 15 aa, Mycobacterium tuberculosis
PAPAPPPFRLPLLFV

SEQ ID NO: 185880 - protein, 15 aa, Mycobacterium tuberculosis
APAPPPFRLPLLFVN

SEQ ID NO: 185881 - protein, 15 aa, Mycobacterium tuberculosis
PAPPPFRLPLLFVNA

SEQ ID NO: 185882 - protein, 15 aa, Mycobacterium tuberculosis
APPPFRLPLLFVNAL

SEQ ID NO: 185883 - protein, 15 aa, Mycobacterium tuberculosis
PPPFRLPLLFVNALG

SEQ ID NO: 185884 - protein, 15 aa, Mycobacterium tuberculosis
PPFRLPLLFVNALGD

SEQ ID NO: 185885 - protein, 15 aa, Mycobacterium tuberculosis
PFRLPLLFVNALGDN

SEQ ID NO: 185886 - protein, 15 aa, Mycobacterium tuberculosis
FRLPLLFVNALGDNW

SEQ ID NO: 185887 - protein, 15 aa, Mycobacterium tuberculosis
RLPLLFVNALGDNWI

SEQ ID NO: 185888 - protein, 15 aa, Mycobacterium tuberculosis
LPLLFVNALGDNWIV

SEQ ID NO: 185889 - protein, 15 aa, Mycobacterium tuberculosis
PLLFVNALGDNWIVG

SEQ ID NO: 185890 - protein, 15 aa, Mycobacterium tuberculosis
LLFVNALGDNWIVGA

SEQ ID NO: 185891 - protein, 15 aa, Mycobacterium tuberculosis
LFVNALGDNWIVGAS

SEQ ID NO: 185892 - protein, 15 aa, Mycobacterium tuberculosis
FVNALGDNWIVGASN

SEQ ID NO: 185893 - protein, 15 aa, Mycobacterium tuberculosis
VNALGDNWIVGASNS

SEQ ID NO: 185894 - protein, 15 aa, Mycobacterium tuberculosis
NALGDNWIVGASNST

SEQ ID NO: 185895 - protein, 15 aa, Mycobacterium tuberculosis
ALGDNWIVGASNSTG

SEQ ID NO: 185896 - protein, 15 aa, Mycobacterium tuberculosis
LGDNWIVGASNSTGM

SEQ ID NO: 185897 - protein, 15 aa, Mycobacterium tuberculosis
GDNWIVGASNSTGMS

SEQ ID NO: 185898 - protein, 15 aa, Mycobacterium tuberculosis
DNWIVGASNSTGMSG

SEQ ID NO: 185899 - protein, 15 aa, Mycobacterium tuberculosis
NWIVGASNSTGMSGG

SEQ ID NO: 185900 - protein, 15 aa, Mycobacterium tuberculosis
WIVGASNSTGMSGGF

SEQ ID NO: 185901 - protein, 15 aa, Mycobacterium tuberculosis
IVGASNSTGMSGGFV

SEQ ID NO: 185902 - protein, 15 aa, Mycobacterium tuberculosis
VGASNSTGMSGGFVT

SEQ ID NO: 185903 - protein, 15 aa, Mycobacterium tuberculosis
GASNSTGMSGGFVTA

SEQ ID NO: 185904 - protein, 15 aa, Mycobacterium tuberculosis
ASNSTGMSGGFVTAP

SEQ ID NO: 185905 - protein, 15 aa, Mycobacterium tuberculosis
SNSTGMSGGFVTAPT

SEQ ID NO: 185906 - protein, 15 aa, Mycobacterium tuberculosis
NSTGMSGGFVTAPTQ

SEQ ID NO: 185907 - protein, 15 aa, Mycobacterium tuberculosis
STGMSGGFVTAPTQG

SEQ ID NO: 185908 - protein, 15 aa, Mycobacterium tuberculosis
TGMSGGFVTAPTQGI

SEQ ID NO: 185909 - protein, 15 aa, Mycobacterium tuberculosis
GMSGGFVTAPTQGIL

SEQ ID NO: 185910 - protein, 15 aa, Mycobacterium tuberculosis
MSGGFVTAPTQGILI

SEQ ID NO: 185911 - protein, 15 aa, Mycobacterium tuberculosis
SGGFVTAPTQGILIH

SEQ ID NO: 185912 - protein, 15 aa, Mycobacterium tuberculosis
GGFVTAPTQGILIHT

SEQ ID NO: 185913 - protein, 15 aa, Mycobacterium tuberculosis
GFVTAPTQGILIHTG

SEQ ID NO: 185914 - protein, 15 aa, Mycobacterium tuberculosis
FVTAPTQGILIHTGP

SEQ ID NO: 185915 - protein, 15 aa, Mycobacterium tuberculosis
VTAPTQGILIHTGPS

SEQ ID NO: 185916 - protein, 15 aa, Mycobacterium tuberculosis
TAPTQGILIHTGPSS

SEQ ID NO: 185917 - protein, 15 aa, Mycobacterium tuberculosis
APTQGILIHTGPSSA

SEQ ID NO: 185918 - protein, 15 aa, Mycobacterium tuberculosis
PTQGILIHTGPSSAT

SEQ ID NO: 185919 - protein, 15 aa, Mycobacterium tuberculosis
TQGILIHTGPSSATT

SEQ ID NO: 185920 - protein, 15 aa, Mycobacterium tuberculosis
QGILIHTGPSSATTG

SEQ ID NO: 185921 - protein, 15 aa, Mycobacterium tuberculosis
GILIHTGPSSATTGS

SEQ ID NO: 185922 - protein, 15 aa, Mycobacterium tuberculosis
ILIHTGPSSATTGSL

SEQ ID NO: 185923 - protein, 15 aa, Mycobacterium tuberculosis
LIHTGPSSATTGSLA

SEQ ID NO: 185924 - protein, 15 aa, Mycobacterium tuberculosis
IHTGPSSATTGSLAL

SEQ ID NO: 185925 - protein, 15 aa, Mycobacterium tuberculosis
HTGPSSATTGSLALT

SEQ ID NO: 185926 - protein, 15 aa, Mycobacterium tuberculosis
TGPSSATTGSLALTL

SEQ ID NO: 185927 - protein, 15 aa, Mycobacterium tuberculosis
GPSSATTGSLALTLP

SEQ ID NO: 185928 - protein, 15 aa, Mycobacterium tuberculosis
PSSATTGSLALTLPT

SEQ ID NO: 185929 - protein, 15 aa, Mycobacterium tuberculosis
SSATTGSLALTLPTV

SEQ ID NO: 185930 - protein, 15 aa, Mycobacterium tuberculosis
SATTGSLALTLPTVT

SEQ ID NO: 185931 - protein, 15 aa, Mycobacterium tuberculosis
ATTGSLALTLPTVTI

SEQ ID NO: 185932 - protein, 15 aa, Mycobacterium tuberculosis
TTGSLALTLPTVTIP

SEQ ID NO: 185933 - protein, 15 aa, Mycobacterium tuberculosis
TGSLALTLPTVTIPT

SEQ ID NO: 185934 - protein, 15 aa, Mycobacterium tuberculosis
GSLALTLPTVTIPTI

SEQ ID NO: 185935 - protein, 15 aa, Mycobacterium tuberculosis
SLALTLPTVTIPTIT

SEQ ID NO: 185936 - protein, 15 aa, Mycobacterium tuberculosis
LALTLPTVTIPTITT

SEQ ID NO: 185937 - protein, 15 aa, Mycobacterium tuberculosis
ALTLPTVTIPTITTS

SEQ ID NO: 185938 - protein, 15 aa, Mycobacterium tuberculosis
LTLPTVTIPTITTSP

SEQ ID NO: 185939 - protein, 15 aa, Mycobacterium tuberculosis
TLPTVTIPTITTSPI

SEQ ID NO: 185940 - protein, 15 aa, Mycobacterium tuberculosis
LPTVTIPTITTSPIP

SEQ ID NO: 185941 - protein, 15 aa, Mycobacterium tuberculosis
PTVTIPTITTSPIPL

SEQ ID NO: 185942 - protein, 15 aa, Mycobacterium tuberculosis
TVTIPTITTSPIPLK

SEQ ID NO: 185943 - protein, 15 aa, Mycobacterium tuberculosis
VTIPTITTSPIPLKI

SEQ ID NO: 185944 - protein, 15 aa, Mycobacterium tuberculosis
TIPTITTSPIPLKID

SEQ ID NO: 185945 - protein, 15 aa, Mycobacterium tuberculosis
IPTITTSPIPLKIDV

SEQ ID NO: 185946 - protein, 15 aa, Mycobacterium tuberculosis
PTITTSPIPLKIDVS

SEQ ID NO: 185947 - protein, 15 aa, Mycobacterium tuberculosis
TITTSPIPLKIDVSG

SEQ ID NO: 185948 - protein, 15 aa, Mycobacterium tuberculosis
ITTSPIPLKIDVSGG

SEQ ID NO: 185949 - protein, 15 aa, Mycobacterium tuberculosis
TTSPIPLKIDVSGGL

SEQ ID NO: 185950 - protein, 15 aa, Mycobacterium tuberculosis
TSPIPLKIDVSGGLP

SEQ ID NO: 185951 - protein, 15 aa, Mycobacterium tuberculosis
SPIPLKIDVSGGLPA

SEQ ID NO: 185952 - protein, 15 aa, Mycobacterium tuberculosis
PIPLKIDVSGGLPAF

SEQ ID NO: 185953 - protein, 15 aa, Mycobacterium tuberculosis
IPLKIDVSGGLPAFT

SEQ ID NO: 185954 - protein, 15 aa, Mycobacterium tuberculosis
PLKIDVSGGLPAFTL

SEQ ID NO: 185955 - protein, 15 aa, Mycobacterium tuberculosis
LKIDVSGGLPAFTLF

SEQ ID NO: 185956 - protein, 15 aa, Mycobacterium tuberculosis
KIDVSGGLPAFTLFP

SEQ ID NO: 185957 - protein, 15 aa, Mycobacterium tuberculosis
IDVSGGLPAFTLFPG

SEQ ID NO: 185958 - protein, 15 aa, Mycobacterium tuberculosis
DVSGGLPAFTLFPGG

SEQ ID NO: 185959 - protein, 15 aa, Mycobacterium tuberculosis
VSGGLPAFTLFPGGL

SEQ ID NO: 185960 - protein, 15 aa, Mycobacterium tuberculosis
SGGLPAFTLFPGGLN

SEQ ID NO: 185961 - protein, 15 aa, Mycobacterium tuberculosis
GGLPAFTLFPGGLNI

SEQ ID NO: 185962 - protein, 15 aa, Mycobacterium tuberculosis
GLPAFTLFPGGLNIP

SEQ ID NO: 185963 - protein, 15 aa, Mycobacterium tuberculosis
LPAFTLFPGGLNIPQ

SEQ ID NO: 185964 - protein, 15 aa, Mycobacterium tuberculosis
PAFTLFPGGLNIPQN

SEQ ID NO: 185965 - protein, 15 aa, Mycobacterium tuberculosis
AFTLFPGGLNIPQNA

SEQ ID NO: 185966 - protein, 15 aa, Mycobacterium tuberculosis
FTLFPGGLNIPQNAI

SEQ ID NO: 185967 - protein, 15 aa, Mycobacterium tuberculosis
TLFPGGLNIPQNAIP

SEQ ID NO: 185968 - protein, 15 aa, Mycobacterium tuberculosis
LFPGGLNIPQNAIPL

SEQ ID NO: 185969 - protein, 15 aa, Mycobacterium tuberculosis
FPGGLNIPQNAIPLT

SEQ ID NO: 185970 - protein, 15 aa, Mycobacterium tuberculosis
PGGLNIPQNAIPLTI

SEQ ID NO: 185971 - protein, 15 aa, Mycobacterium tuberculosis
GGLNIPQNAIPLTID

SEQ ID NO: 185972 - protein, 15 aa, Mycobacterium tuberculosis
GLNIPQNAIPLTIDA

SEQ ID NO: 185973 - protein, 15 aa, Mycobacterium tuberculosis
LNIPQNAIPLTIDAS

SEQ ID NO: 185974 - protein, 15 aa, Mycobacterium tuberculosis
NIPQNAIPLTIDASG

SEQ ID NO: 185975 - protein, 15 aa, Mycobacterium tuberculosis
IPQNAIPLTIDASGV

SEQ ID NO: 185976 - protein, 15 aa, Mycobacterium tuberculosis
PQNAIPLTIDASGVL

SEQ ID NO: 185977 - protein, 15 aa, Mycobacterium tuberculosis
QNAIPLTIDASGVLD

SEQ ID NO: 185978 - protein, 15 aa, Mycobacterium tuberculosis
NAIPLTIDASGVLDP

SEQ ID NO: 185979 - protein, 15 aa, Mycobacterium tuberculosis
AIPLTIDASGVLDPI

SEQ ID NO: 185980 - protein, 15 aa, Mycobacterium tuberculosis
IPLTIDASGVLDPIT

SEQ ID NO: 185981 - protein, 15 aa, Mycobacterium tuberculosis
PLTIDASGVLDPITI

SEQ ID NO: 185982 - protein, 15 aa, Mycobacterium tuberculosis
LTIDASGVLDPITIF

SEQ ID NO: 185983 - protein, 15 aa, Mycobacterium tuberculosis
TIDASGVLDPITIFP

SEQ ID NO: 185984 - protein, 15 aa, Mycobacterium tuberculosis
IDASGVLDPITIFPG

SEQ ID NO: 185985 - protein, 15 aa, Mycobacterium tuberculosis
DASGVLDPITIFPGG

SEQ ID NO: 185986 - protein, 15 aa, Mycobacterium tuberculosis
ASGVLDPITIFPGGF

SEQ ID NO: 185987 - protein, 15 aa, Mycobacterium tuberculosis
SGVLDPITIFPGGFT

SEQ ID NO: 185988 - protein, 15 aa, Mycobacterium tuberculosis
GVLDPITIFPGGFTI

SEQ ID NO: 185989 - protein, 15 aa, Mycobacterium tuberculosis
VLDPITIFPGGFTID

SEQ ID NO: 185990 - protein, 15 aa, Mycobacterium tuberculosis
LDPITIFPGGFTIDP

SEQ ID NO: 185991 - protein, 15 aa, Mycobacterium tuberculosis
DPITIFPGGFTIDPL

SEQ ID NO: 185992 - protein, 15 aa, Mycobacterium tuberculosis
PITIFPGGFTIDPLP

SEQ ID NO: 185993 - protein, 15 aa, Mycobacterium tuberculosis
ITIFPGGFTIDPLPL

SEQ ID NO: 185994 - protein, 15 aa, Mycobacterium tuberculosis
TIFPGGFTIDPLPLS

SEQ ID NO: 185995 - protein, 15 aa, Mycobacterium tuberculosis
IFPGGFTIDPLPLSL

SEQ ID NO: 185996 - protein, 15 aa, Mycobacterium tuberculosis
FPGGFTIDPLPLSLA

SEQ ID NO: 185997 - protein, 15 aa, Mycobacterium tuberculosis
PGGFTIDPLPLSLAL

SEQ ID NO: 185998 - protein, 15 aa, Mycobacterium tuberculosis
GGFTIDPLPLSLALN

SEQ ID NO: 185999 - protein, 15 aa, Mycobacterium tuberculosis
GFTIDPLPLSLALNI

SEQ ID NO: 186000 - protein, 15 aa, Mycobacterium tuberculosis
FTIDPLPLSLALNIS

SEQ ID NO: 186001 - protein, 15 aa, Mycobacterium tuberculosis
TIDPLPLSLALNISV

SEQ ID NO: 186002 - protein, 15 aa, Mycobacterium tuberculosis
IDPLPLSLALNISVP

SEQ ID NO: 186003 - protein, 15 aa, Mycobacterium tuberculosis
DPLPLSLALNISVPD

SEQ ID NO: 186004 - protein, 15 aa, Mycobacterium tuberculosis
PLPLSLALNISVPDS

SEQ ID NO: 186005 - protein, 15 aa, Mycobacterium tuberculosis
LPLSLALNISVPDSS

SEQ ID NO: 186006 - protein, 15 aa, Mycobacterium tuberculosis
PLSLALNISVPDSSV

SEQ ID NO: 186007 - protein, 15 aa, Mycobacterium tuberculosis
LSLALNISVPDSSVP

SEQ ID NO: 186008 - protein, 15 aa, Mycobacterium tuberculosis
SLALNISVPDSSVPI

SEQ ID NO: 186009 - protein, 15 aa, Mycobacterium tuberculosis
LALNISVPDSSVPII

SEQ ID NO: 186010 - protein, 15 aa, Mycobacterium tuberculosis
ALNISVPDSSVPIII

SEQ ID NO: 186011 - protein, 15 aa, Mycobacterium tuberculosis
LNISVPDSSVPIIIV

SEQ ID NO: 186012 - protein, 15 aa, Mycobacterium tuberculosis
NISVPDSSVPIIIVP

SEQ ID NO: 186013 - protein, 15 aa, Mycobacterium tuberculosis
ISVPDSSVPIIIVPP

SEQ ID NO: 186014 - protein, 15 aa, Mycobacterium tuberculosis
SVPDSSVPIIIVPPT

SEQ ID NO: 186015 - protein, 15 aa, Mycobacterium tuberculosis
VPDSSVPIIIVPPTP

SEQ ID NO: 186016 - protein, 15 aa, Mycobacterium tuberculosis
PDSSVPIIIVPPTPG

SEQ ID NO: 186017 - protein, 15 aa, Mycobacterium tuberculosis
DSSVPIIIVPPTPGF

SEQ ID NO: 186018 - protein, 15 aa, Mycobacterium tuberculosis
SSVPIIIVPPTPGFG

SEQ ID NO: 186019 - protein, 15 aa, Mycobacterium tuberculosis
SVPIIIVPPTPGFGN

SEQ ID NO: 186020 - protein, 15 aa, Mycobacterium tuberculosis
VPIIIVPPTPGFGNA

SEQ ID NO: 186021 - protein, 15 aa, Mycobacterium tuberculosis
PIIIVPPTPGFGNAT

SEQ ID NO: 186022 - protein, 15 aa, Mycobacterium tuberculosis
IIIVPPTPGFGNATA

SEQ ID NO: 186023 - protein, 15 aa, Mycobacterium tuberculosis
IIVPPTPGFGNATAT

SEQ ID NO: 186024 - protein, 15 aa, Mycobacterium tuberculosis
IVPPTPGFGNATATP

SEQ ID NO: 186025 - protein, 15 aa, Mycobacterium tuberculosis
VPPTPGFGNATATPS

SEQ ID NO: 186026 - protein, 15 aa, Mycobacterium tuberculosis
PPTPGFGNATATPSS

SEQ ID NO: 186027 - protein, 15 aa, Mycobacterium tuberculosis
PTPGFGNATATPSSG

SEQ ID NO: 186028 - protein, 15 aa, Mycobacterium tuberculosis
TPGFGNATATPSSGF

SEQ ID NO: 186029 - protein, 15 aa, Mycobacterium tuberculosis
PGFGNATATPSSGFF

SEQ ID NO: 186030 - protein, 15 aa, Mycobacterium tuberculosis
GFGNATATPSSGFFN

SEQ ID NO: 186031 - protein, 15 aa, Mycobacterium tuberculosis
FGNATATPSSGFFNS

SEQ ID NO: 186032 - protein, 15 aa, Mycobacterium tuberculosis
GNATATPSSGFFNSG

SEQ ID NO: 186033 - protein, 15 aa, Mycobacterium tuberculosis
NATATPSSGFFNSGA

SEQ ID NO: 186034 - protein, 15 aa, Mycobacterium tuberculosis
ATATPSSGFFNSGAG

SEQ ID NO: 186035 - protein, 15 aa, Mycobacterium tuberculosis
TATPSSGFFNSGAGG

SEQ ID NO: 186036 - protein, 15 aa, Mycobacterium tuberculosis
ATPSSGFFNSGAGGV

SEQ ID NO: 186037 - protein, 15 aa, Mycobacterium tuberculosis
TPSSGFFNSGAGGVS

SEQ ID NO: 186038 - protein, 15 aa, Mycobacterium tuberculosis
PSSGFFNSGAGGVSG

SEQ ID NO: 186039 - protein, 15 aa, Mycobacterium tuberculosis
SSGFFNSGAGGVSGF

SEQ ID NO: 186040 - protein, 15 aa, Mycobacterium tuberculosis
SGFFNSGAGGVSGFG

SEQ ID NO: 186041 - protein, 15 aa, Mycobacterium tuberculosis
GFFNSGAGGVSGFGN

SEQ ID NO: 186042 - protein, 15 aa, Mycobacterium tuberculosis
FFNSGAGGVSGFGNF

SEQ ID NO: 186043 - protein, 15 aa, Mycobacterium tuberculosis
FNSGAGGVSGFGNFG

SEQ ID NO: 186044 - protein, 15 aa, Mycobacterium tuberculosis
NSGAGGVSGFGNFGA

SEQ ID NO: 186045 - protein, 15 aa, Mycobacterium tuberculosis
SGAGGVSGFGNFGAG

SEQ ID NO: 186046 - protein, 15 aa, Mycobacterium tuberculosis
GAGGVSGFGNFGAGS

SEQ ID NO: 186047 - protein, 15 aa, Mycobacterium tuberculosis
AGGVSGFGNFGAGSS

SEQ ID NO: 186048 - protein, 15 aa, Mycobacterium tuberculosis
GGVSGFGNFGAGSSG

SEQ ID NO: 186049 - protein, 15 aa, Mycobacterium tuberculosis
GVSGFGNFGAGSSGW

SEQ ID NO: 186050 - protein, 15 aa, Mycobacterium tuberculosis
VSGFGNFGAGSSGWW

SEQ ID NO: 186051 - protein, 15 aa, Mycobacterium tuberculosis
SGFGNFGAGSSGWWN

SEQ ID NO: 186052 - protein, 15 aa, Mycobacterium tuberculosis
GFGNFGAGSSGWWNQ

SEQ ID NO: 186053 - protein, 15 aa, Mycobacterium tuberculosis
FGNFGAGSSGWWNQA

SEQ ID NO: 186054 - protein, 15 aa, Mycobacterium tuberculosis
GNFGAGSSGWWNQAH

SEQ ID NO: 186055 - protein, 15 aa, Mycobacterium tuberculosis
NFGAGSSGWWNQAHA

SEQ ID NO: 186056 - protein, 15 aa, Mycobacterium tuberculosis
FGAGSSGWWNQAHAA

SEQ ID NO: 186057 - protein, 15 aa, Mycobacterium tuberculosis
GAGSSGWWNQAHAAL

SEQ ID NO: 186058 - protein, 15 aa, Mycobacterium tuberculosis
AGSSGWWNQAHAALA

SEQ ID NO: 186059 - protein, 15 aa, Mycobacterium tuberculosis
GSSGWWNQAHAALAG

SEQ ID NO: 186060 - protein, 15 aa, Mycobacterium tuberculosis
SSGWWNQAHAALAGA

SEQ ID NO: 186061 - protein, 15 aa, Mycobacterium tuberculosis
SGWWNQAHAALAGAG

SEQ ID NO: 186062 - protein, 15 aa, Mycobacterium tuberculosis
GWWNQAHAALAGAGS

SEQ ID NO: 186063 - protein, 15 aa, Mycobacterium tuberculosis
WWNQAHAALAGAGSG

SEQ ID NO: 186064 - protein, 15 aa, Mycobacterium tuberculosis
WNQAHAALAGAGSGV

SEQ ID NO: 186065 - protein, 15 aa, Mycobacterium tuberculosis
NQAHAALAGAGSGVL

SEQ ID NO: 186066 - protein, 15 aa, Mycobacterium tuberculosis
QAHAALAGAGSGVLN

SEQ ID NO: 186067 - protein, 15 aa, Mycobacterium tuberculosis
AHAALAGAGSGVLNV

SEQ ID NO: 186068 - protein, 15 aa, Mycobacterium tuberculosis
HAALAGAGSGVLNVG

SEQ ID NO: 186069 - protein, 15 aa, Mycobacterium tuberculosis
AALAGAGSGVLNVGT

SEQ ID NO: 186070 - protein, 15 aa, Mycobacterium tuberculosis
ALAGAGSGVLNVGTL

SEQ ID NO: 186071 - protein, 15 aa, Mycobacterium tuberculosis
LAGAGSGVLNVGTLN

SEQ ID NO: 186072 - protein, 15 aa, Mycobacterium tuberculosis
AGAGSGVLNVGTLNS

SEQ ID NO: 186073 - protein, 15 aa, Mycobacterium tuberculosis
GAGSGVLNVGTLNSG

SEQ ID NO: 186074 - protein, 15 aa, Mycobacterium tuberculosis
AGSGVLNVGTLNSGV

SEQ ID NO: 186075 - protein, 15 aa, Mycobacterium tuberculosis
GSGVLNVGTLNSGVL

SEQ ID NO: 186076 - protein, 15 aa, Mycobacterium tuberculosis
SGVLNVGTLNSGVLN

SEQ ID NO: 186077 - protein, 15 aa, Mycobacterium tuberculosis
GVLNVGTLNSGVLNV

SEQ ID NO: 186078 - protein, 15 aa, Mycobacterium tuberculosis
VLNVGTLNSGVLNVG

SEQ ID NO: 186079 - protein, 15 aa, Mycobacterium tuberculosis
LNVGTLNSGVLNVGS

SEQ ID NO: 186080 - protein, 15 aa, Mycobacterium tuberculosis
NVGTLNSGVLNVGSG

SEQ ID NO: 186081 - protein, 15 aa, Mycobacterium tuberculosis
VGTLNSGVLNVGSGI

SEQ ID NO: 186082 - protein, 15 aa, Mycobacterium tuberculosis
GTLNSGVLNVGSGIS

SEQ ID NO: 186083 - protein, 15 aa, Mycobacterium tuberculosis
TLNSGVLNVGSGISG

SEQ ID NO: 186084 - protein, 15 aa, Mycobacterium tuberculosis
LNSGVLNVGSGISGL

SEQ ID NO: 186085 - protein, 15 aa, Mycobacterium tuberculosis
NSGVLNVGSGISGLY

SEQ ID NO: 186086 - protein, 15 aa, Mycobacterium tuberculosis
SGVLNVGSGISGLYN

SEQ ID NO: 186087 - protein, 15 aa, Mycobacterium tuberculosis
GVLNVGSGISGLYNT

SEQ ID NO: 186088 - protein, 15 aa, Mycobacterium tuberculosis
VLNVGSGISGLYNTA

SEQ ID NO: 186089 - protein, 15 aa, Mycobacterium tuberculosis
LNVGSGISGLYNTAI

SEQ ID NO: 186090 - protein, 15 aa, Mycobacterium tuberculosis
NVGSGISGLYNTAIV

SEQ ID NO: 186091 - protein, 15 aa, Mycobacterium tuberculosis
VGSGISGLYNTAIVG

SEQ ID NO: 186092 - protein, 15 aa, Mycobacterium tuberculosis
GSGISGLYNTAIVGL

SEQ ID NO: 186093 - protein, 15 aa, Mycobacterium tuberculosis
SGISGLYNTAIVGLG

SEQ ID NO: 186094 - protein, 15 aa, Mycobacterium tuberculosis
GISGLYNTAIVGLGT

SEQ ID NO: 186095 - protein, 15 aa, Mycobacterium tuberculosis
ISGLYNTAIVGLGTP

SEQ ID NO: 186096 - protein, 15 aa, Mycobacterium tuberculosis
SGLYNTAIVGLGTPA

SEQ ID NO: 186097 - protein, 15 aa, Mycobacterium tuberculosis
GLYNTAIVGLGTPAL

SEQ ID NO: 186098 - protein, 15 aa, Mycobacterium tuberculosis
LYNTAIVGLGTPALV

SEQ ID NO: 186099 - protein, 15 aa, Mycobacterium tuberculosis
YNTAIVGLGTPALVS

SEQ ID NO: 186100 - protein, 15 aa, Mycobacterium tuberculosis
NTAIVGLGTPALVSG

SEQ ID NO: 186101 - protein, 15 aa, Mycobacterium tuberculosis
TAIVGLGTPALVSGA

SEQ ID NO: 186102 - protein, 15 aa, Mycobacterium tuberculosis
AIVGLGTPALVSGAG

SEQ ID NO: 186103 - protein, 15 aa, Mycobacterium tuberculosis
IVGLGTPALVSGAGN

SEQ ID NO: 186104 - protein, 15 aa, Mycobacterium tuberculosis
VGLGTPALVSGAGNV

SEQ ID NO: 186105 - protein, 15 aa, Mycobacterium tuberculosis
GLGTPALVSGAGNVG

SEQ ID NO: 186106 - protein, 15 aa, Mycobacterium tuberculosis
LGTPALVSGAGNVGQ

SEQ ID NO: 186107 - protein, 15 aa, Mycobacterium tuberculosis
GTPALVSGAGNVGQQ

SEQ ID NO: 186108 - protein, 15 aa, Mycobacterium tuberculosis
TPALVSGAGNVGQQL

SEQ ID NO: 186109 - protein, 15 aa, Mycobacterium tuberculosis
PALVSGAGNVGQQLS

SEQ ID NO: 186110 - protein, 15 aa, Mycobacterium tuberculosis
ALVSGAGNVGQQLSG

SEQ ID NO: 186111 - protein, 15 aa, Mycobacterium tuberculosis
LVSGAGNVGQQLSGV

SEQ ID NO: 186112 - protein, 15 aa, Mycobacterium tuberculosis
VSGAGNVGQQLSGVL

SEQ ID NO: 186113 - protein, 15 aa, Mycobacterium tuberculosis
SGAGNVGQQLSGVLA

SEQ ID NO: 186114 - protein, 15 aa, Mycobacterium tuberculosis
GAGNVGQQLSGVLAA

SEQ ID NO: 186115 - protein, 15 aa, Mycobacterium tuberculosis
AGNVGQQLSGVLAAG

SEQ ID NO: 186116 - protein, 15 aa, Mycobacterium tuberculosis
GNVGQQLSGVLAAGT

SEQ ID NO: 186117 - protein, 15 aa, Mycobacterium tuberculosis
NVGQQLSGVLAAGTA

SEQ ID NO: 186118 - protein, 15 aa, Mycobacterium tuberculosis
VGQQLSGVLAAGTAL

SEQ ID NO: 186119 - protein, 15 aa, Mycobacterium tuberculosis
GQQLSGVLAAGTALT

SEQ ID NO: 186120 - protein, 15 aa, Mycobacterium tuberculosis
QQLSGVLAAGTALTQ

SEQ ID NO: 186121 - protein, 15 aa, Mycobacterium tuberculosis
QLSGVLAAGTALTQS

SEQ ID NO: 186122 - protein, 15 aa, Mycobacterium tuberculosis
LSGVLAAGTALTQSP

SEQ ID NO: 186123 - protein, 15 aa, Mycobacterium tuberculosis
SGVLAAGTALTQSPI

SEQ ID NO: 186124 - protein, 15 aa, Mycobacterium tuberculosis
GVLAAGTALTQSPII

SEQ ID NO: 186125 - protein, 15 aa, Mycobacterium tuberculosis
VLAAGTALTQSPIIN

SEQ ID NO: 186126 - protein, 15 aa, Mycobacterium tuberculosis
LAAGTALTQSPIINL

SEQ ID NO: 186127 - protein, 15 aa, Mycobacterium tuberculosis
AAGTALTQSPIINLG

SEQ ID NO: 186128 - protein, 15 aa, Mycobacterium tuberculosis
AGTALTQSPIINLGL

SEQ ID NO: 186129 - protein, 15 aa, Mycobacterium tuberculosis
GTALTQSPIINLGLA

SEQ ID NO: 186130 - protein, 15 aa, Mycobacterium tuberculosis
TALTQSPIINLGLAD

SEQ ID NO: 186131 - protein, 15 aa, Mycobacterium tuberculosis
ALTQSPIINLGLADV

SEQ ID NO: 186132 - protein, 15 aa, Mycobacterium tuberculosis
LTQSPIINLGLADVG

SEQ ID NO: 186133 - protein, 15 aa, Mycobacterium tuberculosis
TQSPIINLGLADVGN

SEQ ID NO: 186134 - protein, 15 aa, Mycobacterium tuberculosis
QSPIINLGLADVGNY

SEQ ID NO: 186135 - protein, 15 aa, Mycobacterium tuberculosis
SPIINLGLADVGNYN

SEQ ID NO: 186136 - protein, 15 aa, Mycobacterium tuberculosis
PIINLGLADVGNYNL

SEQ ID NO: 186137 - protein, 15 aa, Mycobacterium tuberculosis
IINLGLADVGNYNLG

SEQ ID NO: 186138 - protein, 15 aa, Mycobacterium tuberculosis
INLGLADVGNYNLGL

SEQ ID NO: 186139 - protein, 15 aa, Mycobacterium tuberculosis
NLGLADVGNYNLGLG

SEQ ID NO: 186140 - protein, 15 aa, Mycobacterium tuberculosis
LGLADVGNYNLGLGN

SEQ ID NO: 186141 - protein, 15 aa, Mycobacterium tuberculosis
GLADVGNYNLGLGNV

SEQ ID NO: 186142 - protein, 15 aa, Mycobacterium tuberculosis
LADVGNYNLGLGNVG

SEQ ID NO: 186143 - protein, 15 aa, Mycobacterium tuberculosis
ADVGNYNLGLGNVGD

SEQ ID NO: 186144 - protein, 15 aa, Mycobacterium tuberculosis
DVGNYNLGLGNVGDF

SEQ ID NO: 186145 - protein, 15 aa, Mycobacterium tuberculosis
VGNYNLGLGNVGDFN

SEQ ID NO: 186146 - protein, 15 aa, Mycobacterium tuberculosis
GNYNLGLGNVGDFNL

SEQ ID NO: 186147 - protein, 15 aa, Mycobacterium tuberculosis
NYNLGLGNVGDFNLG

SEQ ID NO: 186148 - protein, 15 aa, Mycobacterium tuberculosis
YNLGLGNVGDFNLGA

SEQ ID NO: 186149 - protein, 15 aa, Mycobacterium tuberculosis
NLGLGNVGDFNLGAA

SEQ ID NO: 186150 - protein, 15 aa, Mycobacterium tuberculosis
LGLGNVGDFNLGAAN

SEQ ID NO: 186151 - protein, 15 aa, Mycobacterium tuberculosis
GLGNVGDFNLGAANL

SEQ ID NO: 186152 - protein, 15 aa, Mycobacterium tuberculosis
LGNVGDFNLGAANLG

SEQ ID NO: 186153 - protein, 15 aa, Mycobacterium tuberculosis
GNVGDFNLGAANLGD

SEQ ID NO: 186154 - protein, 15 aa, Mycobacterium tuberculosis
NVGDFNLGAANLGDL

SEQ ID NO: 186155 - protein, 15 aa, Mycobacterium tuberculosis
VGDFNLGAANLGDLN

SEQ ID NO: 186156 - protein, 15 aa, Mycobacterium tuberculosis
GDFNLGAANLGDLNL

SEQ ID NO: 186157 - protein, 15 aa, Mycobacterium tuberculosis
DFNLGAANLGDLNLG

SEQ ID NO: 186158 - protein, 15 aa, Mycobacterium tuberculosis
FNLGAANLGDLNLGL

SEQ ID NO: 186159 - protein, 15 aa, Mycobacterium tuberculosis
NLGAANLGDLNLGLG

SEQ ID NO: 186160 - protein, 15 aa, Mycobacterium tuberculosis
LGAANLGDLNLGLGN

SEQ ID NO: 186161 - protein, 15 aa, Mycobacterium tuberculosis
GAANLGDLNLGLGNI

SEQ ID NO: 186162 - protein, 15 aa, Mycobacterium tuberculosis
AANLGDLNLGLGNIG

SEQ ID NO: 186163 - protein, 15 aa, Mycobacterium tuberculosis
ANLGDLNLGLGNIGN

SEQ ID NO: 186164 - protein, 15 aa, Mycobacterium tuberculosis
NLGDLNLGLGNIGNA

SEQ ID NO: 186165 - protein, 15 aa, Mycobacterium tuberculosis
LGDLNLGLGNIGNAN

SEQ ID NO: 186166 - protein, 15 aa, Mycobacterium tuberculosis
GDLNLGLGNIGNANV

SEQ ID NO: 186167 - protein, 15 aa, Mycobacterium tuberculosis
DLNLGLGNIGNANVG

SEQ ID NO: 186168 - protein, 15 aa, Mycobacterium tuberculosis
LNLGLGNIGNANVGF

SEQ ID NO: 186169 - protein, 15 aa, Mycobacterium tuberculosis
NLGLGNIGNANVGFG

SEQ ID NO: 186170 - protein, 15 aa, Mycobacterium tuberculosis
LGLGNIGNANVGFGN

SEQ ID NO: 186171 - protein, 15 aa, Mycobacterium tuberculosis
GLGNIGNANVGFGNI

SEQ ID NO: 186172 - protein, 15 aa, Mycobacterium tuberculosis
LGNIGNANVGFGNIG

SEQ ID NO: 186173 - protein, 15 aa, Mycobacterium tuberculosis
GNIGNANVGFGNIGH

SEQ ID NO: 186174 - protein, 15 aa, Mycobacterium tuberculosis
NIGNANVGFGNIGHG

SEQ ID NO: 186175 - protein, 15 aa, Mycobacterium tuberculosis
IGNANVGFGNIGHGN

SEQ ID NO: 186176 - protein, 15 aa, Mycobacterium tuberculosis
GNANVGFGNIGHGNV

SEQ ID NO: 186177 - protein, 15 aa, Mycobacterium tuberculosis
NANVGFGNIGHGNVG

SEQ ID NO: 186178 - protein, 15 aa, Mycobacterium tuberculosis
ANVGFGNIGHGNVGF

SEQ ID NO: 186179 - protein, 15 aa, Mycobacterium tuberculosis
NVGFGNIGHGNVGFG

SEQ ID NO: 186180 - protein, 15 aa, Mycobacterium tuberculosis
VGFGNIGHGNVGFGN

SEQ ID NO: 186181 - protein, 15 aa, Mycobacterium tuberculosis
GFGNIGHGNVGFGNS

SEQ ID NO: 186182 - protein, 15 aa, Mycobacterium tuberculosis
FGNIGHGNVGFGNSG

SEQ ID NO: 186183 - protein, 15 aa, Mycobacterium tuberculosis
GNIGHGNVGFGNSGL

SEQ ID NO: 186184 - protein, 15 aa, Mycobacterium tuberculosis
NIGHGNVGFGNSGLG

SEQ ID NO: 186185 - protein, 15 aa, Mycobacterium tuberculosis
IGHGNVGFGNSGLGA

SEQ ID NO: 186186 - protein, 15 aa, Mycobacterium tuberculosis
GHGNVGFGNSGLGAA

SEQ ID NO: 186187 - protein, 15 aa, Mycobacterium tuberculosis
HGNVGFGNSGLGAAL

SEQ ID NO: 186188 - protein, 15 aa, Mycobacterium tuberculosis
GNVGFGNSGLGAALG

SEQ ID NO: 186189 - protein, 15 aa, Mycobacterium tuberculosis
NVGFGNSGLGAALGI

SEQ ID NO: 186190 - protein, 15 aa, Mycobacterium tuberculosis
VGFGNSGLGAALGIG

SEQ ID NO: 186191 - protein, 15 aa, Mycobacterium tuberculosis
GFGNSGLGAALGIGN

SEQ ID NO: 186192 - protein, 15 aa, Mycobacterium tuberculosis
FGNSGLGAALGIGNI

SEQ ID NO: 186193 - protein, 15 aa, Mycobacterium tuberculosis
GNSGLGAALGIGNIG

SEQ ID NO: 186194 - protein, 15 aa, Mycobacterium tuberculosis
NSGLGAALGIGNIGL

SEQ ID NO: 186195 - protein, 15 aa, Mycobacterium tuberculosis
SGLGAALGIGNIGLG

SEQ ID NO: 186196 - protein, 15 aa, Mycobacterium tuberculosis
GLGAALGIGNIGLGN

SEQ ID NO: 186197 - protein, 15 aa, Mycobacterium tuberculosis
LGAALGIGNIGLGNA

SEQ ID NO: 186198 - protein, 15 aa, Mycobacterium tuberculosis
GAALGIGNIGLGNAG

SEQ ID NO: 186199 - protein, 15 aa, Mycobacterium tuberculosis
AALGIGNIGLGNAGS

SEQ ID NO: 186200 - protein, 15 aa, Mycobacterium tuberculosis
ALGIGNIGLGNAGST

SEQ ID NO: 186201 - protein, 15 aa, Mycobacterium tuberculosis
LGIGNIGLGNAGSTN

SEQ ID NO: 186202 - protein, 15 aa, Mycobacterium tuberculosis
GIGNIGLGNAGSTNV

SEQ ID NO: 186203 - protein, 15 aa, Mycobacterium tuberculosis
IGNIGLGNAGSTNVG

SEQ ID NO: 186204 - protein, 15 aa, Mycobacterium tuberculosis
GNIGLGNAGSTNVGL

SEQ ID NO: 186205 - protein, 15 aa, Mycobacterium tuberculosis
NIGLGNAGSTNVGLA

SEQ ID NO: 186206 - protein, 15 aa, Mycobacterium tuberculosis
IGLGNAGSTNVGLAN

SEQ ID NO: 186207 - protein, 15 aa, Mycobacterium tuberculosis
GLGNAGSTNVGLANM

SEQ ID NO: 186208 - protein, 15 aa, Mycobacterium tuberculosis
LGNAGSTNVGLANMG

SEQ ID NO: 186209 - protein, 15 aa, Mycobacterium tuberculosis
GNAGSTNVGLANMGV

SEQ ID NO: 186210 - protein, 15 aa, Mycobacterium tuberculosis
NAGSTNVGLANMGVG

SEQ ID NO: 186211 - protein, 15 aa, Mycobacterium tuberculosis
AGSTNVGLANMGVGN

SEQ ID NO: 186212 - protein, 15 aa, Mycobacterium tuberculosis
GSTNVGLANMGVGNI

SEQ ID NO: 186213 - protein, 15 aa, Mycobacterium tuberculosis
STNVGLANMGVGNIG

SEQ ID NO: 186214 - protein, 15 aa, Mycobacterium tuberculosis
TNVGLANMGVGNIGF

SEQ ID NO: 186215 - protein, 15 aa, Mycobacterium tuberculosis
NVGLANMGVGNIGFA

SEQ ID NO: 186216 - protein, 15 aa, Mycobacterium tuberculosis
VGLANMGVGNIGFAN

SEQ ID NO: 186217 - protein, 15 aa, Mycobacterium tuberculosis
GLANMGVGNIGFANT

SEQ ID NO: 186218 - protein, 15 aa, Mycobacterium tuberculosis
LANMGVGNIGFANTG

SEQ ID NO: 186219 - protein, 15 aa, Mycobacterium tuberculosis
ANMGVGNIGFANTGT

SEQ ID NO: 186220 - protein, 15 aa, Mycobacterium tuberculosis
NMGVGNIGFANTGTN

SEQ ID NO: 186221 - protein, 15 aa, Mycobacterium tuberculosis
MGVGNIGFANTGTNN

SEQ ID NO: 186222 - protein, 15 aa, Mycobacterium tuberculosis
GVGNIGFANTGTNNL

SEQ ID NO: 186223 - protein, 15 aa, Mycobacterium tuberculosis
VGNIGFANTGTNNLG

SEQ ID NO: 186224 - protein, 15 aa, Mycobacterium tuberculosis
GNIGFANTGTNNLGI

SEQ ID NO: 186225 - protein, 15 aa, Mycobacterium tuberculosis
NIGFANTGTNNLGIG

SEQ ID NO: 186226 - protein, 15 aa, Mycobacterium tuberculosis
IGFANTGTNNLGIGL

SEQ ID NO: 186227 - protein, 15 aa, Mycobacterium tuberculosis
GFANTGTNNLGIGLT

SEQ ID NO: 186228 - protein, 15 aa, Mycobacterium tuberculosis
FANTGTNNLGIGLTG

SEQ ID NO: 186229 - protein, 15 aa, Mycobacterium tuberculosis
ANTGTNNLGIGLTGD

SEQ ID NO: 186230 - protein, 15 aa, Mycobacterium tuberculosis
NTGTNNLGIGLTGDN

SEQ ID NO: 186231 - protein, 15 aa, Mycobacterium tuberculosis
TGTNNLGIGLTGDNQ

SEQ ID NO: 186232 - protein, 15 aa, Mycobacterium tuberculosis
GTNNLGIGLTGDNQT

SEQ ID NO: 186233 - protein, 15 aa, Mycobacterium tuberculosis
TNNLGIGLTGDNQTG

SEQ ID NO: 186234 - protein, 15 aa, Mycobacterium tuberculosis
NNLGIGLTGDNQTGI

SEQ ID NO: 186235 - protein, 15 aa, Mycobacterium tuberculosis
NLGIGLTGDNQTGIG

SEQ ID NO: 186236 - protein, 15 aa, Mycobacterium tuberculosis
LGIGLTGDNQTGIGG

SEQ ID NO: 186237 - protein, 15 aa, Mycobacterium tuberculosis
GIGLTGDNQTGIGGL

SEQ ID NO: 186238 - protein, 15 aa, Mycobacterium tuberculosis
IGLTGDNQTGIGGLN

SEQ ID NO: 186239 - protein, 15 aa, Mycobacterium tuberculosis
GLTGDNQTGIGGLNS

SEQ ID NO: 186240 - protein, 15 aa, Mycobacterium tuberculosis
LTGDNQTGIGGLNSG

SEQ ID NO: 186241 - protein, 15 aa, Mycobacterium tuberculosis
TGDNQTGIGGLNSGA

SEQ ID NO: 186242 - protein, 15 aa, Mycobacterium tuberculosis
GDNQTGIGGLNSGAG

SEQ ID NO: 186243 - protein, 15 aa, Mycobacterium tuberculosis
DNQTGIGGLNSGAGN

SEQ ID NO: 186244 - protein, 15 aa, Mycobacterium tuberculosis
NQTGIGGLNSGAGNI

SEQ ID NO: 186245 - protein, 15 aa, Mycobacterium tuberculosis
QTGIGGLNSGAGNIG

SEQ ID NO: 186246 - protein, 15 aa, Mycobacterium tuberculosis
TGIGGLNSGAGNIGL

SEQ ID NO: 186247 - protein, 15 aa, Mycobacterium tuberculosis
GIGGLNSGAGNIGLF

SEQ ID NO: 186248 - protein, 15 aa, Mycobacterium tuberculosis
IGGLNSGAGNIGLFN

SEQ ID NO: 186249 - protein, 15 aa, Mycobacterium tuberculosis
GGLNSGAGNIGLFNS

SEQ ID NO: 186250 - protein, 15 aa, Mycobacterium tuberculosis
GLNSGAGNIGLFNSG

SEQ ID NO: 186251 - protein, 15 aa, Mycobacterium tuberculosis
LNSGAGNIGLFNSGT

SEQ ID NO: 186252 - protein, 15 aa, Mycobacterium tuberculosis
NSGAGNIGLFNSGTG

SEQ ID NO: 186253 - protein, 15 aa, Mycobacterium tuberculosis
SGAGNIGLFNSGTGN

SEQ ID NO: 186254 - protein, 15 aa, Mycobacterium tuberculosis
GAGNIGLFNSGTGNI

SEQ ID NO: 186255 - protein, 15 aa, Mycobacterium tuberculosis
AGNIGLFNSGTGNIG

SEQ ID NO: 186256 - protein, 15 aa, Mycobacterium tuberculosis
GNIGLFNSGTGNIGF

SEQ ID NO: 186257 - protein, 15 aa, Mycobacterium tuberculosis
NIGLFNSGTGNIGFF

SEQ ID NO: 186258 - protein, 15 aa, Mycobacterium tuberculosis
IGLFNSGTGNIGFFN

SEQ ID NO: 186259 - protein, 15 aa, Mycobacterium tuberculosis
GLFNSGTGNIGFFNS

SEQ ID NO: 186260 - protein, 15 aa, Mycobacterium tuberculosis
LFNSGTGNIGFFNSG

SEQ ID NO: 186261 - protein, 15 aa, Mycobacterium tuberculosis
FNSGTGNIGFFNSGT

SEQ ID NO: 186262 - protein, 15 aa, Mycobacterium tuberculosis
NSGTGNIGFFNSGTG

SEQ ID NO: 186263 - protein, 15 aa, Mycobacterium tuberculosis
SGTGNIGFFNSGTGN

SEQ ID NO: 186264 - protein, 15 aa, Mycobacterium tuberculosis
GTGNIGFFNSGTGNW

SEQ ID NO: 186265 - protein, 15 aa, Mycobacterium tuberculosis
TGNIGFFNSGTGNWG

SEQ ID NO: 186266 - protein, 15 aa, Mycobacterium tuberculosis
GNIGFFNSGTGNWGL

SEQ ID NO: 186267 - protein, 15 aa, Mycobacterium tuberculosis
NIGFFNSGTGNWGLF

SEQ ID NO: 186268 - protein, 15 aa, Mycobacterium tuberculosis
IGFFNSGTGNWGLFN

SEQ ID NO: 186269 - protein, 15 aa, Mycobacterium tuberculosis
GFFNSGTGNWGLFNS

SEQ ID NO: 186270 - protein, 15 aa, Mycobacterium tuberculosis
FFNSGTGNWGLFNSG

SEQ ID NO: 186271 - protein, 15 aa, Mycobacterium tuberculosis
FNSGTGNWGLFNSGS

SEQ ID NO: 186272 - protein, 15 aa, Mycobacterium tuberculosis
NSGTGNWGLFNSGSF

SEQ ID NO: 186273 - protein, 15 aa, Mycobacterium tuberculosis
SGTGNWGLFNSGSFN

SEQ ID NO: 186274 - protein, 15 aa, Mycobacterium tuberculosis
GTGNWGLFNSGSFNT

SEQ ID NO: 186275 - protein, 15 aa, Mycobacterium tuberculosis
TGNWGLFNSGSFNTG

SEQ ID NO: 186276 - protein, 15 aa, Mycobacterium tuberculosis
GNWGLFNSGSFNTGI

SEQ ID NO: 186277 - protein, 15 aa, Mycobacterium tuberculosis
NWGLFNSGSFNTGIG

SEQ ID NO: 186278 - protein, 15 aa, Mycobacterium tuberculosis
WGLFNSGSFNTGIGN

SEQ ID NO: 186279 - protein, 15 aa, Mycobacterium tuberculosis
GLFNSGSFNTGIGNS

SEQ ID NO: 186280 - protein, 15 aa, Mycobacterium tuberculosis
LFNSGSFNTGIGNSG

SEQ ID NO: 186281 - protein, 15 aa, Mycobacterium tuberculosis
FNSGSFNTGIGNSGT

SEQ ID NO: 186282 - protein, 15 aa, Mycobacterium tuberculosis
NSGSFNTGIGNSGTG

SEQ ID NO: 186283 - protein, 15 aa, Mycobacterium tuberculosis
SGSFNTGIGNSGTGS

SEQ ID NO: 186284 - protein, 15 aa, Mycobacterium tuberculosis
GSFNTGIGNSGTGST

SEQ ID NO: 186285 - protein, 15 aa, Mycobacterium tuberculosis
SFNTGIGNSGTGSTG

SEQ ID NO: 186286 - protein, 15 aa, Mycobacterium tuberculosis
FNTGIGNSGTGSTGL

SEQ ID NO: 186287 - protein, 15 aa, Mycobacterium tuberculosis
NTGIGNSGTGSTGLF

SEQ ID NO: 186288 - protein, 15 aa, Mycobacterium tuberculosis
TGIGNSGTGSTGLFN

SEQ ID NO: 186289 - protein, 15 aa, Mycobacterium tuberculosis
GIGNSGTGSTGLFNA

SEQ ID NO: 186290 - protein, 15 aa, Mycobacterium tuberculosis
IGNSGTGSTGLFNAG

SEQ ID NO: 186291 - protein, 15 aa, Mycobacterium tuberculosis
GNSGTGSTGLFNAGG

SEQ ID NO: 186292 - protein, 15 aa, Mycobacterium tuberculosis
NSGTGSTGLFNAGGF

SEQ ID NO: 186293 - protein, 15 aa, Mycobacterium tuberculosis
SGTGSTGLFNAGGFT

SEQ ID NO: 186294 - protein, 15 aa, Mycobacterium tuberculosis
GTGSTGLFNAGGFTT

SEQ ID NO: 186295 - protein, 15 aa, Mycobacterium tuberculosis
TGSTGLFNAGGFTTG

SEQ ID NO: 186296 - protein, 15 aa, Mycobacterium tuberculosis
GSTGLFNAGGFTTGL

SEQ ID NO: 186297 - protein, 15 aa, Mycobacterium tuberculosis
STGLFNAGGFTTGLA

SEQ ID NO: 186298 - protein, 15 aa, Mycobacterium tuberculosis
TGLFNAGGFTTGLAN

SEQ ID NO: 186299 - protein, 15 aa, Mycobacterium tuberculosis
GLFNAGGFTTGLANA

SEQ ID NO: 186300 - protein, 15 aa, Mycobacterium tuberculosis
LFNAGGFTTGLANAG

SEQ ID NO: 186301 - protein, 15 aa, Mycobacterium tuberculosis
FNAGGFTTGLANAGS

SEQ ID NO: 186302 - protein, 15 aa, Mycobacterium tuberculosis
NAGGFTTGLANAGSY

SEQ ID NO: 186303 - protein, 15 aa, Mycobacterium tuberculosis
AGGFTTGLANAGSYN

SEQ ID NO: 186304 - protein, 15 aa, Mycobacterium tuberculosis
GGFTTGLANAGSYNT

SEQ ID NO: 186305 - protein, 15 aa, Mycobacterium tuberculosis
GFTTGLANAGSYNTG

SEQ ID NO: 186306 - protein, 15 aa, Mycobacterium tuberculosis
FTTGLANAGSYNTGS

SEQ ID NO: 186307 - protein, 15 aa, Mycobacterium tuberculosis
TTGLANAGSYNTGSF

SEQ ID NO: 186308 - protein, 15 aa, Mycobacterium tuberculosis
TGLANAGSYNTGSFN

SEQ ID NO: 186309 - protein, 15 aa, Mycobacterium tuberculosis
GLANAGSYNTGSFNV

SEQ ID NO: 186310 - protein, 15 aa, Mycobacterium tuberculosis
LANAGSYNTGSFNVG

SEQ ID NO: 186311 - protein, 15 aa, Mycobacterium tuberculosis
ANAGSYNTGSFNVGD

SEQ ID NO: 186312 - protein, 15 aa, Mycobacterium tuberculosis
NAGSYNTGSFNVGDT

SEQ ID NO: 186313 - protein, 15 aa, Mycobacterium tuberculosis
AGSYNTGSFNVGDTN

SEQ ID NO: 186314 - protein, 15 aa, Mycobacterium tuberculosis
GSYNTGSFNVGDTNT

SEQ ID NO: 186315 - protein, 15 aa, Mycobacterium tuberculosis
SYNTGSFNVGDTNTG

SEQ ID NO: 186316 - protein, 15 aa, Mycobacterium tuberculosis
YNTGSFNVGDTNTGG

SEQ ID NO: 186317 - protein, 15 aa, Mycobacterium tuberculosis
NTGSFNVGDTNTGGF

SEQ ID NO: 186318 - protein, 15 aa, Mycobacterium tuberculosis
TGSFNVGDTNTGGFN

SEQ ID NO: 186319 - protein, 15 aa, Mycobacterium tuberculosis
GSFNVGDTNTGGFNP

SEQ ID NO: 186320 - protein, 15 aa, Mycobacterium tuberculosis
SFNVGDTNTGGFNPG

SEQ ID NO: 186321 - protein, 15 aa, Mycobacterium tuberculosis
FNVGDTNTGGFNPGS

SEQ ID NO: 186322 - protein, 15 aa, Mycobacterium tuberculosis
NVGDTNTGGFNPGSI

SEQ ID NO: 186323 - protein, 15 aa, Mycobacterium tuberculosis
VGDTNTGGFNPGSIN

SEQ ID NO: 186324 - protein, 15 aa, Mycobacterium tuberculosis
GDTNTGGFNPGSINT

SEQ ID NO: 186325 - protein, 15 aa, Mycobacterium tuberculosis
DTNTGGFNPGSINTG

SEQ ID NO: 186326 - protein, 15 aa, Mycobacterium tuberculosis
TNTGGFNPGSINTGW

SEQ ID NO: 186327 - protein, 15 aa, Mycobacterium tuberculosis
NTGGFNPGSINTGWF

SEQ ID NO: 186328 - protein, 15 aa, Mycobacterium tuberculosis
TGGFNPGSINTGWFN

SEQ ID NO: 186329 - protein, 15 aa, Mycobacterium tuberculosis
GGFNPGSINTGWFNT

SEQ ID NO: 186330 - protein, 15 aa, Mycobacterium tuberculosis
GFNPGSINTGWFNTG

SEQ ID NO: 186331 - protein, 15 aa, Mycobacterium tuberculosis
FNPGSINTGWFNTGN

SEQ ID NO: 186332 - protein, 15 aa, Mycobacterium tuberculosis
NPGSINTGWFNTGNA

SEQ ID NO: 186333 - protein, 15 aa, Mycobacterium tuberculosis
PGSINTGWFNTGNAN

SEQ ID NO: 186334 - protein, 15 aa, Mycobacterium tuberculosis
GSINTGWFNTGNANT

SEQ ID NO: 186335 - protein, 15 aa, Mycobacterium tuberculosis
SINTGWFNTGNANTG

SEQ ID NO: 186336 - protein, 15 aa, Mycobacterium tuberculosis
INTGWFNTGNANTGI

SEQ ID NO: 186337 - protein, 15 aa, Mycobacterium tuberculosis
NTGWFNTGNANTGIA

SEQ ID NO: 186338 - protein, 15 aa, Mycobacterium tuberculosis
TGWFNTGNANTGIAN

SEQ ID NO: 186339 - protein, 15 aa, Mycobacterium tuberculosis
GWFNTGNANTGIANS

SEQ ID NO: 186340 - protein, 15 aa, Mycobacterium tuberculosis
WFNTGNANTGIANSG

SEQ ID NO: 186341 - protein, 15 aa, Mycobacterium tuberculosis
FNTGNANTGIANSGN

SEQ ID NO: 186342 - protein, 15 aa, Mycobacterium tuberculosis
NTGNANTGIANSGNV

SEQ ID NO: 186343 - protein, 15 aa, Mycobacterium tuberculosis
TGNANTGIANSGNVD

SEQ ID NO: 186344 - protein, 15 aa, Mycobacterium tuberculosis
GNANTGIANSGNVDT

SEQ ID NO: 186345 - protein, 15 aa, Mycobacterium tuberculosis
NANTGIANSGNVDTG

SEQ ID NO: 186346 - protein, 15 aa, Mycobacterium tuberculosis
ANTGIANSGNVDTGA

SEQ ID NO: 186347 - protein, 15 aa, Mycobacterium tuberculosis
NTGIANSGNVDTGAL

SEQ ID NO: 186348 - protein, 15 aa, Mycobacterium tuberculosis
TGIANSGNVDTGALM

SEQ ID NO: 186349 - protein, 15 aa, Mycobacterium tuberculosis
GIANSGNVDTGALMS

SEQ ID NO: 186350 - protein, 15 aa, Mycobacterium tuberculosis
IANSGNVDTGALMSG

SEQ ID NO: 186351 - protein, 15 aa, Mycobacterium tuberculosis
ANSGNVDTGALMSGN

SEQ ID NO: 186352 - protein, 15 aa, Mycobacterium tuberculosis
NSGNVDTGALMSGNF

SEQ ID NO: 186353 - protein, 15 aa, Mycobacterium tuberculosis
SGNVDTGALMSGNFS

SEQ ID NO: 186354 - protein, 15 aa, Mycobacterium tuberculosis
GNVDTGALMSGNFSN

SEQ ID NO: 186355 - protein, 15 aa, Mycobacterium tuberculosis
NVDTGALMSGNFSNG

SEQ ID NO: 186356 - protein, 15 aa, Mycobacterium tuberculosis
VDTGALMSGNFSNGI

SEQ ID NO: 186357 - protein, 15 aa, Mycobacterium tuberculosis
DTGALMSGNFSNGIL

SEQ ID NO: 186358 - protein, 15 aa, Mycobacterium tuberculosis
TGALMSGNFSNGILW

SEQ ID NO: 186359 - protein, 15 aa, Mycobacterium tuberculosis
GALMSGNFSNGILWR

SEQ ID NO: 186360 - protein, 15 aa, Mycobacterium tuberculosis
ALMSGNFSNGILWRG

SEQ ID NO: 186361 - protein, 15 aa, Mycobacterium tuberculosis
LMSGNFSNGILWRGN

SEQ ID NO: 186362 - protein, 15 aa, Mycobacterium tuberculosis
MSGNFSNGILWRGNY

SEQ ID NO: 186363 - protein, 15 aa, Mycobacterium tuberculosis
SGNFSNGILWRGNYE

SEQ ID NO: 186364 - protein, 15 aa, Mycobacterium tuberculosis
GNFSNGILWRGNYEG

SEQ ID NO: 186365 - protein, 15 aa, Mycobacterium tuberculosis
NFSNGILWRGNYEGL

SEQ ID NO: 186366 - protein, 15 aa, Mycobacterium tuberculosis
FSNGILWRGNYEGLF

SEQ ID NO: 186367 - protein, 15 aa, Mycobacterium tuberculosis
SNGILWRGNYEGLFS

SEQ ID NO: 186368 - protein, 15 aa, Mycobacterium tuberculosis
NGILWRGNYEGLFSY

SEQ ID NO: 186369 - protein, 15 aa, Mycobacterium tuberculosis
GILWRGNYEGLFSYS

SEQ ID NO: 186370 - protein, 15 aa, Mycobacterium tuberculosis
ILWRGNYEGLFSYSY

SEQ ID NO: 186371 - protein, 15 aa, Mycobacterium tuberculosis
LWRGNYEGLFSYSYS

SEQ ID NO: 186372 - protein, 15 aa, Mycobacterium tuberculosis
WRGNYEGLFSYSYSL

SEQ ID NO: 186373 - protein, 15 aa, Mycobacterium tuberculosis
RGNYEGLFSYSYSLD

SEQ ID NO: 186374 - protein, 15 aa, Mycobacterium tuberculosis
GNYEGLFSYSYSLDV

SEQ ID NO: 186375 - protein, 15 aa, Mycobacterium tuberculosis
NYEGLFSYSYSLDVP

SEQ ID NO: 186376 - protein, 15 aa, Mycobacterium tuberculosis
YEGLFSYSYSLDVPR

SEQ ID NO: 186377 - protein, 15 aa, Mycobacterium tuberculosis
EGLFSYSYSLDVPRI

SEQ ID NO: 186378 - protein, 15 aa, Mycobacterium tuberculosis
GLFSYSYSLDVPRIT

SEQ ID NO: 186379 - protein, 15 aa, Mycobacterium tuberculosis
LFSYSYSLDVPRITI

SEQ ID NO: 186380 - protein, 15 aa, Mycobacterium tuberculosis
FSYSYSLDVPRITIL

SEQ ID NO: 186381 - protein, 15 aa, Mycobacterium tuberculosis
SYSYSLDVPRITILD

SEQ ID NO: 186382 - protein, 15 aa, Mycobacterium tuberculosis
YSYSLDVPRITILDA

SEQ ID NO: 186383 - protein, 15 aa, Mycobacterium tuberculosis
SYSLDVPRITILDAH

SEQ ID NO: 186384 - protein, 15 aa, Mycobacterium tuberculosis
YSLDVPRITILDAHF

SEQ ID NO: 186385 - protein, 15 aa, Mycobacterium tuberculosis
SLDVPRITILDAHFT

SEQ ID NO: 186386 - protein, 15 aa, Mycobacterium tuberculosis
LDVPRITILDAHFTG

SEQ ID NO: 186387 - protein, 15 aa, Mycobacterium tuberculosis
DVPRITILDAHFTGA

SEQ ID NO: 186388 - protein, 15 aa, Mycobacterium tuberculosis
VPRITILDAHFTGAF

SEQ ID NO: 186389 - protein, 15 aa, Mycobacterium tuberculosis
PRITILDAHFTGAFG

SEQ ID NO: 186390 - protein, 15 aa, Mycobacterium tuberculosis
RITILDAHFTGAFGP

SEQ ID NO: 186391 - protein, 15 aa, Mycobacterium tuberculosis
ITILDAHFTGAFGPV

SEQ ID NO: 186392 - protein, 15 aa, Mycobacterium tuberculosis
TILDAHFTGAFGPVV

SEQ ID NO: 186393 - protein, 15 aa, Mycobacterium tuberculosis
ILDAHFTGAFGPVVV

SEQ ID NO: 186394 - protein, 15 aa, Mycobacterium tuberculosis
LDAHFTGAFGPVVVP

SEQ ID NO: 186395 - protein, 15 aa, Mycobacterium tuberculosis
DAHFTGAFGPVVVPP

SEQ ID NO: 186396 - protein, 15 aa, Mycobacterium tuberculosis
AHFTGAFGPVVVPPI

SEQ ID NO: 186397 - protein, 15 aa, Mycobacterium tuberculosis
HFTGAFGPVVVPPIP

SEQ ID NO: 186398 - protein, 15 aa, Mycobacterium tuberculosis
FTGAFGPVVVPPIPV

SEQ ID NO: 186399 - protein, 15 aa, Mycobacterium tuberculosis
TGAFGPVVVPPIPVL

SEQ ID NO: 186400 - protein, 15 aa, Mycobacterium tuberculosis
GAFGPVVVPPIPVLA

SEQ ID NO: 186401 - protein, 15 aa, Mycobacterium tuberculosis
AFGPVVVPPIPVLAI

SEQ ID NO: 186402 - protein, 15 aa, Mycobacterium tuberculosis
FGPVVVPPIPVLAIN

SEQ ID NO: 186403 - protein, 15 aa, Mycobacterium tuberculosis
GPVVVPPIPVLAINA

SEQ ID NO: 186404 - protein, 15 aa, Mycobacterium tuberculosis
PVVVPPIPVLAINAH

SEQ ID NO: 186405 - protein, 15 aa, Mycobacterium tuberculosis
VVVPPIPVLAINAHL

SEQ ID NO: 186406 - protein, 15 aa, Mycobacterium tuberculosis
VVPPIPVLAINAHLT

SEQ ID NO: 186407 - protein, 15 aa, Mycobacterium tuberculosis
VPPIPVLAINAHLTG

SEQ ID NO: 186408 - protein, 15 aa, Mycobacterium tuberculosis
PPIPVLAINAHLTGN

SEQ ID NO: 186409 - protein, 15 aa, Mycobacterium tuberculosis
PIPVLAINAHLTGNA

SEQ ID NO: 186410 - protein, 15 aa, Mycobacterium tuberculosis
IPVLAINAHLTGNAA

SEQ ID NO: 186411 - protein, 15 aa, Mycobacterium tuberculosis
PVLAINAHLTGNAAM

SEQ ID NO: 186412 - protein, 15 aa, Mycobacterium tuberculosis
VLAINAHLTGNAAMG

SEQ ID NO: 186413 - protein, 15 aa, Mycobacterium tuberculosis
LAINAHLTGNAAMGA

SEQ ID NO: 186414 - protein, 15 aa, Mycobacterium tuberculosis
AINAHLTGNAAMGAF

SEQ ID NO: 186415 - protein, 15 aa, Mycobacterium tuberculosis
INAHLTGNAAMGAFT

SEQ ID NO: 186416 - protein, 15 aa, Mycobacterium tuberculosis
NAHLTGNAAMGAFTI

SEQ ID NO: 186417 - protein, 15 aa, Mycobacterium tuberculosis
AHLTGNAAMGAFTIP

SEQ ID NO: 186418 - protein, 15 aa, Mycobacterium tuberculosis
HLTGNAAMGAFTIPQ

SEQ ID NO: 186419 - protein, 15 aa, Mycobacterium tuberculosis
LTGNAAMGAFTIPQI

SEQ ID NO: 186420 - protein, 15 aa, Mycobacterium tuberculosis
TGNAAMGAFTIPQID

SEQ ID NO: 186421 - protein, 15 aa, Mycobacterium tuberculosis
GNAAMGAFTIPQIDI

SEQ ID NO: 186422 - protein, 15 aa, Mycobacterium tuberculosis
NAAMGAFTIPQIDIP

SEQ ID NO: 186423 - protein, 15 aa, Mycobacterium tuberculosis
AAMGAFTIPQIDIPA

SEQ ID NO: 186424 - protein, 15 aa, Mycobacterium tuberculosis
AMGAFTIPQIDIPAL

SEQ ID NO: 186425 - protein, 15 aa, Mycobacterium tuberculosis
MGAFTIPQIDIPALN

SEQ ID NO: 186426 - protein, 15 aa, Mycobacterium tuberculosis
GAFTIPQIDIPALNP

SEQ ID NO: 186427 - protein, 15 aa, Mycobacterium tuberculosis
AFTIPQIDIPALNPN

SEQ ID NO: 186428 - protein, 15 aa, Mycobacterium tuberculosis
FTIPQIDIPALNPNV

SEQ ID NO: 186429 - protein, 15 aa, Mycobacterium tuberculosis
TIPQIDIPALNPNVT

SEQ ID NO: 186430 - protein, 15 aa, Mycobacterium tuberculosis
IPQIDIPALNPNVTG

SEQ ID NO: 186431 - protein, 15 aa, Mycobacterium tuberculosis
PQIDIPALNPNVTGS

SEQ ID NO: 186432 - protein, 15 aa, Mycobacterium tuberculosis
QIDIPALNPNVTGSV

SEQ ID NO: 186433 - protein, 15 aa, Mycobacterium tuberculosis
IDIPALNPNVTGSVG

SEQ ID NO: 186434 - protein, 15 aa, Mycobacterium tuberculosis
DIPALNPNVTGSVGF

SEQ ID NO: 186435 - protein, 15 aa, Mycobacterium tuberculosis
IPALNPNVTGSVGFG

SEQ ID NO: 186436 - protein, 15 aa, Mycobacterium tuberculosis
PALNPNVTGSVGFGP

SEQ ID NO: 186437 - protein, 15 aa, Mycobacterium tuberculosis
ALNPNVTGSVGFGPI

SEQ ID NO: 186438 - protein, 15 aa, Mycobacterium tuberculosis
LNPNVTGSVGFGPIA

SEQ ID NO: 186439 - protein, 15 aa, Mycobacterium tuberculosis
NPNVTGSVGFGPIAV

SEQ ID NO: 186440 - protein, 15 aa, Mycobacterium tuberculosis
PNVTGSVGFGPIAVP

SEQ ID NO: 186441 - protein, 15 aa, Mycobacterium tuberculosis
NVTGSVGFGPIAVPS

SEQ ID NO: 186442 - protein, 15 aa, Mycobacterium tuberculosis
VTGSVGFGPIAVPSV

SEQ ID NO: 186443 - protein, 15 aa, Mycobacterium tuberculosis
TGSVGFGPIAVPSVT

SEQ ID NO: 186444 - protein, 15 aa, Mycobacterium tuberculosis
GSVGFGPIAVPSVTI

SEQ ID NO: 186445 - protein, 15 aa, Mycobacterium tuberculosis
SVGFGPIAVPSVTIP

SEQ ID NO: 186446 - protein, 15 aa, Mycobacterium tuberculosis
VGFGPIAVPSVTIPA

SEQ ID NO: 186447 - protein, 15 aa, Mycobacterium tuberculosis
GFGPIAVPSVTIPAL

SEQ ID NO: 186448 - protein, 15 aa, Mycobacterium tuberculosis
FGPIAVPSVTIPALT

SEQ ID NO: 186449 - protein, 15 aa, Mycobacterium tuberculosis
GPIAVPSVTIPALTA

SEQ ID NO: 186450 - protein, 15 aa, Mycobacterium tuberculosis
PIAVPSVTIPALTAA

SEQ ID NO: 186451 - protein, 15 aa, Mycobacterium tuberculosis
IAVPSVTIPALTAAR

SEQ ID NO: 186452 - protein, 15 aa, Mycobacterium tuberculosis
AVPSVTIPALTAARA

SEQ ID NO: 186453 - protein, 15 aa, Mycobacterium tuberculosis
VPSVTIPALTAARAV

SEQ ID NO: 186454 - protein, 15 aa, Mycobacterium tuberculosis
PSVTIPALTAARAVL

SEQ ID NO: 186455 - protein, 15 aa, Mycobacterium tuberculosis
SVTIPALTAARAVLD

SEQ ID NO: 186456 - protein, 15 aa, Mycobacterium tuberculosis
VTIPALTAARAVLDM

SEQ ID NO: 186457 - protein, 15 aa, Mycobacterium tuberculosis
TIPALTAARAVLDMA

SEQ ID NO: 186458 - protein, 15 aa, Mycobacterium tuberculosis
IPALTAARAVLDMAA

SEQ ID NO: 186459 - protein, 15 aa, Mycobacterium tuberculosis
PALTAARAVLDMAAS

SEQ ID NO: 186460 - protein, 15 aa, Mycobacterium tuberculosis
ALTAARAVLDMAASV

SEQ ID NO: 186461 - protein, 15 aa, Mycobacterium tuberculosis
LTAARAVLDMAASVG

SEQ ID NO: 186462 - protein, 15 aa, Mycobacterium tuberculosis
TAARAVLDMAASVGA

SEQ ID NO: 186463 - protein, 15 aa, Mycobacterium tuberculosis
AARAVLDMAASVGAT

SEQ ID NO: 186464 - protein, 15 aa, Mycobacterium tuberculosis
ARAVLDMAASVGATS

SEQ ID NO: 186465 - protein, 15 aa, Mycobacterium tuberculosis
RAVLDMAASVGATSE

SEQ ID NO: 186466 - protein, 15 aa, Mycobacterium tuberculosis
AVLDMAASVGATSEI

SEQ ID NO: 186467 - protein, 15 aa, Mycobacterium tuberculosis
VLDMAASVGATSEIE

SEQ ID NO: 186468 - protein, 15 aa, Mycobacterium tuberculosis
LDMAASVGATSEIEP

SEQ ID NO: 186469 - protein, 15 aa, Mycobacterium tuberculosis
DMAASVGATSEIEPF

SEQ ID NO: 186470 - protein, 15 aa, Mycobacterium tuberculosis
MAASVGATSEIEPFI

SEQ ID NO: 186471 - protein, 15 aa, Mycobacterium tuberculosis
AASVGATSEIEPFIV

SEQ ID NO: 186472 - protein, 15 aa, Mycobacterium tuberculosis
ASVGATSEIEPFIVW

SEQ ID NO: 186473 - protein, 15 aa, Mycobacterium tuberculosis
SVGATSEIEPFIVWT

SEQ ID NO: 186474 - protein, 15 aa, Mycobacterium tuberculosis
VGATSEIEPFIVWTS

SEQ ID NO: 186475 - protein, 15 aa, Mycobacterium tuberculosis
GATSEIEPFIVWTSS

SEQ ID NO: 186476 - protein, 15 aa, Mycobacterium tuberculosis
ATSEIEPFIVWTSSG

SEQ ID NO: 186477 - protein, 15 aa, Mycobacterium tuberculosis
TSEIEPFIVWTSSGA

SEQ ID NO: 186478 - protein, 15 aa, Mycobacterium tuberculosis
SEIEPFIVWTSSGAI

SEQ ID NO: 186479 - protein, 15 aa, Mycobacterium tuberculosis
EIEPFIVWTSSGAIG

SEQ ID NO: 186480 - protein, 15 aa, Mycobacterium tuberculosis
IEPFIVWTSSGAIGP

SEQ ID NO: 186481 - protein, 15 aa, Mycobacterium tuberculosis
EPFIVWTSSGAIGPT

SEQ ID NO: 186482 - protein, 15 aa, Mycobacterium tuberculosis
PFIVWTSSGAIGPTW

SEQ ID NO: 186483 - protein, 15 aa, Mycobacterium tuberculosis
FIVWTSSGAIGPTWY

SEQ ID NO: 186484 - protein, 15 aa, Mycobacterium tuberculosis
IVWTSSGAIGPTWYS

SEQ ID NO: 186485 - protein, 15 aa, Mycobacterium tuberculosis
VWTSSGAIGPTWYSV

SEQ ID NO: 186486 - protein, 15 aa, Mycobacterium tuberculosis
WTSSGAIGPTWYSVG

SEQ ID NO: 186487 - protein, 15 aa, Mycobacterium tuberculosis
TSSGAIGPTWYSVGR

SEQ ID NO: 186488 - protein, 15 aa, Mycobacterium tuberculosis
SSGAIGPTWYSVGRI

SEQ ID NO: 186489 - protein, 15 aa, Mycobacterium tuberculosis
SGAIGPTWYSVGRIY

SEQ ID NO: 186490 - protein, 15 aa, Mycobacterium tuberculosis
GAIGPTWYSVGRIYN

SEQ ID NO: 186491 - protein, 15 aa, Mycobacterium tuberculosis
AIGPTWYSVGRIYNA

SEQ ID NO: 186492 - protein, 15 aa, Mycobacterium tuberculosis
IGPTWYSVGRIYNAG

SEQ ID NO: 186493 - protein, 15 aa, Mycobacterium tuberculosis
GPTWYSVGRIYNAGD

SEQ ID NO: 186494 - protein, 15 aa, Mycobacterium tuberculosis
PTWYSVGRIYNAGDL

SEQ ID NO: 186495 - protein, 15 aa, Mycobacterium tuberculosis
TWYSVGRIYNAGDLF

SEQ ID NO: 186496 - protein, 15 aa, Mycobacterium tuberculosis
WYSVGRIYNAGDLFV

SEQ ID NO: 186497 - protein, 15 aa, Mycobacterium tuberculosis
YSVGRIYNAGDLFVG

SEQ ID NO: 186498 - protein, 15 aa, Mycobacterium tuberculosis
SVGRIYNAGDLFVGG

SEQ ID NO: 186499 - protein, 15 aa, Mycobacterium tuberculosis
VGRIYNAGDLFVGGN

SEQ ID NO: 186500 - protein, 15 aa, Mycobacterium tuberculosis
GRIYNAGDLFVGGNI

SEQ ID NO: 186501 - protein, 15 aa, Mycobacterium tuberculosis
RIYNAGDLFVGGNII

SEQ ID NO: 186502 - protein, 15 aa, Mycobacterium tuberculosis
IYNAGDLFVGGNIIS

SEQ ID NO: 186503 - protein, 15 aa, Mycobacterium tuberculosis
YNAGDLFVGGNIISG

SEQ ID NO: 186504 - protein, 15 aa, Mycobacterium tuberculosis
NAGDLFVGGNIISGI

SEQ ID NO: 186505 - protein, 15 aa, Mycobacterium tuberculosis
AGDLFVGGNIISGIP

SEQ ID NO: 186506 - protein, 15 aa, Mycobacterium tuberculosis
GDLFVGGNIISGIPT

SEQ ID NO: 186507 - protein, 15 aa, Mycobacterium tuberculosis
DLFVGGNIISGIPTL

SEQ ID NO: 186508 - protein, 15 aa, Mycobacterium tuberculosis
LFVGGNIISGIPTLS

SEQ ID NO: 186509 - protein, 15 aa, Mycobacterium tuberculosis
FVGGNIISGIPTLST

SEQ ID NO: 186510 - protein, 15 aa, Mycobacterium tuberculosis
VGGNIISGIPTLSTT

SEQ ID NO: 186511 - protein, 15 aa, Mycobacterium tuberculosis
GGNIISGIPTLSTTG

SEQ ID NO: 186512 - protein, 15 aa, Mycobacterium tuberculosis
GNIISGIPTLSTTGP

SEQ ID NO: 186513 - protein, 15 aa, Mycobacterium tuberculosis
NIISGIPTLSTTGPV

SEQ ID NO: 186514 - protein, 15 aa, Mycobacterium tuberculosis
IISGIPTLSTTGPVH

SEQ ID NO: 186515 - protein, 15 aa, Mycobacterium tuberculosis
ISGIPTLSTTGPVHA

SEQ ID NO: 186516 - protein, 15 aa, Mycobacterium tuberculosis
SGIPTLSTTGPVHAV

SEQ ID NO: 186517 - protein, 15 aa, Mycobacterium tuberculosis
GIPTLSTTGPVHAVF

SEQ ID NO: 186518 - protein, 15 aa, Mycobacterium tuberculosis
IPTLSTTGPVHAVFN

SEQ ID NO: 186519 - protein, 15 aa, Mycobacterium tuberculosis
PTLSTTGPVHAVFNA

SEQ ID NO: 186520 - protein, 15 aa, Mycobacterium tuberculosis
TLSTTGPVHAVFNAA

SEQ ID NO: 186521 - protein, 15 aa, Mycobacterium tuberculosis
LSTTGPVHAVFNAAS

SEQ ID NO: 186522 - protein, 15 aa, Mycobacterium tuberculosis
STTGPVHAVFNAASQ

SEQ ID NO: 186523 - protein, 15 aa, Mycobacterium tuberculosis
TTGPVHAVFNAASQA

SEQ ID NO: 186524 - protein, 15 aa, Mycobacterium tuberculosis
TGPVHAVFNAASQAF

SEQ ID NO: 186525 - protein, 15 aa, Mycobacterium tuberculosis
GPVHAVFNAASQAFN

SEQ ID NO: 186526 - protein, 15 aa, Mycobacterium tuberculosis
PVHAVFNAASQAFNT

SEQ ID NO: 186527 - protein, 15 aa, Mycobacterium tuberculosis
VHAVFNAASQAFNTP

SEQ ID NO: 186528 - protein, 15 aa, Mycobacterium tuberculosis
HAVFNAASQAFNTPA

SEQ ID NO: 186529 - protein, 15 aa, Mycobacterium tuberculosis
AVFNAASQAFNTPAL

SEQ ID NO: 186530 - protein, 15 aa, Mycobacterium tuberculosis
VFNAASQAFNTPALN

SEQ ID NO: 186531 - protein, 15 aa, Mycobacterium tuberculosis
FNAASQAFNTPALNI

SEQ ID NO: 186532 - protein, 15 aa, Mycobacterium tuberculosis
NAASQAFNTPALNIH

SEQ ID NO: 186533 - protein, 15 aa, Mycobacterium tuberculosis
AASQAFNTPALNIHQ

SEQ ID NO: 186534 - protein, 15 aa, Mycobacterium tuberculosis
ASQAFNTPALNIHQI

SEQ ID NO: 186535 - protein, 15 aa, Mycobacterium tuberculosis
SQAFNTPALNIHQIP

SEQ ID NO: 186536 - protein, 15 aa, Mycobacterium tuberculosis
QAFNTPALNIHQIPL

SEQ ID NO: 186537 - protein, 15 aa, Mycobacterium tuberculosis
AFNTPALNIHQIPLG

SEQ ID NO: 186538 - protein, 15 aa, Mycobacterium tuberculosis
FNTPALNIHQIPLGF

SEQ ID NO: 186539 - protein, 15 aa, Mycobacterium tuberculosis
NTPALNIHQIPLGFQ

SEQ ID NO: 186540 - protein, 15 aa, Mycobacterium tuberculosis
TPALNIHQIPLGFQV

SEQ ID NO: 186541 - protein, 15 aa, Mycobacterium tuberculosis
PALNIHQIPLGFQVP

SEQ ID NO: 186542 - protein, 15 aa, Mycobacterium tuberculosis
ALNIHQIPLGFQVPG

SEQ ID NO: 186543 - protein, 15 aa, Mycobacterium tuberculosis
LNIHQIPLGFQVPGS

SEQ ID NO: 186544 - protein, 15 aa, Mycobacterium tuberculosis
NIHQIPLGFQVPGSI

SEQ ID NO: 186545 - protein, 15 aa, Mycobacterium tuberculosis
IHQIPLGFQVPGSID

SEQ ID NO: 186546 - protein, 15 aa, Mycobacterium tuberculosis
HQIPLGFQVPGSIDA

SEQ ID NO: 186547 - protein, 15 aa, Mycobacterium tuberculosis
QIPLGFQVPGSIDAI

SEQ ID NO: 186548 - protein, 15 aa, Mycobacterium tuberculosis
IPLGFQVPGSIDAIT

SEQ ID NO: 186549 - protein, 15 aa, Mycobacterium tuberculosis
PLGFQVPGSIDAITL

SEQ ID NO: 186550 - protein, 15 aa, Mycobacterium tuberculosis
LGFQVPGSIDAITLF

SEQ ID NO: 186551 - protein, 15 aa, Mycobacterium tuberculosis
GFQVPGSIDAITLFP

SEQ ID NO: 186552 - protein, 15 aa, Mycobacterium tuberculosis
FQVPGSIDAITLFPG

SEQ ID NO: 186553 - protein, 15 aa, Mycobacterium tuberculosis
QVPGSIDAITLFPGG

SEQ ID NO: 186554 - protein, 15 aa, Mycobacterium tuberculosis
VPGSIDAITLFPGGL

SEQ ID NO: 186555 - protein, 15 aa, Mycobacterium tuberculosis
PGSIDAITLFPGGLT

SEQ ID NO: 186556 - protein, 15 aa, Mycobacterium tuberculosis
GSIDAITLFPGGLTF

SEQ ID NO: 186557 - protein, 15 aa, Mycobacterium tuberculosis
SIDAITLFPGGLTFP

SEQ ID NO: 186558 - protein, 15 aa, Mycobacterium tuberculosis
IDAITLFPGGLTFPA

SEQ ID NO: 186559 - protein, 15 aa, Mycobacterium tuberculosis
DAITLFPGGLTFPAN

SEQ ID NO: 186560 - protein, 15 aa, Mycobacterium tuberculosis
AITLFPGGLTFPANS

SEQ ID NO: 186561 - protein, 15 aa, Mycobacterium tuberculosis
ITLFPGGLTFPANSL

SEQ ID NO: 186562 - protein, 15 aa, Mycobacterium tuberculosis
TLFPGGLTFPANSLL

SEQ ID NO: 186563 - protein, 15 aa, Mycobacterium tuberculosis
LFPGGLTFPANSLLN

SEQ ID NO: 186564 - protein, 15 aa, Mycobacterium tuberculosis
FPGGLTFPANSLLNL

SEQ ID NO: 186565 - protein, 15 aa, Mycobacterium tuberculosis
PGGLTFPANSLLNLD

SEQ ID NO: 186566 - protein, 15 aa, Mycobacterium tuberculosis
GGLTFPANSLLNLDV

SEQ ID NO: 186567 - protein, 15 aa, Mycobacterium tuberculosis
GLTFPANSLLNLDVF

SEQ ID NO: 186568 - protein, 15 aa, Mycobacterium tuberculosis
LTFPANSLLNLDVFV

SEQ ID NO: 186569 - protein, 15 aa, Mycobacterium tuberculosis
TFPANSLLNLDVFVG

SEQ ID NO: 186570 - protein, 15 aa, Mycobacterium tuberculosis
FPANSLLNLDVFVGT

SEQ ID NO: 186571 - protein, 15 aa, Mycobacterium tuberculosis
PANSLLNLDVFVGTP

SEQ ID NO: 186572 - protein, 15 aa, Mycobacterium tuberculosis
ANSLLNLDVFVGTPG

SEQ ID NO: 186573 - protein, 15 aa, Mycobacterium tuberculosis
NSLLNLDVFVGTPGA

SEQ ID NO: 186574 - protein, 15 aa, Mycobacterium tuberculosis
SLLNLDVFVGTPGAT

SEQ ID NO: 186575 - protein, 15 aa, Mycobacterium tuberculosis
LLNLDVFVGTPGATI

SEQ ID NO: 186576 - protein, 15 aa, Mycobacterium tuberculosis
LNLDVFVGTPGATIP

SEQ ID NO: 186577 - protein, 15 aa, Mycobacterium tuberculosis
NLDVFVGTPGATIPA

SEQ ID NO: 186578 - protein, 15 aa, Mycobacterium tuberculosis
LDVFVGTPGATIPAI

SEQ ID NO: 186579 - protein, 15 aa, Mycobacterium tuberculosis
DVFVGTPGATIPAIT

SEQ ID NO: 186580 - protein, 15 aa, Mycobacterium tuberculosis
VFVGTPGATIPAITF

SEQ ID NO: 186581 - protein, 15 aa, Mycobacterium tuberculosis
FVGTPGATIPAITFP

SEQ ID NO: 186582 - protein, 15 aa, Mycobacterium tuberculosis
VGTPGATIPAITFPE

SEQ ID NO: 186583 - protein, 15 aa, Mycobacterium tuberculosis
GTPGATIPAITFPEI

SEQ ID NO: 186584 - protein, 15 aa, Mycobacterium tuberculosis
TPGATIPAITFPEIP

SEQ ID NO: 186585 - protein, 15 aa, Mycobacterium tuberculosis
PGATIPAITFPEIPA

SEQ ID NO: 186586 - protein, 15 aa, Mycobacterium tuberculosis
GATIPAITFPEIPAN

SEQ ID NO: 186587 - protein, 15 aa, Mycobacterium tuberculosis
ATIPAITFPEIPANA

SEQ ID NO: 186588 - protein, 15 aa, Mycobacterium tuberculosis
TIPAITFPEIPANAD

SEQ ID NO: 186589 - protein, 15 aa, Mycobacterium tuberculosis
IPAITFPEIPANADG

SEQ ID NO: 186590 - protein, 15 aa, Mycobacterium tuberculosis
PAITFPEIPANADGE

SEQ ID NO: 186591 - protein, 15 aa, Mycobacterium tuberculosis
AITFPEIPANADGEL

SEQ ID NO: 186592 - protein, 15 aa, Mycobacterium tuberculosis
ITFPEIPANADGELY

SEQ ID NO: 186593 - protein, 15 aa, Mycobacterium tuberculosis
TFPEIPANADGELYV

SEQ ID NO: 186594 - protein, 15 aa, Mycobacterium tuberculosis
FPEIPANADGELYVI

SEQ ID NO: 186595 - protein, 15 aa, Mycobacterium tuberculosis
PEIPANADGELYVIA

SEQ ID NO: 186596 - protein, 15 aa, Mycobacterium tuberculosis
EIPANADGELYVIAG

SEQ ID NO: 186597 - protein, 15 aa, Mycobacterium tuberculosis
IPANADGELYVIAGD

SEQ ID NO: 186598 - protein, 15 aa, Mycobacterium tuberculosis
PANADGELYVIAGDI

SEQ ID NO: 186599 - protein, 15 aa, Mycobacterium tuberculosis
ANADGELYVIAGDIP

SEQ ID NO: 186600 - protein, 15 aa, Mycobacterium tuberculosis
NADGELYVIAGDIPL

SEQ ID NO: 186601 - protein, 15 aa, Mycobacterium tuberculosis
ADGELYVIAGDIPLI

SEQ ID NO: 186602 - protein, 15 aa, Mycobacterium tuberculosis
DGELYVIAGDIPLIN

SEQ ID NO: 186603 - protein, 15 aa, Mycobacterium tuberculosis
GELYVIAGDIPLINI

SEQ ID NO: 186604 - protein, 15 aa, Mycobacterium tuberculosis
ELYVIAGDIPLINIP

SEQ ID NO: 186605 - protein, 15 aa, Mycobacterium tuberculosis
LYVIAGDIPLINIPP

SEQ ID NO: 186606 - protein, 15 aa, Mycobacterium tuberculosis
YVIAGDIPLINIPPT

SEQ ID NO: 186607 - protein, 15 aa, Mycobacterium tuberculosis
VIAGDIPLINIPPTP

SEQ ID NO: 186608 - protein, 15 aa, Mycobacterium tuberculosis
IAGDIPLINIPPTPG

SEQ ID NO: 186609 - protein, 15 aa, Mycobacterium tuberculosis
AGDIPLINIPPTPGI

SEQ ID NO: 186610 - protein, 15 aa, Mycobacterium tuberculosis
GDIPLINIPPTPGIG

SEQ ID NO: 186611 - protein, 15 aa, Mycobacterium tuberculosis
DIPLINIPPTPGIGN

SEQ ID NO: 186612 - protein, 15 aa, Mycobacterium tuberculosis
IPLINIPPTPGIGNT

SEQ ID NO: 186613 - protein, 15 aa, Mycobacterium tuberculosis
PLINIPPTPGIGNTT

SEQ ID NO: 186614 - protein, 15 aa, Mycobacterium tuberculosis
LINIPPTPGIGNTTT

SEQ ID NO: 186615 - protein, 15 aa, Mycobacterium tuberculosis
INIPPTPGIGNTTTV

SEQ ID NO: 186616 - protein, 15 aa, Mycobacterium tuberculosis
NIPPTPGIGNTTTVP

SEQ ID NO: 186617 - protein, 15 aa, Mycobacterium tuberculosis
IPPTPGIGNTTTVPS

SEQ ID NO: 186618 - protein, 15 aa, Mycobacterium tuberculosis
PPTPGIGNTTTVPSS

SEQ ID NO: 186619 - protein, 15 aa, Mycobacterium tuberculosis
PTPGIGNTTTVPSSG

SEQ ID NO: 186620 - protein, 15 aa, Mycobacterium tuberculosis
TPGIGNTTTVPSSGF

SEQ ID NO: 186621 - protein, 15 aa, Mycobacterium tuberculosis
PGIGNTTTVPSSGFF

SEQ ID NO: 186622 - protein, 15 aa, Mycobacterium tuberculosis
GIGNTTTVPSSGFFN

SEQ ID NO: 186623 - protein, 15 aa, Mycobacterium tuberculosis
IGNTTTVPSSGFFNT

SEQ ID NO: 186624 - protein, 15 aa, Mycobacterium tuberculosis
GNTTTVPSSGFFNTG

SEQ ID NO: 186625 - protein, 15 aa, Mycobacterium tuberculosis
NTTTVPSSGFFNTGA

SEQ ID NO: 186626 - protein, 15 aa, Mycobacterium tuberculosis
TTTVPSSGFFNTGAG

SEQ ID NO: 186627 - protein, 15 aa, Mycobacterium tuberculosis
TTVPSSGFFNTGAGG

SEQ ID NO: 186628 - protein, 15 aa, Mycobacterium tuberculosis
TVPSSGFFNTGAGGG

SEQ ID NO: 186629 - protein, 15 aa, Mycobacterium tuberculosis
VPSSGFFNTGAGGGS

SEQ ID NO: 186630 - protein, 15 aa, Mycobacterium tuberculosis
PSSGFFNTGAGGGSG

SEQ ID NO: 186631 - protein, 15 aa, Mycobacterium tuberculosis
SSGFFNTGAGGGSGF

SEQ ID NO: 186632 - protein, 15 aa, Mycobacterium tuberculosis
SGFFNTGAGGGSGFG

SEQ ID NO: 186633 - protein, 15 aa, Mycobacterium tuberculosis
GFFNTGAGGGSGFGN

SEQ ID NO: 186634 - protein, 15 aa, Mycobacterium tuberculosis
FFNTGAGGGSGFGNF

SEQ ID NO: 186635 - protein, 15 aa, Mycobacterium tuberculosis
FNTGAGGGSGFGNFG

SEQ ID NO: 186636 - protein, 15 aa, Mycobacterium tuberculosis
NTGAGGGSGFGNFGA

SEQ ID NO: 186637 - protein, 15 aa, Mycobacterium tuberculosis
TGAGGGSGFGNFGAN

SEQ ID NO: 186638 - protein, 15 aa, Mycobacterium tuberculosis
GAGGGSGFGNFGANM

SEQ ID NO: 186639 - protein, 15 aa, Mycobacterium tuberculosis
AGGGSGFGNFGANMS

SEQ ID NO: 186640 - protein, 15 aa, Mycobacterium tuberculosis
GGGSGFGNFGANMSG

SEQ ID NO: 186641 - protein, 15 aa, Mycobacterium tuberculosis
GGSGFGNFGANMSGW

SEQ ID NO: 186642 - protein, 15 aa, Mycobacterium tuberculosis
GSGFGNFGANMSGWW

SEQ ID NO: 186643 - protein, 15 aa, Mycobacterium tuberculosis
SGFGNFGANMSGWWN

SEQ ID NO: 186644 - protein, 15 aa, Mycobacterium tuberculosis
GFGNFGANMSGWWNQ

SEQ ID NO: 186645 - protein, 15 aa, Mycobacterium tuberculosis
FGNFGANMSGWWNQA

SEQ ID NO: 186646 - protein, 15 aa, Mycobacterium tuberculosis
GNFGANMSGWWNQAH

SEQ ID NO: 186647 - protein, 15 aa, Mycobacterium tuberculosis
NFGANMSGWWNQAHT

SEQ ID NO: 186648 - protein, 15 aa, Mycobacterium tuberculosis
FGANMSGWWNQAHTA

SEQ ID NO: 186649 - protein, 15 aa, Mycobacterium tuberculosis
GANMSGWWNQAHTAL

SEQ ID NO: 186650 - protein, 15 aa, Mycobacterium tuberculosis
ANMSGWWNQAHTALA

SEQ ID NO: 186651 - protein, 15 aa, Mycobacterium tuberculosis
NMSGWWNQAHTALAG

SEQ ID NO: 186652 - protein, 15 aa, Mycobacterium tuberculosis
MSGWWNQAHTALAGA

SEQ ID NO: 186653 - protein, 15 aa, Mycobacterium tuberculosis
SGWWNQAHTALAGAG

SEQ ID NO: 186654 - protein, 15 aa, Mycobacterium tuberculosis
GWWNQAHTALAGAGS

SEQ ID NO: 186655 - protein, 15 aa, Mycobacterium tuberculosis
WWNQAHTALAGAGSG

SEQ ID NO: 186656 - protein, 15 aa, Mycobacterium tuberculosis
WNQAHTALAGAGSGI

SEQ ID NO: 186657 - protein, 15 aa, Mycobacterium tuberculosis
NQAHTALAGAGSGIA

SEQ ID NO: 186658 - protein, 15 aa, Mycobacterium tuberculosis
QAHTALAGAGSGIAN

SEQ ID NO: 186659 - protein, 15 aa, Mycobacterium tuberculosis
AHTALAGAGSGIANV

SEQ ID NO: 186660 - protein, 15 aa, Mycobacterium tuberculosis
HTALAGAGSGIANVG

SEQ ID NO: 186661 - protein, 15 aa, Mycobacterium tuberculosis
TALAGAGSGIANVGT

SEQ ID NO: 186662 - protein, 15 aa, Mycobacterium tuberculosis
ALAGAGSGIANVGTL

SEQ ID NO: 186663 - protein, 15 aa, Mycobacterium tuberculosis
LAGAGSGIANVGTLH

SEQ ID NO: 186664 - protein, 15 aa, Mycobacterium tuberculosis
AGAGSGIANVGTLHS

SEQ ID NO: 186665 - protein, 15 aa, Mycobacterium tuberculosis
GAGSGIANVGTLHSG

SEQ ID NO: 186666 - protein, 15 aa, Mycobacterium tuberculosis
AGSGIANVGTLHSGV

SEQ ID NO: 186667 - protein, 15 aa, Mycobacterium tuberculosis
GSGIANVGTLHSGVL

SEQ ID NO: 186668 - protein, 15 aa, Mycobacterium tuberculosis
SGIANVGTLHSGVLN

SEQ ID NO: 186669 - protein, 15 aa, Mycobacterium tuberculosis
GIANVGTLHSGVLNL

SEQ ID NO: 186670 - protein, 15 aa, Mycobacterium tuberculosis
IANVGTLHSGVLNLG

SEQ ID NO: 186671 - protein, 15 aa, Mycobacterium tuberculosis
ANVGTLHSGVLNLGS

SEQ ID NO: 186672 - protein, 15 aa, Mycobacterium tuberculosis
NVGTLHSGVLNLGSG

SEQ ID NO: 186673 - protein, 15 aa, Mycobacterium tuberculosis
VGTLHSGVLNLGSGL

SEQ ID NO: 186674 - protein, 15 aa, Mycobacterium tuberculosis
GTLHSGVLNLGSGLS

SEQ ID NO: 186675 - protein, 15 aa, Mycobacterium tuberculosis
TLHSGVLNLGSGLSG

SEQ ID NO: 186676 - protein, 15 aa, Mycobacterium tuberculosis
LHSGVLNLGSGLSGI

SEQ ID NO: 186677 - protein, 15 aa, Mycobacterium tuberculosis
HSGVLNLGSGLSGIY

SEQ ID NO: 186678 - protein, 15 aa, Mycobacterium tuberculosis
SGVLNLGSGLSGIYN

SEQ ID NO: 186679 - protein, 15 aa, Mycobacterium tuberculosis
GVLNLGSGLSGIYNT

SEQ ID NO: 186680 - protein, 15 aa, Mycobacterium tuberculosis
VLNLGSGLSGIYNTS

SEQ ID NO: 186681 - protein, 15 aa, Mycobacterium tuberculosis
LNLGSGLSGIYNTST

SEQ ID NO: 186682 - protein, 15 aa, Mycobacterium tuberculosis
NLGSGLSGIYNTSTL

SEQ ID NO: 186683 - protein, 15 aa, Mycobacterium tuberculosis
LGSGLSGIYNTSTLP

SEQ ID NO: 186684 - protein, 15 aa, Mycobacterium tuberculosis
GSGLSGIYNTSTLPL

SEQ ID NO: 186685 - protein, 15 aa, Mycobacterium tuberculosis
SGLSGIYNTSTLPLG

SEQ ID NO: 186686 - protein, 15 aa, Mycobacterium tuberculosis
GLSGIYNTSTLPLGT

SEQ ID NO: 186687 - protein, 15 aa, Mycobacterium tuberculosis
LSGIYNTSTLPLGTP

SEQ ID NO: 186688 - protein, 15 aa, Mycobacterium tuberculosis
SGIYNTSTLPLGTPA

SEQ ID NO: 186689 - protein, 15 aa, Mycobacterium tuberculosis
GIYNTSTLPLGTPAL

SEQ ID NO: 186690 - protein, 15 aa, Mycobacterium tuberculosis
IYNTSTLPLGTPALV

SEQ ID NO: 186691 - protein, 15 aa, Mycobacterium tuberculosis
YNTSTLPLGTPALVS

SEQ ID NO: 186692 - protein, 15 aa, Mycobacterium tuberculosis
NTSTLPLGTPALVSG

SEQ ID NO: 186693 - protein, 15 aa, Mycobacterium tuberculosis
TSTLPLGTPALVSGL

SEQ ID NO: 186694 - protein, 15 aa, Mycobacterium tuberculosis
STLPLGTPALVSGLG

SEQ ID NO: 186695 - protein, 15 aa, Mycobacterium tuberculosis
TLPLGTPALVSGLGN

SEQ ID NO: 186696 - protein, 15 aa, Mycobacterium tuberculosis
LPLGTPALVSGLGNV

SEQ ID NO: 186697 - protein, 15 aa, Mycobacterium tuberculosis
PLGTPALVSGLGNVG

SEQ ID NO: 186698 - protein, 15 aa, Mycobacterium tuberculosis
LGTPALVSGLGNVGD

SEQ ID NO: 186699 - protein, 15 aa, Mycobacterium tuberculosis
GTPALVSGLGNVGDH

SEQ ID NO: 186700 - protein, 15 aa, Mycobacterium tuberculosis
TPALVSGLGNVGDHL

SEQ ID NO: 186701 - protein, 15 aa, Mycobacterium tuberculosis
PALVSGLGNVGDHLS

SEQ ID NO: 186702 - protein, 15 aa, Mycobacterium tuberculosis
ALVSGLGNVGDHLSG

SEQ ID NO: 186703 - protein, 15 aa, Mycobacterium tuberculosis
LVSGLGNVGDHLSGL

SEQ ID NO: 186704 - protein, 15 aa, Mycobacterium tuberculosis
VSGLGNVGDHLSGLL

SEQ ID NO: 186705 - protein, 15 aa, Mycobacterium tuberculosis
SGLGNVGDHLSGLLA

SEQ ID NO: 186706 - protein, 15 aa, Mycobacterium tuberculosis
GLGNVGDHLSGLLAS

SEQ ID NO: 186707 - protein, 15 aa, Mycobacterium tuberculosis
LGNVGDHLSGLLASN

SEQ ID NO: 186708 - protein, 15 aa, Mycobacterium tuberculosis
GNVGDHLSGLLASNV

SEQ ID NO: 186709 - protein, 15 aa, Mycobacterium tuberculosis
NVGDHLSGLLASNVG

SEQ ID NO: 186710 - protein, 15 aa, Mycobacterium tuberculosis
VGDHLSGLLASNVGQ

SEQ ID NO: 186711 - protein, 15 aa, Mycobacterium tuberculosis
GDHLSGLLASNVGQN

SEQ ID NO: 186712 - protein, 15 aa, Mycobacterium tuberculosis
DHLSGLLASNVGQNP

SEQ ID NO: 186713 - protein, 15 aa, Mycobacterium tuberculosis
HLSGLLASNVGQNPI

SEQ ID NO: 186714 - protein, 15 aa, Mycobacterium tuberculosis
LSGLLASNVGQNPIT

SEQ ID NO: 186715 - protein, 15 aa, Mycobacterium tuberculosis
SGLLASNVGQNPITI

SEQ ID NO: 186716 - protein, 15 aa, Mycobacterium tuberculosis
GLLASNVGQNPITIV

SEQ ID NO: 186717 - protein, 15 aa, Mycobacterium tuberculosis
LLASNVGQNPITIVN

SEQ ID NO: 186718 - protein, 15 aa, Mycobacterium tuberculosis
LASNVGQNPITIVNI

SEQ ID NO: 186719 - protein, 15 aa, Mycobacterium tuberculosis
ASNVGQNPITIVNIG

SEQ ID NO: 186720 - protein, 15 aa, Mycobacterium tuberculosis
SNVGQNPITIVNIGL

SEQ ID NO: 186721 - protein, 15 aa, Mycobacterium tuberculosis
NVGQNPITIVNIGLA

SEQ ID NO: 186722 - protein, 15 aa, Mycobacterium tuberculosis
VGQNPITIVNIGLAN

SEQ ID NO: 186723 - protein, 15 aa, Mycobacterium tuberculosis
GQNPITIVNIGLANV

SEQ ID NO: 186724 - protein, 15 aa, Mycobacterium tuberculosis
QNPITIVNIGLANVG

SEQ ID NO: 186725 - protein, 15 aa, Mycobacterium tuberculosis
NPITIVNIGLANVGN

SEQ ID NO: 186726 - protein, 15 aa, Mycobacterium tuberculosis
PITIVNIGLANVGNG

SEQ ID NO: 186727 - protein, 15 aa, Mycobacterium tuberculosis
ITIVNIGLANVGNGN

SEQ ID NO: 186728 - protein, 15 aa, Mycobacterium tuberculosis
TIVNIGLANVGNGNV

SEQ ID NO: 186729 - protein, 15 aa, Mycobacterium tuberculosis
IVNIGLANVGNGNVG

SEQ ID NO: 186730 - protein, 15 aa, Mycobacterium tuberculosis
VNIGLANVGNGNVGL

SEQ ID NO: 186731 - protein, 15 aa, Mycobacterium tuberculosis
NIGLANVGNGNVGLG

SEQ ID NO: 186732 - protein, 15 aa, Mycobacterium tuberculosis
IGLANVGNGNVGLGN

SEQ ID NO: 186733 - protein, 15 aa, Mycobacterium tuberculosis
GLANVGNGNVGLGNI

SEQ ID NO: 186734 - protein, 15 aa, Mycobacterium tuberculosis
LANVGNGNVGLGNIG

SEQ ID NO: 186735 - protein, 15 aa, Mycobacterium tuberculosis
ANVGNGNVGLGNIGN

SEQ ID NO: 186736 - protein, 15 aa, Mycobacterium tuberculosis
NVGNGNVGLGNIGNL

SEQ ID NO: 186737 - protein, 15 aa, Mycobacterium tuberculosis
VGNGNVGLGNIGNLN

SEQ ID NO: 186738 - protein, 15 aa, Mycobacterium tuberculosis
GNGNVGLGNIGNLNL

SEQ ID NO: 186739 - protein, 15 aa, Mycobacterium tuberculosis
NGNVGLGNIGNLNLG

SEQ ID NO: 186740 - protein, 15 aa, Mycobacterium tuberculosis
GNVGLGNIGNLNLGA

SEQ ID NO: 186741 - protein, 15 aa, Mycobacterium tuberculosis
NVGLGNIGNLNLGAA

SEQ ID NO: 186742 - protein, 15 aa, Mycobacterium tuberculosis
VGLGNIGNLNLGAAN

SEQ ID NO: 186743 - protein, 15 aa, Mycobacterium tuberculosis
GLGNIGNLNLGAANI

SEQ ID NO: 186744 - protein, 15 aa, Mycobacterium tuberculosis
LGNIGNLNLGAANIG

SEQ ID NO: 186745 - protein, 15 aa, Mycobacterium tuberculosis
GNIGNLNLGAANIGD

SEQ ID NO: 186746 - protein, 15 aa, Mycobacterium tuberculosis
NIGNLNLGAANIGDV

SEQ ID NO: 186747 - protein, 15 aa, Mycobacterium tuberculosis
IGNLNLGAANIGDVN

SEQ ID NO: 186748 - protein, 15 aa, Mycobacterium tuberculosis
GNLNLGAANIGDVNL

SEQ ID NO: 186749 - protein, 15 aa, Mycobacterium tuberculosis
NLNLGAANIGDVNLG

SEQ ID NO: 186750 - protein, 15 aa, Mycobacterium tuberculosis
LNLGAANIGDVNLGF

SEQ ID NO: 186751 - protein, 15 aa, Mycobacterium tuberculosis
NLGAANIGDVNLGFG

SEQ ID NO: 186752 - protein, 15 aa, Mycobacterium tuberculosis
LGAANIGDVNLGFGN

SEQ ID NO: 186753 - protein, 15 aa, Mycobacterium tuberculosis
GAANIGDVNLGFGNI

SEQ ID NO: 186754 - protein, 15 aa, Mycobacterium tuberculosis
AANIGDVNLGFGNIG

SEQ ID NO: 186755 - protein, 15 aa, Mycobacterium tuberculosis
ANIGDVNLGFGNIGD

SEQ ID NO: 186756 - protein, 15 aa, Mycobacterium tuberculosis
NIGDVNLGFGNIGDV

SEQ ID NO: 186757 - protein, 15 aa, Mycobacterium tuberculosis
IGDVNLGFGNIGDVN

SEQ ID NO: 186758 - protein, 15 aa, Mycobacterium tuberculosis
GDVNLGFGNIGDVNL

SEQ ID NO: 186759 - protein, 15 aa, Mycobacterium tuberculosis
DVNLGFGNIGDVNLG

SEQ ID NO: 186760 - protein, 15 aa, Mycobacterium tuberculosis
VNLGFGNIGDVNLGF

SEQ ID NO: 186761 - protein, 15 aa, Mycobacterium tuberculosis
NLGFGNIGDVNLGFG

SEQ ID NO: 186762 - protein, 15 aa, Mycobacterium tuberculosis
LGFGNIGDVNLGFGN

SEQ ID NO: 186763 - protein, 15 aa, Mycobacterium tuberculosis
GFGNIGDVNLGFGNI

SEQ ID NO: 186764 - protein, 15 aa, Mycobacterium tuberculosis
FGNIGDVNLGFGNIG

SEQ ID NO: 186765 - protein, 15 aa, Mycobacterium tuberculosis
GNIGDVNLGFGNIGG

SEQ ID NO: 186766 - protein, 15 aa, Mycobacterium tuberculosis
NIGDVNLGFGNIGGG

SEQ ID NO: 186767 - protein, 15 aa, Mycobacterium tuberculosis
IGDVNLGFGNIGGGN

SEQ ID NO: 186768 - protein, 15 aa, Mycobacterium tuberculosis
GDVNLGFGNIGGGNV

SEQ ID NO: 186769 - protein, 15 aa, Mycobacterium tuberculosis
DVNLGFGNIGGGNVG

SEQ ID NO: 186770 - protein, 15 aa, Mycobacterium tuberculosis
VNLGFGNIGGGNVGF

SEQ ID NO: 186771 - protein, 15 aa, Mycobacterium tuberculosis
NLGFGNIGGGNVGFG

SEQ ID NO: 186772 - protein, 15 aa, Mycobacterium tuberculosis
LGFGNIGGGNVGFGN

SEQ ID NO: 186773 - protein, 15 aa, Mycobacterium tuberculosis
GFGNIGGGNVGFGNI

SEQ ID NO: 186774 - protein, 15 aa, Mycobacterium tuberculosis
FGNIGGGNVGFGNIG

SEQ ID NO: 186775 - protein, 15 aa, Mycobacterium tuberculosis
GNIGGGNVGFGNIGD

SEQ ID NO: 186776 - protein, 15 aa, Mycobacterium tuberculosis
NIGGGNVGFGNIGDA

SEQ ID NO: 186777 - protein, 15 aa, Mycobacterium tuberculosis
IGGGNVGFGNIGDAN

SEQ ID NO: 186778 - protein, 15 aa, Mycobacterium tuberculosis
GGGNVGFGNIGDANF

SEQ ID NO: 186779 - protein, 15 aa, Mycobacterium tuberculosis
GGNVGFGNIGDANFG

SEQ ID NO: 186780 - protein, 15 aa, Mycobacterium tuberculosis
GNVGFGNIGDANFGF

SEQ ID NO: 186781 - protein, 15 aa, Mycobacterium tuberculosis
NVGFGNIGDANFGFG

SEQ ID NO: 186782 - protein, 15 aa, Mycobacterium tuberculosis
VGFGNIGDANFGFGN

SEQ ID NO: 186783 - protein, 15 aa, Mycobacterium tuberculosis
GFGNIGDANFGFGNS

SEQ ID NO: 186784 - protein, 15 aa, Mycobacterium tuberculosis
FGNIGDANFGFGNSG

SEQ ID NO: 186785 - protein, 15 aa, Mycobacterium tuberculosis
GNIGDANFGFGNSGL

SEQ ID NO: 186786 - protein, 15 aa, Mycobacterium tuberculosis
NIGDANFGFGNSGLA

SEQ ID NO: 186787 - protein, 15 aa, Mycobacterium tuberculosis
IGDANFGFGNSGLAA

SEQ ID NO: 186788 - protein, 15 aa, Mycobacterium tuberculosis
GDANFGFGNSGLAAG

SEQ ID NO: 186789 - protein, 15 aa, Mycobacterium tuberculosis
DANFGFGNSGLAAGL

SEQ ID NO: 186790 - protein, 15 aa, Mycobacterium tuberculosis
ANFGFGNSGLAAGLA

SEQ ID NO: 186791 - protein, 15 aa, Mycobacterium tuberculosis
NFGFGNSGLAAGLAG

SEQ ID NO: 186792 - protein, 15 aa, Mycobacterium tuberculosis
FGFGNSGLAAGLAGM

SEQ ID NO: 186793 - protein, 15 aa, Mycobacterium tuberculosis
GFGNSGLAAGLAGMG

SEQ ID NO: 186794 - protein, 15 aa, Mycobacterium tuberculosis
FGNSGLAAGLAGMGN

SEQ ID NO: 186795 - protein, 15 aa, Mycobacterium tuberculosis
GNSGLAAGLAGMGNI

SEQ ID NO: 186796 - protein, 15 aa, Mycobacterium tuberculosis
NSGLAAGLAGMGNIG

SEQ ID NO: 186797 - protein, 15 aa, Mycobacterium tuberculosis
SGLAAGLAGMGNIGL

SEQ ID NO: 186798 - protein, 15 aa, Mycobacterium tuberculosis
GLAAGLAGMGNIGLG

SEQ ID NO: 186799 - protein, 15 aa, Mycobacterium tuberculosis
LAAGLAGMGNIGLGN

SEQ ID NO: 186800 - protein, 15 aa, Mycobacterium tuberculosis
AAGLAGMGNIGLGNA

SEQ ID NO: 186801 - protein, 15 aa, Mycobacterium tuberculosis
AGLAGMGNIGLGNAG

SEQ ID NO: 186802 - protein, 15 aa, Mycobacterium tuberculosis
GLAGMGNIGLGNAGS

SEQ ID NO: 186803 - protein, 15 aa, Mycobacterium tuberculosis
LAGMGNIGLGNAGSG

SEQ ID NO: 186804 - protein, 15 aa, Mycobacterium tuberculosis
AGMGNIGLGNAGSGN

SEQ ID NO: 186805 - protein, 15 aa, Mycobacterium tuberculosis
GMGNIGLGNAGSGNV

SEQ ID NO: 186806 - protein, 15 aa, Mycobacterium tuberculosis
MGNIGLGNAGSGNVG

SEQ ID NO: 186807 - protein, 15 aa, Mycobacterium tuberculosis
GNIGLGNAGSGNVGW

SEQ ID NO: 186808 - protein, 15 aa, Mycobacterium tuberculosis
NIGLGNAGSGNVGWA

SEQ ID NO: 186809 - protein, 15 aa, Mycobacterium tuberculosis
IGLGNAGSGNVGWAN

SEQ ID NO: 186810 - protein, 15 aa, Mycobacterium tuberculosis
GLGNAGSGNVGWANM

SEQ ID NO: 186811 - protein, 15 aa, Mycobacterium tuberculosis
LGNAGSGNVGWANMG

SEQ ID NO: 186812 - protein, 15 aa, Mycobacterium tuberculosis
GNAGSGNVGWANMGL

SEQ ID NO: 186813 - protein, 15 aa, Mycobacterium tuberculosis
NAGSGNVGWANMGLG

SEQ ID NO: 186814 - protein, 15 aa, Mycobacterium tuberculosis
AGSGNVGWANMGLGN

SEQ ID NO: 186815 - protein, 15 aa, Mycobacterium tuberculosis
GSGNVGWANMGLGNI

SEQ ID NO: 186816 - protein, 15 aa, Mycobacterium tuberculosis
SGNVGWANMGLGNIG

SEQ ID NO: 186817 - protein, 15 aa, Mycobacterium tuberculosis
GNVGWANMGLGNIGF

SEQ ID NO: 186818 - protein, 15 aa, Mycobacterium tuberculosis
NVGWANMGLGNIGFG

SEQ ID NO: 186819 - protein, 15 aa, Mycobacterium tuberculosis
VGWANMGLGNIGFGN

SEQ ID NO: 186820 - protein, 15 aa, Mycobacterium tuberculosis
GWANMGLGNIGFGNT

SEQ ID NO: 186821 - protein, 15 aa, Mycobacterium tuberculosis
WANMGLGNIGFGNTG

SEQ ID NO: 186822 - protein, 15 aa, Mycobacterium tuberculosis
ANMGLGNIGFGNTGT

SEQ ID NO: 186823 - protein, 15 aa, Mycobacterium tuberculosis
NMGLGNIGFGNTGTN

SEQ ID NO: 186824 - protein, 15 aa, Mycobacterium tuberculosis
MGLGNIGFGNTGTNN

SEQ ID NO: 186825 - protein, 15 aa, Mycobacterium tuberculosis
GLGNIGFGNTGTNNL

SEQ ID NO: 186826 - protein, 15 aa, Mycobacterium tuberculosis
LGNIGFGNTGTNNLG

SEQ ID NO: 186827 - protein, 15 aa, Mycobacterium tuberculosis
GNIGFGNTGTNNLGI

SEQ ID NO: 186828 - protein, 15 aa, Mycobacterium tuberculosis
NIGFGNTGTNNLGIG

SEQ ID NO: 186829 - protein, 15 aa, Mycobacterium tuberculosis
IGFGNTGTNNLGIGL

SEQ ID NO: 186830 - protein, 15 aa, Mycobacterium tuberculosis
GFGNTGTNNLGIGLT

SEQ ID NO: 186831 - protein, 15 aa, Mycobacterium tuberculosis
FGNTGTNNLGIGLTG

SEQ ID NO: 186832 - protein, 15 aa, Mycobacterium tuberculosis
GNTGTNNLGIGLTGD

SEQ ID NO: 186833 - protein, 15 aa, Mycobacterium tuberculosis
NTGTNNLGIGLTGDN

SEQ ID NO: 186834 - protein, 15 aa, Mycobacterium tuberculosis
TGTNNLGIGLTGDNQ

SEQ ID NO: 186835 - protein, 15 aa, Mycobacterium tuberculosis
GTNNLGIGLTGDNQS

SEQ ID NO: 186836 - protein, 15 aa, Mycobacterium tuberculosis
TNNLGIGLTGDNQSG

SEQ ID NO: 186837 - protein, 15 aa, Mycobacterium tuberculosis
NNLGIGLTGDNQSGI

SEQ ID NO: 186838 - protein, 15 aa, Mycobacterium tuberculosis
NLGIGLTGDNQSGIG

SEQ ID NO: 186839 - protein, 15 aa, Mycobacterium tuberculosis
LGIGLTGDNQSGIGG

SEQ ID NO: 186840 - protein, 15 aa, Mycobacterium tuberculosis
GIGLTGDNQSGIGGL

SEQ ID NO: 186841 - protein, 15 aa, Mycobacterium tuberculosis
IGLTGDNQSGIGGLN

SEQ ID NO: 186842 - protein, 15 aa, Mycobacterium tuberculosis
GLTGDNQSGIGGLNS

SEQ ID NO: 186843 - protein, 15 aa, Mycobacterium tuberculosis
LTGDNQSGIGGLNSG

SEQ ID NO: 186844 - protein, 15 aa, Mycobacterium tuberculosis
TGDNQSGIGGLNSGT

SEQ ID NO: 186845 - protein, 15 aa, Mycobacterium tuberculosis
GDNQSGIGGLNSGTG

SEQ ID NO: 186846 - protein, 15 aa, Mycobacterium tuberculosis
DNQSGIGGLNSGTGN

SEQ ID NO: 186847 - protein, 15 aa, Mycobacterium tuberculosis
NQSGIGGLNSGTGNI

SEQ ID NO: 186848 - protein, 15 aa, Mycobacterium tuberculosis
QSGIGGLNSGTGNIG

SEQ ID NO: 186849 - protein, 15 aa, Mycobacterium tuberculosis
SGIGGLNSGTGNIGL

SEQ ID NO: 186850 - protein, 15 aa, Mycobacterium tuberculosis
GIGGLNSGTGNIGLF

SEQ ID NO: 186851 - protein, 15 aa, Mycobacterium tuberculosis
IGGLNSGTGNIGLFN

SEQ ID NO: 186852 - protein, 15 aa, Mycobacterium tuberculosis
GGLNSGTGNIGLFNS

SEQ ID NO: 186853 - protein, 15 aa, Mycobacterium tuberculosis
GLNSGTGNIGLFNSG

SEQ ID NO: 186854 - protein, 15 aa, Mycobacterium tuberculosis
LNSGTGNIGLFNSGT

SEQ ID NO: 186855 - protein, 15 aa, Mycobacterium tuberculosis
NSGTGNIGLFNSGTG

SEQ ID NO: 186856 - protein, 15 aa, Mycobacterium tuberculosis
SGTGNIGLFNSGTGN

SEQ ID NO: 186857 - protein, 15 aa, Mycobacterium tuberculosis
GTGNIGLFNSGTGNI

SEQ ID NO: 186858 - protein, 15 aa, Mycobacterium tuberculosis
TGNIGLFNSGTGNIG

SEQ ID NO: 186859 - protein, 15 aa, Mycobacterium tuberculosis
GNIGLFNSGTGNIGF

SEQ ID NO: 186860 - protein, 15 aa, Mycobacterium tuberculosis
NIGLFNSGTGNIGFF

SEQ ID NO: 186861 - protein, 15 aa, Mycobacterium tuberculosis
IGLFNSGTGNIGFFN

SEQ ID NO: 186862 - protein, 15 aa, Mycobacterium tuberculosis
GLFNSGTGNIGFFNS

SEQ ID NO: 186863 - protein, 15 aa, Mycobacterium tuberculosis
LFNSGTGNIGFFNSG

SEQ ID NO: 186864 - protein, 15 aa, Mycobacterium tuberculosis
FNSGTGNIGFFNSGT

SEQ ID NO: 186865 - protein, 15 aa, Mycobacterium tuberculosis
NSGTGNIGFFNSGTA

SEQ ID NO: 186866 - protein, 15 aa, Mycobacterium tuberculosis
SGTGNIGFFNSGTAN

SEQ ID NO: 186867 - protein, 15 aa, Mycobacterium tuberculosis
GTGNIGFFNSGTANF

SEQ ID NO: 186868 - protein, 15 aa, Mycobacterium tuberculosis
TGNIGFFNSGTANFG

SEQ ID NO: 186869 - protein, 15 aa, Mycobacterium tuberculosis
GNIGFFNSGTANFGL

SEQ ID NO: 186870 - protein, 15 aa, Mycobacterium tuberculosis
NIGFFNSGTANFGLF

SEQ ID NO: 186871 - protein, 15 aa, Mycobacterium tuberculosis
IGFFNSGTANFGLFN

SEQ ID NO: 186872 - protein, 15 aa, Mycobacterium tuberculosis
GFFNSGTANFGLFNS

SEQ ID NO: 186873 - protein, 15 aa, Mycobacterium tuberculosis
FFNSGTANFGLFNSG

SEQ ID NO: 186874 - protein, 15 aa, Mycobacterium tuberculosis
FNSGTANFGLFNSGS

SEQ ID NO: 186875 - protein, 15 aa, Mycobacterium tuberculosis
NSGTANFGLFNSGSY

SEQ ID NO: 186876 - protein, 15 aa, Mycobacterium tuberculosis
SGTANFGLFNSGSYN

SEQ ID NO: 186877 - protein, 15 aa, Mycobacterium tuberculosis
GTANFGLFNSGSYNT

SEQ ID NO: 186878 - protein, 15 aa, Mycobacterium tuberculosis
TANFGLFNSGSYNTG

SEQ ID NO: 186879 - protein, 15 aa, Mycobacterium tuberculosis
ANFGLFNSGSYNTGI

SEQ ID NO: 186880 - protein, 15 aa, Mycobacterium tuberculosis
NFGLFNSGSYNTGIG

SEQ ID NO: 186881 - protein, 15 aa, Mycobacterium tuberculosis
FGLFNSGSYNTGIGN

SEQ ID NO: 186882 - protein, 15 aa, Mycobacterium tuberculosis
GLFNSGSYNTGIGNS

SEQ ID NO: 186883 - protein, 15 aa, Mycobacterium tuberculosis
LFNSGSYNTGIGNSG

SEQ ID NO: 186884 - protein, 15 aa, Mycobacterium tuberculosis
FNSGSYNTGIGNSGV

SEQ ID NO: 186885 - protein, 15 aa, Mycobacterium tuberculosis
NSGSYNTGIGNSGVA

SEQ ID NO: 186886 - protein, 15 aa, Mycobacterium tuberculosis
SGSYNTGIGNSGVAS

SEQ ID NO: 186887 - protein, 15 aa, Mycobacterium tuberculosis
GSYNTGIGNSGVAST

SEQ ID NO: 186888 - protein, 15 aa, Mycobacterium tuberculosis
SYNTGIGNSGVASTG

SEQ ID NO: 186889 - protein, 15 aa, Mycobacterium tuberculosis
YNTGIGNSGVASTGL

SEQ ID NO: 186890 - protein, 15 aa, Mycobacterium tuberculosis
NTGIGNSGVASTGLV

SEQ ID NO: 186891 - protein, 15 aa, Mycobacterium tuberculosis
TGIGNSGVASTGLVN

SEQ ID NO: 186892 - protein, 15 aa, Mycobacterium tuberculosis
GIGNSGVASTGLVNA

SEQ ID NO: 186893 - protein, 15 aa, Mycobacterium tuberculosis
IGNSGVASTGLVNAG

SEQ ID NO: 186894 - protein, 15 aa, Mycobacterium tuberculosis
GNSGVASTGLVNAGG

SEQ ID NO: 186895 - protein, 15 aa, Mycobacterium tuberculosis
NSGVASTGLVNAGGF

SEQ ID NO: 186896 - protein, 15 aa, Mycobacterium tuberculosis
SGVASTGLVNAGGFN

SEQ ID NO: 186897 - protein, 15 aa, Mycobacterium tuberculosis
GVASTGLVNAGGFNT

SEQ ID NO: 186898 - protein, 15 aa, Mycobacterium tuberculosis
VASTGLVNAGGFNTG

SEQ ID NO: 186899 - protein, 15 aa, Mycobacterium tuberculosis
ASTGLVNAGGFNTGV

SEQ ID NO: 186900 - protein, 15 aa, Mycobacterium tuberculosis
STGLVNAGGFNTGVA

SEQ ID NO: 186901 - protein, 15 aa, Mycobacterium tuberculosis
TGLVNAGGFNTGVAN

SEQ ID NO: 186902 - protein, 15 aa, Mycobacterium tuberculosis
GLVNAGGFNTGVANA

SEQ ID NO: 186903 - protein, 15 aa, Mycobacterium tuberculosis
LVNAGGFNTGVANAG

SEQ ID NO: 186904 - protein, 15 aa, Mycobacterium tuberculosis
VNAGGFNTGVANAGS

SEQ ID NO: 186905 - protein, 15 aa, Mycobacterium tuberculosis
NAGGFNTGVANAGSY

SEQ ID NO: 186906 - protein, 15 aa, Mycobacterium tuberculosis
AGGFNTGVANAGSYN

SEQ ID NO: 186907 - protein, 15 aa, Mycobacterium tuberculosis
GGFNTGVANAGSYNT

SEQ ID NO: 186908 - protein, 15 aa, Mycobacterium tuberculosis
GFNTGVANAGSYNTG

SEQ ID NO: 186909 - protein, 15 aa, Mycobacterium tuberculosis
FNTGVANAGSYNTGS

SEQ ID NO: 186910 - protein, 15 aa, Mycobacterium tuberculosis
NTGVANAGSYNTGSF

SEQ ID NO: 186911 - protein, 15 aa, Mycobacterium tuberculosis
TGVANAGSYNTGSFN

SEQ ID NO: 186912 - protein, 15 aa, Mycobacterium tuberculosis
GVANAGSYNTGSFNA

SEQ ID NO: 186913 - protein, 15 aa, Mycobacterium tuberculosis
VANAGSYNTGSFNAG

SEQ ID NO: 186914 - protein, 15 aa, Mycobacterium tuberculosis
ANAGSYNTGSFNAGD

SEQ ID NO: 186915 - protein, 15 aa, Mycobacterium tuberculosis
NAGSYNTGSFNAGDT

SEQ ID NO: 186916 - protein, 15 aa, Mycobacterium tuberculosis
AGSYNTGSFNAGDTN

SEQ ID NO: 186917 - protein, 15 aa, Mycobacterium tuberculosis
GSYNTGSFNAGDTNT

SEQ ID NO: 186918 - protein, 15 aa, Mycobacterium tuberculosis
SYNTGSFNAGDTNTG

SEQ ID NO: 186919 - protein, 15 aa, Mycobacterium tuberculosis
YNTGSFNAGDTNTGG

SEQ ID NO: 186920 - protein, 15 aa, Mycobacterium tuberculosis
NTGSFNAGDTNTGGF

SEQ ID NO: 186921 - protein, 15 aa, Mycobacterium tuberculosis
TGSFNAGDTNTGGFN

SEQ ID NO: 186922 - protein, 15 aa, Mycobacterium tuberculosis
GSFNAGDTNTGGFNP

SEQ ID NO: 186923 - protein, 15 aa, Mycobacterium tuberculosis
SFNAGDTNTGGFNPG

SEQ ID NO: 186924 - protein, 15 aa, Mycobacterium tuberculosis
FNAGDTNTGGFNPGS

SEQ ID NO: 186925 - protein, 15 aa, Mycobacterium tuberculosis
NAGDTNTGGFNPGST

SEQ ID NO: 186926 - protein, 15 aa, Mycobacterium tuberculosis
AGDTNTGGFNPGSTN

SEQ ID NO: 186927 - protein, 15 aa, Mycobacterium tuberculosis
GDTNTGGFNPGSTNT

SEQ ID NO: 186928 - protein, 15 aa, Mycobacterium tuberculosis
DTNTGGFNPGSTNTG

SEQ ID NO: 186929 - protein, 15 aa, Mycobacterium tuberculosis
TNTGGFNPGSTNTGW

SEQ ID NO: 186930 - protein, 15 aa, Mycobacterium tuberculosis
NTGGFNPGSTNTGWF

SEQ ID NO: 186931 - protein, 15 aa, Mycobacterium tuberculosis
TGGFNPGSTNTGWFN

SEQ ID NO: 186932 - protein, 15 aa, Mycobacterium tuberculosis
GGFNPGSTNTGWFNT

SEQ ID NO: 186933 - protein, 15 aa, Mycobacterium tuberculosis
GFNPGSTNTGWFNTG

SEQ ID NO: 186934 - protein, 15 aa, Mycobacterium tuberculosis
FNPGSTNTGWFNTGN

SEQ ID NO: 186935 - protein, 15 aa, Mycobacterium tuberculosis
NPGSTNTGWFNTGNA

SEQ ID NO: 186936 - protein, 15 aa, Mycobacterium tuberculosis
PGSTNTGWFNTGNAN

SEQ ID NO: 186937 - protein, 15 aa, Mycobacterium tuberculosis
GSTNTGWFNTGNANT

SEQ ID NO: 186938 - protein, 15 aa, Mycobacterium tuberculosis
STNTGWFNTGNANTG

SEQ ID NO: 186939 - protein, 15 aa, Mycobacterium tuberculosis
TNTGWFNTGNANTGV

SEQ ID NO: 186940 - protein, 15 aa, Mycobacterium tuberculosis
NTGWFNTGNANTGVA

SEQ ID NO: 186941 - protein, 15 aa, Mycobacterium tuberculosis
TGWFNTGNANTGVAN

SEQ ID NO: 186942 - protein, 15 aa, Mycobacterium tuberculosis
GWFNTGNANTGVANA

SEQ ID NO: 186943 - protein, 15 aa, Mycobacterium tuberculosis
WFNTGNANTGVANAG

SEQ ID NO: 186944 - protein, 15 aa, Mycobacterium tuberculosis
FNTGNANTGVANAGN

SEQ ID NO: 186945 - protein, 15 aa, Mycobacterium tuberculosis
NTGNANTGVANAGNV

SEQ ID NO: 186946 - protein, 15 aa, Mycobacterium tuberculosis
TGNANTGVANAGNVN

SEQ ID NO: 186947 - protein, 15 aa, Mycobacterium tuberculosis
GNANTGVANAGNVNT

SEQ ID NO: 186948 - protein, 15 aa, Mycobacterium tuberculosis
NANTGVANAGNVNTG

SEQ ID NO: 186949 - protein, 15 aa, Mycobacterium tuberculosis
ANTGVANAGNVNTGA

SEQ ID NO: 186950 - protein, 15 aa, Mycobacterium tuberculosis
NTGVANAGNVNTGAL

SEQ ID NO: 186951 - protein, 15 aa, Mycobacterium tuberculosis
TGVANAGNVNTGALI

SEQ ID NO: 186952 - protein, 15 aa, Mycobacterium tuberculosis
GVANAGNVNTGALIT

SEQ ID NO: 186953 - protein, 15 aa, Mycobacterium tuberculosis
VANAGNVNTGALITG

SEQ ID NO: 186954 - protein, 15 aa, Mycobacterium tuberculosis
ANAGNVNTGALITGN

SEQ ID NO: 186955 - protein, 15 aa, Mycobacterium tuberculosis
NAGNVNTGALITGNF

SEQ ID NO: 186956 - protein, 15 aa, Mycobacterium tuberculosis
AGNVNTGALITGNFS

SEQ ID NO: 186957 - protein, 15 aa, Mycobacterium tuberculosis
GNVNTGALITGNFSN

SEQ ID NO: 186958 - protein, 15 aa, Mycobacterium tuberculosis
NVNTGALITGNFSNG

SEQ ID NO: 186959 - protein, 15 aa, Mycobacterium tuberculosis
VNTGALITGNFSNGI

SEQ ID NO: 186960 - protein, 15 aa, Mycobacterium tuberculosis
NTGALITGNFSNGIL

SEQ ID NO: 186961 - protein, 15 aa, Mycobacterium tuberculosis
TGALITGNFSNGILW

SEQ ID NO: 186962 - protein, 15 aa, Mycobacterium tuberculosis
GALITGNFSNGILWR

SEQ ID NO: 186963 - protein, 15 aa, Mycobacterium tuberculosis
ALITGNFSNGILWRG

SEQ ID NO: 186964 - protein, 15 aa, Mycobacterium tuberculosis
LITGNFSNGILWRGN

SEQ ID NO: 186965 - protein, 15 aa, Mycobacterium tuberculosis
ITGNFSNGILWRGNY

SEQ ID NO: 186966 - protein, 15 aa, Mycobacterium tuberculosis
TGNFSNGILWRGNYE

SEQ ID NO: 186967 - protein, 15 aa, Mycobacterium tuberculosis
GNFSNGILWRGNYEG

SEQ ID NO: 186968 - protein, 15 aa, Mycobacterium tuberculosis
NFSNGILWRGNYEGL

SEQ ID NO: 186969 - protein, 15 aa, Mycobacterium tuberculosis
FSNGILWRGNYEGLA

SEQ ID NO: 186970 - protein, 15 aa, Mycobacterium tuberculosis
SNGILWRGNYEGLAG

SEQ ID NO: 186971 - protein, 15 aa, Mycobacterium tuberculosis
NGILWRGNYEGLAGF

SEQ ID NO: 186972 - protein, 15 aa, Mycobacterium tuberculosis
GILWRGNYEGLAGFS

SEQ ID NO: 186973 - protein, 15 aa, Mycobacterium tuberculosis
ILWRGNYEGLAGFSF

SEQ ID NO: 186974 - protein, 15 aa, Mycobacterium tuberculosis
LWRGNYEGLAGFSFG

SEQ ID NO: 186975 - protein, 15 aa, Mycobacterium tuberculosis
WRGNYEGLAGFSFGY

SEQ ID NO: 186976 - protein, 15 aa, Mycobacterium tuberculosis
RGNYEGLAGFSFGYP

SEQ ID NO: 186977 - protein, 15 aa, Mycobacterium tuberculosis
GNYEGLAGFSFGYPI

SEQ ID NO: 186978 - protein, 15 aa, Mycobacterium tuberculosis
NYEGLAGFSFGYPIP

SEQ ID NO: 186979 - protein, 15 aa, Mycobacterium tuberculosis
YEGLAGFSFGYPIPL

SEQ ID NO: 186980 - protein, 15 aa, Mycobacterium tuberculosis
EGLAGFSFGYPIPLF

SEQ ID NO: 186981 - protein, 15 aa, Mycobacterium tuberculosis
GLAGFSFGYPIPLFP

SEQ ID NO: 186982 - protein, 15 aa, Mycobacterium tuberculosis
LAGFSFGYPIPLFPA

SEQ ID NO: 186983 - protein, 15 aa, Mycobacterium tuberculosis
AGFSFGYPIPLFPAV

SEQ ID NO: 186984 - protein, 15 aa, Mycobacterium tuberculosis
GFSFGYPIPLFPAVG

SEQ ID NO: 186985 - protein, 15 aa, Mycobacterium tuberculosis
FSFGYPIPLFPAVGA

SEQ ID NO: 186986 - protein, 15 aa, Mycobacterium tuberculosis
SFGYPIPLFPAVGAD

SEQ ID NO: 186987 - protein, 15 aa, Mycobacterium tuberculosis
FGYPIPLFPAVGADV

SEQ ID NO: 186988 - protein, 15 aa, Mycobacterium tuberculosis
GYPIPLFPAVGADVT

SEQ ID NO: 186989 - protein, 15 aa, Mycobacterium tuberculosis
YPIPLFPAVGADVTG

SEQ ID NO: 186990 - protein, 15 aa, Mycobacterium tuberculosis
PIPLFPAVGADVTGD

SEQ ID NO: 186991 - protein, 15 aa, Mycobacterium tuberculosis
IPLFPAVGADVTGDI

SEQ ID NO: 186992 - protein, 15 aa, Mycobacterium tuberculosis
PLFPAVGADVTGDIG

SEQ ID NO: 186993 - protein, 15 aa, Mycobacterium tuberculosis
LFPAVGADVTGDIGP

SEQ ID NO: 186994 - protein, 15 aa, Mycobacterium tuberculosis
FPAVGADVTGDIGPA

SEQ ID NO: 186995 - protein, 15 aa, Mycobacterium tuberculosis
PAVGADVTGDIGPAT

SEQ ID NO: 186996 - protein, 15 aa, Mycobacterium tuberculosis
AVGADVTGDIGPATI

SEQ ID NO: 186997 - protein, 15 aa, Mycobacterium tuberculosis
VGADVTGDIGPATII

SEQ ID NO: 186998 - protein, 15 aa, Mycobacterium tuberculosis
GADVTGDIGPATIIP

SEQ ID NO: 186999 - protein, 15 aa, Mycobacterium tuberculosis
ADVTGDIGPATIIPP

SEQ ID NO: 187000 - protein, 15 aa, Mycobacterium tuberculosis
DVTGDIGPATIIPPI

SEQ ID NO: 187001 - protein, 15 aa, Mycobacterium tuberculosis
VTGDIGPATIIPPIH

SEQ ID NO: 187002 - protein, 15 aa, Mycobacterium tuberculosis
TGDIGPATIIPPIHI

SEQ ID NO: 187003 - protein, 15 aa, Mycobacterium tuberculosis
GDIGPATIIPPIHIP

SEQ ID NO: 187004 - protein, 15 aa, Mycobacterium tuberculosis
DIGPATIIPPIHIPS

SEQ ID NO: 187005 - protein, 15 aa, Mycobacterium tuberculosis
IGPATIIPPIHIPSI

SEQ ID NO: 187006 - protein, 15 aa, Mycobacterium tuberculosis
GPATIIPPIHIPSIP

SEQ ID NO: 187007 - protein, 15 aa, Mycobacterium tuberculosis
PATIIPPIHIPSIPL

SEQ ID NO: 187008 - protein, 15 aa, Mycobacterium tuberculosis
ATIIPPIHIPSIPLG

SEQ ID NO: 187009 - protein, 15 aa, Mycobacterium tuberculosis
TIIPPIHIPSIPLGF

SEQ ID NO: 187010 - protein, 15 aa, Mycobacterium tuberculosis
IIPPIHIPSIPLGFA

SEQ ID NO: 187011 - protein, 15 aa, Mycobacterium tuberculosis
IPPIHIPSIPLGFAA

SEQ ID NO: 187012 - protein, 15 aa, Mycobacterium tuberculosis
PPIHIPSIPLGFAAI

SEQ ID NO: 187013 - protein, 15 aa, Mycobacterium tuberculosis
PIHIPSIPLGFAAIG

SEQ ID NO: 187014 - protein, 15 aa, Mycobacterium tuberculosis
IHIPSIPLGFAAIGH

SEQ ID NO: 187015 - protein, 15 aa, Mycobacterium tuberculosis
HIPSIPLGFAAIGHI

SEQ ID NO: 187016 - protein, 15 aa, Mycobacterium tuberculosis
IPSIPLGFAAIGHIG

SEQ ID NO: 187017 - protein, 15 aa, Mycobacterium tuberculosis
PSIPLGFAAIGHIGP

SEQ ID NO: 187018 - protein, 15 aa, Mycobacterium tuberculosis
SIPLGFAAIGHIGPI

SEQ ID NO: 187019 - protein, 15 aa, Mycobacterium tuberculosis
IPLGFAAIGHIGPIS

SEQ ID NO: 187020 - protein, 15 aa, Mycobacterium tuberculosis
PLGFAAIGHIGPISI

SEQ ID NO: 187021 - protein, 15 aa, Mycobacterium tuberculosis
LGFAAIGHIGPISIP

SEQ ID NO: 187022 - protein, 15 aa, Mycobacterium tuberculosis
GFAAIGHIGPISIPN

SEQ ID NO: 187023 - protein, 15 aa, Mycobacterium tuberculosis
FAAIGHIGPISIPNI

SEQ ID NO: 187024 - protein, 15 aa, Mycobacterium tuberculosis
AAIGHIGPISIPNIA

SEQ ID NO: 187025 - protein, 15 aa, Mycobacterium tuberculosis
AIGHIGPISIPNIAI

SEQ ID NO: 187026 - protein, 15 aa, Mycobacterium tuberculosis
IGHIGPISIPNIAIP

SEQ ID NO: 187027 - protein, 15 aa, Mycobacterium tuberculosis
GHIGPISIPNIAIPS

SEQ ID NO: 187028 - protein, 15 aa, Mycobacterium tuberculosis
HIGPISIPNIAIPSI

SEQ ID NO: 187029 - protein, 15 aa, Mycobacterium tuberculosis
IGPISIPNIAIPSIH

SEQ ID NO: 187030 - protein, 15 aa, Mycobacterium tuberculosis
GPISIPNIAIPSIHL

SEQ ID NO: 187031 - protein, 15 aa, Mycobacterium tuberculosis
PISIPNIAIPSIHLG

SEQ ID NO: 187032 - protein, 15 aa, Mycobacterium tuberculosis
ISIPNIAIPSIHLGI

SEQ ID NO: 187033 - protein, 15 aa, Mycobacterium tuberculosis
SIPNIAIPSIHLGID

SEQ ID NO: 187034 - protein, 15 aa, Mycobacterium tuberculosis
IPNIAIPSIHLGIDP

SEQ ID NO: 187035 - protein, 15 aa, Mycobacterium tuberculosis
PNIAIPSIHLGIDPT

SEQ ID NO: 187036 - protein, 15 aa, Mycobacterium tuberculosis
NIAIPSIHLGIDPTF

SEQ ID NO: 187037 - protein, 15 aa, Mycobacterium tuberculosis
IAIPSIHLGIDPTFD

SEQ ID NO: 187038 - protein, 15 aa, Mycobacterium tuberculosis
AIPSIHLGIDPTFDV

SEQ ID NO: 187039 - protein, 15 aa, Mycobacterium tuberculosis
IPSIHLGIDPTFDVG

SEQ ID NO: 187040 - protein, 15 aa, Mycobacterium tuberculosis
PSIHLGIDPTFDVGP

SEQ ID NO: 187041 - protein, 15 aa, Mycobacterium tuberculosis
SIHLGIDPTFDVGPI

SEQ ID NO: 187042 - protein, 15 aa, Mycobacterium tuberculosis
IHLGIDPTFDVGPIT

SEQ ID NO: 187043 - protein, 15 aa, Mycobacterium tuberculosis
HLGIDPTFDVGPITV

SEQ ID NO: 187044 - protein, 15 aa, Mycobacterium tuberculosis
LGIDPTFDVGPITVD

SEQ ID NO: 187045 - protein, 15 aa, Mycobacterium tuberculosis
GIDPTFDVGPITVDP

SEQ ID NO: 187046 - protein, 15 aa, Mycobacterium tuberculosis
IDPTFDVGPITVDPI

SEQ ID NO: 187047 - protein, 15 aa, Mycobacterium tuberculosis
DPTFDVGPITVDPIT

SEQ ID NO: 187048 - protein, 15 aa, Mycobacterium tuberculosis
PTFDVGPITVDPITL

SEQ ID NO: 187049 - protein, 15 aa, Mycobacterium tuberculosis
TFDVGPITVDPITLT

SEQ ID NO: 187050 - protein, 15 aa, Mycobacterium tuberculosis
FDVGPITVDPITLTI

SEQ ID NO: 187051 - protein, 15 aa, Mycobacterium tuberculosis
DVGPITVDPITLTIP

SEQ ID NO: 187052 - protein, 15 aa, Mycobacterium tuberculosis
VGPITVDPITLTIPG

SEQ ID NO: 187053 - protein, 15 aa, Mycobacterium tuberculosis
GPITVDPITLTIPGL

SEQ ID NO: 187054 - protein, 15 aa, Mycobacterium tuberculosis
PITVDPITLTIPGLS

SEQ ID NO: 187055 - protein, 15 aa, Mycobacterium tuberculosis
ITVDPITLTIPGLSL

SEQ ID NO: 187056 - protein, 15 aa, Mycobacterium tuberculosis
TVDPITLTIPGLSLD

SEQ ID NO: 187057 - protein, 15 aa, Mycobacterium tuberculosis
VDPITLTIPGLSLDA

SEQ ID NO: 187058 - protein, 15 aa, Mycobacterium tuberculosis
DPITLTIPGLSLDAA

SEQ ID NO: 187059 - protein, 15 aa, Mycobacterium tuberculosis
PITLTIPGLSLDAAV

SEQ ID NO: 187060 - protein, 15 aa, Mycobacterium tuberculosis
ITLTIPGLSLDAAVS

SEQ ID NO: 187061 - protein, 15 aa, Mycobacterium tuberculosis
TLTIPGLSLDAAVSE

SEQ ID NO: 187062 - protein, 15 aa, Mycobacterium tuberculosis
LTIPGLSLDAAVSEI

SEQ ID NO: 187063 - protein, 15 aa, Mycobacterium tuberculosis
TIPGLSLDAAVSEIR

SEQ ID NO: 187064 - protein, 15 aa, Mycobacterium tuberculosis
IPGLSLDAAVSEIRM

SEQ ID NO: 187065 - protein, 15 aa, Mycobacterium tuberculosis
PGLSLDAAVSEIRMT

SEQ ID NO: 187066 - protein, 15 aa, Mycobacterium tuberculosis
GLSLDAAVSEIRMTS

SEQ ID NO: 187067 - protein, 15 aa, Mycobacterium tuberculosis
LSLDAAVSEIRMTSG

SEQ ID NO: 187068 - protein, 15 aa, Mycobacterium tuberculosis
SLDAAVSEIRMTSGS

SEQ ID NO: 187069 - protein, 15 aa, Mycobacterium tuberculosis
LDAAVSEIRMTSGSS

SEQ ID NO: 187070 - protein, 15 aa, Mycobacterium tuberculosis
DAAVSEIRMTSGSSS

SEQ ID NO: 187071 - protein, 15 aa, Mycobacterium tuberculosis
AAVSEIRMTSGSSSG

SEQ ID NO: 187072 - protein, 15 aa, Mycobacterium tuberculosis
AVSEIRMTSGSSSGF

SEQ ID NO: 187073 - protein, 15 aa, Mycobacterium tuberculosis
VSEIRMTSGSSSGFK

SEQ ID NO: 187074 - protein, 15 aa, Mycobacterium tuberculosis
SEIRMTSGSSSGFKV

SEQ ID NO: 187075 - protein, 15 aa, Mycobacterium tuberculosis
EIRMTSGSSSGFKVR

SEQ ID NO: 187076 - protein, 15 aa, Mycobacterium tuberculosis
IRMTSGSSSGFKVRP

SEQ ID NO: 187077 - protein, 15 aa, Mycobacterium tuberculosis
RMTSGSSSGFKVRPS

SEQ ID NO: 187078 - protein, 15 aa, Mycobacterium tuberculosis
MTSGSSSGFKVRPSF

SEQ ID NO: 187079 - protein, 15 aa, Mycobacterium tuberculosis
TSGSSSGFKVRPSFS

SEQ ID NO: 187080 - protein, 15 aa, Mycobacterium tuberculosis
SGSSSGFKVRPSFSF

SEQ ID NO: 187081 - protein, 15 aa, Mycobacterium tuberculosis
GSSSGFKVRPSFSFF

SEQ ID NO: 187082 - protein, 15 aa, Mycobacterium tuberculosis
SSSGFKVRPSFSFFA

SEQ ID NO: 187083 - protein, 15 aa, Mycobacterium tuberculosis
SSGFKVRPSFSFFAV

SEQ ID NO: 187084 - protein, 15 aa, Mycobacterium tuberculosis
SGFKVRPSFSFFAVG

SEQ ID NO: 187085 - protein, 15 aa, Mycobacterium tuberculosis
GFKVRPSFSFFAVGP

SEQ ID NO: 187086 - protein, 15 aa, Mycobacterium tuberculosis
FKVRPSFSFFAVGPD

SEQ ID NO: 187087 - protein, 15 aa, Mycobacterium tuberculosis
KVRPSFSFFAVGPDG

SEQ ID NO: 187088 - protein, 15 aa, Mycobacterium tuberculosis
VRPSFSFFAVGPDGM

SEQ ID NO: 187089 - protein, 15 aa, Mycobacterium tuberculosis
RPSFSFFAVGPDGMP

SEQ ID NO: 187090 - protein, 15 aa, Mycobacterium tuberculosis
PSFSFFAVGPDGMPG

SEQ ID NO: 187091 - protein, 15 aa, Mycobacterium tuberculosis
SFSFFAVGPDGMPGG

SEQ ID NO: 187092 - protein, 15 aa, Mycobacterium tuberculosis
FSFFAVGPDGMPGGE

SEQ ID NO: 187093 - protein, 15 aa, Mycobacterium tuberculosis
SFFAVGPDGMPGGEV

SEQ ID NO: 187094 - protein, 15 aa, Mycobacterium tuberculosis
FFAVGPDGMPGGEVS

SEQ ID NO: 187095 - protein, 15 aa, Mycobacterium tuberculosis
FAVGPDGMPGGEVSI

SEQ ID NO: 187096 - protein, 15 aa, Mycobacterium tuberculosis
AVGPDGMPGGEVSIL

SEQ ID NO: 187097 - protein, 15 aa, Mycobacterium tuberculosis
VGPDGMPGGEVSILQ

SEQ ID NO: 187098 - protein, 15 aa, Mycobacterium tuberculosis
GPDGMPGGEVSILQP

SEQ ID NO: 187099 - protein, 15 aa, Mycobacterium tuberculosis
PDGMPGGEVSILQPF

SEQ ID NO: 187100 - protein, 15 aa, Mycobacterium tuberculosis
DGMPGGEVSILQPFT

SEQ ID NO: 187101 - protein, 15 aa, Mycobacterium tuberculosis
GMPGGEVSILQPFTV

SEQ ID NO: 187102 - protein, 15 aa, Mycobacterium tuberculosis
MPGGEVSILQPFTVA

SEQ ID NO: 187103 - protein, 15 aa, Mycobacterium tuberculosis
PGGEVSILQPFTVAP

SEQ ID NO: 187104 - protein, 15 aa, Mycobacterium tuberculosis
GGEVSILQPFTVAPI

SEQ ID NO: 187105 - protein, 15 aa, Mycobacterium tuberculosis
GEVSILQPFTVAPIN

SEQ ID NO: 187106 - protein, 15 aa, Mycobacterium tuberculosis
EVSILQPFTVAPINL

SEQ ID NO: 187107 - protein, 15 aa, Mycobacterium tuberculosis
VSILQPFTVAPINLN

SEQ ID NO: 187108 - protein, 15 aa, Mycobacterium tuberculosis
SILQPFTVAPINLNP

SEQ ID NO: 187109 - protein, 15 aa, Mycobacterium tuberculosis
ILQPFTVAPINLNPT

SEQ ID NO: 187110 - protein, 15 aa, Mycobacterium tuberculosis
LQPFTVAPINLNPTT

SEQ ID NO: 187111 - protein, 15 aa, Mycobacterium tuberculosis
QPFTVAPINLNPTTL

SEQ ID NO: 187112 - protein, 15 aa, Mycobacterium tuberculosis
PFTVAPINLNPTTLH

SEQ ID NO: 187113 - protein, 15 aa, Mycobacterium tuberculosis
FTVAPINLNPTTLHF

SEQ ID NO: 187114 - protein, 15 aa, Mycobacterium tuberculosis
TVAPINLNPTTLHFP

SEQ ID NO: 187115 - protein, 15 aa, Mycobacterium tuberculosis
VAPINLNPTTLHFPG

SEQ ID NO: 187116 - protein, 15 aa, Mycobacterium tuberculosis
APINLNPTTLHFPGF

SEQ ID NO: 187117 - protein, 15 aa, Mycobacterium tuberculosis
PINLNPTTLHFPGFT

SEQ ID NO: 187118 - protein, 15 aa, Mycobacterium tuberculosis
INLNPTTLHFPGFTI

SEQ ID NO: 187119 - protein, 15 aa, Mycobacterium tuberculosis
NLNPTTLHFPGFTIP

SEQ ID NO: 187120 - protein, 15 aa, Mycobacterium tuberculosis
LNPTTLHFPGFTIPT

SEQ ID NO: 187121 - protein, 15 aa, Mycobacterium tuberculosis
NPTTLHFPGFTIPTG

SEQ ID NO: 187122 - protein, 15 aa, Mycobacterium tuberculosis
PTTLHFPGFTIPTGP

SEQ ID NO: 187123 - protein, 15 aa, Mycobacterium tuberculosis
TTLHFPGFTIPTGPI

SEQ ID NO: 187124 - protein, 15 aa, Mycobacterium tuberculosis
TLHFPGFTIPTGPIH

SEQ ID NO: 187125 - protein, 15 aa, Mycobacterium tuberculosis
LHFPGFTIPTGPIHI

SEQ ID NO: 187126 - protein, 15 aa, Mycobacterium tuberculosis
HFPGFTIPTGPIHIG

SEQ ID NO: 187127 - protein, 15 aa, Mycobacterium tuberculosis
FPGFTIPTGPIHIGL

SEQ ID NO: 187128 - protein, 15 aa, Mycobacterium tuberculosis
PGFTIPTGPIHIGLP

SEQ ID NO: 187129 - protein, 15 aa, Mycobacterium tuberculosis
GFTIPTGPIHIGLPL

SEQ ID NO: 187130 - protein, 15 aa, Mycobacterium tuberculosis
FTIPTGPIHIGLPLS

SEQ ID NO: 187131 - protein, 15 aa, Mycobacterium tuberculosis
TIPTGPIHIGLPLSL

SEQ ID NO: 187132 - protein, 15 aa, Mycobacterium tuberculosis
IPTGPIHIGLPLSLT

SEQ ID NO: 187133 - protein, 15 aa, Mycobacterium tuberculosis
PTGPIHIGLPLSLTI

SEQ ID NO: 187134 - protein, 15 aa, Mycobacterium tuberculosis
TGPIHIGLPLSLTIP

SEQ ID NO: 187135 - protein, 15 aa, Mycobacterium tuberculosis
GPIHIGLPLSLTIPG

SEQ ID NO: 187136 - protein, 15 aa, Mycobacterium tuberculosis
PIHIGLPLSLTIPGF

SEQ ID NO: 187137 - protein, 15 aa, Mycobacterium tuberculosis
IHIGLPLSLTIPGFT

SEQ ID NO: 187138 - protein, 15 aa, Mycobacterium tuberculosis
HIGLPLSLTIPGFTI

SEQ ID NO: 187139 - protein, 15 aa, Mycobacterium tuberculosis
IGLPLSLTIPGFTIP

SEQ ID NO: 187140 - protein, 15 aa, Mycobacterium tuberculosis
GLPLSLTIPGFTIPG

SEQ ID NO: 187141 - protein, 15 aa, Mycobacterium tuberculosis
LPLSLTIPGFTIPGG

SEQ ID NO: 187142 - protein, 15 aa, Mycobacterium tuberculosis
PLSLTIPGFTIPGGT

SEQ ID NO: 187143 - protein, 15 aa, Mycobacterium tuberculosis
LSLTIPGFTIPGGTL

SEQ ID NO: 187144 - protein, 15 aa, Mycobacterium tuberculosis
SLTIPGFTIPGGTLI

SEQ ID NO: 187145 - protein, 15 aa, Mycobacterium tuberculosis
LTIPGFTIPGGTLIP

SEQ ID NO: 187146 - protein, 15 aa, Mycobacterium tuberculosis
TIPGFTIPGGTLIPQ

SEQ ID NO: 187147 - protein, 15 aa, Mycobacterium tuberculosis
IPGFTIPGGTLIPQL

SEQ ID NO: 187148 - protein, 15 aa, Mycobacterium tuberculosis
PGFTIPGGTLIPQLP

SEQ ID NO: 187149 - protein, 15 aa, Mycobacterium tuberculosis
GFTIPGGTLIPQLPL

SEQ ID NO: 187150 - protein, 15 aa, Mycobacterium tuberculosis
FTIPGGTLIPQLPLG

SEQ ID NO: 187151 - protein, 15 aa, Mycobacterium tuberculosis
TIPGGTLIPQLPLGL

SEQ ID NO: 187152 - protein, 15 aa, Mycobacterium tuberculosis
IPGGTLIPQLPLGLG

SEQ ID NO: 187153 - protein, 15 aa, Mycobacterium tuberculosis
PGGTLIPQLPLGLGL

SEQ ID NO: 187154 - protein, 15 aa, Mycobacterium tuberculosis
GGTLIPQLPLGLGLS

SEQ ID NO: 187155 - protein, 15 aa, Mycobacterium tuberculosis
GTLIPQLPLGLGLSG

SEQ ID NO: 187156 - protein, 15 aa, Mycobacterium tuberculosis
TLIPQLPLGLGLSGG

SEQ ID NO: 187157 - protein, 15 aa, Mycobacterium tuberculosis
LIPQLPLGLGLSGGT

SEQ ID NO: 187158 - protein, 15 aa, Mycobacterium tuberculosis
IPQLPLGLGLSGGTP

SEQ ID NO: 187159 - protein, 15 aa, Mycobacterium tuberculosis
PQLPLGLGLSGGTPP

SEQ ID NO: 187160 - protein, 15 aa, Mycobacterium tuberculosis
QLPLGLGLSGGTPPF

SEQ ID NO: 187161 - protein, 15 aa, Mycobacterium tuberculosis
LPLGLGLSGGTPPFD

SEQ ID NO: 187162 - protein, 15 aa, Mycobacterium tuberculosis
PLGLGLSGGTPPFDL

SEQ ID NO: 187163 - protein, 15 aa, Mycobacterium tuberculosis
LGLGLSGGTPPFDLP

SEQ ID NO: 187164 - protein, 15 aa, Mycobacterium tuberculosis
GLGLSGGTPPFDLPT

SEQ ID NO: 187165 - protein, 15 aa, Mycobacterium tuberculosis
LGLSGGTPPFDLPTV

SEQ ID NO: 187166 - protein, 15 aa, Mycobacterium tuberculosis
GLSGGTPPFDLPTVV

SEQ ID NO: 187167 - protein, 15 aa, Mycobacterium tuberculosis
LSGGTPPFDLPTVVI

SEQ ID NO: 187168 - protein, 15 aa, Mycobacterium tuberculosis
SGGTPPFDLPTVVID

SEQ ID NO: 187169 - protein, 15 aa, Mycobacterium tuberculosis
GGTPPFDLPTVVIDR

SEQ ID NO: 187170 - protein, 15 aa, Mycobacterium tuberculosis
GTPPFDLPTVVIDRI

SEQ ID NO: 187171 - protein, 15 aa, Mycobacterium tuberculosis
TPPFDLPTVVIDRIP

SEQ ID NO: 187172 - protein, 15 aa, Mycobacterium tuberculosis
PPFDLPTVVIDRIPV

SEQ ID NO: 187173 - protein, 15 aa, Mycobacterium tuberculosis
PFDLPTVVIDRIPVE

SEQ ID NO: 187174 - protein, 15 aa, Mycobacterium tuberculosis
FDLPTVVIDRIPVEL

SEQ ID NO: 187175 - protein, 15 aa, Mycobacterium tuberculosis
DLPTVVIDRIPVELH

SEQ ID NO: 187176 - protein, 15 aa, Mycobacterium tuberculosis
LPTVVIDRIPVELHA

SEQ ID NO: 187177 - protein, 15 aa, Mycobacterium tuberculosis
PTVVIDRIPVELHAS

SEQ ID NO: 187178 - protein, 15 aa, Mycobacterium tuberculosis
TVVIDRIPVELHAST

SEQ ID NO: 187179 - protein, 15 aa, Mycobacterium tuberculosis
VVIDRIPVELHASTT

SEQ ID NO: 187180 - protein, 15 aa, Mycobacterium tuberculosis
VIDRIPVELHASTTI

SEQ ID NO: 187181 - protein, 15 aa, Mycobacterium tuberculosis
IDRIPVELHASTTIG

SEQ ID NO: 187182 - protein, 15 aa, Mycobacterium tuberculosis
DRIPVELHASTTIGP

SEQ ID NO: 187183 - protein, 15 aa, Mycobacterium tuberculosis
RIPVELHASTTIGPV

SEQ ID NO: 187184 - protein, 15 aa, Mycobacterium tuberculosis
IPVELHASTTIGPVS

SEQ ID NO: 187185 - protein, 15 aa, Mycobacterium tuberculosis
PVELHASTTIGPVSL

SEQ ID NO: 187186 - protein, 15 aa, Mycobacterium tuberculosis
VELHASTTIGPVSLP

SEQ ID NO: 187187 - protein, 15 aa, Mycobacterium tuberculosis
ELHASTTIGPVSLPI

SEQ ID NO: 187188 - protein, 15 aa, Mycobacterium tuberculosis
LHASTTIGPVSLPIF

SEQ ID NO: 187189 - protein, 15 aa, Mycobacterium tuberculosis
HASTTIGPVSLPIFG

SEQ ID NO: 187190 - protein, 15 aa, Mycobacterium tuberculosis
ASTTIGPVSLPIFGF

SEQ ID NO: 187191 - protein, 15 aa, Mycobacterium tuberculosis
STTIGPVSLPIFGFG

SEQ ID NO: 187192 - protein, 15 aa, Mycobacterium tuberculosis
TTIGPVSLPIFGFGG

SEQ ID NO: 187193 - protein, 15 aa, Mycobacterium tuberculosis
TIGPVSLPIFGFGGA

SEQ ID NO: 187194 - protein, 15 aa, Mycobacterium tuberculosis
IGPVSLPIFGFGGAP

SEQ ID NO: 187195 - protein, 15 aa, Mycobacterium tuberculosis
GPVSLPIFGFGGAPG

SEQ ID NO: 187196 - protein, 15 aa, Mycobacterium tuberculosis
PVSLPIFGFGGAPGF

SEQ ID NO: 187197 - protein, 15 aa, Mycobacterium tuberculosis
VSLPIFGFGGAPGFG

SEQ ID NO: 187198 - protein, 15 aa, Mycobacterium tuberculosis
SLPIFGFGGAPGFGN

SEQ ID NO: 187199 - protein, 15 aa, Mycobacterium tuberculosis
LPIFGFGGAPGFGND

SEQ ID NO: 187200 - protein, 15 aa, Mycobacterium tuberculosis
PIFGFGGAPGFGNDT

SEQ ID NO: 187201 - protein, 15 aa, Mycobacterium tuberculosis
IFGFGGAPGFGNDTT

SEQ ID NO: 187202 - protein, 15 aa, Mycobacterium tuberculosis
FGFGGAPGFGNDTTA

SEQ ID NO: 187203 - protein, 15 aa, Mycobacterium tuberculosis
GFGGAPGFGNDTTAP

SEQ ID NO: 187204 - protein, 15 aa, Mycobacterium tuberculosis
FGGAPGFGNDTTAPS

SEQ ID NO: 187205 - protein, 15 aa, Mycobacterium tuberculosis
GGAPGFGNDTTAPSS

SEQ ID NO: 187206 - protein, 15 aa, Mycobacterium tuberculosis
GAPGFGNDTTAPSSG

SEQ ID NO: 187207 - protein, 15 aa, Mycobacterium tuberculosis
APGFGNDTTAPSSGF

SEQ ID NO: 187208 - protein, 15 aa, Mycobacterium tuberculosis
PGFGNDTTAPSSGFF

SEQ ID NO: 187209 - protein, 15 aa, Mycobacterium tuberculosis
GFGNDTTAPSSGFFN

SEQ ID NO: 187210 - protein, 15 aa, Mycobacterium tuberculosis
FGNDTTAPSSGFFNT

SEQ ID NO: 187211 - protein, 15 aa, Mycobacterium tuberculosis
GNDTTAPSSGFFNTG

SEQ ID NO: 187212 - protein, 15 aa, Mycobacterium tuberculosis
NDTTAPSSGFFNTGG

SEQ ID NO: 187213 - protein, 15 aa, Mycobacterium tuberculosis
DTTAPSSGFFNTGGG

SEQ ID NO: 187214 - protein, 15 aa, Mycobacterium tuberculosis
TTAPSSGFFNTGGGG

SEQ ID NO: 187215 - protein, 15 aa, Mycobacterium tuberculosis
TAPSSGFFNTGGGGG

SEQ ID NO: 187216 - protein, 15 aa, Mycobacterium tuberculosis
APSSGFFNTGGGGGS

SEQ ID NO: 187217 - protein, 15 aa, Mycobacterium tuberculosis
PSSGFFNTGGGGGSG

SEQ ID NO: 187218 - protein, 15 aa, Mycobacterium tuberculosis
SSGFFNTGGGGGSGF

SEQ ID NO: 187219 - protein, 15 aa, Mycobacterium tuberculosis
SGFFNTGGGGGSGFS

SEQ ID NO: 187220 - protein, 15 aa, Mycobacterium tuberculosis
GFFNTGGGGGSGFSN

SEQ ID NO: 187221 - protein, 15 aa, Mycobacterium tuberculosis
FFNTGGGGGSGFSNS

SEQ ID NO: 187222 - protein, 15 aa, Mycobacterium tuberculosis
FNTGGGGGSGFSNSG

SEQ ID NO: 187223 - protein, 15 aa, Mycobacterium tuberculosis
NTGGGGGSGFSNSGS

SEQ ID NO: 187224 - protein, 15 aa, Mycobacterium tuberculosis
TGGGGGSGFSNSGSG

SEQ ID NO: 187225 - protein, 15 aa, Mycobacterium tuberculosis
GGGGGSGFSNSGSGM

SEQ ID NO: 187226 - protein, 15 aa, Mycobacterium tuberculosis
GGGGSGFSNSGSGMS

SEQ ID NO: 187227 - protein, 15 aa, Mycobacterium tuberculosis
GGGSGFSNSGSGMSG

SEQ ID NO: 187228 - protein, 15 aa, Mycobacterium tuberculosis
GGSGFSNSGSGMSGV

SEQ ID NO: 187229 - protein, 15 aa, Mycobacterium tuberculosis
GSGFSNSGSGMSGVL

SEQ ID NO: 187230 - protein, 15 aa, Mycobacterium tuberculosis
SGFSNSGSGMSGVLN

SEQ ID NO: 187231 - protein, 15 aa, Mycobacterium tuberculosis
GFSNSGSGMSGVLNA

SEQ ID NO: 187232 - protein, 15 aa, Mycobacterium tuberculosis
FSNSGSGMSGVLNAI

SEQ ID NO: 187233 - protein, 15 aa, Mycobacterium tuberculosis
SNSGSGMSGVLNAIS

SEQ ID NO: 187234 - protein, 15 aa, Mycobacterium tuberculosis
NSGSGMSGVLNAISD

SEQ ID NO: 187235 - protein, 15 aa, Mycobacterium tuberculosis
SGSGMSGVLNAISDP

SEQ ID NO: 187236 - protein, 15 aa, Mycobacterium tuberculosis
GSGMSGVLNAISDPL

SEQ ID NO: 187237 - protein, 15 aa, Mycobacterium tuberculosis
SGMSGVLNAISDPLL

SEQ ID NO: 187238 - protein, 15 aa, Mycobacterium tuberculosis
GMSGVLNAISDPLLG

SEQ ID NO: 187239 - protein, 15 aa, Mycobacterium tuberculosis
MSGVLNAISDPLLGS

SEQ ID NO: 187240 - protein, 15 aa, Mycobacterium tuberculosis
SGVLNAISDPLLGSA

SEQ ID NO: 187241 - protein, 15 aa, Mycobacterium tuberculosis
GVLNAISDPLLGSAS

SEQ ID NO: 187242 - protein, 15 aa, Mycobacterium tuberculosis
VLNAISDPLLGSASG

SEQ ID NO: 187243 - protein, 15 aa, Mycobacterium tuberculosis
LNAISDPLLGSASGF

SEQ ID NO: 187244 - protein, 15 aa, Mycobacterium tuberculosis
NAISDPLLGSASGFA

SEQ ID NO: 187245 - protein, 15 aa, Mycobacterium tuberculosis
AISDPLLGSASGFAN

SEQ ID NO: 187246 - protein, 15 aa, Mycobacterium tuberculosis
ISDPLLGSASGFANF

SEQ ID NO: 187247 - protein, 15 aa, Mycobacterium tuberculosis
SDPLLGSASGFANFG

SEQ ID NO: 187248 - protein, 15 aa, Mycobacterium tuberculosis
DPLLGSASGFANFGT

SEQ ID NO: 187249 - protein, 15 aa, Mycobacterium tuberculosis
PLLGSASGFANFGTQ

SEQ ID NO: 187250 - protein, 15 aa, Mycobacterium tuberculosis
LLGSASGFANFGTQL

SEQ ID NO: 187251 - protein, 15 aa, Mycobacterium tuberculosis
LGSASGFANFGTQLS

SEQ ID NO: 187252 - protein, 15 aa, Mycobacterium tuberculosis
GSASGFANFGTQLSG

SEQ ID NO: 187253 - protein, 15 aa, Mycobacterium tuberculosis
SASGFANFGTQLSGI

SEQ ID NO: 187254 - protein, 15 aa, Mycobacterium tuberculosis
ASGFANFGTQLSGIL

SEQ ID NO: 187255 - protein, 15 aa, Mycobacterium tuberculosis
SGFANFGTQLSGILN

SEQ ID NO: 187256 - protein, 15 aa, Mycobacterium tuberculosis
GFANFGTQLSGILNR

SEQ ID NO: 187257 - protein, 15 aa, Mycobacterium tuberculosis
FANFGTQLSGILNRG

SEQ ID NO: 187258 - protein, 15 aa, Mycobacterium tuberculosis
ANFGTQLSGILNRGA

SEQ ID NO: 187259 - protein, 15 aa, Mycobacterium tuberculosis
NFGTQLSGILNRGAG

SEQ ID NO: 187260 - protein, 15 aa, Mycobacterium tuberculosis
FGTQLSGILNRGAGI

SEQ ID NO: 187261 - protein, 15 aa, Mycobacterium tuberculosis
GTQLSGILNRGAGIS

SEQ ID NO: 187262 - protein, 15 aa, Mycobacterium tuberculosis
TQLSGILNRGAGISG

SEQ ID NO: 187263 - protein, 15 aa, Mycobacterium tuberculosis
QLSGILNRGAGISGV

SEQ ID NO: 187264 - protein, 15 aa, Mycobacterium tuberculosis
LSGILNRGAGISGVY

SEQ ID NO: 187265 - protein, 15 aa, Mycobacterium tuberculosis
SGILNRGAGISGVYN

SEQ ID NO: 187266 - protein, 15 aa, Mycobacterium tuberculosis
GILNRGAGISGVYNT

SEQ ID NO: 187267 - protein, 15 aa, Mycobacterium tuberculosis
ILNRGAGISGVYNTG

SEQ ID NO: 187268 - protein, 15 aa, Mycobacterium tuberculosis
LNRGAGISGVYNTGT

SEQ ID NO: 187269 - protein, 15 aa, Mycobacterium tuberculosis
NRGAGISGVYNTGTL

SEQ ID NO: 187270 - protein, 15 aa, Mycobacterium tuberculosis
RGAGISGVYNTGTLG

SEQ ID NO: 187271 - protein, 15 aa, Mycobacterium tuberculosis
GAGISGVYNTGTLGL

SEQ ID NO: 187272 - protein, 15 aa, Mycobacterium tuberculosis
AGISGVYNTGTLGLV

SEQ ID NO: 187273 - protein, 15 aa, Mycobacterium tuberculosis
GISGVYNTGTLGLVT

SEQ ID NO: 187274 - protein, 15 aa, Mycobacterium tuberculosis
ISGVYNTGTLGLVTS

SEQ ID NO: 187275 - protein, 15 aa, Mycobacterium tuberculosis
SGVYNTGTLGLVTSA

SEQ ID NO: 187276 - protein, 15 aa, Mycobacterium tuberculosis
GVYNTGTLGLVTSAF

SEQ ID NO: 187277 - protein, 15 aa, Mycobacterium tuberculosis
VYNTGTLGLVTSAFV

SEQ ID NO: 187278 - protein, 15 aa, Mycobacterium tuberculosis
YNTGTLGLVTSAFVS

SEQ ID NO: 187279 - protein, 15 aa, Mycobacterium tuberculosis
NTGTLGLVTSAFVSG

SEQ ID NO: 187280 - protein, 15 aa, Mycobacterium tuberculosis
TGTLGLVTSAFVSGF

SEQ ID NO: 187281 - protein, 15 aa, Mycobacterium tuberculosis
GTLGLVTSAFVSGFM

SEQ ID NO: 187282 - protein, 15 aa, Mycobacterium tuberculosis
TLGLVTSAFVSGFMN

SEQ ID NO: 187283 - protein, 15 aa, Mycobacterium tuberculosis
LGLVTSAFVSGFMNV

SEQ ID NO: 187284 - protein, 15 aa, Mycobacterium tuberculosis
GLVTSAFVSGFMNVG

SEQ ID NO: 187285 - protein, 15 aa, Mycobacterium tuberculosis
LVTSAFVSGFMNVGQ

SEQ ID NO: 187286 - protein, 15 aa, Mycobacterium tuberculosis
VTSAFVSGFMNVGQQ

SEQ ID NO: 187287 - protein, 15 aa, Mycobacterium tuberculosis
TSAFVSGFMNVGQQL

SEQ ID NO: 187288 - protein, 15 aa, Mycobacterium tuberculosis
SAFVSGFMNVGQQLS

SEQ ID NO: 187289 - protein, 15 aa, Mycobacterium tuberculosis
AFVSGFMNVGQQLSG

SEQ ID NO: 187290 - protein, 15 aa, Mycobacterium tuberculosis
FVSGFMNVGQQLSGL

SEQ ID NO: 187291 - protein, 15 aa, Mycobacterium tuberculosis
VSGFMNVGQQLSGLL

SEQ ID NO: 187292 - protein, 15 aa, Mycobacterium tuberculosis
SGFMNVGQQLSGLLF

SEQ ID NO: 187293 - protein, 15 aa, Mycobacterium tuberculosis
GFMNVGQQLSGLLFA

SEQ ID NO: 187294 - protein, 15 aa, Mycobacterium tuberculosis
FMNVGQQLSGLLFAG

SEQ ID NO: 187295 - protein, 15 aa, Mycobacterium tuberculosis
MNVGQQLSGLLFAGT

SEQ ID NO: 187296 - protein, 15 aa, Mycobacterium tuberculosis
NVGQQLSGLLFAGTG

SEQ ID NO: 187297 - protein, 15 aa, Mycobacterium tuberculosis
VGQQLSGLLFAGTGP

SEQ ID NO: 187298 - protein, 16 aa, Mycobacterium tuberculosis
MNFPVLPPEINSVLMY

SEQ ID NO: 187299 - protein, 16 aa, Mycobacterium tuberculosis
NFPVLPPEINSVLMYS

SEQ ID NO: 187300 - protein, 16 aa, Mycobacterium tuberculosis
FPVLPPEINSVLMYSG

SEQ ID NO: 187301 - protein, 16 aa, Mycobacterium tuberculosis
PVLPPEINSVLMYSGA

SEQ ID NO: 187302 - protein, 16 aa, Mycobacterium tuberculosis
VLPPEINSVLMYSGAG

SEQ ID NO: 187303 - protein, 16 aa, Mycobacterium tuberculosis
LPPEINSVLMYSGAGS

SEQ ID NO: 187304 - protein, 16 aa, Mycobacterium tuberculosis
PPEINSVLMYSGAGSS

SEQ ID NO: 187305 - protein, 16 aa, Mycobacterium tuberculosis
PEINSVLMYSGAGSSP

SEQ ID NO: 187306 - protein, 16 aa, Mycobacterium tuberculosis
EINSVLMYSGAGSSPL

SEQ ID NO: 187307 - protein, 16 aa, Mycobacterium tuberculosis
INSVLMYSGAGSSPLL

SEQ ID NO: 187308 - protein, 16 aa, Mycobacterium tuberculosis
NSVLMYSGAGSSPLLA

SEQ ID NO: 187309 - protein, 16 aa, Mycobacterium tuberculosis
SVLMYSGAGSSPLLAA

SEQ ID NO: 187310 - protein, 16 aa, Mycobacterium tuberculosis
VLMYSGAGSSPLLAAA

SEQ ID NO: 187311 - protein, 16 aa, Mycobacterium tuberculosis
LMYSGAGSSPLLAAAA

SEQ ID NO: 187312 - protein, 16 aa, Mycobacterium tuberculosis
MYSGAGSSPLLAAAAA

SEQ ID NO: 187313 - protein, 16 aa, Mycobacterium tuberculosis
YSGAGSSPLLAAAAAW

SEQ ID NO: 187314 - protein, 16 aa, Mycobacterium tuberculosis
SGAGSSPLLAAAAAWD

SEQ ID NO: 187315 - protein, 16 aa, Mycobacterium tuberculosis
GAGSSPLLAAAAAWDG

SEQ ID NO: 187316 - protein, 16 aa, Mycobacterium tuberculosis
AGSSPLLAAAAAWDGL

SEQ ID NO: 187317 - protein, 16 aa, Mycobacterium tuberculosis
GSSPLLAAAAAWDGLA

SEQ ID NO: 187318 - protein, 16 aa, Mycobacterium tuberculosis
SSPLLAAAAAWDGLAE

SEQ ID NO: 187319 - protein, 16 aa, Mycobacterium tuberculosis
SPLLAAAAAWDGLAEE

SEQ ID NO: 187320 - protein, 16 aa, Mycobacterium tuberculosis
PLLAAAAAWDGLAEEL

SEQ ID NO: 187321 - protein, 16 aa, Mycobacterium tuberculosis
LLAAAAAWDGLAEELG

SEQ ID NO: 187322 - protein, 16 aa, Mycobacterium tuberculosis
LAAAAAWDGLAEELGS

SEQ ID NO: 187323 - protein, 16 aa, Mycobacterium tuberculosis
AAAAAWDGLAEELGSA

SEQ ID NO: 187324 - protein, 16 aa, Mycobacterium tuberculosis
AAAAWDGLAEELGSAA

SEQ ID NO: 187325 - protein, 16 aa, Mycobacterium tuberculosis
AAAWDGLAEELGSAAV

SEQ ID NO: 187326 - protein, 16 aa, Mycobacterium tuberculosis
AAWDGLAEELGSAAVS

SEQ ID NO: 187327 - protein, 16 aa, Mycobacterium tuberculosis
AWDGLAEELGSAAVSF

SEQ ID NO: 187328 - protein, 16 aa, Mycobacterium tuberculosis
WDGLAEELGSAAVSFG

SEQ ID NO: 187329 - protein, 16 aa, Mycobacterium tuberculosis
DGLAEELGSAAVSFGQ

SEQ ID NO: 187330 - protein, 16 aa, Mycobacterium tuberculosis
GLAEELGSAAVSFGQV

SEQ ID NO: 187331 - protein, 16 aa, Mycobacterium tuberculosis
LAEELGSAAVSFGQVT

SEQ ID NO: 187332 - protein, 16 aa, Mycobacterium tuberculosis
AEELGSAAVSFGQVTS

SEQ ID NO: 187333 - protein, 16 aa, Mycobacterium tuberculosis
EELGSAAVSFGQVTSG

SEQ ID NO: 187334 - protein, 16 aa, Mycobacterium tuberculosis
ELGSAAVSFGQVTSGL

SEQ ID NO: 187335 - protein, 16 aa, Mycobacterium tuberculosis
LGSAAVSFGQVTSGLT

SEQ ID NO: 187336 - protein, 16 aa, Mycobacterium tuberculosis
GSAAVSFGQVTSGLTA

SEQ ID NO: 187337 - protein, 16 aa, Mycobacterium tuberculosis
SAAVSFGQVTSGLTAG

SEQ ID NO: 187338 - protein, 16 aa, Mycobacterium tuberculosis
AAVSFGQVTSGLTAGV

SEQ ID NO: 187339 - protein, 16 aa, Mycobacterium tuberculosis
AVSFGQVTSGLTAGVW

SEQ ID NO: 187340 - protein, 16 aa, Mycobacterium tuberculosis
VSFGQVTSGLTAGVWQ

SEQ ID NO: 187341 - protein, 16 aa, Mycobacterium tuberculosis
SFGQVTSGLTAGVWQG

SEQ ID NO: 187342 - protein, 16 aa, Mycobacterium tuberculosis
FGQVTSGLTAGVWQGA

SEQ ID NO: 187343 - protein, 16 aa, Mycobacterium tuberculosis
GQVTSGLTAGVWQGAA

SEQ ID NO: 187344 - protein, 16 aa, Mycobacterium tuberculosis
QVTSGLTAGVWQGAAA

SEQ ID NO: 187345 - protein, 16 aa, Mycobacterium tuberculosis
VTSGLTAGVWQGAAAA

SEQ ID NO: 187346 - protein, 16 aa, Mycobacterium tuberculosis
TSGLTAGVWQGAAAAA

SEQ ID NO: 187347 - protein, 16 aa, Mycobacterium tuberculosis
SGLTAGVWQGAAAAAM

SEQ ID NO: 187348 - protein, 16 aa, Mycobacterium tuberculosis
GLTAGVWQGAAAAAMA

SEQ ID NO: 187349 - protein, 16 aa, Mycobacterium tuberculosis
LTAGVWQGAAAAAMAA

SEQ ID NO: 187350 - protein, 16 aa, Mycobacterium tuberculosis
TAGVWQGAAAAAMAAA

SEQ ID NO: 187351 - protein, 16 aa, Mycobacterium tuberculosis
AGVWQGAAAAAMAAAA

SEQ ID NO: 187352 - protein, 16 aa, Mycobacterium tuberculosis
GVWQGAAAAAMAAAAA

SEQ ID NO: 187353 - protein, 16 aa, Mycobacterium tuberculosis
VWQGAAAAAMAAAAAP

SEQ ID NO: 187354 - protein, 16 aa, Mycobacterium tuberculosis
WQGAAAAAMAAAAAPY

SEQ ID NO: 187355 - protein, 16 aa, Mycobacterium tuberculosis
QGAAAAAMAAAAAPYA

SEQ ID NO: 187356 - protein, 16 aa, Mycobacterium tuberculosis
GAAAAAMAAAAAPYAG

SEQ ID NO: 187357 - protein, 16 aa, Mycobacterium tuberculosis
AAAAAMAAAAAPYAGW

SEQ ID NO: 187358 - protein, 16 aa, Mycobacterium tuberculosis
AAAAMAAAAAPYAGWL

SEQ ID NO: 187359 - protein, 16 aa, Mycobacterium tuberculosis
AAAMAAAAAPYAGWLG

SEQ ID NO: 187360 - protein, 16 aa, Mycobacterium tuberculosis
AAMAAAAAPYAGWLGS

SEQ ID NO: 187361 - protein, 16 aa, Mycobacterium tuberculosis
AMAAAAAPYAGWLGSV

SEQ ID NO: 187362 - protein, 16 aa, Mycobacterium tuberculosis
MAAAAAPYAGWLGSVA

SEQ ID NO: 187363 - protein, 16 aa, Mycobacterium tuberculosis
AAAAAPYAGWLGSVAA

SEQ ID NO: 187364 - protein, 16 aa, Mycobacterium tuberculosis
AAAAPYAGWLGSVAAQ

SEQ ID NO: 187365 - protein, 16 aa, Mycobacterium tuberculosis
AAAPYAGWLGSVAAQA

SEQ ID NO: 187366 - protein, 16 aa, Mycobacterium tuberculosis
AAPYAGWLGSVAAQAV

SEQ ID NO: 187367 - protein, 16 aa, Mycobacterium tuberculosis
APYAGWLGSVAAQAVA

SEQ ID NO: 187368 - protein, 16 aa, Mycobacterium tuberculosis
PYAGWLGSVAAQAVAV

SEQ ID NO: 187369 - protein, 16 aa, Mycobacterium tuberculosis
YAGWLGSVAAQAVAVA

SEQ ID NO: 187370 - protein, 16 aa, Mycobacterium tuberculosis
AGWLGSVAAQAVAVAG

SEQ ID NO: 187371 - protein, 16 aa, Mycobacterium tuberculosis
GWLGSVAAQAVAVAGQ

SEQ ID NO: 187372 - protein, 16 aa, Mycobacterium tuberculosis
WLGSVAAQAVAVAGQA

SEQ ID NO: 187373 - protein, 16 aa, Mycobacterium tuberculosis
LGSVAAQAVAVAGQAR

SEQ ID NO: 187374 - protein, 16 aa, Mycobacterium tuberculosis
GSVAAQAVAVAGQARA

SEQ ID NO: 187375 - protein, 16 aa, Mycobacterium tuberculosis
SVAAQAVAVAGQARAA

SEQ ID NO: 187376 - protein, 16 aa, Mycobacterium tuberculosis
VAAQAVAVAGQARAAV

SEQ ID NO: 187377 - protein, 16 aa, Mycobacterium tuberculosis
AAQAVAVAGQARAAVA

SEQ ID NO: 187378 - protein, 16 aa, Mycobacterium tuberculosis
AQAVAVAGQARAAVAA

SEQ ID NO: 187379 - protein, 16 aa, Mycobacterium tuberculosis
QAVAVAGQARAAVAAF

SEQ ID NO: 187380 - protein, 16 aa, Mycobacterium tuberculosis
AVAVAGQARAAVAAFE

SEQ ID NO: 187381 - protein, 16 aa, Mycobacterium tuberculosis
VAVAGQARAAVAAFEA

SEQ ID NO: 187382 - protein, 16 aa, Mycobacterium tuberculosis
AVAGQARAAVAAFEAA

SEQ ID NO: 187383 - protein, 16 aa, Mycobacterium tuberculosis
VAGQARAAVAAFEAAL

SEQ ID NO: 187384 - protein, 16 aa, Mycobacterium tuberculosis
AGQARAAVAAFEAALA

SEQ ID NO: 187385 - protein, 16 aa, Mycobacterium tuberculosis
GQARAAVAAFEAALAA

SEQ ID NO: 187386 - protein, 16 aa, Mycobacterium tuberculosis
QARAAVAAFEAALAAT

SEQ ID NO: 187387 - protein, 16 aa, Mycobacterium tuberculosis
ARAAVAAFEAALAATV

SEQ ID NO: 187388 - protein, 16 aa, Mycobacterium tuberculosis
RAAVAAFEAALAATVD

SEQ ID NO: 187389 - protein, 16 aa, Mycobacterium tuberculosis
AAVAAFEAALAATVDP

SEQ ID NO: 187390 - protein, 16 aa, Mycobacterium tuberculosis
AVAAFEAALAATVDPA

SEQ ID NO: 187391 - protein, 16 aa, Mycobacterium tuberculosis
VAAFEAALAATVDPAA

SEQ ID NO: 187392 - protein, 16 aa, Mycobacterium tuberculosis
AAFEAALAATVDPAAV

SEQ ID NO: 187393 - protein, 16 aa, Mycobacterium tuberculosis
AFEAALAATVDPAAVA

SEQ ID NO: 187394 - protein, 16 aa, Mycobacterium tuberculosis
FEAALAATVDPAAVAV

SEQ ID NO: 187395 - protein, 16 aa, Mycobacterium tuberculosis
EAALAATVDPAAVAVN

SEQ ID NO: 187396 - protein, 16 aa, Mycobacterium tuberculosis
AALAATVDPAAVAVNR

SEQ ID NO: 187397 - protein, 16 aa, Mycobacterium tuberculosis
ALAATVDPAAVAVNRM

SEQ ID NO: 187398 - protein, 16 aa, Mycobacterium tuberculosis
LAATVDPAAVAVNRMA

SEQ ID NO: 187399 - protein, 16 aa, Mycobacterium tuberculosis
AATVDPAAVAVNRMAM

SEQ ID NO: 187400 - protein, 16 aa, Mycobacterium tuberculosis
ATVDPAAVAVNRMAMR

SEQ ID NO: 187401 - protein, 16 aa, Mycobacterium tuberculosis
TVDPAAVAVNRMAMRA

SEQ ID NO: 187402 - protein, 16 aa, Mycobacterium tuberculosis
VDPAAVAVNRMAMRAL

SEQ ID NO: 187403 - protein, 16 aa, Mycobacterium tuberculosis
DPAAVAVNRMAMRALA

SEQ ID NO: 187404 - protein, 16 aa, Mycobacterium tuberculosis
PAAVAVNRMAMRALAM

SEQ ID NO: 187405 - protein, 16 aa, Mycobacterium tuberculosis
AAVAVNRMAMRALAMS

SEQ ID NO: 187406 - protein, 16 aa, Mycobacterium tuberculosis
AVAVNRMAMRALAMSN

SEQ ID NO: 187407 - protein, 16 aa, Mycobacterium tuberculosis
VAVNRMAMRALAMSNL

SEQ ID NO: 187408 - protein, 16 aa, Mycobacterium tuberculosis
AVNRMAMRALAMSNLL

SEQ ID NO: 187409 - protein, 16 aa, Mycobacterium tuberculosis
VNRMAMRALAMSNLLG

SEQ ID NO: 187410 - protein, 16 aa, Mycobacterium tuberculosis
NRMAMRALAMSNLLGQ

SEQ ID NO: 187411 - protein, 16 aa, Mycobacterium tuberculosis
RMAMRALAMSNLLGQN

SEQ ID NO: 187412 - protein, 16 aa, Mycobacterium tuberculosis
MAMRALAMSNLLGQNA

SEQ ID NO: 187413 - protein, 16 aa, Mycobacterium tuberculosis
AMRALAMSNLLGQNAA

SEQ ID NO: 187414 - protein, 16 aa, Mycobacterium tuberculosis
MRALAMSNLLGQNAAA

SEQ ID NO: 187415 - protein, 16 aa, Mycobacterium tuberculosis
RALAMSNLLGQNAAAI

SEQ ID NO: 187416 - protein, 16 aa, Mycobacterium tuberculosis
ALAMSNLLGQNAAAIA

SEQ ID NO: 187417 - protein, 16 aa, Mycobacterium tuberculosis
LAMSNLLGQNAAAIAA

SEQ ID NO: 187418 - protein, 16 aa, Mycobacterium tuberculosis
AMSNLLGQNAAAIAAV

SEQ ID NO: 187419 - protein, 16 aa, Mycobacterium tuberculosis
MSNLLGQNAAAIAAVE

SEQ ID NO: 187420 - protein, 16 aa, Mycobacterium tuberculosis
SNLLGQNAAAIAAVEA

SEQ ID NO: 187421 - protein, 16 aa, Mycobacterium tuberculosis
NLLGQNAAAIAAVEAE

SEQ ID NO: 187422 - protein, 16 aa, Mycobacterium tuberculosis
LLGQNAAAIAAVEAEY

SEQ ID NO: 187423 - protein, 16 aa, Mycobacterium tuberculosis
LGQNAAAIAAVEAEYE

SEQ ID NO: 187424 - protein, 16 aa, Mycobacterium tuberculosis
GQNAAAIAAVEAEYEL

SEQ ID NO: 187425 - protein, 16 aa, Mycobacterium tuberculosis
QNAAAIAAVEAEYELM

SEQ ID NO: 187426 - protein, 16 aa, Mycobacterium tuberculosis
NAAAIAAVEAEYELMW

SEQ ID NO: 187427 - protein, 16 aa, Mycobacterium tuberculosis
AAAIAAVEAEYELMWA

SEQ ID NO: 187428 - protein, 16 aa, Mycobacterium tuberculosis
AAIAAVEAEYELMWAA

SEQ ID NO: 187429 - protein, 16 aa, Mycobacterium tuberculosis
AIAAVEAEYELMWAAD

SEQ ID NO: 187430 - protein, 16 aa, Mycobacterium tuberculosis
IAAVEAEYELMWAADV

SEQ ID NO: 187431 - protein, 16 aa, Mycobacterium tuberculosis
AAVEAEYELMWAADVA

SEQ ID NO: 187432 - protein, 16 aa, Mycobacterium tuberculosis
AVEAEYELMWAADVAA

SEQ ID NO: 187433 - protein, 16 aa, Mycobacterium tuberculosis
VEAEYELMWAADVAAM

SEQ ID NO: 187434 - protein, 16 aa, Mycobacterium tuberculosis
EAEYELMWAADVAAMA

SEQ ID NO: 187435 - protein, 16 aa, Mycobacterium tuberculosis
AEYELMWAADVAAMAG

SEQ ID NO: 187436 - protein, 16 aa, Mycobacterium tuberculosis
EYELMWAADVAAMAGY

SEQ ID NO: 187437 - protein, 16 aa, Mycobacterium tuberculosis
YELMWAADVAAMAGYH

SEQ ID NO: 187438 - protein, 16 aa, Mycobacterium tuberculosis
ELMWAADVAAMAGYHS

SEQ ID NO: 187439 - protein, 16 aa, Mycobacterium tuberculosis
LMWAADVAAMAGYHSG

SEQ ID NO: 187440 - protein, 16 aa, Mycobacterium tuberculosis
MWAADVAAMAGYHSGA

SEQ ID NO: 187441 - protein, 16 aa, Mycobacterium tuberculosis
WAADVAAMAGYHSGAS

SEQ ID NO: 187442 - protein, 16 aa, Mycobacterium tuberculosis
AADVAAMAGYHSGASA

SEQ ID NO: 187443 - protein, 16 aa, Mycobacterium tuberculosis
ADVAAMAGYHSGASAA

SEQ ID NO: 187444 - protein, 16 aa, Mycobacterium tuberculosis
DVAAMAGYHSGASAAA

SEQ ID NO: 187445 - protein, 16 aa, Mycobacterium tuberculosis
VAAMAGYHSGASAAAA

SEQ ID NO: 187446 - protein, 16 aa, Mycobacterium tuberculosis
AAMAGYHSGASAAAAA

SEQ ID NO: 187447 - protein, 16 aa, Mycobacterium tuberculosis
AMAGYHSGASAAAAAL

SEQ ID NO: 187448 - protein, 16 aa, Mycobacterium tuberculosis
MAGYHSGASAAAAALP

SEQ ID NO: 187449 - protein, 16 aa, Mycobacterium tuberculosis
AGYHSGASAAAAALPA

SEQ ID NO: 187450 - protein, 16 aa, Mycobacterium tuberculosis
GYHSGASAAAAALPAF

SEQ ID NO: 187451 - protein, 16 aa, Mycobacterium tuberculosis
YHSGASAAAAALPAFS

SEQ ID NO: 187452 - protein, 16 aa, Mycobacterium tuberculosis
HSGASAAAAALPAFSP

SEQ ID NO: 187453 - protein, 16 aa, Mycobacterium tuberculosis
SGASAAAAALPAFSPP

SEQ ID NO: 187454 - protein, 16 aa, Mycobacterium tuberculosis
GASAAAAALPAFSPPA

SEQ ID NO: 187455 - protein, 16 aa, Mycobacterium tuberculosis
ASAAAAALPAFSPPAQ

SEQ ID NO: 187456 - protein, 16 aa, Mycobacterium tuberculosis
SAAAAALPAFSPPAQA

SEQ ID NO: 187457 - protein, 16 aa, Mycobacterium tuberculosis
AAAAALPAFSPPAQAL

SEQ ID NO: 187458 - protein, 16 aa, Mycobacterium tuberculosis
AAAALPAFSPPAQALG

SEQ ID NO: 187459 - protein, 16 aa, Mycobacterium tuberculosis
AAALPAFSPPAQALGG

SEQ ID NO: 187460 - protein, 16 aa, Mycobacterium tuberculosis
AALPAFSPPAQALGGG

SEQ ID NO: 187461 - protein, 16 aa, Mycobacterium tuberculosis
ALPAFSPPAQALGGGV

SEQ ID NO: 187462 - protein, 16 aa, Mycobacterium tuberculosis
LPAFSPPAQALGGGVG

SEQ ID NO: 187463 - protein, 16 aa, Mycobacterium tuberculosis
PAFSPPAQALGGGVGA

SEQ ID NO: 187464 - protein, 16 aa, Mycobacterium tuberculosis
AFSPPAQALGGGVGAF

SEQ ID NO: 187465 - protein, 16 aa, Mycobacterium tuberculosis
FSPPAQALGGGVGAFL

SEQ ID NO: 187466 - protein, 16 aa, Mycobacterium tuberculosis
SPPAQALGGGVGAFLN

SEQ ID NO: 187467 - protein, 16 aa, Mycobacterium tuberculosis
PPAQALGGGVGAFLNA

SEQ ID NO: 187468 - protein, 16 aa, Mycobacterium tuberculosis
PAQALGGGVGAFLNAL

SEQ ID NO: 187469 - protein, 16 aa, Mycobacterium tuberculosis
AQALGGGVGAFLNALF

SEQ ID NO: 187470 - protein, 16 aa, Mycobacterium tuberculosis
QALGGGVGAFLNALFA

SEQ ID NO: 187471 - protein, 16 aa, Mycobacterium tuberculosis
ALGGGVGAFLNALFAG

SEQ ID NO: 187472 - protein, 16 aa, Mycobacterium tuberculosis
LGGGVGAFLNALFAGP

SEQ ID NO: 187473 - protein, 16 aa, Mycobacterium tuberculosis
GGGVGAFLNALFAGPA

SEQ ID NO: 187474 - protein, 16 aa, Mycobacterium tuberculosis
GGVGAFLNALFAGPAK

SEQ ID NO: 187475 - protein, 16 aa, Mycobacterium tuberculosis
GVGAFLNALFAGPAKM

SEQ ID NO: 187476 - protein, 16 aa, Mycobacterium tuberculosis
VGAFLNALFAGPAKML

SEQ ID NO: 187477 - protein, 16 aa, Mycobacterium tuberculosis
GAFLNALFAGPAKMLR

SEQ ID NO: 187478 - protein, 16 aa, Mycobacterium tuberculosis
AFLNALFAGPAKMLRL

SEQ ID NO: 187479 - protein, 16 aa, Mycobacterium tuberculosis
FLNALFAGPAKMLRLN

SEQ ID NO: 187480 - protein, 16 aa, Mycobacterium tuberculosis
LNALFAGPAKMLRLNA

SEQ ID NO: 187481 - protein, 16 aa, Mycobacterium tuberculosis
NALFAGPAKMLRLNAG

SEQ ID NO: 187482 - protein, 16 aa, Mycobacterium tuberculosis
ALFAGPAKMLRLNAGL

SEQ ID NO: 187483 - protein, 16 aa, Mycobacterium tuberculosis
LFAGPAKMLRLNAGLG

SEQ ID NO: 187484 - protein, 16 aa, Mycobacterium tuberculosis
FAGPAKMLRLNAGLGN

SEQ ID NO: 187485 - protein, 16 aa, Mycobacterium tuberculosis
AGPAKMLRLNAGLGNV

SEQ ID NO: 187486 - protein, 16 aa, Mycobacterium tuberculosis
GPAKMLRLNAGLGNVG

SEQ ID NO: 187487 - protein, 16 aa, Mycobacterium tuberculosis
PAKMLRLNAGLGNVGN

SEQ ID NO: 187488 - protein, 16 aa, Mycobacterium tuberculosis
AKMLRLNAGLGNVGNY

SEQ ID NO: 187489 - protein, 16 aa, Mycobacterium tuberculosis
KMLRLNAGLGNVGNYN

SEQ ID NO: 187490 - protein, 16 aa, Mycobacterium tuberculosis
MLRLNAGLGNVGNYNV

SEQ ID NO: 187491 - protein, 16 aa, Mycobacterium tuberculosis
LRLNAGLGNVGNYNVG

SEQ ID NO: 187492 - protein, 16 aa, Mycobacterium tuberculosis
RLNAGLGNVGNYNVGL

SEQ ID NO: 187493 - protein, 16 aa, Mycobacterium tuberculosis
LNAGLGNVGNYNVGLG

SEQ ID NO: 187494 - protein, 16 aa, Mycobacterium tuberculosis
NAGLGNVGNYNVGLGN

SEQ ID NO: 187495 - protein, 16 aa, Mycobacterium tuberculosis
AGLGNVGNYNVGLGNV

SEQ ID NO: 187496 - protein, 16 aa, Mycobacterium tuberculosis
GLGNVGNYNVGLGNVG

SEQ ID NO: 187497 - protein, 16 aa, Mycobacterium tuberculosis
LGNVGNYNVGLGNVGI

SEQ ID NO: 187498 - protein, 16 aa, Mycobacterium tuberculosis
GNVGNYNVGLGNVGIF

SEQ ID NO: 187499 - protein, 16 aa, Mycobacterium tuberculosis
NVGNYNVGLGNVGIFN

SEQ ID NO: 187500 - protein, 16 aa, Mycobacterium tuberculosis
VGNYNVGLGNVGIFNL

SEQ ID NO: 187501 - protein, 16 aa, Mycobacterium tuberculosis
GNYNVGLGNVGIFNLG

SEQ ID NO: 187502 - protein, 16 aa, Mycobacterium tuberculosis
NYNVGLGNVGIFNLGA

SEQ ID NO: 187503 - protein, 16 aa, Mycobacterium tuberculosis
YNVGLGNVGIFNLGAA

SEQ ID NO: 187504 - protein, 16 aa, Mycobacterium tuberculosis
NVGLGNVGIFNLGAAN

SEQ ID NO: 187505 - protein, 16 aa, Mycobacterium tuberculosis
VGLGNVGIFNLGAANV

SEQ ID NO: 187506 - protein, 16 aa, Mycobacterium tuberculosis
GLGNVGIFNLGAANVG

SEQ ID NO: 187507 - protein, 16 aa, Mycobacterium tuberculosis
LGNVGIFNLGAANVGA

SEQ ID NO: 187508 - protein, 16 aa, Mycobacterium tuberculosis
GNVGIFNLGAANVGAQ

SEQ ID NO: 187509 - protein, 16 aa, Mycobacterium tuberculosis
NVGIFNLGAANVGAQN

SEQ ID NO: 187510 - protein, 16 aa, Mycobacterium tuberculosis
VGIFNLGAANVGAQNL

SEQ ID NO: 187511 - protein, 16 aa, Mycobacterium tuberculosis
GIFNLGAANVGAQNLG

SEQ ID NO: 187512 - protein, 16 aa, Mycobacterium tuberculosis
IFNLGAANVGAQNLGA

SEQ ID NO: 187513 - protein, 16 aa, Mycobacterium tuberculosis
FNLGAANVGAQNLGAA

SEQ ID NO: 187514 - protein, 16 aa, Mycobacterium tuberculosis
NLGAANVGAQNLGAAN

SEQ ID NO: 187515 - protein, 16 aa, Mycobacterium tuberculosis
LGAANVGAQNLGAANA

SEQ ID NO: 187516 - protein, 16 aa, Mycobacterium tuberculosis
GAANVGAQNLGAANAG

SEQ ID NO: 187517 - protein, 16 aa, Mycobacterium tuberculosis
AANVGAQNLGAANAGS

SEQ ID NO: 187518 - protein, 16 aa, Mycobacterium tuberculosis
ANVGAQNLGAANAGSG

SEQ ID NO: 187519 - protein, 16 aa, Mycobacterium tuberculosis
NVGAQNLGAANAGSGN

SEQ ID NO: 187520 - protein, 16 aa, Mycobacterium tuberculosis
VGAQNLGAANAGSGNF

SEQ ID NO: 187521 - protein, 16 aa, Mycobacterium tuberculosis
GAQNLGAANAGSGNFG

SEQ ID NO: 187522 - protein, 16 aa, Mycobacterium tuberculosis
AQNLGAANAGSGNFGF

SEQ ID NO: 187523 - protein, 16 aa, Mycobacterium tuberculosis
QNLGAANAGSGNFGFG

SEQ ID NO: 187524 - protein, 16 aa, Mycobacterium tuberculosis
NLGAANAGSGNFGFGN

SEQ ID NO: 187525 - protein, 16 aa, Mycobacterium tuberculosis
LGAANAGSGNFGFGNI

SEQ ID NO: 187526 - protein, 16 aa, Mycobacterium tuberculosis
GAANAGSGNFGFGNIG

SEQ ID NO: 187527 - protein, 16 aa, Mycobacterium tuberculosis
AANAGSGNFGFGNIGN

SEQ ID NO: 187528 - protein, 16 aa, Mycobacterium tuberculosis
ANAGSGNFGFGNIGNA

SEQ ID NO: 187529 - protein, 16 aa, Mycobacterium tuberculosis
NAGSGNFGFGNIGNAN

SEQ ID NO: 187530 - protein, 16 aa, Mycobacterium tuberculosis
AGSGNFGFGNIGNANF

SEQ ID NO: 187531 - protein, 16 aa, Mycobacterium tuberculosis
GSGNFGFGNIGNANFG

SEQ ID NO: 187532 - protein, 16 aa, Mycobacterium tuberculosis
SGNFGFGNIGNANFGF

SEQ ID NO: 187533 - protein, 16 aa, Mycobacterium tuberculosis
GNFGFGNIGNANFGFG

SEQ ID NO: 187534 - protein, 16 aa, Mycobacterium tuberculosis
NFGFGNIGNANFGFGN

SEQ ID NO: 187535 - protein, 16 aa, Mycobacterium tuberculosis
FGFGNIGNANFGFGNS

SEQ ID NO: 187536 - protein, 16 aa, Mycobacterium tuberculosis
GFGNIGNANFGFGNSG

SEQ ID NO: 187537 - protein, 16 aa, Mycobacterium tuberculosis
FGNIGNANFGFGNSGL

SEQ ID NO: 187538 - protein, 16 aa, Mycobacterium tuberculosis
GNIGNANFGFGNSGLG

SEQ ID NO: 187539 - protein, 16 aa, Mycobacterium tuberculosis
NIGNANFGFGNSGLGL

SEQ ID NO: 187540 - protein, 16 aa, Mycobacterium tuberculosis
IGNANFGFGNSGLGLP

SEQ ID NO: 187541 - protein, 16 aa, Mycobacterium tuberculosis
GNANFGFGNSGLGLPP

SEQ ID NO: 187542 - protein, 16 aa, Mycobacterium tuberculosis
NANFGFGNSGLGLPPG

SEQ ID NO: 187543 - protein, 16 aa, Mycobacterium tuberculosis
ANFGFGNSGLGLPPGM

SEQ ID NO: 187544 - protein, 16 aa, Mycobacterium tuberculosis
NFGFGNSGLGLPPGMG

SEQ ID NO: 187545 - protein, 16 aa, Mycobacterium tuberculosis
FGFGNSGLGLPPGMGN

SEQ ID NO: 187546 - protein, 16 aa, Mycobacterium tuberculosis
GFGNSGLGLPPGMGNI

SEQ ID NO: 187547 - protein, 16 aa, Mycobacterium tuberculosis
FGNSGLGLPPGMGNIG

SEQ ID NO: 187548 - protein, 16 aa, Mycobacterium tuberculosis
GNSGLGLPPGMGNIGL

SEQ ID NO: 187549 - protein, 16 aa, Mycobacterium tuberculosis
NSGLGLPPGMGNIGLG

SEQ ID NO: 187550 - protein, 16 aa, Mycobacterium tuberculosis
SGLGLPPGMGNIGLGN

SEQ ID NO: 187551 - protein, 16 aa, Mycobacterium tuberculosis
GLGLPPGMGNIGLGNA

SEQ ID NO: 187552 - protein, 16 aa, Mycobacterium tuberculosis
LGLPPGMGNIGLGNAG

SEQ ID NO: 187553 - protein, 16 aa, Mycobacterium tuberculosis
GLPPGMGNIGLGNAGS

SEQ ID NO: 187554 - protein, 16 aa, Mycobacterium tuberculosis
LPPGMGNIGLGNAGSS

SEQ ID NO: 187555 - protein, 16 aa, Mycobacterium tuberculosis
PPGMGNIGLGNAGSSN

SEQ ID NO: 187556 - protein, 16 aa, Mycobacterium tuberculosis
PGMGNIGLGNAGSSNY

SEQ ID NO: 187557 - protein, 16 aa, Mycobacterium tuberculosis
GMGNIGLGNAGSSNYG

SEQ ID NO: 187558 - protein, 16 aa, Mycobacterium tuberculosis
MGNIGLGNAGSSNYGL

SEQ ID NO: 187559 - protein, 16 aa, Mycobacterium tuberculosis
GNIGLGNAGSSNYGLA

SEQ ID NO: 187560 - protein, 16 aa, Mycobacterium tuberculosis
NIGLGNAGSSNYGLAN

SEQ ID NO: 187561 - protein, 16 aa, Mycobacterium tuberculosis
IGLGNAGSSNYGLANL

SEQ ID NO: 187562 - protein, 16 aa, Mycobacterium tuberculosis
GLGNAGSSNYGLANLG

SEQ ID NO: 187563 - protein, 16 aa, Mycobacterium tuberculosis
LGNAGSSNYGLANLGV

SEQ ID NO: 187564 - protein, 16 aa, Mycobacterium tuberculosis
GNAGSSNYGLANLGVG

SEQ ID NO: 187565 - protein, 16 aa, Mycobacterium tuberculosis
NAGSSNYGLANLGVGN

SEQ ID NO: 187566 - protein, 16 aa, Mycobacterium tuberculosis
AGSSNYGLANLGVGNI

SEQ ID NO: 187567 - protein, 16 aa, Mycobacterium tuberculosis
GSSNYGLANLGVGNIG

SEQ ID NO: 187568 - protein, 16 aa, Mycobacterium tuberculosis
SSNYGLANLGVGNIGF

SEQ ID NO: 187569 - protein, 16 aa, Mycobacterium tuberculosis
SNYGLANLGVGNIGFA

SEQ ID NO: 187570 - protein, 16 aa, Mycobacterium tuberculosis
NYGLANLGVGNIGFAN

SEQ ID NO: 187571 - protein, 16 aa, Mycobacterium tuberculosis
YGLANLGVGNIGFANT

SEQ ID NO: 187572 - protein, 16 aa, Mycobacterium tuberculosis
GLANLGVGNIGFANTG

SEQ ID NO: 187573 - protein, 16 aa, Mycobacterium tuberculosis
LANLGVGNIGFANTGS

SEQ ID NO: 187574 - protein, 16 aa, Mycobacterium tuberculosis
ANLGVGNIGFANTGSN

SEQ ID NO: 187575 - protein, 16 aa, Mycobacterium tuberculosis
NLGVGNIGFANTGSNN

SEQ ID NO: 187576 - protein, 16 aa, Mycobacterium tuberculosis
LGVGNIGFANTGSNNI

SEQ ID NO: 187577 - protein, 16 aa, Mycobacterium tuberculosis
GVGNIGFANTGSNNIG

SEQ ID NO: 187578 - protein, 16 aa, Mycobacterium tuberculosis
VGNIGFANTGSNNIGI

SEQ ID NO: 187579 - protein, 16 aa, Mycobacterium tuberculosis
GNIGFANTGSNNIGIG

SEQ ID NO: 187580 - protein, 16 aa, Mycobacterium tuberculosis
NIGFANTGSNNIGIGL

SEQ ID NO: 187581 - protein, 16 aa, Mycobacterium tuberculosis
IGFANTGSNNIGIGLT

SEQ ID NO: 187582 - protein, 16 aa, Mycobacterium tuberculosis
GFANTGSNNIGIGLTG

SEQ ID NO: 187583 - protein, 16 aa, Mycobacterium tuberculosis
FANTGSNNIGIGLTGD

SEQ ID NO: 187584 - protein, 16 aa, Mycobacterium tuberculosis
ANTGSNNIGIGLTGDN

SEQ ID NO: 187585 - protein, 16 aa, Mycobacterium tuberculosis
NTGSNNIGIGLTGDNL

SEQ ID NO: 187586 - protein, 16 aa, Mycobacterium tuberculosis
TGSNNIGIGLTGDNLT

SEQ ID NO: 187587 - protein, 16 aa, Mycobacterium tuberculosis
GSNNIGIGLTGDNLTG

SEQ ID NO: 187588 - protein, 16 aa, Mycobacterium tuberculosis
SNNIGIGLTGDNLTGI

SEQ ID NO: 187589 - protein, 16 aa, Mycobacterium tuberculosis
NNIGIGLTGDNLTGIG

SEQ ID NO: 187590 - protein, 16 aa, Mycobacterium tuberculosis
NIGIGLTGDNLTGIGG

SEQ ID NO: 187591 - protein, 16 aa, Mycobacterium tuberculosis
IGIGLTGDNLTGIGGL

SEQ ID NO: 187592 - protein, 16 aa, Mycobacterium tuberculosis
GIGLTGDNLTGIGGLN

SEQ ID NO: 187593 - protein, 16 aa, Mycobacterium tuberculosis
IGLTGDNLTGIGGLNS

SEQ ID NO: 187594 - protein, 16 aa, Mycobacterium tuberculosis
GLTGDNLTGIGGLNSG

SEQ ID NO: 187595 - protein, 16 aa, Mycobacterium tuberculosis
LTGDNLTGIGGLNSGT

SEQ ID NO: 187596 - protein, 16 aa, Mycobacterium tuberculosis
TGDNLTGIGGLNSGTG

SEQ ID NO: 187597 - protein, 16 aa, Mycobacterium tuberculosis
GDNLTGIGGLNSGTGN

SEQ ID NO: 187598 - protein, 16 aa, Mycobacterium tuberculosis
DNLTGIGGLNSGTGNL

SEQ ID NO: 187599 - protein, 16 aa, Mycobacterium tuberculosis
NLTGIGGLNSGTGNLG

SEQ ID NO: 187600 - protein, 16 aa, Mycobacterium tuberculosis
LTGIGGLNSGTGNLGL

SEQ ID NO: 187601 - protein, 16 aa, Mycobacterium tuberculosis
TGIGGLNSGTGNLGLF

SEQ ID NO: 187602 - protein, 16 aa, Mycobacterium tuberculosis
GIGGLNSGTGNLGLFN

SEQ ID NO: 187603 - protein, 16 aa, Mycobacterium tuberculosis
IGGLNSGTGNLGLFNS

SEQ ID NO: 187604 - protein, 16 aa, Mycobacterium tuberculosis
GGLNSGTGNLGLFNSG

SEQ ID NO: 187605 - protein, 16 aa, Mycobacterium tuberculosis
GLNSGTGNLGLFNSGT

SEQ ID NO: 187606 - protein, 16 aa, Mycobacterium tuberculosis
LNSGTGNLGLFNSGTG

SEQ ID NO: 187607 - protein, 16 aa, Mycobacterium tuberculosis
NSGTGNLGLFNSGTGN

SEQ ID NO: 187608 - protein, 16 aa, Mycobacterium tuberculosis
SGTGNLGLFNSGTGNI

SEQ ID NO: 187609 - protein, 16 aa, Mycobacterium tuberculosis
GTGNLGLFNSGTGNIG

SEQ ID NO: 187610 - protein, 16 aa, Mycobacterium tuberculosis
TGNLGLFNSGTGNIGF

SEQ ID NO: 187611 - protein, 16 aa, Mycobacterium tuberculosis
GNLGLFNSGTGNIGFF

SEQ ID NO: 187612 - protein, 16 aa, Mycobacterium tuberculosis
NLGLFNSGTGNIGFFN

SEQ ID NO: 187613 - protein, 16 aa, Mycobacterium tuberculosis
LGLFNSGTGNIGFFNS

SEQ ID NO: 187614 - protein, 16 aa, Mycobacterium tuberculosis
GLFNSGTGNIGFFNSG

SEQ ID NO: 187615 - protein, 16 aa, Mycobacterium tuberculosis
LFNSGTGNIGFFNSGT

SEQ ID NO: 187616 - protein, 16 aa, Mycobacterium tuberculosis
FNSGTGNIGFFNSGTG

SEQ ID NO: 187617 - protein, 16 aa, Mycobacterium tuberculosis
NSGTGNIGFFNSGTGN

SEQ ID NO: 187618 - protein, 16 aa, Mycobacterium tuberculosis
SGTGNIGFFNSGTGNF

SEQ ID NO: 187619 - protein, 16 aa, Mycobacterium tuberculosis
GTGNIGFFNSGTGNFG

SEQ ID NO: 187620 - protein, 16 aa, Mycobacterium tuberculosis
TGNIGFFNSGTGNFGV

SEQ ID NO: 187621 - protein, 16 aa, Mycobacterium tuberculosis
GNIGFFNSGTGNFGVF

SEQ ID NO: 187622 - protein, 16 aa, Mycobacterium tuberculosis
NIGFFNSGTGNFGVFN

SEQ ID NO: 187623 - protein, 16 aa, Mycobacterium tuberculosis
IGFFNSGTGNFGVFNS

SEQ ID NO: 187624 - protein, 16 aa, Mycobacterium tuberculosis
GFFNSGTGNFGVFNSG

SEQ ID NO: 187625 - protein, 16 aa, Mycobacterium tuberculosis
FFNSGTGNFGVFNSGS

SEQ ID NO: 187626 - protein, 16 aa, Mycobacterium tuberculosis
FNSGTGNFGVFNSGSY

SEQ ID NO: 187627 - protein, 16 aa, Mycobacterium tuberculosis
NSGTGNFGVFNSGSYN

SEQ ID NO: 187628 - protein, 16 aa, Mycobacterium tuberculosis
SGTGNFGVFNSGSYNT

SEQ ID NO: 187629 - protein, 16 aa, Mycobacterium tuberculosis
GTGNFGVFNSGSYNTG

SEQ ID NO: 187630 - protein, 16 aa, Mycobacterium tuberculosis
TGNFGVFNSGSYNTGV

SEQ ID NO: 187631 - protein, 16 aa, Mycobacterium tuberculosis
GNFGVFNSGSYNTGVG

SEQ ID NO: 187632 - protein, 16 aa, Mycobacterium tuberculosis
NFGVFNSGSYNTGVGN

SEQ ID NO: 187633 - protein, 16 aa, Mycobacterium tuberculosis
FGVFNSGSYNTGVGNA

SEQ ID NO: 187634 - protein, 16 aa, Mycobacterium tuberculosis
GVFNSGSYNTGVGNAG

SEQ ID NO: 187635 - protein, 16 aa, Mycobacterium tuberculosis
VFNSGSYNTGVGNAGT

SEQ ID NO: 187636 - protein, 16 aa, Mycobacterium tuberculosis
FNSGSYNTGVGNAGTA

SEQ ID NO: 187637 - protein, 16 aa, Mycobacterium tuberculosis
NSGSYNTGVGNAGTAS

SEQ ID NO: 187638 - protein, 16 aa, Mycobacterium tuberculosis
SGSYNTGVGNAGTAST

SEQ ID NO: 187639 - protein, 16 aa, Mycobacterium tuberculosis
GSYNTGVGNAGTASTG

SEQ ID NO: 187640 - protein, 16 aa, Mycobacterium tuberculosis
SYNTGVGNAGTASTGL

SEQ ID NO: 187641 - protein, 16 aa, Mycobacterium tuberculosis
YNTGVGNAGTASTGLF

SEQ ID NO: 187642 - protein, 16 aa, Mycobacterium tuberculosis
NTGVGNAGTASTGLFN

SEQ ID NO: 187643 - protein, 16 aa, Mycobacterium tuberculosis
TGVGNAGTASTGLFNV

SEQ ID NO: 187644 - protein, 16 aa, Mycobacterium tuberculosis
GVGNAGTASTGLFNVG

SEQ ID NO: 187645 - protein, 16 aa, Mycobacterium tuberculosis
VGNAGTASTGLFNVGG

SEQ ID NO: 187646 - protein, 16 aa, Mycobacterium tuberculosis
GNAGTASTGLFNVGGF

SEQ ID NO: 187647 - protein, 16 aa, Mycobacterium tuberculosis
NAGTASTGLFNVGGFN

SEQ ID NO: 187648 - protein, 16 aa, Mycobacterium tuberculosis
AGTASTGLFNVGGFNT

SEQ ID NO: 187649 - protein, 16 aa, Mycobacterium tuberculosis
GTASTGLFNVGGFNTG

SEQ ID NO: 187650 - protein, 16 aa, Mycobacterium tuberculosis
TASTGLFNVGGFNTGV

SEQ ID NO: 187651 - protein, 16 aa, Mycobacterium tuberculosis
ASTGLFNVGGFNTGVA

SEQ ID NO: 187652 - protein, 16 aa, Mycobacterium tuberculosis
STGLFNVGGFNTGVAN

SEQ ID NO: 187653 - protein, 16 aa, Mycobacterium tuberculosis
TGLFNVGGFNTGVANV

SEQ ID NO: 187654 - protein, 16 aa, Mycobacterium tuberculosis
GLFNVGGFNTGVANVG

SEQ ID NO: 187655 - protein, 16 aa, Mycobacterium tuberculosis
LFNVGGFNTGVANVGS

SEQ ID NO: 187656 - protein, 16 aa, Mycobacterium tuberculosis
FNVGGFNTGVANVGSY

SEQ ID NO: 187657 - protein, 16 aa, Mycobacterium tuberculosis
NVGGFNTGVANVGSYN

SEQ ID NO: 187658 - protein, 16 aa, Mycobacterium tuberculosis
VGGFNTGVANVGSYNT

SEQ ID NO: 187659 - protein, 16 aa, Mycobacterium tuberculosis
GGFNTGVANVGSYNTG

SEQ ID NO: 187660 - protein, 16 aa, Mycobacterium tuberculosis
GFNTGVANVGSYNTGS

SEQ ID NO: 187661 - protein, 16 aa, Mycobacterium tuberculosis
FNTGVANVGSYNTGSF

SEQ ID NO: 187662 - protein, 16 aa, Mycobacterium tuberculosis
NTGVANVGSYNTGSFN

SEQ ID NO: 187663 - protein, 16 aa, Mycobacterium tuberculosis
TGVANVGSYNTGSFNA

SEQ ID NO: 187664 - protein, 16 aa, Mycobacterium tuberculosis
GVANVGSYNTGSFNAG

SEQ ID NO: 187665 - protein, 16 aa, Mycobacterium tuberculosis
VANVGSYNTGSFNAGN

SEQ ID NO: 187666 - protein, 16 aa, Mycobacterium tuberculosis
ANVGSYNTGSFNAGNT

SEQ ID NO: 187667 - protein, 16 aa, Mycobacterium tuberculosis
NVGSYNTGSFNAGNTN

SEQ ID NO: 187668 - protein, 16 aa, Mycobacterium tuberculosis
VGSYNTGSFNAGNTNT

SEQ ID NO: 187669 - protein, 16 aa, Mycobacterium tuberculosis
GSYNTGSFNAGNTNTG

SEQ ID NO: 187670 - protein, 16 aa, Mycobacterium tuberculosis
SYNTGSFNAGNTNTGG

SEQ ID NO: 187671 - protein, 16 aa, Mycobacterium tuberculosis
YNTGSFNAGNTNTGGF

SEQ ID NO: 187672 - protein, 16 aa, Mycobacterium tuberculosis
NTGSFNAGNTNTGGFN

SEQ ID NO: 187673 - protein, 16 aa, Mycobacterium tuberculosis
TGSFNAGNTNTGGFNP

SEQ ID NO: 187674 - protein, 16 aa, Mycobacterium tuberculosis
GSFNAGNTNTGGFNPG

SEQ ID NO: 187675 - protein, 16 aa, Mycobacterium tuberculosis
SFNAGNTNTGGFNPGN

SEQ ID NO: 187676 - protein, 16 aa, Mycobacterium tuberculosis
FNAGNTNTGGFNPGNV

SEQ ID NO: 187677 - protein, 16 aa, Mycobacterium tuberculosis
NAGNTNTGGFNPGNVN

SEQ ID NO: 187678 - protein, 16 aa, Mycobacterium tuberculosis
AGNTNTGGFNPGNVNT

SEQ ID NO: 187679 - protein, 16 aa, Mycobacterium tuberculosis
GNTNTGGFNPGNVNTG

SEQ ID NO: 187680 - protein, 16 aa, Mycobacterium tuberculosis
NTNTGGFNPGNVNTGW

SEQ ID NO: 187681 - protein, 16 aa, Mycobacterium tuberculosis
TNTGGFNPGNVNTGWL

SEQ ID NO: 187682 - protein, 16 aa, Mycobacterium tuberculosis
NTGGFNPGNVNTGWLN

SEQ ID NO: 187683 - protein, 16 aa, Mycobacterium tuberculosis
TGGFNPGNVNTGWLNT

SEQ ID NO: 187684 - protein, 16 aa, Mycobacterium tuberculosis
GGFNPGNVNTGWLNTG

SEQ ID NO: 187685 - protein, 16 aa, Mycobacterium tuberculosis
GFNPGNVNTGWLNTGN

SEQ ID NO: 187686 - protein, 16 aa, Mycobacterium tuberculosis
FNPGNVNTGWLNTGNT

SEQ ID NO: 187687 - protein, 16 aa, Mycobacterium tuberculosis
NPGNVNTGWLNTGNTN

SEQ ID NO: 187688 - protein, 16 aa, Mycobacterium tuberculosis
PGNVNTGWLNTGNTNT

SEQ ID NO: 187689 - protein, 16 aa, Mycobacterium tuberculosis
GNVNTGWLNTGNTNTG

SEQ ID NO: 187690 - protein, 16 aa, Mycobacterium tuberculosis
NVNTGWLNTGNTNTGI

SEQ ID NO: 187691 - protein, 16 aa, Mycobacterium tuberculosis
VNTGWLNTGNTNTGIA

SEQ ID NO: 187692 - protein, 16 aa, Mycobacterium tuberculosis
NTGWLNTGNTNTGIAN

SEQ ID NO: 187693 - protein, 16 aa, Mycobacterium tuberculosis
TGWLNTGNTNTGIANS

SEQ ID NO: 187694 - protein, 16 aa, Mycobacterium tuberculosis
GWLNTGNTNTGIANSG

SEQ ID NO: 187695 - protein, 16 aa, Mycobacterium tuberculosis
WLNTGNTNTGIANSGN

SEQ ID NO: 187696 - protein, 16 aa, Mycobacterium tuberculosis
LNTGNTNTGIANSGNV

SEQ ID NO: 187697 - protein, 16 aa, Mycobacterium tuberculosis
NTGNTNTGIANSGNVN

SEQ ID NO: 187698 - protein, 16 aa, Mycobacterium tuberculosis
TGNTNTGIANSGNVNT

SEQ ID NO: 187699 - protein, 16 aa, Mycobacterium tuberculosis
GNTNTGIANSGNVNTG

SEQ ID NO: 187700 - protein, 16 aa, Mycobacterium tuberculosis
NTNTGIANSGNVNTGA

SEQ ID NO: 187701 - protein, 16 aa, Mycobacterium tuberculosis
TNTGIANSGNVNTGAF

SEQ ID NO: 187702 - protein, 16 aa, Mycobacterium tuberculosis
NTGIANSGNVNTGAFI

SEQ ID NO: 187703 - protein, 16 aa, Mycobacterium tuberculosis
TGIANSGNVNTGAFIS

SEQ ID NO: 187704 - protein, 16 aa, Mycobacterium tuberculosis
GIANSGNVNTGAFISG

SEQ ID NO: 187705 - protein, 16 aa, Mycobacterium tuberculosis
IANSGNVNTGAFISGN

SEQ ID NO: 187706 - protein, 16 aa, Mycobacterium tuberculosis
ANSGNVNTGAFISGNF

SEQ ID NO: 187707 - protein, 16 aa, Mycobacterium tuberculosis
NSGNVNTGAFISGNFS

SEQ ID NO: 187708 - protein, 16 aa, Mycobacterium tuberculosis
SGNVNTGAFISGNFSN

SEQ ID NO: 187709 - protein, 16 aa, Mycobacterium tuberculosis
GNVNTGAFISGNFSNG

SEQ ID NO: 187710 - protein, 16 aa, Mycobacterium tuberculosis
NVNTGAFISGNFSNGV

SEQ ID NO: 187711 - protein, 16 aa, Mycobacterium tuberculosis
VNTGAFISGNFSNGVL

SEQ ID NO: 187712 - protein, 16 aa, Mycobacterium tuberculosis
NTGAFISGNFSNGVLW

SEQ ID NO: 187713 - protein, 16 aa, Mycobacterium tuberculosis
TGAFISGNFSNGVLWR

SEQ ID NO: 187714 - protein, 16 aa, Mycobacterium tuberculosis
GAFISGNFSNGVLWRG

SEQ ID NO: 187715 - protein, 16 aa, Mycobacterium tuberculosis
AFISGNFSNGVLWRGD

SEQ ID NO: 187716 - protein, 16 aa, Mycobacterium tuberculosis
FISGNFSNGVLWRGDY

SEQ ID NO: 187717 - protein, 16 aa, Mycobacterium tuberculosis
ISGNFSNGVLWRGDYE

SEQ ID NO: 187718 - protein, 16 aa, Mycobacterium tuberculosis
SGNFSNGVLWRGDYEG

SEQ ID NO: 187719 - protein, 16 aa, Mycobacterium tuberculosis
GNFSNGVLWRGDYEGL

SEQ ID NO: 187720 - protein, 16 aa, Mycobacterium tuberculosis
NFSNGVLWRGDYEGLW

SEQ ID NO: 187721 - protein, 16 aa, Mycobacterium tuberculosis
FSNGVLWRGDYEGLWG

SEQ ID NO: 187722 - protein, 16 aa, Mycobacterium tuberculosis
SNGVLWRGDYEGLWGL

SEQ ID NO: 187723 - protein, 16 aa, Mycobacterium tuberculosis
NGVLWRGDYEGLWGLS

SEQ ID NO: 187724 - protein, 16 aa, Mycobacterium tuberculosis
GVLWRGDYEGLWGLSG

SEQ ID NO: 187725 - protein, 16 aa, Mycobacterium tuberculosis
VLWRGDYEGLWGLSGG

SEQ ID NO: 187726 - protein, 16 aa, Mycobacterium tuberculosis
LWRGDYEGLWGLSGGS

SEQ ID NO: 187727 - protein, 16 aa, Mycobacterium tuberculosis
WRGDYEGLWGLSGGST

SEQ ID NO: 187728 - protein, 16 aa, Mycobacterium tuberculosis
RGDYEGLWGLSGGSTI

SEQ ID NO: 187729 - protein, 16 aa, Mycobacterium tuberculosis
GDYEGLWGLSGGSTIP

SEQ ID NO: 187730 - protein, 16 aa, Mycobacterium tuberculosis
DYEGLWGLSGGSTIPA

SEQ ID NO: 187731 - protein, 16 aa, Mycobacterium tuberculosis
YEGLWGLSGGSTIPAI

SEQ ID NO: 187732 - protein, 16 aa, Mycobacterium tuberculosis
EGLWGLSGGSTIPAIP

SEQ ID NO: 187733 - protein, 16 aa, Mycobacterium tuberculosis
GLWGLSGGSTIPAIPI

SEQ ID NO: 187734 - protein, 16 aa, Mycobacterium tuberculosis
LWGLSGGSTIPAIPIG

SEQ ID NO: 187735 - protein, 16 aa, Mycobacterium tuberculosis
WGLSGGSTIPAIPIGL

SEQ ID NO: 187736 - protein, 16 aa, Mycobacterium tuberculosis
GLSGGSTIPAIPIGLE

SEQ ID NO: 187737 - protein, 16 aa, Mycobacterium tuberculosis
LSGGSTIPAIPIGLEL

SEQ ID NO: 187738 - protein, 16 aa, Mycobacterium tuberculosis
SGGSTIPAIPIGLELN

SEQ ID NO: 187739 - protein, 16 aa, Mycobacterium tuberculosis
GGSTIPAIPIGLELNG

SEQ ID NO: 187740 - protein, 16 aa, Mycobacterium tuberculosis
GSTIPAIPIGLELNGG

SEQ ID NO: 187741 - protein, 16 aa, Mycobacterium tuberculosis
STIPAIPIGLELNGGV

SEQ ID NO: 187742 - protein, 16 aa, Mycobacterium tuberculosis
TIPAIPIGLELNGGVG

SEQ ID NO: 187743 - protein, 16 aa, Mycobacterium tuberculosis
IPAIPIGLELNGGVGP

SEQ ID NO: 187744 - protein, 16 aa, Mycobacterium tuberculosis
PAIPIGLELNGGVGPI

SEQ ID NO: 187745 - protein, 16 aa, Mycobacterium tuberculosis
AIPIGLELNGGVGPIT

SEQ ID NO: 187746 - protein, 16 aa, Mycobacterium tuberculosis
IPIGLELNGGVGPITV

SEQ ID NO: 187747 - protein, 16 aa, Mycobacterium tuberculosis
PIGLELNGGVGPITVL

SEQ ID NO: 187748 - protein, 16 aa, Mycobacterium tuberculosis
IGLELNGGVGPITVLP

SEQ ID NO: 187749 - protein, 16 aa, Mycobacterium tuberculosis
GLELNGGVGPITVLPI

SEQ ID NO: 187750 - protein, 16 aa, Mycobacterium tuberculosis
LELNGGVGPITVLPIQ

SEQ ID NO: 187751 - protein, 16 aa, Mycobacterium tuberculosis
ELNGGVGPITVLPIQI

SEQ ID NO: 187752 - protein, 16 aa, Mycobacterium tuberculosis
LNGGVGPITVLPIQIL

SEQ ID NO: 187753 - protein, 16 aa, Mycobacterium tuberculosis
NGGVGPITVLPIQILP

SEQ ID NO: 187754 - protein, 16 aa, Mycobacterium tuberculosis
GGVGPITVLPIQILPT

SEQ ID NO: 187755 - protein, 16 aa, Mycobacterium tuberculosis
GVGPITVLPIQILPTI

SEQ ID NO: 187756 - protein, 16 aa, Mycobacterium tuberculosis
VGPITVLPIQILPTIP

SEQ ID NO: 187757 - protein, 16 aa, Mycobacterium tuberculosis
GPITVLPIQILPTIPL

SEQ ID NO: 187758 - protein, 16 aa, Mycobacterium tuberculosis
PITVLPIQILPTIPLN

SEQ ID NO: 187759 - protein, 16 aa, Mycobacterium tuberculosis
ITVLPIQILPTIPLNI

SEQ ID NO: 187760 - protein, 16 aa, Mycobacterium tuberculosis
TVLPIQILPTIPLNIH

SEQ ID NO: 187761 - protein, 16 aa, Mycobacterium tuberculosis
VLPIQILPTIPLNIHQ

SEQ ID NO: 187762 - protein, 16 aa, Mycobacterium tuberculosis
LPIQILPTIPLNIHQT

SEQ ID NO: 187763 - protein, 16 aa, Mycobacterium tuberculosis
PIQILPTIPLNIHQTF

SEQ ID NO: 187764 - protein, 16 aa, Mycobacterium tuberculosis
IQILPTIPLNIHQTFS

SEQ ID NO: 187765 - protein, 16 aa, Mycobacterium tuberculosis
QILPTIPLNIHQTFSL

SEQ ID NO: 187766 - protein, 16 aa, Mycobacterium tuberculosis
ILPTIPLNIHQTFSLG

SEQ ID NO: 187767 - protein, 16 aa, Mycobacterium tuberculosis
LPTIPLNIHQTFSLGP

SEQ ID NO: 187768 - protein, 16 aa, Mycobacterium tuberculosis
PTIPLNIHQTFSLGPL

SEQ ID NO: 187769 - protein, 16 aa, Mycobacterium tuberculosis
TIPLNIHQTFSLGPLV

SEQ ID NO: 187770 - protein, 16 aa, Mycobacterium tuberculosis
IPLNIHQTFSLGPLVV

SEQ ID NO: 187771 - protein, 16 aa, Mycobacterium tuberculosis
PLNIHQTFSLGPLVVP

SEQ ID NO: 187772 - protein, 16 aa, Mycobacterium tuberculosis
LNIHQTFSLGPLVVPD

SEQ ID NO: 187773 - protein, 16 aa, Mycobacterium tuberculosis
NIHQTFSLGPLVVPDI

SEQ ID NO: 187774 - protein, 16 aa, Mycobacterium tuberculosis
IHQTFSLGPLVVPDIV

SEQ ID NO: 187775 - protein, 16 aa, Mycobacterium tuberculosis
HQTFSLGPLVVPDIVI

SEQ ID NO: 187776 - protein, 16 aa, Mycobacterium tuberculosis
QTFSLGPLVVPDIVIP

SEQ ID NO: 187777 - protein, 16 aa, Mycobacterium tuberculosis
TFSLGPLVVPDIVIPA

SEQ ID NO: 187778 - protein, 16 aa, Mycobacterium tuberculosis
FSLGPLVVPDIVIPAF

SEQ ID NO: 187779 - protein, 16 aa, Mycobacterium tuberculosis
SLGPLVVPDIVIPAFG

SEQ ID NO: 187780 - protein, 16 aa, Mycobacterium tuberculosis
LGPLVVPDIVIPAFGG

SEQ ID NO: 187781 - protein, 16 aa, Mycobacterium tuberculosis
GPLVVPDIVIPAFGGG

SEQ ID NO: 187782 - protein, 16 aa, Mycobacterium tuberculosis
PLVVPDIVIPAFGGGT

SEQ ID NO: 187783 - protein, 16 aa, Mycobacterium tuberculosis
LVVPDIVIPAFGGGTA

SEQ ID NO: 187784 - protein, 16 aa, Mycobacterium tuberculosis
VVPDIVIPAFGGGTAI

SEQ ID NO: 187785 - protein, 16 aa, Mycobacterium tuberculosis
VPDIVIPAFGGGTAIP

SEQ ID NO: 187786 - protein, 16 aa, Mycobacterium tuberculosis
PDIVIPAFGGGTAIPI

SEQ ID NO: 187787 - protein, 16 aa, Mycobacterium tuberculosis
DIVIPAFGGGTAIPIS

SEQ ID NO: 187788 - protein, 16 aa, Mycobacterium tuberculosis
IVIPAFGGGTAIPISV

SEQ ID NO: 187789 - protein, 16 aa, Mycobacterium tuberculosis
VIPAFGGGTAIPISVG

SEQ ID NO: 187790 - protein, 16 aa, Mycobacterium tuberculosis
IPAFGGGTAIPISVGP

SEQ ID NO: 187791 - protein, 16 aa, Mycobacterium tuberculosis
PAFGGGTAIPISVGPI

SEQ ID NO: 187792 - protein, 16 aa, Mycobacterium tuberculosis
AFGGGTAIPISVGPIT

SEQ ID NO: 187793 - protein, 16 aa, Mycobacterium tuberculosis
FGGGTAIPISVGPITI

SEQ ID NO: 187794 - protein, 16 aa, Mycobacterium tuberculosis
GGGTAIPISVGPITIS

SEQ ID NO: 187795 - protein, 16 aa, Mycobacterium tuberculosis
GGTAIPISVGPITISP

SEQ ID NO: 187796 - protein, 16 aa, Mycobacterium tuberculosis
GTAIPISVGPITISPI

SEQ ID NO: 187797 - protein, 16 aa, Mycobacterium tuberculosis
TAIPISVGPITISPIT

SEQ ID NO: 187798 - protein, 16 aa, Mycobacterium tuberculosis
AIPISVGPITISPITL

SEQ ID NO: 187799 - protein, 16 aa, Mycobacterium tuberculosis
IPISVGPITISPITLF

SEQ ID NO: 187800 - protein, 16 aa, Mycobacterium tuberculosis
PISVGPITISPITLFP

SEQ ID NO: 187801 - protein, 16 aa, Mycobacterium tuberculosis
ISVGPITISPITLFPA

SEQ ID NO: 187802 - protein, 16 aa, Mycobacterium tuberculosis
SVGPITISPITLFPAQ

SEQ ID NO: 187803 - protein, 16 aa, Mycobacterium tuberculosis
VGPITISPITLFPAQN

SEQ ID NO: 187804 - protein, 16 aa, Mycobacterium tuberculosis
GPITISPITLFPAQNF

SEQ ID NO: 187805 - protein, 16 aa, Mycobacterium tuberculosis
PITISPITLFPAQNFN

SEQ ID NO: 187806 - protein, 16 aa, Mycobacterium tuberculosis
ITISPITLFPAQNFNT

SEQ ID NO: 187807 - protein, 16 aa, Mycobacterium tuberculosis
TISPITLFPAQNFNTT

SEQ ID NO: 187808 - protein, 16 aa, Mycobacterium tuberculosis
ISPITLFPAQNFNTTF

SEQ ID NO: 187809 - protein, 16 aa, Mycobacterium tuberculosis
SPITLFPAQNFNTTFP

SEQ ID NO: 187810 - protein, 16 aa, Mycobacterium tuberculosis
PITLFPAQNFNTTFPV

SEQ ID NO: 187811 - protein, 16 aa, Mycobacterium tuberculosis
ITLFPAQNFNTTFPVG

SEQ ID NO: 187812 - protein, 16 aa, Mycobacterium tuberculosis
TLFPAQNFNTTFPVGP

SEQ ID NO: 187813 - protein, 16 aa, Mycobacterium tuberculosis
LFPAQNFNTTFPVGPF

SEQ ID NO: 187814 - protein, 16 aa, Mycobacterium tuberculosis
FPAQNFNTTFPVGPFF

SEQ ID NO: 187815 - protein, 16 aa, Mycobacterium tuberculosis
PAQNFNTTFPVGPFFG

SEQ ID NO: 187816 - protein, 16 aa, Mycobacterium tuberculosis
AQNFNTTFPVGPFFGL

SEQ ID NO: 187817 - protein, 16 aa, Mycobacterium tuberculosis
QNFNTTFPVGPFFGLG

SEQ ID NO: 187818 - protein, 16 aa, Mycobacterium tuberculosis
NFNTTFPVGPFFGLGV

SEQ ID NO: 187819 - protein, 16 aa, Mycobacterium tuberculosis
FNTTFPVGPFFGLGVV

SEQ ID NO: 187820 - protein, 16 aa, Mycobacterium tuberculosis
NTTFPVGPFFGLGVVN

SEQ ID NO: 187821 - protein, 16 aa, Mycobacterium tuberculosis
TTFPVGPFFGLGVVNI

SEQ ID NO: 187822 - protein, 16 aa, Mycobacterium tuberculosis
TFPVGPFFGLGVVNIS

SEQ ID NO: 187823 - protein, 16 aa, Mycobacterium tuberculosis
FPVGPFFGLGVVNISG

SEQ ID NO: 187824 - protein, 16 aa, Mycobacterium tuberculosis
PVGPFFGLGVVNISGI

SEQ ID NO: 187825 - protein, 16 aa, Mycobacterium tuberculosis
VGPFFGLGVVNISGIE

SEQ ID NO: 187826 - protein, 16 aa, Mycobacterium tuberculosis
GPFFGLGVVNISGIEI

SEQ ID NO: 187827 - protein, 16 aa, Mycobacterium tuberculosis
PFFGLGVVNISGIEIK

SEQ ID NO: 187828 - protein, 16 aa, Mycobacterium tuberculosis
FFGLGVVNISGIEIKD

SEQ ID NO: 187829 - protein, 16 aa, Mycobacterium tuberculosis
FGLGVVNISGIEIKDL

SEQ ID NO: 187830 - protein, 16 aa, Mycobacterium tuberculosis
GLGVVNISGIEIKDLA

SEQ ID NO: 187831 - protein, 16 aa, Mycobacterium tuberculosis
LGVVNISGIEIKDLAG

SEQ ID NO: 187832 - protein, 16 aa, Mycobacterium tuberculosis
GVVNISGIEIKDLAGN

SEQ ID NO: 187833 - protein, 16 aa, Mycobacterium tuberculosis
VVNISGIEIKDLAGNV

SEQ ID NO: 187834 - protein, 16 aa, Mycobacterium tuberculosis
VNISGIEIKDLAGNVT

SEQ ID NO: 187835 - protein, 16 aa, Mycobacterium tuberculosis
NISGIEIKDLAGNVTL

SEQ ID NO: 187836 - protein, 16 aa, Mycobacterium tuberculosis
ISGIEIKDLAGNVTLQ

SEQ ID NO: 187837 - protein, 16 aa, Mycobacterium tuberculosis
SGIEIKDLAGNVTLQL

SEQ ID NO: 187838 - protein, 16 aa, Mycobacterium tuberculosis
GIEIKDLAGNVTLQLG

SEQ ID NO: 187839 - protein, 16 aa, Mycobacterium tuberculosis
IEIKDLAGNVTLQLGN

SEQ ID NO: 187840 - protein, 16 aa, Mycobacterium tuberculosis
EIKDLAGNVTLQLGNL

SEQ ID NO: 187841 - protein, 16 aa, Mycobacterium tuberculosis
IKDLAGNVTLQLGNLN

SEQ ID NO: 187842 - protein, 16 aa, Mycobacterium tuberculosis
KDLAGNVTLQLGNLNI

SEQ ID NO: 187843 - protein, 16 aa, Mycobacterium tuberculosis
DLAGNVTLQLGNLNID

SEQ ID NO: 187844 - protein, 16 aa, Mycobacterium tuberculosis
LAGNVTLQLGNLNIDT

SEQ ID NO: 187845 - protein, 16 aa, Mycobacterium tuberculosis
AGNVTLQLGNLNIDTR

SEQ ID NO: 187846 - protein, 16 aa, Mycobacterium tuberculosis
GNVTLQLGNLNIDTRI

SEQ ID NO: 187847 - protein, 16 aa, Mycobacterium tuberculosis
NVTLQLGNLNIDTRIN

SEQ ID NO: 187848 - protein, 16 aa, Mycobacterium tuberculosis
VTLQLGNLNIDTRINQ

SEQ ID NO: 187849 - protein, 16 aa, Mycobacterium tuberculosis
TLQLGNLNIDTRINQS

SEQ ID NO: 187850 - protein, 16 aa, Mycobacterium tuberculosis
LQLGNLNIDTRINQSF

SEQ ID NO: 187851 - protein, 16 aa, Mycobacterium tuberculosis
QLGNLNIDTRINQSFP

SEQ ID NO: 187852 - protein, 16 aa, Mycobacterium tuberculosis
LGNLNIDTRINQSFPV

SEQ ID NO: 187853 - protein, 16 aa, Mycobacterium tuberculosis
GNLNIDTRINQSFPVT

SEQ ID NO: 187854 - protein, 16 aa, Mycobacterium tuberculosis
NLNIDTRINQSFPVTV

SEQ ID NO: 187855 - protein, 16 aa, Mycobacterium tuberculosis
LNIDTRINQSFPVTVN

SEQ ID NO: 187856 - protein, 16 aa, Mycobacterium tuberculosis
NIDTRINQSFPVTVNW

SEQ ID NO: 187857 - protein, 16 aa, Mycobacterium tuberculosis
IDTRINQSFPVTVNWS

SEQ ID NO: 187858 - protein, 16 aa, Mycobacterium tuberculosis
DTRINQSFPVTVNWST

SEQ ID NO: 187859 - protein, 16 aa, Mycobacterium tuberculosis
TRINQSFPVTVNWSTP

SEQ ID NO: 187860 - protein, 16 aa, Mycobacterium tuberculosis
RINQSFPVTVNWSTPA

SEQ ID NO: 187861 - protein, 16 aa, Mycobacterium tuberculosis
INQSFPVTVNWSTPAV

SEQ ID NO: 187862 - protein, 16 aa, Mycobacterium tuberculosis
NQSFPVTVNWSTPAVT

SEQ ID NO: 187863 - protein, 16 aa, Mycobacterium tuberculosis
QSFPVTVNWSTPAVTI

SEQ ID NO: 187864 - protein, 16 aa, Mycobacterium tuberculosis
SFPVTVNWSTPAVTIF

SEQ ID NO: 187865 - protein, 16 aa, Mycobacterium tuberculosis
FPVTVNWSTPAVTIFP

SEQ ID NO: 187866 - protein, 16 aa, Mycobacterium tuberculosis
PVTVNWSTPAVTIFPN

SEQ ID NO: 187867 - protein, 16 aa, Mycobacterium tuberculosis
VTVNWSTPAVTIFPNG

SEQ ID NO: 187868 - protein, 16 aa, Mycobacterium tuberculosis
TVNWSTPAVTIFPNGI

SEQ ID NO: 187869 - protein, 16 aa, Mycobacterium tuberculosis
VNWSTPAVTIFPNGIS

SEQ ID NO: 187870 - protein, 16 aa, Mycobacterium tuberculosis
NWSTPAVTIFPNGISI

SEQ ID NO: 187871 - protein, 16 aa, Mycobacterium tuberculosis
WSTPAVTIFPNGISIP

SEQ ID NO: 187872 - protein, 16 aa, Mycobacterium tuberculosis
STPAVTIFPNGISIPN

SEQ ID NO: 187873 - protein, 16 aa, Mycobacterium tuberculosis
TPAVTIFPNGISIPNN

SEQ ID NO: 187874 - protein, 16 aa, Mycobacterium tuberculosis
PAVTIFPNGISIPNNP

SEQ ID NO: 187875 - protein, 16 aa, Mycobacterium tuberculosis
AVTIFPNGISIPNNPL

SEQ ID NO: 187876 - protein, 16 aa, Mycobacterium tuberculosis
VTIFPNGISIPNNPLA

SEQ ID NO: 187877 - protein, 16 aa, Mycobacterium tuberculosis
TIFPNGISIPNNPLAL

SEQ ID NO: 187878 - protein, 16 aa, Mycobacterium tuberculosis
IFPNGISIPNNPLALL

SEQ ID NO: 187879 - protein, 16 aa, Mycobacterium tuberculosis
FPNGISIPNNPLALLA

SEQ ID NO: 187880 - protein, 16 aa, Mycobacterium tuberculosis
PNGISIPNNPLALLAS

SEQ ID NO: 187881 - protein, 16 aa, Mycobacterium tuberculosis
NGISIPNNPLALLASA

SEQ ID NO: 187882 - protein, 16 aa, Mycobacterium tuberculosis
GISIPNNPLALLASAS

SEQ ID NO: 187883 - protein, 16 aa, Mycobacterium tuberculosis
ISIPNNPLALLASASI

SEQ ID NO: 187884 - protein, 16 aa, Mycobacterium tuberculosis
SIPNNPLALLASASIG

SEQ ID NO: 187885 - protein, 16 aa, Mycobacterium tuberculosis
IPNNPLALLASASIGT

SEQ ID NO: 187886 - protein, 16 aa, Mycobacterium tuberculosis
PNNPLALLASASIGTL

SEQ ID NO: 187887 - protein, 16 aa, Mycobacterium tuberculosis
NNPLALLASASIGTLG

SEQ ID NO: 187888 - protein, 16 aa, Mycobacterium tuberculosis
NPLALLASASIGTLGF

SEQ ID NO: 187889 - protein, 16 aa, Mycobacterium tuberculosis
PLALLASASIGTLGFT

SEQ ID NO: 187890 - protein, 16 aa, Mycobacterium tuberculosis
LALLASASIGTLGFTI

SEQ ID NO: 187891 - protein, 16 aa, Mycobacterium tuberculosis
ALLASASIGTLGFTIP

SEQ ID NO: 187892 - protein, 16 aa, Mycobacterium tuberculosis
LLASASIGTLGFTIPG

SEQ ID NO: 187893 - protein, 16 aa, Mycobacterium tuberculosis
LASASIGTLGFTIPGF

SEQ ID NO: 187894 - protein, 16 aa, Mycobacterium tuberculosis
ASASIGTLGFTIPGFT

SEQ ID NO: 187895 - protein, 16 aa, Mycobacterium tuberculosis
SASIGTLGFTIPGFTI

SEQ ID NO: 187896 - protein, 16 aa, Mycobacterium tuberculosis
ASIGTLGFTIPGFTIP

SEQ ID NO: 187897 - protein, 16 aa, Mycobacterium tuberculosis
SIGTLGFTIPGFTIPA

SEQ ID NO: 187898 - protein, 16 aa, Mycobacterium tuberculosis
IGTLGFTIPGFTIPAA

SEQ ID NO: 187899 - protein, 16 aa, Mycobacterium tuberculosis
GTLGFTIPGFTIPAAP

SEQ ID NO: 187900 - protein, 16 aa, Mycobacterium tuberculosis
TLGFTIPGFTIPAAPL

SEQ ID NO: 187901 - protein, 16 aa, Mycobacterium tuberculosis
LGFTIPGFTIPAAPLP

SEQ ID NO: 187902 - protein, 16 aa, Mycobacterium tuberculosis
GFTIPGFTIPAAPLPL

SEQ ID NO: 187903 - protein, 16 aa, Mycobacterium tuberculosis
FTIPGFTIPAAPLPLT

SEQ ID NO: 187904 - protein, 16 aa, Mycobacterium tuberculosis
TIPGFTIPAAPLPLTI

SEQ ID NO: 187905 - protein, 16 aa, Mycobacterium tuberculosis
IPGFTIPAAPLPLTID

SEQ ID NO: 187906 - protein, 16 aa, Mycobacterium tuberculosis
PGFTIPAAPLPLTIDI

SEQ ID NO: 187907 - protein, 16 aa, Mycobacterium tuberculosis
GFTIPAAPLPLTIDID

SEQ ID NO: 187908 - protein, 16 aa, Mycobacterium tuberculosis
FTIPAAPLPLTIDIDG

SEQ ID NO: 187909 - protein, 16 aa, Mycobacterium tuberculosis
TIPAAPLPLTIDIDGQ

SEQ ID NO: 187910 - protein, 16 aa, Mycobacterium tuberculosis
IPAAPLPLTIDIDGQI

SEQ ID NO: 187911 - protein, 16 aa, Mycobacterium tuberculosis
PAAPLPLTIDIDGQID

SEQ ID NO: 187912 - protein, 16 aa, Mycobacterium tuberculosis
AAPLPLTIDIDGQIDG

SEQ ID NO: 187913 - protein, 16 aa, Mycobacterium tuberculosis
APLPLTIDIDGQIDGF

SEQ ID NO: 187914 - protein, 16 aa, Mycobacterium tuberculosis
PLPLTIDIDGQIDGFS

SEQ ID NO: 187915 - protein, 16 aa, Mycobacterium tuberculosis
LPLTIDIDGQIDGFST

SEQ ID NO: 187916 - protein, 16 aa, Mycobacterium tuberculosis
PLTIDIDGQIDGFSTP

SEQ ID NO: 187917 - protein, 16 aa, Mycobacterium tuberculosis
LTIDIDGQIDGFSTPP

SEQ ID NO: 187918 - protein, 16 aa, Mycobacterium tuberculosis
TIDIDGQIDGFSTPPI

SEQ ID NO: 187919 - protein, 16 aa, Mycobacterium tuberculosis
IDIDGQIDGFSTPPIT

SEQ ID NO: 187920 - protein, 16 aa, Mycobacterium tuberculosis
DIDGQIDGFSTPPITI

SEQ ID NO: 187921 - protein, 16 aa, Mycobacterium tuberculosis
IDGQIDGFSTPPITID

SEQ ID NO: 187922 - protein, 16 aa, Mycobacterium tuberculosis
DGQIDGFSTPPITIDR

SEQ ID NO: 187923 - protein, 16 aa, Mycobacterium tuberculosis
GQIDGFSTPPITIDRI

SEQ ID NO: 187924 - protein, 16 aa, Mycobacterium tuberculosis
QIDGFSTPPITIDRIP

SEQ ID NO: 187925 - protein, 16 aa, Mycobacterium tuberculosis
IDGFSTPPITIDRIPL

SEQ ID NO: 187926 - protein, 16 aa, Mycobacterium tuberculosis
DGFSTPPITIDRIPLN

SEQ ID NO: 187927 - protein, 16 aa, Mycobacterium tuberculosis
GFSTPPITIDRIPLNL

SEQ ID NO: 187928 - protein, 16 aa, Mycobacterium tuberculosis
FSTPPITIDRIPLNLG

SEQ ID NO: 187929 - protein, 16 aa, Mycobacterium tuberculosis
STPPITIDRIPLNLGA

SEQ ID NO: 187930 - protein, 16 aa, Mycobacterium tuberculosis
TPPITIDRIPLNLGAS

SEQ ID NO: 187931 - protein, 16 aa, Mycobacterium tuberculosis
PPITIDRIPLNLGASV

SEQ ID NO: 187932 - protein, 16 aa, Mycobacterium tuberculosis
PITIDRIPLNLGASVT

SEQ ID NO: 187933 - protein, 16 aa, Mycobacterium tuberculosis
ITIDRIPLNLGASVTV

SEQ ID NO: 187934 - protein, 16 aa, Mycobacterium tuberculosis
TIDRIPLNLGASVTVG

SEQ ID NO: 187935 - protein, 16 aa, Mycobacterium tuberculosis
IDRIPLNLGASVTVGP

SEQ ID NO: 187936 - protein, 16 aa, Mycobacterium tuberculosis
DRIPLNLGASVTVGPI

SEQ ID NO: 187937 - protein, 16 aa, Mycobacterium tuberculosis
RIPLNLGASVTVGPIL

SEQ ID NO: 187938 - protein, 16 aa, Mycobacterium tuberculosis
IPLNLGASVTVGPILI

SEQ ID NO: 187939 - protein, 16 aa, Mycobacterium tuberculosis
PLNLGASVTVGPILIN

SEQ ID NO: 187940 - protein, 16 aa, Mycobacterium tuberculosis
LNLGASVTVGPILING

SEQ ID NO: 187941 - protein, 16 aa, Mycobacterium tuberculosis
NLGASVTVGPILINGV

SEQ ID NO: 187942 - protein, 16 aa, Mycobacterium tuberculosis
LGASVTVGPILINGVN

SEQ ID NO: 187943 - protein, 16 aa, Mycobacterium tuberculosis
GASVTVGPILINGVNI

SEQ ID NO: 187944 - protein, 16 aa, Mycobacterium tuberculosis
ASVTVGPILINGVNIP

SEQ ID NO: 187945 - protein, 16 aa, Mycobacterium tuberculosis
SVTVGPILINGVNIPA

SEQ ID NO: 187946 - protein, 16 aa, Mycobacterium tuberculosis
VTVGPILINGVNIPAT

SEQ ID NO: 187947 - protein, 16 aa, Mycobacterium tuberculosis
TVGPILINGVNIPATP

SEQ ID NO: 187948 - protein, 16 aa, Mycobacterium tuberculosis
VGPILINGVNIPATPG

SEQ ID NO: 187949 - protein, 16 aa, Mycobacterium tuberculosis
GPILINGVNIPATPGF

SEQ ID NO: 187950 - protein, 16 aa, Mycobacterium tuberculosis
PILINGVNIPATPGFG

SEQ ID NO: 187951 - protein, 16 aa, Mycobacterium tuberculosis
ILINGVNIPATPGFGN

SEQ ID NO: 187952 - protein, 16 aa, Mycobacterium tuberculosis
LINGVNIPATPGFGNT

SEQ ID NO: 187953 - protein, 16 aa, Mycobacterium tuberculosis
INGVNIPATPGFGNTT

SEQ ID NO: 187954 - protein, 16 aa, Mycobacterium tuberculosis
NGVNIPATPGFGNTTT

SEQ ID NO: 187955 - protein, 16 aa, Mycobacterium tuberculosis
GVNIPATPGFGNTTTA

SEQ ID NO: 187956 - protein, 16 aa, Mycobacterium tuberculosis
VNIPATPGFGNTTTAP

SEQ ID NO: 187957 - protein, 16 aa, Mycobacterium tuberculosis
NIPATPGFGNTTTAPS

SEQ ID NO: 187958 - protein, 16 aa, Mycobacterium tuberculosis
IPATPGFGNTTTAPSS

SEQ ID NO: 187959 - protein, 16 aa, Mycobacterium tuberculosis
PATPGFGNTTTAPSSG

SEQ ID NO: 187960 - protein, 16 aa, Mycobacterium tuberculosis
ATPGFGNTTTAPSSGF

SEQ ID NO: 187961 - protein, 16 aa, Mycobacterium tuberculosis
TPGFGNTTTAPSSGFF

SEQ ID NO: 187962 - protein, 16 aa, Mycobacterium tuberculosis
PGFGNTTTAPSSGFFN

SEQ ID NO: 187963 - protein, 16 aa, Mycobacterium tuberculosis
GFGNTTTAPSSGFFNS

SEQ ID NO: 187964 - protein, 16 aa, Mycobacterium tuberculosis
FGNTTTAPSSGFFNSG

SEQ ID NO: 187965 - protein, 16 aa, Mycobacterium tuberculosis
GNTTTAPSSGFFNSGD

SEQ ID NO: 187966 - protein, 16 aa, Mycobacterium tuberculosis
NTTTAPSSGFFNSGDG

SEQ ID NO: 187967 - protein, 16 aa, Mycobacterium tuberculosis
TTTAPSSGFFNSGDGG

SEQ ID NO: 187968 - protein, 16 aa, Mycobacterium tuberculosis
TTAPSSGFFNSGDGGV

SEQ ID NO: 187969 - protein, 16 aa, Mycobacterium tuberculosis
TAPSSGFFNSGDGGVS

SEQ ID NO: 187970 - protein, 16 aa, Mycobacterium tuberculosis
APSSGFFNSGDGGVSG

SEQ ID NO: 187971 - protein, 16 aa, Mycobacterium tuberculosis
PSSGFFNSGDGGVSGF

SEQ ID NO: 187972 - protein, 16 aa, Mycobacterium tuberculosis
SSGFFNSGDGGVSGFG

SEQ ID NO: 187973 - protein, 16 aa, Mycobacterium tuberculosis
SGFFNSGDGGVSGFGN

SEQ ID NO: 187974 - protein, 16 aa, Mycobacterium tuberculosis
GFFNSGDGGVSGFGNF

SEQ ID NO: 187975 - protein, 16 aa, Mycobacterium tuberculosis
FFNSGDGGVSGFGNFG

SEQ ID NO: 187976 - protein, 16 aa, Mycobacterium tuberculosis
FNSGDGGVSGFGNFGA

SEQ ID NO: 187977 - protein, 16 aa, Mycobacterium tuberculosis
NSGDGGVSGFGNFGAG

SEQ ID NO: 187978 - protein, 16 aa, Mycobacterium tuberculosis
SGDGGVSGFGNFGAGS

SEQ ID NO: 187979 - protein, 16 aa, Mycobacterium tuberculosis
GDGGVSGFGNFGAGSS

SEQ ID NO: 187980 - protein, 16 aa, Mycobacterium tuberculosis
DGGVSGFGNFGAGSSG

SEQ ID NO: 187981 - protein, 16 aa, Mycobacterium tuberculosis
GGVSGFGNFGAGSSGW

SEQ ID NO: 187982 - protein, 16 aa, Mycobacterium tuberculosis
GVSGFGNFGAGSSGWW

SEQ ID NO: 187983 - protein, 16 aa, Mycobacterium tuberculosis
VSGFGNFGAGSSGWWN

SEQ ID NO: 187984 - protein, 16 aa, Mycobacterium tuberculosis
SGFGNFGAGSSGWWNQ

SEQ ID NO: 187985 - protein, 16 aa, Mycobacterium tuberculosis
GFGNFGAGSSGWWNQA

SEQ ID NO: 187986 - protein, 16 aa, Mycobacterium tuberculosis
FGNFGAGSSGWWNQAQ

SEQ ID NO: 187987 - protein, 16 aa, Mycobacterium tuberculosis
GNFGAGSSGWWNQAQT

SEQ ID NO: 187988 - protein, 16 aa, Mycobacterium tuberculosis
NFGAGSSGWWNQAQTE

SEQ ID NO: 187989 - protein, 16 aa, Mycobacterium tuberculosis
FGAGSSGWWNQAQTEV

SEQ ID NO: 187990 - protein, 16 aa, Mycobacterium tuberculosis
GAGSSGWWNQAQTEVA

SEQ ID NO: 187991 - protein, 16 aa, Mycobacterium tuberculosis
AGSSGWWNQAQTEVAG

SEQ ID NO: 187992 - protein, 16 aa, Mycobacterium tuberculosis
GSSGWWNQAQTEVAGA

SEQ ID NO: 187993 - protein, 16 aa, Mycobacterium tuberculosis
SSGWWNQAQTEVAGAG

SEQ ID NO: 187994 - protein, 16 aa, Mycobacterium tuberculosis
SGWWNQAQTEVAGAGS

SEQ ID NO: 187995 - protein, 16 aa, Mycobacterium tuberculosis
GWWNQAQTEVAGAGSG

SEQ ID NO: 187996 - protein, 16 aa, Mycobacterium tuberculosis
WWNQAQTEVAGAGSGF

SEQ ID NO: 187997 - protein, 16 aa, Mycobacterium tuberculosis
WNQAQTEVAGAGSGFA

SEQ ID NO: 187998 - protein, 16 aa, Mycobacterium tuberculosis
NQAQTEVAGAGSGFAN

SEQ ID NO: 187999 - protein, 16 aa, Mycobacterium tuberculosis
QAQTEVAGAGSGFANF

SEQ ID NO: 188000 - protein, 16 aa, Mycobacterium tuberculosis
AQTEVAGAGSGFANFG

SEQ ID NO: 188001 - protein, 16 aa, Mycobacterium tuberculosis
QTEVAGAGSGFANFGS

SEQ ID NO: 188002 - protein, 16 aa, Mycobacterium tuberculosis
TEVAGAGSGFANFGSL

SEQ ID NO: 188003 - protein, 16 aa, Mycobacterium tuberculosis
EVAGAGSGFANFGSLG

SEQ ID NO: 188004 - protein, 16 aa, Mycobacterium tuberculosis
VAGAGSGFANFGSLGS

SEQ ID NO: 188005 - protein, 16 aa, Mycobacterium tuberculosis
AGAGSGFANFGSLGSG

SEQ ID NO: 188006 - protein, 16 aa, Mycobacterium tuberculosis
GAGSGFANFGSLGSGV

SEQ ID NO: 188007 - protein, 16 aa, Mycobacterium tuberculosis
AGSGFANFGSLGSGVL

SEQ ID NO: 188008 - protein, 16 aa, Mycobacterium tuberculosis
GSGFANFGSLGSGVLN

SEQ ID NO: 188009 - protein, 16 aa, Mycobacterium tuberculosis
SGFANFGSLGSGVLNF

SEQ ID NO: 188010 - protein, 16 aa, Mycobacterium tuberculosis
GFANFGSLGSGVLNFG

SEQ ID NO: 188011 - protein, 16 aa, Mycobacterium tuberculosis
FANFGSLGSGVLNFGS

SEQ ID NO: 188012 - protein, 16 aa, Mycobacterium tuberculosis
ANFGSLGSGVLNFGSG

SEQ ID NO: 188013 - protein, 16 aa, Mycobacterium tuberculosis
NFGSLGSGVLNFGSGV

SEQ ID NO: 188014 - protein, 16 aa, Mycobacterium tuberculosis
FGSLGSGVLNFGSGVS

SEQ ID NO: 188015 - protein, 16 aa, Mycobacterium tuberculosis
GSLGSGVLNFGSGVSG

SEQ ID NO: 188016 - protein, 16 aa, Mycobacterium tuberculosis
SLGSGVLNFGSGVSGL

SEQ ID NO: 188017 - protein, 16 aa, Mycobacterium tuberculosis
LGSGVLNFGSGVSGLY

SEQ ID NO: 188018 - protein, 16 aa, Mycobacterium tuberculosis
GSGVLNFGSGVSGLYN

SEQ ID NO: 188019 - protein, 16 aa, Mycobacterium tuberculosis
SGVLNFGSGVSGLYNT

SEQ ID NO: 188020 - protein, 16 aa, Mycobacterium tuberculosis
GVLNFGSGVSGLYNTG

SEQ ID NO: 188021 - protein, 16 aa, Mycobacterium tuberculosis
VLNFGSGVSGLYNTGG

SEQ ID NO: 188022 - protein, 16 aa, Mycobacterium tuberculosis
LNFGSGVSGLYNTGGL

SEQ ID NO: 188023 - protein, 16 aa, Mycobacterium tuberculosis
NFGSGVSGLYNTGGLP

SEQ ID NO: 188024 - protein, 16 aa, Mycobacterium tuberculosis
FGSGVSGLYNTGGLPP

SEQ ID NO: 188025 - protein, 16 aa, Mycobacterium tuberculosis
GSGVSGLYNTGGLPPG

SEQ ID NO: 188026 - protein, 16 aa, Mycobacterium tuberculosis
SGVSGLYNTGGLPPGT

SEQ ID NO: 188027 - protein, 16 aa, Mycobacterium tuberculosis
GVSGLYNTGGLPPGTP

SEQ ID NO: 188028 - protein, 16 aa, Mycobacterium tuberculosis
VSGLYNTGGLPPGTPA

SEQ ID NO: 188029 - protein, 16 aa, Mycobacterium tuberculosis
SGLYNTGGLPPGTPAV

SEQ ID NO: 188030 - protein, 16 aa, Mycobacterium tuberculosis
GLYNTGGLPPGTPAVV

SEQ ID NO: 188031 - protein, 16 aa, Mycobacterium tuberculosis
LYNTGGLPPGTPAVVS

SEQ ID NO: 188032 - protein, 16 aa, Mycobacterium tuberculosis
YNTGGLPPGTPAVVSG

SEQ ID NO: 188033 - protein, 16 aa, Mycobacterium tuberculosis
NTGGLPPGTPAVVSGI

SEQ ID NO: 188034 - protein, 16 aa, Mycobacterium tuberculosis
TGGLPPGTPAVVSGIG

SEQ ID NO: 188035 - protein, 16 aa, Mycobacterium tuberculosis
GGLPPGTPAVVSGIGN

SEQ ID NO: 188036 - protein, 16 aa, Mycobacterium tuberculosis
GLPPGTPAVVSGIGNV

SEQ ID NO: 188037 - protein, 16 aa, Mycobacterium tuberculosis
LPPGTPAVVSGIGNVG

SEQ ID NO: 188038 - protein, 16 aa, Mycobacterium tuberculosis
PPGTPAVVSGIGNVGE

SEQ ID NO: 188039 - protein, 16 aa, Mycobacterium tuberculosis
PGTPAVVSGIGNVGEQ

SEQ ID NO: 188040 - protein, 16 aa, Mycobacterium tuberculosis
GTPAVVSGIGNVGEQL

SEQ ID NO: 188041 - protein, 16 aa, Mycobacterium tuberculosis
TPAVVSGIGNVGEQLS

SEQ ID NO: 188042 - protein, 16 aa, Mycobacterium tuberculosis
PAVVSGIGNVGEQLSG

SEQ ID NO: 188043 - protein, 16 aa, Mycobacterium tuberculosis
AVVSGIGNVGEQLSGL

SEQ ID NO: 188044 - protein, 16 aa, Mycobacterium tuberculosis
VVSGIGNVGEQLSGLS

SEQ ID NO: 188045 - protein, 16 aa, Mycobacterium tuberculosis
VSGIGNVGEQLSGLSS

SEQ ID NO: 188046 - protein, 16 aa, Mycobacterium tuberculosis
SGIGNVGEQLSGLSSA

SEQ ID NO: 188047 - protein, 16 aa, Mycobacterium tuberculosis
GIGNVGEQLSGLSSAG

SEQ ID NO: 188048 - protein, 16 aa, Mycobacterium tuberculosis
IGNVGEQLSGLSSAGT

SEQ ID NO: 188049 - protein, 16 aa, Mycobacterium tuberculosis
GNVGEQLSGLSSAGTA

SEQ ID NO: 188050 - protein, 16 aa, Mycobacterium tuberculosis
NVGEQLSGLSSAGTAL

SEQ ID NO: 188051 - protein, 16 aa, Mycobacterium tuberculosis
VGEQLSGLSSAGTALN

SEQ ID NO: 188052 - protein, 16 aa, Mycobacterium tuberculosis
GEQLSGLSSAGTALNQ

SEQ ID NO: 188053 - protein, 16 aa, Mycobacterium tuberculosis
EQLSGLSSAGTALNQS

SEQ ID NO: 188054 - protein, 16 aa, Mycobacterium tuberculosis
QLSGLSSAGTALNQSL

SEQ ID NO: 188055 - protein, 16 aa, Mycobacterium tuberculosis
LSGLSSAGTALNQSLI

SEQ ID NO: 188056 - protein, 16 aa, Mycobacterium tuberculosis
SGLSSAGTALNQSLII

SEQ ID NO: 188057 - protein, 16 aa, Mycobacterium tuberculosis
GLSSAGTALNQSLIIN

SEQ ID NO: 188058 - protein, 16 aa, Mycobacterium tuberculosis
LSSAGTALNQSLIINL

SEQ ID NO: 188059 - protein, 16 aa, Mycobacterium tuberculosis
SSAGTALNQSLIINLG

SEQ ID NO: 188060 - protein, 16 aa, Mycobacterium tuberculosis
SAGTALNQSLIINLGL

SEQ ID NO: 188061 - protein, 16 aa, Mycobacterium tuberculosis
AGTALNQSLIINLGLA

SEQ ID NO: 188062 - protein, 16 aa, Mycobacterium tuberculosis
GTALNQSLIINLGLAD

SEQ ID NO: 188063 - protein, 16 aa, Mycobacterium tuberculosis
TALNQSLIINLGLADV

SEQ ID NO: 188064 - protein, 16 aa, Mycobacterium tuberculosis
ALNQSLIINLGLADVG

SEQ ID NO: 188065 - protein, 16 aa, Mycobacterium tuberculosis
LNQSLIINLGLADVGS

SEQ ID NO: 188066 - protein, 16 aa, Mycobacterium tuberculosis
NQSLIINLGLADVGSV

SEQ ID NO: 188067 - protein, 16 aa, Mycobacterium tuberculosis
QSLIINLGLADVGSVN

SEQ ID NO: 188068 - protein, 16 aa, Mycobacterium tuberculosis
SLIINLGLADVGSVNV

SEQ ID NO: 188069 - protein, 16 aa, Mycobacterium tuberculosis
LIINLGLADVGSVNVG

SEQ ID NO: 188070 - protein, 16 aa, Mycobacterium tuberculosis
IINLGLADVGSVNVGF

SEQ ID NO: 188071 - protein, 16 aa, Mycobacterium tuberculosis
INLGLADVGSVNVGFG

SEQ ID NO: 188072 - protein, 16 aa, Mycobacterium tuberculosis
NLGLADVGSVNVGFGN

SEQ ID NO: 188073 - protein, 16 aa, Mycobacterium tuberculosis
LGLADVGSVNVGFGNV

SEQ ID NO: 188074 - protein, 16 aa, Mycobacterium tuberculosis
GLADVGSVNVGFGNVG

SEQ ID NO: 188075 - protein, 16 aa, Mycobacterium tuberculosis
LADVGSVNVGFGNVGD

SEQ ID NO: 188076 - protein, 16 aa, Mycobacterium tuberculosis
ADVGSVNVGFGNVGDF

SEQ ID NO: 188077 - protein, 16 aa, Mycobacterium tuberculosis
DVGSVNVGFGNVGDFN

SEQ ID NO: 188078 - protein, 16 aa, Mycobacterium tuberculosis
VGSVNVGFGNVGDFNL

SEQ ID NO: 188079 - protein, 16 aa, Mycobacterium tuberculosis
GSVNVGFGNVGDFNLG

SEQ ID NO: 188080 - protein, 16 aa, Mycobacterium tuberculosis
SVNVGFGNVGDFNLGA

SEQ ID NO: 188081 - protein, 16 aa, Mycobacterium tuberculosis
VNVGFGNVGDFNLGAA

SEQ ID NO: 188082 - protein, 16 aa, Mycobacterium tuberculosis
NVGFGNVGDFNLGAAN

SEQ ID NO: 188083 - protein, 16 aa, Mycobacterium tuberculosis
VGFGNVGDFNLGAANI

SEQ ID NO: 188084 - protein, 16 aa, Mycobacterium tuberculosis
GFGNVGDFNLGAANIG

SEQ ID NO: 188085 - protein, 16 aa, Mycobacterium tuberculosis
FGNVGDFNLGAANIGD

SEQ ID NO: 188086 - protein, 16 aa, Mycobacterium tuberculosis
GNVGDFNLGAANIGDL

SEQ ID NO: 188087 - protein, 16 aa, Mycobacterium tuberculosis
NVGDFNLGAANIGDLN

SEQ ID NO: 188088 - protein, 16 aa, Mycobacterium tuberculosis
VGDFNLGAANIGDLNV

SEQ ID NO: 188089 - protein, 16 aa, Mycobacterium tuberculosis
GDFNLGAANIGDLNVG

SEQ ID NO: 188090 - protein, 16 aa, Mycobacterium tuberculosis
DFNLGAANIGDLNVGL

SEQ ID NO: 188091 - protein, 16 aa, Mycobacterium tuberculosis
FNLGAANIGDLNVGLG

SEQ ID NO: 188092 - protein, 16 aa, Mycobacterium tuberculosis
NLGAANIGDLNVGLGN

SEQ ID NO: 188093 - protein, 16 aa, Mycobacterium tuberculosis
LGAANIGDLNVGLGNV

SEQ ID NO: 188094 - protein, 16 aa, Mycobacterium tuberculosis
GAANIGDLNVGLGNVG

SEQ ID NO: 188095 - protein, 16 aa, Mycobacterium tuberculosis
AANIGDLNVGLGNVGG

SEQ ID NO: 188096 - protein, 16 aa, Mycobacterium tuberculosis
ANIGDLNVGLGNVGGG

SEQ ID NO: 188097 - protein, 16 aa, Mycobacterium tuberculosis
NIGDLNVGLGNVGGGN

SEQ ID NO: 188098 - protein, 16 aa, Mycobacterium tuberculosis
IGDLNVGLGNVGGGNV

SEQ ID NO: 188099 - protein, 16 aa, Mycobacterium tuberculosis
GDLNVGLGNVGGGNVG

SEQ ID NO: 188100 - protein, 16 aa, Mycobacterium tuberculosis
DLNVGLGNVGGGNVGF

SEQ ID NO: 188101 - protein, 16 aa, Mycobacterium tuberculosis
LNVGLGNVGGGNVGFG

SEQ ID NO: 188102 - protein, 16 aa, Mycobacterium tuberculosis
NVGLGNVGGGNVGFGN

SEQ ID NO: 188103 - protein, 16 aa, Mycobacterium tuberculosis
VGLGNVGGGNVGFGNI

SEQ ID NO: 188104 - protein, 16 aa, Mycobacterium tuberculosis
GLGNVGGGNVGFGNIG

SEQ ID NO: 188105 - protein, 16 aa, Mycobacterium tuberculosis
LGNVGGGNVGFGNIGD

SEQ ID NO: 188106 - protein, 16 aa, Mycobacterium tuberculosis
GNVGGGNVGFGNIGDA

SEQ ID NO: 188107 - protein, 16 aa, Mycobacterium tuberculosis
NVGGGNVGFGNIGDAN

SEQ ID NO: 188108 - protein, 16 aa, Mycobacterium tuberculosis
VGGGNVGFGNIGDANF

SEQ ID NO: 188109 - protein, 16 aa, Mycobacterium tuberculosis
GGGNVGFGNIGDANFG

SEQ ID NO: 188110 - protein, 16 aa, Mycobacterium tuberculosis
GGNVGFGNIGDANFGL

SEQ ID NO: 188111 - protein, 16 aa, Mycobacterium tuberculosis
GNVGFGNIGDANFGLG

SEQ ID NO: 188112 - protein, 16 aa, Mycobacterium tuberculosis
NVGFGNIGDANFGLGN

SEQ ID NO: 188113 - protein, 16 aa, Mycobacterium tuberculosis
VGFGNIGDANFGLGNA

SEQ ID NO: 188114 - protein, 16 aa, Mycobacterium tuberculosis
GFGNIGDANFGLGNAG

SEQ ID NO: 188115 - protein, 16 aa, Mycobacterium tuberculosis
FGNIGDANFGLGNAGL

SEQ ID NO: 188116 - protein, 16 aa, Mycobacterium tuberculosis
GNIGDANFGLGNAGLA

SEQ ID NO: 188117 - protein, 16 aa, Mycobacterium tuberculosis
NIGDANFGLGNAGLAA

SEQ ID NO: 188118 - protein, 16 aa, Mycobacterium tuberculosis
IGDANFGLGNAGLAAG

SEQ ID NO: 188119 - protein, 16 aa, Mycobacterium tuberculosis
GDANFGLGNAGLAAGL

SEQ ID NO: 188120 - protein, 16 aa, Mycobacterium tuberculosis
DANFGLGNAGLAAGLA

SEQ ID NO: 188121 - protein, 16 aa, Mycobacterium tuberculosis
ANFGLGNAGLAAGLAG

SEQ ID NO: 188122 - protein, 16 aa, Mycobacterium tuberculosis
NFGLGNAGLAAGLAGV

SEQ ID NO: 188123 - protein, 16 aa, Mycobacterium tuberculosis
FGLGNAGLAAGLAGVG

SEQ ID NO: 188124 - protein, 16 aa, Mycobacterium tuberculosis
GLGNAGLAAGLAGVGN

SEQ ID NO: 188125 - protein, 16 aa, Mycobacterium tuberculosis
LGNAGLAAGLAGVGNI

SEQ ID NO: 188126 - protein, 16 aa, Mycobacterium tuberculosis
GNAGLAAGLAGVGNIG

SEQ ID NO: 188127 - protein, 16 aa, Mycobacterium tuberculosis
NAGLAAGLAGVGNIGL

SEQ ID NO: 188128 - protein, 16 aa, Mycobacterium tuberculosis
AGLAAGLAGVGNIGLG

SEQ ID NO: 188129 - protein, 16 aa, Mycobacterium tuberculosis
GLAAGLAGVGNIGLGN

SEQ ID NO: 188130 - protein, 16 aa, Mycobacterium tuberculosis
LAAGLAGVGNIGLGNA

SEQ ID NO: 188131 - protein, 16 aa, Mycobacterium tuberculosis
AAGLAGVGNIGLGNAG

SEQ ID NO: 188132 - protein, 16 aa, Mycobacterium tuberculosis
AGLAGVGNIGLGNAGS

SEQ ID NO: 188133 - protein, 16 aa, Mycobacterium tuberculosis
GLAGVGNIGLGNAGSG

SEQ ID NO: 188134 - protein, 16 aa, Mycobacterium tuberculosis
LAGVGNIGLGNAGSGN

SEQ ID NO: 188135 - protein, 16 aa, Mycobacterium tuberculosis
AGVGNIGLGNAGSGNV

SEQ ID NO: 188136 - protein, 16 aa, Mycobacterium tuberculosis
GVGNIGLGNAGSGNVG

SEQ ID NO: 188137 - protein, 16 aa, Mycobacterium tuberculosis
VGNIGLGNAGSGNVGF

SEQ ID NO: 188138 - protein, 16 aa, Mycobacterium tuberculosis
GNIGLGNAGSGNVGFG

SEQ ID NO: 188139 - protein, 16 aa, Mycobacterium tuberculosis
NIGLGNAGSGNVGFGN

SEQ ID NO: 188140 - protein, 16 aa, Mycobacterium tuberculosis
IGLGNAGSGNVGFGNM

SEQ ID NO: 188141 - protein, 16 aa, Mycobacterium tuberculosis
GLGNAGSGNVGFGNMG

SEQ ID NO: 188142 - protein, 16 aa, Mycobacterium tuberculosis
LGNAGSGNVGFGNMGV

SEQ ID NO: 188143 - protein, 16 aa, Mycobacterium tuberculosis
GNAGSGNVGFGNMGVG

SEQ ID NO: 188144 - protein, 16 aa, Mycobacterium tuberculosis
NAGSGNVGFGNMGVGN

SEQ ID NO: 188145 - protein, 16 aa, Mycobacterium tuberculosis
AGSGNVGFGNMGVGNI

SEQ ID NO: 188146 - protein, 16 aa, Mycobacterium tuberculosis
GSGNVGFGNMGVGNIG

SEQ ID NO: 188147 - protein, 16 aa, Mycobacterium tuberculosis
SGNVGFGNMGVGNIGF

SEQ ID NO: 188148 - protein, 16 aa, Mycobacterium tuberculosis
GNVGFGNMGVGNIGFG

SEQ ID NO: 188149 - protein, 16 aa, Mycobacterium tuberculosis
NVGFGNMGVGNIGFGN

SEQ ID NO: 188150 - protein, 16 aa, Mycobacterium tuberculosis
VGFGNMGVGNIGFGNT

SEQ ID NO: 188151 - protein, 16 aa, Mycobacterium tuberculosis
GFGNMGVGNIGFGNTG

SEQ ID NO: 188152 - protein, 16 aa, Mycobacterium tuberculosis
FGNMGVGNIGFGNTGT

SEQ ID NO: 188153 - protein, 16 aa, Mycobacterium tuberculosis
GNMGVGNIGFGNTGTN

SEQ ID NO: 188154 - protein, 16 aa, Mycobacterium tuberculosis
NMGVGNIGFGNTGTNN

SEQ ID NO: 188155 - protein, 16 aa, Mycobacterium tuberculosis
MGVGNIGFGNTGTNNL

SEQ ID NO: 188156 - protein, 16 aa, Mycobacterium tuberculosis
GVGNIGFGNTGTNNLG

SEQ ID NO: 188157 - protein, 16 aa, Mycobacterium tuberculosis
VGNIGFGNTGTNNLGI

SEQ ID NO: 188158 - protein, 16 aa, Mycobacterium tuberculosis
GNIGFGNTGTNNLGIG

SEQ ID NO: 188159 - protein, 16 aa, Mycobacterium tuberculosis
NIGFGNTGTNNLGIGL

SEQ ID NO: 188160 - protein, 16 aa, Mycobacterium tuberculosis
IGFGNTGTNNLGIGLT

SEQ ID NO: 188161 - protein, 16 aa, Mycobacterium tuberculosis
GFGNTGTNNLGIGLTG

SEQ ID NO: 188162 - protein, 16 aa, Mycobacterium tuberculosis
FGNTGTNNLGIGLTGD

SEQ ID NO: 188163 - protein, 16 aa, Mycobacterium tuberculosis
GNTGTNNLGIGLTGDN

SEQ ID NO: 188164 - protein, 16 aa, Mycobacterium tuberculosis
NTGTNNLGIGLTGDNQ

SEQ ID NO: 188165 - protein, 16 aa, Mycobacterium tuberculosis
TGTNNLGIGLTGDNQT

SEQ ID NO: 188166 - protein, 16 aa, Mycobacterium tuberculosis
GTNNLGIGLTGDNQTG

SEQ ID NO: 188167 - protein, 16 aa, Mycobacterium tuberculosis
TNNLGIGLTGDNQTGI

SEQ ID NO: 188168 - protein, 16 aa, Mycobacterium tuberculosis
NNLGIGLTGDNQTGIG

SEQ ID NO: 188169 - protein, 16 aa, Mycobacterium tuberculosis
NLGIGLTGDNQTGIGG

SEQ ID NO: 188170 - protein, 16 aa, Mycobacterium tuberculosis
LGIGLTGDNQTGIGGL

SEQ ID NO: 188171 - protein, 16 aa, Mycobacterium tuberculosis
GIGLTGDNQTGIGGLN

SEQ ID NO: 188172 - protein, 16 aa, Mycobacterium tuberculosis
IGLTGDNQTGIGGLNS

SEQ ID NO: 188173 - protein, 16 aa, Mycobacterium tuberculosis
GLTGDNQTGIGGLNSG

SEQ ID NO: 188174 - protein, 16 aa, Mycobacterium tuberculosis
LTGDNQTGIGGLNSGA

SEQ ID NO: 188175 - protein, 16 aa, Mycobacterium tuberculosis
TGDNQTGIGGLNSGAG

SEQ ID NO: 188176 - protein, 16 aa, Mycobacterium tuberculosis
GDNQTGIGGLNSGAGN

SEQ ID NO: 188177 - protein, 16 aa, Mycobacterium tuberculosis
DNQTGIGGLNSGAGNI

SEQ ID NO: 188178 - protein, 16 aa, Mycobacterium tuberculosis
NQTGIGGLNSGAGNIG

SEQ ID NO: 188179 - protein, 16 aa, Mycobacterium tuberculosis
QTGIGGLNSGAGNIGL

SEQ ID NO: 188180 - protein, 16 aa, Mycobacterium tuberculosis
TGIGGLNSGAGNIGLF

SEQ ID NO: 188181 - protein, 16 aa, Mycobacterium tuberculosis
GIGGLNSGAGNIGLFN

SEQ ID NO: 188182 - protein, 16 aa, Mycobacterium tuberculosis
IGGLNSGAGNIGLFNS

SEQ ID NO: 188183 - protein, 16 aa, Mycobacterium tuberculosis
GGLNSGAGNIGLFNSG

SEQ ID NO: 188184 - protein, 16 aa, Mycobacterium tuberculosis
GLNSGAGNIGLFNSGT

SEQ ID NO: 188185 - protein, 16 aa, Mycobacterium tuberculosis
LNSGAGNIGLFNSGTG

SEQ ID NO: 188186 - protein, 16 aa, Mycobacterium tuberculosis
NSGAGNIGLFNSGTGN

SEQ ID NO: 188187 - protein, 16 aa, Mycobacterium tuberculosis
SGAGNIGLFNSGTGNV

SEQ ID NO: 188188 - protein, 16 aa, Mycobacterium tuberculosis
GAGNIGLFNSGTGNVG

SEQ ID NO: 188189 - protein, 16 aa, Mycobacterium tuberculosis
AGNIGLFNSGTGNVGL

SEQ ID NO: 188190 - protein, 16 aa, Mycobacterium tuberculosis
GNIGLFNSGTGNVGLF

SEQ ID NO: 188191 - protein, 16 aa, Mycobacterium tuberculosis
NIGLFNSGTGNVGLFN

SEQ ID NO: 188192 - protein, 16 aa, Mycobacterium tuberculosis
IGLFNSGTGNVGLFNS

SEQ ID NO: 188193 - protein, 16 aa, Mycobacterium tuberculosis
GLFNSGTGNVGLFNSG

SEQ ID NO: 188194 - protein, 16 aa, Mycobacterium tuberculosis
LFNSGTGNVGLFNSGT

SEQ ID NO: 188195 - protein, 16 aa, Mycobacterium tuberculosis
FNSGTGNVGLFNSGTG

SEQ ID NO: 188196 - protein, 16 aa, Mycobacterium tuberculosis
NSGTGNVGLFNSGTGN

SEQ ID NO: 188197 - protein, 16 aa, Mycobacterium tuberculosis
SGTGNVGLFNSGTGNF

SEQ ID NO: 188198 - protein, 16 aa, Mycobacterium tuberculosis
GTGNVGLFNSGTGNFG

SEQ ID NO: 188199 - protein, 16 aa, Mycobacterium tuberculosis
TGNVGLFNSGTGNFGL

SEQ ID NO: 188200 - protein, 16 aa, Mycobacterium tuberculosis
GNVGLFNSGTGNFGLF

SEQ ID NO: 188201 - protein, 16 aa, Mycobacterium tuberculosis
NVGLFNSGTGNFGLFN

SEQ ID NO: 188202 - protein, 16 aa, Mycobacterium tuberculosis
VGLFNSGTGNFGLFNS

SEQ ID NO: 188203 - protein, 16 aa, Mycobacterium tuberculosis
GLFNSGTGNFGLFNSG

SEQ ID NO: 188204 - protein, 16 aa, Mycobacterium tuberculosis
LFNSGTGNFGLFNSGS

SEQ ID NO: 188205 - protein, 16 aa, Mycobacterium tuberculosis
FNSGTGNFGLFNSGSF

SEQ ID NO: 188206 - protein, 16 aa, Mycobacterium tuberculosis
NSGTGNFGLFNSGSFN

SEQ ID NO: 188207 - protein, 16 aa, Mycobacterium tuberculosis
SGTGNFGLFNSGSFNT

SEQ ID NO: 188208 - protein, 16 aa, Mycobacterium tuberculosis
GTGNFGLFNSGSFNTG

SEQ ID NO: 188209 - protein, 16 aa, Mycobacterium tuberculosis
TGNFGLFNSGSFNTGI

SEQ ID NO: 188210 - protein, 16 aa, Mycobacterium tuberculosis
GNFGLFNSGSFNTGIG

SEQ ID NO: 188211 - protein, 16 aa, Mycobacterium tuberculosis
NFGLFNSGSFNTGIGN

SEQ ID NO: 188212 - protein, 16 aa, Mycobacterium tuberculosis
FGLFNSGSFNTGIGNG

SEQ ID NO: 188213 - protein, 16 aa, Mycobacterium tuberculosis
GLFNSGSFNTGIGNGG

SEQ ID NO: 188214 - protein, 16 aa, Mycobacterium tuberculosis
LFNSGSFNTGIGNGGT

SEQ ID NO: 188215 - protein, 16 aa, Mycobacterium tuberculosis
FNSGSFNTGIGNGGTG

SEQ ID NO: 188216 - protein, 16 aa, Mycobacterium tuberculosis
NSGSFNTGIGNGGTGS

SEQ ID NO: 188217 - protein, 16 aa, Mycobacterium tuberculosis
SGSFNTGIGNGGTGST

SEQ ID NO: 188218 - protein, 16 aa, Mycobacterium tuberculosis
GSFNTGIGNGGTGSTG

SEQ ID NO: 188219 - protein, 16 aa, Mycobacterium tuberculosis
SFNTGIGNGGTGSTGL

SEQ ID NO: 188220 - protein, 16 aa, Mycobacterium tuberculosis
FNTGIGNGGTGSTGLF

SEQ ID NO: 188221 - protein, 16 aa, Mycobacterium tuberculosis
NTGIGNGGTGSTGLFN

SEQ ID NO: 188222 - protein, 16 aa, Mycobacterium tuberculosis
TGIGNGGTGSTGLFNA

SEQ ID NO: 188223 - protein, 16 aa, Mycobacterium tuberculosis
GIGNGGTGSTGLFNAG

SEQ ID NO: 188224 - protein, 16 aa, Mycobacterium tuberculosis
IGNGGTGSTGLFNAGN

SEQ ID NO: 188225 - protein, 16 aa, Mycobacterium tuberculosis
GNGGTGSTGLFNAGNF

SEQ ID NO: 188226 - protein, 16 aa, Mycobacterium tuberculosis
NGGTGSTGLFNAGNFN

SEQ ID NO: 188227 - protein, 16 aa, Mycobacterium tuberculosis
GGTGSTGLFNAGNFNT

SEQ ID NO: 188228 - protein, 16 aa, Mycobacterium tuberculosis
GTGSTGLFNAGNFNTG

SEQ ID NO: 188229 - protein, 16 aa, Mycobacterium tuberculosis
TGSTGLFNAGNFNTGV

SEQ ID NO: 188230 - protein, 16 aa, Mycobacterium tuberculosis
GSTGLFNAGNFNTGVA

SEQ ID NO: 188231 - protein, 16 aa, Mycobacterium tuberculosis
STGLFNAGNFNTGVAN

SEQ ID NO: 188232 - protein, 16 aa, Mycobacterium tuberculosis
TGLFNAGNFNTGVANP

SEQ ID NO: 188233 - protein, 16 aa, Mycobacterium tuberculosis
GLFNAGNFNTGVANPG

SEQ ID NO: 188234 - protein, 16 aa, Mycobacterium tuberculosis
LFNAGNFNTGVANPGS

SEQ ID NO: 188235 - protein, 16 aa, Mycobacterium tuberculosis
FNAGNFNTGVANPGSY

SEQ ID NO: 188236 - protein, 16 aa, Mycobacterium tuberculosis
NAGNFNTGVANPGSYN

SEQ ID NO: 188237 - protein, 16 aa, Mycobacterium tuberculosis
AGNFNTGVANPGSYNT

SEQ ID NO: 188238 - protein, 16 aa, Mycobacterium tuberculosis
GNFNTGVANPGSYNTG

SEQ ID NO: 188239 - protein, 16 aa, Mycobacterium tuberculosis
NFNTGVANPGSYNTGS

SEQ ID NO: 188240 - protein, 16 aa, Mycobacterium tuberculosis
FNTGVANPGSYNTGSF

SEQ ID NO: 188241 - protein, 16 aa, Mycobacterium tuberculosis
NTGVANPGSYNTGSFN

SEQ ID NO: 188242 - protein, 16 aa, Mycobacterium tuberculosis
TGVANPGSYNTGSFNV

SEQ ID NO: 188243 - protein, 16 aa, Mycobacterium tuberculosis
GVANPGSYNTGSFNVG

SEQ ID NO: 188244 - protein, 16 aa, Mycobacterium tuberculosis
VANPGSYNTGSFNVGD

SEQ ID NO: 188245 - protein, 16 aa, Mycobacterium tuberculosis
ANPGSYNTGSFNVGDT

SEQ ID NO: 188246 - protein, 16 aa, Mycobacterium tuberculosis
NPGSYNTGSFNVGDTN

SEQ ID NO: 188247 - protein, 16 aa, Mycobacterium tuberculosis
PGSYNTGSFNVGDTNT

SEQ ID NO: 188248 - protein, 16 aa, Mycobacterium tuberculosis
GSYNTGSFNVGDTNTG

SEQ ID NO: 188249 - protein, 16 aa, Mycobacterium tuberculosis
SYNTGSFNVGDTNTGG

SEQ ID NO: 188250 - protein, 16 aa, Mycobacterium tuberculosis
YNTGSFNVGDTNTGGF

SEQ ID NO: 188251 - protein, 16 aa, Mycobacterium tuberculosis
NTGSFNVGDTNTGGFN

SEQ ID NO: 188252 - protein, 16 aa, Mycobacterium tuberculosis
TGSFNVGDTNTGGFNP

SEQ ID NO: 188253 - protein, 16 aa, Mycobacterium tuberculosis
GSFNVGDTNTGGFNPG

SEQ ID NO: 188254 - protein, 16 aa, Mycobacterium tuberculosis
SFNVGDTNTGGFNPGS

SEQ ID NO: 188255 - protein, 16 aa, Mycobacterium tuberculosis
FNVGDTNTGGFNPGSI

SEQ ID NO: 188256 - protein, 16 aa, Mycobacterium tuberculosis
NVGDTNTGGFNPGSIN

SEQ ID NO: 188257 - protein, 16 aa, Mycobacterium tuberculosis
VGDTNTGGFNPGSINT

SEQ ID NO: 188258 - protein, 16 aa, Mycobacterium tuberculosis
GDTNTGGFNPGSINTG

SEQ ID NO: 188259 - protein, 16 aa, Mycobacterium tuberculosis
DTNTGGFNPGSINTGW

SEQ ID NO: 188260 - protein, 16 aa, Mycobacterium tuberculosis
TNTGGFNPGSINTGWF

SEQ ID NO: 188261 - protein, 16 aa, Mycobacterium tuberculosis
NTGGFNPGSINTGWFN

SEQ ID NO: 188262 - protein, 16 aa, Mycobacterium tuberculosis
TGGFNPGSINTGWFNT

SEQ ID NO: 188263 - protein, 16 aa, Mycobacterium tuberculosis
GGFNPGSINTGWFNTG

SEQ ID NO: 188264 - protein, 16 aa, Mycobacterium tuberculosis
GFNPGSINTGWFNTGN

SEQ ID NO: 188265 - protein, 16 aa, Mycobacterium tuberculosis
FNPGSINTGWFNTGNA

SEQ ID NO: 188266 - protein, 16 aa, Mycobacterium tuberculosis
NPGSINTGWFNTGNAN

SEQ ID NO: 188267 - protein, 16 aa, Mycobacterium tuberculosis
PGSINTGWFNTGNANT

SEQ ID NO: 188268 - protein, 16 aa, Mycobacterium tuberculosis
GSINTGWFNTGNANTG

SEQ ID NO: 188269 - protein, 16 aa, Mycobacterium tuberculosis
SINTGWFNTGNANTGV

SEQ ID NO: 188270 - protein, 16 aa, Mycobacterium tuberculosis
INTGWFNTGNANTGVA

SEQ ID NO: 188271 - protein, 16 aa, Mycobacterium tuberculosis
NTGWFNTGNANTGVAN

SEQ ID NO: 188272 - protein, 16 aa, Mycobacterium tuberculosis
TGWFNTGNANTGVANS

SEQ ID NO: 188273 - protein, 16 aa, Mycobacterium tuberculosis
GWFNTGNANTGVANSG

SEQ ID NO: 188274 - protein, 16 aa, Mycobacterium tuberculosis
WFNTGNANTGVANSGN

SEQ ID NO: 188275 - protein, 16 aa, Mycobacterium tuberculosis
FNTGNANTGVANSGNV

SEQ ID NO: 188276 - protein, 16 aa, Mycobacterium tuberculosis
NTGNANTGVANSGNVD

SEQ ID NO: 188277 - protein, 16 aa, Mycobacterium tuberculosis
TGNANTGVANSGNVDT

SEQ ID NO: 188278 - protein, 16 aa, Mycobacterium tuberculosis
GNANTGVANSGNVDTG

SEQ ID NO: 188279 - protein, 16 aa, Mycobacterium tuberculosis
NANTGVANSGNVDTGA

SEQ ID NO: 188280 - protein, 16 aa, Mycobacterium tuberculosis
ANTGVANSGNVDTGAL

SEQ ID NO: 188281 - protein, 16 aa, Mycobacterium tuberculosis
NTGVANSGNVDTGALM

SEQ ID NO: 188282 - protein, 16 aa, Mycobacterium tuberculosis
TGVANSGNVDTGALMS

SEQ ID NO: 188283 - protein, 16 aa, Mycobacterium tuberculosis
GVANSGNVDTGALMSG

SEQ ID NO: 188284 - protein, 16 aa, Mycobacterium tuberculosis
VANSGNVDTGALMSGN

SEQ ID NO: 188285 - protein, 16 aa, Mycobacterium tuberculosis
ANSGNVDTGALMSGNF

SEQ ID NO: 188286 - protein, 16 aa, Mycobacterium tuberculosis
NSGNVDTGALMSGNFS

SEQ ID NO: 188287 - protein, 16 aa, Mycobacterium tuberculosis
SGNVDTGALMSGNFSN

SEQ ID NO: 188288 - protein, 16 aa, Mycobacterium tuberculosis
GNVDTGALMSGNFSNG

SEQ ID NO: 188289 - protein, 16 aa, Mycobacterium tuberculosis
NVDTGALMSGNFSNGI

SEQ ID NO: 188290 - protein, 16 aa, Mycobacterium tuberculosis
VDTGALMSGNFSNGIL

SEQ ID NO: 188291 - protein, 16 aa, Mycobacterium tuberculosis
DTGALMSGNFSNGILW

SEQ ID NO: 188292 - protein, 16 aa, Mycobacterium tuberculosis
TGALMSGNFSNGILWR

SEQ ID NO: 188293 - protein, 16 aa, Mycobacterium tuberculosis
GALMSGNFSNGILWRG

SEQ ID NO: 188294 - protein, 16 aa, Mycobacterium tuberculosis
ALMSGNFSNGILWRGN

SEQ ID NO: 188295 - protein, 16 aa, Mycobacterium tuberculosis
LMSGNFSNGILWRGNF

SEQ ID NO: 188296 - protein, 16 aa, Mycobacterium tuberculosis
MSGNFSNGILWRGNFE

SEQ ID NO: 188297 - protein, 16 aa, Mycobacterium tuberculosis
SGNFSNGILWRGNFEG

SEQ ID NO: 188298 - protein, 16 aa, Mycobacterium tuberculosis
GNFSNGILWRGNFEGL

SEQ ID NO: 188299 - protein, 16 aa, Mycobacterium tuberculosis
NFSNGILWRGNFEGLF

SEQ ID NO: 188300 - protein, 16 aa, Mycobacterium tuberculosis
FSNGILWRGNFEGLFG

SEQ ID NO: 188301 - protein, 16 aa, Mycobacterium tuberculosis
SNGILWRGNFEGLFGL

SEQ ID NO: 188302 - protein, 16 aa, Mycobacterium tuberculosis
NGILWRGNFEGLFGLN

SEQ ID NO: 188303 - protein, 16 aa, Mycobacterium tuberculosis
GILWRGNFEGLFGLNV

SEQ ID NO: 188304 - protein, 16 aa, Mycobacterium tuberculosis
ILWRGNFEGLFGLNVG

SEQ ID NO: 188305 - protein, 16 aa, Mycobacterium tuberculosis
LWRGNFEGLFGLNVGI

SEQ ID NO: 188306 - protein, 16 aa, Mycobacterium tuberculosis
WRGNFEGLFGLNVGIT

SEQ ID NO: 188307 - protein, 16 aa, Mycobacterium tuberculosis
RGNFEGLFGLNVGITI

SEQ ID NO: 188308 - protein, 16 aa, Mycobacterium tuberculosis
GNFEGLFGLNVGITIP

SEQ ID NO: 188309 - protein, 16 aa, Mycobacterium tuberculosis
NFEGLFGLNVGITIPE

SEQ ID NO: 188310 - protein, 16 aa, Mycobacterium tuberculosis
FEGLFGLNVGITIPEF

SEQ ID NO: 188311 - protein, 16 aa, Mycobacterium tuberculosis
EGLFGLNVGITIPEFP

SEQ ID NO: 188312 - protein, 16 aa, Mycobacterium tuberculosis
GLFGLNVGITIPEFPI

SEQ ID NO: 188313 - protein, 16 aa, Mycobacterium tuberculosis
LFGLNVGITIPEFPIH

SEQ ID NO: 188314 - protein, 16 aa, Mycobacterium tuberculosis
FGLNVGITIPEFPIHW

SEQ ID NO: 188315 - protein, 16 aa, Mycobacterium tuberculosis
GLNVGITIPEFPIHWT

SEQ ID NO: 188316 - protein, 16 aa, Mycobacterium tuberculosis
LNVGITIPEFPIHWTS

SEQ ID NO: 188317 - protein, 16 aa, Mycobacterium tuberculosis
NVGITIPEFPIHWTST

SEQ ID NO: 188318 - protein, 16 aa, Mycobacterium tuberculosis
VGITIPEFPIHWTSTG

SEQ ID NO: 188319 - protein, 16 aa, Mycobacterium tuberculosis
GITIPEFPIHWTSTGG

SEQ ID NO: 188320 - protein, 16 aa, Mycobacterium tuberculosis
ITIPEFPIHWTSTGGI

SEQ ID NO: 188321 - protein, 16 aa, Mycobacterium tuberculosis
TIPEFPIHWTSTGGIG

SEQ ID NO: 188322 - protein, 16 aa, Mycobacterium tuberculosis
IPEFPIHWTSTGGIGP

SEQ ID NO: 188323 - protein, 16 aa, Mycobacterium tuberculosis
PEFPIHWTSTGGIGPI

SEQ ID NO: 188324 - protein, 16 aa, Mycobacterium tuberculosis
EFPIHWTSTGGIGPII

SEQ ID NO: 188325 - protein, 16 aa, Mycobacterium tuberculosis
FPIHWTSTGGIGPIII

SEQ ID NO: 188326 - protein, 16 aa, Mycobacterium tuberculosis
PIHWTSTGGIGPIIIP

SEQ ID NO: 188327 - protein, 16 aa, Mycobacterium tuberculosis
IHWTSTGGIGPIIIPD

SEQ ID NO: 188328 - protein, 16 aa, Mycobacterium tuberculosis
HWTSTGGIGPIIIPDT

SEQ ID NO: 188329 - protein, 16 aa, Mycobacterium tuberculosis
WTSTGGIGPIIIPDTT

SEQ ID NO: 188330 - protein, 16 aa, Mycobacterium tuberculosis
TSTGGIGPIIIPDTTI

SEQ ID NO: 188331 - protein, 16 aa, Mycobacterium tuberculosis
STGGIGPIIIPDTTIL

SEQ ID NO: 188332 - protein, 16 aa, Mycobacterium tuberculosis
TGGIGPIIIPDTTILP

SEQ ID NO: 188333 - protein, 16 aa, Mycobacterium tuberculosis
GGIGPIIIPDTTILPP

SEQ ID NO: 188334 - protein, 16 aa, Mycobacterium tuberculosis
GIGPIIIPDTTILPPI

SEQ ID NO: 188335 - protein, 16 aa, Mycobacterium tuberculosis
IGPIIIPDTTILPPIH

SEQ ID NO: 188336 - protein, 16 aa, Mycobacterium tuberculosis
GPIIIPDTTILPPIHL

SEQ ID NO: 188337 - protein, 16 aa, Mycobacterium tuberculosis
PIIIPDTTILPPIHLG

SEQ ID NO: 188338 - protein, 16 aa, Mycobacterium tuberculosis
IIIPDTTILPPIHLGL

SEQ ID NO: 188339 - protein, 16 aa, Mycobacterium tuberculosis
IIPDTTILPPIHLGLT

SEQ ID NO: 188340 - protein, 16 aa, Mycobacterium tuberculosis
IPDTTILPPIHLGLTG

SEQ ID NO: 188341 - protein, 16 aa, Mycobacterium tuberculosis
PDTTILPPIHLGLTGQ

SEQ ID NO: 188342 - protein, 16 aa, Mycobacterium tuberculosis
DTTILPPIHLGLTGQA

SEQ ID NO: 188343 - protein, 16 aa, Mycobacterium tuberculosis
TTILPPIHLGLTGQAN

SEQ ID NO: 188344 - protein, 16 aa, Mycobacterium tuberculosis
TILPPIHLGLTGQANY

SEQ ID NO: 188345 - protein, 16 aa, Mycobacterium tuberculosis
ILPPIHLGLTGQANYG

SEQ ID NO: 188346 - protein, 16 aa, Mycobacterium tuberculosis
LPPIHLGLTGQANYGF

SEQ ID NO: 188347 - protein, 16 aa, Mycobacterium tuberculosis
PPIHLGLTGQANYGFA

SEQ ID NO: 188348 - protein, 16 aa, Mycobacterium tuberculosis
PIHLGLTGQANYGFAV

SEQ ID NO: 188349 - protein, 16 aa, Mycobacterium tuberculosis
IHLGLTGQANYGFAVP

SEQ ID NO: 188350 - protein, 16 aa, Mycobacterium tuberculosis
HLGLTGQANYGFAVPD

SEQ ID NO: 188351 - protein, 16 aa, Mycobacterium tuberculosis
LGLTGQANYGFAVPDI

SEQ ID NO: 188352 - protein, 16 aa, Mycobacterium tuberculosis
GLTGQANYGFAVPDIP

SEQ ID NO: 188353 - protein, 16 aa, Mycobacterium tuberculosis
LTGQANYGFAVPDIPI

SEQ ID NO: 188354 - protein, 16 aa, Mycobacterium tuberculosis
TGQANYGFAVPDIPIP

SEQ ID NO: 188355 - protein, 16 aa, Mycobacterium tuberculosis
GQANYGFAVPDIPIPA

SEQ ID NO: 188356 - protein, 16 aa, Mycobacterium tuberculosis
QANYGFAVPDIPIPAI

SEQ ID NO: 188357 - protein, 16 aa, Mycobacterium tuberculosis
ANYGFAVPDIPIPAIH

SEQ ID NO: 188358 - protein, 16 aa, Mycobacterium tuberculosis
NYGFAVPDIPIPAIHI

SEQ ID NO: 188359 - protein, 16 aa, Mycobacterium tuberculosis
YGFAVPDIPIPAIHID

SEQ ID NO: 188360 - protein, 16 aa, Mycobacterium tuberculosis
GFAVPDIPIPAIHIDF

SEQ ID NO: 188361 - protein, 16 aa, Mycobacterium tuberculosis
FAVPDIPIPAIHIDFD

SEQ ID NO: 188362 - protein, 16 aa, Mycobacterium tuberculosis
AVPDIPIPAIHIDFDG

SEQ ID NO: 188363 - protein, 16 aa, Mycobacterium tuberculosis
VPDIPIPAIHIDFDGA

SEQ ID NO: 188364 - protein, 16 aa, Mycobacterium tuberculosis
PDIPIPAIHIDFDGAA

SEQ ID NO: 188365 - protein, 16 aa, Mycobacterium tuberculosis
DIPIPAIHIDFDGAAD

SEQ ID NO: 188366 - protein, 16 aa, Mycobacterium tuberculosis
IPIPAIHIDFDGAADA

SEQ ID NO: 188367 - protein, 16 aa, Mycobacterium tuberculosis
PIPAIHIDFDGAADAG

SEQ ID NO: 188368 - protein, 16 aa, Mycobacterium tuberculosis
IPAIHIDFDGAADAGF

SEQ ID NO: 188369 - protein, 16 aa, Mycobacterium tuberculosis
PAIHIDFDGAADAGFT

SEQ ID NO: 188370 - protein, 16 aa, Mycobacterium tuberculosis
AIHIDFDGAADAGFTA

SEQ ID NO: 188371 - protein, 16 aa, Mycobacterium tuberculosis
IHIDFDGAADAGFTAP

SEQ ID NO: 188372 - protein, 16 aa, Mycobacterium tuberculosis
HIDFDGAADAGFTAPA

SEQ ID NO: 188373 - protein, 16 aa, Mycobacterium tuberculosis
IDFDGAADAGFTAPAT

SEQ ID NO: 188374 - protein, 16 aa, Mycobacterium tuberculosis
DFDGAADAGFTAPATT

SEQ ID NO: 188375 - protein, 16 aa, Mycobacterium tuberculosis
FDGAADAGFTAPATTL

SEQ ID NO: 188376 - protein, 16 aa, Mycobacterium tuberculosis
DGAADAGFTAPATTLL

SEQ ID NO: 188377 - protein, 16 aa, Mycobacterium tuberculosis
GAADAGFTAPATTLLS

SEQ ID NO: 188378 - protein, 16 aa, Mycobacterium tuberculosis
AADAGFTAPATTLLSA

SEQ ID NO: 188379 - protein, 16 aa, Mycobacterium tuberculosis
ADAGFTAPATTLLSAL

SEQ ID NO: 188380 - protein, 16 aa, Mycobacterium tuberculosis
DAGFTAPATTLLSALG

SEQ ID NO: 188381 - protein, 16 aa, Mycobacterium tuberculosis
AGFTAPATTLLSALGI

SEQ ID NO: 188382 - protein, 16 aa, Mycobacterium tuberculosis
GFTAPATTLLSALGIT

SEQ ID NO: 188383 - protein, 16 aa, Mycobacterium tuberculosis
FTAPATTLLSALGITG

SEQ ID NO: 188384 - protein, 16 aa, Mycobacterium tuberculosis
TAPATTLLSALGITGQ

SEQ ID NO: 188385 - protein, 16 aa, Mycobacterium tuberculosis
APATTLLSALGITGQF

SEQ ID NO: 188386 - protein, 16 aa, Mycobacterium tuberculosis
PATTLLSALGITGQFR

SEQ ID NO: 188387 - protein, 16 aa, Mycobacterium tuberculosis
ATTLLSALGITGQFRF

SEQ ID NO: 188388 - protein, 16 aa, Mycobacterium tuberculosis
TTLLSALGITGQFRFG

SEQ ID NO: 188389 - protein, 16 aa, Mycobacterium tuberculosis
TLLSALGITGQFRFGP

SEQ ID NO: 188390 - protein, 16 aa, Mycobacterium tuberculosis
LLSALGITGQFRFGPI

SEQ ID NO: 188391 - protein, 16 aa, Mycobacterium tuberculosis
LSALGITGQFRFGPIT

SEQ ID NO: 188392 - protein, 16 aa, Mycobacterium tuberculosis
SALGITGQFRFGPITV

SEQ ID NO: 188393 - protein, 16 aa, Mycobacterium tuberculosis
ALGITGQFRFGPITVS

SEQ ID NO: 188394 - protein, 16 aa, Mycobacterium tuberculosis
LGITGQFRFGPITVSN

SEQ ID NO: 188395 - protein, 16 aa, Mycobacterium tuberculosis
GITGQFRFGPITVSNV

SEQ ID NO: 188396 - protein, 16 aa, Mycobacterium tuberculosis
ITGQFRFGPITVSNVQ

SEQ ID NO: 188397 - protein, 16 aa, Mycobacterium tuberculosis
TGQFRFGPITVSNVQL

SEQ ID NO: 188398 - protein, 16 aa, Mycobacterium tuberculosis
GQFRFGPITVSNVQLN

SEQ ID NO: 188399 - protein, 16 aa, Mycobacterium tuberculosis
QFRFGPITVSNVQLNP

SEQ ID NO: 188400 - protein, 16 aa, Mycobacterium tuberculosis
FRFGPITVSNVQLNPF

SEQ ID NO: 188401 - protein, 16 aa, Mycobacterium tuberculosis
RFGPITVSNVQLNPFN

SEQ ID NO: 188402 - protein, 16 aa, Mycobacterium tuberculosis
FGPITVSNVQLNPFNV

SEQ ID NO: 188403 - protein, 16 aa, Mycobacterium tuberculosis
GPITVSNVQLNPFNVN

SEQ ID NO: 188404 - protein, 16 aa, Mycobacterium tuberculosis
PITVSNVQLNPFNVNL

SEQ ID NO: 188405 - protein, 16 aa, Mycobacterium tuberculosis
ITVSNVQLNPFNVNLK

SEQ ID NO: 188406 - protein, 16 aa, Mycobacterium tuberculosis
TVSNVQLNPFNVNLKL

SEQ ID NO: 188407 - protein, 16 aa, Mycobacterium tuberculosis
VSNVQLNPFNVNLKLQ

SEQ ID NO: 188408 - protein, 16 aa, Mycobacterium tuberculosis
SNVQLNPFNVNLKLQF

SEQ ID NO: 188409 - protein, 16 aa, Mycobacterium tuberculosis
NVQLNPFNVNLKLQFL

SEQ ID NO: 188410 - protein, 16 aa, Mycobacterium tuberculosis
VQLNPFNVNLKLQFLH

SEQ ID NO: 188411 - protein, 16 aa, Mycobacterium tuberculosis
QLNPFNVNLKLQFLHD

SEQ ID NO: 188412 - protein, 16 aa, Mycobacterium tuberculosis
LNPFNVNLKLQFLHDA

SEQ ID NO: 188413 - protein, 16 aa, Mycobacterium tuberculosis
NPFNVNLKLQFLHDAF

SEQ ID NO: 188414 - protein, 16 aa, Mycobacterium tuberculosis
PFNVNLKLQFLHDAFP

SEQ ID NO: 188415 - protein, 16 aa, Mycobacterium tuberculosis
FNVNLKLQFLHDAFPN

SEQ ID NO: 188416 - protein, 16 aa, Mycobacterium tuberculosis
NVNLKLQFLHDAFPNE

SEQ ID NO: 188417 - protein, 16 aa, Mycobacterium tuberculosis
VNLKLQFLHDAFPNEF

SEQ ID NO: 188418 - protein, 16 aa, Mycobacterium tuberculosis
NLKLQFLHDAFPNEFP

SEQ ID NO: 188419 - protein, 16 aa, Mycobacterium tuberculosis
LKLQFLHDAFPNEFPD

SEQ ID NO: 188420 - protein, 16 aa, Mycobacterium tuberculosis
KLQFLHDAFPNEFPDP

SEQ ID NO: 188421 - protein, 16 aa, Mycobacterium tuberculosis
LQFLHDAFPNEFPDPT

SEQ ID NO: 188422 - protein, 16 aa, Mycobacterium tuberculosis
QFLHDAFPNEFPDPTI

SEQ ID NO: 188423 - protein, 16 aa, Mycobacterium tuberculosis
FLHDAFPNEFPDPTIS

SEQ ID NO: 188424 - protein, 16 aa, Mycobacterium tuberculosis
LHDAFPNEFPDPTISV

SEQ ID NO: 188425 - protein, 16 aa, Mycobacterium tuberculosis
HDAFPNEFPDPTISVQ

SEQ ID NO: 188426 - protein, 16 aa, Mycobacterium tuberculosis
DAFPNEFPDPTISVQI

SEQ ID NO: 188427 - protein, 16 aa, Mycobacterium tuberculosis
AFPNEFPDPTISVQIQ

SEQ ID NO: 188428 - protein, 16 aa, Mycobacterium tuberculosis
FPNEFPDPTISVQIQV

SEQ ID NO: 188429 - protein, 16 aa, Mycobacterium tuberculosis
PNEFPDPTISVQIQVA

SEQ ID NO: 188430 - protein, 16 aa, Mycobacterium tuberculosis
NEFPDPTISVQIQVAI

SEQ ID NO: 188431 - protein, 16 aa, Mycobacterium tuberculosis
EFPDPTISVQIQVAIP

SEQ ID NO: 188432 - protein, 16 aa, Mycobacterium tuberculosis
FPDPTISVQIQVAIPL

SEQ ID NO: 188433 - protein, 16 aa, Mycobacterium tuberculosis
PDPTISVQIQVAIPLT

SEQ ID NO: 188434 - protein, 16 aa, Mycobacterium tuberculosis
DPTISVQIQVAIPLTS

SEQ ID NO: 188435 - protein, 16 aa, Mycobacterium tuberculosis
PTISVQIQVAIPLTSA

SEQ ID NO: 188436 - protein, 16 aa, Mycobacterium tuberculosis
TISVQIQVAIPLTSAT

SEQ ID NO: 188437 - protein, 16 aa, Mycobacterium tuberculosis
ISVQIQVAIPLTSATL

SEQ ID NO: 188438 - protein, 16 aa, Mycobacterium tuberculosis
SVQIQVAIPLTSATLG

SEQ ID NO: 188439 - protein, 16 aa, Mycobacterium tuberculosis
VQIQVAIPLTSATLGG

SEQ ID NO: 188440 - protein, 16 aa, Mycobacterium tuberculosis
QIQVAIPLTSATLGGL

SEQ ID NO: 188441 - protein, 16 aa, Mycobacterium tuberculosis
IQVAIPLTSATLGGLA

SEQ ID NO: 188442 - protein, 16 aa, Mycobacterium tuberculosis
QVAIPLTSATLGGLAL

SEQ ID NO: 188443 - protein, 16 aa, Mycobacterium tuberculosis
VAIPLTSATLGGLALP

SEQ ID NO: 188444 - protein, 16 aa, Mycobacterium tuberculosis
AIPLTSATLGGLALPL

SEQ ID NO: 188445 - protein, 16 aa, Mycobacterium tuberculosis
IPLTSATLGGLALPLQ

SEQ ID NO: 188446 - protein, 16 aa, Mycobacterium tuberculosis
PLTSATLGGLALPLQQ

SEQ ID NO: 188447 - protein, 16 aa, Mycobacterium tuberculosis
LTSATLGGLALPLQQT

SEQ ID NO: 188448 - protein, 16 aa, Mycobacterium tuberculosis
TSATLGGLALPLQQTI

SEQ ID NO: 188449 - protein, 16 aa, Mycobacterium tuberculosis
SATLGGLALPLQQTID

SEQ ID NO: 188450 - protein, 16 aa, Mycobacterium tuberculosis
ATLGGLALPLQQTIDA

SEQ ID NO: 188451 - protein, 16 aa, Mycobacterium tuberculosis
TLGGLALPLQQTIDAI

SEQ ID NO: 188452 - protein, 16 aa, Mycobacterium tuberculosis
LGGLALPLQQTIDAIE

SEQ ID NO: 188453 - protein, 16 aa, Mycobacterium tuberculosis
GGLALPLQQTIDAIEL

SEQ ID NO: 188454 - protein, 16 aa, Mycobacterium tuberculosis
GLALPLQQTIDAIELP

SEQ ID NO: 188455 - protein, 16 aa, Mycobacterium tuberculosis
LALPLQQTIDAIELPA

SEQ ID NO: 188456 - protein, 16 aa, Mycobacterium tuberculosis
ALPLQQTIDAIELPAI

SEQ ID NO: 188457 - protein, 16 aa, Mycobacterium tuberculosis
LPLQQTIDAIELPAIS

SEQ ID NO: 188458 - protein, 16 aa, Mycobacterium tuberculosis
PLQQTIDAIELPAISF

SEQ ID NO: 188459 - protein, 16 aa, Mycobacterium tuberculosis
LQQTIDAIELPAISFS

SEQ ID NO: 188460 - protein, 16 aa, Mycobacterium tuberculosis
QQTIDAIELPAISFSQ

SEQ ID NO: 188461 - protein, 16 aa, Mycobacterium tuberculosis
QTIDAIELPAISFSQS

SEQ ID NO: 188462 - protein, 16 aa, Mycobacterium tuberculosis
TIDAIELPAISFSQSI

SEQ ID NO: 188463 - protein, 16 aa, Mycobacterium tuberculosis
IDAIELPAISFSQSIP

SEQ ID NO: 188464 - protein, 16 aa, Mycobacterium tuberculosis
DAIELPAISFSQSIPI

SEQ ID NO: 188465 - protein, 16 aa, Mycobacterium tuberculosis
AIELPAISFSQSIPID

SEQ ID NO: 188466 - protein, 16 aa, Mycobacterium tuberculosis
IELPAISFSQSIPIDI

SEQ ID NO: 188467 - protein, 16 aa, Mycobacterium tuberculosis
ELPAISFSQSIPIDIP

SEQ ID NO: 188468 - protein, 16 aa, Mycobacterium tuberculosis
LPAISFSQSIPIDIPP

SEQ ID NO: 188469 - protein, 16 aa, Mycobacterium tuberculosis
PAISFSQSIPIDIPPI

SEQ ID NO: 188470 - protein, 16 aa, Mycobacterium tuberculosis
AISFSQSIPIDIPPID

SEQ ID NO: 188471 - protein, 16 aa, Mycobacterium tuberculosis
ISFSQSIPIDIPPIDI

SEQ ID NO: 188472 - protein, 16 aa, Mycobacterium tuberculosis
SFSQSIPIDIPPIDIP

SEQ ID NO: 188473 - protein, 16 aa, Mycobacterium tuberculosis
FSQSIPIDIPPIDIPA

SEQ ID NO: 188474 - protein, 16 aa, Mycobacterium tuberculosis
SQSIPIDIPPIDIPAS

SEQ ID NO: 188475 - protein, 16 aa, Mycobacterium tuberculosis
QSIPIDIPPIDIPAST

SEQ ID NO: 188476 - protein, 16 aa, Mycobacterium tuberculosis
SIPIDIPPIDIPASTI

SEQ ID NO: 188477 - protein, 16 aa, Mycobacterium tuberculosis
IPIDIPPIDIPASTIN

SEQ ID NO: 188478 - protein, 16 aa, Mycobacterium tuberculosis
PIDIPPIDIPASTING

SEQ ID NO: 188479 - protein, 16 aa, Mycobacterium tuberculosis
IDIPPIDIPASTINGI

SEQ ID NO: 188480 - protein, 16 aa, Mycobacterium tuberculosis
DIPPIDIPASTINGIS

SEQ ID NO: 188481 - protein, 16 aa, Mycobacterium tuberculosis
IPPIDIPASTINGISM

SEQ ID NO: 188482 - protein, 16 aa, Mycobacterium tuberculosis
PPIDIPASTINGISMS

SEQ ID NO: 188483 - protein, 16 aa, Mycobacterium tuberculosis
PIDIPASTINGISMSE

SEQ ID NO: 188484 - protein, 16 aa, Mycobacterium tuberculosis
IDIPASTINGISMSEV

SEQ ID NO: 188485 - protein, 16 aa, Mycobacterium tuberculosis
DIPASTINGISMSEVV

SEQ ID NO: 188486 - protein, 16 aa, Mycobacterium tuberculosis
IPASTINGISMSEVVP

SEQ ID NO: 188487 - protein, 16 aa, Mycobacterium tuberculosis
PASTINGISMSEVVPI

SEQ ID NO: 188488 - protein, 16 aa, Mycobacterium tuberculosis
ASTINGISMSEVVPID

SEQ ID NO: 188489 - protein, 16 aa, Mycobacterium tuberculosis
STINGISMSEVVPIDV

SEQ ID NO: 188490 - protein, 16 aa, Mycobacterium tuberculosis
TINGISMSEVVPIDVS

SEQ ID NO: 188491 - protein, 16 aa, Mycobacterium tuberculosis
INGISMSEVVPIDVSV

SEQ ID NO: 188492 - protein, 16 aa, Mycobacterium tuberculosis
NGISMSEVVPIDVSVD

SEQ ID NO: 188493 - protein, 16 aa, Mycobacterium tuberculosis
GISMSEVVPIDVSVDI

SEQ ID NO: 188494 - protein, 16 aa, Mycobacterium tuberculosis
ISMSEVVPIDVSVDIP

SEQ ID NO: 188495 - protein, 16 aa, Mycobacterium tuberculosis
SMSEVVPIDVSVDIPA

SEQ ID NO: 188496 - protein, 16 aa, Mycobacterium tuberculosis
MSEVVPIDVSVDIPAV

SEQ ID NO: 188497 - protein, 16 aa, Mycobacterium tuberculosis
SEVVPIDVSVDIPAVT

SEQ ID NO: 188498 - protein, 16 aa, Mycobacterium tuberculosis
EVVPIDVSVDIPAVTI

SEQ ID NO: 188499 - protein, 16 aa, Mycobacterium tuberculosis
VVPIDVSVDIPAVTIT

SEQ ID NO: 188500 - protein, 16 aa, Mycobacterium tuberculosis
VPIDVSVDIPAVTITG

SEQ ID NO: 188501 - protein, 16 aa, Mycobacterium tuberculosis
PIDVSVDIPAVTITGT

SEQ ID NO: 188502 - protein, 16 aa, Mycobacterium tuberculosis
IDVSVDIPAVTITGTR

SEQ ID NO: 188503 - protein, 16 aa, Mycobacterium tuberculosis
DVSVDIPAVTITGTRI

SEQ ID NO: 188504 - protein, 16 aa, Mycobacterium tuberculosis
VSVDIPAVTITGTRID

SEQ ID NO: 188505 - protein, 16 aa, Mycobacterium tuberculosis
SVDIPAVTITGTRIDP

SEQ ID NO: 188506 - protein, 16 aa, Mycobacterium tuberculosis
VDIPAVTITGTRIDPI

SEQ ID NO: 188507 - protein, 16 aa, Mycobacterium tuberculosis
DIPAVTITGTRIDPIP

SEQ ID NO: 188508 - protein, 16 aa, Mycobacterium tuberculosis
IPAVTITGTRIDPIPL

SEQ ID NO: 188509 - protein, 16 aa, Mycobacterium tuberculosis
PAVTITGTRIDPIPLN

SEQ ID NO: 188510 - protein, 16 aa, Mycobacterium tuberculosis
AVTITGTRIDPIPLNF

SEQ ID NO: 188511 - protein, 16 aa, Mycobacterium tuberculosis
VTITGTRIDPIPLNFD

SEQ ID NO: 188512 - protein, 16 aa, Mycobacterium tuberculosis
TITGTRIDPIPLNFDV

SEQ ID NO: 188513 - protein, 16 aa, Mycobacterium tuberculosis
ITGTRIDPIPLNFDVL

SEQ ID NO: 188514 - protein, 16 aa, Mycobacterium tuberculosis
TGTRIDPIPLNFDVLS

SEQ ID NO: 188515 - protein, 16 aa, Mycobacterium tuberculosis
GTRIDPIPLNFDVLSS

SEQ ID NO: 188516 - protein, 16 aa, Mycobacterium tuberculosis
TRIDPIPLNFDVLSSA

SEQ ID NO: 188517 - protein, 16 aa, Mycobacterium tuberculosis
RIDPIPLNFDVLSSAG

SEQ ID NO: 188518 - protein, 16 aa, Mycobacterium tuberculosis
IDPIPLNFDVLSSAGP

SEQ ID NO: 188519 - protein, 16 aa, Mycobacterium tuberculosis
DPIPLNFDVLSSAGPI

SEQ ID NO: 188520 - protein, 16 aa, Mycobacterium tuberculosis
PIPLNFDVLSSAGPIN

SEQ ID NO: 188521 - protein, 16 aa, Mycobacterium tuberculosis
IPLNFDVLSSAGPINI

SEQ ID NO: 188522 - protein, 16 aa, Mycobacterium tuberculosis
PLNFDVLSSAGPINIS

SEQ ID NO: 188523 - protein, 16 aa, Mycobacterium tuberculosis
LNFDVLSSAGPINISI

SEQ ID NO: 188524 - protein, 16 aa, Mycobacterium tuberculosis
NFDVLSSAGPINISII

SEQ ID NO: 188525 - protein, 16 aa, Mycobacterium tuberculosis
FDVLSSAGPINISIID

SEQ ID NO: 188526 - protein, 16 aa, Mycobacterium tuberculosis
DVLSSAGPINISIIDI

SEQ ID NO: 188527 - protein, 16 aa, Mycobacterium tuberculosis
VLSSAGPINISIIDIP

SEQ ID NO: 188528 - protein, 16 aa, Mycobacterium tuberculosis
LSSAGPINISIIDIPA

SEQ ID NO: 188529 - protein, 16 aa, Mycobacterium tuberculosis
SSAGPINISIIDIPAL

SEQ ID NO: 188530 - protein, 16 aa, Mycobacterium tuberculosis
SAGPINISIIDIPALP

SEQ ID NO: 188531 - protein, 16 aa, Mycobacterium tuberculosis
AGPINISIIDIPALPG

SEQ ID NO: 188532 - protein, 16 aa, Mycobacterium tuberculosis
GPINISIIDIPALPGF

SEQ ID NO: 188533 - protein, 16 aa, Mycobacterium tuberculosis
PINISIIDIPALPGFG

SEQ ID NO: 188534 - protein, 16 aa, Mycobacterium tuberculosis
INISIIDIPALPGFGN

SEQ ID NO: 188535 - protein, 16 aa, Mycobacterium tuberculosis
NISIIDIPALPGFGNS

SEQ ID NO: 188536 - protein, 16 aa, Mycobacterium tuberculosis
ISIIDIPALPGFGNST

SEQ ID NO: 188537 - protein, 16 aa, Mycobacterium tuberculosis
SIIDIPALPGFGNSTE

SEQ ID NO: 188538 - protein, 16 aa, Mycobacterium tuberculosis
IIDIPALPGFGNSTEL

SEQ ID NO: 188539 - protein, 16 aa, Mycobacterium tuberculosis
IDIPALPGFGNSTELP

SEQ ID NO: 188540 - protein, 16 aa, Mycobacterium tuberculosis
DIPALPGFGNSTELPS

SEQ ID NO: 188541 - protein, 16 aa, Mycobacterium tuberculosis
IPALPGFGNSTELPSS

SEQ ID NO: 188542 - protein, 16 aa, Mycobacterium tuberculosis
PALPGFGNSTELPSSG

SEQ ID NO: 188543 - protein, 16 aa, Mycobacterium tuberculosis
ALPGFGNSTELPSSGF

SEQ ID NO: 188544 - protein, 16 aa, Mycobacterium tuberculosis
LPGFGNSTELPSSGFF

SEQ ID NO: 188545 - protein, 16 aa, Mycobacterium tuberculosis
PGFGNSTELPSSGFFN

SEQ ID NO: 188546 - protein, 16 aa, Mycobacterium tuberculosis
GFGNSTELPSSGFFNT

SEQ ID NO: 188547 - protein, 16 aa, Mycobacterium tuberculosis
FGNSTELPSSGFFNTG

SEQ ID NO: 188548 - protein, 16 aa, Mycobacterium tuberculosis
GNSTELPSSGFFNTGG

SEQ ID NO: 188549 - protein, 16 aa, Mycobacterium tuberculosis
NSTELPSSGFFNTGGG

SEQ ID NO: 188550 - protein, 16 aa, Mycobacterium tuberculosis
STELPSSGFFNTGGGG

SEQ ID NO: 188551 - protein, 16 aa, Mycobacterium tuberculosis
TELPSSGFFNTGGGGG

SEQ ID NO: 188552 - protein, 16 aa, Mycobacterium tuberculosis
ELPSSGFFNTGGGGGS

SEQ ID NO: 188553 - protein, 16 aa, Mycobacterium tuberculosis
LPSSGFFNTGGGGGSG

SEQ ID NO: 188554 - protein, 16 aa, Mycobacterium tuberculosis
PSSGFFNTGGGGGSGI

SEQ ID NO: 188555 - protein, 16 aa, Mycobacterium tuberculosis
SSGFFNTGGGGGSGIA

SEQ ID NO: 188556 - protein, 16 aa, Mycobacterium tuberculosis
SGFFNTGGGGGSGIAN

SEQ ID NO: 188557 - protein, 16 aa, Mycobacterium tuberculosis
GFFNTGGGGGSGIANF

SEQ ID NO: 188558 - protein, 16 aa, Mycobacterium tuberculosis
FFNTGGGGGSGIANFG

SEQ ID NO: 188559 - protein, 16 aa, Mycobacterium tuberculosis
FNTGGGGGSGIANFGA

SEQ ID NO: 188560 - protein, 16 aa, Mycobacterium tuberculosis
NTGGGGGSGIANFGAG

SEQ ID NO: 188561 - protein, 16 aa, Mycobacterium tuberculosis
TGGGGGSGIANFGAGV

SEQ ID NO: 188562 - protein, 16 aa, Mycobacterium tuberculosis
GGGGGSGIANFGAGVS

SEQ ID NO: 188563 - protein, 16 aa, Mycobacterium tuberculosis
GGGGSGIANFGAGVSG

SEQ ID NO: 188564 - protein, 16 aa, Mycobacterium tuberculosis
GGGSGIANFGAGVSGL

SEQ ID NO: 188565 - protein, 16 aa, Mycobacterium tuberculosis
GGSGIANFGAGVSGLL

SEQ ID NO: 188566 - protein, 16 aa, Mycobacterium tuberculosis
GSGIANFGAGVSGLLN

SEQ ID NO: 188567 - protein, 16 aa, Mycobacterium tuberculosis
SGIANFGAGVSGLLNQ

SEQ ID NO: 188568 - protein, 16 aa, Mycobacterium tuberculosis
GIANFGAGVSGLLNQA

SEQ ID NO: 188569 - protein, 16 aa, Mycobacterium tuberculosis
IANFGAGVSGLLNQAS

SEQ ID NO: 188570 - protein, 16 aa, Mycobacterium tuberculosis
ANFGAGVSGLLNQASS

SEQ ID NO: 188571 - protein, 16 aa, Mycobacterium tuberculosis
NFGAGVSGLLNQASSP

SEQ ID NO: 188572 - protein, 16 aa, Mycobacterium tuberculosis
FGAGVSGLLNQASSPM

SEQ ID NO: 188573 - protein, 16 aa, Mycobacterium tuberculosis
GAGVSGLLNQASSPMV

SEQ ID NO: 188574 - protein, 16 aa, Mycobacterium tuberculosis
AGVSGLLNQASSPMVG

SEQ ID NO: 188575 - protein, 16 aa, Mycobacterium tuberculosis
GVSGLLNQASSPMVGT

SEQ ID NO: 188576 - protein, 16 aa, Mycobacterium tuberculosis
VSGLLNQASSPMVGTL

SEQ ID NO: 188577 - protein, 16 aa, Mycobacterium tuberculosis
SGLLNQASSPMVGTLS

SEQ ID NO: 188578 - protein, 16 aa, Mycobacterium tuberculosis
GLLNQASSPMVGTLSG

SEQ ID NO: 188579 - protein, 16 aa, Mycobacterium tuberculosis
LLNQASSPMVGTLSGL

SEQ ID NO: 188580 - protein, 16 aa, Mycobacterium tuberculosis
LNQASSPMVGTLSGLG

SEQ ID NO: 188581 - protein, 16 aa, Mycobacterium tuberculosis
NQASSPMVGTLSGLGN

SEQ ID NO: 188582 - protein, 16 aa, Mycobacterium tuberculosis
QASSPMVGTLSGLGNA

SEQ ID NO: 188583 - protein, 16 aa, Mycobacterium tuberculosis
ASSPMVGTLSGLGNAG

SEQ ID NO: 188584 - protein, 16 aa, Mycobacterium tuberculosis
SSPMVGTLSGLGNAGS

SEQ ID NO: 188585 - protein, 16 aa, Mycobacterium tuberculosis
SPMVGTLSGLGNAGSL

SEQ ID NO: 188586 - protein, 16 aa, Mycobacterium tuberculosis
PMVGTLSGLGNAGSLA

SEQ ID NO: 188587 - protein, 16 aa, Mycobacterium tuberculosis
MVGTLSGLGNAGSLAS

SEQ ID NO: 188588 - protein, 16 aa, Mycobacterium tuberculosis
VGTLSGLGNAGSLASG

SEQ ID NO: 188589 - protein, 16 aa, Mycobacterium tuberculosis
GTLSGLGNAGSLASGV

SEQ ID NO: 188590 - protein, 16 aa, Mycobacterium tuberculosis
TLSGLGNAGSLASGVL

SEQ ID NO: 188591 - protein, 16 aa, Mycobacterium tuberculosis
LSGLGNAGSLASGVLN

SEQ ID NO: 188592 - protein, 16 aa, Mycobacterium tuberculosis
SGLGNAGSLASGVLNS

SEQ ID NO: 188593 - protein, 16 aa, Mycobacterium tuberculosis
GLGNAGSLASGVLNSG

SEQ ID NO: 188594 - protein, 16 aa, Mycobacterium tuberculosis
LGNAGSLASGVLNSGV

SEQ ID NO: 188595 - protein, 16 aa, Mycobacterium tuberculosis
GNAGSLASGVLNSGVD

SEQ ID NO: 188596 - protein, 16 aa, Mycobacterium tuberculosis
NAGSLASGVLNSGVDI

SEQ ID NO: 188597 - protein, 16 aa, Mycobacterium tuberculosis
AGSLASGVLNSGVDIS

SEQ ID NO: 188598 - protein, 16 aa, Mycobacterium tuberculosis
GSLASGVLNSGVDISG

SEQ ID NO: 188599 - protein, 16 aa, Mycobacterium tuberculosis
SLASGVLNSGVDISGM

SEQ ID NO: 188600 - protein, 16 aa, Mycobacterium tuberculosis
LASGVLNSGVDISGMF

SEQ ID NO: 188601 - protein, 16 aa, Mycobacterium tuberculosis
ASGVLNSGVDISGMFN

SEQ ID NO: 188602 - protein, 16 aa, Mycobacterium tuberculosis
SGVLNSGVDISGMFNV

SEQ ID NO: 188603 - protein, 16 aa, Mycobacterium tuberculosis
GVLNSGVDISGMFNVS

SEQ ID NO: 188604 - protein, 16 aa, Mycobacterium tuberculosis
VLNSGVDISGMFNVST

SEQ ID NO: 188605 - protein, 16 aa, Mycobacterium tuberculosis
LNSGVDISGMFNVSTL

SEQ ID NO: 188606 - protein, 16 aa, Mycobacterium tuberculosis
NSGVDISGMFNVSTLG

SEQ ID NO: 188607 - protein, 16 aa, Mycobacterium tuberculosis
SGVDISGMFNVSTLGS

SEQ ID NO: 188608 - protein, 16 aa, Mycobacterium tuberculosis
GVDISGMFNVSTLGSA

SEQ ID NO: 188609 - protein, 16 aa, Mycobacterium tuberculosis
VDISGMFNVSTLGSAP

SEQ ID NO: 188610 - protein, 16 aa, Mycobacterium tuberculosis
DISGMFNVSTLGSAPA

SEQ ID NO: 188611 - protein, 16 aa, Mycobacterium tuberculosis
ISGMFNVSTLGSAPAV

SEQ ID NO: 188612 - protein, 16 aa, Mycobacterium tuberculosis
SGMFNVSTLGSAPAVI

SEQ ID NO: 188613 - protein, 16 aa, Mycobacterium tuberculosis
GMFNVSTLGSAPAVIS

SEQ ID NO: 188614 - protein, 16 aa, Mycobacterium tuberculosis
MFNVSTLGSAPAVISG

SEQ ID NO: 188615 - protein, 16 aa, Mycobacterium tuberculosis
FNVSTLGSAPAVISGF

SEQ ID NO: 188616 - protein, 16 aa, Mycobacterium tuberculosis
NVSTLGSAPAVISGFG

SEQ ID NO: 188617 - protein, 16 aa, Mycobacterium tuberculosis
VSTLGSAPAVISGFGN

SEQ ID NO: 188618 - protein, 16 aa, Mycobacterium tuberculosis
STLGSAPAVISGFGNL

SEQ ID NO: 188619 - protein, 16 aa, Mycobacterium tuberculosis
TLGSAPAVISGFGNLG

SEQ ID NO: 188620 - protein, 16 aa, Mycobacterium tuberculosis
LGSAPAVISGFGNLGN

SEQ ID NO: 188621 - protein, 16 aa, Mycobacterium tuberculosis
GSAPAVISGFGNLGNH

SEQ ID NO: 188622 - protein, 16 aa, Mycobacterium tuberculosis
SAPAVISGFGNLGNHV

SEQ ID NO: 188623 - protein, 16 aa, Mycobacterium tuberculosis
APAVISGFGNLGNHVS

SEQ ID NO: 188624 - protein, 16 aa, Mycobacterium tuberculosis
PAVISGFGNLGNHVSG

SEQ ID NO: 188625 - protein, 16 aa, Mycobacterium tuberculosis
AVISGFGNLGNHVSGV

SEQ ID NO: 188626 - protein, 16 aa, Mycobacterium tuberculosis
VISGFGNLGNHVSGVS

SEQ ID NO: 188627 - protein, 16 aa, Mycobacterium tuberculosis
ISGFGNLGNHVSGVSI

SEQ ID NO: 188628 - protein, 16 aa, Mycobacterium tuberculosis
SGFGNLGNHVSGVSID

SEQ ID NO: 188629 - protein, 16 aa, Mycobacterium tuberculosis
GFGNLGNHVSGVSIDG

SEQ ID NO: 188630 - protein, 16 aa, Mycobacterium tuberculosis
FGNLGNHVSGVSIDGL

SEQ ID NO: 188631 - protein, 16 aa, Mycobacterium tuberculosis
GNLGNHVSGVSIDGLL

SEQ ID NO: 188632 - protein, 16 aa, Mycobacterium tuberculosis
NLGNHVSGVSIDGLLA

SEQ ID NO: 188633 - protein, 16 aa, Mycobacterium tuberculosis
LGNHVSGVSIDGLLAM

SEQ ID NO: 188634 - protein, 16 aa, Mycobacterium tuberculosis
GNHVSGVSIDGLLAML

SEQ ID NO: 188635 - protein, 16 aa, Mycobacterium tuberculosis
NHVSGVSIDGLLAMLT

SEQ ID NO: 188636 - protein, 16 aa, Mycobacterium tuberculosis
HVSGVSIDGLLAMLTS

SEQ ID NO: 188637 - protein, 16 aa, Mycobacterium tuberculosis
VSGVSIDGLLAMLTSG

SEQ ID NO: 188638 - protein, 16 aa, Mycobacterium tuberculosis
SGVSIDGLLAMLTSGG

SEQ ID NO: 188639 - protein, 16 aa, Mycobacterium tuberculosis
GVSIDGLLAMLTSGGS

SEQ ID NO: 188640 - protein, 16 aa, Mycobacterium tuberculosis
VSIDGLLAMLTSGGSG

SEQ ID NO: 188641 - protein, 16 aa, Mycobacterium tuberculosis
SIDGLLAMLTSGGSGG

SEQ ID NO: 188642 - protein, 16 aa, Mycobacterium tuberculosis
IDGLLAMLTSGGSGGS

SEQ ID NO: 188643 - protein, 16 aa, Mycobacterium tuberculosis
DGLLAMLTSGGSGGSG

SEQ ID NO: 188644 - protein, 16 aa, Mycobacterium tuberculosis
GLLAMLTSGGSGGSGQ

SEQ ID NO: 188645 - protein, 16 aa, Mycobacterium tuberculosis
LLAMLTSGGSGGSGQP

SEQ ID NO: 188646 - protein, 16 aa, Mycobacterium tuberculosis
LAMLTSGGSGGSGQPS

SEQ ID NO: 188647 - protein, 16 aa, Mycobacterium tuberculosis
AMLTSGGSGGSGQPSI

SEQ ID NO: 188648 - protein, 16 aa, Mycobacterium tuberculosis
MLTSGGSGGSGQPSII

SEQ ID NO: 188649 - protein, 16 aa, Mycobacterium tuberculosis
LTSGGSGGSGQPSIID

SEQ ID NO: 188650 - protein, 16 aa, Mycobacterium tuberculosis
TSGGSGGSGQPSIIDA

SEQ ID NO: 188651 - protein, 16 aa, Mycobacterium tuberculosis
SGGSGGSGQPSIIDAA

SEQ ID NO: 188652 - protein, 16 aa, Mycobacterium tuberculosis
GGSGGSGQPSIIDAAI

SEQ ID NO: 188653 - protein, 16 aa, Mycobacterium tuberculosis
GSGGSGQPSIIDAAIA

SEQ ID NO: 188654 - protein, 16 aa, Mycobacterium tuberculosis
SGGSGQPSIIDAAIAE

SEQ ID NO: 188655 - protein, 16 aa, Mycobacterium tuberculosis
GGSGQPSIIDAAIAEL

SEQ ID NO: 188656 - protein, 16 aa, Mycobacterium tuberculosis
GSGQPSIIDAAIAELR

SEQ ID NO: 188657 - protein, 16 aa, Mycobacterium tuberculosis
SGQPSIIDAAIAELRH

SEQ ID NO: 188658 - protein, 16 aa, Mycobacterium tuberculosis
GQPSIIDAAIAELRHL

SEQ ID NO: 188659 - protein, 16 aa, Mycobacterium tuberculosis
QPSIIDAAIAELRHLN

SEQ ID NO: 188660 - protein, 16 aa, Mycobacterium tuberculosis
PSIIDAAIAELRHLNP

SEQ ID NO: 188661 - protein, 16 aa, Mycobacterium tuberculosis
SIIDAAIAELRHLNPL

SEQ ID NO: 188662 - protein, 16 aa, Mycobacterium tuberculosis
IIDAAIAELRHLNPLN

SEQ ID NO: 188663 - protein, 16 aa, Mycobacterium tuberculosis
IDAAIAELRHLNPLNI

SEQ ID NO: 188664 - protein, 16 aa, Mycobacterium tuberculosis
DAAIAELRHLNPLNIV

SEQ ID NO: 188665 - protein, 16 aa, Mycobacterium tuberculosis
AAIAELRHLNPLNIVN

SEQ ID NO: 188666 - protein, 16 aa, Mycobacterium tuberculosis
AIAELRHLNPLNIVNL

SEQ ID NO: 188667 - protein, 16 aa, Mycobacterium tuberculosis
IAELRHLNPLNIVNLG

SEQ ID NO: 188668 - protein, 16 aa, Mycobacterium tuberculosis
AELRHLNPLNIVNLGN

SEQ ID NO: 188669 - protein, 16 aa, Mycobacterium tuberculosis
ELRHLNPLNIVNLGNV

SEQ ID NO: 188670 - protein, 16 aa, Mycobacterium tuberculosis
LRHLNPLNIVNLGNVG

SEQ ID NO: 188671 - protein, 16 aa, Mycobacterium tuberculosis
RHLNPLNIVNLGNVGS

SEQ ID NO: 188672 - protein, 16 aa, Mycobacterium tuberculosis
HLNPLNIVNLGNVGSY

SEQ ID NO: 188673 - protein, 16 aa, Mycobacterium tuberculosis
LNPLNIVNLGNVGSYN

SEQ ID NO: 188674 - protein, 16 aa, Mycobacterium tuberculosis
NPLNIVNLGNVGSYNL

SEQ ID NO: 188675 - protein, 16 aa, Mycobacterium tuberculosis
PLNIVNLGNVGSYNLG

SEQ ID NO: 188676 - protein, 16 aa, Mycobacterium tuberculosis
LNIVNLGNVGSYNLGF

SEQ ID NO: 188677 - protein, 16 aa, Mycobacterium tuberculosis
NIVNLGNVGSYNLGFA

SEQ ID NO: 188678 - protein, 16 aa, Mycobacterium tuberculosis
IVNLGNVGSYNLGFAN

SEQ ID NO: 188679 - protein, 16 aa, Mycobacterium tuberculosis
VNLGNVGSYNLGFANV

SEQ ID NO: 188680 - protein, 16 aa, Mycobacterium tuberculosis
NLGNVGSYNLGFANVG

SEQ ID NO: 188681 - protein, 16 aa, Mycobacterium tuberculosis
LGNVGSYNLGFANVGD

SEQ ID NO: 188682 - protein, 16 aa, Mycobacterium tuberculosis
GNVGSYNLGFANVGDV

SEQ ID NO: 188683 - protein, 16 aa, Mycobacterium tuberculosis
NVGSYNLGFANVGDVN

SEQ ID NO: 188684 - protein, 16 aa, Mycobacterium tuberculosis
VGSYNLGFANVGDVNL

SEQ ID NO: 188685 - protein, 16 aa, Mycobacterium tuberculosis
GSYNLGFANVGDVNLG

SEQ ID NO: 188686 - protein, 16 aa, Mycobacterium tuberculosis
SYNLGFANVGDVNLGA

SEQ ID NO: 188687 - protein, 16 aa, Mycobacterium tuberculosis
YNLGFANVGDVNLGAG

SEQ ID NO: 188688 - protein, 16 aa, Mycobacterium tuberculosis
NLGFANVGDVNLGAGN

SEQ ID NO: 188689 - protein, 16 aa, Mycobacterium tuberculosis
LGFANVGDVNLGAGNL

SEQ ID NO: 188690 - protein, 16 aa, Mycobacterium tuberculosis
GFANVGDVNLGAGNLG

SEQ ID NO: 188691 - protein, 16 aa, Mycobacterium tuberculosis
FANVGDVNLGAGNLGN

SEQ ID NO: 188692 - protein, 16 aa, Mycobacterium tuberculosis
ANVGDVNLGAGNLGNL

SEQ ID NO: 188693 - protein, 16 aa, Mycobacterium tuberculosis
NVGDVNLGAGNLGNLN

SEQ ID NO: 188694 - protein, 16 aa, Mycobacterium tuberculosis
VGDVNLGAGNLGNLNL

SEQ ID NO: 188695 - protein, 16 aa, Mycobacterium tuberculosis
GDVNLGAGNLGNLNLG

SEQ ID NO: 188696 - protein, 16 aa, Mycobacterium tuberculosis
DVNLGAGNLGNLNLGG

SEQ ID NO: 188697 - protein, 16 aa, Mycobacterium tuberculosis
VNLGAGNLGNLNLGGG

SEQ ID NO: 188698 - protein, 16 aa, Mycobacterium tuberculosis
NLGAGNLGNLNLGGGN

SEQ ID NO: 188699 - protein, 16 aa, Mycobacterium tuberculosis
LGAGNLGNLNLGGGNL

SEQ ID NO: 188700 - protein, 16 aa, Mycobacterium tuberculosis
GAGNLGNLNLGGGNLG

SEQ ID NO: 188701 - protein, 16 aa, Mycobacterium tuberculosis
AGNLGNLNLGGGNLGG

SEQ ID NO: 188702 - protein, 16 aa, Mycobacterium tuberculosis
GNLGNLNLGGGNLGGQ

SEQ ID NO: 188703 - protein, 16 aa, Mycobacterium tuberculosis
NLGNLNLGGGNLGGQN

SEQ ID NO: 188704 - protein, 16 aa, Mycobacterium tuberculosis
LGNLNLGGGNLGGQNL

SEQ ID NO: 188705 - protein, 16 aa, Mycobacterium tuberculosis
GNLNLGGGNLGGQNLG

SEQ ID NO: 188706 - protein, 16 aa, Mycobacterium tuberculosis
NLNLGGGNLGGQNLGL

SEQ ID NO: 188707 - protein, 16 aa, Mycobacterium tuberculosis
LNLGGGNLGGQNLGLG

SEQ ID NO: 188708 - protein, 16 aa, Mycobacterium tuberculosis
NLGGGNLGGQNLGLGN

SEQ ID NO: 188709 - protein, 16 aa, Mycobacterium tuberculosis
LGGGNLGGQNLGLGNL

SEQ ID NO: 188710 - protein, 16 aa, Mycobacterium tuberculosis
GGGNLGGQNLGLGNLG

SEQ ID NO: 188711 - protein, 16 aa, Mycobacterium tuberculosis
GGNLGGQNLGLGNLGD

SEQ ID NO: 188712 - protein, 16 aa, Mycobacterium tuberculosis
GNLGGQNLGLGNLGDG

SEQ ID NO: 188713 - protein, 16 aa, Mycobacterium tuberculosis
NLGGQNLGLGNLGDGN

SEQ ID NO: 188714 - protein, 16 aa, Mycobacterium tuberculosis
LGGQNLGLGNLGDGNV

SEQ ID NO: 188715 - protein, 16 aa, Mycobacterium tuberculosis
GGQNLGLGNLGDGNVG

SEQ ID NO: 188716 - protein, 16 aa, Mycobacterium tuberculosis
GQNLGLGNLGDGNVGF

SEQ ID NO: 188717 - protein, 16 aa, Mycobacterium tuberculosis
QNLGLGNLGDGNVGFG

SEQ ID NO: 188718 - protein, 16 aa, Mycobacterium tuberculosis
NLGLGNLGDGNVGFGN

SEQ ID NO: 188719 - protein, 16 aa, Mycobacterium tuberculosis
LGLGNLGDGNVGFGNL

SEQ ID NO: 188720 - protein, 16 aa, Mycobacterium tuberculosis
GLGNLGDGNVGFGNLG

SEQ ID NO: 188721 - protein, 16 aa, Mycobacterium tuberculosis
LGNLGDGNVGFGNLGH

SEQ ID NO: 188722 - protein, 16 aa, Mycobacterium tuberculosis
GNLGDGNVGFGNLGHG

SEQ ID NO: 188723 - protein, 16 aa, Mycobacterium tuberculosis
NLGDGNVGFGNLGHGN

SEQ ID NO: 188724 - protein, 16 aa, Mycobacterium tuberculosis
LGDGNVGFGNLGHGNV

SEQ ID NO: 188725 - protein, 16 aa, Mycobacterium tuberculosis
GDGNVGFGNLGHGNVG

SEQ ID NO: 188726 - protein, 16 aa, Mycobacterium tuberculosis
DGNVGFGNLGHGNVGF

SEQ ID NO: 188727 - protein, 16 aa, Mycobacterium tuberculosis
GNVGFGNLGHGNVGFG

SEQ ID NO: 188728 - protein, 16 aa, Mycobacterium tuberculosis
NVGFGNLGHGNVGFGN

SEQ ID NO: 188729 - protein, 16 aa, Mycobacterium tuberculosis
VGFGNLGHGNVGFGNS

SEQ ID NO: 188730 - protein, 16 aa, Mycobacterium tuberculosis
GFGNLGHGNVGFGNSG

SEQ ID NO: 188731 - protein, 16 aa, Mycobacterium tuberculosis
FGNLGHGNVGFGNSGL

SEQ ID NO: 188732 - protein, 16 aa, Mycobacterium tuberculosis
GNLGHGNVGFGNSGLG

SEQ ID NO: 188733 - protein, 16 aa, Mycobacterium tuberculosis
NLGHGNVGFGNSGLGA

SEQ ID NO: 188734 - protein, 16 aa, Mycobacterium tuberculosis
LGHGNVGFGNSGLGAL

SEQ ID NO: 188735 - protein, 16 aa, Mycobacterium tuberculosis
GHGNVGFGNSGLGALP

SEQ ID NO: 188736 - protein, 16 aa, Mycobacterium tuberculosis
HGNVGFGNSGLGALPG

SEQ ID NO: 188737 - protein, 16 aa, Mycobacterium tuberculosis
GNVGFGNSGLGALPGI

SEQ ID NO: 188738 - protein, 16 aa, Mycobacterium tuberculosis
NVGFGNSGLGALPGIG

SEQ ID NO: 188739 - protein, 16 aa, Mycobacterium tuberculosis
VGFGNSGLGALPGIGN

SEQ ID NO: 188740 - protein, 16 aa, Mycobacterium tuberculosis
GFGNSGLGALPGIGNI

SEQ ID NO: 188741 - protein, 16 aa, Mycobacterium tuberculosis
FGNSGLGALPGIGNIG

SEQ ID NO: 188742 - protein, 16 aa, Mycobacterium tuberculosis
GNSGLGALPGIGNIGL

SEQ ID NO: 188743 - protein, 16 aa, Mycobacterium tuberculosis
NSGLGALPGIGNIGLG

SEQ ID NO: 188744 - protein, 16 aa, Mycobacterium tuberculosis
SGLGALPGIGNIGLGN

SEQ ID NO: 188745 - protein, 16 aa, Mycobacterium tuberculosis
GLGALPGIGNIGLGNA

SEQ ID NO: 188746 - protein, 16 aa, Mycobacterium tuberculosis
LGALPGIGNIGLGNAG

SEQ ID NO: 188747 - protein, 16 aa, Mycobacterium tuberculosis
GALPGIGNIGLGNAGS

SEQ ID NO: 188748 - protein, 16 aa, Mycobacterium tuberculosis
ALPGIGNIGLGNAGSN

SEQ ID NO: 188749 - protein, 16 aa, Mycobacterium tuberculosis
LPGIGNIGLGNAGSNN

SEQ ID NO: 188750 - protein, 16 aa, Mycobacterium tuberculosis
PGIGNIGLGNAGSNNV

SEQ ID NO: 188751 - protein, 16 aa, Mycobacterium tuberculosis
GIGNIGLGNAGSNNVG

SEQ ID NO: 188752 - protein, 16 aa, Mycobacterium tuberculosis
IGNIGLGNAGSNNVGF

SEQ ID NO: 188753 - protein, 16 aa, Mycobacterium tuberculosis
GNIGLGNAGSNNVGFG

SEQ ID NO: 188754 - protein, 16 aa, Mycobacterium tuberculosis
NIGLGNAGSNNVGFGN

SEQ ID NO: 188755 - protein, 16 aa, Mycobacterium tuberculosis
IGLGNAGSNNVGFGNM

SEQ ID NO: 188756 - protein, 16 aa, Mycobacterium tuberculosis
GLGNAGSNNVGFGNMG

SEQ ID NO: 188757 - protein, 16 aa, Mycobacterium tuberculosis
LGNAGSNNVGFGNMGL

SEQ ID NO: 188758 - protein, 16 aa, Mycobacterium tuberculosis
GNAGSNNVGFGNMGLG

SEQ ID NO: 188759 - protein, 16 aa, Mycobacterium tuberculosis
NAGSNNVGFGNMGLGN

SEQ ID NO: 188760 - protein, 16 aa, Mycobacterium tuberculosis
AGSNNVGFGNMGLGNI

SEQ ID NO: 188761 - protein, 16 aa, Mycobacterium tuberculosis
GSNNVGFGNMGLGNIG

SEQ ID NO: 188762 - protein, 16 aa, Mycobacterium tuberculosis
SNNVGFGNMGLGNIGF

SEQ ID NO: 188763 - protein, 16 aa, Mycobacterium tuberculosis
NNVGFGNMGLGNIGFG

SEQ ID NO: 188764 - protein, 16 aa, Mycobacterium tuberculosis
NVGFGNMGLGNIGFGN

SEQ ID NO: 188765 - protein, 16 aa, Mycobacterium tuberculosis
VGFGNMGLGNIGFGNT

SEQ ID NO: 188766 - protein, 16 aa, Mycobacterium tuberculosis
GFGNMGLGNIGFGNTG

SEQ ID NO: 188767 - protein, 16 aa, Mycobacterium tuberculosis
FGNMGLGNIGFGNTGT

SEQ ID NO: 188768 - protein, 16 aa, Mycobacterium tuberculosis
GNMGLGNIGFGNTGTN

SEQ ID NO: 188769 - protein, 16 aa, Mycobacterium tuberculosis
NMGLGNIGFGNTGTNN

SEQ ID NO: 188770 - protein, 16 aa, Mycobacterium tuberculosis
MGLGNIGFGNTGTNNL

SEQ ID NO: 188771 - protein, 16 aa, Mycobacterium tuberculosis
GLGNIGFGNTGTNNLG

SEQ ID NO: 188772 - protein, 16 aa, Mycobacterium tuberculosis
LGNIGFGNTGTNNLGI

SEQ ID NO: 188773 - protein, 16 aa, Mycobacterium tuberculosis
GNIGFGNTGTNNLGIG

SEQ ID NO: 188774 - protein, 16 aa, Mycobacterium tuberculosis
NIGFGNTGTNNLGIGL

SEQ ID NO: 188775 - protein, 16 aa, Mycobacterium tuberculosis
IGFGNTGTNNLGIGLT

SEQ ID NO: 188776 - protein, 16 aa, Mycobacterium tuberculosis
GFGNTGTNNLGIGLTG

SEQ ID NO: 188777 - protein, 16 aa, Mycobacterium tuberculosis
FGNTGTNNLGIGLTGD

SEQ ID NO: 188778 - protein, 16 aa, Mycobacterium tuberculosis
GNTGTNNLGIGLTGDN

SEQ ID NO: 188779 - protein, 16 aa, Mycobacterium tuberculosis
NTGTNNLGIGLTGDNQ

SEQ ID NO: 188780 - protein, 16 aa, Mycobacterium tuberculosis
TGTNNLGIGLTGDNQT

SEQ ID NO: 188781 - protein, 16 aa, Mycobacterium tuberculosis
GTNNLGIGLTGDNQTG

SEQ ID NO: 188782 - protein, 16 aa, Mycobacterium tuberculosis
TNNLGIGLTGDNQTGF

SEQ ID NO: 188783 - protein, 16 aa, Mycobacterium tuberculosis
NNLGIGLTGDNQTGFG

SEQ ID NO: 188784 - protein, 16 aa, Mycobacterium tuberculosis
NLGIGLTGDNQTGFGG

SEQ ID NO: 188785 - protein, 16 aa, Mycobacterium tuberculosis
LGIGLTGDNQTGFGGL

SEQ ID NO: 188786 - protein, 16 aa, Mycobacterium tuberculosis
GIGLTGDNQTGFGGLN

SEQ ID NO: 188787 - protein, 16 aa, Mycobacterium tuberculosis
IGLTGDNQTGFGGLNS

SEQ ID NO: 188788 - protein, 16 aa, Mycobacterium tuberculosis
GLTGDNQTGFGGLNSG

SEQ ID NO: 188789 - protein, 16 aa, Mycobacterium tuberculosis
LTGDNQTGFGGLNSGA

SEQ ID NO: 188790 - protein, 16 aa, Mycobacterium tuberculosis
TGDNQTGFGGLNSGAG

SEQ ID NO: 188791 - protein, 16 aa, Mycobacterium tuberculosis
GDNQTGFGGLNSGAGN

SEQ ID NO: 188792 - protein, 16 aa, Mycobacterium tuberculosis
DNQTGFGGLNSGAGNL

SEQ ID NO: 188793 - protein, 16 aa, Mycobacterium tuberculosis
NQTGFGGLNSGAGNLG

SEQ ID NO: 188794 - protein, 16 aa, Mycobacterium tuberculosis
QTGFGGLNSGAGNLGL

SEQ ID NO: 188795 - protein, 16 aa, Mycobacterium tuberculosis
TGFGGLNSGAGNLGLF

SEQ ID NO: 188796 - protein, 16 aa, Mycobacterium tuberculosis
GFGGLNSGAGNLGLFN

SEQ ID NO: 188797 - protein, 16 aa, Mycobacterium tuberculosis
FGGLNSGAGNLGLFNS

SEQ ID NO: 188798 - protein, 16 aa, Mycobacterium tuberculosis
GGLNSGAGNLGLFNSG

SEQ ID NO: 188799 - protein, 16 aa, Mycobacterium tuberculosis
GLNSGAGNLGLFNSGT

SEQ ID NO: 188800 - protein, 16 aa, Mycobacterium tuberculosis
LNSGAGNLGLFNSGTG

SEQ ID NO: 188801 - protein, 16 aa, Mycobacterium tuberculosis
NSGAGNLGLFNSGTGN

SEQ ID NO: 188802 - protein, 16 aa, Mycobacterium tuberculosis
SGAGNLGLFNSGTGNI

SEQ ID NO: 188803 - protein, 16 aa, Mycobacterium tuberculosis
GAGNLGLFNSGTGNIG

SEQ ID NO: 188804 - protein, 16 aa, Mycobacterium tuberculosis
AGNLGLFNSGTGNIGF

SEQ ID NO: 188805 - protein, 16 aa, Mycobacterium tuberculosis
GNLGLFNSGTGNIGFF

SEQ ID NO: 188806 - protein, 16 aa, Mycobacterium tuberculosis
NLGLFNSGTGNIGFFN

SEQ ID NO: 188807 - protein, 16 aa, Mycobacterium tuberculosis
LGLFNSGTGNIGFFNT

SEQ ID NO: 188808 - protein, 16 aa, Mycobacterium tuberculosis
GLFNSGTGNIGFFNTG

SEQ ID NO: 188809 - protein, 16 aa, Mycobacterium tuberculosis
LFNSGTGNIGFFNTGT

SEQ ID NO: 188810 - protein, 16 aa, Mycobacterium tuberculosis
FNSGTGNIGFFNTGTG

SEQ ID NO: 188811 - protein, 16 aa, Mycobacterium tuberculosis
NSGTGNIGFFNTGTGN

SEQ ID NO: 188812 - protein, 16 aa, Mycobacterium tuberculosis
SGTGNIGFFNTGTGNW

SEQ ID NO: 188813 - protein, 16 aa, Mycobacterium tuberculosis
GTGNIGFFNTGTGNWG

SEQ ID NO: 188814 - protein, 16 aa, Mycobacterium tuberculosis
TGNIGFFNTGTGNWGL

SEQ ID NO: 188815 - protein, 16 aa, Mycobacterium tuberculosis
GNIGFFNTGTGNWGLF

SEQ ID NO: 188816 - protein, 16 aa, Mycobacterium tuberculosis
NIGFFNTGTGNWGLFN

SEQ ID NO: 188817 - protein, 16 aa, Mycobacterium tuberculosis
IGFFNTGTGNWGLFNS

SEQ ID NO: 188818 - protein, 16 aa, Mycobacterium tuberculosis
GFFNTGTGNWGLFNSG

SEQ ID NO: 188819 - protein, 16 aa, Mycobacterium tuberculosis
FFNTGTGNWGLFNSGS

SEQ ID NO: 188820 - protein, 16 aa, Mycobacterium tuberculosis
FNTGTGNWGLFNSGSY

SEQ ID NO: 188821 - protein, 16 aa, Mycobacterium tuberculosis
NTGTGNWGLFNSGSYN

SEQ ID NO: 188822 - protein, 16 aa, Mycobacterium tuberculosis
TGTGNWGLFNSGSYNT

SEQ ID NO: 188823 - protein, 16 aa, Mycobacterium tuberculosis
GTGNWGLFNSGSYNTG

SEQ ID NO: 188824 - protein, 16 aa, Mycobacterium tuberculosis
TGNWGLFNSGSYNTGI

SEQ ID NO: 188825 - protein, 16 aa, Mycobacterium tuberculosis
GNWGLFNSGSYNTGIG

SEQ ID NO: 188826 - protein, 16 aa, Mycobacterium tuberculosis
NWGLFNSGSYNTGIGN

SEQ ID NO: 188827 - protein, 16 aa, Mycobacterium tuberculosis
WGLFNSGSYNTGIGNS

SEQ ID NO: 188828 - protein, 16 aa, Mycobacterium tuberculosis
GLFNSGSYNTGIGNSG

SEQ ID NO: 188829 - protein, 16 aa, Mycobacterium tuberculosis
LFNSGSYNTGIGNSGT

SEQ ID NO: 188830 - protein, 16 aa, Mycobacterium tuberculosis
FNSGSYNTGIGNSGTG

SEQ ID NO: 188831 - protein, 16 aa, Mycobacterium tuberculosis
NSGSYNTGIGNSGTGS

SEQ ID NO: 188832 - protein, 16 aa, Mycobacterium tuberculosis
SGSYNTGIGNSGTGST

SEQ ID NO: 188833 - protein, 16 aa, Mycobacterium tuberculosis
GSYNTGIGNSGTGSTG

SEQ ID NO: 188834 - protein, 16 aa, Mycobacterium tuberculosis
SYNTGIGNSGTGSTGL

SEQ ID NO: 188835 - protein, 16 aa, Mycobacterium tuberculosis
YNTGIGNSGTGSTGLF

SEQ ID NO: 188836 - protein, 16 aa, Mycobacterium tuberculosis
NTGIGNSGTGSTGLFN

SEQ ID NO: 188837 - protein, 16 aa, Mycobacterium tuberculosis
TGIGNSGTGSTGLFNA

SEQ ID NO: 188838 - protein, 16 aa, Mycobacterium tuberculosis
GIGNSGTGSTGLFNAG

SEQ ID NO: 188839 - protein, 16 aa, Mycobacterium tuberculosis
IGNSGTGSTGLFNAGS

SEQ ID NO: 188840 - protein, 16 aa, Mycobacterium tuberculosis
GNSGTGSTGLFNAGSF

SEQ ID NO: 188841 - protein, 16 aa, Mycobacterium tuberculosis
NSGTGSTGLFNAGSFN

SEQ ID NO: 188842 - protein, 16 aa, Mycobacterium tuberculosis
SGTGSTGLFNAGSFNT

SEQ ID NO: 188843 - protein, 16 aa, Mycobacterium tuberculosis
GTGSTGLFNAGSFNTG

SEQ ID NO: 188844 - protein, 16 aa, Mycobacterium tuberculosis
TGSTGLFNAGSFNTGL

SEQ ID NO: 188845 - protein, 16 aa, Mycobacterium tuberculosis
GSTGLFNAGSFNTGLA

SEQ ID NO: 188846 - protein, 16 aa, Mycobacterium tuberculosis
STGLFNAGSFNTGLAN

SEQ ID NO: 188847 - protein, 16 aa, Mycobacterium tuberculosis
TGLFNAGSFNTGLANA

SEQ ID NO: 188848 - protein, 16 aa, Mycobacterium tuberculosis
GLFNAGSFNTGLANAG

SEQ ID NO: 188849 - protein, 16 aa, Mycobacterium tuberculosis
LFNAGSFNTGLANAGS

SEQ ID NO: 188850 - protein, 16 aa, Mycobacterium tuberculosis
FNAGSFNTGLANAGSY

SEQ ID NO: 188851 - protein, 16 aa, Mycobacterium tuberculosis
NAGSFNTGLANAGSYN

SEQ ID NO: 188852 - protein, 16 aa, Mycobacterium tuberculosis
AGSFNTGLANAGSYNT

SEQ ID NO: 188853 - protein, 16 aa, Mycobacterium tuberculosis
GSFNTGLANAGSYNTG

SEQ ID NO: 188854 - protein, 16 aa, Mycobacterium tuberculosis
SFNTGLANAGSYNTGS

SEQ ID NO: 188855 - protein, 16 aa, Mycobacterium tuberculosis
FNTGLANAGSYNTGSL

SEQ ID NO: 188856 - protein, 16 aa, Mycobacterium tuberculosis
NTGLANAGSYNTGSLN

SEQ ID NO: 188857 - protein, 16 aa, Mycobacterium tuberculosis
TGLANAGSYNTGSLNA

SEQ ID NO: 188858 - protein, 16 aa, Mycobacterium tuberculosis
GLANAGSYNTGSLNAG

SEQ ID NO: 188859 - protein, 16 aa, Mycobacterium tuberculosis
LANAGSYNTGSLNAGN

SEQ ID NO: 188860 - protein, 16 aa, Mycobacterium tuberculosis
ANAGSYNTGSLNAGNT

SEQ ID NO: 188861 - protein, 16 aa, Mycobacterium tuberculosis
NAGSYNTGSLNAGNTN

SEQ ID NO: 188862 - protein, 16 aa, Mycobacterium tuberculosis
AGSYNTGSLNAGNTNT

SEQ ID NO: 188863 - protein, 16 aa, Mycobacterium tuberculosis
GSYNTGSLNAGNTNTG

SEQ ID NO: 188864 - protein, 16 aa, Mycobacterium tuberculosis
SYNTGSLNAGNTNTGG

SEQ ID NO: 188865 - protein, 16 aa, Mycobacterium tuberculosis
YNTGSLNAGNTNTGGF

SEQ ID NO: 188866 - protein, 16 aa, Mycobacterium tuberculosis
NTGSLNAGNTNTGGFN

SEQ ID NO: 188867 - protein, 16 aa, Mycobacterium tuberculosis
TGSLNAGNTNTGGFNP

SEQ ID NO: 188868 - protein, 16 aa, Mycobacterium tuberculosis
GSLNAGNTNTGGFNPG

SEQ ID NO: 188869 - protein, 16 aa, Mycobacterium tuberculosis
SLNAGNTNTGGFNPGN

SEQ ID NO: 188870 - protein, 16 aa, Mycobacterium tuberculosis
LNAGNTNTGGFNPGNV

SEQ ID NO: 188871 - protein, 16 aa, Mycobacterium tuberculosis
NAGNTNTGGFNPGNVN

SEQ ID NO: 188872 - protein, 16 aa, Mycobacterium tuberculosis
AGNTNTGGFNPGNVNT

SEQ ID NO: 188873 - protein, 16 aa, Mycobacterium tuberculosis
GNTNTGGFNPGNVNTG

SEQ ID NO: 188874 - protein, 16 aa, Mycobacterium tuberculosis
NTNTGGFNPGNVNTGW

SEQ ID NO: 188875 - protein, 16 aa, Mycobacterium tuberculosis
TNTGGFNPGNVNTGWF

SEQ ID NO: 188876 - protein, 16 aa, Mycobacterium tuberculosis
NTGGFNPGNVNTGWFN

SEQ ID NO: 188877 - protein, 16 aa, Mycobacterium tuberculosis
TGGFNPGNVNTGWFNA

SEQ ID NO: 188878 - protein, 16 aa, Mycobacterium tuberculosis
GGFNPGNVNTGWFNAG

SEQ ID NO: 188879 - protein, 16 aa, Mycobacterium tuberculosis
GFNPGNVNTGWFNAGH

SEQ ID NO: 188880 - protein, 16 aa, Mycobacterium tuberculosis
FNPGNVNTGWFNAGHT

SEQ ID NO: 188881 - protein, 16 aa, Mycobacterium tuberculosis
NPGNVNTGWFNAGHTN

SEQ ID NO: 188882 - protein, 16 aa, Mycobacterium tuberculosis
PGNVNTGWFNAGHTNT

SEQ ID NO: 188883 - protein, 16 aa, Mycobacterium tuberculosis
GNVNTGWFNAGHTNTG

SEQ ID NO: 188884 - protein, 16 aa, Mycobacterium tuberculosis
NVNTGWFNAGHTNTGG

SEQ ID NO: 188885 - protein, 16 aa, Mycobacterium tuberculosis
VNTGWFNAGHTNTGGF

SEQ ID NO: 188886 - protein, 16 aa, Mycobacterium tuberculosis
NTGWFNAGHTNTGGFN

SEQ ID NO: 188887 - protein, 16 aa, Mycobacterium tuberculosis
TGWFNAGHTNTGGFNT

SEQ ID NO: 188888 - protein, 16 aa, Mycobacterium tuberculosis
GWFNAGHTNTGGFNTG

SEQ ID NO: 188889 - protein, 16 aa, Mycobacterium tuberculosis
WFNAGHTNTGGFNTGN

SEQ ID NO: 188890 - protein, 16 aa, Mycobacterium tuberculosis
FNAGHTNTGGFNTGNV

SEQ ID NO: 188891 - protein, 16 aa, Mycobacterium tuberculosis
NAGHTNTGGFNTGNVN

SEQ ID NO: 188892 - protein, 16 aa, Mycobacterium tuberculosis
AGHTNTGGFNTGNVNT

SEQ ID NO: 188893 - protein, 16 aa, Mycobacterium tuberculosis
GHTNTGGFNTGNVNTG

SEQ ID NO: 188894 - protein, 16 aa, Mycobacterium tuberculosis
HTNTGGFNTGNVNTGA

SEQ ID NO: 188895 - protein, 16 aa, Mycobacterium tuberculosis
TNTGGFNTGNVNTGAF

SEQ ID NO: 188896 - protein, 16 aa, Mycobacterium tuberculosis
NTGGFNTGNVNTGAFN

SEQ ID NO: 188897 - protein, 16 aa, Mycobacterium tuberculosis
TGGFNTGNVNTGAFNS

SEQ ID NO: 188898 - protein, 16 aa, Mycobacterium tuberculosis
GGFNTGNVNTGAFNSG

SEQ ID NO: 188899 - protein, 16 aa, Mycobacterium tuberculosis
GFNTGNVNTGAFNSGS

SEQ ID NO: 188900 - protein, 16 aa, Mycobacterium tuberculosis
FNTGNVNTGAFNSGSF

SEQ ID NO: 188901 - protein, 16 aa, Mycobacterium tuberculosis
NTGNVNTGAFNSGSFN

SEQ ID NO: 188902 - protein, 16 aa, Mycobacterium tuberculosis
TGNVNTGAFNSGSFNN

SEQ ID NO: 188903 - protein, 16 aa, Mycobacterium tuberculosis
GNVNTGAFNSGSFNNG

SEQ ID NO: 188904 - protein, 16 aa, Mycobacterium tuberculosis
NVNTGAFNSGSFNNGA

SEQ ID NO: 188905 - protein, 16 aa, Mycobacterium tuberculosis
VNTGAFNSGSFNNGAL

SEQ ID NO: 188906 - protein, 16 aa, Mycobacterium tuberculosis
NTGAFNSGSFNNGALW

SEQ ID NO: 188907 - protein, 16 aa, Mycobacterium tuberculosis
TGAFNSGSFNNGALWT

SEQ ID NO: 188908 - protein, 16 aa, Mycobacterium tuberculosis
GAFNSGSFNNGALWTG

SEQ ID NO: 188909 - protein, 16 aa, Mycobacterium tuberculosis
AFNSGSFNNGALWTGD

SEQ ID NO: 188910 - protein, 16 aa, Mycobacterium tuberculosis
FNSGSFNNGALWTGDH

SEQ ID NO: 188911 - protein, 16 aa, Mycobacterium tuberculosis
NSGSFNNGALWTGDHH

SEQ ID NO: 188912 - protein, 16 aa, Mycobacterium tuberculosis
SGSFNNGALWTGDHHG

SEQ ID NO: 188913 - protein, 16 aa, Mycobacterium tuberculosis
GSFNNGALWTGDHHGL

SEQ ID NO: 188914 - protein, 16 aa, Mycobacterium tuberculosis
SFNNGALWTGDHHGLV

SEQ ID NO: 188915 - protein, 16 aa, Mycobacterium tuberculosis
FNNGALWTGDHHGLVG

SEQ ID NO: 188916 - protein, 16 aa, Mycobacterium tuberculosis
NNGALWTGDHHGLVGF

SEQ ID NO: 188917 - protein, 16 aa, Mycobacterium tuberculosis
NGALWTGDHHGLVGFS

SEQ ID NO: 188918 - protein, 16 aa, Mycobacterium tuberculosis
GALWTGDHHGLVGFSY

SEQ ID NO: 188919 - protein, 16 aa, Mycobacterium tuberculosis
ALWTGDHHGLVGFSYS

SEQ ID NO: 188920 - protein, 16 aa, Mycobacterium tuberculosis
LWTGDHHGLVGFSYSI

SEQ ID NO: 188921 - protein, 16 aa, Mycobacterium tuberculosis
WTGDHHGLVGFSYSIE

SEQ ID NO: 188922 - protein, 16 aa, Mycobacterium tuberculosis
TGDHHGLVGFSYSIEI

SEQ ID NO: 188923 - protein, 16 aa, Mycobacterium tuberculosis
GDHHGLVGFSYSIEIT

SEQ ID NO: 188924 - protein, 16 aa, Mycobacterium tuberculosis
DHHGLVGFSYSIEITG

SEQ ID NO: 188925 - protein, 16 aa, Mycobacterium tuberculosis
HHGLVGFSYSIEITGS

SEQ ID NO: 188926 - protein, 16 aa, Mycobacterium tuberculosis
HGLVGFSYSIEITGST

SEQ ID NO: 188927 - protein, 16 aa, Mycobacterium tuberculosis
GLVGFSYSIEITGSTL

SEQ ID NO: 188928 - protein, 16 aa, Mycobacterium tuberculosis
LVGFSYSIEITGSTLV

SEQ ID NO: 188929 - protein, 16 aa, Mycobacterium tuberculosis
VGFSYSIEITGSTLVD

SEQ ID NO: 188930 - protein, 16 aa, Mycobacterium tuberculosis
GFSYSIEITGSTLVDI

SEQ ID NO: 188931 - protein, 16 aa, Mycobacterium tuberculosis
FSYSIEITGSTLVDIN

SEQ ID NO: 188932 - protein, 16 aa, Mycobacterium tuberculosis
SYSIEITGSTLVDINE

SEQ ID NO: 188933 - protein, 16 aa, Mycobacterium tuberculosis
YSIEITGSTLVDINET

SEQ ID NO: 188934 - protein, 16 aa, Mycobacterium tuberculosis
SIEITGSTLVDINETL

SEQ ID NO: 188935 - protein, 16 aa, Mycobacterium tuberculosis
IEITGSTLVDINETLN

SEQ ID NO: 188936 - protein, 16 aa, Mycobacterium tuberculosis
EITGSTLVDINETLNL

SEQ ID NO: 188937 - protein, 16 aa, Mycobacterium tuberculosis
ITGSTLVDINETLNLG

SEQ ID NO: 188938 - protein, 16 aa, Mycobacterium tuberculosis
TGSTLVDINETLNLGP

SEQ ID NO: 188939 - protein, 16 aa, Mycobacterium tuberculosis
GSTLVDINETLNLGPV

SEQ ID NO: 188940 - protein, 16 aa, Mycobacterium tuberculosis
STLVDINETLNLGPVH

SEQ ID NO: 188941 - protein, 16 aa, Mycobacterium tuberculosis
TLVDINETLNLGPVHI

SEQ ID NO: 188942 - protein, 16 aa, Mycobacterium tuberculosis
LVDINETLNLGPVHID

SEQ ID NO: 188943 - protein, 16 aa, Mycobacterium tuberculosis
VDINETLNLGPVHIDQ

SEQ ID NO: 188944 - protein, 16 aa, Mycobacterium tuberculosis
DINETLNLGPVHIDQI

SEQ ID NO: 188945 - protein, 16 aa, Mycobacterium tuberculosis
INETLNLGPVHIDQID

SEQ ID NO: 188946 - protein, 16 aa, Mycobacterium tuberculosis
NETLNLGPVHIDQIDI

SEQ ID NO: 188947 - protein, 16 aa, Mycobacterium tuberculosis
ETLNLGPVHIDQIDIP

SEQ ID NO: 188948 - protein, 16 aa, Mycobacterium tuberculosis
TLNLGPVHIDQIDIPG

SEQ ID NO: 188949 - protein, 16 aa, Mycobacterium tuberculosis
LNLGPVHIDQIDIPGM

SEQ ID NO: 188950 - protein, 16 aa, Mycobacterium tuberculosis
NLGPVHIDQIDIPGMS

SEQ ID NO: 188951 - protein, 16 aa, Mycobacterium tuberculosis
LGPVHIDQIDIPGMSL

SEQ ID NO: 188952 - protein, 16 aa, Mycobacterium tuberculosis
GPVHIDQIDIPGMSLF

SEQ ID NO: 188953 - protein, 16 aa, Mycobacterium tuberculosis
PVHIDQIDIPGMSLFD

SEQ ID NO: 188954 - protein, 16 aa, Mycobacterium tuberculosis
VHIDQIDIPGMSLFDI

SEQ ID NO: 188955 - protein, 16 aa, Mycobacterium tuberculosis
HIDQIDIPGMSLFDIH

SEQ ID NO: 188956 - protein, 16 aa, Mycobacterium tuberculosis
IDQIDIPGMSLFDIHE

SEQ ID NO: 188957 - protein, 16 aa, Mycobacterium tuberculosis
DQIDIPGMSLFDIHEL

SEQ ID NO: 188958 - protein, 16 aa, Mycobacterium tuberculosis
QIDIPGMSLFDIHELV

SEQ ID NO: 188959 - protein, 16 aa, Mycobacterium tuberculosis
IDIPGMSLFDIHELVN

SEQ ID NO: 188960 - protein, 16 aa, Mycobacterium tuberculosis
DIPGMSLFDIHELVNI

SEQ ID NO: 188961 - protein, 16 aa, Mycobacterium tuberculosis
IPGMSLFDIHELVNIG

SEQ ID NO: 188962 - protein, 16 aa, Mycobacterium tuberculosis
PGMSLFDIHELVNIGP

SEQ ID NO: 188963 - protein, 16 aa, Mycobacterium tuberculosis
GMSLFDIHELVNIGPF

SEQ ID NO: 188964 - protein, 16 aa, Mycobacterium tuberculosis
MSLFDIHELVNIGPFR

SEQ ID NO: 188965 - protein, 16 aa, Mycobacterium tuberculosis
SLFDIHELVNIGPFRI

SEQ ID NO: 188966 - protein, 16 aa, Mycobacterium tuberculosis
LFDIHELVNIGPFRIE

SEQ ID NO: 188967 - protein, 16 aa, Mycobacterium tuberculosis
FDIHELVNIGPFRIEP

SEQ ID NO: 188968 - protein, 16 aa, Mycobacterium tuberculosis
DIHELVNIGPFRIEPI

SEQ ID NO: 188969 - protein, 16 aa, Mycobacterium tuberculosis
IHELVNIGPFRIEPID

SEQ ID NO: 188970 - protein, 16 aa, Mycobacterium tuberculosis
HELVNIGPFRIEPIDV

SEQ ID NO: 188971 - protein, 16 aa, Mycobacterium tuberculosis
ELVNIGPFRIEPIDVP

SEQ ID NO: 188972 - protein, 16 aa, Mycobacterium tuberculosis
LVNIGPFRIEPIDVPA

SEQ ID NO: 188973 - protein, 16 aa, Mycobacterium tuberculosis
VNIGPFRIEPIDVPAV

SEQ ID NO: 188974 - protein, 16 aa, Mycobacterium tuberculosis
NIGPFRIEPIDVPAVV

SEQ ID NO: 188975 - protein, 16 aa, Mycobacterium tuberculosis
IGPFRIEPIDVPAVVL

SEQ ID NO: 188976 - protein, 16 aa, Mycobacterium tuberculosis
GPFRIEPIDVPAVVLD

SEQ ID NO: 188977 - protein, 16 aa, Mycobacterium tuberculosis
PFRIEPIDVPAVVLDI

SEQ ID NO: 188978 - protein, 16 aa, Mycobacterium tuberculosis
FRIEPIDVPAVVLDIH

SEQ ID NO: 188979 - protein, 16 aa, Mycobacterium tuberculosis
RIEPIDVPAVVLDIHE

SEQ ID NO: 188980 - protein, 16 aa, Mycobacterium tuberculosis
IEPIDVPAVVLDIHET

SEQ ID NO: 188981 - protein, 16 aa, Mycobacterium tuberculosis
EPIDVPAVVLDIHETM

SEQ ID NO: 188982 - protein, 16 aa, Mycobacterium tuberculosis
PIDVPAVVLDIHETMV

SEQ ID NO: 188983 - protein, 16 aa, Mycobacterium tuberculosis
IDVPAVVLDIHETMVI

SEQ ID NO: 188984 - protein, 16 aa, Mycobacterium tuberculosis
DVPAVVLDIHETMVIP

SEQ ID NO: 188985 - protein, 16 aa, Mycobacterium tuberculosis
VPAVVLDIHETMVIPP

SEQ ID NO: 188986 - protein, 16 aa, Mycobacterium tuberculosis
PAVVLDIHETMVIPPI

SEQ ID NO: 188987 - protein, 16 aa, Mycobacterium tuberculosis
AVVLDIHETMVIPPIV

SEQ ID NO: 188988 - protein, 16 aa, Mycobacterium tuberculosis
VVLDIHETMVIPPIVF

SEQ ID NO: 188989 - protein, 16 aa, Mycobacterium tuberculosis
VLDIHETMVIPPIVFL

SEQ ID NO: 188990 - protein, 16 aa, Mycobacterium tuberculosis
LDIHETMVIPPIVFLP

SEQ ID NO: 188991 - protein, 16 aa, Mycobacterium tuberculosis
DIHETMVIPPIVFLPS

SEQ ID NO: 188992 - protein, 16 aa, Mycobacterium tuberculosis
IHETMVIPPIVFLPSM

SEQ ID NO: 188993 - protein, 16 aa, Mycobacterium tuberculosis
HETMVIPPIVFLPSMT

SEQ ID NO: 188994 - protein, 16 aa, Mycobacterium tuberculosis
ETMVIPPIVFLPSMTI

SEQ ID NO: 188995 - protein, 16 aa, Mycobacterium tuberculosis
TMVIPPIVFLPSMTIG

SEQ ID NO: 188996 - protein, 16 aa, Mycobacterium tuberculosis
MVIPPIVFLPSMTIGG

SEQ ID NO: 188997 - protein, 16 aa, Mycobacterium tuberculosis
VIPPIVFLPSMTIGGQ

SEQ ID NO: 188998 - protein, 16 aa, Mycobacterium tuberculosis
IPPIVFLPSMTIGGQT

SEQ ID NO: 188999 - protein, 16 aa, Mycobacterium tuberculosis
PPIVFLPSMTIGGQTY

SEQ ID NO: 189000 - protein, 16 aa, Mycobacterium tuberculosis
PIVFLPSMTIGGQTYT

SEQ ID NO: 189001 - protein, 16 aa, Mycobacterium tuberculosis
IVFLPSMTIGGQTYTI

SEQ ID NO: 189002 - protein, 16 aa, Mycobacterium tuberculosis
VFLPSMTIGGQTYTIP

SEQ ID NO: 189003 - protein, 16 aa, Mycobacterium tuberculosis
FLPSMTIGGQTYTIPL

SEQ ID NO: 189004 - protein, 16 aa, Mycobacterium tuberculosis
LPSMTIGGQTYTIPLD

SEQ ID NO: 189005 - protein, 16 aa, Mycobacterium tuberculosis
PSMTIGGQTYTIPLDT

SEQ ID NO: 189006 - protein, 16 aa, Mycobacterium tuberculosis
SMTIGGQTYTIPLDTP

SEQ ID NO: 189007 - protein, 16 aa, Mycobacterium tuberculosis
MTIGGQTYTIPLDTPP

SEQ ID NO: 189008 - protein, 16 aa, Mycobacterium tuberculosis
TIGGQTYTIPLDTPPA

SEQ ID NO: 189009 - protein, 16 aa, Mycobacterium tuberculosis
IGGQTYTIPLDTPPAP

SEQ ID NO: 189010 - protein, 16 aa, Mycobacterium tuberculosis
GGQTYTIPLDTPPAPA

SEQ ID NO: 189011 - protein, 16 aa, Mycobacterium tuberculosis
GQTYTIPLDTPPAPAP

SEQ ID NO: 189012 - protein, 16 aa, Mycobacterium tuberculosis
QTYTIPLDTPPAPAPP

SEQ ID NO: 189013 - protein, 16 aa, Mycobacterium tuberculosis
TYTIPLDTPPAPAPPP

SEQ ID NO: 189014 - protein, 16 aa, Mycobacterium tuberculosis
YTIPLDTPPAPAPPPF

SEQ ID NO: 189015 - protein, 16 aa, Mycobacterium tuberculosis
TIPLDTPPAPAPPPFR

SEQ ID NO: 189016 - protein, 16 aa, Mycobacterium tuberculosis
IPLDTPPAPAPPPFRL

SEQ ID NO: 189017 - protein, 16 aa, Mycobacterium tuberculosis
PLDTPPAPAPPPFRLP

SEQ ID NO: 189018 - protein, 16 aa, Mycobacterium tuberculosis
LDTPPAPAPPPFRLPL

SEQ ID NO: 189019 - protein, 16 aa, Mycobacterium tuberculosis
DTPPAPAPPPFRLPLL

SEQ ID NO: 189020 - protein, 16 aa, Mycobacterium tuberculosis
TPPAPAPPPFRLPLLF

SEQ ID NO: 189021 - protein, 16 aa, Mycobacterium tuberculosis
PPAPAPPPFRLPLLFV

SEQ ID NO: 189022 - protein, 16 aa, Mycobacterium tuberculosis
PAPAPPPFRLPLLFVN

SEQ ID NO: 189023 - protein, 16 aa, Mycobacterium tuberculosis
APAPPPFRLPLLFVNA

SEQ ID NO: 189024 - protein, 16 aa, Mycobacterium tuberculosis
PAPPPFRLPLLFVNAL

SEQ ID NO: 189025 - protein, 16 aa, Mycobacterium tuberculosis
APPPFRLPLLFVNALG

SEQ ID NO: 189026 - protein, 16 aa, Mycobacterium tuberculosis
PPPFRLPLLFVNALGD

SEQ ID NO: 189027 - protein, 16 aa, Mycobacterium tuberculosis
PPFRLPLLFVNALGDN

SEQ ID NO: 189028 - protein, 16 aa, Mycobacterium tuberculosis
PFRLPLLFVNALGDNW

SEQ ID NO: 189029 - protein, 16 aa, Mycobacterium tuberculosis
FRLPLLFVNALGDNWI

SEQ ID NO: 189030 - protein, 16 aa, Mycobacterium tuberculosis
RLPLLFVNALGDNWIV

SEQ ID NO: 189031 - protein, 16 aa, Mycobacterium tuberculosis
LPLLFVNALGDNWIVG

SEQ ID NO: 189032 - protein, 16 aa, Mycobacterium tuberculosis
PLLFVNALGDNWIVGA

SEQ ID NO: 189033 - protein, 16 aa, Mycobacterium tuberculosis
LLFVNALGDNWIVGAS

SEQ ID NO: 189034 - protein, 16 aa, Mycobacterium tuberculosis
LFVNALGDNWIVGASN

SEQ ID NO: 189035 - protein, 16 aa, Mycobacterium tuberculosis
FVNALGDNWIVGASNS

SEQ ID NO: 189036 - protein, 16 aa, Mycobacterium tuberculosis
VNALGDNWIVGASNST

SEQ ID NO: 189037 - protein, 16 aa, Mycobacterium tuberculosis
NALGDNWIVGASNSTG

SEQ ID NO: 189038 - protein, 16 aa, Mycobacterium tuberculosis
ALGDNWIVGASNSTGM

SEQ ID NO: 189039 - protein, 16 aa, Mycobacterium tuberculosis
LGDNWIVGASNSTGMS

SEQ ID NO: 189040 - protein, 16 aa, Mycobacterium tuberculosis
GDNWIVGASNSTGMSG

SEQ ID NO: 189041 - protein, 16 aa, Mycobacterium tuberculosis
DNWIVGASNSTGMSGG

SEQ ID NO: 189042 - protein, 16 aa, Mycobacterium tuberculosis
NWIVGASNSTGMSGGF

SEQ ID NO: 189043 - protein, 16 aa, Mycobacterium tuberculosis
WIVGASNSTGMSGGFV

SEQ ID NO: 189044 - protein, 16 aa, Mycobacterium tuberculosis
IVGASNSTGMSGGFVT

SEQ ID NO: 189045 - protein, 16 aa, Mycobacterium tuberculosis
VGASNSTGMSGGFVTA

SEQ ID NO: 189046 - protein, 16 aa, Mycobacterium tuberculosis
GASNSTGMSGGFVTAP

SEQ ID NO: 189047 - protein, 16 aa, Mycobacterium tuberculosis
ASNSTGMSGGFVTAPT

SEQ ID NO: 189048 - protein, 16 aa, Mycobacterium tuberculosis
SNSTGMSGGFVTAPTQ

SEQ ID NO: 189049 - protein, 16 aa, Mycobacterium tuberculosis
NSTGMSGGFVTAPTQG

SEQ ID NO: 189050 - protein, 16 aa, Mycobacterium tuberculosis
STGMSGGFVTAPTQGI

SEQ ID NO: 189051 - protein, 16 aa, Mycobacterium tuberculosis
TGMSGGFVTAPTQGIL

SEQ ID NO: 189052 - protein, 16 aa, Mycobacterium tuberculosis
GMSGGFVTAPTQGILI

SEQ ID NO: 189053 - protein, 16 aa, Mycobacterium tuberculosis
MSGGFVTAPTQGILIH

SEQ ID NO: 189054 - protein, 16 aa, Mycobacterium tuberculosis
SGGFVTAPTQGILIHT

SEQ ID NO: 189055 - protein, 16 aa, Mycobacterium tuberculosis
GGFVTAPTQGILIHTG

SEQ ID NO: 189056 - protein, 16 aa, Mycobacterium tuberculosis
GFVTAPTQGILIHTGP

SEQ ID NO: 189057 - protein, 16 aa, Mycobacterium tuberculosis
FVTAPTQGILIHTGPS

SEQ ID NO: 189058 - protein, 16 aa, Mycobacterium tuberculosis
VTAPTQGILIHTGPSS

SEQ ID NO: 189059 - protein, 16 aa, Mycobacterium tuberculosis
TAPTQGILIHTGPSSA

SEQ ID NO: 189060 - protein, 16 aa, Mycobacterium tuberculosis
APTQGILIHTGPSSAT

SEQ ID NO: 189061 - protein, 16 aa, Mycobacterium tuberculosis
PTQGILIHTGPSSATT

SEQ ID NO: 189062 - protein, 16 aa, Mycobacterium tuberculosis
TQGILIHTGPSSATTG

SEQ ID NO: 189063 - protein, 16 aa, Mycobacterium tuberculosis
QGILIHTGPSSATTGS

SEQ ID NO: 189064 - protein, 16 aa, Mycobacterium tuberculosis
GILIHTGPSSATTGSL

SEQ ID NO: 189065 - protein, 16 aa, Mycobacterium tuberculosis
ILIHTGPSSATTGSLA

SEQ ID NO: 189066 - protein, 16 aa, Mycobacterium tuberculosis
LIHTGPSSATTGSLAL

SEQ ID NO: 189067 - protein, 16 aa, Mycobacterium tuberculosis
IHTGPSSATTGSLALT

SEQ ID NO: 189068 - protein, 16 aa, Mycobacterium tuberculosis
HTGPSSATTGSLALTL

SEQ ID NO: 189069 - protein, 16 aa, Mycobacterium tuberculosis
TGPSSATTGSLALTLP

SEQ ID NO: 189070 - protein, 16 aa, Mycobacterium tuberculosis
GPSSATTGSLALTLPT

SEQ ID NO: 189071 - protein, 16 aa, Mycobacterium tuberculosis
PSSATTGSLALTLPTV

SEQ ID NO: 189072 - protein, 16 aa, Mycobacterium tuberculosis
SSATTGSLALTLPTVT

SEQ ID NO: 189073 - protein, 16 aa, Mycobacterium tuberculosis
SATTGSLALTLPTVTI

SEQ ID NO: 189074 - protein, 16 aa, Mycobacterium tuberculosis
ATTGSLALTLPTVTIP

SEQ ID NO: 189075 - protein, 16 aa, Mycobacterium tuberculosis
TTGSLALTLPTVTIPT

SEQ ID NO: 189076 - protein, 16 aa, Mycobacterium tuberculosis
TGSLALTLPTVTIPTI

SEQ ID NO: 189077 - protein, 16 aa, Mycobacterium tuberculosis
GSLALTLPTVTIPTIT

SEQ ID NO: 189078 - protein, 16 aa, Mycobacterium tuberculosis
SLALTLPTVTIPTITT

SEQ ID NO: 189079 - protein, 16 aa, Mycobacterium tuberculosis
LALTLPTVTIPTITTS

SEQ ID NO: 189080 - protein, 16 aa, Mycobacterium tuberculosis
ALTLPTVTIPTITTSP

SEQ ID NO: 189081 - protein, 16 aa, Mycobacterium tuberculosis
LTLPTVTIPTITTSPI

SEQ ID NO: 189082 - protein, 16 aa, Mycobacterium tuberculosis
TLPTVTIPTITTSPIP

SEQ ID NO: 189083 - protein, 16 aa, Mycobacterium tuberculosis
LPTVTIPTITTSPIPL

SEQ ID NO: 189084 - protein, 16 aa, Mycobacterium tuberculosis
PTVTIPTITTSPIPLK

SEQ ID NO: 189085 - protein, 16 aa, Mycobacterium tuberculosis
TVTIPTITTSPIPLKI

SEQ ID NO: 189086 - protein, 16 aa, Mycobacterium tuberculosis
VTIPTITTSPIPLKID

SEQ ID NO: 189087 - protein, 16 aa, Mycobacterium tuberculosis
TIPTITTSPIPLKIDV

SEQ ID NO: 189088 - protein, 16 aa, Mycobacterium tuberculosis
IPTITTSPIPLKIDVS

SEQ ID NO: 189089 - protein, 16 aa, Mycobacterium tuberculosis
PTITTSPIPLKIDVSG

SEQ ID NO: 189090 - protein, 16 aa, Mycobacterium tuberculosis
TITTSPIPLKIDVSGG

SEQ ID NO: 189091 - protein, 16 aa, Mycobacterium tuberculosis
ITTSPIPLKIDVSGGL

SEQ ID NO: 189092 - protein, 16 aa, Mycobacterium tuberculosis
TTSPIPLKIDVSGGLP

SEQ ID NO: 189093 - protein, 16 aa, Mycobacterium tuberculosis
TSPIPLKIDVSGGLPA

SEQ ID NO: 189094 - protein, 16 aa, Mycobacterium tuberculosis
SPIPLKIDVSGGLPAF

SEQ ID NO: 189095 - protein, 16 aa, Mycobacterium tuberculosis
PIPLKIDVSGGLPAFT

SEQ ID NO: 189096 - protein, 16 aa, Mycobacterium tuberculosis
IPLKIDVSGGLPAFTL

SEQ ID NO: 189097 - protein, 16 aa, Mycobacterium tuberculosis
PLKIDVSGGLPAFTLF

SEQ ID NO: 189098 - protein, 16 aa, Mycobacterium tuberculosis
LKIDVSGGLPAFTLFP

SEQ ID NO: 189099 - protein, 16 aa, Mycobacterium tuberculosis
KIDVSGGLPAFTLFPG

SEQ ID NO: 189100 - protein, 16 aa, Mycobacterium tuberculosis
IDVSGGLPAFTLFPGG

SEQ ID NO: 189101 - protein, 16 aa, Mycobacterium tuberculosis
DVSGGLPAFTLFPGGL

SEQ ID NO: 189102 - protein, 16 aa, Mycobacterium tuberculosis
VSGGLPAFTLFPGGLN

SEQ ID NO: 189103 - protein, 16 aa, Mycobacterium tuberculosis
SGGLPAFTLFPGGLNI

SEQ ID NO: 189104 - protein, 16 aa, Mycobacterium tuberculosis
GGLPAFTLFPGGLNIP

SEQ ID NO: 189105 - protein, 16 aa, Mycobacterium tuberculosis
GLPAFTLFPGGLNIPQ

SEQ ID NO: 189106 - protein, 16 aa, Mycobacterium tuberculosis
LPAFTLFPGGLNIPQN

SEQ ID NO: 189107 - protein, 16 aa, Mycobacterium tuberculosis
PAFTLFPGGLNIPQNA

SEQ ID NO: 189108 - protein, 16 aa, Mycobacterium tuberculosis
AFTLFPGGLNIPQNAI

SEQ ID NO: 189109 - protein, 16 aa, Mycobacterium tuberculosis
FTLFPGGLNIPQNAIP

SEQ ID NO: 189110 - protein, 16 aa, Mycobacterium tuberculosis
TLFPGGLNIPQNAIPL

SEQ ID NO: 189111 - protein, 16 aa, Mycobacterium tuberculosis
LFPGGLNIPQNAIPLT

SEQ ID NO: 189112 - protein, 16 aa, Mycobacterium tuberculosis
FPGGLNIPQNAIPLTI

SEQ ID NO: 189113 - protein, 16 aa, Mycobacterium tuberculosis
PGGLNIPQNAIPLTID

SEQ ID NO: 189114 - protein, 16 aa, Mycobacterium tuberculosis
GGLNIPQNAIPLTIDA

SEQ ID NO: 189115 - protein, 16 aa, Mycobacterium tuberculosis
GLNIPQNAIPLTIDAS

SEQ ID NO: 189116 - protein, 16 aa, Mycobacterium tuberculosis
LNIPQNAIPLTIDASG

SEQ ID NO: 189117 - protein, 16 aa, Mycobacterium tuberculosis
NIPQNAIPLTIDASGV

SEQ ID NO: 189118 - protein, 16 aa, Mycobacterium tuberculosis
IPQNAIPLTIDASGVL

SEQ ID NO: 189119 - protein, 16 aa, Mycobacterium tuberculosis
PQNAIPLTIDASGVLD

SEQ ID NO: 189120 - protein, 16 aa, Mycobacterium tuberculosis
QNAIPLTIDASGVLDP

SEQ ID NO: 189121 - protein, 16 aa, Mycobacterium tuberculosis
NAIPLTIDASGVLDPI

SEQ ID NO: 189122 - protein, 16 aa, Mycobacterium tuberculosis
AIPLTIDASGVLDPIT

SEQ ID NO: 189123 - protein, 16 aa, Mycobacterium tuberculosis
IPLTIDASGVLDPITI

SEQ ID NO: 189124 - protein, 16 aa, Mycobacterium tuberculosis
PLTIDASGVLDPITIF

SEQ ID NO: 189125 - protein, 16 aa, Mycobacterium tuberculosis
LTIDASGVLDPITIFP

SEQ ID NO: 189126 - protein, 16 aa, Mycobacterium tuberculosis
TIDASGVLDPITIFPG

SEQ ID NO: 189127 - protein, 16 aa, Mycobacterium tuberculosis
IDASGVLDPITIFPGG

SEQ ID NO: 189128 - protein, 16 aa, Mycobacterium tuberculosis
DASGVLDPITIFPGGF

SEQ ID NO: 189129 - protein, 16 aa, Mycobacterium tuberculosis
ASGVLDPITIFPGGFT

SEQ ID NO: 189130 - protein, 16 aa, Mycobacterium tuberculosis
SGVLDPITIFPGGFTI

SEQ ID NO: 189131 - protein, 16 aa, Mycobacterium tuberculosis
GVLDPITIFPGGFTID

SEQ ID NO: 189132 - protein, 16 aa, Mycobacterium tuberculosis
VLDPITIFPGGFTIDP

SEQ ID NO: 189133 - protein, 16 aa, Mycobacterium tuberculosis
LDPITIFPGGFTIDPL

SEQ ID NO: 189134 - protein, 16 aa, Mycobacterium tuberculosis
DPITIFPGGFTIDPLP

SEQ ID NO: 189135 - protein, 16 aa, Mycobacterium tuberculosis
PITIFPGGFTIDPLPL

SEQ ID NO: 189136 - protein, 16 aa, Mycobacterium tuberculosis
ITIFPGGFTIDPLPLS

SEQ ID NO: 189137 - protein, 16 aa, Mycobacterium tuberculosis
TIFPGGFTIDPLPLSL

SEQ ID NO: 189138 - protein, 16 aa, Mycobacterium tuberculosis
IFPGGFTIDPLPLSLA

SEQ ID NO: 189139 - protein, 16 aa, Mycobacterium tuberculosis
FPGGFTIDPLPLSLAL

SEQ ID NO: 189140 - protein, 16 aa, Mycobacterium tuberculosis
PGGFTIDPLPLSLALN

SEQ ID NO: 189141 - protein, 16 aa, Mycobacterium tuberculosis
GGFTIDPLPLSLALNI

SEQ ID NO: 189142 - protein, 16 aa, Mycobacterium tuberculosis
GFTIDPLPLSLALNIS

SEQ ID NO: 189143 - protein, 16 aa, Mycobacterium tuberculosis
FTIDPLPLSLALNISV

SEQ ID NO: 189144 - protein, 16 aa, Mycobacterium tuberculosis
TIDPLPLSLALNISVP

SEQ ID NO: 189145 - protein, 16 aa, Mycobacterium tuberculosis
IDPLPLSLALNISVPD

SEQ ID NO: 189146 - protein, 16 aa, Mycobacterium tuberculosis
DPLPLSLALNISVPDS

SEQ ID NO: 189147 - protein, 16 aa, Mycobacterium tuberculosis
PLPLSLALNISVPDSS

SEQ ID NO: 189148 - protein, 16 aa, Mycobacterium tuberculosis
LPLSLALNISVPDSSV

SEQ ID NO: 189149 - protein, 16 aa, Mycobacterium tuberculosis
PLSLALNISVPDSSVP

SEQ ID NO: 189150 - protein, 16 aa, Mycobacterium tuberculosis
LSLALNISVPDSSVPI

SEQ ID NO: 189151 - protein, 16 aa, Mycobacterium tuberculosis
SLALNISVPDSSVPII

SEQ ID NO: 189152 - protein, 16 aa, Mycobacterium tuberculosis
LALNISVPDSSVPIII

SEQ ID NO: 189153 - protein, 16 aa, Mycobacterium tuberculosis
ALNISVPDSSVPIIIV

SEQ ID NO: 189154 - protein, 16 aa, Mycobacterium tuberculosis
LNISVPDSSVPIIIVP

SEQ ID NO: 189155 - protein, 16 aa, Mycobacterium tuberculosis
NISVPDSSVPIIIVPP

SEQ ID NO: 189156 - protein, 16 aa, Mycobacterium tuberculosis
ISVPDSSVPIIIVPPT

SEQ ID NO: 189157 - protein, 16 aa, Mycobacterium tuberculosis
SVPDSSVPIIIVPPTP

SEQ ID NO: 189158 - protein, 16 aa, Mycobacterium tuberculosis
VPDSSVPIIIVPPTPG

SEQ ID NO: 189159 - protein, 16 aa, Mycobacterium tuberculosis
PDSSVPIIIVPPTPGF

SEQ ID NO: 189160 - protein, 16 aa, Mycobacterium tuberculosis
DSSVPIIIVPPTPGFG

SEQ ID NO: 189161 - protein, 16 aa, Mycobacterium tuberculosis
SSVPIIIVPPTPGFGN

SEQ ID NO: 189162 - protein, 16 aa, Mycobacterium tuberculosis
SVPIIIVPPTPGFGNA

SEQ ID NO: 189163 - protein, 16 aa, Mycobacterium tuberculosis
VPIIIVPPTPGFGNAT

SEQ ID NO: 189164 - protein, 16 aa, Mycobacterium tuberculosis
PIIIVPPTPGFGNATA

SEQ ID NO: 189165 - protein, 16 aa, Mycobacterium tuberculosis
IIIVPPTPGFGNATAT

SEQ ID NO: 189166 - protein, 16 aa, Mycobacterium tuberculosis
IIVPPTPGFGNATATP

SEQ ID NO: 189167 - protein, 16 aa, Mycobacterium tuberculosis
IVPPTPGFGNATATPS

SEQ ID NO: 189168 - protein, 16 aa, Mycobacterium tuberculosis
VPPTPGFGNATATPSS

SEQ ID NO: 189169 - protein, 16 aa, Mycobacterium tuberculosis
PPTPGFGNATATPSSG

SEQ ID NO: 189170 - protein, 16 aa, Mycobacterium tuberculosis
PTPGFGNATATPSSGF

SEQ ID NO: 189171 - protein, 16 aa, Mycobacterium tuberculosis
TPGFGNATATPSSGFF

SEQ ID NO: 189172 - protein, 16 aa, Mycobacterium tuberculosis
PGFGNATATPSSGFFN

SEQ ID NO: 189173 - protein, 16 aa, Mycobacterium tuberculosis
GFGNATATPSSGFFNS

SEQ ID NO: 189174 - protein, 16 aa, Mycobacterium tuberculosis
FGNATATPSSGFFNSG

SEQ ID NO: 189175 - protein, 16 aa, Mycobacterium tuberculosis
GNATATPSSGFFNSGA

SEQ ID NO: 189176 - protein, 16 aa, Mycobacterium tuberculosis
NATATPSSGFFNSGAG

SEQ ID NO: 189177 - protein, 16 aa, Mycobacterium tuberculosis
ATATPSSGFFNSGAGG

SEQ ID NO: 189178 - protein, 16 aa, Mycobacterium tuberculosis
TATPSSGFFNSGAGGV

SEQ ID NO: 189179 - protein, 16 aa, Mycobacterium tuberculosis
ATPSSGFFNSGAGGVS

SEQ ID NO: 189180 - protein, 16 aa, Mycobacterium tuberculosis
TPSSGFFNSGAGGVSG

SEQ ID NO: 189181 - protein, 16 aa, Mycobacterium tuberculosis
PSSGFFNSGAGGVSGF

SEQ ID NO: 189182 - protein, 16 aa, Mycobacterium tuberculosis
SSGFFNSGAGGVSGFG

SEQ ID NO: 189183 - protein, 16 aa, Mycobacterium tuberculosis
SGFFNSGAGGVSGFGN

SEQ ID NO: 189184 - protein, 16 aa, Mycobacterium tuberculosis
GFFNSGAGGVSGFGNF

SEQ ID NO: 189185 - protein, 16 aa, Mycobacterium tuberculosis
FFNSGAGGVSGFGNFG

SEQ ID NO: 189186 - protein, 16 aa, Mycobacterium tuberculosis
FNSGAGGVSGFGNFGA

SEQ ID NO: 189187 - protein, 16 aa, Mycobacterium tuberculosis
NSGAGGVSGFGNFGAG

SEQ ID NO: 189188 - protein, 16 aa, Mycobacterium tuberculosis
SGAGGVSGFGNFGAGS

SEQ ID NO: 189189 - protein, 16 aa, Mycobacterium tuberculosis
GAGGVSGFGNFGAGSS

SEQ ID NO: 189190 - protein, 16 aa, Mycobacterium tuberculosis
AGGVSGFGNFGAGSSG

SEQ ID NO: 189191 - protein, 16 aa, Mycobacterium tuberculosis
GGVSGFGNFGAGSSGW

SEQ ID NO: 189192 - protein, 16 aa, Mycobacterium tuberculosis
GVSGFGNFGAGSSGWW

SEQ ID NO: 189193 - protein, 16 aa, Mycobacterium tuberculosis
VSGFGNFGAGSSGWWN

SEQ ID NO: 189194 - protein, 16 aa, Mycobacterium tuberculosis
SGFGNFGAGSSGWWNQ

SEQ ID NO: 189195 - protein, 16 aa, Mycobacterium tuberculosis
GFGNFGAGSSGWWNQA

SEQ ID NO: 189196 - protein, 16 aa, Mycobacterium tuberculosis
FGNFGAGSSGWWNQAH

SEQ ID NO: 189197 - protein, 16 aa, Mycobacterium tuberculosis
GNFGAGSSGWWNQAHA

SEQ ID NO: 189198 - protein, 16 aa, Mycobacterium tuberculosis
NFGAGSSGWWNQAHAA

SEQ ID NO: 189199 - protein, 16 aa, Mycobacterium tuberculosis
FGAGSSGWWNQAHAAL

SEQ ID NO: 189200 - protein, 16 aa, Mycobacterium tuberculosis
GAGSSGWWNQAHAALA

SEQ ID NO: 189201 - protein, 16 aa, Mycobacterium tuberculosis
AGSSGWWNQAHAALAG

SEQ ID NO: 189202 - protein, 16 aa, Mycobacterium tuberculosis
GSSGWWNQAHAALAGA

SEQ ID NO: 189203 - protein, 16 aa, Mycobacterium tuberculosis
SSGWWNQAHAALAGAG

SEQ ID NO: 189204 - protein, 16 aa, Mycobacterium tuberculosis
SGWWNQAHAALAGAGS

SEQ ID NO: 189205 - protein, 16 aa, Mycobacterium tuberculosis
GWWNQAHAALAGAGSG

SEQ ID NO: 189206 - protein, 16 aa, Mycobacterium tuberculosis
WWNQAHAALAGAGSGV

SEQ ID NO: 189207 - protein, 16 aa, Mycobacterium tuberculosis
WNQAHAALAGAGSGVL

SEQ ID NO: 189208 - protein, 16 aa, Mycobacterium tuberculosis
NQAHAALAGAGSGVLN

SEQ ID NO: 189209 - protein, 16 aa, Mycobacterium tuberculosis
QAHAALAGAGSGVLNV

SEQ ID NO: 189210 - protein, 16 aa, Mycobacterium tuberculosis
AHAALAGAGSGVLNVG

SEQ ID NO: 189211 - protein, 16 aa, Mycobacterium tuberculosis
HAALAGAGSGVLNVGT

SEQ ID NO: 189212 - protein, 16 aa, Mycobacterium tuberculosis
AALAGAGSGVLNVGTL

SEQ ID NO: 189213 - protein, 16 aa, Mycobacterium tuberculosis
ALAGAGSGVLNVGTLN

SEQ ID NO: 189214 - protein, 16 aa, Mycobacterium tuberculosis
LAGAGSGVLNVGTLNS

SEQ ID NO: 189215 - protein, 16 aa, Mycobacterium tuberculosis
AGAGSGVLNVGTLNSG

SEQ ID NO: 189216 - protein, 16 aa, Mycobacterium tuberculosis
GAGSGVLNVGTLNSGV

SEQ ID NO: 189217 - protein, 16 aa, Mycobacterium tuberculosis
AGSGVLNVGTLNSGVL

SEQ ID NO: 189218 - protein, 16 aa, Mycobacterium tuberculosis
GSGVLNVGTLNSGVLN

SEQ ID NO: 189219 - protein, 16 aa, Mycobacterium tuberculosis
SGVLNVGTLNSGVLNV

SEQ ID NO: 189220 - protein, 16 aa, Mycobacterium tuberculosis
GVLNVGTLNSGVLNVG

SEQ ID NO: 189221 - protein, 16 aa, Mycobacterium tuberculosis
VLNVGTLNSGVLNVGS

SEQ ID NO: 189222 - protein, 16 aa, Mycobacterium tuberculosis
LNVGTLNSGVLNVGSG

SEQ ID NO: 189223 - protein, 16 aa, Mycobacterium tuberculosis
NVGTLNSGVLNVGSGI

SEQ ID NO: 189224 - protein, 16 aa, Mycobacterium tuberculosis
VGTLNSGVLNVGSGIS

SEQ ID NO: 189225 - protein, 16 aa, Mycobacterium tuberculosis
GTLNSGVLNVGSGISG

SEQ ID NO: 189226 - protein, 16 aa, Mycobacterium tuberculosis
TLNSGVLNVGSGISGL

SEQ ID NO: 189227 - protein, 16 aa, Mycobacterium tuberculosis
LNSGVLNVGSGISGLY

SEQ ID NO: 189228 - protein, 16 aa, Mycobacterium tuberculosis
NSGVLNVGSGISGLYN

SEQ ID NO: 189229 - protein, 16 aa, Mycobacterium tuberculosis
SGVLNVGSGISGLYNT

SEQ ID NO: 189230 - protein, 16 aa, Mycobacterium tuberculosis
GVLNVGSGISGLYNTA

SEQ ID NO: 189231 - protein, 16 aa, Mycobacterium tuberculosis
VLNVGSGISGLYNTAI

SEQ ID NO: 189232 - protein, 16 aa, Mycobacterium tuberculosis
LNVGSGISGLYNTAIV

SEQ ID NO: 189233 - protein, 16 aa, Mycobacterium tuberculosis
NVGSGISGLYNTAIVG

SEQ ID NO: 189234 - protein, 16 aa, Mycobacterium tuberculosis
VGSGISGLYNTAIVGL

SEQ ID NO: 189235 - protein, 16 aa, Mycobacterium tuberculosis
GSGISGLYNTAIVGLG

SEQ ID NO: 189236 - protein, 16 aa, Mycobacterium tuberculosis
SGISGLYNTAIVGLGT

SEQ ID NO: 189237 - protein, 16 aa, Mycobacterium tuberculosis
GISGLYNTAIVGLGTP

SEQ ID NO: 189238 - protein, 16 aa, Mycobacterium tuberculosis
ISGLYNTAIVGLGTPA

SEQ ID NO: 189239 - protein, 16 aa, Mycobacterium tuberculosis
SGLYNTAIVGLGTPAL

SEQ ID NO: 189240 - protein, 16 aa, Mycobacterium tuberculosis
GLYNTAIVGLGTPALV

SEQ ID NO: 189241 - protein, 16 aa, Mycobacterium tuberculosis
LYNTAIVGLGTPALVS

SEQ ID NO: 189242 - protein, 16 aa, Mycobacterium tuberculosis
YNTAIVGLGTPALVSG

SEQ ID NO: 189243 - protein, 16 aa, Mycobacterium tuberculosis
NTAIVGLGTPALVSGA

SEQ ID NO: 189244 - protein, 16 aa, Mycobacterium tuberculosis
TAIVGLGTPALVSGAG

SEQ ID NO: 189245 - protein, 16 aa, Mycobacterium tuberculosis
AIVGLGTPALVSGAGN

SEQ ID NO: 189246 - protein, 16 aa, Mycobacterium tuberculosis
IVGLGTPALVSGAGNV

SEQ ID NO: 189247 - protein, 16 aa, Mycobacterium tuberculosis
VGLGTPALVSGAGNVG

SEQ ID NO: 189248 - protein, 16 aa, Mycobacterium tuberculosis
GLGTPALVSGAGNVGQ

SEQ ID NO: 189249 - protein, 16 aa, Mycobacterium tuberculosis
LGTPALVSGAGNVGQQ

SEQ ID NO: 189250 - protein, 16 aa, Mycobacterium tuberculosis
GTPALVSGAGNVGQQL

SEQ ID NO: 189251 - protein, 16 aa, Mycobacterium tuberculosis
TPALVSGAGNVGQQLS

SEQ ID NO: 189252 - protein, 16 aa, Mycobacterium tuberculosis
PALVSGAGNVGQQLSG

SEQ ID NO: 189253 - protein, 16 aa, Mycobacterium tuberculosis
ALVSGAGNVGQQLSGV

SEQ ID NO: 189254 - protein, 16 aa, Mycobacterium tuberculosis
LVSGAGNVGQQLSGVL

SEQ ID NO: 189255 - protein, 16 aa, Mycobacterium tuberculosis
VSGAGNVGQQLSGVLA

SEQ ID NO: 189256 - protein, 16 aa, Mycobacterium tuberculosis
SGAGNVGQQLSGVLAA

SEQ ID NO: 189257 - protein, 16 aa, Mycobacterium tuberculosis
GAGNVGQQLSGVLAAG

SEQ ID NO: 189258 - protein, 16 aa, Mycobacterium tuberculosis
AGNVGQQLSGVLAAGT

SEQ ID NO: 189259 - protein, 16 aa, Mycobacterium tuberculosis
GNVGQQLSGVLAAGTA

SEQ ID NO: 189260 - protein, 16 aa, Mycobacterium tuberculosis
NVGQQLSGVLAAGTAL

SEQ ID NO: 189261 - protein, 16 aa, Mycobacterium tuberculosis
VGQQLSGVLAAGTALT

SEQ ID NO: 189262 - protein, 16 aa, Mycobacterium tuberculosis
GQQLSGVLAAGTALTQ

SEQ ID NO: 189263 - protein, 16 aa, Mycobacterium tuberculosis
QQLSGVLAAGTALTQS

SEQ ID NO: 189264 - protein, 16 aa, Mycobacterium tuberculosis
QLSGVLAAGTALTQSP

SEQ ID NO: 189265 - protein, 16 aa, Mycobacterium tuberculosis
LSGVLAAGTALTQSPI

SEQ ID NO: 189266 - protein, 16 aa, Mycobacterium tuberculosis
SGVLAAGTALTQSPII

SEQ ID NO: 189267 - protein, 16 aa, Mycobacterium tuberculosis
GVLAAGTALTQSPIIN

SEQ ID NO: 189268 - protein, 16 aa, Mycobacterium tuberculosis
VLAAGTALTQSPIINL

SEQ ID NO: 189269 - protein, 16 aa, Mycobacterium tuberculosis
LAAGTALTQSPIINLG

SEQ ID NO: 189270 - protein, 16 aa, Mycobacterium tuberculosis
AAGTALTQSPIINLGL

SEQ ID NO: 189271 - protein, 16 aa, Mycobacterium tuberculosis
AGTALTQSPIINLGLA

SEQ ID NO: 189272 - protein, 16 aa, Mycobacterium tuberculosis
GTALTQSPIINLGLAD

SEQ ID NO: 189273 - protein, 16 aa, Mycobacterium tuberculosis
TALTQSPIINLGLADV

SEQ ID NO: 189274 - protein, 16 aa, Mycobacterium tuberculosis
ALTQSPIINLGLADVG

SEQ ID NO: 189275 - protein, 16 aa, Mycobacterium tuberculosis
LTQSPIINLGLADVGN

SEQ ID NO: 189276 - protein, 16 aa, Mycobacterium tuberculosis
TQSPIINLGLADVGNY

SEQ ID NO: 189277 - protein, 16 aa, Mycobacterium tuberculosis
QSPIINLGLADVGNYN

SEQ ID NO: 189278 - protein, 16 aa, Mycobacterium tuberculosis
SPIINLGLADVGNYNL

SEQ ID NO: 189279 - protein, 16 aa, Mycobacterium tuberculosis
PIINLGLADVGNYNLG

SEQ ID NO: 189280 - protein, 16 aa, Mycobacterium tuberculosis
IINLGLADVGNYNLGL

SEQ ID NO: 189281 - protein, 16 aa, Mycobacterium tuberculosis
INLGLADVGNYNLGLG

SEQ ID NO: 189282 - protein, 16 aa, Mycobacterium tuberculosis
NLGLADVGNYNLGLGN

SEQ ID NO: 189283 - protein, 16 aa, Mycobacterium tuberculosis
LGLADVGNYNLGLGNV

SEQ ID NO: 189284 - protein, 16 aa, Mycobacterium tuberculosis
GLADVGNYNLGLGNVG

SEQ ID NO: 189285 - protein, 16 aa, Mycobacterium tuberculosis
LADVGNYNLGLGNVGD

SEQ ID NO: 189286 - protein, 16 aa, Mycobacterium tuberculosis
ADVGNYNLGLGNVGDF

SEQ ID NO: 189287 - protein, 16 aa, Mycobacterium tuberculosis
DVGNYNLGLGNVGDFN

SEQ ID NO: 189288 - protein, 16 aa, Mycobacterium tuberculosis
VGNYNLGLGNVGDFNL

SEQ ID NO: 189289 - protein, 16 aa, Mycobacterium tuberculosis
GNYNLGLGNVGDFNLG

SEQ ID NO: 189290 - protein, 16 aa, Mycobacterium tuberculosis
NYNLGLGNVGDFNLGA

SEQ ID NO: 189291 - protein, 16 aa, Mycobacterium tuberculosis
YNLGLGNVGDFNLGAA

SEQ ID NO: 189292 - protein, 16 aa, Mycobacterium tuberculosis
NLGLGNVGDFNLGAAN

SEQ ID NO: 189293 - protein, 16 aa, Mycobacterium tuberculosis
LGLGNVGDFNLGAANL

SEQ ID NO: 189294 - protein, 16 aa, Mycobacterium tuberculosis
GLGNVGDFNLGAANLG

SEQ ID NO: 189295 - protein, 16 aa, Mycobacterium tuberculosis
LGNVGDFNLGAANLGD

SEQ ID NO: 189296 - protein, 16 aa, Mycobacterium tuberculosis
GNVGDFNLGAANLGDL

SEQ ID NO: 189297 - protein, 16 aa, Mycobacterium tuberculosis
NVGDFNLGAANLGDLN

SEQ ID NO: 189298 - protein, 16 aa, Mycobacterium tuberculosis
VGDFNLGAANLGDLNL

SEQ ID NO: 189299 - protein, 16 aa, Mycobacterium tuberculosis
GDFNLGAANLGDLNLG

SEQ ID NO: 189300 - protein, 16 aa, Mycobacterium tuberculosis
DFNLGAANLGDLNLGL

SEQ ID NO: 189301 - protein, 16 aa, Mycobacterium tuberculosis
FNLGAANLGDLNLGLG

SEQ ID NO: 189302 - protein, 16 aa, Mycobacterium tuberculosis
NLGAANLGDLNLGLGN

SEQ ID NO: 189303 - protein, 16 aa, Mycobacterium tuberculosis
LGAANLGDLNLGLGNI

SEQ ID NO: 189304 - protein, 16 aa, Mycobacterium tuberculosis
GAANLGDLNLGLGNIG

SEQ ID NO: 189305 - protein, 16 aa, Mycobacterium tuberculosis
AANLGDLNLGLGNIGN

SEQ ID NO: 189306 - protein, 16 aa, Mycobacterium tuberculosis
ANLGDLNLGLGNIGNA

SEQ ID NO: 189307 - protein, 16 aa, Mycobacterium tuberculosis
NLGDLNLGLGNIGNAN

SEQ ID NO: 189308 - protein, 16 aa, Mycobacterium tuberculosis
LGDLNLGLGNIGNANV

SEQ ID NO: 189309 - protein, 16 aa, Mycobacterium tuberculosis
GDLNLGLGNIGNANVG

SEQ ID NO: 189310 - protein, 16 aa, Mycobacterium tuberculosis
DLNLGLGNIGNANVGF

SEQ ID NO: 189311 - protein, 16 aa, Mycobacterium tuberculosis
LNLGLGNIGNANVGFG

SEQ ID NO: 189312 - protein, 16 aa, Mycobacterium tuberculosis
NLGLGNIGNANVGFGN

SEQ ID NO: 189313 - protein, 16 aa, Mycobacterium tuberculosis
LGLGNIGNANVGFGNI

SEQ ID NO: 189314 - protein, 16 aa, Mycobacterium tuberculosis
GLGNIGNANVGFGNIG

SEQ ID NO: 189315 - protein, 16 aa, Mycobacterium tuberculosis
LGNIGNANVGFGNIGH

SEQ ID NO: 189316 - protein, 16 aa, Mycobacterium tuberculosis
GNIGNANVGFGNIGHG

SEQ ID NO: 189317 - protein, 16 aa, Mycobacterium tuberculosis
NIGNANVGFGNIGHGN

SEQ ID NO: 189318 - protein, 16 aa, Mycobacterium tuberculosis
IGNANVGFGNIGHGNV

SEQ ID NO: 189319 - protein, 16 aa, Mycobacterium tuberculosis
GNANVGFGNIGHGNVG

SEQ ID NO: 189320 - protein, 16 aa, Mycobacterium tuberculosis
NANVGFGNIGHGNVGF

SEQ ID NO: 189321 - protein, 16 aa, Mycobacterium tuberculosis
ANVGFGNIGHGNVGFG

SEQ ID NO: 189322 - protein, 16 aa, Mycobacterium tuberculosis
NVGFGNIGHGNVGFGN

SEQ ID NO: 189323 - protein, 16 aa, Mycobacterium tuberculosis
VGFGNIGHGNVGFGNS

SEQ ID NO: 189324 - protein, 16 aa, Mycobacterium tuberculosis
GFGNIGHGNVGFGNSG

SEQ ID NO: 189325 - protein, 16 aa, Mycobacterium tuberculosis
FGNIGHGNVGFGNSGL

SEQ ID NO: 189326 - protein, 16 aa, Mycobacterium tuberculosis
GNIGHGNVGFGNSGLG

SEQ ID NO: 189327 - protein, 16 aa, Mycobacterium tuberculosis
NIGHGNVGFGNSGLGA

SEQ ID NO: 189328 - protein, 16 aa, Mycobacterium tuberculosis
IGHGNVGFGNSGLGAA

SEQ ID NO: 189329 - protein, 16 aa, Mycobacterium tuberculosis
GHGNVGFGNSGLGAAL

SEQ ID NO: 189330 - protein, 16 aa, Mycobacterium tuberculosis
HGNVGFGNSGLGAALG

SEQ ID NO: 189331 - protein, 16 aa, Mycobacterium tuberculosis
GNVGFGNSGLGAALGI

SEQ ID NO: 189332 - protein, 16 aa, Mycobacterium tuberculosis
NVGFGNSGLGAALGIG

SEQ ID NO: 189333 - protein, 16 aa, Mycobacterium tuberculosis
VGFGNSGLGAALGIGN

SEQ ID NO: 189334 - protein, 16 aa, Mycobacterium tuberculosis
GFGNSGLGAALGIGNI

SEQ ID NO: 189335 - protein, 16 aa, Mycobacterium tuberculosis
FGNSGLGAALGIGNIG

SEQ ID NO: 189336 - protein, 16 aa, Mycobacterium tuberculosis
GNSGLGAALGIGNIGL

SEQ ID NO: 189337 - protein, 16 aa, Mycobacterium tuberculosis
NSGLGAALGIGNIGLG

SEQ ID NO: 189338 - protein, 16 aa, Mycobacterium tuberculosis
SGLGAALGIGNIGLGN

SEQ ID NO: 189339 - protein, 16 aa, Mycobacterium tuberculosis
GLGAALGIGNIGLGNA

SEQ ID NO: 189340 - protein, 16 aa, Mycobacterium tuberculosis
LGAALGIGNIGLGNAG

SEQ ID NO: 189341 - protein, 16 aa, Mycobacterium tuberculosis
GAALGIGNIGLGNAGS

SEQ ID NO: 189342 - protein, 16 aa, Mycobacterium tuberculosis
AALGIGNIGLGNAGST

SEQ ID NO: 189343 - protein, 16 aa, Mycobacterium tuberculosis
ALGIGNIGLGNAGSTN

SEQ ID NO: 189344 - protein, 16 aa, Mycobacterium tuberculosis
LGIGNIGLGNAGSTNV

SEQ ID NO: 189345 - protein, 16 aa, Mycobacterium tuberculosis
GIGNIGLGNAGSTNVG

SEQ ID NO: 189346 - protein, 16 aa, Mycobacterium tuberculosis
IGNIGLGNAGSTNVGL

SEQ ID NO: 189347 - protein, 16 aa, Mycobacterium tuberculosis
GNIGLGNAGSTNVGLA

SEQ ID NO: 189348 - protein, 16 aa, Mycobacterium tuberculosis
NIGLGNAGSTNVGLAN

SEQ ID NO: 189349 - protein, 16 aa, Mycobacterium tuberculosis
IGLGNAGSTNVGLANM

SEQ ID NO: 189350 - protein, 16 aa, Mycobacterium tuberculosis
GLGNAGSTNVGLANMG

SEQ ID NO: 189351 - protein, 16 aa, Mycobacterium tuberculosis
LGNAGSTNVGLANMGV

SEQ ID NO: 189352 - protein, 16 aa, Mycobacterium tuberculosis
GNAGSTNVGLANMGVG

SEQ ID NO: 189353 - protein, 16 aa, Mycobacterium tuberculosis
NAGSTNVGLANMGVGN

SEQ ID NO: 189354 - protein, 16 aa, Mycobacterium tuberculosis
AGSTNVGLANMGVGNI

SEQ ID NO: 189355 - protein, 16 aa, Mycobacterium tuberculosis
GSTNVGLANMGVGNIG

SEQ ID NO: 189356 - protein, 16 aa, Mycobacterium tuberculosis
STNVGLANMGVGNIGF

SEQ ID NO: 189357 - protein, 16 aa, Mycobacterium tuberculosis
TNVGLANMGVGNIGFA

SEQ ID NO: 189358 - protein, 16 aa, Mycobacterium tuberculosis
NVGLANMGVGNIGFAN

SEQ ID NO: 189359 - protein, 16 aa, Mycobacterium tuberculosis
VGLANMGVGNIGFANT

SEQ ID NO: 189360 - protein, 16 aa, Mycobacterium tuberculosis
GLANMGVGNIGFANTG

SEQ ID NO: 189361 - protein, 16 aa, Mycobacterium tuberculosis
LANMGVGNIGFANTGT

SEQ ID NO: 189362 - protein, 16 aa, Mycobacterium tuberculosis
ANMGVGNIGFANTGTN

SEQ ID NO: 189363 - protein, 16 aa, Mycobacterium tuberculosis
NMGVGNIGFANTGTNN

SEQ ID NO: 189364 - protein, 16 aa, Mycobacterium tuberculosis
MGVGNIGFANTGTNNL

SEQ ID NO: 189365 - protein, 16 aa, Mycobacterium tuberculosis
GVGNIGFANTGTNNLG

SEQ ID NO: 189366 - protein, 16 aa, Mycobacterium tuberculosis
VGNIGFANTGTNNLGI

SEQ ID NO: 189367 - protein, 16 aa, Mycobacterium tuberculosis
GNIGFANTGTNNLGIG

SEQ ID NO: 189368 - protein, 16 aa, Mycobacterium tuberculosis
NIGFANTGTNNLGIGL

SEQ ID NO: 189369 - protein, 16 aa, Mycobacterium tuberculosis
IGFANTGTNNLGIGLT

SEQ ID NO: 189370 - protein, 16 aa, Mycobacterium tuberculosis
GFANTGTNNLGIGLTG

SEQ ID NO: 189371 - protein, 16 aa, Mycobacterium tuberculosis
FANTGTNNLGIGLTGD

SEQ ID NO: 189372 - protein, 16 aa, Mycobacterium tuberculosis
ANTGTNNLGIGLTGDN

SEQ ID NO: 189373 - protein, 16 aa, Mycobacterium tuberculosis
NTGTNNLGIGLTGDNQ

SEQ ID NO: 189374 - protein, 16 aa, Mycobacterium tuberculosis
TGTNNLGIGLTGDNQT

SEQ ID NO: 189375 - protein, 16 aa, Mycobacterium tuberculosis
GTNNLGIGLTGDNQTG

SEQ ID NO: 189376 - protein, 16 aa, Mycobacterium tuberculosis
TNNLGIGLTGDNQTGI

SEQ ID NO: 189377 - protein, 16 aa, Mycobacterium tuberculosis
NNLGIGLTGDNQTGIG

SEQ ID NO: 189378 - protein, 16 aa, Mycobacterium tuberculosis
NLGIGLTGDNQTGIGG

SEQ ID NO: 189379 - protein, 16 aa, Mycobacterium tuberculosis
LGIGLTGDNQTGIGGL

SEQ ID NO: 189380 - protein, 16 aa, Mycobacterium tuberculosis
GIGLTGDNQTGIGGLN

SEQ ID NO: 189381 - protein, 16 aa, Mycobacterium tuberculosis
IGLTGDNQTGIGGLNS

SEQ ID NO: 189382 - protein, 16 aa, Mycobacterium tuberculosis
GLTGDNQTGIGGLNSG

SEQ ID NO: 189383 - protein, 16 aa, Mycobacterium tuberculosis
LTGDNQTGIGGLNSGA

SEQ ID NO: 189384 - protein, 16 aa, Mycobacterium tuberculosis
TGDNQTGIGGLNSGAG

SEQ ID NO: 189385 - protein, 16 aa, Mycobacterium tuberculosis
GDNQTGIGGLNSGAGN

SEQ ID NO: 189386 - protein, 16 aa, Mycobacterium tuberculosis
DNQTGIGGLNSGAGNI

SEQ ID NO: 189387 - protein, 16 aa, Mycobacterium tuberculosis
NQTGIGGLNSGAGNIG

SEQ ID NO: 189388 - protein, 16 aa, Mycobacterium tuberculosis
QTGIGGLNSGAGNIGL

SEQ ID NO: 189389 - protein, 16 aa, Mycobacterium tuberculosis
TGIGGLNSGAGNIGLF

SEQ ID NO: 189390 - protein, 16 aa, Mycobacterium tuberculosis
GIGGLNSGAGNIGLFN

SEQ ID NO: 189391 - protein, 16 aa, Mycobacterium tuberculosis
IGGLNSGAGNIGLFNS

SEQ ID NO: 189392 - protein, 16 aa, Mycobacterium tuberculosis
GGLNSGAGNIGLFNSG

SEQ ID NO: 189393 - protein, 16 aa, Mycobacterium tuberculosis
GLNSGAGNIGLFNSGT

SEQ ID NO: 189394 - protein, 16 aa, Mycobacterium tuberculosis
LNSGAGNIGLFNSGTG

SEQ ID NO: 189395 - protein, 16 aa, Mycobacterium tuberculosis
NSGAGNIGLFNSGTGN

SEQ ID NO: 189396 - protein, 16 aa, Mycobacterium tuberculosis
SGAGNIGLFNSGTGNI

SEQ ID NO: 189397 - protein, 16 aa, Mycobacterium tuberculosis
GAGNIGLFNSGTGNIG

SEQ ID NO: 189398 - protein, 16 aa, Mycobacterium tuberculosis
AGNIGLFNSGTGNIGF

SEQ ID NO: 189399 - protein, 16 aa, Mycobacterium tuberculosis
GNIGLFNSGTGNIGFF

SEQ ID NO: 189400 - protein, 16 aa, Mycobacterium tuberculosis
NIGLFNSGTGNIGFFN

SEQ ID NO: 189401 - protein, 16 aa, Mycobacterium tuberculosis
IGLFNSGTGNIGFFNS

SEQ ID NO: 189402 - protein, 16 aa, Mycobacterium tuberculosis
GLFNSGTGNIGFFNSG

SEQ ID NO: 189403 - protein, 16 aa, Mycobacterium tuberculosis
LFNSGTGNIGFFNSGT

SEQ ID NO: 189404 - protein, 16 aa, Mycobacterium tuberculosis
FNSGTGNIGFFNSGTG

SEQ ID NO: 189405 - protein, 16 aa, Mycobacterium tuberculosis
NSGTGNIGFFNSGTGN

SEQ ID NO: 189406 - protein, 16 aa, Mycobacterium tuberculosis
SGTGNIGFFNSGTGNW

SEQ ID NO: 189407 - protein, 16 aa, Mycobacterium tuberculosis
GTGNIGFFNSGTGNWG

SEQ ID NO: 189408 - protein, 16 aa, Mycobacterium tuberculosis
TGNIGFFNSGTGNWGL

SEQ ID NO: 189409 - protein, 16 aa, Mycobacterium tuberculosis
GNIGFFNSGTGNWGLF

SEQ ID NO: 189410 - protein, 16 aa, Mycobacterium tuberculosis
NIGFFNSGTGNWGLFN

SEQ ID NO: 189411 - protein, 16 aa, Mycobacterium tuberculosis
IGFFNSGTGNWGLFNS

SEQ ID NO: 189412 - protein, 16 aa, Mycobacterium tuberculosis
GFFNSGTGNWGLFNSG

SEQ ID NO: 189413 - protein, 16 aa, Mycobacterium tuberculosis
FFNSGTGNWGLFNSGS

SEQ ID NO: 189414 - protein, 16 aa, Mycobacterium tuberculosis
FNSGTGNWGLFNSGSF

SEQ ID NO: 189415 - protein, 16 aa, Mycobacterium tuberculosis
NSGTGNWGLFNSGSFN

SEQ ID NO: 189416 - protein, 16 aa, Mycobacterium tuberculosis
SGTGNWGLFNSGSFNT

SEQ ID NO: 189417 - protein, 16 aa, Mycobacterium tuberculosis
GTGNWGLFNSGSFNTG

SEQ ID NO: 189418 - protein, 16 aa, Mycobacterium tuberculosis
TGNWGLFNSGSFNTGI

SEQ ID NO: 189419 - protein, 16 aa, Mycobacterium tuberculosis
GNWGLFNSGSFNTGIG

SEQ ID NO: 189420 - protein, 16 aa, Mycobacterium tuberculosis
NWGLFNSGSFNTGIGN

SEQ ID NO: 189421 - protein, 16 aa, Mycobacterium tuberculosis
WGLFNSGSFNTGIGNS

SEQ ID NO: 189422 - protein, 16 aa, Mycobacterium tuberculosis
GLFNSGSFNTGIGNSG

SEQ ID NO: 189423 - protein, 16 aa, Mycobacterium tuberculosis
LFNSGSFNTGIGNSGT

SEQ ID NO: 189424 - protein, 16 aa, Mycobacterium tuberculosis
FNSGSFNTGIGNSGTG

SEQ ID NO: 189425 - protein, 16 aa, Mycobacterium tuberculosis
NSGSFNTGIGNSGTGS

SEQ ID NO: 189426 - protein, 16 aa, Mycobacterium tuberculosis
SGSFNTGIGNSGTGST

SEQ ID NO: 189427 - protein, 16 aa, Mycobacterium tuberculosis
GSFNTGIGNSGTGSTG

SEQ ID NO: 189428 - protein, 16 aa, Mycobacterium tuberculosis
SFNTGIGNSGTGSTGL

SEQ ID NO: 189429 - protein, 16 aa, Mycobacterium tuberculosis
FNTGIGNSGTGSTGLF

SEQ ID NO: 189430 - protein, 16 aa, Mycobacterium tuberculosis
NTGIGNSGTGSTGLFN

SEQ ID NO: 189431 - protein, 16 aa, Mycobacterium tuberculosis
TGIGNSGTGSTGLFNA

SEQ ID NO: 189432 - protein, 16 aa, Mycobacterium tuberculosis
GIGNSGTGSTGLFNAG

SEQ ID NO: 189433 - protein, 16 aa, Mycobacterium tuberculosis
IGNSGTGSTGLFNAGG

SEQ ID NO: 189434 - protein, 16 aa, Mycobacterium tuberculosis
GNSGTGSTGLFNAGGF

SEQ ID NO: 189435 - protein, 16 aa, Mycobacterium tuberculosis
NSGTGSTGLFNAGGFT

SEQ ID NO: 189436 - protein, 16 aa, Mycobacterium tuberculosis
SGTGSTGLFNAGGFTT

SEQ ID NO: 189437 - protein, 16 aa, Mycobacterium tuberculosis
GTGSTGLFNAGGFTTG

SEQ ID NO: 189438 - protein, 16 aa, Mycobacterium tuberculosis
TGSTGLFNAGGFTTGL

SEQ ID NO: 189439 - protein, 16 aa, Mycobacterium tuberculosis
GSTGLFNAGGFTTGLA

SEQ ID NO: 189440 - protein, 16 aa, Mycobacterium tuberculosis
STGLFNAGGFTTGLAN

SEQ ID NO: 189441 - protein, 16 aa, Mycobacterium tuberculosis
TGLFNAGGFTTGLANA

SEQ ID NO: 189442 - protein, 16 aa, Mycobacterium tuberculosis
GLFNAGGFTTGLANAG

SEQ ID NO: 189443 - protein, 16 aa, Mycobacterium tuberculosis
LFNAGGFTTGLANAGS

SEQ ID NO: 189444 - protein, 16 aa, Mycobacterium tuberculosis
FNAGGFTTGLANAGSY

SEQ ID NO: 189445 - protein, 16 aa, Mycobacterium tuberculosis
NAGGFTTGLANAGSYN

SEQ ID NO: 189446 - protein, 16 aa, Mycobacterium tuberculosis
AGGFTTGLANAGSYNT

SEQ ID NO: 189447 - protein, 16 aa, Mycobacterium tuberculosis
GGFTTGLANAGSYNTG

SEQ ID NO: 189448 - protein, 16 aa, Mycobacterium tuberculosis
GFTTGLANAGSYNTGS

SEQ ID NO: 189449 - protein, 16 aa, Mycobacterium tuberculosis
FTTGLANAGSYNTGSF

SEQ ID NO: 189450 - protein, 16 aa, Mycobacterium tuberculosis
TTGLANAGSYNTGSFN

SEQ ID NO: 189451 - protein, 16 aa, Mycobacterium tuberculosis
TGLANAGSYNTGSFNV

SEQ ID NO: 189452 - protein, 16 aa, Mycobacterium tuberculosis
GLANAGSYNTGSFNVG

SEQ ID NO: 189453 - protein, 16 aa, Mycobacterium tuberculosis
LANAGSYNTGSFNVGD

SEQ ID NO: 189454 - protein, 16 aa, Mycobacterium tuberculosis
ANAGSYNTGSFNVGDT

SEQ ID NO: 189455 - protein, 16 aa, Mycobacterium tuberculosis
NAGSYNTGSFNVGDTN

SEQ ID NO: 189456 - protein, 16 aa, Mycobacterium tuberculosis
AGSYNTGSFNVGDTNT

SEQ ID NO: 189457 - protein, 16 aa, Mycobacterium tuberculosis
GSYNTGSFNVGDTNTG

SEQ ID NO: 189458 - protein, 16 aa, Mycobacterium tuberculosis
SYNTGSFNVGDTNTGG

SEQ ID NO: 189459 - protein, 16 aa, Mycobacterium tuberculosis
YNTGSFNVGDTNTGGF

SEQ ID NO: 189460 - protein, 16 aa, Mycobacterium tuberculosis
NTGSFNVGDTNTGGFN

SEQ ID NO: 189461 - protein, 16 aa, Mycobacterium tuberculosis
TGSFNVGDTNTGGFNP

SEQ ID NO: 189462 - protein, 16 aa, Mycobacterium tuberculosis
GSFNVGDTNTGGFNPG

SEQ ID NO: 189463 - protein, 16 aa, Mycobacterium tuberculosis
SFNVGDTNTGGFNPGS

SEQ ID NO: 189464 - protein, 16 aa, Mycobacterium tuberculosis
FNVGDTNTGGFNPGSI

SEQ ID NO: 189465 - protein, 16 aa, Mycobacterium tuberculosis
NVGDTNTGGFNPGSIN

SEQ ID NO: 189466 - protein, 16 aa, Mycobacterium tuberculosis
VGDTNTGGFNPGSINT

SEQ ID NO: 189467 - protein, 16 aa, Mycobacterium tuberculosis
GDTNTGGFNPGSINTG

SEQ ID NO: 189468 - protein, 16 aa, Mycobacterium tuberculosis
DTNTGGFNPGSINTGW

SEQ ID NO: 189469 - protein, 16 aa, Mycobacterium tuberculosis
TNTGGFNPGSINTGWF

SEQ ID NO: 189470 - protein, 16 aa, Mycobacterium tuberculosis
NTGGFNPGSINTGWFN

SEQ ID NO: 189471 - protein, 16 aa, Mycobacterium tuberculosis
TGGFNPGSINTGWFNT

SEQ ID NO: 189472 - protein, 16 aa, Mycobacterium tuberculosis
GGFNPGSINTGWFNTG

SEQ ID NO: 189473 - protein, 16 aa, Mycobacterium tuberculosis
GFNPGSINTGWFNTGN

SEQ ID NO: 189474 - protein, 16 aa, Mycobacterium tuberculosis
FNPGSINTGWFNTGNA

SEQ ID NO: 189475 - protein, 16 aa, Mycobacterium tuberculosis
NPGSINTGWFNTGNAN

SEQ ID NO: 189476 - protein, 16 aa, Mycobacterium tuberculosis
PGSINTGWFNTGNANT

SEQ ID NO: 189477 - protein, 16 aa, Mycobacterium tuberculosis
GSINTGWFNTGNANTG

SEQ ID NO: 189478 - protein, 16 aa, Mycobacterium tuberculosis
SINTGWFNTGNANTGI

SEQ ID NO: 189479 - protein, 16 aa, Mycobacterium tuberculosis
INTGWFNTGNANTGIA

SEQ ID NO: 189480 - protein, 16 aa, Mycobacterium tuberculosis
NTGWFNTGNANTGIAN

SEQ ID NO: 189481 - protein, 16 aa, Mycobacterium tuberculosis
TGWFNTGNANTGIANS

SEQ ID NO: 189482 - protein, 16 aa, Mycobacterium tuberculosis
GWFNTGNANTGIANSG

SEQ ID NO: 189483 - protein, 16 aa, Mycobacterium tuberculosis
WFNTGNANTGIANSGN

SEQ ID NO: 189484 - protein, 16 aa, Mycobacterium tuberculosis
FNTGNANTGIANSGNV

SEQ ID NO: 189485 - protein, 16 aa, Mycobacterium tuberculosis
NTGNANTGIANSGNVD

SEQ ID NO: 189486 - protein, 16 aa, Mycobacterium tuberculosis
TGNANTGIANSGNVDT

SEQ ID NO: 189487 - protein, 16 aa, Mycobacterium tuberculosis
GNANTGIANSGNVDTG

SEQ ID NO: 189488 - protein, 16 aa, Mycobacterium tuberculosis
NANTGIANSGNVDTGA

SEQ ID NO: 189489 - protein, 16 aa, Mycobacterium tuberculosis
ANTGIANSGNVDTGAL

SEQ ID NO: 189490 - protein, 16 aa, Mycobacterium tuberculosis
NTGIANSGNVDTGALM

SEQ ID NO: 189491 - protein, 16 aa, Mycobacterium tuberculosis
TGIANSGNVDTGALMS

SEQ ID NO: 189492 - protein, 16 aa, Mycobacterium tuberculosis
GIANSGNVDTGALMSG

SEQ ID NO: 189493 - protein, 16 aa, Mycobacterium tuberculosis
IANSGNVDTGALMSGN

SEQ ID NO: 189494 - protein, 16 aa, Mycobacterium tuberculosis
ANSGNVDTGALMSGNF

SEQ ID NO: 189495 - protein, 16 aa, Mycobacterium tuberculosis
NSGNVDTGALMSGNFS

SEQ ID NO: 189496 - protein, 16 aa, Mycobacterium tuberculosis
SGNVDTGALMSGNFSN

SEQ ID NO: 189497 - protein, 16 aa, Mycobacterium tuberculosis
GNVDTGALMSGNFSNG

SEQ ID NO: 189498 - protein, 16 aa, Mycobacterium tuberculosis
NVDTGALMSGNFSNGI

SEQ ID NO: 189499 - protein, 16 aa, Mycobacterium tuberculosis
VDTGALMSGNFSNGIL

SEQ ID NO: 189500 - protein, 16 aa, Mycobacterium tuberculosis
DTGALMSGNFSNGILW

SEQ ID NO: 189501 - protein, 16 aa, Mycobacterium tuberculosis
TGALMSGNFSNGILWR

SEQ ID NO: 189502 - protein, 16 aa, Mycobacterium tuberculosis
GALMSGNFSNGILWRG

SEQ ID NO: 189503 - protein, 16 aa, Mycobacterium tuberculosis
ALMSGNFSNGILWRGN

SEQ ID NO: 189504 - protein, 16 aa, Mycobacterium tuberculosis
LMSGNFSNGILWRGNY

SEQ ID NO: 189505 - protein, 16 aa, Mycobacterium tuberculosis
MSGNFSNGILWRGNYE

SEQ ID NO: 189506 - protein, 16 aa, Mycobacterium tuberculosis
SGNFSNGILWRGNYEG

SEQ ID NO: 189507 - protein, 16 aa, Mycobacterium tuberculosis
GNFSNGILWRGNYEGL

SEQ ID NO: 189508 - protein, 16 aa, Mycobacterium tuberculosis
NFSNGILWRGNYEGLF

SEQ ID NO: 189509 - protein, 16 aa, Mycobacterium tuberculosis
FSNGILWRGNYEGLFS

SEQ ID NO: 189510 - protein, 16 aa, Mycobacterium tuberculosis
SNGILWRGNYEGLFSY

SEQ ID NO: 189511 - protein, 16 aa, Mycobacterium tuberculosis
NGILWRGNYEGLFSYS

SEQ ID NO: 189512 - protein, 16 aa, Mycobacterium tuberculosis
GILWRGNYEGLFSYSY

SEQ ID NO: 189513 - protein, 16 aa, Mycobacterium tuberculosis
ILWRGNYEGLFSYSYS

SEQ ID NO: 189514 - protein, 16 aa, Mycobacterium tuberculosis
LWRGNYEGLFSYSYSL

SEQ ID NO: 189515 - protein, 16 aa, Mycobacterium tuberculosis
WRGNYEGLFSYSYSLD

SEQ ID NO: 189516 - protein, 16 aa, Mycobacterium tuberculosis
RGNYEGLFSYSYSLDV

SEQ ID NO: 189517 - protein, 16 aa, Mycobacterium tuberculosis
GNYEGLFSYSYSLDVP

SEQ ID NO: 189518 - protein, 16 aa, Mycobacterium tuberculosis
NYEGLFSYSYSLDVPR

SEQ ID NO: 189519 - protein, 16 aa, Mycobacterium tuberculosis
YEGLFSYSYSLDVPRI

SEQ ID NO: 189520 - protein, 16 aa, Mycobacterium tuberculosis
EGLFSYSYSLDVPRIT

SEQ ID NO: 189521 - protein, 16 aa, Mycobacterium tuberculosis
GLFSYSYSLDVPRITI

SEQ ID NO: 189522 - protein, 16 aa, Mycobacterium tuberculosis
LFSYSYSLDVPRITIL

SEQ ID NO: 189523 - protein, 16 aa, Mycobacterium tuberculosis
FSYSYSLDVPRITILD

SEQ ID NO: 189524 - protein, 16 aa, Mycobacterium tuberculosis
SYSYSLDVPRITILDA

SEQ ID NO: 189525 - protein, 16 aa, Mycobacterium tuberculosis
YSYSLDVPRITILDAH

SEQ ID NO: 189526 - protein, 16 aa, Mycobacterium tuberculosis
SYSLDVPRITILDAHF

SEQ ID NO: 189527 - protein, 16 aa, Mycobacterium tuberculosis
YSLDVPRITILDAHFT

SEQ ID NO: 189528 - protein, 16 aa, Mycobacterium tuberculosis
SLDVPRITILDAHFTG

SEQ ID NO: 189529 - protein, 16 aa, Mycobacterium tuberculosis
LDVPRITILDAHFTGA

SEQ ID NO: 189530 - protein, 16 aa, Mycobacterium tuberculosis
DVPRITILDAHFTGAF

SEQ ID NO: 189531 - protein, 16 aa, Mycobacterium tuberculosis
VPRITILDAHFTGAFG

SEQ ID NO: 189532 - protein, 16 aa, Mycobacterium tuberculosis
PRITILDAHFTGAFGP

SEQ ID NO: 189533 - protein, 16 aa, Mycobacterium tuberculosis
RITILDAHFTGAFGPV

SEQ ID NO: 189534 - protein, 16 aa, Mycobacterium tuberculosis
ITILDAHFTGAFGPVV

SEQ ID NO: 189535 - protein, 16 aa, Mycobacterium tuberculosis
TILDAHFTGAFGPVVV

SEQ ID NO: 189536 - protein, 16 aa, Mycobacterium tuberculosis
ILDAHFTGAFGPVVVP

SEQ ID NO: 189537 - protein, 16 aa, Mycobacterium tuberculosis
LDAHFTGAFGPVVVPP

SEQ ID NO: 189538 - protein, 16 aa, Mycobacterium tuberculosis
DAHFTGAFGPVVVPPI

SEQ ID NO: 189539 - protein, 16 aa, Mycobacterium tuberculosis
AHFTGAFGPVVVPPIP

SEQ ID NO: 189540 - protein, 16 aa, Mycobacterium tuberculosis
HFTGAFGPVVVPPIPV

SEQ ID NO: 189541 - protein, 16 aa, Mycobacterium tuberculosis
FTGAFGPVVVPPIPVL

SEQ ID NO: 189542 - protein, 16 aa, Mycobacterium tuberculosis
TGAFGPVVVPPIPVLA

SEQ ID NO: 189543 - protein, 16 aa, Mycobacterium tuberculosis
GAFGPVVVPPIPVLAI

SEQ ID NO: 189544 - protein, 16 aa, Mycobacterium tuberculosis
AFGPVVVPPIPVLAIN

SEQ ID NO: 189545 - protein, 16 aa, Mycobacterium tuberculosis
FGPVVVPPIPVLAINA

SEQ ID NO: 189546 - protein, 16 aa, Mycobacterium tuberculosis
GPVVVPPIPVLAINAH

SEQ ID NO: 189547 - protein, 16 aa, Mycobacterium tuberculosis
PVVVPPIPVLAINAHL

SEQ ID NO: 189548 - protein, 16 aa, Mycobacterium tuberculosis
VVVPPIPVLAINAHLT

SEQ ID NO: 189549 - protein, 16 aa, Mycobacterium tuberculosis
VVPPIPVLAINAHLTG

SEQ ID NO: 189550 - protein, 16 aa, Mycobacterium tuberculosis
VPPIPVLAINAHLTGN

SEQ ID NO: 189551 - protein, 16 aa, Mycobacterium tuberculosis
PPIPVLAINAHLTGNA

SEQ ID NO: 189552 - protein, 16 aa, Mycobacterium tuberculosis
PIPVLAINAHLTGNAA

SEQ ID NO: 189553 - protein, 16 aa, Mycobacterium tuberculosis
IPVLAINAHLTGNAAM

SEQ ID NO: 189554 - protein, 16 aa, Mycobacterium tuberculosis
PVLAINAHLTGNAAMG

SEQ ID NO: 189555 - protein, 16 aa, Mycobacterium tuberculosis
VLAINAHLTGNAAMGA

SEQ ID NO: 189556 - protein, 16 aa, Mycobacterium tuberculosis
LAINAHLTGNAAMGAF

SEQ ID NO: 189557 - protein, 16 aa, Mycobacterium tuberculosis
AINAHLTGNAAMGAFT

SEQ ID NO: 189558 - protein, 16 aa, Mycobacterium tuberculosis
INAHLTGNAAMGAFTI

SEQ ID NO: 189559 - protein, 16 aa, Mycobacterium tuberculosis
NAHLTGNAAMGAFTIP

SEQ ID NO: 189560 - protein, 16 aa, Mycobacterium tuberculosis
AHLTGNAAMGAFTIPQ

SEQ ID NO: 189561 - protein, 16 aa, Mycobacterium tuberculosis
HLTGNAAMGAFTIPQI

SEQ ID NO: 189562 - protein, 16 aa, Mycobacterium tuberculosis
LTGNAAMGAFTIPQID

SEQ ID NO: 189563 - protein, 16 aa, Mycobacterium tuberculosis
TGNAAMGAFTIPQIDI

SEQ ID NO: 189564 - protein, 16 aa, Mycobacterium tuberculosis
GNAAMGAFTIPQIDIP

SEQ ID NO: 189565 - protein, 16 aa, Mycobacterium tuberculosis
NAAMGAFTIPQIDIPA

SEQ ID NO: 189566 - protein, 16 aa, Mycobacterium tuberculosis
AAMGAFTIPQIDIPAL

SEQ ID NO: 189567 - protein, 16 aa, Mycobacterium tuberculosis
AMGAFTIPQIDIPALN

SEQ ID NO: 189568 - protein, 16 aa, Mycobacterium tuberculosis
MGAFTIPQIDIPALNP

SEQ ID NO: 189569 - protein, 16 aa, Mycobacterium tuberculosis
GAFTIPQIDIPALNPN

SEQ ID NO: 189570 - protein, 16 aa, Mycobacterium tuberculosis
AFTIPQIDIPALNPNV

SEQ ID NO: 189571 - protein, 16 aa, Mycobacterium tuberculosis
FTIPQIDIPALNPNVT

SEQ ID NO: 189572 - protein, 16 aa, Mycobacterium tuberculosis
TIPQIDIPALNPNVTG

SEQ ID NO: 189573 - protein, 16 aa, Mycobacterium tuberculosis
IPQIDIPALNPNVTGS

SEQ ID NO: 189574 - protein, 16 aa, Mycobacterium tuberculosis
PQIDIPALNPNVTGSV

SEQ ID NO: 189575 - protein, 16 aa, Mycobacterium tuberculosis
QIDIPALNPNVTGSVG

SEQ ID NO: 189576 - protein, 16 aa, Mycobacterium tuberculosis
IDIPALNPNVTGSVGF

SEQ ID NO: 189577 - protein, 16 aa, Mycobacterium tuberculosis
DIPALNPNVTGSVGFG

SEQ ID NO: 189578 - protein, 16 aa, Mycobacterium tuberculosis
IPALNPNVTGSVGFGP

SEQ ID NO: 189579 - protein, 16 aa, Mycobacterium tuberculosis
PALNPNVTGSVGFGPI

SEQ ID NO: 189580 - protein, 16 aa, Mycobacterium tuberculosis
ALNPNVTGSVGFGPIA

SEQ ID NO: 189581 - protein, 16 aa, Mycobacterium tuberculosis
LNPNVTGSVGFGPIAV

SEQ ID NO: 189582 - protein, 16 aa, Mycobacterium tuberculosis
NPNVTGSVGFGPIAVP

SEQ ID NO: 189583 - protein, 16 aa, Mycobacterium tuberculosis
PNVTGSVGFGPIAVPS

SEQ ID NO: 189584 - protein, 16 aa, Mycobacterium tuberculosis
NVTGSVGFGPIAVPSV

SEQ ID NO: 189585 - protein, 16 aa, Mycobacterium tuberculosis
VTGSVGFGPIAVPSVT

SEQ ID NO: 189586 - protein, 16 aa, Mycobacterium tuberculosis
TGSVGFGPIAVPSVTI

SEQ ID NO: 189587 - protein, 16 aa, Mycobacterium tuberculosis
GSVGFGPIAVPSVTIP

SEQ ID NO: 189588 - protein, 16 aa, Mycobacterium tuberculosis
SVGFGPIAVPSVTIPA

SEQ ID NO: 189589 - protein, 16 aa, Mycobacterium tuberculosis
VGFGPIAVPSVTIPAL

SEQ ID NO: 189590 - protein, 16 aa, Mycobacterium tuberculosis
GFGPIAVPSVTIPALT

SEQ ID NO: 189591 - protein, 16 aa, Mycobacterium tuberculosis
FGPIAVPSVTIPALTA

SEQ ID NO: 189592 - protein, 16 aa, Mycobacterium tuberculosis
GPIAVPSVTIPALTAA

SEQ ID NO: 189593 - protein, 16 aa, Mycobacterium tuberculosis
PIAVPSVTIPALTAAR

SEQ ID NO: 189594 - protein, 16 aa, Mycobacterium tuberculosis
IAVPSVTIPALTAARA

SEQ ID NO: 189595 - protein, 16 aa, Mycobacterium tuberculosis
AVPSVTIPALTAARAV

SEQ ID NO: 189596 - protein, 16 aa, Mycobacterium tuberculosis
VPSVTIPALTAARAVL

SEQ ID NO: 189597 - protein, 16 aa, Mycobacterium tuberculosis
PSVTIPALTAARAVLD

SEQ ID NO: 189598 - protein, 16 aa, Mycobacterium tuberculosis
SVTIPALTAARAVLDM

SEQ ID NO: 189599 - protein, 16 aa, Mycobacterium tuberculosis
VTIPALTAARAVLDMA

SEQ ID NO: 189600 - protein, 16 aa, Mycobacterium tuberculosis
TIPALTAARAVLDMAA

SEQ ID NO: 189601 - protein, 16 aa, Mycobacterium tuberculosis
IPALTAARAVLDMAAS

SEQ ID NO: 189602 - protein, 16 aa, Mycobacterium tuberculosis
PALTAARAVLDMAASV

SEQ ID NO: 189603 - protein, 16 aa, Mycobacterium tuberculosis
ALTAARAVLDMAASVG

SEQ ID NO: 189604 - protein, 16 aa, Mycobacterium tuberculosis
LTAARAVLDMAASVGA

SEQ ID NO: 189605 - protein, 16 aa, Mycobacterium tuberculosis
TAARAVLDMAASVGAT

SEQ ID NO: 189606 - protein, 16 aa, Mycobacterium tuberculosis
AARAVLDMAASVGATS

SEQ ID NO: 189607 - protein, 16 aa, Mycobacterium tuberculosis
ARAVLDMAASVGATSE

SEQ ID NO: 189608 - protein, 16 aa, Mycobacterium tuberculosis
RAVLDMAASVGATSEI

SEQ ID NO: 189609 - protein, 16 aa, Mycobacterium tuberculosis
AVLDMAASVGATSEIE

SEQ ID NO: 189610 - protein, 16 aa, Mycobacterium tuberculosis
VLDMAASVGATSEIEP

SEQ ID NO: 189611 - protein, 16 aa, Mycobacterium tuberculosis
LDMAASVGATSEIEPF

SEQ ID NO: 189612 - protein, 16 aa, Mycobacterium tuberculosis
DMAASVGATSEIEPFI

SEQ ID NO: 189613 - protein, 16 aa, Mycobacterium tuberculosis
MAASVGATSEIEPFIV

SEQ ID NO: 189614 - protein, 16 aa, Mycobacterium tuberculosis
AASVGATSEIEPFIVW

SEQ ID NO: 189615 - protein, 16 aa, Mycobacterium tuberculosis
ASVGATSEIEPFIVWT

SEQ ID NO: 189616 - protein, 16 aa, Mycobacterium tuberculosis
SVGATSEIEPFIVWTS

SEQ ID NO: 189617 - protein, 16 aa, Mycobacterium tuberculosis
VGATSEIEPFIVWTSS

SEQ ID NO: 189618 - protein, 16 aa, Mycobacterium tuberculosis
GATSEIEPFIVWTSSG

SEQ ID NO: 189619 - protein, 16 aa, Mycobacterium tuberculosis
ATSEIEPFIVWTSSGA

SEQ ID NO: 189620 - protein, 16 aa, Mycobacterium tuberculosis
TSEIEPFIVWTSSGAI

SEQ ID NO: 189621 - protein, 16 aa, Mycobacterium tuberculosis
SEIEPFIVWTSSGAIG

SEQ ID NO: 189622 - protein, 16 aa, Mycobacterium tuberculosis
EIEPFIVWTSSGAIGP

SEQ ID NO: 189623 - protein, 16 aa, Mycobacterium tuberculosis
IEPFIVWTSSGAIGPT

SEQ ID NO: 189624 - protein, 16 aa, Mycobacterium tuberculosis
EPFIVWTSSGAIGPTW

SEQ ID NO: 189625 - protein, 16 aa, Mycobacterium tuberculosis
PFIVWTSSGAIGPTWY

SEQ ID NO: 189626 - protein, 16 aa, Mycobacterium tuberculosis
FIVWTSSGAIGPTWYS

SEQ ID NO: 189627 - protein, 16 aa, Mycobacterium tuberculosis
IVWTSSGAIGPTWYSV

SEQ ID NO: 189628 - protein, 16 aa, Mycobacterium tuberculosis
VWTSSGAIGPTWYSVG

SEQ ID NO: 189629 - protein, 16 aa, Mycobacterium tuberculosis
WTSSGAIGPTWYSVGR

SEQ ID NO: 189630 - protein, 16 aa, Mycobacterium tuberculosis
TSSGAIGPTWYSVGRI

SEQ ID NO: 189631 - protein, 16 aa, Mycobacterium tuberculosis
SSGAIGPTWYSVGRIY

SEQ ID NO: 189632 - protein, 16 aa, Mycobacterium tuberculosis
SGAIGPTWYSVGRIYN

SEQ ID NO: 189633 - protein, 16 aa, Mycobacterium tuberculosis
GAIGPTWYSVGRIYNA

SEQ ID NO: 189634 - protein, 16 aa, Mycobacterium tuberculosis
AIGPTWYSVGRIYNAG

SEQ ID NO: 189635 - protein, 16 aa, Mycobacterium tuberculosis
IGPTWYSVGRIYNAGD

SEQ ID NO: 189636 - protein, 16 aa, Mycobacterium tuberculosis
GPTWYSVGRIYNAGDL

SEQ ID NO: 189637 - protein, 16 aa, Mycobacterium tuberculosis
PTWYSVGRIYNAGDLF

SEQ ID NO: 189638 - protein, 16 aa, Mycobacterium tuberculosis
TWYSVGRIYNAGDLFV

SEQ ID NO: 189639 - protein, 16 aa, Mycobacterium tuberculosis
WYSVGRIYNAGDLFVG

SEQ ID NO: 189640 - protein, 16 aa, Mycobacterium tuberculosis
YSVGRIYNAGDLFVGG

SEQ ID NO: 189641 - protein, 16 aa, Mycobacterium tuberculosis
SVGRIYNAGDLFVGGN

SEQ ID NO: 189642 - protein, 16 aa, Mycobacterium tuberculosis
VGRIYNAGDLFVGGNI

SEQ ID NO: 189643 - protein, 16 aa, Mycobacterium tuberculosis
GRIYNAGDLFVGGNII

SEQ ID NO: 189644 - protein, 16 aa, Mycobacterium tuberculosis
RIYNAGDLFVGGNIIS

SEQ ID NO: 189645 - protein, 16 aa, Mycobacterium tuberculosis
IYNAGDLFVGGNIISG

SEQ ID NO: 189646 - protein, 16 aa, Mycobacterium tuberculosis
YNAGDLFVGGNIISGI

SEQ ID NO: 189647 - protein, 16 aa, Mycobacterium tuberculosis
NAGDLFVGGNIISGIP

SEQ ID NO: 189648 - protein, 16 aa, Mycobacterium tuberculosis
AGDLFVGGNIISGIPT

SEQ ID NO: 189649 - protein, 16 aa, Mycobacterium tuberculosis
GDLFVGGNIISGIPTL

SEQ ID NO: 189650 - protein, 16 aa, Mycobacterium tuberculosis
DLFVGGNIISGIPTLS

SEQ ID NO: 189651 - protein, 16 aa, Mycobacterium tuberculosis
LFVGGNIISGIPTLST

SEQ ID NO: 189652 - protein, 16 aa, Mycobacterium tuberculosis
FVGGNIISGIPTLSTT

SEQ ID NO: 189653 - protein, 16 aa, Mycobacterium tuberculosis
VGGNIISGIPTLSTTG

SEQ ID NO: 189654 - protein, 16 aa, Mycobacterium tuberculosis
GGNIISGIPTLSTTGP

SEQ ID NO: 189655 - protein, 16 aa, Mycobacterium tuberculosis
GNIISGIPTLSTTGPV

SEQ ID NO: 189656 - protein, 16 aa, Mycobacterium tuberculosis
NIISGIPTLSTTGPVH

SEQ ID NO: 189657 - protein, 16 aa, Mycobacterium tuberculosis
IISGIPTLSTTGPVHA

SEQ ID NO: 189658 - protein, 16 aa, Mycobacterium tuberculosis
ISGIPTLSTTGPVHAV

SEQ ID NO: 189659 - protein, 16 aa, Mycobacterium tuberculosis
SGIPTLSTTGPVHAVF

SEQ ID NO: 189660 - protein, 16 aa, Mycobacterium tuberculosis
GIPTLSTTGPVHAVFN

SEQ ID NO: 189661 - protein, 16 aa, Mycobacterium tuberculosis
IPTLSTTGPVHAVFNA

SEQ ID NO: 189662 - protein, 16 aa, Mycobacterium tuberculosis
PTLSTTGPVHAVFNAA

SEQ ID NO: 189663 - protein, 16 aa, Mycobacterium tuberculosis
TLSTTGPVHAVFNAAS

SEQ ID NO: 189664 - protein, 16 aa, Mycobacterium tuberculosis
LSTTGPVHAVFNAASQ

SEQ ID NO: 189665 - protein, 16 aa, Mycobacterium tuberculosis
STTGPVHAVFNAASQA

SEQ ID NO: 189666 - protein, 16 aa, Mycobacterium tuberculosis
TTGPVHAVFNAASQAF

SEQ ID NO: 189667 - protein, 16 aa, Mycobacterium tuberculosis
TGPVHAVFNAASQAFN

SEQ ID NO: 189668 - protein, 16 aa, Mycobacterium tuberculosis
GPVHAVFNAASQAFNT

SEQ ID NO: 189669 - protein, 16 aa, Mycobacterium tuberculosis
PVHAVFNAASQAFNTP

SEQ ID NO: 189670 - protein, 16 aa, Mycobacterium tuberculosis
VHAVFNAASQAFNTPA

SEQ ID NO: 189671 - protein, 16 aa, Mycobacterium tuberculosis
HAVFNAASQAFNTPAL

SEQ ID NO: 189672 - protein, 16 aa, Mycobacterium tuberculosis
AVFNAASQAFNTPALN

SEQ ID NO: 189673 - protein, 16 aa, Mycobacterium tuberculosis
VFNAASQAFNTPALNI

SEQ ID NO: 189674 - protein, 16 aa, Mycobacterium tuberculosis
FNAASQAFNTPALNIH

SEQ ID NO: 189675 - protein, 16 aa, Mycobacterium tuberculosis
NAASQAFNTPALNIHQ

SEQ ID NO: 189676 - protein, 16 aa, Mycobacterium tuberculosis
AASQAFNTPALNIHQI

SEQ ID NO: 189677 - protein, 16 aa, Mycobacterium tuberculosis
ASQAFNTPALNIHQIP

SEQ ID NO: 189678 - protein, 16 aa, Mycobacterium tuberculosis
SQAFNTPALNIHQIPL

SEQ ID NO: 189679 - protein, 16 aa, Mycobacterium tuberculosis
QAFNTPALNIHQIPLG

SEQ ID NO: 189680 - protein, 16 aa, Mycobacterium tuberculosis
AFNTPALNIHQIPLGF

SEQ ID NO: 189681 - protein, 16 aa, Mycobacterium tuberculosis
FNTPALNIHQIPLGFQ

SEQ ID NO: 189682 - protein, 16 aa, Mycobacterium tuberculosis
NTPALNIHQIPLGFQV

SEQ ID NO: 189683 - protein, 16 aa, Mycobacterium tuberculosis
TPALNIHQIPLGFQVP

SEQ ID NO: 189684 - protein, 16 aa, Mycobacterium tuberculosis
PALNIHQIPLGFQVPG

SEQ ID NO: 189685 - protein, 16 aa, Mycobacterium tuberculosis
ALNIHQIPLGFQVPGS

SEQ ID NO: 189686 - protein, 16 aa, Mycobacterium tuberculosis
LNIHQIPLGFQVPGSI

SEQ ID NO: 189687 - protein, 16 aa, Mycobacterium tuberculosis
NIHQIPLGFQVPGSID

SEQ ID NO: 189688 - protein, 16 aa, Mycobacterium tuberculosis
IHQIPLGFQVPGSIDA

SEQ ID NO: 189689 - protein, 16 aa, Mycobacterium tuberculosis
HQIPLGFQVPGSIDAI

SEQ ID NO: 189690 - protein, 16 aa, Mycobacterium tuberculosis
QIPLGFQVPGSIDAIT

SEQ ID NO: 189691 - protein, 16 aa, Mycobacterium tuberculosis
IPLGFQVPGSIDAITL

SEQ ID NO: 189692 - protein, 16 aa, Mycobacterium tuberculosis
PLGFQVPGSIDAITLF

SEQ ID NO: 189693 - protein, 16 aa, Mycobacterium tuberculosis
LGFQVPGSIDAITLFP

SEQ ID NO: 189694 - protein, 16 aa, Mycobacterium tuberculosis
GFQVPGSIDAITLFPG

SEQ ID NO: 189695 - protein, 16 aa, Mycobacterium tuberculosis
FQVPGSIDAITLFPGG

SEQ ID NO: 189696 - protein, 16 aa, Mycobacterium tuberculosis
QVPGSIDAITLFPGGL

SEQ ID NO: 189697 - protein, 16 aa, Mycobacterium tuberculosis
VPGSIDAITLFPGGLT

SEQ ID NO: 189698 - protein, 16 aa, Mycobacterium tuberculosis
PGSIDAITLFPGGLTF

SEQ ID NO: 189699 - protein, 16 aa, Mycobacterium tuberculosis
GSIDAITLFPGGLTFP

SEQ ID NO: 189700 - protein, 16 aa, Mycobacterium tuberculosis
SIDAITLFPGGLTFPA

SEQ ID NO: 189701 - protein, 16 aa, Mycobacterium tuberculosis
IDAITLFPGGLTFPAN

SEQ ID NO: 189702 - protein, 16 aa, Mycobacterium tuberculosis
DAITLFPGGLTFPANS

SEQ ID NO: 189703 - protein, 16 aa, Mycobacterium tuberculosis
AITLFPGGLTFPANSL

SEQ ID NO: 189704 - protein, 16 aa, Mycobacterium tuberculosis
ITLFPGGLTFPANSLL

SEQ ID NO: 189705 - protein, 16 aa, Mycobacterium tuberculosis
TLFPGGLTFPANSLLN

SEQ ID NO: 189706 - protein, 16 aa, Mycobacterium tuberculosis
LFPGGLTFPANSLLNL

SEQ ID NO: 189707 - protein, 16 aa, Mycobacterium tuberculosis
FPGGLTFPANSLLNLD

SEQ ID NO: 189708 - protein, 16 aa, Mycobacterium tuberculosis
PGGLTFPANSLLNLDV

SEQ ID NO: 189709 - protein, 16 aa, Mycobacterium tuberculosis
GGLTFPANSLLNLDVF

SEQ ID NO: 189710 - protein, 16 aa, Mycobacterium tuberculosis
GLTFPANSLLNLDVFV

SEQ ID NO: 189711 - protein, 16 aa, Mycobacterium tuberculosis
LTFPANSLLNLDVFVG

SEQ ID NO: 189712 - protein, 16 aa, Mycobacterium tuberculosis
TFPANSLLNLDVFVGT

SEQ ID NO: 189713 - protein, 16 aa, Mycobacterium tuberculosis
FPANSLLNLDVFVGTP

SEQ ID NO: 189714 - protein, 16 aa, Mycobacterium tuberculosis
PANSLLNLDVFVGTPG

SEQ ID NO: 189715 - protein, 16 aa, Mycobacterium tuberculosis
ANSLLNLDVFVGTPGA

SEQ ID NO: 189716 - protein, 16 aa, Mycobacterium tuberculosis
NSLLNLDVFVGTPGAT

SEQ ID NO: 189717 - protein, 16 aa, Mycobacterium tuberculosis
SLLNLDVFVGTPGATI

SEQ ID NO: 189718 - protein, 16 aa, Mycobacterium tuberculosis
LLNLDVFVGTPGATIP

SEQ ID NO: 189719 - protein, 16 aa, Mycobacterium tuberculosis
LNLDVFVGTPGATIPA

SEQ ID NO: 189720 - protein, 16 aa, Mycobacterium tuberculosis
NLDVFVGTPGATIPAI

SEQ ID NO: 189721 - protein, 16 aa, Mycobacterium tuberculosis
LDVFVGTPGATIPAIT

SEQ ID NO: 189722 - protein, 16 aa, Mycobacterium tuberculosis
DVFVGTPGATIPAITF

SEQ ID NO: 189723 - protein, 16 aa, Mycobacterium tuberculosis
VFVGTPGATIPAITFP

SEQ ID NO: 189724 - protein, 16 aa, Mycobacterium tuberculosis
FVGTPGATIPAITFPE

SEQ ID NO: 189725 - protein, 16 aa, Mycobacterium tuberculosis
VGTPGATIPAITFPEI

SEQ ID NO: 189726 - protein, 16 aa, Mycobacterium tuberculosis
GTPGATIPAITFPEIP

SEQ ID NO: 189727 - protein, 16 aa, Mycobacterium tuberculosis
TPGATIPAITFPEIPA

SEQ ID NO: 189728 - protein, 16 aa, Mycobacterium tuberculosis
PGATIPAITFPEIPAN

SEQ ID NO: 189729 - protein, 16 aa, Mycobacterium tuberculosis
GATIPAITFPEIPANA

SEQ ID NO: 189730 - protein, 16 aa, Mycobacterium tuberculosis
ATIPAITFPEIPANAD

SEQ ID NO: 189731 - protein, 16 aa, Mycobacterium tuberculosis
TIPAITFPEIPANADG

SEQ ID NO: 189732 - protein, 16 aa, Mycobacterium tuberculosis
IPAITFPEIPANADGE

SEQ ID NO: 189733 - protein, 16 aa, Mycobacterium tuberculosis
PAITFPEIPANADGEL

SEQ ID NO: 189734 - protein, 16 aa, Mycobacterium tuberculosis
AITFPEIPANADGELY

SEQ ID NO: 189735 - protein, 16 aa, Mycobacterium tuberculosis
ITFPEIPANADGELYV

SEQ ID NO: 189736 - protein, 16 aa, Mycobacterium tuberculosis
TFPEIPANADGELYVI

SEQ ID NO: 189737 - protein, 16 aa, Mycobacterium tuberculosis
FPEIPANADGELYVIA

SEQ ID NO: 189738 - protein, 16 aa, Mycobacterium tuberculosis
PEIPANADGELYVIAG

SEQ ID NO: 189739 - protein, 16 aa, Mycobacterium tuberculosis
EIPANADGELYVIAGD

SEQ ID NO: 189740 - protein, 16 aa, Mycobacterium tuberculosis
IPANADGELYVIAGDI

SEQ ID NO: 189741 - protein, 16 aa, Mycobacterium tuberculosis
PANADGELYVIAGDIP

SEQ ID NO: 189742 - protein, 16 aa, Mycobacterium tuberculosis
ANADGELYVIAGDIPL

SEQ ID NO: 189743 - protein, 16 aa, Mycobacterium tuberculosis
NADGELYVIAGDIPLI

SEQ ID NO: 189744 - protein, 16 aa, Mycobacterium tuberculosis
ADGELYVIAGDIPLIN

SEQ ID NO: 189745 - protein, 16 aa, Mycobacterium tuberculosis
DGELYVIAGDIPLINI

SEQ ID NO: 189746 - protein, 16 aa, Mycobacterium tuberculosis
GELYVIAGDIPLINIP

SEQ ID NO: 189747 - protein, 16 aa, Mycobacterium tuberculosis
ELYVIAGDIPLINIPP

SEQ ID NO: 189748 - protein, 16 aa, Mycobacterium tuberculosis
LYVIAGDIPLINIPPT

SEQ ID NO: 189749 - protein, 16 aa, Mycobacterium tuberculosis
YVIAGDIPLINIPPTP

SEQ ID NO: 189750 - protein, 16 aa, Mycobacterium tuberculosis
VIAGDIPLINIPPTPG

SEQ ID NO: 189751 - protein, 16 aa, Mycobacterium tuberculosis
IAGDIPLINIPPTPGI

SEQ ID NO: 189752 - protein, 16 aa, Mycobacterium tuberculosis
AGDIPLINIPPTPGIG

SEQ ID NO: 189753 - protein, 16 aa, Mycobacterium tuberculosis
GDIPLINIPPTPGIGN

SEQ ID NO: 189754 - protein, 16 aa, Mycobacterium tuberculosis
DIPLINIPPTPGIGNT

SEQ ID NO: 189755 - protein, 16 aa, Mycobacterium tuberculosis
IPLINIPPTPGIGNTT

SEQ ID NO: 189756 - protein, 16 aa, Mycobacterium tuberculosis
PLINIPPTPGIGNTTT

SEQ ID NO: 189757 - protein, 16 aa, Mycobacterium tuberculosis
LINIPPTPGIGNTTTV

SEQ ID NO: 189758 - protein, 16 aa, Mycobacterium tuberculosis
INIPPTPGIGNTTTVP

SEQ ID NO: 189759 - protein, 16 aa, Mycobacterium tuberculosis
NIPPTPGIGNTTTVPS

SEQ ID NO: 189760 - protein, 16 aa, Mycobacterium tuberculosis
IPPTPGIGNTTTVPSS

SEQ ID NO: 189761 - protein, 16 aa, Mycobacterium tuberculosis
PPTPGIGNTTTVPSSG

SEQ ID NO: 189762 - protein, 16 aa, Mycobacterium tuberculosis
PTPGIGNTTTVPSSGF

SEQ ID NO: 189763 - protein, 16 aa, Mycobacterium tuberculosis
TPGIGNTTTVPSSGFF

SEQ ID NO: 189764 - protein, 16 aa, Mycobacterium tuberculosis
PGIGNTTTVPSSGFFN

SEQ ID NO: 189765 - protein, 16 aa, Mycobacterium tuberculosis
GIGNTTTVPSSGFFNT

SEQ ID NO: 189766 - protein, 16 aa, Mycobacterium tuberculosis
IGNTTTVPSSGFFNTG

SEQ ID NO: 189767 - protein, 16 aa, Mycobacterium tuberculosis
GNTTTVPSSGFFNTGA

SEQ ID NO: 189768 - protein, 16 aa, Mycobacterium tuberculosis
NTTTVPSSGFFNTGAG

SEQ ID NO: 189769 - protein, 16 aa, Mycobacterium tuberculosis
TTTVPSSGFFNTGAGG

SEQ ID NO: 189770 - protein, 16 aa, Mycobacterium tuberculosis
TTVPSSGFFNTGAGGG

SEQ ID NO: 189771 - protein, 16 aa, Mycobacterium tuberculosis
TVPSSGFFNTGAGGGS

SEQ ID NO: 189772 - protein, 16 aa, Mycobacterium tuberculosis
VPSSGFFNTGAGGGSG

SEQ ID NO: 189773 - protein, 16 aa, Mycobacterium tuberculosis
PSSGFFNTGAGGGSGF

SEQ ID NO: 189774 - protein, 16 aa, Mycobacterium tuberculosis
SSGFFNTGAGGGSGFG

SEQ ID NO: 189775 - protein, 16 aa, Mycobacterium tuberculosis
SGFFNTGAGGGSGFGN

SEQ ID NO: 189776 - protein, 16 aa, Mycobacterium tuberculosis
GFFNTGAGGGSGFGNF

SEQ ID NO: 189777 - protein, 16 aa, Mycobacterium tuberculosis
FFNTGAGGGSGFGNFG

SEQ ID NO: 189778 - protein, 16 aa, Mycobacterium tuberculosis
FNTGAGGGSGFGNFGA

SEQ ID NO: 189779 - protein, 16 aa, Mycobacterium tuberculosis
NTGAGGGSGFGNFGAN

SEQ ID NO: 189780 - protein, 16 aa, Mycobacterium tuberculosis
TGAGGGSGFGNFGANM

SEQ ID NO: 189781 - protein, 16 aa, Mycobacterium tuberculosis
GAGGGSGFGNFGANMS

SEQ ID NO: 189782 - protein, 16 aa, Mycobacterium tuberculosis
AGGGSGFGNFGANMSG

SEQ ID NO: 189783 - protein, 16 aa, Mycobacterium tuberculosis
GGGSGFGNFGANMSGW

SEQ ID NO: 189784 - protein, 16 aa, Mycobacterium tuberculosis
GGSGFGNFGANMSGWW

SEQ ID NO: 189785 - protein, 16 aa, Mycobacterium tuberculosis
GSGFGNFGANMSGWWN

SEQ ID NO: 189786 - protein, 16 aa, Mycobacterium tuberculosis
SGFGNFGANMSGWWNQ

SEQ ID NO: 189787 - protein, 16 aa, Mycobacterium tuberculosis
GFGNFGANMSGWWNQA

SEQ ID NO: 189788 - protein, 16 aa, Mycobacterium tuberculosis
FGNFGANMSGWWNQAH

SEQ ID NO: 189789 - protein, 16 aa, Mycobacterium tuberculosis
GNFGANMSGWWNQAHT

SEQ ID NO: 189790 - protein, 16 aa, Mycobacterium tuberculosis
NFGANMSGWWNQAHTA

SEQ ID NO: 189791 - protein, 16 aa, Mycobacterium tuberculosis
FGANMSGWWNQAHTAL

SEQ ID NO: 189792 - protein, 16 aa, Mycobacterium tuberculosis
GANMSGWWNQAHTALA

SEQ ID NO: 189793 - protein, 16 aa, Mycobacterium tuberculosis
ANMSGWWNQAHTALAG

SEQ ID NO: 189794 - protein, 16 aa, Mycobacterium tuberculosis
NMSGWWNQAHTALAGA

SEQ ID NO: 189795 - protein, 16 aa, Mycobacterium tuberculosis
MSGWWNQAHTALAGAG

SEQ ID NO: 189796 - protein, 16 aa, Mycobacterium tuberculosis
SGWWNQAHTALAGAGS

SEQ ID NO: 189797 - protein, 16 aa, Mycobacterium tuberculosis
GWWNQAHTALAGAGSG

SEQ ID NO: 189798 - protein, 16 aa, Mycobacterium tuberculosis
WWNQAHTALAGAGSGI

SEQ ID NO: 189799 - protein, 16 aa, Mycobacterium tuberculosis
WNQAHTALAGAGSGIA

SEQ ID NO: 189800 - protein, 16 aa, Mycobacterium tuberculosis
NQAHTALAGAGSGIAN

SEQ ID NO: 189801 - protein, 16 aa, Mycobacterium tuberculosis
QAHTALAGAGSGIANV

SEQ ID NO: 189802 - protein, 16 aa, Mycobacterium tuberculosis
AHTALAGAGSGIANVG

SEQ ID NO: 189803 - protein, 16 aa, Mycobacterium tuberculosis
HTALAGAGSGIANVGT

SEQ ID NO: 189804 - protein, 16 aa, Mycobacterium tuberculosis
TALAGAGSGIANVGTL

SEQ ID NO: 189805 - protein, 16 aa, Mycobacterium tuberculosis
ALAGAGSGIANVGTLH

SEQ ID NO: 189806 - protein, 16 aa, Mycobacterium tuberculosis
LAGAGSGIANVGTLHS

SEQ ID NO: 189807 - protein, 16 aa, Mycobacterium tuberculosis
AGAGSGIANVGTLHSG

SEQ ID NO: 189808 - protein, 16 aa, Mycobacterium tuberculosis
GAGSGIANVGTLHSGV

SEQ ID NO: 189809 - protein, 16 aa, Mycobacterium tuberculosis
AGSGIANVGTLHSGVL

SEQ ID NO: 189810 - protein, 16 aa, Mycobacterium tuberculosis
GSGIANVGTLHSGVLN

SEQ ID NO: 189811 - protein, 16 aa, Mycobacterium tuberculosis
SGIANVGTLHSGVLNL

SEQ ID NO: 189812 - protein, 16 aa, Mycobacterium tuberculosis
GIANVGTLHSGVLNLG

SEQ ID NO: 189813 - protein, 16 aa, Mycobacterium tuberculosis
IANVGTLHSGVLNLGS

SEQ ID NO: 189814 - protein, 16 aa, Mycobacterium tuberculosis
ANVGTLHSGVLNLGSG

SEQ ID NO: 189815 - protein, 16 aa, Mycobacterium tuberculosis
NVGTLHSGVLNLGSGL

SEQ ID NO: 189816 - protein, 16 aa, Mycobacterium tuberculosis
VGTLHSGVLNLGSGLS

SEQ ID NO: 189817 - protein, 16 aa, Mycobacterium tuberculosis
GTLHSGVLNLGSGLSG

SEQ ID NO: 189818 - protein, 16 aa, Mycobacterium tuberculosis
TLHSGVLNLGSGLSGI

SEQ ID NO: 189819 - protein, 16 aa, Mycobacterium tuberculosis
LHSGVLNLGSGLSGIY

SEQ ID NO: 189820 - protein, 16 aa, Mycobacterium tuberculosis
HSGVLNLGSGLSGIYN

SEQ ID NO: 189821 - protein, 16 aa, Mycobacterium tuberculosis
SGVLNLGSGLSGIYNT

SEQ ID NO: 189822 - protein, 16 aa, Mycobacterium tuberculosis
GVLNLGSGLSGIYNTS

SEQ ID NO: 189823 - protein, 16 aa, Mycobacterium tuberculosis
VLNLGSGLSGIYNTST

SEQ ID NO: 189824 - protein, 16 aa, Mycobacterium tuberculosis
LNLGSGLSGIYNTSTL

SEQ ID NO: 189825 - protein, 16 aa, Mycobacterium tuberculosis
NLGSGLSGIYNTSTLP

SEQ ID NO: 189826 - protein, 16 aa, Mycobacterium tuberculosis
LGSGLSGIYNTSTLPL

SEQ ID NO: 189827 - protein, 16 aa, Mycobacterium tuberculosis
GSGLSGIYNTSTLPLG

SEQ ID NO: 189828 - protein, 16 aa, Mycobacterium tuberculosis
SGLSGIYNTSTLPLGT

SEQ ID NO: 189829 - protein, 16 aa, Mycobacterium tuberculosis
GLSGIYNTSTLPLGTP

SEQ ID NO: 189830 - protein, 16 aa, Mycobacterium tuberculosis
LSGIYNTSTLPLGTPA

SEQ ID NO: 189831 - protein, 16 aa, Mycobacterium tuberculosis
SGIYNTSTLPLGTPAL

SEQ ID NO: 189832 - protein, 16 aa, Mycobacterium tuberculosis
GIYNTSTLPLGTPALV

SEQ ID NO: 189833 - protein, 16 aa, Mycobacterium tuberculosis
IYNTSTLPLGTPALVS

SEQ ID NO: 189834 - protein, 16 aa, Mycobacterium tuberculosis
YNTSTLPLGTPALVSG

SEQ ID NO: 189835 - protein, 16 aa, Mycobacterium tuberculosis
NTSTLPLGTPALVSGL

SEQ ID NO: 189836 - protein, 16 aa, Mycobacterium tuberculosis
TSTLPLGTPALVSGLG

SEQ ID NO: 189837 - protein, 16 aa, Mycobacterium tuberculosis
STLPLGTPALVSGLGN

SEQ ID NO: 189838 - protein, 16 aa, Mycobacterium tuberculosis
TLPLGTPALVSGLGNV

SEQ ID NO: 189839 - protein, 16 aa, Mycobacterium tuberculosis
LPLGTPALVSGLGNVG

SEQ ID NO: 189840 - protein, 16 aa, Mycobacterium tuberculosis
PLGTPALVSGLGNVGD

SEQ ID NO: 189841 - protein, 16 aa, Mycobacterium tuberculosis
LGTPALVSGLGNVGDH

SEQ ID NO: 189842 - protein, 16 aa, Mycobacterium tuberculosis
GTPALVSGLGNVGDHL

SEQ ID NO: 189843 - protein, 16 aa, Mycobacterium tuberculosis
TPALVSGLGNVGDHLS

SEQ ID NO: 189844 - protein, 16 aa, Mycobacterium tuberculosis
PALVSGLGNVGDHLSG

SEQ ID NO: 189845 - protein, 16 aa, Mycobacterium tuberculosis
ALVSGLGNVGDHLSGL

SEQ ID NO: 189846 - protein, 16 aa, Mycobacterium tuberculosis
LVSGLGNVGDHLSGLL

SEQ ID NO: 189847 - protein, 16 aa, Mycobacterium tuberculosis
VSGLGNVGDHLSGLLA

SEQ ID NO: 189848 - protein, 16 aa, Mycobacterium tuberculosis
SGLGNVGDHLSGLLAS

SEQ ID NO: 189849 - protein, 16 aa, Mycobacterium tuberculosis
GLGNVGDHLSGLLASN

SEQ ID NO: 189850 - protein, 16 aa, Mycobacterium tuberculosis
LGNVGDHLSGLLASNV

SEQ ID NO: 189851 - protein, 16 aa, Mycobacterium tuberculosis
GNVGDHLSGLLASNVG

SEQ ID NO: 189852 - protein, 16 aa, Mycobacterium tuberculosis
NVGDHLSGLLASNVGQ

SEQ ID NO: 189853 - protein, 16 aa, Mycobacterium tuberculosis
VGDHLSGLLASNVGQN

SEQ ID NO: 189854 - protein, 16 aa, Mycobacterium tuberculosis
GDHLSGLLASNVGQNP

SEQ ID NO: 189855 - protein, 16 aa, Mycobacterium tuberculosis
DHLSGLLASNVGQNPI

SEQ ID NO: 189856 - protein, 16 aa, Mycobacterium tuberculosis
HLSGLLASNVGQNPIT

SEQ ID NO: 189857 - protein, 16 aa, Mycobacterium tuberculosis
LSGLLASNVGQNPITI

SEQ ID NO: 189858 - protein, 16 aa, Mycobacterium tuberculosis
SGLLASNVGQNPITIV

SEQ ID NO: 189859 - protein, 16 aa, Mycobacterium tuberculosis
GLLASNVGQNPITIVN

SEQ ID NO: 189860 - protein, 16 aa, Mycobacterium tuberculosis
LLASNVGQNPITIVNI

SEQ ID NO: 189861 - protein, 16 aa, Mycobacterium tuberculosis
LASNVGQNPITIVNIG

SEQ ID NO: 189862 - protein, 16 aa, Mycobacterium tuberculosis
ASNVGQNPITIVNIGL

SEQ ID NO: 189863 - protein, 16 aa, Mycobacterium tuberculosis
SNVGQNPITIVNIGLA

SEQ ID NO: 189864 - protein, 16 aa, Mycobacterium tuberculosis
NVGQNPITIVNIGLAN

SEQ ID NO: 189865 - protein, 16 aa, Mycobacterium tuberculosis
VGQNPITIVNIGLANV

SEQ ID NO: 189866 - protein, 16 aa, Mycobacterium tuberculosis
GQNPITIVNIGLANVG

SEQ ID NO: 189867 - protein, 16 aa, Mycobacterium tuberculosis
QNPITIVNIGLANVGN

SEQ ID NO: 189868 - protein, 16 aa, Mycobacterium tuberculosis
NPITIVNIGLANVGNG

SEQ ID NO: 189869 - protein, 16 aa, Mycobacterium tuberculosis
PITIVNIGLANVGNGN

SEQ ID NO: 189870 - protein, 16 aa, Mycobacterium tuberculosis
ITIVNIGLANVGNGNV

SEQ ID NO: 189871 - protein, 16 aa, Mycobacterium tuberculosis
TIVNIGLANVGNGNVG

SEQ ID NO: 189872 - protein, 16 aa, Mycobacterium tuberculosis
IVNIGLANVGNGNVGL

SEQ ID NO: 189873 - protein, 16 aa, Mycobacterium tuberculosis
VNIGLANVGNGNVGLG

SEQ ID NO: 189874 - protein, 16 aa, Mycobacterium tuberculosis
NIGLANVGNGNVGLGN

SEQ ID NO: 189875 - protein, 16 aa, Mycobacterium tuberculosis
IGLANVGNGNVGLGNI

SEQ ID NO: 189876 - protein, 16 aa, Mycobacterium tuberculosis
GLANVGNGNVGLGNIG

SEQ ID NO: 189877 - protein, 16 aa, Mycobacterium tuberculosis
LANVGNGNVGLGNIGN

SEQ ID NO: 189878 - protein, 16 aa, Mycobacterium tuberculosis
ANVGNGNVGLGNIGNL

SEQ ID NO: 189879 - protein, 16 aa, Mycobacterium tuberculosis
NVGNGNVGLGNIGNLN

SEQ ID NO: 189880 - protein, 16 aa, Mycobacterium tuberculosis
VGNGNVGLGNIGNLNL

SEQ ID NO: 189881 - protein, 16 aa, Mycobacterium tuberculosis
GNGNVGLGNIGNLNLG

SEQ ID NO: 189882 - protein, 16 aa, Mycobacterium tuberculosis
NGNVGLGNIGNLNLGA

SEQ ID NO: 189883 - protein, 16 aa, Mycobacterium tuberculosis
GNVGLGNIGNLNLGAA

SEQ ID NO: 189884 - protein, 16 aa, Mycobacterium tuberculosis
NVGLGNIGNLNLGAAN

SEQ ID NO: 189885 - protein, 16 aa, Mycobacterium tuberculosis
VGLGNIGNLNLGAANI

SEQ ID NO: 189886 - protein, 16 aa, Mycobacterium tuberculosis
GLGNIGNLNLGAANIG

SEQ ID NO: 189887 - protein, 16 aa, Mycobacterium tuberculosis
LGNIGNLNLGAANIGD

SEQ ID NO: 189888 - protein, 16 aa, Mycobacterium tuberculosis
GNIGNLNLGAANIGDV

SEQ ID NO: 189889 - protein, 16 aa, Mycobacterium tuberculosis
NIGNLNLGAANIGDVN

SEQ ID NO: 189890 - protein, 16 aa, Mycobacterium tuberculosis
IGNLNLGAANIGDVNL

SEQ ID NO: 189891 - protein, 16 aa, Mycobacterium tuberculosis
GNLNLGAANIGDVNLG

SEQ ID NO: 189892 - protein, 16 aa, Mycobacterium tuberculosis
NLNLGAANIGDVNLGF

SEQ ID NO: 189893 - protein, 16 aa, Mycobacterium tuberculosis
LNLGAANIGDVNLGFG

SEQ ID NO: 189894 - protein, 16 aa, Mycobacterium tuberculosis
NLGAANIGDVNLGFGN

SEQ ID NO: 189895 - protein, 16 aa, Mycobacterium tuberculosis
LGAANIGDVNLGFGNI

SEQ ID NO: 189896 - protein, 16 aa, Mycobacterium tuberculosis
GAANIGDVNLGFGNIG

SEQ ID NO: 189897 - protein, 16 aa, Mycobacterium tuberculosis
AANIGDVNLGFGNIGD

SEQ ID NO: 189898 - protein, 16 aa, Mycobacterium tuberculosis
ANIGDVNLGFGNIGDV

SEQ ID NO: 189899 - protein, 16 aa, Mycobacterium tuberculosis
NIGDVNLGFGNIGDVN

SEQ ID NO: 189900 - protein, 16 aa, Mycobacterium tuberculosis
IGDVNLGFGNIGDVNL

SEQ ID NO: 189901 - protein, 16 aa, Mycobacterium tuberculosis
GDVNLGFGNIGDVNLG

SEQ ID NO: 189902 - protein, 16 aa, Mycobacterium tuberculosis
DVNLGFGNIGDVNLGF

SEQ ID NO: 189903 - protein, 16 aa, Mycobacterium tuberculosis
VNLGFGNIGDVNLGFG

SEQ ID NO: 189904 - protein, 16 aa, Mycobacterium tuberculosis
NLGFGNIGDVNLGFGN

SEQ ID NO: 189905 - protein, 16 aa, Mycobacterium tuberculosis
LGFGNIGDVNLGFGNI

SEQ ID NO: 189906 - protein, 16 aa, Mycobacterium tuberculosis
GFGNIGDVNLGFGNIG

SEQ ID NO: 189907 - protein, 16 aa, Mycobacterium tuberculosis
FGNIGDVNLGFGNIGG

SEQ ID NO: 189908 - protein, 16 aa, Mycobacterium tuberculosis
GNIGDVNLGFGNIGGG

SEQ ID NO: 189909 - protein, 16 aa, Mycobacterium tuberculosis
NIGDVNLGFGNIGGGN

SEQ ID NO: 189910 - protein, 16 aa, Mycobacterium tuberculosis
IGDVNLGFGNIGGGNV

SEQ ID NO: 189911 - protein, 16 aa, Mycobacterium tuberculosis
GDVNLGFGNIGGGNVG

SEQ ID NO: 189912 - protein, 16 aa, Mycobacterium tuberculosis
DVNLGFGNIGGGNVGF

SEQ ID NO: 189913 - protein, 16 aa, Mycobacterium tuberculosis
VNLGFGNIGGGNVGFG

SEQ ID NO: 189914 - protein, 16 aa, Mycobacterium tuberculosis
NLGFGNIGGGNVGFGN

SEQ ID NO: 189915 - protein, 16 aa, Mycobacterium tuberculosis
LGFGNIGGGNVGFGNI

SEQ ID NO: 189916 - protein, 16 aa, Mycobacterium tuberculosis
GFGNIGGGNVGFGNIG

SEQ ID NO: 189917 - protein, 16 aa, Mycobacterium tuberculosis
FGNIGGGNVGFGNIGD

SEQ ID NO: 189918 - protein, 16 aa, Mycobacterium tuberculosis
GNIGGGNVGFGNIGDA

SEQ ID NO: 189919 - protein, 16 aa, Mycobacterium tuberculosis
NIGGGNVGFGNIGDAN

SEQ ID NO: 189920 - protein, 16 aa, Mycobacterium tuberculosis
IGGGNVGFGNIGDANF

SEQ ID NO: 189921 - protein, 16 aa, Mycobacterium tuberculosis
GGGNVGFGNIGDANFG

SEQ ID NO: 189922 - protein, 16 aa, Mycobacterium tuberculosis
GGNVGFGNIGDANFGF

SEQ ID NO: 189923 - protein, 16 aa, Mycobacterium tuberculosis
GNVGFGNIGDANFGFG

SEQ ID NO: 189924 - protein, 16 aa, Mycobacterium tuberculosis
NVGFGNIGDANFGFGN

SEQ ID NO: 189925 - protein, 16 aa, Mycobacterium tuberculosis
VGFGNIGDANFGFGNS

SEQ ID NO: 189926 - protein, 16 aa, Mycobacterium tuberculosis
GFGNIGDANFGFGNSG

SEQ ID NO: 189927 - protein, 16 aa, Mycobacterium tuberculosis
FGNIGDANFGFGNSGL

SEQ ID NO: 189928 - protein, 16 aa, Mycobacterium tuberculosis
GNIGDANFGFGNSGLA

SEQ ID NO: 189929 - protein, 16 aa, Mycobacterium tuberculosis
NIGDANFGFGNSGLAA

SEQ ID NO: 189930 - protein, 16 aa, Mycobacterium tuberculosis
IGDANFGFGNSGLAAG

SEQ ID NO: 189931 - protein, 16 aa, Mycobacterium tuberculosis
GDANFGFGNSGLAAGL

SEQ ID NO: 189932 - protein, 16 aa, Mycobacterium tuberculosis
DANFGFGNSGLAAGLA

SEQ ID NO: 189933 - protein, 16 aa, Mycobacterium tuberculosis
ANFGFGNSGLAAGLAG

SEQ ID NO: 189934 - protein, 16 aa, Mycobacterium tuberculosis
NFGFGNSGLAAGLAGM

SEQ ID NO: 189935 - protein, 16 aa, Mycobacterium tuberculosis
FGFGNSGLAAGLAGMG

SEQ ID NO: 189936 - protein, 16 aa, Mycobacterium tuberculosis
GFGNSGLAAGLAGMGN

SEQ ID NO: 189937 - protein, 16 aa, Mycobacterium tuberculosis
FGNSGLAAGLAGMGNI

SEQ ID NO: 189938 - protein, 16 aa, Mycobacterium tuberculosis
GNSGLAAGLAGMGNIG

SEQ ID NO: 189939 - protein, 16 aa, Mycobacterium tuberculosis
NSGLAAGLAGMGNIGL

SEQ ID NO: 189940 - protein, 16 aa, Mycobacterium tuberculosis
SGLAAGLAGMGNIGLG

SEQ ID NO: 189941 - protein, 16 aa, Mycobacterium tuberculosis
GLAAGLAGMGNIGLGN

SEQ ID NO: 189942 - protein, 16 aa, Mycobacterium tuberculosis
LAAGLAGMGNIGLGNA

SEQ ID NO: 189943 - protein, 16 aa, Mycobacterium tuberculosis
AAGLAGMGNIGLGNAG

SEQ ID NO: 189944 - protein, 16 aa, Mycobacterium tuberculosis
AGLAGMGNIGLGNAGS

SEQ ID NO: 189945 - protein, 16 aa, Mycobacterium tuberculosis
GLAGMGNIGLGNAGSG

SEQ ID NO: 189946 - protein, 16 aa, Mycobacterium tuberculosis
LAGMGNIGLGNAGSGN

SEQ ID NO: 189947 - protein, 16 aa, Mycobacterium tuberculosis
AGMGNIGLGNAGSGNV

SEQ ID NO: 189948 - protein, 16 aa, Mycobacterium tuberculosis
GMGNIGLGNAGSGNVG

SEQ ID NO: 189949 - protein, 16 aa, Mycobacterium tuberculosis
MGNIGLGNAGSGNVGW

SEQ ID NO: 189950 - protein, 16 aa, Mycobacterium tuberculosis
GNIGLGNAGSGNVGWA

SEQ ID NO: 189951 - protein, 16 aa, Mycobacterium tuberculosis
NIGLGNAGSGNVGWAN

SEQ ID NO: 189952 - protein, 16 aa, Mycobacterium tuberculosis
IGLGNAGSGNVGWANM

SEQ ID NO: 189953 - protein, 16 aa, Mycobacterium tuberculosis
GLGNAGSGNVGWANMG

SEQ ID NO: 189954 - protein, 16 aa, Mycobacterium tuberculosis
LGNAGSGNVGWANMGL

SEQ ID NO: 189955 - protein, 16 aa, Mycobacterium tuberculosis
GNAGSGNVGWANMGLG

SEQ ID NO: 189956 - protein, 16 aa, Mycobacterium tuberculosis
NAGSGNVGWANMGLGN

SEQ ID NO: 189957 - protein, 16 aa, Mycobacterium tuberculosis
AGSGNVGWANMGLGNI

SEQ ID NO: 189958 - protein, 16 aa, Mycobacterium tuberculosis
GSGNVGWANMGLGNIG

SEQ ID NO: 189959 - protein, 16 aa, Mycobacterium tuberculosis
SGNVGWANMGLGNIGF

SEQ ID NO: 189960 - protein, 16 aa, Mycobacterium tuberculosis
GNVGWANMGLGNIGFG

SEQ ID NO: 189961 - protein, 16 aa, Mycobacterium tuberculosis
NVGWANMGLGNIGFGN

SEQ ID NO: 189962 - protein, 16 aa, Mycobacterium tuberculosis
VGWANMGLGNIGFGNT

SEQ ID NO: 189963 - protein, 16 aa, Mycobacterium tuberculosis
GWANMGLGNIGFGNTG

SEQ ID NO: 189964 - protein, 16 aa, Mycobacterium tuberculosis
WANMGLGNIGFGNTGT

SEQ ID NO: 189965 - protein, 16 aa, Mycobacterium tuberculosis
ANMGLGNIGFGNTGTN

SEQ ID NO: 189966 - protein, 16 aa, Mycobacterium tuberculosis
NMGLGNIGFGNTGTNN

SEQ ID NO: 189967 - protein, 16 aa, Mycobacterium tuberculosis
MGLGNIGFGNTGTNNL

SEQ ID NO: 189968 - protein, 16 aa, Mycobacterium tuberculosis
GLGNIGFGNTGTNNLG

SEQ ID NO: 189969 - protein, 16 aa, Mycobacterium tuberculosis
LGNIGFGNTGTNNLGI

SEQ ID NO: 189970 - protein, 16 aa, Mycobacterium tuberculosis
GNIGFGNTGTNNLGIG

SEQ ID NO: 189971 - protein, 16 aa, Mycobacterium tuberculosis
NIGFGNTGTNNLGIGL

SEQ ID NO: 189972 - protein, 16 aa, Mycobacterium tuberculosis
IGFGNTGTNNLGIGLT

SEQ ID NO: 189973 - protein, 16 aa, Mycobacterium tuberculosis
GFGNTGTNNLGIGLTG

SEQ ID NO: 189974 - protein, 16 aa, Mycobacterium tuberculosis
FGNTGTNNLGIGLTGD

SEQ ID NO: 189975 - protein, 16 aa, Mycobacterium tuberculosis
GNTGTNNLGIGLTGDN

SEQ ID NO: 189976 - protein, 16 aa, Mycobacterium tuberculosis
NTGTNNLGIGLTGDNQ

SEQ ID NO: 189977 - protein, 16 aa, Mycobacterium tuberculosis
TGTNNLGIGLTGDNQS

SEQ ID NO: 189978 - protein, 16 aa, Mycobacterium tuberculosis
GTNNLGIGLTGDNQSG

SEQ ID NO: 189979 - protein, 16 aa, Mycobacterium tuberculosis
TNNLGIGLTGDNQSGI

SEQ ID NO: 189980 - protein, 16 aa, Mycobacterium tuberculosis
NNLGIGLTGDNQSGIG

SEQ ID NO: 189981 - protein, 16 aa, Mycobacterium tuberculosis
NLGIGLTGDNQSGIGG

SEQ ID NO: 189982 - protein, 16 aa, Mycobacterium tuberculosis
LGIGLTGDNQSGIGGL

SEQ ID NO: 189983 - protein, 16 aa, Mycobacterium tuberculosis
GIGLTGDNQSGIGGLN

SEQ ID NO: 189984 - protein, 16 aa, Mycobacterium tuberculosis
IGLTGDNQSGIGGLNS

SEQ ID NO: 189985 - protein, 16 aa, Mycobacterium tuberculosis
GLTGDNQSGIGGLNSG

SEQ ID NO: 189986 - protein, 16 aa, Mycobacterium tuberculosis
LTGDNQSGIGGLNSGT

SEQ ID NO: 189987 - protein, 16 aa, Mycobacterium tuberculosis
TGDNQSGIGGLNSGTG

SEQ ID NO: 189988 - protein, 16 aa, Mycobacterium tuberculosis
GDNQSGIGGLNSGTGN

SEQ ID NO: 189989 - protein, 16 aa, Mycobacterium tuberculosis
DNQSGIGGLNSGTGNI

SEQ ID NO: 189990 - protein, 16 aa, Mycobacterium tuberculosis
NQSGIGGLNSGTGNIG

SEQ ID NO: 189991 - protein, 16 aa, Mycobacterium tuberculosis
QSGIGGLNSGTGNIGL

SEQ ID NO: 189992 - protein, 16 aa, Mycobacterium tuberculosis
SGIGGLNSGTGNIGLF

SEQ ID NO: 189993 - protein, 16 aa, Mycobacterium tuberculosis
GIGGLNSGTGNIGLFN

SEQ ID NO: 189994 - protein, 16 aa, Mycobacterium tuberculosis
IGGLNSGTGNIGLFNS

SEQ ID NO: 189995 - protein, 16 aa, Mycobacterium tuberculosis
GGLNSGTGNIGLFNSG

SEQ ID NO: 189996 - protein, 16 aa, Mycobacterium tuberculosis
GLNSGTGNIGLFNSGT

SEQ ID NO: 189997 - protein, 16 aa, Mycobacterium tuberculosis
LNSGTGNIGLFNSGTG

SEQ ID NO: 189998 - protein, 16 aa, Mycobacterium tuberculosis
NSGTGNIGLFNSGTGN

SEQ ID NO: 189999 - protein, 16 aa, Mycobacterium tuberculosis
SGTGNIGLFNSGTGNI

SEQ ID NO: 190000 - protein, 16 aa, Mycobacterium tuberculosis
GTGNIGLFNSGTGNIG

SEQ ID NO: 190001 - protein, 16 aa, Mycobacterium tuberculosis
TGNIGLFNSGTGNIGF

SEQ ID NO: 190002 - protein, 16 aa, Mycobacterium tuberculosis
GNIGLFNSGTGNIGFF

SEQ ID NO: 190003 - protein, 16 aa, Mycobacterium tuberculosis
NIGLFNSGTGNIGFFN

SEQ ID NO: 190004 - protein, 16 aa, Mycobacterium tuberculosis
IGLFNSGTGNIGFFNS

SEQ ID NO: 190005 - protein, 16 aa, Mycobacterium tuberculosis
GLFNSGTGNIGFFNSG

SEQ ID NO: 190006 - protein, 16 aa, Mycobacterium tuberculosis
LFNSGTGNIGFFNSGT

SEQ ID NO: 190007 - protein, 16 aa, Mycobacterium tuberculosis
FNSGTGNIGFFNSGTA

SEQ ID NO: 190008 - protein, 16 aa, Mycobacterium tuberculosis
NSGTGNIGFFNSGTAN

SEQ ID NO: 190009 - protein, 16 aa, Mycobacterium tuberculosis
SGTGNIGFFNSGTANF

SEQ ID NO: 190010 - protein, 16 aa, Mycobacterium tuberculosis
GTGNIGFFNSGTANFG

SEQ ID NO: 190011 - protein, 16 aa, Mycobacterium tuberculosis
TGNIGFFNSGTANFGL

SEQ ID NO: 190012 - protein, 16 aa, Mycobacterium tuberculosis
GNIGFFNSGTANFGLF

SEQ ID NO: 190013 - protein, 16 aa, Mycobacterium tuberculosis
NIGFFNSGTANFGLFN

SEQ ID NO: 190014 - protein, 16 aa, Mycobacterium tuberculosis
IGFFNSGTANFGLFNS

SEQ ID NO: 190015 - protein, 16 aa, Mycobacterium tuberculosis
GFFNSGTANFGLFNSG

SEQ ID NO: 190016 - protein, 16 aa, Mycobacterium tuberculosis
FFNSGTANFGLFNSGS

SEQ ID NO: 190017 - protein, 16 aa, Mycobacterium tuberculosis
FNSGTANFGLFNSGSY

SEQ ID NO: 190018 - protein, 16 aa, Mycobacterium tuberculosis
NSGTANFGLFNSGSYN

SEQ ID NO: 190019 - protein, 16 aa, Mycobacterium tuberculosis
SGTANFGLFNSGSYNT

SEQ ID NO: 190020 - protein, 16 aa, Mycobacterium tuberculosis
GTANFGLFNSGSYNTG

SEQ ID NO: 190021 - protein, 16 aa, Mycobacterium tuberculosis
TANFGLFNSGSYNTGI

SEQ ID NO: 190022 - protein, 16 aa, Mycobacterium tuberculosis
ANFGLFNSGSYNTGIG

SEQ ID NO: 190023 - protein, 16 aa, Mycobacterium tuberculosis
NFGLFNSGSYNTGIGN

SEQ ID NO: 190024 - protein, 16 aa, Mycobacterium tuberculosis
FGLFNSGSYNTGIGNS

SEQ ID NO: 190025 - protein, 16 aa, Mycobacterium tuberculosis
GLFNSGSYNTGIGNSG

SEQ ID NO: 190026 - protein, 16 aa, Mycobacterium tuberculosis
LFNSGSYNTGIGNSGV

SEQ ID NO: 190027 - protein, 16 aa, Mycobacterium tuberculosis
FNSGSYNTGIGNSGVA

SEQ ID NO: 190028 - protein, 16 aa, Mycobacterium tuberculosis
NSGSYNTGIGNSGVAS

SEQ ID NO: 190029 - protein, 16 aa, Mycobacterium tuberculosis
SGSYNTGIGNSGVAST

SEQ ID NO: 190030 - protein, 16 aa, Mycobacterium tuberculosis
GSYNTGIGNSGVASTG

SEQ ID NO: 190031 - protein, 16 aa, Mycobacterium tuberculosis
SYNTGIGNSGVASTGL

SEQ ID NO: 190032 - protein, 16 aa, Mycobacterium tuberculosis
YNTGIGNSGVASTGLV

SEQ ID NO: 190033 - protein, 16 aa, Mycobacterium tuberculosis
NTGIGNSGVASTGLVN

SEQ ID NO: 190034 - protein, 16 aa, Mycobacterium tuberculosis
TGIGNSGVASTGLVNA

SEQ ID NO: 190035 - protein, 16 aa, Mycobacterium tuberculosis
GIGNSGVASTGLVNAG

SEQ ID NO: 190036 - protein, 16 aa, Mycobacterium tuberculosis
IGNSGVASTGLVNAGG

SEQ ID NO: 190037 - protein, 16 aa, Mycobacterium tuberculosis
GNSGVASTGLVNAGGF

SEQ ID NO: 190038 - protein, 16 aa, Mycobacterium tuberculosis
NSGVASTGLVNAGGFN

SEQ ID NO: 190039 - protein, 16 aa, Mycobacterium tuberculosis
SGVASTGLVNAGGFNT

SEQ ID NO: 190040 - protein, 16 aa, Mycobacterium tuberculosis
GVASTGLVNAGGFNTG

SEQ ID NO: 190041 - protein, 16 aa, Mycobacterium tuberculosis
VASTGLVNAGGFNTGV

SEQ ID NO: 190042 - protein, 16 aa, Mycobacterium tuberculosis
ASTGLVNAGGFNTGVA

SEQ ID NO: 190043 - protein, 16 aa, Mycobacterium tuberculosis
STGLVNAGGFNTGVAN

SEQ ID NO: 190044 - protein, 16 aa, Mycobacterium tuberculosis
TGLVNAGGFNTGVANA

SEQ ID NO: 190045 - protein, 16 aa, Mycobacterium tuberculosis
GLVNAGGFNTGVANAG

SEQ ID NO: 190046 - protein, 16 aa, Mycobacterium tuberculosis
LVNAGGFNTGVANAGS

SEQ ID NO: 190047 - protein, 16 aa, Mycobacterium tuberculosis
VNAGGFNTGVANAGSY

SEQ ID NO: 190048 - protein, 16 aa, Mycobacterium tuberculosis
NAGGFNTGVANAGSYN

SEQ ID NO: 190049 - protein, 16 aa, Mycobacterium tuberculosis
AGGFNTGVANAGSYNT

SEQ ID NO: 190050 - protein, 16 aa, Mycobacterium tuberculosis
GGFNTGVANAGSYNTG

SEQ ID NO: 190051 - protein, 16 aa, Mycobacterium tuberculosis
GFNTGVANAGSYNTGS

SEQ ID NO: 190052 - protein, 16 aa, Mycobacterium tuberculosis
FNTGVANAGSYNTGSF

SEQ ID NO: 190053 - protein, 16 aa, Mycobacterium tuberculosis
NTGVANAGSYNTGSFN

SEQ ID NO: 190054 - protein, 16 aa, Mycobacterium tuberculosis
TGVANAGSYNTGSFNA

SEQ ID NO: 190055 - protein, 16 aa, Mycobacterium tuberculosis
GVANAGSYNTGSFNAG

SEQ ID NO: 190056 - protein, 16 aa, Mycobacterium tuberculosis
VANAGSYNTGSFNAGD

SEQ ID NO: 190057 - protein, 16 aa, Mycobacterium tuberculosis
ANAGSYNTGSFNAGDT

SEQ ID NO: 190058 - protein, 16 aa, Mycobacterium tuberculosis
NAGSYNTGSFNAGDTN

SEQ ID NO: 190059 - protein, 16 aa, Mycobacterium tuberculosis
AGSYNTGSFNAGDTNT

SEQ ID NO: 190060 - protein, 16 aa, Mycobacterium tuberculosis
GSYNTGSFNAGDTNTG

SEQ ID NO: 190061 - protein, 16 aa, Mycobacterium tuberculosis
SYNTGSFNAGDTNTGG

SEQ ID NO: 190062 - protein, 16 aa, Mycobacterium tuberculosis
YNTGSFNAGDTNTGGF

SEQ ID NO: 190063 - protein, 16 aa, Mycobacterium tuberculosis
NTGSFNAGDTNTGGFN

SEQ ID NO: 190064 - protein, 16 aa, Mycobacterium tuberculosis
TGSFNAGDTNTGGFNP

SEQ ID NO: 190065 - protein, 16 aa, Mycobacterium tuberculosis
GSFNAGDTNTGGFNPG

SEQ ID NO: 190066 - protein, 16 aa, Mycobacterium tuberculosis
SFNAGDTNTGGFNPGS

SEQ ID NO: 190067 - protein, 16 aa, Mycobacterium tuberculosis
FNAGDTNTGGFNPGST

SEQ ID NO: 190068 - protein, 16 aa, Mycobacterium tuberculosis
NAGDTNTGGFNPGSTN

SEQ ID NO: 190069 - protein, 16 aa, Mycobacterium tuberculosis
AGDTNTGGFNPGSTNT

SEQ ID NO: 190070 - protein, 16 aa, Mycobacterium tuberculosis
GDTNTGGFNPGSTNTG

SEQ ID NO: 190071 - protein, 16 aa, Mycobacterium tuberculosis
DTNTGGFNPGSTNTGW

SEQ ID NO: 190072 - protein, 16 aa, Mycobacterium tuberculosis
TNTGGFNPGSTNTGWF

SEQ ID NO: 190073 - protein, 16 aa, Mycobacterium tuberculosis
NTGGFNPGSTNTGWFN

SEQ ID NO: 190074 - protein, 16 aa, Mycobacterium tuberculosis
TGGFNPGSTNTGWFNT

SEQ ID NO: 190075 - protein, 16 aa, Mycobacterium tuberculosis
GGFNPGSTNTGWFNTG

SEQ ID NO: 190076 - protein, 16 aa, Mycobacterium tuberculosis
GFNPGSTNTGWFNTGN

SEQ ID NO: 190077 - protein, 16 aa, Mycobacterium tuberculosis
FNPGSTNTGWFNTGNA

SEQ ID NO: 190078 - protein, 16 aa, Mycobacterium tuberculosis
NPGSTNTGWFNTGNAN

SEQ ID NO: 190079 - protein, 16 aa, Mycobacterium tuberculosis
PGSTNTGWFNTGNANT

SEQ ID NO: 190080 - protein, 16 aa, Mycobacterium tuberculosis
GSTNTGWFNTGNANTG

SEQ ID NO: 190081 - protein, 16 aa, Mycobacterium tuberculosis
STNTGWFNTGNANTGV

SEQ ID NO: 190082 - protein, 16 aa, Mycobacterium tuberculosis
TNTGWFNTGNANTGVA

SEQ ID NO: 190083 - protein, 16 aa, Mycobacterium tuberculosis
NTGWFNTGNANTGVAN

SEQ ID NO: 190084 - protein, 16 aa, Mycobacterium tuberculosis
TGWFNTGNANTGVANA

SEQ ID NO: 190085 - protein, 16 aa, Mycobacterium tuberculosis
GWFNTGNANTGVANAG

SEQ ID NO: 190086 - protein, 16 aa, Mycobacterium tuberculosis
WFNTGNANTGVANAGN

SEQ ID NO: 190087 - protein, 16 aa, Mycobacterium tuberculosis
FNTGNANTGVANAGNV

SEQ ID NO: 190088 - protein, 16 aa, Mycobacterium tuberculosis
NTGNANTGVANAGNVN

SEQ ID NO: 190089 - protein, 16 aa, Mycobacterium tuberculosis
TGNANTGVANAGNVNT

SEQ ID NO: 190090 - protein, 16 aa, Mycobacterium tuberculosis
GNANTGVANAGNVNTG

SEQ ID NO: 190091 - protein, 16 aa, Mycobacterium tuberculosis
NANTGVANAGNVNTGA

SEQ ID NO: 190092 - protein, 16 aa, Mycobacterium tuberculosis
ANTGVANAGNVNTGAL

SEQ ID NO: 190093 - protein, 16 aa, Mycobacterium tuberculosis
NTGVANAGNVNTGALI

SEQ ID NO: 190094 - protein, 16 aa, Mycobacterium tuberculosis
TGVANAGNVNTGALIT

SEQ ID NO: 190095 - protein, 16 aa, Mycobacterium tuberculosis
GVANAGNVNTGALITG

SEQ ID NO: 190096 - protein, 16 aa, Mycobacterium tuberculosis
VANAGNVNTGALITGN

SEQ ID NO: 190097 - protein, 16 aa, Mycobacterium tuberculosis
ANAGNVNTGALITGNF

SEQ ID NO: 190098 - protein, 16 aa, Mycobacterium tuberculosis
NAGNVNTGALITGNFS

SEQ ID NO: 190099 - protein, 16 aa, Mycobacterium tuberculosis
AGNVNTGALITGNFSN

SEQ ID NO: 190100 - protein, 16 aa, Mycobacterium tuberculosis
GNVNTGALITGNFSNG

SEQ ID NO: 190101 - protein, 16 aa, Mycobacterium tuberculosis
NVNTGALITGNFSNGI

SEQ ID NO: 190102 - protein, 16 aa, Mycobacterium tuberculosis
VNTGALITGNFSNGIL

SEQ ID NO: 190103 - protein, 16 aa, Mycobacterium tuberculosis
NTGALITGNFSNGILW

SEQ ID NO: 190104 - protein, 16 aa, Mycobacterium tuberculosis
TGALITGNFSNGILWR

SEQ ID NO: 190105 - protein, 16 aa, Mycobacterium tuberculosis
GALITGNFSNGILWRG

SEQ ID NO: 190106 - protein, 16 aa, Mycobacterium tuberculosis
ALITGNFSNGILWRGN

SEQ ID NO: 190107 - protein, 16 aa, Mycobacterium tuberculosis
LITGNFSNGILWRGNY

SEQ ID NO: 190108 - protein, 16 aa, Mycobacterium tuberculosis
ITGNFSNGILWRGNYE

SEQ ID NO: 190109 - protein, 16 aa, Mycobacterium tuberculosis
TGNFSNGILWRGNYEG

SEQ ID NO: 190110 - protein, 16 aa, Mycobacterium tuberculosis
GNFSNGILWRGNYEGL

SEQ ID NO: 190111 - protein, 16 aa, Mycobacterium tuberculosis
NFSNGILWRGNYEGLA

SEQ ID NO: 190112 - protein, 16 aa, Mycobacterium tuberculosis
FSNGILWRGNYEGLAG

SEQ ID NO: 190113 - protein, 16 aa, Mycobacterium tuberculosis
SNGILWRGNYEGLAGF

SEQ ID NO: 190114 - protein, 16 aa, Mycobacterium tuberculosis
NGILWRGNYEGLAGFS

SEQ ID NO: 190115 - protein, 16 aa, Mycobacterium tuberculosis
GILWRGNYEGLAGFSF

SEQ ID NO: 190116 - protein, 16 aa, Mycobacterium tuberculosis
ILWRGNYEGLAGFSFG

SEQ ID NO: 190117 - protein, 16 aa, Mycobacterium tuberculosis
LWRGNYEGLAGFSFGY

SEQ ID NO: 190118 - protein, 16 aa, Mycobacterium tuberculosis
WRGNYEGLAGFSFGYP

SEQ ID NO: 190119 - protein, 16 aa, Mycobacterium tuberculosis
RGNYEGLAGFSFGYPI

SEQ ID NO: 190120 - protein, 16 aa, Mycobacterium tuberculosis
GNYEGLAGFSFGYPIP

SEQ ID NO: 190121 - protein, 16 aa, Mycobacterium tuberculosis
NYEGLAGFSFGYPIPL

SEQ ID NO: 190122 - protein, 16 aa, Mycobacterium tuberculosis
YEGLAGFSFGYPIPLF

SEQ ID NO: 190123 - protein, 16 aa, Mycobacterium tuberculosis
EGLAGFSFGYPIPLFP

SEQ ID NO: 190124 - protein, 16 aa, Mycobacterium tuberculosis
GLAGFSFGYPIPLFPA

SEQ ID NO: 190125 - protein, 16 aa, Mycobacterium tuberculosis
LAGFSFGYPIPLFPAV

SEQ ID NO: 190126 - protein, 16 aa, Mycobacterium tuberculosis
AGFSFGYPIPLFPAVG

SEQ ID NO: 190127 - protein, 16 aa, Mycobacterium tuberculosis
GFSFGYPIPLFPAVGA

SEQ ID NO: 190128 - protein, 16 aa, Mycobacterium tuberculosis
FSFGYPIPLFPAVGAD

SEQ ID NO: 190129 - protein, 16 aa, Mycobacterium tuberculosis
SFGYPIPLFPAVGADV

SEQ ID NO: 190130 - protein, 16 aa, Mycobacterium tuberculosis
FGYPIPLFPAVGADVT

SEQ ID NO: 190131 - protein, 16 aa, Mycobacterium tuberculosis
GYPIPLFPAVGADVTG

SEQ ID NO: 190132 - protein, 16 aa, Mycobacterium tuberculosis
YPIPLFPAVGADVTGD

SEQ ID NO: 190133 - protein, 16 aa, Mycobacterium tuberculosis
PIPLFPAVGADVTGDI

SEQ ID NO: 190134 - protein, 16 aa, Mycobacterium tuberculosis
IPLFPAVGADVTGDIG

SEQ ID NO: 190135 - protein, 16 aa, Mycobacterium tuberculosis
PLFPAVGADVTGDIGP

SEQ ID NO: 190136 - protein, 16 aa, Mycobacterium tuberculosis
LFPAVGADVTGDIGPA

SEQ ID NO: 190137 - protein, 16 aa, Mycobacterium tuberculosis
FPAVGADVTGDIGPAT

SEQ ID NO: 190138 - protein, 16 aa, Mycobacterium tuberculosis
PAVGADVTGDIGPATI

SEQ ID NO: 190139 - protein, 16 aa, Mycobacterium tuberculosis
AVGADVTGDIGPATII

SEQ ID NO: 190140 - protein, 16 aa, Mycobacterium tuberculosis
VGADVTGDIGPATIIP

SEQ ID NO: 190141 - protein, 16 aa, Mycobacterium tuberculosis
GADVTGDIGPATIIPP

SEQ ID NO: 190142 - protein, 16 aa, Mycobacterium tuberculosis
ADVTGDIGPATIIPPI

SEQ ID NO: 190143 - protein, 16 aa, Mycobacterium tuberculosis
DVTGDIGPATIIPPIH

SEQ ID NO: 190144 - protein, 16 aa, Mycobacterium tuberculosis
VTGDIGPATIIPPIHI

SEQ ID NO: 190145 - protein, 16 aa, Mycobacterium tuberculosis
TGDIGPATIIPPIHIP

SEQ ID NO: 190146 - protein, 16 aa, Mycobacterium tuberculosis
GDIGPATIIPPIHIPS

SEQ ID NO: 190147 - protein, 16 aa, Mycobacterium tuberculosis
DIGPATIIPPIHIPSI

SEQ ID NO: 190148 - protein, 16 aa, Mycobacterium tuberculosis
IGPATIIPPIHIPSIP

SEQ ID NO: 190149 - protein, 16 aa, Mycobacterium tuberculosis
GPATIIPPIHIPSIPL

SEQ ID NO: 190150 - protein, 16 aa, Mycobacterium tuberculosis
PATIIPPIHIPSIPLG

SEQ ID NO: 190151 - protein, 16 aa, Mycobacterium tuberculosis
ATIIPPIHIPSIPLGF

SEQ ID NO: 190152 - protein, 16 aa, Mycobacterium tuberculosis
TIIPPIHIPSIPLGFA

SEQ ID NO: 190153 - protein, 16 aa, Mycobacterium tuberculosis
IIPPIHIPSIPLGFAA

SEQ ID NO: 190154 - protein, 16 aa, Mycobacterium tuberculosis
IPPIHIPSIPLGFAAI

SEQ ID NO: 190155 - protein, 16 aa, Mycobacterium tuberculosis
PPIHIPSIPLGFAAIG

SEQ ID NO: 190156 - protein, 16 aa, Mycobacterium tuberculosis
PIHIPSIPLGFAAIGH

SEQ ID NO: 190157 - protein, 16 aa, Mycobacterium tuberculosis
IHIPSIPLGFAAIGHI

SEQ ID NO: 190158 - protein, 16 aa, Mycobacterium tuberculosis
HIPSIPLGFAAIGHIG

SEQ ID NO: 190159 - protein, 16 aa, Mycobacterium tuberculosis
IPSIPLGFAAIGHIGP

SEQ ID NO: 190160 - protein, 16 aa, Mycobacterium tuberculosis
PSIPLGFAAIGHIGPI

SEQ ID NO: 190161 - protein, 16 aa, Mycobacterium tuberculosis
SIPLGFAAIGHIGPIS

SEQ ID NO: 190162 - protein, 16 aa, Mycobacterium tuberculosis
IPLGFAAIGHIGPISI

SEQ ID NO: 190163 - protein, 16 aa, Mycobacterium tuberculosis
PLGFAAIGHIGPISIP

SEQ ID NO: 190164 - protein, 16 aa, Mycobacterium tuberculosis
LGFAAIGHIGPISIPN

SEQ ID NO: 190165 - protein, 16 aa, Mycobacterium tuberculosis
GFAAIGHIGPISIPNI

SEQ ID NO: 190166 - protein, 16 aa, Mycobacterium tuberculosis
FAAIGHIGPISIPNIA

SEQ ID NO: 190167 - protein, 16 aa, Mycobacterium tuberculosis
AAIGHIGPISIPNIAI

SEQ ID NO: 190168 - protein, 16 aa, Mycobacterium tuberculosis
AIGHIGPISIPNIAIP

SEQ ID NO: 190169 - protein, 16 aa, Mycobacterium tuberculosis
IGHIGPISIPNIAIPS

SEQ ID NO: 190170 - protein, 16 aa, Mycobacterium tuberculosis
GHIGPISIPNIAIPSI

SEQ ID NO: 190171 - protein, 16 aa, Mycobacterium tuberculosis
HIGPISIPNIAIPSIH

SEQ ID NO: 190172 - protein, 16 aa, Mycobacterium tuberculosis
IGPISIPNIAIPSIHL

SEQ ID NO: 190173 - protein, 16 aa, Mycobacterium tuberculosis
GPISIPNIAIPSIHLG

SEQ ID NO: 190174 - protein, 16 aa, Mycobacterium tuberculosis
PISIPNIAIPSIHLGI

SEQ ID NO: 190175 - protein, 16 aa, Mycobacterium tuberculosis
ISIPNIAIPSIHLGID

SEQ ID NO: 190176 - protein, 16 aa, Mycobacterium tuberculosis
SIPNIAIPSIHLGIDP

SEQ ID NO: 190177 - protein, 16 aa, Mycobacterium tuberculosis
IPNIAIPSIHLGIDPT

SEQ ID NO: 190178 - protein, 16 aa, Mycobacterium tuberculosis
PNIAIPSIHLGIDPTF

SEQ ID NO: 190179 - protein, 16 aa, Mycobacterium tuberculosis
NIAIPSIHLGIDPTFD

SEQ ID NO: 190180 - protein, 16 aa, Mycobacterium tuberculosis
IAIPSIHLGIDPTFDV

SEQ ID NO: 190181 - protein, 16 aa, Mycobacterium tuberculosis
AIPSIHLGIDPTFDVG

SEQ ID NO: 190182 - protein, 16 aa, Mycobacterium tuberculosis
IPSIHLGIDPTFDVGP

SEQ ID NO: 190183 - protein, 16 aa, Mycobacterium tuberculosis
PSIHLGIDPTFDVGPI

SEQ ID NO: 190184 - protein, 16 aa, Mycobacterium tuberculosis
SIHLGIDPTFDVGPIT

SEQ ID NO: 190185 - protein, 16 aa, Mycobacterium tuberculosis
IHLGIDPTFDVGPITV

SEQ ID NO: 190186 - protein, 16 aa, Mycobacterium tuberculosis
HLGIDPTFDVGPITVD

SEQ ID NO: 190187 - protein, 16 aa, Mycobacterium tuberculosis
LGIDPTFDVGPITVDP

SEQ ID NO: 190188 - protein, 16 aa, Mycobacterium tuberculosis
GIDPTFDVGPITVDPI

SEQ ID NO: 190189 - protein, 16 aa, Mycobacterium tuberculosis
IDPTFDVGPITVDPIT

SEQ ID NO: 190190 - protein, 16 aa, Mycobacterium tuberculosis
DPTFDVGPITVDPITL

SEQ ID NO: 190191 - protein, 16 aa, Mycobacterium tuberculosis
PTFDVGPITVDPITLT

SEQ ID NO: 190192 - protein, 16 aa, Mycobacterium tuberculosis
TFDVGPITVDPITLTI

SEQ ID NO: 190193 - protein, 16 aa, Mycobacterium tuberculosis
FDVGPITVDPITLTIP

SEQ ID NO: 190194 - protein, 16 aa, Mycobacterium tuberculosis
DVGPITVDPITLTIPG

SEQ ID NO: 190195 - protein, 16 aa, Mycobacterium tuberculosis
VGPITVDPITLTIPGL

SEQ ID NO: 190196 - protein, 16 aa, Mycobacterium tuberculosis
GPITVDPITLTIPGLS

SEQ ID NO: 190197 - protein, 16 aa, Mycobacterium tuberculosis
PITVDPITLTIPGLSL

SEQ ID NO: 190198 - protein, 16 aa, Mycobacterium tuberculosis
ITVDPITLTIPGLSLD

SEQ ID NO: 190199 - protein, 16 aa, Mycobacterium tuberculosis
TVDPITLTIPGLSLDA

SEQ ID NO: 190200 - protein, 16 aa, Mycobacterium tuberculosis
VDPITLTIPGLSLDAA

SEQ ID NO: 190201 - protein, 16 aa, Mycobacterium tuberculosis
DPITLTIPGLSLDAAV

SEQ ID NO: 190202 - protein, 16 aa, Mycobacterium tuberculosis
PITLTIPGLSLDAAVS

SEQ ID NO: 190203 - protein, 16 aa, Mycobacterium tuberculosis
ITLTIPGLSLDAAVSE

SEQ ID NO: 190204 - protein, 16 aa, Mycobacterium tuberculosis
TLTIPGLSLDAAVSEI

SEQ ID NO: 190205 - protein, 16 aa, Mycobacterium tuberculosis
LTIPGLSLDAAVSEIR

SEQ ID NO: 190206 - protein, 16 aa, Mycobacterium tuberculosis
TIPGLSLDAAVSEIRM

SEQ ID NO: 190207 - protein, 16 aa, Mycobacterium tuberculosis
IPGLSLDAAVSEIRMT

SEQ ID NO: 190208 - protein, 16 aa, Mycobacterium tuberculosis
PGLSLDAAVSEIRMTS

SEQ ID NO: 190209 - protein, 16 aa, Mycobacterium tuberculosis
GLSLDAAVSEIRMTSG

SEQ ID NO: 190210 - protein, 16 aa, Mycobacterium tuberculosis
LSLDAAVSEIRMTSGS

SEQ ID NO: 190211 - protein, 16 aa, Mycobacterium tuberculosis
SLDAAVSEIRMTSGSS

SEQ ID NO: 190212 - protein, 16 aa, Mycobacterium tuberculosis
LDAAVSEIRMTSGSSS

SEQ ID NO: 190213 - protein, 16 aa, Mycobacterium tuberculosis
DAAVSEIRMTSGSSSG

SEQ ID NO: 190214 - protein, 16 aa, Mycobacterium tuberculosis
AAVSEIRMTSGSSSGF

SEQ ID NO: 190215 - protein, 16 aa, Mycobacterium tuberculosis
AVSEIRMTSGSSSGFK

SEQ ID NO: 190216 - protein, 16 aa, Mycobacterium tuberculosis
VSEIRMTSGSSSGFKV

SEQ ID NO: 190217 - protein, 16 aa, Mycobacterium tuberculosis
SEIRMTSGSSSGFKVR

SEQ ID NO: 190218 - protein, 16 aa, Mycobacterium tuberculosis
EIRMTSGSSSGFKVRP

SEQ ID NO: 190219 - protein, 16 aa, Mycobacterium tuberculosis
IRMTSGSSSGFKVRPS

SEQ ID NO: 190220 - protein, 16 aa, Mycobacterium tuberculosis
RMTSGSSSGFKVRPSF

SEQ ID NO: 190221 - protein, 16 aa, Mycobacterium tuberculosis
MTSGSSSGFKVRPSFS

SEQ ID NO: 190222 - protein, 16 aa, Mycobacterium tuberculosis
TSGSSSGFKVRPSFSF

SEQ ID NO: 190223 - protein, 16 aa, Mycobacterium tuberculosis
SGSSSGFKVRPSFSFF

SEQ ID NO: 190224 - protein, 16 aa, Mycobacterium tuberculosis
GSSSGFKVRPSFSFFA

SEQ ID NO: 190225 - protein, 16 aa, Mycobacterium tuberculosis
SSSGFKVRPSFSFFAV

SEQ ID NO: 190226 - protein, 16 aa, Mycobacterium tuberculosis
SSGFKVRPSFSFFAVG

SEQ ID NO: 190227 - protein, 16 aa, Mycobacterium tuberculosis
SGFKVRPSFSFFAVGP

SEQ ID NO: 190228 - protein, 16 aa, Mycobacterium tuberculosis
GFKVRPSFSFFAVGPD

SEQ ID NO: 190229 - protein, 16 aa, Mycobacterium tuberculosis
FKVRPSFSFFAVGPDG

SEQ ID NO: 190230 - protein, 16 aa, Mycobacterium tuberculosis
KVRPSFSFFAVGPDGM

SEQ ID NO: 190231 - protein, 16 aa, Mycobacterium tuberculosis
VRPSFSFFAVGPDGMP

SEQ ID NO: 190232 - protein, 16 aa, Mycobacterium tuberculosis
RPSFSFFAVGPDGMPG

SEQ ID NO: 190233 - protein, 16 aa, Mycobacterium tuberculosis
PSFSFFAVGPDGMPGG

SEQ ID NO: 190234 - protein, 16 aa, Mycobacterium tuberculosis
SFSFFAVGPDGMPGGE

SEQ ID NO: 190235 - protein, 16 aa, Mycobacterium tuberculosis
FSFFAVGPDGMPGGEV

SEQ ID NO: 190236 - protein, 16 aa, Mycobacterium tuberculosis
SFFAVGPDGMPGGEVS

SEQ ID NO: 190237 - protein, 16 aa, Mycobacterium tuberculosis
FFAVGPDGMPGGEVSI

SEQ ID NO: 190238 - protein, 16 aa, Mycobacterium tuberculosis
FAVGPDGMPGGEVSIL

SEQ ID NO: 190239 - protein, 16 aa, Mycobacterium tuberculosis
AVGPDGMPGGEVSILQ

SEQ ID NO: 190240 - protein, 16 aa, Mycobacterium tuberculosis
VGPDGMPGGEVSILQP

SEQ ID NO: 190241 - protein, 16 aa, Mycobacterium tuberculosis
GPDGMPGGEVSILQPF

SEQ ID NO: 190242 - protein, 16 aa, Mycobacterium tuberculosis
PDGMPGGEVSILQPFT

SEQ ID NO: 190243 - protein, 16 aa, Mycobacterium tuberculosis
DGMPGGEVSILQPFTV

SEQ ID NO: 190244 - protein, 16 aa, Mycobacterium tuberculosis
GMPGGEVSILQPFTVA

SEQ ID NO: 190245 - protein, 16 aa, Mycobacterium tuberculosis
MPGGEVSILQPFTVAP

SEQ ID NO: 190246 - protein, 16 aa, Mycobacterium tuberculosis
PGGEVSILQPFTVAPI

SEQ ID NO: 190247 - protein, 16 aa, Mycobacterium tuberculosis
GGEVSILQPFTVAPIN

SEQ ID NO: 190248 - protein, 16 aa, Mycobacterium tuberculosis
GEVSILQPFTVAPINL

SEQ ID NO: 190249 - protein, 16 aa, Mycobacterium tuberculosis
EVSILQPFTVAPINLN

SEQ ID NO: 190250 - protein, 16 aa, Mycobacterium tuberculosis
VSILQPFTVAPINLNP

SEQ ID NO: 190251 - protein, 16 aa, Mycobacterium tuberculosis
SILQPFTVAPINLNPT

SEQ ID NO: 190252 - protein, 16 aa, Mycobacterium tuberculosis
ILQPFTVAPINLNPTT

SEQ ID NO: 190253 - protein, 16 aa, Mycobacterium tuberculosis
LQPFTVAPINLNPTTL

SEQ ID NO: 190254 - protein, 16 aa, Mycobacterium tuberculosis
QPFTVAPINLNPTTLH

SEQ ID NO: 190255 - protein, 16 aa, Mycobacterium tuberculosis
PFTVAPINLNPTTLHF

SEQ ID NO: 190256 - protein, 16 aa, Mycobacterium tuberculosis
FTVAPINLNPTTLHFP

SEQ ID NO: 190257 - protein, 16 aa, Mycobacterium tuberculosis
TVAPINLNPTTLHFPG

SEQ ID NO: 190258 - protein, 16 aa, Mycobacterium tuberculosis
VAPINLNPTTLHFPGF

SEQ ID NO: 190259 - protein, 16 aa, Mycobacterium tuberculosis
APINLNPTTLHFPGFT

SEQ ID NO: 190260 - protein, 16 aa, Mycobacterium tuberculosis
PINLNPTTLHFPGFTI

SEQ ID NO: 190261 - protein, 16 aa, Mycobacterium tuberculosis
INLNPTTLHFPGFTIP

SEQ ID NO: 190262 - protein, 16 aa, Mycobacterium tuberculosis
NLNPTTLHFPGFTIPT

SEQ ID NO: 190263 - protein, 16 aa, Mycobacterium tuberculosis
LNPTTLHFPGFTIPTG

SEQ ID NO: 190264 - protein, 16 aa, Mycobacterium tuberculosis
NPTTLHFPGFTIPTGP

SEQ ID NO: 190265 - protein, 16 aa, Mycobacterium tuberculosis
PTTLHFPGFTIPTGPI

SEQ ID NO: 190266 - protein, 16 aa, Mycobacterium tuberculosis
TTLHFPGFTIPTGPIH

SEQ ID NO: 190267 - protein, 16 aa, Mycobacterium tuberculosis
TLHFPGFTIPTGPIHI

SEQ ID NO: 190268 - protein, 16 aa, Mycobacterium tuberculosis
LHFPGFTIPTGPIHIG

SEQ ID NO: 190269 - protein, 16 aa, Mycobacterium tuberculosis
HFPGFTIPTGPIHIGL

SEQ ID NO: 190270 - protein, 16 aa, Mycobacterium tuberculosis
FPGFTIPTGPIHIGLP

SEQ ID NO: 190271 - protein, 16 aa, Mycobacterium tuberculosis
PGFTIPTGPIHIGLPL

SEQ ID NO: 190272 - protein, 16 aa, Mycobacterium tuberculosis
GFTIPTGPIHIGLPLS

SEQ ID NO: 190273 - protein, 16 aa, Mycobacterium tuberculosis
FTIPTGPIHIGLPLSL

SEQ ID NO: 190274 - protein, 16 aa, Mycobacterium tuberculosis
TIPTGPIHIGLPLSLT

SEQ ID NO: 190275 - protein, 16 aa, Mycobacterium tuberculosis
IPTGPIHIGLPLSLTI

SEQ ID NO: 190276 - protein, 16 aa, Mycobacterium tuberculosis
PTGPIHIGLPLSLTIP

SEQ ID NO: 190277 - protein, 16 aa, Mycobacterium tuberculosis
TGPIHIGLPLSLTIPG

SEQ ID NO: 190278 - protein, 16 aa, Mycobacterium tuberculosis
GPIHIGLPLSLTIPGF

SEQ ID NO: 190279 - protein, 16 aa, Mycobacterium tuberculosis
PIHIGLPLSLTIPGFT

SEQ ID NO: 190280 - protein, 16 aa, Mycobacterium tuberculosis
IHIGLPLSLTIPGFTI

SEQ ID NO: 190281 - protein, 16 aa, Mycobacterium tuberculosis
HIGLPLSLTIPGFTIP

SEQ ID NO: 190282 - protein, 16 aa, Mycobacterium tuberculosis
IGLPLSLTIPGFTIPG

SEQ ID NO: 190283 - protein, 16 aa, Mycobacterium tuberculosis
GLPLSLTIPGFTIPGG

SEQ ID NO: 190284 - protein, 16 aa, Mycobacterium tuberculosis
LPLSLTIPGFTIPGGT

SEQ ID NO: 190285 - protein, 16 aa, Mycobacterium tuberculosis
PLSLTIPGFTIPGGTL

SEQ ID NO: 190286 - protein, 16 aa, Mycobacterium tuberculosis
LSLTIPGFTIPGGTLI

SEQ ID NO: 190287 - protein, 16 aa, Mycobacterium tuberculosis
SLTIPGFTIPGGTLIP

SEQ ID NO: 190288 - protein, 16 aa, Mycobacterium tuberculosis
LTIPGFTIPGGTLIPQ

SEQ ID NO: 190289 - protein, 16 aa, Mycobacterium tuberculosis
TIPGFTIPGGTLIPQL

SEQ ID NO: 190290 - protein, 16 aa, Mycobacterium tuberculosis
IPGFTIPGGTLIPQLP

SEQ ID NO: 190291 - protein, 16 aa, Mycobacterium tuberculosis
PGFTIPGGTLIPQLPL

SEQ ID NO: 190292 - protein, 16 aa, Mycobacterium tuberculosis
GFTIPGGTLIPQLPLG

SEQ ID NO: 190293 - protein, 16 aa, Mycobacterium tuberculosis
FTIPGGTLIPQLPLGL

SEQ ID NO: 190294 - protein, 16 aa, Mycobacterium tuberculosis
TIPGGTLIPQLPLGLG

SEQ ID NO: 190295 - protein, 16 aa, Mycobacterium tuberculosis
IPGGTLIPQLPLGLGL

SEQ ID NO: 190296 - protein, 16 aa, Mycobacterium tuberculosis
PGGTLIPQLPLGLGLS

SEQ ID NO: 190297 - protein, 16 aa, Mycobacterium tuberculosis
GGTLIPQLPLGLGLSG

SEQ ID NO: 190298 - protein, 16 aa, Mycobacterium tuberculosis
GTLIPQLPLGLGLSGG

SEQ ID NO: 190299 - protein, 16 aa, Mycobacterium tuberculosis
TLIPQLPLGLGLSGGT

SEQ ID NO: 190300 - protein, 16 aa, Mycobacterium tuberculosis
LIPQLPLGLGLSGGTP

SEQ ID NO: 190301 - protein, 16 aa, Mycobacterium tuberculosis
IPQLPLGLGLSGGTPP

SEQ ID NO: 190302 - protein, 16 aa, Mycobacterium tuberculosis
PQLPLGLGLSGGTPPF

SEQ ID NO: 190303 - protein, 16 aa, Mycobacterium tuberculosis
QLPLGLGLSGGTPPFD

SEQ ID NO: 190304 - protein, 16 aa, Mycobacterium tuberculosis
LPLGLGLSGGTPPFDL

SEQ ID NO: 190305 - protein, 16 aa, Mycobacterium tuberculosis
PLGLGLSGGTPPFDLP

SEQ ID NO: 190306 - protein, 16 aa, Mycobacterium tuberculosis
LGLGLSGGTPPFDLPT

SEQ ID NO: 190307 - protein, 16 aa, Mycobacterium tuberculosis
GLGLSGGTPPFDLPTV

SEQ ID NO: 190308 - protein, 16 aa, Mycobacterium tuberculosis
LGLSGGTPPFDLPTVV

SEQ ID NO: 190309 - protein, 16 aa, Mycobacterium tuberculosis
GLSGGTPPFDLPTVVI

SEQ ID NO: 190310 - protein, 16 aa, Mycobacterium tuberculosis
LSGGTPPFDLPTVVID

SEQ ID NO: 190311 - protein, 16 aa, Mycobacterium tuberculosis
SGGTPPFDLPTVVIDR

SEQ ID NO: 190312 - protein, 16 aa, Mycobacterium tuberculosis
GGTPPFDLPTVVIDRI

SEQ ID NO: 190313 - protein, 16 aa, Mycobacterium tuberculosis
GTPPFDLPTVVIDRIP

SEQ ID NO: 190314 - protein, 16 aa, Mycobacterium tuberculosis
TPPFDLPTVVIDRIPV

SEQ ID NO: 190315 - protein, 16 aa, Mycobacterium tuberculosis
PPFDLPTVVIDRIPVE

SEQ ID NO: 190316 - protein, 16 aa, Mycobacterium tuberculosis
PFDLPTVVIDRIPVEL

SEQ ID NO: 190317 - protein, 16 aa, Mycobacterium tuberculosis
FDLPTVVIDRIPVELH

SEQ ID NO: 190318 - protein, 16 aa, Mycobacterium tuberculosis
DLPTVVIDRIPVELHA

SEQ ID NO: 190319 - protein, 16 aa, Mycobacterium tuberculosis
LPTVVIDRIPVELHAS

SEQ ID NO: 190320 - protein, 16 aa, Mycobacterium tuberculosis
PTVVIDRIPVELHAST

SEQ ID NO: 190321 - protein, 16 aa, Mycobacterium tuberculosis
TVVIDRIPVELHASTT

SEQ ID NO: 190322 - protein, 16 aa, Mycobacterium tuberculosis
VVIDRIPVELHASTTI

SEQ ID NO: 190323 - protein, 16 aa, Mycobacterium tuberculosis
VIDRIPVELHASTTIG

SEQ ID NO: 190324 - protein, 16 aa, Mycobacterium tuberculosis
IDRIPVELHASTTIGP

SEQ ID NO: 190325 - protein, 16 aa, Mycobacterium tuberculosis
DRIPVELHASTTIGPV

SEQ ID NO: 190326 - protein, 16 aa, Mycobacterium tuberculosis
RIPVELHASTTIGPVS

SEQ ID NO: 190327 - protein, 16 aa, Mycobacterium tuberculosis
IPVELHASTTIGPVSL

SEQ ID NO: 190328 - protein, 16 aa, Mycobacterium tuberculosis
PVELHASTTIGPVSLP

SEQ ID NO: 190329 - protein, 16 aa, Mycobacterium tuberculosis
VELHASTTIGPVSLPI

SEQ ID NO: 190330 - protein, 16 aa, Mycobacterium tuberculosis
ELHASTTIGPVSLPIF

SEQ ID NO: 190331 - protein, 16 aa, Mycobacterium tuberculosis
LHASTTIGPVSLPIFG

SEQ ID NO: 190332 - protein, 16 aa, Mycobacterium tuberculosis
HASTTIGPVSLPIFGF

SEQ ID NO: 190333 - protein, 16 aa, Mycobacterium tuberculosis
ASTTIGPVSLPIFGFG

SEQ ID NO: 190334 - protein, 16 aa, Mycobacterium tuberculosis
STTIGPVSLPIFGFGG

SEQ ID NO: 190335 - protein, 16 aa, Mycobacterium tuberculosis
TTIGPVSLPIFGFGGA

SEQ ID NO: 190336 - protein, 16 aa, Mycobacterium tuberculosis
TIGPVSLPIFGFGGAP

SEQ ID NO: 190337 - protein, 16 aa, Mycobacterium tuberculosis
IGPVSLPIFGFGGAPG

SEQ ID NO: 190338 - protein, 16 aa, Mycobacterium tuberculosis
GPVSLPIFGFGGAPGF

SEQ ID NO: 190339 - protein, 16 aa, Mycobacterium tuberculosis
PVSLPIFGFGGAPGFG

SEQ ID NO: 190340 - protein, 16 aa, Mycobacterium tuberculosis
VSLPIFGFGGAPGFGN

SEQ ID NO: 190341 - protein, 16 aa, Mycobacterium tuberculosis
SLPIFGFGGAPGFGND

SEQ ID NO: 190342 - protein, 16 aa, Mycobacterium tuberculosis
LPIFGFGGAPGFGNDT

SEQ ID NO: 190343 - protein, 16 aa, Mycobacterium tuberculosis
PIFGFGGAPGFGNDTT

SEQ ID NO: 190344 - protein, 16 aa, Mycobacterium tuberculosis
IFGFGGAPGFGNDTTA

SEQ ID NO: 190345 - protein, 16 aa, Mycobacterium tuberculosis
FGFGGAPGFGNDTTAP

SEQ ID NO: 190346 - protein, 16 aa, Mycobacterium tuberculosis
GFGGAPGFGNDTTAPS

SEQ ID NO: 190347 - protein, 16 aa, Mycobacterium tuberculosis
FGGAPGFGNDTTAPSS

SEQ ID NO: 190348 - protein, 16 aa, Mycobacterium tuberculosis
GGAPGFGNDTTAPSSG

SEQ ID NO: 190349 - protein, 16 aa, Mycobacterium tuberculosis
GAPGFGNDTTAPSSGF

SEQ ID NO: 190350 - protein, 16 aa, Mycobacterium tuberculosis
APGFGNDTTAPSSGFF

SEQ ID NO: 190351 - protein, 16 aa, Mycobacterium tuberculosis
PGFGNDTTAPSSGFFN

SEQ ID NO: 190352 - protein, 16 aa, Mycobacterium tuberculosis
GFGNDTTAPSSGFFNT

SEQ ID NO: 190353 - protein, 16 aa, Mycobacterium tuberculosis
FGNDTTAPSSGFFNTG

SEQ ID NO: 190354 - protein, 16 aa, Mycobacterium tuberculosis
GNDTTAPSSGFFNTGG

SEQ ID NO: 190355 - protein, 16 aa, Mycobacterium tuberculosis
NDTTAPSSGFFNTGGG

SEQ ID NO: 190356 - protein, 16 aa, Mycobacterium tuberculosis
DTTAPSSGFFNTGGGG

SEQ ID NO: 190357 - protein, 16 aa, Mycobacterium tuberculosis
TTAPSSGFFNTGGGGG

SEQ ID NO: 190358 - protein, 16 aa, Mycobacterium tuberculosis
TAPSSGFFNTGGGGGS

SEQ ID NO: 190359 - protein, 16 aa, Mycobacterium tuberculosis
APSSGFFNTGGGGGSG

SEQ ID NO: 190360 - protein, 16 aa, Mycobacterium tuberculosis
PSSGFFNTGGGGGSGF

SEQ ID NO: 190361 - protein, 16 aa, Mycobacterium tuberculosis
SSGFFNTGGGGGSGFS

SEQ ID NO: 190362 - protein, 16 aa, Mycobacterium tuberculosis
SGFFNTGGGGGSGFSN

SEQ ID NO: 190363 - protein, 16 aa, Mycobacterium tuberculosis
GFFNTGGGGGSGFSNS

SEQ ID NO: 190364 - protein, 16 aa, Mycobacterium tuberculosis
FFNTGGGGGSGFSNSG

SEQ ID NO: 190365 - protein, 16 aa, Mycobacterium tuberculosis
FNTGGGGGSGFSNSGS

SEQ ID NO: 190366 - protein, 16 aa, Mycobacterium tuberculosis
NTGGGGGSGFSNSGSG

SEQ ID NO: 190367 - protein, 16 aa, Mycobacterium tuberculosis
TGGGGGSGFSNSGSGM

SEQ ID NO: 190368 - protein, 16 aa, Mycobacterium tuberculosis
GGGGGSGFSNSGSGMS

SEQ ID NO: 190369 - protein, 16 aa, Mycobacterium tuberculosis
GGGGSGFSNSGSGMSG

SEQ ID NO: 190370 - protein, 16 aa, Mycobacterium tuberculosis
GGGSGFSNSGSGMSGV

SEQ ID NO: 190371 - protein, 16 aa, Mycobacterium tuberculosis
GGSGFSNSGSGMSGVL

SEQ ID NO: 190372 - protein, 16 aa, Mycobacterium tuberculosis
GSGFSNSGSGMSGVLN

SEQ ID NO: 190373 - protein, 16 aa, Mycobacterium tuberculosis
SGFSNSGSGMSGVLNA

SEQ ID NO: 190374 - protein, 16 aa, Mycobacterium tuberculosis
GFSNSGSGMSGVLNAI

SEQ ID NO: 190375 - protein, 16 aa, Mycobacterium tuberculosis
FSNSGSGMSGVLNAIS

SEQ ID NO: 190376 - protein, 16 aa, Mycobacterium tuberculosis
SNSGSGMSGVLNAISD

SEQ ID NO: 190377 - protein, 16 aa, Mycobacterium tuberculosis
NSGSGMSGVLNAISDP

SEQ ID NO: 190378 - protein, 16 aa, Mycobacterium tuberculosis
SGSGMSGVLNAISDPL

SEQ ID NO: 190379 - protein, 16 aa, Mycobacterium tuberculosis
GSGMSGVLNAISDPLL

SEQ ID NO: 190380 - protein, 16 aa, Mycobacterium tuberculosis
SGMSGVLNAISDPLLG

SEQ ID NO: 190381 - protein, 16 aa, Mycobacterium tuberculosis
GMSGVLNAISDPLLGS

SEQ ID NO: 190382 - protein, 16 aa, Mycobacterium tuberculosis
MSGVLNAISDPLLGSA

SEQ ID NO: 190383 - protein, 16 aa, Mycobacterium tuberculosis
SGVLNAISDPLLGSAS

SEQ ID NO: 190384 - protein, 16 aa, Mycobacterium tuberculosis
GVLNAISDPLLGSASG

SEQ ID NO: 190385 - protein, 16 aa, Mycobacterium tuberculosis
VLNAISDPLLGSASGF

SEQ ID NO: 190386 - protein, 16 aa, Mycobacterium tuberculosis
LNAISDPLLGSASGFA

SEQ ID NO: 190387 - protein, 16 aa, Mycobacterium tuberculosis
NAISDPLLGSASGFAN

SEQ ID NO: 190388 - protein, 16 aa, Mycobacterium tuberculosis
AISDPLLGSASGFANF

SEQ ID NO: 190389 - protein, 16 aa, Mycobacterium tuberculosis
ISDPLLGSASGFANFG

SEQ ID NO: 190390 - protein, 16 aa, Mycobacterium tuberculosis
SDPLLGSASGFANFGT

SEQ ID NO: 190391 - protein, 16 aa, Mycobacterium tuberculosis
DPLLGSASGFANFGTQ

SEQ ID NO: 190392 - protein, 16 aa, Mycobacterium tuberculosis
PLLGSASGFANFGTQL

SEQ ID NO: 190393 - protein, 16 aa, Mycobacterium tuberculosis
LLGSASGFANFGTQLS

SEQ ID NO: 190394 - protein, 16 aa, Mycobacterium tuberculosis
LGSASGFANFGTQLSG

SEQ ID NO: 190395 - protein, 16 aa, Mycobacterium tuberculosis
GSASGFANFGTQLSGI

SEQ ID NO: 190396 - protein, 16 aa, Mycobacterium tuberculosis
SASGFANFGTQLSGIL

SEQ ID NO: 190397 - protein, 16 aa, Mycobacterium tuberculosis
ASGFANFGTQLSGILN

SEQ ID NO: 190398 - protein, 16 aa, Mycobacterium tuberculosis
SGFANFGTQLSGILNR

SEQ ID NO: 190399 - protein, 16 aa, Mycobacterium tuberculosis
GFANFGTQLSGILNRG

SEQ ID NO: 190400 - protein, 16 aa, Mycobacterium tuberculosis
FANFGTQLSGILNRGA

SEQ ID NO: 190401 - protein, 16 aa, Mycobacterium tuberculosis
ANFGTQLSGILNRGAG

SEQ ID NO: 190402 - protein, 16 aa, Mycobacterium tuberculosis
NFGTQLSGILNRGAGI

SEQ ID NO: 190403 - protein, 16 aa, Mycobacterium tuberculosis
FGTQLSGILNRGAGIS

SEQ ID NO: 190404 - protein, 16 aa, Mycobacterium tuberculosis
GTQLSGILNRGAGISG

SEQ ID NO: 190405 - protein, 16 aa, Mycobacterium tuberculosis
TQLSGILNRGAGISGV

SEQ ID NO: 190406 - protein, 16 aa, Mycobacterium tuberculosis
QLSGILNRGAGISGVY

SEQ ID NO: 190407 - protein, 16 aa, Mycobacterium tuberculosis
LSGILNRGAGISGVYN

SEQ ID NO: 190408 - protein, 16 aa, Mycobacterium tuberculosis
SGILNRGAGISGVYNT

SEQ ID NO: 190409 - protein, 16 aa, Mycobacterium tuberculosis
GILNRGAGISGVYNTG

SEQ ID NO: 190410 - protein, 16 aa, Mycobacterium tuberculosis
ILNRGAGISGVYNTGT

SEQ ID NO: 190411 - protein, 16 aa, Mycobacterium tuberculosis
LNRGAGISGVYNTGTL

SEQ ID NO: 190412 - protein, 16 aa, Mycobacterium tuberculosis
NRGAGISGVYNTGTLG

SEQ ID NO: 190413 - protein, 16 aa, Mycobacterium tuberculosis
RGAGISGVYNTGTLGL

SEQ ID NO: 190414 - protein, 16 aa, Mycobacterium tuberculosis
GAGISGVYNTGTLGLV

SEQ ID NO: 190415 - protein, 16 aa, Mycobacterium tuberculosis
AGISGVYNTGTLGLVT

SEQ ID NO: 190416 - protein, 16 aa, Mycobacterium tuberculosis
GISGVYNTGTLGLVTS

SEQ ID NO: 190417 - protein, 16 aa, Mycobacterium tuberculosis
ISGVYNTGTLGLVTSA

SEQ ID NO: 190418 - protein, 16 aa, Mycobacterium tuberculosis
SGVYNTGTLGLVTSAF

SEQ ID NO: 190419 - protein, 16 aa, Mycobacterium tuberculosis
GVYNTGTLGLVTSAFV

SEQ ID NO: 190420 - protein, 16 aa, Mycobacterium tuberculosis
VYNTGTLGLVTSAFVS

SEQ ID NO: 190421 - protein, 16 aa, Mycobacterium tuberculosis
YNTGTLGLVTSAFVSG

SEQ ID NO: 190422 - protein, 16 aa, Mycobacterium tuberculosis
NTGTLGLVTSAFVSGF

SEQ ID NO: 190423 - protein, 16 aa, Mycobacterium tuberculosis
TGTLGLVTSAFVSGFM

SEQ ID NO: 190424 - protein, 16 aa, Mycobacterium tuberculosis
GTLGLVTSAFVSGFMN

SEQ ID NO: 190425 - protein, 16 aa, Mycobacterium tuberculosis
TLGLVTSAFVSGFMNV

SEQ ID NO: 190426 - protein, 16 aa, Mycobacterium tuberculosis
LGLVTSAFVSGFMNVG

SEQ ID NO: 190427 - protein, 16 aa, Mycobacterium tuberculosis
GLVTSAFVSGFMNVGQ

SEQ ID NO: 190428 - protein, 16 aa, Mycobacterium tuberculosis
LVTSAFVSGFMNVGQQ

SEQ ID NO: 190429 - protein, 16 aa, Mycobacterium tuberculosis
VTSAFVSGFMNVGQQL

SEQ ID NO: 190430 - protein, 16 aa, Mycobacterium tuberculosis
TSAFVSGFMNVGQQLS

SEQ ID NO: 190431 - protein, 16 aa, Mycobacterium tuberculosis
SAFVSGFMNVGQQLSG

SEQ ID NO: 190432 - protein, 16 aa, Mycobacterium tuberculosis
AFVSGFMNVGQQLSGL

SEQ ID NO: 190433 - protein, 16 aa, Mycobacterium tuberculosis
FVSGFMNVGQQLSGLL

SEQ ID NO: 190434 - protein, 16 aa, Mycobacterium tuberculosis
VSGFMNVGQQLSGLLF

SEQ ID NO: 190435 - protein, 16 aa, Mycobacterium tuberculosis
SGFMNVGQQLSGLLFA

SEQ ID NO: 190436 - protein, 16 aa, Mycobacterium tuberculosis
GFMNVGQQLSGLLFAG

SEQ ID NO: 190437 - protein, 16 aa, Mycobacterium tuberculosis
FMNVGQQLSGLLFAGT

SEQ ID NO: 190438 - protein, 16 aa, Mycobacterium tuberculosis
MNVGQQLSGLLFAGTG

SEQ ID NO: 190439 - protein, 16 aa, Mycobacterium tuberculosis
NVGQQLSGLLFAGTGP

SEQ ID NO: 190440 - protein, 428 aa, Mycobacterium tuberculosis
MSVVGTPKSAEQIQQEWDTNPRWKDVTRTYSAEDVVALQGSVVEEHTLARRGAEVLWEQLHDLEWVNALGALTGNMAVQQVRAGLKAIYLSGWQVAGDANLSGHTYPDQSLYPANSVPQVVRRINNALQRADQIAKIEGDTSVENWLAPIVADGEAGFGGALNVYELQKALIAAGVAGSHWEDQLASEKKCGHLGGKVLIPTQQHIRTLTSARLAADVADVPTVVIARTDAEAATLITSDVDERDQPFITGERTREGFYRTKNGIEPCIARAKAYAPFADLIWMETGTPDLEAARQFSEAVKAEYPDQMLAYNCSPSFNWKKHLDDATIAKFQKELAAMGFKFQFITLAGFHALNYSMFDLAYGYAQNQMSAYVELQEREFAAEERGYTATKHQREVGAGYFDRIATTVDPNSSTTALTGSTEEGQFH

SEQ ID NO: 190441 - protein, 8 aa, Mycobacterium tuberculosis
MSVVGTPK

SEQ ID NO: 190442 - protein, 8 aa, Mycobacterium tuberculosis
AEQIQQEW

SEQ ID NO: 190443 - protein, 8 aa, Mycobacterium tuberculosis
NPRWKDVT

SEQ ID NO: 190444 - protein, 8 aa, Mycobacterium tuberculosis
DVTRTYSA

SEQ ID NO: 190445 - protein, 8 aa, Mycobacterium tuberculosis
RTYSAEDV

SEQ ID NO: 190446 - protein, 8 aa, Mycobacterium tuberculosis
SAEDVVAL

SEQ ID NO: 190447 - protein, 8 aa, Mycobacterium tuberculosis
VVALQGSV

SEQ ID NO: 190448 - protein, 8 aa, Mycobacterium tuberculosis
VALQGSVV

SEQ ID NO: 190449 - protein, 8 aa, Mycobacterium tuberculosis
SVVEEHTL

SEQ ID NO: 190450 - protein, 8 aa, Mycobacterium tuberculosis
LARRGAEV

SEQ ID NO: 190451 - protein, 8 aa, Mycobacterium tuberculosis
AEVLWEQL

SEQ ID NO: 190452 - protein, 8 aa, Mycobacterium tuberculosis
VLWEQLHD

SEQ ID NO: 190453 - protein, 8 aa, Mycobacterium tuberculosis
QLHDLEWV

SEQ ID NO: 190454 - protein, 8 aa, Mycobacterium tuberculosis
DLEWVNAL

SEQ ID NO: 190455 - protein, 8 aa, Mycobacterium tuberculosis
WVNALGAL

SEQ ID NO: 190456 - protein, 8 aa, Mycobacterium tuberculosis
ALTGNMAV

SEQ ID NO: 190457 - protein, 8 aa, Mycobacterium tuberculosis
NMAVQQVR

SEQ ID NO: 190458 - protein, 8 aa, Mycobacterium tuberculosis
MAVQQVRA

SEQ ID NO: 190459 - protein, 8 aa, Mycobacterium tuberculosis
VQQVRAGL

SEQ ID NO: 190460 - protein, 8 aa, Mycobacterium tuberculosis
QQVRAGLK

SEQ ID NO: 190461 - protein, 8 aa, Mycobacterium tuberculosis
GLKAIYLS

SEQ ID NO: 190462 - protein, 8 aa, Mycobacterium tuberculosis
KAIYLSGW

SEQ ID NO: 190463 - protein, 8 aa, Mycobacterium tuberculosis
IYLSGWQV

SEQ ID NO: 190464 - protein, 8 aa, Mycobacterium tuberculosis
YLSGWQVA

SEQ ID NO: 190465 - protein, 8 aa, Mycobacterium tuberculosis
QVAGDANL

SEQ ID NO: 190466 - protein, 8 aa, Mycobacterium tuberculosis
HTYPDQSL

SEQ ID NO: 190467 - protein, 8 aa, Mycobacterium tuberculosis
TYPDQSLY

SEQ ID NO: 190468 - protein, 8 aa, Mycobacterium tuberculosis
SLYPANSV

SEQ ID NO: 190469 - protein, 8 aa, Mycobacterium tuberculosis
YPANSVPQ

SEQ ID NO: 190470 - protein, 8 aa, Mycobacterium tuberculosis
NSVPQVVR

SEQ ID NO: 190471 - protein, 8 aa, Mycobacterium tuberculosis
SVPQVVRR

SEQ ID NO: 190472 - protein, 8 aa, Mycobacterium tuberculosis
VPQVVRRI

SEQ ID NO: 190473 - protein, 8 aa, Mycobacterium tuberculosis
RRINNALQ

SEQ ID NO: 190474 - protein, 8 aa, Mycobacterium tuberculosis
RINNALQR

SEQ ID NO: 190475 - protein, 8 aa, Mycobacterium tuberculosis
ALQRADQI

SEQ ID NO: 190476 - protein, 8 aa, Mycobacterium tuberculosis
QRADQIAK

SEQ ID NO: 190477 - protein, 8 aa, Mycobacterium tuberculosis
KIEGDTSV

SEQ ID NO: 190478 - protein, 8 aa, Mycobacterium tuberculosis
DTSVENWL

SEQ ID NO: 190479 - protein, 8 aa, Mycobacterium tuberculosis
TSVENWLA

SEQ ID NO: 190480 - protein, 8 aa, Mycobacterium tuberculosis
VENWLAPI

SEQ ID NO: 190481 - protein, 8 aa, Mycobacterium tuberculosis
ENWLAPIV

SEQ ID NO: 190482 - protein, 8 aa, Mycobacterium tuberculosis
WLAPIVAD

SEQ ID NO: 190483 - protein, 8 aa, Mycobacterium tuberculosis
VADGEAGF

SEQ ID NO: 190484 - protein, 8 aa, Mycobacterium tuberculosis
EAGFGGAL

SEQ ID NO: 190485 - protein, 8 aa, Mycobacterium tuberculosis
GFGGALNV

SEQ ID NO: 190486 - protein, 8 aa, Mycobacterium tuberculosis
FGGALNVY

SEQ ID NO: 190487 - protein, 8 aa, Mycobacterium tuberculosis
GALNVYEL

SEQ ID NO: 190488 - protein, 8 aa, Mycobacterium tuberculosis
ALNVYELQ

SEQ ID NO: 190489 - protein, 8 aa, Mycobacterium tuberculosis
NVYELQKA

SEQ ID NO: 190490 - protein, 8 aa, Mycobacterium tuberculosis
VYELQKAL

SEQ ID NO: 190491 - protein, 8 aa, Mycobacterium tuberculosis
YELQKALI

SEQ ID NO: 190492 - protein, 8 aa, Mycobacterium tuberculosis
ELQKALIA

SEQ ID NO: 190493 - protein, 8 aa, Mycobacterium tuberculosis
LQKALIAA

SEQ ID NO: 190494 - protein, 8 aa, Mycobacterium tuberculosis
KALIAAGV

SEQ ID NO: 190495 - protein, 8 aa, Mycobacterium tuberculosis
ALIAAGVA

SEQ ID NO: 190496 - protein, 8 aa, Mycobacterium tuberculosis
AGVAGSHW

SEQ ID NO: 190497 - protein, 8 aa, Mycobacterium tuberculosis
SEKKCGHL

SEQ ID NO: 190498 - protein, 8 aa, Mycobacterium tuberculosis
GHLGGKVL

SEQ ID NO: 190499 - protein, 8 aa, Mycobacterium tuberculosis
HLGGKVLI

SEQ ID NO: 190500 - protein, 8 aa, Mycobacterium tuberculosis
TQQHIRTL

SEQ ID NO: 190501 - protein, 8 aa, Mycobacterium tuberculosis
HIRTLTSA

SEQ ID NO: 190502 - protein, 8 aa, Mycobacterium tuberculosis
TLTSARLA

SEQ ID NO: 190503 - protein, 8 aa, Mycobacterium tuberculosis
LTSARLAA

SEQ ID NO: 190504 - protein, 8 aa, Mycobacterium tuberculosis
LAADVADV

SEQ ID NO: 190505 - protein, 8 aa, Mycobacterium tuberculosis
DVADVPTV

SEQ ID NO: 190506 - protein, 8 aa, Mycobacterium tuberculosis
VADVPTVV

SEQ ID NO: 190507 - protein, 8 aa, Mycobacterium tuberculosis
AEAATLIT

SEQ ID NO: 190508 - protein, 8 aa, Mycobacterium tuberculosis
ITSDVDER

SEQ ID NO: 190509 - protein, 8 aa, Mycobacterium tuberculosis
DERDQPFI

SEQ ID NO: 190510 - protein, 8 aa, Mycobacterium tuberculosis
QPFITGER

SEQ ID NO: 190511 - protein, 8 aa, Mycobacterium tuberculosis
FITGERTR

SEQ ID NO: 190512 - protein, 8 aa, Mycobacterium tuberculosis
RTREGFYR

SEQ ID NO: 190513 - protein, 8 aa, Mycobacterium tuberculosis
REGFYRTK

SEQ ID NO: 190514 - protein, 8 aa, Mycobacterium tuberculosis
FYRTKNGI

SEQ ID NO: 190515 - protein, 8 aa, Mycobacterium tuberculosis
GIEPCIAR

SEQ ID NO: 190516 - protein, 8 aa, Mycobacterium tuberculosis
EPCIARAK

SEQ ID NO: 190517 - protein, 8 aa, Mycobacterium tuberculosis
CIARAKAY

SEQ ID NO: 190518 - protein, 8 aa, Mycobacterium tuberculosis
RAKAYAPF

SEQ ID NO: 190519 - protein, 8 aa, Mycobacterium tuberculosis
AYAPFADL

SEQ ID NO: 190520 - protein, 8 aa, Mycobacterium tuberculosis
YAPFADLI

SEQ ID NO: 190521 - protein, 8 aa, Mycobacterium tuberculosis
APFADLIW

SEQ ID NO: 190522 - protein, 8 aa, Mycobacterium tuberculosis
METGTPDL

SEQ ID NO: 190523 - protein, 8 aa, Mycobacterium tuberculosis
RQFSEAVK

SEQ ID NO: 190524 - protein, 8 aa, Mycobacterium tuberculosis
SEAVKAEY

SEQ ID NO: 190525 - protein, 8 aa, Mycobacterium tuberculosis
AEYPDQML

SEQ ID NO: 190526 - protein, 8 aa, Mycobacterium tuberculosis
YPDQMLAY

SEQ ID NO: 190527 - protein, 8 aa, Mycobacterium tuberculosis
AYNCSPSF

SEQ ID NO: 190528 - protein, 8 aa, Mycobacterium tuberculosis
NCSPSFNW

SEQ ID NO: 190529 - protein, 8 aa, Mycobacterium tuberculosis
CSPSFNWK

SEQ ID NO: 190530 - protein, 8 aa, Mycobacterium tuberculosis
SPSFNWKK

SEQ ID NO: 190531 - protein, 8 aa, Mycobacterium tuberculosis
HLDDATIA

SEQ ID NO: 190532 - protein, 8 aa, Mycobacterium tuberculosis
ATIAKFQK

SEQ ID NO: 190533 - protein, 8 aa, Mycobacterium tuberculosis
FQKELAAM

SEQ ID NO: 190534 - protein, 8 aa, Mycobacterium tuberculosis
KELAAMGF

SEQ ID NO: 190535 - protein, 8 aa, Mycobacterium tuberculosis
ELAAMGFK

SEQ ID NO: 190536 - protein, 8 aa, Mycobacterium tuberculosis
LAAMGFKF

SEQ ID NO: 190537 - protein, 8 aa, Mycobacterium tuberculosis
MGFKFQFI

SEQ ID NO: 190538 - protein, 8 aa, Mycobacterium tuberculosis
FKFQFITL

SEQ ID NO: 190539 - protein, 8 aa, Mycobacterium tuberculosis
FQFITLAG

SEQ ID NO: 190540 - protein, 8 aa, Mycobacterium tuberculosis
QFITLAGF

SEQ ID NO: 190541 - protein, 8 aa, Mycobacterium tuberculosis
ITLAGFHA

SEQ ID NO: 190542 - protein, 8 aa, Mycobacterium tuberculosis
TLAGFHAL

SEQ ID NO: 190543 - protein, 8 aa, Mycobacterium tuberculosis
FHALNYSM

SEQ ID NO: 190544 - protein, 8 aa, Mycobacterium tuberculosis
HALNYSMF

SEQ ID NO: 190545 - protein, 8 aa, Mycobacterium tuberculosis
YSMFDLAY

SEQ ID NO: 190546 - protein, 8 aa, Mycobacterium tuberculosis
SMFDLAYG

SEQ ID NO: 190547 - protein, 8 aa, Mycobacterium tuberculosis
MFDLAYGY

SEQ ID NO: 190548 - protein, 8 aa, Mycobacterium tuberculosis
YAQNQMSA

SEQ ID NO: 190549 - protein, 8 aa, Mycobacterium tuberculosis
AQNQMSAY

SEQ ID NO: 190550 - protein, 8 aa, Mycobacterium tuberculosis
QMSAYVEL

SEQ ID NO: 190551 - protein, 8 aa, Mycobacterium tuberculosis
MSAYVELQ

SEQ ID NO: 190552 - protein, 8 aa, Mycobacterium tuberculosis
AYVELQER

SEQ ID NO: 190553 - protein, 8 aa, Mycobacterium tuberculosis
VELQEREF

SEQ ID NO: 190554 - protein, 8 aa, Mycobacterium tuberculosis
ELQEREFA

SEQ ID NO: 190555 - protein, 8 aa, Mycobacterium tuberculosis
LQEREFAA

SEQ ID NO: 190556 - protein, 8 aa, Mycobacterium tuberculosis
FAAEERGY

SEQ ID NO: 190557 - protein, 8 aa, Mycobacterium tuberculosis
AEERGYTA

SEQ ID NO: 190558 - protein, 8 aa, Mycobacterium tuberculosis
YTATKHQR

SEQ ID NO: 190559 - protein, 8 aa, Mycobacterium tuberculosis
REVGAGYF

SEQ ID NO: 190560 - protein, 8 aa, Mycobacterium tuberculosis
TTVDPNSS

SEQ ID NO: 190561 - protein, 8 aa, Mycobacterium tuberculosis
DPNSSTTA

SEQ ID NO: 190562 - protein, 8 aa, Mycobacterium tuberculosis
TTALTGST

SEQ ID NO: 190563 - protein, 9 aa, Mycobacterium tuberculosis
SAEQIQQEW

SEQ ID NO: 190564 - protein, 9 aa, Mycobacterium tuberculosis
QEWDTNPRW

SEQ ID NO: 190565 - protein, 9 aa, Mycobacterium tuberculosis
NPRWKDVTR

SEQ ID NO: 190566 - protein, 9 aa, Mycobacterium tuberculosis
RWKDVTRTY

SEQ ID NO: 190567 - protein, 9 aa, Mycobacterium tuberculosis
RTYSAEDVV

SEQ ID NO: 190568 - protein, 9 aa, Mycobacterium tuberculosis
YSAEDVVAL

SEQ ID NO: 190569 - protein, 9 aa, Mycobacterium tuberculosis
DVVALQGSV

SEQ ID NO: 190570 - protein, 9 aa, Mycobacterium tuberculosis
VVALQGSVV

SEQ ID NO: 190571 - protein, 9 aa, Mycobacterium tuberculosis
SVVEEHTLA

SEQ ID NO: 190572 - protein, 9 aa, Mycobacterium tuberculosis
VVEEHTLAR

SEQ ID NO: 190573 - protein, 9 aa, Mycobacterium tuberculosis
TLARRGAEV

SEQ ID NO: 190574 - protein, 9 aa, Mycobacterium tuberculosis
LARRGAEVL

SEQ ID NO: 190575 - protein, 9 aa, Mycobacterium tuberculosis
AEVLWEQLH

SEQ ID NO: 190576 - protein, 9 aa, Mycobacterium tuberculosis
VLWEQLHDL

SEQ ID NO: 190577 - protein, 9 aa, Mycobacterium tuberculosis
WEQLHDLEW

SEQ ID NO: 190578 - protein, 9 aa, Mycobacterium tuberculosis
EQLHDLEWV

SEQ ID NO: 190579 - protein, 9 aa, Mycobacterium tuberculosis
QLHDLEWVN

SEQ ID NO: 190580 - protein, 9 aa, Mycobacterium tuberculosis
HDLEWVNAL

SEQ ID NO: 190581 - protein, 9 aa, Mycobacterium tuberculosis
ALGALTGNM

SEQ ID NO: 190582 - protein, 9 aa, Mycobacterium tuberculosis
GALTGNMAV

SEQ ID NO: 190583 - protein, 9 aa, Mycobacterium tuberculosis
ALTGNMAVQ

SEQ ID NO: 190584 - protein, 9 aa, Mycobacterium tuberculosis
NMAVQQVRA

SEQ ID NO: 190585 - protein, 9 aa, Mycobacterium tuberculosis
AVQQVRAGL

SEQ ID NO: 190586 - protein, 9 aa, Mycobacterium tuberculosis
VQQVRAGLK

SEQ ID NO: 190587 - protein, 9 aa, Mycobacterium tuberculosis
QVRAGLKAI

SEQ ID NO: 190588 - protein, 9 aa, Mycobacterium tuberculosis
VRAGLKAIY

SEQ ID NO: 190589 - protein, 9 aa, Mycobacterium tuberculosis
AIYLSGWQV

SEQ ID NO: 190590 - protein, 9 aa, Mycobacterium tuberculosis
YLSGWQVAG

SEQ ID NO: 190591 - protein, 9 aa, Mycobacterium tuberculosis
WQVAGDANL

SEQ ID NO: 190592 - protein, 9 aa, Mycobacterium tuberculosis
DANLSGHTY

SEQ ID NO: 190593 - protein, 9 aa, Mycobacterium tuberculosis
HTYPDQSLY

SEQ ID NO: 190594 - protein, 9 aa, Mycobacterium tuberculosis
YPDQSLYPA

SEQ ID NO: 190595 - protein, 9 aa, Mycobacterium tuberculosis
QSLYPANSV

SEQ ID NO: 190596 - protein, 9 aa, Mycobacterium tuberculosis
SLYPANSVP

SEQ ID NO: 190597 - protein, 9 aa, Mycobacterium tuberculosis
YPANSVPQV

SEQ ID NO: 190598 - protein, 9 aa, Mycobacterium tuberculosis
NSVPQVVRR

SEQ ID NO: 190599 - protein, 9 aa, Mycobacterium tuberculosis
SVPQVVRRI

SEQ ID NO: 190600 - protein, 9 aa, Mycobacterium tuberculosis
QVVRRINNA

SEQ ID NO: 190601 - protein, 9 aa, Mycobacterium tuberculosis
VVRRINNAL

SEQ ID NO: 190602 - protein, 9 aa, Mycobacterium tuberculosis
RRINNALQR

SEQ ID NO: 190603 - protein, 9 aa, Mycobacterium tuberculosis
RINNALQRA

SEQ ID NO: 190604 - protein, 9 aa, Mycobacterium tuberculosis
ALQRADQIA

SEQ ID NO: 190605 - protein, 9 aa, Mycobacterium tuberculosis
LQRADQIAK

SEQ ID NO: 190606 - protein, 9 aa, Mycobacterium tuberculosis
QRADQIAKI

SEQ ID NO: 190607 - protein, 9 aa, Mycobacterium tuberculosis
AKIEGDTSV

SEQ ID NO: 190608 - protein, 9 aa, Mycobacterium tuberculosis
DTSVENWLA

SEQ ID NO: 190609 - protein, 9 aa, Mycobacterium tuberculosis
SVENWLAPI

SEQ ID NO: 190610 - protein, 9 aa, Mycobacterium tuberculosis
VENWLAPIV

SEQ ID NO: 190611 - protein, 9 aa, Mycobacterium tuberculosis
APIVADGEA

SEQ ID NO: 190612 - protein, 9 aa, Mycobacterium tuberculosis
IVADGEAGF

SEQ ID NO: 190613 - protein, 9 aa, Mycobacterium tuberculosis
GEAGFGGAL

SEQ ID NO: 190614 - protein, 9 aa, Mycobacterium tuberculosis
AGFGGALNV

SEQ ID NO: 190615 - protein, 9 aa, Mycobacterium tuberculosis
ALNVYELQK

SEQ ID NO: 190616 - protein, 9 aa, Mycobacterium tuberculosis
NVYELQKAL

SEQ ID NO: 190617 - protein, 9 aa, Mycobacterium tuberculosis
VYELQKALI

SEQ ID NO: 190618 - protein, 9 aa, Mycobacterium tuberculosis
ELQKALIAA

SEQ ID NO: 190619 - protein, 9 aa, Mycobacterium tuberculosis
QKALIAAGV

SEQ ID NO: 190620 - protein, 9 aa, Mycobacterium tuberculosis
LIAAGVAGS

SEQ ID NO: 190621 - protein, 9 aa, Mycobacterium tuberculosis
AAGVAGSHW

SEQ ID NO: 190622 - protein, 9 aa, Mycobacterium tuberculosis
VLIPTQQHI

SEQ ID NO: 190623 - protein, 9 aa, Mycobacterium tuberculosis
LIPTQQHIR

SEQ ID NO: 190624 - protein, 9 aa, Mycobacterium tuberculosis
HIRTLTSAR

SEQ ID NO: 190625 - protein, 9 aa, Mycobacterium tuberculosis
TLTSARLAA

SEQ ID NO: 190626 - protein, 9 aa, Mycobacterium tuberculosis
TSARLAADV

SEQ ID NO: 190627 - protein, 9 aa, Mycobacterium tuberculosis
RLAADVADV

SEQ ID NO: 190628 - protein, 9 aa, Mycobacterium tuberculosis
DVADVPTVV

SEQ ID NO: 190629 - protein, 9 aa, Mycobacterium tuberculosis
DVPTVVIAR

SEQ ID NO: 190630 - protein, 9 aa, Mycobacterium tuberculosis
VPTVVIART

SEQ ID NO: 190631 - protein, 9 aa, Mycobacterium tuberculosis
VIARTDAEA

SEQ ID NO: 190632 - protein, 9 aa, Mycobacterium tuberculosis
RTDAEAATL

SEQ ID NO: 190633 - protein, 9 aa, Mycobacterium tuberculosis
AEAATLITS

SEQ ID NO: 190634 - protein, 9 aa, Mycobacterium tuberculosis
AATLITSDV

SEQ ID NO: 190635 - protein, 9 aa, Mycobacterium tuberculosis
LITSDVDER

SEQ ID NO: 190636 - protein, 9 aa, Mycobacterium tuberculosis
DVDERDQPF

SEQ ID NO: 190637 - protein, 9 aa, Mycobacterium tuberculosis
DQPFITGER

SEQ ID NO: 190638 - protein, 9 aa, Mycobacterium tuberculosis
RTREGFYRT

SEQ ID NO: 190639 - protein, 9 aa, Mycobacterium tuberculosis
TREGFYRTK

SEQ ID NO: 190640 - protein, 9 aa, Mycobacterium tuberculosis
GFYRTKNGI

SEQ ID NO: 190641 - protein, 9 aa, Mycobacterium tuberculosis
CIARAKAYA

SEQ ID NO: 190642 - protein, 9 aa, Mycobacterium tuberculosis
ARAKAYAPF

SEQ ID NO: 190643 - protein, 9 aa, Mycobacterium tuberculosis
RAKAYAPFA

SEQ ID NO: 190644 - protein, 9 aa, Mycobacterium tuberculosis
KAYAPFADL

SEQ ID NO: 190645 - protein, 9 aa, Mycobacterium tuberculosis
AYAPFADLI

SEQ ID NO: 190646 - protein, 9 aa, Mycobacterium tuberculosis
YAPFADLIW

SEQ ID NO: 190647 - protein, 9 aa, Mycobacterium tuberculosis
APFADLIWM

SEQ ID NO: 190648 - protein, 9 aa, Mycobacterium tuberculosis
FADLIWMET

SEQ ID NO: 190649 - protein, 9 aa, Mycobacterium tuberculosis
WMETGTPDL

SEQ ID NO: 190650 - protein, 9 aa, Mycobacterium tuberculosis
GTPDLEAAR

SEQ ID NO: 190651 - protein, 9 aa, Mycobacterium tuberculosis
EAARQFSEA

SEQ ID NO: 190652 - protein, 9 aa, Mycobacterium tuberculosis
AARQFSEAV

SEQ ID NO: 190653 - protein, 9 aa, Mycobacterium tuberculosis
RQFSEAVKA

SEQ ID NO: 190654 - protein, 9 aa, Mycobacterium tuberculosis
FSEAVKAEY

SEQ ID NO: 190655 - protein, 9 aa, Mycobacterium tuberculosis
AEYPDQMLA

SEQ ID NO: 190656 - protein, 9 aa, Mycobacterium tuberculosis
EYPDQMLAY

SEQ ID NO: 190657 - protein, 9 aa, Mycobacterium tuberculosis
YPDQMLAYN

SEQ ID NO: 190658 - protein, 9 aa, Mycobacterium tuberculosis
MLAYNCSPS

SEQ ID NO: 190659 - protein, 9 aa, Mycobacterium tuberculosis
LAYNCSPSF

SEQ ID NO: 190660 - protein, 9 aa, Mycobacterium tuberculosis
YNCSPSFNW

SEQ ID NO: 190661 - protein, 9 aa, Mycobacterium tuberculosis
CSPSFNWKK

SEQ ID NO: 190662 - protein, 9 aa, Mycobacterium tuberculosis
HLDDATIAK

SEQ ID NO: 190663 - protein, 9 aa, Mycobacterium tuberculosis
DATIAKFQK

SEQ ID NO: 190664 - protein, 9 aa, Mycobacterium tuberculosis
TIAKFQKEL

SEQ ID NO: 190665 - protein, 9 aa, Mycobacterium tuberculosis
KFQKELAAM

SEQ ID NO: 190666 - protein, 9 aa, Mycobacterium tuberculosis
KELAAMGFK

SEQ ID NO: 190667 - protein, 9 aa, Mycobacterium tuberculosis
ELAAMGFKF

SEQ ID NO: 190668 - protein, 9 aa, Mycobacterium tuberculosis
AAMGFKFQF

SEQ ID NO: 190669 - protein, 9 aa, Mycobacterium tuberculosis
AMGFKFQFI

SEQ ID NO: 190670 - protein, 9 aa, Mycobacterium tuberculosis
FKFQFITLA

SEQ ID NO: 190671 - protein, 9 aa, Mycobacterium tuberculosis
FQFITLAGF

SEQ ID NO: 190672 - protein, 9 aa, Mycobacterium tuberculosis
FITLAGFHA

SEQ ID NO: 190673 - protein, 9 aa, Mycobacterium tuberculosis
ITLAGFHAL

SEQ ID NO: 190674 - protein, 9 aa, Mycobacterium tuberculosis
TLAGFHALN

SEQ ID NO: 190675 - protein, 9 aa, Mycobacterium tuberculosis
LAGFHALNY

SEQ ID NO: 190676 - protein, 9 aa, Mycobacterium tuberculosis
FHALNYSMF

SEQ ID NO: 190677 - protein, 9 aa, Mycobacterium tuberculosis
ALNYSMFDL

SEQ ID NO: 190678 - protein, 9 aa, Mycobacterium tuberculosis
NYSMFDLAY

SEQ ID NO: 190679 - protein, 9 aa, Mycobacterium tuberculosis
SMFDLAYGY

SEQ ID NO: 190680 - protein, 9 aa, Mycobacterium tuberculosis
AYGYAQNQM

SEQ ID NO: 190681 - protein, 9 aa, Mycobacterium tuberculosis
YAQNQMSAY

SEQ ID NO: 190682 - protein, 9 aa, Mycobacterium tuberculosis
AQNQMSAYV

SEQ ID NO: 190683 - protein, 9 aa, Mycobacterium tuberculosis
NQMSAYVEL

SEQ ID NO: 190684 - protein, 9 aa, Mycobacterium tuberculosis
QMSAYVELQ

SEQ ID NO: 190685 - protein, 9 aa, Mycobacterium tuberculosis
MSAYVELQE

SEQ ID NO: 190686 - protein, 9 aa, Mycobacterium tuberculosis
SAYVELQER

SEQ ID NO: 190687 - protein, 9 aa, Mycobacterium tuberculosis
YVELQEREF

SEQ ID NO: 190688 - protein, 9 aa, Mycobacterium tuberculosis
ELQEREFAA

SEQ ID NO: 190689 - protein, 9 aa, Mycobacterium tuberculosis
EREFAAEER

SEQ ID NO: 190690 - protein, 9 aa, Mycobacterium tuberculosis
EFAAEERGY

SEQ ID NO: 190691 - protein, 9 aa, Mycobacterium tuberculosis
EERGYTATK

SEQ ID NO: 190692 - protein, 9 aa, Mycobacterium tuberculosis
GYTATKHQR

SEQ ID NO: 190693 - protein, 9 aa, Mycobacterium tuberculosis
HQREVGAGY

SEQ ID NO: 190694 - protein, 9 aa, Mycobacterium tuberculosis
EVGAGYFDR

SEQ ID NO: 190695 - protein, 9 aa, Mycobacterium tuberculosis
VGAGYFDRI

SEQ ID NO: 190696 - protein, 9 aa, Mycobacterium tuberculosis
YFDRIATTV

SEQ ID NO: 190697 - protein, 9 aa, Mycobacterium tuberculosis
TTVDPNSST

SEQ ID NO: 190698 - protein, 9 aa, Mycobacterium tuberculosis
TVDPNSSTT

SEQ ID NO: 190699 - protein, 9 aa, Mycobacterium tuberculosis
DPNSSTTAL

SEQ ID NO: 190700 - protein, 9 aa, Mycobacterium tuberculosis
STTALTGST

SEQ ID NO: 190701 - protein, 10 aa, Mycobacterium tuberculosis
KSAEQIQQEW

SEQ ID NO: 190702 - protein, 10 aa, Mycobacterium tuberculosis
AEQIQQEWDT

SEQ ID NO: 190703 - protein, 10 aa, Mycobacterium tuberculosis
NPRWKDVTRT

SEQ ID NO: 190704 - protein, 10 aa, Mycobacterium tuberculosis
TYSAEDVVAL

SEQ ID NO: 190705 - protein, 10 aa, Mycobacterium tuberculosis
AEDVVALQGS

SEQ ID NO: 190706 - protein, 10 aa, Mycobacterium tuberculosis
DVVALQGSVV

SEQ ID NO: 190707 - protein, 10 aa, Mycobacterium tuberculosis
SVVEEHTLAR

SEQ ID NO: 190708 - protein, 10 aa, Mycobacterium tuberculosis
VVEEHTLARR

SEQ ID NO: 190709 - protein, 10 aa, Mycobacterium tuberculosis
EEHTLARRGA

SEQ ID NO: 190710 - protein, 10 aa, Mycobacterium tuberculosis
HTLARRGAEV

SEQ ID NO: 190711 - protein, 10 aa, Mycobacterium tuberculosis
TLARRGAEVL

SEQ ID NO: 190712 - protein, 10 aa, Mycobacterium tuberculosis
LARRGAEVLW

SEQ ID NO: 190713 - protein, 10 aa, Mycobacterium tuberculosis
AEVLWEQLHD

SEQ ID NO: 190714 - protein, 10 aa, Mycobacterium tuberculosis
EVLWEQLHDL

SEQ ID NO: 190715 - protein, 10 aa, Mycobacterium tuberculosis
VLWEQLHDLE

SEQ ID NO: 190716 - protein, 10 aa, Mycobacterium tuberculosis
WEQLHDLEWV

SEQ ID NO: 190717 - protein, 10 aa, Mycobacterium tuberculosis
QLHDLEWVNA

SEQ ID NO: 190718 - protein, 10 aa, Mycobacterium tuberculosis
LHDLEWVNAL

SEQ ID NO: 190719 - protein, 10 aa, Mycobacterium tuberculosis
DLEWVNALGA

SEQ ID NO: 190720 - protein, 10 aa, Mycobacterium tuberculosis
LEWVNALGAL

SEQ ID NO: 190721 - protein, 10 aa, Mycobacterium tuberculosis
NALGALTGNM

SEQ ID NO: 190722 - protein, 10 aa, Mycobacterium tuberculosis
ALGALTGNMA

SEQ ID NO: 190723 - protein, 10 aa, Mycobacterium tuberculosis
LGALTGNMAV

SEQ ID NO: 190724 - protein, 10 aa, Mycobacterium tuberculosis
ALTGNMAVQQ

SEQ ID NO: 190725 - protein, 10 aa, Mycobacterium tuberculosis
LTGNMAVQQV

SEQ ID NO: 190726 - protein, 10 aa, Mycobacterium tuberculosis
TGNMAVQQVR

SEQ ID NO: 190727 - protein, 10 aa, Mycobacterium tuberculosis
MAVQQVRAGL

SEQ ID NO: 190728 - protein, 10 aa, Mycobacterium tuberculosis
AVQQVRAGLK

SEQ ID NO: 190729 - protein, 10 aa, Mycobacterium tuberculosis
QQVRAGLKAI

SEQ ID NO: 190730 - protein, 10 aa, Mycobacterium tuberculosis
QVRAGLKAIY

SEQ ID NO: 190731 - protein, 10 aa, Mycobacterium tuberculosis
VRAGLKAIYL

SEQ ID NO: 190732 - protein, 10 aa, Mycobacterium tuberculosis
KAIYLSGWQV

SEQ ID NO: 190733 - protein, 10 aa, Mycobacterium tuberculosis
AIYLSGWQVA

SEQ ID NO: 190734 - protein, 10 aa, Mycobacterium tuberculosis
YLSGWQVAGD

SEQ ID NO: 190735 - protein, 10 aa, Mycobacterium tuberculosis
GWQVAGDANL

SEQ ID NO: 190736 - protein, 10 aa, Mycobacterium tuberculosis
WQVAGDANLS

SEQ ID NO: 190737 - protein, 10 aa, Mycobacterium tuberculosis
NLSGHTYPDQ

SEQ ID NO: 190738 - protein, 10 aa, Mycobacterium tuberculosis
YPDQSLYPAN

SEQ ID NO: 190739 - protein, 10 aa, Mycobacterium tuberculosis
SLYPANSVPQ

SEQ ID NO: 190740 - protein, 10 aa, Mycobacterium tuberculosis
LYPANSVPQV

SEQ ID NO: 190741 - protein, 10 aa, Mycobacterium tuberculosis
YPANSVPQVV

SEQ ID NO: 190742 - protein, 10 aa, Mycobacterium tuberculosis
NSVPQVVRRI

SEQ ID NO: 190743 - protein, 10 aa, Mycobacterium tuberculosis
QVVRRINNAL

SEQ ID NO: 190744 - protein, 10 aa, Mycobacterium tuberculosis
RRINNALQRA

SEQ ID NO: 190745 - protein, 10 aa, Mycobacterium tuberculosis
ALQRADQIAK

SEQ ID NO: 190746 - protein, 10 aa, Mycobacterium tuberculosis
LQRADQIAKI

SEQ ID NO: 190747 - protein, 10 aa, Mycobacterium tuberculosis
TSVENWLAPI

SEQ ID NO: 190748 - protein, 10 aa, Mycobacterium tuberculosis
SVENWLAPIV

SEQ ID NO: 190749 - protein, 10 aa, Mycobacterium tuberculosis
VENWLAPIVA

SEQ ID NO: 190750 - protein, 10 aa, Mycobacterium tuberculosis
PIVADGEAGF

SEQ ID NO: 190751 - protein, 10 aa, Mycobacterium tuberculosis
EAGFGGALNV

SEQ ID NO: 190752 - protein, 10 aa, Mycobacterium tuberculosis
AGFGGALNVY

SEQ ID NO: 190753 - protein, 10 aa, Mycobacterium tuberculosis
FGGALNVYEL

SEQ ID NO: 190754 - protein, 10 aa, Mycobacterium tuberculosis
GALNVYELQK

SEQ ID NO: 190755 - protein, 10 aa, Mycobacterium tuberculosis
ALNVYELQKA

SEQ ID NO: 190756 - protein, 10 aa, Mycobacterium tuberculosis
NVYELQKALI

SEQ ID NO: 190757 - protein, 10 aa, Mycobacterium tuberculosis
YELQKALIAA

SEQ ID NO: 190758 - protein, 10 aa, Mycobacterium tuberculosis
LQKALIAAGV

SEQ ID NO: 190759 - protein, 10 aa, Mycobacterium tuberculosis
ALIAAGVAGS

SEQ ID NO: 190760 - protein, 10 aa, Mycobacterium tuberculosis
IAAGVAGSHW

SEQ ID NO: 190761 - protein, 10 aa, Mycobacterium tuberculosis
HLGGKVLIPT

SEQ ID NO: 190762 - protein, 10 aa, Mycobacterium tuberculosis
VLIPTQQHIR

SEQ ID NO: 190763 - protein, 10 aa, Mycobacterium tuberculosis
IPTQQHIRTL

SEQ ID NO: 190764 - protein, 10 aa, Mycobacterium tuberculosis
QQHIRTLTSA

SEQ ID NO: 190765 - protein, 10 aa, Mycobacterium tuberculosis
HIRTLTSARL

SEQ ID NO: 190766 - protein, 10 aa, Mycobacterium tuberculosis
LTSARLAADV

SEQ ID NO: 190767 - protein, 10 aa, Mycobacterium tuberculosis
LAADVADVPT

SEQ ID NO: 190768 - protein, 10 aa, Mycobacterium tuberculosis
AADVADVPTV

SEQ ID NO: 190769 - protein, 10 aa, Mycobacterium tuberculosis
DVADVPTVVI

SEQ ID NO: 190770 - protein, 10 aa, Mycobacterium tuberculosis
VVIARTDAEA

SEQ ID NO: 190771 - protein, 10 aa, Mycobacterium tuberculosis
RTDAEAATLI

SEQ ID NO: 190772 - protein, 10 aa, Mycobacterium tuberculosis
EAATLITSDV

SEQ ID NO: 190773 - protein, 10 aa, Mycobacterium tuberculosis
TLITSDVDER

SEQ ID NO: 190774 - protein, 10 aa, Mycobacterium tuberculosis
DVDERDQPFI

SEQ ID NO: 190775 - protein, 10 aa, Mycobacterium tuberculosis
GERTREGFYR

SEQ ID NO: 190776 - protein, 10 aa, Mycobacterium tuberculosis
RTREGFYRTK

SEQ ID NO: 190777 - protein, 10 aa, Mycobacterium tuberculosis
EGFYRTKNGI

SEQ ID NO: 190778 - protein, 10 aa, Mycobacterium tuberculosis
NGIEPCIARA

SEQ ID NO: 190779 - protein, 10 aa, Mycobacterium tuberculosis
EPCIARAKAY

SEQ ID NO: 190780 - protein, 10 aa, Mycobacterium tuberculosis
IARAKAYAPF

SEQ ID NO: 190781 - protein, 10 aa, Mycobacterium tuberculosis
KAYAPFADLI

SEQ ID NO: 190782 - protein, 10 aa, Mycobacterium tuberculosis
AYAPFADLIW

SEQ ID NO: 190783 - protein, 10 aa, Mycobacterium tuberculosis
YAPFADLIWM

SEQ ID NO: 190784 - protein, 10 aa, Mycobacterium tuberculosis
IWMETGTPDL

SEQ ID NO: 190785 - protein, 10 aa, Mycobacterium tuberculosis
ETGTPDLEAA

SEQ ID NO: 190786 - protein, 10 aa, Mycobacterium tuberculosis
TPDLEAARQF

SEQ ID NO: 190787 - protein, 10 aa, Mycobacterium tuberculosis
EAARQFSEAV

SEQ ID NO: 190788 - protein, 10 aa, Mycobacterium tuberculosis
AARQFSEAVK

SEQ ID NO: 190789 - protein, 10 aa, Mycobacterium tuberculosis
QFSEAVKAEY

SEQ ID NO: 190790 - protein, 10 aa, Mycobacterium tuberculosis
AEYPDQMLAY

SEQ ID NO: 190791 - protein, 10 aa, Mycobacterium tuberculosis
YPDQMLAYNC

SEQ ID NO: 190792 - protein, 10 aa, Mycobacterium tuberculosis
MLAYNCSPSF

SEQ ID NO: 190793 - protein, 10 aa, Mycobacterium tuberculosis
AYNCSPSFNW

SEQ ID NO: 190794 - protein, 10 aa, Mycobacterium tuberculosis
SPSFNWKKHL

SEQ ID NO: 190795 - protein, 10 aa, Mycobacterium tuberculosis
HLDDATIAKF

SEQ ID NO: 190796 - protein, 10 aa, Mycobacterium tuberculosis
DDATIAKFQK

SEQ ID NO: 190797 - protein, 10 aa, Mycobacterium tuberculosis
TIAKFQKELA

SEQ ID NO: 190798 - protein, 10 aa, Mycobacterium tuberculosis
FQKELAAMGF

SEQ ID NO: 190799 - protein, 10 aa, Mycobacterium tuberculosis
KELAAMGFKF

SEQ ID NO: 190800 - protein, 10 aa, Mycobacterium tuberculosis
ELAAMGFKFQ

SEQ ID NO: 190801 - protein, 10 aa, Mycobacterium tuberculosis
LAAMGFKFQF

SEQ ID NO: 190802 - protein, 10 aa, Mycobacterium tuberculosis
AAMGFKFQFI

SEQ ID NO: 190803 - protein, 10 aa, Mycobacterium tuberculosis
MGFKFQFITL

SEQ ID NO: 190804 - protein, 10 aa, Mycobacterium tuberculosis
KFQFITLAGF

SEQ ID NO: 190805 - protein, 10 aa, Mycobacterium tuberculosis
FITLAGFHAL

SEQ ID NO: 190806 - protein, 10 aa, Mycobacterium tuberculosis
TLAGFHALNY

SEQ ID NO: 190807 - protein, 10 aa, Mycobacterium tuberculosis
GFHALNYSMF

SEQ ID NO: 190808 - protein, 10 aa, Mycobacterium tuberculosis
HALNYSMFDL

SEQ ID NO: 190809 - protein, 10 aa, Mycobacterium tuberculosis
ALNYSMFDLA

SEQ ID NO: 190810 - protein, 10 aa, Mycobacterium tuberculosis
LNYSMFDLAY

SEQ ID NO: 190811 - protein, 10 aa, Mycobacterium tuberculosis
YSMFDLAYGY

SEQ ID NO: 190812 - protein, 10 aa, Mycobacterium tuberculosis
SMFDLAYGYA

SEQ ID NO: 190813 - protein, 10 aa, Mycobacterium tuberculosis
LAYGYAQNQM

SEQ ID NO: 190814 - protein, 10 aa, Mycobacterium tuberculosis
GYAQNQMSAY

SEQ ID NO: 190815 - protein, 10 aa, Mycobacterium tuberculosis
YAQNQMSAYV

SEQ ID NO: 190816 - protein, 10 aa, Mycobacterium tuberculosis
MSAYVELQER

SEQ ID NO: 190817 - protein, 10 aa, Mycobacterium tuberculosis
AYVELQEREF

SEQ ID NO: 190818 - protein, 10 aa, Mycobacterium tuberculosis
REFAAEERGY

SEQ ID NO: 190819 - protein, 10 aa, Mycobacterium tuberculosis
FAAEERGYTA

SEQ ID NO: 190820 - protein, 10 aa, Mycobacterium tuberculosis
RGYTATKHQR

SEQ ID NO: 190821 - protein, 10 aa, Mycobacterium tuberculosis
YTATKHQREV

SEQ ID NO: 190822 - protein, 10 aa, Mycobacterium tuberculosis
HQREVGAGYF

SEQ ID NO: 190823 - protein, 10 aa, Mycobacterium tuberculosis
EVGAGYFDRI

SEQ ID NO: 190824 - protein, 10 aa, Mycobacterium tuberculosis
GYFDRIATTV

SEQ ID NO: 190825 - protein, 10 aa, Mycobacterium tuberculosis
TTVDPNSSTT

SEQ ID NO: 190826 - protein, 10 aa, Mycobacterium tuberculosis
TVDPNSSTTA

SEQ ID NO: 190827 - protein, 10 aa, Mycobacterium tuberculosis
DPNSSTTALT

SEQ ID NO: 190828 - protein, 10 aa, Mycobacterium tuberculosis
ALTGSTEEGQ

SEQ ID NO: 190829 - protein, 11 aa, Mycobacterium tuberculosis
QIQQEWDTNPR

SEQ ID NO: 190830 - protein, 11 aa, Mycobacterium tuberculosis
IQQEWDTNPRW

SEQ ID NO: 190831 - protein, 11 aa, Mycobacterium tuberculosis
DTNPRWKDVTR

SEQ ID NO: 190832 - protein, 11 aa, Mycobacterium tuberculosis
NPRWKDVTRTY

SEQ ID NO: 190833 - protein, 11 aa, Mycobacterium tuberculosis
RWKDVTRTYSA

SEQ ID NO: 190834 - protein, 11 aa, Mycobacterium tuberculosis
DVTRTYSAEDV

SEQ ID NO: 190835 - protein, 11 aa, Mycobacterium tuberculosis
VTRTYSAEDVV

SEQ ID NO: 190836 - protein, 11 aa, Mycobacterium tuberculosis
RTYSAEDVVAL

SEQ ID NO: 190837 - protein, 11 aa, Mycobacterium tuberculosis
AEDVVALQGSV

SEQ ID NO: 190838 - protein, 11 aa, Mycobacterium tuberculosis
ALQGSVVEEHT

SEQ ID NO: 190839 - protein, 11 aa, Mycobacterium tuberculosis
LQGSVVEEHTL

SEQ ID NO: 190840 - protein, 11 aa, Mycobacterium tuberculosis
SVVEEHTLARR

SEQ ID NO: 190841 - protein, 11 aa, Mycobacterium tuberculosis
TLARRGAEVLW

SEQ ID NO: 190842 - protein, 11 aa, Mycobacterium tuberculosis
RRGAEVLWEQL

SEQ ID NO: 190843 - protein, 11 aa, Mycobacterium tuberculosis
AEVLWEQLHDL

SEQ ID NO: 190844 - protein, 11 aa, Mycobacterium tuberculosis
VLWEQLHDLEW

SEQ ID NO: 190845 - protein, 11 aa, Mycobacterium tuberculosis
QLHDLEWVNAL

SEQ ID NO: 190846 - protein, 11 aa, Mycobacterium tuberculosis
DLEWVNALGAL

SEQ ID NO: 190847 - protein, 11 aa, Mycobacterium tuberculosis
NALGALTGNMA

SEQ ID NO: 190848 - protein, 11 aa, Mycobacterium tuberculosis
ALGALTGNMAV

SEQ ID NO: 190849 - protein, 11 aa, Mycobacterium tuberculosis
ALTGNMAVQQV

SEQ ID NO: 190850 - protein, 11 aa, Mycobacterium tuberculosis
LTGNMAVQQVR

SEQ ID NO: 190851 - protein, 11 aa, Mycobacterium tuberculosis
NMAVQQVRAGL

SEQ ID NO: 190852 - protein, 11 aa, Mycobacterium tuberculosis
MAVQQVRAGLK

SEQ ID NO: 190853 - protein, 11 aa, Mycobacterium tuberculosis
VQQVRAGLKAI

SEQ ID NO: 190854 - protein, 11 aa, Mycobacterium tuberculosis
QQVRAGLKAIY

SEQ ID NO: 190855 - protein, 11 aa, Mycobacterium tuberculosis
QVRAGLKAIYL

SEQ ID NO: 190856 - protein, 11 aa, Mycobacterium tuberculosis
YLSGWQVAGDA

SEQ ID NO: 190857 - protein, 11 aa, Mycobacterium tuberculosis
WQVAGDANLSG

SEQ ID NO: 190858 - protein, 11 aa, Mycobacterium tuberculosis
NLSGHTYPDQS

SEQ ID NO: 190859 - protein, 11 aa, Mycobacterium tuberculosis
HTYPDQSLYPA

SEQ ID NO: 190860 - protein, 11 aa, Mycobacterium tuberculosis
YPDQSLYPANS

SEQ ID NO: 190861 - protein, 11 aa, Mycobacterium tuberculosis
SLYPANSVPQV

SEQ ID NO: 190862 - protein, 11 aa, Mycobacterium tuberculosis
LYPANSVPQVV

SEQ ID NO: 190863 - protein, 11 aa, Mycobacterium tuberculosis
YPANSVPQVVR

SEQ ID NO: 190864 - protein, 11 aa, Mycobacterium tuberculosis
PANSVPQVVRR

SEQ ID NO: 190865 - protein, 11 aa, Mycobacterium tuberculosis
VPQVVRRINNA

SEQ ID NO: 190866 - protein, 11 aa, Mycobacterium tuberculosis
VVRRINNALQR

SEQ ID NO: 190867 - protein, 11 aa, Mycobacterium tuberculosis
NALQRADQIAK

SEQ ID NO: 190868 - protein, 11 aa, Mycobacterium tuberculosis
ALQRADQIAKI

SEQ ID NO: 190869 - protein, 11 aa, Mycobacterium tuberculosis
QIAKIEGDTSV

SEQ ID NO: 190870 - protein, 11 aa, Mycobacterium tuberculosis
IEGDTSVENWL

SEQ ID NO: 190871 - protein, 11 aa, Mycobacterium tuberculosis
DTSVENWLAPI

SEQ ID NO: 190872 - protein, 11 aa, Mycobacterium tuberculosis
WLAPIVADGEA

SEQ ID NO: 190873 - protein, 11 aa, Mycobacterium tuberculosis
APIVADGEAGF

SEQ ID NO: 190874 - protein, 11 aa, Mycobacterium tuberculosis
GEAGFGGALNV

SEQ ID NO: 190875 - protein, 11 aa, Mycobacterium tuberculosis
EAGFGGALNVY

SEQ ID NO: 190876 - protein, 11 aa, Mycobacterium tuberculosis
GFGGALNVYEL

SEQ ID NO: 190877 - protein, 11 aa, Mycobacterium tuberculosis
ALNVYELQKAL

SEQ ID NO: 190878 - protein, 11 aa, Mycobacterium tuberculosis
NVYELQKALIA

SEQ ID NO: 190879 - protein, 11 aa, Mycobacterium tuberculosis
ELQKALIAAGV

SEQ ID NO: 190880 - protein, 11 aa, Mycobacterium tuberculosis
LQKALIAAGVA

SEQ ID NO: 190881 - protein, 11 aa, Mycobacterium tuberculosis
ALIAAGVAGSH

SEQ ID NO: 190882 - protein, 11 aa, Mycobacterium tuberculosis
LIAAGVAGSHW

SEQ ID NO: 190883 - protein, 11 aa, Mycobacterium tuberculosis
GVAGSHWEDQL

SEQ ID NO: 190884 - protein, 11 aa, Mycobacterium tuberculosis
QLASEKKCGHL

SEQ ID NO: 190885 - protein, 11 aa, Mycobacterium tuberculosis
HLGGKVLIPTQ

SEQ ID NO: 190886 - protein, 11 aa, Mycobacterium tuberculosis
KVLIPTQQHIR

SEQ ID NO: 190887 - protein, 11 aa, Mycobacterium tuberculosis
VLIPTQQHIRT

SEQ ID NO: 190888 - protein, 11 aa, Mycobacterium tuberculosis
LIPTQQHIRTL

SEQ ID NO: 190889 - protein, 11 aa, Mycobacterium tuberculosis
IPTQQHIRTLT

SEQ ID NO: 190890 - protein, 11 aa, Mycobacterium tuberculosis
TQQHIRTLTSA

SEQ ID NO: 190891 - protein, 11 aa, Mycobacterium tuberculosis
QQHIRTLTSAR

SEQ ID NO: 190892 - protein, 11 aa, Mycobacterium tuberculosis
QHIRTLTSARL

SEQ ID NO: 190893 - protein, 11 aa, Mycobacterium tuberculosis
TLTSARLAADV

SEQ ID NO: 190894 - protein, 11 aa, Mycobacterium tuberculosis
RLAADVADVPT

SEQ ID NO: 190895 - protein, 11 aa, Mycobacterium tuberculosis
LAADVADVPTV

SEQ ID NO: 190896 - protein, 11 aa, Mycobacterium tuberculosis
AADVADVPTVV

SEQ ID NO: 190897 - protein, 11 aa, Mycobacterium tuberculosis
DVADVPTVVIA

SEQ ID NO: 190898 - protein, 11 aa, Mycobacterium tuberculosis
VPTVVIARTDA

SEQ ID NO: 190899 - protein, 11 aa, Mycobacterium tuberculosis
TVVIARTDAEA

SEQ ID NO: 190900 - protein, 11 aa, Mycobacterium tuberculosis
VVIARTDAEAA

SEQ ID NO: 190901 - protein, 11 aa, Mycobacterium tuberculosis
IARTDAEAATL

SEQ ID NO: 190902 - protein, 11 aa, Mycobacterium tuberculosis
AEAATLITSDV

SEQ ID NO: 190903 - protein, 11 aa, Mycobacterium tuberculosis
ATLITSDVDER

SEQ ID NO: 190904 - protein, 11 aa, Mycobacterium tuberculosis
DQPFITGERTR

SEQ ID NO: 190905 - protein, 11 aa, Mycobacterium tuberculosis
ITGERTREGFY

SEQ ID NO: 190906 - protein, 11 aa, Mycobacterium tuberculosis
RTREGFYRTKN

SEQ ID NO: 190907 - protein, 11 aa, Mycobacterium tuberculosis
REGFYRTKNGI

SEQ ID NO: 190908 - protein, 11 aa, Mycobacterium tuberculosis
IEPCIARAKAY

SEQ ID NO: 190909 - protein, 11 aa, Mycobacterium tuberculosis
EPCIARAKAYA

SEQ ID NO: 190910 - protein, 11 aa, Mycobacterium tuberculosis
CIARAKAYAPF

SEQ ID NO: 190911 - protein, 11 aa, Mycobacterium tuberculosis
IARAKAYAPFA

SEQ ID NO: 190912 - protein, 11 aa, Mycobacterium tuberculosis
KAYAPFADLIW

SEQ ID NO: 190913 - protein, 11 aa, Mycobacterium tuberculosis
AYAPFADLIWM

SEQ ID NO: 190914 - protein, 11 aa, Mycobacterium tuberculosis
FADLIWMETGT

SEQ ID NO: 190915 - protein, 11 aa, Mycobacterium tuberculosis
LIWMETGTPDL

SEQ ID NO: 190916 - protein, 11 aa, Mycobacterium tuberculosis
WMETGTPDLEA

SEQ ID NO: 190917 - protein, 11 aa, Mycobacterium tuberculosis
ETGTPDLEAAR

SEQ ID NO: 190918 - protein, 11 aa, Mycobacterium tuberculosis
LEAARQFSEAV

SEQ ID NO: 190919 - protein, 11 aa, Mycobacterium tuberculosis
EAARQFSEAVK

SEQ ID NO: 190920 - protein, 11 aa, Mycobacterium tuberculosis
RQFSEAVKAEY

SEQ ID NO: 190921 - protein, 11 aa, Mycobacterium tuberculosis
EAVKAEYPDQM

SEQ ID NO: 190922 - protein, 11 aa, Mycobacterium tuberculosis
KAEYPDQMLAY

SEQ ID NO: 190923 - protein, 11 aa, Mycobacterium tuberculosis
YPDQMLAYNCS

SEQ ID NO: 190924 - protein, 11 aa, Mycobacterium tuberculosis
QMLAYNCSPSF

SEQ ID NO: 190925 - protein, 11 aa, Mycobacterium tuberculosis
LAYNCSPSFNW

SEQ ID NO: 190926 - protein, 11 aa, Mycobacterium tuberculosis
AYNCSPSFNWK

SEQ ID NO: 190927 - protein, 11 aa, Mycobacterium tuberculosis
YNCSPSFNWKK

SEQ ID NO: 190928 - protein, 11 aa, Mycobacterium tuberculosis
KKHLDDATIAK

SEQ ID NO: 190929 - protein, 11 aa, Mycobacterium tuberculosis
KHLDDATIAKF

SEQ ID NO: 190930 - protein, 11 aa, Mycobacterium tuberculosis
HLDDATIAKFQ

SEQ ID NO: 190931 - protein, 11 aa, Mycobacterium tuberculosis
ATIAKFQKELA

SEQ ID NO: 190932 - protein, 11 aa, Mycobacterium tuberculosis
TIAKFQKELAA

SEQ ID NO: 190933 - protein, 11 aa, Mycobacterium tuberculosis
IAKFQKELAAM

SEQ ID NO: 190934 - protein, 11 aa, Mycobacterium tuberculosis
KFQKELAAMGF

SEQ ID NO: 190935 - protein, 11 aa, Mycobacterium tuberculosis
ELAAMGFKFQF

SEQ ID NO: 190936 - protein, 11 aa, Mycobacterium tuberculosis
LAAMGFKFQFI

SEQ ID NO: 190937 - protein, 11 aa, Mycobacterium tuberculosis
AMGFKFQFITL

SEQ ID NO: 190938 - protein, 11 aa, Mycobacterium tuberculosis
MGFKFQFITLA

SEQ ID NO: 190939 - protein, 11 aa, Mycobacterium tuberculosis
FKFQFITLAGF

SEQ ID NO: 190940 - protein, 11 aa, Mycobacterium tuberculosis
KFQFITLAGFH

SEQ ID NO: 190941 - protein, 11 aa, Mycobacterium tuberculosis
FQFITLAGFHA

SEQ ID NO: 190942 - protein, 11 aa, Mycobacterium tuberculosis
QFITLAGFHAL

SEQ ID NO: 190943 - protein, 11 aa, Mycobacterium tuberculosis
ITLAGFHALNY

SEQ ID NO: 190944 - protein, 11 aa, Mycobacterium tuberculosis
TLAGFHALNYS

SEQ ID NO: 190945 - protein, 11 aa, Mycobacterium tuberculosis
LAGFHALNYSM

SEQ ID NO: 190946 - protein, 11 aa, Mycobacterium tuberculosis
FHALNYSMFDL

SEQ ID NO: 190947 - protein, 11 aa, Mycobacterium tuberculosis
HALNYSMFDLA

SEQ ID NO: 190948 - protein, 11 aa, Mycobacterium tuberculosis
ALNYSMFDLAY

SEQ ID NO: 190949 - protein, 11 aa, Mycobacterium tuberculosis
NYSMFDLAYGY

SEQ ID NO: 190950 - protein, 11 aa, Mycobacterium tuberculosis
YSMFDLAYGYA

SEQ ID NO: 190951 - protein, 11 aa, Mycobacterium tuberculosis
SMFDLAYGYAQ

SEQ ID NO: 190952 - protein, 11 aa, Mycobacterium tuberculosis
DLAYGYAQNQM

SEQ ID NO: 190953 - protein, 11 aa, Mycobacterium tuberculosis
YGYAQNQMSAY

SEQ ID NO: 190954 - protein, 11 aa, Mycobacterium tuberculosis
GYAQNQMSAYV

SEQ ID NO: 190955 - protein, 11 aa, Mycobacterium tuberculosis
AQNQMSAYVEL

SEQ ID NO: 190956 - protein, 11 aa, Mycobacterium tuberculosis
QMSAYVELQER

SEQ ID NO: 190957 - protein, 11 aa, Mycobacterium tuberculosis
SAYVELQEREF

SEQ ID NO: 190958 - protein, 11 aa, Mycobacterium tuberculosis
REFAAEERGYT

SEQ ID NO: 190959 - protein, 11 aa, Mycobacterium tuberculosis
FAAEERGYTAT

SEQ ID NO: 190960 - protein, 11 aa, Mycobacterium tuberculosis
AAEERGYTATK

SEQ ID NO: 190961 - protein, 11 aa, Mycobacterium tuberculosis
KHQREVGAGYF

SEQ ID NO: 190962 - protein, 11 aa, Mycobacterium tuberculosis
REVGAGYFDRI

SEQ ID NO: 190963 - protein, 11 aa, Mycobacterium tuberculosis
TTVDPNSSTTA

SEQ ID NO: 190964 - protein, 11 aa, Mycobacterium tuberculosis
TVDPNSSTTAL

SEQ ID NO: 190965 - protein, 13 aa, Mycobacterium tuberculosis
MSVVGTPKSAEQI

SEQ ID NO: 190966 - protein, 13 aa, Mycobacterium tuberculosis
SVVGTPKSAEQIQ

SEQ ID NO: 190967 - protein, 13 aa, Mycobacterium tuberculosis
VVGTPKSAEQIQQ

SEQ ID NO: 190968 - protein, 13 aa, Mycobacterium tuberculosis
VGTPKSAEQIQQE

SEQ ID NO: 190969 - protein, 13 aa, Mycobacterium tuberculosis
GTPKSAEQIQQEW

SEQ ID NO: 190970 - protein, 13 aa, Mycobacterium tuberculosis
TPKSAEQIQQEWD

SEQ ID NO: 190971 - protein, 13 aa, Mycobacterium tuberculosis
PKSAEQIQQEWDT

SEQ ID NO: 190972 - protein, 13 aa, Mycobacterium tuberculosis
KSAEQIQQEWDTN

SEQ ID NO: 190973 - protein, 13 aa, Mycobacterium tuberculosis
SAEQIQQEWDTNP

SEQ ID NO: 190974 - protein, 13 aa, Mycobacterium tuberculosis
AEQIQQEWDTNPR

SEQ ID NO: 190975 - protein, 13 aa, Mycobacterium tuberculosis
EQIQQEWDTNPRW

SEQ ID NO: 190976 - protein, 13 aa, Mycobacterium tuberculosis
QIQQEWDTNPRWK

SEQ ID NO: 190977 - protein, 13 aa, Mycobacterium tuberculosis
IQQEWDTNPRWKD

SEQ ID NO: 190978 - protein, 13 aa, Mycobacterium tuberculosis
QQEWDTNPRWKDV

SEQ ID NO: 190979 - protein, 13 aa, Mycobacterium tuberculosis
QEWDTNPRWKDVT

SEQ ID NO: 190980 - protein, 13 aa, Mycobacterium tuberculosis
EWDTNPRWKDVTR

SEQ ID NO: 190981 - protein, 13 aa, Mycobacterium tuberculosis
WDTNPRWKDVTRT

SEQ ID NO: 190982 - protein, 13 aa, Mycobacterium tuberculosis
DTNPRWKDVTRTY

SEQ ID NO: 190983 - protein, 13 aa, Mycobacterium tuberculosis
TNPRWKDVTRTYS

SEQ ID NO: 190984 - protein, 13 aa, Mycobacterium tuberculosis
NPRWKDVTRTYSA

SEQ ID NO: 190985 - protein, 13 aa, Mycobacterium tuberculosis
PRWKDVTRTYSAE

SEQ ID NO: 190986 - protein, 13 aa, Mycobacterium tuberculosis
RWKDVTRTYSAED

SEQ ID NO: 190987 - protein, 13 aa, Mycobacterium tuberculosis
WKDVTRTYSAEDV

SEQ ID NO: 190988 - protein, 13 aa, Mycobacterium tuberculosis
KDVTRTYSAEDVV

SEQ ID NO: 190989 - protein, 13 aa, Mycobacterium tuberculosis
DVTRTYSAEDVVA

SEQ ID NO: 190990 - protein, 13 aa, Mycobacterium tuberculosis
VTRTYSAEDVVAL

SEQ ID NO: 190991 - protein, 13 aa, Mycobacterium tuberculosis
TRTYSAEDVVALQ

SEQ ID NO: 190992 - protein, 13 aa, Mycobacterium tuberculosis
RTYSAEDVVALQG

SEQ ID NO: 190993 - protein, 13 aa, Mycobacterium tuberculosis
TYSAEDVVALQGS

SEQ ID NO: 190994 - protein, 13 aa, Mycobacterium tuberculosis
YSAEDVVALQGSV

SEQ ID NO: 190995 - protein, 13 aa, Mycobacterium tuberculosis
SAEDVVALQGSVV

SEQ ID NO: 190996 - protein, 13 aa, Mycobacterium tuberculosis
AEDVVALQGSVVE

SEQ ID NO: 190997 - protein, 13 aa, Mycobacterium tuberculosis
EDVVALQGSVVEE

SEQ ID NO: 190998 - protein, 13 aa, Mycobacterium tuberculosis
DVVALQGSVVEEH

SEQ ID NO: 190999 - protein, 13 aa, Mycobacterium tuberculosis
VVALQGSVVEEHT

SEQ ID NO: 191000 - protein, 13 aa, Mycobacterium tuberculosis
VALQGSVVEEHTL

SEQ ID NO: 191001 - protein, 13 aa, Mycobacterium tuberculosis
ALQGSVVEEHTLA

SEQ ID NO: 191002 - protein, 13 aa, Mycobacterium tuberculosis
LQGSVVEEHTLAR

SEQ ID NO: 191003 - protein, 13 aa, Mycobacterium tuberculosis
QGSVVEEHTLARR

SEQ ID NO: 191004 - protein, 13 aa, Mycobacterium tuberculosis
GSVVEEHTLARRG

SEQ ID NO: 191005 - protein, 13 aa, Mycobacterium tuberculosis
SVVEEHTLARRGA

SEQ ID NO: 191006 - protein, 13 aa, Mycobacterium tuberculosis
VVEEHTLARRGAE

SEQ ID NO: 191007 - protein, 13 aa, Mycobacterium tuberculosis
VEEHTLARRGAEV

SEQ ID NO: 191008 - protein, 13 aa, Mycobacterium tuberculosis
EEHTLARRGAEVL

SEQ ID NO: 191009 - protein, 13 aa, Mycobacterium tuberculosis
EHTLARRGAEVLW

SEQ ID NO: 191010 - protein, 13 aa, Mycobacterium tuberculosis
HTLARRGAEVLWE

SEQ ID NO: 191011 - protein, 13 aa, Mycobacterium tuberculosis
TLARRGAEVLWEQ

SEQ ID NO: 191012 - protein, 13 aa, Mycobacterium tuberculosis
LARRGAEVLWEQL

SEQ ID NO: 191013 - protein, 13 aa, Mycobacterium tuberculosis
ARRGAEVLWEQLH

SEQ ID NO: 191014 - protein, 13 aa, Mycobacterium tuberculosis
RRGAEVLWEQLHD

SEQ ID NO: 191015 - protein, 13 aa, Mycobacterium tuberculosis
RGAEVLWEQLHDL

SEQ ID NO: 191016 - protein, 13 aa, Mycobacterium tuberculosis
GAEVLWEQLHDLE

SEQ ID NO: 191017 - protein, 13 aa, Mycobacterium tuberculosis
AEVLWEQLHDLEW

SEQ ID NO: 191018 - protein, 13 aa, Mycobacterium tuberculosis
EVLWEQLHDLEWV

SEQ ID NO: 191019 - protein, 13 aa, Mycobacterium tuberculosis
VLWEQLHDLEWVN

SEQ ID NO: 191020 - protein, 13 aa, Mycobacterium tuberculosis
LWEQLHDLEWVNA

SEQ ID NO: 191021 - protein, 13 aa, Mycobacterium tuberculosis
WEQLHDLEWVNAL

SEQ ID NO: 191022 - protein, 13 aa, Mycobacterium tuberculosis
EQLHDLEWVNALG

SEQ ID NO: 191023 - protein, 13 aa, Mycobacterium tuberculosis
QLHDLEWVNALGA

SEQ ID NO: 191024 - protein, 13 aa, Mycobacterium tuberculosis
LHDLEWVNALGAL

SEQ ID NO: 191025 - protein, 13 aa, Mycobacterium tuberculosis
HDLEWVNALGALT

SEQ ID NO: 191026 - protein, 13 aa, Mycobacterium tuberculosis
DLEWVNALGALTG

SEQ ID NO: 191027 - protein, 13 aa, Mycobacterium tuberculosis
LEWVNALGALTGN

SEQ ID NO: 191028 - protein, 13 aa, Mycobacterium tuberculosis
EWVNALGALTGNM

SEQ ID NO: 191029 - protein, 13 aa, Mycobacterium tuberculosis
WVNALGALTGNMA

SEQ ID NO: 191030 - protein, 13 aa, Mycobacterium tuberculosis
VNALGALTGNMAV

SEQ ID NO: 191031 - protein, 13 aa, Mycobacterium tuberculosis
NALGALTGNMAVQ

SEQ ID NO: 191032 - protein, 13 aa, Mycobacterium tuberculosis
ALGALTGNMAVQQ

SEQ ID NO: 191033 - protein, 13 aa, Mycobacterium tuberculosis
LGALTGNMAVQQV

SEQ ID NO: 191034 - protein, 13 aa, Mycobacterium tuberculosis
GALTGNMAVQQVR

SEQ ID NO: 191035 - protein, 13 aa, Mycobacterium tuberculosis
ALTGNMAVQQVRA

SEQ ID NO: 191036 - protein, 13 aa, Mycobacterium tuberculosis
LTGNMAVQQVRAG

SEQ ID NO: 191037 - protein, 13 aa, Mycobacterium tuberculosis
TGNMAVQQVRAGL

SEQ ID NO: 191038 - protein, 13 aa, Mycobacterium tuberculosis
GNMAVQQVRAGLK

SEQ ID NO: 191039 - protein, 13 aa, Mycobacterium tuberculosis
NMAVQQVRAGLKA

SEQ ID NO: 191040 - protein, 13 aa, Mycobacterium tuberculosis
MAVQQVRAGLKAI

SEQ ID NO: 191041 - protein, 13 aa, Mycobacterium tuberculosis
AVQQVRAGLKAIY

SEQ ID NO: 191042 - protein, 13 aa, Mycobacterium tuberculosis
VQQVRAGLKAIYL

SEQ ID NO: 191043 - protein, 13 aa, Mycobacterium tuberculosis
QQVRAGLKAIYLS

SEQ ID NO: 191044 - protein, 13 aa, Mycobacterium tuberculosis
QVRAGLKAIYLSG

SEQ ID NO: 191045 - protein, 13 aa, Mycobacterium tuberculosis
VRAGLKAIYLSGW

SEQ ID NO: 191046 - protein, 13 aa, Mycobacterium tuberculosis
RAGLKAIYLSGWQ

SEQ ID NO: 191047 - protein, 13 aa, Mycobacterium tuberculosis
AGLKAIYLSGWQV

SEQ ID NO: 191048 - protein, 13 aa, Mycobacterium tuberculosis
GLKAIYLSGWQVA

SEQ ID NO: 191049 - protein, 13 aa, Mycobacterium tuberculosis
LKAIYLSGWQVAG

SEQ ID NO: 191050 - protein, 13 aa, Mycobacterium tuberculosis
KAIYLSGWQVAGD

SEQ ID NO: 191051 - protein, 13 aa, Mycobacterium tuberculosis
AIYLSGWQVAGDA

SEQ ID NO: 191052 - protein, 13 aa, Mycobacterium tuberculosis
IYLSGWQVAGDAN

SEQ ID NO: 191053 - protein, 13 aa, Mycobacterium tuberculosis
YLSGWQVAGDANL

SEQ ID NO: 191054 - protein, 13 aa, Mycobacterium tuberculosis
LSGWQVAGDANLS

SEQ ID NO: 191055 - protein, 13 aa, Mycobacterium tuberculosis
SGWQVAGDANLSG

SEQ ID NO: 191056 - protein, 13 aa, Mycobacterium tuberculosis
GWQVAGDANLSGH

SEQ ID NO: 191057 - protein, 13 aa, Mycobacterium tuberculosis
WQVAGDANLSGHT

SEQ ID NO: 191058 - protein, 13 aa, Mycobacterium tuberculosis
QVAGDANLSGHTY

SEQ ID NO: 191059 - protein, 13 aa, Mycobacterium tuberculosis
VAGDANLSGHTYP

SEQ ID NO: 191060 - protein, 13 aa, Mycobacterium tuberculosis
AGDANLSGHTYPD

SEQ ID NO: 191061 - protein, 13 aa, Mycobacterium tuberculosis
GDANLSGHTYPDQ

SEQ ID NO: 191062 - protein, 13 aa, Mycobacterium tuberculosis
DANLSGHTYPDQS

SEQ ID NO: 191063 - protein, 13 aa, Mycobacterium tuberculosis
ANLSGHTYPDQSL

SEQ ID NO: 191064 - protein, 13 aa, Mycobacterium tuberculosis
NLSGHTYPDQSLY

SEQ ID NO: 191065 - protein, 13 aa, Mycobacterium tuberculosis
LSGHTYPDQSLYP

SEQ ID NO: 191066 - protein, 13 aa, Mycobacterium tuberculosis
SGHTYPDQSLYPA

SEQ ID NO: 191067 - protein, 13 aa, Mycobacterium tuberculosis
GHTYPDQSLYPAN

SEQ ID NO: 191068 - protein, 13 aa, Mycobacterium tuberculosis
HTYPDQSLYPANS

SEQ ID NO: 191069 - protein, 13 aa, Mycobacterium tuberculosis
TYPDQSLYPANSV

SEQ ID NO: 191070 - protein, 13 aa, Mycobacterium tuberculosis
YPDQSLYPANSVP

SEQ ID NO: 191071 - protein, 13 aa, Mycobacterium tuberculosis
PDQSLYPANSVPQ

SEQ ID NO: 191072 - protein, 13 aa, Mycobacterium tuberculosis
DQSLYPANSVPQV

SEQ ID NO: 191073 - protein, 13 aa, Mycobacterium tuberculosis
QSLYPANSVPQVV

SEQ ID NO: 191074 - protein, 13 aa, Mycobacterium tuberculosis
SLYPANSVPQVVR

SEQ ID NO: 191075 - protein, 13 aa, Mycobacterium tuberculosis
LYPANSVPQVVRR

SEQ ID NO: 191076 - protein, 13 aa, Mycobacterium tuberculosis
YPANSVPQVVRRI

SEQ ID NO: 191077 - protein, 13 aa, Mycobacterium tuberculosis
PANSVPQVVRRIN

SEQ ID NO: 191078 - protein, 13 aa, Mycobacterium tuberculosis
ANSVPQVVRRINN

SEQ ID NO: 191079 - protein, 13 aa, Mycobacterium tuberculosis
NSVPQVVRRINNA

SEQ ID NO: 191080 - protein, 13 aa, Mycobacterium tuberculosis
SVPQVVRRINNAL

SEQ ID NO: 191081 - protein, 13 aa, Mycobacterium tuberculosis
VPQVVRRINNALQ

SEQ ID NO: 191082 - protein, 13 aa, Mycobacterium tuberculosis
PQVVRRINNALQR

SEQ ID NO: 191083 - protein, 13 aa, Mycobacterium tuberculosis
QVVRRINNALQRA

SEQ ID NO: 191084 - protein, 13 aa, Mycobacterium tuberculosis
VVRRINNALQRAD

SEQ ID NO: 191085 - protein, 13 aa, Mycobacterium tuberculosis
VRRINNALQRADQ

SEQ ID NO: 191086 - protein, 13 aa, Mycobacterium tuberculosis
RRINNALQRADQI

SEQ ID NO: 191087 - protein, 13 aa, Mycobacterium tuberculosis
RINNALQRADQIA

SEQ ID NO: 191088 - protein, 13 aa, Mycobacterium tuberculosis
INNALQRADQIAK

SEQ ID NO: 191089 - protein, 13 aa, Mycobacterium tuberculosis
NNALQRADQIAKI

SEQ ID NO: 191090 - protein, 13 aa, Mycobacterium tuberculosis
NALQRADQIAKIE

SEQ ID NO: 191091 - protein, 13 aa, Mycobacterium tuberculosis
ALQRADQIAKIEG

SEQ ID NO: 191092 - protein, 13 aa, Mycobacterium tuberculosis
LQRADQIAKIEGD

SEQ ID NO: 191093 - protein, 13 aa, Mycobacterium tuberculosis
QRADQIAKIEGDT

SEQ ID NO: 191094 - protein, 13 aa, Mycobacterium tuberculosis
RADQIAKIEGDTS

SEQ ID NO: 191095 - protein, 13 aa, Mycobacterium tuberculosis
ADQIAKIEGDTSV

SEQ ID NO: 191096 - protein, 13 aa, Mycobacterium tuberculosis
DQIAKIEGDTSVE

SEQ ID NO: 191097 - protein, 13 aa, Mycobacterium tuberculosis
QIAKIEGDTSVEN

SEQ ID NO: 191098 - protein, 13 aa, Mycobacterium tuberculosis
IAKIEGDTSVENW

SEQ ID NO: 191099 - protein, 13 aa, Mycobacterium tuberculosis
AKIEGDTSVENWL

SEQ ID NO: 191100 - protein, 13 aa, Mycobacterium tuberculosis
KIEGDTSVENWLA

SEQ ID NO: 191101 - protein, 13 aa, Mycobacterium tuberculosis
IEGDTSVENWLAP

SEQ ID NO: 191102 - protein, 13 aa, Mycobacterium tuberculosis
EGDTSVENWLAPI

SEQ ID NO: 191103 - protein, 13 aa, Mycobacterium tuberculosis
GDTSVENWLAPIV

SEQ ID NO: 191104 - protein, 13 aa, Mycobacterium tuberculosis
DTSVENWLAPIVA

SEQ ID NO: 191105 - protein, 13 aa, Mycobacterium tuberculosis
TSVENWLAPIVAD

SEQ ID NO: 191106 - protein, 13 aa, Mycobacterium tuberculosis
SVENWLAPIVADG

SEQ ID NO: 191107 - protein, 13 aa, Mycobacterium tuberculosis
VENWLAPIVADGE

SEQ ID NO: 191108 - protein, 13 aa, Mycobacterium tuberculosis
ENWLAPIVADGEA

SEQ ID NO: 191109 - protein, 13 aa, Mycobacterium tuberculosis
NWLAPIVADGEAG

SEQ ID NO: 191110 - protein, 13 aa, Mycobacterium tuberculosis
WLAPIVADGEAGF

SEQ ID NO: 191111 - protein, 13 aa, Mycobacterium tuberculosis
LAPIVADGEAGFG

SEQ ID NO: 191112 - protein, 13 aa, Mycobacterium tuberculosis
APIVADGEAGFGG

SEQ ID NO: 191113 - protein, 13 aa, Mycobacterium tuberculosis
PIVADGEAGFGGA

SEQ ID NO: 191114 - protein, 13 aa, Mycobacterium tuberculosis
IVADGEAGFGGAL

SEQ ID NO: 191115 - protein, 13 aa, Mycobacterium tuberculosis
VADGEAGFGGALN

SEQ ID NO: 191116 - protein, 13 aa, Mycobacterium tuberculosis
ADGEAGFGGALNV

SEQ ID NO: 191117 - protein, 13 aa, Mycobacterium tuberculosis
DGEAGFGGALNVY

SEQ ID NO: 191118 - protein, 13 aa, Mycobacterium tuberculosis
GEAGFGGALNVYE

SEQ ID NO: 191119 - protein, 13 aa, Mycobacterium tuberculosis
EAGFGGALNVYEL

SEQ ID NO: 191120 - protein, 13 aa, Mycobacterium tuberculosis
AGFGGALNVYELQ

SEQ ID NO: 191121 - protein, 13 aa, Mycobacterium tuberculosis
GFGGALNVYELQK

SEQ ID NO: 191122 - protein, 13 aa, Mycobacterium tuberculosis
FGGALNVYELQKA

SEQ ID NO: 191123 - protein, 13 aa, Mycobacterium tuberculosis
GGALNVYELQKAL

SEQ ID NO: 191124 - protein, 13 aa, Mycobacterium tuberculosis
GALNVYELQKALI

SEQ ID NO: 191125 - protein, 13 aa, Mycobacterium tuberculosis
ALNVYELQKALIA

SEQ ID NO: 191126 - protein, 13 aa, Mycobacterium tuberculosis
LNVYELQKALIAA

SEQ ID NO: 191127 - protein, 13 aa, Mycobacterium tuberculosis
NVYELQKALIAAG

SEQ ID NO: 191128 - protein, 13 aa, Mycobacterium tuberculosis
VYELQKALIAAGV

SEQ ID NO: 191129 - protein, 13 aa, Mycobacterium tuberculosis
YELQKALIAAGVA

SEQ ID NO: 191130 - protein, 13 aa, Mycobacterium tuberculosis
ELQKALIAAGVAG

SEQ ID NO: 191131 - protein, 13 aa, Mycobacterium tuberculosis
LQKALIAAGVAGS

SEQ ID NO: 191132 - protein, 13 aa, Mycobacterium tuberculosis
QKALIAAGVAGSH

SEQ ID NO: 191133 - protein, 13 aa, Mycobacterium tuberculosis
KALIAAGVAGSHW

SEQ ID NO: 191134 - protein, 13 aa, Mycobacterium tuberculosis
ALIAAGVAGSHWE

SEQ ID NO: 191135 - protein, 13 aa, Mycobacterium tuberculosis
LIAAGVAGSHWED

SEQ ID NO: 191136 - protein, 13 aa, Mycobacterium tuberculosis
IAAGVAGSHWEDQ

SEQ ID NO: 191137 - protein, 13 aa, Mycobacterium tuberculosis
AAGVAGSHWEDQL

SEQ ID NO: 191138 - protein, 13 aa, Mycobacterium tuberculosis
AGVAGSHWEDQLA

SEQ ID NO: 191139 - protein, 13 aa, Mycobacterium tuberculosis
GVAGSHWEDQLAS

SEQ ID NO: 191140 - protein, 13 aa, Mycobacterium tuberculosis
VAGSHWEDQLASE

SEQ ID NO: 191141 - protein, 13 aa, Mycobacterium tuberculosis
AGSHWEDQLASEK

SEQ ID NO: 191142 - protein, 13 aa, Mycobacterium tuberculosis
GSHWEDQLASEKK

SEQ ID NO: 191143 - protein, 13 aa, Mycobacterium tuberculosis
SHWEDQLASEKKC

SEQ ID NO: 191144 - protein, 13 aa, Mycobacterium tuberculosis
HWEDQLASEKKCG

SEQ ID NO: 191145 - protein, 13 aa, Mycobacterium tuberculosis
WEDQLASEKKCGH

SEQ ID NO: 191146 - protein, 13 aa, Mycobacterium tuberculosis
EDQLASEKKCGHL

SEQ ID NO: 191147 - protein, 13 aa, Mycobacterium tuberculosis
DQLASEKKCGHLG

SEQ ID NO: 191148 - protein, 13 aa, Mycobacterium tuberculosis
QLASEKKCGHLGG

SEQ ID NO: 191149 - protein, 13 aa, Mycobacterium tuberculosis
LASEKKCGHLGGK

SEQ ID NO: 191150 - protein, 13 aa, Mycobacterium tuberculosis
ASEKKCGHLGGKV

SEQ ID NO: 191151 - protein, 13 aa, Mycobacterium tuberculosis
SEKKCGHLGGKVL

SEQ ID NO: 191152 - protein, 13 aa, Mycobacterium tuberculosis
EKKCGHLGGKVLI

SEQ ID NO: 191153 - protein, 13 aa, Mycobacterium tuberculosis
KKCGHLGGKVLIP

SEQ ID NO: 191154 - protein, 13 aa, Mycobacterium tuberculosis
KCGHLGGKVLIPT

SEQ ID NO: 191155 - protein, 13 aa, Mycobacterium tuberculosis
CGHLGGKVLIPTQ

SEQ ID NO: 191156 - protein, 13 aa, Mycobacterium tuberculosis
GHLGGKVLIPTQQ

SEQ ID NO: 191157 - protein, 13 aa, Mycobacterium tuberculosis
HLGGKVLIPTQQH

SEQ ID NO: 191158 - protein, 13 aa, Mycobacterium tuberculosis
LGGKVLIPTQQHI

SEQ ID NO: 191159 - protein, 13 aa, Mycobacterium tuberculosis
GGKVLIPTQQHIR

SEQ ID NO: 191160 - protein, 13 aa, Mycobacterium tuberculosis
GKVLIPTQQHIRT

SEQ ID NO: 191161 - protein, 13 aa, Mycobacterium tuberculosis
KVLIPTQQHIRTL

SEQ ID NO: 191162 - protein, 13 aa, Mycobacterium tuberculosis
VLIPTQQHIRTLT

SEQ ID NO: 191163 - protein, 13 aa, Mycobacterium tuberculosis
LIPTQQHIRTLTS

SEQ ID NO: 191164 - protein, 13 aa, Mycobacterium tuberculosis
IPTQQHIRTLTSA

SEQ ID NO: 191165 - protein, 13 aa, Mycobacterium tuberculosis
PTQQHIRTLTSAR

SEQ ID NO: 191166 - protein, 13 aa, Mycobacterium tuberculosis
TQQHIRTLTSARL

SEQ ID NO: 191167 - protein, 13 aa, Mycobacterium tuberculosis
QQHIRTLTSARLA

SEQ ID NO: 191168 - protein, 13 aa, Mycobacterium tuberculosis
QHIRTLTSARLAA

SEQ ID NO: 191169 - protein, 13 aa, Mycobacterium tuberculosis
HIRTLTSARLAAD

SEQ ID NO: 191170 - protein, 13 aa, Mycobacterium tuberculosis
IRTLTSARLAADV

SEQ ID NO: 191171 - protein, 13 aa, Mycobacterium tuberculosis
RTLTSARLAADVA

SEQ ID NO: 191172 - protein, 13 aa, Mycobacterium tuberculosis
TLTSARLAADVAD

SEQ ID NO: 191173 - protein, 13 aa, Mycobacterium tuberculosis
LTSARLAADVADV

SEQ ID NO: 191174 - protein, 13 aa, Mycobacterium tuberculosis
TSARLAADVADVP

SEQ ID NO: 191175 - protein, 13 aa, Mycobacterium tuberculosis
SARLAADVADVPT

SEQ ID NO: 191176 - protein, 13 aa, Mycobacterium tuberculosis
ARLAADVADVPTV

SEQ ID NO: 191177 - protein, 13 aa, Mycobacterium tuberculosis
RLAADVADVPTVV

SEQ ID NO: 191178 - protein, 13 aa, Mycobacterium tuberculosis
LAADVADVPTVVI

SEQ ID NO: 191179 - protein, 13 aa, Mycobacterium tuberculosis
AADVADVPTVVIA

SEQ ID NO: 191180 - protein, 13 aa, Mycobacterium tuberculosis
ADVADVPTVVIAR

SEQ ID NO: 191181 - protein, 13 aa, Mycobacterium tuberculosis
DVADVPTVVIART

SEQ ID NO: 191182 - protein, 13 aa, Mycobacterium tuberculosis
VADVPTVVIARTD

SEQ ID NO: 191183 - protein, 13 aa, Mycobacterium tuberculosis
ADVPTVVIARTDA

SEQ ID NO: 191184 - protein, 13 aa, Mycobacterium tuberculosis
DVPTVVIARTDAE

SEQ ID NO: 191185 - protein, 13 aa, Mycobacterium tuberculosis
VPTVVIARTDAEA

SEQ ID NO: 191186 - protein, 13 aa, Mycobacterium tuberculosis
PTVVIARTDAEAA

SEQ ID NO: 191187 - protein, 13 aa, Mycobacterium tuberculosis
TVVIARTDAEAAT

SEQ ID NO: 191188 - protein, 13 aa, Mycobacterium tuberculosis
VVIARTDAEAATL

SEQ ID NO: 191189 - protein, 13 aa, Mycobacterium tuberculosis
VIARTDAEAATLI

SEQ ID NO: 191190 - protein, 13 aa, Mycobacterium tuberculosis
IARTDAEAATLIT

SEQ ID NO: 191191 - protein, 13 aa, Mycobacterium tuberculosis
ARTDAEAATLITS

SEQ ID NO: 191192 - protein, 13 aa, Mycobacterium tuberculosis
RTDAEAATLITSD

SEQ ID NO: 191193 - protein, 13 aa, Mycobacterium tuberculosis
TDAEAATLITSDV

SEQ ID NO: 191194 - protein, 13 aa, Mycobacterium tuberculosis
DAEAATLITSDVD

SEQ ID NO: 191195 - protein, 13 aa, Mycobacterium tuberculosis
AEAATLITSDVDE

SEQ ID NO: 191196 - protein, 13 aa, Mycobacterium tuberculosis
EAATLITSDVDER

SEQ ID NO: 191197 - protein, 13 aa, Mycobacterium tuberculosis
AATLITSDVDERD

SEQ ID NO: 191198 - protein, 13 aa, Mycobacterium tuberculosis
ATLITSDVDERDQ

SEQ ID NO: 191199 - protein, 13 aa, Mycobacterium tuberculosis
TLITSDVDERDQP

SEQ ID NO: 191200 - protein, 13 aa, Mycobacterium tuberculosis
LITSDVDERDQPF

SEQ ID NO: 191201 - protein, 13 aa, Mycobacterium tuberculosis
ITSDVDERDQPFI

SEQ ID NO: 191202 - protein, 13 aa, Mycobacterium tuberculosis
TSDVDERDQPFIT

SEQ ID NO: 191203 - protein, 13 aa, Mycobacterium tuberculosis
SDVDERDQPFITG

SEQ ID NO: 191204 - protein, 13 aa, Mycobacterium tuberculosis
DVDERDQPFITGE

SEQ ID NO: 191205 - protein, 13 aa, Mycobacterium tuberculosis
VDERDQPFITGER

SEQ ID NO: 191206 - protein, 13 aa, Mycobacterium tuberculosis
DERDQPFITGERT

SEQ ID NO: 191207 - protein, 13 aa, Mycobacterium tuberculosis
ERDQPFITGERTR

SEQ ID NO: 191208 - protein, 13 aa, Mycobacterium tuberculosis
RDQPFITGERTRE

SEQ ID NO: 191209 - protein, 13 aa, Mycobacterium tuberculosis
DQPFITGERTREG

SEQ ID NO: 191210 - protein, 13 aa, Mycobacterium tuberculosis
QPFITGERTREGF

SEQ ID NO: 191211 - protein, 13 aa, Mycobacterium tuberculosis
PFITGERTREGFY

SEQ ID NO: 191212 - protein, 13 aa, Mycobacterium tuberculosis
FITGERTREGFYR

SEQ ID NO: 191213 - protein, 13 aa, Mycobacterium tuberculosis
ITGERTREGFYRT

SEQ ID NO: 191214 - protein, 13 aa, Mycobacterium tuberculosis
TGERTREGFYRTK

SEQ ID NO: 191215 - protein, 13 aa, Mycobacterium tuberculosis
GERTREGFYRTKN

SEQ ID NO: 191216 - protein, 13 aa, Mycobacterium tuberculosis
ERTREGFYRTKNG

SEQ ID NO: 191217 - protein, 13 aa, Mycobacterium tuberculosis
RTREGFYRTKNGI

SEQ ID NO: 191218 - protein, 13 aa, Mycobacterium tuberculosis
TREGFYRTKNGIE

SEQ ID NO: 191219 - protein, 13 aa, Mycobacterium tuberculosis
REGFYRTKNGIEP

SEQ ID NO: 191220 - protein, 13 aa, Mycobacterium tuberculosis
EGFYRTKNGIEPC

SEQ ID NO: 191221 - protein, 13 aa, Mycobacterium tuberculosis
GFYRTKNGIEPCI

SEQ ID NO: 191222 - protein, 13 aa, Mycobacterium tuberculosis
FYRTKNGIEPCIA

SEQ ID NO: 191223 - protein, 13 aa, Mycobacterium tuberculosis
YRTKNGIEPCIAR

SEQ ID NO: 191224 - protein, 13 aa, Mycobacterium tuberculosis
RTKNGIEPCIARA

SEQ ID NO: 191225 - protein, 13 aa, Mycobacterium tuberculosis
TKNGIEPCIARAK

SEQ ID NO: 191226 - protein, 13 aa, Mycobacterium tuberculosis
KNGIEPCIARAKA

SEQ ID NO: 191227 - protein, 13 aa, Mycobacterium tuberculosis
NGIEPCIARAKAY

SEQ ID NO: 191228 - protein, 13 aa, Mycobacterium tuberculosis
GIEPCIARAKAYA

SEQ ID NO: 191229 - protein, 13 aa, Mycobacterium tuberculosis
IEPCIARAKAYAP

SEQ ID NO: 191230 - protein, 13 aa, Mycobacterium tuberculosis
EPCIARAKAYAPF

SEQ ID NO: 191231 - protein, 13 aa, Mycobacterium tuberculosis
PCIARAKAYAPFA

SEQ ID NO: 191232 - protein, 13 aa, Mycobacterium tuberculosis
CIARAKAYAPFAD

SEQ ID NO: 191233 - protein, 13 aa, Mycobacterium tuberculosis
IARAKAYAPFADL

SEQ ID NO: 191234 - protein, 13 aa, Mycobacterium tuberculosis
ARAKAYAPFADLI

SEQ ID NO: 191235 - protein, 13 aa, Mycobacterium tuberculosis
RAKAYAPFADLIW

SEQ ID NO: 191236 - protein, 13 aa, Mycobacterium tuberculosis
AKAYAPFADLIWM

SEQ ID NO: 191237 - protein, 13 aa, Mycobacterium tuberculosis
KAYAPFADLIWME

SEQ ID NO: 191238 - protein, 13 aa, Mycobacterium tuberculosis
AYAPFADLIWMET

SEQ ID NO: 191239 - protein, 13 aa, Mycobacterium tuberculosis
YAPFADLIWMETG

SEQ ID NO: 191240 - protein, 13 aa, Mycobacterium tuberculosis
APFADLIWMETGT

SEQ ID NO: 191241 - protein, 13 aa, Mycobacterium tuberculosis
PFADLIWMETGTP

SEQ ID NO: 191242 - protein, 13 aa, Mycobacterium tuberculosis
FADLIWMETGTPD

SEQ ID NO: 191243 - protein, 13 aa, Mycobacterium tuberculosis
ADLIWMETGTPDL

SEQ ID NO: 191244 - protein, 13 aa, Mycobacterium tuberculosis
DLIWMETGTPDLE

SEQ ID NO: 191245 - protein, 13 aa, Mycobacterium tuberculosis
LIWMETGTPDLEA

SEQ ID NO: 191246 - protein, 13 aa, Mycobacterium tuberculosis
IWMETGTPDLEAA

SEQ ID NO: 191247 - protein, 13 aa, Mycobacterium tuberculosis
WMETGTPDLEAAR

SEQ ID NO: 191248 - protein, 13 aa, Mycobacterium tuberculosis
METGTPDLEAARQ

SEQ ID NO: 191249 - protein, 13 aa, Mycobacterium tuberculosis
ETGTPDLEAARQF

SEQ ID NO: 191250 - protein, 13 aa, Mycobacterium tuberculosis
TGTPDLEAARQFS

SEQ ID NO: 191251 - protein, 13 aa, Mycobacterium tuberculosis
GTPDLEAARQFSE

SEQ ID NO: 191252 - protein, 13 aa, Mycobacterium tuberculosis
TPDLEAARQFSEA

SEQ ID NO: 191253 - protein, 13 aa, Mycobacterium tuberculosis
PDLEAARQFSEAV

SEQ ID NO: 191254 - protein, 13 aa, Mycobacterium tuberculosis
DLEAARQFSEAVK

SEQ ID NO: 191255 - protein, 13 aa, Mycobacterium tuberculosis
LEAARQFSEAVKA

SEQ ID NO: 191256 - protein, 13 aa, Mycobacterium tuberculosis
EAARQFSEAVKAE

SEQ ID NO: 191257 - protein, 13 aa, Mycobacterium tuberculosis
AARQFSEAVKAEY

SEQ ID NO: 191258 - protein, 13 aa, Mycobacterium tuberculosis
ARQFSEAVKAEYP

SEQ ID NO: 191259 - protein, 13 aa, Mycobacterium tuberculosis
RQFSEAVKAEYPD

SEQ ID NO: 191260 - protein, 13 aa, Mycobacterium tuberculosis
QFSEAVKAEYPDQ

SEQ ID NO: 191261 - protein, 13 aa, Mycobacterium tuberculosis
FSEAVKAEYPDQM

SEQ ID NO: 191262 - protein, 13 aa, Mycobacterium tuberculosis
SEAVKAEYPDQML

SEQ ID NO: 191263 - protein, 13 aa, Mycobacterium tuberculosis
EAVKAEYPDQMLA

SEQ ID NO: 191264 - protein, 13 aa, Mycobacterium tuberculosis
AVKAEYPDQMLAY

SEQ ID NO: 191265 - protein, 13 aa, Mycobacterium tuberculosis
VKAEYPDQMLAYN

SEQ ID NO: 191266 - protein, 13 aa, Mycobacterium tuberculosis
KAEYPDQMLAYNC

SEQ ID NO: 191267 - protein, 13 aa, Mycobacterium tuberculosis
AEYPDQMLAYNCS

SEQ ID NO: 191268 - protein, 13 aa, Mycobacterium tuberculosis
EYPDQMLAYNCSP

SEQ ID NO: 191269 - protein, 13 aa, Mycobacterium tuberculosis
YPDQMLAYNCSPS

SEQ ID NO: 191270 - protein, 13 aa, Mycobacterium tuberculosis
PDQMLAYNCSPSF

SEQ ID NO: 191271 - protein, 13 aa, Mycobacterium tuberculosis
DQMLAYNCSPSFN

SEQ ID NO: 191272 - protein, 13 aa, Mycobacterium tuberculosis
QMLAYNCSPSFNW

SEQ ID NO: 191273 - protein, 13 aa, Mycobacterium tuberculosis
MLAYNCSPSFNWK

SEQ ID NO: 191274 - protein, 13 aa, Mycobacterium tuberculosis
LAYNCSPSFNWKK

SEQ ID NO: 191275 - protein, 13 aa, Mycobacterium tuberculosis
AYNCSPSFNWKKH

SEQ ID NO: 191276 - protein, 13 aa, Mycobacterium tuberculosis
YNCSPSFNWKKHL

SEQ ID NO: 191277 - protein, 13 aa, Mycobacterium tuberculosis
NCSPSFNWKKHLD

SEQ ID NO: 191278 - protein, 13 aa, Mycobacterium tuberculosis
CSPSFNWKKHLDD

SEQ ID NO: 191279 - protein, 13 aa, Mycobacterium tuberculosis
SPSFNWKKHLDDA

SEQ ID NO: 191280 - protein, 13 aa, Mycobacterium tuberculosis
PSFNWKKHLDDAT

SEQ ID NO: 191281 - protein, 13 aa, Mycobacterium tuberculosis
SFNWKKHLDDATI

SEQ ID NO: 191282 - protein, 13 aa, Mycobacterium tuberculosis
FNWKKHLDDATIA

SEQ ID NO: 191283 - protein, 13 aa, Mycobacterium tuberculosis
NWKKHLDDATIAK

SEQ ID NO: 191284 - protein, 13 aa, Mycobacterium tuberculosis
WKKHLDDATIAKF

SEQ ID NO: 191285 - protein, 13 aa, Mycobacterium tuberculosis
KKHLDDATIAKFQ

SEQ ID NO: 191286 - protein, 13 aa, Mycobacterium tuberculosis
KHLDDATIAKFQK

SEQ ID NO: 191287 - protein, 13 aa, Mycobacterium tuberculosis
HLDDATIAKFQKE

SEQ ID NO: 191288 - protein, 13 aa, Mycobacterium tuberculosis
LDDATIAKFQKEL

SEQ ID NO: 191289 - protein, 13 aa, Mycobacterium tuberculosis
DDATIAKFQKELA

SEQ ID NO: 191290 - protein, 13 aa, Mycobacterium tuberculosis
DATIAKFQKELAA

SEQ ID NO: 191291 - protein, 13 aa, Mycobacterium tuberculosis
ATIAKFQKELAAM

SEQ ID NO: 191292 - protein, 13 aa, Mycobacterium tuberculosis
TIAKFQKELAAMG

SEQ ID NO: 191293 - protein, 13 aa, Mycobacterium tuberculosis
IAKFQKELAAMGF

SEQ ID NO: 191294 - protein, 13 aa, Mycobacterium tuberculosis
AKFQKELAAMGFK

SEQ ID NO: 191295 - protein, 13 aa, Mycobacterium tuberculosis
KFQKELAAMGFKF

SEQ ID NO: 191296 - protein, 13 aa, Mycobacterium tuberculosis
FQKELAAMGFKFQ

SEQ ID NO: 191297 - protein, 13 aa, Mycobacterium tuberculosis
QKELAAMGFKFQF

SEQ ID NO: 191298 - protein, 13 aa, Mycobacterium tuberculosis
KELAAMGFKFQFI

SEQ ID NO: 191299 - protein, 13 aa, Mycobacterium tuberculosis
ELAAMGFKFQFIT

SEQ ID NO: 191300 - protein, 13 aa, Mycobacterium tuberculosis
LAAMGFKFQFITL

SEQ ID NO: 191301 - protein, 13 aa, Mycobacterium tuberculosis
AAMGFKFQFITLA

SEQ ID NO: 191302 - protein, 13 aa, Mycobacterium tuberculosis
AMGFKFQFITLAG

SEQ ID NO: 191303 - protein, 13 aa, Mycobacterium tuberculosis
MGFKFQFITLAGF

SEQ ID NO: 191304 - protein, 13 aa, Mycobacterium tuberculosis
GFKFQFITLAGFH

SEQ ID NO: 191305 - protein, 13 aa, Mycobacterium tuberculosis
FKFQFITLAGFHA

SEQ ID NO: 191306 - protein, 13 aa, Mycobacterium tuberculosis
KFQFITLAGFHAL

SEQ ID NO: 191307 - protein, 13 aa, Mycobacterium tuberculosis
FQFITLAGFHALN

SEQ ID NO: 191308 - protein, 13 aa, Mycobacterium tuberculosis
QFITLAGFHALNY

SEQ ID NO: 191309 - protein, 13 aa, Mycobacterium tuberculosis
FITLAGFHALNYS

SEQ ID NO: 191310 - protein, 13 aa, Mycobacterium tuberculosis
ITLAGFHALNYSM

SEQ ID NO: 191311 - protein, 13 aa, Mycobacterium tuberculosis
TLAGFHALNYSMF

SEQ ID NO: 191312 - protein, 13 aa, Mycobacterium tuberculosis
LAGFHALNYSMFD

SEQ ID NO: 191313 - protein, 13 aa, Mycobacterium tuberculosis
AGFHALNYSMFDL

SEQ ID NO: 191314 - protein, 13 aa, Mycobacterium tuberculosis
GFHALNYSMFDLA

SEQ ID NO: 191315 - protein, 13 aa, Mycobacterium tuberculosis
FHALNYSMFDLAY

SEQ ID NO: 191316 - protein, 13 aa, Mycobacterium tuberculosis
HALNYSMFDLAYG

SEQ ID NO: 191317 - protein, 13 aa, Mycobacterium tuberculosis
ALNYSMFDLAYGY

SEQ ID NO: 191318 - protein, 13 aa, Mycobacterium tuberculosis
LNYSMFDLAYGYA

SEQ ID NO: 191319 - protein, 13 aa, Mycobacterium tuberculosis
NYSMFDLAYGYAQ

SEQ ID NO: 191320 - protein, 13 aa, Mycobacterium tuberculosis
YSMFDLAYGYAQN

SEQ ID NO: 191321 - protein, 13 aa, Mycobacterium tuberculosis
SMFDLAYGYAQNQ

SEQ ID NO: 191322 - protein, 13 aa, Mycobacterium tuberculosis
MFDLAYGYAQNQM

SEQ ID NO: 191323 - protein, 13 aa, Mycobacterium tuberculosis
FDLAYGYAQNQMS

SEQ ID NO: 191324 - protein, 13 aa, Mycobacterium tuberculosis
DLAYGYAQNQMSA

SEQ ID NO: 191325 - protein, 13 aa, Mycobacterium tuberculosis
LAYGYAQNQMSAY

SEQ ID NO: 191326 - protein, 13 aa, Mycobacterium tuberculosis
AYGYAQNQMSAYV

SEQ ID NO: 191327 - protein, 13 aa, Mycobacterium tuberculosis
YGYAQNQMSAYVE

SEQ ID NO: 191328 - protein, 13 aa, Mycobacterium tuberculosis
GYAQNQMSAYVEL

SEQ ID NO: 191329 - protein, 13 aa, Mycobacterium tuberculosis
YAQNQMSAYVELQ

SEQ ID NO: 191330 - protein, 13 aa, Mycobacterium tuberculosis
AQNQMSAYVELQE

SEQ ID NO: 191331 - protein, 13 aa, Mycobacterium tuberculosis
QNQMSAYVELQER

SEQ ID NO: 191332 - protein, 13 aa, Mycobacterium tuberculosis
NQMSAYVELQERE

SEQ ID NO: 191333 - protein, 13 aa, Mycobacterium tuberculosis
QMSAYVELQEREF

SEQ ID NO: 191334 - protein, 13 aa, Mycobacterium tuberculosis
MSAYVELQEREFA

SEQ ID NO: 191335 - protein, 13 aa, Mycobacterium tuberculosis
SAYVELQEREFAA

SEQ ID NO: 191336 - protein, 13 aa, Mycobacterium tuberculosis
AYVELQEREFAAE

SEQ ID NO: 191337 - protein, 13 aa, Mycobacterium tuberculosis
YVELQEREFAAEE

SEQ ID NO: 191338 - protein, 13 aa, Mycobacterium tuberculosis
VELQEREFAAEER

SEQ ID NO: 191339 - protein, 13 aa, Mycobacterium tuberculosis
ELQEREFAAEERG

SEQ ID NO: 191340 - protein, 13 aa, Mycobacterium tuberculosis
LQEREFAAEERGY

SEQ ID NO: 191341 - protein, 13 aa, Mycobacterium tuberculosis
QEREFAAEERGYT

SEQ ID NO: 191342 - protein, 13 aa, Mycobacterium tuberculosis
EREFAAEERGYTA

SEQ ID NO: 191343 - protein, 13 aa, Mycobacterium tuberculosis
REFAAEERGYTAT

SEQ ID NO: 191344 - protein, 13 aa, Mycobacterium tuberculosis
EFAAEERGYTATK

SEQ ID NO: 191345 - protein, 13 aa, Mycobacterium tuberculosis
FAAEERGYTATKH

SEQ ID NO: 191346 - protein, 13 aa, Mycobacterium tuberculosis
AAEERGYTATKHQ

SEQ ID NO: 191347 - protein, 13 aa, Mycobacterium tuberculosis
AEERGYTATKHQR

SEQ ID NO: 191348 - protein, 13 aa, Mycobacterium tuberculosis
EERGYTATKHQRE

SEQ ID NO: 191349 - protein, 13 aa, Mycobacterium tuberculosis
ERGYTATKHQREV

SEQ ID NO: 191350 - protein, 13 aa, Mycobacterium tuberculosis
RGYTATKHQREVG

SEQ ID NO: 191351 - protein, 13 aa, Mycobacterium tuberculosis
GYTATKHQREVGA

SEQ ID NO: 191352 - protein, 13 aa, Mycobacterium tuberculosis
YTATKHQREVGAG

SEQ ID NO: 191353 - protein, 13 aa, Mycobacterium tuberculosis
TATKHQREVGAGY

SEQ ID NO: 191354 - protein, 13 aa, Mycobacterium tuberculosis
ATKHQREVGAGYF

SEQ ID NO: 191355 - protein, 13 aa, Mycobacterium tuberculosis
TKHQREVGAGYFD

SEQ ID NO: 191356 - protein, 13 aa, Mycobacterium tuberculosis
KHQREVGAGYFDR

SEQ ID NO: 191357 - protein, 13 aa, Mycobacterium tuberculosis
HQREVGAGYFDRI

SEQ ID NO: 191358 - protein, 13 aa, Mycobacterium tuberculosis
QREVGAGYFDRIA

SEQ ID NO: 191359 - protein, 13 aa, Mycobacterium tuberculosis
REVGAGYFDRIAT

SEQ ID NO: 191360 - protein, 13 aa, Mycobacterium tuberculosis
EVGAGYFDRIATT

SEQ ID NO: 191361 - protein, 13 aa, Mycobacterium tuberculosis
VGAGYFDRIATTV

SEQ ID NO: 191362 - protein, 13 aa, Mycobacterium tuberculosis
GAGYFDRIATTVD

SEQ ID NO: 191363 - protein, 13 aa, Mycobacterium tuberculosis
AGYFDRIATTVDP

SEQ ID NO: 191364 - protein, 13 aa, Mycobacterium tuberculosis
GYFDRIATTVDPN

SEQ ID NO: 191365 - protein, 13 aa, Mycobacterium tuberculosis
YFDRIATTVDPNS

SEQ ID NO: 191366 - protein, 13 aa, Mycobacterium tuberculosis
FDRIATTVDPNSS

SEQ ID NO: 191367 - protein, 13 aa, Mycobacterium tuberculosis
DRIATTVDPNSST

SEQ ID NO: 191368 - protein, 13 aa, Mycobacterium tuberculosis
RIATTVDPNSSTT

SEQ ID NO: 191369 - protein, 13 aa, Mycobacterium tuberculosis
IATTVDPNSSTTA

SEQ ID NO: 191370 - protein, 13 aa, Mycobacterium tuberculosis
ATTVDPNSSTTAL

SEQ ID NO: 191371 - protein, 13 aa, Mycobacterium tuberculosis
TTVDPNSSTTALT

SEQ ID NO: 191372 - protein, 13 aa, Mycobacterium tuberculosis
TVDPNSSTTALTG

SEQ ID NO: 191373 - protein, 13 aa, Mycobacterium tuberculosis
VDPNSSTTALTGS

SEQ ID NO: 191374 - protein, 13 aa, Mycobacterium tuberculosis
DPNSSTTALTGST

SEQ ID NO: 191375 - protein, 13 aa, Mycobacterium tuberculosis
PNSSTTALTGSTE

SEQ ID NO: 191376 - protein, 13 aa, Mycobacterium tuberculosis
NSSTTALTGSTEE

SEQ ID NO: 191377 - protein, 13 aa, Mycobacterium tuberculosis
SSTTALTGSTEEG

SEQ ID NO: 191378 - protein, 13 aa, Mycobacterium tuberculosis
STTALTGSTEEGQ

SEQ ID NO: 191379 - protein, 13 aa, Mycobacterium tuberculosis
TTALTGSTEEGQF

SEQ ID NO: 191380 - protein, 13 aa, Mycobacterium tuberculosis
TALTGSTEEGQFH

SEQ ID NO: 191381 - protein, 14 aa, Mycobacterium tuberculosis
MSVVGTPKSAEQIQ

SEQ ID NO: 191382 - protein, 14 aa, Mycobacterium tuberculosis
SVVGTPKSAEQIQQ

SEQ ID NO: 191383 - protein, 14 aa, Mycobacterium tuberculosis
VVGTPKSAEQIQQE

SEQ ID NO: 191384 - protein, 14 aa, Mycobacterium tuberculosis
VGTPKSAEQIQQEW

SEQ ID NO: 191385 - protein, 14 aa, Mycobacterium tuberculosis
GTPKSAEQIQQEWD

SEQ ID NO: 191386 - protein, 14 aa, Mycobacterium tuberculosis
TPKSAEQIQQEWDT

SEQ ID NO: 191387 - protein, 14 aa, Mycobacterium tuberculosis
PKSAEQIQQEWDTN

SEQ ID NO: 191388 - protein, 14 aa, Mycobacterium tuberculosis
KSAEQIQQEWDTNP

SEQ ID NO: 191389 - protein, 14 aa, Mycobacterium tuberculosis
SAEQIQQEWDTNPR

SEQ ID NO: 191390 - protein, 14 aa, Mycobacterium tuberculosis
AEQIQQEWDTNPRW

SEQ ID NO: 191391 - protein, 14 aa, Mycobacterium tuberculosis
EQIQQEWDTNPRWK

SEQ ID NO: 191392 - protein, 14 aa, Mycobacterium tuberculosis
QIQQEWDTNPRWKD

SEQ ID NO: 191393 - protein, 14 aa, Mycobacterium tuberculosis
IQQEWDTNPRWKDV

SEQ ID NO: 191394 - protein, 14 aa, Mycobacterium tuberculosis
QQEWDTNPRWKDVT

SEQ ID NO: 191395 - protein, 14 aa, Mycobacterium tuberculosis
QEWDTNPRWKDVTR

SEQ ID NO: 191396 - protein, 14 aa, Mycobacterium tuberculosis
EWDTNPRWKDVTRT

SEQ ID NO: 191397 - protein, 14 aa, Mycobacterium tuberculosis
WDTNPRWKDVTRTY

SEQ ID NO: 191398 - protein, 14 aa, Mycobacterium tuberculosis
DTNPRWKDVTRTYS

SEQ ID NO: 191399 - protein, 14 aa, Mycobacterium tuberculosis
TNPRWKDVTRTYSA

SEQ ID NO: 191400 - protein, 14 aa, Mycobacterium tuberculosis
NPRWKDVTRTYSAE

SEQ ID NO: 191401 - protein, 14 aa, Mycobacterium tuberculosis
PRWKDVTRTYSAED

SEQ ID NO: 191402 - protein, 14 aa, Mycobacterium tuberculosis
RWKDVTRTYSAEDV

SEQ ID NO: 191403 - protein, 14 aa, Mycobacterium tuberculosis
WKDVTRTYSAEDVV

SEQ ID NO: 191404 - protein, 14 aa, Mycobacterium tuberculosis
KDVTRTYSAEDVVA

SEQ ID NO: 191405 - protein, 14 aa, Mycobacterium tuberculosis
DVTRTYSAEDVVAL

SEQ ID NO: 191406 - protein, 14 aa, Mycobacterium tuberculosis
VTRTYSAEDVVALQ

SEQ ID NO: 191407 - protein, 14 aa, Mycobacterium tuberculosis
TRTYSAEDVVALQG

SEQ ID NO: 191408 - protein, 14 aa, Mycobacterium tuberculosis
RTYSAEDVVALQGS

SEQ ID NO: 191409 - protein, 14 aa, Mycobacterium tuberculosis
TYSAEDVVALQGSV

SEQ ID NO: 191410 - protein, 14 aa, Mycobacterium tuberculosis
YSAEDVVALQGSVV

SEQ ID NO: 191411 - protein, 14 aa, Mycobacterium tuberculosis
SAEDVVALQGSVVE

SEQ ID NO: 191412 - protein, 14 aa, Mycobacterium tuberculosis
AEDVVALQGSVVEE

SEQ ID NO: 191413 - protein, 14 aa, Mycobacterium tuberculosis
EDVVALQGSVVEEH

SEQ ID NO: 191414 - protein, 14 aa, Mycobacterium tuberculosis
DVVALQGSVVEEHT

SEQ ID NO: 191415 - protein, 14 aa, Mycobacterium tuberculosis
VVALQGSVVEEHTL

SEQ ID NO: 191416 - protein, 14 aa, Mycobacterium tuberculosis
VALQGSVVEEHTLA

SEQ ID NO: 191417 - protein, 14 aa, Mycobacterium tuberculosis
ALQGSVVEEHTLAR

SEQ ID NO: 191418 - protein, 14 aa, Mycobacterium tuberculosis
LQGSVVEEHTLARR

SEQ ID NO: 191419 - protein, 14 aa, Mycobacterium tuberculosis
QGSVVEEHTLARRG

SEQ ID NO: 191420 - protein, 14 aa, Mycobacterium tuberculosis
GSVVEEHTLARRGA

SEQ ID NO: 191421 - protein, 14 aa, Mycobacterium tuberculosis
SVVEEHTLARRGAE

SEQ ID NO: 191422 - protein, 14 aa, Mycobacterium tuberculosis
VVEEHTLARRGAEV

SEQ ID NO: 191423 - protein, 14 aa, Mycobacterium tuberculosis
VEEHTLARRGAEVL

SEQ ID NO: 191424 - protein, 14 aa, Mycobacterium tuberculosis
EEHTLARRGAEVLW

SEQ ID NO: 191425 - protein, 14 aa, Mycobacterium tuberculosis
EHTLARRGAEVLWE

SEQ ID NO: 191426 - protein, 14 aa, Mycobacterium tuberculosis
HTLARRGAEVLWEQ

SEQ ID NO: 191427 - protein, 14 aa, Mycobacterium tuberculosis
TLARRGAEVLWEQL

SEQ ID NO: 191428 - protein, 14 aa, Mycobacterium tuberculosis
LARRGAEVLWEQLH

SEQ ID NO: 191429 - protein, 14 aa, Mycobacterium tuberculosis
ARRGAEVLWEQLHD

SEQ ID NO: 191430 - protein, 14 aa, Mycobacterium tuberculosis
RRGAEVLWEQLHDL

SEQ ID NO: 191431 - protein, 14 aa, Mycobacterium tuberculosis
RGAEVLWEQLHDLE

SEQ ID NO: 191432 - protein, 14 aa, Mycobacterium tuberculosis
GAEVLWEQLHDLEW

SEQ ID NO: 191433 - protein, 14 aa, Mycobacterium tuberculosis
AEVLWEQLHDLEWV

SEQ ID NO: 191434 - protein, 14 aa, Mycobacterium tuberculosis
EVLWEQLHDLEWVN

SEQ ID NO: 191435 - protein, 14 aa, Mycobacterium tuberculosis
VLWEQLHDLEWVNA

SEQ ID NO: 191436 - protein, 14 aa, Mycobacterium tuberculosis
LWEQLHDLEWVNAL

SEQ ID NO: 191437 - protein, 14 aa, Mycobacterium tuberculosis
WEQLHDLEWVNALG

SEQ ID NO: 191438 - protein, 14 aa, Mycobacterium tuberculosis
EQLHDLEWVNALGA

SEQ ID NO: 191439 - protein, 14 aa, Mycobacterium tuberculosis
QLHDLEWVNALGAL

SEQ ID NO: 191440 - protein, 14 aa, Mycobacterium tuberculosis
LHDLEWVNALGALT

SEQ ID NO: 191441 - protein, 14 aa, Mycobacterium tuberculosis
HDLEWVNALGALTG

SEQ ID NO: 191442 - protein, 14 aa, Mycobacterium tuberculosis
DLEWVNALGALTGN

SEQ ID NO: 191443 - protein, 14 aa, Mycobacterium tuberculosis
LEWVNALGALTGNM

SEQ ID NO: 191444 - protein, 14 aa, Mycobacterium tuberculosis
EWVNALGALTGNMA

SEQ ID NO: 191445 - protein, 14 aa, Mycobacterium tuberculosis
WVNALGALTGNMAV

SEQ ID NO: 191446 - protein, 14 aa, Mycobacterium tuberculosis
VNALGALTGNMAVQ

SEQ ID NO: 191447 - protein, 14 aa, Mycobacterium tuberculosis
NALGALTGNMAVQQ

SEQ ID NO: 191448 - protein, 14 aa, Mycobacterium tuberculosis
ALGALTGNMAVQQV

SEQ ID NO: 191449 - protein, 14 aa, Mycobacterium tuberculosis
LGALTGNMAVQQVR

SEQ ID NO: 191450 - protein, 14 aa, Mycobacterium tuberculosis
GALTGNMAVQQVRA

SEQ ID NO: 191451 - protein, 14 aa, Mycobacterium tuberculosis
ALTGNMAVQQVRAG

SEQ ID NO: 191452 - protein, 14 aa, Mycobacterium tuberculosis
LTGNMAVQQVRAGL

SEQ ID NO: 191453 - protein, 14 aa, Mycobacterium tuberculosis
TGNMAVQQVRAGLK

SEQ ID NO: 191454 - protein, 14 aa, Mycobacterium tuberculosis
GNMAVQQVRAGLKA

SEQ ID NO: 191455 - protein, 14 aa, Mycobacterium tuberculosis
NMAVQQVRAGLKAI

SEQ ID NO: 191456 - protein, 14 aa, Mycobacterium tuberculosis
MAVQQVRAGLKAIY

SEQ ID NO: 191457 - protein, 14 aa, Mycobacterium tuberculosis
AVQQVRAGLKAIYL

SEQ ID NO: 191458 - protein, 14 aa, Mycobacterium tuberculosis
VQQVRAGLKAIYLS

SEQ ID NO: 191459 - protein, 14 aa, Mycobacterium tuberculosis
QQVRAGLKAIYLSG

SEQ ID NO: 191460 - protein, 14 aa, Mycobacterium tuberculosis
QVRAGLKAIYLSGW

SEQ ID NO: 191461 - protein, 14 aa, Mycobacterium tuberculosis
VRAGLKAIYLSGWQ

SEQ ID NO: 191462 - protein, 14 aa, Mycobacterium tuberculosis
RAGLKAIYLSGWQV

SEQ ID NO: 191463 - protein, 14 aa, Mycobacterium tuberculosis
AGLKAIYLSGWQVA

SEQ ID NO: 191464 - protein, 14 aa, Mycobacterium tuberculosis
GLKAIYLSGWQVAG

SEQ ID NO: 191465 - protein, 14 aa, Mycobacterium tuberculosis
LKAIYLSGWQVAGD

SEQ ID NO: 191466 - protein, 14 aa, Mycobacterium tuberculosis
KAIYLSGWQVAGDA

SEQ ID NO: 191467 - protein, 14 aa, Mycobacterium tuberculosis
AIYLSGWQVAGDAN

SEQ ID NO: 191468 - protein, 14 aa, Mycobacterium tuberculosis
IYLSGWQVAGDANL

SEQ ID NO: 191469 - protein, 14 aa, Mycobacterium tuberculosis
YLSGWQVAGDANLS

SEQ ID NO: 191470 - protein, 14 aa, Mycobacterium tuberculosis
LSGWQVAGDANLSG

SEQ ID NO: 191471 - protein, 14 aa, Mycobacterium tuberculosis
SGWQVAGDANLSGH

SEQ ID NO: 191472 - protein, 14 aa, Mycobacterium tuberculosis
GWQVAGDANLSGHT

SEQ ID NO: 191473 - protein, 14 aa, Mycobacterium tuberculosis
WQVAGDANLSGHTY

SEQ ID NO: 191474 - protein, 14 aa, Mycobacterium tuberculosis
QVAGDANLSGHTYP

SEQ ID NO: 191475 - protein, 14 aa, Mycobacterium tuberculosis
VAGDANLSGHTYPD

SEQ ID NO: 191476 - protein, 14 aa, Mycobacterium tuberculosis
AGDANLSGHTYPDQ

SEQ ID NO: 191477 - protein, 14 aa, Mycobacterium tuberculosis
GDANLSGHTYPDQS

SEQ ID NO: 191478 - protein, 14 aa, Mycobacterium tuberculosis
DANLSGHTYPDQSL

SEQ ID NO: 191479 - protein, 14 aa, Mycobacterium tuberculosis
ANLSGHTYPDQSLY

SEQ ID NO: 191480 - protein, 14 aa, Mycobacterium tuberculosis
NLSGHTYPDQSLYP

SEQ ID NO: 191481 - protein, 14 aa, Mycobacterium tuberculosis
LSGHTYPDQSLYPA

SEQ ID NO: 191482 - protein, 14 aa, Mycobacterium tuberculosis
SGHTYPDQSLYPAN

SEQ ID NO: 191483 - protein, 14 aa, Mycobacterium tuberculosis
GHTYPDQSLYPANS

SEQ ID NO: 191484 - protein, 14 aa, Mycobacterium tuberculosis
HTYPDQSLYPANSV

SEQ ID NO: 191485 - protein, 14 aa, Mycobacterium tuberculosis
TYPDQSLYPANSVP

SEQ ID NO: 191486 - protein, 14 aa, Mycobacterium tuberculosis
YPDQSLYPANSVPQ

SEQ ID NO: 191487 - protein, 14 aa, Mycobacterium tuberculosis
PDQSLYPANSVPQV

SEQ ID NO: 191488 - protein, 14 aa, Mycobacterium tuberculosis
DQSLYPANSVPQVV

SEQ ID NO: 191489 - protein, 14 aa, Mycobacterium tuberculosis
QSLYPANSVPQVVR

SEQ ID NO: 191490 - protein, 14 aa, Mycobacterium tuberculosis
SLYPANSVPQVVRR

SEQ ID NO: 191491 - protein, 14 aa, Mycobacterium tuberculosis
LYPANSVPQVVRRI

SEQ ID NO: 191492 - protein, 14 aa, Mycobacterium tuberculosis
YPANSVPQVVRRIN

SEQ ID NO: 191493 - protein, 14 aa, Mycobacterium tuberculosis
PANSVPQVVRRINN

SEQ ID NO: 191494 - protein, 14 aa, Mycobacterium tuberculosis
ANSVPQVVRRINNA

SEQ ID NO: 191495 - protein, 14 aa, Mycobacterium tuberculosis
NSVPQVVRRINNAL

SEQ ID NO: 191496 - protein, 14 aa, Mycobacterium tuberculosis
SVPQVVRRINNALQ

SEQ ID NO: 191497 - protein, 14 aa, Mycobacterium tuberculosis
VPQVVRRINNALQR

SEQ ID NO: 191498 - protein, 14 aa, Mycobacterium tuberculosis
PQVVRRINNALQRA

SEQ ID NO: 191499 - protein, 14 aa, Mycobacterium tuberculosis
QVVRRINNALQRAD

SEQ ID NO: 191500 - protein, 14 aa, Mycobacterium tuberculosis
VVRRINNALQRADQ

SEQ ID NO: 191501 - protein, 14 aa, Mycobacterium tuberculosis
VRRINNALQRADQI

SEQ ID NO: 191502 - protein, 14 aa, Mycobacterium tuberculosis
RRINNALQRADQIA

SEQ ID NO: 191503 - protein, 14 aa, Mycobacterium tuberculosis
RINNALQRADQIAK

SEQ ID NO: 191504 - protein, 14 aa, Mycobacterium tuberculosis
INNALQRADQIAKI

SEQ ID NO: 191505 - protein, 14 aa, Mycobacterium tuberculosis
NNALQRADQIAKIE

SEQ ID NO: 191506 - protein, 14 aa, Mycobacterium tuberculosis
NALQRADQIAKIEG

SEQ ID NO: 191507 - protein, 14 aa, Mycobacterium tuberculosis
ALQRADQIAKIEGD

SEQ ID NO: 191508 - protein, 14 aa, Mycobacterium tuberculosis
LQRADQIAKIEGDT

SEQ ID NO: 191509 - protein, 14 aa, Mycobacterium tuberculosis
QRADQIAKIEGDTS

SEQ ID NO: 191510 - protein, 14 aa, Mycobacterium tuberculosis
RADQIAKIEGDTSV

SEQ ID NO: 191511 - protein, 14 aa, Mycobacterium tuberculosis
ADQIAKIEGDTSVE

SEQ ID NO: 191512 - protein, 14 aa, Mycobacterium tuberculosis
DQIAKIEGDTSVEN

SEQ ID NO: 191513 - protein, 14 aa, Mycobacterium tuberculosis
QIAKIEGDTSVENW

SEQ ID NO: 191514 - protein, 14 aa, Mycobacterium tuberculosis
IAKIEGDTSVENWL

SEQ ID NO: 191515 - protein, 14 aa, Mycobacterium tuberculosis
AKIEGDTSVENWLA

SEQ ID NO: 191516 - protein, 14 aa, Mycobacterium tuberculosis
KIEGDTSVENWLAP

SEQ ID NO: 191517 - protein, 14 aa, Mycobacterium tuberculosis
IEGDTSVENWLAPI

SEQ ID NO: 191518 - protein, 14 aa, Mycobacterium tuberculosis
EGDTSVENWLAPIV

SEQ ID NO: 191519 - protein, 14 aa, Mycobacterium tuberculosis
GDTSVENWLAPIVA

SEQ ID NO: 191520 - protein, 14 aa, Mycobacterium tuberculosis
DTSVENWLAPIVAD

SEQ ID NO: 191521 - protein, 14 aa, Mycobacterium tuberculosis
TSVENWLAPIVADG

SEQ ID NO: 191522 - protein, 14 aa, Mycobacterium tuberculosis
SVENWLAPIVADGE

SEQ ID NO: 191523 - protein, 14 aa, Mycobacterium tuberculosis
VENWLAPIVADGEA

SEQ ID NO: 191524 - protein, 14 aa, Mycobacterium tuberculosis
ENWLAPIVADGEAG

SEQ ID NO: 191525 - protein, 14 aa, Mycobacterium tuberculosis
NWLAPIVADGEAGF

SEQ ID NO: 191526 - protein, 14 aa, Mycobacterium tuberculosis
WLAPIVADGEAGFG

SEQ ID NO: 191527 - protein, 14 aa, Mycobacterium tuberculosis
LAPIVADGEAGFGG

SEQ ID NO: 191528 - protein, 14 aa, Mycobacterium tuberculosis
APIVADGEAGFGGA

SEQ ID NO: 191529 - protein, 14 aa, Mycobacterium tuberculosis
PIVADGEAGFGGAL

SEQ ID NO: 191530 - protein, 14 aa, Mycobacterium tuberculosis
IVADGEAGFGGALN

SEQ ID NO: 191531 - protein, 14 aa, Mycobacterium tuberculosis
VADGEAGFGGALNV

SEQ ID NO: 191532 - protein, 14 aa, Mycobacterium tuberculosis
ADGEAGFGGALNVY

SEQ ID NO: 191533 - protein, 14 aa, Mycobacterium tuberculosis
DGEAGFGGALNVYE

SEQ ID NO: 191534 - protein, 14 aa, Mycobacterium tuberculosis
GEAGFGGALNVYEL

SEQ ID NO: 191535 - protein, 14 aa, Mycobacterium tuberculosis
EAGFGGALNVYELQ

SEQ ID NO: 191536 - protein, 14 aa, Mycobacterium tuberculosis
AGFGGALNVYELQK

SEQ ID NO: 191537 - protein, 14 aa, Mycobacterium tuberculosis
GFGGALNVYELQKA

SEQ ID NO: 191538 - protein, 14 aa, Mycobacterium tuberculosis
FGGALNVYELQKAL

SEQ ID NO: 191539 - protein, 14 aa, Mycobacterium tuberculosis
GGALNVYELQKALI

SEQ ID NO: 191540 - protein, 14 aa, Mycobacterium tuberculosis
GALNVYELQKALIA

SEQ ID NO: 191541 - protein, 14 aa, Mycobacterium tuberculosis
ALNVYELQKALIAA

SEQ ID NO: 191542 - protein, 14 aa, Mycobacterium tuberculosis
LNVYELQKALIAAG

SEQ ID NO: 191543 - protein, 14 aa, Mycobacterium tuberculosis
NVYELQKALIAAGV

SEQ ID NO: 191544 - protein, 14 aa, Mycobacterium tuberculosis
VYELQKALIAAGVA

SEQ ID NO: 191545 - protein, 14 aa, Mycobacterium tuberculosis
YELQKALIAAGVAG

SEQ ID NO: 191546 - protein, 14 aa, Mycobacterium tuberculosis
ELQKALIAAGVAGS

SEQ ID NO: 191547 - protein, 14 aa, Mycobacterium tuberculosis
LQKALIAAGVAGSH

SEQ ID NO: 191548 - protein, 14 aa, Mycobacterium tuberculosis
QKALIAAGVAGSHW

SEQ ID NO: 191549 - protein, 14 aa, Mycobacterium tuberculosis
KALIAAGVAGSHWE

SEQ ID NO: 191550 - protein, 14 aa, Mycobacterium tuberculosis
ALIAAGVAGSHWED

SEQ ID NO: 191551 - protein, 14 aa, Mycobacterium tuberculosis
LIAAGVAGSHWEDQ

SEQ ID NO: 191552 - protein, 14 aa, Mycobacterium tuberculosis
IAAGVAGSHWEDQL

SEQ ID NO: 191553 - protein, 14 aa, Mycobacterium tuberculosis
AAGVAGSHWEDQLA

SEQ ID NO: 191554 - protein, 14 aa, Mycobacterium tuberculosis
AGVAGSHWEDQLAS

SEQ ID NO: 191555 - protein, 14 aa, Mycobacterium tuberculosis
GVAGSHWEDQLASE

SEQ ID NO: 191556 - protein, 14 aa, Mycobacterium tuberculosis
VAGSHWEDQLASEK

SEQ ID NO: 191557 - protein, 14 aa, Mycobacterium tuberculosis
AGSHWEDQLASEKK

SEQ ID NO: 191558 - protein, 14 aa, Mycobacterium tuberculosis
GSHWEDQLASEKKC

SEQ ID NO: 191559 - protein, 14 aa, Mycobacterium tuberculosis
SHWEDQLASEKKCG

SEQ ID NO: 191560 - protein, 14 aa, Mycobacterium tuberculosis
HWEDQLASEKKCGH

SEQ ID NO: 191561 - protein, 14 aa, Mycobacterium tuberculosis
WEDQLASEKKCGHL

SEQ ID NO: 191562 - protein, 14 aa, Mycobacterium tuberculosis
EDQLASEKKCGHLG

SEQ ID NO: 191563 - protein, 14 aa, Mycobacterium tuberculosis
DQLASEKKCGHLGG

SEQ ID NO: 191564 - protein, 14 aa, Mycobacterium tuberculosis
QLASEKKCGHLGGK

SEQ ID NO: 191565 - protein, 14 aa, Mycobacterium tuberculosis
LASEKKCGHLGGKV

SEQ ID NO: 191566 - protein, 14 aa, Mycobacterium tuberculosis
ASEKKCGHLGGKVL

SEQ ID NO: 191567 - protein, 14 aa, Mycobacterium tuberculosis
SEKKCGHLGGKVLI

SEQ ID NO: 191568 - protein, 14 aa, Mycobacterium tuberculosis
EKKCGHLGGKVLIP

SEQ ID NO: 191569 - protein, 14 aa, Mycobacterium tuberculosis
KKCGHLGGKVLIPT

SEQ ID NO: 191570 - protein, 14 aa, Mycobacterium tuberculosis
KCGHLGGKVLIPTQ

SEQ ID NO: 191571 - protein, 14 aa, Mycobacterium tuberculosis
CGHLGGKVLIPTQQ

SEQ ID NO: 191572 - protein, 14 aa, Mycobacterium tuberculosis
GHLGGKVLIPTQQH

SEQ ID NO: 191573 - protein, 14 aa, Mycobacterium tuberculosis
HLGGKVLIPTQQHI

SEQ ID NO: 191574 - protein, 14 aa, Mycobacterium tuberculosis
LGGKVLIPTQQHIR

SEQ ID NO: 191575 - protein, 14 aa, Mycobacterium tuberculosis
GGKVLIPTQQHIRT

SEQ ID NO: 191576 - protein, 14 aa, Mycobacterium tuberculosis
GKVLIPTQQHIRTL

SEQ ID NO: 191577 - protein, 14 aa, Mycobacterium tuberculosis
KVLIPTQQHIRTLT

SEQ ID NO: 191578 - protein, 14 aa, Mycobacterium tuberculosis
VLIPTQQHIRTLTS

SEQ ID NO: 191579 - protein, 14 aa, Mycobacterium tuberculosis
LIPTQQHIRTLTSA

SEQ ID NO: 191580 - protein, 14 aa, Mycobacterium tuberculosis
IPTQQHIRTLTSAR

SEQ ID NO: 191581 - protein, 14 aa, Mycobacterium tuberculosis
PTQQHIRTLTSARL

SEQ ID NO: 191582 - protein, 14 aa, Mycobacterium tuberculosis
TQQHIRTLTSARLA

SEQ ID NO: 191583 - protein, 14 aa, Mycobacterium tuberculosis
QQHIRTLTSARLAA

SEQ ID NO: 191584 - protein, 14 aa, Mycobacterium tuberculosis
QHIRTLTSARLAAD

SEQ ID NO: 191585 - protein, 14 aa, Mycobacterium tuberculosis
HIRTLTSARLAADV

SEQ ID NO: 191586 - protein, 14 aa, Mycobacterium tuberculosis
IRTLTSARLAADVA

SEQ ID NO: 191587 - protein, 14 aa, Mycobacterium tuberculosis
RTLTSARLAADVAD

SEQ ID NO: 191588 - protein, 14 aa, Mycobacterium tuberculosis
TLTSARLAADVADV

SEQ ID NO: 191589 - protein, 14 aa, Mycobacterium tuberculosis
LTSARLAADVADVP

SEQ ID NO: 191590 - protein, 14 aa, Mycobacterium tuberculosis
TSARLAADVADVPT

SEQ ID NO: 191591 - protein, 14 aa, Mycobacterium tuberculosis
SARLAADVADVPTV

SEQ ID NO: 191592 - protein, 14 aa, Mycobacterium tuberculosis
ARLAADVADVPTVV

SEQ ID NO: 191593 - protein, 14 aa, Mycobacterium tuberculosis
RLAADVADVPTVVI

SEQ ID NO: 191594 - protein, 14 aa, Mycobacterium tuberculosis
LAADVADVPTVVIA

SEQ ID NO: 191595 - protein, 14 aa, Mycobacterium tuberculosis
AADVADVPTVVIAR

SEQ ID NO: 191596 - protein, 14 aa, Mycobacterium tuberculosis
ADVADVPTVVIART

SEQ ID NO: 191597 - protein, 14 aa, Mycobacterium tuberculosis
DVADVPTVVIARTD

SEQ ID NO: 191598 - protein, 14 aa, Mycobacterium tuberculosis
VADVPTVVIARTDA

SEQ ID NO: 191599 - protein, 14 aa, Mycobacterium tuberculosis
ADVPTVVIARTDAE

SEQ ID NO: 191600 - protein, 14 aa, Mycobacterium tuberculosis
DVPTVVIARTDAEA

SEQ ID NO: 191601 - protein, 14 aa, Mycobacterium tuberculosis
VPTVVIARTDAEAA

SEQ ID NO: 191602 - protein, 14 aa, Mycobacterium tuberculosis
PTVVIARTDAEAAT

SEQ ID NO: 191603 - protein, 14 aa, Mycobacterium tuberculosis
TVVIARTDAEAATL

SEQ ID NO: 191604 - protein, 14 aa, Mycobacterium tuberculosis
VVIARTDAEAATLI

SEQ ID NO: 191605 - protein, 14 aa, Mycobacterium tuberculosis
VIARTDAEAATLIT

SEQ ID NO: 191606 - protein, 14 aa, Mycobacterium tuberculosis
IARTDAEAATLITS

SEQ ID NO: 191607 - protein, 14 aa, Mycobacterium tuberculosis
ARTDAEAATLITSD

SEQ ID NO: 191608 - protein, 14 aa, Mycobacterium tuberculosis
RTDAEAATLITSDV

SEQ ID NO: 191609 - protein, 14 aa, Mycobacterium tuberculosis
TDAEAATLITSDVD

SEQ ID NO: 191610 - protein, 14 aa, Mycobacterium tuberculosis
DAEAATLITSDVDE

SEQ ID NO: 191611 - protein, 14 aa, Mycobacterium tuberculosis
AEAATLITSDVDER

SEQ ID NO: 191612 - protein, 14 aa, Mycobacterium tuberculosis
EAATLITSDVDERD

SEQ ID NO: 191613 - protein, 14 aa, Mycobacterium tuberculosis
AATLITSDVDERDQ

SEQ ID NO: 191614 - protein, 14 aa, Mycobacterium tuberculosis
ATLITSDVDERDQP

SEQ ID NO: 191615 - protein, 14 aa, Mycobacterium tuberculosis
TLITSDVDERDQPF

SEQ ID NO: 191616 - protein, 14 aa, Mycobacterium tuberculosis
LITSDVDERDQPFI

SEQ ID NO: 191617 - protein, 14 aa, Mycobacterium tuberculosis
ITSDVDERDQPFIT

SEQ ID NO: 191618 - protein, 14 aa, Mycobacterium tuberculosis
TSDVDERDQPFITG

SEQ ID NO: 191619 - protein, 14 aa, Mycobacterium tuberculosis
SDVDERDQPFITGE

SEQ ID NO: 191620 - protein, 14 aa, Mycobacterium tuberculosis
DVDERDQPFITGER

SEQ ID NO: 191621 - protein, 14 aa, Mycobacterium tuberculosis
VDERDQPFITGERT

SEQ ID NO: 191622 - protein, 14 aa, Mycobacterium tuberculosis
DERDQPFITGERTR

SEQ ID NO: 191623 - protein, 14 aa, Mycobacterium tuberculosis
ERDQPFITGERTRE

SEQ ID NO: 191624 - protein, 14 aa, Mycobacterium tuberculosis
RDQPFITGERTREG

SEQ ID NO: 191625 - protein, 14 aa, Mycobacterium tuberculosis
DQPFITGERTREGF

SEQ ID NO: 191626 - protein, 14 aa, Mycobacterium tuberculosis
QPFITGERTREGFY

SEQ ID NO: 191627 - protein, 14 aa, Mycobacterium tuberculosis
PFITGERTREGFYR

SEQ ID NO: 191628 - protein, 14 aa, Mycobacterium tuberculosis
FITGERTREGFYRT

SEQ ID NO: 191629 - protein, 14 aa, Mycobacterium tuberculosis
ITGERTREGFYRTK

SEQ ID NO: 191630 - protein, 14 aa, Mycobacterium tuberculosis
TGERTREGFYRTKN

SEQ ID NO: 191631 - protein, 14 aa, Mycobacterium tuberculosis
GERTREGFYRTKNG

SEQ ID NO: 191632 - protein, 14 aa, Mycobacterium tuberculosis
ERTREGFYRTKNGI

SEQ ID NO: 191633 - protein, 14 aa, Mycobacterium tuberculosis
RTREGFYRTKNGIE

SEQ ID NO: 191634 - protein, 14 aa, Mycobacterium tuberculosis
TREGFYRTKNGIEP

SEQ ID NO: 191635 - protein, 14 aa, Mycobacterium tuberculosis
REGFYRTKNGIEPC

SEQ ID NO: 191636 - protein, 14 aa, Mycobacterium tuberculosis
EGFYRTKNGIEPCI

SEQ ID NO: 191637 - protein, 14 aa, Mycobacterium tuberculosis
GFYRTKNGIEPCIA

SEQ ID NO: 191638 - protein, 14 aa, Mycobacterium tuberculosis
FYRTKNGIEPCIAR

SEQ ID NO: 191639 - protein, 14 aa, Mycobacterium tuberculosis
YRTKNGIEPCIARA

SEQ ID NO: 191640 - protein, 14 aa, Mycobacterium tuberculosis
RTKNGIEPCIARAK

SEQ ID NO: 191641 - protein, 14 aa, Mycobacterium tuberculosis
TKNGIEPCIARAKA

SEQ ID NO: 191642 - protein, 14 aa, Mycobacterium tuberculosis
KNGIEPCIARAKAY

SEQ ID NO: 191643 - protein, 14 aa, Mycobacterium tuberculosis
NGIEPCIARAKAYA

SEQ ID NO: 191644 - protein, 14 aa, Mycobacterium tuberculosis
GIEPCIARAKAYAP

SEQ ID NO: 191645 - protein, 14 aa, Mycobacterium tuberculosis
IEPCIARAKAYAPF

SEQ ID NO: 191646 - protein, 14 aa, Mycobacterium tuberculosis
EPCIARAKAYAPFA

SEQ ID NO: 191647 - protein, 14 aa, Mycobacterium tuberculosis
PCIARAKAYAPFAD

SEQ ID NO: 191648 - protein, 14 aa, Mycobacterium tuberculosis
CIARAKAYAPFADL

SEQ ID NO: 191649 - protein, 14 aa, Mycobacterium tuberculosis
IARAKAYAPFADLI

SEQ ID NO: 191650 - protein, 14 aa, Mycobacterium tuberculosis
ARAKAYAPFADLIW

SEQ ID NO: 191651 - protein, 14 aa, Mycobacterium tuberculosis
RAKAYAPFADLIWM

SEQ ID NO: 191652 - protein, 14 aa, Mycobacterium tuberculosis
AKAYAPFADLIWME

SEQ ID NO: 191653 - protein, 14 aa, Mycobacterium tuberculosis
KAYAPFADLIWMET

SEQ ID NO: 191654 - protein, 14 aa, Mycobacterium tuberculosis
AYAPFADLIWMETG

SEQ ID NO: 191655 - protein, 14 aa, Mycobacterium tuberculosis
YAPFADLIWMETGT

SEQ ID NO: 191656 - protein, 14 aa, Mycobacterium tuberculosis
APFADLIWMETGTP

SEQ ID NO: 191657 - protein, 14 aa, Mycobacterium tuberculosis
PFADLIWMETGTPD

SEQ ID NO: 191658 - protein, 14 aa, Mycobacterium tuberculosis
FADLIWMETGTPDL

SEQ ID NO: 191659 - protein, 14 aa, Mycobacterium tuberculosis
ADLIWMETGTPDLE

SEQ ID NO: 191660 - protein, 14 aa, Mycobacterium tuberculosis
DLIWMETGTPDLEA

SEQ ID NO: 191661 - protein, 14 aa, Mycobacterium tuberculosis
LIWMETGTPDLEAA

SEQ ID NO: 191662 - protein, 14 aa, Mycobacterium tuberculosis
IWMETGTPDLEAAR

SEQ ID NO: 191663 - protein, 14 aa, Mycobacterium tuberculosis
WMETGTPDLEAARQ

SEQ ID NO: 191664 - protein, 14 aa, Mycobacterium tuberculosis
METGTPDLEAARQF

SEQ ID NO: 191665 - protein, 14 aa, Mycobacterium tuberculosis
ETGTPDLEAARQFS

SEQ ID NO: 191666 - protein, 14 aa, Mycobacterium tuberculosis
TGTPDLEAARQFSE

SEQ ID NO: 191667 - protein, 14 aa, Mycobacterium tuberculosis
GTPDLEAARQFSEA

SEQ ID NO: 191668 - protein, 14 aa, Mycobacterium tuberculosis
TPDLEAARQFSEAV

SEQ ID NO: 191669 - protein, 14 aa, Mycobacterium tuberculosis
PDLEAARQFSEAVK

SEQ ID NO: 191670 - protein, 14 aa, Mycobacterium tuberculosis
DLEAARQFSEAVKA

SEQ ID NO: 191671 - protein, 14 aa, Mycobacterium tuberculosis
LEAARQFSEAVKAE

SEQ ID NO: 191672 - protein, 14 aa, Mycobacterium tuberculosis
EAARQFSEAVKAEY

SEQ ID NO: 191673 - protein, 14 aa, Mycobacterium tuberculosis
AARQFSEAVKAEYP

SEQ ID NO: 191674 - protein, 14 aa, Mycobacterium tuberculosis
ARQFSEAVKAEYPD

SEQ ID NO: 191675 - protein, 14 aa, Mycobacterium tuberculosis
RQFSEAVKAEYPDQ

SEQ ID NO: 191676 - protein, 14 aa, Mycobacterium tuberculosis
QFSEAVKAEYPDQM

SEQ ID NO: 191677 - protein, 14 aa, Mycobacterium tuberculosis
FSEAVKAEYPDQML

SEQ ID NO: 191678 - protein, 14 aa, Mycobacterium tuberculosis
SEAVKAEYPDQMLA

SEQ ID NO: 191679 - protein, 14 aa, Mycobacterium tuberculosis
EAVKAEYPDQMLAY

SEQ ID NO: 191680 - protein, 14 aa, Mycobacterium tuberculosis
AVKAEYPDQMLAYN

SEQ ID NO: 191681 - protein, 14 aa, Mycobacterium tuberculosis
VKAEYPDQMLAYNC

SEQ ID NO: 191682 - protein, 14 aa, Mycobacterium tuberculosis
KAEYPDQMLAYNCS

SEQ ID NO: 191683 - protein, 14 aa, Mycobacterium tuberculosis
AEYPDQMLAYNCSP

SEQ ID NO: 191684 - protein, 14 aa, Mycobacterium tuberculosis
EYPDQMLAYNCSPS

SEQ ID NO: 191685 - protein, 14 aa, Mycobacterium tuberculosis
YPDQMLAYNCSPSF

SEQ ID NO: 191686 - protein, 14 aa, Mycobacterium tuberculosis
PDQMLAYNCSPSFN

SEQ ID NO: 191687 - protein, 14 aa, Mycobacterium tuberculosis
DQMLAYNCSPSFNW

SEQ ID NO: 191688 - protein, 14 aa, Mycobacterium tuberculosis
QMLAYNCSPSFNWK

SEQ ID NO: 191689 - protein, 14 aa, Mycobacterium tuberculosis
MLAYNCSPSFNWKK

SEQ ID NO: 191690 - protein, 14 aa, Mycobacterium tuberculosis
LAYNCSPSFNWKKH

SEQ ID NO: 191691 - protein, 14 aa, Mycobacterium tuberculosis
AYNCSPSFNWKKHL

SEQ ID NO: 191692 - protein, 14 aa, Mycobacterium tuberculosis
YNCSPSFNWKKHLD

SEQ ID NO: 191693 - protein, 14 aa, Mycobacterium tuberculosis
NCSPSFNWKKHLDD

SEQ ID NO: 191694 - protein, 14 aa, Mycobacterium tuberculosis
CSPSFNWKKHLDDA

SEQ ID NO: 191695 - protein, 14 aa, Mycobacterium tuberculosis
SPSFNWKKHLDDAT

SEQ ID NO: 191696 - protein, 14 aa, Mycobacterium tuberculosis
PSFNWKKHLDDATI

SEQ ID NO: 191697 - protein, 14 aa, Mycobacterium tuberculosis
SFNWKKHLDDATIA

SEQ ID NO: 191698 - protein, 14 aa, Mycobacterium tuberculosis
FNWKKHLDDATIAK

SEQ ID NO: 191699 - protein, 14 aa, Mycobacterium tuberculosis
NWKKHLDDATIAKF

SEQ ID NO: 191700 - protein, 14 aa, Mycobacterium tuberculosis
WKKHLDDATIAKFQ

SEQ ID NO: 191701 - protein, 14 aa, Mycobacterium tuberculosis
KKHLDDATIAKFQK

SEQ ID NO: 191702 - protein, 14 aa, Mycobacterium tuberculosis
KHLDDATIAKFQKE

SEQ ID NO: 191703 - protein, 14 aa, Mycobacterium tuberculosis
HLDDATIAKFQKEL

SEQ ID NO: 191704 - protein, 14 aa, Mycobacterium tuberculosis
LDDATIAKFQKELA

SEQ ID NO: 191705 - protein, 14 aa, Mycobacterium tuberculosis
DDATIAKFQKELAA

SEQ ID NO: 191706 - protein, 14 aa, Mycobacterium tuberculosis
DATIAKFQKELAAM

SEQ ID NO: 191707 - protein, 14 aa, Mycobacterium tuberculosis
ATIAKFQKELAAMG

SEQ ID NO: 191708 - protein, 14 aa, Mycobacterium tuberculosis
TIAKFQKELAAMGF

SEQ ID NO: 191709 - protein, 14 aa, Mycobacterium tuberculosis
IAKFQKELAAMGFK

SEQ ID NO: 191710 - protein, 14 aa, Mycobacterium tuberculosis
AKFQKELAAMGFKF

SEQ ID NO: 191711 - protein, 14 aa, Mycobacterium tuberculosis
KFQKELAAMGFKFQ

SEQ ID NO: 191712 - protein, 14 aa, Mycobacterium tuberculosis
FQKELAAMGFKFQF

SEQ ID NO: 191713 - protein, 14 aa, Mycobacterium tuberculosis
QKELAAMGFKFQFI

SEQ ID NO: 191714 - protein, 14 aa, Mycobacterium tuberculosis
KELAAMGFKFQFIT

SEQ ID NO: 191715 - protein, 14 aa, Mycobacterium tuberculosis
ELAAMGFKFQFITL

SEQ ID NO: 191716 - protein, 14 aa, Mycobacterium tuberculosis
LAAMGFKFQFITLA

SEQ ID NO: 191717 - protein, 14 aa, Mycobacterium tuberculosis
AAMGFKFQFITLAG

SEQ ID NO: 191718 - protein, 14 aa, Mycobacterium tuberculosis
AMGFKFQFITLAGF

SEQ ID NO: 191719 - protein, 14 aa, Mycobacterium tuberculosis
MGFKFQFITLAGFH

SEQ ID NO: 191720 - protein, 14 aa, Mycobacterium tuberculosis
GFKFQFITLAGFHA

SEQ ID NO: 191721 - protein, 14 aa, Mycobacterium tuberculosis
FKFQFITLAGFHAL

SEQ ID NO: 191722 - protein, 14 aa, Mycobacterium tuberculosis
KFQFITLAGFHALN

SEQ ID NO: 191723 - protein, 14 aa, Mycobacterium tuberculosis
FQFITLAGFHALNY

SEQ ID NO: 191724 - protein, 14 aa, Mycobacterium tuberculosis
QFITLAGFHALNYS

SEQ ID NO: 191725 - protein, 14 aa, Mycobacterium tuberculosis
FITLAGFHALNYSM

SEQ ID NO: 191726 - protein, 14 aa, Mycobacterium tuberculosis
ITLAGFHALNYSMF

SEQ ID NO: 191727 - protein, 14 aa, Mycobacterium tuberculosis
TLAGFHALNYSMFD

SEQ ID NO: 191728 - protein, 14 aa, Mycobacterium tuberculosis
LAGFHALNYSMFDL

SEQ ID NO: 191729 - protein, 14 aa, Mycobacterium tuberculosis
AGFHALNYSMFDLA

SEQ ID NO: 191730 - protein, 14 aa, Mycobacterium tuberculosis
GFHALNYSMFDLAY

SEQ ID NO: 191731 - protein, 14 aa, Mycobacterium tuberculosis
FHALNYSMFDLAYG

SEQ ID NO: 191732 - protein, 14 aa, Mycobacterium tuberculosis
HALNYSMFDLAYGY

SEQ ID NO: 191733 - protein, 14 aa, Mycobacterium tuberculosis
ALNYSMFDLAYGYA

SEQ ID NO: 191734 - protein, 14 aa, Mycobacterium tuberculosis
LNYSMFDLAYGYAQ

SEQ ID NO: 191735 - protein, 14 aa, Mycobacterium tuberculosis
NYSMFDLAYGYAQN

SEQ ID NO: 191736 - protein, 14 aa, Mycobacterium tuberculosis
YSMFDLAYGYAQNQ

SEQ ID NO: 191737 - protein, 14 aa, Mycobacterium tuberculosis
SMFDLAYGYAQNQM

SEQ ID NO: 191738 - protein, 14 aa, Mycobacterium tuberculosis
MFDLAYGYAQNQMS

SEQ ID NO: 191739 - protein, 14 aa, Mycobacterium tuberculosis
FDLAYGYAQNQMSA

SEQ ID NO: 191740 - protein, 14 aa, Mycobacterium tuberculosis
DLAYGYAQNQMSAY

SEQ ID NO: 191741 - protein, 14 aa, Mycobacterium tuberculosis
LAYGYAQNQMSAYV

SEQ ID NO: 191742 - protein, 14 aa, Mycobacterium tuberculosis
AYGYAQNQMSAYVE

SEQ ID NO: 191743 - protein, 14 aa, Mycobacterium tuberculosis
YGYAQNQMSAYVEL

SEQ ID NO: 191744 - protein, 14 aa, Mycobacterium tuberculosis
GYAQNQMSAYVELQ

SEQ ID NO: 191745 - protein, 14 aa, Mycobacterium tuberculosis
YAQNQMSAYVELQE

SEQ ID NO: 191746 - protein, 14 aa, Mycobacterium tuberculosis
AQNQMSAYVELQER

SEQ ID NO: 191747 - protein, 14 aa, Mycobacterium tuberculosis
QNQMSAYVELQERE

SEQ ID NO: 191748 - protein, 14 aa, Mycobacterium tuberculosis
NQMSAYVELQEREF

SEQ ID NO: 191749 - protein, 14 aa, Mycobacterium tuberculosis
QMSAYVELQEREFA

SEQ ID NO: 191750 - protein, 14 aa, Mycobacterium tuberculosis
MSAYVELQEREFAA

SEQ ID NO: 191751 - protein, 14 aa, Mycobacterium tuberculosis
SAYVELQEREFAAE

SEQ ID NO: 191752 - protein, 14 aa, Mycobacterium tuberculosis
AYVELQEREFAAEE

SEQ ID NO: 191753 - protein, 14 aa, Mycobacterium tuberculosis
YVELQEREFAAEER

SEQ ID NO: 191754 - protein, 14 aa, Mycobacterium tuberculosis
VELQEREFAAEERG

SEQ ID NO: 191755 - protein, 14 aa, Mycobacterium tuberculosis
ELQEREFAAEERGY

SEQ ID NO: 191756 - protein, 14 aa, Mycobacterium tuberculosis
LQEREFAAEERGYT

SEQ ID NO: 191757 - protein, 14 aa, Mycobacterium tuberculosis
QEREFAAEERGYTA

SEQ ID NO: 191758 - protein, 14 aa, Mycobacterium tuberculosis
EREFAAEERGYTAT

SEQ ID NO: 191759 - protein, 14 aa, Mycobacterium tuberculosis
REFAAEERGYTATK

SEQ ID NO: 191760 - protein, 14 aa, Mycobacterium tuberculosis
EFAAEERGYTATKH

SEQ ID NO: 191761 - protein, 14 aa, Mycobacterium tuberculosis
FAAEERGYTATKHQ

SEQ ID NO: 191762 - protein, 14 aa, Mycobacterium tuberculosis
AAEERGYTATKHQR

SEQ ID NO: 191763 - protein, 14 aa, Mycobacterium tuberculosis
AEERGYTATKHQRE

SEQ ID NO: 191764 - protein, 14 aa, Mycobacterium tuberculosis
EERGYTATKHQREV

SEQ ID NO: 191765 - protein, 14 aa, Mycobacterium tuberculosis
ERGYTATKHQREVG

SEQ ID NO: 191766 - protein, 14 aa, Mycobacterium tuberculosis
RGYTATKHQREVGA

SEQ ID NO: 191767 - protein, 14 aa, Mycobacterium tuberculosis
GYTATKHQREVGAG

SEQ ID NO: 191768 - protein, 14 aa, Mycobacterium tuberculosis
YTATKHQREVGAGY

SEQ ID NO: 191769 - protein, 14 aa, Mycobacterium tuberculosis
TATKHQREVGAGYF

SEQ ID NO: 191770 - protein, 14 aa, Mycobacterium tuberculosis
ATKHQREVGAGYFD

SEQ ID NO: 191771 - protein, 14 aa, Mycobacterium tuberculosis
TKHQREVGAGYFDR

SEQ ID NO: 191772 - protein, 14 aa, Mycobacterium tuberculosis
KHQREVGAGYFDRI

SEQ ID NO: 191773 - protein, 14 aa, Mycobacterium tuberculosis
HQREVGAGYFDRIA

SEQ ID NO: 191774 - protein, 14 aa, Mycobacterium tuberculosis
QREVGAGYFDRIAT

SEQ ID NO: 191775 - protein, 14 aa, Mycobacterium tuberculosis
REVGAGYFDRIATT

SEQ ID NO: 191776 - protein, 14 aa, Mycobacterium tuberculosis
EVGAGYFDRIATTV

SEQ ID NO: 191777 - protein, 14 aa, Mycobacterium tuberculosis
VGAGYFDRIATTVD

SEQ ID NO: 191778 - protein, 14 aa, Mycobacterium tuberculosis
GAGYFDRIATTVDP

SEQ ID NO: 191779 - protein, 14 aa, Mycobacterium tuberculosis
AGYFDRIATTVDPN

SEQ ID NO: 191780 - protein, 14 aa, Mycobacterium tuberculosis
GYFDRIATTVDPNS

SEQ ID NO: 191781 - protein, 14 aa, Mycobacterium tuberculosis
YFDRIATTVDPNSS

SEQ ID NO: 191782 - protein, 14 aa, Mycobacterium tuberculosis
FDRIATTVDPNSST

SEQ ID NO: 191783 - protein, 14 aa, Mycobacterium tuberculosis
DRIATTVDPNSSTT

SEQ ID NO: 191784 - protein, 14 aa, Mycobacterium tuberculosis
RIATTVDPNSSTTA

SEQ ID NO: 191785 - protein, 14 aa, Mycobacterium tuberculosis
IATTVDPNSSTTAL

SEQ ID NO: 191786 - protein, 14 aa, Mycobacterium tuberculosis
ATTVDPNSSTTALT

SEQ ID NO: 191787 - protein, 14 aa, Mycobacterium tuberculosis
TTVDPNSSTTALTG

SEQ ID NO: 191788 - protein, 14 aa, Mycobacterium tuberculosis
TVDPNSSTTALTGS

SEQ ID NO: 191789 - protein, 14 aa, Mycobacterium tuberculosis
VDPNSSTTALTGST

SEQ ID NO: 191790 - protein, 14 aa, Mycobacterium tuberculosis
DPNSSTTALTGSTE

SEQ ID NO: 191791 - protein, 14 aa, Mycobacterium tuberculosis
PNSSTTALTGSTEE

SEQ ID NO: 191792 - protein, 14 aa, Mycobacterium tuberculosis
NSSTTALTGSTEEG

SEQ ID NO: 191793 - protein, 14 aa, Mycobacterium tuberculosis
SSTTALTGSTEEGQ

SEQ ID NO: 191794 - protein, 14 aa, Mycobacterium tuberculosis
STTALTGSTEEGQF

SEQ ID NO: 191795 - protein, 14 aa, Mycobacterium tuberculosis
TTALTGSTEEGQFH

SEQ ID NO: 191796 - protein, 15 aa, Mycobacterium tuberculosis
MSVVGTPKSAEQIQQ

SEQ ID NO: 191797 - protein, 15 aa, Mycobacterium tuberculosis
SVVGTPKSAEQIQQE

SEQ ID NO: 191798 - protein, 15 aa, Mycobacterium tuberculosis
VVGTPKSAEQIQQEW

SEQ ID NO: 191799 - protein, 15 aa, Mycobacterium tuberculosis
VGTPKSAEQIQQEWD

SEQ ID NO: 191800 - protein, 15 aa, Mycobacterium tuberculosis
GTPKSAEQIQQEWDT

SEQ ID NO: 191801 - protein, 15 aa, Mycobacterium tuberculosis
TPKSAEQIQQEWDTN

SEQ ID NO: 191802 - protein, 15 aa, Mycobacterium tuberculosis
PKSAEQIQQEWDTNP

SEQ ID NO: 191803 - protein, 15 aa, Mycobacterium tuberculosis
KSAEQIQQEWDTNPR

SEQ ID NO: 191804 - protein, 15 aa, Mycobacterium tuberculosis
SAEQIQQEWDTNPRW

SEQ ID NO: 191805 - protein, 15 aa, Mycobacterium tuberculosis
AEQIQQEWDTNPRWK

SEQ ID NO: 191806 - protein, 15 aa, Mycobacterium tuberculosis
EQIQQEWDTNPRWKD

SEQ ID NO: 191807 - protein, 15 aa, Mycobacterium tuberculosis
QIQQEWDTNPRWKDV

SEQ ID NO: 191808 - protein, 15 aa, Mycobacterium tuberculosis
IQQEWDTNPRWKDVT

SEQ ID NO: 191809 - protein, 15 aa, Mycobacterium tuberculosis
QQEWDTNPRWKDVTR

SEQ ID NO: 191810 - protein, 15 aa, Mycobacterium tuberculosis
QEWDTNPRWKDVTRT

SEQ ID NO: 191811 - protein, 15 aa, Mycobacterium tuberculosis
EWDTNPRWKDVTRTY

SEQ ID NO: 191812 - protein, 15 aa, Mycobacterium tuberculosis
WDTNPRWKDVTRTYS

SEQ ID NO: 191813 - protein, 15 aa, Mycobacterium tuberculosis
DTNPRWKDVTRTYSA

SEQ ID NO: 191814 - protein, 15 aa, Mycobacterium tuberculosis
TNPRWKDVTRTYSAE

SEQ ID NO: 191815 - protein, 15 aa, Mycobacterium tuberculosis
NPRWKDVTRTYSAED

SEQ ID NO: 191816 - protein, 15 aa, Mycobacterium tuberculosis
PRWKDVTRTYSAEDV

SEQ ID NO: 191817 - protein, 15 aa, Mycobacterium tuberculosis
RWKDVTRTYSAEDVV

SEQ ID NO: 191818 - protein, 15 aa, Mycobacterium tuberculosis
WKDVTRTYSAEDVVA

SEQ ID NO: 191819 - protein, 15 aa, Mycobacterium tuberculosis
KDVTRTYSAEDVVAL

SEQ ID NO: 191820 - protein, 15 aa, Mycobacterium tuberculosis
DVTRTYSAEDVVALQ

SEQ ID NO: 191821 - protein, 15 aa, Mycobacterium tuberculosis
VTRTYSAEDVVALQG

SEQ ID NO: 191822 - protein, 15 aa, Mycobacterium tuberculosis
TRTYSAEDVVALQGS

SEQ ID NO: 191823 - protein, 15 aa, Mycobacterium tuberculosis
RTYSAEDVVALQGSV

SEQ ID NO: 191824 - protein, 15 aa, Mycobacterium tuberculosis
TYSAEDVVALQGSVV

SEQ ID NO: 191825 - protein, 15 aa, Mycobacterium tuberculosis
YSAEDVVALQGSVVE

SEQ ID NO: 191826 - protein, 15 aa, Mycobacterium tuberculosis
SAEDVVALQGSVVEE

SEQ ID NO: 191827 - protein, 15 aa, Mycobacterium tuberculosis
AEDVVALQGSVVEEH

SEQ ID NO: 191828 - protein, 15 aa, Mycobacterium tuberculosis
EDVVALQGSVVEEHT

SEQ ID NO: 191829 - protein, 15 aa, Mycobacterium tuberculosis
DVVALQGSVVEEHTL

SEQ ID NO: 191830 - protein, 15 aa, Mycobacterium tuberculosis
VVALQGSVVEEHTLA

SEQ ID NO: 191831 - protein, 15 aa, Mycobacterium tuberculosis
VALQGSVVEEHTLAR

SEQ ID NO: 191832 - protein, 15 aa, Mycobacterium tuberculosis
ALQGSVVEEHTLARR

SEQ ID NO: 191833 - protein, 15 aa, Mycobacterium tuberculosis
LQGSVVEEHTLARRG

SEQ ID NO: 191834 - protein, 15 aa, Mycobacterium tuberculosis
QGSVVEEHTLARRGA

SEQ ID NO: 191835 - protein, 15 aa, Mycobacterium tuberculosis
GSVVEEHTLARRGAE

SEQ ID NO: 191836 - protein, 15 aa, Mycobacterium tuberculosis
SVVEEHTLARRGAEV

SEQ ID NO: 191837 - protein, 15 aa, Mycobacterium tuberculosis
VVEEHTLARRGAEVL

SEQ ID NO: 191838 - protein, 15 aa, Mycobacterium tuberculosis
VEEHTLARRGAEVLW

SEQ ID NO: 191839 - protein, 15 aa, Mycobacterium tuberculosis
EEHTLARRGAEVLWE

SEQ ID NO: 191840 - protein, 15 aa, Mycobacterium tuberculosis
EHTLARRGAEVLWEQ

SEQ ID NO: 191841 - protein, 15 aa, Mycobacterium tuberculosis
HTLARRGAEVLWEQL

SEQ ID NO: 191842 - protein, 15 aa, Mycobacterium tuberculosis
TLARRGAEVLWEQLH

SEQ ID NO: 191843 - protein, 15 aa, Mycobacterium tuberculosis
LARRGAEVLWEQLHD

SEQ ID NO: 191844 - protein, 15 aa, Mycobacterium tuberculosis
ARRGAEVLWEQLHDL

SEQ ID NO: 191845 - protein, 15 aa, Mycobacterium tuberculosis
RRGAEVLWEQLHDLE

SEQ ID NO: 191846 - protein, 15 aa, Mycobacterium tuberculosis
RGAEVLWEQLHDLEW

SEQ ID NO: 191847 - protein, 15 aa, Mycobacterium tuberculosis
GAEVLWEQLHDLEWV

SEQ ID NO: 191848 - protein, 15 aa, Mycobacterium tuberculosis
AEVLWEQLHDLEWVN

SEQ ID NO: 191849 - protein, 15 aa, Mycobacterium tuberculosis
EVLWEQLHDLEWVNA

SEQ ID NO: 191850 - protein, 15 aa, Mycobacterium tuberculosis
VLWEQLHDLEWVNAL

SEQ ID NO: 191851 - protein, 15 aa, Mycobacterium tuberculosis
LWEQLHDLEWVNALG

SEQ ID NO: 191852 - protein, 15 aa, Mycobacterium tuberculosis
WEQLHDLEWVNALGA

SEQ ID NO: 191853 - protein, 15 aa, Mycobacterium tuberculosis
EQLHDLEWVNALGAL

SEQ ID NO: 191854 - protein, 15 aa, Mycobacterium tuberculosis
QLHDLEWVNALGALT

SEQ ID NO: 191855 - protein, 15 aa, Mycobacterium tuberculosis
LHDLEWVNALGALTG

SEQ ID NO: 191856 - protein, 15 aa, Mycobacterium tuberculosis
HDLEWVNALGALTGN

SEQ ID NO: 191857 - protein, 15 aa, Mycobacterium tuberculosis
DLEWVNALGALTGNM

SEQ ID NO: 191858 - protein, 15 aa, Mycobacterium tuberculosis
LEWVNALGALTGNMA

SEQ ID NO: 191859 - protein, 15 aa, Mycobacterium tuberculosis
EWVNALGALTGNMAV

SEQ ID NO: 191860 - protein, 15 aa, Mycobacterium tuberculosis
WVNALGALTGNMAVQ

SEQ ID NO: 191861 - protein, 15 aa, Mycobacterium tuberculosis
VNALGALTGNMAVQQ

SEQ ID NO: 191862 - protein, 15 aa, Mycobacterium tuberculosis
NALGALTGNMAVQQV

SEQ ID NO: 191863 - protein, 15 aa, Mycobacterium tuberculosis
ALGALTGNMAVQQVR

SEQ ID NO: 191864 - protein, 15 aa, Mycobacterium tuberculosis
LGALTGNMAVQQVRA

SEQ ID NO: 191865 - protein, 15 aa, Mycobacterium tuberculosis
GALTGNMAVQQVRAG

SEQ ID NO: 191866 - protein, 15 aa, Mycobacterium tuberculosis
ALTGNMAVQQVRAGL

SEQ ID NO: 191867 - protein, 15 aa, Mycobacterium tuberculosis
LTGNMAVQQVRAGLK

SEQ ID NO: 191868 - protein, 15 aa, Mycobacterium tuberculosis
TGNMAVQQVRAGLKA

SEQ ID NO: 191869 - protein, 15 aa, Mycobacterium tuberculosis
GNMAVQQVRAGLKAI

SEQ ID NO: 191870 - protein, 15 aa, Mycobacterium tuberculosis
NMAVQQVRAGLKAIY

SEQ ID NO: 191871 - protein, 15 aa, Mycobacterium tuberculosis
MAVQQVRAGLKAIYL

SEQ ID NO: 191872 - protein, 15 aa, Mycobacterium tuberculosis
AVQQVRAGLKAIYLS

SEQ ID NO: 191873 - protein, 15 aa, Mycobacterium tuberculosis
VQQVRAGLKAIYLSG

SEQ ID NO: 191874 - protein, 15 aa, Mycobacterium tuberculosis
QQVRAGLKAIYLSGW

SEQ ID NO: 191875 - protein, 15 aa, Mycobacterium tuberculosis
QVRAGLKAIYLSGWQ

SEQ ID NO: 191876 - protein, 15 aa, Mycobacterium tuberculosis
VRAGLKAIYLSGWQV

SEQ ID NO: 191877 - protein, 15 aa, Mycobacterium tuberculosis
RAGLKAIYLSGWQVA

SEQ ID NO: 191878 - protein, 15 aa, Mycobacterium tuberculosis
AGLKAIYLSGWQVAG

SEQ ID NO: 191879 - protein, 15 aa, Mycobacterium tuberculosis
GLKAIYLSGWQVAGD

SEQ ID NO: 191880 - protein, 15 aa, Mycobacterium tuberculosis
LKAIYLSGWQVAGDA

SEQ ID NO: 191881 - protein, 15 aa, Mycobacterium tuberculosis
KAIYLSGWQVAGDAN

SEQ ID NO: 191882 - protein, 15 aa, Mycobacterium tuberculosis
AIYLSGWQVAGDANL

SEQ ID NO: 191883 - protein, 15 aa, Mycobacterium tuberculosis
IYLSGWQVAGDANLS

SEQ ID NO: 191884 - protein, 15 aa, Mycobacterium tuberculosis
YLSGWQVAGDANLSG

SEQ ID NO: 191885 - protein, 15 aa, Mycobacterium tuberculosis
LSGWQVAGDANLSGH

SEQ ID NO: 191886 - protein, 15 aa, Mycobacterium tuberculosis
SGWQVAGDANLSGHT

SEQ ID NO: 191887 - protein, 15 aa, Mycobacterium tuberculosis
GWQVAGDANLSGHTY

SEQ ID NO: 191888 - protein, 15 aa, Mycobacterium tuberculosis
WQVAGDANLSGHTYP

SEQ ID NO: 191889 - protein, 15 aa, Mycobacterium tuberculosis
QVAGDANLSGHTYPD

SEQ ID NO: 191890 - protein, 15 aa, Mycobacterium tuberculosis
VAGDANLSGHTYPDQ

SEQ ID NO: 191891 - protein, 15 aa, Mycobacterium tuberculosis
AGDANLSGHTYPDQS

SEQ ID NO: 191892 - protein, 15 aa, Mycobacterium tuberculosis
GDANLSGHTYPDQSL

SEQ ID NO: 191893 - protein, 15 aa, Mycobacterium tuberculosis
DANLSGHTYPDQSLY

SEQ ID NO: 191894 - protein, 15 aa, Mycobacterium tuberculosis
ANLSGHTYPDQSLYP

SEQ ID NO: 191895 - protein, 15 aa, Mycobacterium tuberculosis
NLSGHTYPDQSLYPA

SEQ ID NO: 191896 - protein, 15 aa, Mycobacterium tuberculosis
LSGHTYPDQSLYPAN

SEQ ID NO: 191897 - protein, 15 aa, Mycobacterium tuberculosis
SGHTYPDQSLYPANS

SEQ ID NO: 191898 - protein, 15 aa, Mycobacterium tuberculosis
GHTYPDQSLYPANSV

SEQ ID NO: 191899 - protein, 15 aa, Mycobacterium tuberculosis
HTYPDQSLYPANSVP

SEQ ID NO: 191900 - protein, 15 aa, Mycobacterium tuberculosis
TYPDQSLYPANSVPQ

SEQ ID NO: 191901 - protein, 15 aa, Mycobacterium tuberculosis
YPDQSLYPANSVPQV

SEQ ID NO: 191902 - protein, 15 aa, Mycobacterium tuberculosis
PDQSLYPANSVPQVV

SEQ ID NO: 191903 - protein, 15 aa, Mycobacterium tuberculosis
DQSLYPANSVPQVVR

SEQ ID NO: 191904 - protein, 15 aa, Mycobacterium tuberculosis
QSLYPANSVPQVVRR

SEQ ID NO: 191905 - protein, 15 aa, Mycobacterium tuberculosis
SLYPANSVPQVVRRI

SEQ ID NO: 191906 - protein, 15 aa, Mycobacterium tuberculosis
LYPANSVPQVVRRIN

SEQ ID NO: 191907 - protein, 15 aa, Mycobacterium tuberculosis
YPANSVPQVVRRINN

SEQ ID NO: 191908 - protein, 15 aa, Mycobacterium tuberculosis
PANSVPQVVRRINNA

SEQ ID NO: 191909 - protein, 15 aa, Mycobacterium tuberculosis
ANSVPQVVRRINNAL

SEQ ID NO: 191910 - protein, 15 aa, Mycobacterium tuberculosis
NSVPQVVRRINNALQ

SEQ ID NO: 191911 - protein, 15 aa, Mycobacterium tuberculosis
SVPQVVRRINNALQR

SEQ ID NO: 191912 - protein, 15 aa, Mycobacterium tuberculosis
VPQVVRRINNALQRA

SEQ ID NO: 191913 - protein, 15 aa, Mycobacterium tuberculosis
PQVVRRINNALQRAD

SEQ ID NO: 191914 - protein, 15 aa, Mycobacterium tuberculosis
QVVRRINNALQRADQ

SEQ ID NO: 191915 - protein, 15 aa, Mycobacterium tuberculosis
VVRRINNALQRADQI

SEQ ID NO: 191916 - protein, 15 aa, Mycobacterium tuberculosis
VRRINNALQRADQIA

SEQ ID NO: 191917 - protein, 15 aa, Mycobacterium tuberculosis
RRINNALQRADQIAK

SEQ ID NO: 191918 - protein, 15 aa, Mycobacterium tuberculosis
RINNALQRADQIAKI

SEQ ID NO: 191919 - protein, 15 aa, Mycobacterium tuberculosis
INNALQRADQIAKIE

SEQ ID NO: 191920 - protein, 15 aa, Mycobacterium tuberculosis
NNALQRADQIAKIEG

SEQ ID NO: 191921 - protein, 15 aa, Mycobacterium tuberculosis
NALQRADQIAKIEGD

SEQ ID NO: 191922 - protein, 15 aa, Mycobacterium tuberculosis
ALQRADQIAKIEGDT

SEQ ID NO: 191923 - protein, 15 aa, Mycobacterium tuberculosis
LQRADQIAKIEGDTS

SEQ ID NO: 191924 - protein, 15 aa, Mycobacterium tuberculosis
QRADQIAKIEGDTSV

SEQ ID NO: 191925 - protein, 15 aa, Mycobacterium tuberculosis
RADQIAKIEGDTSVE

SEQ ID NO: 191926 - protein, 15 aa, Mycobacterium tuberculosis
ADQIAKIEGDTSVEN

SEQ ID NO: 191927 - protein, 15 aa, Mycobacterium tuberculosis
DQIAKIEGDTSVENW

SEQ ID NO: 191928 - protein, 15 aa, Mycobacterium tuberculosis
QIAKIEGDTSVENWL

SEQ ID NO: 191929 - protein, 15 aa, Mycobacterium tuberculosis
IAKIEGDTSVENWLA

SEQ ID NO: 191930 - protein, 15 aa, Mycobacterium tuberculosis
AKIEGDTSVENWLAP

SEQ ID NO: 191931 - protein, 15 aa, Mycobacterium tuberculosis
KIEGDTSVENWLAPI

SEQ ID NO: 191932 - protein, 15 aa, Mycobacterium tuberculosis
IEGDTSVENWLAPIV

SEQ ID NO: 191933 - protein, 15 aa, Mycobacterium tuberculosis
EGDTSVENWLAPIVA

SEQ ID NO: 191934 - protein, 15 aa, Mycobacterium tuberculosis
GDTSVENWLAPIVAD

SEQ ID NO: 191935 - protein, 15 aa, Mycobacterium tuberculosis
DTSVENWLAPIVADG

SEQ ID NO: 191936 - protein, 15 aa, Mycobacterium tuberculosis
TSVENWLAPIVADGE

SEQ ID NO: 191937 - protein, 15 aa, Mycobacterium tuberculosis
SVENWLAPIVADGEA

SEQ ID NO: 191938 - protein, 15 aa, Mycobacterium tuberculosis
VENWLAPIVADGEAG

SEQ ID NO: 191939 - protein, 15 aa, Mycobacterium tuberculosis
ENWLAPIVADGEAGF

SEQ ID NO: 191940 - protein, 15 aa, Mycobacterium tuberculosis
NWLAPIVADGEAGFG

SEQ ID NO: 191941 - protein, 15 aa, Mycobacterium tuberculosis
WLAPIVADGEAGFGG

SEQ ID NO: 191942 - protein, 15 aa, Mycobacterium tuberculosis
LAPIVADGEAGFGGA

SEQ ID NO: 191943 - protein, 15 aa, Mycobacterium tuberculosis
APIVADGEAGFGGAL

SEQ ID NO: 191944 - protein, 15 aa, Mycobacterium tuberculosis
PIVADGEAGFGGALN

SEQ ID NO: 191945 - protein, 15 aa, Mycobacterium tuberculosis
IVADGEAGFGGALNV

SEQ ID NO: 191946 - protein, 15 aa, Mycobacterium tuberculosis
VADGEAGFGGALNVY

SEQ ID NO: 191947 - protein, 15 aa, Mycobacterium tuberculosis
ADGEAGFGGALNVYE

SEQ ID NO: 191948 - protein, 15 aa, Mycobacterium tuberculosis
DGEAGFGGALNVYEL

SEQ ID NO: 191949 - protein, 15 aa, Mycobacterium tuberculosis
GEAGFGGALNVYELQ

SEQ ID NO: 191950 - protein, 15 aa, Mycobacterium tuberculosis
EAGFGGALNVYELQK

SEQ ID NO: 191951 - protein, 15 aa, Mycobacterium tuberculosis
AGFGGALNVYELQKA

SEQ ID NO: 191952 - protein, 15 aa, Mycobacterium tuberculosis
GFGGALNVYELQKAL

SEQ ID NO: 191953 - protein, 15 aa, Mycobacterium tuberculosis
FGGALNVYELQKALI

SEQ ID NO: 191954 - protein, 15 aa, Mycobacterium tuberculosis
GGALNVYELQKALIA

SEQ ID NO: 191955 - protein, 15 aa, Mycobacterium tuberculosis
GALNVYELQKALIAA

SEQ ID NO: 191956 - protein, 15 aa, Mycobacterium tuberculosis
ALNVYELQKALIAAG

SEQ ID NO: 191957 - protein, 15 aa, Mycobacterium tuberculosis
LNVYELQKALIAAGV

SEQ ID NO: 191958 - protein, 15 aa, Mycobacterium tuberculosis
NVYELQKALIAAGVA

SEQ ID NO: 191959 - protein, 15 aa, Mycobacterium tuberculosis
VYELQKALIAAGVAG

SEQ ID NO: 191960 - protein, 15 aa, Mycobacterium tuberculosis
YELQKALIAAGVAGS

SEQ ID NO: 191961 - protein, 15 aa, Mycobacterium tuberculosis
ELQKALIAAGVAGSH

SEQ ID NO: 191962 - protein, 15 aa, Mycobacterium tuberculosis
LQKALIAAGVAGSHW

SEQ ID NO: 191963 - protein, 15 aa, Mycobacterium tuberculosis
QKALIAAGVAGSHWE

SEQ ID NO: 191964 - protein, 15 aa, Mycobacterium tuberculosis
KALIAAGVAGSHWED

SEQ ID NO: 191965 - protein, 15 aa, Mycobacterium tuberculosis
ALIAAGVAGSHWEDQ

SEQ ID NO: 191966 - protein, 15 aa, Mycobacterium tuberculosis
LIAAGVAGSHWEDQL

SEQ ID NO: 191967 - protein, 15 aa, Mycobacterium tuberculosis
IAAGVAGSHWEDQLA

SEQ ID NO: 191968 - protein, 15 aa, Mycobacterium tuberculosis
AAGVAGSHWEDQLAS

SEQ ID NO: 191969 - protein, 15 aa, Mycobacterium tuberculosis
AGVAGSHWEDQLASE

SEQ ID NO: 191970 - protein, 15 aa, Mycobacterium tuberculosis
GVAGSHWEDQLASEK

SEQ ID NO: 191971 - protein, 15 aa, Mycobacterium tuberculosis
VAGSHWEDQLASEKK

SEQ ID NO: 191972 - protein, 15 aa, Mycobacterium tuberculosis
AGSHWEDQLASEKKC

SEQ ID NO: 191973 - protein, 15 aa, Mycobacterium tuberculosis
GSHWEDQLASEKKCG

SEQ ID NO: 191974 - protein, 15 aa, Mycobacterium tuberculosis
SHWEDQLASEKKCGH

SEQ ID NO: 191975 - protein, 15 aa, Mycobacterium tuberculosis
HWEDQLASEKKCGHL

SEQ ID NO: 191976 - protein, 15 aa, Mycobacterium tuberculosis
WEDQLASEKKCGHLG

SEQ ID NO: 191977 - protein, 15 aa, Mycobacterium tuberculosis
EDQLASEKKCGHLGG

SEQ ID NO: 191978 - protein, 15 aa, Mycobacterium tuberculosis
DQLASEKKCGHLGGK

SEQ ID NO: 191979 - protein, 15 aa, Mycobacterium tuberculosis
QLASEKKCGHLGGKV

SEQ ID NO: 191980 - protein, 15 aa, Mycobacterium tuberculosis
LASEKKCGHLGGKVL

SEQ ID NO: 191981 - protein, 15 aa, Mycobacterium tuberculosis
ASEKKCGHLGGKVLI

SEQ ID NO: 191982 - protein, 15 aa, Mycobacterium tuberculosis
SEKKCGHLGGKVLIP

SEQ ID NO: 191983 - protein, 15 aa, Mycobacterium tuberculosis
EKKCGHLGGKVLIPT

SEQ ID NO: 191984 - protein, 15 aa, Mycobacterium tuberculosis
KKCGHLGGKVLIPTQ

SEQ ID NO: 191985 - protein, 15 aa, Mycobacterium tuberculosis
KCGHLGGKVLIPTQQ

SEQ ID NO: 191986 - protein, 15 aa, Mycobacterium tuberculosis
CGHLGGKVLIPTQQH

SEQ ID NO: 191987 - protein, 15 aa, Mycobacterium tuberculosis
GHLGGKVLIPTQQHI

SEQ ID NO: 191988 - protein, 15 aa, Mycobacterium tuberculosis
HLGGKVLIPTQQHIR

SEQ ID NO: 191989 - protein, 15 aa, Mycobacterium tuberculosis
LGGKVLIPTQQHIRT

SEQ ID NO: 191990 - protein, 15 aa, Mycobacterium tuberculosis
GGKVLIPTQQHIRTL

SEQ ID NO: 191991 - protein, 15 aa, Mycobacterium tuberculosis
GKVLIPTQQHIRTLT

SEQ ID NO: 191992 - protein, 15 aa, Mycobacterium tuberculosis
KVLIPTQQHIRTLTS

SEQ ID NO: 191993 - protein, 15 aa, Mycobacterium tuberculosis
VLIPTQQHIRTLTSA

SEQ ID NO: 191994 - protein, 15 aa, Mycobacterium tuberculosis
LIPTQQHIRTLTSAR

SEQ ID NO: 191995 - protein, 15 aa, Mycobacterium tuberculosis
IPTQQHIRTLTSARL

SEQ ID NO: 191996 - protein, 15 aa, Mycobacterium tuberculosis
PTQQHIRTLTSARLA

SEQ ID NO: 191997 - protein, 15 aa, Mycobacterium tuberculosis
TQQHIRTLTSARLAA

SEQ ID NO: 191998 - protein, 15 aa, Mycobacterium tuberculosis
QQHIRTLTSARLAAD

SEQ ID NO: 191999 - protein, 15 aa, Mycobacterium tuberculosis
QHIRTLTSARLAADV

SEQ ID NO: 192000 - protein, 15 aa, Mycobacterium tuberculosis
HIRTLTSARLAADVA

SEQ ID NO: 192001 - protein, 15 aa, Mycobacterium tuberculosis
IRTLTSARLAADVAD

SEQ ID NO: 192002 - protein, 15 aa, Mycobacterium tuberculosis
RTLTSARLAADVADV

SEQ ID NO: 192003 - protein, 15 aa, Mycobacterium tuberculosis
TLTSARLAADVADVP

SEQ ID NO: 192004 - protein, 15 aa, Mycobacterium tuberculosis
LTSARLAADVADVPT

SEQ ID NO: 192005 - protein, 15 aa, Mycobacterium tuberculosis
TSARLAADVADVPTV

SEQ ID NO: 192006 - protein, 15 aa, Mycobacterium tuberculosis
SARLAADVADVPTVV

SEQ ID NO: 192007 - protein, 15 aa, Mycobacterium tuberculosis
ARLAADVADVPTVVI

SEQ ID NO: 192008 - protein, 15 aa, Mycobacterium tuberculosis
RLAADVADVPTVVIA

SEQ ID NO: 192009 - protein, 15 aa, Mycobacterium tuberculosis
LAADVADVPTVVIAR

SEQ ID NO: 192010 - protein, 15 aa, Mycobacterium tuberculosis
AADVADVPTVVIART

SEQ ID NO: 192011 - protein, 15 aa, Mycobacterium tuberculosis
ADVADVPTVVIARTD

SEQ ID NO: 192012 - protein, 15 aa, Mycobacterium tuberculosis
DVADVPTVVIARTDA

SEQ ID NO: 192013 - protein, 15 aa, Mycobacterium tuberculosis
VADVPTVVIARTDAE

SEQ ID NO: 192014 - protein, 15 aa, Mycobacterium tuberculosis
ADVPTVVIARTDAEA

SEQ ID NO: 192015 - protein, 15 aa, Mycobacterium tuberculosis
DVPTVVIARTDAEAA

SEQ ID NO: 192016 - protein, 15 aa, Mycobacterium tuberculosis
VPTVVIARTDAEAAT

SEQ ID NO: 192017 - protein, 15 aa, Mycobacterium tuberculosis
PTVVIARTDAEAATL

SEQ ID NO: 192018 - protein, 15 aa, Mycobacterium tuberculosis
TVVIARTDAEAATLI

SEQ ID NO: 192019 - protein, 15 aa, Mycobacterium tuberculosis
VVIARTDAEAATLIT

SEQ ID NO: 192020 - protein, 15 aa, Mycobacterium tuberculosis
VIARTDAEAATLITS

SEQ ID NO: 192021 - protein, 15 aa, Mycobacterium tuberculosis
IARTDAEAATLITSD

SEQ ID NO: 192022 - protein, 15 aa, Mycobacterium tuberculosis
ARTDAEAATLITSDV

SEQ ID NO: 192023 - protein, 15 aa, Mycobacterium tuberculosis
RTDAEAATLITSDVD

SEQ ID NO: 192024 - protein, 15 aa, Mycobacterium tuberculosis
TDAEAATLITSDVDE

SEQ ID NO: 192025 - protein, 15 aa, Mycobacterium tuberculosis
DAEAATLITSDVDER

SEQ ID NO: 192026 - protein, 15 aa, Mycobacterium tuberculosis
AEAATLITSDVDERD

SEQ ID NO: 192027 - protein, 15 aa, Mycobacterium tuberculosis
EAATLITSDVDERDQ

SEQ ID NO: 192028 - protein, 15 aa, Mycobacterium tuberculosis
AATLITSDVDERDQP

SEQ ID NO: 192029 - protein, 15 aa, Mycobacterium tuberculosis
ATLITSDVDERDQPF

SEQ ID NO: 192030 - protein, 15 aa, Mycobacterium tuberculosis
TLITSDVDERDQPFI

SEQ ID NO: 192031 - protein, 15 aa, Mycobacterium tuberculosis
LITSDVDERDQPFIT

SEQ ID NO: 192032 - protein, 15 aa, Mycobacterium tuberculosis
ITSDVDERDQPFITG

SEQ ID NO: 192033 - protein, 15 aa, Mycobacterium tuberculosis
TSDVDERDQPFITGE

SEQ ID NO: 192034 - protein, 15 aa, Mycobacterium tuberculosis
SDVDERDQPFITGER

SEQ ID NO: 192035 - protein, 15 aa, Mycobacterium tuberculosis
DVDERDQPFITGERT

SEQ ID NO: 192036 - protein, 15 aa, Mycobacterium tuberculosis
VDERDQPFITGERTR

SEQ ID NO: 192037 - protein, 15 aa, Mycobacterium tuberculosis
DERDQPFITGERTRE

SEQ ID NO: 192038 - protein, 15 aa, Mycobacterium tuberculosis
ERDQPFITGERTREG

SEQ ID NO: 192039 - protein, 15 aa, Mycobacterium tuberculosis
RDQPFITGERTREGF

SEQ ID NO: 192040 - protein, 15 aa, Mycobacterium tuberculosis
DQPFITGERTREGFY

SEQ ID NO: 192041 - protein, 15 aa, Mycobacterium tuberculosis
QPFITGERTREGFYR

SEQ ID NO: 192042 - protein, 15 aa, Mycobacterium tuberculosis
PFITGERTREGFYRT

SEQ ID NO: 192043 - protein, 15 aa, Mycobacterium tuberculosis
FITGERTREGFYRTK

SEQ ID NO: 192044 - protein, 15 aa, Mycobacterium tuberculosis
ITGERTREGFYRTKN

SEQ ID NO: 192045 - protein, 15 aa, Mycobacterium tuberculosis
TGERTREGFYRTKNG

SEQ ID NO: 192046 - protein, 15 aa, Mycobacterium tuberculosis
GERTREGFYRTKNGI

SEQ ID NO: 192047 - protein, 15 aa, Mycobacterium tuberculosis
ERTREGFYRTKNGIE

SEQ ID NO: 192048 - protein, 15 aa, Mycobacterium tuberculosis
RTREGFYRTKNGIEP

SEQ ID NO: 192049 - protein, 15 aa, Mycobacterium tuberculosis
TREGFYRTKNGIEPC

SEQ ID NO: 192050 - protein, 15 aa, Mycobacterium tuberculosis
REGFYRTKNGIEPCI

SEQ ID NO: 192051 - protein, 15 aa, Mycobacterium tuberculosis
EGFYRTKNGIEPCIA

SEQ ID NO: 192052 - protein, 15 aa, Mycobacterium tuberculosis
GFYRTKNGIEPCIAR

SEQ ID NO: 192053 - protein, 15 aa, Mycobacterium tuberculosis
FYRTKNGIEPCIARA

SEQ ID NO: 192054 - protein, 15 aa, Mycobacterium tuberculosis
YRTKNGIEPCIARAK

SEQ ID NO: 192055 - protein, 15 aa, Mycobacterium tuberculosis
RTKNGIEPCIARAKA

SEQ ID NO: 192056 - protein, 15 aa, Mycobacterium tuberculosis
TKNGIEPCIARAKAY

SEQ ID NO: 192057 - protein, 15 aa, Mycobacterium tuberculosis
KNGIEPCIARAKAYA

SEQ ID NO: 192058 - protein, 15 aa, Mycobacterium tuberculosis
NGIEPCIARAKAYAP

SEQ ID NO: 192059 - protein, 15 aa, Mycobacterium tuberculosis
GIEPCIARAKAYAPF

SEQ ID NO: 192060 - protein, 15 aa, Mycobacterium tuberculosis
IEPCIARAKAYAPFA

SEQ ID NO: 192061 - protein, 15 aa, Mycobacterium tuberculosis
EPCIARAKAYAPFAD

SEQ ID NO: 192062 - protein, 15 aa, Mycobacterium tuberculosis
PCIARAKAYAPFADL

SEQ ID NO: 192063 - protein, 15 aa, Mycobacterium tuberculosis
CIARAKAYAPFADLI

SEQ ID NO: 192064 - protein, 15 aa, Mycobacterium tuberculosis
IARAKAYAPFADLIW

SEQ ID NO: 192065 - protein, 15 aa, Mycobacterium tuberculosis
ARAKAYAPFADLIWM

SEQ ID NO: 192066 - protein, 15 aa, Mycobacterium tuberculosis
RAKAYAPFADLIWME

SEQ ID NO: 192067 - protein, 15 aa, Mycobacterium tuberculosis
AKAYAPFADLIWMET

SEQ ID NO: 192068 - protein, 15 aa, Mycobacterium tuberculosis
KAYAPFADLIWMETG

SEQ ID NO: 192069 - protein, 15 aa, Mycobacterium tuberculosis
AYAPFADLIWMETGT

SEQ ID NO: 192070 - protein, 15 aa, Mycobacterium tuberculosis
YAPFADLIWMETGTP

SEQ ID NO: 192071 - protein, 15 aa, Mycobacterium tuberculosis
APFADLIWMETGTPD

SEQ ID NO: 192072 - protein, 15 aa, Mycobacterium tuberculosis
PFADLIWMETGTPDL

SEQ ID NO: 192073 - protein, 15 aa, Mycobacterium tuberculosis
FADLIWMETGTPDLE

SEQ ID NO: 192074 - protein, 15 aa, Mycobacterium tuberculosis
ADLIWMETGTPDLEA

SEQ ID NO: 192075 - protein, 15 aa, Mycobacterium tuberculosis
DLIWMETGTPDLEAA

SEQ ID NO: 192076 - protein, 15 aa, Mycobacterium tuberculosis
LIWMETGTPDLEAAR

SEQ ID NO: 192077 - protein, 15 aa, Mycobacterium tuberculosis
IWMETGTPDLEAARQ

SEQ ID NO: 192078 - protein, 15 aa, Mycobacterium tuberculosis
WMETGTPDLEAARQF

SEQ ID NO: 192079 - protein, 15 aa, Mycobacterium tuberculosis
METGTPDLEAARQFS

SEQ ID NO: 192080 - protein, 15 aa, Mycobacterium tuberculosis
ETGTPDLEAARQFSE

SEQ ID NO: 192081 - protein, 15 aa, Mycobacterium tuberculosis
TGTPDLEAARQFSEA

SEQ ID NO: 192082 - protein, 15 aa, Mycobacterium tuberculosis
GTPDLEAARQFSEAV

SEQ ID NO: 192083 - protein, 15 aa, Mycobacterium tuberculosis
TPDLEAARQFSEAVK

SEQ ID NO: 192084 - protein, 15 aa, Mycobacterium tuberculosis
PDLEAARQFSEAVKA

SEQ ID NO: 192085 - protein, 15 aa, Mycobacterium tuberculosis
DLEAARQFSEAVKAE

SEQ ID NO: 192086 - protein, 15 aa, Mycobacterium tuberculosis
LEAARQFSEAVKAEY

SEQ ID NO: 192087 - protein, 15 aa, Mycobacterium tuberculosis
EAARQFSEAVKAEYP

SEQ ID NO: 192088 - protein, 15 aa, Mycobacterium tuberculosis
AARQFSEAVKAEYPD

SEQ ID NO: 192089 - protein, 15 aa, Mycobacterium tuberculosis
ARQFSEAVKAEYPDQ

SEQ ID NO: 192090 - protein, 15 aa, Mycobacterium tuberculosis
RQFSEAVKAEYPDQM

SEQ ID NO: 192091 - protein, 15 aa, Mycobacterium tuberculosis
QFSEAVKAEYPDQML

SEQ ID NO: 192092 - protein, 15 aa, Mycobacterium tuberculosis
FSEAVKAEYPDQMLA

SEQ ID NO: 192093 - protein, 15 aa, Mycobacterium tuberculosis
SEAVKAEYPDQMLAY

SEQ ID NO: 192094 - protein, 15 aa, Mycobacterium tuberculosis
EAVKAEYPDQMLAYN

SEQ ID NO: 192095 - protein, 15 aa, Mycobacterium tuberculosis
AVKAEYPDQMLAYNC

SEQ ID NO: 192096 - protein, 15 aa, Mycobacterium tuberculosis
VKAEYPDQMLAYNCS

SEQ ID NO: 192097 - protein, 15 aa, Mycobacterium tuberculosis
KAEYPDQMLAYNCSP

SEQ ID NO: 192098 - protein, 15 aa, Mycobacterium tuberculosis
AEYPDQMLAYNCSPS

SEQ ID NO: 192099 - protein, 15 aa, Mycobacterium tuberculosis
EYPDQMLAYNCSPSF

SEQ ID NO: 192100 - protein, 15 aa, Mycobacterium tuberculosis
YPDQMLAYNCSPSFN

SEQ ID NO: 192101 - protein, 15 aa, Mycobacterium tuberculosis
PDQMLAYNCSPSFNW

SEQ ID NO: 192102 - protein, 15 aa, Mycobacterium tuberculosis
DQMLAYNCSPSFNWK

SEQ ID NO: 192103 - protein, 15 aa, Mycobacterium tuberculosis
QMLAYNCSPSFNWKK

SEQ ID NO: 192104 - protein, 15 aa, Mycobacterium tuberculosis
MLAYNCSPSFNWKKH

SEQ ID NO: 192105 - protein, 15 aa, Mycobacterium tuberculosis
LAYNCSPSFNWKKHL

SEQ ID NO: 192106 - protein, 15 aa, Mycobacterium tuberculosis
AYNCSPSFNWKKHLD

SEQ ID NO: 192107 - protein, 15 aa, Mycobacterium tuberculosis
YNCSPSFNWKKHLDD

SEQ ID NO: 192108 - protein, 15 aa, Mycobacterium tuberculosis
NCSPSFNWKKHLDDA

SEQ ID NO: 192109 - protein, 15 aa, Mycobacterium tuberculosis
CSPSFNWKKHLDDAT

SEQ ID NO: 192110 - protein, 15 aa, Mycobacterium tuberculosis
SPSFNWKKHLDDATI

SEQ ID NO: 192111 - protein, 15 aa, Mycobacterium tuberculosis
PSFNWKKHLDDATIA

SEQ ID NO: 192112 - protein, 15 aa, Mycobacterium tuberculosis
SFNWKKHLDDATIAK

SEQ ID NO: 192113 - protein, 15 aa, Mycobacterium tuberculosis
FNWKKHLDDATIAKF

SEQ ID NO: 192114 - protein, 15 aa, Mycobacterium tuberculosis
NWKKHLDDATIAKFQ

SEQ ID NO: 192115 - protein, 15 aa, Mycobacterium tuberculosis
WKKHLDDATIAKFQK

SEQ ID NO: 192116 - protein, 15 aa, Mycobacterium tuberculosis
KKHLDDATIAKFQKE

SEQ ID NO: 192117 - protein, 15 aa, Mycobacterium tuberculosis
KHLDDATIAKFQKEL

SEQ ID NO: 192118 - protein, 15 aa, Mycobacterium tuberculosis
HLDDATIAKFQKELA

SEQ ID NO: 192119 - protein, 15 aa, Mycobacterium tuberculosis
LDDATIAKFQKELAA

SEQ ID NO: 192120 - protein, 15 aa, Mycobacterium tuberculosis
DDATIAKFQKELAAM

SEQ ID NO: 192121 - protein, 15 aa, Mycobacterium tuberculosis
DATIAKFQKELAAMG

SEQ ID NO: 192122 - protein, 15 aa, Mycobacterium tuberculosis
ATIAKFQKELAAMGF

SEQ ID NO: 192123 - protein, 15 aa, Mycobacterium tuberculosis
TIAKFQKELAAMGFK

SEQ ID NO: 192124 - protein, 15 aa, Mycobacterium tuberculosis
IAKFQKELAAMGFKF

SEQ ID NO: 192125 - protein, 15 aa, Mycobacterium tuberculosis
AKFQKELAAMGFKFQ

SEQ ID NO: 192126 - protein, 15 aa, Mycobacterium tuberculosis
KFQKELAAMGFKFQF

SEQ ID NO: 192127 - protein, 15 aa, Mycobacterium tuberculosis
FQKELAAMGFKFQFI

SEQ ID NO: 192128 - protein, 15 aa, Mycobacterium tuberculosis
QKELAAMGFKFQFIT

SEQ ID NO: 192129 - protein, 15 aa, Mycobacterium tuberculosis
KELAAMGFKFQFITL

SEQ ID NO: 192130 - protein, 15 aa, Mycobacterium tuberculosis
ELAAMGFKFQFITLA

SEQ ID NO: 192131 - protein, 15 aa, Mycobacterium tuberculosis
LAAMGFKFQFITLAG

SEQ ID NO: 192132 - protein, 15 aa, Mycobacterium tuberculosis
AAMGFKFQFITLAGF

SEQ ID NO: 192133 - protein, 15 aa, Mycobacterium tuberculosis
AMGFKFQFITLAGFH

SEQ ID NO: 192134 - protein, 15 aa, Mycobacterium tuberculosis
MGFKFQFITLAGFHA

SEQ ID NO: 192135 - protein, 15 aa, Mycobacterium tuberculosis
GFKFQFITLAGFHAL

SEQ ID NO: 192136 - protein, 15 aa, Mycobacterium tuberculosis
FKFQFITLAGFHALN

SEQ ID NO: 192137 - protein, 15 aa, Mycobacterium tuberculosis
KFQFITLAGFHALNY

SEQ ID NO: 192138 - protein, 15 aa, Mycobacterium tuberculosis
FQFITLAGFHALNYS

SEQ ID NO: 192139 - protein, 15 aa, Mycobacterium tuberculosis
QFITLAGFHALNYSM

SEQ ID NO: 192140 - protein, 15 aa, Mycobacterium tuberculosis
FITLAGFHALNYSMF

SEQ ID NO: 192141 - protein, 15 aa, Mycobacterium tuberculosis
ITLAGFHALNYSMFD

SEQ ID NO: 192142 - protein, 15 aa, Mycobacterium tuberculosis
TLAGFHALNYSMFDL

SEQ ID NO: 192143 - protein, 15 aa, Mycobacterium tuberculosis
LAGFHALNYSMFDLA

SEQ ID NO: 192144 - protein, 15 aa, Mycobacterium tuberculosis
AGFHALNYSMFDLAY

SEQ ID NO: 192145 - protein, 15 aa, Mycobacterium tuberculosis
GFHALNYSMFDLAYG

SEQ ID NO: 192146 - protein, 15 aa, Mycobacterium tuberculosis
FHALNYSMFDLAYGY

SEQ ID NO: 192147 - protein, 15 aa, Mycobacterium tuberculosis
HALNYSMFDLAYGYA

SEQ ID NO: 192148 - protein, 15 aa, Mycobacterium tuberculosis
ALNYSMFDLAYGYAQ

SEQ ID NO: 192149 - protein, 15 aa, Mycobacterium tuberculosis
LNYSMFDLAYGYAQN

SEQ ID NO: 192150 - protein, 15 aa, Mycobacterium tuberculosis
NYSMFDLAYGYAQNQ

SEQ ID NO: 192151 - protein, 15 aa, Mycobacterium tuberculosis
YSMFDLAYGYAQNQM

SEQ ID NO: 192152 - protein, 15 aa, Mycobacterium tuberculosis
SMFDLAYGYAQNQMS

SEQ ID NO: 192153 - protein, 15 aa, Mycobacterium tuberculosis
MFDLAYGYAQNQMSA

SEQ ID NO: 192154 - protein, 15 aa, Mycobacterium tuberculosis
FDLAYGYAQNQMSAY

SEQ ID NO: 192155 - protein, 15 aa, Mycobacterium tuberculosis
DLAYGYAQNQMSAYV

SEQ ID NO: 192156 - protein, 15 aa, Mycobacterium tuberculosis
LAYGYAQNQMSAYVE

SEQ ID NO: 192157 - protein, 15 aa, Mycobacterium tuberculosis
AYGYAQNQMSAYVEL

SEQ ID NO: 192158 - protein, 15 aa, Mycobacterium tuberculosis
YGYAQNQMSAYVELQ

SEQ ID NO: 192159 - protein, 15 aa, Mycobacterium tuberculosis
GYAQNQMSAYVELQE

SEQ ID NO: 192160 - protein, 15 aa, Mycobacterium tuberculosis
YAQNQMSAYVELQER

SEQ ID NO: 192161 - protein, 15 aa, Mycobacterium tuberculosis
AQNQMSAYVELQERE

SEQ ID NO: 192162 - protein, 15 aa, Mycobacterium tuberculosis
QNQMSAYVELQEREF

SEQ ID NO: 192163 - protein, 15 aa, Mycobacterium tuberculosis
NQMSAYVELQEREFA

SEQ ID NO: 192164 - protein, 15 aa, Mycobacterium tuberculosis
QMSAYVELQEREFAA

SEQ ID NO: 192165 - protein, 15 aa, Mycobacterium tuberculosis
MSAYVELQEREFAAE

SEQ ID NO: 192166 - protein, 15 aa, Mycobacterium tuberculosis
SAYVELQEREFAAEE

SEQ ID NO: 192167 - protein, 15 aa, Mycobacterium tuberculosis
AYVELQEREFAAEER

SEQ ID NO: 192168 - protein, 15 aa, Mycobacterium tuberculosis
YVELQEREFAAEERG

SEQ ID NO: 192169 - protein, 15 aa, Mycobacterium tuberculosis
VELQEREFAAEERGY

SEQ ID NO: 192170 - protein, 15 aa, Mycobacterium tuberculosis
ELQEREFAAEERGYT

SEQ ID NO: 192171 - protein, 15 aa, Mycobacterium tuberculosis
LQEREFAAEERGYTA

SEQ ID NO: 192172 - protein, 15 aa, Mycobacterium tuberculosis
QEREFAAEERGYTAT

SEQ ID NO: 192173 - protein, 15 aa, Mycobacterium tuberculosis
EREFAAEERGYTATK

SEQ ID NO: 192174 - protein, 15 aa, Mycobacterium tuberculosis
REFAAEERGYTATKH

SEQ ID NO: 192175 - protein, 15 aa, Mycobacterium tuberculosis
EFAAEERGYTATKHQ

SEQ ID NO: 192176 - protein, 15 aa, Mycobacterium tuberculosis
FAAEERGYTATKHQR

SEQ ID NO: 192177 - protein, 15 aa, Mycobacterium tuberculosis
AAEERGYTATKHQRE

SEQ ID NO: 192178 - protein, 15 aa, Mycobacterium tuberculosis
AEERGYTATKHQREV

SEQ ID NO: 192179 - protein, 15 aa, Mycobacterium tuberculosis
EERGYTATKHQREVG

SEQ ID NO: 192180 - protein, 15 aa, Mycobacterium tuberculosis
ERGYTATKHQREVGA

SEQ ID NO: 192181 - protein, 15 aa, Mycobacterium tuberculosis
RGYTATKHQREVGAG

SEQ ID NO: 192182 - protein, 15 aa, Mycobacterium tuberculosis
GYTATKHQREVGAGY

SEQ ID NO: 192183 - protein, 15 aa, Mycobacterium tuberculosis
YTATKHQREVGAGYF

SEQ ID NO: 192184 - protein, 15 aa, Mycobacterium tuberculosis
TATKHQREVGAGYFD

SEQ ID NO: 192185 - protein, 15 aa, Mycobacterium tuberculosis
ATKHQREVGAGYFDR

SEQ ID NO: 192186 - protein, 15 aa, Mycobacterium tuberculosis
TKHQREVGAGYFDRI

SEQ ID NO: 192187 - protein, 15 aa, Mycobacterium tuberculosis
KHQREVGAGYFDRIA

SEQ ID NO: 192188 - protein, 15 aa, Mycobacterium tuberculosis
HQREVGAGYFDRIAT

SEQ ID NO: 192189 - protein, 15 aa, Mycobacterium tuberculosis
QREVGAGYFDRIATT

SEQ ID NO: 192190 - protein, 15 aa, Mycobacterium tuberculosis
REVGAGYFDRIATTV

SEQ ID NO: 192191 - protein, 15 aa, Mycobacterium tuberculosis
EVGAGYFDRIATTVD

SEQ ID NO: 192192 - protein, 15 aa, Mycobacterium tuberculosis
VGAGYFDRIATTVDP

SEQ ID NO: 192193 - protein, 15 aa, Mycobacterium tuberculosis
GAGYFDRIATTVDPN

SEQ ID NO: 192194 - protein, 15 aa, Mycobacterium tuberculosis
AGYFDRIATTVDPNS

SEQ ID NO: 192195 - protein, 15 aa, Mycobacterium tuberculosis
GYFDRIATTVDPNSS

SEQ ID NO: 192196 - protein, 15 aa, Mycobacterium tuberculosis
YFDRIATTVDPNSST

SEQ ID NO: 192197 - protein, 15 aa, Mycobacterium tuberculosis
FDRIATTVDPNSSTT

SEQ ID NO: 192198 - protein, 15 aa, Mycobacterium tuberculosis
DRIATTVDPNSSTTA

SEQ ID NO: 192199 - protein, 15 aa, Mycobacterium tuberculosis
RIATTVDPNSSTTAL

SEQ ID NO: 192200 - protein, 15 aa, Mycobacterium tuberculosis
IATTVDPNSSTTALT

SEQ ID NO: 192201 - protein, 15 aa, Mycobacterium tuberculosis
ATTVDPNSSTTALTG

SEQ ID NO: 192202 - protein, 15 aa, Mycobacterium tuberculosis
TTVDPNSSTTALTGS

SEQ ID NO: 192203 - protein, 15 aa, Mycobacterium tuberculosis
TVDPNSSTTALTGST

SEQ ID NO: 192204 - protein, 15 aa, Mycobacterium tuberculosis
VDPNSSTTALTGSTE

SEQ ID NO: 192205 - protein, 15 aa, Mycobacterium tuberculosis
DPNSSTTALTGSTEE

SEQ ID NO: 192206 - protein, 15 aa, Mycobacterium tuberculosis
PNSSTTALTGSTEEG

SEQ ID NO: 192207 - protein, 15 aa, Mycobacterium tuberculosis
NSSTTALTGSTEEGQ

SEQ ID NO: 192208 - protein, 15 aa, Mycobacterium tuberculosis
SSTTALTGSTEEGQF

SEQ ID NO: 192209 - protein, 15 aa, Mycobacterium tuberculosis
STTALTGSTEEGQFH

SEQ ID NO: 192210 - protein, 16 aa, Mycobacterium tuberculosis
MSVVGTPKSAEQIQQE

SEQ ID NO: 192211 - protein, 16 aa, Mycobacterium tuberculosis
SVVGTPKSAEQIQQEW

SEQ ID NO: 192212 - protein, 16 aa, Mycobacterium tuberculosis
VVGTPKSAEQIQQEWD

SEQ ID NO: 192213 - protein, 16 aa, Mycobacterium tuberculosis
VGTPKSAEQIQQEWDT

SEQ ID NO: 192214 - protein, 16 aa, Mycobacterium tuberculosis
GTPKSAEQIQQEWDTN

SEQ ID NO: 192215 - protein, 16 aa, Mycobacterium tuberculosis
TPKSAEQIQQEWDTNP

SEQ ID NO: 192216 - protein, 16 aa, Mycobacterium tuberculosis
PKSAEQIQQEWDTNPR

SEQ ID NO: 192217 - protein, 16 aa, Mycobacterium tuberculosis
KSAEQIQQEWDTNPRW

SEQ ID NO: 192218 - protein, 16 aa, Mycobacterium tuberculosis
SAEQIQQEWDTNPRWK

SEQ ID NO: 192219 - protein, 16 aa, Mycobacterium tuberculosis
AEQIQQEWDTNPRWKD

SEQ ID NO: 192220 - protein, 16 aa, Mycobacterium tuberculosis
EQIQQEWDTNPRWKDV

SEQ ID NO: 192221 - protein, 16 aa, Mycobacterium tuberculosis
QIQQEWDTNPRWKDVT

SEQ ID NO: 192222 - protein, 16 aa, Mycobacterium tuberculosis
IQQEWDTNPRWKDVTR

SEQ ID NO: 192223 - protein, 16 aa, Mycobacterium tuberculosis
QQEWDTNPRWKDVTRT

SEQ ID NO: 192224 - protein, 16 aa, Mycobacterium tuberculosis
QEWDTNPRWKDVTRTY

SEQ ID NO: 192225 - protein, 16 aa, Mycobacterium tuberculosis
EWDTNPRWKDVTRTYS

SEQ ID NO: 192226 - protein, 16 aa, Mycobacterium tuberculosis
WDTNPRWKDVTRTYSA

SEQ ID NO: 192227 - protein, 16 aa, Mycobacterium tuberculosis
DTNPRWKDVTRTYSAE

SEQ ID NO: 192228 - protein, 16 aa, Mycobacterium tuberculosis
TNPRWKDVTRTYSAED

SEQ ID NO: 192229 - protein, 16 aa, Mycobacterium tuberculosis
NPRWKDVTRTYSAEDV

SEQ ID NO: 192230 - protein, 16 aa, Mycobacterium tuberculosis
PRWKDVTRTYSAEDVV

SEQ ID NO: 192231 - protein, 16 aa, Mycobacterium tuberculosis
RWKDVTRTYSAEDVVA

SEQ ID NO: 192232 - protein, 16 aa, Mycobacterium tuberculosis
WKDVTRTYSAEDVVAL

SEQ ID NO: 192233 - protein, 16 aa, Mycobacterium tuberculosis
KDVTRTYSAEDVVALQ

SEQ ID NO: 192234 - protein, 16 aa, Mycobacterium tuberculosis
DVTRTYSAEDVVALQG

SEQ ID NO: 192235 - protein, 16 aa, Mycobacterium tuberculosis
VTRTYSAEDVVALQGS

SEQ ID NO: 192236 - protein, 16 aa, Mycobacterium tuberculosis
TRTYSAEDVVALQGSV

SEQ ID NO: 192237 - protein, 16 aa, Mycobacterium tuberculosis
RTYSAEDVVALQGSVV

SEQ ID NO: 192238 - protein, 16 aa, Mycobacterium tuberculosis
TYSAEDVVALQGSVVE

SEQ ID NO: 192239 - protein, 16 aa, Mycobacterium tuberculosis
YSAEDVVALQGSVVEE

SEQ ID NO: 192240 - protein, 16 aa, Mycobacterium tuberculosis
SAEDVVALQGSVVEEH

SEQ ID NO: 192241 - protein, 16 aa, Mycobacterium tuberculosis
AEDVVALQGSVVEEHT

SEQ ID NO: 192242 - protein, 16 aa, Mycobacterium tuberculosis
EDVVALQGSVVEEHTL

SEQ ID NO: 192243 - protein, 16 aa, Mycobacterium tuberculosis
DVVALQGSVVEEHTLA

SEQ ID NO: 192244 - protein, 16 aa, Mycobacterium tuberculosis
VVALQGSVVEEHTLAR

SEQ ID NO: 192245 - protein, 16 aa, Mycobacterium tuberculosis
VALQGSVVEEHTLARR

SEQ ID NO: 192246 - protein, 16 aa, Mycobacterium tuberculosis
ALQGSVVEEHTLARRG

SEQ ID NO: 192247 - protein, 16 aa, Mycobacterium tuberculosis
LQGSVVEEHTLARRGA

SEQ ID NO: 192248 - protein, 16 aa, Mycobacterium tuberculosis
QGSVVEEHTLARRGAE

SEQ ID NO: 192249 - protein, 16 aa, Mycobacterium tuberculosis
GSVVEEHTLARRGAEV

SEQ ID NO: 192250 - protein, 16 aa, Mycobacterium tuberculosis
SVVEEHTLARRGAEVL

SEQ ID NO: 192251 - protein, 16 aa, Mycobacterium tuberculosis
VVEEHTLARRGAEVLW

SEQ ID NO: 192252 - protein, 16 aa, Mycobacterium tuberculosis
VEEHTLARRGAEVLWE

SEQ ID NO: 192253 - protein, 16 aa, Mycobacterium tuberculosis
EEHTLARRGAEVLWEQ

SEQ ID NO: 192254 - protein, 16 aa, Mycobacterium tuberculosis
EHTLARRGAEVLWEQL

SEQ ID NO: 192255 - protein, 16 aa, Mycobacterium tuberculosis
HTLARRGAEVLWEQLH

SEQ ID NO: 192256 - protein, 16 aa, Mycobacterium tuberculosis
TLARRGAEVLWEQLHD

SEQ ID NO: 192257 - protein, 16 aa, Mycobacterium tuberculosis
LARRGAEVLWEQLHDL

SEQ ID NO: 192258 - protein, 16 aa, Mycobacterium tuberculosis
ARRGAEVLWEQLHDLE

SEQ ID NO: 192259 - protein, 16 aa, Mycobacterium tuberculosis
RRGAEVLWEQLHDLEW

SEQ ID NO: 192260 - protein, 16 aa, Mycobacterium tuberculosis
RGAEVLWEQLHDLEWV

SEQ ID NO: 192261 - protein, 16 aa, Mycobacterium tuberculosis
GAEVLWEQLHDLEWVN

SEQ ID NO: 192262 - protein, 16 aa, Mycobacterium tuberculosis
AEVLWEQLHDLEWVNA

SEQ ID NO: 192263 - protein, 16 aa, Mycobacterium tuberculosis
EVLWEQLHDLEWVNAL

SEQ ID NO: 192264 - protein, 16 aa, Mycobacterium tuberculosis
VLWEQLHDLEWVNALG

SEQ ID NO: 192265 - protein, 16 aa, Mycobacterium tuberculosis
LWEQLHDLEWVNALGA

SEQ ID NO: 192266 - protein, 16 aa, Mycobacterium tuberculosis
WEQLHDLEWVNALGAL

SEQ ID NO: 192267 - protein, 16 aa, Mycobacterium tuberculosis
EQLHDLEWVNALGALT

SEQ ID NO: 192268 - protein, 16 aa, Mycobacterium tuberculosis
QLHDLEWVNALGALTG

SEQ ID NO: 192269 - protein, 16 aa, Mycobacterium tuberculosis
LHDLEWVNALGALTGN

SEQ ID NO: 192270 - protein, 16 aa, Mycobacterium tuberculosis
HDLEWVNALGALTGNM

SEQ ID NO: 192271 - protein, 16 aa, Mycobacterium tuberculosis
DLEWVNALGALTGNMA

SEQ ID NO: 192272 - protein, 16 aa, Mycobacterium tuberculosis
LEWVNALGALTGNMAV

SEQ ID NO: 192273 - protein, 16 aa, Mycobacterium tuberculosis
EWVNALGALTGNMAVQ

SEQ ID NO: 192274 - protein, 16 aa, Mycobacterium tuberculosis
WVNALGALTGNMAVQQ

SEQ ID NO: 192275 - protein, 16 aa, Mycobacterium tuberculosis
VNALGALTGNMAVQQV

SEQ ID NO: 192276 - protein, 16 aa, Mycobacterium tuberculosis
NALGALTGNMAVQQVR

SEQ ID NO: 192277 - protein, 16 aa, Mycobacterium tuberculosis
ALGALTGNMAVQQVRA

SEQ ID NO: 192278 - protein, 16 aa, Mycobacterium tuberculosis
LGALTGNMAVQQVRAG

SEQ ID NO: 192279 - protein, 16 aa, Mycobacterium tuberculosis
GALTGNMAVQQVRAGL

SEQ ID NO: 192280 - protein, 16 aa, Mycobacterium tuberculosis
ALTGNMAVQQVRAGLK

SEQ ID NO: 192281 - protein, 16 aa, Mycobacterium tuberculosis
LTGNMAVQQVRAGLKA

SEQ ID NO: 192282 - protein, 16 aa, Mycobacterium tuberculosis
TGNMAVQQVRAGLKAI

SEQ ID NO: 192283 - protein, 16 aa, Mycobacterium tuberculosis
GNMAVQQVRAGLKAIY

SEQ ID NO: 192284 - protein, 16 aa, Mycobacterium tuberculosis
NMAVQQVRAGLKAIYL

SEQ ID NO: 192285 - protein, 16 aa, Mycobacterium tuberculosis
MAVQQVRAGLKAIYLS

SEQ ID NO: 192286 - protein, 16 aa, Mycobacterium tuberculosis
AVQQVRAGLKAIYLSG

SEQ ID NO: 192287 - protein, 16 aa, Mycobacterium tuberculosis
VQQVRAGLKAIYLSGW

SEQ ID NO: 192288 - protein, 16 aa, Mycobacterium tuberculosis
QQVRAGLKAIYLSGWQ

SEQ ID NO: 192289 - protein, 16 aa, Mycobacterium tuberculosis
QVRAGLKAIYLSGWQV

SEQ ID NO: 192290 - protein, 16 aa, Mycobacterium tuberculosis
VRAGLKAIYLSGWQVA

SEQ ID NO: 192291 - protein, 16 aa, Mycobacterium tuberculosis
RAGLKAIYLSGWQVAG

SEQ ID NO: 192292 - protein, 16 aa, Mycobacterium tuberculosis
AGLKAIYLSGWQVAGD

SEQ ID NO: 192293 - protein, 16 aa, Mycobacterium tuberculosis
GLKAIYLSGWQVAGDA

SEQ ID NO: 192294 - protein, 16 aa, Mycobacterium tuberculosis
LKAIYLSGWQVAGDAN

SEQ ID NO: 192295 - protein, 16 aa, Mycobacterium tuberculosis
KAIYLSGWQVAGDANL

SEQ ID NO: 192296 - protein, 16 aa, Mycobacterium tuberculosis
AIYLSGWQVAGDANLS

SEQ ID NO: 192297 - protein, 16 aa, Mycobacterium tuberculosis
IYLSGWQVAGDANLSG

SEQ ID NO: 192298 - protein, 16 aa, Mycobacterium tuberculosis
YLSGWQVAGDANLSGH

SEQ ID NO: 192299 - protein, 16 aa, Mycobacterium tuberculosis
LSGWQVAGDANLSGHT

SEQ ID NO: 192300 - protein, 16 aa, Mycobacterium tuberculosis
SGWQVAGDANLSGHTY

SEQ ID NO: 192301 - protein, 16 aa, Mycobacterium tuberculosis
GWQVAGDANLSGHTYP

SEQ ID NO: 192302 - protein, 16 aa, Mycobacterium tuberculosis
WQVAGDANLSGHTYPD

SEQ ID NO: 192303 - protein, 16 aa, Mycobacterium tuberculosis
QVAGDANLSGHTYPDQ

SEQ ID NO: 192304 - protein, 16 aa, Mycobacterium tuberculosis
VAGDANLSGHTYPDQS

SEQ ID NO: 192305 - protein, 16 aa, Mycobacterium tuberculosis
AGDANLSGHTYPDQSL

SEQ ID NO: 192306 - protein, 16 aa, Mycobacterium tuberculosis
GDANLSGHTYPDQSLY

SEQ ID NO: 192307 - protein, 16 aa, Mycobacterium tuberculosis
DANLSGHTYPDQSLYP

SEQ ID NO: 192308 - protein, 16 aa, Mycobacterium tuberculosis
ANLSGHTYPDQSLYPA

SEQ ID NO: 192309 - protein, 16 aa, Mycobacterium tuberculosis
NLSGHTYPDQSLYPAN

SEQ ID NO: 192310 - protein, 16 aa, Mycobacterium tuberculosis
LSGHTYPDQSLYPANS

SEQ ID NO: 192311 - protein, 16 aa, Mycobacterium tuberculosis
SGHTYPDQSLYPANSV

SEQ ID NO: 192312 - protein, 16 aa, Mycobacterium tuberculosis
GHTYPDQSLYPANSVP

SEQ ID NO: 192313 - protein, 16 aa, Mycobacterium tuberculosis
HTYPDQSLYPANSVPQ

SEQ ID NO: 192314 - protein, 16 aa, Mycobacterium tuberculosis
TYPDQSLYPANSVPQV

SEQ ID NO: 192315 - protein, 16 aa, Mycobacterium tuberculosis
YPDQSLYPANSVPQVV

SEQ ID NO: 192316 - protein, 16 aa, Mycobacterium tuberculosis
PDQSLYPANSVPQVVR

SEQ ID NO: 192317 - protein, 16 aa, Mycobacterium tuberculosis
DQSLYPANSVPQVVRR

SEQ ID NO: 192318 - protein, 16 aa, Mycobacterium tuberculosis
QSLYPANSVPQVVRRI

SEQ ID NO: 192319 - protein, 16 aa, Mycobacterium tuberculosis
SLYPANSVPQVVRRIN

SEQ ID NO: 192320 - protein, 16 aa, Mycobacterium tuberculosis
LYPANSVPQVVRRINN

SEQ ID NO: 192321 - protein, 16 aa, Mycobacterium tuberculosis
YPANSVPQVVRRINNA

SEQ ID NO: 192322 - protein, 16 aa, Mycobacterium tuberculosis
PANSVPQVVRRINNAL

SEQ ID NO: 192323 - protein, 16 aa, Mycobacterium tuberculosis
ANSVPQVVRRINNALQ

SEQ ID NO: 192324 - protein, 16 aa, Mycobacterium tuberculosis
NSVPQVVRRINNALQR

SEQ ID NO: 192325 - protein, 16 aa, Mycobacterium tuberculosis
SVPQVVRRINNALQRA

SEQ ID NO: 192326 - protein, 16 aa, Mycobacterium tuberculosis
VPQVVRRINNALQRAD

SEQ ID NO: 192327 - protein, 16 aa, Mycobacterium tuberculosis
PQVVRRINNALQRADQ

SEQ ID NO: 192328 - protein, 16 aa, Mycobacterium tuberculosis
QVVRRINNALQRADQI

SEQ ID NO: 192329 - protein, 16 aa, Mycobacterium tuberculosis
VVRRINNALQRADQIA

SEQ ID NO: 192330 - protein, 16 aa, Mycobacterium tuberculosis
VRRINNALQRADQIAK

SEQ ID NO: 192331 - protein, 16 aa, Mycobacterium tuberculosis
RRINNALQRADQIAKI

SEQ ID NO: 192332 - protein, 16 aa, Mycobacterium tuberculosis
RINNALQRADQIAKIE

SEQ ID NO: 192333 - protein, 16 aa, Mycobacterium tuberculosis
INNALQRADQIAKIEG

SEQ ID NO: 192334 - protein, 16 aa, Mycobacterium tuberculosis
NNALQRADQIAKIEGD

SEQ ID NO: 192335 - protein, 16 aa, Mycobacterium tuberculosis
NALQRADQIAKIEGDT

SEQ ID NO: 192336 - protein, 16 aa, Mycobacterium tuberculosis
ALQRADQIAKIEGDTS

SEQ ID NO: 192337 - protein, 16 aa, Mycobacterium tuberculosis
LQRADQIAKIEGDTSV

SEQ ID NO: 192338 - protein, 16 aa, Mycobacterium tuberculosis
QRADQIAKIEGDTSVE

SEQ ID NO: 192339 - protein, 16 aa, Mycobacterium tuberculosis
RADQIAKIEGDTSVEN

SEQ ID NO: 192340 - protein, 16 aa, Mycobacterium tuberculosis
ADQIAKIEGDTSVENW

SEQ ID NO: 192341 - protein, 16 aa, Mycobacterium tuberculosis
DQIAKIEGDTSVENWL

SEQ ID NO: 192342 - protein, 16 aa, Mycobacterium tuberculosis
QIAKIEGDTSVENWLA

SEQ ID NO: 192343 - protein, 16 aa, Mycobacterium tuberculosis
IAKIEGDTSVENWLAP

SEQ ID NO: 192344 - protein, 16 aa, Mycobacterium tuberculosis
AKIEGDTSVENWLAPI

SEQ ID NO: 192345 - protein, 16 aa, Mycobacterium tuberculosis
KIEGDTSVENWLAPIV

SEQ ID NO: 192346 - protein, 16 aa, Mycobacterium tuberculosis
IEGDTSVENWLAPIVA

SEQ ID NO: 192347 - protein, 16 aa, Mycobacterium tuberculosis
EGDTSVENWLAPIVAD

SEQ ID NO: 192348 - protein, 16 aa, Mycobacterium tuberculosis
GDTSVENWLAPIVADG

SEQ ID NO: 192349 - protein, 16 aa, Mycobacterium tuberculosis
DTSVENWLAPIVADGE

SEQ ID NO: 192350 - protein, 16 aa, Mycobacterium tuberculosis
TSVENWLAPIVADGEA

SEQ ID NO: 192351 - protein, 16 aa, Mycobacterium tuberculosis
SVENWLAPIVADGEAG

SEQ ID NO: 192352 - protein, 16 aa, Mycobacterium tuberculosis
VENWLAPIVADGEAGF

SEQ ID NO: 192353 - protein, 16 aa, Mycobacterium tuberculosis
ENWLAPIVADGEAGFG

SEQ ID NO: 192354 - protein, 16 aa, Mycobacterium tuberculosis
NWLAPIVADGEAGFGG

SEQ ID NO: 192355 - protein, 16 aa, Mycobacterium tuberculosis
WLAPIVADGEAGFGGA

SEQ ID NO: 192356 - protein, 16 aa, Mycobacterium tuberculosis
LAPIVADGEAGFGGAL

SEQ ID NO: 192357 - protein, 16 aa, Mycobacterium tuberculosis
APIVADGEAGFGGALN

SEQ ID NO: 192358 - protein, 16 aa, Mycobacterium tuberculosis
PIVADGEAGFGGALNV

SEQ ID NO: 192359 - protein, 16 aa, Mycobacterium tuberculosis
IVADGEAGFGGALNVY

SEQ ID NO: 192360 - protein, 16 aa, Mycobacterium tuberculosis
VADGEAGFGGALNVYE

SEQ ID NO: 192361 - protein, 16 aa, Mycobacterium tuberculosis
ADGEAGFGGALNVYEL

SEQ ID NO: 192362 - protein, 16 aa, Mycobacterium tuberculosis
DGEAGFGGALNVYELQ

SEQ ID NO: 192363 - protein, 16 aa, Mycobacterium tuberculosis
GEAGFGGALNVYELQK

SEQ ID NO: 192364 - protein, 16 aa, Mycobacterium tuberculosis
EAGFGGALNVYELQKA

SEQ ID NO: 192365 - protein, 16 aa, Mycobacterium tuberculosis
AGFGGALNVYELQKAL

SEQ ID NO: 192366 - protein, 16 aa, Mycobacterium tuberculosis
GFGGALNVYELQKALI

SEQ ID NO: 192367 - protein, 16 aa, Mycobacterium tuberculosis
FGGALNVYELQKALIA

SEQ ID NO: 192368 - protein, 16 aa, Mycobacterium tuberculosis
GGALNVYELQKALIAA

SEQ ID NO: 192369 - protein, 16 aa, Mycobacterium tuberculosis
GALNVYELQKALIAAG

SEQ ID NO: 192370 - protein, 16 aa, Mycobacterium tuberculosis
ALNVYELQKALIAAGV

SEQ ID NO: 192371 - protein, 16 aa, Mycobacterium tuberculosis
LNVYELQKALIAAGVA

SEQ ID NO: 192372 - protein, 16 aa, Mycobacterium tuberculosis
NVYELQKALIAAGVAG

SEQ ID NO: 192373 - protein, 16 aa, Mycobacterium tuberculosis
VYELQKALIAAGVAGS

SEQ ID NO: 192374 - protein, 16 aa, Mycobacterium tuberculosis
YELQKALIAAGVAGSH

SEQ ID NO: 192375 - protein, 16 aa, Mycobacterium tuberculosis
ELQKALIAAGVAGSHW

SEQ ID NO: 192376 - protein, 16 aa, Mycobacterium tuberculosis
LQKALIAAGVAGSHWE

SEQ ID NO: 192377 - protein, 16 aa, Mycobacterium tuberculosis
QKALIAAGVAGSHWED

SEQ ID NO: 192378 - protein, 16 aa, Mycobacterium tuberculosis
KALIAAGVAGSHWEDQ

SEQ ID NO: 192379 - protein, 16 aa, Mycobacterium tuberculosis
ALIAAGVAGSHWEDQL

SEQ ID NO: 192380 - protein, 16 aa, Mycobacterium tuberculosis
LIAAGVAGSHWEDQLA

SEQ ID NO: 192381 - protein, 16 aa, Mycobacterium tuberculosis
IAAGVAGSHWEDQLAS

SEQ ID NO: 192382 - protein, 16 aa, Mycobacterium tuberculosis
AAGVAGSHWEDQLASE

SEQ ID NO: 192383 - protein, 16 aa, Mycobacterium tuberculosis
AGVAGSHWEDQLASEK

SEQ ID NO: 192384 - protein, 16 aa, Mycobacterium tuberculosis
GVAGSHWEDQLASEKK

SEQ ID NO: 192385 - protein, 16 aa, Mycobacterium tuberculosis
VAGSHWEDQLASEKKC

SEQ ID NO: 192386 - protein, 16 aa, Mycobacterium tuberculosis
AGSHWEDQLASEKKCG

SEQ ID NO: 192387 - protein, 16 aa, Mycobacterium tuberculosis
GSHWEDQLASEKKCGH

SEQ ID NO: 192388 - protein, 16 aa, Mycobacterium tuberculosis
SHWEDQLASEKKCGHL

SEQ ID NO: 192389 - protein, 16 aa, Mycobacterium tuberculosis
HWEDQLASEKKCGHLG

SEQ ID NO: 192390 - protein, 16 aa, Mycobacterium tuberculosis
WEDQLASEKKCGHLGG

SEQ ID NO: 192391 - protein, 16 aa, Mycobacterium tuberculosis
EDQLASEKKCGHLGGK

SEQ ID NO: 192392 - protein, 16 aa, Mycobacterium tuberculosis
DQLASEKKCGHLGGKV

SEQ ID NO: 192393 - protein, 16 aa, Mycobacterium tuberculosis
QLASEKKCGHLGGKVL

SEQ ID NO: 192394 - protein, 16 aa, Mycobacterium tuberculosis
LASEKKCGHLGGKVLI

SEQ ID NO: 192395 - protein, 16 aa, Mycobacterium tuberculosis
ASEKKCGHLGGKVLIP

SEQ ID NO: 192396 - protein, 16 aa, Mycobacterium tuberculosis
SEKKCGHLGGKVLIPT

SEQ ID NO: 192397 - protein, 16 aa, Mycobacterium tuberculosis
EKKCGHLGGKVLIPTQ

SEQ ID NO: 192398 - protein, 16 aa, Mycobacterium tuberculosis
KKCGHLGGKVLIPTQQ

SEQ ID NO: 192399 - protein, 16 aa, Mycobacterium tuberculosis
KCGHLGGKVLIPTQQH

SEQ ID NO: 192400 - protein, 16 aa, Mycobacterium tuberculosis
CGHLGGKVLIPTQQHI

SEQ ID NO: 192401 - protein, 16 aa, Mycobacterium tuberculosis
GHLGGKVLIPTQQHIR

SEQ ID NO: 192402 - protein, 16 aa, Mycobacterium tuberculosis
HLGGKVLIPTQQHIRT

SEQ ID NO: 192403 - protein, 16 aa, Mycobacterium tuberculosis
LGGKVLIPTQQHIRTL

SEQ ID NO: 192404 - protein, 16 aa, Mycobacterium tuberculosis
GGKVLIPTQQHIRTLT

SEQ ID NO: 192405 - protein, 16 aa, Mycobacterium tuberculosis
GKVLIPTQQHIRTLTS

SEQ ID NO: 192406 - protein, 16 aa, Mycobacterium tuberculosis
KVLIPTQQHIRTLTSA

SEQ ID NO: 192407 - protein, 16 aa, Mycobacterium tuberculosis
VLIPTQQHIRTLTSAR

SEQ ID NO: 192408 - protein, 16 aa, Mycobacterium tuberculosis
LIPTQQHIRTLTSARL

SEQ ID NO: 192409 - protein, 16 aa, Mycobacterium tuberculosis
IPTQQHIRTLTSARLA

SEQ ID NO: 192410 - protein, 16 aa, Mycobacterium tuberculosis
PTQQHIRTLTSARLAA

SEQ ID NO: 192411 - protein, 16 aa, Mycobacterium tuberculosis
TQQHIRTLTSARLAAD

SEQ ID NO: 192412 - protein, 16 aa, Mycobacterium tuberculosis
QQHIRTLTSARLAADV

SEQ ID NO: 192413 - protein, 16 aa, Mycobacterium tuberculosis
QHIRTLTSARLAADVA

SEQ ID NO: 192414 - protein, 16 aa, Mycobacterium tuberculosis
HIRTLTSARLAADVAD

SEQ ID NO: 192415 - protein, 16 aa, Mycobacterium tuberculosis
IRTLTSARLAADVADV

SEQ ID NO: 192416 - protein, 16 aa, Mycobacterium tuberculosis
RTLTSARLAADVADVP

SEQ ID NO: 192417 - protein, 16 aa, Mycobacterium tuberculosis
TLTSARLAADVADVPT

SEQ ID NO: 192418 - protein, 16 aa, Mycobacterium tuberculosis
LTSARLAADVADVPTV

SEQ ID NO: 192419 - protein, 16 aa, Mycobacterium tuberculosis
TSARLAADVADVPTVV

SEQ ID NO: 192420 - protein, 16 aa, Mycobacterium tuberculosis
SARLAADVADVPTVVI

SEQ ID NO: 192421 - protein, 16 aa, Mycobacterium tuberculosis
ARLAADVADVPTVVIA

SEQ ID NO: 192422 - protein, 16 aa, Mycobacterium tuberculosis
RLAADVADVPTVVIAR

SEQ ID NO: 192423 - protein, 16 aa, Mycobacterium tuberculosis
LAADVADVPTVVIART

SEQ ID NO: 192424 - protein, 16 aa, Mycobacterium tuberculosis
AADVADVPTVVIARTD

SEQ ID NO: 192425 - protein, 16 aa, Mycobacterium tuberculosis
ADVADVPTVVIARTDA

SEQ ID NO: 192426 - protein, 16 aa, Mycobacterium tuberculosis
DVADVPTVVIARTDAE

SEQ ID NO: 192427 - protein, 16 aa, Mycobacterium tuberculosis
VADVPTVVIARTDAEA

SEQ ID NO: 192428 - protein, 16 aa, Mycobacterium tuberculosis
ADVPTVVIARTDAEAA

SEQ ID NO: 192429 - protein, 16 aa, Mycobacterium tuberculosis
DVPTVVIARTDAEAAT

SEQ ID NO: 192430 - protein, 16 aa, Mycobacterium tuberculosis
VPTVVIARTDAEAATL

SEQ ID NO: 192431 - protein, 16 aa, Mycobacterium tuberculosis
PTVVIARTDAEAATLI

SEQ ID NO: 192432 - protein, 16 aa, Mycobacterium tuberculosis
TVVIARTDAEAATLIT

SEQ ID NO: 192433 - protein, 16 aa, Mycobacterium tuberculosis
VVIARTDAEAATLITS

SEQ ID NO: 192434 - protein, 16 aa, Mycobacterium tuberculosis
VIARTDAEAATLITSD

SEQ ID NO: 192435 - protein, 16 aa, Mycobacterium tuberculosis
IARTDAEAATLITSDV

SEQ ID NO: 192436 - protein, 16 aa, Mycobacterium tuberculosis
ARTDAEAATLITSDVD

SEQ ID NO: 192437 - protein, 16 aa, Mycobacterium tuberculosis
RTDAEAATLITSDVDE

SEQ ID NO: 192438 - protein, 16 aa, Mycobacterium tuberculosis
TDAEAATLITSDVDER

SEQ ID NO: 192439 - protein, 16 aa, Mycobacterium tuberculosis
DAEAATLITSDVDERD

SEQ ID NO: 192440 - protein, 16 aa, Mycobacterium tuberculosis
AEAATLITSDVDERDQ

SEQ ID NO: 192441 - protein, 16 aa, Mycobacterium tuberculosis
EAATLITSDVDERDQP

SEQ ID NO: 192442 - protein, 16 aa, Mycobacterium tuberculosis
AATLITSDVDERDQPF

SEQ ID NO: 192443 - protein, 16 aa, Mycobacterium tuberculosis
ATLITSDVDERDQPFI

SEQ ID NO: 192444 - protein, 16 aa, Mycobacterium tuberculosis
TLITSDVDERDQPFIT

SEQ ID NO: 192445 - protein, 16 aa, Mycobacterium tuberculosis
LITSDVDERDQPFITG

SEQ ID NO: 192446 - protein, 16 aa, Mycobacterium tuberculosis
ITSDVDERDQPFITGE

SEQ ID NO: 192447 - protein, 16 aa, Mycobacterium tuberculosis
TSDVDERDQPFITGER

SEQ ID NO: 192448 - protein, 16 aa, Mycobacterium tuberculosis
SDVDERDQPFITGERT

SEQ ID NO: 192449 - protein, 16 aa, Mycobacterium tuberculosis
DVDERDQPFITGERTR

SEQ ID NO: 192450 - protein, 16 aa, Mycobacterium tuberculosis
VDERDQPFITGERTRE

SEQ ID NO: 192451 - protein, 16 aa, Mycobacterium tuberculosis
DERDQPFITGERTREG

SEQ ID NO: 192452 - protein, 16 aa, Mycobacterium tuberculosis
ERDQPFITGERTREGF

SEQ ID NO: 192453 - protein, 16 aa, Mycobacterium tuberculosis
RDQPFITGERTREGFY

SEQ ID NO: 192454 - protein, 16 aa, Mycobacterium tuberculosis
DQPFITGERTREGFYR

SEQ ID NO: 192455 - protein, 16 aa, Mycobacterium tuberculosis
QPFITGERTREGFYRT

SEQ ID NO: 192456 - protein, 16 aa, Mycobacterium tuberculosis
PFITGERTREGFYRTK

SEQ ID NO: 192457 - protein, 16 aa, Mycobacterium tuberculosis
FITGERTREGFYRTKN

SEQ ID NO: 192458 - protein, 16 aa, Mycobacterium tuberculosis
ITGERTREGFYRTKNG

SEQ ID NO: 192459 - protein, 16 aa, Mycobacterium tuberculosis
TGERTREGFYRTKNGI

SEQ ID NO: 192460 - protein, 16 aa, Mycobacterium tuberculosis
GERTREGFYRTKNGIE

SEQ ID NO: 192461 - protein, 16 aa, Mycobacterium tuberculosis
ERTREGFYRTKNGIEP

SEQ ID NO: 192462 - protein, 16 aa, Mycobacterium tuberculosis
RTREGFYRTKNGIEPC

SEQ ID NO: 192463 - protein, 16 aa, Mycobacterium tuberculosis
TREGFYRTKNGIEPCI

SEQ ID NO: 192464 - protein, 16 aa, Mycobacterium tuberculosis
REGFYRTKNGIEPCIA

SEQ ID NO: 192465 - protein, 16 aa, Mycobacterium tuberculosis
EGFYRTKNGIEPCIAR

SEQ ID NO: 192466 - protein, 16 aa, Mycobacterium tuberculosis
GFYRTKNGIEPCIARA

SEQ ID NO: 192467 - protein, 16 aa, Mycobacterium tuberculosis
FYRTKNGIEPCIARAK

SEQ ID NO: 192468 - protein, 16 aa, Mycobacterium tuberculosis
YRTKNGIEPCIARAKA

SEQ ID NO: 192469 - protein, 16 aa, Mycobacterium tuberculosis
RTKNGIEPCIARAKAY

SEQ ID NO: 192470 - protein, 16 aa, Mycobacterium tuberculosis
TKNGIEPCIARAKAYA

SEQ ID NO: 192471 - protein, 16 aa, Mycobacterium tuberculosis
KNGIEPCIARAKAYAP

SEQ ID NO: 192472 - protein, 16 aa, Mycobacterium tuberculosis
NGIEPCIARAKAYAPF

SEQ ID NO: 192473 - protein, 16 aa, Mycobacterium tuberculosis
GIEPCIARAKAYAPFA

SEQ ID NO: 192474 - protein, 16 aa, Mycobacterium tuberculosis
IEPCIARAKAYAPFAD

SEQ ID NO: 192475 - protein, 16 aa, Mycobacterium tuberculosis
EPCIARAKAYAPFADL

SEQ ID NO: 192476 - protein, 16 aa, Mycobacterium tuberculosis
PCIARAKAYAPFADLI

SEQ ID NO: 192477 - protein, 16 aa, Mycobacterium tuberculosis
CIARAKAYAPFADLIW

SEQ ID NO: 192478 - protein, 16 aa, Mycobacterium tuberculosis
IARAKAYAPFADLIWM

SEQ ID NO: 192479 - protein, 16 aa, Mycobacterium tuberculosis
ARAKAYAPFADLIWME

SEQ ID NO: 192480 - protein, 16 aa, Mycobacterium tuberculosis
RAKAYAPFADLIWMET

SEQ ID NO: 192481 - protein, 16 aa, Mycobacterium tuberculosis
AKAYAPFADLIWMETG

SEQ ID NO: 192482 - protein, 16 aa, Mycobacterium tuberculosis
KAYAPFADLIWMETGT

SEQ ID NO: 192483 - protein, 16 aa, Mycobacterium tuberculosis
AYAPFADLIWMETGTP

SEQ ID NO: 192484 - protein, 16 aa, Mycobacterium tuberculosis
YAPFADLIWMETGTPD

SEQ ID NO: 192485 - protein, 16 aa, Mycobacterium tuberculosis
APFADLIWMETGTPDL

SEQ ID NO: 192486 - protein, 16 aa, Mycobacterium tuberculosis
PFADLIWMETGTPDLE

SEQ ID NO: 192487 - protein, 16 aa, Mycobacterium tuberculosis
FADLIWMETGTPDLEA

SEQ ID NO: 192488 - protein, 16 aa, Mycobacterium tuberculosis
ADLIWMETGTPDLEAA

SEQ ID NO: 192489 - protein, 16 aa, Mycobacterium tuberculosis
DLIWMETGTPDLEAAR

SEQ ID NO: 192490 - protein, 16 aa, Mycobacterium tuberculosis
LIWMETGTPDLEAARQ

SEQ ID NO: 192491 - protein, 16 aa, Mycobacterium tuberculosis
IWMETGTPDLEAARQF

SEQ ID NO: 192492 - protein, 16 aa, Mycobacterium tuberculosis
WMETGTPDLEAARQFS

SEQ ID NO: 192493 - protein, 16 aa, Mycobacterium tuberculosis
METGTPDLEAARQFSE

SEQ ID NO: 192494 - protein, 16 aa, Mycobacterium tuberculosis
ETGTPDLEAARQFSEA

SEQ ID NO: 192495 - protein, 16 aa, Mycobacterium tuberculosis
TGTPDLEAARQFSEAV

SEQ ID NO: 192496 - protein, 16 aa, Mycobacterium tuberculosis
GTPDLEAARQFSEAVK

SEQ ID NO: 192497 - protein, 16 aa, Mycobacterium tuberculosis
TPDLEAARQFSEAVKA

SEQ ID NO: 192498 - protein, 16 aa, Mycobacterium tuberculosis
PDLEAARQFSEAVKAE

SEQ ID NO: 192499 - protein, 16 aa, Mycobacterium tuberculosis
DLEAARQFSEAVKAEY

SEQ ID NO: 192500 - protein, 16 aa, Mycobacterium tuberculosis
LEAARQFSEAVKAEYP

SEQ ID NO: 192501 - protein, 16 aa, Mycobacterium tuberculosis
EAARQFSEAVKAEYPD

SEQ ID NO: 192502 - protein, 16 aa, Mycobacterium tuberculosis
AARQFSEAVKAEYPDQ

SEQ ID NO: 192503 - protein, 16 aa, Mycobacterium tuberculosis
ARQFSEAVKAEYPDQM

SEQ ID NO: 192504 - protein, 16 aa, Mycobacterium tuberculosis
RQFSEAVKAEYPDQML

SEQ ID NO: 192505 - protein, 16 aa, Mycobacterium tuberculosis
QFSEAVKAEYPDQMLA

SEQ ID NO: 192506 - protein, 16 aa, Mycobacterium tuberculosis
FSEAVKAEYPDQMLAY

SEQ ID NO: 192507 - protein, 16 aa, Mycobacterium tuberculosis
SEAVKAEYPDQMLAYN

SEQ ID NO: 192508 - protein, 16 aa, Mycobacterium tuberculosis
EAVKAEYPDQMLAYNC

SEQ ID NO: 192509 - protein, 16 aa, Mycobacterium tuberculosis
AVKAEYPDQMLAYNCS

SEQ ID NO: 192510 - protein, 16 aa, Mycobacterium tuberculosis
VKAEYPDQMLAYNCSP

SEQ ID NO: 192511 - protein, 16 aa, Mycobacterium tuberculosis
KAEYPDQMLAYNCSPS

SEQ ID NO: 192512 - protein, 16 aa, Mycobacterium tuberculosis
AEYPDQMLAYNCSPSF

SEQ ID NO: 192513 - protein, 16 aa, Mycobacterium tuberculosis
EYPDQMLAYNCSPSFN

SEQ ID NO: 192514 - protein, 16 aa, Mycobacterium tuberculosis
YPDQMLAYNCSPSFNW

SEQ ID NO: 192515 - protein, 16 aa, Mycobacterium tuberculosis
PDQMLAYNCSPSFNWK

SEQ ID NO: 192516 - protein, 16 aa, Mycobacterium tuberculosis
DQMLAYNCSPSFNWKK

SEQ ID NO: 192517 - protein, 16 aa, Mycobacterium tuberculosis
QMLAYNCSPSFNWKKH

SEQ ID NO: 192518 - protein, 16 aa, Mycobacterium tuberculosis
MLAYNCSPSFNWKKHL

SEQ ID NO: 192519 - protein, 16 aa, Mycobacterium tuberculosis
LAYNCSPSFNWKKHLD

SEQ ID NO: 192520 - protein, 16 aa, Mycobacterium tuberculosis
AYNCSPSFNWKKHLDD

SEQ ID NO: 192521 - protein, 16 aa, Mycobacterium tuberculosis
YNCSPSFNWKKHLDDA

SEQ ID NO: 192522 - protein, 16 aa, Mycobacterium tuberculosis
NCSPSFNWKKHLDDAT

SEQ ID NO: 192523 - protein, 16 aa, Mycobacterium tuberculosis
CSPSFNWKKHLDDATI

SEQ ID NO: 192524 - protein, 16 aa, Mycobacterium tuberculosis
SPSFNWKKHLDDATIA

SEQ ID NO: 192525 - protein, 16 aa, Mycobacterium tuberculosis
PSFNWKKHLDDATIAK

SEQ ID NO: 192526 - protein, 16 aa, Mycobacterium tuberculosis
SFNWKKHLDDATIAKF

SEQ ID NO: 192527 - protein, 16 aa, Mycobacterium tuberculosis
FNWKKHLDDATIAKFQ

SEQ ID NO: 192528 - protein, 16 aa, Mycobacterium tuberculosis
NWKKHLDDATIAKFQK

SEQ ID NO: 192529 - protein, 16 aa, Mycobacterium tuberculosis
WKKHLDDATIAKFQKE

SEQ ID NO: 192530 - protein, 16 aa, Mycobacterium tuberculosis
KKHLDDATIAKFQKEL

SEQ ID NO: 192531 - protein, 16 aa, Mycobacterium tuberculosis
KHLDDATIAKFQKELA

SEQ ID NO: 192532 - protein, 16 aa, Mycobacterium tuberculosis
HLDDATIAKFQKELAA

SEQ ID NO: 192533 - protein, 16 aa, Mycobacterium tuberculosis
LDDATIAKFQKELAAM

SEQ ID NO: 192534 - protein, 16 aa, Mycobacterium tuberculosis
DDATIAKFQKELAAMG

SEQ ID NO: 192535 - protein, 16 aa, Mycobacterium tuberculosis
DATIAKFQKELAAMGF

SEQ ID NO: 192536 - protein, 16 aa, Mycobacterium tuberculosis
ATIAKFQKELAAMGFK

SEQ ID NO: 192537 - protein, 16 aa, Mycobacterium tuberculosis
TIAKFQKELAAMGFKF

SEQ ID NO: 192538 - protein, 16 aa, Mycobacterium tuberculosis
IAKFQKELAAMGFKFQ

SEQ ID NO: 192539 - protein, 16 aa, Mycobacterium tuberculosis
AKFQKELAAMGFKFQF

SEQ ID NO: 192540 - protein, 16 aa, Mycobacterium tuberculosis
KFQKELAAMGFKFQFI

SEQ ID NO: 192541 - protein, 16 aa, Mycobacterium tuberculosis
FQKELAAMGFKFQFIT

SEQ ID NO: 192542 - protein, 16 aa, Mycobacterium tuberculosis
QKELAAMGFKFQFITL

SEQ ID NO: 192543 - protein, 16 aa, Mycobacterium tuberculosis
KELAAMGFKFQFITLA

SEQ ID NO: 192544 - protein, 16 aa, Mycobacterium tuberculosis
ELAAMGFKFQFITLAG

SEQ ID NO: 192545 - protein, 16 aa, Mycobacterium tuberculosis
LAAMGFKFQFITLAGF

SEQ ID NO: 192546 - protein, 16 aa, Mycobacterium tuberculosis
AAMGFKFQFITLAGFH

SEQ ID NO: 192547 - protein, 16 aa, Mycobacterium tuberculosis
AMGFKFQFITLAGFHA

SEQ ID NO: 192548 - protein, 16 aa, Mycobacterium tuberculosis
MGFKFQFITLAGFHAL

SEQ ID NO: 192549 - protein, 16 aa, Mycobacterium tuberculosis
GFKFQFITLAGFHALN

SEQ ID NO: 192550 - protein, 16 aa, Mycobacterium tuberculosis
FKFQFITLAGFHALNY

SEQ ID NO: 192551 - protein, 16 aa, Mycobacterium tuberculosis
KFQFITLAGFHALNYS

SEQ ID NO: 192552 - protein, 16 aa, Mycobacterium tuberculosis
FQFITLAGFHALNYSM

SEQ ID NO: 192553 - protein, 16 aa, Mycobacterium tuberculosis
QFITLAGFHALNYSMF

SEQ ID NO: 192554 - protein, 16 aa, Mycobacterium tuberculosis
FITLAGFHALNYSMFD

SEQ ID NO: 192555 - protein, 16 aa, Mycobacterium tuberculosis
ITLAGFHALNYSMFDL

SEQ ID NO: 192556 - protein, 16 aa, Mycobacterium tuberculosis
TLAGFHALNYSMFDLA

SEQ ID NO: 192557 - protein, 16 aa, Mycobacterium tuberculosis
LAGFHALNYSMFDLAY

SEQ ID NO: 192558 - protein, 16 aa, Mycobacterium tuberculosis
AGFHALNYSMFDLAYG

SEQ ID NO: 192559 - protein, 16 aa, Mycobacterium tuberculosis
GFHALNYSMFDLAYGY

SEQ ID NO: 192560 - protein, 16 aa, Mycobacterium tuberculosis
FHALNYSMFDLAYGYA

SEQ ID NO: 192561 - protein, 16 aa, Mycobacterium tuberculosis
HALNYSMFDLAYGYAQ

SEQ ID NO: 192562 - protein, 16 aa, Mycobacterium tuberculosis
ALNYSMFDLAYGYAQN

SEQ ID NO: 192563 - protein, 16 aa, Mycobacterium tuberculosis
LNYSMFDLAYGYAQNQ

SEQ ID NO: 192564 - protein, 16 aa, Mycobacterium tuberculosis
NYSMFDLAYGYAQNQM

SEQ ID NO: 192565 - protein, 16 aa, Mycobacterium tuberculosis
YSMFDLAYGYAQNQMS

SEQ ID NO: 192566 - protein, 16 aa, Mycobacterium tuberculosis
SMFDLAYGYAQNQMSA

SEQ ID NO: 192567 - protein, 16 aa, Mycobacterium tuberculosis
MFDLAYGYAQNQMSAY

SEQ ID NO: 192568 - protein, 16 aa, Mycobacterium tuberculosis
FDLAYGYAQNQMSAYV

SEQ ID NO: 192569 - protein, 16 aa, Mycobacterium tuberculosis
DLAYGYAQNQMSAYVE

SEQ ID NO: 192570 - protein, 16 aa, Mycobacterium tuberculosis
LAYGYAQNQMSAYVEL

SEQ ID NO: 192571 - protein, 16 aa, Mycobacterium tuberculosis
AYGYAQNQMSAYVELQ

SEQ ID NO: 192572 - protein, 16 aa, Mycobacterium tuberculosis
YGYAQNQMSAYVELQE

SEQ ID NO: 192573 - protein, 16 aa, Mycobacterium tuberculosis
GYAQNQMSAYVELQER

SEQ ID NO: 192574 - protein, 16 aa, Mycobacterium tuberculosis
YAQNQMSAYVELQERE

SEQ ID NO: 192575 - protein, 16 aa, Mycobacterium tuberculosis
AQNQMSAYVELQEREF

SEQ ID NO: 192576 - protein, 16 aa, Mycobacterium tuberculosis
QNQMSAYVELQEREFA

SEQ ID NO: 192577 - protein, 16 aa, Mycobacterium tuberculosis
NQMSAYVELQEREFAA

SEQ ID NO: 192578 - protein, 16 aa, Mycobacterium tuberculosis
QMSAYVELQEREFAAE

SEQ ID NO: 192579 - protein, 16 aa, Mycobacterium tuberculosis
MSAYVELQEREFAAEE

SEQ ID NO: 192580 - protein, 16 aa, Mycobacterium tuberculosis
SAYVELQEREFAAEER

SEQ ID NO: 192581 - protein, 16 aa, Mycobacterium tuberculosis
AYVELQEREFAAEERG

SEQ ID NO: 192582 - protein, 16 aa, Mycobacterium tuberculosis
YVELQEREFAAEERGY

SEQ ID NO: 192583 - protein, 16 aa, Mycobacterium tuberculosis
VELQEREFAAEERGYT

SEQ ID NO: 192584 - protein, 16 aa, Mycobacterium tuberculosis
ELQEREFAAEERGYTA

SEQ ID NO: 192585 - protein, 16 aa, Mycobacterium tuberculosis
LQEREFAAEERGYTAT

SEQ ID NO: 192586 - protein, 16 aa, Mycobacterium tuberculosis
QEREFAAEERGYTATK

SEQ ID NO: 192587 - protein, 16 aa, Mycobacterium tuberculosis
EREFAAEERGYTATKH

SEQ ID NO: 192588 - protein, 16 aa, Mycobacterium tuberculosis
REFAAEERGYTATKHQ

SEQ ID NO: 192589 - protein, 16 aa, Mycobacterium tuberculosis
EFAAEERGYTATKHQR

SEQ ID NO: 192590 - protein, 16 aa, Mycobacterium tuberculosis
FAAEERGYTATKHQRE

SEQ ID NO: 192591 - protein, 16 aa, Mycobacterium tuberculosis
AAEERGYTATKHQREV

SEQ ID NO: 192592 - protein, 16 aa, Mycobacterium tuberculosis
AEERGYTATKHQREVG

SEQ ID NO: 192593 - protein, 16 aa, Mycobacterium tuberculosis
EERGYTATKHQREVGA

SEQ ID NO: 192594 - protein, 16 aa, Mycobacterium tuberculosis
ERGYTATKHQREVGAG

SEQ ID NO: 192595 - protein, 16 aa, Mycobacterium tuberculosis
RGYTATKHQREVGAGY

SEQ ID NO: 192596 - protein, 16 aa, Mycobacterium tuberculosis
GYTATKHQREVGAGYF

SEQ ID NO: 192597 - protein, 16 aa, Mycobacterium tuberculosis
YTATKHQREVGAGYFD

SEQ ID NO: 192598 - protein, 16 aa, Mycobacterium tuberculosis
TATKHQREVGAGYFDR

SEQ ID NO: 192599 - protein, 16 aa, Mycobacterium tuberculosis
ATKHQREVGAGYFDRI

SEQ ID NO: 192600 - protein, 16 aa, Mycobacterium tuberculosis
TKHQREVGAGYFDRIA

SEQ ID NO: 192601 - protein, 16 aa, Mycobacterium tuberculosis
KHQREVGAGYFDRIAT

SEQ ID NO: 192602 - protein, 16 aa, Mycobacterium tuberculosis
HQREVGAGYFDRIATT

SEQ ID NO: 192603 - protein, 16 aa, Mycobacterium tuberculosis
QREVGAGYFDRIATTV

SEQ ID NO: 192604 - protein, 16 aa, Mycobacterium tuberculosis
REVGAGYFDRIATTVD

SEQ ID NO: 192605 - protein, 16 aa, Mycobacterium tuberculosis
EVGAGYFDRIATTVDP

SEQ ID NO: 192606 - protein, 16 aa, Mycobacterium tuberculosis
VGAGYFDRIATTVDPN

SEQ ID NO: 192607 - protein, 16 aa, Mycobacterium tuberculosis
GAGYFDRIATTVDPNS

SEQ ID NO: 192608 - protein, 16 aa, Mycobacterium tuberculosis
AGYFDRIATTVDPNSS

SEQ ID NO: 192609 - protein, 16 aa, Mycobacterium tuberculosis
GYFDRIATTVDPNSST

SEQ ID NO: 192610 - protein, 16 aa, Mycobacterium tuberculosis
YFDRIATTVDPNSSTT

SEQ ID NO: 192611 - protein, 16 aa, Mycobacterium tuberculosis
FDRIATTVDPNSSTTA

SEQ ID NO: 192612 - protein, 16 aa, Mycobacterium tuberculosis
DRIATTVDPNSSTTAL

SEQ ID NO: 192613 - protein, 16 aa, Mycobacterium tuberculosis
RIATTVDPNSSTTALT

SEQ ID NO: 192614 - protein, 16 aa, Mycobacterium tuberculosis
IATTVDPNSSTTALTG

SEQ ID NO: 192615 - protein, 16 aa, Mycobacterium tuberculosis
ATTVDPNSSTTALTGS

SEQ ID NO: 192616 - protein, 16 aa, Mycobacterium tuberculosis
TTVDPNSSTTALTGST

SEQ ID NO: 192617 - protein, 16 aa, Mycobacterium tuberculosis
TVDPNSSTTALTGSTE

SEQ ID NO: 192618 - protein, 16 aa, Mycobacterium tuberculosis
VDPNSSTTALTGSTEE

SEQ ID NO: 192619 - protein, 16 aa, Mycobacterium tuberculosis
DPNSSTTALTGSTEEG

SEQ ID NO: 192620 - protein, 16 aa, Mycobacterium tuberculosis
PNSSTTALTGSTEEGQ

SEQ ID NO: 192621 - protein, 16 aa, Mycobacterium tuberculosis
NSSTTALTGSTEEGQF

SEQ ID NO: 192622 - protein, 16 aa, Mycobacterium tuberculosis
SSTTALTGSTEEGQFH

SEQ ID NO: 192623 - protein, 526 aa, Mycobacterium tuberculosis
MPDQDTKVRFFRVFCWCPVLRMVRIMLMHAVRAWRSADDFPCTEHMAYKIAQVAADPVDVDPEVADMVCNRIIDNAAVSAASMVRRPVTVARHQALAHPVRHGAKVFGVEGSYSADWAAWANGVAARELDFHDTFLAADYSHPADNIPPLVAVAQQLGVCGAELIRGLVTAYEIHIDLTRGICLHEHKIDHVAHLGPAVAAGIGTMLRLDQETIYHAIGQALHLTTSTRQSRKGAISSWKAFAPAHAGKVGIEAVDRAMRGEGSPAPIWEGEDGVIAWLLAGPEHTYRVPLPAPGEPKRAILDSYTKQHSAEYQSQAPIDLACRLRERIGDLDQIASIVLHTSHHTHVVIGTGSGDPQKFDPDASRETLDHSLPYIFAVALQDGCWHHERSYAPERARRSDTVALWHKISTVEDPEWTRRYHCADPAKKAFGARAEVTLHSGEVIVDELAVADAHPLGTRPFERKQYVEKFTELADGVVEPVEQQRFLAVVESLADLESGAVGGLNVLVDPRVLDKAPVIPPGIFR

SEQ ID NO: 192624 - protein, 8 aa, Mycobacterium tuberculosis
MPDQDTKV

SEQ ID NO: 192625 - protein, 8 aa, Mycobacterium tuberculosis
DTKVRFFR

SEQ ID NO: 192626 - protein, 8 aa, Mycobacterium tuberculosis
TKVRFFRV

SEQ ID NO: 192627 - protein, 8 aa, Mycobacterium tuberculosis
KVRFFRVF

SEQ ID NO: 192628 - protein, 8 aa, Mycobacterium tuberculosis
RFFRVFCW

SEQ ID NO: 192629 - protein, 8 aa, Mycobacterium tuberculosis
RVFCWCPV

SEQ ID NO: 192630 - protein, 8 aa, Mycobacterium tuberculosis
CPVLRMVR

SEQ ID NO: 192631 - protein, 8 aa, Mycobacterium tuberculosis
RMVRIMLM

SEQ ID NO: 192632 - protein, 8 aa, Mycobacterium tuberculosis
RIMLMHAV

SEQ ID NO: 192633 - protein, 8 aa, Mycobacterium tuberculosis
IMLMHAVR

SEQ ID NO: 192634 - protein, 8 aa, Mycobacterium tuberculosis
MLMHAVRA

SEQ ID NO: 192635 - protein, 8 aa, Mycobacterium tuberculosis
LMHAVRAW

SEQ ID NO: 192636 - protein, 8 aa, Mycobacterium tuberculosis
MHAVRAWR

SEQ ID NO: 192637 - protein, 8 aa, Mycobacterium tuberculosis
AVRAWRSA

SEQ ID NO: 192638 - protein, 8 aa, Mycobacterium tuberculosis
AWRSADDF

SEQ ID NO: 192639 - protein, 8 aa, Mycobacterium tuberculosis
FPCTEHMA

SEQ ID NO: 192640 - protein, 8 aa, Mycobacterium tuberculosis
CTEHMAYK

SEQ ID NO: 192641 - protein, 8 aa, Mycobacterium tuberculosis
MAYKIAQV

SEQ ID NO: 192642 - protein, 8 aa, Mycobacterium tuberculosis
AQVAADPV

SEQ ID NO: 192643 - protein, 8 aa, Mycobacterium tuberculosis
VAADPVDV

SEQ ID NO: 192644 - protein, 8 aa, Mycobacterium tuberculosis
PVDVDPEV

SEQ ID NO: 192645 - protein, 8 aa, Mycobacterium tuberculosis
VADMVCNR

SEQ ID NO: 192646 - protein, 8 aa, Mycobacterium tuberculosis
RIIDNAAV

SEQ ID NO: 192647 - protein, 8 aa, Mycobacterium tuberculosis
AAVSAASM

SEQ ID NO: 192648 - protein, 8 aa, Mycobacterium tuberculosis
AVSAASMV

SEQ ID NO: 192649 - protein, 8 aa, Mycobacterium tuberculosis
VSAASMVR

SEQ ID NO: 192650 - protein, 8 aa, Mycobacterium tuberculosis
SAASMVRR

SEQ ID NO: 192651 - protein, 8 aa, Mycobacterium tuberculosis
MVRRPVTV

SEQ ID NO: 192652 - protein, 8 aa, Mycobacterium tuberculosis
RRPVTVAR

SEQ ID NO: 192653 - protein, 8 aa, Mycobacterium tuberculosis
TVARHQAL

SEQ ID NO: 192654 - protein, 8 aa, Mycobacterium tuberculosis
HQALAHPV

SEQ ID NO: 192655 - protein, 8 aa, Mycobacterium tuberculosis
QALAHPVR

SEQ ID NO: 192656 - protein, 8 aa, Mycobacterium tuberculosis
PVRHGAKV

SEQ ID NO: 192657 - protein, 8 aa, Mycobacterium tuberculosis
HGAKVFGV

SEQ ID NO: 192658 - protein, 8 aa, Mycobacterium tuberculosis
VFGVEGSY

SEQ ID NO: 192659 - protein, 8 aa, Mycobacterium tuberculosis
YSADWAAW

SEQ ID NO: 192660 - protein, 8 aa, Mycobacterium tuberculosis
SADWAAWA

SEQ ID NO: 192661 - protein, 8 aa, Mycobacterium tuberculosis
WAAWANGV

SEQ ID NO: 192662 - protein, 8 aa, Mycobacterium tuberculosis
WANGVAAR

SEQ ID NO: 192663 - protein, 8 aa, Mycobacterium tuberculosis
VAARELDF

SEQ ID NO: 192664 - protein, 8 aa, Mycobacterium tuberculosis
ELDFHDTF

SEQ ID NO: 192665 - protein, 8 aa, Mycobacterium tuberculosis
DTFLAADY

SEQ ID NO: 192666 - protein, 8 aa, Mycobacterium tuberculosis
FLAADYSH

SEQ ID NO: 192667 - protein, 8 aa, Mycobacterium tuberculosis
NIPPLVAV

SEQ ID NO: 192668 - protein, 8 aa, Mycobacterium tuberculosis
IPPLVAVA

SEQ ID NO: 192669 - protein, 8 aa, Mycobacterium tuberculosis
LVAVAQQL

SEQ ID NO: 192670 - protein, 8 aa, Mycobacterium tuberculosis
AVAQQLGV

SEQ ID NO: 192671 - protein, 8 aa, Mycobacterium tuberculosis
QQLGVCGA

SEQ ID NO: 192672 - protein, 8 aa, Mycobacterium tuberculosis
AELIRGLV

SEQ ID NO: 192673 - protein, 8 aa, Mycobacterium tuberculosis
LIRGLVTA

SEQ ID NO: 192674 - protein, 8 aa, Mycobacterium tuberculosis
GLVTAYEI

SEQ ID NO: 192675 - protein, 8 aa, Mycobacterium tuberculosis
AYEIHIDL

SEQ ID NO: 192676 - protein, 8 aa, Mycobacterium tuberculosis
EIHIDLTR

SEQ ID NO: 192677 - protein, 8 aa, Mycobacterium tuberculosis
DLTRGICL

SEQ ID NO: 192678 - protein, 8 aa, Mycobacterium tuberculosis
GICLHEHK

SEQ ID NO: 192679 - protein, 8 aa, Mycobacterium tuberculosis
KIDHVAHL

SEQ ID NO: 192680 - protein, 8 aa, Mycobacterium tuberculosis
HVAHLGPA

SEQ ID NO: 192681 - protein, 8 aa, Mycobacterium tuberculosis
VAHLGPAV

SEQ ID NO: 192682 - protein, 8 aa, Mycobacterium tuberculosis
HLGPAVAA

SEQ ID NO: 192683 - protein, 8 aa, Mycobacterium tuberculosis
GPAVAAGI

SEQ ID NO: 192684 - protein, 8 aa, Mycobacterium tuberculosis
VAAGIGTM

SEQ ID NO: 192685 - protein, 8 aa, Mycobacterium tuberculosis
GIGTMLRL

SEQ ID NO: 192686 - protein, 8 aa, Mycobacterium tuberculosis
RLDQETIY

SEQ ID NO: 192687 - protein, 8 aa, Mycobacterium tuberculosis
QETIYHAI

SEQ ID NO: 192688 - protein, 8 aa, Mycobacterium tuberculosis
YHAIGQAL

SEQ ID NO: 192689 - protein, 8 aa, Mycobacterium tuberculosis
AIGQALHL

SEQ ID NO: 192690 - protein, 8 aa, Mycobacterium tuberculosis
GQALHLTT

SEQ ID NO: 192691 - protein, 8 aa, Mycobacterium tuberculosis
ALHLTTST

SEQ ID NO: 192692 - protein, 8 aa, Mycobacterium tuberculosis
TTSTRQSR

SEQ ID NO: 192693 - protein, 8 aa, Mycobacterium tuberculosis
TSTRQSRK

SEQ ID NO: 192694 - protein, 8 aa, Mycobacterium tuberculosis
RQSRKGAI

SEQ ID NO: 192695 - protein, 8 aa, Mycobacterium tuberculosis
AISSWKAF

SEQ ID NO: 192696 - protein, 8 aa, Mycobacterium tuberculosis
FAPAHAGK

SEQ ID NO: 192697 - protein, 8 aa, Mycobacterium tuberculosis
APAHAGKV

SEQ ID NO: 192698 - protein, 8 aa, Mycobacterium tuberculosis
EAVDRAMR

SEQ ID NO: 192699 - protein, 8 aa, Mycobacterium tuberculosis
EGSPAPIW

SEQ ID NO: 192700 - protein, 8 aa, Mycobacterium tuberculosis
WEGEDGVI

SEQ ID NO: 192701 - protein, 8 aa, Mycobacterium tuberculosis
GEDGVIAW

SEQ ID NO: 192702 - protein, 8 aa, Mycobacterium tuberculosis
GVIAWLLA

SEQ ID NO: 192703 - protein, 8 aa, Mycobacterium tuberculosis
LLAGPEHT

SEQ ID NO: 192704 - protein, 8 aa, Mycobacterium tuberculosis
LAGPEHTY

SEQ ID NO: 192705 - protein, 8 aa, Mycobacterium tuberculosis
EHTYRVPL

SEQ ID NO: 192706 - protein, 8 aa, Mycobacterium tuberculosis
GEPKRAIL

SEQ ID NO: 192707 - protein, 8 aa, Mycobacterium tuberculosis
KRAILDSY

SEQ ID NO: 192708 - protein, 8 aa, Mycobacterium tuberculosis
AILDSYTK

SEQ ID NO: 192709 - protein, 8 aa, Mycobacterium tuberculosis
ILDSYTKQ

SEQ ID NO: 192710 - protein, 8 aa, Mycobacterium tuberculosis
YTKQHSAE

SEQ ID NO: 192711 - protein, 8 aa, Mycobacterium tuberculosis
EYQSQAPI

SEQ ID NO: 192712 - protein, 8 aa, Mycobacterium tuberculosis
SQAPIDLA

SEQ ID NO: 192713 - protein, 8 aa, Mycobacterium tuberculosis
PIDLACRL

SEQ ID NO: 192714 - protein, 8 aa, Mycobacterium tuberculosis
LACRLRER

SEQ ID NO: 192715 - protein, 8 aa, Mycobacterium tuberculosis
RIGDLDQI

SEQ ID NO: 192716 - protein, 8 aa, Mycobacterium tuberculosis
DLDQIASI

SEQ ID NO: 192717 - protein, 8 aa, Mycobacterium tuberculosis
QIASIVLH

SEQ ID NO: 192718 - protein, 8 aa, Mycobacterium tuberculosis
VLHTSHHT

SEQ ID NO: 192719 - protein, 8 aa, Mycobacterium tuberculosis
HTSHHTHV

SEQ ID NO: 192720 - protein, 8 aa, Mycobacterium tuberculosis
TSHHTHVV

SEQ ID NO: 192721 - protein, 8 aa, Mycobacterium tuberculosis
KFDPDASR

SEQ ID NO: 192722 - protein, 8 aa, Mycobacterium tuberculosis
RETLDHSL

SEQ ID NO: 192723 - protein, 8 aa, Mycobacterium tuberculosis
TLDHSLPY

SEQ ID NO: 192724 - protein, 8 aa, Mycobacterium tuberculosis
HSLPYIFA

SEQ ID NO: 192725 - protein, 8 aa, Mycobacterium tuberculosis
SLPYIFAV

SEQ ID NO: 192726 - protein, 8 aa, Mycobacterium tuberculosis
LPYIFAVA

SEQ ID NO: 192727 - protein, 8 aa, Mycobacterium tuberculosis
PYIFAVAL

SEQ ID NO: 192728 - protein, 8 aa, Mycobacterium tuberculosis
YIFAVALQ

SEQ ID NO: 192729 - protein, 8 aa, Mycobacterium tuberculosis
VALQDGCW

SEQ ID NO: 192730 - protein, 8 aa, Mycobacterium tuberculosis
ALQDGCWH

SEQ ID NO: 192731 - protein, 8 aa, Mycobacterium tuberculosis
DGCWHHER

SEQ ID NO: 192732 - protein, 8 aa, Mycobacterium tuberculosis
CWHHERSY

SEQ ID NO: 192733 - protein, 8 aa, Mycobacterium tuberculosis
ERSYAPER

SEQ ID NO: 192734 - protein, 8 aa, Mycobacterium tuberculosis
SYAPERAR

SEQ ID NO: 192735 - protein, 8 aa, Mycobacterium tuberculosis
YAPERARR

SEQ ID NO: 192736 - protein, 8 aa, Mycobacterium tuberculosis
RARRSDTV

SEQ ID NO: 192737 - protein, 8 aa, Mycobacterium tuberculosis
RRSDTVAL

SEQ ID NO: 192738 - protein, 8 aa, Mycobacterium tuberculosis
RSDTVALW

SEQ ID NO: 192739 - protein, 8 aa, Mycobacterium tuberculosis
DTVALWHK

SEQ ID NO: 192740 - protein, 8 aa, Mycobacterium tuberculosis
TVALWHKI

SEQ ID NO: 192741 - protein, 8 aa, Mycobacterium tuberculosis
ALWHKIST

SEQ ID NO: 192742 - protein, 8 aa, Mycobacterium tuberculosis
STVEDPEW

SEQ ID NO: 192743 - protein, 8 aa, Mycobacterium tuberculosis
DPEWTRRY

SEQ ID NO: 192744 - protein, 8 aa, Mycobacterium tuberculosis
RYHCADPA

SEQ ID NO: 192745 - protein, 8 aa, Mycobacterium tuberculosis
AFGARAEV

SEQ ID NO: 192746 - protein, 8 aa, Mycobacterium tuberculosis
AEVTLHSG

SEQ ID NO: 192747 - protein, 8 aa, Mycobacterium tuberculosis
VTLHSGEV

SEQ ID NO: 192748 - protein, 8 aa, Mycobacterium tuberculosis
TLHSGEVI

SEQ ID NO: 192749 - protein, 8 aa, Mycobacterium tuberculosis
GEVIVDEL

SEQ ID NO: 192750 - protein, 8 aa, Mycobacterium tuberculosis
EVIVDELA

SEQ ID NO: 192751 - protein, 8 aa, Mycobacterium tuberculosis
VIVDELAV

SEQ ID NO: 192752 - protein, 8 aa, Mycobacterium tuberculosis
IVDELAVA

SEQ ID NO: 192753 - protein, 8 aa, Mycobacterium tuberculosis
AVADAHPL

SEQ ID NO: 192754 - protein, 8 aa, Mycobacterium tuberculosis
DAHPLGTR

SEQ ID NO: 192755 - protein, 8 aa, Mycobacterium tuberculosis
HPLGTRPF

SEQ ID NO: 192756 - protein, 8 aa, Mycobacterium tuberculosis
LGTRPFER

SEQ ID NO: 192757 - protein, 8 aa, Mycobacterium tuberculosis
GTRPFERK

SEQ ID NO: 192758 - protein, 8 aa, Mycobacterium tuberculosis
YVEKFTEL

SEQ ID NO: 192759 - protein, 8 aa, Mycobacterium tuberculosis
FTELADGV

SEQ ID NO: 192760 - protein, 8 aa, Mycobacterium tuberculosis
ELADGVVE

SEQ ID NO: 192761 - protein, 8 aa, Mycobacterium tuberculosis
EPVEQQRF

SEQ ID NO: 192762 - protein, 8 aa, Mycobacterium tuberculosis
EQQRFLAV

SEQ ID NO: 192763 - protein, 8 aa, Mycobacterium tuberculosis
QQRFLAVV

SEQ ID NO: 192764 - protein, 8 aa, Mycobacterium tuberculosis
FLAVVESL

SEQ ID NO: 192765 - protein, 8 aa, Mycobacterium tuberculosis
SLADLESG

SEQ ID NO: 192766 - protein, 8 aa, Mycobacterium tuberculosis
ESGAVGGL

SEQ ID NO: 192767 - protein, 8 aa, Mycobacterium tuberculosis
GAVGGLNV

SEQ ID NO: 192768 - protein, 8 aa, Mycobacterium tuberculosis
AVGGLNVL

SEQ ID NO: 192769 - protein, 8 aa, Mycobacterium tuberculosis
NVLVDPRV

SEQ ID NO: 192770 - protein, 8 aa, Mycobacterium tuberculosis
VLVDPRVL

SEQ ID NO: 192771 - protein, 8 aa, Mycobacterium tuberculosis
RVLDKAPV

SEQ ID NO: 192772 - protein, 8 aa, Mycobacterium tuberculosis
VLDKAPVI

SEQ ID NO: 192773 - protein, 8 aa, Mycobacterium tuberculosis
APVIPPGI

SEQ ID NO: 192774 - protein, 8 aa, Mycobacterium tuberculosis
PVIPPGIF

SEQ ID NO: 192775 - protein, 8 aa, Mycobacterium tuberculosis
VIPPGIFR

SEQ ID NO: 192776 - protein, 9 aa, Mycobacterium tuberculosis
QDTKVRFFR

SEQ ID NO: 192777 - protein, 9 aa, Mycobacterium tuberculosis
DTKVRFFRV

SEQ ID NO: 192778 - protein, 9 aa, Mycobacterium tuberculosis
KVRFFRVFC

SEQ ID NO: 192779 - protein, 9 aa, Mycobacterium tuberculosis
FRVFCWCPV

SEQ ID NO: 192780 - protein, 9 aa, Mycobacterium tuberculosis
RVFCWCPVL

SEQ ID NO: 192781 - protein, 9 aa, Mycobacterium tuberculosis
VFCWCPVLR

SEQ ID NO: 192782 - protein, 9 aa, Mycobacterium tuberculosis
FCWCPVLRM

SEQ ID NO: 192783 - protein, 9 aa, Mycobacterium tuberculosis
CPVLRMVRI

SEQ ID NO: 192784 - protein, 9 aa, Mycobacterium tuberculosis
VLRMVRIML

SEQ ID NO: 192785 - protein, 9 aa, Mycobacterium tuberculosis
RMVRIMLMH

SEQ ID NO: 192786 - protein, 9 aa, Mycobacterium tuberculosis
MVRIMLMHA

SEQ ID NO: 192787 - protein, 9 aa, Mycobacterium tuberculosis
RIMLMHAVR

SEQ ID NO: 192788 - protein, 9 aa, Mycobacterium tuberculosis
IMLMHAVRA

SEQ ID NO: 192789 - protein, 9 aa, Mycobacterium tuberculosis
MLMHAVRAW

SEQ ID NO: 192790 - protein, 9 aa, Mycobacterium tuberculosis
LMHAVRAWR

SEQ ID NO: 192791 - protein, 9 aa, Mycobacterium tuberculosis
RAWRSADDF

SEQ ID NO: 192792 - protein, 9 aa, Mycobacterium tuberculosis
FPCTEHMAY

SEQ ID NO: 192793 - protein, 9 aa, Mycobacterium tuberculosis
HMAYKIAQV

SEQ ID NO: 192794 - protein, 9 aa, Mycobacterium tuberculosis
MAYKIAQVA

SEQ ID NO: 192795 - protein, 9 aa, Mycobacterium tuberculosis
QVAADPVDV

SEQ ID NO: 192796 - protein, 9 aa, Mycobacterium tuberculosis
DPVDVDPEV

SEQ ID NO: 192797 - protein, 9 aa, Mycobacterium tuberculosis
DVDPEVADM

SEQ ID NO: 192798 - protein, 9 aa, Mycobacterium tuberculosis
DPEVADMVC

SEQ ID NO: 192799 - protein, 9 aa, Mycobacterium tuberculosis
EVADMVCNR

SEQ ID NO: 192800 - protein, 9 aa, Mycobacterium tuberculosis
IIDNAAVSA

SEQ ID NO: 192801 - protein, 9 aa, Mycobacterium tuberculosis
NAAVSAASM

SEQ ID NO: 192802 - protein, 9 aa, Mycobacterium tuberculosis
AAVSAASMV

SEQ ID NO: 192803 - protein, 9 aa, Mycobacterium tuberculosis
AVSAASMVR

SEQ ID NO: 192804 - protein, 9 aa, Mycobacterium tuberculosis
VSAASMVRR

SEQ ID NO: 192805 - protein, 9 aa, Mycobacterium tuberculosis
AASMVRRPV

SEQ ID NO: 192806 - protein, 9 aa, Mycobacterium tuberculosis
SMVRRPVTV

SEQ ID NO: 192807 - protein, 9 aa, Mycobacterium tuberculosis
MVRRPVTVA

SEQ ID NO: 192808 - protein, 9 aa, Mycobacterium tuberculosis
VTVARHQAL

SEQ ID NO: 192809 - protein, 9 aa, Mycobacterium tuberculosis
TVARHQALA

SEQ ID NO: 192810 - protein, 9 aa, Mycobacterium tuberculosis
HQALAHPVR

SEQ ID NO: 192811 - protein, 9 aa, Mycobacterium tuberculosis
LAHPVRHGA

SEQ ID NO: 192812 - protein, 9 aa, Mycobacterium tuberculosis
HPVRHGAKV

SEQ ID NO: 192813 - protein, 9 aa, Mycobacterium tuberculosis
KVFGVEGSY

SEQ ID NO: 192814 - protein, 9 aa, Mycobacterium tuberculosis
FGVEGSYSA

SEQ ID NO: 192815 - protein, 9 aa, Mycobacterium tuberculosis
SYSADWAAW

SEQ ID NO: 192816 - protein, 9 aa, Mycobacterium tuberculosis
YSADWAAWA

SEQ ID NO: 192817 - protein, 9 aa, Mycobacterium tuberculosis
DWAAWANGV

SEQ ID NO: 192818 - protein, 9 aa, Mycobacterium tuberculosis
WAAWANGVA

SEQ ID NO: 192819 - protein, 9 aa, Mycobacterium tuberculosis
AAWANGVAA

SEQ ID NO: 192820 - protein, 9 aa, Mycobacterium tuberculosis
AWANGVAAR

SEQ ID NO: 192821 - protein, 9 aa, Mycobacterium tuberculosis
GVAARELDF

SEQ ID NO: 192822 - protein, 9 aa, Mycobacterium tuberculosis
RELDFHDTF

SEQ ID NO: 192823 - protein, 9 aa, Mycobacterium tuberculosis
ELDFHDTFL

SEQ ID NO: 192824 - protein, 9 aa, Mycobacterium tuberculosis
DTFLAADYS

SEQ ID NO: 192825 - protein, 9 aa, Mycobacterium tuberculosis
FLAADYSHP

SEQ ID NO: 192826 - protein, 9 aa, Mycobacterium tuberculosis
LAADYSHPA

SEQ ID NO: 192827 - protein, 9 aa, Mycobacterium tuberculosis
DYSHPADNI

SEQ ID NO: 192828 - protein, 9 aa, Mycobacterium tuberculosis
HPADNIPPL

SEQ ID NO: 192829 - protein, 9 aa, Mycobacterium tuberculosis
PADNIPPLV

SEQ ID NO: 192830 - protein, 9 aa, Mycobacterium tuberculosis
DNIPPLVAV

SEQ ID NO: 192831 - protein, 9 aa, Mycobacterium tuberculosis
NIPPLVAVA

SEQ ID NO: 192832 - protein, 9 aa, Mycobacterium tuberculosis
PLVAVAQQL

SEQ ID NO: 192833 - protein, 9 aa, Mycobacterium tuberculosis
VAVAQQLGV

SEQ ID NO: 192834 - protein, 9 aa, Mycobacterium tuberculosis
AQQLGVCGA

SEQ ID NO: 192835 - protein, 9 aa, Mycobacterium tuberculosis
QLGVCGAEL

SEQ ID NO: 192836 - protein, 9 aa, Mycobacterium tuberculosis
GVCGAELIR

SEQ ID NO: 192837 - protein, 9 aa, Mycobacterium tuberculosis
AELIRGLVT

SEQ ID NO: 192838 - protein, 9 aa, Mycobacterium tuberculosis
ELIRGLVTA

SEQ ID NO: 192839 - protein, 9 aa, Mycobacterium tuberculosis
LIRGLVTAY

SEQ ID NO: 192840 - protein, 9 aa, Mycobacterium tuberculosis
TAYEIHIDL

SEQ ID NO: 192841 - protein, 9 aa, Mycobacterium tuberculosis
YEIHIDLTR

SEQ ID NO: 192842 - protein, 9 aa, Mycobacterium tuberculosis
RGICLHEHK

SEQ ID NO: 192843 - protein, 9 aa, Mycobacterium tuberculosis
HVAHLGPAV

SEQ ID NO: 192844 - protein, 9 aa, Mycobacterium tuberculosis
LGPAVAAGI

SEQ ID NO: 192845 - protein, 9 aa, Mycobacterium tuberculosis
AVAAGIGTM

SEQ ID NO: 192846 - protein, 9 aa, Mycobacterium tuberculosis
VAAGIGTML

SEQ ID NO: 192847 - protein, 9 aa, Mycobacterium tuberculosis
AAGIGTMLR

SEQ ID NO: 192848 - protein, 9 aa, Mycobacterium tuberculosis
TMLRLDQET

SEQ ID NO: 192849 - protein, 9 aa, Mycobacterium tuberculosis
MLRLDQETI

SEQ ID NO: 192850 - protein, 9 aa, Mycobacterium tuberculosis
RLDQETIYH

SEQ ID NO: 192851 - protein, 9 aa, Mycobacterium tuberculosis
ETIYHAIGQ

SEQ ID NO: 192852 - protein, 9 aa, Mycobacterium tuberculosis
TIYHAIGQA

SEQ ID NO: 192853 - protein, 9 aa, Mycobacterium tuberculosis
IYHAIGQAL

SEQ ID NO: 192854 - protein, 9 aa, Mycobacterium tuberculosis
HAIGQALHL

SEQ ID NO: 192855 - protein, 9 aa, Mycobacterium tuberculosis
AIGQALHLT

SEQ ID NO: 192856 - protein, 9 aa, Mycobacterium tuberculosis
GQALHLTTS

SEQ ID NO: 192857 - protein, 9 aa, Mycobacterium tuberculosis
ALHLTTSTR

SEQ ID NO: 192858 - protein, 9 aa, Mycobacterium tuberculosis
LTTSTRQSR

SEQ ID NO: 192859 - protein, 9 aa, Mycobacterium tuberculosis
TTSTRQSRK

SEQ ID NO: 192860 - protein, 9 aa, Mycobacterium tuberculosis
STRQSRKGA

SEQ ID NO: 192861 - protein, 9 aa, Mycobacterium tuberculosis
GAISSWKAF

SEQ ID NO: 192862 - protein, 9 aa, Mycobacterium tuberculosis
AISSWKAFA

SEQ ID NO: 192863 - protein, 9 aa, Mycobacterium tuberculosis
SSWKAFAPA

SEQ ID NO: 192864 - protein, 9 aa, Mycobacterium tuberculosis
AFAPAHAGK

SEQ ID NO: 192865 - protein, 9 aa, Mycobacterium tuberculosis
FAPAHAGKV

SEQ ID NO: 192866 - protein, 9 aa, Mycobacterium tuberculosis
APAHAGKVG

SEQ ID NO: 192867 - protein, 9 aa, Mycobacterium tuberculosis
AMRGEGSPA

SEQ ID NO: 192868 - protein, 9 aa, Mycobacterium tuberculosis
PIWEGEDGV

SEQ ID NO: 192869 - protein, 9 aa, Mycobacterium tuberculosis
GEDGVIAWL

SEQ ID NO: 192870 - protein, 9 aa, Mycobacterium tuberculosis
WLLAGPEHT

SEQ ID NO: 192871 - protein, 9 aa, Mycobacterium tuberculosis
LLAGPEHTY

SEQ ID NO: 192872 - protein, 9 aa, Mycobacterium tuberculosis
LAGPEHTYR

SEQ ID NO: 192873 - protein, 9 aa, Mycobacterium tuberculosis
AGPEHTYRV

SEQ ID NO: 192874 - protein, 9 aa, Mycobacterium tuberculosis
PEHTYRVPL

SEQ ID NO: 192875 - protein, 9 aa, Mycobacterium tuberculosis
HTYRVPLPA

SEQ ID NO: 192876 - protein, 9 aa, Mycobacterium tuberculosis
APGEPKRAI

SEQ ID NO: 192877 - protein, 9 aa, Mycobacterium tuberculosis
RAILDSYTK

SEQ ID NO: 192878 - protein, 9 aa, Mycobacterium tuberculosis
YTKQHSAEY

SEQ ID NO: 192879 - protein, 9 aa, Mycobacterium tuberculosis
HSAEYQSQA

SEQ ID NO: 192880 - protein, 9 aa, Mycobacterium tuberculosis
AEYQSQAPI

SEQ ID NO: 192881 - protein, 9 aa, Mycobacterium tuberculosis
YQSQAPIDL

SEQ ID NO: 192882 - protein, 9 aa, Mycobacterium tuberculosis
SQAPIDLAC

SEQ ID NO: 192883 - protein, 9 aa, Mycobacterium tuberculosis
QAPIDLACR

SEQ ID NO: 192884 - protein, 9 aa, Mycobacterium tuberculosis
APIDLACRL

SEQ ID NO: 192885 - protein, 9 aa, Mycobacterium tuberculosis
DLACRLRER

SEQ ID NO: 192886 - protein, 9 aa, Mycobacterium tuberculosis
RLRERIGDL

SEQ ID NO: 192887 - protein, 9 aa, Mycobacterium tuberculosis
RIGDLDQIA

SEQ ID NO: 192888 - protein, 9 aa, Mycobacterium tuberculosis
DLDQIASIV

SEQ ID NO: 192889 - protein, 9 aa, Mycobacterium tuberculosis
HTSHHTHVV

SEQ ID NO: 192890 - protein, 9 aa, Mycobacterium tuberculosis
GTGSGDPQK

SEQ ID NO: 192891 - protein, 9 aa, Mycobacterium tuberculosis
ETLDHSLPY

SEQ ID NO: 192892 - protein, 9 aa, Mycobacterium tuberculosis
TLDHSLPYI

SEQ ID NO: 192893 - protein, 9 aa, Mycobacterium tuberculosis
HSLPYIFAV

SEQ ID NO: 192894 - protein, 9 aa, Mycobacterium tuberculosis
SLPYIFAVA

SEQ ID NO: 192895 - protein, 9 aa, Mycobacterium tuberculosis
LPYIFAVAL

SEQ ID NO: 192896 - protein, 9 aa, Mycobacterium tuberculosis
ALQDGCWHH

SEQ ID NO: 192897 - protein, 9 aa, Mycobacterium tuberculosis
RSYAPERAR

SEQ ID NO: 192898 - protein, 9 aa, Mycobacterium tuberculosis
SYAPERARR

SEQ ID NO: 192899 - protein, 9 aa, Mycobacterium tuberculosis
APERARRSD

SEQ ID NO: 192900 - protein, 9 aa, Mycobacterium tuberculosis
ERARRSDTV

SEQ ID NO: 192901 - protein, 9 aa, Mycobacterium tuberculosis
RARRSDTVA

SEQ ID NO: 192902 - protein, 9 aa, Mycobacterium tuberculosis
ARRSDTVAL

SEQ ID NO: 192903 - protein, 9 aa, Mycobacterium tuberculosis
RRSDTVALW

SEQ ID NO: 192904 - protein, 9 aa, Mycobacterium tuberculosis
DTVALWHKI

SEQ ID NO: 192905 - protein, 9 aa, Mycobacterium tuberculosis
ALWHKISTV

SEQ ID NO: 192906 - protein, 9 aa, Mycobacterium tuberculosis
ISTVEDPEW

SEQ ID NO: 192907 - protein, 9 aa, Mycobacterium tuberculosis
TVEDPEWTR

SEQ ID NO: 192908 - protein, 9 aa, Mycobacterium tuberculosis
RYHCADPAK

SEQ ID NO: 192909 - protein, 9 aa, Mycobacterium tuberculosis
CADPAKKAF

SEQ ID NO: 192910 - protein, 9 aa, Mycobacterium tuberculosis
PAKKAFGAR

SEQ ID NO: 192911 - protein, 9 aa, Mycobacterium tuberculosis
KAFGARAEV

SEQ ID NO: 192912 - protein, 9 aa, Mycobacterium tuberculosis
FGARAEVTL

SEQ ID NO: 192913 - protein, 9 aa, Mycobacterium tuberculosis
AEVTLHSGE

SEQ ID NO: 192914 - protein, 9 aa, Mycobacterium tuberculosis
EVTLHSGEV

SEQ ID NO: 192915 - protein, 9 aa, Mycobacterium tuberculosis
TLHSGEVIV

SEQ ID NO: 192916 - protein, 9 aa, Mycobacterium tuberculosis
EVIVDELAV

SEQ ID NO: 192917 - protein, 9 aa, Mycobacterium tuberculosis
VIVDELAVA

SEQ ID NO: 192918 - protein, 9 aa, Mycobacterium tuberculosis
LAVADAHPL

SEQ ID NO: 192919 - protein, 9 aa, Mycobacterium tuberculosis
PLGTRPFER

SEQ ID NO: 192920 - protein, 9 aa, Mycobacterium tuberculosis
RPFERKQYV

SEQ ID NO: 192921 - protein, 9 aa, Mycobacterium tuberculosis
QYVEKFTEL

SEQ ID NO: 192922 - protein, 9 aa, Mycobacterium tuberculosis
YVEKFTELA

SEQ ID NO: 192923 - protein, 9 aa, Mycobacterium tuberculosis
KFTELADGV

SEQ ID NO: 192924 - protein, 9 aa, Mycobacterium tuberculosis
FTELADGVV

SEQ ID NO: 192925 - protein, 9 aa, Mycobacterium tuberculosis
ELADGVVEP

SEQ ID NO: 192926 - protein, 9 aa, Mycobacterium tuberculosis
LADGVVEPV

SEQ ID NO: 192927 - protein, 9 aa, Mycobacterium tuberculosis
VVEPVEQQR

SEQ ID NO: 192928 - protein, 9 aa, Mycobacterium tuberculosis
EPVEQQRFL

SEQ ID NO: 192929 - protein, 9 aa, Mycobacterium tuberculosis
VEQQRFLAV

SEQ ID NO: 192930 - protein, 9 aa, Mycobacterium tuberculosis
RFLAVVESL

SEQ ID NO: 192931 - protein, 9 aa, Mycobacterium tuberculosis
FLAVVESLA

SEQ ID NO: 192932 - protein, 9 aa, Mycobacterium tuberculosis
AVVESLADL

SEQ ID NO: 192933 - protein, 9 aa, Mycobacterium tuberculosis
SLADLESGA

SEQ ID NO: 192934 - protein, 9 aa, Mycobacterium tuberculosis
LESGAVGGL

SEQ ID NO: 192935 - protein, 9 aa, Mycobacterium tuberculosis
GAVGGLNVL

SEQ ID NO: 192936 - protein, 9 aa, Mycobacterium tuberculosis
AVGGLNVLV

SEQ ID NO: 192937 - protein, 9 aa, Mycobacterium tuberculosis
GLNVLVDPR

SEQ ID NO: 192938 - protein, 9 aa, Mycobacterium tuberculosis
VLVDPRVLD

SEQ ID NO: 192939 - protein, 9 aa, Mycobacterium tuberculosis
LVDPRVLDK

SEQ ID NO: 192940 - protein, 9 aa, Mycobacterium tuberculosis
RVLDKAPVI

SEQ ID NO: 192941 - protein, 9 aa, Mycobacterium tuberculosis
APVIPPGIF

SEQ ID NO: 192942 - protein, 10 aa, Mycobacterium tuberculosis
MPDQDTKVRF

SEQ ID NO: 192943 - protein, 10 aa, Mycobacterium tuberculosis
DQDTKVRFFR

SEQ ID NO: 192944 - protein, 10 aa, Mycobacterium tuberculosis
QDTKVRFFRV

SEQ ID NO: 192945 - protein, 10 aa, Mycobacterium tuberculosis
DTKVRFFRVF

SEQ ID NO: 192946 - protein, 10 aa, Mycobacterium tuberculosis
KVRFFRVFCW

SEQ ID NO: 192947 - protein, 10 aa, Mycobacterium tuberculosis
FRVFCWCPVL

SEQ ID NO: 192948 - protein, 10 aa, Mycobacterium tuberculosis
RVFCWCPVLR

SEQ ID NO: 192949 - protein, 10 aa, Mycobacterium tuberculosis
FCWCPVLRMV

SEQ ID NO: 192950 - protein, 10 aa, Mycobacterium tuberculosis
CWCPVLRMVR

SEQ ID NO: 192951 - protein, 10 aa, Mycobacterium tuberculosis
WCPVLRMVRI

SEQ ID NO: 192952 - protein, 10 aa, Mycobacterium tuberculosis
CPVLRMVRIM

SEQ ID NO: 192953 - protein, 10 aa, Mycobacterium tuberculosis
VLRMVRIMLM

SEQ ID NO: 192954 - protein, 10 aa, Mycobacterium tuberculosis
RMVRIMLMHA

SEQ ID NO: 192955 - protein, 10 aa, Mycobacterium tuberculosis
MVRIMLMHAV

SEQ ID NO: 192956 - protein, 10 aa, Mycobacterium tuberculosis
VRIMLMHAVR

SEQ ID NO: 192957 - protein, 10 aa, Mycobacterium tuberculosis
RIMLMHAVRA

SEQ ID NO: 192958 - protein, 10 aa, Mycobacterium tuberculosis
IMLMHAVRAW

SEQ ID NO: 192959 - protein, 10 aa, Mycobacterium tuberculosis
MLMHAVRAWR

SEQ ID NO: 192960 - protein, 10 aa, Mycobacterium tuberculosis
DFPCTEHMAY

SEQ ID NO: 192961 - protein, 10 aa, Mycobacterium tuberculosis
FPCTEHMAYK

SEQ ID NO: 192962 - protein, 10 aa, Mycobacterium tuberculosis
HMAYKIAQVA

SEQ ID NO: 192963 - protein, 10 aa, Mycobacterium tuberculosis
MAYKIAQVAA

SEQ ID NO: 192964 - protein, 10 aa, Mycobacterium tuberculosis
KIAQVAADPV

SEQ ID NO: 192965 - protein, 10 aa, Mycobacterium tuberculosis
AQVAADPVDV

SEQ ID NO: 192966 - protein, 10 aa, Mycobacterium tuberculosis
DPVDVDPEVA

SEQ ID NO: 192967 - protein, 10 aa, Mycobacterium tuberculosis
DVDPEVADMV

SEQ ID NO: 192968 - protein, 10 aa, Mycobacterium tuberculosis
EVADMVCNRI

SEQ ID NO: 192969 - protein, 10 aa, Mycobacterium tuberculosis
MVCNRIIDNA

SEQ ID NO: 192970 - protein, 10 aa, Mycobacterium tuberculosis
RIIDNAAVSA

SEQ ID NO: 192971 - protein, 10 aa, Mycobacterium tuberculosis
IIDNAAVSAA

SEQ ID NO: 192972 - protein, 10 aa, Mycobacterium tuberculosis
NAAVSAASMV

SEQ ID NO: 192973 - protein, 10 aa, Mycobacterium tuberculosis
AAVSAASMVR

SEQ ID NO: 192974 - protein, 10 aa, Mycobacterium tuberculosis
AVSAASMVRR

SEQ ID NO: 192975 - protein, 10 aa, Mycobacterium tuberculosis
SAASMVRRPV

SEQ ID NO: 192976 - protein, 10 aa, Mycobacterium tuberculosis
SMVRRPVTVA

SEQ ID NO: 192977 - protein, 10 aa, Mycobacterium tuberculosis
MVRRPVTVAR

SEQ ID NO: 192978 - protein, 10 aa, Mycobacterium tuberculosis
RPVTVARHQA

SEQ ID NO: 192979 - protein, 10 aa, Mycobacterium tuberculosis
TVARHQALAH

SEQ ID NO: 192980 - protein, 10 aa, Mycobacterium tuberculosis
RHQALAHPVR

SEQ ID NO: 192981 - protein, 10 aa, Mycobacterium tuberculosis
ALAHPVRHGA

SEQ ID NO: 192982 - protein, 10 aa, Mycobacterium tuberculosis
LAHPVRHGAK

SEQ ID NO: 192983 - protein, 10 aa, Mycobacterium tuberculosis
HPVRHGAKVF

SEQ ID NO: 192984 - protein, 10 aa, Mycobacterium tuberculosis
EGSYSADWAA

SEQ ID NO: 192985 - protein, 10 aa, Mycobacterium tuberculosis
GSYSADWAAW

SEQ ID NO: 192986 - protein, 10 aa, Mycobacterium tuberculosis
WAAWANGVAA

SEQ ID NO: 192987 - protein, 10 aa, Mycobacterium tuberculosis
WANGVAAREL

SEQ ID NO: 192988 - protein, 10 aa, Mycobacterium tuberculosis
RELDFHDTFL

SEQ ID NO: 192989 - protein, 10 aa, Mycobacterium tuberculosis
ELDFHDTFLA

SEQ ID NO: 192990 - protein, 10 aa, Mycobacterium tuberculosis
DTFLAADYSH

SEQ ID NO: 192991 - protein, 10 aa, Mycobacterium tuberculosis
FLAADYSHPA

SEQ ID NO: 192992 - protein, 10 aa, Mycobacterium tuberculosis
SHPADNIPPL

SEQ ID NO: 192993 - protein, 10 aa, Mycobacterium tuberculosis
HPADNIPPLV

SEQ ID NO: 192994 - protein, 10 aa, Mycobacterium tuberculosis
LVAVAQQLGV

SEQ ID NO: 192995 - protein, 10 aa, Mycobacterium tuberculosis
QQLGVCGAEL

SEQ ID NO: 192996 - protein, 10 aa, Mycobacterium tuberculosis
QLGVCGAELI

SEQ ID NO: 192997 - protein, 10 aa, Mycobacterium tuberculosis
CGAELIRGLV

SEQ ID NO: 192998 - protein, 10 aa, Mycobacterium tuberculosis
AELIRGLVTA

SEQ ID NO: 192999 - protein, 10 aa, Mycobacterium tuberculosis
ELIRGLVTAY

SEQ ID NO: 193000 - protein, 10 aa, Mycobacterium tuberculosis
GLVTAYEIHI

SEQ ID NO: 193001 - protein, 10 aa, Mycobacterium tuberculosis
VTAYEIHIDL

SEQ ID NO: 193002 - protein, 10 aa, Mycobacterium tuberculosis
AYEIHIDLTR

SEQ ID NO: 193003 - protein, 10 aa, Mycobacterium tuberculosis
HIDLTRGICL

SEQ ID NO: 193004 - protein, 10 aa, Mycobacterium tuberculosis
CLHEHKIDHV

SEQ ID NO: 193005 - protein, 10 aa, Mycobacterium tuberculosis
HVAHLGPAVA

SEQ ID NO: 193006 - protein, 10 aa, Mycobacterium tuberculosis
HLGPAVAAGI

SEQ ID NO: 193007 - protein, 10 aa, Mycobacterium tuberculosis
PAVAAGIGTM

SEQ ID NO: 193008 - protein, 10 aa, Mycobacterium tuberculosis
AVAAGIGTML

SEQ ID NO: 193009 - protein, 10 aa, Mycobacterium tuberculosis
VAAGIGTMLR

SEQ ID NO: 193010 - protein, 10 aa, Mycobacterium tuberculosis
TMLRLDQETI

SEQ ID NO: 193011 - protein, 10 aa, Mycobacterium tuberculosis
MLRLDQETIY

SEQ ID NO: 193012 - protein, 10 aa, Mycobacterium tuberculosis
RLDQETIYHA

SEQ ID NO: 193013 - protein, 10 aa, Mycobacterium tuberculosis
ETIYHAIGQA

SEQ ID NO: 193014 - protein, 10 aa, Mycobacterium tuberculosis
TIYHAIGQAL

SEQ ID NO: 193015 - protein, 10 aa, Mycobacterium tuberculosis
YHAIGQALHL

SEQ ID NO: 193016 - protein, 10 aa, Mycobacterium tuberculosis
GQALHLTTST

SEQ ID NO: 193017 - protein, 10 aa, Mycobacterium tuberculosis
QALHLTTSTR

SEQ ID NO: 193018 - protein, 10 aa, Mycobacterium tuberculosis
HLTTSTRQSR

SEQ ID NO: 193019 - protein, 10 aa, Mycobacterium tuberculosis
LTTSTRQSRK

SEQ ID NO: 193020 - protein, 10 aa, Mycobacterium tuberculosis
STRQSRKGAI

SEQ ID NO: 193021 - protein, 10 aa, Mycobacterium tuberculosis
QSRKGAISSW

SEQ ID NO: 193022 - protein, 10 aa, Mycobacterium tuberculosis
SRKGAISSWK

SEQ ID NO: 193023 - protein, 10 aa, Mycobacterium tuberculosis
KGAISSWKAF

SEQ ID NO: 193024 - protein, 10 aa, Mycobacterium tuberculosis
KAFAPAHAGK

SEQ ID NO: 193025 - protein, 10 aa, Mycobacterium tuberculosis
AFAPAHAGKV

SEQ ID NO: 193026 - protein, 10 aa, Mycobacterium tuberculosis
APAHAGKVGI

SEQ ID NO: 193027 - protein, 10 aa, Mycobacterium tuberculosis
HAGKVGIEAV

SEQ ID NO: 193028 - protein, 10 aa, Mycobacterium tuberculosis
GIEAVDRAMR

SEQ ID NO: 193029 - protein, 10 aa, Mycobacterium tuberculosis
RGEGSPAPIW

SEQ ID NO: 193030 - protein, 10 aa, Mycobacterium tuberculosis
APIWEGEDGV

SEQ ID NO: 193031 - protein, 10 aa, Mycobacterium tuberculosis
PIWEGEDGVI

SEQ ID NO: 193032 - protein, 10 aa, Mycobacterium tuberculosis
WEGEDGVIAW

SEQ ID NO: 193033 - protein, 10 aa, Mycobacterium tuberculosis
GEDGVIAWLL

SEQ ID NO: 193034 - protein, 10 aa, Mycobacterium tuberculosis
IAWLLAGPEH

SEQ ID NO: 193035 - protein, 10 aa, Mycobacterium tuberculosis
WLLAGPEHTY

SEQ ID NO: 193036 - protein, 10 aa, Mycobacterium tuberculosis
LLAGPEHTYR

SEQ ID NO: 193037 - protein, 10 aa, Mycobacterium tuberculosis
LAGPEHTYRV

SEQ ID NO: 193038 - protein, 10 aa, Mycobacterium tuberculosis
GPEHTYRVPL

SEQ ID NO: 193039 - protein, 10 aa, Mycobacterium tuberculosis
LPAPGEPKRA

SEQ ID NO: 193040 - protein, 10 aa, Mycobacterium tuberculosis
APGEPKRAIL

SEQ ID NO: 193041 - protein, 10 aa, Mycobacterium tuberculosis
EPKRAILDSY

SEQ ID NO: 193042 - protein, 10 aa, Mycobacterium tuberculosis
KRAILDSYTK

SEQ ID NO: 193043 - protein, 10 aa, Mycobacterium tuberculosis
ILDSYTKQHS

SEQ ID NO: 193044 - protein, 10 aa, Mycobacterium tuberculosis
SYTKQHSAEY

SEQ ID NO: 193045 - protein, 10 aa, Mycobacterium tuberculosis
EYQSQAPIDL

SEQ ID NO: 193046 - protein, 10 aa, Mycobacterium tuberculosis
YQSQAPIDLA

SEQ ID NO: 193047 - protein, 10 aa, Mycobacterium tuberculosis
SQAPIDLACR

SEQ ID NO: 193048 - protein, 10 aa, Mycobacterium tuberculosis
DLACRLRERI

SEQ ID NO: 193049 - protein, 10 aa, Mycobacterium tuberculosis
RERIGDLDQI

SEQ ID NO: 193050 - protein, 10 aa, Mycobacterium tuberculosis
DLDQIASIVL

SEQ ID NO: 193051 - protein, 10 aa, Mycobacterium tuberculosis
VLHTSHHTHV

SEQ ID NO: 193052 - protein, 10 aa, Mycobacterium tuberculosis
HTSHHTHVVI

SEQ ID NO: 193053 - protein, 10 aa, Mycobacterium tuberculosis
RETLDHSLPY

SEQ ID NO: 193054 - protein, 10 aa, Mycobacterium tuberculosis
ETLDHSLPYI

SEQ ID NO: 193055 - protein, 10 aa, Mycobacterium tuberculosis
TLDHSLPYIF

SEQ ID NO: 193056 - protein, 10 aa, Mycobacterium tuberculosis
HSLPYIFAVA

SEQ ID NO: 193057 - protein, 10 aa, Mycobacterium tuberculosis
SLPYIFAVAL

SEQ ID NO: 193058 - protein, 10 aa, Mycobacterium tuberculosis
LPYIFAVALQ

SEQ ID NO: 193059 - protein, 10 aa, Mycobacterium tuberculosis
FAVALQDGCW

SEQ ID NO: 193060 - protein, 10 aa, Mycobacterium tuberculosis
ALQDGCWHHE

SEQ ID NO: 193061 - protein, 10 aa, Mycobacterium tuberculosis
LQDGCWHHER

SEQ ID NO: 193062 - protein, 10 aa, Mycobacterium tuberculosis
RSYAPERARR

SEQ ID NO: 193063 - protein, 10 aa, Mycobacterium tuberculosis
APERARRSDT

SEQ ID NO: 193064 - protein, 10 aa, Mycobacterium tuberculosis
RARRSDTVAL

SEQ ID NO: 193065 - protein, 10 aa, Mycobacterium tuberculosis
RRSDTVALWH

SEQ ID NO: 193066 - protein, 10 aa, Mycobacterium tuberculosis
RSDTVALWHK

SEQ ID NO: 193067 - protein, 10 aa, Mycobacterium tuberculosis
VALWHKISTV

SEQ ID NO: 193068 - protein, 10 aa, Mycobacterium tuberculosis
KISTVEDPEW

SEQ ID NO: 193069 - protein, 10 aa, Mycobacterium tuberculosis
STVEDPEWTR

SEQ ID NO: 193070 - protein, 10 aa, Mycobacterium tuberculosis
TVEDPEWTRR

SEQ ID NO: 193071 - protein, 10 aa, Mycobacterium tuberculosis
RRYHCADPAK

SEQ ID NO: 193072 - protein, 10 aa, Mycobacterium tuberculosis
RYHCADPAKK

SEQ ID NO: 193073 - protein, 10 aa, Mycobacterium tuberculosis
DPAKKAFGAR

SEQ ID NO: 193074 - protein, 10 aa, Mycobacterium tuberculosis
AFGARAEVTL

SEQ ID NO: 193075 - protein, 10 aa, Mycobacterium tuberculosis
AEVTLHSGEV

SEQ ID NO: 193076 - protein, 10 aa, Mycobacterium tuberculosis
EVTLHSGEVI

SEQ ID NO: 193077 - protein, 10 aa, Mycobacterium tuberculosis
VTLHSGEVIV

SEQ ID NO: 193078 - protein, 10 aa, Mycobacterium tuberculosis
GEVIVDELAV

SEQ ID NO: 193079 - protein, 10 aa, Mycobacterium tuberculosis
EVIVDELAVA

SEQ ID NO: 193080 - protein, 10 aa, Mycobacterium tuberculosis
IVDELAVADA

SEQ ID NO: 193081 - protein, 10 aa, Mycobacterium tuberculosis
ELAVADAHPL

SEQ ID NO: 193082 - protein, 10 aa, Mycobacterium tuberculosis
DAHPLGTRPF

SEQ ID NO: 193083 - protein, 10 aa, Mycobacterium tuberculosis
HPLGTRPFER

SEQ ID NO: 193084 - protein, 10 aa, Mycobacterium tuberculosis
GTRPFERKQY

SEQ ID NO: 193085 - protein, 10 aa, Mycobacterium tuberculosis
FERKQYVEKF

SEQ ID NO: 193086 - protein, 10 aa, Mycobacterium tuberculosis
KQYVEKFTEL

SEQ ID NO: 193087 - protein, 10 aa, Mycobacterium tuberculosis
EKFTELADGV

SEQ ID NO: 193088 - protein, 10 aa, Mycobacterium tuberculosis
ELADGVVEPV

SEQ ID NO: 193089 - protein, 10 aa, Mycobacterium tuberculosis
GVVEPVEQQR

SEQ ID NO: 193090 - protein, 10 aa, Mycobacterium tuberculosis
EPVEQQRFLA

SEQ ID NO: 193091 - protein, 10 aa, Mycobacterium tuberculosis
PVEQQRFLAV

SEQ ID NO: 193092 - protein, 10 aa, Mycobacterium tuberculosis
VEQQRFLAVV

SEQ ID NO: 193093 - protein, 10 aa, Mycobacterium tuberculosis
QRFLAVVESL

SEQ ID NO: 193094 - protein, 10 aa, Mycobacterium tuberculosis
LAVVESLADL

SEQ ID NO: 193095 - protein, 10 aa, Mycobacterium tuberculosis
SLADLESGAV

SEQ ID NO: 193096 - protein, 10 aa, Mycobacterium tuberculosis
DLESGAVGGL

SEQ ID NO: 193097 - protein, 10 aa, Mycobacterium tuberculosis
ESGAVGGLNV

SEQ ID NO: 193098 - protein, 10 aa, Mycobacterium tuberculosis
GAVGGLNVLV

SEQ ID NO: 193099 - protein, 10 aa, Mycobacterium tuberculosis
GLNVLVDPRV

SEQ ID NO: 193100 - protein, 10 aa, Mycobacterium tuberculosis
VLVDPRVLDK

SEQ ID NO: 193101 - protein, 10 aa, Mycobacterium tuberculosis
LVDPRVLDKA

SEQ ID NO: 193102 - protein, 10 aa, Mycobacterium tuberculosis
DKAPVIPPGI

SEQ ID NO: 193103 - protein, 11 aa, Mycobacterium tuberculosis
MPDQDTKVRFF

SEQ ID NO: 193104 - protein, 11 aa, Mycobacterium tuberculosis
DTKVRFFRVFC

SEQ ID NO: 193105 - protein, 11 aa, Mycobacterium tuberculosis
RFFRVFCWCPV

SEQ ID NO: 193106 - protein, 11 aa, Mycobacterium tuberculosis
FRVFCWCPVLR

SEQ ID NO: 193107 - protein, 11 aa, Mycobacterium tuberculosis
CPVLRMVRIML

SEQ ID NO: 193108 - protein, 11 aa, Mycobacterium tuberculosis
PVLRMVRIMLM

SEQ ID NO: 193109 - protein, 11 aa, Mycobacterium tuberculosis
RMVRIMLMHAV

SEQ ID NO: 193110 - protein, 11 aa, Mycobacterium tuberculosis
MVRIMLMHAVR

SEQ ID NO: 193111 - protein, 11 aa, Mycobacterium tuberculosis
RIMLMHAVRAW

SEQ ID NO: 193112 - protein, 11 aa, Mycobacterium tuberculosis
IMLMHAVRAWR

SEQ ID NO: 193113 - protein, 11 aa, Mycobacterium tuberculosis
MLMHAVRAWRS

SEQ ID NO: 193114 - protein, 11 aa, Mycobacterium tuberculosis
LMHAVRAWRSA

SEQ ID NO: 193115 - protein, 11 aa, Mycobacterium tuberculosis
AVRAWRSADDF

SEQ ID NO: 193116 - protein, 11 aa, Mycobacterium tuberculosis
SADDFPCTEHM

SEQ ID NO: 193117 - protein, 11 aa, Mycobacterium tuberculosis
DDFPCTEHMAY

SEQ ID NO: 193118 - protein, 11 aa, Mycobacterium tuberculosis
DFPCTEHMAYK

SEQ ID NO: 193119 - protein, 11 aa, Mycobacterium tuberculosis
FPCTEHMAYKI

SEQ ID NO: 193120 - protein, 11 aa, Mycobacterium tuberculosis
HMAYKIAQVAA

SEQ ID NO: 193121 - protein, 11 aa, Mycobacterium tuberculosis
YKIAQVAADPV

SEQ ID NO: 193122 - protein, 11 aa, Mycobacterium tuberculosis
AADPVDVDPEV

SEQ ID NO: 193123 - protein, 11 aa, Mycobacterium tuberculosis
DPEVADMVCNR

SEQ ID NO: 193124 - protein, 11 aa, Mycobacterium tuberculosis
EVADMVCNRII

SEQ ID NO: 193125 - protein, 11 aa, Mycobacterium tuberculosis
MVCNRIIDNAA

SEQ ID NO: 193126 - protein, 11 aa, Mycobacterium tuberculosis
RIIDNAAVSAA

SEQ ID NO: 193127 - protein, 11 aa, Mycobacterium tuberculosis
DNAAVSAASMV

SEQ ID NO: 193128 - protein, 11 aa, Mycobacterium tuberculosis
NAAVSAASMVR

SEQ ID NO: 193129 - protein, 11 aa, Mycobacterium tuberculosis
AAVSAASMVRR

SEQ ID NO: 193130 - protein, 11 aa, Mycobacterium tuberculosis
VSAASMVRRPV

SEQ ID NO: 193131 - protein, 11 aa, Mycobacterium tuberculosis
AASMVRRPVTV

SEQ ID NO: 193132 - protein, 11 aa, Mycobacterium tuberculosis
SMVRRPVTVAR

SEQ ID NO: 193133 - protein, 11 aa, Mycobacterium tuberculosis
RPVTVARHQAL

SEQ ID NO: 193134 - protein, 11 aa, Mycobacterium tuberculosis
VARHQALAHPV

SEQ ID NO: 193135 - protein, 11 aa, Mycobacterium tuberculosis
QALAHPVRHGA

SEQ ID NO: 193136 - protein, 11 aa, Mycobacterium tuberculosis
ALAHPVRHGAK

SEQ ID NO: 193137 - protein, 11 aa, Mycobacterium tuberculosis
LAHPVRHGAKV

SEQ ID NO: 193138 - protein, 11 aa, Mycobacterium tuberculosis
AHPVRHGAKVF

SEQ ID NO: 193139 - protein, 11 aa, Mycobacterium tuberculosis
GAKVFGVEGSY

SEQ ID NO: 193140 - protein, 11 aa, Mycobacterium tuberculosis
KVFGVEGSYSA

SEQ ID NO: 193141 - protein, 11 aa, Mycobacterium tuberculosis
FGVEGSYSADW

SEQ ID NO: 193142 - protein, 11 aa, Mycobacterium tuberculosis
SADWAAWANGV

SEQ ID NO: 193143 - protein, 11 aa, Mycobacterium tuberculosis
WAAWANGVAAR

SEQ ID NO: 193144 - protein, 11 aa, Mycobacterium tuberculosis
RELDFHDTFLA

SEQ ID NO: 193145 - protein, 11 aa, Mycobacterium tuberculosis
ELDFHDTFLAA

SEQ ID NO: 193146 - protein, 11 aa, Mycobacterium tuberculosis
DFHDTFLAADY

SEQ ID NO: 193147 - protein, 11 aa, Mycobacterium tuberculosis
YSHPADNIPPL

SEQ ID NO: 193148 - protein, 11 aa, Mycobacterium tuberculosis
HPADNIPPLVA

SEQ ID NO: 193149 - protein, 11 aa, Mycobacterium tuberculosis
PADNIPPLVAV

SEQ ID NO: 193150 - protein, 11 aa, Mycobacterium tuberculosis
IPPLVAVAQQL

SEQ ID NO: 193151 - protein, 11 aa, Mycobacterium tuberculosis
PLVAVAQQLGV

SEQ ID NO: 193152 - protein, 11 aa, Mycobacterium tuberculosis
AVAQQLGVCGA

SEQ ID NO: 193153 - protein, 11 aa, Mycobacterium tuberculosis
AQQLGVCGAEL

SEQ ID NO: 193154 - protein, 11 aa, Mycobacterium tuberculosis
QQLGVCGAELI

SEQ ID NO: 193155 - protein, 11 aa, Mycobacterium tuberculosis
AELIRGLVTAY

SEQ ID NO: 193156 - protein, 11 aa, Mycobacterium tuberculosis
ELIRGLVTAYE

SEQ ID NO: 193157 - protein, 11 aa, Mycobacterium tuberculosis
LIRGLVTAYEI

SEQ ID NO: 193158 - protein, 11 aa, Mycobacterium tuberculosis
TAYEIHIDLTR

SEQ ID NO: 193159 - protein, 11 aa, Mycobacterium tuberculosis
YEIHIDLTRGI

SEQ ID NO: 193160 - protein, 11 aa, Mycobacterium tuberculosis
LTRGICLHEHK

SEQ ID NO: 193161 - protein, 11 aa, Mycobacterium tuberculosis
CLHEHKIDHVA

SEQ ID NO: 193162 - protein, 11 aa, Mycobacterium tuberculosis
HEHKIDHVAHL

SEQ ID NO: 193163 - protein, 11 aa, Mycobacterium tuberculosis
KIDHVAHLGPA

SEQ ID NO: 193164 - protein, 11 aa, Mycobacterium tuberculosis
HVAHLGPAVAA

SEQ ID NO: 193165 - protein, 11 aa, Mycobacterium tuberculosis
GPAVAAGIGTM

SEQ ID NO: 193166 - protein, 11 aa, Mycobacterium tuberculosis
AVAAGIGTMLR

SEQ ID NO: 193167 - protein, 11 aa, Mycobacterium tuberculosis
GTMLRLDQETI

SEQ ID NO: 193168 - protein, 11 aa, Mycobacterium tuberculosis
TMLRLDQETIY

SEQ ID NO: 193169 - protein, 11 aa, Mycobacterium tuberculosis
RLDQETIYHAI

SEQ ID NO: 193170 - protein, 11 aa, Mycobacterium tuberculosis
ETIYHAIGQAL

SEQ ID NO: 193171 - protein, 11 aa, Mycobacterium tuberculosis
TIYHAIGQALH

SEQ ID NO: 193172 - protein, 11 aa, Mycobacterium tuberculosis
IYHAIGQALHL

SEQ ID NO: 193173 - protein, 11 aa, Mycobacterium tuberculosis
GQALHLTTSTR

SEQ ID NO: 193174 - protein, 11 aa, Mycobacterium tuberculosis
HLTTSTRQSRK

SEQ ID NO: 193175 - protein, 11 aa, Mycobacterium tuberculosis
RQSRKGAISSW

SEQ ID NO: 193176 - protein, 11 aa, Mycobacterium tuberculosis
QSRKGAISSWK

SEQ ID NO: 193177 - protein, 11 aa, Mycobacterium tuberculosis
AISSWKAFAPA

SEQ ID NO: 193178 - protein, 11 aa, Mycobacterium tuberculosis
KAFAPAHAGKV

SEQ ID NO: 193179 - protein, 11 aa, Mycobacterium tuberculosis
FAPAHAGKVGI

SEQ ID NO: 193180 - protein, 11 aa, Mycobacterium tuberculosis
AMRGEGSPAPI

SEQ ID NO: 193181 - protein, 11 aa, Mycobacterium tuberculosis
APIWEGEDGVI

SEQ ID NO: 193182 - protein, 11 aa, Mycobacterium tuberculosis
PIWEGEDGVIA

SEQ ID NO: 193183 - protein, 11 aa, Mycobacterium tuberculosis
WEGEDGVIAWL

SEQ ID NO: 193184 - protein, 11 aa, Mycobacterium tuberculosis
WLLAGPEHTYR

SEQ ID NO: 193185 - protein, 11 aa, Mycobacterium tuberculosis
LLAGPEHTYRV

SEQ ID NO: 193186 - protein, 11 aa, Mycobacterium tuberculosis
RVPLPAPGEPK

SEQ ID NO: 193187 - protein, 11 aa, Mycobacterium tuberculosis
LPAPGEPKRAI

SEQ ID NO: 193188 - protein, 11 aa, Mycobacterium tuberculosis
ILDSYTKQHSA

SEQ ID NO: 193189 - protein, 11 aa, Mycobacterium tuberculosis
DSYTKQHSAEY

SEQ ID NO: 193190 - protein, 11 aa, Mycobacterium tuberculosis
KQHSAEYQSQA

SEQ ID NO: 193191 - protein, 11 aa, Mycobacterium tuberculosis
HSAEYQSQAPI

SEQ ID NO: 193192 - protein, 11 aa, Mycobacterium tuberculosis
AEYQSQAPIDL

SEQ ID NO: 193193 - protein, 11 aa, Mycobacterium tuberculosis
YQSQAPIDLAC

SEQ ID NO: 193194 - protein, 11 aa, Mycobacterium tuberculosis
QSQAPIDLACR

SEQ ID NO: 193195 - protein, 11 aa, Mycobacterium tuberculosis
SQAPIDLACRL

SEQ ID NO: 193196 - protein, 11 aa, Mycobacterium tuberculosis
QAPIDLACRLR

SEQ ID NO: 193197 - protein, 11 aa, Mycobacterium tuberculosis
RIGDLDQIASI

SEQ ID NO: 193198 - protein, 11 aa, Mycobacterium tuberculosis
IVLHTSHHTHV

SEQ ID NO: 193199 - protein, 11 aa, Mycobacterium tuberculosis
VLHTSHHTHVV

SEQ ID NO: 193200 - protein, 11 aa, Mycobacterium tuberculosis
VIGTGSGDPQK

SEQ ID NO: 193201 - protein, 11 aa, Mycobacterium tuberculosis
DPQKFDPDASR

SEQ ID NO: 193202 - protein, 11 aa, Mycobacterium tuberculosis
KFDPDASRETL

SEQ ID NO: 193203 - protein, 11 aa, Mycobacterium tuberculosis
RETLDHSLPYI

SEQ ID NO: 193204 - protein, 11 aa, Mycobacterium tuberculosis
ETLDHSLPYIF

SEQ ID NO: 193205 - protein, 11 aa, Mycobacterium tuberculosis
TLDHSLPYIFA

SEQ ID NO: 193206 - protein, 11 aa, Mycobacterium tuberculosis
HSLPYIFAVAL

SEQ ID NO: 193207 - protein, 11 aa, Mycobacterium tuberculosis
SLPYIFAVALQ

SEQ ID NO: 193208 - protein, 11 aa, Mycobacterium tuberculosis
LPYIFAVALQD

SEQ ID NO: 193209 - protein, 11 aa, Mycobacterium tuberculosis
YIFAVALQDGC

SEQ ID NO: 193210 - protein, 11 aa, Mycobacterium tuberculosis
IFAVALQDGCW

SEQ ID NO: 193211 - protein, 11 aa, Mycobacterium tuberculosis
ALQDGCWHHER

SEQ ID NO: 193212 - protein, 11 aa, Mycobacterium tuberculosis
APERARRSDTV

SEQ ID NO: 193213 - protein, 11 aa, Mycobacterium tuberculosis
ERARRSDTVAL

SEQ ID NO: 193214 - protein, 11 aa, Mycobacterium tuberculosis
RARRSDTVALW

SEQ ID NO: 193215 - protein, 11 aa, Mycobacterium tuberculosis
RRSDTVALWHK

SEQ ID NO: 193216 - protein, 11 aa, Mycobacterium tuberculosis
TVALWHKISTV

SEQ ID NO: 193217 - protein, 11 aa, Mycobacterium tuberculosis
HKISTVEDPEW

SEQ ID NO: 193218 - protein, 11 aa, Mycobacterium tuberculosis
ISTVEDPEWTR

SEQ ID NO: 193219 - protein, 11 aa, Mycobacterium tuberculosis
STVEDPEWTRR

SEQ ID NO: 193220 - protein, 11 aa, Mycobacterium tuberculosis
TVEDPEWTRRY

SEQ ID NO: 193221 - protein, 11 aa, Mycobacterium tuberculosis
WTRRYHCADPA

SEQ ID NO: 193222 - protein, 11 aa, Mycobacterium tuberculosis
TRRYHCADPAK

SEQ ID NO: 193223 - protein, 11 aa, Mycobacterium tuberculosis
RRYHCADPAKK

SEQ ID NO: 193224 - protein, 11 aa, Mycobacterium tuberculosis
RYHCADPAKKA

SEQ ID NO: 193225 - protein, 11 aa, Mycobacterium tuberculosis
KAFGARAEVTL

SEQ ID NO: 193226 - protein, 11 aa, Mycobacterium tuberculosis
AEVTLHSGEVI

SEQ ID NO: 193227 - protein, 11 aa, Mycobacterium tuberculosis
EVTLHSGEVIV

SEQ ID NO: 193228 - protein, 11 aa, Mycobacterium tuberculosis
LHSGEVIVDEL

SEQ ID NO: 193229 - protein, 11 aa, Mycobacterium tuberculosis
VIVDELAVADA

SEQ ID NO: 193230 - protein, 11 aa, Mycobacterium tuberculosis
DELAVADAHPL

SEQ ID NO: 193231 - protein, 11 aa, Mycobacterium tuberculosis
AVADAHPLGTR

SEQ ID NO: 193232 - protein, 11 aa, Mycobacterium tuberculosis
GTRPFERKQYV

SEQ ID NO: 193233 - protein, 11 aa, Mycobacterium tuberculosis
RPFERKQYVEK

SEQ ID NO: 193234 - protein, 11 aa, Mycobacterium tuberculosis
PFERKQYVEKF

SEQ ID NO: 193235 - protein, 11 aa, Mycobacterium tuberculosis
KQYVEKFTELA

SEQ ID NO: 193236 - protein, 11 aa, Mycobacterium tuberculosis
TELADGVVEPV

SEQ ID NO: 193237 - protein, 11 aa, Mycobacterium tuberculosis
ELADGVVEPVE

SEQ ID NO: 193238 - protein, 11 aa, Mycobacterium tuberculosis
VVEPVEQQRFL

SEQ ID NO: 193239 - protein, 11 aa, Mycobacterium tuberculosis
EPVEQQRFLAV

SEQ ID NO: 193240 - protein, 11 aa, Mycobacterium tuberculosis
PVEQQRFLAVV

SEQ ID NO: 193241 - protein, 11 aa, Mycobacterium tuberculosis
QQRFLAVVESL

SEQ ID NO: 193242 - protein, 11 aa, Mycobacterium tuberculosis
FLAVVESLADL

SEQ ID NO: 193243 - protein, 11 aa, Mycobacterium tuberculosis
ESLADLESGAV

SEQ ID NO: 193244 - protein, 11 aa, Mycobacterium tuberculosis
SLADLESGAVG

SEQ ID NO: 193245 - protein, 11 aa, Mycobacterium tuberculosis
LESGAVGGLNV

SEQ ID NO: 193246 - protein, 11 aa, Mycobacterium tuberculosis
SGAVGGLNVLV

SEQ ID NO: 193247 - protein, 11 aa, Mycobacterium tuberculosis
GLNVLVDPRVL

SEQ ID NO: 193248 - protein, 11 aa, Mycobacterium tuberculosis
NVLVDPRVLDK

SEQ ID NO: 193249 - protein, 11 aa, Mycobacterium tuberculosis
VLVDPRVLDKA

SEQ ID NO: 193250 - protein, 11 aa, Mycobacterium tuberculosis
KAPVIPPGIFR

SEQ ID NO: 193251 - protein, 13 aa, Mycobacterium tuberculosis
MPDQDTKVRFFRV

SEQ ID NO: 193252 - protein, 13 aa, Mycobacterium tuberculosis
PDQDTKVRFFRVF

SEQ ID NO: 193253 - protein, 13 aa, Mycobacterium tuberculosis
DQDTKVRFFRVFC

SEQ ID NO: 193254 - protein, 13 aa, Mycobacterium tuberculosis
QDTKVRFFRVFCW

SEQ ID NO: 193255 - protein, 13 aa, Mycobacterium tuberculosis
DTKVRFFRVFCWC

SEQ ID NO: 193256 - protein, 13 aa, Mycobacterium tuberculosis
TKVRFFRVFCWCP

SEQ ID NO: 193257 - protein, 13 aa, Mycobacterium tuberculosis
KVRFFRVFCWCPV

SEQ ID NO: 193258 - protein, 13 aa, Mycobacterium tuberculosis
VRFFRVFCWCPVL

SEQ ID NO: 193259 - protein, 13 aa, Mycobacterium tuberculosis
RFFRVFCWCPVLR

SEQ ID NO: 193260 - protein, 13 aa, Mycobacterium tuberculosis
FFRVFCWCPVLRM

SEQ ID NO: 193261 - protein, 13 aa, Mycobacterium tuberculosis
FRVFCWCPVLRMV

SEQ ID NO: 193262 - protein, 13 aa, Mycobacterium tuberculosis
RVFCWCPVLRMVR

SEQ ID NO: 193263 - protein, 13 aa, Mycobacterium tuberculosis
VFCWCPVLRMVRI

SEQ ID NO: 193264 - protein, 13 aa, Mycobacterium tuberculosis
FCWCPVLRMVRIM

SEQ ID NO: 193265 - protein, 13 aa, Mycobacterium tuberculosis
CWCPVLRMVRIML

SEQ ID NO: 193266 - protein, 13 aa, Mycobacterium tuberculosis
WCPVLRMVRIMLM

SEQ ID NO: 193267 - protein, 13 aa, Mycobacterium tuberculosis
CPVLRMVRIMLMH

SEQ ID NO: 193268 - protein, 13 aa, Mycobacterium tuberculosis
PVLRMVRIMLMHA

SEQ ID NO: 193269 - protein, 13 aa, Mycobacterium tuberculosis
VLRMVRIMLMHAV

SEQ ID NO: 193270 - protein, 13 aa, Mycobacterium tuberculosis
LRMVRIMLMHAVR

SEQ ID NO: 193271 - protein, 13 aa, Mycobacterium tuberculosis
RMVRIMLMHAVRA

SEQ ID NO: 193272 - protein, 13 aa, Mycobacterium tuberculosis
MVRIMLMHAVRAW

SEQ ID NO: 193273 - protein, 13 aa, Mycobacterium tuberculosis
VRIMLMHAVRAWR

SEQ ID NO: 193274 - protein, 13 aa, Mycobacterium tuberculosis
RIMLMHAVRAWRS

SEQ ID NO: 193275 - protein, 13 aa, Mycobacterium tuberculosis
IMLMHAVRAWRSA

SEQ ID NO: 193276 - protein, 13 aa, Mycobacterium tuberculosis
MLMHAVRAWRSAD

SEQ ID NO: 193277 - protein, 13 aa, Mycobacterium tuberculosis
LMHAVRAWRSADD

SEQ ID NO: 193278 - protein, 13 aa, Mycobacterium tuberculosis
MHAVRAWRSADDF

SEQ ID NO: 193279 - protein, 13 aa, Mycobacterium tuberculosis
HAVRAWRSADDFP

SEQ ID NO: 193280 - protein, 13 aa, Mycobacterium tuberculosis
AVRAWRSADDFPC

SEQ ID NO: 193281 - protein, 13 aa, Mycobacterium tuberculosis
VRAWRSADDFPCT

SEQ ID NO: 193282 - protein, 13 aa, Mycobacterium tuberculosis
RAWRSADDFPCTE

SEQ ID NO: 193283 - protein, 13 aa, Mycobacterium tuberculosis
AWRSADDFPCTEH

SEQ ID NO: 193284 - protein, 13 aa, Mycobacterium tuberculosis
WRSADDFPCTEHM

SEQ ID NO: 193285 - protein, 13 aa, Mycobacterium tuberculosis
RSADDFPCTEHMA

SEQ ID NO: 193286 - protein, 13 aa, Mycobacterium tuberculosis
SADDFPCTEHMAY

SEQ ID NO: 193287 - protein, 13 aa, Mycobacterium tuberculosis
ADDFPCTEHMAYK

SEQ ID NO: 193288 - protein, 13 aa, Mycobacterium tuberculosis
DDFPCTEHMAYKI

SEQ ID NO: 193289 - protein, 13 aa, Mycobacterium tuberculosis
DFPCTEHMAYKIA

SEQ ID NO: 193290 - protein, 13 aa, Mycobacterium tuberculosis
FPCTEHMAYKIAQ

SEQ ID NO: 193291 - protein, 13 aa, Mycobacterium tuberculosis
PCTEHMAYKIAQV

SEQ ID NO: 193292 - protein, 13 aa, Mycobacterium tuberculosis
CTEHMAYKIAQVA

SEQ ID NO: 193293 - protein, 13 aa, Mycobacterium tuberculosis
TEHMAYKIAQVAA

SEQ ID NO: 193294 - protein, 13 aa, Mycobacterium tuberculosis
EHMAYKIAQVAAD

SEQ ID NO: 193295 - protein, 13 aa, Mycobacterium tuberculosis
HMAYKIAQVAADP

SEQ ID NO: 193296 - protein, 13 aa, Mycobacterium tuberculosis
MAYKIAQVAADPV

SEQ ID NO: 193297 - protein, 13 aa, Mycobacterium tuberculosis
AYKIAQVAADPVD

SEQ ID NO: 193298 - protein, 13 aa, Mycobacterium tuberculosis
YKIAQVAADPVDV

SEQ ID NO: 193299 - protein, 13 aa, Mycobacterium tuberculosis
KIAQVAADPVDVD

SEQ ID NO: 193300 - protein, 13 aa, Mycobacterium tuberculosis
IAQVAADPVDVDP

SEQ ID NO: 193301 - protein, 13 aa, Mycobacterium tuberculosis
AQVAADPVDVDPE

SEQ ID NO: 193302 - protein, 13 aa, Mycobacterium tuberculosis
QVAADPVDVDPEV

SEQ ID NO: 193303 - protein, 13 aa, Mycobacterium tuberculosis
VAADPVDVDPEVA

SEQ ID NO: 193304 - protein, 13 aa, Mycobacterium tuberculosis
AADPVDVDPEVAD

SEQ ID NO: 193305 - protein, 13 aa, Mycobacterium tuberculosis
ADPVDVDPEVADM

SEQ ID NO: 193306 - protein, 13 aa, Mycobacterium tuberculosis
DPVDVDPEVADMV

SEQ ID NO: 193307 - protein, 13 aa, Mycobacterium tuberculosis
PVDVDPEVADMVC

SEQ ID NO: 193308 - protein, 13 aa, Mycobacterium tuberculosis
VDVDPEVADMVCN

SEQ ID NO: 193309 - protein, 13 aa, Mycobacterium tuberculosis
DVDPEVADMVCNR

SEQ ID NO: 193310 - protein, 13 aa, Mycobacterium tuberculosis
VDPEVADMVCNRI

SEQ ID NO: 193311 - protein, 13 aa, Mycobacterium tuberculosis
DPEVADMVCNRII

SEQ ID NO: 193312 - protein, 13 aa, Mycobacterium tuberculosis
PEVADMVCNRIID

SEQ ID NO: 193313 - protein, 13 aa, Mycobacterium tuberculosis
EVADMVCNRIIDN

SEQ ID NO: 193314 - protein, 13 aa, Mycobacterium tuberculosis
VADMVCNRIIDNA

SEQ ID NO: 193315 - protein, 13 aa, Mycobacterium tuberculosis
ADMVCNRIIDNAA

SEQ ID NO: 193316 - protein, 13 aa, Mycobacterium tuberculosis
DMVCNRIIDNAAV

SEQ ID NO: 193317 - protein, 13 aa, Mycobacterium tuberculosis
MVCNRIIDNAAVS

SEQ ID NO: 193318 - protein, 13 aa, Mycobacterium tuberculosis
VCNRIIDNAAVSA

SEQ ID NO: 193319 - protein, 13 aa, Mycobacterium tuberculosis
CNRIIDNAAVSAA

SEQ ID NO: 193320 - protein, 13 aa, Mycobacterium tuberculosis
NRIIDNAAVSAAS

SEQ ID NO: 193321 - protein, 13 aa, Mycobacterium tuberculosis
RIIDNAAVSAASM

SEQ ID NO: 193322 - protein, 13 aa, Mycobacterium tuberculosis
IIDNAAVSAASMV

SEQ ID NO: 193323 - protein, 13 aa, Mycobacterium tuberculosis
IDNAAVSAASMVR

SEQ ID NO: 193324 - protein, 13 aa, Mycobacterium tuberculosis
DNAAVSAASMVRR

SEQ ID NO: 193325 - protein, 13 aa, Mycobacterium tuberculosis
NAAVSAASMVRRP

SEQ ID NO: 193326 - protein, 13 aa, Mycobacterium tuberculosis
AAVSAASMVRRPV

SEQ ID NO: 193327 - protein, 13 aa, Mycobacterium tuberculosis
AVSAASMVRRPVT

SEQ ID NO: 193328 - protein, 13 aa, Mycobacterium tuberculosis
VSAASMVRRPVTV

SEQ ID NO: 193329 - protein, 13 aa, Mycobacterium tuberculosis
SAASMVRRPVTVA

SEQ ID NO: 193330 - protein, 13 aa, Mycobacterium tuberculosis
AASMVRRPVTVAR

SEQ ID NO: 193331 - protein, 13 aa, Mycobacterium tuberculosis
ASMVRRPVTVARH

SEQ ID NO: 193332 - protein, 13 aa, Mycobacterium tuberculosis
SMVRRPVTVARHQ

SEQ ID NO: 193333 - protein, 13 aa, Mycobacterium tuberculosis
MVRRPVTVARHQA

SEQ ID NO: 193334 - protein, 13 aa, Mycobacterium tuberculosis
VRRPVTVARHQAL

SEQ ID NO: 193335 - protein, 13 aa, Mycobacterium tuberculosis
RRPVTVARHQALA

SEQ ID NO: 193336 - protein, 13 aa, Mycobacterium tuberculosis
RPVTVARHQALAH

SEQ ID NO: 193337 - protein, 13 aa, Mycobacterium tuberculosis
PVTVARHQALAHP

SEQ ID NO: 193338 - protein, 13 aa, Mycobacterium tuberculosis
VTVARHQALAHPV

SEQ ID NO: 193339 - protein, 13 aa, Mycobacterium tuberculosis
TVARHQALAHPVR

SEQ ID NO: 193340 - protein, 13 aa, Mycobacterium tuberculosis
VARHQALAHPVRH

SEQ ID NO: 193341 - protein, 13 aa, Mycobacterium tuberculosis
ARHQALAHPVRHG

SEQ ID NO: 193342 - protein, 13 aa, Mycobacterium tuberculosis
RHQALAHPVRHGA

SEQ ID NO: 193343 - protein, 13 aa, Mycobacterium tuberculosis
HQALAHPVRHGAK

SEQ ID NO: 193344 - protein, 13 aa, Mycobacterium tuberculosis
QALAHPVRHGAKV

SEQ ID NO: 193345 - protein, 13 aa, Mycobacterium tuberculosis
ALAHPVRHGAKVF

SEQ ID NO: 193346 - protein, 13 aa, Mycobacterium tuberculosis
LAHPVRHGAKVFG

SEQ ID NO: 193347 - protein, 13 aa, Mycobacterium tuberculosis
AHPVRHGAKVFGV

SEQ ID NO: 193348 - protein, 13 aa, Mycobacterium tuberculosis
HPVRHGAKVFGVE

SEQ ID NO: 193349 - protein, 13 aa, Mycobacterium tuberculosis
PVRHGAKVFGVEG

SEQ ID NO: 193350 - protein, 13 aa, Mycobacterium tuberculosis
VRHGAKVFGVEGS

SEQ ID NO: 193351 - protein, 13 aa, Mycobacterium tuberculosis
RHGAKVFGVEGSY

SEQ ID NO: 193352 - protein, 13 aa, Mycobacterium tuberculosis
HGAKVFGVEGSYS

SEQ ID NO: 193353 - protein, 13 aa, Mycobacterium tuberculosis
GAKVFGVEGSYSA

SEQ ID NO: 193354 - protein, 13 aa, Mycobacterium tuberculosis
AKVFGVEGSYSAD

SEQ ID NO: 193355 - protein, 13 aa, Mycobacterium tuberculosis
KVFGVEGSYSADW

SEQ ID NO: 193356 - protein, 13 aa, Mycobacterium tuberculosis
VFGVEGSYSADWA

SEQ ID NO: 193357 - protein, 13 aa, Mycobacterium tuberculosis
FGVEGSYSADWAA

SEQ ID NO: 193358 - protein, 13 aa, Mycobacterium tuberculosis
GVEGSYSADWAAW

SEQ ID NO: 193359 - protein, 13 aa, Mycobacterium tuberculosis
VEGSYSADWAAWA

SEQ ID NO: 193360 - protein, 13 aa, Mycobacterium tuberculosis
EGSYSADWAAWAN

SEQ ID NO: 193361 - protein, 13 aa, Mycobacterium tuberculosis
GSYSADWAAWANG

SEQ ID NO: 193362 - protein, 13 aa, Mycobacterium tuberculosis
SYSADWAAWANGV

SEQ ID NO: 193363 - protein, 13 aa, Mycobacterium tuberculosis
YSADWAAWANGVA

SEQ ID NO: 193364 - protein, 13 aa, Mycobacterium tuberculosis
SADWAAWANGVAA

SEQ ID NO: 193365 - protein, 13 aa, Mycobacterium tuberculosis
ADWAAWANGVAAR

SEQ ID NO: 193366 - protein, 13 aa, Mycobacterium tuberculosis
DWAAWANGVAARE

SEQ ID NO: 193367 - protein, 13 aa, Mycobacterium tuberculosis
WAAWANGVAAREL

SEQ ID NO: 193368 - protein, 13 aa, Mycobacterium tuberculosis
AAWANGVAARELD

SEQ ID NO: 193369 - protein, 13 aa, Mycobacterium tuberculosis
AWANGVAARELDF

SEQ ID NO: 193370 - protein, 13 aa, Mycobacterium tuberculosis
WANGVAARELDFH

SEQ ID NO: 193371 - protein, 13 aa, Mycobacterium tuberculosis
ANGVAARELDFHD

SEQ ID NO: 193372 - protein, 13 aa, Mycobacterium tuberculosis
NGVAARELDFHDT

SEQ ID NO: 193373 - protein, 13 aa, Mycobacterium tuberculosis
GVAARELDFHDTF

SEQ ID NO: 193374 - protein, 13 aa, Mycobacterium tuberculosis
VAARELDFHDTFL

SEQ ID NO: 193375 - protein, 13 aa, Mycobacterium tuberculosis
AARELDFHDTFLA

SEQ ID NO: 193376 - protein, 13 aa, Mycobacterium tuberculosis
ARELDFHDTFLAA

SEQ ID NO: 193377 - protein, 13 aa, Mycobacterium tuberculosis
RELDFHDTFLAAD

SEQ ID NO: 193378 - protein, 13 aa, Mycobacterium tuberculosis
ELDFHDTFLAADY

SEQ ID NO: 193379 - protein, 13 aa, Mycobacterium tuberculosis
LDFHDTFLAADYS

SEQ ID NO: 193380 - protein, 13 aa, Mycobacterium tuberculosis
DFHDTFLAADYSH

SEQ ID NO: 193381 - protein, 13 aa, Mycobacterium tuberculosis
FHDTFLAADYSHP

SEQ ID NO: 193382 - protein, 13 aa, Mycobacterium tuberculosis
HDTFLAADYSHPA

SEQ ID NO: 193383 - protein, 13 aa, Mycobacterium tuberculosis
DTFLAADYSHPAD

SEQ ID NO: 193384 - protein, 13 aa, Mycobacterium tuberculosis
TFLAADYSHPADN

SEQ ID NO: 193385 - protein, 13 aa, Mycobacterium tuberculosis
FLAADYSHPADNI

SEQ ID NO: 193386 - protein, 13 aa, Mycobacterium tuberculosis
LAADYSHPADNIP

SEQ ID NO: 193387 - protein, 13 aa, Mycobacterium tuberculosis
AADYSHPADNIPP

SEQ ID NO: 193388 - protein, 13 aa, Mycobacterium tuberculosis
ADYSHPADNIPPL

SEQ ID NO: 193389 - protein, 13 aa, Mycobacterium tuberculosis
DYSHPADNIPPLV

SEQ ID NO: 193390 - protein, 13 aa, Mycobacterium tuberculosis
YSHPADNIPPLVA

SEQ ID NO: 193391 - protein, 13 aa, Mycobacterium tuberculosis
SHPADNIPPLVAV

SEQ ID NO: 193392 - protein, 13 aa, Mycobacterium tuberculosis
HPADNIPPLVAVA

SEQ ID NO: 193393 - protein, 13 aa, Mycobacterium tuberculosis
PADNIPPLVAVAQ

SEQ ID NO: 193394 - protein, 13 aa, Mycobacterium tuberculosis
ADNIPPLVAVAQQ

SEQ ID NO: 193395 - protein, 13 aa, Mycobacterium tuberculosis
DNIPPLVAVAQQL

SEQ ID NO: 193396 - protein, 13 aa, Mycobacterium tuberculosis
NIPPLVAVAQQLG

SEQ ID NO: 193397 - protein, 13 aa, Mycobacterium tuberculosis
IPPLVAVAQQLGV

SEQ ID NO: 193398 - protein, 13 aa, Mycobacterium tuberculosis
PPLVAVAQQLGVC

SEQ ID NO: 193399 - protein, 13 aa, Mycobacterium tuberculosis
PLVAVAQQLGVCG

SEQ ID NO: 193400 - protein, 13 aa, Mycobacterium tuberculosis
LVAVAQQLGVCGA

SEQ ID NO: 193401 - protein, 13 aa, Mycobacterium tuberculosis
VAVAQQLGVCGAE

SEQ ID NO: 193402 - protein, 13 aa, Mycobacterium tuberculosis
AVAQQLGVCGAEL

SEQ ID NO: 193403 - protein, 13 aa, Mycobacterium tuberculosis
VAQQLGVCGAELI

SEQ ID NO: 193404 - protein, 13 aa, Mycobacterium tuberculosis
AQQLGVCGAELIR

SEQ ID NO: 193405 - protein, 13 aa, Mycobacterium tuberculosis
QQLGVCGAELIRG

SEQ ID NO: 193406 - protein, 13 aa, Mycobacterium tuberculosis
QLGVCGAELIRGL

SEQ ID NO: 193407 - protein, 13 aa, Mycobacterium tuberculosis
LGVCGAELIRGLV

SEQ ID NO: 193408 - protein, 13 aa, Mycobacterium tuberculosis
GVCGAELIRGLVT

SEQ ID NO: 193409 - protein, 13 aa, Mycobacterium tuberculosis
VCGAELIRGLVTA

SEQ ID NO: 193410 - protein, 13 aa, Mycobacterium tuberculosis
CGAELIRGLVTAY

SEQ ID NO: 193411 - protein, 13 aa, Mycobacterium tuberculosis
GAELIRGLVTAYE

SEQ ID NO: 193412 - protein, 13 aa, Mycobacterium tuberculosis
AELIRGLVTAYEI

SEQ ID NO: 193413 - protein, 13 aa, Mycobacterium tuberculosis
ELIRGLVTAYEIH

SEQ ID NO: 193414 - protein, 13 aa, Mycobacterium tuberculosis
LIRGLVTAYEIHI

SEQ ID NO: 193415 - protein, 13 aa, Mycobacterium tuberculosis
IRGLVTAYEIHID

SEQ ID NO: 193416 - protein, 13 aa, Mycobacterium tuberculosis
RGLVTAYEIHIDL

SEQ ID NO: 193417 - protein, 13 aa, Mycobacterium tuberculosis
GLVTAYEIHIDLT

SEQ ID NO: 193418 - protein, 13 aa, Mycobacterium tuberculosis
LVTAYEIHIDLTR

SEQ ID NO: 193419 - protein, 13 aa, Mycobacterium tuberculosis
VTAYEIHIDLTRG

SEQ ID NO: 193420 - protein, 13 aa, Mycobacterium tuberculosis
TAYEIHIDLTRGI

SEQ ID NO: 193421 - protein, 13 aa, Mycobacterium tuberculosis
AYEIHIDLTRGIC

SEQ ID NO: 193422 - protein, 13 aa, Mycobacterium tuberculosis
YEIHIDLTRGICL

SEQ ID NO: 193423 - protein, 13 aa, Mycobacterium tuberculosis
EIHIDLTRGICLH

SEQ ID NO: 193424 - protein, 13 aa, Mycobacterium tuberculosis
IHIDLTRGICLHE

SEQ ID NO: 193425 - protein, 13 aa, Mycobacterium tuberculosis
HIDLTRGICLHEH

SEQ ID NO: 193426 - protein, 13 aa, Mycobacterium tuberculosis
IDLTRGICLHEHK

SEQ ID NO: 193427 - protein, 13 aa, Mycobacterium tuberculosis
DLTRGICLHEHKI

SEQ ID NO: 193428 - protein, 13 aa, Mycobacterium tuberculosis
LTRGICLHEHKID

SEQ ID NO: 193429 - protein, 13 aa, Mycobacterium tuberculosis
TRGICLHEHKIDH

SEQ ID NO: 193430 - protein, 13 aa, Mycobacterium tuberculosis
RGICLHEHKIDHV

SEQ ID NO: 193431 - protein, 13 aa, Mycobacterium tuberculosis
GICLHEHKIDHVA

SEQ ID NO: 193432 - protein, 13 aa, Mycobacterium tuberculosis
ICLHEHKIDHVAH

SEQ ID NO: 193433 - protein, 13 aa, Mycobacterium tuberculosis
CLHEHKIDHVAHL

SEQ ID NO: 193434 - protein, 13 aa, Mycobacterium tuberculosis
LHEHKIDHVAHLG

SEQ ID NO: 193435 - protein, 13 aa, Mycobacterium tuberculosis
HEHKIDHVAHLGP

SEQ ID NO: 193436 - protein, 13 aa, Mycobacterium tuberculosis
EHKIDHVAHLGPA

SEQ ID NO: 193437 - protein, 13 aa, Mycobacterium tuberculosis
HKIDHVAHLGPAV

SEQ ID NO: 193438 - protein, 13 aa, Mycobacterium tuberculosis
KIDHVAHLGPAVA

SEQ ID NO: 193439 - protein, 13 aa, Mycobacterium tuberculosis
IDHVAHLGPAVAA

SEQ ID NO: 193440 - protein, 13 aa, Mycobacterium tuberculosis
DHVAHLGPAVAAG

SEQ ID NO: 193441 - protein, 13 aa, Mycobacterium tuberculosis
HVAHLGPAVAAGI

SEQ ID NO: 193442 - protein, 13 aa, Mycobacterium tuberculosis
VAHLGPAVAAGIG

SEQ ID NO: 193443 - protein, 13 aa, Mycobacterium tuberculosis
AHLGPAVAAGIGT

SEQ ID NO: 193444 - protein, 13 aa, Mycobacterium tuberculosis
HLGPAVAAGIGTM

SEQ ID NO: 193445 - protein, 13 aa, Mycobacterium tuberculosis
LGPAVAAGIGTML

SEQ ID NO: 193446 - protein, 13 aa, Mycobacterium tuberculosis
GPAVAAGIGTMLR

SEQ ID NO: 193447 - protein, 13 aa, Mycobacterium tuberculosis
PAVAAGIGTMLRL

SEQ ID NO: 193448 - protein, 13 aa, Mycobacterium tuberculosis
AVAAGIGTMLRLD

SEQ ID NO: 193449 - protein, 13 aa, Mycobacterium tuberculosis
VAAGIGTMLRLDQ

SEQ ID NO: 193450 - protein, 13 aa, Mycobacterium tuberculosis
AAGIGTMLRLDQE

SEQ ID NO: 193451 - protein, 13 aa, Mycobacterium tuberculosis
AGIGTMLRLDQET

SEQ ID NO: 193452 - protein, 13 aa, Mycobacterium tuberculosis
GIGTMLRLDQETI

SEQ ID NO: 193453 - protein, 13 aa, Mycobacterium tuberculosis
IGTMLRLDQETIY

SEQ ID NO: 193454 - protein, 13 aa, Mycobacterium tuberculosis
GTMLRLDQETIYH

SEQ ID NO: 193455 - protein, 13 aa, Mycobacterium tuberculosis
TMLRLDQETIYHA

SEQ ID NO: 193456 - protein, 13 aa, Mycobacterium tuberculosis
MLRLDQETIYHAI

SEQ ID NO: 193457 - protein, 13 aa, Mycobacterium tuberculosis
LRLDQETIYHAIG

SEQ ID NO: 193458 - protein, 13 aa, Mycobacterium tuberculosis
RLDQETIYHAIGQ

SEQ ID NO: 193459 - protein, 13 aa, Mycobacterium tuberculosis
LDQETIYHAIGQA

SEQ ID NO: 193460 - protein, 13 aa, Mycobacterium tuberculosis
DQETIYHAIGQAL

SEQ ID NO: 193461 - protein, 13 aa, Mycobacterium tuberculosis
QETIYHAIGQALH

SEQ ID NO: 193462 - protein, 13 aa, Mycobacterium tuberculosis
ETIYHAIGQALHL

SEQ ID NO: 193463 - protein, 13 aa, Mycobacterium tuberculosis
TIYHAIGQALHLT

SEQ ID NO: 193464 - protein, 13 aa, Mycobacterium tuberculosis
IYHAIGQALHLTT

SEQ ID NO: 193465 - protein, 13 aa, Mycobacterium tuberculosis
YHAIGQALHLTTS

SEQ ID NO: 193466 - protein, 13 aa, Mycobacterium tuberculosis
HAIGQALHLTTST

SEQ ID NO: 193467 - protein, 13 aa, Mycobacterium tuberculosis
AIGQALHLTTSTR

SEQ ID NO: 193468 - protein, 13 aa, Mycobacterium tuberculosis
IGQALHLTTSTRQ

SEQ ID NO: 193469 - protein, 13 aa, Mycobacterium tuberculosis
GQALHLTTSTRQS

SEQ ID NO: 193470 - protein, 13 aa, Mycobacterium tuberculosis
QALHLTTSTRQSR

SEQ ID NO: 193471 - protein, 13 aa, Mycobacterium tuberculosis
ALHLTTSTRQSRK

SEQ ID NO: 193472 - protein, 13 aa, Mycobacterium tuberculosis
LHLTTSTRQSRKG

SEQ ID NO: 193473 - protein, 13 aa, Mycobacterium tuberculosis
HLTTSTRQSRKGA

SEQ ID NO: 193474 - protein, 13 aa, Mycobacterium tuberculosis
LTTSTRQSRKGAI

SEQ ID NO: 193475 - protein, 13 aa, Mycobacterium tuberculosis
TTSTRQSRKGAIS

SEQ ID NO: 193476 - protein, 13 aa, Mycobacterium tuberculosis
TSTRQSRKGAISS

SEQ ID NO: 193477 - protein, 13 aa, Mycobacterium tuberculosis
STRQSRKGAISSW

SEQ ID NO: 193478 - protein, 13 aa, Mycobacterium tuberculosis
TRQSRKGAISSWK

SEQ ID NO: 193479 - protein, 13 aa, Mycobacterium tuberculosis
RQSRKGAISSWKA

SEQ ID NO: 193480 - protein, 13 aa, Mycobacterium tuberculosis
QSRKGAISSWKAF

SEQ ID NO: 193481 - protein, 13 aa, Mycobacterium tuberculosis
SRKGAISSWKAFA

SEQ ID NO: 193482 - protein, 13 aa, Mycobacterium tuberculosis
RKGAISSWKAFAP

SEQ ID NO: 193483 - protein, 13 aa, Mycobacterium tuberculosis
KGAISSWKAFAPA

SEQ ID NO: 193484 - protein, 13 aa, Mycobacterium tuberculosis
GAISSWKAFAPAH

SEQ ID NO: 193485 - protein, 13 aa, Mycobacterium tuberculosis
AISSWKAFAPAHA

SEQ ID NO: 193486 - protein, 13 aa, Mycobacterium tuberculosis
ISSWKAFAPAHAG

SEQ ID NO: 193487 - protein, 13 aa, Mycobacterium tuberculosis
SSWKAFAPAHAGK

SEQ ID NO: 193488 - protein, 13 aa, Mycobacterium tuberculosis
SWKAFAPAHAGKV

SEQ ID NO: 193489 - protein, 13 aa, Mycobacterium tuberculosis
WKAFAPAHAGKVG

SEQ ID NO: 193490 - protein, 13 aa, Mycobacterium tuberculosis
KAFAPAHAGKVGI

SEQ ID NO: 193491 - protein, 13 aa, Mycobacterium tuberculosis
AFAPAHAGKVGIE

SEQ ID NO: 193492 - protein, 13 aa, Mycobacterium tuberculosis
FAPAHAGKVGIEA

SEQ ID NO: 193493 - protein, 13 aa, Mycobacterium tuberculosis
APAHAGKVGIEAV

SEQ ID NO: 193494 - protein, 13 aa, Mycobacterium tuberculosis
PAHAGKVGIEAVD

SEQ ID NO: 193495 - protein, 13 aa, Mycobacterium tuberculosis
AHAGKVGIEAVDR

SEQ ID NO: 193496 - protein, 13 aa, Mycobacterium tuberculosis
HAGKVGIEAVDRA

SEQ ID NO: 193497 - protein, 13 aa, Mycobacterium tuberculosis
AGKVGIEAVDRAM

SEQ ID NO: 193498 - protein, 13 aa, Mycobacterium tuberculosis
GKVGIEAVDRAMR

SEQ ID NO: 193499 - protein, 13 aa, Mycobacterium tuberculosis
KVGIEAVDRAMRG

SEQ ID NO: 193500 - protein, 13 aa, Mycobacterium tuberculosis
VGIEAVDRAMRGE

SEQ ID NO: 193501 - protein, 13 aa, Mycobacterium tuberculosis
GIEAVDRAMRGEG

SEQ ID NO: 193502 - protein, 13 aa, Mycobacterium tuberculosis
IEAVDRAMRGEGS

SEQ ID NO: 193503 - protein, 13 aa, Mycobacterium tuberculosis
EAVDRAMRGEGSP

SEQ ID NO: 193504 - protein, 13 aa, Mycobacterium tuberculosis
AVDRAMRGEGSPA

SEQ ID NO: 193505 - protein, 13 aa, Mycobacterium tuberculosis
VDRAMRGEGSPAP

SEQ ID NO: 193506 - protein, 13 aa, Mycobacterium tuberculosis
DRAMRGEGSPAPI

SEQ ID NO: 193507 - protein, 13 aa, Mycobacterium tuberculosis
RAMRGEGSPAPIW

SEQ ID NO: 193508 - protein, 13 aa, Mycobacterium tuberculosis
AMRGEGSPAPIWE

SEQ ID NO: 193509 - protein, 13 aa, Mycobacterium tuberculosis
MRGEGSPAPIWEG

SEQ ID NO: 193510 - protein, 13 aa, Mycobacterium tuberculosis
RGEGSPAPIWEGE

SEQ ID NO: 193511 - protein, 13 aa, Mycobacterium tuberculosis
GEGSPAPIWEGED

SEQ ID NO: 193512 - protein, 13 aa, Mycobacterium tuberculosis
EGSPAPIWEGEDG

SEQ ID NO: 193513 - protein, 13 aa, Mycobacterium tuberculosis
GSPAPIWEGEDGV

SEQ ID NO: 193514 - protein, 13 aa, Mycobacterium tuberculosis
SPAPIWEGEDGVI

SEQ ID NO: 193515 - protein, 13 aa, Mycobacterium tuberculosis
PAPIWEGEDGVIA

SEQ ID NO: 193516 - protein, 13 aa, Mycobacterium tuberculosis
APIWEGEDGVIAW

SEQ ID NO: 193517 - protein, 13 aa, Mycobacterium tuberculosis
PIWEGEDGVIAWL

SEQ ID NO: 193518 - protein, 13 aa, Mycobacterium tuberculosis
IWEGEDGVIAWLL

SEQ ID NO: 193519 - protein, 13 aa, Mycobacterium tuberculosis
WEGEDGVIAWLLA

SEQ ID NO: 193520 - protein, 13 aa, Mycobacterium tuberculosis
EGEDGVIAWLLAG

SEQ ID NO: 193521 - protein, 13 aa, Mycobacterium tuberculosis
GEDGVIAWLLAGP

SEQ ID NO: 193522 - protein, 13 aa, Mycobacterium tuberculosis
EDGVIAWLLAGPE

SEQ ID NO: 193523 - protein, 13 aa, Mycobacterium tuberculosis
DGVIAWLLAGPEH

SEQ ID NO: 193524 - protein, 13 aa, Mycobacterium tuberculosis
GVIAWLLAGPEHT

SEQ ID NO: 193525 - protein, 13 aa, Mycobacterium tuberculosis
VIAWLLAGPEHTY

SEQ ID NO: 193526 - protein, 13 aa, Mycobacterium tuberculosis
IAWLLAGPEHTYR

SEQ ID NO: 193527 - protein, 13 aa, Mycobacterium tuberculosis
AWLLAGPEHTYRV

SEQ ID NO: 193528 - protein, 13 aa, Mycobacterium tuberculosis
WLLAGPEHTYRVP

SEQ ID NO: 193529 - protein, 13 aa, Mycobacterium tuberculosis
LLAGPEHTYRVPL

SEQ ID NO: 193530 - protein, 13 aa, Mycobacterium tuberculosis
LAGPEHTYRVPLP

SEQ ID NO: 193531 - protein, 13 aa, Mycobacterium tuberculosis
AGPEHTYRVPLPA

SEQ ID NO: 193532 - protein, 13 aa, Mycobacterium tuberculosis
GPEHTYRVPLPAP

SEQ ID NO: 193533 - protein, 13 aa, Mycobacterium tuberculosis
PEHTYRVPLPAPG

SEQ ID NO: 193534 - protein, 13 aa, Mycobacterium tuberculosis
EHTYRVPLPAPGE

SEQ ID NO: 193535 - protein, 13 aa, Mycobacterium tuberculosis
HTYRVPLPAPGEP

SEQ ID NO: 193536 - protein, 13 aa, Mycobacterium tuberculosis
TYRVPLPAPGEPK

SEQ ID NO: 193537 - protein, 13 aa, Mycobacterium tuberculosis
YRVPLPAPGEPKR

SEQ ID NO: 193538 - protein, 13 aa, Mycobacterium tuberculosis
RVPLPAPGEPKRA

SEQ ID NO: 193539 - protein, 13 aa, Mycobacterium tuberculosis
VPLPAPGEPKRAI

SEQ ID NO: 193540 - protein, 13 aa, Mycobacterium tuberculosis
PLPAPGEPKRAIL

SEQ ID NO: 193541 - protein, 13 aa, Mycobacterium tuberculosis
LPAPGEPKRAILD

SEQ ID NO: 193542 - protein, 13 aa, Mycobacterium tuberculosis
PAPGEPKRAILDS

SEQ ID NO: 193543 - protein, 13 aa, Mycobacterium tuberculosis
APGEPKRAILDSY

SEQ ID NO: 193544 - protein, 13 aa, Mycobacterium tuberculosis
PGEPKRAILDSYT

SEQ ID NO: 193545 - protein, 13 aa, Mycobacterium tuberculosis
GEPKRAILDSYTK

SEQ ID NO: 193546 - protein, 13 aa, Mycobacterium tuberculosis
EPKRAILDSYTKQ

SEQ ID NO: 193547 - protein, 13 aa, Mycobacterium tuberculosis
PKRAILDSYTKQH

SEQ ID NO: 193548 - protein, 13 aa, Mycobacterium tuberculosis
KRAILDSYTKQHS

SEQ ID NO: 193549 - protein, 13 aa, Mycobacterium tuberculosis
RAILDSYTKQHSA

SEQ ID NO: 193550 - protein, 13 aa, Mycobacterium tuberculosis
AILDSYTKQHSAE

SEQ ID NO: 193551 - protein, 13 aa, Mycobacterium tuberculosis
ILDSYTKQHSAEY

SEQ ID NO: 193552 - protein, 13 aa, Mycobacterium tuberculosis
LDSYTKQHSAEYQ

SEQ ID NO: 193553 - protein, 13 aa, Mycobacterium tuberculosis
DSYTKQHSAEYQS

SEQ ID NO: 193554 - protein, 13 aa, Mycobacterium tuberculosis
SYTKQHSAEYQSQ

SEQ ID NO: 193555 - protein, 13 aa, Mycobacterium tuberculosis
YTKQHSAEYQSQA

SEQ ID NO: 193556 - protein, 13 aa, Mycobacterium tuberculosis
TKQHSAEYQSQAP

SEQ ID NO: 193557 - protein, 13 aa, Mycobacterium tuberculosis
KQHSAEYQSQAPI

SEQ ID NO: 193558 - protein, 13 aa, Mycobacterium tuberculosis
QHSAEYQSQAPID

SEQ ID NO: 193559 - protein, 13 aa, Mycobacterium tuberculosis
HSAEYQSQAPIDL

SEQ ID NO: 193560 - protein, 13 aa, Mycobacterium tuberculosis
SAEYQSQAPIDLA

SEQ ID NO: 193561 - protein, 13 aa, Mycobacterium tuberculosis
AEYQSQAPIDLAC

SEQ ID NO: 193562 - protein, 13 aa, Mycobacterium tuberculosis
EYQSQAPIDLACR

SEQ ID NO: 193563 - protein, 13 aa, Mycobacterium tuberculosis
YQSQAPIDLACRL

SEQ ID NO: 193564 - protein, 13 aa, Mycobacterium tuberculosis
QSQAPIDLACRLR

SEQ ID NO: 193565 - protein, 13 aa, Mycobacterium tuberculosis
SQAPIDLACRLRE

SEQ ID NO: 193566 - protein, 13 aa, Mycobacterium tuberculosis
QAPIDLACRLRER

SEQ ID NO: 193567 - protein, 13 aa, Mycobacterium tuberculosis
APIDLACRLRERI

SEQ ID NO: 193568 - protein, 13 aa, Mycobacterium tuberculosis
PIDLACRLRERIG

SEQ ID NO: 193569 - protein, 13 aa, Mycobacterium tuberculosis
IDLACRLRERIGD

SEQ ID NO: 193570 - protein, 13 aa, Mycobacterium tuberculosis
DLACRLRERIGDL

SEQ ID NO: 193571 - protein, 13 aa, Mycobacterium tuberculosis
LACRLRERIGDLD

SEQ ID NO: 193572 - protein, 13 aa, Mycobacterium tuberculosis
ACRLRERIGDLDQ

SEQ ID NO: 193573 - protein, 13 aa, Mycobacterium tuberculosis
CRLRERIGDLDQI

SEQ ID NO: 193574 - protein, 13 aa, Mycobacterium tuberculosis
RLRERIGDLDQIA

SEQ ID NO: 193575 - protein, 13 aa, Mycobacterium tuberculosis
LRERIGDLDQIAS

SEQ ID NO: 193576 - protein, 13 aa, Mycobacterium tuberculosis
RERIGDLDQIASI

SEQ ID NO: 193577 - protein, 13 aa, Mycobacterium tuberculosis
ERIGDLDQIASIV

SEQ ID NO: 193578 - protein, 13 aa, Mycobacterium tuberculosis
RIGDLDQIASIVL

SEQ ID NO: 193579 - protein, 13 aa, Mycobacterium tuberculosis
IGDLDQIASIVLH

SEQ ID NO: 193580 - protein, 13 aa, Mycobacterium tuberculosis
GDLDQIASIVLHT

SEQ ID NO: 193581 - protein, 13 aa, Mycobacterium tuberculosis
DLDQIASIVLHTS

SEQ ID NO: 193582 - protein, 13 aa, Mycobacterium tuberculosis
LDQIASIVLHTSH

SEQ ID NO: 193583 - protein, 13 aa, Mycobacterium tuberculosis
DQIASIVLHTSHH

SEQ ID NO: 193584 - protein, 13 aa, Mycobacterium tuberculosis
QIASIVLHTSHHT

SEQ ID NO: 193585 - protein, 13 aa, Mycobacterium tuberculosis
IASIVLHTSHHTH

SEQ ID NO: 193586 - protein, 13 aa, Mycobacterium tuberculosis
ASIVLHTSHHTHV

SEQ ID NO: 193587 - protein, 13 aa, Mycobacterium tuberculosis
SIVLHTSHHTHVV

SEQ ID NO: 193588 - protein, 13 aa, Mycobacterium tuberculosis
IVLHTSHHTHVVI

SEQ ID NO: 193589 - protein, 13 aa, Mycobacterium tuberculosis
VLHTSHHTHVVIG

SEQ ID NO: 193590 - protein, 13 aa, Mycobacterium tuberculosis
LHTSHHTHVVIGT

SEQ ID NO: 193591 - protein, 13 aa, Mycobacterium tuberculosis
HTSHHTHVVIGTG

SEQ ID NO: 193592 - protein, 13 aa, Mycobacterium tuberculosis
TSHHTHVVIGTGS

SEQ ID NO: 193593 - protein, 13 aa, Mycobacterium tuberculosis
SHHTHVVIGTGSG

SEQ ID NO: 193594 - protein, 13 aa, Mycobacterium tuberculosis
HHTHVVIGTGSGD

SEQ ID NO: 193595 - protein, 13 aa, Mycobacterium tuberculosis
HTHVVIGTGSGDP

SEQ ID NO: 193596 - protein, 13 aa, Mycobacterium tuberculosis
THVVIGTGSGDPQ

SEQ ID NO: 193597 - protein, 13 aa, Mycobacterium tuberculosis
HVVIGTGSGDPQK

SEQ ID NO: 193598 - protein, 13 aa, Mycobacterium tuberculosis
VVIGTGSGDPQKF

SEQ ID NO: 193599 - protein, 13 aa, Mycobacterium tuberculosis
VIGTGSGDPQKFD

SEQ ID NO: 193600 - protein, 13 aa, Mycobacterium tuberculosis
IGTGSGDPQKFDP

SEQ ID NO: 193601 - protein, 13 aa, Mycobacterium tuberculosis
GTGSGDPQKFDPD

SEQ ID NO: 193602 - protein, 13 aa, Mycobacterium tuberculosis
TGSGDPQKFDPDA

SEQ ID NO: 193603 - protein, 13 aa, Mycobacterium tuberculosis
GSGDPQKFDPDAS

SEQ ID NO: 193604 - protein, 13 aa, Mycobacterium tuberculosis
SGDPQKFDPDASR

SEQ ID NO: 193605 - protein, 13 aa, Mycobacterium tuberculosis
GDPQKFDPDASRE

SEQ ID NO: 193606 - protein, 13 aa, Mycobacterium tuberculosis
DPQKFDPDASRET

SEQ ID NO: 193607 - protein, 13 aa, Mycobacterium tuberculosis
PQKFDPDASRETL

SEQ ID NO: 193608 - protein, 13 aa, Mycobacterium tuberculosis
QKFDPDASRETLD

SEQ ID NO: 193609 - protein, 13 aa, Mycobacterium tuberculosis
KFDPDASRETLDH

SEQ ID NO: 193610 - protein, 13 aa, Mycobacterium tuberculosis
FDPDASRETLDHS

SEQ ID NO: 193611 - protein, 13 aa, Mycobacterium tuberculosis
DPDASRETLDHSL

SEQ ID NO: 193612 - protein, 13 aa, Mycobacterium tuberculosis
PDASRETLDHSLP

SEQ ID NO: 193613 - protein, 13 aa, Mycobacterium tuberculosis
DASRETLDHSLPY

SEQ ID NO: 193614 - protein, 13 aa, Mycobacterium tuberculosis
ASRETLDHSLPYI

SEQ ID NO: 193615 - protein, 13 aa, Mycobacterium tuberculosis
SRETLDHSLPYIF

SEQ ID NO: 193616 - protein, 13 aa, Mycobacterium tuberculosis
RETLDHSLPYIFA

SEQ ID NO: 193617 - protein, 13 aa, Mycobacterium tuberculosis
ETLDHSLPYIFAV

SEQ ID NO: 193618 - protein, 13 aa, Mycobacterium tuberculosis
TLDHSLPYIFAVA

SEQ ID NO: 193619 - protein, 13 aa, Mycobacterium tuberculosis
LDHSLPYIFAVAL

SEQ ID NO: 193620 - protein, 13 aa, Mycobacterium tuberculosis
DHSLPYIFAVALQ

SEQ ID NO: 193621 - protein, 13 aa, Mycobacterium tuberculosis
HSLPYIFAVALQD

SEQ ID NO: 193622 - protein, 13 aa, Mycobacterium tuberculosis
SLPYIFAVALQDG

SEQ ID NO: 193623 - protein, 13 aa, Mycobacterium tuberculosis
LPYIFAVALQDGC

SEQ ID NO: 193624 - protein, 13 aa, Mycobacterium tuberculosis
PYIFAVALQDGCW

SEQ ID NO: 193625 - protein, 13 aa, Mycobacterium tuberculosis
YIFAVALQDGCWH

SEQ ID NO: 193626 - protein, 13 aa, Mycobacterium tuberculosis
IFAVALQDGCWHH

SEQ ID NO: 193627 - protein, 13 aa, Mycobacterium tuberculosis
FAVALQDGCWHHE

SEQ ID NO: 193628 - protein, 13 aa, Mycobacterium tuberculosis
AVALQDGCWHHER

SEQ ID NO: 193629 - protein, 13 aa, Mycobacterium tuberculosis
VALQDGCWHHERS

SEQ ID NO: 193630 - protein, 13 aa, Mycobacterium tuberculosis
ALQDGCWHHERSY

SEQ ID NO: 193631 - protein, 13 aa, Mycobacterium tuberculosis
LQDGCWHHERSYA

SEQ ID NO: 193632 - protein, 13 aa, Mycobacterium tuberculosis
QDGCWHHERSYAP

SEQ ID NO: 193633 - protein, 13 aa, Mycobacterium tuberculosis
DGCWHHERSYAPE

SEQ ID NO: 193634 - protein, 13 aa, Mycobacterium tuberculosis
GCWHHERSYAPER

SEQ ID NO: 193635 - protein, 13 aa, Mycobacterium tuberculosis
CWHHERSYAPERA

SEQ ID NO: 193636 - protein, 13 aa, Mycobacterium tuberculosis
WHHERSYAPERAR

SEQ ID NO: 193637 - protein, 13 aa, Mycobacterium tuberculosis
HHERSYAPERARR

SEQ ID NO: 193638 - protein, 13 aa, Mycobacterium tuberculosis
HERSYAPERARRS

SEQ ID NO: 193639 - protein, 13 aa, Mycobacterium tuberculosis
ERSYAPERARRSD

SEQ ID NO: 193640 - protein, 13 aa, Mycobacterium tuberculosis
RSYAPERARRSDT

SEQ ID NO: 193641 - protein, 13 aa, Mycobacterium tuberculosis
SYAPERARRSDTV

SEQ ID NO: 193642 - protein, 13 aa, Mycobacterium tuberculosis
YAPERARRSDTVA

SEQ ID NO: 193643 - protein, 13 aa, Mycobacterium tuberculosis
APERARRSDTVAL

SEQ ID NO: 193644 - protein, 13 aa, Mycobacterium tuberculosis
PERARRSDTVALW

SEQ ID NO: 193645 - protein, 13 aa, Mycobacterium tuberculosis
ERARRSDTVALWH

SEQ ID NO: 193646 - protein, 13 aa, Mycobacterium tuberculosis
RARRSDTVALWHK

SEQ ID NO: 193647 - protein, 13 aa, Mycobacterium tuberculosis
ARRSDTVALWHKI

SEQ ID NO: 193648 - protein, 13 aa, Mycobacterium tuberculosis
RRSDTVALWHKIS

SEQ ID NO: 193649 - protein, 13 aa, Mycobacterium tuberculosis
RSDTVALWHKIST

SEQ ID NO: 193650 - protein, 13 aa, Mycobacterium tuberculosis
SDTVALWHKISTV

SEQ ID NO: 193651 - protein, 13 aa, Mycobacterium tuberculosis
DTVALWHKISTVE

SEQ ID NO: 193652 - protein, 13 aa, Mycobacterium tuberculosis
TVALWHKISTVED

SEQ ID NO: 193653 - protein, 13 aa, Mycobacterium tuberculosis
VALWHKISTVEDP

SEQ ID NO: 193654 - protein, 13 aa, Mycobacterium tuberculosis
ALWHKISTVEDPE

SEQ ID NO: 193655 - protein, 13 aa, Mycobacterium tuberculosis
LWHKISTVEDPEW

SEQ ID NO: 193656 - protein, 13 aa, Mycobacterium tuberculosis
WHKISTVEDPEWT

SEQ ID NO: 193657 - protein, 13 aa, Mycobacterium tuberculosis
HKISTVEDPEWTR

SEQ ID NO: 193658 - protein, 13 aa, Mycobacterium tuberculosis
KISTVEDPEWTRR

SEQ ID NO: 193659 - protein, 13 aa, Mycobacterium tuberculosis
ISTVEDPEWTRRY

SEQ ID NO: 193660 - protein, 13 aa, Mycobacterium tuberculosis
STVEDPEWTRRYH

SEQ ID NO: 193661 - protein, 13 aa, Mycobacterium tuberculosis
TVEDPEWTRRYHC

SEQ ID NO: 193662 - protein, 13 aa, Mycobacterium tuberculosis
VEDPEWTRRYHCA

SEQ ID NO: 193663 - protein, 13 aa, Mycobacterium tuberculosis
EDPEWTRRYHCAD

SEQ ID NO: 193664 - protein, 13 aa, Mycobacterium tuberculosis
DPEWTRRYHCADP

SEQ ID NO: 193665 - protein, 13 aa, Mycobacterium tuberculosis
PEWTRRYHCADPA

SEQ ID NO: 193666 - protein, 13 aa, Mycobacterium tuberculosis
EWTRRYHCADPAK

SEQ ID NO: 193667 - protein, 13 aa, Mycobacterium tuberculosis
WTRRYHCADPAKK

SEQ ID NO: 193668 - protein, 13 aa, Mycobacterium tuberculosis
TRRYHCADPAKKA

SEQ ID NO: 193669 - protein, 13 aa, Mycobacterium tuberculosis
RRYHCADPAKKAF

SEQ ID NO: 193670 - protein, 13 aa, Mycobacterium tuberculosis
RYHCADPAKKAFG

SEQ ID NO: 193671 - protein, 13 aa, Mycobacterium tuberculosis
YHCADPAKKAFGA

SEQ ID NO: 193672 - protein, 13 aa, Mycobacterium tuberculosis
HCADPAKKAFGAR

SEQ ID NO: 193673 - protein, 13 aa, Mycobacterium tuberculosis
CADPAKKAFGARA

SEQ ID NO: 193674 - protein, 13 aa, Mycobacterium tuberculosis
ADPAKKAFGARAE

SEQ ID NO: 193675 - protein, 13 aa, Mycobacterium tuberculosis
DPAKKAFGARAEV

SEQ ID NO: 193676 - protein, 13 aa, Mycobacterium tuberculosis
PAKKAFGARAEVT

SEQ ID NO: 193677 - protein, 13 aa, Mycobacterium tuberculosis
AKKAFGARAEVTL

SEQ ID NO: 193678 - protein, 13 aa, Mycobacterium tuberculosis
KKAFGARAEVTLH

SEQ ID NO: 193679 - protein, 13 aa, Mycobacterium tuberculosis
KAFGARAEVTLHS

SEQ ID NO: 193680 - protein, 13 aa, Mycobacterium tuberculosis
AFGARAEVTLHSG

SEQ ID NO: 193681 - protein, 13 aa, Mycobacterium tuberculosis
FGARAEVTLHSGE

SEQ ID NO: 193682 - protein, 13 aa, Mycobacterium tuberculosis
GARAEVTLHSGEV

SEQ ID NO: 193683 - protein, 13 aa, Mycobacterium tuberculosis
ARAEVTLHSGEVI

SEQ ID NO: 193684 - protein, 13 aa, Mycobacterium tuberculosis
RAEVTLHSGEVIV

SEQ ID NO: 193685 - protein, 13 aa, Mycobacterium tuberculosis
AEVTLHSGEVIVD

SEQ ID NO: 193686 - protein, 13 aa, Mycobacterium tuberculosis
EVTLHSGEVIVDE

SEQ ID NO: 193687 - protein, 13 aa, Mycobacterium tuberculosis
VTLHSGEVIVDEL

SEQ ID NO: 193688 - protein, 13 aa, Mycobacterium tuberculosis
TLHSGEVIVDELA

SEQ ID NO: 193689 - protein, 13 aa, Mycobacterium tuberculosis
LHSGEVIVDELAV

SEQ ID NO: 193690 - protein, 13 aa, Mycobacterium tuberculosis
HSGEVIVDELAVA

SEQ ID NO: 193691 - protein, 13 aa, Mycobacterium tuberculosis
SGEVIVDELAVAD

SEQ ID NO: 193692 - protein, 13 aa, Mycobacterium tuberculosis
GEVIVDELAVADA

SEQ ID NO: 193693 - protein, 13 aa, Mycobacterium tuberculosis
EVIVDELAVADAH

SEQ ID NO: 193694 - protein, 13 aa, Mycobacterium tuberculosis
VIVDELAVADAHP

SEQ ID NO: 193695 - protein, 13 aa, Mycobacterium tuberculosis
IVDELAVADAHPL

SEQ ID NO: 193696 - protein, 13 aa, Mycobacterium tuberculosis
VDELAVADAHPLG

SEQ ID NO: 193697 - protein, 13 aa, Mycobacterium tuberculosis
DELAVADAHPLGT

SEQ ID NO: 193698 - protein, 13 aa, Mycobacterium tuberculosis
ELAVADAHPLGTR

SEQ ID NO: 193699 - protein, 13 aa, Mycobacterium tuberculosis
LAVADAHPLGTRP

SEQ ID NO: 193700 - protein, 13 aa, Mycobacterium tuberculosis
AVADAHPLGTRPF

SEQ ID NO: 193701 - protein, 13 aa, Mycobacterium tuberculosis
VADAHPLGTRPFE

SEQ ID NO: 193702 - protein, 13 aa, Mycobacterium tuberculosis
ADAHPLGTRPFER

SEQ ID NO: 193703 - protein, 13 aa, Mycobacterium tuberculosis
DAHPLGTRPFERK

SEQ ID NO: 193704 - protein, 13 aa, Mycobacterium tuberculosis
AHPLGTRPFERKQ

SEQ ID NO: 193705 - protein, 13 aa, Mycobacterium tuberculosis
HPLGTRPFERKQY

SEQ ID NO: 193706 - protein, 13 aa, Mycobacterium tuberculosis
PLGTRPFERKQYV

SEQ ID NO: 193707 - protein, 13 aa, Mycobacterium tuberculosis
LGTRPFERKQYVE

SEQ ID NO: 193708 - protein, 13 aa, Mycobacterium tuberculosis
GTRPFERKQYVEK

SEQ ID NO: 193709 - protein, 13 aa, Mycobacterium tuberculosis
TRPFERKQYVEKF

SEQ ID NO: 193710 - protein, 13 aa, Mycobacterium tuberculosis
RPFERKQYVEKFT

SEQ ID NO: 193711 - protein, 13 aa, Mycobacterium tuberculosis
PFERKQYVEKFTE

SEQ ID NO: 193712 - protein, 13 aa, Mycobacterium tuberculosis
FERKQYVEKFTEL

SEQ ID NO: 193713 - protein, 13 aa, Mycobacterium tuberculosis
ERKQYVEKFTELA

SEQ ID NO: 193714 - protein, 13 aa, Mycobacterium tuberculosis
RKQYVEKFTELAD

SEQ ID NO: 193715 - protein, 13 aa, Mycobacterium tuberculosis
KQYVEKFTELADG

SEQ ID NO: 193716 - protein, 13 aa, Mycobacterium tuberculosis
QYVEKFTELADGV

SEQ ID NO: 193717 - protein, 13 aa, Mycobacterium tuberculosis
YVEKFTELADGVV

SEQ ID NO: 193718 - protein, 13 aa, Mycobacterium tuberculosis
VEKFTELADGVVE

SEQ ID NO: 193719 - protein, 13 aa, Mycobacterium tuberculosis
EKFTELADGVVEP

SEQ ID NO: 193720 - protein, 13 aa, Mycobacterium tuberculosis
KFTELADGVVEPV

SEQ ID NO: 193721 - protein, 13 aa, Mycobacterium tuberculosis
FTELADGVVEPVE

SEQ ID NO: 193722 - protein, 13 aa, Mycobacterium tuberculosis
TELADGVVEPVEQ

SEQ ID NO: 193723 - protein, 13 aa, Mycobacterium tuberculosis
ELADGVVEPVEQQ

SEQ ID NO: 193724 - protein, 13 aa, Mycobacterium tuberculosis
LADGVVEPVEQQR

SEQ ID NO: 193725 - protein, 13 aa, Mycobacterium tuberculosis
ADGVVEPVEQQRF

SEQ ID NO: 193726 - protein, 13 aa, Mycobacterium tuberculosis
DGVVEPVEQQRFL

SEQ ID NO: 193727 - protein, 13 aa, Mycobacterium tuberculosis
GVVEPVEQQRFLA

SEQ ID NO: 193728 - protein, 13 aa, Mycobacterium tuberculosis
VVEPVEQQRFLAV

SEQ ID NO: 193729 - protein, 13 aa, Mycobacterium tuberculosis
VEPVEQQRFLAVV

SEQ ID NO: 193730 - protein, 13 aa, Mycobacterium tuberculosis
EPVEQQRFLAVVE

SEQ ID NO: 193731 - protein, 13 aa, Mycobacterium tuberculosis
PVEQQRFLAVVES

SEQ ID NO: 193732 - protein, 13 aa, Mycobacterium tuberculosis
VEQQRFLAVVESL

SEQ ID NO: 193733 - protein, 13 aa, Mycobacterium tuberculosis
EQQRFLAVVESLA

SEQ ID NO: 193734 - protein, 13 aa, Mycobacterium tuberculosis
QQRFLAVVESLAD

SEQ ID NO: 193735 - protein, 13 aa, Mycobacterium tuberculosis
QRFLAVVESLADL

SEQ ID NO: 193736 - protein, 13 aa, Mycobacterium tuberculosis
RFLAVVESLADLE

SEQ ID NO: 193737 - protein, 13 aa, Mycobacterium tuberculosis
FLAVVESLADLES

SEQ ID NO: 193738 - protein, 13 aa, Mycobacterium tuberculosis
LAVVESLADLESG

SEQ ID NO: 193739 - protein, 13 aa, Mycobacterium tuberculosis
AVVESLADLESGA

SEQ ID NO: 193740 - protein, 13 aa, Mycobacterium tuberculosis
VVESLADLESGAV

SEQ ID NO: 193741 - protein, 13 aa, Mycobacterium tuberculosis
VESLADLESGAVG

SEQ ID NO: 193742 - protein, 13 aa, Mycobacterium tuberculosis
ESLADLESGAVGG

SEQ ID NO: 193743 - protein, 13 aa, Mycobacterium tuberculosis
SLADLESGAVGGL

SEQ ID NO: 193744 - protein, 13 aa, Mycobacterium tuberculosis
LADLESGAVGGLN

SEQ ID NO: 193745 - protein, 13 aa, Mycobacterium tuberculosis
ADLESGAVGGLNV

SEQ ID NO: 193746 - protein, 13 aa, Mycobacterium tuberculosis
DLESGAVGGLNVL

SEQ ID NO: 193747 - protein, 13 aa, Mycobacterium tuberculosis
LESGAVGGLNVLV

SEQ ID NO: 193748 - protein, 13 aa, Mycobacterium tuberculosis
ESGAVGGLNVLVD

SEQ ID NO: 193749 - protein, 13 aa, Mycobacterium tuberculosis
SGAVGGLNVLVDP

SEQ ID NO: 193750 - protein, 13 aa, Mycobacterium tuberculosis
GAVGGLNVLVDPR

SEQ ID NO: 193751 - protein, 13 aa, Mycobacterium tuberculosis
AVGGLNVLVDPRV

SEQ ID NO: 193752 - protein, 13 aa, Mycobacterium tuberculosis
VGGLNVLVDPRVL

SEQ ID NO: 193753 - protein, 13 aa, Mycobacterium tuberculosis
GGLNVLVDPRVLD

SEQ ID NO: 193754 - protein, 13 aa, Mycobacterium tuberculosis
GLNVLVDPRVLDK

SEQ ID NO: 193755 - protein, 13 aa, Mycobacterium tuberculosis
LNVLVDPRVLDKA

SEQ ID NO: 193756 - protein, 13 aa, Mycobacterium tuberculosis
NVLVDPRVLDKAP

SEQ ID NO: 193757 - protein, 13 aa, Mycobacterium tuberculosis
VLVDPRVLDKAPV

SEQ ID NO: 193758 - protein, 13 aa, Mycobacterium tuberculosis
LVDPRVLDKAPVI

SEQ ID NO: 193759 - protein, 13 aa, Mycobacterium tuberculosis
VDPRVLDKAPVIP

SEQ ID NO: 193760 - protein, 13 aa, Mycobacterium tuberculosis
DPRVLDKAPVIPP

SEQ ID NO: 193761 - protein, 13 aa, Mycobacterium tuberculosis
PRVLDKAPVIPPG

SEQ ID NO: 193762 - protein, 13 aa, Mycobacterium tuberculosis
RVLDKAPVIPPGI

SEQ ID NO: 193763 - protein, 13 aa, Mycobacterium tuberculosis
VLDKAPVIPPGIF

SEQ ID NO: 193764 - protein, 13 aa, Mycobacterium tuberculosis
LDKAPVIPPGIFR

SEQ ID NO: 193765 - protein, 14 aa, Mycobacterium tuberculosis
MPDQDTKVRFFRVF

SEQ ID NO: 193766 - protein, 14 aa, Mycobacterium tuberculosis
PDQDTKVRFFRVFC

SEQ ID NO: 193767 - protein, 14 aa, Mycobacterium tuberculosis
DQDTKVRFFRVFCW

SEQ ID NO: 193768 - protein, 14 aa, Mycobacterium tuberculosis
QDTKVRFFRVFCWC

SEQ ID NO: 193769 - protein, 14 aa, Mycobacterium tuberculosis
DTKVRFFRVFCWCP

SEQ ID NO: 193770 - protein, 14 aa, Mycobacterium tuberculosis
TKVRFFRVFCWCPV

SEQ ID NO: 193771 - protein, 14 aa, Mycobacterium tuberculosis
KVRFFRVFCWCPVL

SEQ ID NO: 193772 - protein, 14 aa, Mycobacterium tuberculosis
VRFFRVFCWCPVLR

SEQ ID NO: 193773 - protein, 14 aa, Mycobacterium tuberculosis
RFFRVFCWCPVLRM

SEQ ID NO: 193774 - protein, 14 aa, Mycobacterium tuberculosis
FFRVFCWCPVLRMV

SEQ ID NO: 193775 - protein, 14 aa, Mycobacterium tuberculosis
FRVFCWCPVLRMVR

SEQ ID NO: 193776 - protein, 14 aa, Mycobacterium tuberculosis
RVFCWCPVLRMVRI

SEQ ID NO: 193777 - protein, 14 aa, Mycobacterium tuberculosis
VFCWCPVLRMVRIM

SEQ ID NO: 193778 - protein, 14 aa, Mycobacterium tuberculosis
FCWCPVLRMVRIML

SEQ ID NO: 193779 - protein, 14 aa, Mycobacterium tuberculosis
CWCPVLRMVRIMLM

SEQ ID NO: 193780 - protein, 14 aa, Mycobacterium tuberculosis
WCPVLRMVRIMLMH

SEQ ID NO: 193781 - protein, 14 aa, Mycobacterium tuberculosis
CPVLRMVRIMLMHA

SEQ ID NO: 193782 - protein, 14 aa, Mycobacterium tuberculosis
PVLRMVRIMLMHAV

SEQ ID NO: 193783 - protein, 14 aa, Mycobacterium tuberculosis
VLRMVRIMLMHAVR

SEQ ID NO: 193784 - protein, 14 aa, Mycobacterium tuberculosis
LRMVRIMLMHAVRA

SEQ ID NO: 193785 - protein, 14 aa, Mycobacterium tuberculosis
RMVRIMLMHAVRAW

SEQ ID NO: 193786 - protein, 14 aa, Mycobacterium tuberculosis
MVRIMLMHAVRAWR

SEQ ID NO: 193787 - protein, 14 aa, Mycobacterium tuberculosis
VRIMLMHAVRAWRS

SEQ ID NO: 193788 - protein, 14 aa, Mycobacterium tuberculosis
RIMLMHAVRAWRSA

SEQ ID NO: 193789 - protein, 14 aa, Mycobacterium tuberculosis
IMLMHAVRAWRSAD

SEQ ID NO: 193790 - protein, 14 aa, Mycobacterium tuberculosis
MLMHAVRAWRSADD

SEQ ID NO: 193791 - protein, 14 aa, Mycobacterium tuberculosis
LMHAVRAWRSADDF

SEQ ID NO: 193792 - protein, 14 aa, Mycobacterium tuberculosis
MHAVRAWRSADDFP

SEQ ID NO: 193793 - protein, 14 aa, Mycobacterium tuberculosis
HAVRAWRSADDFPC

SEQ ID NO: 193794 - protein, 14 aa, Mycobacterium tuberculosis
AVRAWRSADDFPCT

SEQ ID NO: 193795 - protein, 14 aa, Mycobacterium tuberculosis
VRAWRSADDFPCTE

SEQ ID NO: 193796 - protein, 14 aa, Mycobacterium tuberculosis
RAWRSADDFPCTEH

SEQ ID NO: 193797 - protein, 14 aa, Mycobacterium tuberculosis
AWRSADDFPCTEHM

SEQ ID NO: 193798 - protein, 14 aa, Mycobacterium tuberculosis
WRSADDFPCTEHMA

SEQ ID NO: 193799 - protein, 14 aa, Mycobacterium tuberculosis
RSADDFPCTEHMAY

SEQ ID NO: 193800 - protein, 14 aa, Mycobacterium tuberculosis
SADDFPCTEHMAYK

SEQ ID NO: 193801 - protein, 14 aa, Mycobacterium tuberculosis
ADDFPCTEHMAYKI

SEQ ID NO: 193802 - protein, 14 aa, Mycobacterium tuberculosis
DDFPCTEHMAYKIA

SEQ ID NO: 193803 - protein, 14 aa, Mycobacterium tuberculosis
DFPCTEHMAYKIAQ

SEQ ID NO: 193804 - protein, 14 aa, Mycobacterium tuberculosis
FPCTEHMAYKIAQV

SEQ ID NO: 193805 - protein, 14 aa, Mycobacterium tuberculosis
PCTEHMAYKIAQVA

SEQ ID NO: 193806 - protein, 14 aa, Mycobacterium tuberculosis
CTEHMAYKIAQVAA

SEQ ID NO: 193807 - protein, 14 aa, Mycobacterium tuberculosis
TEHMAYKIAQVAAD

SEQ ID NO: 193808 - protein, 14 aa, Mycobacterium tuberculosis
EHMAYKIAQVAADP

SEQ ID NO: 193809 - protein, 14 aa, Mycobacterium tuberculosis
HMAYKIAQVAADPV

SEQ ID NO: 193810 - protein, 14 aa, Mycobacterium tuberculosis
MAYKIAQVAADPVD

SEQ ID NO: 193811 - protein, 14 aa, Mycobacterium tuberculosis
AYKIAQVAADPVDV

SEQ ID NO: 193812 - protein, 14 aa, Mycobacterium tuberculosis
YKIAQVAADPVDVD

SEQ ID NO: 193813 - protein, 14 aa, Mycobacterium tuberculosis
KIAQVAADPVDVDP

SEQ ID NO: 193814 - protein, 14 aa, Mycobacterium tuberculosis
IAQVAADPVDVDPE

SEQ ID NO: 193815 - protein, 14 aa, Mycobacterium tuberculosis
AQVAADPVDVDPEV

SEQ ID NO: 193816 - protein, 14 aa, Mycobacterium tuberculosis
QVAADPVDVDPEVA

SEQ ID NO: 193817 - protein, 14 aa, Mycobacterium tuberculosis
VAADPVDVDPEVAD

SEQ ID NO: 193818 - protein, 14 aa, Mycobacterium tuberculosis
AADPVDVDPEVADM

SEQ ID NO: 193819 - protein, 14 aa, Mycobacterium tuberculosis
ADPVDVDPEVADMV

SEQ ID NO: 193820 - protein, 14 aa, Mycobacterium tuberculosis
DPVDVDPEVADMVC

SEQ ID NO: 193821 - protein, 14 aa, Mycobacterium tuberculosis
PVDVDPEVADMVCN

SEQ ID NO: 193822 - protein, 14 aa, Mycobacterium tuberculosis
VDVDPEVADMVCNR

SEQ ID NO: 193823 - protein, 14 aa, Mycobacterium tuberculosis
DVDPEVADMVCNRI

SEQ ID NO: 193824 - protein, 14 aa, Mycobacterium tuberculosis
VDPEVADMVCNRII

SEQ ID NO: 193825 - protein, 14 aa, Mycobacterium tuberculosis
DPEVADMVCNRIID

SEQ ID NO: 193826 - protein, 14 aa, Mycobacterium tuberculosis
PEVADMVCNRIIDN

SEQ ID NO: 193827 - protein, 14 aa, Mycobacterium tuberculosis
EVADMVCNRIIDNA

SEQ ID NO: 193828 - protein, 14 aa, Mycobacterium tuberculosis
VADMVCNRIIDNAA

SEQ ID NO: 193829 - protein, 14 aa, Mycobacterium tuberculosis
ADMVCNRIIDNAAV

SEQ ID NO: 193830 - protein, 14 aa, Mycobacterium tuberculosis
DMVCNRIIDNAAVS

SEQ ID NO: 193831 - protein, 14 aa, Mycobacterium tuberculosis
MVCNRIIDNAAVSA

SEQ ID NO: 193832 - protein, 14 aa, Mycobacterium tuberculosis
VCNRIIDNAAVSAA

SEQ ID NO: 193833 - protein, 14 aa, Mycobacterium tuberculosis
CNRIIDNAAVSAAS

SEQ ID NO: 193834 - protein, 14 aa, Mycobacterium tuberculosis
NRIIDNAAVSAASM

SEQ ID NO: 193835 - protein, 14 aa, Mycobacterium tuberculosis
RIIDNAAVSAASMV

SEQ ID NO: 193836 - protein, 14 aa, Mycobacterium tuberculosis
IIDNAAVSAASMVR

SEQ ID NO: 193837 - protein, 14 aa, Mycobacterium tuberculosis
IDNAAVSAASMVRR

SEQ ID NO: 193838 - protein, 14 aa, Mycobacterium tuberculosis
DNAAVSAASMVRRP

SEQ ID NO: 193839 - protein, 14 aa, Mycobacterium tuberculosis
NAAVSAASMVRRPV

SEQ ID NO: 193840 - protein, 14 aa, Mycobacterium tuberculosis
AAVSAASMVRRPVT

SEQ ID NO: 193841 - protein, 14 aa, Mycobacterium tuberculosis
AVSAASMVRRPVTV

SEQ ID NO: 193842 - protein, 14 aa, Mycobacterium tuberculosis
VSAASMVRRPVTVA

SEQ ID NO: 193843 - protein, 14 aa, Mycobacterium tuberculosis
SAASMVRRPVTVAR

SEQ ID NO: 193844 - protein, 14 aa, Mycobacterium tuberculosis
AASMVRRPVTVARH

SEQ ID NO: 193845 - protein, 14 aa, Mycobacterium tuberculosis
ASMVRRPVTVARHQ

SEQ ID NO: 193846 - protein, 14 aa, Mycobacterium tuberculosis
SMVRRPVTVARHQA

SEQ ID NO: 193847 - protein, 14 aa, Mycobacterium tuberculosis
MVRRPVTVARHQAL

SEQ ID NO: 193848 - protein, 14 aa, Mycobacterium tuberculosis
VRRPVTVARHQALA

SEQ ID NO: 193849 - protein, 14 aa, Mycobacterium tuberculosis
RRPVTVARHQALAH

SEQ ID NO: 193850 - protein, 14 aa, Mycobacterium tuberculosis
RPVTVARHQALAHP

SEQ ID NO: 193851 - protein, 14 aa, Mycobacterium tuberculosis
PVTVARHQALAHPV

SEQ ID NO: 193852 - protein, 14 aa, Mycobacterium tuberculosis
VTVARHQALAHPVR

SEQ ID NO: 193853 - protein, 14 aa, Mycobacterium tuberculosis
TVARHQALAHPVRH

SEQ ID NO: 193854 - protein, 14 aa, Mycobacterium tuberculosis
VARHQALAHPVRHG

SEQ ID NO: 193855 - protein, 14 aa, Mycobacterium tuberculosis
ARHQALAHPVRHGA

SEQ ID NO: 193856 - protein, 14 aa, Mycobacterium tuberculosis
RHQALAHPVRHGAK

SEQ ID NO: 193857 - protein, 14 aa, Mycobacterium tuberculosis
HQALAHPVRHGAKV

SEQ ID NO: 193858 - protein, 14 aa, Mycobacterium tuberculosis
QALAHPVRHGAKVF

SEQ ID NO: 193859 - protein, 14 aa, Mycobacterium tuberculosis
ALAHPVRHGAKVFG

SEQ ID NO: 193860 - protein, 14 aa, Mycobacterium tuberculosis
LAHPVRHGAKVFGV

SEQ ID NO: 193861 - protein, 14 aa, Mycobacterium tuberculosis
AHPVRHGAKVFGVE

SEQ ID NO: 193862 - protein, 14 aa, Mycobacterium tuberculosis
HPVRHGAKVFGVEG

SEQ ID NO: 193863 - protein, 14 aa, Mycobacterium tuberculosis
PVRHGAKVFGVEGS

SEQ ID NO: 193864 - protein, 14 aa, Mycobacterium tuberculosis
VRHGAKVFGVEGSY

SEQ ID NO: 193865 - protein, 14 aa, Mycobacterium tuberculosis
RHGAKVFGVEGSYS

SEQ ID NO: 193866 - protein, 14 aa, Mycobacterium tuberculosis
HGAKVFGVEGSYSA

SEQ ID NO: 193867 - protein, 14 aa, Mycobacterium tuberculosis
GAKVFGVEGSYSAD

SEQ ID NO: 193868 - protein, 14 aa, Mycobacterium tuberculosis
AKVFGVEGSYSADW

SEQ ID NO: 193869 - protein, 14 aa, Mycobacterium tuberculosis
KVFGVEGSYSADWA

SEQ ID NO: 193870 - protein, 14 aa, Mycobacterium tuberculosis
VFGVEGSYSADWAA

SEQ ID NO: 193871 - protein, 14 aa, Mycobacterium tuberculosis
FGVEGSYSADWAAW

SEQ ID NO: 193872 - protein, 14 aa, Mycobacterium tuberculosis
GVEGSYSADWAAWA

SEQ ID NO: 193873 - protein, 14 aa, Mycobacterium tuberculosis
VEGSYSADWAAWAN

SEQ ID NO: 193874 - protein, 14 aa, Mycobacterium tuberculosis
EGSYSADWAAWANG

SEQ ID NO: 193875 - protein, 14 aa, Mycobacterium tuberculosis
GSYSADWAAWANGV

SEQ ID NO: 193876 - protein, 14 aa, Mycobacterium tuberculosis
SYSADWAAWANGVA

SEQ ID NO: 193877 - protein, 14 aa, Mycobacterium tuberculosis
YSADWAAWANGVAA

SEQ ID NO: 193878 - protein, 14 aa, Mycobacterium tuberculosis
SADWAAWANGVAAR

SEQ ID NO: 193879 - protein, 14 aa, Mycobacterium tuberculosis
ADWAAWANGVAARE

SEQ ID NO: 193880 - protein, 14 aa, Mycobacterium tuberculosis
DWAAWANGVAAREL

SEQ ID NO: 193881 - protein, 14 aa, Mycobacterium tuberculosis
WAAWANGVAARELD

SEQ ID NO: 193882 - protein, 14 aa, Mycobacterium tuberculosis
AAWANGVAARELDF

SEQ ID NO: 193883 - protein, 14 aa, Mycobacterium tuberculosis
AWANGVAARELDFH

SEQ ID NO: 193884 - protein, 14 aa, Mycobacterium tuberculosis
WANGVAARELDFHD

SEQ ID NO: 193885 - protein, 14 aa, Mycobacterium tuberculosis
ANGVAARELDFHDT

SEQ ID NO: 193886 - protein, 14 aa, Mycobacterium tuberculosis
NGVAARELDFHDTF

SEQ ID NO: 193887 - protein, 14 aa, Mycobacterium tuberculosis
GVAARELDFHDTFL

SEQ ID NO: 193888 - protein, 14 aa, Mycobacterium tuberculosis
VAARELDFHDTFLA

SEQ ID NO: 193889 - protein, 14 aa, Mycobacterium tuberculosis
AARELDFHDTFLAA

SEQ ID NO: 193890 - protein, 14 aa, Mycobacterium tuberculosis
ARELDFHDTFLAAD

SEQ ID NO: 193891 - protein, 14 aa, Mycobacterium tuberculosis
RELDFHDTFLAADY

SEQ ID NO: 193892 - protein, 14 aa, Mycobacterium tuberculosis
ELDFHDTFLAADYS

SEQ ID NO: 193893 - protein, 14 aa, Mycobacterium tuberculosis
LDFHDTFLAADYSH

SEQ ID NO: 193894 - protein, 14 aa, Mycobacterium tuberculosis
DFHDTFLAADYSHP

SEQ ID NO: 193895 - protein, 14 aa, Mycobacterium tuberculosis
FHDTFLAADYSHPA

SEQ ID NO: 193896 - protein, 14 aa, Mycobacterium tuberculosis
HDTFLAADYSHPAD

SEQ ID NO: 193897 - protein, 14 aa, Mycobacterium tuberculosis
DTFLAADYSHPADN

SEQ ID NO: 193898 - protein, 14 aa, Mycobacterium tuberculosis
TFLAADYSHPADNI

SEQ ID NO: 193899 - protein, 14 aa, Mycobacterium tuberculosis
FLAADYSHPADNIP

SEQ ID NO: 193900 - protein, 14 aa, Mycobacterium tuberculosis
LAADYSHPADNIPP

SEQ ID NO: 193901 - protein, 14 aa, Mycobacterium tuberculosis
AADYSHPADNIPPL

SEQ ID NO: 193902 - protein, 14 aa, Mycobacterium tuberculosis
ADYSHPADNIPPLV

SEQ ID NO: 193903 - protein, 14 aa, Mycobacterium tuberculosis
DYSHPADNIPPLVA

SEQ ID NO: 193904 - protein, 14 aa, Mycobacterium tuberculosis
YSHPADNIPPLVAV

SEQ ID NO: 193905 - protein, 14 aa, Mycobacterium tuberculosis
SHPADNIPPLVAVA

SEQ ID NO: 193906 - protein, 14 aa, Mycobacterium tuberculosis
HPADNIPPLVAVAQ

SEQ ID NO: 193907 - protein, 14 aa, Mycobacterium tuberculosis
PADNIPPLVAVAQQ

SEQ ID NO: 193908 - protein, 14 aa, Mycobacterium tuberculosis
ADNIPPLVAVAQQL

SEQ ID NO: 193909 - protein, 14 aa, Mycobacterium tuberculosis
DNIPPLVAVAQQLG

SEQ ID NO: 193910 - protein, 14 aa, Mycobacterium tuberculosis
NIPPLVAVAQQLGV

SEQ ID NO: 193911 - protein, 14 aa, Mycobacterium tuberculosis
IPPLVAVAQQLGVC

SEQ ID NO: 193912 - protein, 14 aa, Mycobacterium tuberculosis
PPLVAVAQQLGVCG

SEQ ID NO: 193913 - protein, 14 aa, Mycobacterium tuberculosis
PLVAVAQQLGVCGA

SEQ ID NO: 193914 - protein, 14 aa, Mycobacterium tuberculosis
LVAVAQQLGVCGAE

SEQ ID NO: 193915 - protein, 14 aa, Mycobacterium tuberculosis
VAVAQQLGVCGAEL

SEQ ID NO: 193916 - protein, 14 aa, Mycobacterium tuberculosis
AVAQQLGVCGAELI

SEQ ID NO: 193917 - protein, 14 aa, Mycobacterium tuberculosis
VAQQLGVCGAELIR

SEQ ID NO: 193918 - protein, 14 aa, Mycobacterium tuberculosis
AQQLGVCGAELIRG

SEQ ID NO: 193919 - protein, 14 aa, Mycobacterium tuberculosis
QQLGVCGAELIRGL

SEQ ID NO: 193920 - protein, 14 aa, Mycobacterium tuberculosis
QLGVCGAELIRGLV

SEQ ID NO: 193921 - protein, 14 aa, Mycobacterium tuberculosis
LGVCGAELIRGLVT

SEQ ID NO: 193922 - protein, 14 aa, Mycobacterium tuberculosis
GVCGAELIRGLVTA

SEQ ID NO: 193923 - protein, 14 aa, Mycobacterium tuberculosis
VCGAELIRGLVTAY

SEQ ID NO: 193924 - protein, 14 aa, Mycobacterium tuberculosis
CGAELIRGLVTAYE

SEQ ID NO: 193925 - protein, 14 aa, Mycobacterium tuberculosis
GAELIRGLVTAYEI

SEQ ID NO: 193926 - protein, 14 aa, Mycobacterium tuberculosis
AELIRGLVTAYEIH

SEQ ID NO: 193927 - protein, 14 aa, Mycobacterium tuberculosis
ELIRGLVTAYEIHI

SEQ ID NO: 193928 - protein, 14 aa, Mycobacterium tuberculosis
LIRGLVTAYEIHID

SEQ ID NO: 193929 - protein, 14 aa, Mycobacterium tuberculosis
IRGLVTAYEIHIDL

SEQ ID NO: 193930 - protein, 14 aa, Mycobacterium tuberculosis
RGLVTAYEIHIDLT

SEQ ID NO: 193931 - protein, 14 aa, Mycobacterium tuberculosis
GLVTAYEIHIDLTR

SEQ ID NO: 193932 - protein, 14 aa, Mycobacterium tuberculosis
LVTAYEIHIDLTRG

SEQ ID NO: 193933 - protein, 14 aa, Mycobacterium tuberculosis
VTAYEIHIDLTRGI

SEQ ID NO: 193934 - protein, 14 aa, Mycobacterium tuberculosis
TAYEIHIDLTRGIC

SEQ ID NO: 193935 - protein, 14 aa, Mycobacterium tuberculosis
AYEIHIDLTRGICL

SEQ ID NO: 193936 - protein, 14 aa, Mycobacterium tuberculosis
YEIHIDLTRGICLH

SEQ ID NO: 193937 - protein, 14 aa, Mycobacterium tuberculosis
EIHIDLTRGICLHE

SEQ ID NO: 193938 - protein, 14 aa, Mycobacterium tuberculosis
IHIDLTRGICLHEH

SEQ ID NO: 193939 - protein, 14 aa, Mycobacterium tuberculosis
HIDLTRGICLHEHK

SEQ ID NO: 193940 - protein, 14 aa, Mycobacterium tuberculosis
IDLTRGICLHEHKI

SEQ ID NO: 193941 - protein, 14 aa, Mycobacterium tuberculosis
DLTRGICLHEHKID

SEQ ID NO: 193942 - protein, 14 aa, Mycobacterium tuberculosis
LTRGICLHEHKIDH

SEQ ID NO: 193943 - protein, 14 aa, Mycobacterium tuberculosis
TRGICLHEHKIDHV

SEQ ID NO: 193944 - protein, 14 aa, Mycobacterium tuberculosis
RGICLHEHKIDHVA

SEQ ID NO: 193945 - protein, 14 aa, Mycobacterium tuberculosis
GICLHEHKIDHVAH

SEQ ID NO: 193946 - protein, 14 aa, Mycobacterium tuberculosis
ICLHEHKIDHVAHL

SEQ ID NO: 193947 - protein, 14 aa, Mycobacterium tuberculosis
CLHEHKIDHVAHLG

SEQ ID NO: 193948 - protein, 14 aa, Mycobacterium tuberculosis
LHEHKIDHVAHLGP

SEQ ID NO: 193949 - protein, 14 aa, Mycobacterium tuberculosis
HEHKIDHVAHLGPA

SEQ ID NO: 193950 - protein, 14 aa, Mycobacterium tuberculosis
EHKIDHVAHLGPAV

SEQ ID NO: 193951 - protein, 14 aa, Mycobacterium tuberculosis
HKIDHVAHLGPAVA

SEQ ID NO: 193952 - protein, 14 aa, Mycobacterium tuberculosis
KIDHVAHLGPAVAA

SEQ ID NO: 193953 - protein, 14 aa, Mycobacterium tuberculosis
IDHVAHLGPAVAAG

SEQ ID NO: 193954 - protein, 14 aa, Mycobacterium tuberculosis
DHVAHLGPAVAAGI

SEQ ID NO: 193955 - protein, 14 aa, Mycobacterium tuberculosis
HVAHLGPAVAAGIG

SEQ ID NO: 193956 - protein, 14 aa, Mycobacterium tuberculosis
VAHLGPAVAAGIGT

SEQ ID NO: 193957 - protein, 14 aa, Mycobacterium tuberculosis
AHLGPAVAAGIGTM

SEQ ID NO: 193958 - protein, 14 aa, Mycobacterium tuberculosis
HLGPAVAAGIGTML

SEQ ID NO: 193959 - protein, 14 aa, Mycobacterium tuberculosis
LGPAVAAGIGTMLR

SEQ ID NO: 193960 - protein, 14 aa, Mycobacterium tuberculosis
GPAVAAGIGTMLRL

SEQ ID NO: 193961 - protein, 14 aa, Mycobacterium tuberculosis
PAVAAGIGTMLRLD

SEQ ID NO: 193962 - protein, 14 aa, Mycobacterium tuberculosis
AVAAGIGTMLRLDQ

SEQ ID NO: 193963 - protein, 14 aa, Mycobacterium tuberculosis
VAAGIGTMLRLDQE

SEQ ID NO: 193964 - protein, 14 aa, Mycobacterium tuberculosis
AAGIGTMLRLDQET

SEQ ID NO: 193965 - protein, 14 aa, Mycobacterium tuberculosis
AGIGTMLRLDQETI

SEQ ID NO: 193966 - protein, 14 aa, Mycobacterium tuberculosis
GIGTMLRLDQETIY

SEQ ID NO: 193967 - protein, 14 aa, Mycobacterium tuberculosis
IGTMLRLDQETIYH

SEQ ID NO: 193968 - protein, 14 aa, Mycobacterium tuberculosis
GTMLRLDQETIYHA

SEQ ID NO: 193969 - protein, 14 aa, Mycobacterium tuberculosis
TMLRLDQETIYHAI

SEQ ID NO: 193970 - protein, 14 aa, Mycobacterium tuberculosis
MLRLDQETIYHAIG

SEQ ID NO: 193971 - protein, 14 aa, Mycobacterium tuberculosis
LRLDQETIYHAIGQ

SEQ ID NO: 193972 - protein, 14 aa, Mycobacterium tuberculosis
RLDQETIYHAIGQA

SEQ ID NO: 193973 - protein, 14 aa, Mycobacterium tuberculosis
LDQETIYHAIGQAL

SEQ ID NO: 193974 - protein, 14 aa, Mycobacterium tuberculosis
DQETIYHAIGQALH

SEQ ID NO: 193975 - protein, 14 aa, Mycobacterium tuberculosis
QETIYHAIGQALHL

SEQ ID NO: 193976 - protein, 14 aa, Mycobacterium tuberculosis
ETIYHAIGQALHLT

SEQ ID NO: 193977 - protein, 14 aa, Mycobacterium tuberculosis
TIYHAIGQALHLTT

SEQ ID NO: 193978 - protein, 14 aa, Mycobacterium tuberculosis
IYHAIGQALHLTTS

SEQ ID NO: 193979 - protein, 14 aa, Mycobacterium tuberculosis
YHAIGQALHLTTST

SEQ ID NO: 193980 - protein, 14 aa, Mycobacterium tuberculosis
HAIGQALHLTTSTR

SEQ ID NO: 193981 - protein, 14 aa, Mycobacterium tuberculosis
AIGQALHLTTSTRQ

SEQ ID NO: 193982 - protein, 14 aa, Mycobacterium tuberculosis
IGQALHLTTSTRQS

SEQ ID NO: 193983 - protein, 14 aa, Mycobacterium tuberculosis
GQALHLTTSTRQSR

SEQ ID NO: 193984 - protein, 14 aa, Mycobacterium tuberculosis
QALHLTTSTRQSRK

SEQ ID NO: 193985 - protein, 14 aa, Mycobacterium tuberculosis
ALHLTTSTRQSRKG

SEQ ID NO: 193986 - protein, 14 aa, Mycobacterium tuberculosis
LHLTTSTRQSRKGA

SEQ ID NO: 193987 - protein, 14 aa, Mycobacterium tuberculosis
HLTTSTRQSRKGAI

SEQ ID NO: 193988 - protein, 14 aa, Mycobacterium tuberculosis
LTTSTRQSRKGAIS

SEQ ID NO: 193989 - protein, 14 aa, Mycobacterium tuberculosis
TTSTRQSRKGAISS

SEQ ID NO: 193990 - protein, 14 aa, Mycobacterium tuberculosis
TSTRQSRKGAISSW

SEQ ID NO: 193991 - protein, 14 aa, Mycobacterium tuberculosis
STRQSRKGAISSWK

SEQ ID NO: 193992 - protein, 14 aa, Mycobacterium tuberculosis
TRQSRKGAISSWKA

SEQ ID NO: 193993 - protein, 14 aa, Mycobacterium tuberculosis
RQSRKGAISSWKAF

SEQ ID NO: 193994 - protein, 14 aa, Mycobacterium tuberculosis
QSRKGAISSWKAFA

SEQ ID NO: 193995 - protein, 14 aa, Mycobacterium tuberculosis
SRKGAISSWKAFAP

SEQ ID NO: 193996 - protein, 14 aa, Mycobacterium tuberculosis
RKGAISSWKAFAPA

SEQ ID NO: 193997 - protein, 14 aa, Mycobacterium tuberculosis
KGAISSWKAFAPAH

SEQ ID NO: 193998 - protein, 14 aa, Mycobacterium tuberculosis
GAISSWKAFAPAHA

SEQ ID NO: 193999 - protein, 14 aa, Mycobacterium tuberculosis
AISSWKAFAPAHAG

SEQ ID NO: 194000 - protein, 14 aa, Mycobacterium tuberculosis
ISSWKAFAPAHAGK

SEQ ID NO: 194001 - protein, 14 aa, Mycobacterium tuberculosis
SSWKAFAPAHAGKV

SEQ ID NO: 194002 - protein, 14 aa, Mycobacterium tuberculosis
SWKAFAPAHAGKVG

SEQ ID NO: 194003 - protein, 14 aa, Mycobacterium tuberculosis
WKAFAPAHAGKVGI

SEQ ID NO: 194004 - protein, 14 aa, Mycobacterium tuberculosis
KAFAPAHAGKVGIE

SEQ ID NO: 194005 - protein, 14 aa, Mycobacterium tuberculosis
AFAPAHAGKVGIEA

SEQ ID NO: 194006 - protein, 14 aa, Mycobacterium tuberculosis
FAPAHAGKVGIEAV

SEQ ID NO: 194007 - protein, 14 aa, Mycobacterium tuberculosis
APAHAGKVGIEAVD

SEQ ID NO: 194008 - protein, 14 aa, Mycobacterium tuberculosis
PAHAGKVGIEAVDR

SEQ ID NO: 194009 - protein, 14 aa, Mycobacterium tuberculosis
AHAGKVGIEAVDRA

SEQ ID NO: 194010 - protein, 14 aa, Mycobacterium tuberculosis
HAGKVGIEAVDRAM

SEQ ID NO: 194011 - protein, 14 aa, Mycobacterium tuberculosis
AGKVGIEAVDRAMR

SEQ ID NO: 194012 - protein, 14 aa, Mycobacterium tuberculosis
GKVGIEAVDRAMRG

SEQ ID NO: 194013 - protein, 14 aa, Mycobacterium tuberculosis
KVGIEAVDRAMRGE

SEQ ID NO: 194014 - protein, 14 aa, Mycobacterium tuberculosis
VGIEAVDRAMRGEG

SEQ ID NO: 194015 - protein, 14 aa, Mycobacterium tuberculosis
GIEAVDRAMRGEGS

SEQ ID NO: 194016 - protein, 14 aa, Mycobacterium tuberculosis
IEAVDRAMRGEGSP

SEQ ID NO: 194017 - protein, 14 aa, Mycobacterium tuberculosis
EAVDRAMRGEGSPA

SEQ ID NO: 194018 - protein, 14 aa, Mycobacterium tuberculosis
AVDRAMRGEGSPAP

SEQ ID NO: 194019 - protein, 14 aa, Mycobacterium tuberculosis
VDRAMRGEGSPAPI

SEQ ID NO: 194020 - protein, 14 aa, Mycobacterium tuberculosis
DRAMRGEGSPAPIW

SEQ ID NO: 194021 - protein, 14 aa, Mycobacterium tuberculosis
RAMRGEGSPAPIWE

SEQ ID NO: 194022 - protein, 14 aa, Mycobacterium tuberculosis
AMRGEGSPAPIWEG

SEQ ID NO: 194023 - protein, 14 aa, Mycobacterium tuberculosis
MRGEGSPAPIWEGE

SEQ ID NO: 194024 - protein, 14 aa, Mycobacterium tuberculosis
RGEGSPAPIWEGED

SEQ ID NO: 194025 - protein, 14 aa, Mycobacterium tuberculosis
GEGSPAPIWEGEDG

SEQ ID NO: 194026 - protein, 14 aa, Mycobacterium tuberculosis
EGSPAPIWEGEDGV

SEQ ID NO: 194027 - protein, 14 aa, Mycobacterium tuberculosis
GSPAPIWEGEDGVI

SEQ ID NO: 194028 - protein, 14 aa, Mycobacterium tuberculosis
SPAPIWEGEDGVIA

SEQ ID NO: 194029 - protein, 14 aa, Mycobacterium tuberculosis
PAPIWEGEDGVIAW

SEQ ID NO: 194030 - protein, 14 aa, Mycobacterium tuberculosis
APIWEGEDGVIAWL

SEQ ID NO: 194031 - protein, 14 aa, Mycobacterium tuberculosis
PIWEGEDGVIAWLL

SEQ ID NO: 194032 - protein, 14 aa, Mycobacterium tuberculosis
IWEGEDGVIAWLLA

SEQ ID NO: 194033 - protein, 14 aa, Mycobacterium tuberculosis
WEGEDGVIAWLLAG

SEQ ID NO: 194034 - protein, 14 aa, Mycobacterium tuberculosis
EGEDGVIAWLLAGP

SEQ ID NO: 194035 - protein, 14 aa, Mycobacterium tuberculosis
GEDGVIAWLLAGPE

SEQ ID NO: 194036 - protein, 14 aa, Mycobacterium tuberculosis
EDGVIAWLLAGPEH

SEQ ID NO: 194037 - protein, 14 aa, Mycobacterium tuberculosis
DGVIAWLLAGPEHT

SEQ ID NO: 194038 - protein, 14 aa, Mycobacterium tuberculosis
GVIAWLLAGPEHTY

SEQ ID NO: 194039 - protein, 14 aa, Mycobacterium tuberculosis
VIAWLLAGPEHTYR

SEQ ID NO: 194040 - protein, 14 aa, Mycobacterium tuberculosis
IAWLLAGPEHTYRV

SEQ ID NO: 194041 - protein, 14 aa, Mycobacterium tuberculosis
AWLLAGPEHTYRVP

SEQ ID NO: 194042 - protein, 14 aa, Mycobacterium tuberculosis
WLLAGPEHTYRVPL

SEQ ID NO: 194043 - protein, 14 aa, Mycobacterium tuberculosis
LLAGPEHTYRVPLP

SEQ ID NO: 194044 - protein, 14 aa, Mycobacterium tuberculosis
LAGPEHTYRVPLPA

SEQ ID NO: 194045 - protein, 14 aa, Mycobacterium tuberculosis
AGPEHTYRVPLPAP

SEQ ID NO: 194046 - protein, 14 aa, Mycobacterium tuberculosis
GPEHTYRVPLPAPG

SEQ ID NO: 194047 - protein, 14 aa, Mycobacterium tuberculosis
PEHTYRVPLPAPGE

SEQ ID NO: 194048 - protein, 14 aa, Mycobacterium tuberculosis
EHTYRVPLPAPGEP

SEQ ID NO: 194049 - protein, 14 aa, Mycobacterium tuberculosis
HTYRVPLPAPGEPK

SEQ ID NO: 194050 - protein, 14 aa, Mycobacterium tuberculosis
TYRVPLPAPGEPKR

SEQ ID NO: 194051 - protein, 14 aa, Mycobacterium tuberculosis
YRVPLPAPGEPKRA

SEQ ID NO: 194052 - protein, 14 aa, Mycobacterium tuberculosis
RVPLPAPGEPKRAI

SEQ ID NO: 194053 - protein, 14 aa, Mycobacterium tuberculosis
VPLPAPGEPKRAIL

SEQ ID NO: 194054 - protein, 14 aa, Mycobacterium tuberculosis
PLPAPGEPKRAILD

SEQ ID NO: 194055 - protein, 14 aa, Mycobacterium tuberculosis
LPAPGEPKRAILDS

SEQ ID NO: 194056 - protein, 14 aa, Mycobacterium tuberculosis
PAPGEPKRAILDSY

SEQ ID NO: 194057 - protein, 14 aa, Mycobacterium tuberculosis
APGEPKRAILDSYT

SEQ ID NO: 194058 - protein, 14 aa, Mycobacterium tuberculosis
PGEPKRAILDSYTK

SEQ ID NO: 194059 - protein, 14 aa, Mycobacterium tuberculosis
GEPKRAILDSYTKQ

SEQ ID NO: 194060 - protein, 14 aa, Mycobacterium tuberculosis
EPKRAILDSYTKQH

SEQ ID NO: 194061 - protein, 14 aa, Mycobacterium tuberculosis
PKRAILDSYTKQHS

SEQ ID NO: 194062 - protein, 14 aa, Mycobacterium tuberculosis
KRAILDSYTKQHSA

SEQ ID NO: 194063 - protein, 14 aa, Mycobacterium tuberculosis
RAILDSYTKQHSAE

SEQ ID NO: 194064 - protein, 14 aa, Mycobacterium tuberculosis
AILDSYTKQHSAEY

SEQ ID NO: 194065 - protein, 14 aa, Mycobacterium tuberculosis
ILDSYTKQHSAEYQ

SEQ ID NO: 194066 - protein, 14 aa, Mycobacterium tuberculosis
LDSYTKQHSAEYQS

SEQ ID NO: 194067 - protein, 14 aa, Mycobacterium tuberculosis
DSYTKQHSAEYQSQ

SEQ ID NO: 194068 - protein, 14 aa, Mycobacterium tuberculosis
SYTKQHSAEYQSQA

SEQ ID NO: 194069 - protein, 14 aa, Mycobacterium tuberculosis
YTKQHSAEYQSQAP

SEQ ID NO: 194070 - protein, 14 aa, Mycobacterium tuberculosis
TKQHSAEYQSQAPI

SEQ ID NO: 194071 - protein, 14 aa, Mycobacterium tuberculosis
KQHSAEYQSQAPID

SEQ ID NO: 194072 - protein, 14 aa, Mycobacterium tuberculosis
QHSAEYQSQAPIDL

SEQ ID NO: 194073 - protein, 14 aa, Mycobacterium tuberculosis
HSAEYQSQAPIDLA

SEQ ID NO: 194074 - protein, 14 aa, Mycobacterium tuberculosis
SAEYQSQAPIDLAC

SEQ ID NO: 194075 - protein, 14 aa, Mycobacterium tuberculosis
AEYQSQAPIDLACR

SEQ ID NO: 194076 - protein, 14 aa, Mycobacterium tuberculosis
EYQSQAPIDLACRL

SEQ ID NO: 194077 - protein, 14 aa, Mycobacterium tuberculosis
YQSQAPIDLACRLR

SEQ ID NO: 194078 - protein, 14 aa, Mycobacterium tuberculosis
QSQAPIDLACRLRE

SEQ ID NO: 194079 - protein, 14 aa, Mycobacterium tuberculosis
SQAPIDLACRLRER

SEQ ID NO: 194080 - protein, 14 aa, Mycobacterium tuberculosis
QAPIDLACRLRERI

SEQ ID NO: 194081 - protein, 14 aa, Mycobacterium tuberculosis
APIDLACRLRERIG

SEQ ID NO: 194082 - protein, 14 aa, Mycobacterium tuberculosis
PIDLACRLRERIGD

SEQ ID NO: 194083 - protein, 14 aa, Mycobacterium tuberculosis
IDLACRLRERIGDL

SEQ ID NO: 194084 - protein, 14 aa, Mycobacterium tuberculosis
DLACRLRERIGDLD

SEQ ID NO: 194085 - protein, 14 aa, Mycobacterium tuberculosis
LACRLRERIGDLDQ

SEQ ID NO: 194086 - protein, 14 aa, Mycobacterium tuberculosis
ACRLRERIGDLDQI

SEQ ID NO: 194087 - protein, 14 aa, Mycobacterium tuberculosis
CRLRERIGDLDQIA

SEQ ID NO: 194088 - protein, 14 aa, Mycobacterium tuberculosis
RLRERIGDLDQIAS

SEQ ID NO: 194089 - protein, 14 aa, Mycobacterium tuberculosis
LRERIGDLDQIASI

SEQ ID NO: 194090 - protein, 14 aa, Mycobacterium tuberculosis
RERIGDLDQIASIV

SEQ ID NO: 194091 - protein, 14 aa, Mycobacterium tuberculosis
ERIGDLDQIASIVL

SEQ ID NO: 194092 - protein, 14 aa, Mycobacterium tuberculosis
RIGDLDQIASIVLH

SEQ ID NO: 194093 - protein, 14 aa, Mycobacterium tuberculosis
IGDLDQIASIVLHT

SEQ ID NO: 194094 - protein, 14 aa, Mycobacterium tuberculosis
GDLDQIASIVLHTS

SEQ ID NO: 194095 - protein, 14 aa, Mycobacterium tuberculosis
DLDQIASIVLHTSH

SEQ ID NO: 194096 - protein, 14 aa, Mycobacterium tuberculosis
LDQIASIVLHTSHH

SEQ ID NO: 194097 - protein, 14 aa, Mycobacterium tuberculosis
DQIASIVLHTSHHT

SEQ ID NO: 194098 - protein, 14 aa, Mycobacterium tuberculosis
QIASIVLHTSHHTH

SEQ ID NO: 194099 - protein, 14 aa, Mycobacterium tuberculosis
IASIVLHTSHHTHV

SEQ ID NO: 194100 - protein, 14 aa, Mycobacterium tuberculosis
ASIVLHTSHHTHVV

SEQ ID NO: 194101 - protein, 14 aa, Mycobacterium tuberculosis
SIVLHTSHHTHVVI

SEQ ID NO: 194102 - protein, 14 aa, Mycobacterium tuberculosis
IVLHTSHHTHVVIG

SEQ ID NO: 194103 - protein, 14 aa, Mycobacterium tuberculosis
VLHTSHHTHVVIGT

SEQ ID NO: 194104 - protein, 14 aa, Mycobacterium tuberculosis
LHTSHHTHVVIGTG

SEQ ID NO: 194105 - protein, 14 aa, Mycobacterium tuberculosis
HTSHHTHVVIGTGS

SEQ ID NO: 194106 - protein, 14 aa, Mycobacterium tuberculosis
TSHHTHVVIGTGSG

SEQ ID NO: 194107 - protein, 14 aa, Mycobacterium tuberculosis
SHHTHVVIGTGSGD

SEQ ID NO: 194108 - protein, 14 aa, Mycobacterium tuberculosis
HHTHVVIGTGSGDP

SEQ ID NO: 194109 - protein, 14 aa, Mycobacterium tuberculosis
HTHVVIGTGSGDPQ

SEQ ID NO: 194110 - protein, 14 aa, Mycobacterium tuberculosis
THVVIGTGSGDPQK

SEQ ID NO: 194111 - protein, 14 aa, Mycobacterium tuberculosis
HVVIGTGSGDPQKF

SEQ ID NO: 194112 - protein, 14 aa, Mycobacterium tuberculosis
VVIGTGSGDPQKFD

SEQ ID NO: 194113 - protein, 14 aa, Mycobacterium tuberculosis
VIGTGSGDPQKFDP

SEQ ID NO: 194114 - protein, 14 aa, Mycobacterium tuberculosis
IGTGSGDPQKFDPD

SEQ ID NO: 194115 - protein, 14 aa, Mycobacterium tuberculosis
GTGSGDPQKFDPDA

SEQ ID NO: 194116 - protein, 14 aa, Mycobacterium tuberculosis
TGSGDPQKFDPDAS

SEQ ID NO: 194117 - protein, 14 aa, Mycobacterium tuberculosis
GSGDPQKFDPDASR

SEQ ID NO: 194118 - protein, 14 aa, Mycobacterium tuberculosis
SGDPQKFDPDASRE

SEQ ID NO: 194119 - protein, 14 aa, Mycobacterium tuberculosis
GDPQKFDPDASRET

SEQ ID NO: 194120 - protein, 14 aa, Mycobacterium tuberculosis
DPQKFDPDASRETL

SEQ ID NO: 194121 - protein, 14 aa, Mycobacterium tuberculosis
PQKFDPDASRETLD

SEQ ID NO: 194122 - protein, 14 aa, Mycobacterium tuberculosis
QKFDPDASRETLDH

SEQ ID NO: 194123 - protein, 14 aa, Mycobacterium tuberculosis
KFDPDASRETLDHS

SEQ ID NO: 194124 - protein, 14 aa, Mycobacterium tuberculosis
FDPDASRETLDHSL

SEQ ID NO: 194125 - protein, 14 aa, Mycobacterium tuberculosis
DPDASRETLDHSLP

SEQ ID NO: 194126 - protein, 14 aa, Mycobacterium tuberculosis
PDASRETLDHSLPY

SEQ ID NO: 194127 - protein, 14 aa, Mycobacterium tuberculosis
DASRETLDHSLPYI

SEQ ID NO: 194128 - protein, 14 aa, Mycobacterium tuberculosis
ASRETLDHSLPYIF

SEQ ID NO: 194129 - protein, 14 aa, Mycobacterium tuberculosis
SRETLDHSLPYIFA

SEQ ID NO: 194130 - protein, 14 aa, Mycobacterium tuberculosis
RETLDHSLPYIFAV

SEQ ID NO: 194131 - protein, 14 aa, Mycobacterium tuberculosis
ETLDHSLPYIFAVA

SEQ ID NO: 194132 - protein, 14 aa, Mycobacterium tuberculosis
TLDHSLPYIFAVAL

SEQ ID NO: 194133 - protein, 14 aa, Mycobacterium tuberculosis
LDHSLPYIFAVALQ

SEQ ID NO: 194134 - protein, 14 aa, Mycobacterium tuberculosis
DHSLPYIFAVALQD

SEQ ID NO: 194135 - protein, 14 aa, Mycobacterium tuberculosis
HSLPYIFAVALQDG

SEQ ID NO: 194136 - protein, 14 aa, Mycobacterium tuberculosis
SLPYIFAVALQDGC

SEQ ID NO: 194137 - protein, 14 aa, Mycobacterium tuberculosis
LPYIFAVALQDGCW

SEQ ID NO: 194138 - protein, 14 aa, Mycobacterium tuberculosis
PYIFAVALQDGCWH

SEQ ID NO: 194139 - protein, 14 aa, Mycobacterium tuberculosis
YIFAVALQDGCWHH

SEQ ID NO: 194140 - protein, 14 aa, Mycobacterium tuberculosis
IFAVALQDGCWHHE

SEQ ID NO: 194141 - protein, 14 aa, Mycobacterium tuberculosis
FAVALQDGCWHHER

SEQ ID NO: 194142 - protein, 14 aa, Mycobacterium tuberculosis
AVALQDGCWHHERS

SEQ ID NO: 194143 - protein, 14 aa, Mycobacterium tuberculosis
VALQDGCWHHERSY

SEQ ID NO: 194144 - protein, 14 aa, Mycobacterium tuberculosis
ALQDGCWHHERSYA

SEQ ID NO: 194145 - protein, 14 aa, Mycobacterium tuberculosis
LQDGCWHHERSYAP

SEQ ID NO: 194146 - protein, 14 aa, Mycobacterium tuberculosis
QDGCWHHERSYAPE

SEQ ID NO: 194147 - protein, 14 aa, Mycobacterium tuberculosis
DGCWHHERSYAPER

SEQ ID NO: 194148 - protein, 14 aa, Mycobacterium tuberculosis
GCWHHERSYAPERA

SEQ ID NO: 194149 - protein, 14 aa, Mycobacterium tuberculosis
CWHHERSYAPERAR

SEQ ID NO: 194150 - protein, 14 aa, Mycobacterium tuberculosis
WHHERSYAPERARR

SEQ ID NO: 194151 - protein, 14 aa, Mycobacterium tuberculosis
HHERSYAPERARRS

SEQ ID NO: 194152 - protein, 14 aa, Mycobacterium tuberculosis
HERSYAPERARRSD

SEQ ID NO: 194153 - protein, 14 aa, Mycobacterium tuberculosis
ERSYAPERARRSDT

SEQ ID NO: 194154 - protein, 14 aa, Mycobacterium tuberculosis
RSYAPERARRSDTV

SEQ ID NO: 194155 - protein, 14 aa, Mycobacterium tuberculosis
SYAPERARRSDTVA

SEQ ID NO: 194156 - protein, 14 aa, Mycobacterium tuberculosis
YAPERARRSDTVAL

SEQ ID NO: 194157 - protein, 14 aa, Mycobacterium tuberculosis
APERARRSDTVALW

SEQ ID NO: 194158 - protein, 14 aa, Mycobacterium tuberculosis
PERARRSDTVALWH

SEQ ID NO: 194159 - protein, 14 aa, Mycobacterium tuberculosis
ERARRSDTVALWHK

SEQ ID NO: 194160 - protein, 14 aa, Mycobacterium tuberculosis
RARRSDTVALWHKI

SEQ ID NO: 194161 - protein, 14 aa, Mycobacterium tuberculosis
ARRSDTVALWHKIS

SEQ ID NO: 194162 - protein, 14 aa, Mycobacterium tuberculosis
RRSDTVALWHKIST

SEQ ID NO: 194163 - protein, 14 aa, Mycobacterium tuberculosis
RSDTVALWHKISTV

SEQ ID NO: 194164 - protein, 14 aa, Mycobacterium tuberculosis
SDTVALWHKISTVE

SEQ ID NO: 194165 - protein, 14 aa, Mycobacterium tuberculosis
DTVALWHKISTVED

SEQ ID NO: 194166 - protein, 14 aa, Mycobacterium tuberculosis
TVALWHKISTVEDP

SEQ ID NO: 194167 - protein, 14 aa, Mycobacterium tuberculosis
VALWHKISTVEDPE

SEQ ID NO: 194168 - protein, 14 aa, Mycobacterium tuberculosis
ALWHKISTVEDPEW

SEQ ID NO: 194169 - protein, 14 aa, Mycobacterium tuberculosis
LWHKISTVEDPEWT

SEQ ID NO: 194170 - protein, 14 aa, Mycobacterium tuberculosis
WHKISTVEDPEWTR

SEQ ID NO: 194171 - protein, 14 aa, Mycobacterium tuberculosis
HKISTVEDPEWTRR

SEQ ID NO: 194172 - protein, 14 aa, Mycobacterium tuberculosis
KISTVEDPEWTRRY

SEQ ID NO: 194173 - protein, 14 aa, Mycobacterium tuberculosis
ISTVEDPEWTRRYH

SEQ ID NO: 194174 - protein, 14 aa, Mycobacterium tuberculosis
STVEDPEWTRRYHC

SEQ ID NO: 194175 - protein, 14 aa, Mycobacterium tuberculosis
TVEDPEWTRRYHCA

SEQ ID NO: 194176 - protein, 14 aa, Mycobacterium tuberculosis
VEDPEWTRRYHCAD

SEQ ID NO: 194177 - protein, 14 aa, Mycobacterium tuberculosis
EDPEWTRRYHCADP

SEQ ID NO: 194178 - protein, 14 aa, Mycobacterium tuberculosis
DPEWTRRYHCADPA

SEQ ID NO: 194179 - protein, 14 aa, Mycobacterium tuberculosis
PEWTRRYHCADPAK

SEQ ID NO: 194180 - protein, 14 aa, Mycobacterium tuberculosis
EWTRRYHCADPAKK

SEQ ID NO: 194181 - protein, 14 aa, Mycobacterium tuberculosis
WTRRYHCADPAKKA

SEQ ID NO: 194182 - protein, 14 aa, Mycobacterium tuberculosis
TRRYHCADPAKKAF

SEQ ID NO: 194183 - protein, 14 aa, Mycobacterium tuberculosis
RRYHCADPAKKAFG

SEQ ID NO: 194184 - protein, 14 aa, Mycobacterium tuberculosis
RYHCADPAKKAFGA

SEQ ID NO: 194185 - protein, 14 aa, Mycobacterium tuberculosis
YHCADPAKKAFGAR

SEQ ID NO: 194186 - protein, 14 aa, Mycobacterium tuberculosis
HCADPAKKAFGARA

SEQ ID NO: 194187 - protein, 14 aa, Mycobacterium tuberculosis
CADPAKKAFGARAE

SEQ ID NO: 194188 - protein, 14 aa, Mycobacterium tuberculosis
ADPAKKAFGARAEV

SEQ ID NO: 194189 - protein, 14 aa, Mycobacterium tuberculosis
DPAKKAFGARAEVT

SEQ ID NO: 194190 - protein, 14 aa, Mycobacterium tuberculosis
PAKKAFGARAEVTL

SEQ ID NO: 194191 - protein, 14 aa, Mycobacterium tuberculosis
AKKAFGARAEVTLH

SEQ ID NO: 194192 - protein, 14 aa, Mycobacterium tuberculosis
KKAFGARAEVTLHS

SEQ ID NO: 194193 - protein, 14 aa, Mycobacterium tuberculosis
KAFGARAEVTLHSG

SEQ ID NO: 194194 - protein, 14 aa, Mycobacterium tuberculosis
AFGARAEVTLHSGE

SEQ ID NO: 194195 - protein, 14 aa, Mycobacterium tuberculosis
FGARAEVTLHSGEV

SEQ ID NO: 194196 - protein, 14 aa, Mycobacterium tuberculosis
GARAEVTLHSGEVI

SEQ ID NO: 194197 - protein, 14 aa, Mycobacterium tuberculosis
ARAEVTLHSGEVIV

SEQ ID NO: 194198 - protein, 14 aa, Mycobacterium tuberculosis
RAEVTLHSGEVIVD

SEQ ID NO: 194199 - protein, 14 aa, Mycobacterium tuberculosis
AEVTLHSGEVIVDE

SEQ ID NO: 194200 - protein, 14 aa, Mycobacterium tuberculosis
EVTLHSGEVIVDEL

SEQ ID NO: 194201 - protein, 14 aa, Mycobacterium tuberculosis
VTLHSGEVIVDELA

SEQ ID NO: 194202 - protein, 14 aa, Mycobacterium tuberculosis
TLHSGEVIVDELAV

SEQ ID NO: 194203 - protein, 14 aa, Mycobacterium tuberculosis
LHSGEVIVDELAVA

SEQ ID NO: 194204 - protein, 14 aa, Mycobacterium tuberculosis
HSGEVIVDELAVAD

SEQ ID NO: 194205 - protein, 14 aa, Mycobacterium tuberculosis
SGEVIVDELAVADA

SEQ ID NO: 194206 - protein, 14 aa, Mycobacterium tuberculosis
GEVIVDELAVADAH

SEQ ID NO: 194207 - protein, 14 aa, Mycobacterium tuberculosis
EVIVDELAVADAHP

SEQ ID NO: 194208 - protein, 14 aa, Mycobacterium tuberculosis
VIVDELAVADAHPL

SEQ ID NO: 194209 - protein, 14 aa, Mycobacterium tuberculosis
IVDELAVADAHPLG

SEQ ID NO: 194210 - protein, 14 aa, Mycobacterium tuberculosis
VDELAVADAHPLGT

SEQ ID NO: 194211 - protein, 14 aa, Mycobacterium tuberculosis
DELAVADAHPLGTR

SEQ ID NO: 194212 - protein, 14 aa, Mycobacterium tuberculosis
ELAVADAHPLGTRP

SEQ ID NO: 194213 - protein, 14 aa, Mycobacterium tuberculosis
LAVADAHPLGTRPF

SEQ ID NO: 194214 - protein, 14 aa, Mycobacterium tuberculosis
AVADAHPLGTRPFE

SEQ ID NO: 194215 - protein, 14 aa, Mycobacterium tuberculosis
VADAHPLGTRPFER

SEQ ID NO: 194216 - protein, 14 aa, Mycobacterium tuberculosis
ADAHPLGTRPFERK

SEQ ID NO: 194217 - protein, 14 aa, Mycobacterium tuberculosis
DAHPLGTRPFERKQ

SEQ ID NO: 194218 - protein, 14 aa, Mycobacterium tuberculosis
AHPLGTRPFERKQY

SEQ ID NO: 194219 - protein, 14 aa, Mycobacterium tuberculosis
HPLGTRPFERKQYV

SEQ ID NO: 194220 - protein, 14 aa, Mycobacterium tuberculosis
PLGTRPFERKQYVE

SEQ ID NO: 194221 - protein, 14 aa, Mycobacterium tuberculosis
LGTRPFERKQYVEK

SEQ ID NO: 194222 - protein, 14 aa, Mycobacterium tuberculosis
GTRPFERKQYVEKF

SEQ ID NO: 194223 - protein, 14 aa, Mycobacterium tuberculosis
TRPFERKQYVEKFT

SEQ ID NO: 194224 - protein, 14 aa, Mycobacterium tuberculosis
RPFERKQYVEKFTE

SEQ ID NO: 194225 - protein, 14 aa, Mycobacterium tuberculosis
PFERKQYVEKFTEL

SEQ ID NO: 194226 - protein, 14 aa, Mycobacterium tuberculosis
FERKQYVEKFTELA

SEQ ID NO: 194227 - protein, 14 aa, Mycobacterium tuberculosis
ERKQYVEKFTELAD

SEQ ID NO: 194228 - protein, 14 aa, Mycobacterium tuberculosis
RKQYVEKFTELADG

SEQ ID NO: 194229 - protein, 14 aa, Mycobacterium tuberculosis
KQYVEKFTELADGV

SEQ ID NO: 194230 - protein, 14 aa, Mycobacterium tuberculosis
QYVEKFTELADGVV

SEQ ID NO: 194231 - protein, 14 aa, Mycobacterium tuberculosis
YVEKFTELADGVVE

SEQ ID NO: 194232 - protein, 14 aa, Mycobacterium tuberculosis
VEKFTELADGVVEP

SEQ ID NO: 194233 - protein, 14 aa, Mycobacterium tuberculosis
EKFTELADGVVEPV

SEQ ID NO: 194234 - protein, 14 aa, Mycobacterium tuberculosis
KFTELADGVVEPVE

SEQ ID NO: 194235 - protein, 14 aa, Mycobacterium tuberculosis
FTELADGVVEPVEQ

SEQ ID NO: 194236 - protein, 14 aa, Mycobacterium tuberculosis
TELADGVVEPVEQQ

SEQ ID NO: 194237 - protein, 14 aa, Mycobacterium tuberculosis
ELADGVVEPVEQQR

SEQ ID NO: 194238 - protein, 14 aa, Mycobacterium tuberculosis
LADGVVEPVEQQRF

SEQ ID NO: 194239 - protein, 14 aa, Mycobacterium tuberculosis
ADGVVEPVEQQRFL

SEQ ID NO: 194240 - protein, 14 aa, Mycobacterium tuberculosis
DGVVEPVEQQRFLA

SEQ ID NO: 194241 - protein, 14 aa, Mycobacterium tuberculosis
GVVEPVEQQRFLAV

SEQ ID NO: 194242 - protein, 14 aa, Mycobacterium tuberculosis
VVEPVEQQRFLAVV

SEQ ID NO: 194243 - protein, 14 aa, Mycobacterium tuberculosis
VEPVEQQRFLAVVE

SEQ ID NO: 194244 - protein, 14 aa, Mycobacterium tuberculosis
EPVEQQRFLAVVES

SEQ ID NO: 194245 - protein, 14 aa, Mycobacterium tuberculosis
PVEQQRFLAVVESL

SEQ ID NO: 194246 - protein, 14 aa, Mycobacterium tuberculosis
VEQQRFLAVVESLA

SEQ ID NO: 194247 - protein, 14 aa, Mycobacterium tuberculosis
EQQRFLAVVESLAD

SEQ ID NO: 194248 - protein, 14 aa, Mycobacterium tuberculosis
QQRFLAVVESLADL

SEQ ID NO: 194249 - protein, 14 aa, Mycobacterium tuberculosis
QRFLAVVESLADLE

SEQ ID NO: 194250 - protein, 14 aa, Mycobacterium tuberculosis
RFLAVVESLADLES

SEQ ID NO: 194251 - protein, 14 aa, Mycobacterium tuberculosis
FLAVVESLADLESG

SEQ ID NO: 194252 - protein, 14 aa, Mycobacterium tuberculosis
LAVVESLADLESGA

SEQ ID NO: 194253 - protein, 14 aa, Mycobacterium tuberculosis
AVVESLADLESGAV

SEQ ID NO: 194254 - protein, 14 aa, Mycobacterium tuberculosis
VVESLADLESGAVG

SEQ ID NO: 194255 - protein, 14 aa, Mycobacterium tuberculosis
VESLADLESGAVGG

SEQ ID NO: 194256 - protein, 14 aa, Mycobacterium tuberculosis
ESLADLESGAVGGL

SEQ ID NO: 194257 - protein, 14 aa, Mycobacterium tuberculosis
SLADLESGAVGGLN

SEQ ID NO: 194258 - protein, 14 aa, Mycobacterium tuberculosis
LADLESGAVGGLNV

SEQ ID NO: 194259 - protein, 14 aa, Mycobacterium tuberculosis
ADLESGAVGGLNVL

SEQ ID NO: 194260 - protein, 14 aa, Mycobacterium tuberculosis
DLESGAVGGLNVLV

SEQ ID NO: 194261 - protein, 14 aa, Mycobacterium tuberculosis
LESGAVGGLNVLVD

SEQ ID NO: 194262 - protein, 14 aa, Mycobacterium tuberculosis
ESGAVGGLNVLVDP

SEQ ID NO: 194263 - protein, 14 aa, Mycobacterium tuberculosis
SGAVGGLNVLVDPR

SEQ ID NO: 194264 - protein, 14 aa, Mycobacterium tuberculosis
GAVGGLNVLVDPRV

SEQ ID NO: 194265 - protein, 14 aa, Mycobacterium tuberculosis
AVGGLNVLVDPRVL

SEQ ID NO: 194266 - protein, 14 aa, Mycobacterium tuberculosis
VGGLNVLVDPRVLD

SEQ ID NO: 194267 - protein, 14 aa, Mycobacterium tuberculosis
GGLNVLVDPRVLDK

SEQ ID NO: 194268 - protein, 14 aa, Mycobacterium tuberculosis
GLNVLVDPRVLDKA

SEQ ID NO: 194269 - protein, 14 aa, Mycobacterium tuberculosis
LNVLVDPRVLDKAP

SEQ ID NO: 194270 - protein, 14 aa, Mycobacterium tuberculosis
NVLVDPRVLDKAPV

SEQ ID NO: 194271 - protein, 14 aa, Mycobacterium tuberculosis
VLVDPRVLDKAPVI

SEQ ID NO: 194272 - protein, 14 aa, Mycobacterium tuberculosis
LVDPRVLDKAPVIP

SEQ ID NO: 194273 - protein, 14 aa, Mycobacterium tuberculosis
VDPRVLDKAPVIPP

SEQ ID NO: 194274 - protein, 14 aa, Mycobacterium tuberculosis
DPRVLDKAPVIPPG

SEQ ID NO: 194275 - protein, 14 aa, Mycobacterium tuberculosis
PRVLDKAPVIPPGI

SEQ ID NO: 194276 - protein, 14 aa, Mycobacterium tuberculosis
RVLDKAPVIPPGIF

SEQ ID NO: 194277 - protein, 14 aa, Mycobacterium tuberculosis
VLDKAPVIPPGIFR

SEQ ID NO: 194278 - protein, 15 aa, Mycobacterium tuberculosis
MPDQDTKVRFFRVFC

SEQ ID NO: 194279 - protein, 15 aa, Mycobacterium tuberculosis
PDQDTKVRFFRVFCW

SEQ ID NO: 194280 - protein, 15 aa, Mycobacterium tuberculosis
DQDTKVRFFRVFCWC

SEQ ID NO: 194281 - protein, 15 aa, Mycobacterium tuberculosis
QDTKVRFFRVFCWCP

SEQ ID NO: 194282 - protein, 15 aa, Mycobacterium tuberculosis
DTKVRFFRVFCWCPV

SEQ ID NO: 194283 - protein, 15 aa, Mycobacterium tuberculosis
TKVRFFRVFCWCPVL

SEQ ID NO: 194284 - protein, 15 aa, Mycobacterium tuberculosis
KVRFFRVFCWCPVLR

SEQ ID NO: 194285 - protein, 15 aa, Mycobacterium tuberculosis
VRFFRVFCWCPVLRM

SEQ ID NO: 194286 - protein, 15 aa, Mycobacterium tuberculosis
RFFRVFCWCPVLRMV

SEQ ID NO: 194287 - protein, 15 aa, Mycobacterium tuberculosis
FFRVFCWCPVLRMVR

SEQ ID NO: 194288 - protein, 15 aa, Mycobacterium tuberculosis
FRVFCWCPVLRMVRI

SEQ ID NO: 194289 - protein, 15 aa, Mycobacterium tuberculosis
RVFCWCPVLRMVRIM

SEQ ID NO: 194290 - protein, 15 aa, Mycobacterium tuberculosis
VFCWCPVLRMVRIML

SEQ ID NO: 194291 - protein, 15 aa, Mycobacterium tuberculosis
FCWCPVLRMVRIMLM

SEQ ID NO: 194292 - protein, 15 aa, Mycobacterium tuberculosis
CWCPVLRMVRIMLMH

SEQ ID NO: 194293 - protein, 15 aa, Mycobacterium tuberculosis
WCPVLRMVRIMLMHA

SEQ ID NO: 194294 - protein, 15 aa, Mycobacterium tuberculosis
CPVLRMVRIMLMHAV

SEQ ID NO: 194295 - protein, 15 aa, Mycobacterium tuberculosis
PVLRMVRIMLMHAVR

SEQ ID NO: 194296 - protein, 15 aa, Mycobacterium tuberculosis
VLRMVRIMLMHAVRA

SEQ ID NO: 194297 - protein, 15 aa, Mycobacterium tuberculosis
LRMVRIMLMHAVRAW

SEQ ID NO: 194298 - protein, 15 aa, Mycobacterium tuberculosis
RMVRIMLMHAVRAWR

SEQ ID NO: 194299 - protein, 15 aa, Mycobacterium tuberculosis
MVRIMLMHAVRAWRS

SEQ ID NO: 194300 - protein, 15 aa, Mycobacterium tuberculosis
VRIMLMHAVRAWRSA

SEQ ID NO: 194301 - protein, 15 aa, Mycobacterium tuberculosis
RIMLMHAVRAWRSAD

SEQ ID NO: 194302 - protein, 15 aa, Mycobacterium tuberculosis
IMLMHAVRAWRSADD

SEQ ID NO: 194303 - protein, 15 aa, Mycobacterium tuberculosis
MLMHAVRAWRSADDF

SEQ ID NO: 194304 - protein, 15 aa, Mycobacterium tuberculosis
LMHAVRAWRSADDFP

SEQ ID NO: 194305 - protein, 15 aa, Mycobacterium tuberculosis
MHAVRAWRSADDFPC

SEQ ID NO: 194306 - protein, 15 aa, Mycobacterium tuberculosis
HAVRAWRSADDFPCT

SEQ ID NO: 194307 - protein, 15 aa, Mycobacterium tuberculosis
AVRAWRSADDFPCTE

SEQ ID NO: 194308 - protein, 15 aa, Mycobacterium tuberculosis
VRAWRSADDFPCTEH

SEQ ID NO: 194309 - protein, 15 aa, Mycobacterium tuberculosis
RAWRSADDFPCTEHM

SEQ ID NO: 194310 - protein, 15 aa, Mycobacterium tuberculosis
AWRSADDFPCTEHMA

SEQ ID NO: 194311 - protein, 15 aa, Mycobacterium tuberculosis
WRSADDFPCTEHMAY

SEQ ID NO: 194312 - protein, 15 aa, Mycobacterium tuberculosis
RSADDFPCTEHMAYK

SEQ ID NO: 194313 - protein, 15 aa, Mycobacterium tuberculosis
SADDFPCTEHMAYKI

SEQ ID NO: 194314 - protein, 15 aa, Mycobacterium tuberculosis
ADDFPCTEHMAYKIA

SEQ ID NO: 194315 - protein, 15 aa, Mycobacterium tuberculosis
DDFPCTEHMAYKIAQ

SEQ ID NO: 194316 - protein, 15 aa, Mycobacterium tuberculosis
DFPCTEHMAYKIAQV

SEQ ID NO: 194317 - protein, 15 aa, Mycobacterium tuberculosis
FPCTEHMAYKIAQVA

SEQ ID NO: 194318 - protein, 15 aa, Mycobacterium tuberculosis
PCTEHMAYKIAQVAA

SEQ ID NO: 194319 - protein, 15 aa, Mycobacterium tuberculosis
CTEHMAYKIAQVAAD

SEQ ID NO: 194320 - protein, 15 aa, Mycobacterium tuberculosis
TEHMAYKIAQVAADP

SEQ ID NO: 194321 - protein, 15 aa, Mycobacterium tuberculosis
EHMAYKIAQVAADPV

SEQ ID NO: 194322 - protein, 15 aa, Mycobacterium tuberculosis
HMAYKIAQVAADPVD

SEQ ID NO: 194323 - protein, 15 aa, Mycobacterium tuberculosis
MAYKIAQVAADPVDV

SEQ ID NO: 194324 - protein, 15 aa, Mycobacterium tuberculosis
AYKIAQVAADPVDVD

SEQ ID NO: 194325 - protein, 15 aa, Mycobacterium tuberculosis
YKIAQVAADPVDVDP

SEQ ID NO: 194326 - protein, 15 aa, Mycobacterium tuberculosis
KIAQVAADPVDVDPE

SEQ ID NO: 194327 - protein, 15 aa, Mycobacterium tuberculosis
IAQVAADPVDVDPEV

SEQ ID NO: 194328 - protein, 15 aa, Mycobacterium tuberculosis
AQVAADPVDVDPEVA

SEQ ID NO: 194329 - protein, 15 aa, Mycobacterium tuberculosis
QVAADPVDVDPEVAD

SEQ ID NO: 194330 - protein, 15 aa, Mycobacterium tuberculosis
VAADPVDVDPEVADM

SEQ ID NO: 194331 - protein, 15 aa, Mycobacterium tuberculosis
AADPVDVDPEVADMV

SEQ ID NO: 194332 - protein, 15 aa, Mycobacterium tuberculosis
ADPVDVDPEVADMVC

SEQ ID NO: 194333 - protein, 15 aa, Mycobacterium tuberculosis
DPVDVDPEVADMVCN

SEQ ID NO: 194334 - protein, 15 aa, Mycobacterium tuberculosis
PVDVDPEVADMVCNR

SEQ ID NO: 194335 - protein, 15 aa, Mycobacterium tuberculosis
VDVDPEVADMVCNRI

SEQ ID NO: 194336 - protein, 15 aa, Mycobacterium tuberculosis
DVDPEVADMVCNRII

SEQ ID NO: 194337 - protein, 15 aa, Mycobacterium tuberculosis
VDPEVADMVCNRIID

SEQ ID NO: 194338 - protein, 15 aa, Mycobacterium tuberculosis
DPEVADMVCNRIIDN

SEQ ID NO: 194339 - protein, 15 aa, Mycobacterium tuberculosis
PEVADMVCNRIIDNA

SEQ ID NO: 194340 - protein, 15 aa, Mycobacterium tuberculosis
EVADMVCNRIIDNAA

SEQ ID NO: 194341 - protein, 15 aa, Mycobacterium tuberculosis
VADMVCNRIIDNAAV

SEQ ID NO: 194342 - protein, 15 aa, Mycobacterium tuberculosis
ADMVCNRIIDNAAVS

SEQ ID NO: 194343 - protein, 15 aa, Mycobacterium tuberculosis
DMVCNRIIDNAAVSA

SEQ ID NO: 194344 - protein, 15 aa, Mycobacterium tuberculosis
MVCNRIIDNAAVSAA

SEQ ID NO: 194345 - protein, 15 aa, Mycobacterium tuberculosis
VCNRIIDNAAVSAAS

SEQ ID NO: 194346 - protein, 15 aa, Mycobacterium tuberculosis
CNRIIDNAAVSAASM

SEQ ID NO: 194347 - protein, 15 aa, Mycobacterium tuberculosis
NRIIDNAAVSAASMV

SEQ ID NO: 194348 - protein, 15 aa, Mycobacterium tuberculosis
RIIDNAAVSAASMVR

SEQ ID NO: 194349 - protein, 15 aa, Mycobacterium tuberculosis
IIDNAAVSAASMVRR

SEQ ID NO: 194350 - protein, 15 aa, Mycobacterium tuberculosis
IDNAAVSAASMVRRP

SEQ ID NO: 194351 - protein, 15 aa, Mycobacterium tuberculosis
DNAAVSAASMVRRPV

SEQ ID NO: 194352 - protein, 15 aa, Mycobacterium tuberculosis
NAAVSAASMVRRPVT

SEQ ID NO: 194353 - protein, 15 aa, Mycobacterium tuberculosis
AAVSAASMVRRPVTV

SEQ ID NO: 194354 - protein, 15 aa, Mycobacterium tuberculosis
AVSAASMVRRPVTVA

SEQ ID NO: 194355 - protein, 15 aa, Mycobacterium tuberculosis
VSAASMVRRPVTVAR

SEQ ID NO: 194356 - protein, 15 aa, Mycobacterium tuberculosis
SAASMVRRPVTVARH

SEQ ID NO: 194357 - protein, 15 aa, Mycobacterium tuberculosis
AASMVRRPVTVARHQ

SEQ ID NO: 194358 - protein, 15 aa, Mycobacterium tuberculosis
ASMVRRPVTVARHQA

SEQ ID NO: 194359 - protein, 15 aa, Mycobacterium tuberculosis
SMVRRPVTVARHQAL

SEQ ID NO: 194360 - protein, 15 aa, Mycobacterium tuberculosis
MVRRPVTVARHQALA

SEQ ID NO: 194361 - protein, 15 aa, Mycobacterium tuberculosis
VRRPVTVARHQALAH

SEQ ID NO: 194362 - protein, 15 aa, Mycobacterium tuberculosis
RRPVTVARHQALAHP

SEQ ID NO: 194363 - protein, 15 aa, Mycobacterium tuberculosis
RPVTVARHQALAHPV

SEQ ID NO: 194364 - protein, 15 aa, Mycobacterium tuberculosis
PVTVARHQALAHPVR

SEQ ID NO: 194365 - protein, 15 aa, Mycobacterium tuberculosis
VTVARHQALAHPVRH

SEQ ID NO: 194366 - protein, 15 aa, Mycobacterium tuberculosis
TVARHQALAHPVRHG

SEQ ID NO: 194367 - protein, 15 aa, Mycobacterium tuberculosis
VARHQALAHPVRHGA

SEQ ID NO: 194368 - protein, 15 aa, Mycobacterium tuberculosis
ARHQALAHPVRHGAK

SEQ ID NO: 194369 - protein, 15 aa, Mycobacterium tuberculosis
RHQALAHPVRHGAKV

SEQ ID NO: 194370 - protein, 15 aa, Mycobacterium tuberculosis
HQALAHPVRHGAKVF

SEQ ID NO: 194371 - protein, 15 aa, Mycobacterium tuberculosis
QALAHPVRHGAKVFG

SEQ ID NO: 194372 - protein, 15 aa, Mycobacterium tuberculosis
ALAHPVRHGAKVFGV

SEQ ID NO: 194373 - protein, 15 aa, Mycobacterium tuberculosis
LAHPVRHGAKVFGVE

SEQ ID NO: 194374 - protein, 15 aa, Mycobacterium tuberculosis
AHPVRHGAKVFGVEG

SEQ ID NO: 194375 - protein, 15 aa, Mycobacterium tuberculosis
HPVRHGAKVFGVEGS

SEQ ID NO: 194376 - protein, 15 aa, Mycobacterium tuberculosis
PVRHGAKVFGVEGSY

SEQ ID NO: 194377 - protein, 15 aa, Mycobacterium tuberculosis
VRHGAKVFGVEGSYS

SEQ ID NO: 194378 - protein, 15 aa, Mycobacterium tuberculosis
RHGAKVFGVEGSYSA

SEQ ID NO: 194379 - protein, 15 aa, Mycobacterium tuberculosis
HGAKVFGVEGSYSAD

SEQ ID NO: 194380 - protein, 15 aa, Mycobacterium tuberculosis
GAKVFGVEGSYSADW

SEQ ID NO: 194381 - protein, 15 aa, Mycobacterium tuberculosis
AKVFGVEGSYSADWA

SEQ ID NO: 194382 - protein, 15 aa, Mycobacterium tuberculosis
KVFGVEGSYSADWAA

SEQ ID NO: 194383 - protein, 15 aa, Mycobacterium tuberculosis
VFGVEGSYSADWAAW

SEQ ID NO: 194384 - protein, 15 aa, Mycobacterium tuberculosis
FGVEGSYSADWAAWA

SEQ ID NO: 194385 - protein, 15 aa, Mycobacterium tuberculosis
GVEGSYSADWAAWAN

SEQ ID NO: 194386 - protein, 15 aa, Mycobacterium tuberculosis
VEGSYSADWAAWANG

SEQ ID NO: 194387 - protein, 15 aa, Mycobacterium tuberculosis
EGSYSADWAAWANGV

SEQ ID NO: 194388 - protein, 15 aa, Mycobacterium tuberculosis
GSYSADWAAWANGVA

SEQ ID NO: 194389 - protein, 15 aa, Mycobacterium tuberculosis
SYSADWAAWANGVAA

SEQ ID NO: 194390 - protein, 15 aa, Mycobacterium tuberculosis
YSADWAAWANGVAAR

SEQ ID NO: 194391 - protein, 15 aa, Mycobacterium tuberculosis
SADWAAWANGVAARE

SEQ ID NO: 194392 - protein, 15 aa, Mycobacterium tuberculosis
ADWAAWANGVAAREL

SEQ ID NO: 194393 - protein, 15 aa, Mycobacterium tuberculosis
DWAAWANGVAARELD

SEQ ID NO: 194394 - protein, 15 aa, Mycobacterium tuberculosis
WAAWANGVAARELDF

SEQ ID NO: 194395 - protein, 15 aa, Mycobacterium tuberculosis
AAWANGVAARELDFH

SEQ ID NO: 194396 - protein, 15 aa, Mycobacterium tuberculosis
AWANGVAARELDFHD

SEQ ID NO: 194397 - protein, 15 aa, Mycobacterium tuberculosis
WANGVAARELDFHDT

SEQ ID NO: 194398 - protein, 15 aa, Mycobacterium tuberculosis
ANGVAARELDFHDTF

SEQ ID NO: 194399 - protein, 15 aa, Mycobacterium tuberculosis
NGVAARELDFHDTFL

SEQ ID NO: 194400 - protein, 15 aa, Mycobacterium tuberculosis
GVAARELDFHDTFLA

SEQ ID NO: 194401 - protein, 15 aa, Mycobacterium tuberculosis
VAARELDFHDTFLAA

SEQ ID NO: 194402 - protein, 15 aa, Mycobacterium tuberculosis
AARELDFHDTFLAAD

SEQ ID NO: 194403 - protein, 15 aa, Mycobacterium tuberculosis
ARELDFHDTFLAADY

SEQ ID NO: 194404 - protein, 15 aa, Mycobacterium tuberculosis
RELDFHDTFLAADYS

SEQ ID NO: 194405 - protein, 15 aa, Mycobacterium tuberculosis
ELDFHDTFLAADYSH

SEQ ID NO: 194406 - protein, 15 aa, Mycobacterium tuberculosis
LDFHDTFLAADYSHP

SEQ ID NO: 194407 - protein, 15 aa, Mycobacterium tuberculosis
DFHDTFLAADYSHPA

SEQ ID NO: 194408 - protein, 15 aa, Mycobacterium tuberculosis
FHDTFLAADYSHPAD

SEQ ID NO: 194409 - protein, 15 aa, Mycobacterium tuberculosis
HDTFLAADYSHPADN

SEQ ID NO: 194410 - protein, 15 aa, Mycobacterium tuberculosis
DTFLAADYSHPADNI

SEQ ID NO: 194411 - protein, 15 aa, Mycobacterium tuberculosis
TFLAADYSHPADNIP

SEQ ID NO: 194412 - protein, 15 aa, Mycobacterium tuberculosis
FLAADYSHPADNIPP

SEQ ID NO: 194413 - protein, 15 aa, Mycobacterium tuberculosis
LAADYSHPADNIPPL

SEQ ID NO: 194414 - protein, 15 aa, Mycobacterium tuberculosis
AADYSHPADNIPPLV

SEQ ID NO: 194415 - protein, 15 aa, Mycobacterium tuberculosis
ADYSHPADNIPPLVA

SEQ ID NO: 194416 - protein, 15 aa, Mycobacterium tuberculosis
DYSHPADNIPPLVAV

SEQ ID NO: 194417 - protein, 15 aa, Mycobacterium tuberculosis
YSHPADNIPPLVAVA

SEQ ID NO: 194418 - protein, 15 aa, Mycobacterium tuberculosis
SHPADNIPPLVAVAQ

SEQ ID NO: 194419 - protein, 15 aa, Mycobacterium tuberculosis
HPADNIPPLVAVAQQ

SEQ ID NO: 194420 - protein, 15 aa, Mycobacterium tuberculosis
PADNIPPLVAVAQQL

SEQ ID NO: 194421 - protein, 15 aa, Mycobacterium tuberculosis
ADNIPPLVAVAQQLG

SEQ ID NO: 194422 - protein, 15 aa, Mycobacterium tuberculosis
DNIPPLVAVAQQLGV

SEQ ID NO: 194423 - protein, 15 aa, Mycobacterium tuberculosis
NIPPLVAVAQQLGVC

SEQ ID NO: 194424 - protein, 15 aa, Mycobacterium tuberculosis
IPPLVAVAQQLGVCG

SEQ ID NO: 194425 - protein, 15 aa, Mycobacterium tuberculosis
PPLVAVAQQLGVCGA

SEQ ID NO: 194426 - protein, 15 aa, Mycobacterium tuberculosis
PLVAVAQQLGVCGAE

SEQ ID NO: 194427 - protein, 15 aa, Mycobacterium tuberculosis
LVAVAQQLGVCGAEL

SEQ ID NO: 194428 - protein, 15 aa, Mycobacterium tuberculosis
VAVAQQLGVCGAELI

SEQ ID NO: 194429 - protein, 15 aa, Mycobacterium tuberculosis
AVAQQLGVCGAELIR

SEQ ID NO: 194430 - protein, 15 aa, Mycobacterium tuberculosis
VAQQLGVCGAELIRG

SEQ ID NO: 194431 - protein, 15 aa, Mycobacterium tuberculosis
AQQLGVCGAELIRGL

SEQ ID NO: 194432 - protein, 15 aa, Mycobacterium tuberculosis
QQLGVCGAELIRGLV

SEQ ID NO: 194433 - protein, 15 aa, Mycobacterium tuberculosis
QLGVCGAELIRGLVT

SEQ ID NO: 194434 - protein, 15 aa, Mycobacterium tuberculosis
LGVCGAELIRGLVTA

SEQ ID NO: 194435 - protein, 15 aa, Mycobacterium tuberculosis
GVCGAELIRGLVTAY

SEQ ID NO: 194436 - protein, 15 aa, Mycobacterium tuberculosis
VCGAELIRGLVTAYE

SEQ ID NO: 194437 - protein, 15 aa, Mycobacterium tuberculosis
CGAELIRGLVTAYEI

SEQ ID NO: 194438 - protein, 15 aa, Mycobacterium tuberculosis
GAELIRGLVTAYEIH

SEQ ID NO: 194439 - protein, 15 aa, Mycobacterium tuberculosis
AELIRGLVTAYEIHI

SEQ ID NO: 194440 - protein, 15 aa, Mycobacterium tuberculosis
ELIRGLVTAYEIHID

SEQ ID NO: 194441 - protein, 15 aa, Mycobacterium tuberculosis
LIRGLVTAYEIHIDL

SEQ ID NO: 194442 - protein, 15 aa, Mycobacterium tuberculosis
IRGLVTAYEIHIDLT

SEQ ID NO: 194443 - protein, 15 aa, Mycobacterium tuberculosis
RGLVTAYEIHIDLTR

SEQ ID NO: 194444 - protein, 15 aa, Mycobacterium tuberculosis
GLVTAYEIHIDLTRG

SEQ ID NO: 194445 - protein, 15 aa, Mycobacterium tuberculosis
LVTAYEIHIDLTRGI

SEQ ID NO: 194446 - protein, 15 aa, Mycobacterium tuberculosis
VTAYEIHIDLTRGIC

SEQ ID NO: 194447 - protein, 15 aa, Mycobacterium tuberculosis
TAYEIHIDLTRGICL

SEQ ID NO: 194448 - protein, 15 aa, Mycobacterium tuberculosis
AYEIHIDLTRGICLH

SEQ ID NO: 194449 - protein, 15 aa, Mycobacterium tuberculosis
YEIHIDLTRGICLHE

SEQ ID NO: 194450 - protein, 15 aa, Mycobacterium tuberculosis
EIHIDLTRGICLHEH

SEQ ID NO: 194451 - protein, 15 aa, Mycobacterium tuberculosis
IHIDLTRGICLHEHK

SEQ ID NO: 194452 - protein, 15 aa, Mycobacterium tuberculosis
HIDLTRGICLHEHKI

SEQ ID NO: 194453 - protein, 15 aa, Mycobacterium tuberculosis
IDLTRGICLHEHKID

SEQ ID NO: 194454 - protein, 15 aa, Mycobacterium tuberculosis
DLTRGICLHEHKIDH

SEQ ID NO: 194455 - protein, 15 aa, Mycobacterium tuberculosis
LTRGICLHEHKIDHV

SEQ ID NO: 194456 - protein, 15 aa, Mycobacterium tuberculosis
TRGICLHEHKIDHVA

SEQ ID NO: 194457 - protein, 15 aa, Mycobacterium tuberculosis
RGICLHEHKIDHVAH

SEQ ID NO: 194458 - protein, 15 aa, Mycobacterium tuberculosis
GICLHEHKIDHVAHL

SEQ ID NO: 194459 - protein, 15 aa, Mycobacterium tuberculosis
ICLHEHKIDHVAHLG

SEQ ID NO: 194460 - protein, 15 aa, Mycobacterium tuberculosis
CLHEHKIDHVAHLGP

SEQ ID NO: 194461 - protein, 15 aa, Mycobacterium tuberculosis
LHEHKIDHVAHLGPA

SEQ ID NO: 194462 - protein, 15 aa, Mycobacterium tuberculosis
HEHKIDHVAHLGPAV

SEQ ID NO: 194463 - protein, 15 aa, Mycobacterium tuberculosis
EHKIDHVAHLGPAVA

SEQ ID NO: 194464 - protein, 15 aa, Mycobacterium tuberculosis
HKIDHVAHLGPAVAA

SEQ ID NO: 194465 - protein, 15 aa, Mycobacterium tuberculosis
KIDHVAHLGPAVAAG

SEQ ID NO: 194466 - protein, 15 aa, Mycobacterium tuberculosis
IDHVAHLGPAVAAGI

SEQ ID NO: 194467 - protein, 15 aa, Mycobacterium tuberculosis
DHVAHLGPAVAAGIG

SEQ ID NO: 194468 - protein, 15 aa, Mycobacterium tuberculosis
HVAHLGPAVAAGIGT

SEQ ID NO: 194469 - protein, 15 aa, Mycobacterium tuberculosis
VAHLGPAVAAGIGTM

SEQ ID NO: 194470 - protein, 15 aa, Mycobacterium tuberculosis
AHLGPAVAAGIGTML

SEQ ID NO: 194471 - protein, 15 aa, Mycobacterium tuberculosis
HLGPAVAAGIGTMLR

SEQ ID NO: 194472 - protein, 15 aa, Mycobacterium tuberculosis
LGPAVAAGIGTMLRL

SEQ ID NO: 194473 - protein, 15 aa, Mycobacterium tuberculosis
GPAVAAGIGTMLRLD

SEQ ID NO: 194474 - protein, 15 aa, Mycobacterium tuberculosis
PAVAAGIGTMLRLDQ

SEQ ID NO: 194475 - protein, 15 aa, Mycobacterium tuberculosis
AVAAGIGTMLRLDQE

SEQ ID NO: 194476 - protein, 15 aa, Mycobacterium tuberculosis
VAAGIGTMLRLDQET

SEQ ID NO: 194477 - protein, 15 aa, Mycobacterium tuberculosis
AAGIGTMLRLDQETI

SEQ ID NO: 194478 - protein, 15 aa, Mycobacterium tuberculosis
AGIGTMLRLDQETIY

SEQ ID NO: 194479 - protein, 15 aa, Mycobacterium tuberculosis
GIGTMLRLDQETIYH

SEQ ID NO: 194480 - protein, 15 aa, Mycobacterium tuberculosis
IGTMLRLDQETIYHA

SEQ ID NO: 194481 - protein, 15 aa, Mycobacterium tuberculosis
GTMLRLDQETIYHAI

SEQ ID NO: 194482 - protein, 15 aa, Mycobacterium tuberculosis
TMLRLDQETIYHAIG

SEQ ID NO: 194483 - protein, 15 aa, Mycobacterium tuberculosis
MLRLDQETIYHAIGQ

SEQ ID NO: 194484 - protein, 15 aa, Mycobacterium tuberculosis
LRLDQETIYHAIGQA

SEQ ID NO: 194485 - protein, 15 aa, Mycobacterium tuberculosis
RLDQETIYHAIGQAL

SEQ ID NO: 194486 - protein, 15 aa, Mycobacterium tuberculosis
LDQETIYHAIGQALH

SEQ ID NO: 194487 - protein, 15 aa, Mycobacterium tuberculosis
DQETIYHAIGQALHL

SEQ ID NO: 194488 - protein, 15 aa, Mycobacterium tuberculosis
QETIYHAIGQALHLT

SEQ ID NO: 194489 - protein, 15 aa, Mycobacterium tuberculosis
ETIYHAIGQALHLTT

SEQ ID NO: 194490 - protein, 15 aa, Mycobacterium tuberculosis
TIYHAIGQALHLTTS

SEQ ID NO: 194491 - protein, 15 aa, Mycobacterium tuberculosis
IYHAIGQALHLTTST

SEQ ID NO: 194492 - protein, 15 aa, Mycobacterium tuberculosis
YHAIGQALHLTTSTR

SEQ ID NO: 194493 - protein, 15 aa, Mycobacterium tuberculosis
HAIGQALHLTTSTRQ

SEQ ID NO: 194494 - protein, 15 aa, Mycobacterium tuberculosis
AIGQALHLTTSTRQS

SEQ ID NO: 194495 - protein, 15 aa, Mycobacterium tuberculosis
IGQALHLTTSTRQSR

SEQ ID NO: 194496 - protein, 15 aa, Mycobacterium tuberculosis
GQALHLTTSTRQSRK

SEQ ID NO: 194497 - protein, 15 aa, Mycobacterium tuberculosis
QALHLTTSTRQSRKG

SEQ ID NO: 194498 - protein, 15 aa, Mycobacterium tuberculosis
ALHLTTSTRQSRKGA

SEQ ID NO: 194499 - protein, 15 aa, Mycobacterium tuberculosis
LHLTTSTRQSRKGAI

SEQ ID NO: 194500 - protein, 15 aa, Mycobacterium tuberculosis
HLTTSTRQSRKGAIS

SEQ ID NO: 194501 - protein, 15 aa, Mycobacterium tuberculosis
LTTSTRQSRKGAISS

SEQ ID NO: 194502 - protein, 15 aa, Mycobacterium tuberculosis
TTSTRQSRKGAISSW

SEQ ID NO: 194503 - protein, 15 aa, Mycobacterium tuberculosis
TSTRQSRKGAISSWK

SEQ ID NO: 194504 - protein, 15 aa, Mycobacterium tuberculosis
STRQSRKGAISSWKA

SEQ ID NO: 194505 - protein, 15 aa, Mycobacterium tuberculosis
TRQSRKGAISSWKAF

SEQ ID NO: 194506 - protein, 15 aa, Mycobacterium tuberculosis
RQSRKGAISSWKAFA

SEQ ID NO: 194507 - protein, 15 aa, Mycobacterium tuberculosis
QSRKGAISSWKAFAP

SEQ ID NO: 194508 - protein, 15 aa, Mycobacterium tuberculosis
SRKGAISSWKAFAPA

SEQ ID NO: 194509 - protein, 15 aa, Mycobacterium tuberculosis
RKGAISSWKAFAPAH

SEQ ID NO: 194510 - protein, 15 aa, Mycobacterium tuberculosis
KGAISSWKAFAPAHA

SEQ ID NO: 194511 - protein, 15 aa, Mycobacterium tuberculosis
GAISSWKAFAPAHAG

SEQ ID NO: 194512 - protein, 15 aa, Mycobacterium tuberculosis
AISSWKAFAPAHAGK

SEQ ID NO: 194513 - protein, 15 aa, Mycobacterium tuberculosis
ISSWKAFAPAHAGKV

SEQ ID NO: 194514 - protein, 15 aa, Mycobacterium tuberculosis
SSWKAFAPAHAGKVG

SEQ ID NO: 194515 - protein, 15 aa, Mycobacterium tuberculosis
SWKAFAPAHAGKVGI

SEQ ID NO: 194516 - protein, 15 aa, Mycobacterium tuberculosis
WKAFAPAHAGKVGIE

SEQ ID NO: 194517 - protein, 15 aa, Mycobacterium tuberculosis
KAFAPAHAGKVGIEA

SEQ ID NO: 194518 - protein, 15 aa, Mycobacterium tuberculosis
AFAPAHAGKVGIEAV

SEQ ID NO: 194519 - protein, 15 aa, Mycobacterium tuberculosis
FAPAHAGKVGIEAVD

SEQ ID NO: 194520 - protein, 15 aa, Mycobacterium tuberculosis
APAHAGKVGIEAVDR

SEQ ID NO: 194521 - protein, 15 aa, Mycobacterium tuberculosis
PAHAGKVGIEAVDRA

SEQ ID NO: 194522 - protein, 15 aa, Mycobacterium tuberculosis
AHAGKVGIEAVDRAM

SEQ ID NO: 194523 - protein, 15 aa, Mycobacterium tuberculosis
HAGKVGIEAVDRAMR

SEQ ID NO: 194524 - protein, 15 aa, Mycobacterium tuberculosis
AGKVGIEAVDRAMRG

SEQ ID NO: 194525 - protein, 15 aa, Mycobacterium tuberculosis
GKVGIEAVDRAMRGE

SEQ ID NO: 194526 - protein, 15 aa, Mycobacterium tuberculosis
KVGIEAVDRAMRGEG

SEQ ID NO: 194527 - protein, 15 aa, Mycobacterium tuberculosis
VGIEAVDRAMRGEGS

SEQ ID NO: 194528 - protein, 15 aa, Mycobacterium tuberculosis
GIEAVDRAMRGEGSP

SEQ ID NO: 194529 - protein, 15 aa, Mycobacterium tuberculosis
IEAVDRAMRGEGSPA

SEQ ID NO: 194530 - protein, 15 aa, Mycobacterium tuberculosis
EAVDRAMRGEGSPAP

SEQ ID NO: 194531 - protein, 15 aa, Mycobacterium tuberculosis
AVDRAMRGEGSPAPI

SEQ ID NO: 194532 - protein, 15 aa, Mycobacterium tuberculosis
VDRAMRGEGSPAPIW

SEQ ID NO: 194533 - protein, 15 aa, Mycobacterium tuberculosis
DRAMRGEGSPAPIWE

SEQ ID NO: 194534 - protein, 15 aa, Mycobacterium tuberculosis
RAMRGEGSPAPIWEG

SEQ ID NO: 194535 - protein, 15 aa, Mycobacterium tuberculosis
AMRGEGSPAPIWEGE

SEQ ID NO: 194536 - protein, 15 aa, Mycobacterium tuberculosis
MRGEGSPAPIWEGED

SEQ ID NO: 194537 - protein, 15 aa, Mycobacterium tuberculosis
RGEGSPAPIWEGEDG

SEQ ID NO: 194538 - protein, 15 aa, Mycobacterium tuberculosis
GEGSPAPIWEGEDGV

SEQ ID NO: 194539 - protein, 15 aa, Mycobacterium tuberculosis
EGSPAPIWEGEDGVI

SEQ ID NO: 194540 - protein, 15 aa, Mycobacterium tuberculosis
GSPAPIWEGEDGVIA

SEQ ID NO: 194541 - protein, 15 aa, Mycobacterium tuberculosis
SPAPIWEGEDGVIAW

SEQ ID NO: 194542 - protein, 15 aa, Mycobacterium tuberculosis
PAPIWEGEDGVIAWL

SEQ ID NO: 194543 - protein, 15 aa, Mycobacterium tuberculosis
APIWEGEDGVIAWLL

SEQ ID NO: 194544 - protein, 15 aa, Mycobacterium tuberculosis
PIWEGEDGVIAWLLA

SEQ ID NO: 194545 - protein, 15 aa, Mycobacterium tuberculosis
IWEGEDGVIAWLLAG

SEQ ID NO: 194546 - protein, 15 aa, Mycobacterium tuberculosis
WEGEDGVIAWLLAGP

SEQ ID NO: 194547 - protein, 15 aa, Mycobacterium tuberculosis
EGEDGVIAWLLAGPE

SEQ ID NO: 194548 - protein, 15 aa, Mycobacterium tuberculosis
GEDGVIAWLLAGPEH

SEQ ID NO: 194549 - protein, 15 aa, Mycobacterium tuberculosis
EDGVIAWLLAGPEHT

SEQ ID NO: 194550 - protein, 15 aa, Mycobacterium tuberculosis
DGVIAWLLAGPEHTY

SEQ ID NO: 194551 - protein, 15 aa, Mycobacterium tuberculosis
GVIAWLLAGPEHTYR

SEQ ID NO: 194552 - protein, 15 aa, Mycobacterium tuberculosis
VIAWLLAGPEHTYRV

SEQ ID NO: 194553 - protein, 15 aa, Mycobacterium tuberculosis
IAWLLAGPEHTYRVP

SEQ ID NO: 194554 - protein, 15 aa, Mycobacterium tuberculosis
AWLLAGPEHTYRVPL

SEQ ID NO: 194555 - protein, 15 aa, Mycobacterium tuberculosis
WLLAGPEHTYRVPLP

SEQ ID NO: 194556 - protein, 15 aa, Mycobacterium tuberculosis
LLAGPEHTYRVPLPA

SEQ ID NO: 194557 - protein, 15 aa, Mycobacterium tuberculosis
LAGPEHTYRVPLPAP

SEQ ID NO: 194558 - protein, 15 aa, Mycobacterium tuberculosis
AGPEHTYRVPLPAPG

SEQ ID NO: 194559 - protein, 15 aa, Mycobacterium tuberculosis
GPEHTYRVPLPAPGE

SEQ ID NO: 194560 - protein, 15 aa, Mycobacterium tuberculosis
PEHTYRVPLPAPGEP

SEQ ID NO: 194561 - protein, 15 aa, Mycobacterium tuberculosis
EHTYRVPLPAPGEPK

SEQ ID NO: 194562 - protein, 15 aa, Mycobacterium tuberculosis
HTYRVPLPAPGEPKR

SEQ ID NO: 194563 - protein, 15 aa, Mycobacterium tuberculosis
TYRVPLPAPGEPKRA

SEQ ID NO: 194564 - protein, 15 aa, Mycobacterium tuberculosis
YRVPLPAPGEPKRAI

SEQ ID NO: 194565 - protein, 15 aa, Mycobacterium tuberculosis
RVPLPAPGEPKRAIL

SEQ ID NO: 194566 - protein, 15 aa, Mycobacterium tuberculosis
VPLPAPGEPKRAILD

SEQ ID NO: 194567 - protein, 15 aa, Mycobacterium tuberculosis
PLPAPGEPKRAILDS

SEQ ID NO: 194568 - protein, 15 aa, Mycobacterium tuberculosis
LPAPGEPKRAILDSY

SEQ ID NO: 194569 - protein, 15 aa, Mycobacterium tuberculosis
PAPGEPKRAILDSYT

SEQ ID NO: 194570 - protein, 15 aa, Mycobacterium tuberculosis
APGEPKRAILDSYTK

SEQ ID NO: 194571 - protein, 15 aa, Mycobacterium tuberculosis
PGEPKRAILDSYTKQ

SEQ ID NO: 194572 - protein, 15 aa, Mycobacterium tuberculosis
GEPKRAILDSYTKQH

SEQ ID NO: 194573 - protein, 15 aa, Mycobacterium tuberculosis
EPKRAILDSYTKQHS

SEQ ID NO: 194574 - protein, 15 aa, Mycobacterium tuberculosis
PKRAILDSYTKQHSA

SEQ ID NO: 194575 - protein, 15 aa, Mycobacterium tuberculosis
KRAILDSYTKQHSAE

SEQ ID NO: 194576 - protein, 15 aa, Mycobacterium tuberculosis
RAILDSYTKQHSAEY

SEQ ID NO: 194577 - protein, 15 aa, Mycobacterium tuberculosis
AILDSYTKQHSAEYQ

SEQ ID NO: 194578 - protein, 15 aa, Mycobacterium tuberculosis
ILDSYTKQHSAEYQS

SEQ ID NO: 194579 - protein, 15 aa, Mycobacterium tuberculosis
LDSYTKQHSAEYQSQ

SEQ ID NO: 194580 - protein, 15 aa, Mycobacterium tuberculosis
DSYTKQHSAEYQSQA

SEQ ID NO: 194581 - protein, 15 aa, Mycobacterium tuberculosis
SYTKQHSAEYQSQAP

SEQ ID NO: 194582 - protein, 15 aa, Mycobacterium tuberculosis
YTKQHSAEYQSQAPI

SEQ ID NO: 194583 - protein, 15 aa, Mycobacterium tuberculosis
TKQHSAEYQSQAPID

SEQ ID NO: 194584 - protein, 15 aa, Mycobacterium tuberculosis
KQHSAEYQSQAPIDL

SEQ ID NO: 194585 - protein, 15 aa, Mycobacterium tuberculosis
QHSAEYQSQAPIDLA

SEQ ID NO: 194586 - protein, 15 aa, Mycobacterium tuberculosis
HSAEYQSQAPIDLAC

SEQ ID NO: 194587 - protein, 15 aa, Mycobacterium tuberculosis
SAEYQSQAPIDLACR

SEQ ID NO: 194588 - protein, 15 aa, Mycobacterium tuberculosis
AEYQSQAPIDLACRL

SEQ ID NO: 194589 - protein, 15 aa, Mycobacterium tuberculosis
EYQSQAPIDLACRLR

SEQ ID NO: 194590 - protein, 15 aa, Mycobacterium tuberculosis
YQSQAPIDLACRLRE

SEQ ID NO: 194591 - protein, 15 aa, Mycobacterium tuberculosis
QSQAPIDLACRLRER

SEQ ID NO: 194592 - protein, 15 aa, Mycobacterium tuberculosis
SQAPIDLACRLRERI

SEQ ID NO: 194593 - protein, 15 aa, Mycobacterium tuberculosis
QAPIDLACRLRERIG

SEQ ID NO: 194594 - protein, 15 aa, Mycobacterium tuberculosis
APIDLACRLRERIGD

SEQ ID NO: 194595 - protein, 15 aa, Mycobacterium tuberculosis
PIDLACRLRERIGDL

SEQ ID NO: 194596 - protein, 15 aa, Mycobacterium tuberculosis
IDLACRLRERIGDLD

SEQ ID NO: 194597 - protein, 15 aa, Mycobacterium tuberculosis
DLACRLRERIGDLDQ

SEQ ID NO: 194598 - protein, 15 aa, Mycobacterium tuberculosis
LACRLRERIGDLDQI

SEQ ID NO: 194599 - protein, 15 aa, Mycobacterium tuberculosis
ACRLRERIGDLDQIA

SEQ ID NO: 194600 - protein, 15 aa, Mycobacterium tuberculosis
CRLRERIGDLDQIAS

SEQ ID NO: 194601 - protein, 15 aa, Mycobacterium tuberculosis
RLRERIGDLDQIASI

SEQ ID NO: 194602 - protein, 15 aa, Mycobacterium tuberculosis
LRERIGDLDQIASIV

SEQ ID NO: 194603 - protein, 15 aa, Mycobacterium tuberculosis
RERIGDLDQIASIVL

SEQ ID NO: 194604 - protein, 15 aa, Mycobacterium tuberculosis
ERIGDLDQIASIVLH

SEQ ID NO: 194605 - protein, 15 aa, Mycobacterium tuberculosis
RIGDLDQIASIVLHT

SEQ ID NO: 194606 - protein, 15 aa, Mycobacterium tuberculosis
IGDLDQIASIVLHTS

SEQ ID NO: 194607 - protein, 15 aa, Mycobacterium tuberculosis
GDLDQIASIVLHTSH

SEQ ID NO: 194608 - protein, 15 aa, Mycobacterium tuberculosis
DLDQIASIVLHTSHH

SEQ ID NO: 194609 - protein, 15 aa, Mycobacterium tuberculosis
LDQIASIVLHTSHHT

SEQ ID NO: 194610 - protein, 15 aa, Mycobacterium tuberculosis
DQIASIVLHTSHHTH

SEQ ID NO: 194611 - protein, 15 aa, Mycobacterium tuberculosis
QIASIVLHTSHHTHV

SEQ ID NO: 194612 - protein, 15 aa, Mycobacterium tuberculosis
IASIVLHTSHHTHVV

SEQ ID NO: 194613 - protein, 15 aa, Mycobacterium tuberculosis
ASIVLHTSHHTHVVI

SEQ ID NO: 194614 - protein, 15 aa, Mycobacterium tuberculosis
SIVLHTSHHTHVVIG

SEQ ID NO: 194615 - protein, 15 aa, Mycobacterium tuberculosis
IVLHTSHHTHVVIGT

SEQ ID NO: 194616 - protein, 15 aa, Mycobacterium tuberculosis
VLHTSHHTHVVIGTG

SEQ ID NO: 194617 - protein, 15 aa, Mycobacterium tuberculosis
LHTSHHTHVVIGTGS

SEQ ID NO: 194618 - protein, 15 aa, Mycobacterium tuberculosis
HTSHHTHVVIGTGSG

SEQ ID NO: 194619 - protein, 15 aa, Mycobacterium tuberculosis
TSHHTHVVIGTGSGD

SEQ ID NO: 194620 - protein, 15 aa, Mycobacterium tuberculosis
SHHTHVVIGTGSGDP

SEQ ID NO: 194621 - protein, 15 aa, Mycobacterium tuberculosis
HHTHVVIGTGSGDPQ

SEQ ID NO: 194622 - protein, 15 aa, Mycobacterium tuberculosis
HTHVVIGTGSGDPQK

SEQ ID NO: 194623 - protein, 15 aa, Mycobacterium tuberculosis
THVVIGTGSGDPQKF

SEQ ID NO: 194624 - protein, 15 aa, Mycobacterium tuberculosis
HVVIGTGSGDPQKFD

SEQ ID NO: 194625 - protein, 15 aa, Mycobacterium tuberculosis
VVIGTGSGDPQKFDP

SEQ ID NO: 194626 - protein, 15 aa, Mycobacterium tuberculosis
VIGTGSGDPQKFDPD

SEQ ID NO: 194627 - protein, 15 aa, Mycobacterium tuberculosis
IGTGSGDPQKFDPDA

SEQ ID NO: 194628 - protein, 15 aa, Mycobacterium tuberculosis
GTGSGDPQKFDPDAS

SEQ ID NO: 194629 - protein, 15 aa, Mycobacterium tuberculosis
TGSGDPQKFDPDASR

SEQ ID NO: 194630 - protein, 15 aa, Mycobacterium tuberculosis
GSGDPQKFDPDASRE

SEQ ID NO: 194631 - protein, 15 aa, Mycobacterium tuberculosis
SGDPQKFDPDASRET

SEQ ID NO: 194632 - protein, 15 aa, Mycobacterium tuberculosis
GDPQKFDPDASRETL

SEQ ID NO: 194633 - protein, 15 aa, Mycobacterium tuberculosis
DPQKFDPDASRETLD

SEQ ID NO: 194634 - protein, 15 aa, Mycobacterium tuberculosis
PQKFDPDASRETLDH

SEQ ID NO: 194635 - protein, 15 aa, Mycobacterium tuberculosis
QKFDPDASRETLDHS

SEQ ID NO: 194636 - protein, 15 aa, Mycobacterium tuberculosis
KFDPDASRETLDHSL

SEQ ID NO: 194637 - protein, 15 aa, Mycobacterium tuberculosis
FDPDASRETLDHSLP

SEQ ID NO: 194638 - protein, 15 aa, Mycobacterium tuberculosis
DPDASRETLDHSLPY

SEQ ID NO: 194639 - protein, 15 aa, Mycobacterium tuberculosis
PDASRETLDHSLPYI

SEQ ID NO: 194640 - protein, 15 aa, Mycobacterium tuberculosis
DASRETLDHSLPYIF

SEQ ID NO: 194641 - protein, 15 aa, Mycobacterium tuberculosis
ASRETLDHSLPYIFA

SEQ ID NO: 194642 - protein, 15 aa, Mycobacterium tuberculosis
SRETLDHSLPYIFAV

SEQ ID NO: 194643 - protein, 15 aa, Mycobacterium tuberculosis
RETLDHSLPYIFAVA

SEQ ID NO: 194644 - protein, 15 aa, Mycobacterium tuberculosis
ETLDHSLPYIFAVAL

SEQ ID NO: 194645 - protein, 15 aa, Mycobacterium tuberculosis
TLDHSLPYIFAVALQ

SEQ ID NO: 194646 - protein, 15 aa, Mycobacterium tuberculosis
LDHSLPYIFAVALQD

SEQ ID NO: 194647 - protein, 15 aa, Mycobacterium tuberculosis
DHSLPYIFAVALQDG

SEQ ID NO: 194648 - protein, 15 aa, Mycobacterium tuberculosis
HSLPYIFAVALQDGC

SEQ ID NO: 194649 - protein, 15 aa, Mycobacterium tuberculosis
SLPYIFAVALQDGCW

SEQ ID NO: 194650 - protein, 15 aa, Mycobacterium tuberculosis
LPYIFAVALQDGCWH

SEQ ID NO: 194651 - protein, 15 aa, Mycobacterium tuberculosis
PYIFAVALQDGCWHH

SEQ ID NO: 194652 - protein, 15 aa, Mycobacterium tuberculosis
YIFAVALQDGCWHHE

SEQ ID NO: 194653 - protein, 15 aa, Mycobacterium tuberculosis
IFAVALQDGCWHHER

SEQ ID NO: 194654 - protein, 15 aa, Mycobacterium tuberculosis
FAVALQDGCWHHERS

SEQ ID NO: 194655 - protein, 15 aa, Mycobacterium tuberculosis
AVALQDGCWHHERSY

SEQ ID NO: 194656 - protein, 15 aa, Mycobacterium tuberculosis
VALQDGCWHHERSYA

SEQ ID NO: 194657 - protein, 15 aa, Mycobacterium tuberculosis
ALQDGCWHHERSYAP

SEQ ID NO: 194658 - protein, 15 aa, Mycobacterium tuberculosis
LQDGCWHHERSYAPE

SEQ ID NO: 194659 - protein, 15 aa, Mycobacterium tuberculosis
QDGCWHHERSYAPER

SEQ ID NO: 194660 - protein, 15 aa, Mycobacterium tuberculosis
DGCWHHERSYAPERA

SEQ ID NO: 194661 - protein, 15 aa, Mycobacterium tuberculosis
GCWHHERSYAPERAR

SEQ ID NO: 194662 - protein, 15 aa, Mycobacterium tuberculosis
CWHHERSYAPERARR

SEQ ID NO: 194663 - protein, 15 aa, Mycobacterium tuberculosis
WHHERSYAPERARRS

SEQ ID NO: 194664 - protein, 15 aa, Mycobacterium tuberculosis
HHERSYAPERARRSD

SEQ ID NO: 194665 - protein, 15 aa, Mycobacterium tuberculosis
HERSYAPERARRSDT

SEQ ID NO: 194666 - protein, 15 aa, Mycobacterium tuberculosis
ERSYAPERARRSDTV

SEQ ID NO: 194667 - protein, 15 aa, Mycobacterium tuberculosis
RSYAPERARRSDTVA

SEQ ID NO: 194668 - protein, 15 aa, Mycobacterium tuberculosis
SYAPERARRSDTVAL

SEQ ID NO: 194669 - protein, 15 aa, Mycobacterium tuberculosis
YAPERARRSDTVALW

SEQ ID NO: 194670 - protein, 15 aa, Mycobacterium tuberculosis
APERARRSDTVALWH

SEQ ID NO: 194671 - protein, 15 aa, Mycobacterium tuberculosis
PERARRSDTVALWHK

SEQ ID NO: 194672 - protein, 15 aa, Mycobacterium tuberculosis
ERARRSDTVALWHKI

SEQ ID NO: 194673 - protein, 15 aa, Mycobacterium tuberculosis
RARRSDTVALWHKIS

SEQ ID NO: 194674 - protein, 15 aa, Mycobacterium tuberculosis
ARRSDTVALWHKIST

SEQ ID NO: 194675 - protein, 15 aa, Mycobacterium tuberculosis
RRSDTVALWHKISTV

SEQ ID NO: 194676 - protein, 15 aa, Mycobacterium tuberculosis
RSDTVALWHKISTVE

SEQ ID NO: 194677 - protein, 15 aa, Mycobacterium tuberculosis
SDTVALWHKISTVED

SEQ ID NO: 194678 - protein, 15 aa, Mycobacterium tuberculosis
DTVALWHKISTVEDP

SEQ ID NO: 194679 - protein, 15 aa, Mycobacterium tuberculosis
TVALWHKISTVEDPE

SEQ ID NO: 194680 - protein, 15 aa, Mycobacterium tuberculosis
VALWHKISTVEDPEW

SEQ ID NO: 194681 - protein, 15 aa, Mycobacterium tuberculosis
ALWHKISTVEDPEWT

SEQ ID NO: 194682 - protein, 15 aa, Mycobacterium tuberculosis
LWHKISTVEDPEWTR

SEQ ID NO: 194683 - protein, 15 aa, Mycobacterium tuberculosis
WHKISTVEDPEWTRR

SEQ ID NO: 194684 - protein, 15 aa, Mycobacterium tuberculosis
HKISTVEDPEWTRRY

SEQ ID NO: 194685 - protein, 15 aa, Mycobacterium tuberculosis
KISTVEDPEWTRRYH

SEQ ID NO: 194686 - protein, 15 aa, Mycobacterium tuberculosis
ISTVEDPEWTRRYHC

SEQ ID NO: 194687 - protein, 15 aa, Mycobacterium tuberculosis
STVEDPEWTRRYHCA

SEQ ID NO: 194688 - protein, 15 aa, Mycobacterium tuberculosis
TVEDPEWTRRYHCAD

SEQ ID NO: 194689 - protein, 15 aa, Mycobacterium tuberculosis
VEDPEWTRRYHCADP

SEQ ID NO: 194690 - protein, 15 aa, Mycobacterium tuberculosis
EDPEWTRRYHCADPA

SEQ ID NO: 194691 - protein, 15 aa, Mycobacterium tuberculosis
DPEWTRRYHCADPAK

SEQ ID NO: 194692 - protein, 15 aa, Mycobacterium tuberculosis
PEWTRRYHCADPAKK

SEQ ID NO: 194693 - protein, 15 aa, Mycobacterium tuberculosis
EWTRRYHCADPAKKA

SEQ ID NO: 194694 - protein, 15 aa, Mycobacterium tuberculosis
WTRRYHCADPAKKAF

SEQ ID NO: 194695 - protein, 15 aa, Mycobacterium tuberculosis
TRRYHCADPAKKAFG

SEQ ID NO: 194696 - protein, 15 aa, Mycobacterium tuberculosis
RRYHCADPAKKAFGA

SEQ ID NO: 194697 - protein, 15 aa, Mycobacterium tuberculosis
RYHCADPAKKAFGAR

SEQ ID NO: 194698 - protein, 15 aa, Mycobacterium tuberculosis
YHCADPAKKAFGARA

SEQ ID NO: 194699 - protein, 15 aa, Mycobacterium tuberculosis
HCADPAKKAFGARAE

SEQ ID NO: 194700 - protein, 15 aa, Mycobacterium tuberculosis
CADPAKKAFGARAEV

SEQ ID NO: 194701 - protein, 15 aa, Mycobacterium tuberculosis
ADPAKKAFGARAEVT

SEQ ID NO: 194702 - protein, 15 aa, Mycobacterium tuberculosis
DPAKKAFGARAEVTL

SEQ ID NO: 194703 - protein, 15 aa, Mycobacterium tuberculosis
PAKKAFGARAEVTLH

SEQ ID NO: 194704 - protein, 15 aa, Mycobacterium tuberculosis
AKKAFGARAEVTLHS

SEQ ID NO: 194705 - protein, 15 aa, Mycobacterium tuberculosis
KKAFGARAEVTLHSG

SEQ ID NO: 194706 - protein, 15 aa, Mycobacterium tuberculosis
KAFGARAEVTLHSGE

SEQ ID NO: 194707 - protein, 15 aa, Mycobacterium tuberculosis
AFGARAEVTLHSGEV

SEQ ID NO: 194708 - protein, 15 aa, Mycobacterium tuberculosis
FGARAEVTLHSGEVI

SEQ ID NO: 194709 - protein, 15 aa, Mycobacterium tuberculosis
GARAEVTLHSGEVIV

SEQ ID NO: 194710 - protein, 15 aa, Mycobacterium tuberculosis
ARAEVTLHSGEVIVD

SEQ ID NO: 194711 - protein, 15 aa, Mycobacterium tuberculosis
RAEVTLHSGEVIVDE

SEQ ID NO: 194712 - protein, 15 aa, Mycobacterium tuberculosis
AEVTLHSGEVIVDEL

SEQ ID NO: 194713 - protein, 15 aa, Mycobacterium tuberculosis
EVTLHSGEVIVDELA

SEQ ID NO: 194714 - protein, 15 aa, Mycobacterium tuberculosis
VTLHSGEVIVDELAV

SEQ ID NO: 194715 - protein, 15 aa, Mycobacterium tuberculosis
TLHSGEVIVDELAVA

SEQ ID NO: 194716 - protein, 15 aa, Mycobacterium tuberculosis
LHSGEVIVDELAVAD

SEQ ID NO: 194717 - protein, 15 aa, Mycobacterium tuberculosis
HSGEVIVDELAVADA

SEQ ID NO: 194718 - protein, 15 aa, Mycobacterium tuberculosis
SGEVIVDELAVADAH

SEQ ID NO: 194719 - protein, 15 aa, Mycobacterium tuberculosis
GEVIVDELAVADAHP

SEQ ID NO: 194720 - protein, 15 aa, Mycobacterium tuberculosis
EVIVDELAVADAHPL

SEQ ID NO: 194721 - protein, 15 aa, Mycobacterium tuberculosis
VIVDELAVADAHPLG

SEQ ID NO: 194722 - protein, 15 aa, Mycobacterium tuberculosis
IVDELAVADAHPLGT

SEQ ID NO: 194723 - protein, 15 aa, Mycobacterium tuberculosis
VDELAVADAHPLGTR

SEQ ID NO: 194724 - protein, 15 aa, Mycobacterium tuberculosis
DELAVADAHPLGTRP

SEQ ID NO: 194725 - protein, 15 aa, Mycobacterium tuberculosis
ELAVADAHPLGTRPF

SEQ ID NO: 194726 - protein, 15 aa, Mycobacterium tuberculosis
LAVADAHPLGTRPFE

SEQ ID NO: 194727 - protein, 15 aa, Mycobacterium tuberculosis
AVADAHPLGTRPFER

SEQ ID NO: 194728 - protein, 15 aa, Mycobacterium tuberculosis
VADAHPLGTRPFERK

SEQ ID NO: 194729 - protein, 15 aa, Mycobacterium tuberculosis
ADAHPLGTRPFERKQ

SEQ ID NO: 194730 - protein, 15 aa, Mycobacterium tuberculosis
DAHPLGTRPFERKQY

SEQ ID NO: 194731 - protein, 15 aa, Mycobacterium tuberculosis
AHPLGTRPFERKQYV

SEQ ID NO: 194732 - protein, 15 aa, Mycobacterium tuberculosis
HPLGTRPFERKQYVE

SEQ ID NO: 194733 - protein, 15 aa, Mycobacterium tuberculosis
PLGTRPFERKQYVEK

SEQ ID NO: 194734 - protein, 15 aa, Mycobacterium tuberculosis
LGTRPFERKQYVEKF

SEQ ID NO: 194735 - protein, 15 aa, Mycobacterium tuberculosis
GTRPFERKQYVEKFT

SEQ ID NO: 194736 - protein, 15 aa, Mycobacterium tuberculosis
TRPFERKQYVEKFTE

SEQ ID NO: 194737 - protein, 15 aa, Mycobacterium tuberculosis
RPFERKQYVEKFTEL

SEQ ID NO: 194738 - protein, 15 aa, Mycobacterium tuberculosis
PFERKQYVEKFTELA

SEQ ID NO: 194739 - protein, 15 aa, Mycobacterium tuberculosis
FERKQYVEKFTELAD

SEQ ID NO: 194740 - protein, 15 aa, Mycobacterium tuberculosis
ERKQYVEKFTELADG

SEQ ID NO: 194741 - protein, 15 aa, Mycobacterium tuberculosis
RKQYVEKFTELADGV

SEQ ID NO: 194742 - protein, 15 aa, Mycobacterium tuberculosis
KQYVEKFTELADGVV

SEQ ID NO: 194743 - protein, 15 aa, Mycobacterium tuberculosis
QYVEKFTELADGVVE

SEQ ID NO: 194744 - protein, 15 aa, Mycobacterium tuberculosis
YVEKFTELADGVVEP

SEQ ID NO: 194745 - protein, 15 aa, Mycobacterium tuberculosis
VEKFTELADGVVEPV

SEQ ID NO: 194746 - protein, 15 aa, Mycobacterium tuberculosis
EKFTELADGVVEPVE

SEQ ID NO: 194747 - protein, 15 aa, Mycobacterium tuberculosis
KFTELADGVVEPVEQ

SEQ ID NO: 194748 - protein, 15 aa, Mycobacterium tuberculosis
FTELADGVVEPVEQQ

SEQ ID NO: 194749 - protein, 15 aa, Mycobacterium tuberculosis
TELADGVVEPVEQQR

SEQ ID NO: 194750 - protein, 15 aa, Mycobacterium tuberculosis
ELADGVVEPVEQQRF

SEQ ID NO: 194751 - protein, 15 aa, Mycobacterium tuberculosis
LADGVVEPVEQQRFL

SEQ ID NO: 194752 - protein, 15 aa, Mycobacterium tuberculosis
ADGVVEPVEQQRFLA

SEQ ID NO: 194753 - protein, 15 aa, Mycobacterium tuberculosis
DGVVEPVEQQRFLAV

SEQ ID NO: 194754 - protein, 15 aa, Mycobacterium tuberculosis
GVVEPVEQQRFLAVV

SEQ ID NO: 194755 - protein, 15 aa, Mycobacterium tuberculosis
VVEPVEQQRFLAVVE

SEQ ID NO: 194756 - protein, 15 aa, Mycobacterium tuberculosis
VEPVEQQRFLAVVES

SEQ ID NO: 194757 - protein, 15 aa, Mycobacterium tuberculosis
EPVEQQRFLAVVESL

SEQ ID NO: 194758 - protein, 15 aa, Mycobacterium tuberculosis
PVEQQRFLAVVESLA

SEQ ID NO: 194759 - protein, 15 aa, Mycobacterium tuberculosis
VEQQRFLAVVESLAD

SEQ ID NO: 194760 - protein, 15 aa, Mycobacterium tuberculosis
EQQRFLAVVESLADL

SEQ ID NO: 194761 - protein, 15 aa, Mycobacterium tuberculosis
QQRFLAVVESLADLE

SEQ ID NO: 194762 - protein, 15 aa, Mycobacterium tuberculosis
QRFLAVVESLADLES

SEQ ID NO: 194763 - protein, 15 aa, Mycobacterium tuberculosis
RFLAVVESLADLESG

SEQ ID NO: 194764 - protein, 15 aa, Mycobacterium tuberculosis
FLAVVESLADLESGA

SEQ ID NO: 194765 - protein, 15 aa, Mycobacterium tuberculosis
LAVVESLADLESGAV

SEQ ID NO: 194766 - protein, 15 aa, Mycobacterium tuberculosis
AVVESLADLESGAVG

SEQ ID NO: 194767 - protein, 15 aa, Mycobacterium tuberculosis
VVESLADLESGAVGG

SEQ ID NO: 194768 - protein, 15 aa, Mycobacterium tuberculosis
VESLADLESGAVGGL

SEQ ID NO: 194769 - protein, 15 aa, Mycobacterium tuberculosis
ESLADLESGAVGGLN

SEQ ID NO: 194770 - protein, 15 aa, Mycobacterium tuberculosis
SLADLESGAVGGLNV

SEQ ID NO: 194771 - protein, 15 aa, Mycobacterium tuberculosis
LADLESGAVGGLNVL

SEQ ID NO: 194772 - protein, 15 aa, Mycobacterium tuberculosis
ADLESGAVGGLNVLV

SEQ ID NO: 194773 - protein, 15 aa, Mycobacterium tuberculosis
DLESGAVGGLNVLVD

SEQ ID NO: 194774 - protein, 15 aa, Mycobacterium tuberculosis
LESGAVGGLNVLVDP

SEQ ID NO: 194775 - protein, 15 aa, Mycobacterium tuberculosis
ESGAVGGLNVLVDPR

SEQ ID NO: 194776 - protein, 15 aa, Mycobacterium tuberculosis
SGAVGGLNVLVDPRV

SEQ ID NO: 194777 - protein, 15 aa, Mycobacterium tuberculosis
GAVGGLNVLVDPRVL

SEQ ID NO: 194778 - protein, 15 aa, Mycobacterium tuberculosis
AVGGLNVLVDPRVLD

SEQ ID NO: 194779 - protein, 15 aa, Mycobacterium tuberculosis
VGGLNVLVDPRVLDK

SEQ ID NO: 194780 - protein, 15 aa, Mycobacterium tuberculosis
GGLNVLVDPRVLDKA

SEQ ID NO: 194781 - protein, 15 aa, Mycobacterium tuberculosis
GLNVLVDPRVLDKAP

SEQ ID NO: 194782 - protein, 15 aa, Mycobacterium tuberculosis
LNVLVDPRVLDKAPV

SEQ ID NO: 194783 - protein, 15 aa, Mycobacterium tuberculosis
NVLVDPRVLDKAPVI

SEQ ID NO: 194784 - protein, 15 aa, Mycobacterium tuberculosis
VLVDPRVLDKAPVIP

SEQ ID NO: 194785 - protein, 15 aa, Mycobacterium tuberculosis
LVDPRVLDKAPVIPP

SEQ ID NO: 194786 - protein, 15 aa, Mycobacterium tuberculosis
VDPRVLDKAPVIPPG

SEQ ID NO: 194787 - protein, 15 aa, Mycobacterium tuberculosis
DPRVLDKAPVIPPGI

SEQ ID NO: 194788 - protein, 15 aa, Mycobacterium tuberculosis
PRVLDKAPVIPPGIF

SEQ ID NO: 194789 - protein, 15 aa, Mycobacterium tuberculosis
RVLDKAPVIPPGIFR

SEQ ID NO: 194790 - protein, 16 aa, Mycobacterium tuberculosis
MPDQDTKVRFFRVFCW

SEQ ID NO: 194791 - protein, 16 aa, Mycobacterium tuberculosis
PDQDTKVRFFRVFCWC

SEQ ID NO: 194792 - protein, 16 aa, Mycobacterium tuberculosis
DQDTKVRFFRVFCWCP

SEQ ID NO: 194793 - protein, 16 aa, Mycobacterium tuberculosis
QDTKVRFFRVFCWCPV

SEQ ID NO: 194794 - protein, 16 aa, Mycobacterium tuberculosis
DTKVRFFRVFCWCPVL

SEQ ID NO: 194795 - protein, 16 aa, Mycobacterium tuberculosis
TKVRFFRVFCWCPVLR

SEQ ID NO: 194796 - protein, 16 aa, Mycobacterium tuberculosis
KVRFFRVFCWCPVLRM

SEQ ID NO: 194797 - protein, 16 aa, Mycobacterium tuberculosis
VRFFRVFCWCPVLRMV

SEQ ID NO: 194798 - protein, 16 aa, Mycobacterium tuberculosis
RFFRVFCWCPVLRMVR

SEQ ID NO: 194799 - protein, 16 aa, Mycobacterium tuberculosis
FFRVFCWCPVLRMVRI

SEQ ID NO: 194800 - protein, 16 aa, Mycobacterium tuberculosis
FRVFCWCPVLRMVRIM

SEQ ID NO: 194801 - protein, 16 aa, Mycobacterium tuberculosis
RVFCWCPVLRMVRIML

SEQ ID NO: 194802 - protein, 16 aa, Mycobacterium tuberculosis
VFCWCPVLRMVRIMLM

SEQ ID NO: 194803 - protein, 16 aa, Mycobacterium tuberculosis
FCWCPVLRMVRIMLMH

SEQ ID NO: 194804 - protein, 16 aa, Mycobacterium tuberculosis
CWCPVLRMVRIMLMHA

SEQ ID NO: 194805 - protein, 16 aa, Mycobacterium tuberculosis
WCPVLRMVRIMLMHAV

SEQ ID NO: 194806 - protein, 16 aa, Mycobacterium tuberculosis
CPVLRMVRIMLMHAVR

SEQ ID NO: 194807 - protein, 16 aa, Mycobacterium tuberculosis
PVLRMVRIMLMHAVRA

SEQ ID NO: 194808 - protein, 16 aa, Mycobacterium tuberculosis
VLRMVRIMLMHAVRAW

SEQ ID NO: 194809 - protein, 16 aa, Mycobacterium tuberculosis
LRMVRIMLMHAVRAWR

SEQ ID NO: 194810 - protein, 16 aa, Mycobacterium tuberculosis
RMVRIMLMHAVRAWRS

SEQ ID NO: 194811 - protein, 16 aa, Mycobacterium tuberculosis
MVRIMLMHAVRAWRSA

SEQ ID NO: 194812 - protein, 16 aa, Mycobacterium tuberculosis
VRIMLMHAVRAWRSAD

SEQ ID NO: 194813 - protein, 16 aa, Mycobacterium tuberculosis
RIMLMHAVRAWRSADD

SEQ ID NO: 194814 - protein, 16 aa, Mycobacterium tuberculosis
IMLMHAVRAWRSADDF

SEQ ID NO: 194815 - protein, 16 aa, Mycobacterium tuberculosis
MLMHAVRAWRSADDFP

SEQ ID NO: 194816 - protein, 16 aa, Mycobacterium tuberculosis
LMHAVRAWRSADDFPC

SEQ ID NO: 194817 - protein, 16 aa, Mycobacterium tuberculosis
MHAVRAWRSADDFPCT

SEQ ID NO: 194818 - protein, 16 aa, Mycobacterium tuberculosis
HAVRAWRSADDFPCTE

SEQ ID NO: 194819 - protein, 16 aa, Mycobacterium tuberculosis
AVRAWRSADDFPCTEH

SEQ ID NO: 194820 - protein, 16 aa, Mycobacterium tuberculosis
VRAWRSADDFPCTEHM

SEQ ID NO: 194821 - protein, 16 aa, Mycobacterium tuberculosis
RAWRSADDFPCTEHMA

SEQ ID NO: 194822 - protein, 16 aa, Mycobacterium tuberculosis
AWRSADDFPCTEHMAY

SEQ ID NO: 194823 - protein, 16 aa, Mycobacterium tuberculosis
WRSADDFPCTEHMAYK

SEQ ID NO: 194824 - protein, 16 aa, Mycobacterium tuberculosis
RSADDFPCTEHMAYKI

SEQ ID NO: 194825 - protein, 16 aa, Mycobacterium tuberculosis
SADDFPCTEHMAYKIA

SEQ ID NO: 194826 - protein, 16 aa, Mycobacterium tuberculosis
ADDFPCTEHMAYKIAQ

SEQ ID NO: 194827 - protein, 16 aa, Mycobacterium tuberculosis
DDFPCTEHMAYKIAQV

SEQ ID NO: 194828 - protein, 16 aa, Mycobacterium tuberculosis
DFPCTEHMAYKIAQVA

SEQ ID NO: 194829 - protein, 16 aa, Mycobacterium tuberculosis
FPCTEHMAYKIAQVAA

SEQ ID NO: 194830 - protein, 16 aa, Mycobacterium tuberculosis
PCTEHMAYKIAQVAAD

SEQ ID NO: 194831 - protein, 16 aa, Mycobacterium tuberculosis
CTEHMAYKIAQVAADP

SEQ ID NO: 194832 - protein, 16 aa, Mycobacterium tuberculosis
TEHMAYKIAQVAADPV

SEQ ID NO: 194833 - protein, 16 aa, Mycobacterium tuberculosis
EHMAYKIAQVAADPVD

SEQ ID NO: 194834 - protein, 16 aa, Mycobacterium tuberculosis
HMAYKIAQVAADPVDV

SEQ ID NO: 194835 - protein, 16 aa, Mycobacterium tuberculosis
MAYKIAQVAADPVDVD

SEQ ID NO: 194836 - protein, 16 aa, Mycobacterium tuberculosis
AYKIAQVAADPVDVDP

SEQ ID NO: 194837 - protein, 16 aa, Mycobacterium tuberculosis
YKIAQVAADPVDVDPE

SEQ ID NO: 194838 - protein, 16 aa, Mycobacterium tuberculosis
KIAQVAADPVDVDPEV

SEQ ID NO: 194839 - protein, 16 aa, Mycobacterium tuberculosis
IAQVAADPVDVDPEVA

SEQ ID NO: 194840 - protein, 16 aa, Mycobacterium tuberculosis
AQVAADPVDVDPEVAD

SEQ ID NO: 194841 - protein, 16 aa, Mycobacterium tuberculosis
QVAADPVDVDPEVADM

SEQ ID NO: 194842 - protein, 16 aa, Mycobacterium tuberculosis
VAADPVDVDPEVADMV

SEQ ID NO: 194843 - protein, 16 aa, Mycobacterium tuberculosis
AADPVDVDPEVADMVC

SEQ ID NO: 194844 - protein, 16 aa, Mycobacterium tuberculosis
ADPVDVDPEVADMVCN

SEQ ID NO: 194845 - protein, 16 aa, Mycobacterium tuberculosis
DPVDVDPEVADMVCNR

SEQ ID NO: 194846 - protein, 16 aa, Mycobacterium tuberculosis
PVDVDPEVADMVCNRI

SEQ ID NO: 194847 - protein, 16 aa, Mycobacterium tuberculosis
VDVDPEVADMVCNRII

SEQ ID NO: 194848 - protein, 16 aa, Mycobacterium tuberculosis
DVDPEVADMVCNRIID

SEQ ID NO: 194849 - protein, 16 aa, Mycobacterium tuberculosis
VDPEVADMVCNRIIDN

SEQ ID NO: 194850 - protein, 16 aa, Mycobacterium tuberculosis
DPEVADMVCNRIIDNA

SEQ ID NO: 194851 - protein, 16 aa, Mycobacterium tuberculosis
PEVADMVCNRIIDNAA

SEQ ID NO: 194852 - protein, 16 aa, Mycobacterium tuberculosis
EVADMVCNRIIDNAAV

SEQ ID NO: 194853 - protein, 16 aa, Mycobacterium tuberculosis
VADMVCNRIIDNAAVS

SEQ ID NO: 194854 - protein, 16 aa, Mycobacterium tuberculosis
ADMVCNRIIDNAAVSA

SEQ ID NO: 194855 - protein, 16 aa, Mycobacterium tuberculosis
DMVCNRIIDNAAVSAA

SEQ ID NO: 194856 - protein, 16 aa, Mycobacterium tuberculosis
MVCNRIIDNAAVSAAS

SEQ ID NO: 194857 - protein, 16 aa, Mycobacterium tuberculosis
VCNRIIDNAAVSAASM

SEQ ID NO: 194858 - protein, 16 aa, Mycobacterium tuberculosis
CNRIIDNAAVSAASMV

SEQ ID NO: 194859 - protein, 16 aa, Mycobacterium tuberculosis
NRIIDNAAVSAASMVR

SEQ ID NO: 194860 - protein, 16 aa, Mycobacterium tuberculosis
RIIDNAAVSAASMVRR

SEQ ID NO: 194861 - protein, 16 aa, Mycobacterium tuberculosis
IIDNAAVSAASMVRRP

SEQ ID NO: 194862 - protein, 16 aa, Mycobacterium tuberculosis
IDNAAVSAASMVRRPV

SEQ ID NO: 194863 - protein, 16 aa, Mycobacterium tuberculosis
DNAAVSAASMVRRPVT

SEQ ID NO: 194864 - protein, 16 aa, Mycobacterium tuberculosis
NAAVSAASMVRRPVTV

SEQ ID NO: 194865 - protein, 16 aa, Mycobacterium tuberculosis
AAVSAASMVRRPVTVA

SEQ ID NO: 194866 - protein, 16 aa, Mycobacterium tuberculosis
AVSAASMVRRPVTVAR

SEQ ID NO: 194867 - protein, 16 aa, Mycobacterium tuberculosis
VSAASMVRRPVTVARH

SEQ ID NO: 194868 - protein, 16 aa, Mycobacterium tuberculosis
SAASMVRRPVTVARHQ

SEQ ID NO: 194869 - protein, 16 aa, Mycobacterium tuberculosis
AASMVRRPVTVARHQA

SEQ ID NO: 194870 - protein, 16 aa, Mycobacterium tuberculosis
ASMVRRPVTVARHQAL

SEQ ID NO: 194871 - protein, 16 aa, Mycobacterium tuberculosis
SMVRRPVTVARHQALA

SEQ ID NO: 194872 - protein, 16 aa, Mycobacterium tuberculosis
MVRRPVTVARHQALAH

SEQ ID NO: 194873 - protein, 16 aa, Mycobacterium tuberculosis
VRRPVTVARHQALAHP

SEQ ID NO: 194874 - protein, 16 aa, Mycobacterium tuberculosis
RRPVTVARHQALAHPV

SEQ ID NO: 194875 - protein, 16 aa, Mycobacterium tuberculosis
RPVTVARHQALAHPVR

SEQ ID NO: 194876 - protein, 16 aa, Mycobacterium tuberculosis
PVTVARHQALAHPVRH

SEQ ID NO: 194877 - protein, 16 aa, Mycobacterium tuberculosis
VTVARHQALAHPVRHG

SEQ ID NO: 194878 - protein, 16 aa, Mycobacterium tuberculosis
TVARHQALAHPVRHGA

SEQ ID NO: 194879 - protein, 16 aa, Mycobacterium tuberculosis
VARHQALAHPVRHGAK

SEQ ID NO: 194880 - protein, 16 aa, Mycobacterium tuberculosis
ARHQALAHPVRHGAKV

SEQ ID NO: 194881 - protein, 16 aa, Mycobacterium tuberculosis
RHQALAHPVRHGAKVF

SEQ ID NO: 194882 - protein, 16 aa, Mycobacterium tuberculosis
HQALAHPVRHGAKVFG

SEQ ID NO: 194883 - protein, 16 aa, Mycobacterium tuberculosis
QALAHPVRHGAKVFGV

SEQ ID NO: 194884 - protein, 16 aa, Mycobacterium tuberculosis
ALAHPVRHGAKVFGVE

SEQ ID NO: 194885 - protein, 16 aa, Mycobacterium tuberculosis
LAHPVRHGAKVFGVEG

SEQ ID NO: 194886 - protein, 16 aa, Mycobacterium tuberculosis
AHPVRHGAKVFGVEGS

SEQ ID NO: 194887 - protein, 16 aa, Mycobacterium tuberculosis
HPVRHGAKVFGVEGSY

SEQ ID NO: 194888 - protein, 16 aa, Mycobacterium tuberculosis
PVRHGAKVFGVEGSYS

SEQ ID NO: 194889 - protein, 16 aa, Mycobacterium tuberculosis
VRHGAKVFGVEGSYSA

SEQ ID NO: 194890 - protein, 16 aa, Mycobacterium tuberculosis
RHGAKVFGVEGSYSAD

SEQ ID NO: 194891 - protein, 16 aa, Mycobacterium tuberculosis
HGAKVFGVEGSYSADW

SEQ ID NO: 194892 - protein, 16 aa, Mycobacterium tuberculosis
GAKVFGVEGSYSADWA

SEQ ID NO: 194893 - protein, 16 aa, Mycobacterium tuberculosis
AKVFGVEGSYSADWAA

SEQ ID NO: 194894 - protein, 16 aa, Mycobacterium tuberculosis
KVFGVEGSYSADWAAW

SEQ ID NO: 194895 - protein, 16 aa, Mycobacterium tuberculosis
VFGVEGSYSADWAAWA

SEQ ID NO: 194896 - protein, 16 aa, Mycobacterium tuberculosis
FGVEGSYSADWAAWAN

SEQ ID NO: 194897 - protein, 16 aa, Mycobacterium tuberculosis
GVEGSYSADWAAWANG

SEQ ID NO: 194898 - protein, 16 aa, Mycobacterium tuberculosis
VEGSYSADWAAWANGV

SEQ ID NO: 194899 - protein, 16 aa, Mycobacterium tuberculosis
EGSYSADWAAWANGVA

SEQ ID NO: 194900 - protein, 16 aa, Mycobacterium tuberculosis
GSYSADWAAWANGVAA

SEQ ID NO: 194901 - protein, 16 aa, Mycobacterium tuberculosis
SYSADWAAWANGVAAR

SEQ ID NO: 194902 - protein, 16 aa, Mycobacterium tuberculosis
YSADWAAWANGVAARE

SEQ ID NO: 194903 - protein, 16 aa, Mycobacterium tuberculosis
SADWAAWANGVAAREL

SEQ ID NO: 194904 - protein, 16 aa, Mycobacterium tuberculosis
ADWAAWANGVAARELD

SEQ ID NO: 194905 - protein, 16 aa, Mycobacterium tuberculosis
DWAAWANGVAARELDF

SEQ ID NO: 194906 - protein, 16 aa, Mycobacterium tuberculosis
WAAWANGVAARELDFH

SEQ ID NO: 194907 - protein, 16 aa, Mycobacterium tuberculosis
AAWANGVAARELDFHD

SEQ ID NO: 194908 - protein, 16 aa, Mycobacterium tuberculosis
AWANGVAARELDFHDT

SEQ ID NO: 194909 - protein, 16 aa, Mycobacterium tuberculosis
WANGVAARELDFHDTF

SEQ ID NO: 194910 - protein, 16 aa, Mycobacterium tuberculosis
ANGVAARELDFHDTFL

SEQ ID NO: 194911 - protein, 16 aa, Mycobacterium tuberculosis
NGVAARELDFHDTFLA

SEQ ID NO: 194912 - protein, 16 aa, Mycobacterium tuberculosis
GVAARELDFHDTFLAA

SEQ ID NO: 194913 - protein, 16 aa, Mycobacterium tuberculosis
VAARELDFHDTFLAAD

SEQ ID NO: 194914 - protein, 16 aa, Mycobacterium tuberculosis
AARELDFHDTFLAADY

SEQ ID NO: 194915 - protein, 16 aa, Mycobacterium tuberculosis
ARELDFHDTFLAADYS

SEQ ID NO: 194916 - protein, 16 aa, Mycobacterium tuberculosis
RELDFHDTFLAADYSH

SEQ ID NO: 194917 - protein, 16 aa, Mycobacterium tuberculosis
ELDFHDTFLAADYSHP

SEQ ID NO: 194918 - protein, 16 aa, Mycobacterium tuberculosis
LDFHDTFLAADYSHPA

SEQ ID NO: 194919 - protein, 16 aa, Mycobacterium tuberculosis
DFHDTFLAADYSHPAD

SEQ ID NO: 194920 - protein, 16 aa, Mycobacterium tuberculosis
FHDTFLAADYSHPADN

SEQ ID NO: 194921 - protein, 16 aa, Mycobacterium tuberculosis
HDTFLAADYSHPADNI

SEQ ID NO: 194922 - protein, 16 aa, Mycobacterium tuberculosis
DTFLAADYSHPADNIP

SEQ ID NO: 194923 - protein, 16 aa, Mycobacterium tuberculosis
TFLAADYSHPADNIPP

SEQ ID NO: 194924 - protein, 16 aa, Mycobacterium tuberculosis
FLAADYSHPADNIPPL

SEQ ID NO: 194925 - protein, 16 aa, Mycobacterium tuberculosis
LAADYSHPADNIPPLV

SEQ ID NO: 194926 - protein, 16 aa, Mycobacterium tuberculosis
AADYSHPADNIPPLVA

SEQ ID NO: 194927 - protein, 16 aa, Mycobacterium tuberculosis
ADYSHPADNIPPLVAV

SEQ ID NO: 194928 - protein, 16 aa, Mycobacterium tuberculosis
DYSHPADNIPPLVAVA

SEQ ID NO: 194929 - protein, 16 aa, Mycobacterium tuberculosis
YSHPADNIPPLVAVAQ

SEQ ID NO: 194930 - protein, 16 aa, Mycobacterium tuberculosis
SHPADNIPPLVAVAQQ

SEQ ID NO: 194931 - protein, 16 aa, Mycobacterium tuberculosis
HPADNIPPLVAVAQQL

SEQ ID NO: 194932 - protein, 16 aa, Mycobacterium tuberculosis
PADNIPPLVAVAQQLG

SEQ ID NO: 194933 - protein, 16 aa, Mycobacterium tuberculosis
ADNIPPLVAVAQQLGV

SEQ ID NO: 194934 - protein, 16 aa, Mycobacterium tuberculosis
DNIPPLVAVAQQLGVC

SEQ ID NO: 194935 - protein, 16 aa, Mycobacterium tuberculosis
NIPPLVAVAQQLGVCG

SEQ ID NO: 194936 - protein, 16 aa, Mycobacterium tuberculosis
IPPLVAVAQQLGVCGA

SEQ ID NO: 194937 - protein, 16 aa, Mycobacterium tuberculosis
PPLVAVAQQLGVCGAE

SEQ ID NO: 194938 - protein, 16 aa, Mycobacterium tuberculosis
PLVAVAQQLGVCGAEL

SEQ ID NO: 194939 - protein, 16 aa, Mycobacterium tuberculosis
LVAVAQQLGVCGAELI

SEQ ID NO: 194940 - protein, 16 aa, Mycobacterium tuberculosis
VAVAQQLGVCGAELIR

SEQ ID NO: 194941 - protein, 16 aa, Mycobacterium tuberculosis
AVAQQLGVCGAELIRG

SEQ ID NO: 194942 - protein, 16 aa, Mycobacterium tuberculosis
VAQQLGVCGAELIRGL

SEQ ID NO: 194943 - protein, 16 aa, Mycobacterium tuberculosis
AQQLGVCGAELIRGLV

SEQ ID NO: 194944 - protein, 16 aa, Mycobacterium tuberculosis
QQLGVCGAELIRGLVT

SEQ ID NO: 194945 - protein, 16 aa, Mycobacterium tuberculosis
QLGVCGAELIRGLVTA

SEQ ID NO: 194946 - protein, 16 aa, Mycobacterium tuberculosis
LGVCGAELIRGLVTAY

SEQ ID NO: 194947 - protein, 16 aa, Mycobacterium tuberculosis
GVCGAELIRGLVTAYE

SEQ ID NO: 194948 - protein, 16 aa, Mycobacterium tuberculosis
VCGAELIRGLVTAYEI

SEQ ID NO: 194949 - protein, 16 aa, Mycobacterium tuberculosis
CGAELIRGLVTAYEIH

SEQ ID NO: 194950 - protein, 16 aa, Mycobacterium tuberculosis
GAELIRGLVTAYEIHI

SEQ ID NO: 194951 - protein, 16 aa, Mycobacterium tuberculosis
AELIRGLVTAYEIHID

SEQ ID NO: 194952 - protein, 16 aa, Mycobacterium tuberculosis
ELIRGLVTAYEIHIDL

SEQ ID NO: 194953 - protein, 16 aa, Mycobacterium tuberculosis
LIRGLVTAYEIHIDLT

SEQ ID NO: 194954 - protein, 16 aa, Mycobacterium tuberculosis
IRGLVTAYEIHIDLTR

SEQ ID NO: 194955 - protein, 16 aa, Mycobacterium tuberculosis
RGLVTAYEIHIDLTRG

SEQ ID NO: 194956 - protein, 16 aa, Mycobacterium tuberculosis
GLVTAYEIHIDLTRGI

SEQ ID NO: 194957 - protein, 16 aa, Mycobacterium tuberculosis
LVTAYEIHIDLTRGIC

SEQ ID NO: 194958 - protein, 16 aa, Mycobacterium tuberculosis
VTAYEIHIDLTRGICL

SEQ ID NO: 194959 - protein, 16 aa, Mycobacterium tuberculosis
TAYEIHIDLTRGICLH

SEQ ID NO: 194960 - protein, 16 aa, Mycobacterium tuberculosis
AYEIHIDLTRGICLHE

SEQ ID NO: 194961 - protein, 16 aa, Mycobacterium tuberculosis
YEIHIDLTRGICLHEH

SEQ ID NO: 194962 - protein, 16 aa, Mycobacterium tuberculosis
EIHIDLTRGICLHEHK

SEQ ID NO: 194963 - protein, 16 aa, Mycobacterium tuberculosis
IHIDLTRGICLHEHKI

SEQ ID NO: 194964 - protein, 16 aa, Mycobacterium tuberculosis
HIDLTRGICLHEHKID

SEQ ID NO: 194965 - protein, 16 aa, Mycobacterium tuberculosis
IDLTRGICLHEHKIDH

SEQ ID NO: 194966 - protein, 16 aa, Mycobacterium tuberculosis
DLTRGICLHEHKIDHV

SEQ ID NO: 194967 - protein, 16 aa, Mycobacterium tuberculosis
LTRGICLHEHKIDHVA

SEQ ID NO: 194968 - protein, 16 aa, Mycobacterium tuberculosis
TRGICLHEHKIDHVAH

SEQ ID NO: 194969 - protein, 16 aa, Mycobacterium tuberculosis
RGICLHEHKIDHVAHL

SEQ ID NO: 194970 - protein, 16 aa, Mycobacterium tuberculosis
GICLHEHKIDHVAHLG

SEQ ID NO: 194971 - protein, 16 aa, Mycobacterium tuberculosis
ICLHEHKIDHVAHLGP

SEQ ID NO: 194972 - protein, 16 aa, Mycobacterium tuberculosis
CLHEHKIDHVAHLGPA

SEQ ID NO: 194973 - protein, 16 aa, Mycobacterium tuberculosis
LHEHKIDHVAHLGPAV

SEQ ID NO: 194974 - protein, 16 aa, Mycobacterium tuberculosis
HEHKIDHVAHLGPAVA

SEQ ID NO: 194975 - protein, 16 aa, Mycobacterium tuberculosis
EHKIDHVAHLGPAVAA

SEQ ID NO: 194976 - protein, 16 aa, Mycobacterium tuberculosis
HKIDHVAHLGPAVAAG

SEQ ID NO: 194977 - protein, 16 aa, Mycobacterium tuberculosis
KIDHVAHLGPAVAAGI

SEQ ID NO: 194978 - protein, 16 aa, Mycobacterium tuberculosis
IDHVAHLGPAVAAGIG

SEQ ID NO: 194979 - protein, 16 aa, Mycobacterium tuberculosis
DHVAHLGPAVAAGIGT

SEQ ID NO: 194980 - protein, 16 aa, Mycobacterium tuberculosis
HVAHLGPAVAAGIGTM

SEQ ID NO: 194981 - protein, 16 aa, Mycobacterium tuberculosis
VAHLGPAVAAGIGTML

SEQ ID NO: 194982 - protein, 16 aa, Mycobacterium tuberculosis
AHLGPAVAAGIGTMLR

SEQ ID NO: 194983 - protein, 16 aa, Mycobacterium tuberculosis
HLGPAVAAGIGTMLRL

SEQ ID NO: 194984 - protein, 16 aa, Mycobacterium tuberculosis
LGPAVAAGIGTMLRLD

SEQ ID NO: 194985 - protein, 16 aa, Mycobacterium tuberculosis
GPAVAAGIGTMLRLDQ

SEQ ID NO: 194986 - protein, 16 aa, Mycobacterium tuberculosis
PAVAAGIGTMLRLDQE

SEQ ID NO: 194987 - protein, 16 aa, Mycobacterium tuberculosis
AVAAGIGTMLRLDQET

SEQ ID NO: 194988 - protein, 16 aa, Mycobacterium tuberculosis
VAAGIGTMLRLDQETI

SEQ ID NO: 194989 - protein, 16 aa, Mycobacterium tuberculosis
AAGIGTMLRLDQETIY

SEQ ID NO: 194990 - protein, 16 aa, Mycobacterium tuberculosis
AGIGTMLRLDQETIYH

SEQ ID NO: 194991 - protein, 16 aa, Mycobacterium tuberculosis
GIGTMLRLDQETIYHA

SEQ ID NO: 194992 - protein, 16 aa, Mycobacterium tuberculosis
IGTMLRLDQETIYHAI

SEQ ID NO: 194993 - protein, 16 aa, Mycobacterium tuberculosis
GTMLRLDQETIYHAIG

SEQ ID NO: 194994 - protein, 16 aa, Mycobacterium tuberculosis
TMLRLDQETIYHAIGQ

SEQ ID NO: 194995 - protein, 16 aa, Mycobacterium tuberculosis
MLRLDQETIYHAIGQA

SEQ ID NO: 194996 - protein, 16 aa, Mycobacterium tuberculosis
LRLDQETIYHAIGQAL

SEQ ID NO: 194997 - protein, 16 aa, Mycobacterium tuberculosis
RLDQETIYHAIGQALH

SEQ ID NO: 194998 - protein, 16 aa, Mycobacterium tuberculosis
LDQETIYHAIGQALHL

SEQ ID NO: 194999 - protein, 16 aa, Mycobacterium tuberculosis
DQETIYHAIGQALHLT

SEQ ID NO: 195000 - protein, 16 aa, Mycobacterium tuberculosis
QETIYHAIGQALHLTT

SEQ ID NO: 195001 - protein, 16 aa, Mycobacterium tuberculosis
ETIYHAIGQALHLTTS

SEQ ID NO: 195002 - protein, 16 aa, Mycobacterium tuberculosis
TIYHAIGQALHLTTST

SEQ ID NO: 195003 - protein, 16 aa, Mycobacterium tuberculosis
IYHAIGQALHLTTSTR

SEQ ID NO: 195004 - protein, 16 aa, Mycobacterium tuberculosis
YHAIGQALHLTTSTRQ

SEQ ID NO: 195005 - protein, 16 aa, Mycobacterium tuberculosis
HAIGQALHLTTSTRQS

SEQ ID NO: 195006 - protein, 16 aa, Mycobacterium tuberculosis
AIGQALHLTTSTRQSR

SEQ ID NO: 195007 - protein, 16 aa, Mycobacterium tuberculosis
IGQALHLTTSTRQSRK

SEQ ID NO: 195008 - protein, 16 aa, Mycobacterium tuberculosis
GQALHLTTSTRQSRKG

SEQ ID NO: 195009 - protein, 16 aa, Mycobacterium tuberculosis
QALHLTTSTRQSRKGA

SEQ ID NO: 195010 - protein, 16 aa, Mycobacterium tuberculosis
ALHLTTSTRQSRKGAI

SEQ ID NO: 195011 - protein, 16 aa, Mycobacterium tuberculosis
LHLTTSTRQSRKGAIS

SEQ ID NO: 195012 - protein, 16 aa, Mycobacterium tuberculosis
HLTTSTRQSRKGAISS

SEQ ID NO: 195013 - protein, 16 aa, Mycobacterium tuberculosis
LTTSTRQSRKGAISSW

SEQ ID NO: 195014 - protein, 16 aa, Mycobacterium tuberculosis
TTSTRQSRKGAISSWK

SEQ ID NO: 195015 - protein, 16 aa, Mycobacterium tuberculosis
TSTRQSRKGAISSWKA

SEQ ID NO: 195016 - protein, 16 aa, Mycobacterium tuberculosis
STRQSRKGAISSWKAF

SEQ ID NO: 195017 - protein, 16 aa, Mycobacterium tuberculosis
TRQSRKGAISSWKAFA

SEQ ID NO: 195018 - protein, 16 aa, Mycobacterium tuberculosis
RQSRKGAISSWKAFAP

SEQ ID NO: 195019 - protein, 16 aa, Mycobacterium tuberculosis
QSRKGAISSWKAFAPA

SEQ ID NO: 195020 - protein, 16 aa, Mycobacterium tuberculosis
SRKGAISSWKAFAPAH

SEQ ID NO: 195021 - protein, 16 aa, Mycobacterium tuberculosis
RKGAISSWKAFAPAHA

SEQ ID NO: 195022 - protein, 16 aa, Mycobacterium tuberculosis
KGAISSWKAFAPAHAG

SEQ ID NO: 195023 - protein, 16 aa, Mycobacterium tuberculosis
GAISSWKAFAPAHAGK

SEQ ID NO: 195024 - protein, 16 aa, Mycobacterium tuberculosis
AISSWKAFAPAHAGKV

SEQ ID NO: 195025 - protein, 16 aa, Mycobacterium tuberculosis
ISSWKAFAPAHAGKVG

SEQ ID NO: 195026 - protein, 16 aa, Mycobacterium tuberculosis
SSWKAFAPAHAGKVGI

SEQ ID NO: 195027 - protein, 16 aa, Mycobacterium tuberculosis
SWKAFAPAHAGKVGIE

SEQ ID NO: 195028 - protein, 16 aa, Mycobacterium tuberculosis
WKAFAPAHAGKVGIEA

SEQ ID NO: 195029 - protein, 16 aa, Mycobacterium tuberculosis
KAFAPAHAGKVGIEAV

SEQ ID NO: 195030 - protein, 16 aa, Mycobacterium tuberculosis
AFAPAHAGKVGIEAVD

SEQ ID NO: 195031 - protein, 16 aa, Mycobacterium tuberculosis
FAPAHAGKVGIEAVDR

SEQ ID NO: 195032 - protein, 16 aa, Mycobacterium tuberculosis
APAHAGKVGIEAVDRA

SEQ ID NO: 195033 - protein, 16 aa, Mycobacterium tuberculosis
PAHAGKVGIEAVDRAM

SEQ ID NO: 195034 - protein, 16 aa, Mycobacterium tuberculosis
AHAGKVGIEAVDRAMR

SEQ ID NO: 195035 - protein, 16 aa, Mycobacterium tuberculosis
HAGKVGIEAVDRAMRG

SEQ ID NO: 195036 - protein, 16 aa, Mycobacterium tuberculosis
AGKVGIEAVDRAMRGE

SEQ ID NO: 195037 - protein, 16 aa, Mycobacterium tuberculosis
GKVGIEAVDRAMRGEG

SEQ ID NO: 195038 - protein, 16 aa, Mycobacterium tuberculosis
KVGIEAVDRAMRGEGS

SEQ ID NO: 195039 - protein, 16 aa, Mycobacterium tuberculosis
VGIEAVDRAMRGEGSP

SEQ ID NO: 195040 - protein, 16 aa, Mycobacterium tuberculosis
GIEAVDRAMRGEGSPA

SEQ ID NO: 195041 - protein, 16 aa, Mycobacterium tuberculosis
IEAVDRAMRGEGSPAP

SEQ ID NO: 195042 - protein, 16 aa, Mycobacterium tuberculosis
EAVDRAMRGEGSPAPI

SEQ ID NO: 195043 - protein, 16 aa, Mycobacterium tuberculosis
AVDRAMRGEGSPAPIW

SEQ ID NO: 195044 - protein, 16 aa, Mycobacterium tuberculosis
VDRAMRGEGSPAPIWE

SEQ ID NO: 195045 - protein, 16 aa, Mycobacterium tuberculosis
DRAMRGEGSPAPIWEG

SEQ ID NO: 195046 - protein, 16 aa, Mycobacterium tuberculosis
RAMRGEGSPAPIWEGE

SEQ ID NO: 195047 - protein, 16 aa, Mycobacterium tuberculosis
AMRGEGSPAPIWEGED

SEQ ID NO: 195048 - protein, 16 aa, Mycobacterium tuberculosis
MRGEGSPAPIWEGEDG

SEQ ID NO: 195049 - protein, 16 aa, Mycobacterium tuberculosis
RGEGSPAPIWEGEDGV

SEQ ID NO: 195050 - protein, 16 aa, Mycobacterium tuberculosis
GEGSPAPIWEGEDGVI

SEQ ID NO: 195051 - protein, 16 aa, Mycobacterium tuberculosis
EGSPAPIWEGEDGVIA

SEQ ID NO: 195052 - protein, 16 aa, Mycobacterium tuberculosis
GSPAPIWEGEDGVIAW

SEQ ID NO: 195053 - protein, 16 aa, Mycobacterium tuberculosis
SPAPIWEGEDGVIAWL

SEQ ID NO: 195054 - protein, 16 aa, Mycobacterium tuberculosis
PAPIWEGEDGVIAWLL

SEQ ID NO: 195055 - protein, 16 aa, Mycobacterium tuberculosis
APIWEGEDGVIAWLLA

SEQ ID NO: 195056 - protein, 16 aa, Mycobacterium tuberculosis
PIWEGEDGVIAWLLAG

SEQ ID NO: 195057 - protein, 16 aa, Mycobacterium tuberculosis
IWEGEDGVIAWLLAGP

SEQ ID NO: 195058 - protein, 16 aa, Mycobacterium tuberculosis
WEGEDGVIAWLLAGPE

SEQ ID NO: 195059 - protein, 16 aa, Mycobacterium tuberculosis
EGEDGVIAWLLAGPEH

SEQ ID NO: 195060 - protein, 16 aa, Mycobacterium tuberculosis
GEDGVIAWLLAGPEHT

SEQ ID NO: 195061 - protein, 16 aa, Mycobacterium tuberculosis
EDGVIAWLLAGPEHTY

SEQ ID NO: 195062 - protein, 16 aa, Mycobacterium tuberculosis
DGVIAWLLAGPEHTYR

SEQ ID NO: 195063 - protein, 16 aa, Mycobacterium tuberculosis
GVIAWLLAGPEHTYRV

SEQ ID NO: 195064 - protein, 16 aa, Mycobacterium tuberculosis
VIAWLLAGPEHTYRVP

SEQ ID NO: 195065 - protein, 16 aa, Mycobacterium tuberculosis
IAWLLAGPEHTYRVPL

SEQ ID NO: 195066 - protein, 16 aa, Mycobacterium tuberculosis
AWLLAGPEHTYRVPLP

SEQ ID NO: 195067 - protein, 16 aa, Mycobacterium tuberculosis
WLLAGPEHTYRVPLPA

SEQ ID NO: 195068 - protein, 16 aa, Mycobacterium tuberculosis
LLAGPEHTYRVPLPAP

SEQ ID NO: 195069 - protein, 16 aa, Mycobacterium tuberculosis
LAGPEHTYRVPLPAPG

SEQ ID NO: 195070 - protein, 16 aa, Mycobacterium tuberculosis
AGPEHTYRVPLPAPGE

SEQ ID NO: 195071 - protein, 16 aa, Mycobacterium tuberculosis
GPEHTYRVPLPAPGEP

SEQ ID NO: 195072 - protein, 16 aa, Mycobacterium tuberculosis
PEHTYRVPLPAPGEPK

SEQ ID NO: 195073 - protein, 16 aa, Mycobacterium tuberculosis
EHTYRVPLPAPGEPKR

SEQ ID NO: 195074 - protein, 16 aa, Mycobacterium tuberculosis
HTYRVPLPAPGEPKRA

SEQ ID NO: 195075 - protein, 16 aa, Mycobacterium tuberculosis
TYRVPLPAPGEPKRAI

SEQ ID NO: 195076 - protein, 16 aa, Mycobacterium tuberculosis
YRVPLPAPGEPKRAIL

SEQ ID NO: 195077 - protein, 16 aa, Mycobacterium tuberculosis
RVPLPAPGEPKRAILD

SEQ ID NO: 195078 - protein, 16 aa, Mycobacterium tuberculosis
VPLPAPGEPKRAILDS

SEQ ID NO: 195079 - protein, 16 aa, Mycobacterium tuberculosis
PLPAPGEPKRAILDSY

SEQ ID NO: 195080 - protein, 16 aa, Mycobacterium tuberculosis
LPAPGEPKRAILDSYT

SEQ ID NO: 195081 - protein, 16 aa, Mycobacterium tuberculosis
PAPGEPKRAILDSYTK

SEQ ID NO: 195082 - protein, 16 aa, Mycobacterium tuberculosis
APGEPKRAILDSYTKQ

SEQ ID NO: 195083 - protein, 16 aa, Mycobacterium tuberculosis
PGEPKRAILDSYTKQH

SEQ ID NO: 195084 - protein, 16 aa, Mycobacterium tuberculosis
GEPKRAILDSYTKQHS

SEQ ID NO: 195085 - protein, 16 aa, Mycobacterium tuberculosis
EPKRAILDSYTKQHSA

SEQ ID NO: 195086 - protein, 16 aa, Mycobacterium tuberculosis
PKRAILDSYTKQHSAE

SEQ ID NO: 195087 - protein, 16 aa, Mycobacterium tuberculosis
KRAILDSYTKQHSAEY

SEQ ID NO: 195088 - protein, 16 aa, Mycobacterium tuberculosis
RAILDSYTKQHSAEYQ

SEQ ID NO: 195089 - protein, 16 aa, Mycobacterium tuberculosis
AILDSYTKQHSAEYQS

SEQ ID NO: 195090 - protein, 16 aa, Mycobacterium tuberculosis
ILDSYTKQHSAEYQSQ

SEQ ID NO: 195091 - protein, 16 aa, Mycobacterium tuberculosis
LDSYTKQHSAEYQSQA

SEQ ID NO: 195092 - protein, 16 aa, Mycobacterium tuberculosis
DSYTKQHSAEYQSQAP

SEQ ID NO: 195093 - protein, 16 aa, Mycobacterium tuberculosis
SYTKQHSAEYQSQAPI

SEQ ID NO: 195094 - protein, 16 aa, Mycobacterium tuberculosis
YTKQHSAEYQSQAPID

SEQ ID NO: 195095 - protein, 16 aa, Mycobacterium tuberculosis
TKQHSAEYQSQAPIDL

SEQ ID NO: 195096 - protein, 16 aa, Mycobacterium tuberculosis
KQHSAEYQSQAPIDLA

SEQ ID NO: 195097 - protein, 16 aa, Mycobacterium tuberculosis
QHSAEYQSQAPIDLAC

SEQ ID NO: 195098 - protein, 16 aa, Mycobacterium tuberculosis
HSAEYQSQAPIDLACR

SEQ ID NO: 195099 - protein, 16 aa, Mycobacterium tuberculosis
SAEYQSQAPIDLACRL

SEQ ID NO: 195100 - protein, 16 aa, Mycobacterium tuberculosis
AEYQSQAPIDLACRLR

SEQ ID NO: 195101 - protein, 16 aa, Mycobacterium tuberculosis
EYQSQAPIDLACRLRE

SEQ ID NO: 195102 - protein, 16 aa, Mycobacterium tuberculosis
YQSQAPIDLACRLRER

SEQ ID NO: 195103 - protein, 16 aa, Mycobacterium tuberculosis
QSQAPIDLACRLRERI

SEQ ID NO: 195104 - protein, 16 aa, Mycobacterium tuberculosis
SQAPIDLACRLRERIG

SEQ ID NO: 195105 - protein, 16 aa, Mycobacterium tuberculosis
QAPIDLACRLRERIGD

SEQ ID NO: 195106 - protein, 16 aa, Mycobacterium tuberculosis
APIDLACRLRERIGDL

SEQ ID NO: 195107 - protein, 16 aa, Mycobacterium tuberculosis
PIDLACRLRERIGDLD

SEQ ID NO: 195108 - protein, 16 aa, Mycobacterium tuberculosis
IDLACRLRERIGDLDQ

SEQ ID NO: 195109 - protein, 16 aa, Mycobacterium tuberculosis
DLACRLRERIGDLDQI

SEQ ID NO: 195110 - protein, 16 aa, Mycobacterium tuberculosis
LACRLRERIGDLDQIA

SEQ ID NO: 195111 - protein, 16 aa, Mycobacterium tuberculosis
ACRLRERIGDLDQIAS

SEQ ID NO: 195112 - protein, 16 aa, Mycobacterium tuberculosis
CRLRERIGDLDQIASI

SEQ ID NO: 195113 - protein, 16 aa, Mycobacterium tuberculosis
RLRERIGDLDQIASIV

SEQ ID NO: 195114 - protein, 16 aa, Mycobacterium tuberculosis
LRERIGDLDQIASIVL

SEQ ID NO: 195115 - protein, 16 aa, Mycobacterium tuberculosis
RERIGDLDQIASIVLH

SEQ ID NO: 195116 - protein, 16 aa, Mycobacterium tuberculosis
ERIGDLDQIASIVLHT

SEQ ID NO: 195117 - protein, 16 aa, Mycobacterium tuberculosis
RIGDLDQIASIVLHTS

SEQ ID NO: 195118 - protein, 16 aa, Mycobacterium tuberculosis
IGDLDQIASIVLHTSH

SEQ ID NO: 195119 - protein, 16 aa, Mycobacterium tuberculosis
GDLDQIASIVLHTSHH

SEQ ID NO: 195120 - protein, 16 aa, Mycobacterium tuberculosis
DLDQIASIVLHTSHHT

SEQ ID NO: 195121 - protein, 16 aa, Mycobacterium tuberculosis
LDQIASIVLHTSHHTH

SEQ ID NO: 195122 - protein, 16 aa, Mycobacterium tuberculosis
DQIASIVLHTSHHTHV

SEQ ID NO: 195123 - protein, 16 aa, Mycobacterium tuberculosis
QIASIVLHTSHHTHVV

SEQ ID NO: 195124 - protein, 16 aa, Mycobacterium tuberculosis
IASIVLHTSHHTHVVI

SEQ ID NO: 195125 - protein, 16 aa, Mycobacterium tuberculosis
ASIVLHTSHHTHVVIG

SEQ ID NO: 195126 - protein, 16 aa, Mycobacterium tuberculosis
SIVLHTSHHTHVVIGT

SEQ ID NO: 195127 - protein, 16 aa, Mycobacterium tuberculosis
IVLHTSHHTHVVIGTG

SEQ ID NO: 195128 - protein, 16 aa, Mycobacterium tuberculosis
VLHTSHHTHVVIGTGS

SEQ ID NO: 195129 - protein, 16 aa, Mycobacterium tuberculosis
LHTSHHTHVVIGTGSG

SEQ ID NO: 195130 - protein, 16 aa, Mycobacterium tuberculosis
HTSHHTHVVIGTGSGD

SEQ ID NO: 195131 - protein, 16 aa, Mycobacterium tuberculosis
TSHHTHVVIGTGSGDP

SEQ ID NO: 195132 - protein, 16 aa, Mycobacterium tuberculosis
SHHTHVVIGTGSGDPQ

SEQ ID NO: 195133 - protein, 16 aa, Mycobacterium tuberculosis
HHTHVVIGTGSGDPQK

SEQ ID NO: 195134 - protein, 16 aa, Mycobacterium tuberculosis
HTHVVIGTGSGDPQKF

SEQ ID NO: 195135 - protein, 16 aa, Mycobacterium tuberculosis
THVVIGTGSGDPQKFD

SEQ ID NO: 195136 - protein, 16 aa, Mycobacterium tuberculosis
HVVIGTGSGDPQKFDP

SEQ ID NO: 195137 - protein, 16 aa, Mycobacterium tuberculosis
VVIGTGSGDPQKFDPD

SEQ ID NO: 195138 - protein, 16 aa, Mycobacterium tuberculosis
VIGTGSGDPQKFDPDA

SEQ ID NO: 195139 - protein, 16 aa, Mycobacterium tuberculosis
IGTGSGDPQKFDPDAS

SEQ ID NO: 195140 - protein, 16 aa, Mycobacterium tuberculosis
GTGSGDPQKFDPDASR

SEQ ID NO: 195141 - protein, 16 aa, Mycobacterium tuberculosis
TGSGDPQKFDPDASRE

SEQ ID NO: 195142 - protein, 16 aa, Mycobacterium tuberculosis
GSGDPQKFDPDASRET

SEQ ID NO: 195143 - protein, 16 aa, Mycobacterium tuberculosis
SGDPQKFDPDASRETL

SEQ ID NO: 195144 - protein, 16 aa, Mycobacterium tuberculosis
GDPQKFDPDASRETLD

SEQ ID NO: 195145 - protein, 16 aa, Mycobacterium tuberculosis
DPQKFDPDASRETLDH

SEQ ID NO: 195146 - protein, 16 aa, Mycobacterium tuberculosis
PQKFDPDASRETLDHS

SEQ ID NO: 195147 - protein, 16 aa, Mycobacterium tuberculosis
QKFDPDASRETLDHSL

SEQ ID NO: 195148 - protein, 16 aa, Mycobacterium tuberculosis
KFDPDASRETLDHSLP

SEQ ID NO: 195149 - protein, 16 aa, Mycobacterium tuberculosis
FDPDASRETLDHSLPY

SEQ ID NO: 195150 - protein, 16 aa, Mycobacterium tuberculosis
DPDASRETLDHSLPYI

SEQ ID NO: 195151 - protein, 16 aa, Mycobacterium tuberculosis
PDASRETLDHSLPYIF

SEQ ID NO: 195152 - protein, 16 aa, Mycobacterium tuberculosis
DASRETLDHSLPYIFA

SEQ ID NO: 195153 - protein, 16 aa, Mycobacterium tuberculosis
ASRETLDHSLPYIFAV

SEQ ID NO: 195154 - protein, 16 aa, Mycobacterium tuberculosis
SRETLDHSLPYIFAVA

SEQ ID NO: 195155 - protein, 16 aa, Mycobacterium tuberculosis
RETLDHSLPYIFAVAL

SEQ ID NO: 195156 - protein, 16 aa, Mycobacterium tuberculosis
ETLDHSLPYIFAVALQ

SEQ ID NO: 195157 - protein, 16 aa, Mycobacterium tuberculosis
TLDHSLPYIFAVALQD

SEQ ID NO: 195158 - protein, 16 aa, Mycobacterium tuberculosis
LDHSLPYIFAVALQDG

SEQ ID NO: 195159 - protein, 16 aa, Mycobacterium tuberculosis
DHSLPYIFAVALQDGC

SEQ ID NO: 195160 - protein, 16 aa, Mycobacterium tuberculosis
HSLPYIFAVALQDGCW

SEQ ID NO: 195161 - protein, 16 aa, Mycobacterium tuberculosis
SLPYIFAVALQDGCWH

SEQ ID NO: 195162 - protein, 16 aa, Mycobacterium tuberculosis
LPYIFAVALQDGCWHH

SEQ ID NO: 195163 - protein, 16 aa, Mycobacterium tuberculosis
PYIFAVALQDGCWHHE

SEQ ID NO: 195164 - protein, 16 aa, Mycobacterium tuberculosis
YIFAVALQDGCWHHER

SEQ ID NO: 195165 - protein, 16 aa, Mycobacterium tuberculosis
IFAVALQDGCWHHERS

SEQ ID NO: 195166 - protein, 16 aa, Mycobacterium tuberculosis
FAVALQDGCWHHERSY

SEQ ID NO: 195167 - protein, 16 aa, Mycobacterium tuberculosis
AVALQDGCWHHERSYA

SEQ ID NO: 195168 - protein, 16 aa, Mycobacterium tuberculosis
VALQDGCWHHERSYAP

SEQ ID NO: 195169 - protein, 16 aa, Mycobacterium tuberculosis
ALQDGCWHHERSYAPE

SEQ ID NO: 195170 - protein, 16 aa, Mycobacterium tuberculosis
LQDGCWHHERSYAPER

SEQ ID NO: 195171 - protein, 16 aa, Mycobacterium tuberculosis
QDGCWHHERSYAPERA

SEQ ID NO: 195172 - protein, 16 aa, Mycobacterium tuberculosis
DGCWHHERSYAPERAR

SEQ ID NO: 195173 - protein, 16 aa, Mycobacterium tuberculosis
GCWHHERSYAPERARR

SEQ ID NO: 195174 - protein, 16 aa, Mycobacterium tuberculosis
CWHHERSYAPERARRS

SEQ ID NO: 195175 - protein, 16 aa, Mycobacterium tuberculosis
WHHERSYAPERARRSD

SEQ ID NO: 195176 - protein, 16 aa, Mycobacterium tuberculosis
HHERSYAPERARRSDT

SEQ ID NO: 195177 - protein, 16 aa, Mycobacterium tuberculosis
HERSYAPERARRSDTV

SEQ ID NO: 195178 - protein, 16 aa, Mycobacterium tuberculosis
ERSYAPERARRSDTVA

SEQ ID NO: 195179 - protein, 16 aa, Mycobacterium tuberculosis
RSYAPERARRSDTVAL

SEQ ID NO: 195180 - protein, 16 aa, Mycobacterium tuberculosis
SYAPERARRSDTVALW

SEQ ID NO: 195181 - protein, 16 aa, Mycobacterium tuberculosis
YAPERARRSDTVALWH

SEQ ID NO: 195182 - protein, 16 aa, Mycobacterium tuberculosis
APERARRSDTVALWHK

SEQ ID NO: 195183 - protein, 16 aa, Mycobacterium tuberculosis
PERARRSDTVALWHKI

SEQ ID NO: 195184 - protein, 16 aa, Mycobacterium tuberculosis
ERARRSDTVALWHKIS

SEQ ID NO: 195185 - protein, 16 aa, Mycobacterium tuberculosis
RARRSDTVALWHKIST

SEQ ID NO: 195186 - protein, 16 aa, Mycobacterium tuberculosis
ARRSDTVALWHKISTV

SEQ ID NO: 195187 - protein, 16 aa, Mycobacterium tuberculosis
RRSDTVALWHKISTVE

SEQ ID NO: 195188 - protein, 16 aa, Mycobacterium tuberculosis
RSDTVALWHKISTVED

SEQ ID NO: 195189 - protein, 16 aa, Mycobacterium tuberculosis
SDTVALWHKISTVEDP

SEQ ID NO: 195190 - protein, 16 aa, Mycobacterium tuberculosis
DTVALWHKISTVEDPE

SEQ ID NO: 195191 - protein, 16 aa, Mycobacterium tuberculosis
TVALWHKISTVEDPEW

SEQ ID NO: 195192 - protein, 16 aa, Mycobacterium tuberculosis
VALWHKISTVEDPEWT

SEQ ID NO: 195193 - protein, 16 aa, Mycobacterium tuberculosis
ALWHKISTVEDPEWTR

SEQ ID NO: 195194 - protein, 16 aa, Mycobacterium tuberculosis
LWHKISTVEDPEWTRR

SEQ ID NO: 195195 - protein, 16 aa, Mycobacterium tuberculosis
WHKISTVEDPEWTRRY

SEQ ID NO: 195196 - protein, 16 aa, Mycobacterium tuberculosis
HKISTVEDPEWTRRYH

SEQ ID NO: 195197 - protein, 16 aa, Mycobacterium tuberculosis
KISTVEDPEWTRRYHC

SEQ ID NO: 195198 - protein, 16 aa, Mycobacterium tuberculosis
ISTVEDPEWTRRYHCA

SEQ ID NO: 195199 - protein, 16 aa, Mycobacterium tuberculosis
STVEDPEWTRRYHCAD

SEQ ID NO: 195200 - protein, 16 aa, Mycobacterium tuberculosis
TVEDPEWTRRYHCADP

SEQ ID NO: 195201 - protein, 16 aa, Mycobacterium tuberculosis
VEDPEWTRRYHCADPA

SEQ ID NO: 195202 - protein, 16 aa, Mycobacterium tuberculosis
EDPEWTRRYHCADPAK

SEQ ID NO: 195203 - protein, 16 aa, Mycobacterium tuberculosis
DPEWTRRYHCADPAKK

SEQ ID NO: 195204 - protein, 16 aa, Mycobacterium tuberculosis
PEWTRRYHCADPAKKA

SEQ ID NO: 195205 - protein, 16 aa, Mycobacterium tuberculosis
EWTRRYHCADPAKKAF

SEQ ID NO: 195206 - protein, 16 aa, Mycobacterium tuberculosis
WTRRYHCADPAKKAFG

SEQ ID NO: 195207 - protein, 16 aa, Mycobacterium tuberculosis
TRRYHCADPAKKAFGA

SEQ ID NO: 195208 - protein, 16 aa, Mycobacterium tuberculosis
RRYHCADPAKKAFGAR

SEQ ID NO: 195209 - protein, 16 aa, Mycobacterium tuberculosis
RYHCADPAKKAFGARA

SEQ ID NO: 195210 - protein, 16 aa, Mycobacterium tuberculosis
YHCADPAKKAFGARAE

SEQ ID NO: 195211 - protein, 16 aa, Mycobacterium tuberculosis
HCADPAKKAFGARAEV

SEQ ID NO: 195212 - protein, 16 aa, Mycobacterium tuberculosis
CADPAKKAFGARAEVT

SEQ ID NO: 195213 - protein, 16 aa, Mycobacterium tuberculosis
ADPAKKAFGARAEVTL

SEQ ID NO: 195214 - protein, 16 aa, Mycobacterium tuberculosis
DPAKKAFGARAEVTLH

SEQ ID NO: 195215 - protein, 16 aa, Mycobacterium tuberculosis
PAKKAFGARAEVTLHS

SEQ ID NO: 195216 - protein, 16 aa, Mycobacterium tuberculosis
AKKAFGARAEVTLHSG

SEQ ID NO: 195217 - protein, 16 aa, Mycobacterium tuberculosis
KKAFGARAEVTLHSGE

SEQ ID NO: 195218 - protein, 16 aa, Mycobacterium tuberculosis
KAFGARAEVTLHSGEV

SEQ ID NO: 195219 - protein, 16 aa, Mycobacterium tuberculosis
AFGARAEVTLHSGEVI

SEQ ID NO: 195220 - protein, 16 aa, Mycobacterium tuberculosis
FGARAEVTLHSGEVIV

SEQ ID NO: 195221 - protein, 16 aa, Mycobacterium tuberculosis
GARAEVTLHSGEVIVD

SEQ ID NO: 195222 - protein, 16 aa, Mycobacterium tuberculosis
ARAEVTLHSGEVIVDE

SEQ ID NO: 195223 - protein, 16 aa, Mycobacterium tuberculosis
RAEVTLHSGEVIVDEL

SEQ ID NO: 195224 - protein, 16 aa, Mycobacterium tuberculosis
AEVTLHSGEVIVDELA

SEQ ID NO: 195225 - protein, 16 aa, Mycobacterium tuberculosis
EVTLHSGEVIVDELAV

SEQ ID NO: 195226 - protein, 16 aa, Mycobacterium tuberculosis
VTLHSGEVIVDELAVA

SEQ ID NO: 195227 - protein, 16 aa, Mycobacterium tuberculosis
TLHSGEVIVDELAVAD

SEQ ID NO: 195228 - protein, 16 aa, Mycobacterium tuberculosis
LHSGEVIVDELAVADA

SEQ ID NO: 195229 - protein, 16 aa, Mycobacterium tuberculosis
HSGEVIVDELAVADAH

SEQ ID NO: 195230 - protein, 16 aa, Mycobacterium tuberculosis
SGEVIVDELAVADAHP

SEQ ID NO: 195231 - protein, 16 aa, Mycobacterium tuberculosis
GEVIVDELAVADAHPL

SEQ ID NO: 195232 - protein, 16 aa, Mycobacterium tuberculosis
EVIVDELAVADAHPLG

SEQ ID NO: 195233 - protein, 16 aa, Mycobacterium tuberculosis
VIVDELAVADAHPLGT

SEQ ID NO: 195234 - protein, 16 aa, Mycobacterium tuberculosis
IVDELAVADAHPLGTR

SEQ ID NO: 195235 - protein, 16 aa, Mycobacterium tuberculosis
VDELAVADAHPLGTRP

SEQ ID NO: 195236 - protein, 16 aa, Mycobacterium tuberculosis
DELAVADAHPLGTRPF

SEQ ID NO: 195237 - protein, 16 aa, Mycobacterium tuberculosis
ELAVADAHPLGTRPFE

SEQ ID NO: 195238 - protein, 16 aa, Mycobacterium tuberculosis
LAVADAHPLGTRPFER

SEQ ID NO: 195239 - protein, 16 aa, Mycobacterium tuberculosis
AVADAHPLGTRPFERK

SEQ ID NO: 195240 - protein, 16 aa, Mycobacterium tuberculosis
VADAHPLGTRPFERKQ

SEQ ID NO: 195241 - protein, 16 aa, Mycobacterium tuberculosis
ADAHPLGTRPFERKQY

SEQ ID NO: 195242 - protein, 16 aa, Mycobacterium tuberculosis
DAHPLGTRPFERKQYV

SEQ ID NO: 195243 - protein, 16 aa, Mycobacterium tuberculosis
AHPLGTRPFERKQYVE

SEQ ID NO: 195244 - protein, 16 aa, Mycobacterium tuberculosis
HPLGTRPFERKQYVEK

SEQ ID NO: 195245 - protein, 16 aa, Mycobacterium tuberculosis
PLGTRPFERKQYVEKF

SEQ ID NO: 195246 - protein, 16 aa, Mycobacterium tuberculosis
LGTRPFERKQYVEKFT

SEQ ID NO: 195247 - protein, 16 aa, Mycobacterium tuberculosis
GTRPFERKQYVEKFTE

SEQ ID NO: 195248 - protein, 16 aa, Mycobacterium tuberculosis
TRPFERKQYVEKFTEL

SEQ ID NO: 195249 - protein, 16 aa, Mycobacterium tuberculosis
RPFERKQYVEKFTELA

SEQ ID NO: 195250 - protein, 16 aa, Mycobacterium tuberculosis
PFERKQYVEKFTELAD

SEQ ID NO: 195251 - protein, 16 aa, Mycobacterium tuberculosis
FERKQYVEKFTELADG

SEQ ID NO: 195252 - protein, 16 aa, Mycobacterium tuberculosis
ERKQYVEKFTELADGV

SEQ ID NO: 195253 - protein, 16 aa, Mycobacterium tuberculosis
RKQYVEKFTELADGVV

SEQ ID NO: 195254 - protein, 16 aa, Mycobacterium tuberculosis
KQYVEKFTELADGVVE

SEQ ID NO: 195255 - protein, 16 aa, Mycobacterium tuberculosis
QYVEKFTELADGVVEP

SEQ ID NO: 195256 - protein, 16 aa, Mycobacterium tuberculosis
YVEKFTELADGVVEPV

SEQ ID NO: 195257 - protein, 16 aa, Mycobacterium tuberculosis
VEKFTELADGVVEPVE

SEQ ID NO: 195258 - protein, 16 aa, Mycobacterium tuberculosis
EKFTELADGVVEPVEQ

SEQ ID NO: 195259 - protein, 16 aa, Mycobacterium tuberculosis
KFTELADGVVEPVEQQ

SEQ ID NO: 195260 - protein, 16 aa, Mycobacterium tuberculosis
FTELADGVVEPVEQQR

SEQ ID NO: 195261 - protein, 16 aa, Mycobacterium tuberculosis
TELADGVVEPVEQQRF

SEQ ID NO: 195262 - protein, 16 aa, Mycobacterium tuberculosis
ELADGVVEPVEQQRFL

SEQ ID NO: 195263 - protein, 16 aa, Mycobacterium tuberculosis
LADGVVEPVEQQRFLA

SEQ ID NO: 195264 - protein, 16 aa, Mycobacterium tuberculosis
ADGVVEPVEQQRFLAV

SEQ ID NO: 195265 - protein, 16 aa, Mycobacterium tuberculosis
DGVVEPVEQQRFLAVV

SEQ ID NO: 195266 - protein, 16 aa, Mycobacterium tuberculosis
GVVEPVEQQRFLAVVE

SEQ ID NO: 195267 - protein, 16 aa, Mycobacterium tuberculosis
VVEPVEQQRFLAVVES

SEQ ID NO: 195268 - protein, 16 aa, Mycobacterium tuberculosis
VEPVEQQRFLAVVESL

SEQ ID NO: 195269 - protein, 16 aa, Mycobacterium tuberculosis
EPVEQQRFLAVVESLA

SEQ ID NO: 195270 - protein, 16 aa, Mycobacterium tuberculosis
PVEQQRFLAVVESLAD

SEQ ID NO: 195271 - protein, 16 aa, Mycobacterium tuberculosis
VEQQRFLAVVESLADL

SEQ ID NO: 195272 - protein, 16 aa, Mycobacterium tuberculosis
EQQRFLAVVESLADLE

SEQ ID NO: 195273 - protein, 16 aa, Mycobacterium tuberculosis
QQRFLAVVESLADLES

SEQ ID NO: 195274 - protein, 16 aa, Mycobacterium tuberculosis
QRFLAVVESLADLESG

SEQ ID NO: 195275 - protein, 16 aa, Mycobacterium tuberculosis
RFLAVVESLADLESGA

SEQ ID NO: 195276 - protein, 16 aa, Mycobacterium tuberculosis
FLAVVESLADLESGAV

SEQ ID NO: 195277 - protein, 16 aa, Mycobacterium tuberculosis
LAVVESLADLESGAVG

SEQ ID NO: 195278 - protein, 16 aa, Mycobacterium tuberculosis
AVVESLADLESGAVGG

SEQ ID NO: 195279 - protein, 16 aa, Mycobacterium tuberculosis
VVESLADLESGAVGGL

SEQ ID NO: 195280 - protein, 16 aa, Mycobacterium tuberculosis
VESLADLESGAVGGLN

SEQ ID NO: 195281 - protein, 16 aa, Mycobacterium tuberculosis
ESLADLESGAVGGLNV

SEQ ID NO: 195282 - protein, 16 aa, Mycobacterium tuberculosis
SLADLESGAVGGLNVL

SEQ ID NO: 195283 - protein, 16 aa, Mycobacterium tuberculosis
LADLESGAVGGLNVLV

SEQ ID NO: 195284 - protein, 16 aa, Mycobacterium tuberculosis
ADLESGAVGGLNVLVD

SEQ ID NO: 195285 - protein, 16 aa, Mycobacterium tuberculosis
DLESGAVGGLNVLVDP

SEQ ID NO: 195286 - protein, 16 aa, Mycobacterium tuberculosis
LESGAVGGLNVLVDPR

SEQ ID NO: 195287 - protein, 16 aa, Mycobacterium tuberculosis
ESGAVGGLNVLVDPRV

SEQ ID NO: 195288 - protein, 16 aa, Mycobacterium tuberculosis
SGAVGGLNVLVDPRVL

SEQ ID NO: 195289 - protein, 16 aa, Mycobacterium tuberculosis
GAVGGLNVLVDPRVLD

SEQ ID NO: 195290 - protein, 16 aa, Mycobacterium tuberculosis
AVGGLNVLVDPRVLDK

SEQ ID NO: 195291 - protein, 16 aa, Mycobacterium tuberculosis
VGGLNVLVDPRVLDKA

SEQ ID NO: 195292 - protein, 16 aa, Mycobacterium tuberculosis
GGLNVLVDPRVLDKAP

SEQ ID NO: 195293 - protein, 16 aa, Mycobacterium tuberculosis
GLNVLVDPRVLDKAPV

SEQ ID NO: 195294 - protein, 16 aa, Mycobacterium tuberculosis
LNVLVDPRVLDKAPVI

SEQ ID NO: 195295 - protein, 16 aa, Mycobacterium tuberculosis
NVLVDPRVLDKAPVIP

SEQ ID NO: 195296 - protein, 16 aa, Mycobacterium tuberculosis
VLVDPRVLDKAPVIPP

SEQ ID NO: 195297 - protein, 16 aa, Mycobacterium tuberculosis
LVDPRVLDKAPVIPPG

SEQ ID NO: 195298 - protein, 16 aa, Mycobacterium tuberculosis
VDPRVLDKAPVIPPGI

SEQ ID NO: 195299 - protein, 16 aa, Mycobacterium tuberculosis
DPRVLDKAPVIPPGIF

SEQ ID NO: 195300 - protein, 16 aa, Mycobacterium tuberculosis
PRVLDKAPVIPPGIFR

SEQ ID NO: 195301 - protein, 100 aa, Mycobacterium tuberculosis
MSFVTTRPDSIGETAANLHEIGVTMSAHDDGVTPLITNVESPAHDLVSIVTSMLFSMHGELYKAIARQAHVIHESFVQTLQTSKTSYWLTELANRAGTST

SEQ ID NO: 195302 - protein, 8 aa, Mycobacterium tuberculosis
ETAANLHE

SEQ ID NO: 195303 - protein, 8 aa, Mycobacterium tuberculosis
TAANLHEI

SEQ ID NO: 195304 - protein, 8 aa, Mycobacterium tuberculosis
NLHEIGVT

SEQ ID NO: 195305 - protein, 8 aa, Mycobacterium tuberculosis
EIGVTMSA

SEQ ID NO: 195306 - protein, 8 aa, Mycobacterium tuberculosis
MSAHDDGV

SEQ ID NO: 195307 - protein, 8 aa, Mycobacterium tuberculosis
HDDGVTPL

SEQ ID NO: 195308 - protein, 8 aa, Mycobacterium tuberculosis
VTPLITNV

SEQ ID NO: 195309 - protein, 8 aa, Mycobacterium tuberculosis
VESPAHDL

SEQ ID NO: 195310 - protein, 8 aa, Mycobacterium tuberculosis
ESPAHDLV

SEQ ID NO: 195311 - protein, 8 aa, Mycobacterium tuberculosis
LVSIVTSM

SEQ ID NO: 195312 - protein, 8 aa, Mycobacterium tuberculosis
SIVTSMLF

SEQ ID NO: 195313 - protein, 8 aa, Mycobacterium tuberculosis
VTSMLFSM

SEQ ID NO: 195314 - protein, 8 aa, Mycobacterium tuberculosis
TSMLFSMH

SEQ ID NO: 195315 - protein, 8 aa, Mycobacterium tuberculosis
MLFSMHGE

SEQ ID NO: 195316 - protein, 8 aa, Mycobacterium tuberculosis
FSMHGELY

SEQ ID NO: 195317 - protein, 8 aa, Mycobacterium tuberculosis
SMHGELYK

SEQ ID NO: 195318 - protein, 8 aa, Mycobacterium tuberculosis
ELYKAIAR

SEQ ID NO: 195319 - protein, 8 aa, Mycobacterium tuberculosis
AIARQAHV

SEQ ID NO: 195320 - protein, 8 aa, Mycobacterium tuberculosis
IARQAHVI

SEQ ID NO: 195321 - protein, 8 aa, Mycobacterium tuberculosis
RQAHVIHE

SEQ ID NO: 195322 - protein, 8 aa, Mycobacterium tuberculosis
HVIHESFV

SEQ ID NO: 195323 - protein, 8 aa, Mycobacterium tuberculosis
HESFVQTL

SEQ ID NO: 195324 - protein, 8 aa, Mycobacterium tuberculosis
ESFVQTLQ

SEQ ID NO: 195325 - protein, 8 aa, Mycobacterium tuberculosis
VQTLQTSK

SEQ ID NO: 195326 - protein, 8 aa, Mycobacterium tuberculosis
LQTSKTSY

SEQ ID NO: 195327 - protein, 8 aa, Mycobacterium tuberculosis
QTSKTSYW

SEQ ID NO: 195328 - protein, 8 aa, Mycobacterium tuberculosis
TSYWLTEL

SEQ ID NO: 195329 - protein, 8 aa, Mycobacterium tuberculosis
WLTELANR

SEQ ID NO: 195330 - protein, 9 aa, Mycobacterium tuberculosis
FVTTRPDSI

SEQ ID NO: 195331 - protein, 9 aa, Mycobacterium tuberculosis
RPDSIGETA

SEQ ID NO: 195332 - protein, 9 aa, Mycobacterium tuberculosis
SIGETAANL

SEQ ID NO: 195333 - protein, 9 aa, Mycobacterium tuberculosis
ETAANLHEI

SEQ ID NO: 195334 - protein, 9 aa, Mycobacterium tuberculosis
AANLHEIGV

SEQ ID NO: 195335 - protein, 9 aa, Mycobacterium tuberculosis
NLHEIGVTM

SEQ ID NO: 195336 - protein, 9 aa, Mycobacterium tuberculosis
HEIGVTMSA

SEQ ID NO: 195337 - protein, 9 aa, Mycobacterium tuberculosis
EIGVTMSAH

SEQ ID NO: 195338 - protein, 9 aa, Mycobacterium tuberculosis
TMSAHDDGV

SEQ ID NO: 195339 - protein, 9 aa, Mycobacterium tuberculosis
AHDDGVTPL

SEQ ID NO: 195340 - protein, 9 aa, Mycobacterium tuberculosis
GVTPLITNV

SEQ ID NO: 195341 - protein, 9 aa, Mycobacterium tuberculosis
SPAHDLVSI

SEQ ID NO: 195342 - protein, 9 aa, Mycobacterium tuberculosis
PAHDLVSIV

SEQ ID NO: 195343 - protein, 9 aa, Mycobacterium tuberculosis
DLVSIVTSM

SEQ ID NO: 195344 - protein, 9 aa, Mycobacterium tuberculosis
LVSIVTSML

SEQ ID NO: 195345 - protein, 9 aa, Mycobacterium tuberculosis
VSIVTSMLF

SEQ ID NO: 195346 - protein, 9 aa, Mycobacterium tuberculosis
SIVTSMLFS

SEQ ID NO: 195347 - protein, 9 aa, Mycobacterium tuberculosis
IVTSMLFSM

SEQ ID NO: 195348 - protein, 9 aa, Mycobacterium tuberculosis
VTSMLFSMH

SEQ ID NO: 195349 - protein, 9 aa, Mycobacterium tuberculosis
MLFSMHGEL

SEQ ID NO: 195350 - protein, 9 aa, Mycobacterium tuberculosis
LFSMHGELY

SEQ ID NO: 195351 - protein, 9 aa, Mycobacterium tuberculosis
FSMHGELYK

SEQ ID NO: 195352 - protein, 9 aa, Mycobacterium tuberculosis
SMHGELYKA

SEQ ID NO: 195353 - protein, 9 aa, Mycobacterium tuberculosis
ELYKAIARQ

SEQ ID NO: 195354 - protein, 9 aa, Mycobacterium tuberculosis
KAIARQAHV

SEQ ID NO: 195355 - protein, 9 aa, Mycobacterium tuberculosis
AIARQAHVI

SEQ ID NO: 195356 - protein, 9 aa, Mycobacterium tuberculosis
RQAHVIHES

SEQ ID NO: 195357 - protein, 9 aa, Mycobacterium tuberculosis
QAHVIHESF

SEQ ID NO: 195358 - protein, 9 aa, Mycobacterium tuberculosis
IHESFVQTL

SEQ ID NO: 195359 - protein, 9 aa, Mycobacterium tuberculosis
FVQTLQTSK

SEQ ID NO: 195360 - protein, 9 aa, Mycobacterium tuberculosis
TLQTSKTSY

SEQ ID NO: 195361 - protein, 9 aa, Mycobacterium tuberculosis
QTSKTSYWL

SEQ ID NO: 195362 - protein, 9 aa, Mycobacterium tuberculosis
KTSYWLTEL

SEQ ID NO: 195363 - protein, 9 aa, Mycobacterium tuberculosis
TSYWLTELA

SEQ ID NO: 195364 - protein, 9 aa, Mycobacterium tuberculosis
YWLTELANR

SEQ ID NO: 195365 - protein, 9 aa, Mycobacterium tuberculosis
WLTELANRA

SEQ ID NO: 195366 - protein, 10 aa, Mycobacterium tuberculosis
RPDSIGETAA

SEQ ID NO: 195367 - protein, 10 aa, Mycobacterium tuberculosis
DSIGETAANL

SEQ ID NO: 195368 - protein, 10 aa, Mycobacterium tuberculosis
GETAANLHEI

SEQ ID NO: 195369 - protein, 10 aa, Mycobacterium tuberculosis
TAANLHEIGV

SEQ ID NO: 195370 - protein, 10 aa, Mycobacterium tuberculosis
VTMSAHDDGV

SEQ ID NO: 195371 - protein, 10 aa, Mycobacterium tuberculosis
SAHDDGVTPL

SEQ ID NO: 195372 - protein, 10 aa, Mycobacterium tuberculosis
DGVTPLITNV

SEQ ID NO: 195373 - protein, 10 aa, Mycobacterium tuberculosis
PLITNVESPA

SEQ ID NO: 195374 - protein, 10 aa, Mycobacterium tuberculosis
NVESPAHDLV

SEQ ID NO: 195375 - protein, 10 aa, Mycobacterium tuberculosis
ESPAHDLVSI

SEQ ID NO: 195376 - protein, 10 aa, Mycobacterium tuberculosis
SPAHDLVSIV

SEQ ID NO: 195377 - protein, 10 aa, Mycobacterium tuberculosis
DLVSIVTSML

SEQ ID NO: 195378 - protein, 10 aa, Mycobacterium tuberculosis
LVSIVTSMLF

SEQ ID NO: 195379 - protein, 10 aa, Mycobacterium tuberculosis
SIVTSMLFSM

SEQ ID NO: 195380 - protein, 10 aa, Mycobacterium tuberculosis
SMLFSMHGEL

SEQ ID NO: 195381 - protein, 10 aa, Mycobacterium tuberculosis
MLFSMHGELY

SEQ ID NO: 195382 - protein, 10 aa, Mycobacterium tuberculosis
LFSMHGELYK

SEQ ID NO: 195383 - protein, 10 aa, Mycobacterium tuberculosis
FSMHGELYKA

SEQ ID NO: 195384 - protein, 10 aa, Mycobacterium tuberculosis
SMHGELYKAI

SEQ ID NO: 195385 - protein, 10 aa, Mycobacterium tuberculosis
ELYKAIARQA

SEQ ID NO: 195386 - protein, 10 aa, Mycobacterium tuberculosis
KAIARQAHVI

SEQ ID NO: 195387 - protein, 10 aa, Mycobacterium tuberculosis
RQAHVIHESF

SEQ ID NO: 195388 - protein, 10 aa, Mycobacterium tuberculosis
QAHVIHESFV

SEQ ID NO: 195389 - protein, 10 aa, Mycobacterium tuberculosis
VIHESFVQTL

SEQ ID NO: 195390 - protein, 10 aa, Mycobacterium tuberculosis
QTLQTSKTSY

SEQ ID NO: 195391 - protein, 10 aa, Mycobacterium tuberculosis
LQTSKTSYWL

SEQ ID NO: 195392 - protein, 10 aa, Mycobacterium tuberculosis
KTSYWLTELA

SEQ ID NO: 195393 - protein, 10 aa, Mycobacterium tuberculosis
SYWLTELANR

SEQ ID NO: 195394 - protein, 11 aa, Mycobacterium tuberculosis
MSFVTTRPDSI

SEQ ID NO: 195395 - protein, 11 aa, Mycobacterium tuberculosis
ETAANLHEIGV

SEQ ID NO: 195396 - protein, 11 aa, Mycobacterium tuberculosis
AANLHEIGVTM

SEQ ID NO: 195397 - protein, 11 aa, Mycobacterium tuberculosis
NLHEIGVTMSA

SEQ ID NO: 195398 - protein, 11 aa, Mycobacterium tuberculosis
GVTMSAHDDGV

SEQ ID NO: 195399 - protein, 11 aa, Mycobacterium tuberculosis
MSAHDDGVTPL

SEQ ID NO: 195400 - protein, 11 aa, Mycobacterium tuberculosis
SAHDDGVTPLI

SEQ ID NO: 195401 - protein, 11 aa, Mycobacterium tuberculosis
TPLITNVESPA

SEQ ID NO: 195402 - protein, 11 aa, Mycobacterium tuberculosis
VESPAHDLVSI

SEQ ID NO: 195403 - protein, 11 aa, Mycobacterium tuberculosis
ESPAHDLVSIV

SEQ ID NO: 195404 - protein, 11 aa, Mycobacterium tuberculosis
SPAHDLVSIVT

SEQ ID NO: 195405 - protein, 11 aa, Mycobacterium tuberculosis
DLVSIVTSMLF

SEQ ID NO: 195406 - protein, 11 aa, Mycobacterium tuberculosis
VSIVTSMLFSM

SEQ ID NO: 195407 - protein, 11 aa, Mycobacterium tuberculosis
SIVTSMLFSMH

SEQ ID NO: 195408 - protein, 11 aa, Mycobacterium tuberculosis
TSMLFSMHGEL

SEQ ID NO: 195409 - protein, 11 aa, Mycobacterium tuberculosis
SMLFSMHGELY

SEQ ID NO: 195410 - protein, 11 aa, Mycobacterium tuberculosis
MLFSMHGELYK

SEQ ID NO: 195411 - protein, 11 aa, Mycobacterium tuberculosis
FSMHGELYKAI

SEQ ID NO: 195412 - protein, 11 aa, Mycobacterium tuberculosis
SMHGELYKAIA

SEQ ID NO: 195413 - protein, 11 aa, Mycobacterium tuberculosis
YKAIARQAHVI

SEQ ID NO: 195414 - protein, 11 aa, Mycobacterium tuberculosis
RQAHVIHESFV

SEQ ID NO: 195415 - protein, 11 aa, Mycobacterium tuberculosis
HVIHESFVQTL

SEQ ID NO: 195416 - protein, 11 aa, Mycobacterium tuberculosis
ESFVQTLQTSK

SEQ ID NO: 195417 - protein, 11 aa, Mycobacterium tuberculosis
VQTLQTSKTSY

SEQ ID NO: 195418 - protein, 11 aa, Mycobacterium tuberculosis
QTLQTSKTSYW

SEQ ID NO: 195419 - protein, 11 aa, Mycobacterium tuberculosis
TLQTSKTSYWL

SEQ ID NO: 195420 - protein, 11 aa, Mycobacterium tuberculosis
LQTSKTSYWLT

SEQ ID NO: 195421 - protein, 11 aa, Mycobacterium tuberculosis
TSYWLTELANR

SEQ ID NO: 195422 - protein, 11 aa, Mycobacterium tuberculosis
WLTELANRAGT

SEQ ID NO: 195423 - protein, 13 aa, Mycobacterium tuberculosis
MSFVTTRPDSIGE

SEQ ID NO: 195424 - protein, 13 aa, Mycobacterium tuberculosis
SFVTTRPDSIGET

SEQ ID NO: 195425 - protein, 13 aa, Mycobacterium tuberculosis
FVTTRPDSIGETA

SEQ ID NO: 195426 - protein, 13 aa, Mycobacterium tuberculosis
VTTRPDSIGETAA

SEQ ID NO: 195427 - protein, 13 aa, Mycobacterium tuberculosis
TTRPDSIGETAAN

SEQ ID NO: 195428 - protein, 13 aa, Mycobacterium tuberculosis
TRPDSIGETAANL

SEQ ID NO: 195429 - protein, 13 aa, Mycobacterium tuberculosis
RPDSIGETAANLH

SEQ ID NO: 195430 - protein, 13 aa, Mycobacterium tuberculosis
PDSIGETAANLHE

SEQ ID NO: 195431 - protein, 13 aa, Mycobacterium tuberculosis
DSIGETAANLHEI

SEQ ID NO: 195432 - protein, 13 aa, Mycobacterium tuberculosis
SIGETAANLHEIG

SEQ ID NO: 195433 - protein, 13 aa, Mycobacterium tuberculosis
IGETAANLHEIGV

SEQ ID NO: 195434 - protein, 13 aa, Mycobacterium tuberculosis
GETAANLHEIGVT

SEQ ID NO: 195435 - protein, 13 aa, Mycobacterium tuberculosis
ETAANLHEIGVTM

SEQ ID NO: 195436 - protein, 13 aa, Mycobacterium tuberculosis
TAANLHEIGVTMS

SEQ ID NO: 195437 - protein, 13 aa, Mycobacterium tuberculosis
AANLHEIGVTMSA

SEQ ID NO: 195438 - protein, 13 aa, Mycobacterium tuberculosis
ANLHEIGVTMSAH

SEQ ID NO: 195439 - protein, 13 aa, Mycobacterium tuberculosis
NLHEIGVTMSAHD

SEQ ID NO: 195440 - protein, 13 aa, Mycobacterium tuberculosis
LHEIGVTMSAHDD

SEQ ID NO: 195441 - protein, 13 aa, Mycobacterium tuberculosis
HEIGVTMSAHDDG

SEQ ID NO: 195442 - protein, 13 aa, Mycobacterium tuberculosis
EIGVTMSAHDDGV

SEQ ID NO: 195443 - protein, 13 aa, Mycobacterium tuberculosis
IGVTMSAHDDGVT

SEQ ID NO: 195444 - protein, 13 aa, Mycobacterium tuberculosis
GVTMSAHDDGVTP

SEQ ID NO: 195445 - protein, 13 aa, Mycobacterium tuberculosis
VTMSAHDDGVTPL

SEQ ID NO: 195446 - protein, 13 aa, Mycobacterium tuberculosis
TMSAHDDGVTPLI

SEQ ID NO: 195447 - protein, 13 aa, Mycobacterium tuberculosis
MSAHDDGVTPLIT

SEQ ID NO: 195448 - protein, 13 aa, Mycobacterium tuberculosis
SAHDDGVTPLITN

SEQ ID NO: 195449 - protein, 13 aa, Mycobacterium tuberculosis
AHDDGVTPLITNV

SEQ ID NO: 195450 - protein, 13 aa, Mycobacterium tuberculosis
HDDGVTPLITNVE

SEQ ID NO: 195451 - protein, 13 aa, Mycobacterium tuberculosis
DDGVTPLITNVES

SEQ ID NO: 195452 - protein, 13 aa, Mycobacterium tuberculosis
DGVTPLITNVESP

SEQ ID NO: 195453 - protein, 13 aa, Mycobacterium tuberculosis
GVTPLITNVESPA

SEQ ID NO: 195454 - protein, 13 aa, Mycobacterium tuberculosis
VTPLITNVESPAH

SEQ ID NO: 195455 - protein, 13 aa, Mycobacterium tuberculosis
TPLITNVESPAHD

SEQ ID NO: 195456 - protein, 13 aa, Mycobacterium tuberculosis
PLITNVESPAHDL

SEQ ID NO: 195457 - protein, 13 aa, Mycobacterium tuberculosis
LITNVESPAHDLV

SEQ ID NO: 195458 - protein, 13 aa, Mycobacterium tuberculosis
ITNVESPAHDLVS

SEQ ID NO: 195459 - protein, 13 aa, Mycobacterium tuberculosis
TNVESPAHDLVSI

SEQ ID NO: 195460 - protein, 13 aa, Mycobacterium tuberculosis
NVESPAHDLVSIV

SEQ ID NO: 195461 - protein, 13 aa, Mycobacterium tuberculosis
VESPAHDLVSIVT

SEQ ID NO: 195462 - protein, 13 aa, Mycobacterium tuberculosis
ESPAHDLVSIVTS

SEQ ID NO: 195463 - protein, 13 aa, Mycobacterium tuberculosis
SPAHDLVSIVTSM

SEQ ID NO: 195464 - protein, 13 aa, Mycobacterium tuberculosis
PAHDLVSIVTSML

SEQ ID NO: 195465 - protein, 13 aa, Mycobacterium tuberculosis
AHDLVSIVTSMLF

SEQ ID NO: 195466 - protein, 13 aa, Mycobacterium tuberculosis
HDLVSIVTSMLFS

SEQ ID NO: 195467 - protein, 13 aa, Mycobacterium tuberculosis
DLVSIVTSMLFSM

SEQ ID NO: 195468 - protein, 13 aa, Mycobacterium tuberculosis
LVSIVTSMLFSMH

SEQ ID NO: 195469 - protein, 13 aa, Mycobacterium tuberculosis
VSIVTSMLFSMHG

SEQ ID NO: 195470 - protein, 13 aa, Mycobacterium tuberculosis
SIVTSMLFSMHGE

SEQ ID NO: 195471 - protein, 13 aa, Mycobacterium tuberculosis
IVTSMLFSMHGEL

SEQ ID NO: 195472 - protein, 13 aa, Mycobacterium tuberculosis
VTSMLFSMHGELY

SEQ ID NO: 195473 - protein, 13 aa, Mycobacterium tuberculosis
TSMLFSMHGELYK

SEQ ID NO: 195474 - protein, 13 aa, Mycobacterium tuberculosis
SMLFSMHGELYKA

SEQ ID NO: 195475 - protein, 13 aa, Mycobacterium tuberculosis
MLFSMHGELYKAI

SEQ ID NO: 195476 - protein, 13 aa, Mycobacterium tuberculosis
LFSMHGELYKAIA

SEQ ID NO: 195477 - protein, 13 aa, Mycobacterium tuberculosis
FSMHGELYKAIAR

SEQ ID NO: 195478 - protein, 13 aa, Mycobacterium tuberculosis
SMHGELYKAIARQ

SEQ ID NO: 195479 - protein, 13 aa, Mycobacterium tuberculosis
MHGELYKAIARQA

SEQ ID NO: 195480 - protein, 13 aa, Mycobacterium tuberculosis
HGELYKAIARQAH

SEQ ID NO: 195481 - protein, 13 aa, Mycobacterium tuberculosis
GELYKAIARQAHV

SEQ ID NO: 195482 - protein, 13 aa, Mycobacterium tuberculosis
ELYKAIARQAHVI

SEQ ID NO: 195483 - protein, 13 aa, Mycobacterium tuberculosis
LYKAIARQAHVIH

SEQ ID NO: 195484 - protein, 13 aa, Mycobacterium tuberculosis
YKAIARQAHVIHE

SEQ ID NO: 195485 - protein, 13 aa, Mycobacterium tuberculosis
KAIARQAHVIHES

SEQ ID NO: 195486 - protein, 13 aa, Mycobacterium tuberculosis
AIARQAHVIHESF

SEQ ID NO: 195487 - protein, 13 aa, Mycobacterium tuberculosis
IARQAHVIHESFV

SEQ ID NO: 195488 - protein, 13 aa, Mycobacterium tuberculosis
ARQAHVIHESFVQ

SEQ ID NO: 195489 - protein, 13 aa, Mycobacterium tuberculosis
RQAHVIHESFVQT

SEQ ID NO: 195490 - protein, 13 aa, Mycobacterium tuberculosis
QAHVIHESFVQTL

SEQ ID NO: 195491 - protein, 13 aa, Mycobacterium tuberculosis
AHVIHESFVQTLQ

SEQ ID NO: 195492 - protein, 13 aa, Mycobacterium tuberculosis
HVIHESFVQTLQT

SEQ ID NO: 195493 - protein, 13 aa, Mycobacterium tuberculosis
VIHESFVQTLQTS

SEQ ID NO: 195494 - protein, 13 aa, Mycobacterium tuberculosis
IHESFVQTLQTSK

SEQ ID NO: 195495 - protein, 13 aa, Mycobacterium tuberculosis
HESFVQTLQTSKT

SEQ ID NO: 195496 - protein, 13 aa, Mycobacterium tuberculosis
ESFVQTLQTSKTS

SEQ ID NO: 195497 - protein, 13 aa, Mycobacterium tuberculosis
SFVQTLQTSKTSY

SEQ ID NO: 195498 - protein, 13 aa, Mycobacterium tuberculosis
FVQTLQTSKTSYW

SEQ ID NO: 195499 - protein, 13 aa, Mycobacterium tuberculosis
VQTLQTSKTSYWL

SEQ ID NO: 195500 - protein, 13 aa, Mycobacterium tuberculosis
QTLQTSKTSYWLT

SEQ ID NO: 195501 - protein, 13 aa, Mycobacterium tuberculosis
TLQTSKTSYWLTE

SEQ ID NO: 195502 - protein, 13 aa, Mycobacterium tuberculosis
LQTSKTSYWLTEL

SEQ ID NO: 195503 - protein, 13 aa, Mycobacterium tuberculosis
QTSKTSYWLTELA

SEQ ID NO: 195504 - protein, 13 aa, Mycobacterium tuberculosis
TSKTSYWLTELAN

SEQ ID NO: 195505 - protein, 13 aa, Mycobacterium tuberculosis
SKTSYWLTELANR

SEQ ID NO: 195506 - protein, 13 aa, Mycobacterium tuberculosis
KTSYWLTELANRA

SEQ ID NO: 195507 - protein, 13 aa, Mycobacterium tuberculosis
TSYWLTELANRAG

SEQ ID NO: 195508 - protein, 13 aa, Mycobacterium tuberculosis
SYWLTELANRAGT

SEQ ID NO: 195509 - protein, 13 aa, Mycobacterium tuberculosis
YWLTELANRAGTS

SEQ ID NO: 195510 - protein, 13 aa, Mycobacterium tuberculosis
WLTELANRAGTST

SEQ ID NO: 195511 - protein, 14 aa, Mycobacterium tuberculosis
MSFVTTRPDSIGET

SEQ ID NO: 195512 - protein, 14 aa, Mycobacterium tuberculosis
SFVTTRPDSIGETA

SEQ ID NO: 195513 - protein, 14 aa, Mycobacterium tuberculosis
FVTTRPDSIGETAA

SEQ ID NO: 195514 - protein, 14 aa, Mycobacterium tuberculosis
VTTRPDSIGETAAN

SEQ ID NO: 195515 - protein, 14 aa, Mycobacterium tuberculosis
TTRPDSIGETAANL

SEQ ID NO: 195516 - protein, 14 aa, Mycobacterium tuberculosis
TRPDSIGETAANLH

SEQ ID NO: 195517 - protein, 14 aa, Mycobacterium tuberculosis
RPDSIGETAANLHE

SEQ ID NO: 195518 - protein, 14 aa, Mycobacterium tuberculosis
PDSIGETAANLHEI

SEQ ID NO: 195519 - protein, 14 aa, Mycobacterium tuberculosis
DSIGETAANLHEIG

SEQ ID NO: 195520 - protein, 14 aa, Mycobacterium tuberculosis
SIGETAANLHEIGV

SEQ ID NO: 195521 - protein, 14 aa, Mycobacterium tuberculosis
IGETAANLHEIGVT

SEQ ID NO: 195522 - protein, 14 aa, Mycobacterium tuberculosis
GETAANLHEIGVTM

SEQ ID NO: 195523 - protein, 14 aa, Mycobacterium tuberculosis
ETAANLHEIGVTMS

SEQ ID NO: 195524 - protein, 14 aa, Mycobacterium tuberculosis
TAANLHEIGVTMSA

SEQ ID NO: 195525 - protein, 14 aa, Mycobacterium tuberculosis
AANLHEIGVTMSAH

SEQ ID NO: 195526 - protein, 14 aa, Mycobacterium tuberculosis
ANLHEIGVTMSAHD

SEQ ID NO: 195527 - protein, 14 aa, Mycobacterium tuberculosis
NLHEIGVTMSAHDD

SEQ ID NO: 195528 - protein, 14 aa, Mycobacterium tuberculosis
LHEIGVTMSAHDDG

SEQ ID NO: 195529 - protein, 14 aa, Mycobacterium tuberculosis
HEIGVTMSAHDDGV

SEQ ID NO: 195530 - protein, 14 aa, Mycobacterium tuberculosis
EIGVTMSAHDDGVT

SEQ ID NO: 195531 - protein, 14 aa, Mycobacterium tuberculosis
IGVTMSAHDDGVTP

SEQ ID NO: 195532 - protein, 14 aa, Mycobacterium tuberculosis
GVTMSAHDDGVTPL

SEQ ID NO: 195533 - protein, 14 aa, Mycobacterium tuberculosis
VTMSAHDDGVTPLI

SEQ ID NO: 195534 - protein, 14 aa, Mycobacterium tuberculosis
TMSAHDDGVTPLIT

SEQ ID NO: 195535 - protein, 14 aa, Mycobacterium tuberculosis
MSAHDDGVTPLITN

SEQ ID NO: 195536 - protein, 14 aa, Mycobacterium tuberculosis
SAHDDGVTPLITNV

SEQ ID NO: 195537 - protein, 14 aa, Mycobacterium tuberculosis
AHDDGVTPLITNVE

SEQ ID NO: 195538 - protein, 14 aa, Mycobacterium tuberculosis
HDDGVTPLITNVES

SEQ ID NO: 195539 - protein, 14 aa, Mycobacterium tuberculosis
DDGVTPLITNVESP

SEQ ID NO: 195540 - protein, 14 aa, Mycobacterium tuberculosis
DGVTPLITNVESPA

SEQ ID NO: 195541 - protein, 14 aa, Mycobacterium tuberculosis
GVTPLITNVESPAH

SEQ ID NO: 195542 - protein, 14 aa, Mycobacterium tuberculosis
VTPLITNVESPAHD

SEQ ID NO: 195543 - protein, 14 aa, Mycobacterium tuberculosis
TPLITNVESPAHDL

SEQ ID NO: 195544 - protein, 14 aa, Mycobacterium tuberculosis
PLITNVESPAHDLV

SEQ ID NO: 195545 - protein, 14 aa, Mycobacterium tuberculosis
LITNVESPAHDLVS

SEQ ID NO: 195546 - protein, 14 aa, Mycobacterium tuberculosis
ITNVESPAHDLVSI

SEQ ID NO: 195547 - protein, 14 aa, Mycobacterium tuberculosis
TNVESPAHDLVSIV

SEQ ID NO: 195548 - protein, 14 aa, Mycobacterium tuberculosis
NVESPAHDLVSIVT

SEQ ID NO: 195549 - protein, 14 aa, Mycobacterium tuberculosis
VESPAHDLVSIVTS

SEQ ID NO: 195550 - protein, 14 aa, Mycobacterium tuberculosis
ESPAHDLVSIVTSM

SEQ ID NO: 195551 - protein, 14 aa, Mycobacterium tuberculosis
SPAHDLVSIVTSML

SEQ ID NO: 195552 - protein, 14 aa, Mycobacterium tuberculosis
PAHDLVSIVTSMLF

SEQ ID NO: 195553 - protein, 14 aa, Mycobacterium tuberculosis
AHDLVSIVTSMLFS

SEQ ID NO: 195554 - protein, 14 aa, Mycobacterium tuberculosis
HDLVSIVTSMLFSM

SEQ ID NO: 195555 - protein, 14 aa, Mycobacterium tuberculosis
DLVSIVTSMLFSMH

SEQ ID NO: 195556 - protein, 14 aa, Mycobacterium tuberculosis
LVSIVTSMLFSMHG

SEQ ID NO: 195557 - protein, 14 aa, Mycobacterium tuberculosis
VSIVTSMLFSMHGE

SEQ ID NO: 195558 - protein, 14 aa, Mycobacterium tuberculosis
SIVTSMLFSMHGEL

SEQ ID NO: 195559 - protein, 14 aa, Mycobacterium tuberculosis
IVTSMLFSMHGELY

SEQ ID NO: 195560 - protein, 14 aa, Mycobacterium tuberculosis
VTSMLFSMHGELYK

SEQ ID NO: 195561 - protein, 14 aa, Mycobacterium tuberculosis
TSMLFSMHGELYKA

SEQ ID NO: 195562 - protein, 14 aa, Mycobacterium tuberculosis
SMLFSMHGELYKAI

SEQ ID NO: 195563 - protein, 14 aa, Mycobacterium tuberculosis
MLFSMHGELYKAIA

SEQ ID NO: 195564 - protein, 14 aa, Mycobacterium tuberculosis
LFSMHGELYKAIAR

SEQ ID NO: 195565 - protein, 14 aa, Mycobacterium tuberculosis
FSMHGELYKAIARQ

SEQ ID NO: 195566 - protein, 14 aa, Mycobacterium tuberculosis
SMHGELYKAIARQA

SEQ ID NO: 195567 - protein, 14 aa, Mycobacterium tuberculosis
MHGELYKAIARQAH

SEQ ID NO: 195568 - protein, 14 aa, Mycobacterium tuberculosis
HGELYKAIARQAHV

SEQ ID NO: 195569 - protein, 14 aa, Mycobacterium tuberculosis
GELYKAIARQAHVI

SEQ ID NO: 195570 - protein, 14 aa, Mycobacterium tuberculosis
ELYKAIARQAHVIH

SEQ ID NO: 195571 - protein, 14 aa, Mycobacterium tuberculosis
LYKAIARQAHVIHE

SEQ ID NO: 195572 - protein, 14 aa, Mycobacterium tuberculosis
YKAIARQAHVIHES

SEQ ID NO: 195573 - protein, 14 aa, Mycobacterium tuberculosis
KAIARQAHVIHESF

SEQ ID NO: 195574 - protein, 14 aa, Mycobacterium tuberculosis
AIARQAHVIHESFV

SEQ ID NO: 195575 - protein, 14 aa, Mycobacterium tuberculosis
IARQAHVIHESFVQ

SEQ ID NO: 195576 - protein, 14 aa, Mycobacterium tuberculosis
ARQAHVIHESFVQT

SEQ ID NO: 195577 - protein, 14 aa, Mycobacterium tuberculosis
RQAHVIHESFVQTL

SEQ ID NO: 195578 - protein, 14 aa, Mycobacterium tuberculosis
QAHVIHESFVQTLQ

SEQ ID NO: 195579 - protein, 14 aa, Mycobacterium tuberculosis
AHVIHESFVQTLQT

SEQ ID NO: 195580 - protein, 14 aa, Mycobacterium tuberculosis
HVIHESFVQTLQTS

SEQ ID NO: 195581 - protein, 14 aa, Mycobacterium tuberculosis
VIHESFVQTLQTSK

SEQ ID NO: 195582 - protein, 14 aa, Mycobacterium tuberculosis
IHESFVQTLQTSKT

SEQ ID NO: 195583 - protein, 14 aa, Mycobacterium tuberculosis
HESFVQTLQTSKTS

SEQ ID NO: 195584 - protein, 14 aa, Mycobacterium tuberculosis
ESFVQTLQTSKTSY

SEQ ID NO: 195585 - protein, 14 aa, Mycobacterium tuberculosis
SFVQTLQTSKTSYW

SEQ ID NO: 195586 - protein, 14 aa, Mycobacterium tuberculosis
FVQTLQTSKTSYWL

SEQ ID NO: 195587 - protein, 14 aa, Mycobacterium tuberculosis
VQTLQTSKTSYWLT

SEQ ID NO: 195588 - protein, 14 aa, Mycobacterium tuberculosis
QTLQTSKTSYWLTE

SEQ ID NO: 195589 - protein, 14 aa, Mycobacterium tuberculosis
TLQTSKTSYWLTEL

SEQ ID NO: 195590 - protein, 14 aa, Mycobacterium tuberculosis
LQTSKTSYWLTELA

SEQ ID NO: 195591 - protein, 14 aa, Mycobacterium tuberculosis
QTSKTSYWLTELAN

SEQ ID NO: 195592 - protein, 14 aa, Mycobacterium tuberculosis
TSKTSYWLTELANR

SEQ ID NO: 195593 - protein, 14 aa, Mycobacterium tuberculosis
SKTSYWLTELANRA

SEQ ID NO: 195594 - protein, 14 aa, Mycobacterium tuberculosis
KTSYWLTELANRAG

SEQ ID NO: 195595 - protein, 14 aa, Mycobacterium tuberculosis
TSYWLTELANRAGT

SEQ ID NO: 195596 - protein, 14 aa, Mycobacterium tuberculosis
SYWLTELANRAGTS

SEQ ID NO: 195597 - protein, 14 aa, Mycobacterium tuberculosis
YWLTELANRAGTST

SEQ ID NO: 195598 - protein, 15 aa, Mycobacterium tuberculosis
MSFVTTRPDSIGETA

SEQ ID NO: 195599 - protein, 15 aa, Mycobacterium tuberculosis
SFVTTRPDSIGETAA

SEQ ID NO: 195600 - protein, 15 aa, Mycobacterium tuberculosis
FVTTRPDSIGETAAN

SEQ ID NO: 195601 - protein, 15 aa, Mycobacterium tuberculosis
VTTRPDSIGETAANL

SEQ ID NO: 195602 - protein, 15 aa, Mycobacterium tuberculosis
TTRPDSIGETAANLH

SEQ ID NO: 195603 - protein, 15 aa, Mycobacterium tuberculosis
TRPDSIGETAANLHE

SEQ ID NO: 195604 - protein, 15 aa, Mycobacterium tuberculosis
RPDSIGETAANLHEI

SEQ ID NO: 195605 - protein, 15 aa, Mycobacterium tuberculosis
PDSIGETAANLHEIG

SEQ ID NO: 195606 - protein, 15 aa, Mycobacterium tuberculosis
DSIGETAANLHEIGV

SEQ ID NO: 195607 - protein, 15 aa, Mycobacterium tuberculosis
SIGETAANLHEIGVT

SEQ ID NO: 195608 - protein, 15 aa, Mycobacterium tuberculosis
IGETAANLHEIGVTM

SEQ ID NO: 195609 - protein, 15 aa, Mycobacterium tuberculosis
GETAANLHEIGVTMS

SEQ ID NO: 195610 - protein, 15 aa, Mycobacterium tuberculosis
ETAANLHEIGVTMSA

SEQ ID NO: 195611 - protein, 15 aa, Mycobacterium tuberculosis
TAANLHEIGVTMSAH

SEQ ID NO: 195612 - protein, 15 aa, Mycobacterium tuberculosis
AANLHEIGVTMSAHD

SEQ ID NO: 195613 - protein, 15 aa, Mycobacterium tuberculosis
ANLHEIGVTMSAHDD

SEQ ID NO: 195614 - protein, 15 aa, Mycobacterium tuberculosis
NLHEIGVTMSAHDDG

SEQ ID NO: 195615 - protein, 15 aa, Mycobacterium tuberculosis
LHEIGVTMSAHDDGV

SEQ ID NO: 195616 - protein, 15 aa, Mycobacterium tuberculosis
HEIGVTMSAHDDGVT

SEQ ID NO: 195617 - protein, 15 aa, Mycobacterium tuberculosis
EIGVTMSAHDDGVTP

SEQ ID NO: 195618 - protein, 15 aa, Mycobacterium tuberculosis
IGVTMSAHDDGVTPL

SEQ ID NO: 195619 - protein, 15 aa, Mycobacterium tuberculosis
GVTMSAHDDGVTPLI

SEQ ID NO: 195620 - protein, 15 aa, Mycobacterium tuberculosis
VTMSAHDDGVTPLIT

SEQ ID NO: 195621 - protein, 15 aa, Mycobacterium tuberculosis
TMSAHDDGVTPLITN

SEQ ID NO: 195622 - protein, 15 aa, Mycobacterium tuberculosis
MSAHDDGVTPLITNV

SEQ ID NO: 195623 - protein, 15 aa, Mycobacterium tuberculosis
SAHDDGVTPLITNVE

SEQ ID NO: 195624 - protein, 15 aa, Mycobacterium tuberculosis
AHDDGVTPLITNVES

SEQ ID NO: 195625 - protein, 15 aa, Mycobacterium tuberculosis
HDDGVTPLITNVESP

SEQ ID NO: 195626 - protein, 15 aa, Mycobacterium tuberculosis
DDGVTPLITNVESPA

SEQ ID NO: 195627 - protein, 15 aa, Mycobacterium tuberculosis
DGVTPLITNVESPAH

SEQ ID NO: 195628 - protein, 15 aa, Mycobacterium tuberculosis
GVTPLITNVESPAHD

SEQ ID NO: 195629 - protein, 15 aa, Mycobacterium tuberculosis
VTPLITNVESPAHDL

SEQ ID NO: 195630 - protein, 15 aa, Mycobacterium tuberculosis
TPLITNVESPAHDLV

SEQ ID NO: 195631 - protein, 15 aa, Mycobacterium tuberculosis
PLITNVESPAHDLVS

SEQ ID NO: 195632 - protein, 15 aa, Mycobacterium tuberculosis
LITNVESPAHDLVSI

SEQ ID NO: 195633 - protein, 15 aa, Mycobacterium tuberculosis
ITNVESPAHDLVSIV

SEQ ID NO: 195634 - protein, 15 aa, Mycobacterium tuberculosis
TNVESPAHDLVSIVT

SEQ ID NO: 195635 - protein, 15 aa, Mycobacterium tuberculosis
NVESPAHDLVSIVTS

SEQ ID NO: 195636 - protein, 15 aa, Mycobacterium tuberculosis
VESPAHDLVSIVTSM

SEQ ID NO: 195637 - protein, 15 aa, Mycobacterium tuberculosis
ESPAHDLVSIVTSML

SEQ ID NO: 195638 - protein, 15 aa, Mycobacterium tuberculosis
SPAHDLVSIVTSMLF

SEQ ID NO: 195639 - protein, 15 aa, Mycobacterium tuberculosis
PAHDLVSIVTSMLFS

SEQ ID NO: 195640 - protein, 15 aa, Mycobacterium tuberculosis
AHDLVSIVTSMLFSM

SEQ ID NO: 195641 - protein, 15 aa, Mycobacterium tuberculosis
HDLVSIVTSMLFSMH

SEQ ID NO: 195642 - protein, 15 aa, Mycobacterium tuberculosis
DLVSIVTSMLFSMHG

SEQ ID NO: 195643 - protein, 15 aa, Mycobacterium tuberculosis
LVSIVTSMLFSMHGE

SEQ ID NO: 195644 - protein, 15 aa, Mycobacterium tuberculosis
VSIVTSMLFSMHGEL

SEQ ID NO: 195645 - protein, 15 aa, Mycobacterium tuberculosis
SIVTSMLFSMHGELY

SEQ ID NO: 195646 - protein, 15 aa, Mycobacterium tuberculosis
IVTSMLFSMHGELYK

SEQ ID NO: 195647 - protein, 15 aa, Mycobacterium tuberculosis
VTSMLFSMHGELYKA

SEQ ID NO: 195648 - protein, 15 aa, Mycobacterium tuberculosis
TSMLFSMHGELYKAI

SEQ ID NO: 195649 - protein, 15 aa, Mycobacterium tuberculosis
SMLFSMHGELYKAIA

SEQ ID NO: 195650 - protein, 15 aa, Mycobacterium tuberculosis
MLFSMHGELYKAIAR

SEQ ID NO: 195651 - protein, 15 aa, Mycobacterium tuberculosis
LFSMHGELYKAIARQ

SEQ ID NO: 195652 - protein, 15 aa, Mycobacterium tuberculosis
FSMHGELYKAIARQA

SEQ ID NO: 195653 - protein, 15 aa, Mycobacterium tuberculosis
SMHGELYKAIARQAH

SEQ ID NO: 195654 - protein, 15 aa, Mycobacterium tuberculosis
MHGELYKAIARQAHV

SEQ ID NO: 195655 - protein, 15 aa, Mycobacterium tuberculosis
HGELYKAIARQAHVI

SEQ ID NO: 195656 - protein, 15 aa, Mycobacterium tuberculosis
GELYKAIARQAHVIH

SEQ ID NO: 195657 - protein, 15 aa, Mycobacterium tuberculosis
ELYKAIARQAHVIHE

SEQ ID NO: 195658 - protein, 15 aa, Mycobacterium tuberculosis
LYKAIARQAHVIHES

SEQ ID NO: 195659 - protein, 15 aa, Mycobacterium tuberculosis
YKAIARQAHVIHESF

SEQ ID NO: 195660 - protein, 15 aa, Mycobacterium tuberculosis
KAIARQAHVIHESFV

SEQ ID NO: 195661 - protein, 15 aa, Mycobacterium tuberculosis
AIARQAHVIHESFVQ

SEQ ID NO: 195662 - protein, 15 aa, Mycobacterium tuberculosis
IARQAHVIHESFVQT

SEQ ID NO: 195663 - protein, 15 aa, Mycobacterium tuberculosis
ARQAHVIHESFVQTL

SEQ ID NO: 195664 - protein, 15 aa, Mycobacterium tuberculosis
RQAHVIHESFVQTLQ

SEQ ID NO: 195665 - protein, 15 aa, Mycobacterium tuberculosis
QAHVIHESFVQTLQT

SEQ ID NO: 195666 - protein, 15 aa, Mycobacterium tuberculosis
AHVIHESFVQTLQTS

SEQ ID NO: 195667 - protein, 15 aa, Mycobacterium tuberculosis
HVIHESFVQTLQTSK

SEQ ID NO: 195668 - protein, 15 aa, Mycobacterium tuberculosis
VIHESFVQTLQTSKT

SEQ ID NO: 195669 - protein, 15 aa, Mycobacterium tuberculosis
IHESFVQTLQTSKTS

SEQ ID NO: 195670 - protein, 15 aa, Mycobacterium tuberculosis
HESFVQTLQTSKTSY

SEQ ID NO: 195671 - protein, 15 aa, Mycobacterium tuberculosis
ESFVQTLQTSKTSYW

SEQ ID NO: 195672 - protein, 15 aa, Mycobacterium tuberculosis
SFVQTLQTSKTSYWL

SEQ ID NO: 195673 - protein, 15 aa, Mycobacterium tuberculosis
FVQTLQTSKTSYWLT

SEQ ID NO: 195674 - protein, 15 aa, Mycobacterium tuberculosis
VQTLQTSKTSYWLTE

SEQ ID NO: 195675 - protein, 15 aa, Mycobacterium tuberculosis
QTLQTSKTSYWLTEL

SEQ ID NO: 195676 - protein, 15 aa, Mycobacterium tuberculosis
TLQTSKTSYWLTELA

SEQ ID NO: 195677 - protein, 15 aa, Mycobacterium tuberculosis
LQTSKTSYWLTELAN

SEQ ID NO: 195678 - protein, 15 aa, Mycobacterium tuberculosis
QTSKTSYWLTELANR

SEQ ID NO: 195679 - protein, 15 aa, Mycobacterium tuberculosis
TSKTSYWLTELANRA

SEQ ID NO: 195680 - protein, 15 aa, Mycobacterium tuberculosis
SKTSYWLTELANRAG

SEQ ID NO: 195681 - protein, 15 aa, Mycobacterium tuberculosis
KTSYWLTELANRAGT

SEQ ID NO: 195682 - protein, 15 aa, Mycobacterium tuberculosis
TSYWLTELANRAGTS

SEQ ID NO: 195683 - protein, 15 aa, Mycobacterium tuberculosis
SYWLTELANRAGTST

SEQ ID NO: 195684 - protein, 16 aa, Mycobacterium tuberculosis
MSFVTTRPDSIGETAA

SEQ ID NO: 195685 - protein, 16 aa, Mycobacterium tuberculosis
SFVTTRPDSIGETAAN

SEQ ID NO: 195686 - protein, 16 aa, Mycobacterium tuberculosis
FVTTRPDSIGETAANL

SEQ ID NO: 195687 - protein, 16 aa, Mycobacterium tuberculosis
VTTRPDSIGETAANLH

SEQ ID NO: 195688 - protein, 16 aa, Mycobacterium tuberculosis
TTRPDSIGETAANLHE

SEQ ID NO: 195689 - protein, 16 aa, Mycobacterium tuberculosis
TRPDSIGETAANLHEI

SEQ ID NO: 195690 - protein, 16 aa, Mycobacterium tuberculosis
RPDSIGETAANLHEIG

SEQ ID NO: 195691 - protein, 16 aa, Mycobacterium tuberculosis
PDSIGETAANLHEIGV

SEQ ID NO: 195692 - protein, 16 aa, Mycobacterium tuberculosis
DSIGETAANLHEIGVT

SEQ ID NO: 195693 - protein, 16 aa, Mycobacterium tuberculosis
SIGETAANLHEIGVTM

SEQ ID NO: 195694 - protein, 16 aa, Mycobacterium tuberculosis
IGETAANLHEIGVTMS

SEQ ID NO: 195695 - protein, 16 aa, Mycobacterium tuberculosis
GETAANLHEIGVTMSA

SEQ ID NO: 195696 - protein, 16 aa, Mycobacterium tuberculosis
ETAANLHEIGVTMSAH

SEQ ID NO: 195697 - protein, 16 aa, Mycobacterium tuberculosis
TAANLHEIGVTMSAHD

SEQ ID NO: 195698 - protein, 16 aa, Mycobacterium tuberculosis
AANLHEIGVTMSAHDD

SEQ ID NO: 195699 - protein, 16 aa, Mycobacterium tuberculosis
ANLHEIGVTMSAHDDG

SEQ ID NO: 195700 - protein, 16 aa, Mycobacterium tuberculosis
NLHEIGVTMSAHDDGV

SEQ ID NO: 195701 - protein, 16 aa, Mycobacterium tuberculosis
LHEIGVTMSAHDDGVT

SEQ ID NO: 195702 - protein, 16 aa, Mycobacterium tuberculosis
HEIGVTMSAHDDGVTP

SEQ ID NO: 195703 - protein, 16 aa, Mycobacterium tuberculosis
EIGVTMSAHDDGVTPL

SEQ ID NO: 195704 - protein, 16 aa, Mycobacterium tuberculosis
IGVTMSAHDDGVTPLI

SEQ ID NO: 195705 - protein, 16 aa, Mycobacterium tuberculosis
GVTMSAHDDGVTPLIT

SEQ ID NO: 195706 - protein, 16 aa, Mycobacterium tuberculosis
VTMSAHDDGVTPLITN

SEQ ID NO: 195707 - protein, 16 aa, Mycobacterium tuberculosis
TMSAHDDGVTPLITNV

SEQ ID NO: 195708 - protein, 16 aa, Mycobacterium tuberculosis
MSAHDDGVTPLITNVE

SEQ ID NO: 195709 - protein, 16 aa, Mycobacterium tuberculosis
SAHDDGVTPLITNVES

SEQ ID NO: 195710 - protein, 16 aa, Mycobacterium tuberculosis
AHDDGVTPLITNVESP

SEQ ID NO: 195711 - protein, 16 aa, Mycobacterium tuberculosis
HDDGVTPLITNVESPA

SEQ ID NO: 195712 - protein, 16 aa, Mycobacterium tuberculosis
DDGVTPLITNVESPAH

SEQ ID NO: 195713 - protein, 16 aa, Mycobacterium tuberculosis
DGVTPLITNVESPAHD

SEQ ID NO: 195714 - protein, 16 aa, Mycobacterium tuberculosis
GVTPLITNVESPAHDL

SEQ ID NO: 195715 - protein, 16 aa, Mycobacterium tuberculosis
VTPLITNVESPAHDLV

SEQ ID NO: 195716 - protein, 16 aa, Mycobacterium tuberculosis
TPLITNVESPAHDLVS

SEQ ID NO: 195717 - protein, 16 aa, Mycobacterium tuberculosis
PLITNVESPAHDLVSI

SEQ ID NO: 195718 - protein, 16 aa, Mycobacterium tuberculosis
LITNVESPAHDLVSIV

SEQ ID NO: 195719 - protein, 16 aa, Mycobacterium tuberculosis
ITNVESPAHDLVSIVT

SEQ ID NO: 195720 - protein, 16 aa, Mycobacterium tuberculosis
TNVESPAHDLVSIVTS

SEQ ID NO: 195721 - protein, 16 aa, Mycobacterium tuberculosis
NVESPAHDLVSIVTSM

SEQ ID NO: 195722 - protein, 16 aa, Mycobacterium tuberculosis
VESPAHDLVSIVTSML

SEQ ID NO: 195723 - protein, 16 aa, Mycobacterium tuberculosis
ESPAHDLVSIVTSMLF

SEQ ID NO: 195724 - protein, 16 aa, Mycobacterium tuberculosis
SPAHDLVSIVTSMLFS

SEQ ID NO: 195725 - protein, 16 aa, Mycobacterium tuberculosis
PAHDLVSIVTSMLFSM

SEQ ID NO: 195726 - protein, 16 aa, Mycobacterium tuberculosis
AHDLVSIVTSMLFSMH

SEQ ID NO: 195727 - protein, 16 aa, Mycobacterium tuberculosis
HDLVSIVTSMLFSMHG

SEQ ID NO: 195728 - protein, 16 aa, Mycobacterium tuberculosis
DLVSIVTSMLFSMHGE

SEQ ID NO: 195729 - protein, 16 aa, Mycobacterium tuberculosis
LVSIVTSMLFSMHGEL

SEQ ID NO: 195730 - protein, 16 aa, Mycobacterium tuberculosis
VSIVTSMLFSMHGELY

SEQ ID NO: 195731 - protein, 16 aa, Mycobacterium tuberculosis
SIVTSMLFSMHGELYK

SEQ ID NO: 195732 - protein, 16 aa, Mycobacterium tuberculosis
IVTSMLFSMHGELYKA

SEQ ID NO: 195733 - protein, 16 aa, Mycobacterium tuberculosis
VTSMLFSMHGELYKAI

SEQ ID NO: 195734 - protein, 16 aa, Mycobacterium tuberculosis
TSMLFSMHGELYKAIA

SEQ ID NO: 195735 - protein, 16 aa, Mycobacterium tuberculosis
SMLFSMHGELYKAIAR

SEQ ID NO: 195736 - protein, 16 aa, Mycobacterium tuberculosis
MLFSMHGELYKAIARQ

SEQ ID NO: 195737 - protein, 16 aa, Mycobacterium tuberculosis
LFSMHGELYKAIARQA

SEQ ID NO: 195738 - protein, 16 aa, Mycobacterium tuberculosis
FSMHGELYKAIARQAH

SEQ ID NO: 195739 - protein, 16 aa, Mycobacterium tuberculosis
SMHGELYKAIARQAHV

SEQ ID NO: 195740 - protein, 16 aa, Mycobacterium tuberculosis
MHGELYKAIARQAHVI

SEQ ID NO: 195741 - protein, 16 aa, Mycobacterium tuberculosis
HGELYKAIARQAHVIH

SEQ ID NO: 195742 - protein, 16 aa, Mycobacterium tuberculosis
GELYKAIARQAHVIHE

SEQ ID NO: 195743 - protein, 16 aa, Mycobacterium tuberculosis
ELYKAIARQAHVIHES

SEQ ID NO: 195744 - protein, 16 aa, Mycobacterium tuberculosis
LYKAIARQAHVIHESF

SEQ ID NO: 195745 - protein, 16 aa, Mycobacterium tuberculosis
YKAIARQAHVIHESFV

SEQ ID NO: 195746 - protein, 16 aa, Mycobacterium tuberculosis
KAIARQAHVIHESFVQ

SEQ ID NO: 195747 - protein, 16 aa, Mycobacterium tuberculosis
AIARQAHVIHESFVQT

SEQ ID NO: 195748 - protein, 16 aa, Mycobacterium tuberculosis
IARQAHVIHESFVQTL

SEQ ID NO: 195749 - protein, 16 aa, Mycobacterium tuberculosis
ARQAHVIHESFVQTLQ

SEQ ID NO: 195750 - protein, 16 aa, Mycobacterium tuberculosis
RQAHVIHESFVQTLQT

SEQ ID NO: 195751 - protein, 16 aa, Mycobacterium tuberculosis
QAHVIHESFVQTLQTS

SEQ ID NO: 195752 - protein, 16 aa, Mycobacterium tuberculosis
AHVIHESFVQTLQTSK

SEQ ID NO: 195753 - protein, 16 aa, Mycobacterium tuberculosis
HVIHESFVQTLQTSKT

SEQ ID NO: 195754 - protein, 16 aa, Mycobacterium tuberculosis
VIHESFVQTLQTSKTS

SEQ ID NO: 195755 - protein, 16 aa, Mycobacterium tuberculosis
IHESFVQTLQTSKTSY

SEQ ID NO: 195756 - protein, 16 aa, Mycobacterium tuberculosis
HESFVQTLQTSKTSYW

SEQ ID NO: 195757 - protein, 16 aa, Mycobacterium tuberculosis
ESFVQTLQTSKTSYWL

SEQ ID NO: 195758 - protein, 16 aa, Mycobacterium tuberculosis
SFVQTLQTSKTSYWLT

SEQ ID NO: 195759 - protein, 16 aa, Mycobacterium tuberculosis
FVQTLQTSKTSYWLTE

SEQ ID NO: 195760 - protein, 16 aa, Mycobacterium tuberculosis
VQTLQTSKTSYWLTEL

SEQ ID NO: 195761 - protein, 16 aa, Mycobacterium tuberculosis
QTLQTSKTSYWLTELA

SEQ ID NO: 195762 - protein, 16 aa, Mycobacterium tuberculosis
TLQTSKTSYWLTELAN

SEQ ID NO: 195763 - protein, 16 aa, Mycobacterium tuberculosis
LQTSKTSYWLTELANR

SEQ ID NO: 195764 - protein, 16 aa, Mycobacterium tuberculosis
QTSKTSYWLTELANRA

SEQ ID NO: 195765 - protein, 16 aa, Mycobacterium tuberculosis
TSKTSYWLTELANRAG

SEQ ID NO: 195766 - protein, 16 aa, Mycobacterium tuberculosis
SKTSYWLTELANRAGT

SEQ ID NO: 195767 - protein, 16 aa, Mycobacterium tuberculosis
KTSYWLTELANRAGTS

SEQ ID NO: 195768 - protein, 16 aa, Mycobacterium tuberculosis
TSYWLTELANRAGTST

SEQ ID NO: 195769 - protein, 374 aa, Mycobacterium tuberculosis
MRSERLRWLVAAEGPFASVYFDDSHDTLDAVERREATWRDVRKHLESRDAKQELIDSLEEAVRDSRPAVGQRGRALIATGEQVLVNEHLIGPPPATVIRLSDYPYVVPLIDLEMRRPTYVFAAVDHTGADVKLYQGATISSTKIDGVGYPVHKPVTAGWNGYGDFQHTTEEAIRMNCRAVADHLTRLVDAADPEVVFVSGEVRSRTDLLSTLPQRVAVRVSQLHAGPRKSALDEEEIWDLTSAEFTRRRYAEITNVAQQFEAEIGRGSGLAAQGLAEVCAALRDGDVDTLIVGELGEATVVTGKARTTVARDADMLSELGEPVDRVARADEALPFAAIAVGAALVRDDNRIAPLDGVGALLRYAATNRLGSHRS

SEQ ID NO: 195770 - protein, 8 aa, Mycobacterium tuberculosis
RLRWLVAA

SEQ ID NO: 195771 - protein, 8 aa, Mycobacterium tuberculosis
LVAAEGPF

SEQ ID NO: 195772 - protein, 8 aa, Mycobacterium tuberculosis
VAAEGPFA

SEQ ID NO: 195773 - protein, 8 aa, Mycobacterium tuberculosis
AEGPFASV

SEQ ID NO: 195774 - protein, 8 aa, Mycobacterium tuberculosis
EGPFASVY

SEQ ID NO: 195775 - protein, 8 aa, Mycobacterium tuberculosis
GPFASVYF

SEQ ID NO: 195776 - protein, 8 aa, Mycobacterium tuberculosis
DTLDAVER

SEQ ID NO: 195777 - protein, 8 aa, Mycobacterium tuberculosis
TLDAVERR

SEQ ID NO: 195778 - protein, 8 aa, Mycobacterium tuberculosis
VERREATW

SEQ ID NO: 195779 - protein, 8 aa, Mycobacterium tuberculosis
EATWRDVR

SEQ ID NO: 195780 - protein, 8 aa, Mycobacterium tuberculosis
ATWRDVRK

SEQ ID NO: 195781 - protein, 8 aa, Mycobacterium tuberculosis
KQELIDSL

SEQ ID NO: 195782 - protein, 8 aa, Mycobacterium tuberculosis
LIDSLEEA

SEQ ID NO: 195783 - protein, 8 aa, Mycobacterium tuberculosis
DSLEEAVR

SEQ ID NO: 195784 - protein, 8 aa, Mycobacterium tuberculosis
AVRDSRPA

SEQ ID NO: 195785 - protein, 8 aa, Mycobacterium tuberculosis
LIATGEQV

SEQ ID NO: 195786 - protein, 8 aa, Mycobacterium tuberculosis
ATGEQVLV

SEQ ID NO: 195787 - protein, 8 aa, Mycobacterium tuberculosis
VLVNEHLI

SEQ ID NO: 195788 - protein, 8 aa, Mycobacterium tuberculosis
HLIGPPPA

SEQ ID NO: 195789 - protein, 8 aa, Mycobacterium tuberculosis
GPPPATVI

SEQ ID NO: 195790 - protein, 8 aa, Mycobacterium tuberculosis
TVIRLSDY

SEQ ID NO: 195791 - protein, 8 aa, Mycobacterium tuberculosis
IRLSDYPY

SEQ ID NO: 195792 - protein, 8 aa, Mycobacterium tuberculosis
RLSDYPYV

SEQ ID NO: 195793 - protein, 8 aa, Mycobacterium tuberculosis
DYPYVVPL

SEQ ID NO: 195794 - protein, 8 aa, Mycobacterium tuberculosis
YPYVVPLI

SEQ ID NO: 195795 - protein, 8 aa, Mycobacterium tuberculosis
YVVPLIDL

SEQ ID NO: 195796 - protein, 8 aa, Mycobacterium tuberculosis
VPLIDLEM

SEQ ID NO: 195797 - protein, 8 aa, Mycobacterium tuberculosis
LEMRRPTY

SEQ ID NO: 195798 - protein, 8 aa, Mycobacterium tuberculosis
EMRRPTYV

SEQ ID NO: 195799 - protein, 8 aa, Mycobacterium tuberculosis
MRRPTYVF

SEQ ID NO: 195800 - protein, 8 aa, Mycobacterium tuberculosis
RPTYVFAA

SEQ ID NO: 195801 - protein, 8 aa, Mycobacterium tuberculosis
PTYVFAAV

SEQ ID NO: 195802 - protein, 8 aa, Mycobacterium tuberculosis
AAVDHTGA

SEQ ID NO: 195803 - protein, 8 aa, Mycobacterium tuberculosis
KLYQGATI

SEQ ID NO: 195804 - protein, 8 aa, Mycobacterium tuberculosis
YQGATISS

SEQ ID NO: 195805 - protein, 8 aa, Mycobacterium tuberculosis
GATISSTK

SEQ ID NO: 195806 - protein, 8 aa, Mycobacterium tuberculosis
ATISSTKI

SEQ ID NO: 195807 - protein, 8 aa, Mycobacterium tuberculosis
SSTKIDGV

SEQ ID NO: 195808 - protein, 8 aa, Mycobacterium tuberculosis
TKIDGVGY

SEQ ID NO: 195809 - protein, 8 aa, Mycobacterium tuberculosis
GVGYPVHK

SEQ ID NO: 195810 - protein, 8 aa, Mycobacterium tuberculosis
YPVHKPVT

SEQ ID NO: 195811 - protein, 8 aa, Mycobacterium tuberculosis
VTAGWNGY

SEQ ID NO: 195812 - protein, 8 aa, Mycobacterium tuberculosis
GWNGYGDF

SEQ ID NO: 195813 - protein, 8 aa, Mycobacterium tuberculosis
FQHTTEEA

SEQ ID NO: 195814 - protein, 8 aa, Mycobacterium tuberculosis
HTTEEAIR

SEQ ID NO: 195815 - protein, 8 aa, Mycobacterium tuberculosis
TTEEAIRM

SEQ ID NO: 195816 - protein, 8 aa, Mycobacterium tuberculosis
EAIRMNCR

SEQ ID NO: 195817 - protein, 8 aa, Mycobacterium tuberculosis
RMNCRAVA

SEQ ID NO: 195818 - protein, 8 aa, Mycobacterium tuberculosis
AVADHLTR

SEQ ID NO: 195819 - protein, 8 aa, Mycobacterium tuberculosis
HLTRLVDA

SEQ ID NO: 195820 - protein, 8 aa, Mycobacterium tuberculosis
DAADPEVV

SEQ ID NO: 195821 - protein, 8 aa, Mycobacterium tuberculosis
AADPEVVF

SEQ ID NO: 195822 - protein, 8 aa, Mycobacterium tuberculosis
EVVFVSGE

SEQ ID NO: 195823 - protein, 8 aa, Mycobacterium tuberculosis
VVFVSGEV

SEQ ID NO: 195824 - protein, 8 aa, Mycobacterium tuberculosis
VFVSGEVR

SEQ ID NO: 195825 - protein, 8 aa, Mycobacterium tuberculosis
VSGEVRSR

SEQ ID NO: 195826 - protein, 8 aa, Mycobacterium tuberculosis
EVRSRTDL

SEQ ID NO: 195827 - protein, 8 aa, Mycobacterium tuberculosis
RTDLLSTL

SEQ ID NO: 195828 - protein, 8 aa, Mycobacterium tuberculosis
DLLSTLPQ

SEQ ID NO: 195829 - protein, 8 aa, Mycobacterium tuberculosis
LLSTLPQR

SEQ ID NO: 195830 - protein, 8 aa, Mycobacterium tuberculosis
TLPQRVAV

SEQ ID NO: 195831 - protein, 8 aa, Mycobacterium tuberculosis
AVRVSQLH

SEQ ID NO: 195832 - protein, 8 aa, Mycobacterium tuberculosis
SQLHAGPR

SEQ ID NO: 195833 - protein, 8 aa, Mycobacterium tuberculosis
QLHAGPRK

SEQ ID NO: 195834 - protein, 8 aa, Mycobacterium tuberculosis
SALDEEEI

SEQ ID NO: 195835 - protein, 8 aa, Mycobacterium tuberculosis
DEEEIWDL

SEQ ID NO: 195836 - protein, 8 aa, Mycobacterium tuberculosis
EEIWDLTS

SEQ ID NO: 195837 - protein, 8 aa, Mycobacterium tuberculosis
EIWDLTSA

SEQ ID NO: 195838 - protein, 8 aa, Mycobacterium tuberculosis
WDLTSAEF

SEQ ID NO: 195839 - protein, 8 aa, Mycobacterium tuberculosis
LTSAEFTR

SEQ ID NO: 195840 - protein, 8 aa, Mycobacterium tuberculosis
TSAEFTRR

SEQ ID NO: 195841 - protein, 8 aa, Mycobacterium tuberculosis
SAEFTRRR

SEQ ID NO: 195842 - protein, 8 aa, Mycobacterium tuberculosis
AEFTRRRY

SEQ ID NO: 195843 - protein, 8 aa, Mycobacterium tuberculosis
RRYAEITN

SEQ ID NO: 195844 - protein, 8 aa, Mycobacterium tuberculosis
RYAEITNV

SEQ ID NO: 195845 - protein, 8 aa, Mycobacterium tuberculosis
AEITNVAQ

SEQ ID NO: 195846 - protein, 8 aa, Mycobacterium tuberculosis
ITNVAQQF

SEQ ID NO: 195847 - protein, 8 aa, Mycobacterium tuberculosis
NVAQQFEA

SEQ ID NO: 195848 - protein, 8 aa, Mycobacterium tuberculosis
AQQFEAEI

SEQ ID NO: 195849 - protein, 8 aa, Mycobacterium tuberculosis
EIGRGSGL

SEQ ID NO: 195850 - protein, 8 aa, Mycobacterium tuberculosis
GLAAQGLA

SEQ ID NO: 195851 - protein, 8 aa, Mycobacterium tuberculosis
AAQGLAEV

SEQ ID NO: 195852 - protein, 8 aa, Mycobacterium tuberculosis
GLAEVCAA

SEQ ID NO: 195853 - protein, 8 aa, Mycobacterium tuberculosis
LAEVCAAL

SEQ ID NO: 195854 - protein, 8 aa, Mycobacterium tuberculosis
AEVCAALR

SEQ ID NO: 195855 - protein, 8 aa, Mycobacterium tuberculosis
DTLIVGEL

SEQ ID NO: 195856 - protein, 8 aa, Mycobacterium tuberculosis
GELGEATV

SEQ ID NO: 195857 - protein, 8 aa, Mycobacterium tuberculosis
ELGEATVV

SEQ ID NO: 195858 - protein, 8 aa, Mycobacterium tuberculosis
EATVVTGK

SEQ ID NO: 195859 - protein, 8 aa, Mycobacterium tuberculosis
TVVTGKAR

SEQ ID NO: 195860 - protein, 8 aa, Mycobacterium tuberculosis
KARTTVAR

SEQ ID NO: 195861 - protein, 8 aa, Mycobacterium tuberculosis
TVARDADM

SEQ ID NO: 195862 - protein, 8 aa, Mycobacterium tuberculosis
EPVDRVAR

SEQ ID NO: 195863 - protein, 8 aa, Mycobacterium tuberculosis
VARADEAL

SEQ ID NO: 195864 - protein, 8 aa, Mycobacterium tuberculosis
RADEALPF

SEQ ID NO: 195865 - protein, 8 aa, Mycobacterium tuberculosis
EALPFAAI

SEQ ID NO: 195866 - protein, 8 aa, Mycobacterium tuberculosis
ALPFAAIA

SEQ ID NO: 195867 - protein, 8 aa, Mycobacterium tuberculosis
LPFAAIAV

SEQ ID NO: 195868 - protein, 8 aa, Mycobacterium tuberculosis
FAAIAVGA

SEQ ID NO: 195869 - protein, 8 aa, Mycobacterium tuberculosis
AAIAVGAA

SEQ ID NO: 195870 - protein, 8 aa, Mycobacterium tuberculosis
AIAVGAAL

SEQ ID NO: 195871 - protein, 8 aa, Mycobacterium tuberculosis
IAVGAALV

SEQ ID NO: 195872 - protein, 8 aa, Mycobacterium tuberculosis
AVGAALVR

SEQ ID NO: 195873 - protein, 8 aa, Mycobacterium tuberculosis
RIAPLDGV

SEQ ID NO: 195874 - protein, 8 aa, Mycobacterium tuberculosis
APLDGVGA

SEQ ID NO: 195875 - protein, 8 aa, Mycobacterium tuberculosis
PLDGVGAL

SEQ ID NO: 195876 - protein, 8 aa, Mycobacterium tuberculosis
DGVGALLR

SEQ ID NO: 195877 - protein, 8 aa, Mycobacterium tuberculosis
GVGALLRY

SEQ ID NO: 195878 - protein, 8 aa, Mycobacterium tuberculosis
ALLRYAAT

SEQ ID NO: 195879 - protein, 8 aa, Mycobacterium tuberculosis
RYAATNRL

SEQ ID NO: 195880 - protein, 9 aa, Mycobacterium tuberculosis
RSERLRWLV

SEQ ID NO: 195881 - protein, 9 aa, Mycobacterium tuberculosis
RLRWLVAAE

SEQ ID NO: 195882 - protein, 9 aa, Mycobacterium tuberculosis
WLVAAEGPF

SEQ ID NO: 195883 - protein, 9 aa, Mycobacterium tuberculosis
AAEGPFASV

SEQ ID NO: 195884 - protein, 9 aa, Mycobacterium tuberculosis
AEGPFASVY

SEQ ID NO: 195885 - protein, 9 aa, Mycobacterium tuberculosis
EGPFASVYF

SEQ ID NO: 195886 - protein, 9 aa, Mycobacterium tuberculosis
YFDDSHDTL

SEQ ID NO: 195887 - protein, 9 aa, Mycobacterium tuberculosis
DSHDTLDAV

SEQ ID NO: 195888 - protein, 9 aa, Mycobacterium tuberculosis
HDTLDAVER

SEQ ID NO: 195889 - protein, 9 aa, Mycobacterium tuberculosis
DTLDAVERR

SEQ ID NO: 195890 - protein, 9 aa, Mycobacterium tuberculosis
EATWRDVRK

SEQ ID NO: 195891 - protein, 9 aa, Mycobacterium tuberculosis
DVRKHLESR

SEQ ID NO: 195892 - protein, 9 aa, Mycobacterium tuberculosis
ELIDSLEEA

SEQ ID NO: 195893 - protein, 9 aa, Mycobacterium tuberculosis
LIDSLEEAV

SEQ ID NO: 195894 - protein, 9 aa, Mycobacterium tuberculosis
AVRDSRPAV

SEQ ID NO: 195895 - protein, 9 aa, Mycobacterium tuberculosis
DSRPAVGQR

SEQ ID NO: 195896 - protein, 9 aa, Mycobacterium tuberculosis
AVGQRGRAL

SEQ ID NO: 195897 - protein, 9 aa, Mycobacterium tuberculosis
ALIATGEQV

SEQ ID NO: 195898 - protein, 9 aa, Mycobacterium tuberculosis
LIATGEQVL

SEQ ID NO: 195899 - protein, 9 aa, Mycobacterium tuberculosis
IATGEQVLV

SEQ ID NO: 195900 - protein, 9 aa, Mycobacterium tuberculosis
QVLVNEHLI

SEQ ID NO: 195901 - protein, 9 aa, Mycobacterium tuberculosis
HLIGPPPAT

SEQ ID NO: 195902 - protein, 9 aa, Mycobacterium tuberculosis
LIGPPPATV

SEQ ID NO: 195903 - protein, 9 aa, Mycobacterium tuberculosis
PPPATVIRL

SEQ ID NO: 195904 - protein, 9 aa, Mycobacterium tuberculosis
ATVIRLSDY

SEQ ID NO: 195905 - protein, 9 aa, Mycobacterium tuberculosis
VIRLSDYPY

SEQ ID NO: 195906 - protein, 9 aa, Mycobacterium tuberculosis
RLSDYPYVV

SEQ ID NO: 195907 - protein, 9 aa, Mycobacterium tuberculosis
SDYPYVVPL

SEQ ID NO: 195908 - protein, 9 aa, Mycobacterium tuberculosis
DYPYVVPLI

SEQ ID NO: 195909 - protein, 9 aa, Mycobacterium tuberculosis
YPYVVPLID

SEQ ID NO: 195910 - protein, 9 aa, Mycobacterium tuberculosis
PYVVPLIDL

SEQ ID NO: 195911 - protein, 9 aa, Mycobacterium tuberculosis
LEMRRPTYV

SEQ ID NO: 195912 - protein, 9 aa, Mycobacterium tuberculosis
EMRRPTYVF

SEQ ID NO: 195913 - protein, 9 aa, Mycobacterium tuberculosis
RPTYVFAAV

SEQ ID NO: 195914 - protein, 9 aa, Mycobacterium tuberculosis
FAAVDHTGA

SEQ ID NO: 195915 - protein, 9 aa, Mycobacterium tuberculosis
AVDHTGADV

SEQ ID NO: 195916 - protein, 9 aa, Mycobacterium tuberculosis
HTGADVKLY

SEQ ID NO: 195917 - protein, 9 aa, Mycobacterium tuberculosis
KLYQGATIS

SEQ ID NO: 195918 - protein, 9 aa, Mycobacterium tuberculosis
YQGATISST

SEQ ID NO: 195919 - protein, 9 aa, Mycobacterium tuberculosis
QGATISSTK

SEQ ID NO: 195920 - protein, 9 aa, Mycobacterium tuberculosis
STKIDGVGY

SEQ ID NO: 195921 - protein, 9 aa, Mycobacterium tuberculosis
KIDGVGYPV

SEQ ID NO: 195922 - protein, 9 aa, Mycobacterium tuberculosis
VGYPVHKPV

SEQ ID NO: 195923 - protein, 9 aa, Mycobacterium tuberculosis
YPVHKPVTA

SEQ ID NO: 195924 - protein, 9 aa, Mycobacterium tuberculosis
PVTAGWNGY

SEQ ID NO: 195925 - protein, 9 aa, Mycobacterium tuberculosis
FQHTTEEAI

SEQ ID NO: 195926 - protein, 9 aa, Mycobacterium tuberculosis
EEAIRMNCR

SEQ ID NO: 195927 - protein, 9 aa, Mycobacterium tuberculosis
EAIRMNCRA

SEQ ID NO: 195928 - protein, 9 aa, Mycobacterium tuberculosis
AIRMNCRAV

SEQ ID NO: 195929 - protein, 9 aa, Mycobacterium tuberculosis
RAVADHLTR

SEQ ID NO: 195930 - protein, 9 aa, Mycobacterium tuberculosis
AVADHLTRL

SEQ ID NO: 195931 - protein, 9 aa, Mycobacterium tuberculosis
VADHLTRLV

SEQ ID NO: 195932 - protein, 9 aa, Mycobacterium tuberculosis
HLTRLVDAA

SEQ ID NO: 195933 - protein, 9 aa, Mycobacterium tuberculosis
LVDAADPEV

SEQ ID NO: 195934 - protein, 9 aa, Mycobacterium tuberculosis
DAADPEVVF

SEQ ID NO: 195935 - protein, 9 aa, Mycobacterium tuberculosis
AADPEVVFV

SEQ ID NO: 195936 - protein, 9 aa, Mycobacterium tuberculosis
EVVFVSGEV

SEQ ID NO: 195937 - protein, 9 aa, Mycobacterium tuberculosis
VVFVSGEVR

SEQ ID NO: 195938 - protein, 9 aa, Mycobacterium tuberculosis
FVSGEVRSR

SEQ ID NO: 195939 - protein, 9 aa, Mycobacterium tuberculosis
GEVRSRTDL

SEQ ID NO: 195940 - protein, 9 aa, Mycobacterium tuberculosis
EVRSRTDLL

SEQ ID NO: 195941 - protein, 9 aa, Mycobacterium tuberculosis
SRTDLLSTL

SEQ ID NO: 195942 - protein, 9 aa, Mycobacterium tuberculosis
DLLSTLPQR

SEQ ID NO: 195943 - protein, 9 aa, Mycobacterium tuberculosis
LLSTLPQRV

SEQ ID NO: 195944 - protein, 9 aa, Mycobacterium tuberculosis
STLPQRVAV

SEQ ID NO: 195945 - protein, 9 aa, Mycobacterium tuberculosis
TLPQRVAVR

SEQ ID NO: 195946 - protein, 9 aa, Mycobacterium tuberculosis
LPQRVAVRV

SEQ ID NO: 195947 - protein, 9 aa, Mycobacterium tuberculosis
QRVAVRVSQ

SEQ ID NO: 195948 - protein, 9 aa, Mycobacterium tuberculosis
RVAVRVSQL

SEQ ID NO: 195949 - protein, 9 aa, Mycobacterium tuberculosis
AVRVSQLHA

SEQ ID NO: 195950 - protein, 9 aa, Mycobacterium tuberculosis
VSQLHAGPR

SEQ ID NO: 195951 - protein, 9 aa, Mycobacterium tuberculosis
SQLHAGPRK

SEQ ID NO: 195952 - protein, 9 aa, Mycobacterium tuberculosis
HAGPRKSAL

SEQ ID NO: 195953 - protein, 9 aa, Mycobacterium tuberculosis
SALDEEEIW

SEQ ID NO: 195954 - protein, 9 aa, Mycobacterium tuberculosis
ALDEEEIWD

SEQ ID NO: 195955 - protein, 9 aa, Mycobacterium tuberculosis
EEEIWDLTS

SEQ ID NO: 195956 - protein, 9 aa, Mycobacterium tuberculosis
IWDLTSAEF

SEQ ID NO: 195957 - protein, 9 aa, Mycobacterium tuberculosis
DLTSAEFTR

SEQ ID NO: 195958 - protein, 9 aa, Mycobacterium tuberculosis
LTSAEFTRR

SEQ ID NO: 195959 - protein, 9 aa, Mycobacterium tuberculosis
TSAEFTRRR

SEQ ID NO: 195960 - protein, 9 aa, Mycobacterium tuberculosis
AEFTRRRYA

SEQ ID NO: 195961 - protein, 9 aa, Mycobacterium tuberculosis
EFTRRRYAE

SEQ ID NO: 195962 - protein, 9 aa, Mycobacterium tuberculosis
FTRRRYAEI

SEQ ID NO: 195963 - protein, 9 aa, Mycobacterium tuberculosis
RRYAEITNV

SEQ ID NO: 195964 - protein, 9 aa, Mycobacterium tuberculosis
AEITNVAQQ

SEQ ID NO: 195965 - protein, 9 aa, Mycobacterium tuberculosis
EITNVAQQF

SEQ ID NO: 195966 - protein, 9 aa, Mycobacterium tuberculosis
QQFEAEIGR

SEQ ID NO: 195967 - protein, 9 aa, Mycobacterium tuberculosis
AEIGRGSGL

SEQ ID NO: 195968 - protein, 9 aa, Mycobacterium tuberculosis
LAAQGLAEV

SEQ ID NO: 195969 - protein, 9 aa, Mycobacterium tuberculosis
GLAEVCAAL

SEQ ID NO: 195970 - protein, 9 aa, Mycobacterium tuberculosis
LAEVCAALR

SEQ ID NO: 195971 - protein, 9 aa, Mycobacterium tuberculosis
AEVCAALRD

SEQ ID NO: 195972 - protein, 9 aa, Mycobacterium tuberculosis
ALRDGDVDT

SEQ ID NO: 195973 - protein, 9 aa, Mycobacterium tuberculosis
LRDGDVDTL

SEQ ID NO: 195974 - protein, 9 aa, Mycobacterium tuberculosis
LIVGELGEA

SEQ ID NO: 195975 - protein, 9 aa, Mycobacterium tuberculosis
GELGEATVV

SEQ ID NO: 195976 - protein, 9 aa, Mycobacterium tuberculosis
ELGEATVVT

SEQ ID NO: 195977 - protein, 9 aa, Mycobacterium tuberculosis
EATVVTGKA

SEQ ID NO: 195978 - protein, 9 aa, Mycobacterium tuberculosis
ATVVTGKAR

SEQ ID NO: 195979 - protein, 9 aa, Mycobacterium tuberculosis
VTGKARTTV

SEQ ID NO: 195980 - protein, 9 aa, Mycobacterium tuberculosis
TTVARDADM

SEQ ID NO: 195981 - protein, 9 aa, Mycobacterium tuberculosis
TVARDADML

SEQ ID NO: 195982 - protein, 9 aa, Mycobacterium tuberculosis
RDADMLSEL

SEQ ID NO: 195983 - protein, 9 aa, Mycobacterium tuberculosis
MLSELGEPV

SEQ ID NO: 195984 - protein, 9 aa, Mycobacterium tuberculosis
ELGEPVDRV

SEQ ID NO: 195985 - protein, 9 aa, Mycobacterium tuberculosis
EPVDRVARA

SEQ ID NO: 195986 - protein, 9 aa, Mycobacterium tuberculosis
RVARADEAL

SEQ ID NO: 195987 - protein, 9 aa, Mycobacterium tuberculosis
ARADEALPF

SEQ ID NO: 195988 - protein, 9 aa, Mycobacterium tuberculosis
RADEALPFA

SEQ ID NO: 195989 - protein, 9 aa, Mycobacterium tuberculosis
DEALPFAAI

SEQ ID NO: 195990 - protein, 9 aa, Mycobacterium tuberculosis
EALPFAAIA

SEQ ID NO: 195991 - protein, 9 aa, Mycobacterium tuberculosis
ALPFAAIAV

SEQ ID NO: 195992 - protein, 9 aa, Mycobacterium tuberculosis
LPFAAIAVG

SEQ ID NO: 195993 - protein, 9 aa, Mycobacterium tuberculosis
FAAIAVGAA

SEQ ID NO: 195994 - protein, 9 aa, Mycobacterium tuberculosis
AAIAVGAAL

SEQ ID NO: 195995 - protein, 9 aa, Mycobacterium tuberculosis
AIAVGAALV

SEQ ID NO: 195996 - protein, 9 aa, Mycobacterium tuberculosis
IAVGAALVR

SEQ ID NO: 195997 - protein, 9 aa, Mycobacterium tuberculosis
AALVRDDNR

SEQ ID NO: 195998 - protein, 9 aa, Mycobacterium tuberculosis
ALVRDDNRI

SEQ ID NO: 195999 - protein, 9 aa, Mycobacterium tuberculosis
NRIAPLDGV

SEQ ID NO: 196000 - protein, 9 aa, Mycobacterium tuberculosis
APLDGVGAL

SEQ ID NO: 196001 - protein, 9 aa, Mycobacterium tuberculosis
PLDGVGALL

SEQ ID NO: 196002 - protein, 9 aa, Mycobacterium tuberculosis
DGVGALLRY

SEQ ID NO: 196003 - protein, 9 aa, Mycobacterium tuberculosis
GVGALLRYA

SEQ ID NO: 196004 - protein, 9 aa, Mycobacterium tuberculosis
LLRYAATNR

SEQ ID NO: 196005 - protein, 9 aa, Mycobacterium tuberculosis
LRYAATNRL

SEQ ID NO: 196006 - protein, 9 aa, Mycobacterium tuberculosis
ATNRLGSHR

SEQ ID NO: 196007 - protein, 10 aa, Mycobacterium tuberculosis
MRSERLRWLV

SEQ ID NO: 196008 - protein, 10 aa, Mycobacterium tuberculosis
RWLVAAEGPF

SEQ ID NO: 196009 - protein, 10 aa, Mycobacterium tuberculosis
WLVAAEGPFA

SEQ ID NO: 196010 - protein, 10 aa, Mycobacterium tuberculosis
VAAEGPFASV

SEQ ID NO: 196011 - protein, 10 aa, Mycobacterium tuberculosis
AAEGPFASVY

SEQ ID NO: 196012 - protein, 10 aa, Mycobacterium tuberculosis
AEGPFASVYF

SEQ ID NO: 196013 - protein, 10 aa, Mycobacterium tuberculosis
FASVYFDDSH

SEQ ID NO: 196014 - protein, 10 aa, Mycobacterium tuberculosis
VYFDDSHDTL

SEQ ID NO: 196015 - protein, 10 aa, Mycobacterium tuberculosis
TLDAVERREA

SEQ ID NO: 196016 - protein, 10 aa, Mycobacterium tuberculosis
RREATWRDVR

SEQ ID NO: 196017 - protein, 10 aa, Mycobacterium tuberculosis
RKHLESRDAK

SEQ ID NO: 196018 - protein, 10 aa, Mycobacterium tuberculosis
LESRDAKQEL

SEQ ID NO: 196019 - protein, 10 aa, Mycobacterium tuberculosis
ELIDSLEEAV

SEQ ID NO: 196020 - protein, 10 aa, Mycobacterium tuberculosis
EAVRDSRPAV

SEQ ID NO: 196021 - protein, 10 aa, Mycobacterium tuberculosis
RPAVGQRGRA

SEQ ID NO: 196022 - protein, 10 aa, Mycobacterium tuberculosis
RALIATGEQV

SEQ ID NO: 196023 - protein, 10 aa, Mycobacterium tuberculosis
ALIATGEQVL

SEQ ID NO: 196024 - protein, 10 aa, Mycobacterium tuberculosis
LIATGEQVLV

SEQ ID NO: 196025 - protein, 10 aa, Mycobacterium tuberculosis
GEQVLVNEHL

SEQ ID NO: 196026 - protein, 10 aa, Mycobacterium tuberculosis
HLIGPPPATV

SEQ ID NO: 196027 - protein, 10 aa, Mycobacterium tuberculosis
LIGPPPATVI

SEQ ID NO: 196028 - protein, 10 aa, Mycobacterium tuberculosis
GPPPATVIRL

SEQ ID NO: 196029 - protein, 10 aa, Mycobacterium tuberculosis
TVIRLSDYPY

SEQ ID NO: 196030 - protein, 10 aa, Mycobacterium tuberculosis
VIRLSDYPYV

SEQ ID NO: 196031 - protein, 10 aa, Mycobacterium tuberculosis
IRLSDYPYVV

SEQ ID NO: 196032 - protein, 10 aa, Mycobacterium tuberculosis
RLSDYPYVVP

SEQ ID NO: 196033 - protein, 10 aa, Mycobacterium tuberculosis
LSDYPYVVPL

SEQ ID NO: 196034 - protein, 10 aa, Mycobacterium tuberculosis
YPYVVPLIDL

SEQ ID NO: 196035 - protein, 10 aa, Mycobacterium tuberculosis
YVVPLIDLEM

SEQ ID NO: 196036 - protein, 10 aa, Mycobacterium tuberculosis
VVPLIDLEMR

SEQ ID NO: 196037 - protein, 10 aa, Mycobacterium tuberculosis
IDLEMRRPTY

SEQ ID NO: 196038 - protein, 10 aa, Mycobacterium tuberculosis
DLEMRRPTYV

SEQ ID NO: 196039 - protein, 10 aa, Mycobacterium tuberculosis
LEMRRPTYVF

SEQ ID NO: 196040 - protein, 10 aa, Mycobacterium tuberculosis
EMRRPTYVFA

SEQ ID NO: 196041 - protein, 10 aa, Mycobacterium tuberculosis
RRPTYVFAAV

SEQ ID NO: 196042 - protein, 10 aa, Mycobacterium tuberculosis
RPTYVFAAVD

SEQ ID NO: 196043 - protein, 10 aa, Mycobacterium tuberculosis
AAVDHTGADV

SEQ ID NO: 196044 - protein, 10 aa, Mycobacterium tuberculosis
AVDHTGADVK

SEQ ID NO: 196045 - protein, 10 aa, Mycobacterium tuberculosis
KLYQGATISS

SEQ ID NO: 196046 - protein, 10 aa, Mycobacterium tuberculosis
YQGATISSTK

SEQ ID NO: 196047 - protein, 10 aa, Mycobacterium tuberculosis
QGATISSTKI

SEQ ID NO: 196048 - protein, 10 aa, Mycobacterium tuberculosis
TISSTKIDGV

SEQ ID NO: 196049 - protein, 10 aa, Mycobacterium tuberculosis
TKIDGVGYPV

SEQ ID NO: 196050 - protein, 10 aa, Mycobacterium tuberculosis
GVGYPVHKPV

SEQ ID NO: 196051 - protein, 10 aa, Mycobacterium tuberculosis
YPVHKPVTAG

SEQ ID NO: 196052 - protein, 10 aa, Mycobacterium tuberculosis
KPVTAGWNGY

SEQ ID NO: 196053 - protein, 10 aa, Mycobacterium tuberculosis
TAGWNGYGDF

SEQ ID NO: 196054 - protein, 10 aa, Mycobacterium tuberculosis
EEAIRMNCRA

SEQ ID NO: 196055 - protein, 10 aa, Mycobacterium tuberculosis
EAIRMNCRAV

SEQ ID NO: 196056 - protein, 10 aa, Mycobacterium tuberculosis
RAVADHLTRL

SEQ ID NO: 196057 - protein, 10 aa, Mycobacterium tuberculosis
AVADHLTRLV

SEQ ID NO: 196058 - protein, 10 aa, Mycobacterium tuberculosis
RLVDAADPEV

SEQ ID NO: 196059 - protein, 10 aa, Mycobacterium tuberculosis
LVDAADPEVV

SEQ ID NO: 196060 - protein, 10 aa, Mycobacterium tuberculosis
DAADPEVVFV

SEQ ID NO: 196061 - protein, 10 aa, Mycobacterium tuberculosis
EVVFVSGEVR

SEQ ID NO: 196062 - protein, 10 aa, Mycobacterium tuberculosis
VFVSGEVRSR

SEQ ID NO: 196063 - protein, 10 aa, Mycobacterium tuberculosis
GEVRSRTDLL

SEQ ID NO: 196064 - protein, 10 aa, Mycobacterium tuberculosis
DLLSTLPQRV

SEQ ID NO: 196065 - protein, 10 aa, Mycobacterium tuberculosis
LLSTLPQRVA

SEQ ID NO: 196066 - protein, 10 aa, Mycobacterium tuberculosis
STLPQRVAVR

SEQ ID NO: 196067 - protein, 10 aa, Mycobacterium tuberculosis
TLPQRVAVRV

SEQ ID NO: 196068 - protein, 10 aa, Mycobacterium tuberculosis
LPQRVAVRVS

SEQ ID NO: 196069 - protein, 10 aa, Mycobacterium tuberculosis
QRVAVRVSQL

SEQ ID NO: 196070 - protein, 10 aa, Mycobacterium tuberculosis
RVSQLHAGPR

SEQ ID NO: 196071 - protein, 10 aa, Mycobacterium tuberculosis
VSQLHAGPRK

SEQ ID NO: 196072 - protein, 10 aa, Mycobacterium tuberculosis
QLHAGPRKSA

SEQ ID NO: 196073 - protein, 10 aa, Mycobacterium tuberculosis
LHAGPRKSAL

SEQ ID NO: 196074 - protein, 10 aa, Mycobacterium tuberculosis
KSALDEEEIW

SEQ ID NO: 196075 - protein, 10 aa, Mycobacterium tuberculosis
ALDEEEIWDL

SEQ ID NO: 196076 - protein, 10 aa, Mycobacterium tuberculosis
EEEIWDLTSA

SEQ ID NO: 196077 - protein, 10 aa, Mycobacterium tuberculosis
EIWDLTSAEF

SEQ ID NO: 196078 - protein, 10 aa, Mycobacterium tuberculosis
DLTSAEFTRR

SEQ ID NO: 196079 - protein, 10 aa, Mycobacterium tuberculosis
LTSAEFTRRR

SEQ ID NO: 196080 - protein, 10 aa, Mycobacterium tuberculosis
TSAEFTRRRY

SEQ ID NO: 196081 - protein, 10 aa, Mycobacterium tuberculosis
RRYAEITNVA

SEQ ID NO: 196082 - protein, 10 aa, Mycobacterium tuberculosis
AEITNVAQQF

SEQ ID NO: 196083 - protein, 10 aa, Mycobacterium tuberculosis
NVAQQFEAEI

SEQ ID NO: 196084 - protein, 10 aa, Mycobacterium tuberculosis
AEIGRGSGLA

SEQ ID NO: 196085 - protein, 10 aa, Mycobacterium tuberculosis
GLAAQGLAEV

SEQ ID NO: 196086 - protein, 10 aa, Mycobacterium tuberculosis
AQGLAEVCAA

SEQ ID NO: 196087 - protein, 10 aa, Mycobacterium tuberculosis
GLAEVCAALR

SEQ ID NO: 196088 - protein, 10 aa, Mycobacterium tuberculosis
AEVCAALRDG

SEQ ID NO: 196089 - protein, 10 aa, Mycobacterium tuberculosis
ALRDGDVDTL

SEQ ID NO: 196090 - protein, 10 aa, Mycobacterium tuberculosis
DVDTLIVGEL

SEQ ID NO: 196091 - protein, 10 aa, Mycobacterium tuberculosis
TLIVGELGEA

SEQ ID NO: 196092 - protein, 10 aa, Mycobacterium tuberculosis
IVGELGEATV

SEQ ID NO: 196093 - protein, 10 aa, Mycobacterium tuberculosis
EATVVTGKAR

SEQ ID NO: 196094 - protein, 10 aa, Mycobacterium tuberculosis
VVTGKARTTV

SEQ ID NO: 196095 - protein, 10 aa, Mycobacterium tuberculosis
TTVARDADML

SEQ ID NO: 196096 - protein, 10 aa, Mycobacterium tuberculosis
DMLSELGEPV

SEQ ID NO: 196097 - protein, 10 aa, Mycobacterium tuberculosis
ELGEPVDRVA

SEQ ID NO: 196098 - protein, 10 aa, Mycobacterium tuberculosis
VARADEALPF

SEQ ID NO: 196099 - protein, 10 aa, Mycobacterium tuberculosis
RADEALPFAA

SEQ ID NO: 196100 - protein, 10 aa, Mycobacterium tuberculosis
EALPFAAIAV

SEQ ID NO: 196101 - protein, 10 aa, Mycobacterium tuberculosis
LPFAAIAVGA

SEQ ID NO: 196102 - protein, 10 aa, Mycobacterium tuberculosis
FAAIAVGAAL

SEQ ID NO: 196103 - protein, 10 aa, Mycobacterium tuberculosis
AAIAVGAALV

SEQ ID NO: 196104 - protein, 10 aa, Mycobacterium tuberculosis
AIAVGAALVR

SEQ ID NO: 196105 - protein, 10 aa, Mycobacterium tuberculosis
GAALVRDDNR

SEQ ID NO: 196106 - protein, 10 aa, Mycobacterium tuberculosis
ALVRDDNRIA

SEQ ID NO: 196107 - protein, 10 aa, Mycobacterium tuberculosis
VRDDNRIAPL

SEQ ID NO: 196108 - protein, 10 aa, Mycobacterium tuberculosis
RIAPLDGVGA

SEQ ID NO: 196109 - protein, 10 aa, Mycobacterium tuberculosis
APLDGVGALL

SEQ ID NO: 196110 - protein, 10 aa, Mycobacterium tuberculosis
PLDGVGALLR

SEQ ID NO: 196111 - protein, 10 aa, Mycobacterium tuberculosis
ALLRYAATNR

SEQ ID NO: 196112 - protein, 10 aa, Mycobacterium tuberculosis
LLRYAATNRL

SEQ ID NO: 196113 - protein, 10 aa, Mycobacterium tuberculosis
AATNRLGSHR

SEQ ID NO: 196114 - protein, 11 aa, Mycobacterium tuberculosis
LRWLVAAEGPF

SEQ ID NO: 196115 - protein, 11 aa, Mycobacterium tuberculosis
WLVAAEGPFAS

SEQ ID NO: 196116 - protein, 11 aa, Mycobacterium tuberculosis
LVAAEGPFASV

SEQ ID NO: 196117 - protein, 11 aa, Mycobacterium tuberculosis
VAAEGPFASVY

SEQ ID NO: 196118 - protein, 11 aa, Mycobacterium tuberculosis
SVYFDDSHDTL

SEQ ID NO: 196119 - protein, 11 aa, Mycobacterium tuberculosis
FDDSHDTLDAV

SEQ ID NO: 196120 - protein, 11 aa, Mycobacterium tuberculosis
DSHDTLDAVER

SEQ ID NO: 196121 - protein, 11 aa, Mycobacterium tuberculosis
DTLDAVERREA

SEQ ID NO: 196122 - protein, 11 aa, Mycobacterium tuberculosis
TLDAVERREAT

SEQ ID NO: 196123 - protein, 11 aa, Mycobacterium tuberculosis
DAVERREATWR

SEQ ID NO: 196124 - protein, 11 aa, Mycobacterium tuberculosis
RREATWRDVRK

SEQ ID NO: 196125 - protein, 11 aa, Mycobacterium tuberculosis
HLESRDAKQEL

SEQ ID NO: 196126 - protein, 11 aa, Mycobacterium tuberculosis
KQELIDSLEEA

SEQ ID NO: 196127 - protein, 11 aa, Mycobacterium tuberculosis
ELIDSLEEAVR

SEQ ID NO: 196128 - protein, 11 aa, Mycobacterium tuberculosis
DSLEEAVRDSR

SEQ ID NO: 196129 - protein, 11 aa, Mycobacterium tuberculosis
EEAVRDSRPAV

SEQ ID NO: 196130 - protein, 11 aa, Mycobacterium tuberculosis
AVRDSRPAVGQ

SEQ ID NO: 196131 - protein, 11 aa, Mycobacterium tuberculosis
DSRPAVGQRGR

SEQ ID NO: 196132 - protein, 11 aa, Mycobacterium tuberculosis
RPAVGQRGRAL

SEQ ID NO: 196133 - protein, 11 aa, Mycobacterium tuberculosis
RGRALIATGEQ

SEQ ID NO: 196134 - protein, 11 aa, Mycobacterium tuberculosis
ALIATGEQVLV

SEQ ID NO: 196135 - protein, 11 aa, Mycobacterium tuberculosis
GEQVLVNEHLI

SEQ ID NO: 196136 - protein, 11 aa, Mycobacterium tuberculosis
EHLIGPPPATV

SEQ ID NO: 196137 - protein, 11 aa, Mycobacterium tuberculosis
HLIGPPPATVI

SEQ ID NO: 196138 - protein, 11 aa, Mycobacterium tuberculosis
LIGPPPATVIR

SEQ ID NO: 196139 - protein, 11 aa, Mycobacterium tuberculosis
ATVIRLSDYPY

SEQ ID NO: 196140 - protein, 11 aa, Mycobacterium tuberculosis
TVIRLSDYPYV

SEQ ID NO: 196141 - protein, 11 aa, Mycobacterium tuberculosis
VIRLSDYPYVV

SEQ ID NO: 196142 - protein, 11 aa, Mycobacterium tuberculosis
RLSDYPYVVPL

SEQ ID NO: 196143 - protein, 11 aa, Mycobacterium tuberculosis
DYPYVVPLIDL

SEQ ID NO: 196144 - protein, 11 aa, Mycobacterium tuberculosis
YPYVVPLIDLE

SEQ ID NO: 196145 - protein, 11 aa, Mycobacterium tuberculosis
PYVVPLIDLEM

SEQ ID NO: 196146 - protein, 11 aa, Mycobacterium tuberculosis
YVVPLIDLEMR

SEQ ID NO: 196147 - protein, 11 aa, Mycobacterium tuberculosis
VVPLIDLEMRR

SEQ ID NO: 196148 - protein, 11 aa, Mycobacterium tuberculosis
PLIDLEMRRPT

SEQ ID NO: 196149 - protein, 11 aa, Mycobacterium tuberculosis
LIDLEMRRPTY

SEQ ID NO: 196150 - protein, 11 aa, Mycobacterium tuberculosis
EMRRPTYVFAA

SEQ ID NO: 196151 - protein, 11 aa, Mycobacterium tuberculosis
MRRPTYVFAAV

SEQ ID NO: 196152 - protein, 11 aa, Mycobacterium tuberculosis
YVFAAVDHTGA

SEQ ID NO: 196153 - protein, 11 aa, Mycobacterium tuberculosis
FAAVDHTGADV

SEQ ID NO: 196154 - protein, 11 aa, Mycobacterium tuberculosis
AAVDHTGADVK

SEQ ID NO: 196155 - protein, 11 aa, Mycobacterium tuberculosis
AVDHTGADVKL

SEQ ID NO: 196156 - protein, 11 aa, Mycobacterium tuberculosis
TGADVKLYQGA

SEQ ID NO: 196157 - protein, 11 aa, Mycobacterium tuberculosis
KLYQGATISST

SEQ ID NO: 196158 - protein, 11 aa, Mycobacterium tuberculosis
LYQGATISSTK

SEQ ID NO: 196159 - protein, 11 aa, Mycobacterium tuberculosis
YQGATISSTKI

SEQ ID NO: 196160 - protein, 11 aa, Mycobacterium tuberculosis
ATISSTKIDGV

SEQ ID NO: 196161 - protein, 11 aa, Mycobacterium tuberculosis
STKIDGVGYPV

SEQ ID NO: 196162 - protein, 11 aa, Mycobacterium tuberculosis
KIDGVGYPVHK

SEQ ID NO: 196163 - protein, 11 aa, Mycobacterium tuberculosis
DGVGYPVHKPV

SEQ ID NO: 196164 - protein, 11 aa, Mycobacterium tuberculosis
YPVHKPVTAGW

SEQ ID NO: 196165 - protein, 11 aa, Mycobacterium tuberculosis
VTAGWNGYGDF

SEQ ID NO: 196166 - protein, 11 aa, Mycobacterium tuberculosis
DFQHTTEEAIR

SEQ ID NO: 196167 - protein, 11 aa, Mycobacterium tuberculosis
FQHTTEEAIRM

SEQ ID NO: 196168 - protein, 11 aa, Mycobacterium tuberculosis
TTEEAIRMNCR

SEQ ID NO: 196169 - protein, 11 aa, Mycobacterium tuberculosis
EEAIRMNCRAV

SEQ ID NO: 196170 - protein, 11 aa, Mycobacterium tuberculosis
EAIRMNCRAVA

SEQ ID NO: 196171 - protein, 11 aa, Mycobacterium tuberculosis
RMNCRAVADHL

SEQ ID NO: 196172 - protein, 11 aa, Mycobacterium tuberculosis
RAVADHLTRLV

SEQ ID NO: 196173 - protein, 11 aa, Mycobacterium tuberculosis
RLVDAADPEVV

SEQ ID NO: 196174 - protein, 11 aa, Mycobacterium tuberculosis
LVDAADPEVVF

SEQ ID NO: 196175 - protein, 11 aa, Mycobacterium tuberculosis
EVVFVSGEVRS

SEQ ID NO: 196176 - protein, 11 aa, Mycobacterium tuberculosis
VVFVSGEVRSR

SEQ ID NO: 196177 - protein, 11 aa, Mycobacterium tuberculosis
RTDLLSTLPQR

SEQ ID NO: 196178 - protein, 11 aa, Mycobacterium tuberculosis
DLLSTLPQRVA

SEQ ID NO: 196179 - protein, 11 aa, Mycobacterium tuberculosis
LLSTLPQRVAV

SEQ ID NO: 196180 - protein, 11 aa, Mycobacterium tuberculosis
LSTLPQRVAVR

SEQ ID NO: 196181 - protein, 11 aa, Mycobacterium tuberculosis
STLPQRVAVRV

SEQ ID NO: 196182 - protein, 11 aa, Mycobacterium tuberculosis
RVSQLHAGPRK

SEQ ID NO: 196183 - protein, 11 aa, Mycobacterium tuberculosis
SQLHAGPRKSA

SEQ ID NO: 196184 - protein, 11 aa, Mycobacterium tuberculosis
QLHAGPRKSAL

SEQ ID NO: 196185 - protein, 11 aa, Mycobacterium tuberculosis
RKSALDEEEIW

SEQ ID NO: 196186 - protein, 11 aa, Mycobacterium tuberculosis
SALDEEEIWDL

SEQ ID NO: 196187 - protein, 11 aa, Mycobacterium tuberculosis
ALDEEEIWDLT

SEQ ID NO: 196188 - protein, 11 aa, Mycobacterium tuberculosis
EEIWDLTSAEF

SEQ ID NO: 196189 - protein, 11 aa, Mycobacterium tuberculosis
EIWDLTSAEFT

SEQ ID NO: 196190 - protein, 11 aa, Mycobacterium tuberculosis
DLTSAEFTRRR

SEQ ID NO: 196191 - protein, 11 aa, Mycobacterium tuberculosis
LTSAEFTRRRY

SEQ ID NO: 196192 - protein, 11 aa, Mycobacterium tuberculosis
TSAEFTRRRYA

SEQ ID NO: 196193 - protein, 11 aa, Mycobacterium tuberculosis
AEFTRRRYAEI

SEQ ID NO: 196194 - protein, 11 aa, Mycobacterium tuberculosis
RRYAEITNVAQ

SEQ ID NO: 196195 - protein, 11 aa, Mycobacterium tuberculosis
YAEITNVAQQF

SEQ ID NO: 196196 - protein, 11 aa, Mycobacterium tuberculosis
EITNVAQQFEA

SEQ ID NO: 196197 - protein, 11 aa, Mycobacterium tuberculosis
VAQQFEAEIGR

SEQ ID NO: 196198 - protein, 11 aa, Mycobacterium tuberculosis
FEAEIGRGSGL

SEQ ID NO: 196199 - protein, 11 aa, Mycobacterium tuberculosis
AEIGRGSGLAA

SEQ ID NO: 196200 - protein, 11 aa, Mycobacterium tuberculosis
SGLAAQGLAEV

SEQ ID NO: 196201 - protein, 11 aa, Mycobacterium tuberculosis
AQGLAEVCAAL

SEQ ID NO: 196202 - protein, 11 aa, Mycobacterium tuberculosis
AEVCAALRDGD

SEQ ID NO: 196203 - protein, 11 aa, Mycobacterium tuberculosis
EVCAALRDGDV

SEQ ID NO: 196204 - protein, 11 aa, Mycobacterium tuberculosis
ALRDGDVDTLI

SEQ ID NO: 196205 - protein, 11 aa, Mycobacterium tuberculosis
DTLIVGELGEA

SEQ ID NO: 196206 - protein, 11 aa, Mycobacterium tuberculosis
LIVGELGEATV

SEQ ID NO: 196207 - protein, 11 aa, Mycobacterium tuberculosis
IVGELGEATVV

SEQ ID NO: 196208 - protein, 11 aa, Mycobacterium tuberculosis
ELGEATVVTGK

SEQ ID NO: 196209 - protein, 11 aa, Mycobacterium tuberculosis
TVVTGKARTTV

SEQ ID NO: 196210 - protein, 11 aa, Mycobacterium tuberculosis
VTGKARTTVAR

SEQ ID NO: 196211 - protein, 11 aa, Mycobacterium tuberculosis
MLSELGEPVDR

SEQ ID NO: 196212 - protein, 11 aa, Mycobacterium tuberculosis
ELGEPVDRVAR

SEQ ID NO: 196213 - protein, 11 aa, Mycobacterium tuberculosis
RVARADEALPF

SEQ ID NO: 196214 - protein, 11 aa, Mycobacterium tuberculosis
RADEALPFAAI

SEQ ID NO: 196215 - protein, 11 aa, Mycobacterium tuberculosis
DEALPFAAIAV

SEQ ID NO: 196216 - protein, 11 aa, Mycobacterium tuberculosis
ALPFAAIAVGA

SEQ ID NO: 196217 - protein, 11 aa, Mycobacterium tuberculosis
LPFAAIAVGAA

SEQ ID NO: 196218 - protein, 11 aa, Mycobacterium tuberculosis
FAAIAVGAALV

SEQ ID NO: 196219 - protein, 11 aa, Mycobacterium tuberculosis
AAIAVGAALVR

SEQ ID NO: 196220 - protein, 11 aa, Mycobacterium tuberculosis
LVRDDNRIAPL

SEQ ID NO: 196221 - protein, 11 aa, Mycobacterium tuberculosis
RIAPLDGVGAL

SEQ ID NO: 196222 - protein, 11 aa, Mycobacterium tuberculosis
PLDGVGALLRY

SEQ ID NO: 196223 - protein, 11 aa, Mycobacterium tuberculosis
GALLRYAATNR

SEQ ID NO: 196224 - protein, 11 aa, Mycobacterium tuberculosis
ALLRYAATNRL

SEQ ID NO: 196225 - protein, 11 aa, Mycobacterium tuberculosis
YAATNRLGSHR

SEQ ID NO: 196226 - protein, 13 aa, Mycobacterium tuberculosis
MRSERLRWLVAAE

SEQ ID NO: 196227 - protein, 13 aa, Mycobacterium tuberculosis
RSERLRWLVAAEG

SEQ ID NO: 196228 - protein, 13 aa, Mycobacterium tuberculosis
SERLRWLVAAEGP

SEQ ID NO: 196229 - protein, 13 aa, Mycobacterium tuberculosis
ERLRWLVAAEGPF

SEQ ID NO: 196230 - protein, 13 aa, Mycobacterium tuberculosis
RLRWLVAAEGPFA

SEQ ID NO: 196231 - protein, 13 aa, Mycobacterium tuberculosis
LRWLVAAEGPFAS

SEQ ID NO: 196232 - protein, 13 aa, Mycobacterium tuberculosis
RWLVAAEGPFASV

SEQ ID NO: 196233 - protein, 13 aa, Mycobacterium tuberculosis
WLVAAEGPFASVY

SEQ ID NO: 196234 - protein, 13 aa, Mycobacterium tuberculosis
LVAAEGPFASVYF

SEQ ID NO: 196235 - protein, 13 aa, Mycobacterium tuberculosis
VAAEGPFASVYFD

SEQ ID NO: 196236 - protein, 13 aa, Mycobacterium tuberculosis
AAEGPFASVYFDD

SEQ ID NO: 196237 - protein, 13 aa, Mycobacterium tuberculosis
AEGPFASVYFDDS

SEQ ID NO: 196238 - protein, 13 aa, Mycobacterium tuberculosis
EGPFASVYFDDSH

SEQ ID NO: 196239 - protein, 13 aa, Mycobacterium tuberculosis
GPFASVYFDDSHD

SEQ ID NO: 196240 - protein, 13 aa, Mycobacterium tuberculosis
PFASVYFDDSHDT

SEQ ID NO: 196241 - protein, 13 aa, Mycobacterium tuberculosis
FASVYFDDSHDTL

SEQ ID NO: 196242 - protein, 13 aa, Mycobacterium tuberculosis
ASVYFDDSHDTLD

SEQ ID NO: 196243 - protein, 13 aa, Mycobacterium tuberculosis
SVYFDDSHDTLDA

SEQ ID NO: 196244 - protein, 13 aa, Mycobacterium tuberculosis
VYFDDSHDTLDAV

SEQ ID NO: 196245 - protein, 13 aa, Mycobacterium tuberculosis
YFDDSHDTLDAVE

SEQ ID NO: 196246 - protein, 13 aa, Mycobacterium tuberculosis
FDDSHDTLDAVER

SEQ ID NO: 196247 - protein, 13 aa, Mycobacterium tuberculosis
DDSHDTLDAVERR

SEQ ID NO: 196248 - protein, 13 aa, Mycobacterium tuberculosis
DSHDTLDAVERRE

SEQ ID NO: 196249 - protein, 13 aa, Mycobacterium tuberculosis
SHDTLDAVERREA

SEQ ID NO: 196250 - protein, 13 aa, Mycobacterium tuberculosis
HDTLDAVERREAT

SEQ ID NO: 196251 - protein, 13 aa, Mycobacterium tuberculosis
DTLDAVERREATW

SEQ ID NO: 196252 - protein, 13 aa, Mycobacterium tuberculosis
TLDAVERREATWR

SEQ ID NO: 196253 - protein, 13 aa, Mycobacterium tuberculosis
LDAVERREATWRD

SEQ ID NO: 196254 - protein, 13 aa, Mycobacterium tuberculosis
DAVERREATWRDV

SEQ ID NO: 196255 - protein, 13 aa, Mycobacterium tuberculosis
AVERREATWRDVR

SEQ ID NO: 196256 - protein, 13 aa, Mycobacterium tuberculosis
VERREATWRDVRK

SEQ ID NO: 196257 - protein, 13 aa, Mycobacterium tuberculosis
ERREATWRDVRKH

SEQ ID NO: 196258 - protein, 13 aa, Mycobacterium tuberculosis
RREATWRDVRKHL

SEQ ID NO: 196259 - protein, 13 aa, Mycobacterium tuberculosis
REATWRDVRKHLE

SEQ ID NO: 196260 - protein, 13 aa, Mycobacterium tuberculosis
EATWRDVRKHLES

SEQ ID NO: 196261 - protein, 13 aa, Mycobacterium tuberculosis
ATWRDVRKHLESR

SEQ ID NO: 196262 - protein, 13 aa, Mycobacterium tuberculosis
TWRDVRKHLESRD

SEQ ID NO: 196263 - protein, 13 aa, Mycobacterium tuberculosis
WRDVRKHLESRDA

SEQ ID NO: 196264 - protein, 13 aa, Mycobacterium tuberculosis
RDVRKHLESRDAK

SEQ ID NO: 196265 - protein, 13 aa, Mycobacterium tuberculosis
DVRKHLESRDAKQ

SEQ ID NO: 196266 - protein, 13 aa, Mycobacterium tuberculosis
VRKHLESRDAKQE

SEQ ID NO: 196267 - protein, 13 aa, Mycobacterium tuberculosis
RKHLESRDAKQEL

SEQ ID NO: 196268 - protein, 13 aa, Mycobacterium tuberculosis
KHLESRDAKQELI

SEQ ID NO: 196269 - protein, 13 aa, Mycobacterium tuberculosis
HLESRDAKQELID

SEQ ID NO: 196270 - protein, 13 aa, Mycobacterium tuberculosis
LESRDAKQELIDS

SEQ ID NO: 196271 - protein, 13 aa, Mycobacterium tuberculosis
ESRDAKQELIDSL

SEQ ID NO: 196272 - protein, 13 aa, Mycobacterium tuberculosis
SRDAKQELIDSLE

SEQ ID NO: 196273 - protein, 13 aa, Mycobacterium tuberculosis
RDAKQELIDSLEE

SEQ ID NO: 196274 - protein, 13 aa, Mycobacterium tuberculosis
DAKQELIDSLEEA

SEQ ID NO: 196275 - protein, 13 aa, Mycobacterium tuberculosis
AKQELIDSLEEAV

SEQ ID NO: 196276 - protein, 13 aa, Mycobacterium tuberculosis
KQELIDSLEEAVR

SEQ ID NO: 196277 - protein, 13 aa, Mycobacterium tuberculosis
QELIDSLEEAVRD

SEQ ID NO: 196278 - protein, 13 aa, Mycobacterium tuberculosis
ELIDSLEEAVRDS

SEQ ID NO: 196279 - protein, 13 aa, Mycobacterium tuberculosis
LIDSLEEAVRDSR

SEQ ID NO: 196280 - protein, 13 aa, Mycobacterium tuberculosis
IDSLEEAVRDSRP

SEQ ID NO: 196281 - protein, 13 aa, Mycobacterium tuberculosis
DSLEEAVRDSRPA

SEQ ID NO: 196282 - protein, 13 aa, Mycobacterium tuberculosis
SLEEAVRDSRPAV

SEQ ID NO: 196283 - protein, 13 aa, Mycobacterium tuberculosis
LEEAVRDSRPAVG

SEQ ID NO: 196284 - protein, 13 aa, Mycobacterium tuberculosis
EEAVRDSRPAVGQ

SEQ ID NO: 196285 - protein, 13 aa, Mycobacterium tuberculosis
EAVRDSRPAVGQR

SEQ ID NO: 196286 - protein, 13 aa, Mycobacterium tuberculosis
AVRDSRPAVGQRG

SEQ ID NO: 196287 - protein, 13 aa, Mycobacterium tuberculosis
VRDSRPAVGQRGR

SEQ ID NO: 196288 - protein, 13 aa, Mycobacterium tuberculosis
RDSRPAVGQRGRA

SEQ ID NO: 196289 - protein, 13 aa, Mycobacterium tuberculosis
DSRPAVGQRGRAL

SEQ ID NO: 196290 - protein, 13 aa, Mycobacterium tuberculosis
SRPAVGQRGRALI

SEQ ID NO: 196291 - protein, 13 aa, Mycobacterium tuberculosis
RPAVGQRGRALIA

SEQ ID NO: 196292 - protein, 13 aa, Mycobacterium tuberculosis
PAVGQRGRALIAT

SEQ ID NO: 196293 - protein, 13 aa, Mycobacterium tuberculosis
AVGQRGRALIATG

SEQ ID NO: 196294 - protein, 13 aa, Mycobacterium tuberculosis
VGQRGRALIATGE

SEQ ID NO: 196295 - protein, 13 aa, Mycobacterium tuberculosis
GQRGRALIATGEQ

SEQ ID NO: 196296 - protein, 13 aa, Mycobacterium tuberculosis
QRGRALIATGEQV

SEQ ID NO: 196297 - protein, 13 aa, Mycobacterium tuberculosis
RGRALIATGEQVL

SEQ ID NO: 196298 - protein, 13 aa, Mycobacterium tuberculosis
GRALIATGEQVLV

SEQ ID NO: 196299 - protein, 13 aa, Mycobacterium tuberculosis
RALIATGEQVLVN

SEQ ID NO: 196300 - protein, 13 aa, Mycobacterium tuberculosis
ALIATGEQVLVNE

SEQ ID NO: 196301 - protein, 13 aa, Mycobacterium tuberculosis
LIATGEQVLVNEH

SEQ ID NO: 196302 - protein, 13 aa, Mycobacterium tuberculosis
IATGEQVLVNEHL

SEQ ID NO: 196303 - protein, 13 aa, Mycobacterium tuberculosis
ATGEQVLVNEHLI

SEQ ID NO: 196304 - protein, 13 aa, Mycobacterium tuberculosis
TGEQVLVNEHLIG

SEQ ID NO: 196305 - protein, 13 aa, Mycobacterium tuberculosis
GEQVLVNEHLIGP

SEQ ID NO: 196306 - protein, 13 aa, Mycobacterium tuberculosis
EQVLVNEHLIGPP

SEQ ID NO: 196307 - protein, 13 aa, Mycobacterium tuberculosis
QVLVNEHLIGPPP

SEQ ID NO: 196308 - protein, 13 aa, Mycobacterium tuberculosis
VLVNEHLIGPPPA

SEQ ID NO: 196309 - protein, 13 aa, Mycobacterium tuberculosis
LVNEHLIGPPPAT

SEQ ID NO: 196310 - protein, 13 aa, Mycobacterium tuberculosis
VNEHLIGPPPATV

SEQ ID NO: 196311 - protein, 13 aa, Mycobacterium tuberculosis
NEHLIGPPPATVI

SEQ ID NO: 196312 - protein, 13 aa, Mycobacterium tuberculosis
EHLIGPPPATVIR

SEQ ID NO: 196313 - protein, 13 aa, Mycobacterium tuberculosis
HLIGPPPATVIRL

SEQ ID NO: 196314 - protein, 13 aa, Mycobacterium tuberculosis
LIGPPPATVIRLS

SEQ ID NO: 196315 - protein, 13 aa, Mycobacterium tuberculosis
IGPPPATVIRLSD

SEQ ID NO: 196316 - protein, 13 aa, Mycobacterium tuberculosis
GPPPATVIRLSDY

SEQ ID NO: 196317 - protein, 13 aa, Mycobacterium tuberculosis
PPPATVIRLSDYP

SEQ ID NO: 196318 - protein, 13 aa, Mycobacterium tuberculosis
PPATVIRLSDYPY

SEQ ID NO: 196319 - protein, 13 aa, Mycobacterium tuberculosis
PATVIRLSDYPYV

SEQ ID NO: 196320 - protein, 13 aa, Mycobacterium tuberculosis
ATVIRLSDYPYVV

SEQ ID NO: 196321 - protein, 13 aa, Mycobacterium tuberculosis
TVIRLSDYPYVVP

SEQ ID NO: 196322 - protein, 13 aa, Mycobacterium tuberculosis
VIRLSDYPYVVPL

SEQ ID NO: 196323 - protein, 13 aa, Mycobacterium tuberculosis
IRLSDYPYVVPLI

SEQ ID NO: 196324 - protein, 13 aa, Mycobacterium tuberculosis
RLSDYPYVVPLID

SEQ ID NO: 196325 - protein, 13 aa, Mycobacterium tuberculosis
LSDYPYVVPLIDL

SEQ ID NO: 196326 - protein, 13 aa, Mycobacterium tuberculosis
SDYPYVVPLIDLE

SEQ ID NO: 196327 - protein, 13 aa, Mycobacterium tuberculosis
DYPYVVPLIDLEM

SEQ ID NO: 196328 - protein, 13 aa, Mycobacterium tuberculosis
YPYVVPLIDLEMR

SEQ ID NO: 196329 - protein, 13 aa, Mycobacterium tuberculosis
PYVVPLIDLEMRR

SEQ ID NO: 196330 - protein, 13 aa, Mycobacterium tuberculosis
YVVPLIDLEMRRP

SEQ ID NO: 196331 - protein, 13 aa, Mycobacterium tuberculosis
VVPLIDLEMRRPT

SEQ ID NO: 196332 - protein, 13 aa, Mycobacterium tuberculosis
VPLIDLEMRRPTY

SEQ ID NO: 196333 - protein, 13 aa, Mycobacterium tuberculosis
PLIDLEMRRPTYV

SEQ ID NO: 196334 - protein, 13 aa, Mycobacterium tuberculosis
LIDLEMRRPTYVF

SEQ ID NO: 196335 - protein, 13 aa, Mycobacterium tuberculosis
IDLEMRRPTYVFA

SEQ ID NO: 196336 - protein, 13 aa, Mycobacterium tuberculosis
DLEMRRPTYVFAA

SEQ ID NO: 196337 - protein, 13 aa, Mycobacterium tuberculosis
LEMRRPTYVFAAV

SEQ ID NO: 196338 - protein, 13 aa, Mycobacterium tuberculosis
EMRRPTYVFAAVD

SEQ ID NO: 196339 - protein, 13 aa, Mycobacterium tuberculosis
MRRPTYVFAAVDH

SEQ ID NO: 196340 - protein, 13 aa, Mycobacterium tuberculosis
RRPTYVFAAVDHT

SEQ ID NO: 196341 - protein, 13 aa, Mycobacterium tuberculosis
RPTYVFAAVDHTG

SEQ ID NO: 196342 - protein, 13 aa, Mycobacterium tuberculosis
PTYVFAAVDHTGA

SEQ ID NO: 196343 - protein, 13 aa, Mycobacterium tuberculosis
TYVFAAVDHTGAD

SEQ ID NO: 196344 - protein, 13 aa, Mycobacterium tuberculosis
YVFAAVDHTGADV

SEQ ID NO: 196345 - protein, 13 aa, Mycobacterium tuberculosis
VFAAVDHTGADVK

SEQ ID NO: 196346 - protein, 13 aa, Mycobacterium tuberculosis
FAAVDHTGADVKL

SEQ ID NO: 196347 - protein, 13 aa, Mycobacterium tuberculosis
AAVDHTGADVKLY

SEQ ID NO: 196348 - protein, 13 aa, Mycobacterium tuberculosis
AVDHTGADVKLYQ

SEQ ID NO: 196349 - protein, 13 aa, Mycobacterium tuberculosis
VDHTGADVKLYQG

SEQ ID NO: 196350 - protein, 13 aa, Mycobacterium tuberculosis
DHTGADVKLYQGA

SEQ ID NO: 196351 - protein, 13 aa, Mycobacterium tuberculosis
HTGADVKLYQGAT

SEQ ID NO: 196352 - protein, 13 aa, Mycobacterium tuberculosis
TGADVKLYQGATI

SEQ ID NO: 196353 - protein, 13 aa, Mycobacterium tuberculosis
GADVKLYQGATIS

SEQ ID NO: 196354 - protein, 13 aa, Mycobacterium tuberculosis
ADVKLYQGATISS

SEQ ID NO: 196355 - protein, 13 aa, Mycobacterium tuberculosis
DVKLYQGATISST

SEQ ID NO: 196356 - protein, 13 aa, Mycobacterium tuberculosis
VKLYQGATISSTK

SEQ ID NO: 196357 - protein, 13 aa, Mycobacterium tuberculosis
KLYQGATISSTKI

SEQ ID NO: 196358 - protein, 13 aa, Mycobacterium tuberculosis
LYQGATISSTKID

SEQ ID NO: 196359 - protein, 13 aa, Mycobacterium tuberculosis
YQGATISSTKIDG

SEQ ID NO: 196360 - protein, 13 aa, Mycobacterium tuberculosis
QGATISSTKIDGV

SEQ ID NO: 196361 - protein, 13 aa, Mycobacterium tuberculosis
GATISSTKIDGVG

SEQ ID NO: 196362 - protein, 13 aa, Mycobacterium tuberculosis
ATISSTKIDGVGY

SEQ ID NO: 196363 - protein, 13 aa, Mycobacterium tuberculosis
TISSTKIDGVGYP

SEQ ID NO: 196364 - protein, 13 aa, Mycobacterium tuberculosis
ISSTKIDGVGYPV

SEQ ID NO: 196365 - protein, 13 aa, Mycobacterium tuberculosis
SSTKIDGVGYPVH

SEQ ID NO: 196366 - protein, 13 aa, Mycobacterium tuberculosis
STKIDGVGYPVHK

SEQ ID NO: 196367 - protein, 13 aa, Mycobacterium tuberculosis
TKIDGVGYPVHKP

SEQ ID NO: 196368 - protein, 13 aa, Mycobacterium tuberculosis
KIDGVGYPVHKPV

SEQ ID NO: 196369 - protein, 13 aa, Mycobacterium tuberculosis
IDGVGYPVHKPVT

SEQ ID NO: 196370 - protein, 13 aa, Mycobacterium tuberculosis
DGVGYPVHKPVTA

SEQ ID NO: 196371 - protein, 13 aa, Mycobacterium tuberculosis
GVGYPVHKPVTAG

SEQ ID NO: 196372 - protein, 13 aa, Mycobacterium tuberculosis
VGYPVHKPVTAGW

SEQ ID NO: 196373 - protein, 13 aa, Mycobacterium tuberculosis
GYPVHKPVTAGWN

SEQ ID NO: 196374 - protein, 13 aa, Mycobacterium tuberculosis
YPVHKPVTAGWNG

SEQ ID NO: 196375 - protein, 13 aa, Mycobacterium tuberculosis
PVHKPVTAGWNGY

SEQ ID NO: 196376 - protein, 13 aa, Mycobacterium tuberculosis
VHKPVTAGWNGYG

SEQ ID NO: 196377 - protein, 13 aa, Mycobacterium tuberculosis
HKPVTAGWNGYGD

SEQ ID NO: 196378 - protein, 13 aa, Mycobacterium tuberculosis
KPVTAGWNGYGDF

SEQ ID NO: 196379 - protein, 13 aa, Mycobacterium tuberculosis
PVTAGWNGYGDFQ

SEQ ID NO: 196380 - protein, 13 aa, Mycobacterium tuberculosis
VTAGWNGYGDFQH

SEQ ID NO: 196381 - protein, 13 aa, Mycobacterium tuberculosis
TAGWNGYGDFQHT

SEQ ID NO: 196382 - protein, 13 aa, Mycobacterium tuberculosis
AGWNGYGDFQHTT

SEQ ID NO: 196383 - protein, 13 aa, Mycobacterium tuberculosis
GWNGYGDFQHTTE

SEQ ID NO: 196384 - protein, 13 aa, Mycobacterium tuberculosis
WNGYGDFQHTTEE

SEQ ID NO: 196385 - protein, 13 aa, Mycobacterium tuberculosis
NGYGDFQHTTEEA

SEQ ID NO: 196386 - protein, 13 aa, Mycobacterium tuberculosis
GYGDFQHTTEEAI

SEQ ID NO: 196387 - protein, 13 aa, Mycobacterium tuberculosis
YGDFQHTTEEAIR

SEQ ID NO: 196388 - protein, 13 aa, Mycobacterium tuberculosis
GDFQHTTEEAIRM

SEQ ID NO: 196389 - protein, 13 aa, Mycobacterium tuberculosis
DFQHTTEEAIRMN

SEQ ID NO: 196390 - protein, 13 aa, Mycobacterium tuberculosis
FQHTTEEAIRMNC

SEQ ID NO: 196391 - protein, 13 aa, Mycobacterium tuberculosis
QHTTEEAIRMNCR

SEQ ID NO: 196392 - protein, 13 aa, Mycobacterium tuberculosis
HTTEEAIRMNCRA

SEQ ID NO: 196393 - protein, 13 aa, Mycobacterium tuberculosis
TTEEAIRMNCRAV

SEQ ID NO: 196394 - protein, 13 aa, Mycobacterium tuberculosis
TEEAIRMNCRAVA

SEQ ID NO: 196395 - protein, 13 aa, Mycobacterium tuberculosis
EEAIRMNCRAVAD

SEQ ID NO: 196396 - protein, 13 aa, Mycobacterium tuberculosis
EAIRMNCRAVADH

SEQ ID NO: 196397 - protein, 13 aa, Mycobacterium tuberculosis
AIRMNCRAVADHL

SEQ ID NO: 196398 - protein, 13 aa, Mycobacterium tuberculosis
IRMNCRAVADHLT

SEQ ID NO: 196399 - protein, 13 aa, Mycobacterium tuberculosis
RMNCRAVADHLTR

SEQ ID NO: 196400 - protein, 13 aa, Mycobacterium tuberculosis
MNCRAVADHLTRL

SEQ ID NO: 196401 - protein, 13 aa, Mycobacterium tuberculosis
NCRAVADHLTRLV

SEQ ID NO: 196402 - protein, 13 aa, Mycobacterium tuberculosis
CRAVADHLTRLVD

SEQ ID NO: 196403 - protein, 13 aa, Mycobacterium tuberculosis
RAVADHLTRLVDA

SEQ ID NO: 196404 - protein, 13 aa, Mycobacterium tuberculosis
AVADHLTRLVDAA

SEQ ID NO: 196405 - protein, 13 aa, Mycobacterium tuberculosis
VADHLTRLVDAAD

SEQ ID NO: 196406 - protein, 13 aa, Mycobacterium tuberculosis
ADHLTRLVDAADP

SEQ ID NO: 196407 - protein, 13 aa, Mycobacterium tuberculosis
DHLTRLVDAADPE

SEQ ID NO: 196408 - protein, 13 aa, Mycobacterium tuberculosis
HLTRLVDAADPEV

SEQ ID NO: 196409 - protein, 13 aa, Mycobacterium tuberculosis
LTRLVDAADPEVV

SEQ ID NO: 196410 - protein, 13 aa, Mycobacterium tuberculosis
TRLVDAADPEVVF

SEQ ID NO: 196411 - protein, 13 aa, Mycobacterium tuberculosis
RLVDAADPEVVFV

SEQ ID NO: 196412 - protein, 13 aa, Mycobacterium tuberculosis
LVDAADPEVVFVS

SEQ ID NO: 196413 - protein, 13 aa, Mycobacterium tuberculosis
VDAADPEVVFVSG

SEQ ID NO: 196414 - protein, 13 aa, Mycobacterium tuberculosis
DAADPEVVFVSGE

SEQ ID NO: 196415 - protein, 13 aa, Mycobacterium tuberculosis
AADPEVVFVSGEV

SEQ ID NO: 196416 - protein, 13 aa, Mycobacterium tuberculosis
ADPEVVFVSGEVR

SEQ ID NO: 196417 - protein, 13 aa, Mycobacterium tuberculosis
DPEVVFVSGEVRS

SEQ ID NO: 196418 - protein, 13 aa, Mycobacterium tuberculosis
PEVVFVSGEVRSR

SEQ ID NO: 196419 - protein, 13 aa, Mycobacterium tuberculosis
EVVFVSGEVRSRT

SEQ ID NO: 196420 - protein, 13 aa, Mycobacterium tuberculosis
VVFVSGEVRSRTD

SEQ ID NO: 196421 - protein, 13 aa, Mycobacterium tuberculosis
VFVSGEVRSRTDL

SEQ ID NO: 196422 - protein, 13 aa, Mycobacterium tuberculosis
FVSGEVRSRTDLL

SEQ ID NO: 196423 - protein, 13 aa, Mycobacterium tuberculosis
VSGEVRSRTDLLS

SEQ ID NO: 196424 - protein, 13 aa, Mycobacterium tuberculosis
SGEVRSRTDLLST

SEQ ID NO: 196425 - protein, 13 aa, Mycobacterium tuberculosis
GEVRSRTDLLSTL

SEQ ID NO: 196426 - protein, 13 aa, Mycobacterium tuberculosis
EVRSRTDLLSTLP

SEQ ID NO: 196427 - protein, 13 aa, Mycobacterium tuberculosis
VRSRTDLLSTLPQ

SEQ ID NO: 196428 - protein, 13 aa, Mycobacterium tuberculosis
RSRTDLLSTLPQR

SEQ ID NO: 196429 - protein, 13 aa, Mycobacterium tuberculosis
SRTDLLSTLPQRV

SEQ ID NO: 196430 - protein, 13 aa, Mycobacterium tuberculosis
RTDLLSTLPQRVA

SEQ ID NO: 196431 - protein, 13 aa, Mycobacterium tuberculosis
TDLLSTLPQRVAV

SEQ ID NO: 196432 - protein, 13 aa, Mycobacterium tuberculosis
DLLSTLPQRVAVR

SEQ ID NO: 196433 - protein, 13 aa, Mycobacterium tuberculosis
LLSTLPQRVAVRV

SEQ ID NO: 196434 - protein, 13 aa, Mycobacterium tuberculosis
LSTLPQRVAVRVS

SEQ ID NO: 196435 - protein, 13 aa, Mycobacterium tuberculosis
STLPQRVAVRVSQ

SEQ ID NO: 196436 - protein, 13 aa, Mycobacterium tuberculosis
TLPQRVAVRVSQL

SEQ ID NO: 196437 - protein, 13 aa, Mycobacterium tuberculosis
LPQRVAVRVSQLH

SEQ ID NO: 196438 - protein, 13 aa, Mycobacterium tuberculosis
PQRVAVRVSQLHA

SEQ ID NO: 196439 - protein, 13 aa, Mycobacterium tuberculosis
QRVAVRVSQLHAG

SEQ ID NO: 196440 - protein, 13 aa, Mycobacterium tuberculosis
RVAVRVSQLHAGP

SEQ ID NO: 196441 - protein, 13 aa, Mycobacterium tuberculosis
VAVRVSQLHAGPR

SEQ ID NO: 196442 - protein, 13 aa, Mycobacterium tuberculosis
AVRVSQLHAGPRK

SEQ ID NO: 196443 - protein, 13 aa, Mycobacterium tuberculosis
VRVSQLHAGPRKS

SEQ ID NO: 196444 - protein, 13 aa, Mycobacterium tuberculosis
RVSQLHAGPRKSA

SEQ ID NO: 196445 - protein, 13 aa, Mycobacterium tuberculosis
VSQLHAGPRKSAL

SEQ ID NO: 196446 - protein, 13 aa, Mycobacterium tuberculosis
SQLHAGPRKSALD

SEQ ID NO: 196447 - protein, 13 aa, Mycobacterium tuberculosis
QLHAGPRKSALDE

SEQ ID NO: 196448 - protein, 13 aa, Mycobacterium tuberculosis
LHAGPRKSALDEE

SEQ ID NO: 196449 - protein, 13 aa, Mycobacterium tuberculosis
HAGPRKSALDEEE

SEQ ID NO: 196450 - protein, 13 aa, Mycobacterium tuberculosis
AGPRKSALDEEEI

SEQ ID NO: 196451 - protein, 13 aa, Mycobacterium tuberculosis
GPRKSALDEEEIW

SEQ ID NO: 196452 - protein, 13 aa, Mycobacterium tuberculosis
PRKSALDEEEIWD

SEQ ID NO: 196453 - protein, 13 aa, Mycobacterium tuberculosis
RKSALDEEEIWDL

SEQ ID NO: 196454 - protein, 13 aa, Mycobacterium tuberculosis
KSALDEEEIWDLT

SEQ ID NO: 196455 - protein, 13 aa, Mycobacterium tuberculosis
SALDEEEIWDLTS

SEQ ID NO: 196456 - protein, 13 aa, Mycobacterium tuberculosis
ALDEEEIWDLTSA

SEQ ID NO: 196457 - protein, 13 aa, Mycobacterium tuberculosis
LDEEEIWDLTSAE

SEQ ID NO: 196458 - protein, 13 aa, Mycobacterium tuberculosis
DEEEIWDLTSAEF

SEQ ID NO: 196459 - protein, 13 aa, Mycobacterium tuberculosis
EEEIWDLTSAEFT

SEQ ID NO: 196460 - protein, 13 aa, Mycobacterium tuberculosis
EEIWDLTSAEFTR

SEQ ID NO: 196461 - protein, 13 aa, Mycobacterium tuberculosis
EIWDLTSAEFTRR

SEQ ID NO: 196462 - protein, 13 aa, Mycobacterium tuberculosis
IWDLTSAEFTRRR

SEQ ID NO: 196463 - protein, 13 aa, Mycobacterium tuberculosis
WDLTSAEFTRRRY

SEQ ID NO: 196464 - protein, 13 aa, Mycobacterium tuberculosis
DLTSAEFTRRRYA

SEQ ID NO: 196465 - protein, 13 aa, Mycobacterium tuberculosis
LTSAEFTRRRYAE

SEQ ID NO: 196466 - protein, 13 aa, Mycobacterium tuberculosis
TSAEFTRRRYAEI

SEQ ID NO: 196467 - protein, 13 aa, Mycobacterium tuberculosis
SAEFTRRRYAEIT

SEQ ID NO: 196468 - protein, 13 aa, Mycobacterium tuberculosis
AEFTRRRYAEITN

SEQ ID NO: 196469 - protein, 13 aa, Mycobacterium tuberculosis
EFTRRRYAEITNV

SEQ ID NO: 196470 - protein, 13 aa, Mycobacterium tuberculosis
FTRRRYAEITNVA

SEQ ID NO: 196471 - protein, 13 aa, Mycobacterium tuberculosis
TRRRYAEITNVAQ

SEQ ID NO: 196472 - protein, 13 aa, Mycobacterium tuberculosis
RRRYAEITNVAQQ

SEQ ID NO: 196473 - protein, 13 aa, Mycobacterium tuberculosis
RRYAEITNVAQQF

SEQ ID NO: 196474 - protein, 13 aa, Mycobacterium tuberculosis
RYAEITNVAQQFE

SEQ ID NO: 196475 - protein, 13 aa, Mycobacterium tuberculosis
YAEITNVAQQFEA

SEQ ID NO: 196476 - protein, 13 aa, Mycobacterium tuberculosis
AEITNVAQQFEAE

SEQ ID NO: 196477 - protein, 13 aa, Mycobacterium tuberculosis
EITNVAQQFEAEI

SEQ ID NO: 196478 - protein, 13 aa, Mycobacterium tuberculosis
ITNVAQQFEAEIG

SEQ ID NO: 196479 - protein, 13 aa, Mycobacterium tuberculosis
TNVAQQFEAEIGR

SEQ ID NO: 196480 - protein, 13 aa, Mycobacterium tuberculosis
NVAQQFEAEIGRG

SEQ ID NO: 196481 - protein, 13 aa, Mycobacterium tuberculosis
VAQQFEAEIGRGS

SEQ ID NO: 196482 - protein, 13 aa, Mycobacterium tuberculosis
AQQFEAEIGRGSG

SEQ ID NO: 196483 - protein, 13 aa, Mycobacterium tuberculosis
QQFEAEIGRGSGL

SEQ ID NO: 196484 - protein, 13 aa, Mycobacterium tuberculosis
QFEAEIGRGSGLA

SEQ ID NO: 196485 - protein, 13 aa, Mycobacterium tuberculosis
FEAEIGRGSGLAA

SEQ ID NO: 196486 - protein, 13 aa, Mycobacterium tuberculosis
EAEIGRGSGLAAQ

SEQ ID NO: 196487 - protein, 13 aa, Mycobacterium tuberculosis
AEIGRGSGLAAQG

SEQ ID NO: 196488 - protein, 13 aa, Mycobacterium tuberculosis
EIGRGSGLAAQGL

SEQ ID NO: 196489 - protein, 13 aa, Mycobacterium tuberculosis
IGRGSGLAAQGLA

SEQ ID NO: 196490 - protein, 13 aa, Mycobacterium tuberculosis
GRGSGLAAQGLAE

SEQ ID NO: 196491 - protein, 13 aa, Mycobacterium tuberculosis
RGSGLAAQGLAEV

SEQ ID NO: 196492 - protein, 13 aa, Mycobacterium tuberculosis
GSGLAAQGLAEVC

SEQ ID NO: 196493 - protein, 13 aa, Mycobacterium tuberculosis
SGLAAQGLAEVCA

SEQ ID NO: 196494 - protein, 13 aa, Mycobacterium tuberculosis
GLAAQGLAEVCAA

SEQ ID NO: 196495 - protein, 13 aa, Mycobacterium tuberculosis
LAAQGLAEVCAAL

SEQ ID NO: 196496 - protein, 13 aa, Mycobacterium tuberculosis
AAQGLAEVCAALR

SEQ ID NO: 196497 - protein, 13 aa, Mycobacterium tuberculosis
AQGLAEVCAALRD

SEQ ID NO: 196498 - protein, 13 aa, Mycobacterium tuberculosis
QGLAEVCAALRDG

SEQ ID NO: 196499 - protein, 13 aa, Mycobacterium tuberculosis
GLAEVCAALRDGD

SEQ ID NO: 196500 - protein, 13 aa, Mycobacterium tuberculosis
LAEVCAALRDGDV

SEQ ID NO: 196501 - protein, 13 aa, Mycobacterium tuberculosis
AEVCAALRDGDVD

SEQ ID NO: 196502 - protein, 13 aa, Mycobacterium tuberculosis
EVCAALRDGDVDT

SEQ ID NO: 196503 - protein, 13 aa, Mycobacterium tuberculosis
VCAALRDGDVDTL

SEQ ID NO: 196504 - protein, 13 aa, Mycobacterium tuberculosis
CAALRDGDVDTLI

SEQ ID NO: 196505 - protein, 13 aa, Mycobacterium tuberculosis
AALRDGDVDTLIV

SEQ ID NO: 196506 - protein, 13 aa, Mycobacterium tuberculosis
ALRDGDVDTLIVG

SEQ ID NO: 196507 - protein, 13 aa, Mycobacterium tuberculosis
LRDGDVDTLIVGE

SEQ ID NO: 196508 - protein, 13 aa, Mycobacterium tuberculosis
RDGDVDTLIVGEL

SEQ ID NO: 196509 - protein, 13 aa, Mycobacterium tuberculosis
DGDVDTLIVGELG

SEQ ID NO: 196510 - protein, 13 aa, Mycobacterium tuberculosis
GDVDTLIVGELGE

SEQ ID NO: 196511 - protein, 13 aa, Mycobacterium tuberculosis
DVDTLIVGELGEA

SEQ ID NO: 196512 - protein, 13 aa, Mycobacterium tuberculosis
VDTLIVGELGEAT

SEQ ID NO: 196513 - protein, 13 aa, Mycobacterium tuberculosis
DTLIVGELGEATV

SEQ ID NO: 196514 - protein, 13 aa, Mycobacterium tuberculosis
TLIVGELGEATVV

SEQ ID NO: 196515 - protein, 13 aa, Mycobacterium tuberculosis
LIVGELGEATVVT

SEQ ID NO: 196516 - protein, 13 aa, Mycobacterium tuberculosis
IVGELGEATVVTG

SEQ ID NO: 196517 - protein, 13 aa, Mycobacterium tuberculosis
VGELGEATVVTGK

SEQ ID NO: 196518 - protein, 13 aa, Mycobacterium tuberculosis
GELGEATVVTGKA

SEQ ID NO: 196519 - protein, 13 aa, Mycobacterium tuberculosis
ELGEATVVTGKAR

SEQ ID NO: 196520 - protein, 13 aa, Mycobacterium tuberculosis
LGEATVVTGKART

SEQ ID NO: 196521 - protein, 13 aa, Mycobacterium tuberculosis
GEATVVTGKARTT

SEQ ID NO: 196522 - protein, 13 aa, Mycobacterium tuberculosis
EATVVTGKARTTV

SEQ ID NO: 196523 - protein, 13 aa, Mycobacterium tuberculosis
ATVVTGKARTTVA

SEQ ID NO: 196524 - protein, 13 aa, Mycobacterium tuberculosis
TVVTGKARTTVAR

SEQ ID NO: 196525 - protein, 13 aa, Mycobacterium tuberculosis
VVTGKARTTVARD

SEQ ID NO: 196526 - protein, 13 aa, Mycobacterium tuberculosis
VTGKARTTVARDA

SEQ ID NO: 196527 - protein, 13 aa, Mycobacterium tuberculosis
TGKARTTVARDAD

SEQ ID NO: 196528 - protein, 13 aa, Mycobacterium tuberculosis
GKARTTVARDADM

SEQ ID NO: 196529 - protein, 13 aa, Mycobacterium tuberculosis
KARTTVARDADML

SEQ ID NO: 196530 - protein, 13 aa, Mycobacterium tuberculosis
ARTTVARDADMLS

SEQ ID NO: 196531 - protein, 13 aa, Mycobacterium tuberculosis
RTTVARDADMLSE

SEQ ID NO: 196532 - protein, 13 aa, Mycobacterium tuberculosis
TTVARDADMLSEL

SEQ ID NO: 196533 - protein, 13 aa, Mycobacterium tuberculosis
TVARDADMLSELG

SEQ ID NO: 196534 - protein, 13 aa, Mycobacterium tuberculosis
VARDADMLSELGE

SEQ ID NO: 196535 - protein, 13 aa, Mycobacterium tuberculosis
ARDADMLSELGEP

SEQ ID NO: 196536 - protein, 13 aa, Mycobacterium tuberculosis
RDADMLSELGEPV

SEQ ID NO: 196537 - protein, 13 aa, Mycobacterium tuberculosis
DADMLSELGEPVD

SEQ ID NO: 196538 - protein, 13 aa, Mycobacterium tuberculosis
ADMLSELGEPVDR

SEQ ID NO: 196539 - protein, 13 aa, Mycobacterium tuberculosis
DMLSELGEPVDRV

SEQ ID NO: 196540 - protein, 13 aa, Mycobacterium tuberculosis
MLSELGEPVDRVA

SEQ ID NO: 196541 - protein, 13 aa, Mycobacterium tuberculosis
LSELGEPVDRVAR

SEQ ID NO: 196542 - protein, 13 aa, Mycobacterium tuberculosis
SELGEPVDRVARA

SEQ ID NO: 196543 - protein, 13 aa, Mycobacterium tuberculosis
ELGEPVDRVARAD

SEQ ID NO: 196544 - protein, 13 aa, Mycobacterium tuberculosis
LGEPVDRVARADE

SEQ ID NO: 196545 - protein, 13 aa, Mycobacterium tuberculosis
GEPVDRVARADEA

SEQ ID NO: 196546 - protein, 13 aa, Mycobacterium tuberculosis
EPVDRVARADEAL

SEQ ID NO: 196547 - protein, 13 aa, Mycobacterium tuberculosis
PVDRVARADEALP

SEQ ID NO: 196548 - protein, 13 aa, Mycobacterium tuberculosis
VDRVARADEALPF

SEQ ID NO: 196549 - protein, 13 aa, Mycobacterium tuberculosis
DRVARADEALPFA

SEQ ID NO: 196550 - protein, 13 aa, Mycobacterium tuberculosis
RVARADEALPFAA

SEQ ID NO: 196551 - protein, 13 aa, Mycobacterium tuberculosis
VARADEALPFAAI

SEQ ID NO: 196552 - protein, 13 aa, Mycobacterium tuberculosis
ARADEALPFAAIA

SEQ ID NO: 196553 - protein, 13 aa, Mycobacterium tuberculosis
RADEALPFAAIAV

SEQ ID NO: 196554 - protein, 13 aa, Mycobacterium tuberculosis
ADEALPFAAIAVG

SEQ ID NO: 196555 - protein, 13 aa, Mycobacterium tuberculosis
DEALPFAAIAVGA

SEQ ID NO: 196556 - protein, 13 aa, Mycobacterium tuberculosis
EALPFAAIAVGAA

SEQ ID NO: 196557 - protein, 13 aa, Mycobacterium tuberculosis
ALPFAAIAVGAAL

SEQ ID NO: 196558 - protein, 13 aa, Mycobacterium tuberculosis
LPFAAIAVGAALV

SEQ ID NO: 196559 - protein, 13 aa, Mycobacterium tuberculosis
PFAAIAVGAALVR

SEQ ID NO: 196560 - protein, 13 aa, Mycobacterium tuberculosis
FAAIAVGAALVRD

SEQ ID NO: 196561 - protein, 13 aa, Mycobacterium tuberculosis
AAIAVGAALVRDD

SEQ ID NO: 196562 - protein, 13 aa, Mycobacterium tuberculosis
AIAVGAALVRDDN

SEQ ID NO: 196563 - protein, 13 aa, Mycobacterium tuberculosis
IAVGAALVRDDNR

SEQ ID NO: 196564 - protein, 13 aa, Mycobacterium tuberculosis
AVGAALVRDDNRI

SEQ ID NO: 196565 - protein, 13 aa, Mycobacterium tuberculosis
VGAALVRDDNRIA

SEQ ID NO: 196566 - protein, 13 aa, Mycobacterium tuberculosis
GAALVRDDNRIAP

SEQ ID NO: 196567 - protein, 13 aa, Mycobacterium tuberculosis
AALVRDDNRIAPL

SEQ ID NO: 196568 - protein, 13 aa, Mycobacterium tuberculosis
ALVRDDNRIAPLD

SEQ ID NO: 196569 - protein, 13 aa, Mycobacterium tuberculosis
LVRDDNRIAPLDG

SEQ ID NO: 196570 - protein, 13 aa, Mycobacterium tuberculosis
VRDDNRIAPLDGV

SEQ ID NO: 196571 - protein, 13 aa, Mycobacterium tuberculosis
RDDNRIAPLDGVG

SEQ ID NO: 196572 - protein, 13 aa, Mycobacterium tuberculosis
DDNRIAPLDGVGA

SEQ ID NO: 196573 - protein, 13 aa, Mycobacterium tuberculosis
DNRIAPLDGVGAL

SEQ ID NO: 196574 - protein, 13 aa, Mycobacterium tuberculosis
NRIAPLDGVGALL

SEQ ID NO: 196575 - protein, 13 aa, Mycobacterium tuberculosis
RIAPLDGVGALLR

SEQ ID NO: 196576 - protein, 13 aa, Mycobacterium tuberculosis
IAPLDGVGALLRY

SEQ ID NO: 196577 - protein, 13 aa, Mycobacterium tuberculosis
APLDGVGALLRYA

SEQ ID NO: 196578 - protein, 13 aa, Mycobacterium tuberculosis
PLDGVGALLRYAA

SEQ ID NO: 196579 - protein, 13 aa, Mycobacterium tuberculosis
LDGVGALLRYAAT

SEQ ID NO: 196580 - protein, 13 aa, Mycobacterium tuberculosis
DGVGALLRYAATN

SEQ ID NO: 196581 - protein, 13 aa, Mycobacterium tuberculosis
GVGALLRYAATNR

SEQ ID NO: 196582 - protein, 13 aa, Mycobacterium tuberculosis
VGALLRYAATNRL

SEQ ID NO: 196583 - protein, 13 aa, Mycobacterium tuberculosis
GALLRYAATNRLG

SEQ ID NO: 196584 - protein, 13 aa, Mycobacterium tuberculosis
ALLRYAATNRLGS

SEQ ID NO: 196585 - protein, 13 aa, Mycobacterium tuberculosis
LLRYAATNRLGSH

SEQ ID NO: 196586 - protein, 13 aa, Mycobacterium tuberculosis
LRYAATNRLGSHR

SEQ ID NO: 196587 - protein, 13 aa, Mycobacterium tuberculosis
RYAATNRLGSHRS

SEQ ID NO: 196588 - protein, 14 aa, Mycobacterium tuberculosis
MRSERLRWLVAAEG

SEQ ID NO: 196589 - protein, 14 aa, Mycobacterium tuberculosis
RSERLRWLVAAEGP

SEQ ID NO: 196590 - protein, 14 aa, Mycobacterium tuberculosis
SERLRWLVAAEGPF

SEQ ID NO: 196591 - protein, 14 aa, Mycobacterium tuberculosis
ERLRWLVAAEGPFA

SEQ ID NO: 196592 - protein, 14 aa, Mycobacterium tuberculosis
RLRWLVAAEGPFAS

SEQ ID NO: 196593 - protein, 14 aa, Mycobacterium tuberculosis
LRWLVAAEGPFASV

SEQ ID NO: 196594 - protein, 14 aa, Mycobacterium tuberculosis
RWLVAAEGPFASVY

SEQ ID NO: 196595 - protein, 14 aa, Mycobacterium tuberculosis
WLVAAEGPFASVYF

SEQ ID NO: 196596 - protein, 14 aa, Mycobacterium tuberculosis
LVAAEGPFASVYFD

SEQ ID NO: 196597 - protein, 14 aa, Mycobacterium tuberculosis
VAAEGPFASVYFDD

SEQ ID NO: 196598 - protein, 14 aa, Mycobacterium tuberculosis
AAEGPFASVYFDDS

SEQ ID NO: 196599 - protein, 14 aa, Mycobacterium tuberculosis
AEGPFASVYFDDSH

SEQ ID NO: 196600 - protein, 14 aa, Mycobacterium tuberculosis
EGPFASVYFDDSHD

SEQ ID NO: 196601 - protein, 14 aa, Mycobacterium tuberculosis
GPFASVYFDDSHDT

SEQ ID NO: 196602 - protein, 14 aa, Mycobacterium tuberculosis
PFASVYFDDSHDTL

SEQ ID NO: 196603 - protein, 14 aa, Mycobacterium tuberculosis
FASVYFDDSHDTLD

SEQ ID NO: 196604 - protein, 14 aa, Mycobacterium tuberculosis
ASVYFDDSHDTLDA

SEQ ID NO: 196605 - protein, 14 aa, Mycobacterium tuberculosis
SVYFDDSHDTLDAV

SEQ ID NO: 196606 - protein, 14 aa, Mycobacterium tuberculosis
VYFDDSHDTLDAVE

SEQ ID NO: 196607 - protein, 14 aa, Mycobacterium tuberculosis
YFDDSHDTLDAVER

SEQ ID NO: 196608 - protein, 14 aa, Mycobacterium tuberculosis
FDDSHDTLDAVERR

SEQ ID NO: 196609 - protein, 14 aa, Mycobacterium tuberculosis
DDSHDTLDAVERRE

SEQ ID NO: 196610 - protein, 14 aa, Mycobacterium tuberculosis
DSHDTLDAVERREA

SEQ ID NO: 196611 - protein, 14 aa, Mycobacterium tuberculosis
SHDTLDAVERREAT

SEQ ID NO: 196612 - protein, 14 aa, Mycobacterium tuberculosis
HDTLDAVERREATW

SEQ ID NO: 196613 - protein, 14 aa, Mycobacterium tuberculosis
DTLDAVERREATWR

SEQ ID NO: 196614 - protein, 14 aa, Mycobacterium tuberculosis
TLDAVERREATWRD

SEQ ID NO: 196615 - protein, 14 aa, Mycobacterium tuberculosis
LDAVERREATWRDV

SEQ ID NO: 196616 - protein, 14 aa, Mycobacterium tuberculosis
DAVERREATWRDVR

SEQ ID NO: 196617 - protein, 14 aa, Mycobacterium tuberculosis
AVERREATWRDVRK

SEQ ID NO: 196618 - protein, 14 aa, Mycobacterium tuberculosis
VERREATWRDVRKH

SEQ ID NO: 196619 - protein, 14 aa, Mycobacterium tuberculosis
ERREATWRDVRKHL

SEQ ID NO: 196620 - protein, 14 aa, Mycobacterium tuberculosis
RREATWRDVRKHLE

SEQ ID NO: 196621 - protein, 14 aa, Mycobacterium tuberculosis
REATWRDVRKHLES

SEQ ID NO: 196622 - protein, 14 aa, Mycobacterium tuberculosis
EATWRDVRKHLESR

SEQ ID NO: 196623 - protein, 14 aa, Mycobacterium tuberculosis
ATWRDVRKHLESRD

SEQ ID NO: 196624 - protein, 14 aa, Mycobacterium tuberculosis
TWRDVRKHLESRDA

SEQ ID NO: 196625 - protein, 14 aa, Mycobacterium tuberculosis
WRDVRKHLESRDAK

SEQ ID NO: 196626 - protein, 14 aa, Mycobacterium tuberculosis
RDVRKHLESRDAKQ

SEQ ID NO: 196627 - protein, 14 aa, Mycobacterium tuberculosis
DVRKHLESRDAKQE

SEQ ID NO: 196628 - protein, 14 aa, Mycobacterium tuberculosis
VRKHLESRDAKQEL

SEQ ID NO: 196629 - protein, 14 aa, Mycobacterium tuberculosis
RKHLESRDAKQELI

SEQ ID NO: 196630 - protein, 14 aa, Mycobacterium tuberculosis
KHLESRDAKQELID

SEQ ID NO: 196631 - protein, 14 aa, Mycobacterium tuberculosis
HLESRDAKQELIDS

SEQ ID NO: 196632 - protein, 14 aa, Mycobacterium tuberculosis
LESRDAKQELIDSL

SEQ ID NO: 196633 - protein, 14 aa, Mycobacterium tuberculosis
ESRDAKQELIDSLE

SEQ ID NO: 196634 - protein, 14 aa, Mycobacterium tuberculosis
SRDAKQELIDSLEE

SEQ ID NO: 196635 - protein, 14 aa, Mycobacterium tuberculosis
RDAKQELIDSLEEA

SEQ ID NO: 196636 - protein, 14 aa, Mycobacterium tuberculosis
DAKQELIDSLEEAV

SEQ ID NO: 196637 - protein, 14 aa, Mycobacterium tuberculosis
AKQELIDSLEEAVR

SEQ ID NO: 196638 - protein, 14 aa, Mycobacterium tuberculosis
KQELIDSLEEAVRD

SEQ ID NO: 196639 - protein, 14 aa, Mycobacterium tuberculosis
QELIDSLEEAVRDS

SEQ ID NO: 196640 - protein, 14 aa, Mycobacterium tuberculosis
ELIDSLEEAVRDSR

SEQ ID NO: 196641 - protein, 14 aa, Mycobacterium tuberculosis
LIDSLEEAVRDSRP

SEQ ID NO: 196642 - protein, 14 aa, Mycobacterium tuberculosis
IDSLEEAVRDSRPA

SEQ ID NO: 196643 - protein, 14 aa, Mycobacterium tuberculosis
DSLEEAVRDSRPAV

SEQ ID NO: 196644 - protein, 14 aa, Mycobacterium tuberculosis
SLEEAVRDSRPAVG

SEQ ID NO: 196645 - protein, 14 aa, Mycobacterium tuberculosis
LEEAVRDSRPAVGQ

SEQ ID NO: 196646 - protein, 14 aa, Mycobacterium tuberculosis
EEAVRDSRPAVGQR

SEQ ID NO: 196647 - protein, 14 aa, Mycobacterium tuberculosis
EAVRDSRPAVGQRG

SEQ ID NO: 196648 - protein, 14 aa, Mycobacterium tuberculosis
AVRDSRPAVGQRGR

SEQ ID NO: 196649 - protein, 14 aa, Mycobacterium tuberculosis
VRDSRPAVGQRGRA

SEQ ID NO: 196650 - protein, 14 aa, Mycobacterium tuberculosis
RDSRPAVGQRGRAL

SEQ ID NO: 196651 - protein, 14 aa, Mycobacterium tuberculosis
DSRPAVGQRGRALI

SEQ ID NO: 196652 - protein, 14 aa, Mycobacterium tuberculosis
SRPAVGQRGRALIA

SEQ ID NO: 196653 - protein, 14 aa, Mycobacterium tuberculosis
RPAVGQRGRALIAT

SEQ ID NO: 196654 - protein, 14 aa, Mycobacterium tuberculosis
PAVGQRGRALIATG

SEQ ID NO: 196655 - protein, 14 aa, Mycobacterium tuberculosis
AVGQRGRALIATGE

SEQ ID NO: 196656 - protein, 14 aa, Mycobacterium tuberculosis
VGQRGRALIATGEQ

SEQ ID NO: 196657 - protein, 14 aa, Mycobacterium tuberculosis
GQRGRALIATGEQV

SEQ ID NO: 196658 - protein, 14 aa, Mycobacterium tuberculosis
QRGRALIATGEQVL

SEQ ID NO: 196659 - protein, 14 aa, Mycobacterium tuberculosis
RGRALIATGEQVLV

SEQ ID NO: 196660 - protein, 14 aa, Mycobacterium tuberculosis
GRALIATGEQVLVN

SEQ ID NO: 196661 - protein, 14 aa, Mycobacterium tuberculosis
RALIATGEQVLVNE

SEQ ID NO: 196662 - protein, 14 aa, Mycobacterium tuberculosis
ALIATGEQVLVNEH

SEQ ID NO: 196663 - protein, 14 aa, Mycobacterium tuberculosis
LIATGEQVLVNEHL

SEQ ID NO: 196664 - protein, 14 aa, Mycobacterium tuberculosis
IATGEQVLVNEHLI

SEQ ID NO: 196665 - protein, 14 aa, Mycobacterium tuberculosis
ATGEQVLVNEHLIG

SEQ ID NO: 196666 - protein, 14 aa, Mycobacterium tuberculosis
TGEQVLVNEHLIGP

SEQ ID NO: 196667 - protein, 14 aa, Mycobacterium tuberculosis
GEQVLVNEHLIGPP

SEQ ID NO: 196668 - protein, 14 aa, Mycobacterium tuberculosis
EQVLVNEHLIGPPP

SEQ ID NO: 196669 - protein, 14 aa, Mycobacterium tuberculosis
QVLVNEHLIGPPPA

SEQ ID NO: 196670 - protein, 14 aa, Mycobacterium tuberculosis
VLVNEHLIGPPPAT

SEQ ID NO: 196671 - protein, 14 aa, Mycobacterium tuberculosis
LVNEHLIGPPPATV

SEQ ID NO: 196672 - protein, 14 aa, Mycobacterium tuberculosis
VNEHLIGPPPATVI

SEQ ID NO: 196673 - protein, 14 aa, Mycobacterium tuberculosis
NEHLIGPPPATVIR

SEQ ID NO: 196674 - protein, 14 aa, Mycobacterium tuberculosis
EHLIGPPPATVIRL

SEQ ID NO: 196675 - protein, 14 aa, Mycobacterium tuberculosis
HLIGPPPATVIRLS

SEQ ID NO: 196676 - protein, 14 aa, Mycobacterium tuberculosis
LIGPPPATVIRLSD

SEQ ID NO: 196677 - protein, 14 aa, Mycobacterium tuberculosis
IGPPPATVIRLSDY

SEQ ID NO: 196678 - protein, 14 aa, Mycobacterium tuberculosis
GPPPATVIRLSDYP

SEQ ID NO: 196679 - protein, 14 aa, Mycobacterium tuberculosis
PPPATVIRLSDYPY

SEQ ID NO: 196680 - protein, 14 aa, Mycobacterium tuberculosis
PPATVIRLSDYPYV

SEQ ID NO: 196681 - protein, 14 aa, Mycobacterium tuberculosis
PATVIRLSDYPYVV

SEQ ID NO: 196682 - protein, 14 aa, Mycobacterium tuberculosis
ATVIRLSDYPYVVP

SEQ ID NO: 196683 - protein, 14 aa, Mycobacterium tuberculosis
TVIRLSDYPYVVPL

SEQ ID NO: 196684 - protein, 14 aa, Mycobacterium tuberculosis
VIRLSDYPYVVPLI

SEQ ID NO: 196685 - protein, 14 aa, Mycobacterium tuberculosis
IRLSDYPYVVPLID

SEQ ID NO: 196686 - protein, 14 aa, Mycobacterium tuberculosis
RLSDYPYVVPLIDL

SEQ ID NO: 196687 - protein, 14 aa, Mycobacterium tuberculosis
LSDYPYVVPLIDLE

SEQ ID NO: 196688 - protein, 14 aa, Mycobacterium tuberculosis
SDYPYVVPLIDLEM

SEQ ID NO: 196689 - protein, 14 aa, Mycobacterium tuberculosis
DYPYVVPLIDLEMR

SEQ ID NO: 196690 - protein, 14 aa, Mycobacterium tuberculosis
YPYVVPLIDLEMRR

SEQ ID NO: 196691 - protein, 14 aa, Mycobacterium tuberculosis
PYVVPLIDLEMRRP

SEQ ID NO: 196692 - protein, 14 aa, Mycobacterium tuberculosis
YVVPLIDLEMRRPT

SEQ ID NO: 196693 - protein, 14 aa, Mycobacterium tuberculosis
VVPLIDLEMRRPTY

SEQ ID NO: 196694 - protein, 14 aa, Mycobacterium tuberculosis
VPLIDLEMRRPTYV

SEQ ID NO: 196695 - protein, 14 aa, Mycobacterium tuberculosis
PLIDLEMRRPTYVF

SEQ ID NO: 196696 - protein, 14 aa, Mycobacterium tuberculosis
LIDLEMRRPTYVFA

SEQ ID NO: 196697 - protein, 14 aa, Mycobacterium tuberculosis
IDLEMRRPTYVFAA

SEQ ID NO: 196698 - protein, 14 aa, Mycobacterium tuberculosis
DLEMRRPTYVFAAV

SEQ ID NO: 196699 - protein, 14 aa, Mycobacterium tuberculosis
LEMRRPTYVFAAVD

SEQ ID NO: 196700 - protein, 14 aa, Mycobacterium tuberculosis
EMRRPTYVFAAVDH

SEQ ID NO: 196701 - protein, 14 aa, Mycobacterium tuberculosis
MRRPTYVFAAVDHT

SEQ ID NO: 196702 - protein, 14 aa, Mycobacterium tuberculosis
RRPTYVFAAVDHTG

SEQ ID NO: 196703 - protein, 14 aa, Mycobacterium tuberculosis
RPTYVFAAVDHTGA

SEQ ID NO: 196704 - protein, 14 aa, Mycobacterium tuberculosis
PTYVFAAVDHTGAD

SEQ ID NO: 196705 - protein, 14 aa, Mycobacterium tuberculosis
TYVFAAVDHTGADV

SEQ ID NO: 196706 - protein, 14 aa, Mycobacterium tuberculosis
YVFAAVDHTGADVK

SEQ ID NO: 196707 - protein, 14 aa, Mycobacterium tuberculosis
VFAAVDHTGADVKL

SEQ ID NO: 196708 - protein, 14 aa, Mycobacterium tuberculosis
FAAVDHTGADVKLY

SEQ ID NO: 196709 - protein, 14 aa, Mycobacterium tuberculosis
AAVDHTGADVKLYQ

SEQ ID NO: 196710 - protein, 14 aa, Mycobacterium tuberculosis
AVDHTGADVKLYQG

SEQ ID NO: 196711 - protein, 14 aa, Mycobacterium tuberculosis
VDHTGADVKLYQGA

SEQ ID NO: 196712 - protein, 14 aa, Mycobacterium tuberculosis
DHTGADVKLYQGAT

SEQ ID NO: 196713 - protein, 14 aa, Mycobacterium tuberculosis
HTGADVKLYQGATI

SEQ ID NO: 196714 - protein, 14 aa, Mycobacterium tuberculosis
TGADVKLYQGATIS

SEQ ID NO: 196715 - protein, 14 aa, Mycobacterium tuberculosis
GADVKLYQGATISS

SEQ ID NO: 196716 - protein, 14 aa, Mycobacterium tuberculosis
ADVKLYQGATISST

SEQ ID NO: 196717 - protein, 14 aa, Mycobacterium tuberculosis
DVKLYQGATISSTK

SEQ ID NO: 196718 - protein, 14 aa, Mycobacterium tuberculosis
VKLYQGATISSTKI

SEQ ID NO: 196719 - protein, 14 aa, Mycobacterium tuberculosis
KLYQGATISSTKID

SEQ ID NO: 196720 - protein, 14 aa, Mycobacterium tuberculosis
LYQGATISSTKIDG

SEQ ID NO: 196721 - protein, 14 aa, Mycobacterium tuberculosis
YQGATISSTKIDGV

SEQ ID NO: 196722 - protein, 14 aa, Mycobacterium tuberculosis
QGATISSTKIDGVG

SEQ ID NO: 196723 - protein, 14 aa, Mycobacterium tuberculosis
GATISSTKIDGVGY

SEQ ID NO: 196724 - protein, 14 aa, Mycobacterium tuberculosis
ATISSTKIDGVGYP

SEQ ID NO: 196725 - protein, 14 aa, Mycobacterium tuberculosis
TISSTKIDGVGYPV

SEQ ID NO: 196726 - protein, 14 aa, Mycobacterium tuberculosis
ISSTKIDGVGYPVH

SEQ ID NO: 196727 - protein, 14 aa, Mycobacterium tuberculosis
SSTKIDGVGYPVHK

SEQ ID NO: 196728 - protein, 14 aa, Mycobacterium tuberculosis
STKIDGVGYPVHKP

SEQ ID NO: 196729 - protein, 14 aa, Mycobacterium tuberculosis
TKIDGVGYPVHKPV

SEQ ID NO: 196730 - protein, 14 aa, Mycobacterium tuberculosis
KIDGVGYPVHKPVT

SEQ ID NO: 196731 - protein, 14 aa, Mycobacterium tuberculosis
IDGVGYPVHKPVTA

SEQ ID NO: 196732 - protein, 14 aa, Mycobacterium tuberculosis
DGVGYPVHKPVTAG

SEQ ID NO: 196733 - protein, 14 aa, Mycobacterium tuberculosis
GVGYPVHKPVTAGW

SEQ ID NO: 196734 - protein, 14 aa, Mycobacterium tuberculosis
VGYPVHKPVTAGWN

SEQ ID NO: 196735 - protein, 14 aa, Mycobacterium tuberculosis
GYPVHKPVTAGWNG

SEQ ID NO: 196736 - protein, 14 aa, Mycobacterium tuberculosis
YPVHKPVTAGWNGY

SEQ ID NO: 196737 - protein, 14 aa, Mycobacterium tuberculosis
PVHKPVTAGWNGYG

SEQ ID NO: 196738 - protein, 14 aa, Mycobacterium tuberculosis
VHKPVTAGWNGYGD

SEQ ID NO: 196739 - protein, 14 aa, Mycobacterium tuberculosis
HKPVTAGWNGYGDF

SEQ ID NO: 196740 - protein, 14 aa, Mycobacterium tuberculosis
KPVTAGWNGYGDFQ

SEQ ID NO: 196741 - protein, 14 aa, Mycobacterium tuberculosis
PVTAGWNGYGDFQH

SEQ ID NO: 196742 - protein, 14 aa, Mycobacterium tuberculosis
VTAGWNGYGDFQHT

SEQ ID NO: 196743 - protein, 14 aa, Mycobacterium tuberculosis
TAGWNGYGDFQHTT

SEQ ID NO: 196744 - protein, 14 aa, Mycobacterium tuberculosis
AGWNGYGDFQHTTE

SEQ ID NO: 196745 - protein, 14 aa, Mycobacterium tuberculosis
GWNGYGDFQHTTEE

SEQ ID NO: 196746 - protein, 14 aa, Mycobacterium tuberculosis
WNGYGDFQHTTEEA

SEQ ID NO: 196747 - protein, 14 aa, Mycobacterium tuberculosis
NGYGDFQHTTEEAI

SEQ ID NO: 196748 - protein, 14 aa, Mycobacterium tuberculosis
GYGDFQHTTEEAIR

SEQ ID NO: 196749 - protein, 14 aa, Mycobacterium tuberculosis
YGDFQHTTEEAIRM

SEQ ID NO: 196750 - protein, 14 aa, Mycobacterium tuberculosis
GDFQHTTEEAIRMN

SEQ ID NO: 196751 - protein, 14 aa, Mycobacterium tuberculosis
DFQHTTEEAIRMNC

SEQ ID NO: 196752 - protein, 14 aa, Mycobacterium tuberculosis
FQHTTEEAIRMNCR

SEQ ID NO: 196753 - protein, 14 aa, Mycobacterium tuberculosis
QHTTEEAIRMNCRA

SEQ ID NO: 196754 - protein, 14 aa, Mycobacterium tuberculosis
HTTEEAIRMNCRAV

SEQ ID NO: 196755 - protein, 14 aa, Mycobacterium tuberculosis
TTEEAIRMNCRAVA

SEQ ID NO: 196756 - protein, 14 aa, Mycobacterium tuberculosis
TEEAIRMNCRAVAD

SEQ ID NO: 196757 - protein, 14 aa, Mycobacterium tuberculosis
EEAIRMNCRAVADH

SEQ ID NO: 196758 - protein, 14 aa, Mycobacterium tuberculosis
EAIRMNCRAVADHL

SEQ ID NO: 196759 - protein, 14 aa, Mycobacterium tuberculosis
AIRMNCRAVADHLT

SEQ ID NO: 196760 - protein, 14 aa, Mycobacterium tuberculosis
IRMNCRAVADHLTR

SEQ ID NO: 196761 - protein, 14 aa, Mycobacterium tuberculosis
RMNCRAVADHLTRL

SEQ ID NO: 196762 - protein, 14 aa, Mycobacterium tuberculosis
MNCRAVADHLTRLV

SEQ ID NO: 196763 - protein, 14 aa, Mycobacterium tuberculosis
NCRAVADHLTRLVD

SEQ ID NO: 196764 - protein, 14 aa, Mycobacterium tuberculosis
CRAVADHLTRLVDA

SEQ ID NO: 196765 - protein, 14 aa, Mycobacterium tuberculosis
RAVADHLTRLVDAA

SEQ ID NO: 196766 - protein, 14 aa, Mycobacterium tuberculosis
AVADHLTRLVDAAD

SEQ ID NO: 196767 - protein, 14 aa, Mycobacterium tuberculosis
VADHLTRLVDAADP

SEQ ID NO: 196768 - protein, 14 aa, Mycobacterium tuberculosis
ADHLTRLVDAADPE

SEQ ID NO: 196769 - protein, 14 aa, Mycobacterium tuberculosis
DHLTRLVDAADPEV

SEQ ID NO: 196770 - protein, 14 aa, Mycobacterium tuberculosis
HLTRLVDAADPEVV

SEQ ID NO: 196771 - protein, 14 aa, Mycobacterium tuberculosis
LTRLVDAADPEVVF

SEQ ID NO: 196772 - protein, 14 aa, Mycobacterium tuberculosis
TRLVDAADPEVVFV

SEQ ID NO: 196773 - protein, 14 aa, Mycobacterium tuberculosis
RLVDAADPEVVFVS

SEQ ID NO: 196774 - protein, 14 aa, Mycobacterium tuberculosis
LVDAADPEVVFVSG

SEQ ID NO: 196775 - protein, 14 aa, Mycobacterium tuberculosis
VDAADPEVVFVSGE

SEQ ID NO: 196776 - protein, 14 aa, Mycobacterium tuberculosis
DAADPEVVFVSGEV

SEQ ID NO: 196777 - protein, 14 aa, Mycobacterium tuberculosis
AADPEVVFVSGEVR

SEQ ID NO: 196778 - protein, 14 aa, Mycobacterium tuberculosis
ADPEVVFVSGEVRS

SEQ ID NO: 196779 - protein, 14 aa, Mycobacterium tuberculosis
DPEVVFVSGEVRSR

SEQ ID NO: 196780 - protein, 14 aa, Mycobacterium tuberculosis
PEVVFVSGEVRSRT

SEQ ID NO: 196781 - protein, 14 aa, Mycobacterium tuberculosis
EVVFVSGEVRSRTD

SEQ ID NO: 196782 - protein, 14 aa, Mycobacterium tuberculosis
VVFVSGEVRSRTDL

SEQ ID NO: 196783 - protein, 14 aa, Mycobacterium tuberculosis
VFVSGEVRSRTDLL

SEQ ID NO: 196784 - protein, 14 aa, Mycobacterium tuberculosis
FVSGEVRSRTDLLS

SEQ ID NO: 196785 - protein, 14 aa, Mycobacterium tuberculosis
VSGEVRSRTDLLST

SEQ ID NO: 196786 - protein, 14 aa, Mycobacterium tuberculosis
SGEVRSRTDLLSTL

SEQ ID NO: 196787 - protein, 14 aa, Mycobacterium tuberculosis
GEVRSRTDLLSTLP

SEQ ID NO: 196788 - protein, 14 aa, Mycobacterium tuberculosis
EVRSRTDLLSTLPQ

SEQ ID NO: 196789 - protein, 14 aa, Mycobacterium tuberculosis
VRSRTDLLSTLPQR

SEQ ID NO: 196790 - protein, 14 aa, Mycobacterium tuberculosis
RSRTDLLSTLPQRV

SEQ ID NO: 196791 - protein, 14 aa, Mycobacterium tuberculosis
SRTDLLSTLPQRVA

SEQ ID NO: 196792 - protein, 14 aa, Mycobacterium tuberculosis
RTDLLSTLPQRVAV

SEQ ID NO: 196793 - protein, 14 aa, Mycobacterium tuberculosis
TDLLSTLPQRVAVR

SEQ ID NO: 196794 - protein, 14 aa, Mycobacterium tuberculosis
DLLSTLPQRVAVRV

SEQ ID NO: 196795 - protein, 14 aa, Mycobacterium tuberculosis
LLSTLPQRVAVRVS

SEQ ID NO: 196796 - protein, 14 aa, Mycobacterium tuberculosis
LSTLPQRVAVRVSQ

SEQ ID NO: 196797 - protein, 14 aa, Mycobacterium tuberculosis
STLPQRVAVRVSQL

SEQ ID NO: 196798 - protein, 14 aa, Mycobacterium tuberculosis
TLPQRVAVRVSQLH

SEQ ID NO: 196799 - protein, 14 aa, Mycobacterium tuberculosis
LPQRVAVRVSQLHA

SEQ ID NO: 196800 - protein, 14 aa, Mycobacterium tuberculosis
PQRVAVRVSQLHAG

SEQ ID NO: 196801 - protein, 14 aa, Mycobacterium tuberculosis
QRVAVRVSQLHAGP

SEQ ID NO: 196802 - protein, 14 aa, Mycobacterium tuberculosis
RVAVRVSQLHAGPR

SEQ ID NO: 196803 - protein, 14 aa, Mycobacterium tuberculosis
VAVRVSQLHAGPRK

SEQ ID NO: 196804 - protein, 14 aa, Mycobacterium tuberculosis
AVRVSQLHAGPRKS

SEQ ID NO: 196805 - protein, 14 aa, Mycobacterium tuberculosis
VRVSQLHAGPRKSA

SEQ ID NO: 196806 - protein, 14 aa, Mycobacterium tuberculosis
RVSQLHAGPRKSAL

SEQ ID NO: 196807 - protein, 14 aa, Mycobacterium tuberculosis
VSQLHAGPRKSALD

SEQ ID NO: 196808 - protein, 14 aa, Mycobacterium tuberculosis
SQLHAGPRKSALDE

SEQ ID NO: 196809 - protein, 14 aa, Mycobacterium tuberculosis
QLHAGPRKSALDEE

SEQ ID NO: 196810 - protein, 14 aa, Mycobacterium tuberculosis
LHAGPRKSALDEEE

SEQ ID NO: 196811 - protein, 14 aa, Mycobacterium tuberculosis
HAGPRKSALDEEEI

SEQ ID NO: 196812 - protein, 14 aa, Mycobacterium tuberculosis
AGPRKSALDEEEIW

SEQ ID NO: 196813 - protein, 14 aa, Mycobacterium tuberculosis
GPRKSALDEEEIWD

SEQ ID NO: 196814 - protein, 14 aa, Mycobacterium tuberculosis
PRKSALDEEEIWDL

SEQ ID NO: 196815 - protein, 14 aa, Mycobacterium tuberculosis
RKSALDEEEIWDLT

SEQ ID NO: 196816 - protein, 14 aa, Mycobacterium tuberculosis
KSALDEEEIWDLTS

SEQ ID NO: 196817 - protein, 14 aa, Mycobacterium tuberculosis
SALDEEEIWDLTSA

SEQ ID NO: 196818 - protein, 14 aa, Mycobacterium tuberculosis
ALDEEEIWDLTSAE

SEQ ID NO: 196819 - protein, 14 aa, Mycobacterium tuberculosis
LDEEEIWDLTSAEF

SEQ ID NO: 196820 - protein, 14 aa, Mycobacterium tuberculosis
DEEEIWDLTSAEFT

SEQ ID NO: 196821 - protein, 14 aa, Mycobacterium tuberculosis
EEEIWDLTSAEFTR

SEQ ID NO: 196822 - protein, 14 aa, Mycobacterium tuberculosis
EEIWDLTSAEFTRR

SEQ ID NO: 196823 - protein, 14 aa, Mycobacterium tuberculosis
EIWDLTSAEFTRRR

SEQ ID NO: 196824 - protein, 14 aa, Mycobacterium tuberculosis
IWDLTSAEFTRRRY

SEQ ID NO: 196825 - protein, 14 aa, Mycobacterium tuberculosis
WDLTSAEFTRRRYA

SEQ ID NO: 196826 - protein, 14 aa, Mycobacterium tuberculosis
DLTSAEFTRRRYAE

SEQ ID NO: 196827 - protein, 14 aa, Mycobacterium tuberculosis
LTSAEFTRRRYAEI

SEQ ID NO: 196828 - protein, 14 aa, Mycobacterium tuberculosis
TSAEFTRRRYAEIT

SEQ ID NO: 196829 - protein, 14 aa, Mycobacterium tuberculosis
SAEFTRRRYAEITN

SEQ ID NO: 196830 - protein, 14 aa, Mycobacterium tuberculosis
AEFTRRRYAEITNV

SEQ ID NO: 196831 - protein, 14 aa, Mycobacterium tuberculosis
EFTRRRYAEITNVA

SEQ ID NO: 196832 - protein, 14 aa, Mycobacterium tuberculosis
FTRRRYAEITNVAQ

SEQ ID NO: 196833 - protein, 14 aa, Mycobacterium tuberculosis
TRRRYAEITNVAQQ

SEQ ID NO: 196834 - protein, 14 aa, Mycobacterium tuberculosis
RRRYAEITNVAQQF

SEQ ID NO: 196835 - protein, 14 aa, Mycobacterium tuberculosis
RRYAEITNVAQQFE

SEQ ID NO: 196836 - protein, 14 aa, Mycobacterium tuberculosis
RYAEITNVAQQFEA

SEQ ID NO: 196837 - protein, 14 aa, Mycobacterium tuberculosis
YAEITNVAQQFEAE

SEQ ID NO: 196838 - protein, 14 aa, Mycobacterium tuberculosis
AEITNVAQQFEAEI

SEQ ID NO: 196839 - protein, 14 aa, Mycobacterium tuberculosis
EITNVAQQFEAEIG

SEQ ID NO: 196840 - protein, 14 aa, Mycobacterium tuberculosis
ITNVAQQFEAEIGR

SEQ ID NO: 196841 - protein, 14 aa, Mycobacterium tuberculosis
TNVAQQFEAEIGRG

SEQ ID NO: 196842 - protein, 14 aa, Mycobacterium tuberculosis
NVAQQFEAEIGRGS

SEQ ID NO: 196843 - protein, 14 aa, Mycobacterium tuberculosis
VAQQFEAEIGRGSG

SEQ ID NO: 196844 - protein, 14 aa, Mycobacterium tuberculosis
AQQFEAEIGRGSGL

SEQ ID NO: 196845 - protein, 14 aa, Mycobacterium tuberculosis
QQFEAEIGRGSGLA

SEQ ID NO: 196846 - protein, 14 aa, Mycobacterium tuberculosis
QFEAEIGRGSGLAA

SEQ ID NO: 196847 - protein, 14 aa, Mycobacterium tuberculosis
FEAEIGRGSGLAAQ

SEQ ID NO: 196848 - protein, 14 aa, Mycobacterium tuberculosis
EAEIGRGSGLAAQG

SEQ ID NO: 196849 - protein, 14 aa, Mycobacterium tuberculosis
AEIGRGSGLAAQGL

SEQ ID NO: 196850 - protein, 14 aa, Mycobacterium tuberculosis
EIGRGSGLAAQGLA

SEQ ID NO: 196851 - protein, 14 aa, Mycobacterium tuberculosis
IGRGSGLAAQGLAE

SEQ ID NO: 196852 - protein, 14 aa, Mycobacterium tuberculosis
GRGSGLAAQGLAEV

SEQ ID NO: 196853 - protein, 14 aa, Mycobacterium tuberculosis
RGSGLAAQGLAEVC

SEQ ID NO: 196854 - protein, 14 aa, Mycobacterium tuberculosis
GSGLAAQGLAEVCA

SEQ ID NO: 196855 - protein, 14 aa, Mycobacterium tuberculosis
SGLAAQGLAEVCAA

SEQ ID NO: 196856 - protein, 14 aa, Mycobacterium tuberculosis
GLAAQGLAEVCAAL

SEQ ID NO: 196857 - protein, 14 aa, Mycobacterium tuberculosis
LAAQGLAEVCAALR

SEQ ID NO: 196858 - protein, 14 aa, Mycobacterium tuberculosis
AAQGLAEVCAALRD

SEQ ID NO: 196859 - protein, 14 aa, Mycobacterium tuberculosis
AQGLAEVCAALRDG

SEQ ID NO: 196860 - protein, 14 aa, Mycobacterium tuberculosis
QGLAEVCAALRDGD

SEQ ID NO: 196861 - protein, 14 aa, Mycobacterium tuberculosis
GLAEVCAALRDGDV

SEQ ID NO: 196862 - protein, 14 aa, Mycobacterium tuberculosis
LAEVCAALRDGDVD

SEQ ID NO: 196863 - protein, 14 aa, Mycobacterium tuberculosis
AEVCAALRDGDVDT

SEQ ID NO: 196864 - protein, 14 aa, Mycobacterium tuberculosis
EVCAALRDGDVDTL

SEQ ID NO: 196865 - protein, 14 aa, Mycobacterium tuberculosis
VCAALRDGDVDTLI

SEQ ID NO: 196866 - protein, 14 aa, Mycobacterium tuberculosis
CAALRDGDVDTLIV

SEQ ID NO: 196867 - protein, 14 aa, Mycobacterium tuberculosis
AALRDGDVDTLIVG

SEQ ID NO: 196868 - protein, 14 aa, Mycobacterium tuberculosis
ALRDGDVDTLIVGE

SEQ ID NO: 196869 - protein, 14 aa, Mycobacterium tuberculosis
LRDGDVDTLIVGEL

SEQ ID NO: 196870 - protein, 14 aa, Mycobacterium tuberculosis
RDGDVDTLIVGELG

SEQ ID NO: 196871 - protein, 14 aa, Mycobacterium tuberculosis
DGDVDTLIVGELGE

SEQ ID NO: 196872 - protein, 14 aa, Mycobacterium tuberculosis
GDVDTLIVGELGEA

SEQ ID NO: 196873 - protein, 14 aa, Mycobacterium tuberculosis
DVDTLIVGELGEAT

SEQ ID NO: 196874 - protein, 14 aa, Mycobacterium tuberculosis
VDTLIVGELGEATV

SEQ ID NO: 196875 - protein, 14 aa, Mycobacterium tuberculosis
DTLIVGELGEATVV

SEQ ID NO: 196876 - protein, 14 aa, Mycobacterium tuberculosis
TLIVGELGEATVVT

SEQ ID NO: 196877 - protein, 14 aa, Mycobacterium tuberculosis
LIVGELGEATVVTG

SEQ ID NO: 196878 - protein, 14 aa, Mycobacterium tuberculosis
IVGELGEATVVTGK

SEQ ID NO: 196879 - protein, 14 aa, Mycobacterium tuberculosis
VGELGEATVVTGKA

SEQ ID NO: 196880 - protein, 14 aa, Mycobacterium tuberculosis
GELGEATVVTGKAR

SEQ ID NO: 196881 - protein, 14 aa, Mycobacterium tuberculosis
ELGEATVVTGKART

SEQ ID NO: 196882 - protein, 14 aa, Mycobacterium tuberculosis
LGEATVVTGKARTT

SEQ ID NO: 196883 - protein, 14 aa, Mycobacterium tuberculosis
GEATVVTGKARTTV

SEQ ID NO: 196884 - protein, 14 aa, Mycobacterium tuberculosis
EATVVTGKARTTVA

SEQ ID NO: 196885 - protein, 14 aa, Mycobacterium tuberculosis
ATVVTGKARTTVAR

SEQ ID NO: 196886 - protein, 14 aa, Mycobacterium tuberculosis
TVVTGKARTTVARD

SEQ ID NO: 196887 - protein, 14 aa, Mycobacterium tuberculosis
VVTGKARTTVARDA

SEQ ID NO: 196888 - protein, 14 aa, Mycobacterium tuberculosis
VTGKARTTVARDAD

SEQ ID NO: 196889 - protein, 14 aa, Mycobacterium tuberculosis
TGKARTTVARDADM

SEQ ID NO: 196890 - protein, 14 aa, Mycobacterium tuberculosis
GKARTTVARDADML

SEQ ID NO: 196891 - protein, 14 aa, Mycobacterium tuberculosis
KARTTVARDADMLS

SEQ ID NO: 196892 - protein, 14 aa, Mycobacterium tuberculosis
ARTTVARDADMLSE

SEQ ID NO: 196893 - protein, 14 aa, Mycobacterium tuberculosis
RTTVARDADMLSEL

SEQ ID NO: 196894 - protein, 14 aa, Mycobacterium tuberculosis
TTVARDADMLSELG

SEQ ID NO: 196895 - protein, 14 aa, Mycobacterium tuberculosis
TVARDADMLSELGE

SEQ ID NO: 196896 - protein, 14 aa, Mycobacterium tuberculosis
VARDADMLSELGEP

SEQ ID NO: 196897 - protein, 14 aa, Mycobacterium tuberculosis
ARDADMLSELGEPV

SEQ ID NO: 196898 - protein, 14 aa, Mycobacterium tuberculosis
RDADMLSELGEPVD

SEQ ID NO: 196899 - protein, 14 aa, Mycobacterium tuberculosis
DADMLSELGEPVDR

SEQ ID NO: 196900 - protein, 14 aa, Mycobacterium tuberculosis
ADMLSELGEPVDRV

SEQ ID NO: 196901 - protein, 14 aa, Mycobacterium tuberculosis
DMLSELGEPVDRVA

SEQ ID NO: 196902 - protein, 14 aa, Mycobacterium tuberculosis
MLSELGEPVDRVAR

SEQ ID NO: 196903 - protein, 14 aa, Mycobacterium tuberculosis
LSELGEPVDRVARA

SEQ ID NO: 196904 - protein, 14 aa, Mycobacterium tuberculosis
SELGEPVDRVARAD

SEQ ID NO: 196905 - protein, 14 aa, Mycobacterium tuberculosis
ELGEPVDRVARADE

SEQ ID NO: 196906 - protein, 14 aa, Mycobacterium tuberculosis
LGEPVDRVARADEA

SEQ ID NO: 196907 - protein, 14 aa, Mycobacterium tuberculosis
GEPVDRVARADEAL

SEQ ID NO: 196908 - protein, 14 aa, Mycobacterium tuberculosis
EPVDRVARADEALP

SEQ ID NO: 196909 - protein, 14 aa, Mycobacterium tuberculosis
PVDRVARADEALPF

SEQ ID NO: 196910 - protein, 14 aa, Mycobacterium tuberculosis
VDRVARADEALPFA

SEQ ID NO: 196911 - protein, 14 aa, Mycobacterium tuberculosis
DRVARADEALPFAA

SEQ ID NO: 196912 - protein, 14 aa, Mycobacterium tuberculosis
RVARADEALPFAAI

SEQ ID NO: 196913 - protein, 14 aa, Mycobacterium tuberculosis
VARADEALPFAAIA

SEQ ID NO: 196914 - protein, 14 aa, Mycobacterium tuberculosis
ARADEALPFAAIAV

SEQ ID NO: 196915 - protein, 14 aa, Mycobacterium tuberculosis
RADEALPFAAIAVG

SEQ ID NO: 196916 - protein, 14 aa, Mycobacterium tuberculosis
ADEALPFAAIAVGA

SEQ ID NO: 196917 - protein, 14 aa, Mycobacterium tuberculosis
DEALPFAAIAVGAA

SEQ ID NO: 196918 - protein, 14 aa, Mycobacterium tuberculosis
EALPFAAIAVGAAL

SEQ ID NO: 196919 - protein, 14 aa, Mycobacterium tuberculosis
ALPFAAIAVGAALV

SEQ ID NO: 196920 - protein, 14 aa, Mycobacterium tuberculosis
LPFAAIAVGAALVR

SEQ ID NO: 196921 - protein, 14 aa, Mycobacterium tuberculosis
PFAAIAVGAALVRD

SEQ ID NO: 196922 - protein, 14 aa, Mycobacterium tuberculosis
FAAIAVGAALVRDD

SEQ ID NO: 196923 - protein, 14 aa, Mycobacterium tuberculosis
AAIAVGAALVRDDN

SEQ ID NO: 196924 - protein, 14 aa, Mycobacterium tuberculosis
AIAVGAALVRDDNR

SEQ ID NO: 196925 - protein, 14 aa, Mycobacterium tuberculosis
IAVGAALVRDDNRI

SEQ ID NO: 196926 - protein, 14 aa, Mycobacterium tuberculosis
AVGAALVRDDNRIA

SEQ ID NO: 196927 - protein, 14 aa, Mycobacterium tuberculosis
VGAALVRDDNRIAP

SEQ ID NO: 196928 - protein, 14 aa, Mycobacterium tuberculosis
GAALVRDDNRIAPL

SEQ ID NO: 196929 - protein, 14 aa, Mycobacterium tuberculosis
AALVRDDNRIAPLD

SEQ ID NO: 196930 - protein, 14 aa, Mycobacterium tuberculosis
ALVRDDNRIAPLDG

SEQ ID NO: 196931 - protein, 14 aa, Mycobacterium tuberculosis
LVRDDNRIAPLDGV

SEQ ID NO: 196932 - protein, 14 aa, Mycobacterium tuberculosis
VRDDNRIAPLDGVG

SEQ ID NO: 196933 - protein, 14 aa, Mycobacterium tuberculosis
RDDNRIAPLDGVGA

SEQ ID NO: 196934 - protein, 14 aa, Mycobacterium tuberculosis
DDNRIAPLDGVGAL

SEQ ID NO: 196935 - protein, 14 aa, Mycobacterium tuberculosis
DNRIAPLDGVGALL

SEQ ID NO: 196936 - protein, 14 aa, Mycobacterium tuberculosis
NRIAPLDGVGALLR

SEQ ID NO: 196937 - protein, 14 aa, Mycobacterium tuberculosis
RIAPLDGVGALLRY

SEQ ID NO: 196938 - protein, 14 aa, Mycobacterium tuberculosis
IAPLDGVGALLRYA

SEQ ID NO: 196939 - protein, 14 aa, Mycobacterium tuberculosis
APLDGVGALLRYAA

SEQ ID NO: 196940 - protein, 14 aa, Mycobacterium tuberculosis
PLDGVGALLRYAAT

SEQ ID NO: 196941 - protein, 14 aa, Mycobacterium tuberculosis
LDGVGALLRYAATN

SEQ ID NO: 196942 - protein, 14 aa, Mycobacterium tuberculosis
DGVGALLRYAATNR

SEQ ID NO: 196943 - protein, 14 aa, Mycobacterium tuberculosis
GVGALLRYAATNRL

SEQ ID NO: 196944 - protein, 14 aa, Mycobacterium tuberculosis
VGALLRYAATNRLG

SEQ ID NO: 196945 - protein, 14 aa, Mycobacterium tuberculosis
GALLRYAATNRLGS

SEQ ID NO: 196946 - protein, 14 aa, Mycobacterium tuberculosis
ALLRYAATNRLGSH

SEQ ID NO: 196947 - protein, 14 aa, Mycobacterium tuberculosis
LLRYAATNRLGSHR

SEQ ID NO: 196948 - protein, 14 aa, Mycobacterium tuberculosis
LRYAATNRLGSHRS

SEQ ID NO: 196949 - protein, 15 aa, Mycobacterium tuberculosis
MRSERLRWLVAAEGP

SEQ ID NO: 196950 - protein, 15 aa, Mycobacterium tuberculosis
RSERLRWLVAAEGPF

SEQ ID NO: 196951 - protein, 15 aa, Mycobacterium tuberculosis
SERLRWLVAAEGPFA

SEQ ID NO: 196952 - protein, 15 aa, Mycobacterium tuberculosis
ERLRWLVAAEGPFAS

SEQ ID NO: 196953 - protein, 15 aa, Mycobacterium tuberculosis
RLRWLVAAEGPFASV

SEQ ID NO: 196954 - protein, 15 aa, Mycobacterium tuberculosis
LRWLVAAEGPFASVY

SEQ ID NO: 196955 - protein, 15 aa, Mycobacterium tuberculosis
RWLVAAEGPFASVYF

SEQ ID NO: 196956 - protein, 15 aa, Mycobacterium tuberculosis
WLVAAEGPFASVYFD

SEQ ID NO: 196957 - protein, 15 aa, Mycobacterium tuberculosis
LVAAEGPFASVYFDD

SEQ ID NO: 196958 - protein, 15 aa, Mycobacterium tuberculosis
VAAEGPFASVYFDDS

SEQ ID NO: 196959 - protein, 15 aa, Mycobacterium tuberculosis
AAEGPFASVYFDDSH

SEQ ID NO: 196960 - protein, 15 aa, Mycobacterium tuberculosis
AEGPFASVYFDDSHD

SEQ ID NO: 196961 - protein, 15 aa, Mycobacterium tuberculosis
EGPFASVYFDDSHDT

SEQ ID NO: 196962 - protein, 15 aa, Mycobacterium tuberculosis
GPFASVYFDDSHDTL

SEQ ID NO: 196963 - protein, 15 aa, Mycobacterium tuberculosis
PFASVYFDDSHDTLD

SEQ ID NO: 196964 - protein, 15 aa, Mycobacterium tuberculosis
FASVYFDDSHDTLDA

SEQ ID NO: 196965 - protein, 15 aa, Mycobacterium tuberculosis
ASVYFDDSHDTLDAV

SEQ ID NO: 196966 - protein, 15 aa, Mycobacterium tuberculosis
SVYFDDSHDTLDAVE

SEQ ID NO: 196967 - protein, 15 aa, Mycobacterium tuberculosis
VYFDDSHDTLDAVER

SEQ ID NO: 196968 - protein, 15 aa, Mycobacterium tuberculosis
YFDDSHDTLDAVERR

SEQ ID NO: 196969 - protein, 15 aa, Mycobacterium tuberculosis
FDDSHDTLDAVERRE

SEQ ID NO: 196970 - protein, 15 aa, Mycobacterium tuberculosis
DDSHDTLDAVERREA

SEQ ID NO: 196971 - protein, 15 aa, Mycobacterium tuberculosis
DSHDTLDAVERREAT

SEQ ID NO: 196972 - protein, 15 aa, Mycobacterium tuberculosis
SHDTLDAVERREATW

SEQ ID NO: 196973 - protein, 15 aa, Mycobacterium tuberculosis
HDTLDAVERREATWR

SEQ ID NO: 196974 - protein, 15 aa, Mycobacterium tuberculosis
DTLDAVERREATWRD

SEQ ID NO: 196975 - protein, 15 aa, Mycobacterium tuberculosis
TLDAVERREATWRDV

SEQ ID NO: 196976 - protein, 15 aa, Mycobacterium tuberculosis
LDAVERREATWRDVR

SEQ ID NO: 196977 - protein, 15 aa, Mycobacterium tuberculosis
DAVERREATWRDVRK

SEQ ID NO: 196978 - protein, 15 aa, Mycobacterium tuberculosis
AVERREATWRDVRKH

SEQ ID NO: 196979 - protein, 15 aa, Mycobacterium tuberculosis
VERREATWRDVRKHL

SEQ ID NO: 196980 - protein, 15 aa, Mycobacterium tuberculosis
ERREATWRDVRKHLE

SEQ ID NO: 196981 - protein, 15 aa, Mycobacterium tuberculosis
RREATWRDVRKHLES

SEQ ID NO: 196982 - protein, 15 aa, Mycobacterium tuberculosis
REATWRDVRKHLESR

SEQ ID NO: 196983 - protein, 15 aa, Mycobacterium tuberculosis
EATWRDVRKHLESRD

SEQ ID NO: 196984 - protein, 15 aa, Mycobacterium tuberculosis
ATWRDVRKHLESRDA

SEQ ID NO: 196985 - protein, 15 aa, Mycobacterium tuberculosis
TWRDVRKHLESRDAK

SEQ ID NO: 196986 - protein, 15 aa, Mycobacterium tuberculosis
WRDVRKHLESRDAKQ

SEQ ID NO: 196987 - protein, 15 aa, Mycobacterium tuberculosis
RDVRKHLESRDAKQE

SEQ ID NO: 196988 - protein, 15 aa, Mycobacterium tuberculosis
DVRKHLESRDAKQEL

SEQ ID NO: 196989 - protein, 15 aa, Mycobacterium tuberculosis
VRKHLESRDAKQELI

SEQ ID NO: 196990 - protein, 15 aa, Mycobacterium tuberculosis
RKHLESRDAKQELID

SEQ ID NO: 196991 - protein, 15 aa, Mycobacterium tuberculosis
KHLESRDAKQELIDS

SEQ ID NO: 196992 - protein, 15 aa, Mycobacterium tuberculosis
HLESRDAKQELIDSL

SEQ ID NO: 196993 - protein, 15 aa, Mycobacterium tuberculosis
LESRDAKQELIDSLE

SEQ ID NO: 196994 - protein, 15 aa, Mycobacterium tuberculosis
ESRDAKQELIDSLEE

SEQ ID NO: 196995 - protein, 15 aa, Mycobacterium tuberculosis
SRDAKQELIDSLEEA

SEQ ID NO: 196996 - protein, 15 aa, Mycobacterium tuberculosis
RDAKQELIDSLEEAV

SEQ ID NO: 196997 - protein, 15 aa, Mycobacterium tuberculosis
DAKQELIDSLEEAVR

SEQ ID NO: 196998 - protein, 15 aa, Mycobacterium tuberculosis
AKQELIDSLEEAVRD

SEQ ID NO: 196999 - protein, 15 aa, Mycobacterium tuberculosis
KQELIDSLEEAVRDS

SEQ ID NO: 197000 - protein, 15 aa, Mycobacterium tuberculosis
QELIDSLEEAVRDSR

SEQ ID NO: 197001 - protein, 15 aa, Mycobacterium tuberculosis
ELIDSLEEAVRDSRP

SEQ ID NO: 197002 - protein, 15 aa, Mycobacterium tuberculosis
LIDSLEEAVRDSRPA

SEQ ID NO: 197003 - protein, 15 aa, Mycobacterium tuberculosis
IDSLEEAVRDSRPAV

SEQ ID NO: 197004 - protein, 15 aa, Mycobacterium tuberculosis
DSLEEAVRDSRPAVG

SEQ ID NO: 197005 - protein, 15 aa, Mycobacterium tuberculosis
SLEEAVRDSRPAVGQ

SEQ ID NO: 197006 - protein, 15 aa, Mycobacterium tuberculosis
LEEAVRDSRPAVGQR

SEQ ID NO: 197007 - protein, 15 aa, Mycobacterium tuberculosis
EEAVRDSRPAVGQRG

SEQ ID NO: 197008 - protein, 15 aa, Mycobacterium tuberculosis
EAVRDSRPAVGQRGR

SEQ ID NO: 197009 - protein, 15 aa, Mycobacterium tuberculosis
AVRDSRPAVGQRGRA

SEQ ID NO: 197010 - protein, 15 aa, Mycobacterium tuberculosis
VRDSRPAVGQRGRAL

SEQ ID NO: 197011 - protein, 15 aa, Mycobacterium tuberculosis
RDSRPAVGQRGRALI

SEQ ID NO: 197012 - protein, 15 aa, Mycobacterium tuberculosis
DSRPAVGQRGRALIA

SEQ ID NO: 197013 - protein, 15 aa, Mycobacterium tuberculosis
SRPAVGQRGRALIAT

SEQ ID NO: 197014 - protein, 15 aa, Mycobacterium tuberculosis
RPAVGQRGRALIATG

SEQ ID NO: 197015 - protein, 15 aa, Mycobacterium tuberculosis
PAVGQRGRALIATGE

SEQ ID NO: 197016 - protein, 15 aa, Mycobacterium tuberculosis
AVGQRGRALIATGEQ

SEQ ID NO: 197017 - protein, 15 aa, Mycobacterium tuberculosis
VGQRGRALIATGEQV

SEQ ID NO: 197018 - protein, 15 aa, Mycobacterium tuberculosis
GQRGRALIATGEQVL

SEQ ID NO: 197019 - protein, 15 aa, Mycobacterium tuberculosis
QRGRALIATGEQVLV

SEQ ID NO: 197020 - protein, 15 aa, Mycobacterium tuberculosis
RGRALIATGEQVLVN

SEQ ID NO: 197021 - protein, 15 aa, Mycobacterium tuberculosis
GRALIATGEQVLVNE

SEQ ID NO: 197022 - protein, 15 aa, Mycobacterium tuberculosis
RALIATGEQVLVNEH

SEQ ID NO: 197023 - protein, 15 aa, Mycobacterium tuberculosis
ALIATGEQVLVNEHL

SEQ ID NO: 197024 - protein, 15 aa, Mycobacterium tuberculosis
LIATGEQVLVNEHLI

SEQ ID NO: 197025 - protein, 15 aa, Mycobacterium tuberculosis
IATGEQVLVNEHLIG

SEQ ID NO: 197026 - protein, 15 aa, Mycobacterium tuberculosis
ATGEQVLVNEHLIGP

SEQ ID NO: 197027 - protein, 15 aa, Mycobacterium tuberculosis
TGEQVLVNEHLIGPP

SEQ ID NO: 197028 - protein, 15 aa, Mycobacterium tuberculosis
GEQVLVNEHLIGPPP

SEQ ID NO: 197029 - protein, 15 aa, Mycobacterium tuberculosis
EQVLVNEHLIGPPPA

SEQ ID NO: 197030 - protein, 15 aa, Mycobacterium tuberculosis
QVLVNEHLIGPPPAT

SEQ ID NO: 197031 - protein, 15 aa, Mycobacterium tuberculosis
VLVNEHLIGPPPATV

SEQ ID NO: 197032 - protein, 15 aa, Mycobacterium tuberculosis
LVNEHLIGPPPATVI

SEQ ID NO: 197033 - protein, 15 aa, Mycobacterium tuberculosis
VNEHLIGPPPATVIR

SEQ ID NO: 197034 - protein, 15 aa, Mycobacterium tuberculosis
NEHLIGPPPATVIRL

SEQ ID NO: 197035 - protein, 15 aa, Mycobacterium tuberculosis
EHLIGPPPATVIRLS

SEQ ID NO: 197036 - protein, 15 aa, Mycobacterium tuberculosis
HLIGPPPATVIRLSD

SEQ ID NO: 197037 - protein, 15 aa, Mycobacterium tuberculosis
LIGPPPATVIRLSDY

SEQ ID NO: 197038 - protein, 15 aa, Mycobacterium tuberculosis
IGPPPATVIRLSDYP

SEQ ID NO: 197039 - protein, 15 aa, Mycobacterium tuberculosis
GPPPATVIRLSDYPY

SEQ ID NO: 197040 - protein, 15 aa, Mycobacterium tuberculosis
PPPATVIRLSDYPYV

SEQ ID NO: 197041 - protein, 15 aa, Mycobacterium tuberculosis
PPATVIRLSDYPYVV

SEQ ID NO: 197042 - protein, 15 aa, Mycobacterium tuberculosis
PATVIRLSDYPYVVP

SEQ ID NO: 197043 - protein, 15 aa, Mycobacterium tuberculosis
ATVIRLSDYPYVVPL

SEQ ID NO: 197044 - protein, 15 aa, Mycobacterium tuberculosis
TVIRLSDYPYVVPLI

SEQ ID NO: 197045 - protein, 15 aa, Mycobacterium tuberculosis
VIRLSDYPYVVPLID

SEQ ID NO: 197046 - protein, 15 aa, Mycobacterium tuberculosis
IRLSDYPYVVPLIDL

SEQ ID NO: 197047 - protein, 15 aa, Mycobacterium tuberculosis
RLSDYPYVVPLIDLE

SEQ ID NO: 197048 - protein, 15 aa, Mycobacterium tuberculosis
LSDYPYVVPLIDLEM

SEQ ID NO: 197049 - protein, 15 aa, Mycobacterium tuberculosis
SDYPYVVPLIDLEMR

SEQ ID NO: 197050 - protein, 15 aa, Mycobacterium tuberculosis
DYPYVVPLIDLEMRR

SEQ ID NO: 197051 - protein, 15 aa, Mycobacterium tuberculosis
YPYVVPLIDLEMRRP

SEQ ID NO: 197052 - protein, 15 aa, Mycobacterium tuberculosis
PYVVPLIDLEMRRPT

SEQ ID NO: 197053 - protein, 15 aa, Mycobacterium tuberculosis
YVVPLIDLEMRRPTY

SEQ ID NO: 197054 - protein, 15 aa, Mycobacterium tuberculosis
VVPLIDLEMRRPTYV

SEQ ID NO: 197055 - protein, 15 aa, Mycobacterium tuberculosis
VPLIDLEMRRPTYVF

SEQ ID NO: 197056 - protein, 15 aa, Mycobacterium tuberculosis
PLIDLEMRRPTYVFA

SEQ ID NO: 197057 - protein, 15 aa, Mycobacterium tuberculosis
LIDLEMRRPTYVFAA

SEQ ID NO: 197058 - protein, 15 aa, Mycobacterium tuberculosis
IDLEMRRPTYVFAAV

SEQ ID NO: 197059 - protein, 15 aa, Mycobacterium tuberculosis
DLEMRRPTYVFAAVD

SEQ ID NO: 197060 - protein, 15 aa, Mycobacterium tuberculosis
LEMRRPTYVFAAVDH

SEQ ID NO: 197061 - protein, 15 aa, Mycobacterium tuberculosis
EMRRPTYVFAAVDHT

SEQ ID NO: 197062 - protein, 15 aa, Mycobacterium tuberculosis
MRRPTYVFAAVDHTG

SEQ ID NO: 197063 - protein, 15 aa, Mycobacterium tuberculosis
RRPTYVFAAVDHTGA

SEQ ID NO: 197064 - protein, 15 aa, Mycobacterium tuberculosis
RPTYVFAAVDHTGAD

SEQ ID NO: 197065 - protein, 15 aa, Mycobacterium tuberculosis
PTYVFAAVDHTGADV

SEQ ID NO: 197066 - protein, 15 aa, Mycobacterium tuberculosis
TYVFAAVDHTGADVK

SEQ ID NO: 197067 - protein, 15 aa, Mycobacterium tuberculosis
YVFAAVDHTGADVKL

SEQ ID NO: 197068 - protein, 15 aa, Mycobacterium tuberculosis
VFAAVDHTGADVKLY

SEQ ID NO: 197069 - protein, 15 aa, Mycobacterium tuberculosis
FAAVDHTGADVKLYQ

SEQ ID NO: 197070 - protein, 15 aa, Mycobacterium tuberculosis
AAVDHTGADVKLYQG

SEQ ID NO: 197071 - protein, 15 aa, Mycobacterium tuberculosis
AVDHTGADVKLYQGA

SEQ ID NO: 197072 - protein, 15 aa, Mycobacterium tuberculosis
VDHTGADVKLYQGAT

SEQ ID NO: 197073 - protein, 15 aa, Mycobacterium tuberculosis
DHTGADVKLYQGATI

SEQ ID NO: 197074 - protein, 15 aa, Mycobacterium tuberculosis
HTGADVKLYQGATIS

SEQ ID NO: 197075 - protein, 15 aa, Mycobacterium tuberculosis
TGADVKLYQGATISS

SEQ ID NO: 197076 - protein, 15 aa, Mycobacterium tuberculosis
GADVKLYQGATISST

SEQ ID NO: 197077 - protein, 15 aa, Mycobacterium tuberculosis
ADVKLYQGATISSTK

SEQ ID NO: 197078 - protein, 15 aa, Mycobacterium tuberculosis
DVKLYQGATISSTKI

SEQ ID NO: 197079 - protein, 15 aa, Mycobacterium tuberculosis
VKLYQGATISSTKID

SEQ ID NO: 197080 - protein, 15 aa, Mycobacterium tuberculosis
KLYQGATISSTKIDG

SEQ ID NO: 197081 - protein, 15 aa, Mycobacterium tuberculosis
LYQGATISSTKIDGV

SEQ ID NO: 197082 - protein, 15 aa, Mycobacterium tuberculosis
YQGATISSTKIDGVG

SEQ ID NO: 197083 - protein, 15 aa, Mycobacterium tuberculosis
QGATISSTKIDGVGY

SEQ ID NO: 197084 - protein, 15 aa, Mycobacterium tuberculosis
GATISSTKIDGVGYP

SEQ ID NO: 197085 - protein, 15 aa, Mycobacterium tuberculosis
ATISSTKIDGVGYPV

SEQ ID NO: 197086 - protein, 15 aa, Mycobacterium tuberculosis
TISSTKIDGVGYPVH

SEQ ID NO: 197087 - protein, 15 aa, Mycobacterium tuberculosis
ISSTKIDGVGYPVHK

SEQ ID NO: 197088 - protein, 15 aa, Mycobacterium tuberculosis
SSTKIDGVGYPVHKP

SEQ ID NO: 197089 - protein, 15 aa, Mycobacterium tuberculosis
STKIDGVGYPVHKPV

SEQ ID NO: 197090 - protein, 15 aa, Mycobacterium tuberculosis
TKIDGVGYPVHKPVT

SEQ ID NO: 197091 - protein, 15 aa, Mycobacterium tuberculosis
KIDGVGYPVHKPVTA

SEQ ID NO: 197092 - protein, 15 aa, Mycobacterium tuberculosis
IDGVGYPVHKPVTAG

SEQ ID NO: 197093 - protein, 15 aa, Mycobacterium tuberculosis
DGVGYPVHKPVTAGW

SEQ ID NO: 197094 - protein, 15 aa, Mycobacterium tuberculosis
GVGYPVHKPVTAGWN

SEQ ID NO: 197095 - protein, 15 aa, Mycobacterium tuberculosis
VGYPVHKPVTAGWNG

SEQ ID NO: 197096 - protein, 15 aa, Mycobacterium tuberculosis
GYPVHKPVTAGWNGY

SEQ ID NO: 197097 - protein, 15 aa, Mycobacterium tuberculosis
YPVHKPVTAGWNGYG

SEQ ID NO: 197098 - protein, 15 aa, Mycobacterium tuberculosis
PVHKPVTAGWNGYGD

SEQ ID NO: 197099 - protein, 15 aa, Mycobacterium tuberculosis
VHKPVTAGWNGYGDF

SEQ ID NO: 197100 - protein, 15 aa, Mycobacterium tuberculosis
HKPVTAGWNGYGDFQ

SEQ ID NO: 197101 - protein, 15 aa, Mycobacterium tuberculosis
KPVTAGWNGYGDFQH

SEQ ID NO: 197102 - protein, 15 aa, Mycobacterium tuberculosis
PVTAGWNGYGDFQHT

SEQ ID NO: 197103 - protein, 15 aa, Mycobacterium tuberculosis
VTAGWNGYGDFQHTT

SEQ ID NO: 197104 - protein, 15 aa, Mycobacterium tuberculosis
TAGWNGYGDFQHTTE

SEQ ID NO: 197105 - protein, 15 aa, Mycobacterium tuberculosis
AGWNGYGDFQHTTEE

SEQ ID NO: 197106 - protein, 15 aa, Mycobacterium tuberculosis
GWNGYGDFQHTTEEA

SEQ ID NO: 197107 - protein, 15 aa, Mycobacterium tuberculosis
WNGYGDFQHTTEEAI

SEQ ID NO: 197108 - protein, 15 aa, Mycobacterium tuberculosis
NGYGDFQHTTEEAIR

SEQ ID NO: 197109 - protein, 15 aa, Mycobacterium tuberculosis
GYGDFQHTTEEAIRM

SEQ ID NO: 197110 - protein, 15 aa, Mycobacterium tuberculosis
YGDFQHTTEEAIRMN

SEQ ID NO: 197111 - protein, 15 aa, Mycobacterium tuberculosis
GDFQHTTEEAIRMNC

SEQ ID NO: 197112 - protein, 15 aa, Mycobacterium tuberculosis
DFQHTTEEAIRMNCR

SEQ ID NO: 197113 - protein, 15 aa, Mycobacterium tuberculosis
FQHTTEEAIRMNCRA

SEQ ID NO: 197114 - protein, 15 aa, Mycobacterium tuberculosis
QHTTEEAIRMNCRAV

SEQ ID NO: 197115 - protein, 15 aa, Mycobacterium tuberculosis
HTTEEAIRMNCRAVA

SEQ ID NO: 197116 - protein, 15 aa, Mycobacterium tuberculosis
TTEEAIRMNCRAVAD

SEQ ID NO: 197117 - protein, 15 aa, Mycobacterium tuberculosis
TEEAIRMNCRAVADH

SEQ ID NO: 197118 - protein, 15 aa, Mycobacterium tuberculosis
EEAIRMNCRAVADHL

SEQ ID NO: 197119 - protein, 15 aa, Mycobacterium tuberculosis
EAIRMNCRAVADHLT

SEQ ID NO: 197120 - protein, 15 aa, Mycobacterium tuberculosis
AIRMNCRAVADHLTR

SEQ ID NO: 197121 - protein, 15 aa, Mycobacterium tuberculosis
IRMNCRAVADHLTRL

SEQ ID NO: 197122 - protein, 15 aa, Mycobacterium tuberculosis
RMNCRAVADHLTRLV

SEQ ID NO: 197123 - protein, 15 aa, Mycobacterium tuberculosis
MNCRAVADHLTRLVD

SEQ ID NO: 197124 - protein, 15 aa, Mycobacterium tuberculosis
NCRAVADHLTRLVDA

SEQ ID NO: 197125 - protein, 15 aa, Mycobacterium tuberculosis
CRAVADHLTRLVDAA

SEQ ID NO: 197126 - protein, 15 aa, Mycobacterium tuberculosis
RAVADHLTRLVDAAD

SEQ ID NO: 197127 - protein, 15 aa, Mycobacterium tuberculosis
AVADHLTRLVDAADP

SEQ ID NO: 197128 - protein, 15 aa, Mycobacterium tuberculosis
VADHLTRLVDAADPE

SEQ ID NO: 197129 - protein, 15 aa, Mycobacterium tuberculosis
ADHLTRLVDAADPEV

SEQ ID NO: 197130 - protein, 15 aa, Mycobacterium tuberculosis
DHLTRLVDAADPEVV

SEQ ID NO: 197131 - protein, 15 aa, Mycobacterium tuberculosis
HLTRLVDAADPEVVF

SEQ ID NO: 197132 - protein, 15 aa, Mycobacterium tuberculosis
LTRLVDAADPEVVFV

SEQ ID NO: 197133 - protein, 15 aa, Mycobacterium tuberculosis
TRLVDAADPEVVFVS

SEQ ID NO: 197134 - protein, 15 aa, Mycobacterium tuberculosis
RLVDAADPEVVFVSG

SEQ ID NO: 197135 - protein, 15 aa, Mycobacterium tuberculosis
LVDAADPEVVFVSGE

SEQ ID NO: 197136 - protein, 15 aa, Mycobacterium tuberculosis
VDAADPEVVFVSGEV

SEQ ID NO: 197137 - protein, 15 aa, Mycobacterium tuberculosis
DAADPEVVFVSGEVR

SEQ ID NO: 197138 - protein, 15 aa, Mycobacterium tuberculosis
AADPEVVFVSGEVRS

SEQ ID NO: 197139 - protein, 15 aa, Mycobacterium tuberculosis
ADPEVVFVSGEVRSR

SEQ ID NO: 197140 - protein, 15 aa, Mycobacterium tuberculosis
DPEVVFVSGEVRSRT

SEQ ID NO: 197141 - protein, 15 aa, Mycobacterium tuberculosis
PEVVFVSGEVRSRTD

SEQ ID NO: 197142 - protein, 15 aa, Mycobacterium tuberculosis
EVVFVSGEVRSRTDL

SEQ ID NO: 197143 - protein, 15 aa, Mycobacterium tuberculosis
VVFVSGEVRSRTDLL

SEQ ID NO: 197144 - protein, 15 aa, Mycobacterium tuberculosis
VFVSGEVRSRTDLLS

SEQ ID NO: 197145 - protein, 15 aa, Mycobacterium tuberculosis
FVSGEVRSRTDLLST

SEQ ID NO: 197146 - protein, 15 aa, Mycobacterium tuberculosis
VSGEVRSRTDLLSTL

SEQ ID NO: 197147 - protein, 15 aa, Mycobacterium tuberculosis
SGEVRSRTDLLSTLP

SEQ ID NO: 197148 - protein, 15 aa, Mycobacterium tuberculosis
GEVRSRTDLLSTLPQ

SEQ ID NO: 197149 - protein, 15 aa, Mycobacterium tuberculosis
EVRSRTDLLSTLPQR

SEQ ID NO: 197150 - protein, 15 aa, Mycobacterium tuberculosis
VRSRTDLLSTLPQRV

SEQ ID NO: 197151 - protein, 15 aa, Mycobacterium tuberculosis
RSRTDLLSTLPQRVA

SEQ ID NO: 197152 - protein, 15 aa, Mycobacterium tuberculosis
SRTDLLSTLPQRVAV

SEQ ID NO: 197153 - protein, 15 aa, Mycobacterium tuberculosis
RTDLLSTLPQRVAVR

SEQ ID NO: 197154 - protein, 15 aa, Mycobacterium tuberculosis
TDLLSTLPQRVAVRV

SEQ ID NO: 197155 - protein, 15 aa, Mycobacterium tuberculosis
DLLSTLPQRVAVRVS

SEQ ID NO: 197156 - protein, 15 aa, Mycobacterium tuberculosis
LLSTLPQRVAVRVSQ

SEQ ID NO: 197157 - protein, 15 aa, Mycobacterium tuberculosis
LSTLPQRVAVRVSQL

SEQ ID NO: 197158 - protein, 15 aa, Mycobacterium tuberculosis
STLPQRVAVRVSQLH

SEQ ID NO: 197159 - protein, 15 aa, Mycobacterium tuberculosis
TLPQRVAVRVSQLHA

SEQ ID NO: 197160 - protein, 15 aa, Mycobacterium tuberculosis
LPQRVAVRVSQLHAG

SEQ ID NO: 197161 - protein, 15 aa, Mycobacterium tuberculosis
PQRVAVRVSQLHAGP

SEQ ID NO: 197162 - protein, 15 aa, Mycobacterium tuberculosis
QRVAVRVSQLHAGPR

SEQ ID NO: 197163 - protein, 15 aa, Mycobacterium tuberculosis
RVAVRVSQLHAGPRK

SEQ ID NO: 197164 - protein, 15 aa, Mycobacterium tuberculosis
VAVRVSQLHAGPRKS

SEQ ID NO: 197165 - protein, 15 aa, Mycobacterium tuberculosis
AVRVSQLHAGPRKSA

SEQ ID NO: 197166 - protein, 15 aa, Mycobacterium tuberculosis
VRVSQLHAGPRKSAL

SEQ ID NO: 197167 - protein, 15 aa, Mycobacterium tuberculosis
RVSQLHAGPRKSALD

SEQ ID NO: 197168 - protein, 15 aa, Mycobacterium tuberculosis
VSQLHAGPRKSALDE

SEQ ID NO: 197169 - protein, 15 aa, Mycobacterium tuberculosis
SQLHAGPRKSALDEE

SEQ ID NO: 197170 - protein, 15 aa, Mycobacterium tuberculosis
QLHAGPRKSALDEEE

SEQ ID NO: 197171 - protein, 15 aa, Mycobacterium tuberculosis
LHAGPRKSALDEEEI

SEQ ID NO: 197172 - protein, 15 aa, Mycobacterium tuberculosis
HAGPRKSALDEEEIW

SEQ ID NO: 197173 - protein, 15 aa, Mycobacterium tuberculosis
AGPRKSALDEEEIWD

SEQ ID NO: 197174 - protein, 15 aa, Mycobacterium tuberculosis
GPRKSALDEEEIWDL

SEQ ID NO: 197175 - protein, 15 aa, Mycobacterium tuberculosis
PRKSALDEEEIWDLT

SEQ ID NO: 197176 - protein, 15 aa, Mycobacterium tuberculosis
RKSALDEEEIWDLTS

SEQ ID NO: 197177 - protein, 15 aa, Mycobacterium tuberculosis
KSALDEEEIWDLTSA

SEQ ID NO: 197178 - protein, 15 aa, Mycobacterium tuberculosis
SALDEEEIWDLTSAE

SEQ ID NO: 197179 - protein, 15 aa, Mycobacterium tuberculosis
ALDEEEIWDLTSAEF

SEQ ID NO: 197180 - protein, 15 aa, Mycobacterium tuberculosis
LDEEEIWDLTSAEFT

SEQ ID NO: 197181 - protein, 15 aa, Mycobacterium tuberculosis
DEEEIWDLTSAEFTR

SEQ ID NO: 197182 - protein, 15 aa, Mycobacterium tuberculosis
EEEIWDLTSAEFTRR

SEQ ID NO: 197183 - protein, 15 aa, Mycobacterium tuberculosis
EEIWDLTSAEFTRRR

SEQ ID NO: 197184 - protein, 15 aa, Mycobacterium tuberculosis
EIWDLTSAEFTRRRY

SEQ ID NO: 197185 - protein, 15 aa, Mycobacterium tuberculosis
IWDLTSAEFTRRRYA

SEQ ID NO: 197186 - protein, 15 aa, Mycobacterium tuberculosis
WDLTSAEFTRRRYAE

SEQ ID NO: 197187 - protein, 15 aa, Mycobacterium tuberculosis
DLTSAEFTRRRYAEI

SEQ ID NO: 197188 - protein, 15 aa, Mycobacterium tuberculosis
LTSAEFTRRRYAEIT

SEQ ID NO: 197189 - protein, 15 aa, Mycobacterium tuberculosis
TSAEFTRRRYAEITN

SEQ ID NO: 197190 - protein, 15 aa, Mycobacterium tuberculosis
SAEFTRRRYAEITNV

SEQ ID NO: 197191 - protein, 15 aa, Mycobacterium tuberculosis
AEFTRRRYAEITNVA

SEQ ID NO: 197192 - protein, 15 aa, Mycobacterium tuberculosis
EFTRRRYAEITNVAQ

SEQ ID NO: 197193 - protein, 15 aa, Mycobacterium tuberculosis
FTRRRYAEITNVAQQ

SEQ ID NO: 197194 - protein, 15 aa, Mycobacterium tuberculosis
TRRRYAEITNVAQQF

SEQ ID NO: 197195 - protein, 15 aa, Mycobacterium tuberculosis
RRRYAEITNVAQQFE

SEQ ID NO: 197196 - protein, 15 aa, Mycobacterium tuberculosis
RRYAEITNVAQQFEA

SEQ ID NO: 197197 - protein, 15 aa, Mycobacterium tuberculosis
RYAEITNVAQQFEAE

SEQ ID NO: 197198 - protein, 15 aa, Mycobacterium tuberculosis
YAEITNVAQQFEAEI

SEQ ID NO: 197199 - protein, 15 aa, Mycobacterium tuberculosis
AEITNVAQQFEAEIG

SEQ ID NO: 197200 - protein, 15 aa, Mycobacterium tuberculosis
EITNVAQQFEAEIGR

SEQ ID NO: 197201 - protein, 15 aa, Mycobacterium tuberculosis
ITNVAQQFEAEIGRG

SEQ ID NO: 197202 - protein, 15 aa, Mycobacterium tuberculosis
TNVAQQFEAEIGRGS

SEQ ID NO: 197203 - protein, 15 aa, Mycobacterium tuberculosis
NVAQQFEAEIGRGSG

SEQ ID NO: 197204 - protein, 15 aa, Mycobacterium tuberculosis
VAQQFEAEIGRGSGL

SEQ ID NO: 197205 - protein, 15 aa, Mycobacterium tuberculosis
AQQFEAEIGRGSGLA

SEQ ID NO: 197206 - protein, 15 aa, Mycobacterium tuberculosis
QQFEAEIGRGSGLAA

SEQ ID NO: 197207 - protein, 15 aa, Mycobacterium tuberculosis
QFEAEIGRGSGLAAQ

SEQ ID NO: 197208 - protein, 15 aa, Mycobacterium tuberculosis
FEAEIGRGSGLAAQG

SEQ ID NO: 197209 - protein, 15 aa, Mycobacterium tuberculosis
EAEIGRGSGLAAQGL

SEQ ID NO: 197210 - protein, 15 aa, Mycobacterium tuberculosis
AEIGRGSGLAAQGLA

SEQ ID NO: 197211 - protein, 15 aa, Mycobacterium tuberculosis
EIGRGSGLAAQGLAE

SEQ ID NO: 197212 - protein, 15 aa, Mycobacterium tuberculosis
IGRGSGLAAQGLAEV

SEQ ID NO: 197213 - protein, 15 aa, Mycobacterium tuberculosis
GRGSGLAAQGLAEVC

SEQ ID NO: 197214 - protein, 15 aa, Mycobacterium tuberculosis
RGSGLAAQGLAEVCA

SEQ ID NO: 197215 - protein, 15 aa, Mycobacterium tuberculosis
GSGLAAQGLAEVCAA

SEQ ID NO: 197216 - protein, 15 aa, Mycobacterium tuberculosis
SGLAAQGLAEVCAAL

SEQ ID NO: 197217 - protein, 15 aa, Mycobacterium tuberculosis
GLAAQGLAEVCAALR

SEQ ID NO: 197218 - protein, 15 aa, Mycobacterium tuberculosis
LAAQGLAEVCAALRD

SEQ ID NO: 197219 - protein, 15 aa, Mycobacterium tuberculosis
AAQGLAEVCAALRDG

SEQ ID NO: 197220 - protein, 15 aa, Mycobacterium tuberculosis
AQGLAEVCAALRDGD

SEQ ID NO: 197221 - protein, 15 aa, Mycobacterium tuberculosis
QGLAEVCAALRDGDV

SEQ ID NO: 197222 - protein, 15 aa, Mycobacterium tuberculosis
GLAEVCAALRDGDVD

SEQ ID NO: 197223 - protein, 15 aa, Mycobacterium tuberculosis
LAEVCAALRDGDVDT

SEQ ID NO: 197224 - protein, 15 aa, Mycobacterium tuberculosis
AEVCAALRDGDVDTL

SEQ ID NO: 197225 - protein, 15 aa, Mycobacterium tuberculosis
EVCAALRDGDVDTLI

SEQ ID NO: 197226 - protein, 15 aa, Mycobacterium tuberculosis
VCAALRDGDVDTLIV

SEQ ID NO: 197227 - protein, 15 aa, Mycobacterium tuberculosis
CAALRDGDVDTLIVG

SEQ ID NO: 197228 - protein, 15 aa, Mycobacterium tuberculosis
AALRDGDVDTLIVGE

SEQ ID NO: 197229 - protein, 15 aa, Mycobacterium tuberculosis
ALRDGDVDTLIVGEL

SEQ ID NO: 197230 - protein, 15 aa, Mycobacterium tuberculosis
LRDGDVDTLIVGELG

SEQ ID NO: 197231 - protein, 15 aa, Mycobacterium tuberculosis
RDGDVDTLIVGELGE

SEQ ID NO: 197232 - protein, 15 aa, Mycobacterium tuberculosis
DGDVDTLIVGELGEA

SEQ ID NO: 197233 - protein, 15 aa, Mycobacterium tuberculosis
GDVDTLIVGELGEAT

SEQ ID NO: 197234 - protein, 15 aa, Mycobacterium tuberculosis
DVDTLIVGELGEATV

SEQ ID NO: 197235 - protein, 15 aa, Mycobacterium tuberculosis
VDTLIVGELGEATVV

SEQ ID NO: 197236 - protein, 15 aa, Mycobacterium tuberculosis
DTLIVGELGEATVVT

SEQ ID NO: 197237 - protein, 15 aa, Mycobacterium tuberculosis
TLIVGELGEATVVTG

SEQ ID NO: 197238 - protein, 15 aa, Mycobacterium tuberculosis
LIVGELGEATVVTGK

SEQ ID NO: 197239 - protein, 15 aa, Mycobacterium tuberculosis
IVGELGEATVVTGKA

SEQ ID NO: 197240 - protein, 15 aa, Mycobacterium tuberculosis
VGELGEATVVTGKAR

SEQ ID NO: 197241 - protein, 15 aa, Mycobacterium tuberculosis
GELGEATVVTGKART

SEQ ID NO: 197242 - protein, 15 aa, Mycobacterium tuberculosis
ELGEATVVTGKARTT

SEQ ID NO: 197243 - protein, 15 aa, Mycobacterium tuberculosis
LGEATVVTGKARTTV

SEQ ID NO: 197244 - protein, 15 aa, Mycobacterium tuberculosis
GEATVVTGKARTTVA

SEQ ID NO: 197245 - protein, 15 aa, Mycobacterium tuberculosis
EATVVTGKARTTVAR

SEQ ID NO: 197246 - protein, 15 aa, Mycobacterium tuberculosis
ATVVTGKARTTVARD

SEQ ID NO: 197247 - protein, 15 aa, Mycobacterium tuberculosis
TVVTGKARTTVARDA

SEQ ID NO: 197248 - protein, 15 aa, Mycobacterium tuberculosis
VVTGKARTTVARDAD

SEQ ID NO: 197249 - protein, 15 aa, Mycobacterium tuberculosis
VTGKARTTVARDADM

SEQ ID NO: 197250 - protein, 15 aa, Mycobacterium tuberculosis
TGKARTTVARDADML

SEQ ID NO: 197251 - protein, 15 aa, Mycobacterium tuberculosis
GKARTTVARDADMLS

SEQ ID NO: 197252 - protein, 15 aa, Mycobacterium tuberculosis
KARTTVARDADMLSE

SEQ ID NO: 197253 - protein, 15 aa, Mycobacterium tuberculosis
ARTTVARDADMLSEL

SEQ ID NO: 197254 - protein, 15 aa, Mycobacterium tuberculosis
RTTVARDADMLSELG

SEQ ID NO: 197255 - protein, 15 aa, Mycobacterium tuberculosis
TTVARDADMLSELGE

SEQ ID NO: 197256 - protein, 15 aa, Mycobacterium tuberculosis
TVARDADMLSELGEP

SEQ ID NO: 197257 - protein, 15 aa, Mycobacterium tuberculosis
VARDADMLSELGEPV

SEQ ID NO: 197258 - protein, 15 aa, Mycobacterium tuberculosis
ARDADMLSELGEPVD

SEQ ID NO: 197259 - protein, 15 aa, Mycobacterium tuberculosis
RDADMLSELGEPVDR

SEQ ID NO: 197260 - protein, 15 aa, Mycobacterium tuberculosis
DADMLSELGEPVDRV

SEQ ID NO: 197261 - protein, 15 aa, Mycobacterium tuberculosis
ADMLSELGEPVDRVA

SEQ ID NO: 197262 - protein, 15 aa, Mycobacterium tuberculosis
DMLSELGEPVDRVAR

SEQ ID NO: 197263 - protein, 15 aa, Mycobacterium tuberculosis
MLSELGEPVDRVARA

SEQ ID NO: 197264 - protein, 15 aa, Mycobacterium tuberculosis
LSELGEPVDRVARAD

SEQ ID NO: 197265 - protein, 15 aa, Mycobacterium tuberculosis
SELGEPVDRVARADE

SEQ ID NO: 197266 - protein, 15 aa, Mycobacterium tuberculosis
ELGEPVDRVARADEA

SEQ ID NO: 197267 - protein, 15 aa, Mycobacterium tuberculosis
LGEPVDRVARADEAL

SEQ ID NO: 197268 - protein, 15 aa, Mycobacterium tuberculosis
GEPVDRVARADEALP

SEQ ID NO: 197269 - protein, 15 aa, Mycobacterium tuberculosis
EPVDRVARADEALPF

SEQ ID NO: 197270 - protein, 15 aa, Mycobacterium tuberculosis
PVDRVARADEALPFA

SEQ ID NO: 197271 - protein, 15 aa, Mycobacterium tuberculosis
VDRVARADEALPFAA

SEQ ID NO: 197272 - protein, 15 aa, Mycobacterium tuberculosis
DRVARADEALPFAAI

SEQ ID NO: 197273 - protein, 15 aa, Mycobacterium tuberculosis
RVARADEALPFAAIA

SEQ ID NO: 197274 - protein, 15 aa, Mycobacterium tuberculosis
VARADEALPFAAIAV

SEQ ID NO: 197275 - protein, 15 aa, Mycobacterium tuberculosis
ARADEALPFAAIAVG

SEQ ID NO: 197276 - protein, 15 aa, Mycobacterium tuberculosis
RADEALPFAAIAVGA

SEQ ID NO: 197277 - protein, 15 aa, Mycobacterium tuberculosis
ADEALPFAAIAVGAA

SEQ ID NO: 197278 - protein, 15 aa, Mycobacterium tuberculosis
DEALPFAAIAVGAAL

SEQ ID NO: 197279 - protein, 15 aa, Mycobacterium tuberculosis
EALPFAAIAVGAALV

SEQ ID NO: 197280 - protein, 15 aa, Mycobacterium tuberculosis
ALPFAAIAVGAALVR

SEQ ID NO: 197281 - protein, 15 aa, Mycobacterium tuberculosis
LPFAAIAVGAALVRD

SEQ ID NO: 197282 - protein, 15 aa, Mycobacterium tuberculosis
PFAAIAVGAALVRDD

SEQ ID NO: 197283 - protein, 15 aa, Mycobacterium tuberculosis
FAAIAVGAALVRDDN

SEQ ID NO: 197284 - protein, 15 aa, Mycobacterium tuberculosis
AAIAVGAALVRDDNR

SEQ ID NO: 197285 - protein, 15 aa, Mycobacterium tuberculosis
AIAVGAALVRDDNRI

SEQ ID NO: 197286 - protein, 15 aa, Mycobacterium tuberculosis
IAVGAALVRDDNRIA

SEQ ID NO: 197287 - protein, 15 aa, Mycobacterium tuberculosis
AVGAALVRDDNRIAP

SEQ ID NO: 197288 - protein, 15 aa, Mycobacterium tuberculosis
VGAALVRDDNRIAPL

SEQ ID NO: 197289 - protein, 15 aa, Mycobacterium tuberculosis
GAALVRDDNRIAPLD

SEQ ID NO: 197290 - protein, 15 aa, Mycobacterium tuberculosis
AALVRDDNRIAPLDG

SEQ ID NO: 197291 - protein, 15 aa, Mycobacterium tuberculosis
ALVRDDNRIAPLDGV

SEQ ID NO: 197292 - protein, 15 aa, Mycobacterium tuberculosis
LVRDDNRIAPLDGVG

SEQ ID NO: 197293 - protein, 15 aa, Mycobacterium tuberculosis
VRDDNRIAPLDGVGA

SEQ ID NO: 197294 - protein, 15 aa, Mycobacterium tuberculosis
RDDNRIAPLDGVGAL

SEQ ID NO: 197295 - protein, 15 aa, Mycobacterium tuberculosis
DDNRIAPLDGVGALL

SEQ ID NO: 197296 - protein, 15 aa, Mycobacterium tuberculosis
DNRIAPLDGVGALLR

SEQ ID NO: 197297 - protein, 15 aa, Mycobacterium tuberculosis
NRIAPLDGVGALLRY

SEQ ID NO: 197298 - protein, 15 aa, Mycobacterium tuberculosis
RIAPLDGVGALLRYA

SEQ ID NO: 197299 - protein, 15 aa, Mycobacterium tuberculosis
IAPLDGVGALLRYAA

SEQ ID NO: 197300 - protein, 15 aa, Mycobacterium tuberculosis
APLDGVGALLRYAAT

SEQ ID NO: 197301 - protein, 15 aa, Mycobacterium tuberculosis
PLDGVGALLRYAATN

SEQ ID NO: 197302 - protein, 15 aa, Mycobacterium tuberculosis
LDGVGALLRYAATNR

SEQ ID NO: 197303 - protein, 15 aa, Mycobacterium tuberculosis
DGVGALLRYAATNRL

SEQ ID NO: 197304 - protein, 15 aa, Mycobacterium tuberculosis
GVGALLRYAATNRLG

SEQ ID NO: 197305 - protein, 15 aa, Mycobacterium tuberculosis
VGALLRYAATNRLGS

SEQ ID NO: 197306 - protein, 15 aa, Mycobacterium tuberculosis
GALLRYAATNRLGSH

SEQ ID NO: 197307 - protein, 15 aa, Mycobacterium tuberculosis
ALLRYAATNRLGSHR

SEQ ID NO: 197308 - protein, 15 aa, Mycobacterium tuberculosis
LLRYAATNRLGSHRS

SEQ ID NO: 197309 - protein, 16 aa, Mycobacterium tuberculosis
MRSERLRWLVAAEGPF

SEQ ID NO: 197310 - protein, 16 aa, Mycobacterium tuberculosis
RSERLRWLVAAEGPFA

SEQ ID NO: 197311 - protein, 16 aa, Mycobacterium tuberculosis
SERLRWLVAAEGPFAS

SEQ ID NO: 197312 - protein, 16 aa, Mycobacterium tuberculosis
ERLRWLVAAEGPFASV

SEQ ID NO: 197313 - protein, 16 aa, Mycobacterium tuberculosis
RLRWLVAAEGPFASVY

SEQ ID NO: 197314 - protein, 16 aa, Mycobacterium tuberculosis
LRWLVAAEGPFASVYF

SEQ ID NO: 197315 - protein, 16 aa, Mycobacterium tuberculosis
RWLVAAEGPFASVYFD

SEQ ID NO: 197316 - protein, 16 aa, Mycobacterium tuberculosis
WLVAAEGPFASVYFDD

SEQ ID NO: 197317 - protein, 16 aa, Mycobacterium tuberculosis
LVAAEGPFASVYFDDS

SEQ ID NO: 197318 - protein, 16 aa, Mycobacterium tuberculosis
VAAEGPFASVYFDDSH

SEQ ID NO: 197319 - protein, 16 aa, Mycobacterium tuberculosis
AAEGPFASVYFDDSHD

SEQ ID NO: 197320 - protein, 16 aa, Mycobacterium tuberculosis
AEGPFASVYFDDSHDT

SEQ ID NO: 197321 - protein, 16 aa, Mycobacterium tuberculosis
EGPFASVYFDDSHDTL

SEQ ID NO: 197322 - protein, 16 aa, Mycobacterium tuberculosis
GPFASVYFDDSHDTLD

SEQ ID NO: 197323 - protein, 16 aa, Mycobacterium tuberculosis
PFASVYFDDSHDTLDA

SEQ ID NO: 197324 - protein, 16 aa, Mycobacterium tuberculosis
FASVYFDDSHDTLDAV

SEQ ID NO: 197325 - protein, 16 aa, Mycobacterium tuberculosis
ASVYFDDSHDTLDAVE

SEQ ID NO: 197326 - protein, 16 aa, Mycobacterium tuberculosis
SVYFDDSHDTLDAVER

SEQ ID NO: 197327 - protein, 16 aa, Mycobacterium tuberculosis
VYFDDSHDTLDAVERR

SEQ ID NO: 197328 - protein, 16 aa, Mycobacterium tuberculosis
YFDDSHDTLDAVERRE

SEQ ID NO: 197329 - protein, 16 aa, Mycobacterium tuberculosis
FDDSHDTLDAVERREA

SEQ ID NO: 197330 - protein, 16 aa, Mycobacterium tuberculosis
DDSHDTLDAVERREAT

SEQ ID NO: 197331 - protein, 16 aa, Mycobacterium tuberculosis
DSHDTLDAVERREATW

SEQ ID NO: 197332 - protein, 16 aa, Mycobacterium tuberculosis
SHDTLDAVERREATWR

SEQ ID NO: 197333 - protein, 16 aa, Mycobacterium tuberculosis
HDTLDAVERREATWRD

SEQ ID NO: 197334 - protein, 16 aa, Mycobacterium tuberculosis
DTLDAVERREATWRDV

SEQ ID NO: 197335 - protein, 16 aa, Mycobacterium tuberculosis
TLDAVERREATWRDVR

SEQ ID NO: 197336 - protein, 16 aa, Mycobacterium tuberculosis
LDAVERREATWRDVRK

SEQ ID NO: 197337 - protein, 16 aa, Mycobacterium tuberculosis
DAVERREATWRDVRKH

SEQ ID NO: 197338 - protein, 16 aa, Mycobacterium tuberculosis
AVERREATWRDVRKHL

SEQ ID NO: 197339 - protein, 16 aa, Mycobacterium tuberculosis
VERREATWRDVRKHLE

SEQ ID NO: 197340 - protein, 16 aa, Mycobacterium tuberculosis
ERREATWRDVRKHLES

SEQ ID NO: 197341 - protein, 16 aa, Mycobacterium tuberculosis
RREATWRDVRKHLESR

SEQ ID NO: 197342 - protein, 16 aa, Mycobacterium tuberculosis
REATWRDVRKHLESRD

SEQ ID NO: 197343 - protein, 16 aa, Mycobacterium tuberculosis
EATWRDVRKHLESRDA

SEQ ID NO: 197344 - protein, 16 aa, Mycobacterium tuberculosis
ATWRDVRKHLESRDAK

SEQ ID NO: 197345 - protein, 16 aa, Mycobacterium tuberculosis
TWRDVRKHLESRDAKQ

SEQ ID NO: 197346 - protein, 16 aa, Mycobacterium tuberculosis
WRDVRKHLESRDAKQE

SEQ ID NO: 197347 - protein, 16 aa, Mycobacterium tuberculosis
RDVRKHLESRDAKQEL

SEQ ID NO: 197348 - protein, 16 aa, Mycobacterium tuberculosis
DVRKHLESRDAKQELI

SEQ ID NO: 197349 - protein, 16 aa, Mycobacterium tuberculosis
VRKHLESRDAKQELID

SEQ ID NO: 197350 - protein, 16 aa, Mycobacterium tuberculosis
RKHLESRDAKQELIDS

SEQ ID NO: 197351 - protein, 16 aa, Mycobacterium tuberculosis
KHLESRDAKQELIDSL

SEQ ID NO: 197352 - protein, 16 aa, Mycobacterium tuberculosis
HLESRDAKQELIDSLE

SEQ ID NO: 197353 - protein, 16 aa, Mycobacterium tuberculosis
LESRDAKQELIDSLEE

SEQ ID NO: 197354 - protein, 16 aa, Mycobacterium tuberculosis
ESRDAKQELIDSLEEA

SEQ ID NO: 197355 - protein, 16 aa, Mycobacterium tuberculosis
SRDAKQELIDSLEEAV

SEQ ID NO: 197356 - protein, 16 aa, Mycobacterium tuberculosis
RDAKQELIDSLEEAVR

SEQ ID NO: 197357 - protein, 16 aa, Mycobacterium tuberculosis
DAKQELIDSLEEAVRD

SEQ ID NO: 197358 - protein, 16 aa, Mycobacterium tuberculosis
AKQELIDSLEEAVRDS

SEQ ID NO: 197359 - protein, 16 aa, Mycobacterium tuberculosis
KQELIDSLEEAVRDSR

SEQ ID NO: 197360 - protein, 16 aa, Mycobacterium tuberculosis
QELIDSLEEAVRDSRP

SEQ ID NO: 197361 - protein, 16 aa, Mycobacterium tuberculosis
ELIDSLEEAVRDSRPA

SEQ ID NO: 197362 - protein, 16 aa, Mycobacterium tuberculosis
LIDSLEEAVRDSRPAV

SEQ ID NO: 197363 - protein, 16 aa, Mycobacterium tuberculosis
IDSLEEAVRDSRPAVG

SEQ ID NO: 197364 - protein, 16 aa, Mycobacterium tuberculosis
DSLEEAVRDSRPAVGQ

SEQ ID NO: 197365 - protein, 16 aa, Mycobacterium tuberculosis
SLEEAVRDSRPAVGQR

SEQ ID NO: 197366 - protein, 16 aa, Mycobacterium tuberculosis
LEEAVRDSRPAVGQRG

SEQ ID NO: 197367 - protein, 16 aa, Mycobacterium tuberculosis
EEAVRDSRPAVGQRGR

SEQ ID NO: 197368 - protein, 16 aa, Mycobacterium tuberculosis
EAVRDSRPAVGQRGRA

SEQ ID NO: 197369 - protein, 16 aa, Mycobacterium tuberculosis
AVRDSRPAVGQRGRAL

SEQ ID NO: 197370 - protein, 16 aa, Mycobacterium tuberculosis
VRDSRPAVGQRGRALI

SEQ ID NO: 197371 - protein, 16 aa, Mycobacterium tuberculosis
RDSRPAVGQRGRALIA

SEQ ID NO: 197372 - protein, 16 aa, Mycobacterium tuberculosis
DSRPAVGQRGRALIAT

SEQ ID NO: 197373 - protein, 16 aa, Mycobacterium tuberculosis
SRPAVGQRGRALIATG

SEQ ID NO: 197374 - protein, 16 aa, Mycobacterium tuberculosis
RPAVGQRGRALIATGE

SEQ ID NO: 197375 - protein, 16 aa, Mycobacterium tuberculosis
PAVGQRGRALIATGEQ

SEQ ID NO: 197376 - protein, 16 aa, Mycobacterium tuberculosis
AVGQRGRALIATGEQV

SEQ ID NO: 197377 - protein, 16 aa, Mycobacterium tuberculosis
VGQRGRALIATGEQVL

SEQ ID NO: 197378 - protein, 16 aa, Mycobacterium tuberculosis
GQRGRALIATGEQVLV

SEQ ID NO: 197379 - protein, 16 aa, Mycobacterium tuberculosis
QRGRALIATGEQVLVN

SEQ ID NO: 197380 - protein, 16 aa, Mycobacterium tuberculosis
RGRALIATGEQVLVNE

SEQ ID NO: 197381 - protein, 16 aa, Mycobacterium tuberculosis
GRALIATGEQVLVNEH

SEQ ID NO: 197382 - protein, 16 aa, Mycobacterium tuberculosis
RALIATGEQVLVNEHL

SEQ ID NO: 197383 - protein, 16 aa, Mycobacterium tuberculosis
ALIATGEQVLVNEHLI

SEQ ID NO: 197384 - protein, 16 aa, Mycobacterium tuberculosis
LIATGEQVLVNEHLIG

SEQ ID NO: 197385 - protein, 16 aa, Mycobacterium tuberculosis
IATGEQVLVNEHLIGP

SEQ ID NO: 197386 - protein, 16 aa, Mycobacterium tuberculosis
ATGEQVLVNEHLIGPP

SEQ ID NO: 197387 - protein, 16 aa, Mycobacterium tuberculosis
TGEQVLVNEHLIGPPP

SEQ ID NO: 197388 - protein, 16 aa, Mycobacterium tuberculosis
GEQVLVNEHLIGPPPA

SEQ ID NO: 197389 - protein, 16 aa, Mycobacterium tuberculosis
EQVLVNEHLIGPPPAT

SEQ ID NO: 197390 - protein, 16 aa, Mycobacterium tuberculosis
QVLVNEHLIGPPPATV

SEQ ID NO: 197391 - protein, 16 aa, Mycobacterium tuberculosis
VLVNEHLIGPPPATVI

SEQ ID NO: 197392 - protein, 16 aa, Mycobacterium tuberculosis
LVNEHLIGPPPATVIR

SEQ ID NO: 197393 - protein, 16 aa, Mycobacterium tuberculosis
VNEHLIGPPPATVIRL

SEQ ID NO: 197394 - protein, 16 aa, Mycobacterium tuberculosis
NEHLIGPPPATVIRLS

SEQ ID NO: 197395 - protein, 16 aa, Mycobacterium tuberculosis
EHLIGPPPATVIRLSD

SEQ ID NO: 197396 - protein, 16 aa, Mycobacterium tuberculosis
HLIGPPPATVIRLSDY

SEQ ID NO: 197397 - protein, 16 aa, Mycobacterium tuberculosis
LIGPPPATVIRLSDYP

SEQ ID NO: 197398 - protein, 16 aa, Mycobacterium tuberculosis
IGPPPATVIRLSDYPY

SEQ ID NO: 197399 - protein, 16 aa, Mycobacterium tuberculosis
GPPPATVIRLSDYPYV

SEQ ID NO: 197400 - protein, 16 aa, Mycobacterium tuberculosis
PPPATVIRLSDYPYVV

SEQ ID NO: 197401 - protein, 16 aa, Mycobacterium tuberculosis
PPATVIRLSDYPYVVP

SEQ ID NO: 197402 - protein, 16 aa, Mycobacterium tuberculosis
PATVIRLSDYPYVVPL

SEQ ID NO: 197403 - protein, 16 aa, Mycobacterium tuberculosis
ATVIRLSDYPYVVPLI

SEQ ID NO: 197404 - protein, 16 aa, Mycobacterium tuberculosis
TVIRLSDYPYVVPLID

SEQ ID NO: 197405 - protein, 16 aa, Mycobacterium tuberculosis
VIRLSDYPYVVPLIDL

SEQ ID NO: 197406 - protein, 16 aa, Mycobacterium tuberculosis
IRLSDYPYVVPLIDLE

SEQ ID NO: 197407 - protein, 16 aa, Mycobacterium tuberculosis
RLSDYPYVVPLIDLEM

SEQ ID NO: 197408 - protein, 16 aa, Mycobacterium tuberculosis
LSDYPYVVPLIDLEMR

SEQ ID NO: 197409 - protein, 16 aa, Mycobacterium tuberculosis
SDYPYVVPLIDLEMRR

SEQ ID NO: 197410 - protein, 16 aa, Mycobacterium tuberculosis
DYPYVVPLIDLEMRRP

SEQ ID NO: 197411 - protein, 16 aa, Mycobacterium tuberculosis
YPYVVPLIDLEMRRPT

SEQ ID NO: 197412 - protein, 16 aa, Mycobacterium tuberculosis
PYVVPLIDLEMRRPTY

SEQ ID NO: 197413 - protein, 16 aa, Mycobacterium tuberculosis
YVVPLIDLEMRRPTYV

SEQ ID NO: 197414 - protein, 16 aa, Mycobacterium tuberculosis
VVPLIDLEMRRPTYVF

SEQ ID NO: 197415 - protein, 16 aa, Mycobacterium tuberculosis
VPLIDLEMRRPTYVFA

SEQ ID NO: 197416 - protein, 16 aa, Mycobacterium tuberculosis
PLIDLEMRRPTYVFAA

SEQ ID NO: 197417 - protein, 16 aa, Mycobacterium tuberculosis
LIDLEMRRPTYVFAAV

SEQ ID NO: 197418 - protein, 16 aa, Mycobacterium tuberculosis
IDLEMRRPTYVFAAVD

SEQ ID NO: 197419 - protein, 16 aa, Mycobacterium tuberculosis
DLEMRRPTYVFAAVDH

SEQ ID NO: 197420 - protein, 16 aa, Mycobacterium tuberculosis
LEMRRPTYVFAAVDHT

SEQ ID NO: 197421 - protein, 16 aa, Mycobacterium tuberculosis
EMRRPTYVFAAVDHTG

SEQ ID NO: 197422 - protein, 16 aa, Mycobacterium tuberculosis
MRRPTYVFAAVDHTGA

SEQ ID NO: 197423 - protein, 16 aa, Mycobacterium tuberculosis
RRPTYVFAAVDHTGAD

SEQ ID NO: 197424 - protein, 16 aa, Mycobacterium tuberculosis
RPTYVFAAVDHTGADV

SEQ ID NO: 197425 - protein, 16 aa, Mycobacterium tuberculosis
PTYVFAAVDHTGADVK

SEQ ID NO: 197426 - protein, 16 aa, Mycobacterium tuberculosis
TYVFAAVDHTGADVKL

SEQ ID NO: 197427 - protein, 16 aa, Mycobacterium tuberculosis
YVFAAVDHTGADVKLY

SEQ ID NO: 197428 - protein, 16 aa, Mycobacterium tuberculosis
VFAAVDHTGADVKLYQ

SEQ ID NO: 197429 - protein, 16 aa, Mycobacterium tuberculosis
FAAVDHTGADVKLYQG

SEQ ID NO: 197430 - protein, 16 aa, Mycobacterium tuberculosis
AAVDHTGADVKLYQGA

SEQ ID NO: 197431 - protein, 16 aa, Mycobacterium tuberculosis
AVDHTGADVKLYQGAT

SEQ ID NO: 197432 - protein, 16 aa, Mycobacterium tuberculosis
VDHTGADVKLYQGATI

SEQ ID NO: 197433 - protein, 16 aa, Mycobacterium tuberculosis
DHTGADVKLYQGATIS

SEQ ID NO: 197434 - protein, 16 aa, Mycobacterium tuberculosis
HTGADVKLYQGATISS

SEQ ID NO: 197435 - protein, 16 aa, Mycobacterium tuberculosis
TGADVKLYQGATISST

SEQ ID NO: 197436 - protein, 16 aa, Mycobacterium tuberculosis
GADVKLYQGATISSTK

SEQ ID NO: 197437 - protein, 16 aa, Mycobacterium tuberculosis
ADVKLYQGATISSTKI

SEQ ID NO: 197438 - protein, 16 aa, Mycobacterium tuberculosis
DVKLYQGATISSTKID

SEQ ID NO: 197439 - protein, 16 aa, Mycobacterium tuberculosis
VKLYQGATISSTKIDG

SEQ ID NO: 197440 - protein, 16 aa, Mycobacterium tuberculosis
KLYQGATISSTKIDGV

SEQ ID NO: 197441 - protein, 16 aa, Mycobacterium tuberculosis
LYQGATISSTKIDGVG

SEQ ID NO: 197442 - protein, 16 aa, Mycobacterium tuberculosis
YQGATISSTKIDGVGY

SEQ ID NO: 197443 - protein, 16 aa, Mycobacterium tuberculosis
QGATISSTKIDGVGYP

SEQ ID NO: 197444 - protein, 16 aa, Mycobacterium tuberculosis
GATISSTKIDGVGYPV

SEQ ID NO: 197445 - protein, 16 aa, Mycobacterium tuberculosis
ATISSTKIDGVGYPVH

SEQ ID NO: 197446 - protein, 16 aa, Mycobacterium tuberculosis
TISSTKIDGVGYPVHK

SEQ ID NO: 197447 - protein, 16 aa, Mycobacterium tuberculosis
ISSTKIDGVGYPVHKP

SEQ ID NO: 197448 - protein, 16 aa, Mycobacterium tuberculosis
SSTKIDGVGYPVHKPV

SEQ ID NO: 197449 - protein, 16 aa, Mycobacterium tuberculosis
STKIDGVGYPVHKPVT

SEQ ID NO: 197450 - protein, 16 aa, Mycobacterium tuberculosis
TKIDGVGYPVHKPVTA

SEQ ID NO: 197451 - protein, 16 aa, Mycobacterium tuberculosis
KIDGVGYPVHKPVTAG

SEQ ID NO: 197452 - protein, 16 aa, Mycobacterium tuberculosis
IDGVGYPVHKPVTAGW

SEQ ID NO: 197453 - protein, 16 aa, Mycobacterium tuberculosis
DGVGYPVHKPVTAGWN

SEQ ID NO: 197454 - protein, 16 aa, Mycobacterium tuberculosis
GVGYPVHKPVTAGWNG

SEQ ID NO: 197455 - protein, 16 aa, Mycobacterium tuberculosis
VGYPVHKPVTAGWNGY

SEQ ID NO: 197456 - protein, 16 aa, Mycobacterium tuberculosis
GYPVHKPVTAGWNGYG

SEQ ID NO: 197457 - protein, 16 aa, Mycobacterium tuberculosis
YPVHKPVTAGWNGYGD

SEQ ID NO: 197458 - protein, 16 aa, Mycobacterium tuberculosis
PVHKPVTAGWNGYGDF

SEQ ID NO: 197459 - protein, 16 aa, Mycobacterium tuberculosis
VHKPVTAGWNGYGDFQ

SEQ ID NO: 197460 - protein, 16 aa, Mycobacterium tuberculosis
HKPVTAGWNGYGDFQH

SEQ ID NO: 197461 - protein, 16 aa, Mycobacterium tuberculosis
KPVTAGWNGYGDFQHT

SEQ ID NO: 197462 - protein, 16 aa, Mycobacterium tuberculosis
PVTAGWNGYGDFQHTT

SEQ ID NO: 197463 - protein, 16 aa, Mycobacterium tuberculosis
VTAGWNGYGDFQHTTE

SEQ ID NO: 197464 - protein, 16 aa, Mycobacterium tuberculosis
TAGWNGYGDFQHTTEE

SEQ ID NO: 197465 - protein, 16 aa, Mycobacterium tuberculosis
AGWNGYGDFQHTTEEA

SEQ ID NO: 197466 - protein, 16 aa, Mycobacterium tuberculosis
GWNGYGDFQHTTEEAI

SEQ ID NO: 197467 - protein, 16 aa, Mycobacterium tuberculosis
WNGYGDFQHTTEEAIR

SEQ ID NO: 197468 - protein, 16 aa, Mycobacterium tuberculosis
NGYGDFQHTTEEAIRM

SEQ ID NO: 197469 - protein, 16 aa, Mycobacterium tuberculosis
GYGDFQHTTEEAIRMN

SEQ ID NO: 197470 - protein, 16 aa, Mycobacterium tuberculosis
YGDFQHTTEEAIRMNC

SEQ ID NO: 197471 - protein, 16 aa, Mycobacterium tuberculosis
GDFQHTTEEAIRMNCR

SEQ ID NO: 197472 - protein, 16 aa, Mycobacterium tuberculosis
DFQHTTEEAIRMNCRA

SEQ ID NO: 197473 - protein, 16 aa, Mycobacterium tuberculosis
FQHTTEEAIRMNCRAV

SEQ ID NO: 197474 - protein, 16 aa, Mycobacterium tuberculosis
QHTTEEAIRMNCRAVA

SEQ ID NO: 197475 - protein, 16 aa, Mycobacterium tuberculosis
HTTEEAIRMNCRAVAD

SEQ ID NO: 197476 - protein, 16 aa, Mycobacterium tuberculosis
TTEEAIRMNCRAVADH

SEQ ID NO: 197477 - protein, 16 aa, Mycobacterium tuberculosis
TEEAIRMNCRAVADHL

SEQ ID NO: 197478 - protein, 16 aa, Mycobacterium tuberculosis
EEAIRMNCRAVADHLT

SEQ ID NO: 197479 - protein, 16 aa, Mycobacterium tuberculosis
EAIRMNCRAVADHLTR

SEQ ID NO: 197480 - protein, 16 aa, Mycobacterium tuberculosis
AIRMNCRAVADHLTRL

SEQ ID NO: 197481 - protein, 16 aa, Mycobacterium tuberculosis
IRMNCRAVADHLTRLV

SEQ ID NO: 197482 - protein, 16 aa, Mycobacterium tuberculosis
RMNCRAVADHLTRLVD

SEQ ID NO: 197483 - protein, 16 aa, Mycobacterium tuberculosis
MNCRAVADHLTRLVDA

SEQ ID NO: 197484 - protein, 16 aa, Mycobacterium tuberculosis
NCRAVADHLTRLVDAA

SEQ ID NO: 197485 - protein, 16 aa, Mycobacterium tuberculosis
CRAVADHLTRLVDAAD

SEQ ID NO: 197486 - protein, 16 aa, Mycobacterium tuberculosis
RAVADHLTRLVDAADP

SEQ ID NO: 197487 - protein, 16 aa, Mycobacterium tuberculosis
AVADHLTRLVDAADPE

SEQ ID NO: 197488 - protein, 16 aa, Mycobacterium tuberculosis
VADHLTRLVDAADPEV

SEQ ID NO: 197489 - protein, 16 aa, Mycobacterium tuberculosis
ADHLTRLVDAADPEVV

SEQ ID NO: 197490 - protein, 16 aa, Mycobacterium tuberculosis
DHLTRLVDAADPEVVF

SEQ ID NO: 197491 - protein, 16 aa, Mycobacterium tuberculosis
HLTRLVDAADPEVVFV

SEQ ID NO: 197492 - protein, 16 aa, Mycobacterium tuberculosis
LTRLVDAADPEVVFVS

SEQ ID NO: 197493 - protein, 16 aa, Mycobacterium tuberculosis
TRLVDAADPEVVFVSG

SEQ ID NO: 197494 - protein, 16 aa, Mycobacterium tuberculosis
RLVDAADPEVVFVSGE

SEQ ID NO: 197495 - protein, 16 aa, Mycobacterium tuberculosis
LVDAADPEVVFVSGEV

SEQ ID NO: 197496 - protein, 16 aa, Mycobacterium tuberculosis
VDAADPEVVFVSGEVR

SEQ ID NO: 197497 - protein, 16 aa, Mycobacterium tuberculosis
DAADPEVVFVSGEVRS

SEQ ID NO: 197498 - protein, 16 aa, Mycobacterium tuberculosis
AADPEVVFVSGEVRSR

SEQ ID NO: 197499 - protein, 16 aa, Mycobacterium tuberculosis
ADPEVVFVSGEVRSRT

SEQ ID NO: 197500 - protein, 16 aa, Mycobacterium tuberculosis
DPEVVFVSGEVRSRTD

SEQ ID NO: 197501 - protein, 16 aa, Mycobacterium tuberculosis
PEVVFVSGEVRSRTDL

SEQ ID NO: 197502 - protein, 16 aa, Mycobacterium tuberculosis
EVVFVSGEVRSRTDLL

SEQ ID NO: 197503 - protein, 16 aa, Mycobacterium tuberculosis
VVFVSGEVRSRTDLLS

SEQ ID NO: 197504 - protein, 16 aa, Mycobacterium tuberculosis
VFVSGEVRSRTDLLST

SEQ ID NO: 197505 - protein, 16 aa, Mycobacterium tuberculosis
FVSGEVRSRTDLLSTL

SEQ ID NO: 197506 - protein, 16 aa, Mycobacterium tuberculosis
VSGEVRSRTDLLSTLP

SEQ ID NO: 197507 - protein, 16 aa, Mycobacterium tuberculosis
SGEVRSRTDLLSTLPQ

SEQ ID NO: 197508 - protein, 16 aa, Mycobacterium tuberculosis
GEVRSRTDLLSTLPQR

SEQ ID NO: 197509 - protein, 16 aa, Mycobacterium tuberculosis
EVRSRTDLLSTLPQRV

SEQ ID NO: 197510 - protein, 16 aa, Mycobacterium tuberculosis
VRSRTDLLSTLPQRVA

SEQ ID NO: 197511 - protein, 16 aa, Mycobacterium tuberculosis
RSRTDLLSTLPQRVAV

SEQ ID NO: 197512 - protein, 16 aa, Mycobacterium tuberculosis
SRTDLLSTLPQRVAVR

SEQ ID NO: 197513 - protein, 16 aa, Mycobacterium tuberculosis
RTDLLSTLPQRVAVRV

SEQ ID NO: 197514 - protein, 16 aa, Mycobacterium tuberculosis
TDLLSTLPQRVAVRVS

SEQ ID NO: 197515 - protein, 16 aa, Mycobacterium tuberculosis
DLLSTLPQRVAVRVSQ

SEQ ID NO: 197516 - protein, 16 aa, Mycobacterium tuberculosis
LLSTLPQRVAVRVSQL

SEQ ID NO: 197517 - protein, 16 aa, Mycobacterium tuberculosis
LSTLPQRVAVRVSQLH

SEQ ID NO: 197518 - protein, 16 aa, Mycobacterium tuberculosis
STLPQRVAVRVSQLHA

SEQ ID NO: 197519 - protein, 16 aa, Mycobacterium tuberculosis
TLPQRVAVRVSQLHAG

SEQ ID NO: 197520 - protein, 16 aa, Mycobacterium tuberculosis
LPQRVAVRVSQLHAGP

SEQ ID NO: 197521 - protein, 16 aa, Mycobacterium tuberculosis
PQRVAVRVSQLHAGPR

SEQ ID NO: 197522 - protein, 16 aa, Mycobacterium tuberculosis
QRVAVRVSQLHAGPRK

SEQ ID NO: 197523 - protein, 16 aa, Mycobacterium tuberculosis
RVAVRVSQLHAGPRKS

SEQ ID NO: 197524 - protein, 16 aa, Mycobacterium tuberculosis
VAVRVSQLHAGPRKSA

SEQ ID NO: 197525 - protein, 16 aa, Mycobacterium tuberculosis
AVRVSQLHAGPRKSAL

SEQ ID NO: 197526 - protein, 16 aa, Mycobacterium tuberculosis
VRVSQLHAGPRKSALD

SEQ ID NO: 197527 - protein, 16 aa, Mycobacterium tuberculosis
RVSQLHAGPRKSALDE

SEQ ID NO: 197528 - protein, 16 aa, Mycobacterium tuberculosis
VSQLHAGPRKSALDEE

SEQ ID NO: 197529 - protein, 16 aa, Mycobacterium tuberculosis
SQLHAGPRKSALDEEE

SEQ ID NO: 197530 - protein, 16 aa, Mycobacterium tuberculosis
QLHAGPRKSALDEEEI

SEQ ID NO: 197531 - protein, 16 aa, Mycobacterium tuberculosis
LHAGPRKSALDEEEIW

SEQ ID NO: 197532 - protein, 16 aa, Mycobacterium tuberculosis
HAGPRKSALDEEEIWD

SEQ ID NO: 197533 - protein, 16 aa, Mycobacterium tuberculosis
AGPRKSALDEEEIWDL

SEQ ID NO: 197534 - protein, 16 aa, Mycobacterium tuberculosis
GPRKSALDEEEIWDLT

SEQ ID NO: 197535 - protein, 16 aa, Mycobacterium tuberculosis
PRKSALDEEEIWDLTS

SEQ ID NO: 197536 - protein, 16 aa, Mycobacterium tuberculosis
RKSALDEEEIWDLTSA

SEQ ID NO: 197537 - protein, 16 aa, Mycobacterium tuberculosis
KSALDEEEIWDLTSAE

SEQ ID NO: 197538 - protein, 16 aa, Mycobacterium tuberculosis
SALDEEEIWDLTSAEF

SEQ ID NO: 197539 - protein, 16 aa, Mycobacterium tuberculosis
ALDEEEIWDLTSAEFT

SEQ ID NO: 197540 - protein, 16 aa, Mycobacterium tuberculosis
LDEEEIWDLTSAEFTR

SEQ ID NO: 197541 - protein, 16 aa, Mycobacterium tuberculosis
DEEEIWDLTSAEFTRR

SEQ ID NO: 197542 - protein, 16 aa, Mycobacterium tuberculosis
EEEIWDLTSAEFTRRR

SEQ ID NO: 197543 - protein, 16 aa, Mycobacterium tuberculosis
EEIWDLTSAEFTRRRY

SEQ ID NO: 197544 - protein, 16 aa, Mycobacterium tuberculosis
EIWDLTSAEFTRRRYA

SEQ ID NO: 197545 - protein, 16 aa, Mycobacterium tuberculosis
IWDLTSAEFTRRRYAE

SEQ ID NO: 197546 - protein, 16 aa, Mycobacterium tuberculosis
WDLTSAEFTRRRYAEI

SEQ ID NO: 197547 - protein, 16 aa, Mycobacterium tuberculosis
DLTSAEFTRRRYAEIT

SEQ ID NO: 197548 - protein, 16 aa, Mycobacterium tuberculosis
LTSAEFTRRRYAEITN

SEQ ID NO: 197549 - protein, 16 aa, Mycobacterium tuberculosis
TSAEFTRRRYAEITNV

SEQ ID NO: 197550 - protein, 16 aa, Mycobacterium tuberculosis
SAEFTRRRYAEITNVA

SEQ ID NO: 197551 - protein, 16 aa, Mycobacterium tuberculosis
AEFTRRRYAEITNVAQ

SEQ ID NO: 197552 - protein, 16 aa, Mycobacterium tuberculosis
EFTRRRYAEITNVAQQ

SEQ ID NO: 197553 - protein, 16 aa, Mycobacterium tuberculosis
FTRRRYAEITNVAQQF

SEQ ID NO: 197554 - protein, 16 aa, Mycobacterium tuberculosis
TRRRYAEITNVAQQFE

SEQ ID NO: 197555 - protein, 16 aa, Mycobacterium tuberculosis
RRRYAEITNVAQQFEA

SEQ ID NO: 197556 - protein, 16 aa, Mycobacterium tuberculosis
RRYAEITNVAQQFEAE

SEQ ID NO: 197557 - protein, 16 aa, Mycobacterium tuberculosis
RYAEITNVAQQFEAEI

SEQ ID NO: 197558 - protein, 16 aa, Mycobacterium tuberculosis
YAEITNVAQQFEAEIG

SEQ ID NO: 197559 - protein, 16 aa, Mycobacterium tuberculosis
AEITNVAQQFEAEIGR

SEQ ID NO: 197560 - protein, 16 aa, Mycobacterium tuberculosis
EITNVAQQFEAEIGRG

SEQ ID NO: 197561 - protein, 16 aa, Mycobacterium tuberculosis
ITNVAQQFEAEIGRGS

SEQ ID NO: 197562 - protein, 16 aa, Mycobacterium tuberculosis
TNVAQQFEAEIGRGSG

SEQ ID NO: 197563 - protein, 16 aa, Mycobacterium tuberculosis
NVAQQFEAEIGRGSGL

SEQ ID NO: 197564 - protein, 16 aa, Mycobacterium tuberculosis
VAQQFEAEIGRGSGLA

SEQ ID NO: 197565 - protein, 16 aa, Mycobacterium tuberculosis
AQQFEAEIGRGSGLAA

SEQ ID NO: 197566 - protein, 16 aa, Mycobacterium tuberculosis
QQFEAEIGRGSGLAAQ

SEQ ID NO: 197567 - protein, 16 aa, Mycobacterium tuberculosis
QFEAEIGRGSGLAAQG

SEQ ID NO: 197568 - protein, 16 aa, Mycobacterium tuberculosis
FEAEIGRGSGLAAQGL

SEQ ID NO: 197569 - protein, 16 aa, Mycobacterium tuberculosis
EAEIGRGSGLAAQGLA

SEQ ID NO: 197570 - protein, 16 aa, Mycobacterium tuberculosis
AEIGRGSGLAAQGLAE

SEQ ID NO: 197571 - protein, 16 aa, Mycobacterium tuberculosis
EIGRGSGLAAQGLAEV

SEQ ID NO: 197572 - protein, 16 aa, Mycobacterium tuberculosis
IGRGSGLAAQGLAEVC

SEQ ID NO: 197573 - protein, 16 aa, Mycobacterium tuberculosis
GRGSGLAAQGLAEVCA

SEQ ID NO: 197574 - protein, 16 aa, Mycobacterium tuberculosis
RGSGLAAQGLAEVCAA

SEQ ID NO: 197575 - protein, 16 aa, Mycobacterium tuberculosis
GSGLAAQGLAEVCAAL

SEQ ID NO: 197576 - protein, 16 aa, Mycobacterium tuberculosis
SGLAAQGLAEVCAALR

SEQ ID NO: 197577 - protein, 16 aa, Mycobacterium tuberculosis
GLAAQGLAEVCAALRD

SEQ ID NO: 197578 - protein, 16 aa, Mycobacterium tuberculosis
LAAQGLAEVCAALRDG

SEQ ID NO: 197579 - protein, 16 aa, Mycobacterium tuberculosis
AAQGLAEVCAALRDGD

SEQ ID NO: 197580 - protein, 16 aa, Mycobacterium tuberculosis
AQGLAEVCAALRDGDV

SEQ ID NO: 197581 - protein, 16 aa, Mycobacterium tuberculosis
QGLAEVCAALRDGDVD

SEQ ID NO: 197582 - protein, 16 aa, Mycobacterium tuberculosis
GLAEVCAALRDGDVDT

SEQ ID NO: 197583 - protein, 16 aa, Mycobacterium tuberculosis
LAEVCAALRDGDVDTL

SEQ ID NO: 197584 - protein, 16 aa, Mycobacterium tuberculosis
AEVCAALRDGDVDTLI

SEQ ID NO: 197585 - protein, 16 aa, Mycobacterium tuberculosis
EVCAALRDGDVDTLIV

SEQ ID NO: 197586 - protein, 16 aa, Mycobacterium tuberculosis
VCAALRDGDVDTLIVG

SEQ ID NO: 197587 - protein, 16 aa, Mycobacterium tuberculosis
CAALRDGDVDTLIVGE

SEQ ID NO: 197588 - protein, 16 aa, Mycobacterium tuberculosis
AALRDGDVDTLIVGEL

SEQ ID NO: 197589 - protein, 16 aa, Mycobacterium tuberculosis
ALRDGDVDTLIVGELG

SEQ ID NO: 197590 - protein, 16 aa, Mycobacterium tuberculosis
LRDGDVDTLIVGELGE

SEQ ID NO: 197591 - protein, 16 aa, Mycobacterium tuberculosis
RDGDVDTLIVGELGEA

SEQ ID NO: 197592 - protein, 16 aa, Mycobacterium tuberculosis
DGDVDTLIVGELGEAT

SEQ ID NO: 197593 - protein, 16 aa, Mycobacterium tuberculosis
GDVDTLIVGELGEATV

SEQ ID NO: 197594 - protein, 16 aa, Mycobacterium tuberculosis
DVDTLIVGELGEATVV

SEQ ID NO: 197595 - protein, 16 aa, Mycobacterium tuberculosis
VDTLIVGELGEATVVT

SEQ ID NO: 197596 - protein, 16 aa, Mycobacterium tuberculosis
DTLIVGELGEATVVTG

SEQ ID NO: 197597 - protein, 16 aa, Mycobacterium tuberculosis
TLIVGELGEATVVTGK

SEQ ID NO: 197598 - protein, 16 aa, Mycobacterium tuberculosis
LIVGELGEATVVTGKA

SEQ ID NO: 197599 - protein, 16 aa, Mycobacterium tuberculosis
IVGELGEATVVTGKAR

SEQ ID NO: 197600 - protein, 16 aa, Mycobacterium tuberculosis
VGELGEATVVTGKART

SEQ ID NO: 197601 - protein, 16 aa, Mycobacterium tuberculosis
GELGEATVVTGKARTT

SEQ ID NO: 197602 - protein, 16 aa, Mycobacterium tuberculosis
ELGEATVVTGKARTTV

SEQ ID NO: 197603 - protein, 16 aa, Mycobacterium tuberculosis
LGEATVVTGKARTTVA

SEQ ID NO: 197604 - protein, 16 aa, Mycobacterium tuberculosis
GEATVVTGKARTTVAR

SEQ ID NO: 197605 - protein, 16 aa, Mycobacterium tuberculosis
EATVVTGKARTTVARD

SEQ ID NO: 197606 - protein, 16 aa, Mycobacterium tuberculosis
ATVVTGKARTTVARDA

SEQ ID NO: 197607 - protein, 16 aa, Mycobacterium tuberculosis
TVVTGKARTTVARDAD

SEQ ID NO: 197608 - protein, 16 aa, Mycobacterium tuberculosis
VVTGKARTTVARDADM

SEQ ID NO: 197609 - protein, 16 aa, Mycobacterium tuberculosis
VTGKARTTVARDADML

SEQ ID NO: 197610 - protein, 16 aa, Mycobacterium tuberculosis
TGKARTTVARDADMLS

SEQ ID NO: 197611 - protein, 16 aa, Mycobacterium tuberculosis
GKARTTVARDADMLSE

SEQ ID NO: 197612 - protein, 16 aa, Mycobacterium tuberculosis
KARTTVARDADMLSEL

SEQ ID NO: 197613 - protein, 16 aa, Mycobacterium tuberculosis
ARTTVARDADMLSELG

SEQ ID NO: 197614 - protein, 16 aa, Mycobacterium tuberculosis
RTTVARDADMLSELGE

SEQ ID NO: 197615 - protein, 16 aa, Mycobacterium tuberculosis
TTVARDADMLSELGEP

SEQ ID NO: 197616 - protein, 16 aa, Mycobacterium tuberculosis
TVARDADMLSELGEPV

SEQ ID NO: 197617 - protein, 16 aa, Mycobacterium tuberculosis
VARDADMLSELGEPVD

SEQ ID NO: 197618 - protein, 16 aa, Mycobacterium tuberculosis
ARDADMLSELGEPVDR

SEQ ID NO: 197619 - protein, 16 aa, Mycobacterium tuberculosis
RDADMLSELGEPVDRV

SEQ ID NO: 197620 - protein, 16 aa, Mycobacterium tuberculosis
DADMLSELGEPVDRVA

SEQ ID NO: 197621 - protein, 16 aa, Mycobacterium tuberculosis
ADMLSELGEPVDRVAR

SEQ ID NO: 197622 - protein, 16 aa, Mycobacterium tuberculosis
DMLSELGEPVDRVARA

SEQ ID NO: 197623 - protein, 16 aa, Mycobacterium tuberculosis
MLSELGEPVDRVARAD

SEQ ID NO: 197624 - protein, 16 aa, Mycobacterium tuberculosis
LSELGEPVDRVARADE

SEQ ID NO: 197625 - protein, 16 aa, Mycobacterium tuberculosis
SELGEPVDRVARADEA

SEQ ID NO: 197626 - protein, 16 aa, Mycobacterium tuberculosis
ELGEPVDRVARADEAL

SEQ ID NO: 197627 - protein, 16 aa, Mycobacterium tuberculosis
LGEPVDRVARADEALP

SEQ ID NO: 197628 - protein, 16 aa, Mycobacterium tuberculosis
GEPVDRVARADEALPF

SEQ ID NO: 197629 - protein, 16 aa, Mycobacterium tuberculosis
EPVDRVARADEALPFA

SEQ ID NO: 197630 - protein, 16 aa, Mycobacterium tuberculosis
PVDRVARADEALPFAA

SEQ ID NO: 197631 - protein, 16 aa, Mycobacterium tuberculosis
VDRVARADEALPFAAI

SEQ ID NO: 197632 - protein, 16 aa, Mycobacterium tuberculosis
DRVARADEALPFAAIA

SEQ ID NO: 197633 - protein, 16 aa, Mycobacterium tuberculosis
RVARADEALPFAAIAV

SEQ ID NO: 197634 - protein, 16 aa, Mycobacterium tuberculosis
VARADEALPFAAIAVG

SEQ ID NO: 197635 - protein, 16 aa, Mycobacterium tuberculosis
ARADEALPFAAIAVGA

SEQ ID NO: 197636 - protein, 16 aa, Mycobacterium tuberculosis
RADEALPFAAIAVGAA

SEQ ID NO: 197637 - protein, 16 aa, Mycobacterium tuberculosis
ADEALPFAAIAVGAAL

SEQ ID NO: 197638 - protein, 16 aa, Mycobacterium tuberculosis
DEALPFAAIAVGAALV

SEQ ID NO: 197639 - protein, 16 aa, Mycobacterium tuberculosis
EALPFAAIAVGAALVR

SEQ ID NO: 197640 - protein, 16 aa, Mycobacterium tuberculosis
ALPFAAIAVGAALVRD

SEQ ID NO: 197641 - protein, 16 aa, Mycobacterium tuberculosis
LPFAAIAVGAALVRDD

SEQ ID NO: 197642 - protein, 16 aa, Mycobacterium tuberculosis
PFAAIAVGAALVRDDN

SEQ ID NO: 197643 - protein, 16 aa, Mycobacterium tuberculosis
FAAIAVGAALVRDDNR

SEQ ID NO: 197644 - protein, 16 aa, Mycobacterium tuberculosis
AAIAVGAALVRDDNRI

SEQ ID NO: 197645 - protein, 16 aa, Mycobacterium tuberculosis
AIAVGAALVRDDNRIA

SEQ ID NO: 197646 - protein, 16 aa, Mycobacterium tuberculosis
IAVGAALVRDDNRIAP

SEQ ID NO: 197647 - protein, 16 aa, Mycobacterium tuberculosis
AVGAALVRDDNRIAPL

SEQ ID NO: 197648 - protein, 16 aa, Mycobacterium tuberculosis
VGAALVRDDNRIAPLD

SEQ ID NO: 197649 - protein, 16 aa, Mycobacterium tuberculosis
GAALVRDDNRIAPLDG

SEQ ID NO: 197650 - protein, 16 aa, Mycobacterium tuberculosis
AALVRDDNRIAPLDGV

SEQ ID NO: 197651 - protein, 16 aa, Mycobacterium tuberculosis
ALVRDDNRIAPLDGVG

SEQ ID NO: 197652 - protein, 16 aa, Mycobacterium tuberculosis
LVRDDNRIAPLDGVGA

SEQ ID NO: 197653 - protein, 16 aa, Mycobacterium tuberculosis
VRDDNRIAPLDGVGAL

SEQ ID NO: 197654 - protein, 16 aa, Mycobacterium tuberculosis
RDDNRIAPLDGVGALL

SEQ ID NO: 197655 - protein, 16 aa, Mycobacterium tuberculosis
DDNRIAPLDGVGALLR

SEQ ID NO: 197656 - protein, 16 aa, Mycobacterium tuberculosis
DNRIAPLDGVGALLRY

SEQ ID NO: 197657 - protein, 16 aa, Mycobacterium tuberculosis
NRIAPLDGVGALLRYA

SEQ ID NO: 197658 - protein, 16 aa, Mycobacterium tuberculosis
RIAPLDGVGALLRYAA

SEQ ID NO: 197659 - protein, 16 aa, Mycobacterium tuberculosis
IAPLDGVGALLRYAAT

SEQ ID NO: 197660 - protein, 16 aa, Mycobacterium tuberculosis
APLDGVGALLRYAATN

SEQ ID NO: 197661 - protein, 16 aa, Mycobacterium tuberculosis
PLDGVGALLRYAATNR

SEQ ID NO: 197662 - protein, 16 aa, Mycobacterium tuberculosis
LDGVGALLRYAATNRL

SEQ ID NO: 197663 - protein, 16 aa, Mycobacterium tuberculosis
DGVGALLRYAATNRLG

SEQ ID NO: 197664 - protein, 16 aa, Mycobacterium tuberculosis
GVGALLRYAATNRLGS

SEQ ID NO: 197665 - protein, 16 aa, Mycobacterium tuberculosis
VGALLRYAATNRLGSH

SEQ ID NO: 197666 - protein, 16 aa, Mycobacterium tuberculosis
GALLRYAATNRLGSHR

SEQ ID NO: 197667 - protein, 16 aa, Mycobacterium tuberculosis
ALLRYAATNRLGSHRS

SEQ ID NO: 197668 - protein, 262 aa, Mycobacterium tuberculosis
MSSESDAANTEPEVLVEQRDRILIITINRPKAKNAVNAAVSRGLADAMDQLDGDAGLSVAILTGGGGSFCAGMDLKAFARGENVVVEGRGLGFTERPPTKPLIAAVEGYALAGGTELALAADLIVAARDSAFGIPEVKRGLVAGGGGLLRLPERIPYAIAMELALTGDNLPAERAHELGLVNVLAEPGTALDAAIALAEKITANGPLAVVATKRIITESRGWSPDTMFAEQMKILVPVFTSNDAKEGAIAFAERRRPRWTGT

SEQ ID NO: 197669 - protein, 8 aa, Mycobacterium tuberculosis
MSSESDAA

SEQ ID NO: 197670 - protein, 8 aa, Mycobacterium tuberculosis
NTEPEVLV

SEQ ID NO: 197671 - protein, 8 aa, Mycobacterium tuberculosis
VEQRDRIL

SEQ ID NO: 197672 - protein, 8 aa, Mycobacterium tuberculosis
ILIITINR

SEQ ID NO: 197673 - protein, 8 aa, Mycobacterium tuberculosis
IITINRPK

SEQ ID NO: 197674 - protein, 8 aa, Mycobacterium tuberculosis
TINRPKAK

SEQ ID NO: 197675 - protein, 8 aa, Mycobacterium tuberculosis
RPKAKNAV

SEQ ID NO: 197676 - protein, 8 aa, Mycobacterium tuberculosis
AVNAAVSR

SEQ ID NO: 197677 - protein, 8 aa, Mycobacterium tuberculosis
NAAVSRGL

SEQ ID NO: 197678 - protein, 8 aa, Mycobacterium tuberculosis
GLADAMDQ

SEQ ID NO: 197679 - protein, 8 aa, Mycobacterium tuberculosis
QLDGDAGL

SEQ ID NO: 197680 - protein, 8 aa, Mycobacterium tuberculosis
GLSVAILT

SEQ ID NO: 197681 - protein, 8 aa, Mycobacterium tuberculosis
LTGGGGSF

SEQ ID NO: 197682 - protein, 8 aa, Mycobacterium tuberculosis
GMDLKAFA

SEQ ID NO: 197683 - protein, 8 aa, Mycobacterium tuberculosis
MDLKAFAR

SEQ ID NO: 197684 - protein, 8 aa, Mycobacterium tuberculosis
AFARGENV

SEQ ID NO: 197685 - protein, 8 aa, Mycobacterium tuberculosis
FARGENVV

SEQ ID NO: 197686 - protein, 8 aa, Mycobacterium tuberculosis
ENVVVEGR

SEQ ID NO: 197687 - protein, 8 aa, Mycobacterium tuberculosis
VVVEGRGL

SEQ ID NO: 197688 - protein, 8 aa, Mycobacterium tuberculosis
RGLGFTER

SEQ ID NO: 197689 - protein, 8 aa, Mycobacterium tuberculosis
FTERPPTK

SEQ ID NO: 197690 - protein, 8 aa, Mycobacterium tuberculosis
RPPTKPLI

SEQ ID NO: 197691 - protein, 8 aa, Mycobacterium tuberculosis
TKPLIAAV

SEQ ID NO: 197692 - protein, 8 aa, Mycobacterium tuberculosis
LIAAVEGY

SEQ ID NO: 197693 - protein, 8 aa, Mycobacterium tuberculosis
AAVEGYAL

SEQ ID NO: 197694 - protein, 8 aa, Mycobacterium tuberculosis
ALAGGTEL

SEQ ID NO: 197695 - protein, 8 aa, Mycobacterium tuberculosis
ELALAADL

SEQ ID NO: 197696 - protein, 8 aa, Mycobacterium tuberculosis
ALAADLIV

SEQ ID NO: 197697 - protein, 8 aa, Mycobacterium tuberculosis
LAADLIVA

SEQ ID NO: 197698 - protein, 8 aa, Mycobacterium tuberculosis
IVAARDSA

SEQ ID NO: 197699 - protein, 8 aa, Mycobacterium tuberculosis
VAARDSAF

SEQ ID NO: 197700 - protein, 8 aa, Mycobacterium tuberculosis
SAFGIPEV

SEQ ID NO: 197701 - protein, 8 aa, Mycobacterium tuberculosis
IPEVKRGL

SEQ ID NO: 197702 - protein, 8 aa, Mycobacterium tuberculosis
LVAGGGGL

SEQ ID NO: 197703 - protein, 8 aa, Mycobacterium tuberculosis
GLLRLPER

SEQ ID NO: 197704 - protein, 8 aa, Mycobacterium tuberculosis
LLRLPERI

SEQ ID NO: 197705 - protein, 8 aa, Mycobacterium tuberculosis
RLPERIPY

SEQ ID NO: 197706 - protein, 8 aa, Mycobacterium tuberculosis
LPERIPYA

SEQ ID NO: 197707 - protein, 8 aa, Mycobacterium tuberculosis
RIPYAIAM

SEQ ID NO: 197708 - protein, 8 aa, Mycobacterium tuberculosis
PYAIAMEL

SEQ ID NO: 197709 - protein, 8 aa, Mycobacterium tuberculosis
YAIAMELA

SEQ ID NO: 197710 - protein, 8 aa, Mycobacterium tuberculosis
AIAMELAL

SEQ ID NO: 197711 - protein, 8 aa, Mycobacterium tuberculosis
LTGDNLPA

SEQ ID NO: 197712 - protein, 8 aa, Mycobacterium tuberculosis
RAHELGLV

SEQ ID NO: 197713 - protein, 8 aa, Mycobacterium tuberculosis
HELGLVNV

SEQ ID NO: 197714 - protein, 8 aa, Mycobacterium tuberculosis
ELGLVNVL

SEQ ID NO: 197715 - protein, 8 aa, Mycobacterium tuberculosis
VLAEPGTA

SEQ ID NO: 197716 - protein, 8 aa, Mycobacterium tuberculosis
LAEPGTAL

SEQ ID NO: 197717 - protein, 8 aa, Mycobacterium tuberculosis
ALDAAIAL

SEQ ID NO: 197718 - protein, 8 aa, Mycobacterium tuberculosis
AAIALAEK

SEQ ID NO: 197719 - protein, 8 aa, Mycobacterium tuberculosis
ALAEKITA

SEQ ID NO: 197720 - protein, 8 aa, Mycobacterium tuberculosis
KITANGPL

SEQ ID NO: 197721 - protein, 8 aa, Mycobacterium tuberculosis
ITANGPLA

SEQ ID NO: 197722 - protein, 8 aa, Mycobacterium tuberculosis
TANGPLAV

SEQ ID NO: 197723 - protein, 8 aa, Mycobacterium tuberculosis
GPLAVVAT

SEQ ID NO: 197724 - protein, 8 aa, Mycobacterium tuberculosis
LAVVATKR

SEQ ID NO: 197725 - protein, 8 aa, Mycobacterium tuberculosis
KRIITESR

SEQ ID NO: 197726 - protein, 8 aa, Mycobacterium tuberculosis
GWSPDTMF

SEQ ID NO: 197727 - protein, 8 aa, Mycobacterium tuberculosis
WSPDTMFA

SEQ ID NO: 197728 - protein, 8 aa, Mycobacterium tuberculosis
DTMFAEQM

SEQ ID NO: 197729 - protein, 8 aa, Mycobacterium tuberculosis
TMFAEQMK

SEQ ID NO: 197730 - protein, 8 aa, Mycobacterium tuberculosis
FAEQMKIL

SEQ ID NO: 197731 - protein, 8 aa, Mycobacterium tuberculosis
AEQMKILV

SEQ ID NO: 197732 - protein, 8 aa, Mycobacterium tuberculosis
QMKILVPV

SEQ ID NO: 197733 - protein, 8 aa, Mycobacterium tuberculosis
ILVPVFTS

SEQ ID NO: 197734 - protein, 8 aa, Mycobacterium tuberculosis
GAIAFAER

SEQ ID NO: 197735 - protein, 8 aa, Mycobacterium tuberculosis
AIAFAERR

SEQ ID NO: 197736 - protein, 8 aa, Mycobacterium tuberculosis
IAFAERRR

SEQ ID NO: 197737 - protein, 8 aa, Mycobacterium tuberculosis
FAERRRPR

SEQ ID NO: 197738 - protein, 8 aa, Mycobacterium tuberculosis
AERRRPRW

SEQ ID NO: 197739 - protein, 9 aa, Mycobacterium tuberculosis
DAANTEPEV

SEQ ID NO: 197740 - protein, 9 aa, Mycobacterium tuberculosis
EPEVLVEQR

SEQ ID NO: 197741 - protein, 9 aa, Mycobacterium tuberculosis
EVLVEQRDR

SEQ ID NO: 197742 - protein, 9 aa, Mycobacterium tuberculosis
VLVEQRDRI

SEQ ID NO: 197743 - protein, 9 aa, Mycobacterium tuberculosis
RILIITINR

SEQ ID NO: 197744 - protein, 9 aa, Mycobacterium tuberculosis
LIITINRPK

SEQ ID NO: 197745 - protein, 9 aa, Mycobacterium tuberculosis
ITINRPKAK

SEQ ID NO: 197746 - protein, 9 aa, Mycobacterium tuberculosis
NAVNAAVSR

SEQ ID NO: 197747 - protein, 9 aa, Mycobacterium tuberculosis
NAAVSRGLA

SEQ ID NO: 197748 - protein, 9 aa, Mycobacterium tuberculosis
AVSRGLADA

SEQ ID NO: 197749 - protein, 9 aa, Mycobacterium tuberculosis
GLADAMDQL

SEQ ID NO: 197750 - protein, 9 aa, Mycobacterium tuberculosis
AMDQLDGDA

SEQ ID NO: 197751 - protein, 9 aa, Mycobacterium tuberculosis
QLDGDAGLS

SEQ ID NO: 197752 - protein, 9 aa, Mycobacterium tuberculosis
ILTGGGGSF

SEQ ID NO: 197753 - protein, 9 aa, Mycobacterium tuberculosis
SFCAGMDLK

SEQ ID NO: 197754 - protein, 9 aa, Mycobacterium tuberculosis
CAGMDLKAF

SEQ ID NO: 197755 - protein, 9 aa, Mycobacterium tuberculosis
GMDLKAFAR

SEQ ID NO: 197756 - protein, 9 aa, Mycobacterium tuberculosis
KAFARGENV

SEQ ID NO: 197757 - protein, 9 aa, Mycobacterium tuberculosis
AFARGENVV

SEQ ID NO: 197758 - protein, 9 aa, Mycobacterium tuberculosis
FARGENVVV

SEQ ID NO: 197759 - protein, 9 aa, Mycobacterium tuberculosis
VVEGRGLGF

SEQ ID NO: 197760 - protein, 9 aa, Mycobacterium tuberculosis
TERPPTKPL

SEQ ID NO: 197761 - protein, 9 aa, Mycobacterium tuberculosis
RPPTKPLIA

SEQ ID NO: 197762 - protein, 9 aa, Mycobacterium tuberculosis
PPTKPLIAA

SEQ ID NO: 197763 - protein, 9 aa, Mycobacterium tuberculosis
PTKPLIAAV

SEQ ID NO: 197764 - protein, 9 aa, Mycobacterium tuberculosis
LIAAVEGYA

SEQ ID NO: 197765 - protein, 9 aa, Mycobacterium tuberculosis
IAAVEGYAL

SEQ ID NO: 197766 - protein, 9 aa, Mycobacterium tuberculosis
AAVEGYALA

SEQ ID NO: 197767 - protein, 9 aa, Mycobacterium tuberculosis
YALAGGTEL

SEQ ID NO: 197768 - protein, 9 aa, Mycobacterium tuberculosis
ALAGGTELA

SEQ ID NO: 197769 - protein, 9 aa, Mycobacterium tuberculosis
LAGGTELAL

SEQ ID NO: 197770 - protein, 9 aa, Mycobacterium tuberculosis
TELALAADL

SEQ ID NO: 197771 - protein, 9 aa, Mycobacterium tuberculosis
ELALAADLI

SEQ ID NO: 197772 - protein, 9 aa, Mycobacterium tuberculosis
LALAADLIV

SEQ ID NO: 197773 - protein, 9 aa, Mycobacterium tuberculosis
ALAADLIVA

SEQ ID NO: 197774 - protein, 9 aa, Mycobacterium tuberculosis
LAADLIVAA

SEQ ID NO: 197775 - protein, 9 aa, Mycobacterium tuberculosis
AADLIVAAR

SEQ ID NO: 197776 - protein, 9 aa, Mycobacterium tuberculosis
LIVAARDSA

SEQ ID NO: 197777 - protein, 9 aa, Mycobacterium tuberculosis
IVAARDSAF

SEQ ID NO: 197778 - protein, 9 aa, Mycobacterium tuberculosis
DSAFGIPEV

SEQ ID NO: 197779 - protein, 9 aa, Mycobacterium tuberculosis
SAFGIPEVK

SEQ ID NO: 197780 - protein, 9 aa, Mycobacterium tuberculosis
AFGIPEVKR

SEQ ID NO: 197781 - protein, 9 aa, Mycobacterium tuberculosis
GIPEVKRGL

SEQ ID NO: 197782 - protein, 9 aa, Mycobacterium tuberculosis
IPEVKRGLV

SEQ ID NO: 197783 - protein, 9 aa, Mycobacterium tuberculosis
GLVAGGGGL

SEQ ID NO: 197784 - protein, 9 aa, Mycobacterium tuberculosis
LVAGGGGLL

SEQ ID NO: 197785 - protein, 9 aa, Mycobacterium tuberculosis
GLLRLPERI

SEQ ID NO: 197786 - protein, 9 aa, Mycobacterium tuberculosis
LRLPERIPY

SEQ ID NO: 197787 - protein, 9 aa, Mycobacterium tuberculosis
RLPERIPYA

SEQ ID NO: 197788 - protein, 9 aa, Mycobacterium tuberculosis
LPERIPYAI

SEQ ID NO: 197789 - protein, 9 aa, Mycobacterium tuberculosis
ERIPYAIAM

SEQ ID NO: 197790 - protein, 9 aa, Mycobacterium tuberculosis
IPYAIAMEL

SEQ ID NO: 197791 - protein, 9 aa, Mycobacterium tuberculosis
YAIAMELAL

SEQ ID NO: 197792 - protein, 9 aa, Mycobacterium tuberculosis
AIAMELALT

SEQ ID NO: 197793 - protein, 9 aa, Mycobacterium tuberculosis
ELALTGDNL

SEQ ID NO: 197794 - protein, 9 aa, Mycobacterium tuberculosis
ALTGDNLPA

SEQ ID NO: 197795 - protein, 9 aa, Mycobacterium tuberculosis
LPAERAHEL

SEQ ID NO: 197796 - protein, 9 aa, Mycobacterium tuberculosis
AERAHELGL

SEQ ID NO: 197797 - protein, 9 aa, Mycobacterium tuberculosis
ERAHELGLV

SEQ ID NO: 197798 - protein, 9 aa, Mycobacterium tuberculosis
HELGLVNVL

SEQ ID NO: 197799 - protein, 9 aa, Mycobacterium tuberculosis
ELGLVNVLA

SEQ ID NO: 197800 - protein, 9 aa, Mycobacterium tuberculosis
VLAEPGTAL

SEQ ID NO: 197801 - protein, 9 aa, Mycobacterium tuberculosis
AEPGTALDA

SEQ ID NO: 197802 - protein, 9 aa, Mycobacterium tuberculosis
EPGTALDAA

SEQ ID NO: 197803 - protein, 9 aa, Mycobacterium tuberculosis
TALDAAIAL

SEQ ID NO: 197804 - protein, 9 aa, Mycobacterium tuberculosis
ALDAAIALA

SEQ ID NO: 197805 - protein, 9 aa, Mycobacterium tuberculosis
DAAIALAEK

SEQ ID NO: 197806 - protein, 9 aa, Mycobacterium tuberculosis
EKITANGPL

SEQ ID NO: 197807 - protein, 9 aa, Mycobacterium tuberculosis
ITANGPLAV

SEQ ID NO: 197808 - protein, 9 aa, Mycobacterium tuberculosis
TANGPLAVV

SEQ ID NO: 197809 - protein, 9 aa, Mycobacterium tuberculosis
RIITESRGW

SEQ ID NO: 197810 - protein, 9 aa, Mycobacterium tuberculosis
RGWSPDTMF

SEQ ID NO: 197811 - protein, 9 aa, Mycobacterium tuberculosis
SPDTMFAEQ

SEQ ID NO: 197812 - protein, 9 aa, Mycobacterium tuberculosis
DTMFAEQMK

SEQ ID NO: 197813 - protein, 9 aa, Mycobacterium tuberculosis
TMFAEQMKI

SEQ ID NO: 197814 - protein, 9 aa, Mycobacterium tuberculosis
MFAEQMKIL

SEQ ID NO: 197815 - protein, 9 aa, Mycobacterium tuberculosis
FAEQMKILV

SEQ ID NO: 197816 - protein, 9 aa, Mycobacterium tuberculosis
EQMKILVPV

SEQ ID NO: 197817 - protein, 9 aa, Mycobacterium tuberculosis
QMKILVPVF

SEQ ID NO: 197818 - protein, 9 aa, Mycobacterium tuberculosis
ILVPVFTSN

SEQ ID NO: 197819 - protein, 9 aa, Mycobacterium tuberculosis
VPVFTSNDA

SEQ ID NO: 197820 - protein, 9 aa, Mycobacterium tuberculosis
PVFTSNDAK

SEQ ID NO: 197821 - protein, 9 aa, Mycobacterium tuberculosis
DAKEGAIAF

SEQ ID NO: 197822 - protein, 9 aa, Mycobacterium tuberculosis
EGAIAFAER

SEQ ID NO: 197823 - protein, 9 aa, Mycobacterium tuberculosis
GAIAFAERR

SEQ ID NO: 197824 - protein, 9 aa, Mycobacterium tuberculosis
AIAFAERRR

SEQ ID NO: 197825 - protein, 9 aa, Mycobacterium tuberculosis
AFAERRRPR

SEQ ID NO: 197826 - protein, 9 aa, Mycobacterium tuberculosis
FAERRRPRW

SEQ ID NO: 197827 - protein, 10 aa, Mycobacterium tuberculosis
DAANTEPEVL

SEQ ID NO: 197828 - protein, 10 aa, Mycobacterium tuberculosis
VLVEQRDRIL

SEQ ID NO: 197829 - protein, 10 aa, Mycobacterium tuberculosis
DRILIITINR

SEQ ID NO: 197830 - protein, 10 aa, Mycobacterium tuberculosis
ILIITINRPK

SEQ ID NO: 197831 - protein, 10 aa, Mycobacterium tuberculosis
IITINRPKAK

SEQ ID NO: 197832 - protein, 10 aa, Mycobacterium tuberculosis
RPKAKNAVNA

SEQ ID NO: 197833 - protein, 10 aa, Mycobacterium tuberculosis
KAKNAVNAAV

SEQ ID NO: 197834 - protein, 10 aa, Mycobacterium tuberculosis
AVNAAVSRGL

SEQ ID NO: 197835 - protein, 10 aa, Mycobacterium tuberculosis
AVSRGLADAM

SEQ ID NO: 197836 - protein, 10 aa, Mycobacterium tuberculosis
QLDGDAGLSV

SEQ ID NO: 197837 - protein, 10 aa, Mycobacterium tuberculosis
AILTGGGGSF

SEQ ID NO: 197838 - protein, 10 aa, Mycobacterium tuberculosis
ILTGGGGSFC

SEQ ID NO: 197839 - protein, 10 aa, Mycobacterium tuberculosis
GSFCAGMDLK

SEQ ID NO: 197840 - protein, 10 aa, Mycobacterium tuberculosis
FCAGMDLKAF

SEQ ID NO: 197841 - protein, 10 aa, Mycobacterium tuberculosis
AGMDLKAFAR

SEQ ID NO: 197842 - protein, 10 aa, Mycobacterium tuberculosis
KAFARGENVV

SEQ ID NO: 197843 - protein, 10 aa, Mycobacterium tuberculosis
AFARGENVVV

SEQ ID NO: 197844 - protein, 10 aa, Mycobacterium tuberculosis
VVVEGRGLGF

SEQ ID NO: 197845 - protein, 10 aa, Mycobacterium tuberculosis
LGFTERPPTK

SEQ ID NO: 197846 - protein, 10 aa, Mycobacterium tuberculosis
FTERPPTKPL

SEQ ID NO: 197847 - protein, 10 aa, Mycobacterium tuberculosis
TERPPTKPLI

SEQ ID NO: 197848 - protein, 10 aa, Mycobacterium tuberculosis
RPPTKPLIAA

SEQ ID NO: 197849 - protein, 10 aa, Mycobacterium tuberculosis
PPTKPLIAAV

SEQ ID NO: 197850 - protein, 10 aa, Mycobacterium tuberculosis
KPLIAAVEGY

SEQ ID NO: 197851 - protein, 10 aa, Mycobacterium tuberculosis
PLIAAVEGYA

SEQ ID NO: 197852 - protein, 10 aa, Mycobacterium tuberculosis
LIAAVEGYAL

SEQ ID NO: 197853 - protein, 10 aa, Mycobacterium tuberculosis
GYALAGGTEL

SEQ ID NO: 197854 - protein, 10 aa, Mycobacterium tuberculosis
YALAGGTELA

SEQ ID NO: 197855 - protein, 10 aa, Mycobacterium tuberculosis
ALAGGTELAL

SEQ ID NO: 197856 - protein, 10 aa, Mycobacterium tuberculosis
ELALAADLIV

SEQ ID NO: 197857 - protein, 10 aa, Mycobacterium tuberculosis
ALAADLIVAA

SEQ ID NO: 197858 - protein, 10 aa, Mycobacterium tuberculosis
LAADLIVAAR

SEQ ID NO: 197859 - protein, 10 aa, Mycobacterium tuberculosis
LIVAARDSAF

SEQ ID NO: 197860 - protein, 10 aa, Mycobacterium tuberculosis
VAARDSAFGI

SEQ ID NO: 197861 - protein, 10 aa, Mycobacterium tuberculosis
DSAFGIPEVK

SEQ ID NO: 197862 - protein, 10 aa, Mycobacterium tuberculosis
SAFGIPEVKR

SEQ ID NO: 197863 - protein, 10 aa, Mycobacterium tuberculosis
GIPEVKRGLV

SEQ ID NO: 197864 - protein, 10 aa, Mycobacterium tuberculosis
IPEVKRGLVA

SEQ ID NO: 197865 - protein, 10 aa, Mycobacterium tuberculosis
GLVAGGGGLL

SEQ ID NO: 197866 - protein, 10 aa, Mycobacterium tuberculosis
LVAGGGGLLR

SEQ ID NO: 197867 - protein, 10 aa, Mycobacterium tuberculosis
VAGGGGLLRL

SEQ ID NO: 197868 - protein, 10 aa, Mycobacterium tuberculosis
LLRLPERIPY

SEQ ID NO: 197869 - protein, 10 aa, Mycobacterium tuberculosis
RLPERIPYAI

SEQ ID NO: 197870 - protein, 10 aa, Mycobacterium tuberculosis
LPERIPYAIA

SEQ ID NO: 197871 - protein, 10 aa, Mycobacterium tuberculosis
PERIPYAIAM

SEQ ID NO: 197872 - protein, 10 aa, Mycobacterium tuberculosis
RIPYAIAMEL

SEQ ID NO: 197873 - protein, 10 aa, Mycobacterium tuberculosis
IPYAIAMELA

SEQ ID NO: 197874 - protein, 10 aa, Mycobacterium tuberculosis
PYAIAMELAL

SEQ ID NO: 197875 - protein, 10 aa, Mycobacterium tuberculosis
MELALTGDNL

SEQ ID NO: 197876 - protein, 10 aa, Mycobacterium tuberculosis
LALTGDNLPA

SEQ ID NO: 197877 - protein, 10 aa, Mycobacterium tuberculosis
ALTGDNLPAE

SEQ ID NO: 197878 - protein, 10 aa, Mycobacterium tuberculosis
LTGDNLPAER

SEQ ID NO: 197879 - protein, 10 aa, Mycobacterium tuberculosis
NLPAERAHEL

SEQ ID NO: 197880 - protein, 10 aa, Mycobacterium tuberculosis
AERAHELGLV

SEQ ID NO: 197881 - protein, 10 aa, Mycobacterium tuberculosis
RAHELGLVNV

SEQ ID NO: 197882 - protein, 10 aa, Mycobacterium tuberculosis
AHELGLVNVL

SEQ ID NO: 197883 - protein, 10 aa, Mycobacterium tuberculosis
NVLAEPGTAL

SEQ ID NO: 197884 - protein, 10 aa, Mycobacterium tuberculosis
EPGTALDAAI

SEQ ID NO: 197885 - protein, 10 aa, Mycobacterium tuberculosis
GTALDAAIAL

SEQ ID NO: 197886 - protein, 10 aa, Mycobacterium tuberculosis
TALDAAIALA

SEQ ID NO: 197887 - protein, 10 aa, Mycobacterium tuberculosis
ALDAAIALAE

SEQ ID NO: 197888 - protein, 10 aa, Mycobacterium tuberculosis
DAAIALAEKI

SEQ ID NO: 197889 - protein, 10 aa, Mycobacterium tuberculosis
ALAEKITANG

SEQ ID NO: 197890 - protein, 10 aa, Mycobacterium tuberculosis
AEKITANGPL

SEQ ID NO: 197891 - protein, 10 aa, Mycobacterium tuberculosis
KITANGPLAV

SEQ ID NO: 197892 - protein, 10 aa, Mycobacterium tuberculosis
ITANGPLAVV

SEQ ID NO: 197893 - protein, 10 aa, Mycobacterium tuberculosis
PLAVVATKRI

SEQ ID NO: 197894 - protein, 10 aa, Mycobacterium tuberculosis
ATKRIITESR

SEQ ID NO: 197895 - protein, 10 aa, Mycobacterium tuberculosis
SPDTMFAEQM

SEQ ID NO: 197896 - protein, 10 aa, Mycobacterium tuberculosis
DTMFAEQMKI

SEQ ID NO: 197897 - protein, 10 aa, Mycobacterium tuberculosis
TMFAEQMKIL

SEQ ID NO: 197898 - protein, 10 aa, Mycobacterium tuberculosis
MFAEQMKILV

SEQ ID NO: 197899 - protein, 10 aa, Mycobacterium tuberculosis
AEQMKILVPV

SEQ ID NO: 197900 - protein, 10 aa, Mycobacterium tuberculosis
EQMKILVPVF

SEQ ID NO: 197901 - protein, 10 aa, Mycobacterium tuberculosis
FTSNDAKEGA

SEQ ID NO: 197902 - protein, 10 aa, Mycobacterium tuberculosis
KEGAIAFAER

SEQ ID NO: 197903 - protein, 10 aa, Mycobacterium tuberculosis
EGAIAFAERR

SEQ ID NO: 197904 - protein, 10 aa, Mycobacterium tuberculosis
GAIAFAERRR

SEQ ID NO: 197905 - protein, 10 aa, Mycobacterium tuberculosis
IAFAERRRPR

SEQ ID NO: 197906 - protein, 11 aa, Mycobacterium tuberculosis
ESDAANTEPEV

SEQ ID NO: 197907 - protein, 11 aa, Mycobacterium tuberculosis
DAANTEPEVLV

SEQ ID NO: 197908 - protein, 11 aa, Mycobacterium tuberculosis
NTEPEVLVEQR

SEQ ID NO: 197909 - protein, 11 aa, Mycobacterium tuberculosis
EVLVEQRDRIL

SEQ ID NO: 197910 - protein, 11 aa, Mycobacterium tuberculosis
VLVEQRDRILI

SEQ ID NO: 197911 - protein, 11 aa, Mycobacterium tuberculosis
RDRILIITINR

SEQ ID NO: 197912 - protein, 11 aa, Mycobacterium tuberculosis
RILIITINRPK

SEQ ID NO: 197913 - protein, 11 aa, Mycobacterium tuberculosis
ILIITINRPKA

SEQ ID NO: 197914 - protein, 11 aa, Mycobacterium tuberculosis
LIITINRPKAK

SEQ ID NO: 197915 - protein, 11 aa, Mycobacterium tuberculosis
TINRPKAKNAV

SEQ ID NO: 197916 - protein, 11 aa, Mycobacterium tuberculosis
RPKAKNAVNAA

SEQ ID NO: 197917 - protein, 11 aa, Mycobacterium tuberculosis
NAVNAAVSRGL

SEQ ID NO: 197918 - protein, 11 aa, Mycobacterium tuberculosis
AVNAAVSRGLA

SEQ ID NO: 197919 - protein, 11 aa, Mycobacterium tuberculosis
AAVSRGLADAM

SEQ ID NO: 197920 - protein, 11 aa, Mycobacterium tuberculosis
AMDQLDGDAGL

SEQ ID NO: 197921 - protein, 11 aa, Mycobacterium tuberculosis
DQLDGDAGLSV

SEQ ID NO: 197922 - protein, 11 aa, Mycobacterium tuberculosis
QLDGDAGLSVA

SEQ ID NO: 197923 - protein, 11 aa, Mycobacterium tuberculosis
VAILTGGGGSF

SEQ ID NO: 197924 - protein, 11 aa, Mycobacterium tuberculosis
ILTGGGGSFCA

SEQ ID NO: 197925 - protein, 11 aa, Mycobacterium tuberculosis
SFCAGMDLKAF

SEQ ID NO: 197926 - protein, 11 aa, Mycobacterium tuberculosis
FCAGMDLKAFA

SEQ ID NO: 197927 - protein, 11 aa, Mycobacterium tuberculosis
CAGMDLKAFAR

SEQ ID NO: 197928 - protein, 11 aa, Mycobacterium tuberculosis
DLKAFARGENV

SEQ ID NO: 197929 - protein, 11 aa, Mycobacterium tuberculosis
KAFARGENVVV

SEQ ID NO: 197930 - protein, 11 aa, Mycobacterium tuberculosis
GENVVVEGRGL

SEQ ID NO: 197931 - protein, 11 aa, Mycobacterium tuberculosis
GLGFTERPPTK

SEQ ID NO: 197932 - protein, 11 aa, Mycobacterium tuberculosis
FTERPPTKPLI

SEQ ID NO: 197933 - protein, 11 aa, Mycobacterium tuberculosis
RPPTKPLIAAV

SEQ ID NO: 197934 - protein, 11 aa, Mycobacterium tuberculosis
KPLIAAVEGYA

SEQ ID NO: 197935 - protein, 11 aa, Mycobacterium tuberculosis
PLIAAVEGYAL

SEQ ID NO: 197936 - protein, 11 aa, Mycobacterium tuberculosis
LIAAVEGYALA

SEQ ID NO: 197937 - protein, 11 aa, Mycobacterium tuberculosis
YALAGGTELAL

SEQ ID NO: 197938 - protein, 11 aa, Mycobacterium tuberculosis
ALAGGTELALA

SEQ ID NO: 197939 - protein, 11 aa, Mycobacterium tuberculosis
ELALAADLIVA

SEQ ID NO: 197940 - protein, 11 aa, Mycobacterium tuberculosis
LALAADLIVAA

SEQ ID NO: 197941 - protein, 11 aa, Mycobacterium tuberculosis
ALAADLIVAAR

SEQ ID NO: 197942 - protein, 11 aa, Mycobacterium tuberculosis
DLIVAARDSAF

SEQ ID NO: 197943 - protein, 11 aa, Mycobacterium tuberculosis
IVAARDSAFGI

SEQ ID NO: 197944 - protein, 11 aa, Mycobacterium tuberculosis
DSAFGIPEVKR

SEQ ID NO: 197945 - protein, 11 aa, Mycobacterium tuberculosis
FGIPEVKRGLV

SEQ ID NO: 197946 - protein, 11 aa, Mycobacterium tuberculosis
LVAGGGGLLRL

SEQ ID NO: 197947 - protein, 11 aa, Mycobacterium tuberculosis
GLLRLPERIPY

SEQ ID NO: 197948 - protein, 11 aa, Mycobacterium tuberculosis
LLRLPERIPYA

SEQ ID NO: 197949 - protein, 11 aa, Mycobacterium tuberculosis
RLPERIPYAIA

SEQ ID NO: 197950 - protein, 11 aa, Mycobacterium tuberculosis
LPERIPYAIAM

SEQ ID NO: 197951 - protein, 11 aa, Mycobacterium tuberculosis
ERIPYAIAMEL

SEQ ID NO: 197952 - protein, 11 aa, Mycobacterium tuberculosis
RIPYAIAMELA

SEQ ID NO: 197953 - protein, 11 aa, Mycobacterium tuberculosis
IPYAIAMELAL

SEQ ID NO: 197954 - protein, 11 aa, Mycobacterium tuberculosis
AMELALTGDNL

SEQ ID NO: 197955 - protein, 11 aa, Mycobacterium tuberculosis
ELALTGDNLPA

SEQ ID NO: 197956 - protein, 11 aa, Mycobacterium tuberculosis
ALTGDNLPAER

SEQ ID NO: 197957 - protein, 11 aa, Mycobacterium tuberculosis
LPAERAHELGL

SEQ ID NO: 197958 - protein, 11 aa, Mycobacterium tuberculosis
AERAHELGLVN

SEQ ID NO: 197959 - protein, 11 aa, Mycobacterium tuberculosis
ERAHELGLVNV

SEQ ID NO: 197960 - protein, 11 aa, Mycobacterium tuberculosis
RAHELGLVNVL

SEQ ID NO: 197961 - protein, 11 aa, Mycobacterium tuberculosis
GLVNVLAEPGT

SEQ ID NO: 197962 - protein, 11 aa, Mycobacterium tuberculosis
LVNVLAEPGTA

SEQ ID NO: 197963 - protein, 11 aa, Mycobacterium tuberculosis
VLAEPGTALDA

SEQ ID NO: 197964 - protein, 11 aa, Mycobacterium tuberculosis
LAEPGTALDAA

SEQ ID NO: 197965 - protein, 11 aa, Mycobacterium tuberculosis
AEPGTALDAAI

SEQ ID NO: 197966 - protein, 11 aa, Mycobacterium tuberculosis
EPGTALDAAIA

SEQ ID NO: 197967 - protein, 11 aa, Mycobacterium tuberculosis
ALDAAIALAEK

SEQ ID NO: 197968 - protein, 11 aa, Mycobacterium tuberculosis
LAEKITANGPL

SEQ ID NO: 197969 - protein, 11 aa, Mycobacterium tuberculosis
AEKITANGPLA

SEQ ID NO: 197970 - protein, 11 aa, Mycobacterium tuberculosis
EKITANGPLAV

SEQ ID NO: 197971 - protein, 11 aa, Mycobacterium tuberculosis
KITANGPLAVV

SEQ ID NO: 197972 - protein, 11 aa, Mycobacterium tuberculosis
GPLAVVATKRI

SEQ ID NO: 197973 - protein, 11 aa, Mycobacterium tuberculosis
VATKRIITESR

SEQ ID NO: 197974 - protein, 11 aa, Mycobacterium tuberculosis
DTMFAEQMKIL

SEQ ID NO: 197975 - protein, 11 aa, Mycobacterium tuberculosis
TMFAEQMKILV

SEQ ID NO: 197976 - protein, 11 aa, Mycobacterium tuberculosis
FAEQMKILVPV

SEQ ID NO: 197977 - protein, 11 aa, Mycobacterium tuberculosis
AEQMKILVPVF

SEQ ID NO: 197978 - protein, 11 aa, Mycobacterium tuberculosis
ILVPVFTSNDA

SEQ ID NO: 197979 - protein, 11 aa, Mycobacterium tuberculosis
LVPVFTSNDAK

SEQ ID NO: 197980 - protein, 11 aa, Mycobacterium tuberculosis
FTSNDAKEGAI

SEQ ID NO: 197981 - protein, 11 aa, Mycobacterium tuberculosis
EGAIAFAERRR

SEQ ID NO: 197982 - protein, 11 aa, Mycobacterium tuberculosis
AIAFAERRRPR

SEQ ID NO: 197983 - protein, 11 aa, Mycobacterium tuberculosis
IAFAERRRPRW

SEQ ID NO: 197984 - protein, 11 aa, Mycobacterium tuberculosis
ESDAANTEPEV

SEQ ID NO: 197985 - protein, 11 aa, Mycobacterium tuberculosis
DAANTEPEVLV

SEQ ID NO: 197986 - protein, 11 aa, Mycobacterium tuberculosis
NTEPEVLVEQR

SEQ ID NO: 197987 - protein, 11 aa, Mycobacterium tuberculosis
EVLVEQRDRIL

SEQ ID NO: 197988 - protein, 11 aa, Mycobacterium tuberculosis
VLVEQRDRILI

SEQ ID NO: 197989 - protein, 11 aa, Mycobacterium tuberculosis
RDRILIITINR

SEQ ID NO: 197990 - protein, 11 aa, Mycobacterium tuberculosis
RILIITINRPK

SEQ ID NO: 197991 - protein, 11 aa, Mycobacterium tuberculosis
ILIITINRPKA

SEQ ID NO: 197992 - protein, 11 aa, Mycobacterium tuberculosis
LIITINRPKAK

SEQ ID NO: 197993 - protein, 11 aa, Mycobacterium tuberculosis
TINRPKAKNAV

SEQ ID NO: 197994 - protein, 11 aa, Mycobacterium tuberculosis
RPKAKNAVNAA

SEQ ID NO: 197995 - protein, 11 aa, Mycobacterium tuberculosis
NAVNAAVSRGL

SEQ ID NO: 197996 - protein, 11 aa, Mycobacterium tuberculosis
AVNAAVSRGLA

SEQ ID NO: 197997 - protein, 11 aa, Mycobacterium tuberculosis
AAVSRGLADAM

SEQ ID NO: 197998 - protein, 11 aa, Mycobacterium tuberculosis
AMDQLDGDAGL

SEQ ID NO: 197999 - protein, 11 aa, Mycobacterium tuberculosis
DQLDGDAGLSV

SEQ ID NO: 198000 - protein, 11 aa, Mycobacterium tuberculosis
QLDGDAGLSVA

SEQ ID NO: 198001 - protein, 11 aa, Mycobacterium tuberculosis
VAILTGGGGSF

SEQ ID NO: 198002 - protein, 11 aa, Mycobacterium tuberculosis
ILTGGGGSFCA

SEQ ID NO: 198003 - protein, 11 aa, Mycobacterium tuberculosis
SFCAGMDLKAF

SEQ ID NO: 198004 - protein, 11 aa, Mycobacterium tuberculosis
FCAGMDLKAFA

SEQ ID NO: 198005 - protein, 11 aa, Mycobacterium tuberculosis
CAGMDLKAFAR

SEQ ID NO: 198006 - protein, 11 aa, Mycobacterium tuberculosis
DLKAFARGENV

SEQ ID NO: 198007 - protein, 11 aa, Mycobacterium tuberculosis
KAFARGENVVV

SEQ ID NO: 198008 - protein, 11 aa, Mycobacterium tuberculosis
GENVVVEGRGL

SEQ ID NO: 198009 - protein, 11 aa, Mycobacterium tuberculosis
GLGFTERPPTK

SEQ ID NO: 198010 - protein, 11 aa, Mycobacterium tuberculosis
FTERPPTKPLI

SEQ ID NO: 198011 - protein, 11 aa, Mycobacterium tuberculosis
RPPTKPLIAAV

SEQ ID NO: 198012 - protein, 11 aa, Mycobacterium tuberculosis
KPLIAAVEGYA

SEQ ID NO: 198013 - protein, 11 aa, Mycobacterium tuberculosis
PLIAAVEGYAL

SEQ ID NO: 198014 - protein, 11 aa, Mycobacterium tuberculosis
LIAAVEGYALA

SEQ ID NO: 198015 - protein, 11 aa, Mycobacterium tuberculosis
YALAGGTELAL

SEQ ID NO: 198016 - protein, 11 aa, Mycobacterium tuberculosis
ALAGGTELALA

SEQ ID NO: 198017 - protein, 11 aa, Mycobacterium tuberculosis
ELALAADLIVA

SEQ ID NO: 198018 - protein, 11 aa, Mycobacterium tuberculosis
LALAADLIVAA

SEQ ID NO: 198019 - protein, 11 aa, Mycobacterium tuberculosis
ALAADLIVAAR

SEQ ID NO: 198020 - protein, 11 aa, Mycobacterium tuberculosis
DLIVAARDSAF

SEQ ID NO: 198021 - protein, 11 aa, Mycobacterium tuberculosis
IVAARDSAFGI

SEQ ID NO: 198022 - protein, 11 aa, Mycobacterium tuberculosis
DSAFGIPEVKR

SEQ ID NO: 198023 - protein, 11 aa, Mycobacterium tuberculosis
FGIPEVKRGLV

SEQ ID NO: 198024 - protein, 11 aa, Mycobacterium tuberculosis
LVAGGGGLLRL

SEQ ID NO: 198025 - protein, 11 aa, Mycobacterium tuberculosis
GLLRLPERIPY

SEQ ID NO: 198026 - protein, 11 aa, Mycobacterium tuberculosis
LLRLPERIPYA

SEQ ID NO: 198027 - protein, 11 aa, Mycobacterium tuberculosis
RLPERIPYAIA

SEQ ID NO: 198028 - protein, 11 aa, Mycobacterium tuberculosis
LPERIPYAIAM

SEQ ID NO: 198029 - protein, 11 aa, Mycobacterium tuberculosis
ERIPYAIAMEL

SEQ ID NO: 198030 - protein, 11 aa, Mycobacterium tuberculosis
RIPYAIAMELA

SEQ ID NO: 198031 - protein, 11 aa, Mycobacterium tuberculosis
IPYAIAMELAL

SEQ ID NO: 198032 - protein, 11 aa, Mycobacterium tuberculosis
AMELALTGDNL

SEQ ID NO: 198033 - protein, 11 aa, Mycobacterium tuberculosis
ELALTGDNLPA

SEQ ID NO: 198034 - protein, 11 aa, Mycobacterium tuberculosis
ALTGDNLPAER

SEQ ID NO: 198035 - protein, 11 aa, Mycobacterium tuberculosis
LPAERAHELGL

SEQ ID NO: 198036 - protein, 11 aa, Mycobacterium tuberculosis
AERAHELGLVN

SEQ ID NO: 198037 - protein, 11 aa, Mycobacterium tuberculosis
ERAHELGLVNV

SEQ ID NO: 198038 - protein, 11 aa, Mycobacterium tuberculosis
RAHELGLVNVL

SEQ ID NO: 198039 - protein, 11 aa, Mycobacterium tuberculosis
GLVNVLAEPGT

SEQ ID NO: 198040 - protein, 11 aa, Mycobacterium tuberculosis
LVNVLAEPGTA

SEQ ID NO: 198041 - protein, 11 aa, Mycobacterium tuberculosis
VLAEPGTALDA

SEQ ID NO: 198042 - protein, 11 aa, Mycobacterium tuberculosis
LAEPGTALDAA

SEQ ID NO: 198043 - protein, 11 aa, Mycobacterium tuberculosis
AEPGTALDAAI

SEQ ID NO: 198044 - protein, 11 aa, Mycobacterium tuberculosis
EPGTALDAAIA

SEQ ID NO: 198045 - protein, 11 aa, Mycobacterium tuberculosis
ALDAAIALAEK

SEQ ID NO: 198046 - protein, 11 aa, Mycobacterium tuberculosis
LAEKITANGPL

SEQ ID NO: 198047 - protein, 11 aa, Mycobacterium tuberculosis
AEKITANGPLA

SEQ ID NO: 198048 - protein, 11 aa, Mycobacterium tuberculosis
EKITANGPLAV

SEQ ID NO: 198049 - protein, 11 aa, Mycobacterium tuberculosis
KITANGPLAVV

SEQ ID NO: 198050 - protein, 11 aa, Mycobacterium tuberculosis
GPLAVVATKRI

SEQ ID NO: 198051 - protein, 11 aa, Mycobacterium tuberculosis
VATKRIITESR

SEQ ID NO: 198052 - protein, 11 aa, Mycobacterium tuberculosis
DTMFAEQMKIL

SEQ ID NO: 198053 - protein, 11 aa, Mycobacterium tuberculosis
TMFAEQMKILV

SEQ ID NO: 198054 - protein, 11 aa, Mycobacterium tuberculosis
FAEQMKILVPV

SEQ ID NO: 198055 - protein, 11 aa, Mycobacterium tuberculosis
AEQMKILVPVF

SEQ ID NO: 198056 - protein, 11 aa, Mycobacterium tuberculosis
ILVPVFTSNDA

SEQ ID NO: 198057 - protein, 11 aa, Mycobacterium tuberculosis
LVPVFTSNDAK

SEQ ID NO: 198058 - protein, 11 aa, Mycobacterium tuberculosis
FTSNDAKEGAI

SEQ ID NO: 198059 - protein, 11 aa, Mycobacterium tuberculosis
EGAIAFAERRR

SEQ ID NO: 198060 - protein, 11 aa, Mycobacterium tuberculosis
AIAFAERRRPR

SEQ ID NO: 198061 - protein, 11 aa, Mycobacterium tuberculosis
IAFAERRRPRW

SEQ ID NO: 198062 - protein, 13 aa, Mycobacterium tuberculosis
MSSESDAANTEPE

SEQ ID NO: 198063 - protein, 13 aa, Mycobacterium tuberculosis
SSESDAANTEPEV

SEQ ID NO: 198064 - protein, 13 aa, Mycobacterium tuberculosis
SESDAANTEPEVL

SEQ ID NO: 198065 - protein, 13 aa, Mycobacterium tuberculosis
ESDAANTEPEVLV

SEQ ID NO: 198066 - protein, 13 aa, Mycobacterium tuberculosis
SDAANTEPEVLVE

SEQ ID NO: 198067 - protein, 13 aa, Mycobacterium tuberculosis
DAANTEPEVLVEQ

SEQ ID NO: 198068 - protein, 13 aa, Mycobacterium tuberculosis
AANTEPEVLVEQR

SEQ ID NO: 198069 - protein, 13 aa, Mycobacterium tuberculosis
ANTEPEVLVEQRD

SEQ ID NO: 198070 - protein, 13 aa, Mycobacterium tuberculosis
NTEPEVLVEQRDR

SEQ ID NO: 198071 - protein, 13 aa, Mycobacterium tuberculosis
TEPEVLVEQRDRI

SEQ ID NO: 198072 - protein, 13 aa, Mycobacterium tuberculosis
EPEVLVEQRDRIL

SEQ ID NO: 198073 - protein, 13 aa, Mycobacterium tuberculosis
PEVLVEQRDRILI

SEQ ID NO: 198074 - protein, 13 aa, Mycobacterium tuberculosis
EVLVEQRDRILII

SEQ ID NO: 198075 - protein, 13 aa, Mycobacterium tuberculosis
VLVEQRDRILIIT

SEQ ID NO: 198076 - protein, 13 aa, Mycobacterium tuberculosis
LVEQRDRILIITI

SEQ ID NO: 198077 - protein, 13 aa, Mycobacterium tuberculosis
VEQRDRILIITIN

SEQ ID NO: 198078 - protein, 13 aa, Mycobacterium tuberculosis
EQRDRILIITINR

SEQ ID NO: 198079 - protein, 13 aa, Mycobacterium tuberculosis
QRDRILIITINRP

SEQ ID NO: 198080 - protein, 13 aa, Mycobacterium tuberculosis
RDRILIITINRPK

SEQ ID NO: 198081 - protein, 13 aa, Mycobacterium tuberculosis
DRILIITINRPKA

SEQ ID NO: 198082 - protein, 13 aa, Mycobacterium tuberculosis
RILIITINRPKAK

SEQ ID NO: 198083 - protein, 13 aa, Mycobacterium tuberculosis
ILIITINRPKAKN

SEQ ID NO: 198084 - protein, 13 aa, Mycobacterium tuberculosis
LIITINRPKAKNA

SEQ ID NO: 198085 - protein, 13 aa, Mycobacterium tuberculosis
IITINRPKAKNAV

SEQ ID NO: 198086 - protein, 13 aa, Mycobacterium tuberculosis
ITINRPKAKNAVN

SEQ ID NO: 198087 - protein, 13 aa, Mycobacterium tuberculosis
TINRPKAKNAVNA

SEQ ID NO: 198088 - protein, 13 aa, Mycobacterium tuberculosis
INRPKAKNAVNAA

SEQ ID NO: 198089 - protein, 13 aa, Mycobacterium tuberculosis
NRPKAKNAVNAAV

SEQ ID NO: 198090 - protein, 13 aa, Mycobacterium tuberculosis
RPKAKNAVNAAVS

SEQ ID NO: 198091 - protein, 13 aa, Mycobacterium tuberculosis
PKAKNAVNAAVSR

SEQ ID NO: 198092 - protein, 13 aa, Mycobacterium tuberculosis
KAKNAVNAAVSRG

SEQ ID NO: 198093 - protein, 13 aa, Mycobacterium tuberculosis
AKNAVNAAVSRGL

SEQ ID NO: 198094 - protein, 13 aa, Mycobacterium tuberculosis
KNAVNAAVSRGLA

SEQ ID NO: 198095 - protein, 13 aa, Mycobacterium tuberculosis
NAVNAAVSRGLAD

SEQ ID NO: 198096 - protein, 13 aa, Mycobacterium tuberculosis
AVNAAVSRGLADA

SEQ ID NO: 198097 - protein, 13 aa, Mycobacterium tuberculosis
VNAAVSRGLADAM

SEQ ID NO: 198098 - protein, 13 aa, Mycobacterium tuberculosis
NAAVSRGLADAMD

SEQ ID NO: 198099 - protein, 13 aa, Mycobacterium tuberculosis
AAVSRGLADAMDQ

SEQ ID NO: 198100 - protein, 13 aa, Mycobacterium tuberculosis
AVSRGLADAMDQL

SEQ ID NO: 198101 - protein, 13 aa, Mycobacterium tuberculosis
VSRGLADAMDQLD

SEQ ID NO: 198102 - protein, 13 aa, Mycobacterium tuberculosis
SRGLADAMDQLDG

SEQ ID NO: 198103 - protein, 13 aa, Mycobacterium tuberculosis
RGLADAMDQLDGD

SEQ ID NO: 198104 - protein, 13 aa, Mycobacterium tuberculosis
GLADAMDQLDGDA

SEQ ID NO: 198105 - protein, 13 aa, Mycobacterium tuberculosis
LADAMDQLDGDAG

SEQ ID NO: 198106 - protein, 13 aa, Mycobacterium tuberculosis
ADAMDQLDGDAGL

SEQ ID NO: 198107 - protein, 13 aa, Mycobacterium tuberculosis
DAMDQLDGDAGLS

SEQ ID NO: 198108 - protein, 13 aa, Mycobacterium tuberculosis
AMDQLDGDAGLSV

SEQ ID NO: 198109 - protein, 13 aa, Mycobacterium tuberculosis
MDQLDGDAGLSVA

SEQ ID NO: 198110 - protein, 13 aa, Mycobacterium tuberculosis
DQLDGDAGLSVAI

SEQ ID NO: 198111 - protein, 13 aa, Mycobacterium tuberculosis
QLDGDAGLSVAIL

SEQ ID NO: 198112 - protein, 13 aa, Mycobacterium tuberculosis
LDGDAGLSVAILT

SEQ ID NO: 198113 - protein, 13 aa, Mycobacterium tuberculosis
DGDAGLSVAILTG

SEQ ID NO: 198114 - protein, 13 aa, Mycobacterium tuberculosis
GDAGLSVAILTGG

SEQ ID NO: 198115 - protein, 13 aa, Mycobacterium tuberculosis
DAGLSVAILTGGG

SEQ ID NO: 198116 - protein, 13 aa, Mycobacterium tuberculosis
AGLSVAILTGGGG

SEQ ID NO: 198117 - protein, 13 aa, Mycobacterium tuberculosis
GLSVAILTGGGGS

SEQ ID NO: 198118 - protein, 13 aa, Mycobacterium tuberculosis
LSVAILTGGGGSF

SEQ ID NO: 198119 - protein, 13 aa, Mycobacterium tuberculosis
SVAILTGGGGSFC

SEQ ID NO: 198120 - protein, 13 aa, Mycobacterium tuberculosis
VAILTGGGGSFCA

SEQ ID NO: 198121 - protein, 13 aa, Mycobacterium tuberculosis
AILTGGGGSFCAG

SEQ ID NO: 198122 - protein, 13 aa, Mycobacterium tuberculosis
ILTGGGGSFCAGM

SEQ ID NO: 198123 - protein, 13 aa, Mycobacterium tuberculosis
LTGGGGSFCAGMD

SEQ ID NO: 198124 - protein, 13 aa, Mycobacterium tuberculosis
TGGGGSFCAGMDL

SEQ ID NO: 198125 - protein, 13 aa, Mycobacterium tuberculosis
GGGGSFCAGMDLK

SEQ ID NO: 198126 - protein, 13 aa, Mycobacterium tuberculosis
GGGSFCAGMDLKA

SEQ ID NO: 198127 - protein, 13 aa, Mycobacterium tuberculosis
GGSFCAGMDLKAF

SEQ ID NO: 198128 - protein, 13 aa, Mycobacterium tuberculosis
GSFCAGMDLKAFA

SEQ ID NO: 198129 - protein, 13 aa, Mycobacterium tuberculosis
SFCAGMDLKAFAR

SEQ ID NO: 198130 - protein, 13 aa, Mycobacterium tuberculosis
FCAGMDLKAFARG

SEQ ID NO: 198131 - protein, 13 aa, Mycobacterium tuberculosis
CAGMDLKAFARGE

SEQ ID NO: 198132 - protein, 13 aa, Mycobacterium tuberculosis
AGMDLKAFARGEN

SEQ ID NO: 198133 - protein, 13 aa, Mycobacterium tuberculosis
GMDLKAFARGENV

SEQ ID NO: 198134 - protein, 13 aa, Mycobacterium tuberculosis
MDLKAFARGENVV

SEQ ID NO: 198135 - protein, 13 aa, Mycobacterium tuberculosis
DLKAFARGENVVV

SEQ ID NO: 198136 - protein, 13 aa, Mycobacterium tuberculosis
LKAFARGENVVVE

SEQ ID NO: 198137 - protein, 13 aa, Mycobacterium tuberculosis
KAFARGENVVVEG

SEQ ID NO: 198138 - protein, 13 aa, Mycobacterium tuberculosis
AFARGENVVVEGR

SEQ ID NO: 198139 - protein, 13 aa, Mycobacterium tuberculosis
FARGENVVVEGRG

SEQ ID NO: 198140 - protein, 13 aa, Mycobacterium tuberculosis
ARGENVVVEGRGL

SEQ ID NO: 198141 - protein, 13 aa, Mycobacterium tuberculosis
RGENVVVEGRGLG

SEQ ID NO: 198142 - protein, 13 aa, Mycobacterium tuberculosis
GENVVVEGRGLGF

SEQ ID NO: 198143 - protein, 13 aa, Mycobacterium tuberculosis
ENVVVEGRGLGFT

SEQ ID NO: 198144 - protein, 13 aa, Mycobacterium tuberculosis
NVVVEGRGLGFTE

SEQ ID NO: 198145 - protein, 13 aa, Mycobacterium tuberculosis
VVVEGRGLGFTER

SEQ ID NO: 198146 - protein, 13 aa, Mycobacterium tuberculosis
VVEGRGLGFTERP

SEQ ID NO: 198147 - protein, 13 aa, Mycobacterium tuberculosis
VEGRGLGFTERPP

SEQ ID NO: 198148 - protein, 13 aa, Mycobacterium tuberculosis
EGRGLGFTERPPT

SEQ ID NO: 198149 - protein, 13 aa, Mycobacterium tuberculosis
GRGLGFTERPPTK

SEQ ID NO: 198150 - protein, 13 aa, Mycobacterium tuberculosis
RGLGFTERPPTKP

SEQ ID NO: 198151 - protein, 13 aa, Mycobacterium tuberculosis
GLGFTERPPTKPL

SEQ ID NO: 198152 - protein, 13 aa, Mycobacterium tuberculosis
LGFTERPPTKPLI

SEQ ID NO: 198153 - protein, 13 aa, Mycobacterium tuberculosis
GFTERPPTKPLIA

SEQ ID NO: 198154 - protein, 13 aa, Mycobacterium tuberculosis
FTERPPTKPLIAA

SEQ ID NO: 198155 - protein, 13 aa, Mycobacterium tuberculosis
TERPPTKPLIAAV

SEQ ID NO: 198156 - protein, 13 aa, Mycobacterium tuberculosis
ERPPTKPLIAAVE

SEQ ID NO: 198157 - protein, 13 aa, Mycobacterium tuberculosis
RPPTKPLIAAVEG

SEQ ID NO: 198158 - protein, 13 aa, Mycobacterium tuberculosis
PPTKPLIAAVEGY

SEQ ID NO: 198159 - protein, 13 aa, Mycobacterium tuberculosis
PTKPLIAAVEGYA

SEQ ID NO: 198160 - protein, 13 aa, Mycobacterium tuberculosis
TKPLIAAVEGYAL

SEQ ID NO: 198161 - protein, 13 aa, Mycobacterium tuberculosis
KPLIAAVEGYALA

SEQ ID NO: 198162 - protein, 13 aa, Mycobacterium tuberculosis
PLIAAVEGYALAG

SEQ ID NO: 198163 - protein, 13 aa, Mycobacterium tuberculosis
LIAAVEGYALAGG

SEQ ID NO: 198164 - protein, 13 aa, Mycobacterium tuberculosis
IAAVEGYALAGGT

SEQ ID NO: 198165 - protein, 13 aa, Mycobacterium tuberculosis
AAVEGYALAGGTE

SEQ ID NO: 198166 - protein, 13 aa, Mycobacterium tuberculosis
AVEGYALAGGTEL

SEQ ID NO: 198167 - protein, 13 aa, Mycobacterium tuberculosis
VEGYALAGGTELA

SEQ ID NO: 198168 - protein, 13 aa, Mycobacterium tuberculosis
EGYALAGGTELAL

SEQ ID NO: 198169 - protein, 13 aa, Mycobacterium tuberculosis
GYALAGGTELALA

SEQ ID NO: 198170 - protein, 13 aa, Mycobacterium tuberculosis
YALAGGTELALAA

SEQ ID NO: 198171 - protein, 13 aa, Mycobacterium tuberculosis
ALAGGTELALAAD

SEQ ID NO: 198172 - protein, 13 aa, Mycobacterium tuberculosis
LAGGTELALAADL

SEQ ID NO: 198173 - protein, 13 aa, Mycobacterium tuberculosis
AGGTELALAADLI

SEQ ID NO: 198174 - protein, 13 aa, Mycobacterium tuberculosis
GGTELALAADLIV

SEQ ID NO: 198175 - protein, 13 aa, Mycobacterium tuberculosis
GTELALAADLIVA

SEQ ID NO: 198176 - protein, 13 aa, Mycobacterium tuberculosis
TELALAADLIVAA

SEQ ID NO: 198177 - protein, 13 aa, Mycobacterium tuberculosis
ELALAADLIVAAR

SEQ ID NO: 198178 - protein, 13 aa, Mycobacterium tuberculosis
LALAADLIVAARD

SEQ ID NO: 198179 - protein, 13 aa, Mycobacterium tuberculosis
ALAADLIVAARDS

SEQ ID NO: 198180 - protein, 13 aa, Mycobacterium tuberculosis
LAADLIVAARDSA

SEQ ID NO: 198181 - protein, 13 aa, Mycobacterium tuberculosis
AADLIVAARDSAF

SEQ ID NO: 198182 - protein, 13 aa, Mycobacterium tuberculosis
ADLIVAARDSAFG

SEQ ID NO: 198183 - protein, 13 aa, Mycobacterium tuberculosis
DLIVAARDSAFGI

SEQ ID NO: 198184 - protein, 13 aa, Mycobacterium tuberculosis
LIVAARDSAFGIP

SEQ ID NO: 198185 - protein, 13 aa, Mycobacterium tuberculosis
IVAARDSAFGIPE

SEQ ID NO: 198186 - protein, 13 aa, Mycobacterium tuberculosis
VAARDSAFGIPEV

SEQ ID NO: 198187 - protein, 13 aa, Mycobacterium tuberculosis
AARDSAFGIPEVK

SEQ ID NO: 198188 - protein, 13 aa, Mycobacterium tuberculosis
ARDSAFGIPEVKR

SEQ ID NO: 198189 - protein, 13 aa, Mycobacterium tuberculosis
RDSAFGIPEVKRG

SEQ ID NO: 198190 - protein, 13 aa, Mycobacterium tuberculosis
DSAFGIPEVKRGL

SEQ ID NO: 198191 - protein, 13 aa, Mycobacterium tuberculosis
SAFGIPEVKRGLV

SEQ ID NO: 198192 - protein, 13 aa, Mycobacterium tuberculosis
AFGIPEVKRGLVA

SEQ ID NO: 198193 - protein, 13 aa, Mycobacterium tuberculosis
FGIPEVKRGLVAG

SEQ ID NO: 198194 - protein, 13 aa, Mycobacterium tuberculosis
GIPEVKRGLVAGG

SEQ ID NO: 198195 - protein, 13 aa, Mycobacterium tuberculosis
IPEVKRGLVAGGG

SEQ ID NO: 198196 - protein, 13 aa, Mycobacterium tuberculosis
PEVKRGLVAGGGG

SEQ ID NO: 198197 - protein, 13 aa, Mycobacterium tuberculosis
EVKRGLVAGGGGL

SEQ ID NO: 198198 - protein, 13 aa, Mycobacterium tuberculosis
VKRGLVAGGGGLL

SEQ ID NO: 198199 - protein, 13 aa, Mycobacterium tuberculosis
KRGLVAGGGGLLR

SEQ ID NO: 198200 - protein, 13 aa, Mycobacterium tuberculosis
RGLVAGGGGLLRL

SEQ ID NO: 198201 - protein, 13 aa, Mycobacterium tuberculosis
GLVAGGGGLLRLP

SEQ ID NO: 198202 - protein, 13 aa, Mycobacterium tuberculosis
LVAGGGGLLRLPE

SEQ ID NO: 198203 - protein, 13 aa, Mycobacterium tuberculosis
VAGGGGLLRLPER

SEQ ID NO: 198204 - protein, 13 aa, Mycobacterium tuberculosis
AGGGGLLRLPERI

SEQ ID NO: 198205 - protein, 13 aa, Mycobacterium tuberculosis
GGGGLLRLPERIP

SEQ ID NO: 198206 - protein, 13 aa, Mycobacterium tuberculosis
GGGLLRLPERIPY

SEQ ID NO: 198207 - protein, 13 aa, Mycobacterium tuberculosis
GGLLRLPERIPYA

SEQ ID NO: 198208 - protein, 13 aa, Mycobacterium tuberculosis
GLLRLPERIPYAI

SEQ ID NO: 198209 - protein, 13 aa, Mycobacterium tuberculosis
LLRLPERIPYAIA

SEQ ID NO: 198210 - protein, 13 aa, Mycobacterium tuberculosis
LRLPERIPYAIAM

SEQ ID NO: 198211 - protein, 13 aa, Mycobacterium tuberculosis
RLPERIPYAIAME

SEQ ID NO: 198212 - protein, 13 aa, Mycobacterium tuberculosis
LPERIPYAIAMEL

SEQ ID NO: 198213 - protein, 13 aa, Mycobacterium tuberculosis
PERIPYAIAMELA

SEQ ID NO: 198214 - protein, 13 aa, Mycobacterium tuberculosis
ERIPYAIAMELAL

SEQ ID NO: 198215 - protein, 13 aa, Mycobacterium tuberculosis
RIPYAIAMELALT

SEQ ID NO: 198216 - protein, 13 aa, Mycobacterium tuberculosis
IPYAIAMELALTG

SEQ ID NO: 198217 - protein, 13 aa, Mycobacterium tuberculosis
PYAIAMELALTGD

SEQ ID NO: 198218 - protein, 13 aa, Mycobacterium tuberculosis
YAIAMELALTGDN

SEQ ID NO: 198219 - protein, 13 aa, Mycobacterium tuberculosis
AIAMELALTGDNL

SEQ ID NO: 198220 - protein, 13 aa, Mycobacterium tuberculosis
IAMELALTGDNLP

SEQ ID NO: 198221 - protein, 13 aa, Mycobacterium tuberculosis
AMELALTGDNLPA

SEQ ID NO: 198222 - protein, 13 aa, Mycobacterium tuberculosis
MELALTGDNLPAE

SEQ ID NO: 198223 - protein, 13 aa, Mycobacterium tuberculosis
ELALTGDNLPAER

SEQ ID NO: 198224 - protein, 13 aa, Mycobacterium tuberculosis
LALTGDNLPAERA

SEQ ID NO: 198225 - protein, 13 aa, Mycobacterium tuberculosis
ALTGDNLPAERAH

SEQ ID NO: 198226 - protein, 13 aa, Mycobacterium tuberculosis
LTGDNLPAERAHE

SEQ ID NO: 198227 - protein, 13 aa, Mycobacterium tuberculosis
TGDNLPAERAHEL

SEQ ID NO: 198228 - protein, 13 aa, Mycobacterium tuberculosis
GDNLPAERAHELG

SEQ ID NO: 198229 - protein, 13 aa, Mycobacterium tuberculosis
DNLPAERAHELGL

SEQ ID NO: 198230 - protein, 13 aa, Mycobacterium tuberculosis
NLPAERAHELGLV

SEQ ID NO: 198231 - protein, 13 aa, Mycobacterium tuberculosis
LPAERAHELGLVN

SEQ ID NO: 198232 - protein, 13 aa, Mycobacterium tuberculosis
PAERAHELGLVNV

SEQ ID NO: 198233 - protein, 13 aa, Mycobacterium tuberculosis
AERAHELGLVNVL

SEQ ID NO: 198234 - protein, 13 aa, Mycobacterium tuberculosis
ERAHELGLVNVLA

SEQ ID NO: 198235 - protein, 13 aa, Mycobacterium tuberculosis
RAHELGLVNVLAE

SEQ ID NO: 198236 - protein, 13 aa, Mycobacterium tuberculosis
AHELGLVNVLAEP

SEQ ID NO: 198237 - protein, 13 aa, Mycobacterium tuberculosis
HELGLVNVLAEPG

SEQ ID NO: 198238 - protein, 13 aa, Mycobacterium tuberculosis
ELGLVNVLAEPGT

SEQ ID NO: 198239 - protein, 13 aa, Mycobacterium tuberculosis
LGLVNVLAEPGTA

SEQ ID NO: 198240 - protein, 13 aa, Mycobacterium tuberculosis
GLVNVLAEPGTAL

SEQ ID NO: 198241 - protein, 13 aa, Mycobacterium tuberculosis
LVNVLAEPGTALD

SEQ ID NO: 198242 - protein, 13 aa, Mycobacterium tuberculosis
VNVLAEPGTALDA

SEQ ID NO: 198243 - protein, 13 aa, Mycobacterium tuberculosis
NVLAEPGTALDAA

SEQ ID NO: 198244 - protein, 13 aa, Mycobacterium tuberculosis
VLAEPGTALDAAI

SEQ ID NO: 198245 - protein, 13 aa, Mycobacterium tuberculosis
LAEPGTALDAAIA

SEQ ID NO: 198246 - protein, 13 aa, Mycobacterium tuberculosis
AEPGTALDAAIAL

SEQ ID NO: 198247 - protein, 13 aa, Mycobacterium tuberculosis
EPGTALDAAIALA

SEQ ID NO: 198248 - protein, 13 aa, Mycobacterium tuberculosis
PGTALDAAIALAE

SEQ ID NO: 198249 - protein, 13 aa, Mycobacterium tuberculosis
GTALDAAIALAEK

SEQ ID NO: 198250 - protein, 13 aa, Mycobacterium tuberculosis
TALDAAIALAEKI

SEQ ID NO: 198251 - protein, 13 aa, Mycobacterium tuberculosis
ALDAAIALAEKIT

SEQ ID NO: 198252 - protein, 13 aa, Mycobacterium tuberculosis
LDAAIALAEKITA

SEQ ID NO: 198253 - protein, 13 aa, Mycobacterium tuberculosis
DAAIALAEKITAN

SEQ ID NO: 198254 - protein, 13 aa, Mycobacterium tuberculosis
AAIALAEKITANG

SEQ ID NO: 198255 - protein, 13 aa, Mycobacterium tuberculosis
AIALAEKITANGP

SEQ ID NO: 198256 - protein, 13 aa, Mycobacterium tuberculosis
IALAEKITANGPL

SEQ ID NO: 198257 - protein, 13 aa, Mycobacterium tuberculosis
ALAEKITANGPLA

SEQ ID NO: 198258 - protein, 13 aa, Mycobacterium tuberculosis
LAEKITANGPLAV

SEQ ID NO: 198259 - protein, 13 aa, Mycobacterium tuberculosis
AEKITANGPLAVV

SEQ ID NO: 198260 - protein, 13 aa, Mycobacterium tuberculosis
EKITANGPLAVVA

SEQ ID NO: 198261 - protein, 13 aa, Mycobacterium tuberculosis
KITANGPLAVVAT

SEQ ID NO: 198262 - protein, 13 aa, Mycobacterium tuberculosis
ITANGPLAVVATK

SEQ ID NO: 198263 - protein, 13 aa, Mycobacterium tuberculosis
TANGPLAVVATKR

SEQ ID NO: 198264 - protein, 13 aa, Mycobacterium tuberculosis
ANGPLAVVATKRI

SEQ ID NO: 198265 - protein, 13 aa, Mycobacterium tuberculosis
NGPLAVVATKRII

SEQ ID NO: 198266 - protein, 13 aa, Mycobacterium tuberculosis
GPLAVVATKRIIT

SEQ ID NO: 198267 - protein, 13 aa, Mycobacterium tuberculosis
PLAVVATKRIITE

SEQ ID NO: 198268 - protein, 13 aa, Mycobacterium tuberculosis
LAVVATKRIITES

SEQ ID NO: 198269 - protein, 13 aa, Mycobacterium tuberculosis
AVVATKRIITESR

SEQ ID NO: 198270 - protein, 13 aa, Mycobacterium tuberculosis
VVATKRIITESRG

SEQ ID NO: 198271 - protein, 13 aa, Mycobacterium tuberculosis
VATKRIITESRGW

SEQ ID NO: 198272 - protein, 13 aa, Mycobacterium tuberculosis
ATKRIITESRGWS

SEQ ID NO: 198273 - protein, 13 aa, Mycobacterium tuberculosis
TKRIITESRGWSP

SEQ ID NO: 198274 - protein, 13 aa, Mycobacterium tuberculosis
KRIITESRGWSPD

SEQ ID NO: 198275 - protein, 13 aa, Mycobacterium tuberculosis
RIITESRGWSPDT

SEQ ID NO: 198276 - protein, 13 aa, Mycobacterium tuberculosis
IITESRGWSPDTM

SEQ ID NO: 198277 - protein, 13 aa, Mycobacterium tuberculosis
ITESRGWSPDTMF

SEQ ID NO: 198278 - protein, 13 aa, Mycobacterium tuberculosis
TESRGWSPDTMFA

SEQ ID NO: 198279 - protein, 13 aa, Mycobacterium tuberculosis
ESRGWSPDTMFAE

SEQ ID NO: 198280 - protein, 13 aa, Mycobacterium tuberculosis
SRGWSPDTMFAEQ

SEQ ID NO: 198281 - protein, 13 aa, Mycobacterium tuberculosis
RGWSPDTMFAEQM

SEQ ID NO: 198282 - protein, 13 aa, Mycobacterium tuberculosis
GWSPDTMFAEQMK

SEQ ID NO: 198283 - protein, 13 aa, Mycobacterium tuberculosis
WSPDTMFAEQMKI

SEQ ID NO: 198284 - protein, 13 aa, Mycobacterium tuberculosis
SPDTMFAEQMKIL

SEQ ID NO: 198285 - protein, 13 aa, Mycobacterium tuberculosis
PDTMFAEQMKILV

SEQ ID NO: 198286 - protein, 13 aa, Mycobacterium tuberculosis
DTMFAEQMKILVP

SEQ ID NO: 198287 - protein, 13 aa, Mycobacterium tuberculosis
TMFAEQMKILVPV

SEQ ID NO: 198288 - protein, 13 aa, Mycobacterium tuberculosis
MFAEQMKILVPVF

SEQ ID NO: 198289 - protein, 13 aa, Mycobacterium tuberculosis
FAEQMKILVPVFT

SEQ ID NO: 198290 - protein, 13 aa, Mycobacterium tuberculosis
AEQMKILVPVFTS

SEQ ID NO: 198291 - protein, 13 aa, Mycobacterium tuberculosis
EQMKILVPVFTSN

SEQ ID NO: 198292 - protein, 13 aa, Mycobacterium tuberculosis
QMKILVPVFTSND

SEQ ID NO: 198293 - protein, 13 aa, Mycobacterium tuberculosis
MKILVPVFTSNDA

SEQ ID NO: 198294 - protein, 13 aa, Mycobacterium tuberculosis
KILVPVFTSNDAK

SEQ ID NO: 198295 - protein, 13 aa, Mycobacterium tuberculosis
ILVPVFTSNDAKE

SEQ ID NO: 198296 - protein, 13 aa, Mycobacterium tuberculosis
LVPVFTSNDAKEG

SEQ ID NO: 198297 - protein, 13 aa, Mycobacterium tuberculosis
VPVFTSNDAKEGA

SEQ ID NO: 198298 - protein, 13 aa, Mycobacterium tuberculosis
PVFTSNDAKEGAI

SEQ ID NO: 198299 - protein, 13 aa, Mycobacterium tuberculosis
VFTSNDAKEGAIA

SEQ ID NO: 198300 - protein, 13 aa, Mycobacterium tuberculosis
FTSNDAKEGAIAF

SEQ ID NO: 198301 - protein, 13 aa, Mycobacterium tuberculosis
TSNDAKEGAIAFA

SEQ ID NO: 198302 - protein, 13 aa, Mycobacterium tuberculosis
SNDAKEGAIAFAE

SEQ ID NO: 198303 - protein, 13 aa, Mycobacterium tuberculosis
NDAKEGAIAFAER

SEQ ID NO: 198304 - protein, 13 aa, Mycobacterium tuberculosis
DAKEGAIAFAERR

SEQ ID NO: 198305 - protein, 13 aa, Mycobacterium tuberculosis
AKEGAIAFAERRR

SEQ ID NO: 198306 - protein, 13 aa, Mycobacterium tuberculosis
KEGAIAFAERRRP

SEQ ID NO: 198307 - protein, 13 aa, Mycobacterium tuberculosis
EGAIAFAERRRPR

SEQ ID NO: 198308 - protein, 13 aa, Mycobacterium tuberculosis
GAIAFAERRRPRW

SEQ ID NO: 198309 - protein, 13 aa, Mycobacterium tuberculosis
AIAFAERRRPRWT

SEQ ID NO: 198310 - protein, 13 aa, Mycobacterium tuberculosis
IAFAERRRPRWTG

SEQ ID NO: 198311 - protein, 13 aa, Mycobacterium tuberculosis
AFAERRRPRWTGT

SEQ ID NO: 198312 - protein, 14 aa, Mycobacterium tuberculosis
MSSESDAANTEPEV

SEQ ID NO: 198313 - protein, 14 aa, Mycobacterium tuberculosis
SSESDAANTEPEVL

SEQ ID NO: 198314 - protein, 14 aa, Mycobacterium tuberculosis
SESDAANTEPEVLV

SEQ ID NO: 198315 - protein, 14 aa, Mycobacterium tuberculosis
ESDAANTEPEVLVE

SEQ ID NO: 198316 - protein, 14 aa, Mycobacterium tuberculosis
SDAANTEPEVLVEQ

SEQ ID NO: 198317 - protein, 14 aa, Mycobacterium tuberculosis
DAANTEPEVLVEQR

SEQ ID NO: 198318 - protein, 14 aa, Mycobacterium tuberculosis
AANTEPEVLVEQRD

SEQ ID NO: 198319 - protein, 14 aa, Mycobacterium tuberculosis
ANTEPEVLVEQRDR

SEQ ID NO: 198320 - protein, 14 aa, Mycobacterium tuberculosis
NTEPEVLVEQRDRI

SEQ ID NO: 198321 - protein, 14 aa, Mycobacterium tuberculosis
TEPEVLVEQRDRIL

SEQ ID NO: 198322 - protein, 14 aa, Mycobacterium tuberculosis
EPEVLVEQRDRILI

SEQ ID NO: 198323 - protein, 14 aa, Mycobacterium tuberculosis
PEVLVEQRDRILII

SEQ ID NO: 198324 - protein, 14 aa, Mycobacterium tuberculosis
EVLVEQRDRILIIT

SEQ ID NO: 198325 - protein, 14 aa, Mycobacterium tuberculosis
VLVEQRDRILIITI

SEQ ID NO: 198326 - protein, 14 aa, Mycobacterium tuberculosis
LVEQRDRILIITIN

SEQ ID NO: 198327 - protein, 14 aa, Mycobacterium tuberculosis
VEQRDRILIITINR

SEQ ID NO: 198328 - protein, 14 aa, Mycobacterium tuberculosis
EQRDRILIITINRP

SEQ ID NO: 198329 - protein, 14 aa, Mycobacterium tuberculosis
QRDRILIITINRPK

SEQ ID NO: 198330 - protein, 14 aa, Mycobacterium tuberculosis
RDRILIITINRPKA

SEQ ID NO: 198331 - protein, 14 aa, Mycobacterium tuberculosis
DRILIITINRPKAK

SEQ ID NO: 198332 - protein, 14 aa, Mycobacterium tuberculosis
RILIITINRPKAKN

SEQ ID NO: 198333 - protein, 14 aa, Mycobacterium tuberculosis
ILIITINRPKAKNA

SEQ ID NO: 198334 - protein, 14 aa, Mycobacterium tuberculosis
LIITINRPKAKNAV

SEQ ID NO: 198335 - protein, 14 aa, Mycobacterium tuberculosis
IITINRPKAKNAVN

SEQ ID NO: 198336 - protein, 14 aa, Mycobacterium tuberculosis
ITINRPKAKNAVNA

SEQ ID NO: 198337 - protein, 14 aa, Mycobacterium tuberculosis
TINRPKAKNAVNAA

SEQ ID NO: 198338 - protein, 14 aa, Mycobacterium tuberculosis
INRPKAKNAVNAAV

SEQ ID NO: 198339 - protein, 14 aa, Mycobacterium tuberculosis
NRPKAKNAVNAAVS

SEQ ID NO: 198340 - protein, 14 aa, Mycobacterium tuberculosis
RPKAKNAVNAAVSR

SEQ ID NO: 198341 - protein, 14 aa, Mycobacterium tuberculosis
PKAKNAVNAAVSRG

SEQ ID NO: 198342 - protein, 14 aa, Mycobacterium tuberculosis
KAKNAVNAAVSRGL

SEQ ID NO: 198343 - protein, 14 aa, Mycobacterium tuberculosis
AKNAVNAAVSRGLA

SEQ ID NO: 198344 - protein, 14 aa, Mycobacterium tuberculosis
KNAVNAAVSRGLAD

SEQ ID NO: 198345 - protein, 14 aa, Mycobacterium tuberculosis
NAVNAAVSRGLADA

SEQ ID NO: 198346 - protein, 14 aa, Mycobacterium tuberculosis
AVNAAVSRGLADAM

SEQ ID NO: 198347 - protein, 14 aa, Mycobacterium tuberculosis
VNAAVSRGLADAMD

SEQ ID NO: 198348 - protein, 14 aa, Mycobacterium tuberculosis
NAAVSRGLADAMDQ

SEQ ID NO: 198349 - protein, 14 aa, Mycobacterium tuberculosis
AAVSRGLADAMDQL

SEQ ID NO: 198350 - protein, 14 aa, Mycobacterium tuberculosis
AVSRGLADAMDQLD

SEQ ID NO: 198351 - protein, 14 aa, Mycobacterium tuberculosis
VSRGLADAMDQLDG

SEQ ID NO: 198352 - protein, 14 aa, Mycobacterium tuberculosis
SRGLADAMDQLDGD

SEQ ID NO: 198353 - protein, 14 aa, Mycobacterium tuberculosis
RGLADAMDQLDGDA

SEQ ID NO: 198354 - protein, 14 aa, Mycobacterium tuberculosis
GLADAMDQLDGDAG

SEQ ID NO: 198355 - protein, 14 aa, Mycobacterium tuberculosis
LADAMDQLDGDAGL

SEQ ID NO: 198356 - protein, 14 aa, Mycobacterium tuberculosis
ADAMDQLDGDAGLS

SEQ ID NO: 198357 - protein, 14 aa, Mycobacterium tuberculosis
DAMDQLDGDAGLSV

SEQ ID NO: 198358 - protein, 14 aa, Mycobacterium tuberculosis
AMDQLDGDAGLSVA

SEQ ID NO: 198359 - protein, 14 aa, Mycobacterium tuberculosis
MDQLDGDAGLSVAI

SEQ ID NO: 198360 - protein, 14 aa, Mycobacterium tuberculosis
DQLDGDAGLSVAIL

SEQ ID NO: 198361 - protein, 14 aa, Mycobacterium tuberculosis
QLDGDAGLSVAILT

SEQ ID NO: 198362 - protein, 14 aa, Mycobacterium tuberculosis
LDGDAGLSVAILTG

SEQ ID NO: 198363 - protein, 14 aa, Mycobacterium tuberculosis
DGDAGLSVAILTGG

SEQ ID NO: 198364 - protein, 14 aa, Mycobacterium tuberculosis
GDAGLSVAILTGGG

SEQ ID NO: 198365 - protein, 14 aa, Mycobacterium tuberculosis
DAGLSVAILTGGGG

SEQ ID NO: 198366 - protein, 14 aa, Mycobacterium tuberculosis
AGLSVAILTGGGGS

SEQ ID NO: 198367 - protein, 14 aa, Mycobacterium tuberculosis
GLSVAILTGGGGSF

SEQ ID NO: 198368 - protein, 14 aa, Mycobacterium tuberculosis
LSVAILTGGGGSFC

SEQ ID NO: 198369 - protein, 14 aa, Mycobacterium tuberculosis
SVAILTGGGGSFCA

SEQ ID NO: 198370 - protein, 14 aa, Mycobacterium tuberculosis
VAILTGGGGSFCAG

SEQ ID NO: 198371 - protein, 14 aa, Mycobacterium tuberculosis
AILTGGGGSFCAGM

SEQ ID NO: 198372 - protein, 14 aa, Mycobacterium tuberculosis
ILTGGGGSFCAGMD

SEQ ID NO: 198373 - protein, 14 aa, Mycobacterium tuberculosis
LTGGGGSFCAGMDL

SEQ ID NO: 198374 - protein, 14 aa, Mycobacterium tuberculosis
TGGGGSFCAGMDLK

SEQ ID NO: 198375 - protein, 14 aa, Mycobacterium tuberculosis
GGGGSFCAGMDLKA

SEQ ID NO: 198376 - protein, 14 aa, Mycobacterium tuberculosis
GGGSFCAGMDLKAF

SEQ ID NO: 198377 - protein, 14 aa, Mycobacterium tuberculosis
GGSFCAGMDLKAFA

SEQ ID NO: 198378 - protein, 14 aa, Mycobacterium tuberculosis
GSFCAGMDLKAFAR

SEQ ID NO: 198379 - protein, 14 aa, Mycobacterium tuberculosis
SFCAGMDLKAFARG

SEQ ID NO: 198380 - protein, 14 aa, Mycobacterium tuberculosis
FCAGMDLKAFARGE

SEQ ID NO: 198381 - protein, 14 aa, Mycobacterium tuberculosis
CAGMDLKAFARGEN

SEQ ID NO: 198382 - protein, 14 aa, Mycobacterium tuberculosis
AGMDLKAFARGENV

SEQ ID NO: 198383 - protein, 14 aa, Mycobacterium tuberculosis
GMDLKAFARGENVV

SEQ ID NO: 198384 - protein, 14 aa, Mycobacterium tuberculosis
MDLKAFARGENVVV

SEQ ID NO: 198385 - protein, 14 aa, Mycobacterium tuberculosis
DLKAFARGENVVVE

SEQ ID NO: 198386 - protein, 14 aa, Mycobacterium tuberculosis
LKAFARGENVVVEG

SEQ ID NO: 198387 - protein, 14 aa, Mycobacterium tuberculosis
KAFARGENVVVEGR

SEQ ID NO: 198388 - protein, 14 aa, Mycobacterium tuberculosis
AFARGENVVVEGRG

SEQ ID NO: 198389 - protein, 14 aa, Mycobacterium tuberculosis
FARGENVVVEGRGL

SEQ ID NO: 198390 - protein, 14 aa, Mycobacterium tuberculosis
ARGENVVVEGRGLG

SEQ ID NO: 198391 - protein, 14 aa, Mycobacterium tuberculosis
RGENVVVEGRGLGF

SEQ ID NO: 198392 - protein, 14 aa, Mycobacterium tuberculosis
GENVVVEGRGLGFT

SEQ ID NO: 198393 - protein, 14 aa, Mycobacterium tuberculosis
ENVVVEGRGLGFTE

SEQ ID NO: 198394 - protein, 14 aa, Mycobacterium tuberculosis
NVVVEGRGLGFTER

SEQ ID NO: 198395 - protein, 14 aa, Mycobacterium tuberculosis
VVVEGRGLGFTERP

SEQ ID NO: 198396 - protein, 14 aa, Mycobacterium tuberculosis
VVEGRGLGFTERPP

SEQ ID NO: 198397 - protein, 14 aa, Mycobacterium tuberculosis
VEGRGLGFTERPPT

SEQ ID NO: 198398 - protein, 14 aa, Mycobacterium tuberculosis
EGRGLGFTERPPTK

SEQ ID NO: 198399 - protein, 14 aa, Mycobacterium tuberculosis
GRGLGFTERPPTKP

SEQ ID NO: 198400 - protein, 14 aa, Mycobacterium tuberculosis
RGLGFTERPPTKPL

SEQ ID NO: 198401 - protein, 14 aa, Mycobacterium tuberculosis
GLGFTERPPTKPLI

SEQ ID NO: 198402 - protein, 14 aa, Mycobacterium tuberculosis
LGFTERPPTKPLIA

SEQ ID NO: 198403 - protein, 14 aa, Mycobacterium tuberculosis
GFTERPPTKPLIAA

SEQ ID NO: 198404 - protein, 14 aa, Mycobacterium tuberculosis
FTERPPTKPLIAAV

SEQ ID NO: 198405 - protein, 14 aa, Mycobacterium tuberculosis
TERPPTKPLIAAVE

SEQ ID NO: 198406 - protein, 14 aa, Mycobacterium tuberculosis
ERPPTKPLIAAVEG

SEQ ID NO: 198407 - protein, 14 aa, Mycobacterium tuberculosis
RPPTKPLIAAVEGY

SEQ ID NO: 198408 - protein, 14 aa, Mycobacterium tuberculosis
PPTKPLIAAVEGYA

SEQ ID NO: 198409 - protein, 14 aa, Mycobacterium tuberculosis
PTKPLIAAVEGYAL

SEQ ID NO: 198410 - protein, 14 aa, Mycobacterium tuberculosis
TKPLIAAVEGYALA

SEQ ID NO: 198411 - protein, 14 aa, Mycobacterium tuberculosis
KPLIAAVEGYALAG

SEQ ID NO: 198412 - protein, 14 aa, Mycobacterium tuberculosis
PLIAAVEGYALAGG

SEQ ID NO: 198413 - protein, 14 aa, Mycobacterium tuberculosis
LIAAVEGYALAGGT

SEQ ID NO: 198414 - protein, 14 aa, Mycobacterium tuberculosis
IAAVEGYALAGGTE

SEQ ID NO: 198415 - protein, 14 aa, Mycobacterium tuberculosis
AAVEGYALAGGTEL

SEQ ID NO: 198416 - protein, 14 aa, Mycobacterium tuberculosis
AVEGYALAGGTELA

SEQ ID NO: 198417 - protein, 14 aa, Mycobacterium tuberculosis
VEGYALAGGTELAL

SEQ ID NO: 198418 - protein, 14 aa, Mycobacterium tuberculosis
EGYALAGGTELALA

SEQ ID NO: 198419 - protein, 14 aa, Mycobacterium tuberculosis
GYALAGGTELALAA

SEQ ID NO: 198420 - protein, 14 aa, Mycobacterium tuberculosis
YALAGGTELALAAD

SEQ ID NO: 198421 - protein, 14 aa, Mycobacterium tuberculosis
ALAGGTELALAADL

SEQ ID NO: 198422 - protein, 14 aa, Mycobacterium tuberculosis
LAGGTELALAADLI

SEQ ID NO: 198423 - protein, 14 aa, Mycobacterium tuberculosis
AGGTELALAADLIV

SEQ ID NO: 198424 - protein, 14 aa, Mycobacterium tuberculosis
GGTELALAADLIVA

SEQ ID NO: 198425 - protein, 14 aa, Mycobacterium tuberculosis
GTELALAADLIVAA

SEQ ID NO: 198426 - protein, 14 aa, Mycobacterium tuberculosis
TELALAADLIVAAR

SEQ ID NO: 198427 - protein, 14 aa, Mycobacterium tuberculosis
ELALAADLIVAARD

SEQ ID NO: 198428 - protein, 14 aa, Mycobacterium tuberculosis
LALAADLIVAARDS

SEQ ID NO: 198429 - protein, 14 aa, Mycobacterium tuberculosis
ALAADLIVAARDSA

SEQ ID NO: 198430 - protein, 14 aa, Mycobacterium tuberculosis
LAADLIVAARDSAF

SEQ ID NO: 198431 - protein, 14 aa, Mycobacterium tuberculosis
AADLIVAARDSAFG

SEQ ID NO: 198432 - protein, 14 aa, Mycobacterium tuberculosis
ADLIVAARDSAFGI

SEQ ID NO: 198433 - protein, 14 aa, Mycobacterium tuberculosis
DLIVAARDSAFGIP

SEQ ID NO: 198434 - protein, 14 aa, Mycobacterium tuberculosis
LIVAARDSAFGIPE

SEQ ID NO: 198435 - protein, 14 aa, Mycobacterium tuberculosis
IVAARDSAFGIPEV

SEQ ID NO: 198436 - protein, 14 aa, Mycobacterium tuberculosis
VAARDSAFGIPEVK

SEQ ID NO: 198437 - protein, 14 aa, Mycobacterium tuberculosis
AARDSAFGIPEVKR

SEQ ID NO: 198438 - protein, 14 aa, Mycobacterium tuberculosis
ARDSAFGIPEVKRG

SEQ ID NO: 198439 - protein, 14 aa, Mycobacterium tuberculosis
RDSAFGIPEVKRGL

SEQ ID NO: 198440 - protein, 14 aa, Mycobacterium tuberculosis
DSAFGIPEVKRGLV

SEQ ID NO: 198441 - protein, 14 aa, Mycobacterium tuberculosis
SAFGIPEVKRGLVA

SEQ ID NO: 198442 - protein, 14 aa, Mycobacterium tuberculosis
AFGIPEVKRGLVAG

SEQ ID NO: 198443 - protein, 14 aa, Mycobacterium tuberculosis
FGIPEVKRGLVAGG

SEQ ID NO: 198444 - protein, 14 aa, Mycobacterium tuberculosis
GIPEVKRGLVAGGG

SEQ ID NO: 198445 - protein, 14 aa, Mycobacterium tuberculosis
IPEVKRGLVAGGGG

SEQ ID NO: 198446 - protein, 14 aa, Mycobacterium tuberculosis
PEVKRGLVAGGGGL

SEQ ID NO: 198447 - protein, 14 aa, Mycobacterium tuberculosis
EVKRGLVAGGGGLL

SEQ ID NO: 198448 - protein, 14 aa, Mycobacterium tuberculosis
VKRGLVAGGGGLLR

SEQ ID NO: 198449 - protein, 14 aa, Mycobacterium tuberculosis
KRGLVAGGGGLLRL

SEQ ID NO: 198450 - protein, 14 aa, Mycobacterium tuberculosis
RGLVAGGGGLLRLP

SEQ ID NO: 198451 - protein, 14 aa, Mycobacterium tuberculosis
GLVAGGGGLLRLPE

SEQ ID NO: 198452 - protein, 14 aa, Mycobacterium tuberculosis
LVAGGGGLLRLPER

SEQ ID NO: 198453 - protein, 14 aa, Mycobacterium tuberculosis
VAGGGGLLRLPERI

SEQ ID NO: 198454 - protein, 14 aa, Mycobacterium tuberculosis
AGGGGLLRLPERIP

SEQ ID NO: 198455 - protein, 14 aa, Mycobacterium tuberculosis
GGGGLLRLPERIPY

SEQ ID NO: 198456 - protein, 14 aa, Mycobacterium tuberculosis
GGGLLRLPERIPYA

SEQ ID NO: 198457 - protein, 14 aa, Mycobacterium tuberculosis
GGLLRLPERIPYAI

SEQ ID NO: 198458 - protein, 14 aa, Mycobacterium tuberculosis
GLLRLPERIPYAIA

SEQ ID NO: 198459 - protein, 14 aa, Mycobacterium tuberculosis
LLRLPERIPYAIAM

SEQ ID NO: 198460 - protein, 14 aa, Mycobacterium tuberculosis
LRLPERIPYAIAME

SEQ ID NO: 198461 - protein, 14 aa, Mycobacterium tuberculosis
RLPERIPYAIAMEL
